United States Patent 7,655,785 (BIOINFORMATICALLY DETECTABLE GROUP OF NOVEL REGULATORY OLIGONUCLEOTIDES AND USES THEREOF) - sequence listing, part 33

SEQ ID NO: 1352135 - RNA, 15 nt, Homo sapiens
ugccucuucuuugug

SEQ ID NO: 1352136 - RNA, 22 nt, Homo sapiens
ugccugaauaaaguaaugccuc

SEQ ID NO: 1352137 - RNA, 16 nt, Homo sapiens
ugccuggacacuguac

SEQ ID NO: 1352138 - RNA, 20 nt, Homo sapiens
ugccugggggcuuuugccac

SEQ ID NO: 1352139 - RNA, 20 nt, Homo sapiens
ugccuguaauccuagcacuu

SEQ ID NO: 1352140 - RNA, 18 nt, Homo sapiens
ugccugugccuuuugcca

SEQ ID NO: 1352141 - RNA, 21 nt, Homo sapiens
ugccuguguacugccuuaaau

SEQ ID NO: 1352142 - RNA, 20 nt, Homo sapiens
ugccuguucccauucuugca

SEQ ID NO: 1352143 - RNA, 17 nt, Homo sapiens
ugccuucaacaacguga

SEQ ID NO: 1352144 - RNA, 14 nt, Homo sapiens
ugccuucucaggaa

SEQ ID NO: 1352145 - RNA, 16 nt, Homo sapiens
ugccuugccacauuaa

SEQ ID NO: 1352146 - RNA, 17 nt, Homo sapiens
ugccuuguuuaauguua

SEQ ID NO: 1352147 - RNA, 15 nt, Homo sapiens
ugccuuuuauguaaa

SEQ ID NO: 1352148 - RNA, 21 nt, Homo sapiens
ugcgagacgcacacagcugag

SEQ ID NO: 1352149 - RNA, 15 nt, Homo sapiens
ugcgccgagccucag

SEQ ID NO: 1352150 - RNA, 22 nt, Homo sapiens
ugcgccgccgccggaguccacu

SEQ ID NO: 1352151 - RNA, 13 nt, Homo sapiens
ugcgcuguguaca

SEQ ID NO: 1352152 - RNA, 19 nt, Homo sapiens
ugcgcuguguacaauguga

SEQ ID NO: 1352153 - RNA, 17 nt, Homo sapiens
ugcuaaguaauuuagaa

SEQ ID NO: 1352154 - RNA, 20 nt, Homo sapiens
ugcuaucagcaaugccccaa

SEQ ID NO: 1352155 - RNA, 21 nt, Homo sapiens
ugcuauuguagagccagaggu

SEQ ID NO: 1352156 - RNA, 15 nt, Homo sapiens
ugcuauuugcauuuc

SEQ ID NO: 1352157 - RNA, 15 nt, Homo sapiens
ugcucagagacacug

SEQ ID NO: 1352158 - RNA, 12 nt, Homo sapiens
ugcuccaccagc

SEQ ID NO: 1352159 - RNA, 14 nt, Homo sapiens
ugcucccacagaac

SEQ ID NO: 1352160 - RNA, 18 nt, Homo sapiens
ugcucccccugguggugg

SEQ ID NO: 1352161 - RNA, 15 nt, Homo sapiens
ugcuccugcaucuca

SEQ ID NO: 1352162 - RNA, 15 nt, Homo sapiens
ugcucuacagauaau

SEQ ID NO: 1352163 - RNA, 18 nt, Homo sapiens
ugcucuauacuguggccu

SEQ ID NO: 1352164 - RNA, 15 nt, Homo sapiens
ugcucuguuguaggg

SEQ ID NO: 1352165 - RNA, 17 nt, Homo sapiens
ugcugaaugccucgcuc

SEQ ID NO: 1352166 - RNA, 19 nt, Homo sapiens
ugcugacguguuucuuguc

SEQ ID NO: 1352167 - RNA, 14 nt, Homo sapiens
ugcugcccaugcac

SEQ ID NO: 1352168 - RNA, 22 nt, Homo sapiens
ugcugccuuuguugaggugcaa

SEQ ID NO: 1352169 - RNA, 21 nt, Homo sapiens
ugcugcuccccuaaagccagg

SEQ ID NO: 1352170 - RNA, 12 nt, Homo sapiens
ugcugcugauac

SEQ ID NO: 1352171 - RNA, 20 nt, Homo sapiens
ugcugcuggggaagacagug

SEQ ID NO: 1352172 - RNA, 13 nt, Homo sapiens
ugcuggacuguca

SEQ ID NO: 1352173 - RNA, 18 nt, Homo sapiens
ugcugggcugggcccucu

SEQ ID NO: 1352174 - RNA, 18 nt, Homo sapiens
ugcuggggaagacagugg

SEQ ID NO: 1352175 - RNA, 14 nt, Homo sapiens
ugcuguacaaaagc

SEQ ID NO: 1352176 - RNA, 15 nt, Homo sapiens
ugcuguaugugagcu

SEQ ID NO: 1352177 - RNA, 19 nt, Homo sapiens
ugcuguuaauauaguuuag

SEQ ID NO: 1352178 - RNA, 15 nt, Homo sapiens
ugcuguugugaagcu

SEQ ID NO: 1352179 - RNA, 14 nt, Homo sapiens
ugcuguuuugccag

SEQ ID NO: 1352180 - RNA, 16 nt, Homo sapiens
ugcuuaaaauugugag

SEQ ID NO: 1352181 - RNA, 14 nt, Homo sapiens
ugcuuacauuugaa

SEQ ID NO: 1352182 - RNA, 16 nt, Homo sapiens
ugcuuaccugaucuca

SEQ ID NO: 1352183 - RNA, 23 nt, Homo sapiens
ugcuuagcuugagggugacuaug

SEQ ID NO: 1352184 - RNA, 23 nt, Homo sapiens
ugcuuaguagagcuuuuugcaug

SEQ ID NO: 1352185 - RNA, 19 nt, Homo sapiens
ugcuuaguauugacacucu

SEQ ID NO: 1352186 - RNA, 18 nt, Homo sapiens
ugcuuaucagugugcaau

SEQ ID NO: 1352187 - RNA, 20 nt, Homo sapiens
ugcuuaucagugugcaauac

SEQ ID NO: 1352188 - RNA, 17 nt, Homo sapiens
ugcuucauccaauguga

SEQ ID NO: 1352189 - RNA, 20 nt, Homo sapiens
ugcuuccugcuguaugugag

SEQ ID NO: 1352190 - RNA, 18 nt, Homo sapiens
ugcuucuacaugaugcua

SEQ ID NO: 1352191 - RNA, 17 nt, Homo sapiens
ugcuugaggcuaccucu

SEQ ID NO: 1352192 - RNA, 14 nt, Homo sapiens
ugcuuggcugcugu

SEQ ID NO: 1352193 - RNA, 19 nt, Homo sapiens
ugcuuuaaaaaacacaguc

SEQ ID NO: 1352194 - RNA, 23 nt, Homo sapiens
uaauggaggugacggcacuccca

SEQ ID NO: 1352195 - RNA, 20 nt, Homo sapiens
uaauggcagcuagugccuuu

SEQ ID NO: 1352196 - RNA, 23 nt, Homo sapiens
uaauguaccaaugaugaauuuau

SEQ ID NO: 1352197 - RNA, 17 nt, Homo sapiens
uaauguauaccagccua

SEQ ID NO: 1352198 - RNA, 22 nt, Homo sapiens
uaauguugauuuuaauccugua

SEQ ID NO: 1352199 - RNA, 15 nt, Homo sapiens
uaauguuugcauuuc

SEQ ID NO: 1352200 - RNA, 13 nt, Homo sapiens
uaauuauaucuaa

SEQ ID NO: 1352201 - RNA, 18 nt, Homo sapiens
uaauucauugugauuuau

SEQ ID NO: 1352202 - RNA, 13 nt, Homo sapiens
uaauuguacaaua

SEQ ID NO: 1352203 - RNA, 19 nt, Homo sapiens
uaauuguuacaauuuucua

SEQ ID NO: 1352204 - RNA, 16 nt, Homo sapiens
uaauuuucaguucuau

SEQ ID NO: 1352205 - RNA, 15 nt, Homo sapiens
uaauuuuccaaugca

SEQ ID NO: 1352206 - RNA, 18 nt, Homo sapiens
uaauuuuccaaugcacag

SEQ ID NO: 1352207 - RNA, 19 nt, Homo sapiens
uaauuuuccaaugcacagu

SEQ ID NO: 1352208 - RNA, 22 nt, Homo sapiens
uaauuuuuucccagacuacuau

SEQ ID NO: 1352209 - RNA, 16 nt, Homo sapiens
uacaaaaacacagcaa

SEQ ID NO: 1352210 - RNA, 22 nt, Homo sapiens
uacaaaaauaccuacugcugag

SEQ ID NO: 1352211 - RNA, 20 nt, Homo sapiens
uacaacaaaaaucaccaucu

SEQ ID NO: 1352212 - RNA, 14 nt, Homo sapiens
uacaacccuacccu

SEQ ID NO: 1352213 - RNA, 21 nt, Homo sapiens
uacaaguaauauuauuacuuu

SEQ ID NO: 1352214 - RNA, 19 nt, Homo sapiens
uacaaguuucuagcucuca

SEQ ID NO: 1352215 - RNA, 16 nt, Homo sapiens
uacaauaaacugguau

SEQ ID NO: 1352216 - RNA, 21 nt, Homo sapiens
uacaaucagcccagugcaaac

SEQ ID NO: 1352217 - RNA, 12 nt, Homo sapiens
uacaauugucau

SEQ ID NO: 1352218 - RNA, 20 nt, Homo sapiens
uacaauuuaaugcacuaaaa

SEQ ID NO: 1352219 - RNA, 14 nt, Homo sapiens
uacacaauaagcaa

SEQ ID NO: 1352220 - RNA, 21 nt, Homo sapiens
uacacacacacagacauauau

SEQ ID NO: 1352221 - RNA, 21 nt, Homo sapiens
uacaccagcaauuuagacaaa

SEQ ID NO: 1352222 - RNA, 19 nt, Homo sapiens
uacacccaguucugaauaa

SEQ ID NO: 1352223 - RNA, 21 nt, Homo sapiens
uacacggaggucucuguaaaa

SEQ ID NO: 1352224 - RNA, 22 nt, Homo sapiens
uacacucauggggaagcuucca

SEQ ID NO: 1352225 - RNA, 22 nt, Homo sapiens
uacacugaaucauuaacagugc

SEQ ID NO: 1352226 - RNA, 20 nt, Homo sapiens
uacacuuuuuggaagugaaa

SEQ ID NO: 1352227 - RNA, 15 nt, Homo sapiens
uacagaaacugaugc

SEQ ID NO: 1352228 - RNA, 15 nt, Homo sapiens
uacagacaucuaaug

SEQ ID NO: 1352229 - RNA, 20 nt, Homo sapiens
uacagagauuacuuugcugc

SEQ ID NO: 1352230 - RNA, 14 nt, Homo sapiens
uacagaggacagua

SEQ ID NO: 1352231 - RNA, 13 nt, Homo sapiens
uacagaugccaua

SEQ ID NO: 1352232 - RNA, 20 nt, Homo sapiens
uacagcugcuuugagcuaca

SEQ ID NO: 1352233 - RNA, 20 nt, Homo sapiens
uacaggaacagaagaggaaa

SEQ ID NO: 1352234 - RNA, 20 nt, Homo sapiens
uacaggccuugcucacagcu

SEQ ID NO: 1352235 - RNA, 20 nt, Homo sapiens
uacagggacacuaucacuca

SEQ ID NO: 1352236 - RNA, 17 nt, Homo sapiens
uacaggugacagugaag

SEQ ID NO: 1352237 - RNA, 16 nt, Homo sapiens
uacaguaacugugacu

SEQ ID NO: 1352238 - RNA, 12 nt, Homo sapiens
uacaguagcuug

SEQ ID NO: 1352239 - RNA, 16 nt, Homo sapiens
uacaguguacucuuau

SEQ ID NO: 1352240 - RNA, 18 nt, Homo sapiens
uacauaaugguacuccca

SEQ ID NO: 1352241 - RNA, 16 nt, Homo sapiens
uacauacuauggaauu

SEQ ID NO: 1352242 - RNA, 18 nt, Homo sapiens
uacauauguaaacauaag

SEQ ID NO: 1352243 - RNA, 15 nt, Homo sapiens
uacauauuaucucau

SEQ ID NO: 1352244 - RNA, 21 nt, Homo sapiens
uacaucugggacugacuuucc

SEQ ID NO: 1352245 - RNA, 13 nt, Homo sapiens
uacauuaucucac

SEQ ID NO: 1352246 - RNA, 13 nt, Homo sapiens
uacauucuugcua

SEQ ID NO: 1352247 - RNA, 18 nt, Homo sapiens
uacauugaaaacaacaaa

SEQ ID NO: 1352248 - RNA, 14 nt, Homo sapiens
uaccaaagcaucaa

SEQ ID NO: 1352249 - RNA, 17 nt, Homo sapiens
uaccaaaucugacauau

SEQ ID NO: 1352250 - RNA, 20 nt, Homo sapiens
uaccacaugauuuuacucau

SEQ ID NO: 1352251 - RNA, 16 nt, Homo sapiens
uaccacgaggaaaaga

SEQ ID NO: 1352252 - RNA, 15 nt, Homo sapiens
uaccagcaucuccca

SEQ ID NO: 1352253 - RNA, 17 nt, Homo sapiens
uaccaguauaagcaucu

SEQ ID NO: 1352254 - RNA, 22 nt, Homo sapiens
uaccaguauaagcaucugccau

SEQ ID NO: 1352255 - RNA, 20 nt, Homo sapiens
uaccccagacuagauguagu

SEQ ID NO: 1352256 - RNA, 15 nt, Homo sapiens
uacccuaaagugcaa

SEQ ID NO: 1352257 - RNA, 23 nt, Homo sapiens
uacccuuggaaagaaauguagau

SEQ ID NO: 1352258 - RNA, 14 nt, Homo sapiens
uaccgcuggcccug

SEQ ID NO: 1352259 - RNA, 13 nt, Homo sapiens
uaccggauucucu

SEQ ID NO: 1352260 - RNA, 23 nt, Homo sapiens
uaccuauucugaaaaagacauaa

SEQ ID NO: 1352261 - RNA, 21 nt, Homo sapiens
uaccucaaccaaugccaaaaa

SEQ ID NO: 1352262 - RNA, 22 nt, Homo sapiens
uaccucaaccaaugccaaaaaa

SEQ ID NO: 1352263 - RNA, 20 nt, Homo sapiens
uaccucaagucucaggagaa

SEQ ID NO: 1352264 - RNA, 23 nt, Homo sapiens
uaccuccuaauuccacacccuca

SEQ ID NO: 1352265 - RNA, 19 nt, Homo sapiens
uaccugagauggaggaguc

SEQ ID NO: 1352266 - RNA, 11 nt, Homo sapiens
uaccuguuauu

SEQ ID NO: 1352267 - RNA, 16 nt, Homo sapiens
uaccuuaucacugcau

SEQ ID NO: 1352268 - RNA, 22 nt, Homo sapiens
uaccuuuuauuuuaauguuucc

SEQ ID NO: 1352269 - RNA, 20 nt, Homo sapiens
uacgcacgauaucuagugac

SEQ ID NO: 1352270 - RNA, 14 nt, Homo sapiens
uacguuuacauucu

SEQ ID NO: 1352271 - RNA, 20 nt, Homo sapiens
uacguuuguguggugacauu

SEQ ID NO: 1352272 - RNA, 19 nt, Homo sapiens
uacuaaacuucaccuacau

SEQ ID NO: 1352273 - RNA, 19 nt, Homo sapiens
uacuaacauuuucauugau

SEQ ID NO: 1352274 - RNA, 22 nt, Homo sapiens
uacuaaccuacagagaugcuaa

SEQ ID NO: 1352275 - RNA, 13 nt, Homo sapiens
uacuaaucuuucu

SEQ ID NO: 1352276 - RNA, 17 nt, Homo sapiens
uacuagauugugauccc

SEQ ID NO: 1352277 - RNA, 15 nt, Homo sapiens
uacuaucauaauuca

SEQ ID NO: 1352278 - RNA, 15 nt, Homo sapiens
uacuauccaaucugu

SEQ ID NO: 1352279 - RNA, 16 nt, Homo sapiens
uacuaugcacaacaga

SEQ ID NO: 1352280 - RNA, 16 nt, Homo sapiens
uacucuuuugggcaac

SEQ ID NO: 1352281 - RNA, 21 nt, Homo sapiens
uacugaaaaggaggggucugg

SEQ ID NO: 1352282 - RNA, 19 nt, Homo sapiens
uacugguguucuguuucaa

SEQ ID NO: 1352283 - RNA, 20 nt, Homo sapiens
uacuguaggaauuuucuuga

SEQ ID NO: 1352284 - RNA, 21 nt, Homo sapiens
uacuguaggcacacuuugcac

SEQ ID NO: 1352285 - RNA, 17 nt, Homo sapiens
uacuguauggaaacacu

SEQ ID NO: 1352286 - RNA, 20 nt, Homo sapiens
uacuuacaaguuucuagcuc

SEQ ID NO: 1352287 - RNA, 18 nt, Homo sapiens
uacuuacauaucugacuu

SEQ ID NO: 1352288 - RNA, 19 nt, Homo sapiens
uacuuacauaucugacuuc

SEQ ID NO: 1352289 - RNA, 21 nt, Homo sapiens
uacuuacauaucugacuucua

SEQ ID NO: 1352290 - RNA, 19 nt, Homo sapiens
uacuucuggagucuauaaa

SEQ ID NO: 1352291 - RNA, 16 nt, Homo sapiens
uacuugccuaucugac

SEQ ID NO: 1352292 - RNA, 18 nt, Homo sapiens
uacuugccuaucugacuu

SEQ ID NO: 1352293 - RNA, 20 nt, Homo sapiens
uacuugccuaucugacuuca

SEQ ID NO: 1352294 - RNA, 22 nt, Homo sapiens
uacuugggucacaugacucuca

SEQ ID NO: 1352295 - RNA, 15 nt, Homo sapiens
uacuuuaccuccuau

SEQ ID NO: 1352296 - RNA, 16 nt, Homo sapiens
uacuuucuaugugaca

SEQ ID NO: 1352297 - RNA, 17 nt, Homo sapiens
aauuaaaacacuuucaa

SEQ ID NO: 1352298 - RNA, 22 nt, Homo sapiens
aauuaaggguaugauuaacucu

SEQ ID NO: 1352299 - RNA, 17 nt, Homo sapiens
aauuaauaaaugucauu

SEQ ID NO: 1352300 - RNA, 12 nt, Homo sapiens
aauuacuggaau

SEQ ID NO: 1352301 - RNA, 23 nt, Homo sapiens
aauuagcaauugacugucacugu

SEQ ID NO: 1352302 - RNA, 10 nt, Homo sapiens
aauuaggcag

SEQ ID NO: 1352303 - RNA, 15 nt, Homo sapiens
aauuaggcuguaacu

SEQ ID NO: 1352304 - RNA, 20 nt, Homo sapiens
aauuaguucccauucuuuca

SEQ ID NO: 1352305 - RNA, 21 nt, Homo sapiens
aauuauagcucaugugcauua

SEQ ID NO: 1352306 - RNA, 16 nt, Homo sapiens
aauuauaucuccccca

SEQ ID NO: 1352307 - RNA, 14 nt, Homo sapiens
aauuaucucaagua

SEQ ID NO: 1352308 - RNA, 19 nt, Homo sapiens
aauuaucuuuuuucuuccu

SEQ ID NO: 1352309 - RNA, 13 nt, Homo sapiens
aauuaugugcaaa

SEQ ID NO: 1352310 - RNA, 15 nt, Homo sapiens
aauuauuucucucac

SEQ ID NO: 1352311 - RNA, 17 nt, Homo sapiens
aauuauuuuuguucaua

SEQ ID NO: 1352312 - RNA, 13 nt, Homo sapiens
aauucagcacuua

SEQ ID NO: 1352313 - RNA, 17 nt, Homo sapiens
aauucauugugauuuau

SEQ ID NO: 1352314 - RNA, 23 nt, Homo sapiens
aauucauuucacuguagcucuaa

SEQ ID NO: 1352315 - RNA, 21 nt, Homo sapiens
aauuccuagaaguugagagag

SEQ ID NO: 1352316 - RNA, 20 nt, Homo sapiens
aauucguucaccuacauuug

SEQ ID NO: 1352317 - RNA, 22 nt, Homo sapiens
aauucuaccuccuuguguugca

SEQ ID NO: 1352318 - RNA, 13 nt, Homo sapiens
aauucuacuuuga

SEQ ID NO: 1352319 - RNA, 21 nt, Homo sapiens
aauucucuuauccaacaucaa

SEQ ID NO: 1352320 - RNA, 22 nt, Homo sapiens
aauucugugacauacauauuau

SEQ ID NO: 1352321 - RNA, 16 nt, Homo sapiens
aauucuuauaguaccu

SEQ ID NO: 1352322 - RNA, 20 nt, Homo sapiens
aauucuuuuaucaaucccag

SEQ ID NO: 1352323 - RNA, 15 nt, Homo sapiens
aauugaacuuccagg

SEQ ID NO: 1352324 - RNA, 18 nt, Homo sapiens
aauugcaguuuacaguau

SEQ ID NO: 1352325 - RNA, 14 nt, Homo sapiens
aauugccagcaaau

SEQ ID NO: 1352326 - RNA, 14 nt, Homo sapiens
aauugccuguaaca

SEQ ID NO: 1352327 - RNA, 18 nt, Homo sapiens
aauugccuguaacacaua

SEQ ID NO: 1352328 - RNA, 14 nt, Homo sapiens
aauuggacaauuau

SEQ ID NO: 1352329 - RNA, 20 nt, Homo sapiens
aauuggccucuguaugcagu

SEQ ID NO: 1352330 - RNA, 15 nt, Homo sapiens
aauugguagaaggau

SEQ ID NO: 1352331 - RNA, 11 nt, Homo sapiens
aauuguacaau

SEQ ID NO: 1352332 - RNA, 23 nt, Homo sapiens
aauuguauuauaauucauuguga

SEQ ID NO: 1352333 - RNA, 23 nt, Homo sapiens
aauugugacauaauaauagcagu

SEQ ID NO: 1352334 - RNA, 18 nt, Homo sapiens
aauuguuaauaugcagcc

SEQ ID NO: 1352335 - RNA, 22 nt, Homo sapiens
aauuuaaaaaauauauaugcau

SEQ ID NO: 1352336 - RNA, 17 nt, Homo sapiens
aauuuaacuuauugcua

SEQ ID NO: 1352337 - RNA, 14 nt, Homo sapiens
aauuuaaugcacua

SEQ ID NO: 1352338 - RNA, 14 nt, Homo sapiens
aauuuaaugcugcc

SEQ ID NO: 1352339 - RNA, 19 nt, Homo sapiens
aauuuaccuaagauuacaa

SEQ ID NO: 1352340 - RNA, 21 nt, Homo sapiens
aauuuagagauaggaaacuga

SEQ ID NO: 1352341 - RNA, 20 nt, Homo sapiens
aauuuauacaccagcaauuu

SEQ ID NO: 1352342 - RNA, 16 nt, Homo sapiens
aauuucauaccuauca

SEQ ID NO: 1352343 - RNA, 19 nt, Homo sapiens
aauuucauaccuaucaucu

SEQ ID NO: 1352344 - RNA, 20 nt, Homo sapiens
aauuucucccagucauuuaa

SEQ ID NO: 1352345 - RNA, 16 nt, Homo sapiens
aauuugauuuacauau

SEQ ID NO: 1352346 - RNA, 13 nt, Homo sapiens
aauuugucuuaaa

SEQ ID NO: 1352347 - RNA, 24 nt, Homo sapiens
aauuugugguccacugagcuauaa

SEQ ID NO: 1352348 - RNA, 17 nt, Homo sapiens
aauuuuagcucuuccca

SEQ ID NO: 1352349 - RNA, 22 nt, Homo sapiens
aauuuuauugacacaguaccau

SEQ ID NO: 1352350 - RNA, 20 nt, Homo sapiens
aauuuucugaaacugcauaa

SEQ ID NO: 1352351 - RNA, 20 nt, Homo sapiens
aauuuugguuuaugacucuu

SEQ ID NO: 1352352 - RNA, 13 nt, Homo sapiens
aauuuuuaggcaa

SEQ ID NO: 1352353 - RNA, 22 nt, Homo sapiens
aauuuuucugugcucaaugugu

SEQ ID NO: 1352354 - RNA, 19 nt, Homo sapiens
aauuuuuuuuaaaaaucca

SEQ ID NO: 1352355 - RNA, 18 nt, Homo sapiens
acaaaaugauuuugaaga

SEQ ID NO: 1352356 - RNA, 22 nt, Homo sapiens
acaaacaaauuuuucugcuuua

SEQ ID NO: 1352357 - RNA, 21 nt, Homo sapiens
acaaagacauugacagcaauu

SEQ ID NO: 1352358 - RNA, 13 nt, Homo sapiens
acaaagauucucu

SEQ ID NO: 1352359 - RNA, 11 nt, Homo sapiens
acaaagcaauu

SEQ ID NO: 1352360 - RNA, 15 nt, Homo sapiens
acaaagcccuuccau

SEQ ID NO: 1352361 - RNA, 23 nt, Homo sapiens
acaaauaagugugcaguaucugu

SEQ ID NO: 1352362 - RNA, 14 nt, Homo sapiens
acaaauacauuccu

SEQ ID NO: 1352363 - RNA, 15 nt, Homo sapiens
acaaauuucacuuau

SEQ ID NO: 1352364 - RNA, 13 nt, Homo sapiens
acaacacugggaa

SEQ ID NO: 1352365 - RNA, 11 nt, Homo sapiens
acaacacuuaa

SEQ ID NO: 1352366 - RNA, 13 nt, Homo sapiens
acaacagugaaaa

SEQ ID NO: 1352367 - RNA, 14 nt, Homo sapiens
acaacaucgcaaua

SEQ ID NO: 1352368 - RNA, 17 nt, Homo sapiens
acaacauuguagccuca

SEQ ID NO: 1352369 - RNA, 17 nt, Homo sapiens
acaacuuaguguaauau

SEQ ID NO: 1352370 - RNA, 18 nt, Homo sapiens
acaagaagcaauguuaua

SEQ ID NO: 1352371 - RNA, 20 nt, Homo sapiens
acaagaagguggaaggcagu

SEQ ID NO: 1352372 - RNA, 13 nt, Homo sapiens
acaagccaaagag

SEQ ID NO: 1352373 - RNA, 19 nt, Homo sapiens
acaagcgaaucucugccuu

SEQ ID NO: 1352374 - RNA, 22 nt, Homo sapiens
acaaggccugcuugacuuucca

SEQ ID NO: 1352375 - RNA, 22 nt, Homo sapiens
acaaggggcuccacaccuuugc

SEQ ID NO: 1352376 - RNA, 16 nt, Homo sapiens
acaaguuucuagcucu

SEQ ID NO: 1352377 - RNA, 23 nt, Homo sapiens
acaauaggucuuucucucaguga

SEQ ID NO: 1352378 - RNA, 15 nt, Homo sapiens
acaauauaagagcuu

SEQ ID NO: 1352379 - RNA, 16 nt, Homo sapiens
acaauauuaauucagg

SEQ ID NO: 1352380 - RNA, 15 nt, Homo sapiens
acaaucagcccagug

SEQ ID NO: 1352381 - RNA, 16 nt, Homo sapiens
acaaucagcccagugc

SEQ ID NO: 1352382 - RNA, 20 nt, Homo sapiens
acaaucagcccagugcaaac

SEQ ID NO: 1352383 - RNA, 12 nt, Homo sapiens
acaaucauguaa

SEQ ID NO: 1352384 - RNA, 16 nt, Homo sapiens
acaauccuugccacag

SEQ ID NO: 1352385 - RNA, 20 nt, Homo sapiens
acaaugauacaguugcaugu

SEQ ID NO: 1352386 - RNA, 14 nt, Homo sapiens
acaauugucaugua

SEQ ID NO: 1352387 - RNA, 12 nt, Homo sapiens
acaauuucugca

SEQ ID NO: 1352388 - RNA, 18 nt, Homo sapiens
acacaaggauagaugcug

SEQ ID NO: 1352389 - RNA, 21 nt, Homo sapiens
aaggacaucagcaaacaggau

SEQ ID NO: 1352390 - RNA, 15 nt, Homo sapiens
aaggagccuacucca

SEQ ID NO: 1352391 - RNA, 19 nt, Homo sapiens
aaggagccuacuccaagaa

SEQ ID NO: 1352392 - RNA, 18 nt, Homo sapiens
aaggagggugagugcaag

SEQ ID NO: 1352393 - RNA, 19 nt, Homo sapiens
aaggauuuuaccaaagcau

SEQ ID NO: 1352394 - RNA, 18 nt, Homo sapiens
aaggcaagucaaauacca

SEQ ID NO: 1352395 - RNA, 23 nt, Homo sapiens
aaggcaauuccugauggaaaaug

SEQ ID NO: 1352396 - RNA, 20 nt, Homo sapiens
aaggcaggaggaucacuuga

SEQ ID NO: 1352397 - RNA, 18 nt, Homo sapiens
aaggccugcccugaugcu

SEQ ID NO: 1352398 - RNA, 21 nt, Homo sapiens
aaggcucagucgcuagcauuu

SEQ ID NO: 1352399 - RNA, 16 nt, Homo sapiens
aaggcugcaagguuua

SEQ ID NO: 1352400 - RNA, 18 nt, Homo sapiens
aagggacaccaagccuug

SEQ ID NO: 1352401 - RNA, 19 nt, Homo sapiens
aagggacaccaagccuugg

SEQ ID NO: 1352402 - RNA, 17 nt, Homo sapiens
aagggacuaggaaauuc

SEQ ID NO: 1352403 - RNA, 12 nt, Homo sapiens
aagggagacuga

SEQ ID NO: 1352404 - RNA, 14 nt, Homo sapiens
aagggagaguucuu

SEQ ID NO: 1352405 - RNA, 16 nt, Homo sapiens
aagggaguuagaccaa

SEQ ID NO: 1352406 - RNA, 18 nt, Homo sapiens
aagggcagcuccacaggg

SEQ ID NO: 1352407 - RNA, 18 nt, Homo sapiens
aaggggaaucagaacuca

SEQ ID NO: 1352408 - RNA, 23 nt, Homo sapiens
aaggguuucgacugguccagcuc

SEQ ID NO: 1352409 - RNA, 13 nt, Homo sapiens
aagguagaacaaa

SEQ ID NO: 1352410 - RNA, 15 nt, Homo sapiens
aaggucaaaacugaa

SEQ ID NO: 1352411 - RNA, 18 nt, Homo sapiens
aaggucuaaucagugauu

SEQ ID NO: 1352412 - RNA, 20 nt, Homo sapiens
aaggugggcggaucaccuga

SEQ ID NO: 1352413 - RNA, 11 nt, Homo sapiens
aagguucucug

SEQ ID NO: 1352414 - RNA, 15 nt, Homo sapiens
aagguuuguguccag

SEQ ID NO: 1352415 - RNA, 18 nt, Homo sapiens
aagguuuucuucauucau

SEQ ID NO: 1352416 - RNA, 16 nt, Homo sapiens
aaguaaaagucuaccu

SEQ ID NO: 1352417 - RNA, 15 nt, Homo sapiens
aaguaagcauuucca

SEQ ID NO: 1352418 - RNA, 16 nt, Homo sapiens
aaguagaaguuacuua

SEQ ID NO: 1352419 - RNA, 23 nt, Homo sapiens
aaguagaccucuuuuucuuacca

SEQ ID NO: 1352420 - RNA, 17 nt, Homo sapiens
aaguauuaagcaguuca

SEQ ID NO: 1352421 - RNA, 17 nt, Homo sapiens
aaguauuuaaauguucu

SEQ ID NO: 1352422 - RNA, 18 nt, Homo sapiens
aagucaauguacuuguuu

SEQ ID NO: 1352423 - RNA, 20 nt, Homo sapiens
aagucacuggccaguggcug

SEQ ID NO: 1352424 - RNA, 23 nt, Homo sapiens
aaguccagaaacuguucccaccu

SEQ ID NO: 1352425 - RNA, 14 nt, Homo sapiens
aagucccuuuguga

SEQ ID NO: 1352426 - RNA, 20 nt, Homo sapiens
aagucccuuugugacuucaa

SEQ ID NO: 1352427 - RNA, 23 nt, Homo sapiens
aagucucagacugauuucuugcg

SEQ ID NO: 1352428 - RNA, 11 nt, Homo sapiens
aagucuugccu

SEQ ID NO: 1352429 - RNA, 13 nt, Homo sapiens
aagugaaaaacau

SEQ ID NO: 1352430 - RNA, 17 nt, Homo sapiens
aagugaccucacuggcc

SEQ ID NO: 1352431 - RNA, 21 nt, Homo sapiens
aagugucaccccucacuguga

SEQ ID NO: 1352432 - RNA, 19 nt, Homo sapiens
aagugucuugagacuuuau

SEQ ID NO: 1352433 - RNA, 20 nt, Homo sapiens
aaguguucacaacagugaaa

SEQ ID NO: 1352434 - RNA, 15 nt, Homo sapiens
aaguuaacuuccaau

SEQ ID NO: 1352435 - RNA, 17 nt, Homo sapiens
aaguuacaugcuguaua

SEQ ID NO: 1352436 - RNA, 17 nt, Homo sapiens
aaguuacuuaauugcca

SEQ ID NO: 1352437 - RNA, 20 nt, Homo sapiens
aaguucaugcagcuguggca

SEQ ID NO: 1352438 - RNA, 21 nt, Homo sapiens
aaguucuaggcauacuuuuca

SEQ ID NO: 1352439 - RNA, 12 nt, Homo sapiens
aaguugacuuau

SEQ ID NO: 1352440 - RNA, 14 nt, Homo sapiens
aaguuuaaugccua

SEQ ID NO: 1352441 - RNA, 18 nt, Homo sapiens
aaguuugcugcaacccaa

SEQ ID NO: 1352442 - RNA, 20 nt, Homo sapiens
aaguuugcugugcuuuggaa

SEQ ID NO: 1352443 - RNA, 20 nt, Homo sapiens
aauaaaaagucacaaugagu

SEQ ID NO: 1352444 - RNA, 13 nt, Homo sapiens
aauaaaagcacaa

SEQ ID NO: 1352445 - RNA, 16 nt, Homo sapiens
aauaaaauuuaacuca

SEQ ID NO: 1352446 - RNA, 23 nt, Homo sapiens
aauaaaauuuaacucacacugcc

SEQ ID NO: 1352447 - RNA, 12 nt, Homo sapiens
aauaaacaguua

SEQ ID NO: 1352448 - RNA, 12 nt, Homo sapiens
aauaaacauaau

SEQ ID NO: 1352449 - RNA, 14 nt, Homo sapiens
aauaaauaaucuca

SEQ ID NO: 1352450 - RNA, 13 nt, Homo sapiens
aauaaauacgugu

SEQ ID NO: 1352451 - RNA, 16 nt, Homo sapiens
aauaaaugucauuuca

SEQ ID NO: 1352452 - RNA, 18 nt, Homo sapiens
aauaaauucuaaauuaca

SEQ ID NO: 1352453 - RNA, 15 nt, Homo sapiens
aauaaauucuaccuc

SEQ ID NO: 1352454 - RNA, 16 nt, Homo sapiens
aauaacaaacuaguca

SEQ ID NO: 1352455 - RNA, 16 nt, Homo sapiens
aauaacagauuucuca

SEQ ID NO: 1352456 - RNA, 21 nt, Homo sapiens
aauaacugaaccaaauugcac

SEQ ID NO: 1352457 - RNA, 15 nt, Homo sapiens
aauaaggcccagagc

SEQ ID NO: 1352458 - RNA, 17 nt, Homo sapiens
aauaauauuaauaagaa

SEQ ID NO: 1352459 - RNA, 20 nt, Homo sapiens
aauaaugcugcaaacuuaau

SEQ ID NO: 1352460 - RNA, 12 nt, Homo sapiens
aauaauucuucc

SEQ ID NO: 1352461 - RNA, 13 nt, Homo sapiens
aauaauuucugua

SEQ ID NO: 1352462 - RNA, 13 nt, Homo sapiens
aauacaaccagcc

SEQ ID NO: 1352463 - RNA, 15 nt, Homo sapiens
aauacaaguaauauu

SEQ ID NO: 1352464 - RNA, 15 nt, Homo sapiens
aauacaaucagccca

SEQ ID NO: 1352465 - RNA, 17 nt, Homo sapiens
aauacaaucagcccagu

SEQ ID NO: 1352466 - RNA, 23 nt, Homo sapiens
aauacaaucagcccagugcaaac

SEQ ID NO: 1352467 - RNA, 14 nt, Homo sapiens
aauacagauuugaa

SEQ ID NO: 1352468 - RNA, 13 nt, Homo sapiens
aauacgugucaaa

SEQ ID NO: 1352469 - RNA, 13 nt, Homo sapiens
aauacuguuucca

SEQ ID NO: 1352470 - RNA, 22 nt, Homo sapiens
aauagauucagagaaauuuaga

SEQ ID NO: 1352471 - RNA, 15 nt, Homo sapiens
aauagcaauauucuu

SEQ ID NO: 1352472 - RNA, 19 nt, Homo sapiens
aauagcauaucacagagag

SEQ ID NO: 1352473 - RNA, 22 nt, Homo sapiens
aauagcauuaucuuaucauuua

SEQ ID NO: 1352474 - RNA, 21 nt, Homo sapiens
aauagucuagauggcuccucu

SEQ ID NO: 1352475 - RNA, 20 nt, Homo sapiens
aauauaaacaggaucucaaa

SEQ ID NO: 1352476 - RNA, 14 nt, Homo sapiens
aauauaaccuccca

SEQ ID NO: 1352477 - RNA, 17 nt, Homo sapiens
aauauaauuuucaaaaa

SEQ ID NO: 1352478 - RNA, 16 nt, Homo sapiens
aauauaguuuaggagu

SEQ ID NO: 1352479 - RNA, 14 nt, Homo sapiens
aauaucaaagucau

SEQ ID NO: 1352480 - RNA, 21 nt, Homo sapiens
aauaucuauguuuuaccaagc

SEQ ID NO: 1352481 - RNA, 14 nt, Homo sapiens
aauaugaguacaaa

SEQ ID NO: 1352482 - RNA, 20 nt, Homo sapiens
aauaugaguacaaaugccuu

SEQ ID NO: 1352483 - RNA, 16 nt, Homo sapiens
aauauguaaaugguau

SEQ ID NO: 1352484 - RNA, 13 nt, Homo sapiens
aauauuaacauau

SEQ ID NO: 1352485 - RNA, 21 nt, Homo sapiens
aauauuccacuauuugcagag

SEQ ID NO: 1352486 - RNA, 14 nt, Homo sapiens
aauauugugcaaac

SEQ ID NO: 1352487 - RNA, 20 nt, Homo sapiens
aauauuuuauauuguuauau

SEQ ID NO: 1352488 - RNA, 16 nt, Homo sapiens
aauauuuuuuacagau

SEQ ID NO: 1352489 - RNA, 13 nt, Homo sapiens
aaucaaggauaaa

SEQ ID NO: 1352490 - RNA, 22 nt, Homo sapiens
aaucacuggauuauaaguucua

SEQ ID NO: 1352491 - RNA, 22 nt, Homo sapiens
aaucagcuuaaaauccaaagug

SEQ ID NO: 1352492 - RNA, 22 nt, Homo sapiens
aaucaggacagguggugcaaau

SEQ ID NO: 1352493 - RNA, 18 nt, Homo sapiens
aaucagguccucagagaa

SEQ ID NO: 1352494 - RNA, 21 nt, Homo sapiens
aaucagugauuauuuuuccag

SEQ ID NO: 1352495 - RNA, 19 nt, Homo sapiens
aaucauacaaacucucacc

SEQ ID NO: 1352496 - RNA, 16 nt, Homo sapiens
aaucauuucugcauca

SEQ ID NO: 1352497 - RNA, 20 nt, Homo sapiens
aaucauuucugcaucagcug

SEQ ID NO: 1352498 - RNA, 17 nt, Homo sapiens
aaucauuuuaagugcau

SEQ ID NO: 1352499 - RNA, 24 nt, Homo sapiens
aauccaguauuauccacaauuauu

SEQ ID NO: 1352500 - RNA, 13 nt, Homo sapiens
aauccaugguguu

SEQ ID NO: 1352501 - RNA, 22 nt, Homo sapiens
aauccaugguguuauuuucuga

SEQ ID NO: 1352502 - RNA, 16 nt, Homo sapiens
aaucccagacugacag

SEQ ID NO: 1352503 - RNA, 16 nt, Homo sapiens
aauccuagacuugaaa

SEQ ID NO: 1352504 - RNA, 23 nt, Homo sapiens
aauccucacuguuccuucuugag

SEQ ID NO: 1352505 - RNA, 12 nt, Homo sapiens
aauccucaggaa

SEQ ID NO: 1352506 - RNA, 15 nt, Homo sapiens
aauccuccuaccuca

SEQ ID NO: 1352507 - RNA, 18 nt, Homo sapiens
aauccugauucauauuua

SEQ ID NO: 1352508 - RNA, 20 nt, Homo sapiens
aauccuuaacacauucaaua

SEQ ID NO: 1352509 - RNA, 15 nt, Homo sapiens
aauccuugacucuua

SEQ ID NO: 1352510 - RNA, 18 nt, Homo sapiens
aaucgacuuguucuugau

SEQ ID NO: 1352511 - RNA, 13 nt, Homo sapiens
aaucuacauucac

SEQ ID NO: 1352512 - RNA, 18 nt, Homo sapiens
aaucuacauucacuuuuu

SEQ ID NO: 1352513 - RNA, 21 nt, Homo sapiens
aaucuauuuucucauugcucu

SEQ ID NO: 1352514 - RNA, 22 nt, Homo sapiens
aaucucuugccugcuccaucuc

SEQ ID NO: 1352515 - RNA, 21 nt, Homo sapiens
aaucugaauaaauaauucuuc

SEQ ID NO: 1352516 - RNA, 12 nt, Homo sapiens
aaucugaguaua

SEQ ID NO: 1352517 - RNA, 13 nt, Homo sapiens
aaucugcucugaa

SEQ ID NO: 1352518 - RNA, 19 nt, Homo sapiens
aaucuuugccuuuaucucu

SEQ ID NO: 1352519 - RNA, 20 nt, Homo sapiens
aaucuuuguuacucuguaaa

SEQ ID NO: 1352520 - RNA, 16 nt, Homo sapiens
aaugaaaucuucccag

SEQ ID NO: 1352521 - RNA, 15 nt, Homo sapiens
aaugaauuauguuau

SEQ ID NO: 1352522 - RNA, 18 nt, Homo sapiens
aaugaccgagcccuggag

SEQ ID NO: 1352523 - RNA, 13 nt, Homo sapiens
aaugagcauugau

SEQ ID NO: 1352524 - RNA, 18 nt, Homo sapiens
aagccccagcuuggcuca

SEQ ID NO: 1352525 - RNA, 13 nt, Homo sapiens
aagccccgucucu

SEQ ID NO: 1352526 - RNA, 15 nt, Homo sapiens
aagccuccaaggguu

SEQ ID NO: 1352527 - RNA, 24 nt, Homo sapiens
aagccuccugcccccugccaguga

SEQ ID NO: 1352528 - RNA, 15 nt, Homo sapiens
aagccuuaagcaaau

SEQ ID NO: 1352529 - RNA, 13 nt, Homo sapiens
aagccuugccuaa

SEQ ID NO: 1352530 - RNA, 13 nt, Homo sapiens
aagcgagcacagu

SEQ ID NO: 1352531 - RNA, 17 nt, Homo sapiens
aagcgcacauucaugug

SEQ ID NO: 1352532 - RNA, 14 nt, Homo sapiens
aagcuaaugucaca

SEQ ID NO: 1352533 - RNA, 16 nt, Homo sapiens
aagcuacuauguacug

SEQ ID NO: 1352534 - RNA, 21 nt, Homo sapiens
aagcuacuauguacugccuua

SEQ ID NO: 1352535 - RNA, 13 nt, Homo sapiens
aagcucuguccaa

SEQ ID NO: 1352536 - RNA, 23 nt, Homo sapiens
aagcugcucagggaaaagcagcu

SEQ ID NO: 1352537 - RNA, 16 nt, Homo sapiens
aagcuggcuuuuccca

SEQ ID NO: 1352538 - RNA, 14 nt, Homo sapiens
aagcugucagggac

SEQ ID NO: 1352539 - RNA, 19 nt, Homo sapiens
aaggaaaacuauguauuaa

SEQ ID NO: 1352540 - RNA, 22 nt, Homo sapiens
aaggaacccucaggccacccuc

SEQ ID NO: 1352541 - RNA, 13 nt, Homo sapiens
aaggagacaccaa

SEQ ID NO: 1352542 - RNA, 15 nt, Homo sapiens
aaggagagugauuga

SEQ ID NO: 1352543 - RNA, 20 nt, Homo sapiens
aaggaggcugaucccugaga

SEQ ID NO: 1352544 - RNA, 19 nt, Homo sapiens
aaggauaaaugucuuucca

SEQ ID NO: 1352545 - RNA, 16 nt, Homo sapiens
aaggauagugugaaga

SEQ ID NO: 1352546 - RNA, 15 nt, Homo sapiens
aaggauaugauuaau

SEQ ID NO: 1352547 - RNA, 14 nt, Homo sapiens
aaggaugucugcca

SEQ ID NO: 1352548 - RNA, 22 nt, Homo sapiens
aaggauuacagaaacugaugcc

SEQ ID NO: 1352549 - RNA, 16 nt, Homo sapiens
aaggauuuuaccaaag

SEQ ID NO: 1352550 - RNA, 17 nt, Homo sapiens
aaggauuuuaccaaagc

SEQ ID NO: 1352551 - RNA, 22 nt, Homo sapiens
aaggauuuuaccaaagcaucaa

SEQ ID NO: 1352552 - RNA, 19 nt, Homo sapiens
aaggcaagucaaauaccac

SEQ ID NO: 1352553 - RNA, 21 nt, Homo sapiens
aaggcagaaagauagcuugag

SEQ ID NO: 1352554 - RNA, 22 nt, Homo sapiens
aaggcagagccuuuuuaccugg

SEQ ID NO: 1352555 - RNA, 23 nt, Homo sapiens
aaggcaguguuauuuauuucuuu

SEQ ID NO: 1352556 - RNA, 16 nt, Homo sapiens
aaggccuucuucccaa

SEQ ID NO: 1352557 - RNA, 21 nt, Homo sapiens
aaggccuuguuaaaauccaag

SEQ ID NO: 1352558 - RNA, 12 nt, Homo sapiens
aaggcucagacu

SEQ ID NO: 1352559 - RNA, 17 nt, Homo sapiens
aagggaagagcauguaa

SEQ ID NO: 1352560 - RNA, 22 nt, Homo sapiens
aagggagucauuuuuuaaguga

SEQ ID NO: 1352561 - RNA, 20 nt, Homo sapiens
aagggaguggccucauuuca

SEQ ID NO: 1352562 - RNA, 17 nt, Homo sapiens
aagggauggacuuguga

SEQ ID NO: 1352563 - RNA, 17 nt, Homo sapiens
aagggauuuuuacaucc

SEQ ID NO: 1352564 - RNA, 22 nt, Homo sapiens
aagggauuuuuacauccuugau

SEQ ID NO: 1352565 - RNA, 16 nt, Homo sapiens
aagggggcugcugcuc

SEQ ID NO: 1352566 - RNA, 16 nt, Homo sapiens
aagggguuuucuugau

SEQ ID NO: 1352567 - RNA, 19 nt, Homo sapiens
aagggucucucuccagguc

SEQ ID NO: 1352568 - RNA, 21 nt, Homo sapiens
aaggucauaaaaauauuguua

SEQ ID NO: 1352569 - RNA, 19 nt, Homo sapiens
aaggucuccuaaaacuggg

SEQ ID NO: 1352570 - RNA, 14 nt, Homo sapiens
aaggucugaugucu

SEQ ID NO: 1352571 - RNA, 19 nt, Homo sapiens
aaggucugcacuccuuuau

SEQ ID NO: 1352572 - RNA, 22 nt, Homo sapiens
aaggucuugcuauguugcccag

SEQ ID NO: 1352573 - RNA, 15 nt, Homo sapiens
aaggugaaccaaaga

SEQ ID NO: 1352574 - RNA, 19 nt, Homo sapiens
aagguggaacaagcacaga

SEQ ID NO: 1352575 - RNA, 15 nt, Homo sapiens
aagguggaaggcagu

SEQ ID NO: 1352576 - RNA, 14 nt, Homo sapiens
aagguucucugugc

SEQ ID NO: 1352577 - RNA, 23 nt, Homo sapiens
aagguuuaaaguuugaagauuau

SEQ ID NO: 1352578 - RNA, 12 nt, Homo sapiens
aaguaaaaccac

SEQ ID NO: 1352579 - RNA, 18 nt, Homo sapiens
aaguaauccaccugccuc

SEQ ID NO: 1352580 - RNA, 15 nt, Homo sapiens
aaguaauuugaauag

SEQ ID NO: 1352581 - RNA, 21 nt, Homo sapiens
aaguacuaucuuuguguugca

SEQ ID NO: 1352582 - RNA, 15 nt, Homo sapiens
aaguauaacaugucg

SEQ ID NO: 1352583 - RNA, 15 nt, Homo sapiens
aagucaaauaccaca

SEQ ID NO: 1352584 - RNA, 16 nt, Homo sapiens
aagucaaauaccacau

SEQ ID NO: 1352585 - RNA, 13 nt, Homo sapiens
aagucacucccaa

SEQ ID NO: 1352586 - RNA, 13 nt, Homo sapiens
aagucacugcaca

SEQ ID NO: 1352587 - RNA, 23 nt, Homo sapiens
aagucacugcacagugcaucuca

SEQ ID NO: 1352588 - RNA, 15 nt, Homo sapiens
aagucacuggccagu

SEQ ID NO: 1352589 - RNA, 17 nt, Homo sapiens
aagucagaauugcucaa

SEQ ID NO: 1352590 - RNA, 13 nt, Homo sapiens
aagucaucuugcu

SEQ ID NO: 1352591 - RNA, 22 nt, Homo sapiens
aaguccagcugggaagcccuuu

SEQ ID NO: 1352592 - RNA, 17 nt, Homo sapiens
aaguccggcggaauuca

SEQ ID NO: 1352593 - RNA, 13 nt, Homo sapiens
aagucucucaccc

SEQ ID NO: 1352594 - RNA, 13 nt, Homo sapiens
aagugaaagcaag

SEQ ID NO: 1352595 - RNA, 23 nt, Homo sapiens
aagugacaggacuuucauuguuc

SEQ ID NO: 1352596 - RNA, 21 nt, Homo sapiens
aagugaguuaaucuuguauga

SEQ ID NO: 1352597 - RNA, 16 nt, Homo sapiens
aagugauccucaggca

SEQ ID NO: 1352598 - RNA, 17 nt, Homo sapiens
aagugccaaaugcucuc

SEQ ID NO: 1352599 - RNA, 11 nt, Homo sapiens
aagugcuguuu

SEQ ID NO: 1352600 - RNA, 22 nt, Homo sapiens
aagugucaccccucacugugac

SEQ ID NO: 1352601 - RNA, 16 nt, Homo sapiens
aagugugcagccauag

SEQ ID NO: 1352602 - RNA, 18 nt, Homo sapiens
aaguuaguuccacugaga

SEQ ID NO: 1352603 - RNA, 14 nt, Homo sapiens
aaguucaucuugca

SEQ ID NO: 1352604 - RNA, 22 nt, Homo sapiens
aaguucccuacuuccugugacu

SEQ ID NO: 1352605 - RNA, 15 nt, Homo sapiens
aaguucucauugaau

SEQ ID NO: 1352606 - RNA, 17 nt, Homo sapiens
aaguugaugguauucau

SEQ ID NO: 1352607 - RNA, 21 nt, Homo sapiens
aaguuggguuuucuccauuca

SEQ ID NO: 1352608 - RNA, 22 nt, Homo sapiens
aaguuuaagugugcagccauag

SEQ ID NO: 1352609 - RNA, 12 nt, Homo sapiens
aaguuucauccg

SEQ ID NO: 1352610 - RNA, 14 nt, Homo sapiens
aauaaaacugagcu

SEQ ID NO: 1352611 - RNA, 13 nt, Homo sapiens
aauaaacaucagu

SEQ ID NO: 1352612 - RNA, 12 nt, Homo sapiens
aauaaaccgugu

SEQ ID NO: 1352613 - RNA, 13 nt, Homo sapiens
aauaaacuacucu

SEQ ID NO: 1352614 - RNA, 18 nt, Homo sapiens
aauaaacuuacauauuua

SEQ ID NO: 1352615 - RNA, 15 nt, Homo sapiens
aauaaagaccugaga

SEQ ID NO: 1352616 - RNA, 11 nt, Homo sapiens
aauaaagcaau

SEQ ID NO: 1352617 - RNA, 11 nt, Homo sapiens
aauaaagccuu

SEQ ID NO: 1352618 - RNA, 17 nt, Homo sapiens
aauaaaucugacccagu

SEQ ID NO: 1352619 - RNA, 19 nt, Homo sapiens
aauaaaucugacccagugc

SEQ ID NO: 1352620 - RNA, 22 nt, Homo sapiens
aauaaauggcccggacaugucu

SEQ ID NO: 1352621 - RNA, 18 nt, Homo sapiens
aauaaauucccaacuucu

SEQ ID NO: 1352622 - RNA, 13 nt, Homo sapiens
aauaaauucuaaa

SEQ ID NO: 1352623 - RNA, 14 nt, Homo sapiens
aauaaauugcuccu

SEQ ID NO: 1352624 - RNA, 21 nt, Homo sapiens
aauaaauugcuuacugauauu

SEQ ID NO: 1352625 - RNA, 18 nt, Homo sapiens
aauaacgugcaugcuuua

SEQ ID NO: 1352626 - RNA, 23 nt, Homo sapiens
aauaagacuuagauugugcuccu

SEQ ID NO: 1352627 - RNA, 23 nt, Homo sapiens
aauaaguuuuuuuaaaguguuau

SEQ ID NO: 1352628 - RNA, 15 nt, Homo sapiens
aauaaugacauaaaa

SEQ ID NO: 1352629 - RNA, 14 nt, Homo sapiens
aauaauucuuccuc

SEQ ID NO: 1352630 - RNA, 22 nt, Homo sapiens
aauaauuuccuucaggcagcug

SEQ ID NO: 1352631 - RNA, 17 nt, Homo sapiens
aauacacacucaaauca

SEQ ID NO: 1352632 - RNA, 15 nt, Homo sapiens
aauacagacaucuaa

SEQ ID NO: 1352633 - RNA, 19 nt, Homo sapiens
aauacauuuaaaacauuaa

SEQ ID NO: 1352634 - RNA, 15 nt, Homo sapiens
aauaccacaugauuu

SEQ ID NO: 1352635 - RNA, 21 nt, Homo sapiens
aauaccacaugauuuuacuca

SEQ ID NO: 1352636 - RNA, 22 nt, Homo sapiens
aauacugauguuccuagugaaa

SEQ ID NO: 1352637 - RNA, 20 nt, Homo sapiens
aauacuuauuuucagugcau

SEQ ID NO: 1352638 - RNA, 12 nt, Homo sapiens
aauagaaaaagu

SEQ ID NO: 1352639 - RNA, 13 nt, Homo sapiens
aauagaauacccu

SEQ ID NO: 1352640 - RNA, 18 nt, Homo sapiens
aauagcaauauucuugga

SEQ ID NO: 1352641 - RNA, 21 nt, Homo sapiens
aauagcccaggauauauuuua

SEQ ID NO: 1352642 - RNA, 21 nt, Homo sapiens
aauaggaaucuucacuagaag

SEQ ID NO: 1352643 - RNA, 13 nt, Homo sapiens
aauaguauuccaa

SEQ ID NO: 1352644 - RNA, 15 nt, Homo sapiens
aauagugguugccaa

SEQ ID NO: 1352645 - RNA, 14 nt, Homo sapiens
aauaguugcuguca

SEQ ID NO: 1352646 - RNA, 21 nt, Homo sapiens
aauaguugguuucaaauccuu

SEQ ID NO: 1352647 - RNA, 22 nt, Homo sapiens
aauauaaauuuguguucucaaa

SEQ ID NO: 1352648 - RNA, 16 nt, Homo sapiens
aauaucccuacaugua

SEQ ID NO: 1352649 - RNA, 17 nt, Homo sapiens
aauaucccuacauguau

SEQ ID NO: 1352650 - RNA, 22 nt, Homo sapiens
aauaucccuacauguauugcac

SEQ ID NO: 1352651 - RNA, 13 nt, Homo sapiens
aauauccuuugcc

SEQ ID NO: 1352652 - RNA, 23 nt, Homo sapiens
aauaucguuagggugaagcauua

SEQ ID NO: 1352653 - RNA, 16 nt, Homo sapiens
aauaugcaaaccagga

SEQ ID NO: 1352654 - RNA, 19 nt, Homo sapiens
aauaugcaaaccaggauuu

SEQ ID NO: 1352655 - RNA, 16 nt, Homo sapiens
aauauuauacuucuuu

SEQ ID NO: 1352656 - RNA, 20 nt, Homo sapiens
ccaggcuggagugcaaugac

SEQ ID NO: 1352657 - RNA, 20 nt, Homo sapiens
ccaggcuggucuugaacugg

SEQ ID NO: 1352658 - RNA, 12 nt, Homo sapiens
ccagggccagug

SEQ ID NO: 1352659 - RNA, 18 nt, Homo sapiens
ccagguacaggagaggca

SEQ ID NO: 1352660 - RNA, 18 nt, Homo sapiens
ccagguuuuucaaaagga

SEQ ID NO: 1352661 - RNA, 14 nt, Homo sapiens
ccaguaacuuuucu

SEQ ID NO: 1352662 - RNA, 17 nt, Homo sapiens
ccagucauuauguuaau

SEQ ID NO: 1352663 - RNA, 17 nt, Homo sapiens
ccagugacgcugcugac

SEQ ID NO: 1352664 - RNA, 21 nt, Homo sapiens
ccagugagaucaaugugacgg

SEQ ID NO: 1352665 - RNA, 13 nt, Homo sapiens
ccagugcagccac

SEQ ID NO: 1352666 - RNA, 16 nt, Homo sapiens
ccagugcaguccauuu

SEQ ID NO: 1352667 - RNA, 16 nt, Homo sapiens
ccagugccugugagca

SEQ ID NO: 1352668 - RNA, 16 nt, Homo sapiens
ccagugugagacccca

SEQ ID NO: 1352669 - RNA, 18 nt, Homo sapiens
ccaguguuccugaagcug

SEQ ID NO: 1352670 - RNA, 15 nt, Homo sapiens
ccaguucacauuuau

SEQ ID NO: 1352671 - RNA, 15 nt, Homo sapiens
ccaguucacccugau

SEQ ID NO: 1352672 - RNA, 22 nt, Homo sapiens
ccauaaacgguuccuggugacu

SEQ ID NO: 1352673 - RNA, 19 nt, Homo sapiens
ccauacaguguacucuuau

SEQ ID NO: 1352674 - RNA, 22 nt, Homo sapiens
ccauaggguccugaauguuuca

SEQ ID NO: 1352675 - RNA, 21 nt, Homo sapiens
ccaucaauaaauguugcaaug

SEQ ID NO: 1352676 - RNA, 20 nt, Homo sapiens
ccaucagcaaauauuauucu

SEQ ID NO: 1352677 - RNA, 16 nt, Homo sapiens
ccaucauacacuuccu

SEQ ID NO: 1352678 - RNA, 21 nt, Homo sapiens
ccauccuggccaacauuguaa

SEQ ID NO: 1352679 - RNA, 17 nt, Homo sapiens
ccaucgcaggaugacag

SEQ ID NO: 1352680 - RNA, 19 nt, Homo sapiens
ccaucucacugcaguagca

SEQ ID NO: 1352681 - RNA, 13 nt, Homo sapiens
ccaucucuuuacc

SEQ ID NO: 1352682 - RNA, 21 nt, Homo sapiens
ccaucuguuugauacaguauu

SEQ ID NO: 1352683 - RNA, 16 nt, Homo sapiens
ccaugagaaucuuaau

SEQ ID NO: 1352684 - RNA, 17 nt, Homo sapiens
ccaugauggcaacagau

SEQ ID NO: 1352685 - RNA, 21 nt, Homo sapiens
ccaugauguccuuggacucca

SEQ ID NO: 1352686 - RNA, 19 nt, Homo sapiens
ccaugccaguaacugugcu

SEQ ID NO: 1352687 - RNA, 16 nt, Homo sapiens
ccaugcugauaaacug

SEQ ID NO: 1352688 - RNA, 22 nt, Homo sapiens
ccaugcugcuggggaagacagu

SEQ ID NO: 1352689 - RNA, 18 nt, Homo sapiens
ccaugcuuuguagguguc

SEQ ID NO: 1352690 - RNA, 18 nt, Homo sapiens
ccauggaagguucucugu

SEQ ID NO: 1352691 - RNA, 21 nt, Homo sapiens
ccauggggcugauuguauuua

SEQ ID NO: 1352692 - RNA, 20 nt, Homo sapiens
ccaugugccuuucuuugccu

SEQ ID NO: 1352693 - RNA, 18 nt, Homo sapiens
ccauguuguaaugcugca

SEQ ID NO: 1352694 - RNA, 18 nt, Homo sapiens
ccauuccucagcuucuuc

SEQ ID NO: 1352695 - RNA, 18 nt, Homo sapiens
ccauucuauucuccagac

SEQ ID NO: 1352696 - RNA, 23 nt, Homo sapiens
ccauuugggcagagaggcugugg

SEQ ID NO: 1352697 - RNA, 17 nt, Homo sapiens
ccauuugugauacuucc

SEQ ID NO: 1352698 - RNA, 17 nt, Homo sapiens
cccaaaacugucauccu

SEQ ID NO: 1352699 - RNA, 19 nt, Homo sapiens
cccaaaggaacacugacau

SEQ ID NO: 1352700 - RNA, 20 nt, Homo sapiens
cccaaauuucauaccuauca

SEQ ID NO: 1352701 - RNA, 22 nt, Homo sapiens
cccaacacaaacccccacucca

SEQ ID NO: 1352702 - RNA, 17 nt, Homo sapiens
cccacacuggagccauc

SEQ ID NO: 1352703 - RNA, 11 nt, Homo sapiens
cccacccaguc

SEQ ID NO: 1352704 - RNA, 16 nt, Homo sapiens
cccaccccacaauucc

SEQ ID NO: 1352705 - RNA, 14 nt, Homo sapiens
cccacccgcuccca

SEQ ID NO: 1352706 - RNA, 20 nt, Homo sapiens
cccacgcugaccaugcguca

SEQ ID NO: 1352707 - RNA, 14 nt, Homo sapiens
cccacuucuggcca

SEQ ID NO: 1352708 - RNA, 21 nt, Homo sapiens
cccagaaugagacauccagca

SEQ ID NO: 1352709 - RNA, 18 nt, Homo sapiens
cccagacaauuccauuca

SEQ ID NO: 1352710 - RNA, 12 nt, Homo sapiens
cccagacugucu

SEQ ID NO: 1352711 - RNA, 19 nt, Homo sapiens
cccagagacauacuugaag

SEQ ID NO: 1352712 - RNA, 22 nt, Homo sapiens
cccagagacauacuugaagggc

SEQ ID NO: 1352713 - RNA, 22 nt, Homo sapiens
cccagaggagccaccaguucuc

SEQ ID NO: 1352714 - RNA, 23 nt, Homo sapiens
cccagaggcuucuccaaagggag

SEQ ID NO: 1352715 - RNA, 18 nt, Homo sapiens
cccagagugcugggauua

SEQ ID NO: 1352716 - RNA, 18 nt, Homo sapiens
cccagauucaugcacugu

SEQ ID NO: 1352717 - RNA, 19 nt, Homo sapiens
cccagcaucgcacucuggc

SEQ ID NO: 1352718 - RNA, 19 nt, Homo sapiens
cccagccagggcucaaucu

SEQ ID NO: 1352719 - RNA, 18 nt, Homo sapiens
cccagccauccagggggc

SEQ ID NO: 1352720 - RNA, 15 nt, Homo sapiens
cccagcccagagcca

SEQ ID NO: 1352721 - RNA, 14 nt, Homo sapiens
cccagcccagcacc

SEQ ID NO: 1352722 - RNA, 20 nt, Homo sapiens
cccagcccugggaaccacuc

SEQ ID NO: 1352723 - RNA, 16 nt, Homo sapiens
cccagccuacauucac

SEQ ID NO: 1352724 - RNA, 20 nt, Homo sapiens
cccagcucacaggagcuuaa

SEQ ID NO: 1352725 - RNA, 13 nt, Homo sapiens
cccagcuugggca

SEQ ID NO: 1352726 - RNA, 21 nt, Homo sapiens
cccaggaaagguuuuccuuau

SEQ ID NO: 1352727 - RNA, 13 nt, Homo sapiens
cccaggaccagcu

SEQ ID NO: 1352728 - RNA, 23 nt, Homo sapiens
cccaggacccugaaggggccaug

SEQ ID NO: 1352729 - RNA, 21 nt, Homo sapiens
cccaggaguauccucuugcca

SEQ ID NO: 1352730 - RNA, 18 nt, Homo sapiens
cccaggcuagagugcaau

SEQ ID NO: 1352731 - RNA, 20 nt, Homo sapiens
cccaggcuagagugcaaugg

SEQ ID NO: 1352732 - RNA, 18 nt, Homo sapiens
cccaggcuggagugcaau

SEQ ID NO: 1352733 - RNA, 15 nt, Homo sapiens
cccagggggccuuuc

SEQ ID NO: 1352734 - RNA, 22 nt, Homo sapiens
cccagucuuucuucacucuggc

SEQ ID NO: 1352735 - RNA, 19 nt, Homo sapiens
cccagugacaacaucgcaa

SEQ ID NO: 1352736 - RNA, 16 nt, Homo sapiens
cccagugacaaccaaa

SEQ ID NO: 1352737 - RNA, 20 nt, Homo sapiens
cccagugcccccacugacca

SEQ ID NO: 1352738 - RNA, 22 nt, Homo sapiens
cccaguucacccugauuuagga

SEQ ID NO: 1352739 - RNA, 21 nt, Homo sapiens
cccaugcaucuuccacuggaa

SEQ ID NO: 1352740 - RNA, 21 nt, Homo sapiens
cccauuccuaagaggaguuua

SEQ ID NO: 1352741 - RNA, 12 nt, Homo sapiens
cccauucuugca

SEQ ID NO: 1352742 - RNA, 17 nt, Homo sapiens
cccauuucaauuccugu

SEQ ID NO: 1352743 - RNA, 17 nt, Homo sapiens
ccccaagggggcugcug

SEQ ID NO: 1352744 - RNA, 22 nt, Homo sapiens
ccccacacugaccuguguuccc

SEQ ID NO: 1352745 - RNA, 23 nt, Homo sapiens
ccccacacuggagccaucucuuc

SEQ ID NO: 1352746 - RNA, 22 nt, Homo sapiens
ccccacguugccucuacuuuau

SEQ ID NO: 1352747 - RNA, 17 nt, Homo sapiens
ccccacucagugccucc

SEQ ID NO: 1352748 - RNA, 12 nt, Homo sapiens
ccccacugacca

SEQ ID NO: 1352749 - RNA, 15 nt, Homo sapiens
ccccagagcuccgau

SEQ ID NO: 1352750 - RNA, 15 nt, Homo sapiens
ccccagaucugcucc

SEQ ID NO: 1352751 - RNA, 14 nt, Homo sapiens
ccccagccauccag

SEQ ID NO: 1352752 - RNA, 22 nt, Homo sapiens
ccccaggagggaggcaggggag

SEQ ID NO: 1352753 - RNA, 17 nt, Homo sapiens
ccccauaaaaugauccu

SEQ ID NO: 1352754 - RNA, 14 nt, Homo sapiens
ccccaucugagcug

SEQ ID NO: 1352755 - RNA, 22 nt, Homo sapiens
ccccauggccggcuuucaggag

SEQ ID NO: 1352756 - RNA, 17 nt, Homo sapiens
ccccaugggcacagugg

SEQ ID NO: 1352757 - RNA, 21 nt, Homo sapiens
cccccaaugacacccaugcca

SEQ ID NO: 1352758 - RNA, 23 nt, Homo sapiens
cccccauaaaagauauguugaag

SEQ ID NO: 1352759 - RNA, 20 nt, Homo sapiens
cccccugggcuggggccuca

SEQ ID NO: 1352760 - RNA, 22 nt, Homo sapiens
ccccgcgcucgcccagcaggag

SEQ ID NO: 1352761 - RNA, 22 nt, Homo sapiens
ccccgggaaugcgcccaccaag

SEQ ID NO: 1352762 - RNA, 13 nt, Homo sapiens
ccccuaaaccaaa

SEQ ID NO: 1352763 - RNA, 13 nt, Homo sapiens
ccccuaaagccag

SEQ ID NO: 1352764 - RNA, 13 nt, Homo sapiens
ccccucaaacugc

SEQ ID NO: 1352765 - RNA, 17 nt, Homo sapiens
ccccucacaauccuugc

SEQ ID NO: 1352766 - RNA, 16 nt, Homo sapiens
ccccuguagcagucac

SEQ ID NO: 1352767 - RNA, 15 nt, Homo sapiens
ccccuuguguuugaa

SEQ ID NO: 1352768 - RNA, 18 nt, Homo sapiens
ccccuuugauugcugaga

SEQ ID NO: 1352769 - RNA, 16 nt, Homo sapiens
cccgacagugccaucc

SEQ ID NO: 1352770 - RNA, 17 nt, Homo sapiens
cccgcuaaggugaaaag

SEQ ID NO: 1352771 - RNA, 16 nt, Homo sapiens
cccgggggugaagggg

SEQ ID NO: 1352772 - RNA, 17 nt, Homo sapiens
cccuaaaagcacacuca

SEQ ID NO: 1352773 - RNA, 16 nt, Homo sapiens
cccuacagacagcuua

SEQ ID NO: 1352774 - RNA, 16 nt, Homo sapiens
cccuagcccugguuag

SEQ ID NO: 1352775 - RNA, 14 nt, Homo sapiens
cccuauugcugcua

SEQ ID NO: 1352776 - RNA, 15 nt, Homo sapiens
cccucagacaguuug

SEQ ID NO: 1352777 - RNA, 18 nt, Homo sapiens
cccuccaaaccuccagcc

SEQ ID NO: 1352778 - RNA, 21 nt, Homo sapiens
cccuccaaaggucugaugucu

SEQ ID NO: 1352779 - RNA, 13 nt, Homo sapiens
cccuccaauccca

SEQ ID NO: 1352780 - RNA, 13 nt, Homo sapiens
cccuccucuccca

SEQ ID NO: 1352781 - RNA, 21 nt, Homo sapiens
cccuccuuggcuuuaugcaaa

SEQ ID NO: 1352782 - RNA, 13 nt, Homo sapiens
cccucuguauacu

SEQ ID NO: 1352783 - RNA, 15 nt, Homo sapiens
cccugacuguauaca

SEQ ID NO: 1352784 - RNA, 14 nt, Homo sapiens
cccugcacaaagcc

SEQ ID NO: 1352785 - RNA, 11 nt, Homo sapiens
cccugccauca

SEQ ID NO: 1352786 - RNA, 15 nt, Homo sapiens
cccugcccaccaaga

SEQ ID NO: 1352787 - RNA, 17 nt, Homo sapiens
cccugccccguggagcc

SEQ ID NO: 1352788 - RNA, 21 nt, Homo sapiens
cucaguugaaauaacaacaga

SEQ ID NO: 1352789 - RNA, 15 nt, Homo sapiens
cucaguuucuaggca

SEQ ID NO: 1352790 - RNA, 22 nt, Homo sapiens
cucauaacucugugaucuugcu

SEQ ID NO: 1352791 - RNA, 16 nt, Homo sapiens
cucauaauuuugcaaa

SEQ ID NO: 1352792 - RNA, 13 nt, Homo sapiens
cucauacacagaa

SEQ ID NO: 1352793 - RNA, 17 nt, Homo sapiens
cucauacacaugugcac

SEQ ID NO: 1352794 - RNA, 15 nt, Homo sapiens
cucauauaagacaaa

SEQ ID NO: 1352795 - RNA, 23 nt, Homo sapiens
cucaucaggccauugucccugaa

SEQ ID NO: 1352796 - RNA, 17 nt, Homo sapiens
cucaugccuguaaucuc

SEQ ID NO: 1352797 - RNA, 18 nt, Homo sapiens
cucaugccuguaaucuca

SEQ ID NO: 1352798 - RNA, 12 nt, Homo sapiens
cucaugcugcuc

SEQ ID NO: 1352799 - RNA, 21 nt, Homo sapiens
cucauggaugcuuuggcaaug

SEQ ID NO: 1352800 - RNA, 15 nt, Homo sapiens
cucauugaccuucag

SEQ ID NO: 1352801 - RNA, 16 nt, Homo sapiens
cucauuuagcauugaa

SEQ ID NO: 1352802 - RNA, 14 nt, Homo sapiens
cucauuuuaacuca

SEQ ID NO: 1352803 - RNA, 16 nt, Homo sapiens
cucauuuuacacaaag

SEQ ID NO: 1352804 - RNA, 14 nt, Homo sapiens
cucauuuugcucaa

SEQ ID NO: 1352805 - RNA, 20 nt, Homo sapiens
cucauuuugcucaacauggu

SEQ ID NO: 1352806 - RNA, 23 nt, Homo sapiens
cucauuuuuguuuucauuaucuc

SEQ ID NO: 1352807 - RNA, 23 nt, Homo sapiens
cuccaacgccccuguggccaacu

SEQ ID NO: 1352808 - RNA, 15 nt, Homo sapiens
cuccaacuccauacu

SEQ ID NO: 1352809 - RNA, 23 nt, Homo sapiens
cuccaagcccgcucccugcucag

SEQ ID NO: 1352810 - RNA, 21 nt, Homo sapiens
cuccacaugcugccuggcaca

SEQ ID NO: 1352811 - RNA, 19 nt, Homo sapiens
cuccacuggccuccuggca

SEQ ID NO: 1352812 - RNA, 19 nt, Homo sapiens
cuccagaugccacaaugga

SEQ ID NO: 1352813 - RNA, 15 nt, Homo sapiens
cuccagcagcuuucc

SEQ ID NO: 1352814 - RNA, 23 nt, Homo sapiens
cuccagccucccugucuccagcu

SEQ ID NO: 1352815 - RNA, 16 nt, Homo sapiens
cuccagcugacagcca

SEQ ID NO: 1352816 - RNA, 22 nt, Homo sapiens
cuccagguuccugaaauaucca

SEQ ID NO: 1352817 - RNA, 13 nt, Homo sapiens
cuccagugcaguc

SEQ ID NO: 1352818 - RNA, 17 nt, Homo sapiens
cuccauacaguguacuc

SEQ ID NO: 1352819 - RNA, 15 nt, Homo sapiens
cuccaucagcuccug

SEQ ID NO: 1352820 - RNA, 22 nt, Homo sapiens
cuccauccugcagauacuuuga

SEQ ID NO: 1352821 - RNA, 16 nt, Homo sapiens
cuccaucgcaguguuc

SEQ ID NO: 1352822 - RNA, 12 nt, Homo sapiens
cuccaucucaua

SEQ ID NO: 1352823 - RNA, 10 nt, Homo sapiens
cuccaugcac

SEQ ID NO: 1352824 - RNA, 19 nt, Homo sapiens
cuccaugcugccuccagaa

SEQ ID NO: 1352825 - RNA, 18 nt, Homo sapiens
cuccauugguguugacau

SEQ ID NO: 1352826 - RNA, 19 nt, Homo sapiens
cucccaaagugcugggauu

SEQ ID NO: 1352827 - RNA, 13 nt, Homo sapiens
cucccacagcuuc

SEQ ID NO: 1352828 - RNA, 19 nt, Homo sapiens
cucccagagugcugggauu

SEQ ID NO: 1352829 - RNA, 20 nt, Homo sapiens
cucccagguucccccagcaa

SEQ ID NO: 1352830 - RNA, 16 nt, Homo sapiens
cucccauagcaaagag

SEQ ID NO: 1352831 - RNA, 23 nt, Homo sapiens
cucccaugugcugacucccccca

SEQ ID NO: 1352832 - RNA, 17 nt, Homo sapiens
cuccccaaggcugcaaa

SEQ ID NO: 1352833 - RNA, 21 nt, Homo sapiens
cuccccagaugugacuacuga

SEQ ID NO: 1352834 - RNA, 20 nt, Homo sapiens
cuccccaguagcugggauua

SEQ ID NO: 1352835 - RNA, 18 nt, Homo sapiens
cucccccuuucacacugg

SEQ ID NO: 1352836 - RNA, 21 nt, Homo sapiens
cuccccuaaagccaggcucag

SEQ ID NO: 1352837 - RNA, 16 nt, Homo sapiens
cuccccuaacaggugc

SEQ ID NO: 1352838 - RNA, 21 nt, Homo sapiens
cucccuaggcugcccacucuc

SEQ ID NO: 1352839 - RNA, 16 nt, Homo sapiens
cucccugaagccuuug

SEQ ID NO: 1352840 - RNA, 17 nt, Homo sapiens
cucccuguuccccagag

SEQ ID NO: 1352841 - RNA, 16 nt, Homo sapiens
cuccgaaaugcugucu

SEQ ID NO: 1352842 - RNA, 14 nt, Homo sapiens
cuccuaaagcuuuu

SEQ ID NO: 1352843 - RNA, 19 nt, Homo sapiens
cuccucacccaccucuggg

SEQ ID NO: 1352844 - RNA, 15 nt, Homo sapiens
cuccucauagcauga

SEQ ID NO: 1352845 - RNA, 15 nt, Homo sapiens
cuccucaucuccaag

SEQ ID NO: 1352846 - RNA, 19 nt, Homo sapiens
cuccucucccagugacaac

SEQ ID NO: 1352847 - RNA, 19 nt, Homo sapiens
cuccugaguagcuggauua

SEQ ID NO: 1352848 - RNA, 20 nt, Homo sapiens
cuccugaguagcugggauua

SEQ ID NO: 1352849 - RNA, 22 nt, Homo sapiens
cuccugccauaggguccugaau

SEQ ID NO: 1352850 - RNA, 19 nt, Homo sapiens
cuccuggcucaagcccuga

SEQ ID NO: 1352851 - RNA, 17 nt, Homo sapiens
cuccuguaccucagugg

SEQ ID NO: 1352852 - RNA, 15 nt, Homo sapiens
cuccugucuccagca

SEQ ID NO: 1352853 - RNA, 18 nt, Homo sapiens
cuccuuccccaaguaauu

SEQ ID NO: 1352854 - RNA, 19 nt, Homo sapiens
cuccuucgcccucuuguag

SEQ ID NO: 1352855 - RNA, 20 nt, Homo sapiens
cuccuugaauaucuuucgau

SEQ ID NO: 1352856 - RNA, 14 nt, Homo sapiens
cuccuuggcuuuau

SEQ ID NO: 1352857 - RNA, 20 nt, Homo sapiens
cucgagcacugaagucacca

SEQ ID NO: 1352858 - RNA, 18 nt, Homo sapiens
cucgaggaacguaguguu

SEQ ID NO: 1352859 - RNA, 17 nt, Homo sapiens
cucgccggaucugaggg

SEQ ID NO: 1352860 - RNA, 21 nt, Homo sapiens
cucggagaagagcuguucaca

SEQ ID NO: 1352861 - RNA, 21 nt, Homo sapiens
cucggagggauggagaaagaa

SEQ ID NO: 1352862 - RNA, 20 nt, Homo sapiens
cucggcucaccgugagaaag

SEQ ID NO: 1352863 - RNA, 15 nt, Homo sapiens
cucuaagugcugcug

SEQ ID NO: 1352864 - RNA, 17 nt, Homo sapiens
cucuaaugugucucuca

SEQ ID NO: 1352865 - RNA, 18 nt, Homo sapiens
cucuaauucacagugcuc

SEQ ID NO: 1352866 - RNA, 12 nt, Homo sapiens
cucuacccugag

SEQ ID NO: 1352867 - RNA, 20 nt, Homo sapiens
cucuacucuggagguuuguu

SEQ ID NO: 1352868 - RNA, 19 nt, Homo sapiens
cucuagccuggcaacagag

SEQ ID NO: 1352869 - RNA, 20 nt, Homo sapiens
cucuauuuuaauuacugcua

SEQ ID NO: 1352870 - RNA, 15 nt, Homo sapiens
cucucauguacuuuu

SEQ ID NO: 1352871 - RNA, 16 nt, Homo sapiens
cucuccaccagguucu

SEQ ID NO: 1352872 - RNA, 13 nt, Homo sapiens
cucuccauauccc

SEQ ID NO: 1352873 - RNA, 16 nt, Homo sapiens
cucuccaucagcuccu

SEQ ID NO: 1352874 - RNA, 18 nt, Homo sapiens
cucuccccagcccagaga

SEQ ID NO: 1352875 - RNA, 20 nt, Homo sapiens
cucuccccucagagugcaag

SEQ ID NO: 1352876 - RNA, 16 nt, Homo sapiens
cucuccugacuuuuaa

SEQ ID NO: 1352877 - RNA, 14 nt, Homo sapiens
cucucucugagggg

SEQ ID NO: 1352878 - RNA, 15 nt, Homo sapiens
cucugaggcuaugga

SEQ ID NO: 1352879 - RNA, 15 nt, Homo sapiens
cucugaucaaguauu

SEQ ID NO: 1352880 - RNA, 17 nt, Homo sapiens
cucugcagcucagggac

SEQ ID NO: 1352881 - RNA, 18 nt, Homo sapiens
cucugcauggaacagcau

SEQ ID NO: 1352882 - RNA, 21 nt, Homo sapiens
cucugcauuuauaaagaccgu

SEQ ID NO: 1352883 - RNA, 21 nt, Homo sapiens
cucugccaaaggaugugauau

SEQ ID NO: 1352884 - RNA, 21 nt, Homo sapiens
cucugccuuaaacacacauug

SEQ ID NO: 1352885 - RNA, 19 nt, Homo sapiens
cucugcgucgguccuggug

SEQ ID NO: 1352886 - RNA, 20 nt, Homo sapiens
cucuggacuggaaagcacaa

SEQ ID NO: 1352887 - RNA, 17 nt, Homo sapiens
cucuggcaccaucagcc

SEQ ID NO: 1352888 - RNA, 19 nt, Homo sapiens
cucuggccuguacccagua

SEQ ID NO: 1352889 - RNA, 20 nt, Homo sapiens
cucuggcuucaaaaagccac

SEQ ID NO: 1352890 - RNA, 21 nt, Homo sapiens
cucugggaaguggucagcgca

SEQ ID NO: 1352891 - RNA, 15 nt, Homo sapiens
cucugggcuccagag

SEQ ID NO: 1352892 - RNA, 15 nt, Homo sapiens
cucugguaauauuga

SEQ ID NO: 1352893 - RNA, 21 nt, Homo sapiens
cucuggugcuccugcaucuca

SEQ ID NO: 1352894 - RNA, 16 nt, Homo sapiens
cucuggugugugguga

SEQ ID NO: 1352895 - RNA, 13 nt, Homo sapiens
cucugugacuccc

SEQ ID NO: 1352896 - RNA, 16 nt, Homo sapiens
cucugugccuugccac

SEQ ID NO: 1352897 - RNA, 18 nt, Homo sapiens
cucuuaagagaacauuau

SEQ ID NO: 1352898 - RNA, 13 nt, Homo sapiens
cucuuagcucagc

SEQ ID NO: 1352899 - RNA, 18 nt, Homo sapiens
cucuuaugugugccuuug

SEQ ID NO: 1352900 - RNA, 23 nt, Homo sapiens
cucuucccgccgcccagcccacc

SEQ ID NO: 1352901 - RNA, 16 nt, Homo sapiens
cucuucugccuucuca

SEQ ID NO: 1352902 - RNA, 12 nt, Homo sapiens
cucuugacuacu

SEQ ID NO: 1352903 - RNA, 17 nt, Homo sapiens
cucuugagucacacugc

SEQ ID NO: 1352904 - RNA, 20 nt, Homo sapiens
cucuugccugcuccaucuca

SEQ ID NO: 1352905 - RNA, 23 nt, Homo sapiens
cucuugcggaugcuugguacugu

SEQ ID NO: 1352906 - RNA, 23 nt, Homo sapiens
cucuugggcccaggacuguugau

SEQ ID NO: 1352907 - RNA, 13 nt, Homo sapiens
cucuuuaccuccu

SEQ ID NO: 1352908 - RNA, 13 nt, Homo sapiens
cucuuuggggcua

SEQ ID NO: 1352909 - RNA, 23 nt, Homo sapiens
cugaaaaaugguaauuguugcua

SEQ ID NO: 1352910 - RNA, 19 nt, Homo sapiens
cugaaagacucgagaacca

SEQ ID NO: 1352911 - RNA, 12 nt, Homo sapiens
cugaaaggccag

SEQ ID NO: 1352912 - RNA, 16 nt, Homo sapiens
cugaaaggccagcagc

SEQ ID NO: 1352913 - RNA, 17 nt, Homo sapiens
cugaaauauccaggaau

SEQ ID NO: 1352914 - RNA, 16 nt, Homo sapiens
cugaacaggaaagagc

SEQ ID NO: 1352915 - RNA, 19 nt, Homo sapiens
cugaacccuccaaaggaac

SEQ ID NO: 1352916 - RNA, 18 nt, Homo sapiens
cugaacuuucucccucau

SEQ ID NO: 1352917 - RNA, 21 nt, Homo sapiens
cugaagcucccuguccugaaa

SEQ ID NO: 1352918 - RNA, 19 nt, Homo sapiens
cugaauaaauaauucuucc

SEQ ID NO: 1352919 - RNA, 16 nt, Homo sapiens
cugaauaacuugaaga

SEQ ID NO: 1352920 - RNA, 20 nt, Homo sapiens
uauagccuggggugggguca

SEQ ID NO: 1352921 - RNA, 15 nt, Homo sapiens
uauagcggcauauag

SEQ ID NO: 1352922 - RNA, 17 nt, Homo sapiens
uauagcuaaguacacaa

SEQ ID NO: 1352923 - RNA, 20 nt, Homo sapiens
uauagcuaauaacaugugaa

SEQ ID NO: 1352924 - RNA, 22 nt, Homo sapiens
uauaggaucauuuguuggaaug

SEQ ID NO: 1352925 - RNA, 21 nt, Homo sapiens
uauaggugcuacaaaaacaca

SEQ ID NO: 1352926 - RNA, 18 nt, Homo sapiens
uauagugacaugcaguua

SEQ ID NO: 1352927 - RNA, 20 nt, Homo sapiens
uauaguguuuggacagcuga

SEQ ID NO: 1352928 - RNA, 13 nt, Homo sapiens
uauauaaguugcu

SEQ ID NO: 1352929 - RNA, 14 nt, Homo sapiens
uauauauauaugca

SEQ ID NO: 1352930 - RNA, 21 nt, Homo sapiens
uauauuacuugccuaucugac

SEQ ID NO: 1352931 - RNA, 16 nt, Homo sapiens
uauauuaugauugcau

SEQ ID NO: 1352932 - RNA, 18 nt, Homo sapiens
uauauuauuacuaauugu

SEQ ID NO: 1352933 - RNA, 21 nt, Homo sapiens
uauauugcuuaccugaucuca

SEQ ID NO: 1352934 - RNA, 22 nt, Homo sapiens
uauauuugaaaaaaacuucauu

SEQ ID NO: 1352935 - RNA, 13 nt, Homo sapiens
uaucaaauguaac

SEQ ID NO: 1352936 - RNA, 13 nt, Homo sapiens
uaucacuguugca

SEQ ID NO: 1352937 - RNA, 20 nt, Homo sapiens
uaucacuucauucacauuca

SEQ ID NO: 1352938 - RNA, 19 nt, Homo sapiens
uaucagccugugccacgau

SEQ ID NO: 1352939 - RNA, 12 nt, Homo sapiens
uaucaggagaaa

SEQ ID NO: 1352940 - RNA, 14 nt, Homo sapiens
uaucagugugcaau

SEQ ID NO: 1352941 - RNA, 15 nt, Homo sapiens
uaucagugugcaaua

SEQ ID NO: 1352942 - RNA, 20 nt, Homo sapiens
uaucaguuuuauagcuuuau

SEQ ID NO: 1352943 - RNA, 19 nt, Homo sapiens
uaucauaauucagcacuua

SEQ ID NO: 1352944 - RNA, 13 nt, Homo sapiens
uauccauccaugg

SEQ ID NO: 1352945 - RNA, 21 nt, Homo sapiens
uauccuuguagcaaagcacau

SEQ ID NO: 1352946 - RNA, 12 nt, Homo sapiens
uaucucaaguaa

SEQ ID NO: 1352947 - RNA, 13 nt, Homo sapiens
uaucucagccaua

SEQ ID NO: 1352948 - RNA, 23 nt, Homo sapiens
uaucucauuuuacacaaagggaa

SEQ ID NO: 1352949 - RNA, 14 nt, Homo sapiens
uaucucuguuuccu

SEQ ID NO: 1352950 - RNA, 16 nt, Homo sapiens
uaucugacuucauaca

SEQ ID NO: 1352951 - RNA, 16 nt, Homo sapiens
uaucugcgugcacuuc

SEQ ID NO: 1352952 - RNA, 18 nt, Homo sapiens
uaucuuucgauaaacaac

SEQ ID NO: 1352953 - RNA, 22 nt, Homo sapiens
uaucuuuuuucuuccuauuucc

SEQ ID NO: 1352954 - RNA, 22 nt, Homo sapiens
uaugaaaggcagggcaagaaca

SEQ ID NO: 1352955 - RNA, 17 nt, Homo sapiens
uaugaagaaucugcucu

SEQ ID NO: 1352956 - RNA, 21 nt, Homo sapiens
uaugaaggauuacucuccaua

SEQ ID NO: 1352957 - RNA, 15 nt, Homo sapiens
uaugaauaauugcau

SEQ ID NO: 1352958 - RNA, 21 nt, Homo sapiens
uaugagguuucuuugacuuca

SEQ ID NO: 1352959 - RNA, 13 nt, Homo sapiens
uaugaucagaaga

SEQ ID NO: 1352960 - RNA, 21 nt, Homo sapiens
uaugauuauuaacgaugucca

SEQ ID NO: 1352961 - RNA, 16 nt, Homo sapiens
uaugcaaauacaauca

SEQ ID NO: 1352962 - RNA, 17 nt, Homo sapiens
uaugcaaauacaaucag

SEQ ID NO: 1352963 - RNA, 14 nt, Homo sapiens
uaugcaagcagcuu

SEQ ID NO: 1352964 - RNA, 15 nt, Homo sapiens
uaugcacacauauau

SEQ ID NO: 1352965 - RNA, 19 nt, Homo sapiens
uaugcauggugccccagga

SEQ ID NO: 1352966 - RNA, 13 nt, Homo sapiens
uaugcccucaagu

SEQ ID NO: 1352967 - RNA, 21 nt, Homo sapiens
uaugccucagucuauucugua

SEQ ID NO: 1352968 - RNA, 23 nt, Homo sapiens
uaugccugaaugacuccacuguu

SEQ ID NO: 1352969 - RNA, 16 nt, Homo sapiens
uaugcugacagcucuu

SEQ ID NO: 1352970 - RNA, 20 nt, Homo sapiens
uaugcugacagcucuucaca

SEQ ID NO: 1352971 - RNA, 18 nt, Homo sapiens
uaugcugguagaugcuga

SEQ ID NO: 1352972 - RNA, 16 nt, Homo sapiens
uaugcuuuaucuugaa

SEQ ID NO: 1352973 - RNA, 13 nt, Homo sapiens
uauggaggacugu

SEQ ID NO: 1352974 - RNA, 21 nt, Homo sapiens
uauggcuauaggugcuacaaa

SEQ ID NO: 1352975 - RNA, 20 nt, Homo sapiens
uaugggcuaccaggaagaag

SEQ ID NO: 1352976 - RNA, 19 nt, Homo sapiens
uaugggugauguagagauu

SEQ ID NO: 1352977 - RNA, 18 nt, Homo sapiens
uauggguuggacaaccuc

SEQ ID NO: 1352978 - RNA, 22 nt, Homo sapiens
uaugguaggaacugcugggcuu

SEQ ID NO: 1352979 - RNA, 14 nt, Homo sapiens
uauggucauuuaaa

SEQ ID NO: 1352980 - RNA, 14 nt, Homo sapiens
uaugguucucaggc

SEQ ID NO: 1352981 - RNA, 13 nt, Homo sapiens
uauguacugccuu

SEQ ID NO: 1352982 - RNA, 21 nt, Homo sapiens
uauguacugccuuagugcuga

SEQ ID NO: 1352983 - RNA, 20 nt, Homo sapiens
uaugugacauuuuacauuaa

SEQ ID NO: 1352984 - RNA, 12 nt, Homo sapiens
uaugugcacauc

SEQ ID NO: 1352985 - RNA, 22 nt, Homo sapiens
uauguggaagugugggucugug

SEQ ID NO: 1352986 - RNA, 17 nt, Homo sapiens
uaugugggggucugugu

SEQ ID NO: 1352987 - RNA, 20 nt, Homo sapiens
uauguguaguuauaaaccaa

SEQ ID NO: 1352988 - RNA, 22 nt, Homo sapiens
uauguuaauauuuuauguguaa

SEQ ID NO: 1352989 - RNA, 19 nt, Homo sapiens
uauguucccccuguuucag

SEQ ID NO: 1352990 - RNA, 23 nt, Homo sapiens
uauguuuggaauauuccacuauu

SEQ ID NO: 1352991 - RNA, 18 nt, Homo sapiens
uauuaaagaauaagcugu

SEQ ID NO: 1352992 - RNA, 15 nt, Homo sapiens
uauuaacggugguga

SEQ ID NO: 1352993 - RNA, 16 nt, Homo sapiens
uauuaagcaguacaaa

SEQ ID NO: 1352994 - RNA, 20 nt, Homo sapiens
uauuaagguuuucaaccgga

SEQ ID NO: 1352995 - RNA, 16 nt, Homo sapiens
uauuaauucagguuuu

SEQ ID NO: 1352996 - RNA, 21 nt, Homo sapiens
uauuaauuuuccaaugcacag

SEQ ID NO: 1352997 - RNA, 14 nt, Homo sapiens
uauuacauugcugc

SEQ ID NO: 1352998 - RNA, 20 nt, Homo sapiens
uauuagucgcacauguauug

SEQ ID NO: 1352999 - RNA, 15 nt, Homo sapiens
uauucacaguaucug

SEQ ID NO: 1353000 - RNA, 16 nt, Homo sapiens
uauuccaagcauauaa

SEQ ID NO: 1353001 - RNA, 22 nt, Homo sapiens
uauuccauggcuaacuggcgag

SEQ ID NO: 1353002 - RNA, 21 nt, Homo sapiens
uauucucuuaugauacuugag

SEQ ID NO: 1353003 - RNA, 12 nt, Homo sapiens
uauucugcuuag

SEQ ID NO: 1353004 - RNA, 17 nt, Homo sapiens
uauugaauucauuucac

SEQ ID NO: 1353005 - RNA, 13 nt, Homo sapiens
uauugauauucaa

SEQ ID NO: 1353006 - RNA, 18 nt, Homo sapiens
uauugcauuuauauguac

SEQ ID NO: 1353007 - RNA, 19 nt, Homo sapiens
uauugccuguguuugccac

SEQ ID NO: 1353008 - RNA, 11 nt, Homo sapiens
uauugcugcua

SEQ ID NO: 1353009 - RNA, 15 nt, Homo sapiens
uauugcuguuaauau

SEQ ID NO: 1353010 - RNA, 23 nt, Homo sapiens
uauuggcccuaaauagcagaaag

SEQ ID NO: 1353011 - RNA, 22 nt, Homo sapiens
uauuguccccuaaaccaaaaac

SEQ ID NO: 1353012 - RNA, 21 nt, Homo sapiens
uauugucgguuaccucugcau

SEQ ID NO: 1353013 - RNA, 19 nt, Homo sapiens
uauuuaacagugcaaaagg

SEQ ID NO: 1353014 - RNA, 14 nt, Homo sapiens
uauuuaagacauaa

SEQ ID NO: 1353015 - RNA, 17 nt, Homo sapiens
uauuuaagcagcuugaa

SEQ ID NO: 1353016 - RNA, 14 nt, Homo sapiens
uauuuauauuucaa

SEQ ID NO: 1353017 - RNA, 17 nt, Homo sapiens
uauuuauuuuuaggaca

SEQ ID NO: 1353018 - RNA, 18 nt, Homo sapiens
uauuucaagucucucacc

SEQ ID NO: 1353019 - RNA, 13 nt, Homo sapiens
uauuucuugaaga

SEQ ID NO: 1353020 - RNA, 12 nt, Homo sapiens
uauuucuugaua

SEQ ID NO: 1353021 - RNA, 19 nt, Homo sapiens
uauuucuuuuuugccaaau

SEQ ID NO: 1353022 - RNA, 19 nt, Homo sapiens
uauuuggaaauaaagucag

SEQ ID NO: 1353023 - RNA, 23 nt, Homo sapiens
uauuuuuuuucuuguauuuuucc

SEQ ID NO: 1353024 - RNA, 14 nt, Homo sapiens
ucaaaaacauucuu

SEQ ID NO: 1353025 - RNA, 15 nt, Homo sapiens
ucaaaaacauucuua

SEQ ID NO: 1353026 - RNA, 20 nt, Homo sapiens
ucaaaagccauaacuugaaa

SEQ ID NO: 1353027 - RNA, 19 nt, Homo sapiens
ucaaaaguuuguuugcuua

SEQ ID NO: 1353028 - RNA, 19 nt, Homo sapiens
ucaaaaguuuuuucuaagu

SEQ ID NO: 1353029 - RNA, 13 nt, Homo sapiens
ucaaaauaaugaa

SEQ ID NO: 1353030 - RNA, 15 nt, Homo sapiens
ucaaaauaaugaagu

SEQ ID NO: 1353031 - RNA, 23 nt, Homo sapiens
ucaaacauuuuguaucaaggaaa

SEQ ID NO: 1353032 - RNA, 22 nt, Homo sapiens
ucaaacccaaguuaguucaauc

SEQ ID NO: 1353033 - RNA, 18 nt, Homo sapiens
ucaaaccccgaccaccug

SEQ ID NO: 1353034 - RNA, 17 nt, Homo sapiens
ucaaacuccugaccuca

SEQ ID NO: 1353035 - RNA, 21 nt, Homo sapiens
ucaaacugcaugauucaugcc

SEQ ID NO: 1353036 - RNA, 22 nt, Homo sapiens
ucaaagaaaguguauugguuua

SEQ ID NO: 1353037 - RNA, 20 nt, Homo sapiens
ucaaagaagucauucuuuaa

SEQ ID NO: 1353038 - RNA, 19 nt, Homo sapiens
ucaaagacuuccucuggcu

SEQ ID NO: 1353039 - RNA, 16 nt, Homo sapiens
ucaaagcaaagcucuu

SEQ ID NO: 1353040 - RNA, 20 nt, Homo sapiens
ucaaagggagagagugcuau

SEQ ID NO: 1353041 - RNA, 22 nt, Homo sapiens
ucaaagggagagagugcuauug

SEQ ID NO: 1353042 - RNA, 21 nt, Homo sapiens
ucaaauacauuuaaaacauua

SEQ ID NO: 1353043 - RNA, 15 nt, Homo sapiens
ucaaaugagccccuu

SEQ ID NO: 1353044 - RNA, 23 nt, Homo sapiens
ucaaaugcuggcaaauccaggcu

SEQ ID NO: 1353045 - RNA, 21 nt, Homo sapiens
ucaaauguuuuaaaguuuaau

SEQ ID NO: 1353046 - RNA, 14 nt, Homo sapiens
ucaacaacuuguga

SEQ ID NO: 1353047 - RNA, 22 nt, Homo sapiens
ucaaccaacaacaauguguugu

SEQ ID NO: 1353048 - RNA, 15 nt, Homo sapiens
ucaacugguuguaua

SEQ ID NO: 1353049 - RNA, 16 nt, Homo sapiens
ucaacuuaagguauau

SEQ ID NO: 1353050 - RNA, 13 nt, Homo sapiens
ucaagaagaggaa

SEQ ID NO: 1353051 - RNA, 15 nt, Homo sapiens
ugacuaagagucucc

SEQ ID NO: 1353052 - RNA, 19 nt, Homo sapiens
ugacucaauuauuugcaua

SEQ ID NO: 1353053 - RNA, 15 nt, Homo sapiens
ugacucaggacaucc

SEQ ID NO: 1353054 - RNA, 23 nt, Homo sapiens
ugacuccuguugccauggauuca

SEQ ID NO: 1353055 - RNA, 16 nt, Homo sapiens
ugacucucagcagcua

SEQ ID NO: 1353056 - RNA, 14 nt, Homo sapiens
ugacugaacuguaa

SEQ ID NO: 1353057 - RNA, 18 nt, Homo sapiens
ugacugagcagcauccac

SEQ ID NO: 1353058 - RNA, 17 nt, Homo sapiens
ugacugccaagccagau

SEQ ID NO: 1353059 - RNA, 22 nt, Homo sapiens
ugacuggccuauuuaucugauc

SEQ ID NO: 1353060 - RNA, 18 nt, Homo sapiens
ugacuguauacagaauga

SEQ ID NO: 1353061 - RNA, 22 nt, Homo sapiens
ugacuguauuuuccaacuuguu

SEQ ID NO: 1353062 - RNA, 16 nt, Homo sapiens
ugacuuccugccaugg

SEQ ID NO: 1353063 - RNA, 13 nt, Homo sapiens
ugacuugauugcc

SEQ ID NO: 1353064 - RNA, 14 nt, Homo sapiens
ugacuuuauacaga

SEQ ID NO: 1353065 - RNA, 17 nt, Homo sapiens
ugagaacccuugcacua

SEQ ID NO: 1353066 - RNA, 22 nt, Homo sapiens
ugagaagaaaaucagagaggga

SEQ ID NO: 1353067 - RNA, 12 nt, Homo sapiens
ugagacagacua

SEQ ID NO: 1353068 - RNA, 18 nt, Homo sapiens
ugagaccuggcagccaca

SEQ ID NO: 1353069 - RNA, 21 nt, Homo sapiens
ugagacuagacauaguaccga

SEQ ID NO: 1353070 - RNA, 19 nt, Homo sapiens
ugagagggcugcugaccau

SEQ ID NO: 1353071 - RNA, 22 nt, Homo sapiens
ugagauauuaaauucucaaagu

SEQ ID NO: 1353072 - RNA, 15 nt, Homo sapiens
ugagaucaaugugac

SEQ ID NO: 1353073 - RNA, 15 nt, Homo sapiens
ugagaucauugugaa

SEQ ID NO: 1353074 - RNA, 20 nt, Homo sapiens
ugagcacugaaccacauuca

SEQ ID NO: 1353075 - RNA, 14 nt, Homo sapiens
ugagcagcuuuucu

SEQ ID NO: 1353076 - RNA, 18 nt, Homo sapiens
ugagcagcuuuucucccc

SEQ ID NO: 1353077 - RNA, 17 nt, Homo sapiens
ugagcagggaucugccc

SEQ ID NO: 1353078 - RNA, 18 nt, Homo sapiens
ugagcaggguccacagcu

SEQ ID NO: 1353079 - RNA, 15 nt, Homo sapiens
ugagcauggggccag

SEQ ID NO: 1353080 - RNA, 23 nt, Homo sapiens
ugagcauggggccaggaaagucu

SEQ ID NO: 1353081 - RNA, 12 nt, Homo sapiens
ugagcaugugau

SEQ ID NO: 1353082 - RNA, 19 nt, Homo sapiens
ugagccacagucacuggau

SEQ ID NO: 1353083 - RNA, 15 nt, Homo sapiens
ugagccacucagagc

SEQ ID NO: 1353084 - RNA, 15 nt, Homo sapiens
ugagccuuugugcuu

SEQ ID NO: 1353085 - RNA, 22 nt, Homo sapiens
ugagcugcaacuucuuacuucc

SEQ ID NO: 1353086 - RNA, 23 nt, Homo sapiens
ugaggacuuaaaauauuccugca

SEQ ID NO: 1353087 - RNA, 16 nt, Homo sapiens
ugaggccaucucagga

SEQ ID NO: 1353088 - RNA, 20 nt, Homo sapiens
ugaggcccauucuucacucu

SEQ ID NO: 1353089 - RNA, 14 nt, Homo sapiens
ugaggccucucauu

SEQ ID NO: 1353090 - RNA, 23 nt, Homo sapiens
ugagggugggggugcucucucug

SEQ ID NO: 1353091 - RNA, 20 nt, Homo sapiens
ugagguguauugguguugca

SEQ ID NO: 1353092 - RNA, 21 nt, Homo sapiens
ugaguaacgacauggaacuga

SEQ ID NO: 1353093 - RNA, 18 nt, Homo sapiens
ugaguaagcccucaggag

SEQ ID NO: 1353094 - RNA, 17 nt, Homo sapiens
ugaguagcucuccugac

SEQ ID NO: 1353095 - RNA, 16 nt, Homo sapiens
ugaguauaaauuuacu

SEQ ID NO: 1353096 - RNA, 16 nt, Homo sapiens
ugaguguauguguuua

SEQ ID NO: 1353097 - RNA, 13 nt, Homo sapiens
ugaguuuuuagug

SEQ ID NO: 1353098 - RNA, 15 nt, Homo sapiens
ugauaaaauuauuga

SEQ ID NO: 1353099 - RNA, 19 nt, Homo sapiens
ugauacaguugcauguuau

SEQ ID NO: 1353100 - RNA, 23 nt, Homo sapiens
ugauacucuuucuaaugcugaua

SEQ ID NO: 1353101 - RNA, 21 nt, Homo sapiens
ugauacugucucuccagugaa

SEQ ID NO: 1353102 - RNA, 19 nt, Homo sapiens
ugauagauuucuacacuga

SEQ ID NO: 1353103 - RNA, 14 nt, Homo sapiens
ugauaucuaauaau

SEQ ID NO: 1353104 - RNA, 17 nt, Homo sapiens
ugauaucugcagggaca

SEQ ID NO: 1353105 - RNA, 12 nt, Homo sapiens
ugaucagacuga

SEQ ID NO: 1353106 - RNA, 14 nt, Homo sapiens
ugauccuaaccuug

SEQ ID NO: 1353107 - RNA, 15 nt, Homo sapiens
ugaucugcugcugag

SEQ ID NO: 1353108 - RNA, 17 nt, Homo sapiens
ugaucuuuuucugccau

SEQ ID NO: 1353109 - RNA, 12 nt, Homo sapiens
ugaugaagucac

SEQ ID NO: 1353110 - RNA, 14 nt, Homo sapiens
ugaugacauucccu

SEQ ID NO: 1353111 - RNA, 20 nt, Homo sapiens
ugaugacuuaguacaaaguu

SEQ ID NO: 1353112 - RNA, 20 nt, Homo sapiens
ugaugaggaaggacuugacu

SEQ ID NO: 1353113 - RNA, 15 nt, Homo sapiens
ugaugaugaucucau

SEQ ID NO: 1353114 - RNA, 19 nt, Homo sapiens
ugaugccuguguacugccu

SEQ ID NO: 1353115 - RNA, 21 nt, Homo sapiens
ugauggaaaauaaacaucagu

SEQ ID NO: 1353116 - RNA, 15 nt, Homo sapiens
ugauggcagagccag

SEQ ID NO: 1353117 - RNA, 18 nt, Homo sapiens
ugaugguaucuauaguca

SEQ ID NO: 1353118 - RNA, 13 nt, Homo sapiens
ugauguacucuaa

SEQ ID NO: 1353119 - RNA, 20 nt, Homo sapiens
ugauguacucuaaauacuga

SEQ ID NO: 1353120 - RNA, 21 nt, Homo sapiens
ugauguauuucaagucucuca

SEQ ID NO: 1353121 - RNA, 19 nt, Homo sapiens
ugauguccuuggacuccau

SEQ ID NO: 1353122 - RNA, 16 nt, Homo sapiens
ugaugucuccacuuuc

SEQ ID NO: 1353123 - RNA, 18 nt, Homo sapiens
ugauguuugccauuugcu

SEQ ID NO: 1353124 - RNA, 15 nt, Homo sapiens
ugauuacguuuacau

SEQ ID NO: 1353125 - RNA, 18 nt, Homo sapiens
ugauuauggagccuuaga

SEQ ID NO: 1353126 - RNA, 15 nt, Homo sapiens
ugauucaacacuuaa

SEQ ID NO: 1353127 - RNA, 16 nt, Homo sapiens
ugauucaacacuuaag

SEQ ID NO: 1353128 - RNA, 22 nt, Homo sapiens
ugauucaggggucugaugacac

SEQ ID NO: 1353129 - RNA, 18 nt, Homo sapiens
ugauucugauguacucua

SEQ ID NO: 1353130 - RNA, 19 nt, Homo sapiens
ugauucugauguacucuaa

SEQ ID NO: 1353131 - RNA, 17 nt, Homo sapiens
ugauugcaggaagggaa

SEQ ID NO: 1353132 - RNA, 17 nt, Homo sapiens
ugauugcugagagccau

SEQ ID NO: 1353133 - RNA, 16 nt, Homo sapiens
ugauuuccauuugcaa

SEQ ID NO: 1353134 - RNA, 18 nt, Homo sapiens
ugauuucuacaacuggag

SEQ ID NO: 1353135 - RNA, 19 nt, Homo sapiens
ugauuuuacuuaacucauu

SEQ ID NO: 1353136 - RNA, 19 nt, Homo sapiens
ugauuuuguuuacugaaau

SEQ ID NO: 1353137 - RNA, 15 nt, Homo sapiens
ugcaaacacaccuug

SEQ ID NO: 1353138 - RNA, 19 nt, Homo sapiens
ugcaaagcaaaacagacug

SEQ ID NO: 1353139 - RNA, 13 nt, Homo sapiens
ugcaaagcacuga

SEQ ID NO: 1353140 - RNA, 11 nt, Homo sapiens
ugcaaagggaa

SEQ ID NO: 1353141 - RNA, 23 nt, Homo sapiens
ugcaaaucguguaucugacaaaa

SEQ ID NO: 1353142 - RNA, 23 nt, Homo sapiens
ugcaacaugccagccacugugau

SEQ ID NO: 1353143 - RNA, 19 nt, Homo sapiens
ugcaacauuuuaaggcaau

SEQ ID NO: 1353144 - RNA, 18 nt, Homo sapiens
ugcaacucuaacucugag

SEQ ID NO: 1353145 - RNA, 15 nt, Homo sapiens
ugcaagccaucucua

SEQ ID NO: 1353146 - RNA, 22 nt, Homo sapiens
ugcaagguacucuggugaguca

SEQ ID NO: 1353147 - RNA, 18 nt, Homo sapiens
ugcaaugacacagucuug

SEQ ID NO: 1353148 - RNA, 13 nt, Homo sapiens
ugcaauggcucaa

SEQ ID NO: 1353149 - RNA, 15 nt, Homo sapiens
ugcacaaagcccuuc

SEQ ID NO: 1353150 - RNA, 16 nt, Homo sapiens
ugcacaaagcccuucc

SEQ ID NO: 1353151 - RNA, 14 nt, Homo sapiens
ugcacacucuccca

SEQ ID NO: 1353152 - RNA, 19 nt, Homo sapiens
ugcacaggucccacugccc

SEQ ID NO: 1353153 - RNA, 11 nt, Homo sapiens
ugcacauugua

SEQ ID NO: 1353154 - RNA, 20 nt, Homo sapiens
ugcaccacuuccgucccauc

SEQ ID NO: 1353155 - RNA, 13 nt, Homo sapiens
ugcaccaucucac

SEQ ID NO: 1353156 - RNA, 14 nt, Homo sapiens
ugcaccaugcugcu

SEQ ID NO: 1353157 - RNA, 17 nt, Homo sapiens
ugcaccauugcacucua

SEQ ID NO: 1353158 - RNA, 12 nt, Homo sapiens
ugcaccuaccuu

SEQ ID NO: 1353159 - RNA, 15 nt, Homo sapiens
ugcaccugugcauuu

SEQ ID NO: 1353160 - RNA, 18 nt, Homo sapiens
ugcacgcugggcaaugag

SEQ ID NO: 1353161 - RNA, 16 nt, Homo sapiens
ugcacguggggcccac

SEQ ID NO: 1353162 - RNA, 17 nt, Homo sapiens
ugcacuaaaaguaguau

SEQ ID NO: 1353163 - RNA, 20 nt, Homo sapiens
ugcacuagaggaacccuaca

SEQ ID NO: 1353164 - RNA, 19 nt, Homo sapiens
ugcacuccagccugggcaa

SEQ ID NO: 1353165 - RNA, 20 nt, Homo sapiens
ugcacuccagccugggcaac

SEQ ID NO: 1353166 - RNA, 17 nt, Homo sapiens
ugcacuucuaagacuuu

SEQ ID NO: 1353167 - RNA, 14 nt, Homo sapiens
ugcagcacucuuau

SEQ ID NO: 1353168 - RNA, 19 nt, Homo sapiens
ugcagcacucuuaucuaca

SEQ ID NO: 1353169 - RNA, 18 nt, Homo sapiens
ugcagcagggaugcccug

SEQ ID NO: 1353170 - RNA, 21 nt, Homo sapiens
ugcagccgccgaaaaacagga

SEQ ID NO: 1353171 - RNA, 22 nt, Homo sapiens
ugcagccuaagaagaaggccag

SEQ ID NO: 1353172 - RNA, 23 nt, Homo sapiens
ugcagccuaagaagaaggccaga

SEQ ID NO: 1353173 - RNA, 15 nt, Homo sapiens
ugcagccucucuggc

SEQ ID NO: 1353174 - RNA, 19 nt, Homo sapiens
ugcaggacccuguccugca

SEQ ID NO: 1353175 - RNA, 20 nt, Homo sapiens
ugcaggacguuagacuguug

SEQ ID NO: 1353176 - RNA, 17 nt, Homo sapiens
ugcaggauuucuucaca

SEQ ID NO: 1353177 - RNA, 16 nt, Homo sapiens
ugcaggcgauggggca

SEQ ID NO: 1353178 - RNA, 21 nt, Homo sapiens
ugcaguagugcaccaucucac

SEQ ID NO: 1353179 - RNA, 15 nt, Homo sapiens
ugcaguccauuuccu

SEQ ID NO: 1353180 - RNA, 18 nt, Homo sapiens
ugcagucccacacugugc

SEQ ID NO: 1353181 - RNA, 22 nt, Homo sapiens
ugcagucggugguaccugagau

SEQ ID NO: 1353182 - RNA, 20 nt, Homo sapiens
ugcagugaauuuucauuucu

SEQ ID NO: 1353183 - RNA, 18 nt, Homo sapiens
auucuauuauacuacaau

SEQ ID NO: 1353184 - RNA, 17 nt, Homo sapiens
auucuauucuccagaca

SEQ ID NO: 1353185 - RNA, 19 nt, Homo sapiens
auucuauucuccagacaug

SEQ ID NO: 1353186 - RNA, 13 nt, Homo sapiens
auucucugaguca

SEQ ID NO: 1353187 - RNA, 17 nt, Homo sapiens
auucugaaaaagacaua

SEQ ID NO: 1353188 - RNA, 18 nt, Homo sapiens
auucugaaaaagacauaa

SEQ ID NO: 1353189 - RNA, 16 nt, Homo sapiens
auucugccuagagugu

SEQ ID NO: 1353190 - RNA, 22 nt, Homo sapiens
auucuguaaaauuaaacaaaua

SEQ ID NO: 1353191 - RNA, 14 nt, Homo sapiens
auucugucauuuca

SEQ ID NO: 1353192 - RNA, 18 nt, Homo sapiens
auucuuacccuguacaua

SEQ ID NO: 1353193 - RNA, 22 nt, Homo sapiens
auucuuauaguaccucacugca

SEQ ID NO: 1353194 - RNA, 15 nt, Homo sapiens
auucuucacucuguu

SEQ ID NO: 1353195 - RNA, 17 nt, Homo sapiens
auucuuuacugcacuca

SEQ ID NO: 1353196 - RNA, 15 nt, Homo sapiens
auucuuugaccuguu

SEQ ID NO: 1353197 - RNA, 19 nt, Homo sapiens
auucuuuuugaaaugucaa

SEQ ID NO: 1353198 - RNA, 20 nt, Homo sapiens
auucuuuuuuaauaaacuac

SEQ ID NO: 1353199 - RNA, 20 nt, Homo sapiens
auugaaggguggucaguagu

SEQ ID NO: 1353200 - RNA, 17 nt, Homo sapiens
auugacagcaauucaug

SEQ ID NO: 1353201 - RNA, 13 nt, Homo sapiens
auugauguugcug

SEQ ID NO: 1353202 - RNA, 16 nt, Homo sapiens
auugcaccuggaugua

SEQ ID NO: 1353203 - RNA, 20 nt, Homo sapiens
auugcagauaacuuugacuu

SEQ ID NO: 1353204 - RNA, 22 nt, Homo sapiens
auugcccccucucacuuuagca

SEQ ID NO: 1353205 - RNA, 22 nt, Homo sapiens
auugccccuggcuuugccucuu

SEQ ID NO: 1353206 - RNA, 13 nt, Homo sapiens
auugccuguaaca

SEQ ID NO: 1353207 - RNA, 16 nt, Homo sapiens
auugcuaauuuagaga

SEQ ID NO: 1353208 - RNA, 20 nt, Homo sapiens
auugcuagccagcauuccau

SEQ ID NO: 1353209 - RNA, 16 nt, Homo sapiens
auugcuaucagcaaug

SEQ ID NO: 1353210 - RNA, 18 nt, Homo sapiens
auugcucugaauauguca

SEQ ID NO: 1353211 - RNA, 20 nt, Homo sapiens
auugcucuuuaucugguuua

SEQ ID NO: 1353212 - RNA, 20 nt, Homo sapiens
auugcuuacaagccuaagaa

SEQ ID NO: 1353213 - RNA, 19 nt, Homo sapiens
auugcuuuuuuaaauauua

SEQ ID NO: 1353214 - RNA, 11 nt, Homo sapiens
auuggcaaagu

SEQ ID NO: 1353215 - RNA, 18 nt, Homo sapiens
auuggcaaagugacaaag

SEQ ID NO: 1353216 - RNA, 23 nt, Homo sapiens
auuggcaaagugacaaagcaauu

SEQ ID NO: 1353217 - RNA, 16 nt, Homo sapiens
auugguagaaggauuu

SEQ ID NO: 1353218 - RNA, 18 nt, Homo sapiens
auugguguugacauacau

SEQ ID NO: 1353219 - RNA, 13 nt, Homo sapiens
auugguucaccug

SEQ ID NO: 1353220 - RNA, 19 nt, Homo sapiens
auuguagauaacacugacu

SEQ ID NO: 1353221 - RNA, 14 nt, Homo sapiens
auuguagccucaau

SEQ ID NO: 1353222 - RNA, 20 nt, Homo sapiens
auugucgguuaccucugcau

SEQ ID NO: 1353223 - RNA, 13 nt, Homo sapiens
auuguuuaaucuu

SEQ ID NO: 1353224 - RNA, 21 nt, Homo sapiens
auuguuuagaugaggcucaga

SEQ ID NO: 1353225 - RNA, 16 nt, Homo sapiens
auuuaacagugcaaaa

SEQ ID NO: 1353226 - RNA, 13 nt, Homo sapiens
auuuaagccuuau

SEQ ID NO: 1353227 - RNA, 20 nt, Homo sapiens
auuuaagugaauacauuaac

SEQ ID NO: 1353228 - RNA, 14 nt, Homo sapiens
auuuaaugcacuaa

SEQ ID NO: 1353229 - RNA, 13 nt, Homo sapiens
auuuaaugcugcc

SEQ ID NO: 1353230 - RNA, 12 nt, Homo sapiens
auuuacauucuu

SEQ ID NO: 1353231 - RNA, 14 nt, Homo sapiens
auuuacccuuuucc

SEQ ID NO: 1353232 - RNA, 19 nt, Homo sapiens
auuuaccugauuuuaauca

SEQ ID NO: 1353233 - RNA, 22 nt, Homo sapiens
auuuagaaaauagagcuuuuaa

SEQ ID NO: 1353234 - RNA, 19 nt, Homo sapiens
auuuagaagccaacuauga

SEQ ID NO: 1353235 - RNA, 15 nt, Homo sapiens
auuuagcugcuaaca

SEQ ID NO: 1353236 - RNA, 22 nt, Homo sapiens
auuuaguugcaguccagcucuu

SEQ ID NO: 1353237 - RNA, 14 nt, Homo sapiens
auuuauaagcauuu

SEQ ID NO: 1353238 - RNA, 23 nt, Homo sapiens
auuuaugaauauuagucgcacau

SEQ ID NO: 1353239 - RNA, 19 nt, Homo sapiens
auuuauggccgggcagggu

SEQ ID NO: 1353240 - RNA, 15 nt, Homo sapiens
auuuaugguucucag

SEQ ID NO: 1353241 - RNA, 15 nt, Homo sapiens
cacacagacauauau

SEQ ID NO: 1353242 - RNA, 15 nt, Homo sapiens
cacacagcugcccua

SEQ ID NO: 1353243 - RNA, 14 nt, Homo sapiens
cacacauugcagcu

SEQ ID NO: 1353244 - RNA, 18 nt, Homo sapiens
cacaccaaguaccaguau

SEQ ID NO: 1353245 - RNA, 21 nt, Homo sapiens
cacaccaggcccucucuccag

SEQ ID NO: 1353246 - RNA, 17 nt, Homo sapiens
cacacccccuuuccauc

SEQ ID NO: 1353247 - RNA, 23 nt, Homo sapiens
cacaccuccucccacugcccacu

SEQ ID NO: 1353248 - RNA, 15 nt, Homo sapiens
cacaccugggcauuu

SEQ ID NO: 1353249 - RNA, 23 nt, Homo sapiens
cacaccuuggagaaguggcauca

SEQ ID NO: 1353250 - RNA, 13 nt, Homo sapiens
cacacgcauuaau

SEQ ID NO: 1353251 - RNA, 15 nt, Homo sapiens
cacacugcaagggau

SEQ ID NO: 1353252 - RNA, 16 nt, Homo sapiens
cacacuguccuauuau

SEQ ID NO: 1353253 - RNA, 17 nt, Homo sapiens
cacacuugguccaucca

SEQ ID NO: 1353254 - RNA, 18 nt, Homo sapiens
cacagaaguggaauuuga

SEQ ID NO: 1353255 - RNA, 15 nt, Homo sapiens
cacagacacuaacga

SEQ ID NO: 1353256 - RNA, 16 nt, Homo sapiens
cacagagggaagccau

SEQ ID NO: 1353257 - RNA, 17 nt, Homo sapiens
cacagauauuguuauaa

SEQ ID NO: 1353258 - RNA, 21 nt, Homo sapiens
cacagcagccccugcacaaag

SEQ ID NO: 1353259 - RNA, 16 nt, Homo sapiens
cacagcccauaauuca

SEQ ID NO: 1353260 - RNA, 18 nt, Homo sapiens
cacagcuauuuagaagca

SEQ ID NO: 1353261 - RNA, 17 nt, Homo sapiens
cacagcucuucauucca

SEQ ID NO: 1353262 - RNA, 19 nt, Homo sapiens
cacagcugauugggcaccu

SEQ ID NO: 1353263 - RNA, 13 nt, Homo sapiens
cacagcugcccua

SEQ ID NO: 1353264 - RNA, 18 nt, Homo sapiens
cacaggucccacugcccu

SEQ ID NO: 1353265 - RNA, 20 nt, Homo sapiens
cacagucuucccagcaauua

SEQ ID NO: 1353266 - RNA, 17 nt, Homo sapiens
cacagugcugaccagac

SEQ ID NO: 1353267 - RNA, 17 nt, Homo sapiens
cacauccacacagccaa

SEQ ID NO: 1353268 - RNA, 19 nt, Homo sapiens
cacauccuucucacugcca

SEQ ID NO: 1353269 - RNA, 11 nt, Homo sapiens
cacaucucagg

SEQ ID NO: 1353270 - RNA, 17 nt, Homo sapiens
cacaucuugcucugcau

SEQ ID NO: 1353271 - RNA, 17 nt, Homo sapiens
cacaugaggccaucuca

SEQ ID NO: 1353272 - RNA, 21 nt, Homo sapiens
cacaugauaccucugaucaag

SEQ ID NO: 1353273 - RNA, 19 nt, Homo sapiens
cacaugauuuuacucauau

SEQ ID NO: 1353274 - RNA, 12 nt, Homo sapiens
cacaugcugucu

SEQ ID NO: 1353275 - RNA, 17 nt, Homo sapiens
cacaugguuacauauca

SEQ ID NO: 1353276 - RNA, 18 nt, Homo sapiens
cacauuuccauucaugga

SEQ ID NO: 1353277 - RNA, 19 nt, Homo sapiens
cacauuuggaauugacgga

SEQ ID NO: 1353278 - RNA, 20 nt, Homo sapiens
cacauuugggauguuccuuu

SEQ ID NO: 1353279 - RNA, 17 nt, Homo sapiens
caccaaagagcauacac

SEQ ID NO: 1353280 - RNA, 22 nt, Homo sapiens
caccaaguaccaguauaagcau

SEQ ID NO: 1353281 - RNA, 14 nt, Homo sapiens
caccacacacacac

SEQ ID NO: 1353282 - RNA, 21 nt, Homo sapiens
caccacagccggucagaggag

SEQ ID NO: 1353283 - RNA, 17 nt, Homo sapiens
caccacagccuccaaaa

SEQ ID NO: 1353284 - RNA, 20 nt, Homo sapiens
caccaggcucugcuggaugu

SEQ ID NO: 1353285 - RNA, 11 nt, Homo sapiens
caccaguguua

SEQ ID NO: 1353286 - RNA, 11 nt, Homo sapiens
caccaucucac

SEQ ID NO: 1353287 - RNA, 18 nt, Homo sapiens
caccaucucacugcagua

SEQ ID NO: 1353288 - RNA, 18 nt, Homo sapiens
caccaucucuuuaccucc

SEQ ID NO: 1353289 - RNA, 19 nt, Homo sapiens
caccaucucuuuaccuccu

SEQ ID NO: 1353290 - RNA, 20 nt, Homo sapiens
caccaugaugugaagaguuu

SEQ ID NO: 1353291 - RNA, 18 nt, Homo sapiens
caccaugcugcuggggaa

SEQ ID NO: 1353292 - RNA, 18 nt, Homo sapiens
caccaugcuugccugaag

SEQ ID NO: 1353293 - RNA, 19 nt, Homo sapiens
cacccaaggaugucugcca

SEQ ID NO: 1353294 - RNA, 17 nt, Homo sapiens
cacccacccccucugga

SEQ ID NO: 1353295 - RNA, 14 nt, Homo sapiens
cacccagaacagug

SEQ ID NO: 1353296 - RNA, 17 nt, Homo sapiens
cacccaguugugacaau

SEQ ID NO: 1353297 - RNA, 18 nt, Homo sapiens
cacccccucuguugcaca

SEQ ID NO: 1353298 - RNA, 14 nt, Homo sapiens
cacccgugugcaca

SEQ ID NO: 1353299 - RNA, 18 nt, Homo sapiens
caccggccuugcauugcc

SEQ ID NO: 1353300 - RNA, 20 nt, Homo sapiens
caccuaauccaggcagaucc

SEQ ID NO: 1353301 - RNA, 22 nt, Homo sapiens
caccuaauccaggcagauccag

SEQ ID NO: 1353302 - RNA, 12 nt, Homo sapiens
caccuagccucg

SEQ ID NO: 1353303 - RNA, 14 nt, Homo sapiens
caccuaguucuccc

SEQ ID NO: 1353304 - RNA, 23 nt, Homo sapiens
uuagcucucuuggguucccaaau

SEQ ID NO: 1353305 - RNA, 16 nt, Homo sapiens
uuagggugaagcauua

SEQ ID NO: 1353306 - RNA, 22 nt, Homo sapiens
uuaguaaaggaaccauuccuuu

SEQ ID NO: 1353307 - RNA, 18 nt, Homo sapiens
uuaguaaauuucugugau

SEQ ID NO: 1353308 - RNA, 18 nt, Homo sapiens
uuaguaucacaaaaccac

SEQ ID NO: 1353309 - RNA, 14 nt, Homo sapiens
uuagucaacauaua

SEQ ID NO: 1353310 - RNA, 13 nt, Homo sapiens
uuagucaugugac

SEQ ID NO: 1353311 - RNA, 22 nt, Homo sapiens
uuagucucuggaaaaagacuga

SEQ ID NO: 1353312 - RNA, 16 nt, Homo sapiens
uuaguuccacugagac

SEQ ID NO: 1353313 - RNA, 20 nt, Homo sapiens
uuauaaaggauaaagaagga

SEQ ID NO: 1353314 - RNA, 22 nt, Homo sapiens
uuauaaauauuauuagauuuau

SEQ ID NO: 1353315 - RNA, 21 nt, Homo sapiens
uuauaauucauugugauuuau

SEQ ID NO: 1353316 - RNA, 22 nt, Homo sapiens
uuauauaaggaauaaagccuuu

SEQ ID NO: 1353317 - RNA, 22 nt, Homo sapiens
uuauauauauaaagucagugac

SEQ ID NO: 1353318 - RNA, 17 nt, Homo sapiens
uuauaugccugauucau

SEQ ID NO: 1353319 - RNA, 17 nt, Homo sapiens
uuauauggauaaucuga

SEQ ID NO: 1353320 - RNA, 12 nt, Homo sapiens
uuauauuacuug

SEQ ID NO: 1353321 - RNA, 14 nt, Homo sapiens
uuauauucauucuu

SEQ ID NO: 1353322 - RNA, 13 nt, Homo sapiens
uuaucccucucuu

SEQ ID NO: 1353323 - RNA, 16 nt, Homo sapiens
uuauccuagucauucu

SEQ ID NO: 1353324 - RNA, 18 nt, Homo sapiens
uuauccuagucauucuuc

SEQ ID NO: 1353325 - RNA, 21 nt, Homo sapiens
uuaucuauagcuaaguacaca

SEQ ID NO: 1353326 - RNA, 19 nt, Homo sapiens
uuaucucaaguaaaacaaa

SEQ ID NO: 1353327 - RNA, 21 nt, Homo sapiens
uuaucuguaauuguaauucca

SEQ ID NO: 1353328 - RNA, 16 nt, Homo sapiens
uuaugcaaauacaauc

SEQ ID NO: 1353329 - RNA, 15 nt, Homo sapiens
uuauggcuucacauu

SEQ ID NO: 1353330 - RNA, 14 nt, Homo sapiens
uuaugugugccuuu

SEQ ID NO: 1353331 - RNA, 13 nt, Homo sapiens
uuauuaagacugg

SEQ ID NO: 1353332 - RNA, 18 nt, Homo sapiens
uuauuauaaauucuacua

SEQ ID NO: 1353333 - RNA, 13 nt, Homo sapiens
uuauucaucuugc

SEQ ID NO: 1353334 - RNA, 17 nt, Homo sapiens
uuauugaauucauuuca

SEQ ID NO: 1353335 - RNA, 22 nt, Homo sapiens
uuauugguguaagguacuuuca

SEQ ID NO: 1353336 - RNA, 21 nt, Homo sapiens
uuauuuaggaaguugacuuau

SEQ ID NO: 1353337 - RNA, 21 nt, Homo sapiens
uuauuucugguaacucacuca

SEQ ID NO: 1353338 - RNA, 21 nt, Homo sapiens
uucaaaacaaaaugaaacaaa

SEQ ID NO: 1353339 - RNA, 17 nt, Homo sapiens
uucaaacugcaugauuc

SEQ ID NO: 1353340 - RNA, 18 nt, Homo sapiens
uucaaacugcaugauuca

SEQ ID NO: 1353341 - RNA, 15 nt, Homo sapiens
uucaaauguucucca

SEQ ID NO: 1353342 - RNA, 13 nt, Homo sapiens
uucaacccagugg

SEQ ID NO: 1353343 - RNA, 16 nt, Homo sapiens
uucaacugaaguucua

SEQ ID NO: 1353344 - RNA, 15 nt, Homo sapiens
uucaagaaagcuuca

SEQ ID NO: 1353345 - RNA, 19 nt, Homo sapiens
uucaagacaagagcuguua

SEQ ID NO: 1353346 - RNA, 21 nt, Homo sapiens
uucaagcaauccuccuaccuc

SEQ ID NO: 1353347 - RNA, 18 nt, Homo sapiens
uucaaggcucaaugcuau

SEQ ID NO: 1353348 - RNA, 15 nt, Homo sapiens
uucaauacuuacaua

SEQ ID NO: 1353349 - RNA, 20 nt, Homo sapiens
uucaauacuuacauaucuga

SEQ ID NO: 1353350 - RNA, 15 nt, Homo sapiens
uucaaugaaccacaa

SEQ ID NO: 1353351 - RNA, 13 nt, Homo sapiens
uucaauguauuga

SEQ ID NO: 1353352 - RNA, 14 nt, Homo sapiens
uucacaaaauauca

SEQ ID NO: 1353353 - RNA, 16 nt, Homo sapiens
uucacaaauccuucaa

SEQ ID NO: 1353354 - RNA, 23 nt, Homo sapiens
uucacaagccuccuguaccucag

SEQ ID NO: 1353355 - RNA, 15 nt, Homo sapiens
uucaccagauuugcu

SEQ ID NO: 1353356 - RNA, 17 nt, Homo sapiens
uucacgaacaugggcau

SEQ ID NO: 1353357 - RNA, 15 nt, Homo sapiens
uucacgccauucucc

SEQ ID NO: 1353358 - RNA, 20 nt, Homo sapiens
uucacuagaaaaugagaaaa

SEQ ID NO: 1353359 - RNA, 15 nt, Homo sapiens
uucacucagagggaa

SEQ ID NO: 1353360 - RNA, 16 nt, Homo sapiens
uucacuggacacuuca

SEQ ID NO: 1353361 - RNA, 18 nt, Homo sapiens
uucacuguagaaugauuu

SEQ ID NO: 1353362 - RNA, 19 nt, Homo sapiens
uucacuguagcucuaaaau

SEQ ID NO: 1353363 - RNA, 16 nt, Homo sapiens
uucacuuaacaaacaa

SEQ ID NO: 1353364 - RNA, 20 nt, Homo sapiens
uucacuuauuuagauucacu

SEQ ID NO: 1353365 - RNA, 11 nt, Homo sapiens
uguguccaaaa

SEQ ID NO: 1353366 - RNA, 14 nt, Homo sapiens
ugugugacuccauu

SEQ ID NO: 1353367 - RNA, 19 nt, Homo sapiens
ugugugccuuuguuuccca

SEQ ID NO: 1353368 - RNA, 14 nt, Homo sapiens
uguguuaucucuua

SEQ ID NO: 1353369 - RNA, 16 nt, Homo sapiens
uguguuuuuucggaca

SEQ ID NO: 1353370 - RNA, 21 nt, Homo sapiens
uguuaaaagaaaacacuguca

SEQ ID NO: 1353371 - RNA, 15 nt, Homo sapiens
uguuaacuguucaaa

SEQ ID NO: 1353372 - RNA, 13 nt, Homo sapiens
uguuaaucugaug

SEQ ID NO: 1353373 - RNA, 21 nt, Homo sapiens
uguuaguaaaggaaccauucc

SEQ ID NO: 1353374 - RNA, 21 nt, Homo sapiens
uguuaguaaauccaugguguu

SEQ ID NO: 1353375 - RNA, 21 nt, Homo sapiens
uguuaguauuuuaauccugua

SEQ ID NO: 1353376 - RNA, 14 nt, Homo sapiens
uguuauacuugaug

SEQ ID NO: 1353377 - RNA, 19 nt, Homo sapiens
uguuauauacauacuauga

SEQ ID NO: 1353378 - RNA, 14 nt, Homo sapiens
uguuaugcagugaa

SEQ ID NO: 1353379 - RNA, 17 nt, Homo sapiens
uguuauuaacagauaau

SEQ ID NO: 1353380 - RNA, 22 nt, Homo sapiens
uguucccuccccgaucaucuuu

SEQ ID NO: 1353381 - RNA, 19 nt, Homo sapiens
uguuccuugucacugguag

SEQ ID NO: 1353382 - RNA, 21 nt, Homo sapiens
uguucgacucagccucaggga

SEQ ID NO: 1353383 - RNA, 22 nt, Homo sapiens
uguucuuacaaaccauacugaa

SEQ ID NO: 1353384 - RNA, 15 nt, Homo sapiens
uguucuuagagugua

SEQ ID NO: 1353385 - RNA, 13 nt, Homo sapiens
uguucuucagucc

SEQ ID NO: 1353386 - RNA, 17 nt, Homo sapiens
uguugaaucuauuucac

SEQ ID NO: 1353387 - RNA, 16 nt, Homo sapiens
uguugaggugcaagga

SEQ ID NO: 1353388 - RNA, 15 nt, Homo sapiens
uguugauuuccucug

SEQ ID NO: 1353389 - RNA, 21 nt, Homo sapiens
uguugccccauuccuaagagg

SEQ ID NO: 1353390 - RNA, 21 nt, Homo sapiens
uguugcuggacugucauagaa

SEQ ID NO: 1353391 - RNA, 16 nt, Homo sapiens
uguuggaaaguaucau

SEQ ID NO: 1353392 - RNA, 14 nt, Homo sapiens
uguugguagcaauu

SEQ ID NO: 1353393 - RNA, 17 nt, Homo sapiens
uguuguauuucuauaca

SEQ ID NO: 1353394 - RNA, 19 nt, Homo sapiens
uguugucacaucucaggga

SEQ ID NO: 1353395 - RNA, 19 nt, Homo sapiens
uguuuagaaugucaguuga

SEQ ID NO: 1353396 - RNA, 22 nt, Homo sapiens
uguuuccuuuaauuuuuuacua

SEQ ID NO: 1353397 - RNA, 13 nt, Homo sapiens
uguuucuugcugc

SEQ ID NO: 1353398 - RNA, 17 nt, Homo sapiens
uguuugauacaguauua

SEQ ID NO: 1353399 - RNA, 9 nt, Homo sapiens
uguuugaug

SEQ ID NO: 1353400 - RNA, 20 nt, Homo sapiens
uguuuggaauauuccacuau

SEQ ID NO: 1353401 - RNA, 22 nt, Homo sapiens
uguuuggaauauuccacuauuu

SEQ ID NO: 1353402 - RNA, 23 nt, Homo sapiens
uguuuuaauccuuaacacauuca

SEQ ID NO: 1353403 - RNA, 13 nt, Homo sapiens
uguuuuaucacuu

SEQ ID NO: 1353404 - RNA, 18 nt, Homo sapiens
uguuuucggcagccuuaa

SEQ ID NO: 1353405 - RNA, 17 nt, Homo sapiens
uguuuugcauggaguau

SEQ ID NO: 1353406 - RNA, 12 nt, Homo sapiens
uguuuugccagc

SEQ ID NO: 1353407 - RNA, 19 nt, Homo sapiens
uguuuuuaauaaagacagg

SEQ ID NO: 1353408 - RNA, 12 nt, Homo sapiens
uguuuuuggaca

SEQ ID NO: 1353409 - RNA, 19 nt, Homo sapiens
uuaaaaaaaaauacugaug

SEQ ID NO: 1353410 - RNA, 14 nt, Homo sapiens
uuaaaaaaacugga

SEQ ID NO: 1353411 - RNA, 18 nt, Homo sapiens
uuaaaacaauucugugac

SEQ ID NO: 1353412 - RNA, 19 nt, Homo sapiens
uuaaaacaauucugugaca

SEQ ID NO: 1353413 - RNA, 19 nt, Homo sapiens
uuaaaaggucaaaacugaa

SEQ ID NO: 1353414 - RNA, 20 nt, Homo sapiens
uuaaaaggucaaaacugaag

SEQ ID NO: 1353415 - RNA, 18 nt, Homo sapiens
uuaaaauggugaaugaca

SEQ ID NO: 1353416 - RNA, 21 nt, Homo sapiens
uuaaaauggugaaugacacua

SEQ ID NO: 1353417 - RNA, 23 nt, Homo sapiens
uuaaacacacauugcagcuucaa

SEQ ID NO: 1353418 - RNA, 18 nt, Homo sapiens
uuaaacauauucaaggag

SEQ ID NO: 1353419 - RNA, 23 nt, Homo sapiens
uuaaacuggaaaggaucugugau

SEQ ID NO: 1353420 - RNA, 18 nt, Homo sapiens
uuaaacuugcaguaucuc

SEQ ID NO: 1353421 - RNA, 13 nt, Homo sapiens
uuaaagaaagugu

SEQ ID NO: 1353422 - RNA, 18 nt, Homo sapiens
uuaaagacguucccuuuu

SEQ ID NO: 1353423 - RNA, 17 nt, Homo sapiens
uuaaagagggacaggcu

SEQ ID NO: 1353424 - RNA, 15 nt, Homo sapiens
uuaaagauacaguac

SEQ ID NO: 1353425 - RNA, 17 nt, Homo sapiens
uuaaauaaaucauaaaa

SEQ ID NO: 1353426 - RNA, 23 nt, Homo sapiens
uuaaauaaaucauaaaacuugau

SEQ ID NO: 1353427 - RNA, 13 nt, Homo sapiens
uuaaauguggaag

SEQ ID NO: 1353428 - RNA, 19 nt, Homo sapiens
uuaaauuauuuuuguucau

SEQ ID NO: 1353429 - RNA, 21 nt, Homo sapiens
guuuccacugccuccugugac

SEQ ID NO: 1353430 - RNA, 13 nt, Homo sapiens
guuuccauuuaug

SEQ ID NO: 1353431 - RNA, 22 nt, Homo sapiens
guuuccccuccuuggcuuuaug

SEQ ID NO: 1353432 - RNA, 16 nt, Homo sapiens
guuucccuuucacugg

SEQ ID NO: 1353433 - RNA, 14 nt, Homo sapiens
guuuccucagugau

SEQ ID NO: 1353434 - RNA, 13 nt, Homo sapiens
guuucuacauuca

SEQ ID NO: 1353435 - RNA, 17 nt, Homo sapiens
guuucuaggcaccucag

SEQ ID NO: 1353436 - RNA, 16 nt, Homo sapiens
guuugauauuuuguaa

SEQ ID NO: 1353437 - RNA, 22 nt, Homo sapiens
guuugcagauauucucuaguca

SEQ ID NO: 1353438 - RNA, 23 nt, Homo sapiens
guuuguucccugugucauuucaa

SEQ ID NO: 1353439 - RNA, 20 nt, Homo sapiens
guuuuaaaaggcaagucaaa

SEQ ID NO: 1353440 - RNA, 13 nt, Homo sapiens
guuuuaacugaau

SEQ ID NO: 1353441 - RNA, 21 nt, Homo sapiens
guuuuacaguguuucuggcuu

SEQ ID NO: 1353442 - RNA, 13 nt, Homo sapiens
guuuuccaaagag

SEQ ID NO: 1353443 - RNA, 14 nt, Homo sapiens
guuuucuucauuca

SEQ ID NO: 1353444 - RNA, 12 nt, Homo sapiens
guuuucuugaua

SEQ ID NO: 1353445 - RNA, 12 nt, Homo sapiens
guuuuggcagcc

SEQ ID NO: 1353446 - RNA, 21 nt, Homo sapiens
guuuuuugaaauuaugugaca

SEQ ID NO: 1353447 - RNA, 23 nt, Homo sapiens
guuuuuuuuuuccacuuagaaau

SEQ ID NO: 1353448 - RNA, 22 nt, Homo sapiens
uaaaaaaacuggauauuucaau

SEQ ID NO: 1353449 - RNA, 14 nt, Homo sapiens
uaaaaaaugacaaa

SEQ ID NO: 1353450 - RNA, 16 nt, Homo sapiens
uaaaaagauugccaau

SEQ ID NO: 1353451 - RNA, 13 nt, Homo sapiens
uaaaaagugcagu

SEQ ID NO: 1353452 - RNA, 22 nt, Homo sapiens
uaaaaaguguuuaaaugucaaa

SEQ ID NO: 1353453 - RNA, 16 nt, Homo sapiens
uaaaaaugaaaauucu

SEQ ID NO: 1353454 - RNA, 14 nt, Homo sapiens
uaaaaauugucauu

SEQ ID NO: 1353455 - RNA, 15 nt, Homo sapiens
uaaaaccacagcagu

SEQ ID NO: 1353456 - RNA, 19 nt, Homo sapiens
uaaaacuguuauuuuuaca

SEQ ID NO: 1353457 - RNA, 14 nt, Homo sapiens
uaaaacuucugcuc

SEQ ID NO: 1353458 - RNA, 11 nt, Homo sapiens
uaaaagacagc

SEQ ID NO: 1353459 - RNA, 22 nt, Homo sapiens
uaaaagcacacucauccccuca

SEQ ID NO: 1353460 - RNA, 19 nt, Homo sapiens
uaaaagcauuuuguaauaa

SEQ ID NO: 1353461 - RNA, 22 nt, Homo sapiens
uaaaagccccagcuuggcucac

SEQ ID NO: 1353462 - RNA, 20 nt, Homo sapiens
uaaaagcuacuauguacugc

SEQ ID NO: 1353463 - RNA, 22 nt, Homo sapiens
uaaaaggcaagucaaauaccac

SEQ ID NO: 1353464 - RNA, 14 nt, Homo sapiens
uaaaagucuaccug

SEQ ID NO: 1353465 - RNA, 22 nt, Homo sapiens
uaaaaguugcauguuaugugag

SEQ ID NO: 1353466 - RNA, 19 nt, Homo sapiens
uaaaaguuuauuguuugau

SEQ ID NO: 1353467 - RNA, 13 nt, Homo sapiens
uaaaauaaaccaa

SEQ ID NO: 1353468 - RNA, 16 nt, Homo sapiens
uaaaauaaaccaaaua

SEQ ID NO: 1353469 - RNA, 19 nt, Homo sapiens
uaaaauagcuuugcaguga

SEQ ID NO: 1353470 - RNA, 19 nt, Homo sapiens
uaaaauauaaucucuauaa

SEQ ID NO: 1353471 - RNA, 14 nt, Homo sapiens
uaaaaugagcauug

SEQ ID NO: 1353472 - RNA, 19 nt, Homo sapiens
uaaaaugauauuguuauau

SEQ ID NO: 1353473 - RNA, 15 nt, Homo sapiens
uaaaaugcuuacauu

SEQ ID NO: 1353474 - RNA, 15 nt, Homo sapiens
uaaaauucuauuaua

SEQ ID NO: 1353475 - RNA, 20 nt, Homo sapiens
uaaaauucuauuauacuaca

SEQ ID NO: 1353476 - RNA, 21 nt, Homo sapiens
uaaaauucuauuauacuacaa

SEQ ID NO: 1353477 - RNA, 15 nt, Homo sapiens
uaaaauuugucuuaa

SEQ ID NO: 1353478 - RNA, 17 nt, Homo sapiens
uaaacaaaaaacuauca

SEQ ID NO: 1353479 - RNA, 21 nt, Homo sapiens
uaaacaaagacuuugauccau

SEQ ID NO: 1353480 - RNA, 20 nt, Homo sapiens
uaaacagugagccugaauuu

SEQ ID NO: 1353481 - RNA, 16 nt, Homo sapiens
uaaacauuucauuucc

SEQ ID NO: 1353482 - RNA, 16 nt, Homo sapiens
uaaacgguuccuggug

SEQ ID NO: 1353483 - RNA, 17 nt, Homo sapiens
uaaacuaucuuggugaa

SEQ ID NO: 1353484 - RNA, 21 nt, Homo sapiens
uaaacucaucaaugugccuuu

SEQ ID NO: 1353485 - RNA, 14 nt, Homo sapiens
uaaacucucuaggg

SEQ ID NO: 1353486 - RNA, 14 nt, Homo sapiens
uaaacugauuuauc

SEQ ID NO: 1353487 - RNA, 23 nt, Homo sapiens
uaaacuucaccuacauuaucuca

SEQ ID NO: 1353488 - RNA, 11 nt, Homo sapiens
uaaacuugaau

SEQ ID NO: 1353489 - RNA, 23 nt, Homo sapiens
uaaacuuuuuuucuguaccaguu

SEQ ID NO: 1353490 - RNA, 14 nt, Homo sapiens
uaaagaaaaccaca

SEQ ID NO: 1353491 - RNA, 21 nt, Homo sapiens
uaaagaaauaacgugcaugcu

SEQ ID NO: 1353492 - RNA, 15 nt, Homo sapiens
uaaagacaaucacug

SEQ ID NO: 1353493 - RNA, 18 nt, Homo sapiens
uaaagacuuguauagcau

SEQ ID NO: 1353494 - RNA, 22 nt, Homo sapiens
uaaagacuuguauagcaugaaa

SEQ ID NO: 1353495 - RNA, 13 nt, Homo sapiens
uaaagcaggauuu

SEQ ID NO: 1353496 - RNA, 15 nt, Homo sapiens
uaaagccaggcucag

SEQ ID NO: 1353497 - RNA, 20 nt, Homo sapiens
uaaagccuguggguuugguc

SEQ ID NO: 1353498 - RNA, 21 nt, Homo sapiens
uaaaggaaaauaauguuugau

SEQ ID NO: 1353499 - RNA, 14 nt, Homo sapiens
uaaaggaacuaauc

SEQ ID NO: 1353500 - RNA, 15 nt, Homo sapiens
uaaaggcaguuuucu

SEQ ID NO: 1353501 - RNA, 13 nt, Homo sapiens
uaaagucuugccu

SEQ ID NO: 1353502 - RNA, 21 nt, Homo sapiens
uaaaguuugcucuaccaaaua

SEQ ID NO: 1353503 - RNA, 16 nt, Homo sapiens
uaaauaaaagcacaag

SEQ ID NO: 1353504 - RNA, 21 nt, Homo sapiens
uaaauaagauuuaauucacau

SEQ ID NO: 1353505 - RNA, 13 nt, Homo sapiens
uaaauaccaaaaa

SEQ ID NO: 1353506 - RNA, 15 nt, Homo sapiens
uaaauauaucuaccc

SEQ ID NO: 1353507 - RNA, 22 nt, Homo sapiens
uaaauauuuauuuaacuauuca

SEQ ID NO: 1353508 - RNA, 21 nt, Homo sapiens
uaaaucaguguuugauugccc

SEQ ID NO: 1353509 - RNA, 21 nt, Homo sapiens
uaaauccauccauccaaaggc

SEQ ID NO: 1353510 - RNA, 22 nt, Homo sapiens
uaaaucccagacugacagacuu

SEQ ID NO: 1353511 - RNA, 20 nt, Homo sapiens
uaaaugauagacaauugagg

SEQ ID NO: 1353512 - RNA, 18 nt, Homo sapiens
uaaauggugcugcagauu

SEQ ID NO: 1353513 - RNA, 21 nt, Homo sapiens
uaaauguauacuauaguacca

SEQ ID NO: 1353514 - RNA, 16 nt, Homo sapiens
uaaauguaucauagaa

SEQ ID NO: 1353515 - RNA, 17 nt, Homo sapiens
uaaauguaucauagaaa

SEQ ID NO: 1353516 - RNA, 15 nt, Homo sapiens
uaaauguuaccucua

SEQ ID NO: 1353517 - RNA, 15 nt, Homo sapiens
uaaauguucuaauaa

SEQ ID NO: 1353518 - RNA, 18 nt, Homo sapiens
uaaauguugcaaugcaug

SEQ ID NO: 1353519 - RNA, 12 nt, Homo sapiens
uaaauuacaguc

SEQ ID NO: 1353520 - RNA, 22 nt, Homo sapiens
uaaauuaccuuaaacuugcagu

SEQ ID NO: 1353521 - RNA, 21 nt, Homo sapiens
uaaauugcaguuuacaguauu

SEQ ID NO: 1353522 - RNA, 16 nt, Homo sapiens
uaaauuguguauuuaa

SEQ ID NO: 1353523 - RNA, 20 nt, Homo sapiens
uaaauuucaguaguggugau

SEQ ID NO: 1353524 - RNA, 19 nt, Homo sapiens
uaacaaacccaacuaaagu

SEQ ID NO: 1353525 - RNA, 15 nt, Homo sapiens
uaacaagaagcaaug

SEQ ID NO: 1353526 - RNA, 21 nt, Homo sapiens
uaacacauuaaauguggaagg

SEQ ID NO: 1353527 - RNA, 14 nt, Homo sapiens
uaacacauucaaua

SEQ ID NO: 1353528 - RNA, 23 nt, Homo sapiens
uaacaccagacagacaacacugg

SEQ ID NO: 1353529 - RNA, 23 nt, Homo sapiens
uaacagaaagccugggugacauu

SEQ ID NO: 1353530 - RNA, 19 nt, Homo sapiens
uaacagaucagaacaugaa

SEQ ID NO: 1353531 - RNA, 16 nt, Homo sapiens
uaacaggauacaggug

SEQ ID NO: 1353532 - RNA, 20 nt, Homo sapiens
uaacaggugcgguuccucau

SEQ ID NO: 1353533 - RNA, 13 nt, Homo sapiens
uaacagugcaaaa

SEQ ID NO: 1353534 - RNA, 14 nt, Homo sapiens
uaacauagauuuaa

SEQ ID NO: 1353535 - RNA, 21 nt, Homo sapiens
uaacauagauuuaagugaaua

SEQ ID NO: 1353536 - RNA, 19 nt, Homo sapiens
uaacaugcccuguucagcu

SEQ ID NO: 1353537 - RNA, 20 nt, Homo sapiens
uaacaugcccuguucagcua

SEQ ID NO: 1353538 - RNA, 15 nt, Homo sapiens
uaacaugugaaaaga

SEQ ID NO: 1353539 - RNA, 14 nt, Homo sapiens
uaaccacagugaaa

SEQ ID NO: 1353540 - RNA, 23 nt, Homo sapiens
uaaccccagauucaugcacugua

SEQ ID NO: 1353541 - RNA, 16 nt, Homo sapiens
uaaccucccacccugc

SEQ ID NO: 1353542 - RNA, 15 nt, Homo sapiens
uaacuaugacagaua

SEQ ID NO: 1353543 - RNA, 13 nt, Homo sapiens
uaacuauucauaa

SEQ ID NO: 1353544 - RNA, 14 nt, Homo sapiens
uaacucacucaguu

SEQ ID NO: 1353545 - RNA, 15 nt, Homo sapiens
uaacucagacacaaa

SEQ ID NO: 1353546 - RNA, 13 nt, Homo sapiens
uaaggaugaaggu

SEQ ID NO: 1353547 - RNA, 18 nt, Homo sapiens
uaaggcaaugguuucaca

SEQ ID NO: 1353548 - RNA, 19 nt, Homo sapiens
uaaggcaaugguuucacau

SEQ ID NO: 1353549 - RNA, 14 nt, Homo sapiens
uaagggaaacugcc

SEQ ID NO: 1353550 - RNA, 23 nt, Homo sapiens
uaagggaguggccucauuucacu

SEQ ID NO: 1353551 - RNA, 14 nt, Homo sapiens
uaagggcagugccc

SEQ ID NO: 1353552 - RNA, 19 nt, Homo sapiens
uaagguuaucuacuuuuac

SEQ ID NO: 1353553 - RNA, 20 nt, Homo sapiens
uaagguugucuacgggggca

SEQ ID NO: 1353554 - RNA, 20 nt, Homo sapiens
uaaguaaaagcuacuaugua

SEQ ID NO: 1353555 - RNA, 21 nt, Homo sapiens
uaaguccuuccaccugccacc

SEQ ID NO: 1353556 - RNA, 11 nt, Homo sapiens
uaagugauaua

SEQ ID NO: 1353557 - RNA, 12 nt, Homo sapiens
uaagugcugcug

SEQ ID NO: 1353558 - RNA, 15 nt, Homo sapiens
uaauaaacuacucuu

SEQ ID NO: 1353559 - RNA, 14 nt, Homo sapiens
uaauaacagcagug

SEQ ID NO: 1353560 - RNA, 19 nt, Homo sapiens
uaauaauaagucaguguua

SEQ ID NO: 1353561 - RNA, 22 nt, Homo sapiens
uaauauaccagcuuguaugcaa

SEQ ID NO: 1353562 - RNA, 16 nt, Homo sapiens
uaauauugacuuguau

SEQ ID NO: 1353563 - RNA, 19 nt, Homo sapiens
uaauauuuuaauguacuaa

SEQ ID NO: 1353564 - RNA, 13 nt, Homo sapiens
uaaucaaaccacu

SEQ ID NO: 1353565 - RNA, 17 nt, Homo sapiens
uaaucaaaccacuguua

SEQ ID NO: 1353566 - RNA, 17 nt, Homo sapiens
uaaucacaaauuucacu

SEQ ID NO: 1353567 - RNA, 22 nt, Homo sapiens
uaaucagguccucagagaauuu

SEQ ID NO: 1353568 - RNA, 13 nt, Homo sapiens
uaaucccagcacu

SEQ ID NO: 1353569 - RNA, 15 nt, Homo sapiens
uaauccuucuggcaa

SEQ ID NO: 1353570 - RNA, 21 nt, Homo sapiens
uaaucugagaggccacagugc

SEQ ID NO: 1353571 - RNA, 16 nt, Homo sapiens
uaaucuggacuccucu

SEQ ID NO: 1353572 - RNA, 19 nt, Homo sapiens
uaaucuucuuaugcaauuu

SEQ ID NO: 1353573 - RNA, 14 nt, Homo sapiens
uaaucuuugcuuua

SEQ ID NO: 1353574 - RNA, 15 nt, Homo sapiens
uaaugaaauggagga

SEQ ID NO: 1353575 - RNA, 21 nt, Homo sapiens
uaaugaaguagaaguuacuua

SEQ ID NO: 1353576 - RNA, 14 nt, Homo sapiens
uaaugacaacacuu

SEQ ID NO: 1353577 - RNA, 14 nt, Homo sapiens
uaaugacauaaaaa

SEQ ID NO: 1353578 - RNA, 21 nt, Homo sapiens
uaaugcacuaaaaguaguauu

SEQ ID NO: 1353579 - RNA, 23 nt, Homo sapiens
uaauggaugguugaauuaacuuc

SEQ ID NO: 1353580 - RNA, 17 nt, Homo sapiens
uaaugugcugagcauuu

SEQ ID NO: 1353581 - RNA, 18 nt, Homo sapiens
uaaugugguguuacugua

SEQ ID NO: 1353582 - RNA, 13 nt, Homo sapiens
uaauguuugcauu

SEQ ID NO: 1353583 - RNA, 16 nt, Homo sapiens
uaauguuugcauuucc

SEQ ID NO: 1353584 - RNA, 15 nt, Homo sapiens
uaauuaauugucauu

SEQ ID NO: 1353585 - RNA, 13 nt, Homo sapiens
uaauucagcacuu

SEQ ID NO: 1353586 - RNA, 14 nt, Homo sapiens
uaauucagcacuua

SEQ ID NO: 1353587 - RNA, 19 nt, Homo sapiens
uaauucauugugauuuauu

SEQ ID NO: 1353588 - RNA, 17 nt, Homo sapiens
uaauucccgccuuaugc

SEQ ID NO: 1353589 - RNA, 18 nt, Homo sapiens
uaauuggccaugucgcca

SEQ ID NO: 1353590 - RNA, 14 nt, Homo sapiens
uaauuggcuuuacu

SEQ ID NO: 1353591 - RNA, 18 nt, Homo sapiens
uaauugggaacugaaauc

SEQ ID NO: 1353592 - RNA, 15 nt, Homo sapiens
uaauuguacaauaaa

SEQ ID NO: 1353593 - RNA, 18 nt, Homo sapiens
uaauuugcugguguuuua

SEQ ID NO: 1353594 - RNA, 13 nt, Homo sapiens
uaauuuguaaaac

SEQ ID NO: 1353595 - RNA, 15 nt, Homo sapiens
uaauuuguaagaaua

SEQ ID NO: 1353596 - RNA, 14 nt, Homo sapiens
uaauuuuacacucu

SEQ ID NO: 1353597 - RNA, 13 nt, Homo sapiens
uaauuuugagaua

SEQ ID NO: 1353598 - RNA, 14 nt, Homo sapiens
uacaaaaacacagc

SEQ ID NO: 1353599 - RNA, 16 nt, Homo sapiens
uacaaaaauaccuacu

SEQ ID NO: 1353600 - RNA, 17 nt, Homo sapiens
uacaaacucccacuugu

SEQ ID NO: 1353601 - RNA, 21 nt, Homo sapiens
uacaacgccgagugcacugca

SEQ ID NO: 1353602 - RNA, 16 nt, Homo sapiens
uacaaguuucuagcuc

SEQ ID NO: 1353603 - RNA, 17 nt, Homo sapiens
uacaaugaucaccgacu

SEQ ID NO: 1353604 - RNA, 13 nt, Homo sapiens
uacaauguagaug

SEQ ID NO: 1353605 - RNA, 19 nt, Homo sapiens
uacacacacacgcacacaa

SEQ ID NO: 1353606 - RNA, 13 nt, Homo sapiens
uacacacgcugcc

SEQ ID NO: 1353607 - RNA, 17 nt, Homo sapiens
uacacagaauuguucca

SEQ ID NO: 1353608 - RNA, 14 nt, Homo sapiens
uacacaugugcaca

SEQ ID NO: 1353609 - RNA, 18 nt, Homo sapiens
uacaccuugcuaaccuaa

SEQ ID NO: 1353610 - RNA, 12 nt, Homo sapiens
uacacgggacca

SEQ ID NO: 1353611 - RNA, 23 nt, Homo sapiens
uacacgggaccagcucacguaau

SEQ ID NO: 1353612 - RNA, 15 nt, Homo sapiens
uacacuaaccaaauc

SEQ ID NO: 1353613 - RNA, 23 nt, Homo sapiens
uacacucauggggaagcuuccau

SEQ ID NO: 1353614 - RNA, 16 nt, Homo sapiens
uacacugaaucauuaa

SEQ ID NO: 1353615 - RNA, 13 nt, Homo sapiens
uacacuugugauu

SEQ ID NO: 1353616 - RNA, 15 nt, Homo sapiens
uacaggugacaguga

SEQ ID NO: 1353617 - RNA, 20 nt, Homo sapiens
uacaggugacagugaagaua

SEQ ID NO: 1353618 - RNA, 20 nt, Homo sapiens
uacagguuaagacaaagggu

SEQ ID NO: 1353619 - RNA, 16 nt, Homo sapiens
uacaguucugucauau

SEQ ID NO: 1353620 - RNA, 20 nt, Homo sapiens
uacauaacuccugucccuuu

SEQ ID NO: 1353621 - RNA, 16 nt, Homo sapiens
uacauaggaugacaaa

SEQ ID NO: 1353622 - RNA, 19 nt, Homo sapiens
uacauaucaaaacauccca

SEQ ID NO: 1353623 - RNA, 17 nt, Homo sapiens
uacauaucugacuucua

SEQ ID NO: 1353624 - RNA, 15 nt, Homo sapiens
uacauaugaggacaa

SEQ ID NO: 1353625 - RNA, 23 nt, Homo sapiens
uacaugaugcuaaaggcugcgaa

SEQ ID NO: 1353626 - RNA, 14 nt, Homo sapiens
uacauggguucaau

SEQ ID NO: 1353627 - RNA, 21 nt, Homo sapiens
uacauuaaaauaaaccaaaua

SEQ ID NO: 1353628 - RNA, 17 nt, Homo sapiens
uacauuaacggugcuaa

SEQ ID NO: 1353629 - RNA, 15 nt, Homo sapiens
uacauucuugcuaau

SEQ ID NO: 1353630 - RNA, 14 nt, Homo sapiens
uacauuucauacaa

SEQ ID NO: 1353631 - RNA, 22 nt, Homo sapiens
uacauuugaacuugauggcuaa

SEQ ID NO: 1353632 - RNA, 21 nt, Homo sapiens
uacauuuuuugggcagcaauu

SEQ ID NO: 1353633 - RNA, 24 nt, Homo sapiens
uacauuuuuugggcagcaauuuaa

SEQ ID NO: 1353634 - RNA, 17 nt, Homo sapiens
uaccaaaagacauuaga

SEQ ID NO: 1353635 - RNA, 17 nt, Homo sapiens
uaccaaccugaagacac

SEQ ID NO: 1353636 - RNA, 17 nt, Homo sapiens
uacccaacccugcccug

SEQ ID NO: 1353637 - RNA, 14 nt, Homo sapiens
uacccacacaaaua

SEQ ID NO: 1353638 - RNA, 21 nt, Homo sapiens
uacccauuuuuuaaaaaagca

SEQ ID NO: 1353639 - RNA, 22 nt, Homo sapiens
uacccauuuuuuaaaaaagcaa

SEQ ID NO: 1353640 - RNA, 16 nt, Homo sapiens
uaccccucaaacugca

SEQ ID NO: 1353641 - RNA, 13 nt, Homo sapiens
uacccuaaccaag

SEQ ID NO: 1353642 - RNA, 13 nt, Homo sapiens
uaccuauucugaa

SEQ ID NO: 1353643 - RNA, 23 nt, Homo sapiens
uaccucauggaugcuuuggcaau

SEQ ID NO: 1353644 - RNA, 14 nt, Homo sapiens
uaccucuuggcugc

SEQ ID NO: 1353645 - RNA, 20 nt, Homo sapiens
uaccuguuuuacuuuugggu

SEQ ID NO: 1353646 - RNA, 14 nt, Homo sapiens
uaccuucuaccucu

SEQ ID NO: 1353647 - RNA, 15 nt, Homo sapiens
uaccuucuaccucuu

SEQ ID NO: 1353648 - RNA, 21 nt, Homo sapiens
uaccuucuaccucuuggcugc

SEQ ID NO: 1353649 - RNA, 12 nt, Homo sapiens
uacgaucucuug

SEQ ID NO: 1353650 - RNA, 12 nt, Homo sapiens
uacgugucaaaa

SEQ ID NO: 1353651 - RNA, 19 nt, Homo sapiens
uacuaaaaaguauaaaaua

SEQ ID NO: 1353652 - RNA, 19 nt, Homo sapiens
uacuaaaucuaaucaggaa

SEQ ID NO: 1353653 - RNA, 13 nt, Homo sapiens
uacuaauugucua

SEQ ID NO: 1353654 - RNA, 21 nt, Homo sapiens
uacuacaguaacugugacuga

SEQ ID NO: 1353655 - RNA, 21 nt, Homo sapiens
uacuagcuuuugaaauccaga

SEQ ID NO: 1353656 - RNA, 12 nt, Homo sapiens
uacuauggagug

SEQ ID NO: 1353657 - RNA, 12 nt, Homo sapiens
uacuauuuaguc

SEQ ID NO: 1353658 - RNA, 18 nt, Homo sapiens
uacuauuucaauacuuac

SEQ ID NO: 1353659 - RNA, 21 nt, Homo sapiens
uacuauuuuuacuaaucuuuc

SEQ ID NO: 1353660 - RNA, 16 nt, Homo sapiens
uguauuucaagaccuc

SEQ ID NO: 1353661 - RNA, 15 nt, Homo sapiens
uguauuuuccaagua

SEQ ID NO: 1353662 - RNA, 17 nt, Homo sapiens
ugucaaaacuacugaca

SEQ ID NO: 1353663 - RNA, 22 nt, Homo sapiens
ugucaacacaaacuggcuuaau

SEQ ID NO: 1353664 - RNA, 21 nt, Homo sapiens
ugucaagaugaugaugaucuu

SEQ ID NO: 1353665 - RNA, 12 nt, Homo sapiens
ugucacaucuca

SEQ ID NO: 1353666 - RNA, 14 nt, Homo sapiens
ugucaguucccaau

SEQ ID NO: 1353667 - RNA, 22 nt, Homo sapiens
ugucauguggcuaccuguaacu

SEQ ID NO: 1353668 - RNA, 16 nt, Homo sapiens
ugucauguuaugcagu

SEQ ID NO: 1353669 - RNA, 15 nt, Homo sapiens
ugucauuucaaagac

SEQ ID NO: 1353670 - RNA, 14 nt, Homo sapiens
uguccaaaacugcc

SEQ ID NO: 1353671 - RNA, 20 nt, Homo sapiens
uguccacacuaccaguuuca

SEQ ID NO: 1353672 - RNA, 19 nt, Homo sapiens
uguccacuuggagcuaaaa

SEQ ID NO: 1353673 - RNA, 23 nt, Homo sapiens
uguccacuuggagcuaaaacugg

SEQ ID NO: 1353674 - RNA, 21 nt, Homo sapiens
uguccagagauaaaaaucaua

SEQ ID NO: 1353675 - RNA, 16 nt, Homo sapiens
uguccauuuauaucau

SEQ ID NO: 1353676 - RNA, 21 nt, Homo sapiens
ugucccagaaugccuccugca

SEQ ID NO: 1353677 - RNA, 16 nt, Homo sapiens
uguccccugacagggc

SEQ ID NO: 1353678 - RNA, 21 nt, Homo sapiens
uguccccugacagggccagug

SEQ ID NO: 1353679 - RNA, 22 nt, Homo sapiens
ugucccucauccauagcaccuc

SEQ ID NO: 1353680 - RNA, 13 nt, Homo sapiens
ugucccucugccc

SEQ ID NO: 1353681 - RNA, 15 nt, Homo sapiens
ugucccuucccagcg

SEQ ID NO: 1353682 - RNA, 13 nt, Homo sapiens
uguccgugauaau

SEQ ID NO: 1353683 - RNA, 13 nt, Homo sapiens
uguccuacaguga

SEQ ID NO: 1353684 - RNA, 18 nt, Homo sapiens
uguccucagccuugccag

SEQ ID NO: 1353685 - RNA, 16 nt, Homo sapiens
uguccuccaccaugca

SEQ ID NO: 1353686 - RNA, 21 nt, Homo sapiens
uguccugaugcuuuugucuaa

SEQ ID NO: 1353687 - RNA, 21 nt, Homo sapiens
uguccugcagucccacacugu

SEQ ID NO: 1353688 - RNA, 19 nt, Homo sapiens
uguccugcuuauucuuuug

SEQ ID NO: 1353689 - RNA, 13 nt, Homo sapiens
ugucgccaaaaau

SEQ ID NO: 1353690 - RNA, 18 nt, Homo sapiens
ugucgguuaccucugcau

SEQ ID NO: 1353691 - RNA, 16 nt, Homo sapiens
ugucuaaagcagggaa

SEQ ID NO: 1353692 - RNA, 16 nt, Homo sapiens
ugucucaaauucaugg

SEQ ID NO: 1353693 - RNA, 15 nt, Homo sapiens
ugucucucaugacca

SEQ ID NO: 1353694 - RNA, 19 nt, Homo sapiens
ugucucugcgccugaguaa

SEQ ID NO: 1353695 - RNA, 13 nt, Homo sapiens
ugucucuguuauc

SEQ ID NO: 1353696 - RNA, 16 nt, Homo sapiens
ugucuggguuccaaaa

SEQ ID NO: 1353697 - RNA, 20 nt, Homo sapiens
ugucuguccugauuucuaca

SEQ ID NO: 1353698 - RNA, 19 nt, Homo sapiens
ugucuguuuccucuguaua

SEQ ID NO: 1353699 - RNA, 19 nt, Homo sapiens
ugucuuaauuuucuuucac

SEQ ID NO: 1353700 - RNA, 15 nt, Homo sapiens
ugucuuauuguccca

SEQ ID NO: 1353701 - RNA, 14 nt, Homo sapiens
ugucuuggggccac

SEQ ID NO: 1353702 - RNA, 19 nt, Homo sapiens
ugugaaauaccaaccugaa

SEQ ID NO: 1353703 - RNA, 18 nt, Homo sapiens
ugugaaguuugcuuugua

SEQ ID NO: 1353704 - RNA, 23 nt, Homo sapiens
ugugagacuguaaguuacaugaa

SEQ ID NO: 1353705 - RNA, 14 nt, Homo sapiens
ugugauaucuaaua

SEQ ID NO: 1353706 - RNA, 20 nt, Homo sapiens
ugugaugugucacagguuaa

SEQ ID NO: 1353707 - RNA, 14 nt, Homo sapiens
ugugauguguccug

SEQ ID NO: 1353708 - RNA, 14 nt, Homo sapiens
ugugcagccauagu

SEQ ID NO: 1353709 - RNA, 13 nt, Homo sapiens
ugugcaugugcug

SEQ ID NO: 1353710 - RNA, 13 nt, Homo sapiens
ugugccaaccugu

SEQ ID NO: 1353711 - RNA, 12 nt, Homo sapiens
ugugccaguuua

SEQ ID NO: 1353712 - RNA, 19 nt, Homo sapiens
ugugcccgacugacuggag

SEQ ID NO: 1353713 - RNA, 12 nt, Homo sapiens
ugugcccgggga

SEQ ID NO: 1353714 - RNA, 18 nt, Homo sapiens
ugugcucuaaaauucuau

SEQ ID NO: 1353715 - RNA, 21 nt, Homo sapiens
uguggaagcauguagacugug

SEQ ID NO: 1353716 - RNA, 21 nt, Homo sapiens
uguggacguggguugcacugg

SEQ ID NO: 1353717 - RNA, 21 nt, Homo sapiens
uguggggagggauuuggggcu

SEQ ID NO: 1353718 - RNA, 15 nt, Homo sapiens
uguggguaccuguau

SEQ ID NO: 1353719 - RNA, 18 nt, Homo sapiens
uguggguuugguccuuga

SEQ ID NO: 1353720 - RNA, 22 nt, Homo sapiens
ugugguauuguaauaggcauuu

SEQ ID NO: 1353721 - RNA, 16 nt, Homo sapiens
uguggucacccaugca

SEQ ID NO: 1353722 - RNA, 12 nt, Homo sapiens
uguggugacauu

SEQ ID NO: 1353723 - RNA, 21 nt, Homo sapiens
ugugguggugacucauuucca

SEQ ID NO: 1353724 - RNA, 21 nt, Homo sapiens
ugugguuuucagccuuucuaa

SEQ ID NO: 1353725 - RNA, 16 nt, Homo sapiens
uguguaauuagugcca

SEQ ID NO: 1353726 - RNA, 14 nt, Homo sapiens
uguguacugccuua

SEQ ID NO: 1353727 - RNA, 16 nt, Homo sapiens
cucaaaugcuggcaaa

SEQ ID NO: 1353728 - RNA, 18 nt, Homo sapiens
cucaaccuaacacauuaa

SEQ ID NO: 1353729 - RNA, 20 nt, Homo sapiens
cucaagccccauuuccucac

SEQ ID NO: 1353730 - RNA, 16 nt, Homo sapiens
cucaauaaacauuuca

SEQ ID NO: 1353731 - RNA, 18 nt, Homo sapiens
cucacaggccccaggaaa

SEQ ID NO: 1353732 - RNA, 19 nt, Homo sapiens
cucacauaagcccaguuca

SEQ ID NO: 1353733 - RNA, 20 nt, Homo sapiens
cucacauacccucacuuaaa

SEQ ID NO: 1353734 - RNA, 19 nt, Homo sapiens
cucacauccauucuucccu

SEQ ID NO: 1353735 - RNA, 21 nt, Homo sapiens
cucacauuuggggcuagacag

SEQ ID NO: 1353736 - RNA, 14 nt, Homo sapiens
cucaccaaacacaa

SEQ ID NO: 1353737 - RNA, 17 nt, Homo sapiens
cucacccagucuucuac

SEQ ID NO: 1353738 - RNA, 23 nt, Homo sapiens
cucacccccagcuuugcuaccaa

SEQ ID NO: 1353739 - RNA, 13 nt, Homo sapiens
cucacugcaguag

SEQ ID NO: 1353740 - RNA, 16 nt, Homo sapiens
cucacugcagugcuga

SEQ ID NO: 1353741 - RNA, 15 nt, Homo sapiens
cucacuguuccuucu

SEQ ID NO: 1353742 - RNA, 22 nt, Homo sapiens
cucagaaacugcgaggccaguu

SEQ ID NO: 1353743 - RNA, 21 nt, Homo sapiens
cucagaaaugucauguggcua

SEQ ID NO: 1353744 - RNA, 20 nt, Homo sapiens
cucagacauccacauaaccc

SEQ ID NO: 1353745 - RNA, 12 nt, Homo sapiens
cucagaccagcu

SEQ ID NO: 1353746 - RNA, 16 nt, Homo sapiens
cucagaccagcucuuc

SEQ ID NO: 1353747 - RNA, 14 nt, Homo sapiens
cucagacccaacag

SEQ ID NO: 1353748 - RNA, 23 nt, Homo sapiens
cucagagaauuucuaccauuuca

SEQ ID NO: 1353749 - RNA, 19 nt, Homo sapiens
cucagagcuccucacuuag

SEQ ID NO: 1353750 - RNA, 18 nt, Homo sapiens
cucagagugcaagccccu

SEQ ID NO: 1353751 - RNA, 18 nt, Homo sapiens
cucagccucccaaagugc

SEQ ID NO: 1353752 - RNA, 23 nt, Homo sapiens
cucagcuucuucacaggcacucc

SEQ ID NO: 1353753 - RNA, 16 nt, Homo sapiens
cucaggaauucagugc

SEQ ID NO: 1353754 - RNA, 17 nt, Homo sapiens
cucaggcaccugcacuu

SEQ ID NO: 1353755 - RNA, 16 nt, Homo sapiens
cucaggggucauucau

SEQ ID NO: 1353756 - RNA, 14 nt, Homo sapiens
cucaggucccugca

SEQ ID NO: 1353757 - RNA, 18 nt, Homo sapiens
cucaguugaaaaugcaac

SEQ ID NO: 1353758 - RNA, 15 nt, Homo sapiens
cucauauguggaauc

SEQ ID NO: 1353759 - RNA, 14 nt, Homo sapiens
cucaucaggccauu

SEQ ID NO: 1353760 - RNA, 17 nt, Homo sapiens
cucuuguuccugaaaug

SEQ ID NO: 1353761 - RNA, 16 nt, Homo sapiens
cucuuuaaucagcuua

SEQ ID NO: 1353762 - RNA, 20 nt, Homo sapiens
cucuuuacuugaaauuuggc

SEQ ID NO: 1353763 - RNA, 14 nt, Homo sapiens
cucuuucucuauua

SEQ ID NO: 1353764 - RNA, 13 nt, Homo sapiens
cucuuuuccuggc

SEQ ID NO: 1353765 - RNA, 15 nt, Homo sapiens
cugaaaaagacauaa

SEQ ID NO: 1353766 - RNA, 12 nt, Homo sapiens
cugaaagugaaa

SEQ ID NO: 1353767 - RNA, 21 nt, Homo sapiens
cugaaagugaaaguccagaaa

SEQ ID NO: 1353768 - RNA, 23 nt, Homo sapiens
cugaaauuuaucuuuucuucuau

SEQ ID NO: 1353769 - RNA, 16 nt, Homo sapiens
cugaaccaaauugcac

SEQ ID NO: 1353770 - RNA, 14 nt, Homo sapiens
cugaaccacauuca

SEQ ID NO: 1353771 - RNA, 18 nt, Homo sapiens
cugaaccacauucaggga

SEQ ID NO: 1353772 - RNA, 21 nt, Homo sapiens
cugaacuuuaucuguucuguu

SEQ ID NO: 1353773 - RNA, 13 nt, Homo sapiens
cugaagcuaaaaa

SEQ ID NO: 1353774 - RNA, 20 nt, Homo sapiens
cugaaguuuuugaaauaccu

SEQ ID NO: 1353775 - RNA, 20 nt, Homo sapiens
cugaaucagcuggacauacu

SEQ ID NO: 1353776 - RNA, 21 nt, Homo sapiens
cugaaucauuaacagugcugu

SEQ ID NO: 1353777 - RNA, 16 nt, Homo sapiens
cugaaugaaaauaacu

SEQ ID NO: 1353778 - RNA, 18 nt, Homo sapiens
cugaauuucccucucuca

SEQ ID NO: 1353779 - RNA, 19 nt, Homo sapiens
cugacagccacaccguggc

SEQ ID NO: 1353780 - RNA, 22 nt, Homo sapiens
cugacagccuuccccagcucca

SEQ ID NO: 1353781 - RNA, 19 nt, Homo sapiens
cugacagggccagugcagu

SEQ ID NO: 1353782 - RNA, 18 nt, Homo sapiens
cugacauauuaugccuga

SEQ ID NO: 1353783 - RNA, 17 nt, Homo sapiens
cugacccagugccccca

SEQ ID NO: 1353784 - RNA, 16 nt, Homo sapiens
cugaccccgccaugca

SEQ ID NO: 1353785 - RNA, 14 nt, Homo sapiens
cugaccuguguucc

SEQ ID NO: 1353786 - RNA, 17 nt, Homo sapiens
cugaccuuaaaugcaac

SEQ ID NO: 1353787 - RNA, 17 nt, Homo sapiens
cugaccuuggguccuga

SEQ ID NO: 1353788 - RNA, 17 nt, Homo sapiens
cugacugccaagccaga

SEQ ID NO: 1353789 - RNA, 15 nt, Homo sapiens
cugacuuggggacaa

SEQ ID NO: 1353790 - RNA, 13 nt, Homo sapiens
cugagaaaccucg

SEQ ID NO: 1353791 - RNA, 13 nt, Homo sapiens
cugagcaggauuu

SEQ ID NO: 1353792 - RNA, 23 nt, Homo sapiens
cugagcagguguucuucauuacc

SEQ ID NO: 1353793 - RNA, 23 nt, Homo sapiens
cugagcuggaaggggccacgugg

SEQ ID NO: 1353794 - RNA, 19 nt, Homo sapiens
cugagcuggccuccuaugc

SEQ ID NO: 1353795 - RNA, 23 nt, Homo sapiens
cugaggagaagcgggaguggcug

SEQ ID NO: 1353796 - RNA, 15 nt, Homo sapiens
cugaggcccagagag

SEQ ID NO: 1353797 - RNA, 15 nt, Homo sapiens
cugagggcauugcuu

SEQ ID NO: 1353798 - RNA, 20 nt, Homo sapiens
cugaguaauaaagauacaaa

SEQ ID NO: 1353799 - RNA, 15 nt, Homo sapiens
cugaguauaaauuua

SEQ ID NO: 1353800 - RNA, 13 nt, Homo sapiens
cugauaaacacaa

SEQ ID NO: 1353801 - RNA, 14 nt, Homo sapiens
cugauaccauucua

SEQ ID NO: 1353802 - RNA, 23 nt, Homo sapiens
cugaugccuguguacugccuuaa

SEQ ID NO: 1353803 - RNA, 17 nt, Homo sapiens
cugaugguggcucuggu

SEQ ID NO: 1353804 - RNA, 15 nt, Homo sapiens
cugauguauaaugua

SEQ ID NO: 1353805 - RNA, 19 nt, Homo sapiens
cugaugucuccacuuucac

SEQ ID NO: 1353806 - RNA, 22 nt, Homo sapiens
cugauuuaggagaagccaggaa

SEQ ID NO: 1353807 - RNA, 19 nt, Homo sapiens
cugauuuuggccaucagga

SEQ ID NO: 1353808 - RNA, 18 nt, Homo sapiens
cugcaaaaaaaugugcau

SEQ ID NO: 1353809 - RNA, 21 nt, Homo sapiens
cugcaaagcaaaacagacugu

SEQ ID NO: 1353810 - RNA, 23 nt, Homo sapiens
cugcaacaugccagccacuguga

SEQ ID NO: 1353811 - RNA, 12 nt, Homo sapiens
cugcaagagcca

SEQ ID NO: 1353812 - RNA, 16 nt, Homo sapiens
cugcaaguaaguauga

SEQ ID NO: 1353813 - RNA, 21 nt, Homo sapiens
cugcacaaagcccuuccaugu

SEQ ID NO: 1353814 - RNA, 14 nt, Homo sapiens
cugcaccaugcugc

SEQ ID NO: 1353815 - RNA, 15 nt, Homo sapiens
cugcacuuacaggcc

SEQ ID NO: 1353816 - RNA, 23 nt, Homo sapiens
cugcagauacuuugaagugcagc

SEQ ID NO: 1353817 - RNA, 21 nt, Homo sapiens
cugcagcccaggccagucaga

SEQ ID NO: 1353818 - RNA, 16 nt, Homo sapiens
cugcagccucaaccuc

SEQ ID NO: 1353819 - RNA, 11 nt, Homo sapiens
cugcagccuuc

SEQ ID NO: 1353820 - RNA, 15 nt, Homo sapiens
cugcagcucagggac

SEQ ID NO: 1353821 - RNA, 21 nt, Homo sapiens
cugcaggcagccugccuuuaa

SEQ ID NO: 1353822 - RNA, 16 nt, Homo sapiens
cugcagggacagagca

SEQ ID NO: 1353823 - RNA, 23 nt, Homo sapiens
cugcagggguugagagcuuucug

SEQ ID NO: 1353824 - RNA, 15 nt, Homo sapiens
cugcaguaaaacaca

SEQ ID NO: 1353825 - RNA, 20 nt, Homo sapiens
cugcagucccacacugugca

SEQ ID NO: 1353826 - RNA, 23 nt, Homo sapiens
cugcagucccauccucuugucag

SEQ ID NO: 1353827 - RNA, 22 nt, Homo sapiens
cugccacgccgcccuaaaagca

SEQ ID NO: 1353828 - RNA, 12 nt, Homo sapiens
cugccacuccau

SEQ ID NO: 1353829 - RNA, 18 nt, Homo sapiens
cugccaggcccuuugcac

SEQ ID NO: 1353830 - RNA, 13 nt, Homo sapiens
cugccaugccagu

SEQ ID NO: 1353831 - RNA, 12 nt, Homo sapiens
cugccauuuccc

SEQ ID NO: 1353832 - RNA, 15 nt, Homo sapiens
cugcccaggggagcc

SEQ ID NO: 1353833 - RNA, 22 nt, Homo sapiens
cugcccagucgaccccaaagga

SEQ ID NO: 1353834 - RNA, 12 nt, Homo sapiens
cugcccaugcac

SEQ ID NO: 1353835 - RNA, 15 nt, Homo sapiens
cugcccaugcaccuu

SEQ ID NO: 1353836 - RNA, 18 nt, Homo sapiens
cugcccauuguaacuuau

SEQ ID NO: 1353837 - RNA, 18 nt, Homo sapiens
cugccccaccccaccuca

SEQ ID NO: 1353838 - RNA, 15 nt, Homo sapiens
cugcccggcacuggg

SEQ ID NO: 1353839 - RNA, 18 nt, Homo sapiens
cugcccgggagggcuucc

SEQ ID NO: 1353840 - RNA, 17 nt, Homo sapiens
cugcccugcucccacag

SEQ ID NO: 1353841 - RNA, 18 nt, Homo sapiens
cugccucaggccaaggga

SEQ ID NO: 1353842 - RNA, 15 nt, Homo sapiens
cugccuccucuucaa

SEQ ID NO: 1353843 - RNA, 19 nt, Homo sapiens
cugccugggccguggcaca

SEQ ID NO: 1353844 - RNA, 21 nt, Homo sapiens
cugccuguuggcaggcccacu

SEQ ID NO: 1353845 - RNA, 14 nt, Homo sapiens
cugccuuaaacaca

SEQ ID NO: 1353846 - RNA, 21 nt, Homo sapiens
cugccuuagccuaccauguga

SEQ ID NO: 1353847 - RNA, 20 nt, Homo sapiens
cugccuuguuuaauguuaau

SEQ ID NO: 1353848 - RNA, 18 nt, Homo sapiens
cugcgaaugggauccuga

SEQ ID NO: 1353849 - RNA, 18 nt, Homo sapiens
cugcgccaccucacugca

SEQ ID NO: 1353850 - RNA, 18 nt, Homo sapiens
cugcggaccccucgucau

SEQ ID NO: 1353851 - RNA, 20 nt, Homo sapiens
cugcuaagucauuggcaaag

SEQ ID NO: 1353852 - RNA, 16 nt, Homo sapiens
cugcuauaacuaugac

SEQ ID NO: 1353853 - RNA, 15 nt, Homo sapiens
cugcuccaacuccau

SEQ ID NO: 1353854 - RNA, 14 nt, Homo sapiens
cugcuccaccagca

SEQ ID NO: 1353855 - RNA, 22 nt, Homo sapiens
cugcuccaccagcagcauggca

SEQ ID NO: 1353856 - RNA, 17 nt, Homo sapiens
cugcucuauacuguggc

SEQ ID NO: 1353857 - RNA, 20 nt, Homo sapiens
cugcucucggaggaugccua

SEQ ID NO: 1353858 - RNA, 18 nt, Homo sapiens
cugcugaccauuugguca

SEQ ID NO: 1353859 - RNA, 23 nt, Homo sapiens
cugcugagagggcugcugaccau

SEQ ID NO: 1353860 - RNA, 19 nt, Homo sapiens
cugcugccacagacugugg

SEQ ID NO: 1353861 - RNA, 15 nt, Homo sapiens
cugcugcugcugcug

SEQ ID NO: 1353862 - RNA, 21 nt, Homo sapiens
cugggaugugaagucucuggg

SEQ ID NO: 1353863 - RNA, 22 nt, Homo sapiens
cugggauuacagggaugagcca

SEQ ID NO: 1353864 - RNA, 22 nt, Homo sapiens
cugggauuauaggcaugagcca

SEQ ID NO: 1353865 - RNA, 23 nt, Homo sapiens
cugggauuauaggcaugagccac

SEQ ID NO: 1353866 - RNA, 22 nt, Homo sapiens
cugggauucuagaacugugaau

SEQ ID NO: 1353867 - RNA, 13 nt, Homo sapiens
cugggcaccaccu

SEQ ID NO: 1353868 - RNA, 22 nt, Homo sapiens
cugggcaucucugagcaauugu

SEQ ID NO: 1353869 - RNA, 15 nt, Homo sapiens
cugggccguggcaca

SEQ ID NO: 1353870 - RNA, 20 nt, Homo sapiens
cugggcuaauauacuuguaa

SEQ ID NO: 1353871 - RNA, 17 nt, Homo sapiens
cugggcuauugcugcug

SEQ ID NO: 1353872 - RNA, 15 nt, Homo sapiens
cugggcucacugugc

SEQ ID NO: 1353873 - RNA, 16 nt, Homo sapiens
cugggcucagacaucc

SEQ ID NO: 1353874 - RNA, 20 nt, Homo sapiens
cugggcucagacauccacau

SEQ ID NO: 1353875 - RNA, 13 nt, Homo sapiens
cugggcuguggua

SEQ ID NO: 1353876 - RNA, 14 nt, Homo sapiens
cuggggaagacagu

SEQ ID NO: 1353877 - RNA, 15 nt, Homo sapiens
cuggggacucaggga

SEQ ID NO: 1353878 - RNA, 19 nt, Homo sapiens
cuggggagugguuaggcag

SEQ ID NO: 1353879 - RNA, 21 nt, Homo sapiens
cuggggaucuucccacaggag

SEQ ID NO: 1353880 - RNA, 18 nt, Homo sapiens
cuggggaugguaggauug

SEQ ID NO: 1353881 - RNA, 18 nt, Homo sapiens
cugggggagguccaagca

SEQ ID NO: 1353882 - RNA, 16 nt, Homo sapiens
cugggguccauucucu

SEQ ID NO: 1353883 - RNA, 15 nt, Homo sapiens
cugguauuuccuggc

SEQ ID NO: 1353884 - RNA, 21 nt, Homo sapiens
cuggucagcauguacuccccu

SEQ ID NO: 1353885 - RNA, 16 nt, Homo sapiens
cugguccuggagacaa

SEQ ID NO: 1353886 - RNA, 15 nt, Homo sapiens
cuggucgccaaucca

SEQ ID NO: 1353887 - RNA, 19 nt, Homo sapiens
cuggugcucaucuucucuu

SEQ ID NO: 1353888 - RNA, 17 nt, Homo sapiens
cugguguugacuggacu

SEQ ID NO: 1353889 - RNA, 15 nt, Homo sapiens
cugguuagaaaugca

SEQ ID NO: 1353890 - RNA, 16 nt, Homo sapiens
cuguaaacuuccaagc

SEQ ID NO: 1353891 - RNA, 13 nt, Homo sapiens
cuguaacagggua

SEQ ID NO: 1353892 - RNA, 23 nt, Homo sapiens
cuguaacccuggcacuuaagggg

SEQ ID NO: 1353893 - RNA, 17 nt, Homo sapiens
cuguaaucccagcacuu

SEQ ID NO: 1353894 - RNA, 21 nt, Homo sapiens
cuguaaucccagcacuuuggg

SEQ ID NO: 1353895 - RNA, 17 nt, Homo sapiens
cuguaaucucagcacuu

SEQ ID NO: 1353896 - RNA, 17 nt, Homo sapiens
cuguaccgacuuugaua

SEQ ID NO: 1353897 - RNA, 14 nt, Homo sapiens
cuguaccucagugg

SEQ ID NO: 1353898 - RNA, 12 nt, Homo sapiens
cuguagucccag

SEQ ID NO: 1353899 - RNA, 18 nt, Homo sapiens
cuguauucccaguuacuu

SEQ ID NO: 1353900 - RNA, 19 nt, Homo sapiens
cuguauuuuuaaauugcca

SEQ ID NO: 1353901 - RNA, 16 nt, Homo sapiens
cugucaaaacuacuga

SEQ ID NO: 1353902 - RNA, 12 nt, Homo sapiens
cugucacccaca

SEQ ID NO: 1353903 - RNA, 22 nt, Homo sapiens
cugucagcaagacugaagaugg

SEQ ID NO: 1353904 - RNA, 13 nt, Homo sapiens
cugucagcugcaa

SEQ ID NO: 1353905 - RNA, 12 nt, Homo sapiens
cugucaguucuc

SEQ ID NO: 1353906 - RNA, 20 nt, Homo sapiens
cugucauuucagauauucca

SEQ ID NO: 1353907 - RNA, 12 nt, Homo sapiens
cuguccagcucc

SEQ ID NO: 1353908 - RNA, 14 nt, Homo sapiens
cugucccacccaca

SEQ ID NO: 1353909 - RNA, 17 nt, Homo sapiens
cuguccuauuauauuca

SEQ ID NO: 1353910 - RNA, 18 nt, Homo sapiens
cuguccugaaagccacag

SEQ ID NO: 1353911 - RNA, 12 nt, Homo sapiens
cuguccuugccc

SEQ ID NO: 1353912 - RNA, 18 nt, Homo sapiens
cugucucuccagugaaau

SEQ ID NO: 1353913 - RNA, 21 nt, Homo sapiens
cugugacauacauauuaucuc

SEQ ID NO: 1353914 - RNA, 22 nt, Homo sapiens
cugugauauuuucacacuggua

SEQ ID NO: 1353915 - RNA, 15 nt, Homo sapiens
cugugaugacauucc

SEQ ID NO: 1353916 - RNA, 16 nt, Homo sapiens
cugugauuuaugccaa

SEQ ID NO: 1353917 - RNA, 21 nt, Homo sapiens
cugugauuucuuucuuugcac

SEQ ID NO: 1353918 - RNA, 21 nt, Homo sapiens
cugugcaggcauggucccuua

SEQ ID NO: 1353919 - RNA, 20 nt, Homo sapiens
cugugcccggggaaaggcaa

SEQ ID NO: 1353920 - RNA, 17 nt, Homo sapiens
cugugccucugccuguc

SEQ ID NO: 1353921 - RNA, 14 nt, Homo sapiens
cugugccuuuugcc

SEQ ID NO: 1353922 - RNA, 18 nt, Homo sapiens
cuguggaacauaaaaagg

SEQ ID NO: 1353923 - RNA, 20 nt, Homo sapiens
cuguggagggagggcagcug

SEQ ID NO: 1353924 - RNA, 14 nt, Homo sapiens
cuguggcagaguua

SEQ ID NO: 1353925 - RNA, 14 nt, Homo sapiens
cuguggccauuugu

SEQ ID NO: 1353926 - RNA, 13 nt, Homo sapiens
cuguggugcagug

SEQ ID NO: 1353927 - RNA, 15 nt, Homo sapiens
cugugucuguauaca

SEQ ID NO: 1353928 - RNA, 16 nt, Homo sapiens
cugugugauugacagc

SEQ ID NO: 1353929 - RNA, 14 nt, Homo sapiens
cuguguguccaaaa

SEQ ID NO: 1353930 - RNA, 16 nt, Homo sapiens
cuguguguccaaaacu

SEQ ID NO: 1353931 - RNA, 16 nt, Homo sapiens
cuguuaaucugaugua

SEQ ID NO: 1353932 - RNA, 23 nt, Homo sapiens
cuguuaucuaaugauguucucug

SEQ ID NO: 1353933 - RNA, 13 nt, Homo sapiens
cuguucacagcca

SEQ ID NO: 1353934 - RNA, 17 nt, Homo sapiens
cuguucagagcacucau

SEQ ID NO: 1353935 - RNA, 14 nt, Homo sapiens
cuguuccccagaga

SEQ ID NO: 1353936 - RNA, 19 nt, Homo sapiens
cuguucuguuggaugacuu

SEQ ID NO: 1353937 - RNA, 23 nt, Homo sapiens
cuguucuguuggaugacuuugag

SEQ ID NO: 1353938 - RNA, 16 nt, Homo sapiens
cuguucuuuuguccca

SEQ ID NO: 1353939 - RNA, 23 nt, Homo sapiens
cuguuggucugccuucugcugaa

SEQ ID NO: 1353940 - RNA, 17 nt, Homo sapiens
cuguuuaaaguggcaau

SEQ ID NO: 1353941 - RNA, 18 nt, Homo sapiens
cuguuuggaugcuucuga

SEQ ID NO: 1353942 - RNA, 23 nt, Homo sapiens
cuguuuguugccccauuccuaag

SEQ ID NO: 1353943 - RNA, 20 nt, Homo sapiens
cuguuuugcauggaguauua

SEQ ID NO: 1353944 - RNA, 20 nt, Homo sapiens
cuuaaaaaagcccuuugcua

SEQ ID NO: 1353945 - RNA, 23 nt, Homo sapiens
cuuaaaaaagcccuuugcuaaaa

SEQ ID NO: 1353946 - RNA, 19 nt, Homo sapiens
cuuaaaacaauucugugac

SEQ ID NO: 1353947 - RNA, 16 nt, Homo sapiens
cuuaaaccacagcacu

SEQ ID NO: 1353948 - RNA, 13 nt, Homo sapiens
cuuaaacucuguu

SEQ ID NO: 1353949 - RNA, 15 nt, Homo sapiens
cuuaacacauucaau

SEQ ID NO: 1353950 - RNA, 17 nt, Homo sapiens
cuuaagcaacaauggau

SEQ ID NO: 1353951 - RNA, 13 nt, Homo sapiens
cuuaaucuaaucu

SEQ ID NO: 1353952 - RNA, 17 nt, Homo sapiens
cuuaaucuuauggggcc

SEQ ID NO: 1353953 - RNA, 15 nt, Homo sapiens
cuuacacacuggaaa

SEQ ID NO: 1353954 - RNA, 20 nt, Homo sapiens
cuuacacuuuaugcacaaaa

SEQ ID NO: 1353955 - RNA, 11 nt, Homo sapiens
cuuacaucugg

SEQ ID NO: 1353956 - RNA, 14 nt, Homo sapiens
cuuacauuagugau

SEQ ID NO: 1353957 - RNA, 19 nt, Homo sapiens
cuuacauuagugauuccau

SEQ ID NO: 1353958 - RNA, 19 nt, Homo sapiens
cuuaccagggucuuugcag

SEQ ID NO: 1353959 - RNA, 18 nt, Homo sapiens
cuuaccaguauuuaacuu

SEQ ID NO: 1353960 - RNA, 14 nt, Homo sapiens
cuuaccgcucuguu

SEQ ID NO: 1353961 - RNA, 18 nt, Homo sapiens
cuuagaaaacaaguauug

SEQ ID NO: 1353962 - RNA, 12 nt, Homo sapiens
cuuagaacaaag

SEQ ID NO: 1353963 - RNA, 16 nt, Homo sapiens
cuuagaauaaugaagg

SEQ ID NO: 1353964 - RNA, 17 nt, Homo sapiens
cuuagagggugauggaa

SEQ ID NO: 1353965 - RNA, 20 nt, Homo sapiens
guaacaggguagugugguau

SEQ ID NO: 1353966 - RNA, 17 nt, Homo sapiens
guaacaguuugauauuu

SEQ ID NO: 1353967 - RNA, 14 nt, Homo sapiens
guaacaucuguuau

SEQ ID NO: 1353968 - RNA, 19 nt, Homo sapiens
guaacuccccucagggaua

SEQ ID NO: 1353969 - RNA, 14 nt, Homo sapiens
guaacuuccugugg

SEQ ID NO: 1353970 - RNA, 17 nt, Homo sapiens
guaacuugagauucaag

SEQ ID NO: 1353971 - RNA, 22 nt, Homo sapiens
guaaguauuuagaagugugaau

SEQ ID NO: 1353972 - RNA, 22 nt, Homo sapiens
guaaguuacaugaaggcagcag

SEQ ID NO: 1353973 - RNA, 19 nt, Homo sapiens
guaauacguagcucucuua

SEQ ID NO: 1353974 - RNA, 15 nt, Homo sapiens
guaaucucagcacuu

SEQ ID NO: 1353975 - RNA, 14 nt, Homo sapiens
guaaugaaauggag

SEQ ID NO: 1353976 - RNA, 20 nt, Homo sapiens
guaauguuaguaaauccaug

SEQ ID NO: 1353977 - RNA, 20 nt, Homo sapiens
guaauugcagauaacuuuga

SEQ ID NO: 1353978 - RNA, 16 nt, Homo sapiens
guaauuuuauuuacau

SEQ ID NO: 1353979 - RNA, 21 nt, Homo sapiens
guacaaggcccccacugccug

SEQ ID NO: 1353980 - RNA, 15 nt, Homo sapiens
guacaggaacugcau

SEQ ID NO: 1353981 - RNA, 18 nt, Homo sapiens
guacauauguaaacauaa

SEQ ID NO: 1353982 - RNA, 19 nt, Homo sapiens
guacauuucugauucugau

SEQ ID NO: 1353983 - RNA, 16 nt, Homo sapiens
guaccaaaucugacau

SEQ ID NO: 1353984 - RNA, 13 nt, Homo sapiens
guaccgacuuuga

SEQ ID NO: 1353985 - RNA, 15 nt, Homo sapiens
guaccuguuccuccc

SEQ ID NO: 1353986 - RNA, 18 nt, Homo sapiens
guacucccaaacugacaa

SEQ ID NO: 1353987 - RNA, 18 nt, Homo sapiens
guacugccuuagugcuga

SEQ ID NO: 1353988 - RNA, 13 nt, Homo sapiens
guagaaguggcau

SEQ ID NO: 1353989 - RNA, 17 nt, Homo sapiens
guagacucauucuucac

SEQ ID NO: 1353990 - RNA, 14 nt, Homo sapiens
guagacugugccag

SEQ ID NO: 1353991 - RNA, 19 nt, Homo sapiens
guagccugggcucacugug

SEQ ID NO: 1353992 - RNA, 21 nt, Homo sapiens
guagcuuuuaugcccucagga

SEQ ID NO: 1353993 - RNA, 17 nt, Homo sapiens
guaggaauuuucuugaa

SEQ ID NO: 1353994 - RNA, 21 nt, Homo sapiens
guaggcuuuguauucaaaaau

SEQ ID NO: 1353995 - RNA, 19 nt, Homo sapiens
guaggugguucgugcugug

SEQ ID NO: 1353996 - RNA, 20 nt, Homo sapiens
guaguuuuauuacacauuua

SEQ ID NO: 1353997 - RNA, 18 nt, Homo sapiens
guauaaaugugauaugau

SEQ ID NO: 1353998 - RNA, 16 nt, Homo sapiens
guauaaauuuacuuuu

SEQ ID NO: 1353999 - RNA, 16 nt, Homo sapiens
guauaaauuuuuaccu

SEQ ID NO: 1354000 - RNA, 21 nt, Homo sapiens
guauaagguggucauaaguga

SEQ ID NO: 1354001 - RNA, 11 nt, Homo sapiens
guauacaguau

SEQ ID NO: 1354002 - RNA, 11 nt, Homo sapiens
guauacuauag

SEQ ID NO: 1354003 - RNA, 18 nt, Homo sapiens
guauauuacaaugaucac

SEQ ID NO: 1354004 - RNA, 19 nt, Homo sapiens
guauauuuaauuuugacau

SEQ ID NO: 1354005 - RNA, 14 nt, Homo sapiens
guauccucuugcca

SEQ ID NO: 1354006 - RNA, 18 nt, Homo sapiens
guaucguuuguuuaugaa

SEQ ID NO: 1354007 - RNA, 14 nt, Homo sapiens
guaugcaauggauu

SEQ ID NO: 1354008 - RNA, 17 nt, Homo sapiens
guaugguauaugcacaa

SEQ ID NO: 1354009 - RNA, 15 nt, Homo sapiens
guauuaaacucuaau

SEQ ID NO: 1354010 - RNA, 18 nt, Homo sapiens
guauuaaacucuaaugua

SEQ ID NO: 1354011 - RNA, 23 nt, Homo sapiens
guauuauuuuuuaauaaacugca

SEQ ID NO: 1354012 - RNA, 19 nt, Homo sapiens
guauuuauuacaacucuau

SEQ ID NO: 1354013 - RNA, 17 nt, Homo sapiens
guauuuuaauccuguac

SEQ ID NO: 1354014 - RNA, 22 nt, Homo sapiens
guauuuuccaacuuguucaaau

SEQ ID NO: 1354015 - RNA, 15 nt, Homo sapiens
guauuuuguaugcau

SEQ ID NO: 1354016 - RNA, 21 nt, Homo sapiens
guauuuuucuuuaaccaaaca

SEQ ID NO: 1354017 - RNA, 16 nt, Homo sapiens
gucaaaacuacugaca

SEQ ID NO: 1354018 - RNA, 13 nt, Homo sapiens
gucaaaacugaag

SEQ ID NO: 1354019 - RNA, 17 nt, Homo sapiens
gucaagaauagcauugu

SEQ ID NO: 1354020 - RNA, 18 nt, Homo sapiens
gucacaauuaugugcaaa

SEQ ID NO: 1354021 - RNA, 23 nt, Homo sapiens
gucagacuuuguguucauuucau

SEQ ID NO: 1354022 - RNA, 20 nt, Homo sapiens
gucagauuugaacucuucaa

SEQ ID NO: 1354023 - RNA, 18 nt, Homo sapiens
gucagcagaugcuguugu

SEQ ID NO: 1354024 - RNA, 22 nt, Homo sapiens
gucagcuguggggaacacagcu

SEQ ID NO: 1354025 - RNA, 10 nt, Homo sapiens
gucauagaaa

SEQ ID NO: 1354026 - RNA, 17 nt, Homo sapiens
gucaucaggugcauagc

SEQ ID NO: 1354027 - RNA, 18 nt, Homo sapiens
gucaugcugucaguuccc

SEQ ID NO: 1354028 - RNA, 17 nt, Homo sapiens
gucauguggcuaccugu

SEQ ID NO: 1354029 - RNA, 16 nt, Homo sapiens
gucauuauguagcugu

SEQ ID NO: 1354030 - RNA, 17 nt, Homo sapiens
gucauugcaccuaucuc

SEQ ID NO: 1354031 - RNA, 13 nt, Homo sapiens
gucauuuguuaau

SEQ ID NO: 1354032 - RNA, 14 nt, Homo sapiens
guccacugucaggg

SEQ ID NO: 1354033 - RNA, 20 nt, Homo sapiens
guccaggcuggagugcaaug

SEQ ID NO: 1354034 - RNA, 17 nt, Homo sapiens
guccauagcacuguaua

SEQ ID NO: 1354035 - RNA, 11 nt, Homo sapiens
guccauucucu

SEQ ID NO: 1354036 - RNA, 14 nt, Homo sapiens
gucccacacugugg

SEQ ID NO: 1354037 - RNA, 23 nt, Homo sapiens
gucccagaaugccuccugcaggg

SEQ ID NO: 1354038 - RNA, 17 nt, Homo sapiens
gucccaguuaagugaag

SEQ ID NO: 1354039 - RNA, 19 nt, Homo sapiens
gucccccugcuugucuuca

SEQ ID NO: 1354040 - RNA, 18 nt, Homo sapiens
guccccuaaaccaaaaac

SEQ ID NO: 1354041 - RNA, 19 nt, Homo sapiens
guccucagccuugccagag

SEQ ID NO: 1354042 - RNA, 22 nt, Homo sapiens
guccucaggggaggacuaggaa

SEQ ID NO: 1354043 - RNA, 20 nt, Homo sapiens
guccucccaauuucagacuc

SEQ ID NO: 1354044 - RNA, 15 nt, Homo sapiens
guccuccuaucuccc

SEQ ID NO: 1354045 - RNA, 15 nt, Homo sapiens
guccucuuugugaua

SEQ ID NO: 1354046 - RNA, 21 nt, Homo sapiens
guccucuuugugauaauucuc

SEQ ID NO: 1354047 - RNA, 16 nt, Homo sapiens
guccugaaagccacag

SEQ ID NO: 1354048 - RNA, 12 nt, Homo sapiens
guccuugaacaa

SEQ ID NO: 1354049 - RNA, 14 nt, Homo sapiens
guccuuuugacacu

SEQ ID NO: 1354050 - RNA, 21 nt, Homo sapiens
guccuuuuuuauacaggaaaa

SEQ ID NO: 1354051 - RNA, 18 nt, Homo sapiens
gucuaaagcuuuggggga

SEQ ID NO: 1354052 - RNA, 14 nt, Homo sapiens
gucuaaucagugau

SEQ ID NO: 1354053 - RNA, 23 nt, Homo sapiens
gucucaccuggacuuaagcaucu

SEQ ID NO: 1354054 - RNA, 14 nt, Homo sapiens
gucucuccagugaa

SEQ ID NO: 1354055 - RNA, 12 nt, Homo sapiens
gucugaugacac

SEQ ID NO: 1354056 - RNA, 15 nt, Homo sapiens
gucuggcccaccagg

SEQ ID NO: 1354057 - RNA, 16 nt, Homo sapiens
gucugggccacucagg

SEQ ID NO: 1354058 - RNA, 12 nt, Homo sapiens
gucugggccagu

SEQ ID NO: 1354059 - RNA, 15 nt, Homo sapiens
gucuguaugucaugg

SEQ ID NO: 1354060 - RNA, 18 nt, Homo sapiens
gucuguggcuuucagccu

SEQ ID NO: 1354061 - RNA, 21 nt, Homo sapiens
gucuucagugucuuaaugugg

SEQ ID NO: 1354062 - RNA, 18 nt, Homo sapiens
gucuucgcagccuagaua

SEQ ID NO: 1354063 - RNA, 17 nt, Homo sapiens
gucuuguugauuuccuc

SEQ ID NO: 1354064 - RNA, 14 nt, Homo sapiens
gucuuuacaccucg

SEQ ID NO: 1354065 - RNA, 16 nt, Homo sapiens
gucuuuauacugcaaa

SEQ ID NO: 1354066 - RNA, 23 nt, Homo sapiens
gucuuucauguaaaaagugcagu

SEQ ID NO: 1354067 - RNA, 14 nt, Homo sapiens
gucuuuccaaaagu

SEQ ID NO: 1354068 - RNA, 20 nt, Homo sapiens
gucuuuccuaaggcugcaag

SEQ ID NO: 1354069 - RNA, 18 nt, Homo sapiens
gucuuucuuugucauuca

SEQ ID NO: 1354070 - RNA, 17 nt, Homo sapiens
gucuuuguucugugauu

SEQ ID NO: 1354071 - RNA, 15 nt, Homo sapiens
gugaacacaucagcu

SEQ ID NO: 1354072 - RNA, 13 nt, Homo sapiens
gugaacugagcug

SEQ ID NO: 1354073 - RNA, 14 nt, Homo sapiens
gugaagagucuaca

SEQ ID NO: 1354074 - RNA, 20 nt, Homo sapiens
gugaagauuggggacacuca

SEQ ID NO: 1354075 - RNA, 14 nt, Homo sapiens
gugaagccucugag

SEQ ID NO: 1354076 - RNA, 22 nt, Homo sapiens
gugaauacauuaacggugcuaa

SEQ ID NO: 1354077 - RNA, 14 nt, Homo sapiens
gugaaugcugguca

SEQ ID NO: 1354078 - RNA, 16 nt, Homo sapiens
gugaauuaggcuguaa

SEQ ID NO: 1354079 - RNA, 21 nt, Homo sapiens
gugaauuaggcuguaacuacu

SEQ ID NO: 1354080 - RNA, 12 nt, Homo sapiens
gugaauuugcca

SEQ ID NO: 1354081 - RNA, 17 nt, Homo sapiens
gugacaggacuuucauu

SEQ ID NO: 1354082 - RNA, 22 nt, Homo sapiens
gugaccacagccuuaccaaagc

SEQ ID NO: 1354083 - RNA, 16 nt, Homo sapiens
gugccacuggaccuca

SEQ ID NO: 1354084 - RNA, 18 nt, Homo sapiens
gugccacuggaccucagu

SEQ ID NO: 1354085 - RNA, 16 nt, Homo sapiens
gugccaggauggaaug

SEQ ID NO: 1354086 - RNA, 17 nt, Homo sapiens
gugccaguuauggcuau

SEQ ID NO: 1354087 - RNA, 13 nt, Homo sapiens
gugccccacaaaa

SEQ ID NO: 1354088 - RNA, 15 nt, Homo sapiens
gugccccaccacucc

SEQ ID NO: 1354089 - RNA, 17 nt, Homo sapiens
gugccgcucucucugag

SEQ ID NO: 1354090 - RNA, 18 nt, Homo sapiens
gugcuacaaaaacacagc

SEQ ID NO: 1354091 - RNA, 19 nt, Homo sapiens
gugcucgaguauccuugua

SEQ ID NO: 1354092 - RNA, 17 nt, Homo sapiens
gugcucuggcaccauca

SEQ ID NO: 1354093 - RNA, 18 nt, Homo sapiens
gugcucuuggcugacccc

SEQ ID NO: 1354094 - RNA, 17 nt, Homo sapiens
gugcugcucucuccgag

SEQ ID NO: 1354095 - RNA, 19 nt, Homo sapiens
gugcugggauuacagggau

SEQ ID NO: 1354096 - RNA, 13 nt, Homo sapiens
gugcuguuucaaa

SEQ ID NO: 1354097 - RNA, 17 nt, Homo sapiens
gugcuuguuagcuguuu

SEQ ID NO: 1354098 - RNA, 16 nt, Homo sapiens
gugcuuuuugucaugu

SEQ ID NO: 1354099 - RNA, 21 nt, Homo sapiens
guggaaagucaggcuagcugu

SEQ ID NO: 1354100 - RNA, 15 nt, Homo sapiens
guggaacaagcacag

SEQ ID NO: 1354101 - RNA, 19 nt, Homo sapiens
guggacugugcuggugcau

SEQ ID NO: 1354102 - RNA, 14 nt, Homo sapiens
guggagacaguccu

SEQ ID NO: 1354103 - RNA, 17 nt, Homo sapiens
guggaugccugcugcau

SEQ ID NO: 1354104 - RNA, 19 nt, Homo sapiens
guggcaaaggagccuacuc

SEQ ID NO: 1354105 - RNA, 19 nt, Homo sapiens
guggccaaggagcugcuau

SEQ ID NO: 1354106 - RNA, 22 nt, Homo sapiens
guggccaggccuuacaucuggc

SEQ ID NO: 1354107 - RNA, 18 nt, Homo sapiens
guggcuucccgcucagcc

SEQ ID NO: 1354108 - RNA, 17 nt, Homo sapiens
gugggaagaauuggaag

SEQ ID NO: 1354109 - RNA, 12 nt, Homo sapiens
gugggcacuggu

SEQ ID NO: 1354110 - RNA, 15 nt, Homo sapiens
guggguguacauuuu

SEQ ID NO: 1354111 - RNA, 14 nt, Homo sapiens
gugguccacugagc

SEQ ID NO: 1354112 - RNA, 21 nt, Homo sapiens
guggugggggaggagccucug

SEQ ID NO: 1354113 - RNA, 22 nt, Homo sapiens
guguacacggaggucucuguaa

SEQ ID NO: 1354114 - RNA, 15 nt, Homo sapiens
guguagcuuugcucu

SEQ ID NO: 1354115 - RNA, 17 nt, Homo sapiens
guguaucugacaaaagg

SEQ ID NO: 1354116 - RNA, 18 nt, Homo sapiens
gugucaugaagugcacag

SEQ ID NO: 1354117 - RNA, 18 nt, Homo sapiens
gugucauuggaagccauc

SEQ ID NO: 1354118 - RNA, 17 nt, Homo sapiens
guguccaguugcagcug

SEQ ID NO: 1354119 - RNA, 18 nt, Homo sapiens
gugucccccauaaaagau

SEQ ID NO: 1354120 - RNA, 19 nt, Homo sapiens
gugucucaggccacaccgg

SEQ ID NO: 1354121 - RNA, 23 nt, Homo sapiens
gugucucugcgccugaguaacga

SEQ ID NO: 1354122 - RNA, 22 nt, Homo sapiens
gugucuggagcgcuucaguuca

SEQ ID NO: 1354123 - RNA, 16 nt, Homo sapiens
gugucuuuggugggga

SEQ ID NO: 1354124 - RNA, 20 nt, Homo sapiens
gugugggggaggcgcacagu

SEQ ID NO: 1354125 - RNA, 17 nt, Homo sapiens
guguuuccacagccugc

SEQ ID NO: 1354126 - RNA, 15 nt, Homo sapiens
guguuugaacagggc

SEQ ID NO: 1354127 - RNA, 22 nt, Homo sapiens
guguuuuuaauaaagacagggu

SEQ ID NO: 1354128 - RNA, 17 nt, Homo sapiens
guuaauaaaccuuugca

SEQ ID NO: 1354129 - RNA, 14 nt, Homo sapiens
guuaaucugaugua

SEQ ID NO: 1354130 - RNA, 16 nt, Homo sapiens
guuaaucugauguaua

SEQ ID NO: 1354131 - RNA, 22 nt, Homo sapiens
guuaauguuugcauuuccucag

SEQ ID NO: 1354132 - RNA, 20 nt, Homo sapiens
guuaauuuuuccaacuacua

SEQ ID NO: 1354133 - RNA, 13 nt, Homo sapiens
guuacagaccuca

SEQ ID NO: 1354134 - RNA, 22 nt, Homo sapiens
guuacauuaaaauaaaccaaau

SEQ ID NO: 1354135 - RNA, 20 nt, Homo sapiens
guuacucuguaaaugaaaaa

SEQ ID NO: 1354136 - RNA, 15 nt, Homo sapiens
guuauaaaagcaaua

SEQ ID NO: 1354137 - RNA, 15 nt, Homo sapiens
guuauaaaccaauga

SEQ ID NO: 1354138 - RNA, 22 nt, Homo sapiens
guuauauuacuugccuaucuga

SEQ ID NO: 1354139 - RNA, 15 nt, Homo sapiens
guuaugacuauguaa

SEQ ID NO: 1354140 - RNA, 17 nt, Homo sapiens
guuaugcagugaacuau

SEQ ID NO: 1354141 - RNA, 12 nt, Homo sapiens
guuauuugcucu

SEQ ID NO: 1354142 - RNA, 17 nt, Homo sapiens
guucaaaaacaagacag

SEQ ID NO: 1354143 - RNA, 18 nt, Homo sapiens
guucaaaaccuugcacag

SEQ ID NO: 1354144 - RNA, 21 nt, Homo sapiens
guucaaaagaacaucaacgug

SEQ ID NO: 1354145 - RNA, 15 nt, Homo sapiens
guucagacacagcuc

SEQ ID NO: 1354146 - RNA, 13 nt, Homo sapiens
guuccauaugggu

SEQ ID NO: 1354147 - RNA, 16 nt, Homo sapiens
guucccaauacaaaaa

SEQ ID NO: 1354148 - RNA, 13 nt, Homo sapiens
guuccccucugcu

SEQ ID NO: 1354149 - RNA, 17 nt, Homo sapiens
guuccgcccgcccuccc

SEQ ID NO: 1354150 - RNA, 20 nt, Homo sapiens
guuccggggagaaacccaga

SEQ ID NO: 1354151 - RNA, 20 nt, Homo sapiens
guuccucaucugagaggcuc

SEQ ID NO: 1354152 - RNA, 21 nt, Homo sapiens
guuccugugugacccugggca

SEQ ID NO: 1354153 - RNA, 20 nt, Homo sapiens
guuccuuaccucccuggucc

SEQ ID NO: 1354154 - RNA, 20 nt, Homo sapiens
guuccuuuuaacggaugguu

SEQ ID NO: 1354155 - RNA, 12 nt, Homo sapiens
guucgugcugug

SEQ ID NO: 1354156 - RNA, 16 nt, Homo sapiens
guucguggagucucau

SEQ ID NO: 1354157 - RNA, 16 nt, Homo sapiens
guucuaacauguaauu

SEQ ID NO: 1354158 - RNA, 22 nt, Homo sapiens
guucuacugagaaaagccucuc

SEQ ID NO: 1354159 - RNA, 14 nt, Homo sapiens
guucucauaacucu

SEQ ID NO: 1354160 - RNA, 18 nt, Homo sapiens
guucucauaacucuguga

SEQ ID NO: 1354161 - RNA, 14 nt, Homo sapiens
guucucccaaagau

SEQ ID NO: 1354162 - RNA, 20 nt, Homo sapiens
guucucuucuuuaaagggau

SEQ ID NO: 1354163 - RNA, 21 nt, Homo sapiens
guucuggauaccauuauaugu

SEQ ID NO: 1354164 - RNA, 16 nt, Homo sapiens
guucuguuucaaugua

SEQ ID NO: 1354165 - RNA, 11 nt, Homo sapiens
guucuuaccug

SEQ ID NO: 1354166 - RNA, 12 nt, Homo sapiens
guucuuuccucc

SEQ ID NO: 1354167 - RNA, 14 nt, Homo sapiens
guucuuugggccag

SEQ ID NO: 1354168 - RNA, 16 nt, Homo sapiens
guucuuugggccagac

SEQ ID NO: 1354169 - RNA, 14 nt, Homo sapiens
guugaaaacccaga

SEQ ID NO: 1354170 - RNA, 18 nt, Homo sapiens
guugaagaucgugaugcu

SEQ ID NO: 1354171 - RNA, 13 nt, Homo sapiens
guugauucuugcc

SEQ ID NO: 1354172 - RNA, 13 nt, Homo sapiens
guugcacuggcca

SEQ ID NO: 1354173 - RNA, 13 nt, Homo sapiens
guugcaguaguau

SEQ ID NO: 1354174 - RNA, 21 nt, Homo sapiens
guugcauauaccaguugugau

SEQ ID NO: 1354175 - RNA, 17 nt, Homo sapiens
guugccauggauucacc

SEQ ID NO: 1354176 - RNA, 14 nt, Homo sapiens
guugcuauacaugu

SEQ ID NO: 1354177 - RNA, 16 nt, Homo sapiens
guugcuauagugacau

SEQ ID NO: 1354178 - RNA, 13 nt, Homo sapiens
guuggaacauccu

SEQ ID NO: 1354179 - RNA, 20 nt, Homo sapiens
guuggucugccuucugcuga

SEQ ID NO: 1354180 - RNA, 12 nt, Homo sapiens
guuggugugaau

SEQ ID NO: 1354181 - RNA, 22 nt, Homo sapiens
guuguaaaaagcccagcacuug

SEQ ID NO: 1354182 - RNA, 23 nt, Homo sapiens
guuguaaaaagcccagcacuuga

SEQ ID NO: 1354183 - RNA, 23 nt, Homo sapiens
guuguucucuucuuuaaagggau

SEQ ID NO: 1354184 - RNA, 20 nt, Homo sapiens
guuuaaacaaaaaacccaca

SEQ ID NO: 1354185 - RNA, 14 nt, Homo sapiens
guuuaacugcugca

SEQ ID NO: 1354186 - RNA, 19 nt, Homo sapiens
guuuaccuuguauacugua

SEQ ID NO: 1354187 - RNA, 13 nt, Homo sapiens
guuuauauggaua

SEQ ID NO: 1354188 - RNA, 13 nt, Homo sapiens
guuuaugaaugac

SEQ ID NO: 1354189 - RNA, 22 nt, Homo sapiens
guuuauguaacuuccuguggau

SEQ ID NO: 1354190 - RNA, 14 nt, Homo sapiens
guuuauugaauuca

SEQ ID NO: 1354191 - RNA, 15 nt, Homo sapiens
guuuauugauauuca

SEQ ID NO: 1354192 - RNA, 15 nt, Homo sapiens
guuuauuugcacuau

SEQ ID NO: 1354193 - RNA, 19 nt, Homo sapiens
guuucaccguguuagccag

SEQ ID NO: 1354194 - RNA, 20 nt, Homo sapiens
guuucauuuagucaugugac

SEQ ID NO: 1354195 - RNA, 15 nt, Homo sapiens
uaaugucucuucuaa

SEQ ID NO: 1354196 - RNA, 19 nt, Homo sapiens
uaaugugguguuacuguag

SEQ ID NO: 1354197 - RNA, 15 nt, Homo sapiens
uaauguuauuuuccu

SEQ ID NO: 1354198 - RNA, 14 nt, Homo sapiens
uaauuacaaacaau

SEQ ID NO: 1354199 - RNA, 15 nt, Homo sapiens
uaauucauugugauu

SEQ ID NO: 1354200 - RNA, 17 nt, Homo sapiens
uaauucauugugauuua

SEQ ID NO: 1354201 - RNA, 23 nt, Homo sapiens
uaauuccacacccucacugcugu

SEQ ID NO: 1354202 - RNA, 16 nt, Homo sapiens
uaauucggauuugcca

SEQ ID NO: 1354203 - RNA, 14 nt, Homo sapiens
uaauucuggagaua

SEQ ID NO: 1354204 - RNA, 18 nt, Homo sapiens
uaauugcuuugagcacaa

SEQ ID NO: 1354205 - RNA, 15 nt, Homo sapiens
uaauuggaagugcag

SEQ ID NO: 1354206 - RNA, 17 nt, Homo sapiens
uaauuuaaauagcauua

SEQ ID NO: 1354207 - RNA, 19 nt, Homo sapiens
uaauuuaaauagcauuauc

SEQ ID NO: 1354208 - RNA, 18 nt, Homo sapiens
uaauuuuguaauguauca

SEQ ID NO: 1354209 - RNA, 21 nt, Homo sapiens
uacaaaaauaccuacugcuga

SEQ ID NO: 1354210 - RNA, 15 nt, Homo sapiens
uacaaagaacucuca

SEQ ID NO: 1354211 - RNA, 11 nt, Homo sapiens
uacaaccagcc

SEQ ID NO: 1354212 - RNA, 14 nt, Homo sapiens
uacaaccagcccaa

SEQ ID NO: 1354213 - RNA, 20 nt, Homo sapiens
uacaacgccgagugcacugc

SEQ ID NO: 1354214 - RNA, 23 nt, Homo sapiens
uacaauaaauuuuuuuuggucaa

SEQ ID NO: 1354215 - RNA, 16 nt, Homo sapiens
uacaaucagcccagug

SEQ ID NO: 1354216 - RNA, 20 nt, Homo sapiens
uacaaucagcccagugcaaa

SEQ ID NO: 1354217 - RNA, 14 nt, Homo sapiens
uacaauuuaaugca

SEQ ID NO: 1354218 - RNA, 20 nt, Homo sapiens
uacacaucacacccauuuaa

SEQ ID NO: 1354219 - RNA, 15 nt, Homo sapiens
uacacaugugcacac

SEQ ID NO: 1354220 - RNA, 12 nt, Homo sapiens
uacacauuccau

SEQ ID NO: 1354221 - RNA, 18 nt, Homo sapiens
uacaccucgucaagagca

SEQ ID NO: 1354222 - RNA, 13 nt, Homo sapiens
uacagacaucuaa

SEQ ID NO: 1354223 - RNA, 15 nt, Homo sapiens
uacagacauggaaca

SEQ ID NO: 1354224 - RNA, 13 nt, Homo sapiens
uacagagaagauu

SEQ ID NO: 1354225 - RNA, 15 nt, Homo sapiens
uacagguuaagacaa

SEQ ID NO: 1354226 - RNA, 21 nt, Homo sapiens
uacagguuacgugagaacaau

SEQ ID NO: 1354227 - RNA, 15 nt, Homo sapiens
uacagguuugcauuu

SEQ ID NO: 1354228 - RNA, 18 nt, Homo sapiens
uacauaucaaaacauccc

SEQ ID NO: 1354229 - RNA, 13 nt, Homo sapiens
uacauaugugcug

SEQ ID NO: 1354230 - RNA, 13 nt, Homo sapiens
uacauauuaucuc

SEQ ID NO: 1354231 - RNA, 12 nt, Homo sapiens
uacaugcaauuu

SEQ ID NO: 1354232 - RNA, 14 nt, Homo sapiens
uacaugcauauaau

SEQ ID NO: 1354233 - RNA, 14 nt, Homo sapiens
uacauguauugcac

SEQ ID NO: 1354234 - RNA, 16 nt, Homo sapiens
uacauuagugauucca

SEQ ID NO: 1354235 - RNA, 16 nt, Homo sapiens
uacauuaucucacuua

SEQ ID NO: 1354236 - RNA, 12 nt, Homo sapiens
uacauucacuuc

SEQ ID NO: 1354237 - RNA, 12 nt, Homo sapiens
uacauucacuuu

SEQ ID NO: 1354238 - RNA, 21 nt, Homo sapiens
uacauucccaagguuacuuaa

SEQ ID NO: 1354239 - RNA, 16 nt, Homo sapiens
uacauugaaaacaaca

SEQ ID NO: 1354240 - RNA, 19 nt, Homo sapiens
uacauuuaauaauaucaaa

SEQ ID NO: 1354241 - RNA, 15 nt, Homo sapiens
uacauuuguauuuau

SEQ ID NO: 1354242 - RNA, 18 nt, Homo sapiens
uaccaaaucugacauauu

SEQ ID NO: 1354243 - RNA, 18 nt, Homo sapiens
uaccacagcuauuuagaa

SEQ ID NO: 1354244 - RNA, 18 nt, Homo sapiens
uaccaccuaauguuuaua

SEQ ID NO: 1354245 - RNA, 21 nt, Homo sapiens
uaccagauaacaaacacugaa

SEQ ID NO: 1354246 - RNA, 19 nt, Homo sapiens
uaccaugugaaacucuacc

SEQ ID NO: 1354247 - RNA, 20 nt, Homo sapiens
uaccauguggccauuaacaa

SEQ ID NO: 1354248 - RNA, 22 nt, Homo sapiens
uaccauuuaauggggaggacaa

SEQ ID NO: 1354249 - RNA, 21 nt, Homo sapiens
uacccagacugguuugggcaa

SEQ ID NO: 1354250 - RNA, 12 nt, Homo sapiens
uacccucccacc

SEQ ID NO: 1354251 - RNA, 15 nt, Homo sapiens
uacccucccaccaga

SEQ ID NO: 1354252 - RNA, 18 nt, Homo sapiens
uaccgcuggcccugccgu

SEQ ID NO: 1354253 - RNA, 13 nt, Homo sapiens
uaccuacugcuga

SEQ ID NO: 1354254 - RNA, 14 nt, Homo sapiens
uaccuacugcugag

SEQ ID NO: 1354255 - RNA, 15 nt, Homo sapiens
uaccuauucugaaaa

SEQ ID NO: 1354256 - RNA, 20 nt, Homo sapiens
uaccucaaccaaugccaaaa

SEQ ID NO: 1354257 - RNA, 20 nt, Homo sapiens
uaccuccuuguguugcacug

SEQ ID NO: 1354258 - RNA, 19 nt, Homo sapiens
uaccucugaucaaguauuu

SEQ ID NO: 1354259 - RNA, 19 nt, Homo sapiens
uaccucuuggcugccuugu

SEQ ID NO: 1354260 - RNA, 19 nt, Homo sapiens
uaccuggcccugugccuug

SEQ ID NO: 1354261 - RNA, 20 nt, Homo sapiens
uaccuggcccugugccuugg

SEQ ID NO: 1354262 - RNA, 15 nt, Homo sapiens
uaccugugacucuua

SEQ ID NO: 1354263 - RNA, 16 nt, Homo sapiens
uaccuucuauguauua

SEQ ID NO: 1354264 - RNA, 23 nt, Homo sapiens
uaccuuuaucuuucaccuuucua

SEQ ID NO: 1354265 - RNA, 15 nt, Homo sapiens
uacuaaaaauugugg

SEQ ID NO: 1354266 - RNA, 14 nt, Homo sapiens
uacuaaaacauaca

SEQ ID NO: 1354267 - RNA, 14 nt, Homo sapiens
uacuaaucauguga

SEQ ID NO: 1354268 - RNA, 17 nt, Homo sapiens
uacuagucaccagagac

SEQ ID NO: 1354269 - RNA, 16 nt, Homo sapiens
uacuauaguaccagua

SEQ ID NO: 1354270 - RNA, 19 nt, Homo sapiens
uacuauggagugcucacaa

SEQ ID NO: 1354271 - RNA, 13 nt, Homo sapiens
uacuauguacugc

SEQ ID NO: 1354272 - RNA, 14 nt, Homo sapiens
uacuauguacugcc

SEQ ID NO: 1354273 - RNA, 16 nt, Homo sapiens
uacuauguacugccuu

SEQ ID NO: 1354274 - RNA, 17 nt, Homo sapiens
uacuauguacugccuua

SEQ ID NO: 1354275 - RNA, 16 nt, Homo sapiens
uacuauuuuuacuaau

SEQ ID NO: 1354276 - RNA, 17 nt, Homo sapiens
uacuccaagaauggagg

SEQ ID NO: 1354277 - RNA, 12 nt, Homo sapiens
uacucugugaaa

SEQ ID NO: 1354278 - RNA, 15 nt, Homo sapiens
uacucuuauucuugg

SEQ ID NO: 1354279 - RNA, 15 nt, Homo sapiens
uacugaugacagugu

SEQ ID NO: 1354280 - RNA, 15 nt, Homo sapiens
uacugcgacuaaacu

SEQ ID NO: 1354281 - RNA, 19 nt, Homo sapiens
uacugcuggaguccagugc

SEQ ID NO: 1354282 - RNA, 18 nt, Homo sapiens
uacuggucuuguggaauu

SEQ ID NO: 1354283 - RNA, 19 nt, Homo sapiens
uacuguauggaaacacuga

SEQ ID NO: 1354284 - RNA, 18 nt, Homo sapiens
uacugucucuccagugaa

SEQ ID NO: 1354285 - RNA, 12 nt, Homo sapiens
uacuguuuccau

SEQ ID NO: 1354286 - RNA, 16 nt, Homo sapiens
uacuuaauaaacugug

SEQ ID NO: 1354287 - RNA, 19 nt, Homo sapiens
uacuuacaaguuucuagcu

SEQ ID NO: 1354288 - RNA, 11 nt, Homo sapiens
uacuuccacug

SEQ ID NO: 1354289 - RNA, 14 nt, Homo sapiens
uacuuccacugagg

SEQ ID NO: 1354290 - RNA, 15 nt, Homo sapiens
uacuucccucaggcc

SEQ ID NO: 1354291 - RNA, 20 nt, Homo sapiens
uacuucucuuguuagguaau

SEQ ID NO: 1354292 - RNA, 14 nt, Homo sapiens
uacuugaaggucua

SEQ ID NO: 1354293 - RNA, 16 nt, Homo sapiens
uacuuggaacuaggcu

SEQ ID NO: 1354294 - RNA, 12 nt, Homo sapiens
uacuuuaccucc

SEQ ID NO: 1354295 - RNA, 14 nt, Homo sapiens
uacuuucuaucuca

SEQ ID NO: 1354296 - RNA, 14 nt, Homo sapiens
uagaaacacugcaa

SEQ ID NO: 1354297 - RNA, 20 nt, Homo sapiens
uagaaagaaggacccagaac

SEQ ID NO: 1354298 - RNA, 17 nt, Homo sapiens
uggaugcuuuggcaaug

SEQ ID NO: 1354299 - RNA, 16 nt, Homo sapiens
uggaugggggaacuca

SEQ ID NO: 1354300 - RNA, 23 nt, Homo sapiens
uggaugggggaacucagauccag

SEQ ID NO: 1354301 - RNA, 23 nt, Homo sapiens
uggauugugccuaauguguuuga

SEQ ID NO: 1354302 - RNA, 18 nt, Homo sapiens
uggcaaaaaggagccuuu

SEQ ID NO: 1354303 - RNA, 22 nt, Homo sapiens
uggcaaaaaggagccuuuugcu

SEQ ID NO: 1354304 - RNA, 17 nt, Homo sapiens
uggcaaagugacaaagc

SEQ ID NO: 1354305 - RNA, 18 nt, Homo sapiens
uggcaaaugccugacuca

SEQ ID NO: 1354306 - RNA, 20 nt, Homo sapiens
uggcaaaugccugacucagu

SEQ ID NO: 1354307 - RNA, 23 nt, Homo sapiens
uggcaacagaucuggaaccucag

SEQ ID NO: 1354308 - RNA, 14 nt, Homo sapiens
uggcacuaauauaa

SEQ ID NO: 1354309 - RNA, 19 nt, Homo sapiens
uggcacugguuuguucccu

SEQ ID NO: 1354310 - RNA, 19 nt, Homo sapiens
uggcagaaccaaagcucaa

SEQ ID NO: 1354311 - RNA, 23 nt, Homo sapiens
uggcagagcuuuuaccuguuauu

SEQ ID NO: 1354312 - RNA, 19 nt, Homo sapiens
uggcagaguuacaguucug

SEQ ID NO: 1354313 - RNA, 14 nt, Homo sapiens
uggcagcuuuuuca

SEQ ID NO: 1354314 - RNA, 14 nt, Homo sapiens
uggcaggauucuaa

SEQ ID NO: 1354315 - RNA, 17 nt, Homo sapiens
uggcaggggggcugugg

SEQ ID NO: 1354316 - RNA, 17 nt, Homo sapiens
uggcauaaccugucuca

SEQ ID NO: 1354317 - RNA, 14 nt, Homo sapiens
uggcaucagucaac

SEQ ID NO: 1354318 - RNA, 19 nt, Homo sapiens
uggcaugcgccaccaugcc

SEQ ID NO: 1354319 - RNA, 14 nt, Homo sapiens
uggccaacugcaaa

SEQ ID NO: 1354320 - RNA, 22 nt, Homo sapiens
uggccaacugcaaaaaaagccu

SEQ ID NO: 1354321 - RNA, 19 nt, Homo sapiens
uggccaggacccugaccuc

SEQ ID NO: 1354322 - RNA, 13 nt, Homo sapiens
uggccagugagau

SEQ ID NO: 1354323 - RNA, 21 nt, Homo sapiens
uggccagugagaucaauguga

SEQ ID NO: 1354324 - RNA, 20 nt, Homo sapiens
uggccauccuucuguguacc

SEQ ID NO: 1354325 - RNA, 13 nt, Homo sapiens
uggccaugcagaa

SEQ ID NO: 1354326 - RNA, 17 nt, Homo sapiens
uggccaugggucccauu

SEQ ID NO: 1354327 - RNA, 21 nt, Homo sapiens
uggcccccacccaguccugca

SEQ ID NO: 1354328 - RNA, 22 nt, Homo sapiens
uggccccuucuggggguggugg

SEQ ID NO: 1354329 - RNA, 15 nt, Homo sapiens
uggccucaugucaaa

SEQ ID NO: 1354330 - RNA, 19 nt, Homo sapiens
uggccuccgucacuaccug

SEQ ID NO: 1354331 - RNA, 22 nt, Homo sapiens
uggccugaagaguccucugaau

SEQ ID NO: 1354332 - RNA, 14 nt, Homo sapiens
uggccuggccauuu

SEQ ID NO: 1354333 - RNA, 23 nt, Homo sapiens
uggccuggggcaggucacuuuac

SEQ ID NO: 1354334 - RNA, 22 nt, Homo sapiens
uggccuuuagcaaaacuggaca

SEQ ID NO: 1354335 - RNA, 23 nt, Homo sapiens
uggcgccaucgccgggacuccag

SEQ ID NO: 1354336 - RNA, 22 nt, Homo sapiens
uggcgccccuuccuaggucaug

SEQ ID NO: 1354337 - RNA, 13 nt, Homo sapiens
uggcuaccuguaa

SEQ ID NO: 1354338 - RNA, 15 nt, Homo sapiens
uggcucacaccugua

SEQ ID NO: 1354339 - RNA, 14 nt, Homo sapiens
uggcuccacuggga

SEQ ID NO: 1354340 - RNA, 23 nt, Homo sapiens
uggcucuggugugaaguuugcuu

SEQ ID NO: 1354341 - RNA, 21 nt, Homo sapiens
uggcugggaauaagugccagg

SEQ ID NO: 1354342 - RNA, 15 nt, Homo sapiens
uggcugggccuucac

SEQ ID NO: 1354343 - RNA, 14 nt, Homo sapiens
uggcuuaaagggau

SEQ ID NO: 1354344 - RNA, 13 nt, Homo sapiens
uggcuucucacgg

SEQ ID NO: 1354345 - RNA, 14 nt, Homo sapiens
uggcuuguauccuu

SEQ ID NO: 1354346 - RNA, 22 nt, Homo sapiens
uggcuuuaugcaaauacaauca

SEQ ID NO: 1354347 - RNA, 21 nt, Homo sapiens
uggcuuuuccuggacagcuag

SEQ ID NO: 1354348 - RNA, 11 nt, Homo sapiens
ugggaaaaccu

SEQ ID NO: 1354349 - RNA, 17 nt, Homo sapiens
ugggaacacaucuggcu

SEQ ID NO: 1354350 - RNA, 19 nt, Homo sapiens
ugggaagaaagauucaauu

SEQ ID NO: 1354351 - RNA, 22 nt, Homo sapiens
ugggacacuccgucugcuccaa

SEQ ID NO: 1354352 - RNA, 14 nt, Homo sapiens
ugggacagccauuu

SEQ ID NO: 1354353 - RNA, 15 nt, Homo sapiens
ugggacauugcaauu

SEQ ID NO: 1354354 - RNA, 15 nt, Homo sapiens
ugggaccgugcccac

SEQ ID NO: 1354355 - RNA, 19 nt, Homo sapiens
ugggagaguaaaccuugaa

SEQ ID NO: 1354356 - RNA, 21 nt, Homo sapiens
ugggagauuuggaauacacau

SEQ ID NO: 1354357 - RNA, 19 nt, Homo sapiens
ugggagcacggacugucag

SEQ ID NO: 1354358 - RNA, 15 nt, Homo sapiens
ugggauuacagggau

SEQ ID NO: 1354359 - RNA, 19 nt, Homo sapiens
ugggauucuagaacuguga

SEQ ID NO: 1354360 - RNA, 23 nt, Homo sapiens
ugggcaaagccccucacacugca

SEQ ID NO: 1354361 - RNA, 16 nt, Homo sapiens
ugggcaauauagcaag

SEQ ID NO: 1354362 - RNA, 18 nt, Homo sapiens
ugggcaauauagcaagau

SEQ ID NO: 1354363 - RNA, 14 nt, Homo sapiens
ugggcagaucuccc

SEQ ID NO: 1354364 - RNA, 22 nt, Homo sapiens
ugggcagaucucccacaugcca

SEQ ID NO: 1354365 - RNA, 17 nt, Homo sapiens
ugggcccaggacuguug

SEQ ID NO: 1354366 - RNA, 20 nt, Homo sapiens
ugggccuugcaagaugggag

SEQ ID NO: 1354367 - RNA, 17 nt, Homo sapiens
ugggcggaaguacuucc

SEQ ID NO: 1354368 - RNA, 21 nt, Homo sapiens
ugggcguuugaacucagggag

SEQ ID NO: 1354369 - RNA, 16 nt, Homo sapiens
ugggcucagacaucca

SEQ ID NO: 1354370 - RNA, 16 nt, Homo sapiens
uggggaugucucucau

SEQ ID NO: 1354371 - RNA, 15 nt, Homo sapiens
uggggauuguacacg

SEQ ID NO: 1354372 - RNA, 14 nt, Homo sapiens
uggggccagaucca

SEQ ID NO: 1354373 - RNA, 17 nt, Homo sapiens
uggggcccagacaccag

SEQ ID NO: 1354374 - RNA, 14 nt, Homo sapiens
uggggccucaggcu

SEQ ID NO: 1354375 - RNA, 23 nt, Homo sapiens
ugggggaagacuuuaaaccaccu

SEQ ID NO: 1354376 - RNA, 14 nt, Homo sapiens
ugggggaguggaau

SEQ ID NO: 1354377 - RNA, 21 nt, Homo sapiens
ugggggugccgcucucucuga

SEQ ID NO: 1354378 - RNA, 23 nt, Homo sapiens
ugggggugccgcucucucugagg

SEQ ID NO: 1354379 - RNA, 21 nt, Homo sapiens
ugggggugccgcugucucuga

SEQ ID NO: 1354380 - RNA, 22 nt, Homo sapiens
ugggggugccgcugucucugag

SEQ ID NO: 1354381 - RNA, 22 nt, Homo sapiens
ugggggugccgcuuucucugag

SEQ ID NO: 1354382 - RNA, 23 nt, Homo sapiens
ugggggugccgcuuucucugagg

SEQ ID NO: 1354383 - RNA, 15 nt, Homo sapiens
ugggggugcucucuc

SEQ ID NO: 1354384 - RNA, 13 nt, Homo sapiens
uggggucaugccc

SEQ ID NO: 1354385 - RNA, 22 nt, Homo sapiens
ugggugcuuaguaaguacuuaa

SEQ ID NO: 1354386 - RNA, 11 nt, Homo sapiens
uggguucaagc

SEQ ID NO: 1354387 - RNA, 15 nt, Homo sapiens
uggguucacucauuc

SEQ ID NO: 1354388 - RNA, 21 nt, Homo sapiens
ugguaauaaaugugacucagc

SEQ ID NO: 1354389 - RNA, 18 nt, Homo sapiens
ugguaauauugacuugua

SEQ ID NO: 1354390 - RNA, 18 nt, Homo sapiens
ugguaaucugaggcaauc

SEQ ID NO: 1354391 - RNA, 17 nt, Homo sapiens
ugguacuuguaccuccg

SEQ ID NO: 1354392 - RNA, 19 nt, Homo sapiens
ugguauuguaauaggcauu

SEQ ID NO: 1354393 - RNA, 15 nt, Homo sapiens
ugguccucaggggag

SEQ ID NO: 1354394 - RNA, 18 nt, Homo sapiens
uggucgccaauccaugcu

SEQ ID NO: 1354395 - RNA, 22 nt, Homo sapiens
uggucugucaaugagagcauaa

SEQ ID NO: 1354396 - RNA, 22 nt, Homo sapiens
uggucuguggagauggacucag

SEQ ID NO: 1354397 - RNA, 23 nt, Homo sapiens
uggucuuagagggugauggaaca

SEQ ID NO: 1354398 - RNA, 13 nt, Homo sapiens
uggugcagugugu

SEQ ID NO: 1354399 - RNA, 19 nt, Homo sapiens
ugguggguaauuguacaau

SEQ ID NO: 1354400 - RNA, 13 nt, Homo sapiens
ugguuacauauca

SEQ ID NO: 1354401 - RNA, 14 nt, Homo sapiens
ugguuagaaguaag

SEQ ID NO: 1354402 - RNA, 23 nt, Homo sapiens
ugguuccaguaaggauuuuuaug

SEQ ID NO: 1354403 - RNA, 16 nt, Homo sapiens
ugguucccugcugcgc

SEQ ID NO: 1354404 - RNA, 14 nt, Homo sapiens
ugguucuauaugaa

SEQ ID NO: 1354405 - RNA, 12 nt, Homo sapiens
ugguucuuucau

SEQ ID NO: 1354406 - RNA, 20 nt, Homo sapiens
ugguuuuucuuuucuuuauu

SEQ ID NO: 1354407 - RNA, 13 nt, Homo sapiens
uguaaaaauguua

SEQ ID NO: 1354408 - RNA, 13 nt, Homo sapiens
uguaaaagcacau

SEQ ID NO: 1354409 - RNA, 23 nt, Homo sapiens
uguaacagcggcaggguguccca

SEQ ID NO: 1354410 - RNA, 15 nt, Homo sapiens
uguaacuuacugcga

SEQ ID NO: 1354411 - RNA, 23 nt, Homo sapiens
uguaacuugaagguggcuacaaa

SEQ ID NO: 1354412 - RNA, 17 nt, Homo sapiens
uguaagguacuuucaua

SEQ ID NO: 1354413 - RNA, 19 nt, Homo sapiens
uguaaucccagcacuuugg

SEQ ID NO: 1354414 - RNA, 17 nt, Homo sapiens
uguaaucucagcacuuu

SEQ ID NO: 1354415 - RNA, 17 nt, Homo sapiens
uguaauuauaucuaaaa

SEQ ID NO: 1354416 - RNA, 17 nt, Homo sapiens
uguaauuucugccaaua

SEQ ID NO: 1354417 - RNA, 20 nt, Homo sapiens
uguacauuuaauaauaucaa

SEQ ID NO: 1354418 - RNA, 15 nt, Homo sapiens
uguaccaaugaugaa

SEQ ID NO: 1354419 - RNA, 20 nt, Homo sapiens
uguaccaccaacuacuaccu

SEQ ID NO: 1354420 - RNA, 15 nt, Homo sapiens
uguaccucaaucuau

SEQ ID NO: 1354421 - RNA, 13 nt, Homo sapiens
uguaccucagugg

SEQ ID NO: 1354422 - RNA, 19 nt, Homo sapiens
uguaccucauggaugcuuu

SEQ ID NO: 1354423 - RNA, 22 nt, Homo sapiens
uguacuaacccagucuuucuuc

SEQ ID NO: 1354424 - RNA, 17 nt, Homo sapiens
uguacucuuauucuugg

SEQ ID NO: 1354425 - RNA, 15 nt, Homo sapiens
uguacugagcacuga

SEQ ID NO: 1354426 - RNA, 19 nt, Homo sapiens
uguacugccuuaaauguac

SEQ ID NO: 1354427 - RNA, 13 nt, Homo sapiens
uguacugccuuag

SEQ ID NO: 1354428 - RNA, 20 nt, Homo sapiens
uguagaaaauaaaacugagc

SEQ ID NO: 1354429 - RNA, 19 nt, Homo sapiens
uguagauuuucuacaggaa

SEQ ID NO: 1354430 - RNA, 13 nt, Homo sapiens
uguagcauauaaa

SEQ ID NO: 1354431 - RNA, 18 nt, Homo sapiens
uucauggugcacugagcu

SEQ ID NO: 1354432 - RNA, 20 nt, Homo sapiens
uucauguaaaaagugcagua

SEQ ID NO: 1354433 - RNA, 21 nt, Homo sapiens
uucauuaucucaaaacugcac

SEQ ID NO: 1354434 - RNA, 19 nt, Homo sapiens
uucauucuuuuugaaaugu

SEQ ID NO: 1354435 - RNA, 23 nt, Homo sapiens
uucauuggacccugacuguauac

SEQ ID NO: 1354436 - RNA, 15 nt, Homo sapiens
uucauuguucuuggc

SEQ ID NO: 1354437 - RNA, 21 nt, Homo sapiens
uucauuucacuguagcucuaa

SEQ ID NO: 1354438 - RNA, 19 nt, Homo sapiens
uucauuuccuuguccugcu

SEQ ID NO: 1354439 - RNA, 15 nt, Homo sapiens
uucauuugcuugcaa

SEQ ID NO: 1354440 - RNA, 15 nt, Homo sapiens
uuccaaaacauuucu

SEQ ID NO: 1354441 - RNA, 18 nt, Homo sapiens
uuccaaguucucaccucu

SEQ ID NO: 1354442 - RNA, 17 nt, Homo sapiens
uuccacaaguuaaauaa

SEQ ID NO: 1354443 - RNA, 20 nt, Homo sapiens
uuccacccacaaacuccagg

SEQ ID NO: 1354444 - RNA, 12 nt, Homo sapiens
uuccaccucacc

SEQ ID NO: 1354445 - RNA, 23 nt, Homo sapiens
uuccacuggaacguuucacugca

SEQ ID NO: 1354446 - RNA, 13 nt, Homo sapiens
uuccagccuucua

SEQ ID NO: 1354447 - RNA, 14 nt, Homo sapiens
uuccaguacuaugg

SEQ ID NO: 1354448 - RNA, 22 nt, Homo sapiens
uuccaguacuauggagugcuca

SEQ ID NO: 1354449 - RNA, 15 nt, Homo sapiens
uuccaguauugaaaa

SEQ ID NO: 1354450 - RNA, 20 nt, Homo sapiens
uuccagugucugucauuuca

SEQ ID NO: 1354451 - RNA, 14 nt, Homo sapiens
uuccauauggguag

SEQ ID NO: 1354452 - RNA, 23 nt, Homo sapiens
uuccaugucgccucugcauucag

SEQ ID NO: 1354453 - RNA, 13 nt, Homo sapiens
uuccaugugccuu

SEQ ID NO: 1354454 - RNA, 13 nt, Homo sapiens
uuccauugauuca

SEQ ID NO: 1354455 - RNA, 18 nt, Homo sapiens
uucccaaauuucauaccu

SEQ ID NO: 1354456 - RNA, 23 nt, Homo sapiens
uucccaauagcaaggcugugcau

SEQ ID NO: 1354457 - RNA, 16 nt, Homo sapiens
uucccaauugacaagu

SEQ ID NO: 1354458 - RNA, 17 nt, Homo sapiens
uucccauucuacauacu

SEQ ID NO: 1354459 - RNA, 15 nt, Homo sapiens
uuccccacaaaacaa

SEQ ID NO: 1354460 - RNA, 20 nt, Homo sapiens
uuccccuccuuggcuuuaug

SEQ ID NO: 1354461 - RNA, 14 nt, Homo sapiens
uucccuaaacugca

SEQ ID NO: 1354462 - RNA, 19 nt, Homo sapiens
uucccuacuuccugugacu

SEQ ID NO: 1354463 - RNA, 19 nt, Homo sapiens
uucccuccgcaucccguca

SEQ ID NO: 1354464 - RNA, 14 nt, Homo sapiens
uucccuguucuccc

SEQ ID NO: 1354465 - RNA, 17 nt, Homo sapiens
uucccuuucacuggcau

SEQ ID NO: 1354466 - RNA, 22 nt, Homo sapiens
uuccuauuaauaacagguuuaa

SEQ ID NO: 1354467 - RNA, 13 nt, Homo sapiens
uuccucgcauuaa

SEQ ID NO: 1354468 - RNA, 12 nt, Homo sapiens
uuccucuguaua

SEQ ID NO: 1354469 - RNA, 15 nt, Homo sapiens
uuccugaagcugcug

SEQ ID NO: 1354470 - RNA, 22 nt, Homo sapiens
uuccugagggcuaauucuggga

SEQ ID NO: 1354471 - RNA, 15 nt, Homo sapiens
uuccugauaaacaga

SEQ ID NO: 1354472 - RNA, 18 nt, Homo sapiens
uuccugcaucucugugaa

SEQ ID NO: 1354473 - RNA, 15 nt, Homo sapiens
uuccuggaaacagca

SEQ ID NO: 1354474 - RNA, 16 nt, Homo sapiens
uuccuggcagcugcug

SEQ ID NO: 1354475 - RNA, 16 nt, Homo sapiens
uuccuggugacuccug

SEQ ID NO: 1354476 - RNA, 11 nt, Homo sapiens
uuccugugauu

SEQ ID NO: 1354477 - RNA, 13 nt, Homo sapiens
uuccuguugucaa

SEQ ID NO: 1354478 - RNA, 15 nt, Homo sapiens
gaggacucacuugcc

SEQ ID NO: 1354479 - RNA, 16 nt, Homo sapiens
gaggagaagcaauggg

SEQ ID NO: 1354480 - RNA, 20 nt, Homo sapiens
gaggagauaagguggcuucu

SEQ ID NO: 1354481 - RNA, 21 nt, Homo sapiens
gaggcaacccgugcucagcug

SEQ ID NO: 1354482 - RNA, 20 nt, Homo sapiens
gaggcaggagaaucgcuuga

SEQ ID NO: 1354483 - RNA, 17 nt, Homo sapiens
gaggcauagucaccuag

SEQ ID NO: 1354484 - RNA, 11 nt, Homo sapiens
gaggcaucuga

SEQ ID NO: 1354485 - RNA, 21 nt, Homo sapiens
gaggccacauugcuggcugcc

SEQ ID NO: 1354486 - RNA, 16 nt, Homo sapiens
gaggccucucauucca

SEQ ID NO: 1354487 - RNA, 22 nt, Homo sapiens
gaggcuucuccuucuccuuccc

SEQ ID NO: 1354488 - RNA, 18 nt, Homo sapiens
gagggaccucucccaggg

SEQ ID NO: 1354489 - RNA, 15 nt, Homo sapiens
gagggccaccggugg

SEQ ID NO: 1354490 - RNA, 16 nt, Homo sapiens
gagggcccagcccaga

SEQ ID NO: 1354491 - RNA, 17 nt, Homo sapiens
gagggccccgcccagug

SEQ ID NO: 1354492 - RNA, 19 nt, Homo sapiens
gagggccgugagggguccc

SEQ ID NO: 1354493 - RNA, 16 nt, Homo sapiens
gagggcucagggcagu

SEQ ID NO: 1354494 - RNA, 19 nt, Homo sapiens
gagggcugcugaccauuug

SEQ ID NO: 1354495 - RNA, 17 nt, Homo sapiens
gagggggaguagccaag

SEQ ID NO: 1354496 - RNA, 14 nt, Homo sapiens
gaggguacuugaau

SEQ ID NO: 1354497 - RNA, 20 nt, Homo sapiens
gagguggggcuggaugucuc

SEQ ID NO: 1354498 - RNA, 15 nt, Homo sapiens
gaguaaaccuugaag

SEQ ID NO: 1354499 - RNA, 24 nt, Homo sapiens
gaguaggugggggaacacugagaa

SEQ ID NO: 1354500 - RNA, 12 nt, Homo sapiens
gaguauccucuu

SEQ ID NO: 1354501 - RNA, 16 nt, Homo sapiens
gaguauccucuugcca

SEQ ID NO: 1354502 - RNA, 13 nt, Homo sapiens
gagucaaauccag

SEQ ID NO: 1354503 - RNA, 17 nt, Homo sapiens
gagucagugccaggucc

SEQ ID NO: 1354504 - RNA, 14 nt, Homo sapiens
gaguccacucccag

SEQ ID NO: 1354505 - RNA, 17 nt, Homo sapiens
gaguccccccacuccca

SEQ ID NO: 1354506 - RNA, 14 nt, Homo sapiens
gagucuacagagaa

SEQ ID NO: 1354507 - RNA, 17 nt, Homo sapiens
gagucucuucuccacug

SEQ ID NO: 1354508 - RNA, 18 nt, Homo sapiens
gagucucuucuccacugg

SEQ ID NO: 1354509 - RNA, 19 nt, Homo sapiens
gagugaaacuccgucucaa

SEQ ID NO: 1354510 - RNA, 18 nt, Homo sapiens
gagugaaggggccaagga

SEQ ID NO: 1354511 - RNA, 19 nt, Homo sapiens
gagugcaauggugcaauca

SEQ ID NO: 1354512 - RNA, 23 nt, Homo sapiens
gagugccuuuucgagacuggcag

SEQ ID NO: 1354513 - RNA, 15 nt, Homo sapiens
gaguggaaauacacu

SEQ ID NO: 1354514 - RNA, 14 nt, Homo sapiens
gaguggggaugaca

SEQ ID NO: 1354515 - RNA, 15 nt, Homo sapiens
gaguggucacuguca

SEQ ID NO: 1354516 - RNA, 12 nt, Homo sapiens
gaguguagccua

SEQ ID NO: 1354517 - RNA, 13 nt, Homo sapiens
gaguguguggucu

SEQ ID NO: 1354518 - RNA, 22 nt, Homo sapiens
gaguugcagccagggccagugg

SEQ ID NO: 1354519 - RNA, 23 nt, Homo sapiens
gaguuguucaaauguuccuuuua

SEQ ID NO: 1354520 - RNA, 19 nt, Homo sapiens
gaguuucacaaauccuuca

SEQ ID NO: 1354521 - RNA, 13 nt, Homo sapiens
gauaaaaaucaua

SEQ ID NO: 1354522 - RNA, 19 nt, Homo sapiens
gauaaaacacuaacuuaau

SEQ ID NO: 1354523 - RNA, 17 nt, Homo sapiens
gauaaaugauagacaau

SEQ ID NO: 1354524 - RNA, 12 nt, Homo sapiens
gauaacauggaa

SEQ ID NO: 1354525 - RNA, 14 nt, Homo sapiens
gauaauaauggguu

SEQ ID NO: 1354526 - RNA, 19 nt, Homo sapiens
gauacaggugacagugaag

SEQ ID NO: 1354527 - RNA, 20 nt, Homo sapiens
gauacagugucugacuauaa

SEQ ID NO: 1354528 - RNA, 20 nt, Homo sapiens
gauacuaacauuuucauuga

SEQ ID NO: 1354529 - RNA, 12 nt, Homo sapiens
gauacugucucu

SEQ ID NO: 1354530 - RNA, 21 nt, Homo sapiens
gauacugucucuccagugaaa

SEQ ID NO: 1354531 - RNA, 15 nt, Homo sapiens
gauacuuuuacaggu

SEQ ID NO: 1354532 - RNA, 13 nt, Homo sapiens
gauagagugcagu

SEQ ID NO: 1354533 - RNA, 19 nt, Homo sapiens
gauagggagcagaugcaau

SEQ ID NO: 1354534 - RNA, 23 nt, Homo sapiens
gauaguggggagacuucuuggcu

SEQ ID NO: 1354535 - RNA, 19 nt, Homo sapiens
gauauacuugguucucucc

SEQ ID NO: 1354536 - RNA, 20 nt, Homo sapiens
gauauauuuaagccuuauaa

SEQ ID NO: 1354537 - RNA, 13 nt, Homo sapiens
gauaucacuucca

SEQ ID NO: 1354538 - RNA, 21 nt, Homo sapiens
gauaucacuuccaugacauaa

SEQ ID NO: 1354539 - RNA, 18 nt, Homo sapiens
gauauccucccuccagau

SEQ ID NO: 1354540 - RNA, 12 nt, Homo sapiens
gauaucuacugu

SEQ ID NO: 1354541 - RNA, 18 nt, Homo sapiens
gauaucugcagggacaga

SEQ ID NO: 1354542 - RNA, 19 nt, Homo sapiens
gauaugaagaaucugcucu

SEQ ID NO: 1354543 - RNA, 19 nt, Homo sapiens
gauauucucuagucauuug

SEQ ID NO: 1354544 - RNA, 17 nt, Homo sapiens
gauauugauuacuauca

SEQ ID NO: 1354545 - RNA, 13 nt, Homo sapiens
gauauuguuauau

SEQ ID NO: 1354546 - RNA, 14 nt, Homo sapiens
gaucaacucugucu

SEQ ID NO: 1354547 - RNA, 19 nt, Homo sapiens
gaucaacucugucuugggc

SEQ ID NO: 1354548 - RNA, 19 nt, Homo sapiens
gaucagauaauuaugcuuu

SEQ ID NO: 1354549 - RNA, 22 nt, Homo sapiens
gaucagcauuuuagaaacuaca

SEQ ID NO: 1354550 - RNA, 15 nt, Homo sapiens
gaucagcgacccuga

SEQ ID NO: 1354551 - RNA, 15 nt, Homo sapiens
gaucaguauuucacu

SEQ ID NO: 1354552 - RNA, 20 nt, Homo sapiens
gaucaucgaggagcuagaac

SEQ ID NO: 1354553 - RNA, 14 nt, Homo sapiens
gauccagcccaaac

SEQ ID NO: 1354554 - RNA, 17 nt, Homo sapiens
gaucgguucugugccuu

SEQ ID NO: 1354555 - RNA, 21 nt, Homo sapiens
gaucuauuguuuguugcacua

SEQ ID NO: 1354556 - RNA, 15 nt, Homo sapiens
gaucucaaacuugau

SEQ ID NO: 1354557 - RNA, 23 nt, Homo sapiens
gaucuggaacccagacucagaca

SEQ ID NO: 1354558 - RNA, 15 nt, Homo sapiens
gaucuucccacagga

SEQ ID NO: 1354559 - RNA, 19 nt, Homo sapiens
gaugaacgggcuggagcag

SEQ ID NO: 1354560 - RNA, 13 nt, Homo sapiens
gaugacaaccucc

SEQ ID NO: 1354561 - RNA, 16 nt, Homo sapiens
gaugagggaagcaaua

SEQ ID NO: 1354562 - RNA, 13 nt, Homo sapiens
gaugaugaucuca

SEQ ID NO: 1354563 - RNA, 18 nt, Homo sapiens
gaugcaaugacucaggac

SEQ ID NO: 1354564 - RNA, 17 nt, Homo sapiens
gaugcacaguaucugcu

SEQ ID NO: 1354565 - RNA, 17 nt, Homo sapiens
gaugcacguggggccca

SEQ ID NO: 1354566 - RNA, 15 nt, Homo sapiens
gaugcauauagacac

SEQ ID NO: 1354567 - RNA, 21 nt, Homo sapiens
gaugccacuucucacucacca

SEQ ID NO: 1354568 - RNA, 17 nt, Homo sapiens
gaugccuguguacugcc

SEQ ID NO: 1354569 - RNA, 21 nt, Homo sapiens
gaugccuguguacugccuuaa

SEQ ID NO: 1354570 - RNA, 13 nt, Homo sapiens
gauggaagcuugu

SEQ ID NO: 1354571 - RNA, 13 nt, Homo sapiens
gauggacucagga

SEQ ID NO: 1354572 - RNA, 22 nt, Homo sapiens
gauggacuugugauuggcugca

SEQ ID NO: 1354573 - RNA, 18 nt, Homo sapiens
gaugguaaucugaggcaa

SEQ ID NO: 1354574 - RNA, 19 nt, Homo sapiens
gaugucauggagugacaga

SEQ ID NO: 1354575 - RNA, 18 nt, Homo sapiens
gaugucugccacaccucu

SEQ ID NO: 1354576 - RNA, 17 nt, Homo sapiens
gauguggccuuuagcaa

SEQ ID NO: 1354577 - RNA, 13 nt, Homo sapiens
gauguguggacac

SEQ ID NO: 1354578 - RNA, 19 nt, Homo sapiens
gauguugcuauagugacau

SEQ ID NO: 1354579 - RNA, 18 nt, Homo sapiens
gauguugcuggacuguca

SEQ ID NO: 1354580 - RNA, 15 nt, Homo sapiens
gauuaaaaauaccuu

SEQ ID NO: 1354581 - RNA, 14 nt, Homo sapiens
gauuaaagugccca

SEQ ID NO: 1354582 - RNA, 23 nt, Homo sapiens
gauuacucuccauaucccuuccu

SEQ ID NO: 1354583 - RNA, 19 nt, Homo sapiens
gauuacuuugcugccuuaa

SEQ ID NO: 1354584 - RNA, 20 nt, Homo sapiens
gauucaagacaagagcuguu

SEQ ID NO: 1354585 - RNA, 20 nt, Homo sapiens
gauucaggggucugaugaca

SEQ ID NO: 1354586 - RNA, 23 nt, Homo sapiens
gauucccugauggaaccauaaua

SEQ ID NO: 1354587 - RNA, 15 nt, Homo sapiens
gauucugauugcuau

SEQ ID NO: 1354588 - RNA, 16 nt, Homo sapiens
gauucuucacuguguu

SEQ ID NO: 1354589 - RNA, 22 nt, Homo sapiens
gauugucaacacaaacuggcuu

SEQ ID NO: 1354590 - RNA, 20 nt, Homo sapiens
gauuuaaacucaucaaugug

SEQ ID NO: 1354591 - RNA, 23 nt, Homo sapiens
gauuuauuguuauauuacuugcc

SEQ ID NO: 1354592 - RNA, 15 nt, Homo sapiens
gauuuuacaaguaua

SEQ ID NO: 1354593 - RNA, 14 nt, Homo sapiens
gauuuuaccaaagc

SEQ ID NO: 1354594 - RNA, 23 nt, Homo sapiens
gauuuucaaccagauaacauacc

SEQ ID NO: 1354595 - RNA, 18 nt, Homo sapiens
gauuuugaagagauuuua

SEQ ID NO: 1354596 - RNA, 16 nt, Homo sapiens
gcaaaaaaaugugcau

SEQ ID NO: 1354597 - RNA, 21 nt, Homo sapiens
gcaaaaaaaugugcaugaccu

SEQ ID NO: 1354598 - RNA, 14 nt, Homo sapiens
gcaaaaaucuccca

SEQ ID NO: 1354599 - RNA, 15 nt, Homo sapiens
gcaaaacuuuacuuu

SEQ ID NO: 1354600 - RNA, 22 nt, Homo sapiens
gcaaaaggaucuuuguggccaa

SEQ ID NO: 1354601 - RNA, 18 nt, Homo sapiens
gcaaaaucuguucuaaca

SEQ ID NO: 1354602 - RNA, 23 nt, Homo sapiens
gcaaaaucuguucuaacauguaa

SEQ ID NO: 1354603 - RNA, 17 nt, Homo sapiens
gcaaacguuucuugaac

SEQ ID NO: 1354604 - RNA, 19 nt, Homo sapiens
gcaaacuccagguuccuga

SEQ ID NO: 1354605 - RNA, 17 nt, Homo sapiens
gcaaaggaaaaauugau

SEQ ID NO: 1354606 - RNA, 19 nt, Homo sapiens
gcaaaguucccuacuuccu

SEQ ID NO: 1354607 - RNA, 14 nt, Homo sapiens
gcaaauacaaucag

SEQ ID NO: 1354608 - RNA, 22 nt, Homo sapiens
gcaaauacaaucagcccagugc

SEQ ID NO: 1354609 - RNA, 18 nt, Homo sapiens
gcaaauauuuauaagcua

SEQ ID NO: 1354610 - RNA, 17 nt, Homo sapiens
gcaaauggccaaugaga

SEQ ID NO: 1354611 - RNA, 15 nt, Homo sapiens
gcaaauguacuucuc

SEQ ID NO: 1354612 - RNA, 19 nt, Homo sapiens
gcgucaugacgugcaugag

SEQ ID NO: 1354613 - RNA, 15 nt, Homo sapiens
gcguccucugacccc

SEQ ID NO: 1354614 - RNA, 12 nt, Homo sapiens
gcguccugguca

SEQ ID NO: 1354615 - RNA, 16 nt, Homo sapiens
gcgucucuaaugucug

SEQ ID NO: 1354616 - RNA, 19 nt, Homo sapiens
gcguuguugcauguuugaa

SEQ ID NO: 1354617 - RNA, 14 nt, Homo sapiens
gcuaccaguauuua

SEQ ID NO: 1354618 - RNA, 16 nt, Homo sapiens
gcuacugguuaccugg

SEQ ID NO: 1354619 - RNA, 17 nt, Homo sapiens
gcuacuguaaugcugcc

SEQ ID NO: 1354620 - RNA, 18 nt, Homo sapiens
gcuacuguaaugcugccu

SEQ ID NO: 1354621 - RNA, 15 nt, Homo sapiens
gcuagcaguacuaau

SEQ ID NO: 1354622 - RNA, 20 nt, Homo sapiens
gcuaguguuguauuucuaua

SEQ ID NO: 1354623 - RNA, 20 nt, Homo sapiens
gcuauggggauagaugugug

SEQ ID NO: 1354624 - RNA, 13 nt, Homo sapiens
gcuauugcugcug

SEQ ID NO: 1354625 - RNA, 16 nt, Homo sapiens
gcuauuuacacuauua

SEQ ID NO: 1354626 - RNA, 19 nt, Homo sapiens
gcucaaugaugcaggcaau

SEQ ID NO: 1354627 - RNA, 14 nt, Homo sapiens
gcucacaccuguaa

SEQ ID NO: 1354628 - RNA, 14 nt, Homo sapiens
gcucagaccagcuc

SEQ ID NO: 1354629 - RNA, 18 nt, Homo sapiens
gcucagauuguaauaugu

SEQ ID NO: 1354630 - RNA, 22 nt, Homo sapiens
gcucagcccugcaccaugcugc

SEQ ID NO: 1354631 - RNA, 19 nt, Homo sapiens
gcucagggaaaagcagcuc

SEQ ID NO: 1354632 - RNA, 22 nt, Homo sapiens
gcuccaaccugcaaagaucugu

SEQ ID NO: 1354633 - RNA, 20 nt, Homo sapiens
gcuccaagauguucuccuga

SEQ ID NO: 1354634 - RNA, 18 nt, Homo sapiens
gcuccagaagauagcuuc

SEQ ID NO: 1354635 - RNA, 16 nt, Homo sapiens
gcucccaaaacauuuu

SEQ ID NO: 1354636 - RNA, 17 nt, Homo sapiens
gcucccacuucuuggga

SEQ ID NO: 1354637 - RNA, 16 nt, Homo sapiens
gcuccccucacucugu

SEQ ID NO: 1354638 - RNA, 19 nt, Homo sapiens
gcucccugcucaggagcag

SEQ ID NO: 1354639 - RNA, 15 nt, Homo sapiens
gcuccgggaucagca

SEQ ID NO: 1354640 - RNA, 14 nt, Homo sapiens
gcuccuccaugccu

SEQ ID NO: 1354641 - RNA, 20 nt, Homo sapiens
gcuccucuccccagcccaga

SEQ ID NO: 1354642 - RNA, 17 nt, Homo sapiens
gcuccugccuggaagaa

SEQ ID NO: 1354643 - RNA, 22 nt, Homo sapiens
gcuccuuggcacccccaugcug

SEQ ID NO: 1354644 - RNA, 16 nt, Homo sapiens
gcucgauuccucaggg

SEQ ID NO: 1354645 - RNA, 16 nt, Homo sapiens
gcucguggacugugcu

SEQ ID NO: 1354646 - RNA, 14 nt, Homo sapiens
gcucuauacugugg

SEQ ID NO: 1354647 - RNA, 21 nt, Homo sapiens
gcucuauacuguggccugcag

SEQ ID NO: 1354648 - RNA, 13 nt, Homo sapiens
gcucucacucugu

SEQ ID NO: 1354649 - RNA, 21 nt, Homo sapiens
gcucuccccucagagugcaag

SEQ ID NO: 1354650 - RNA, 19 nt, Homo sapiens
gcucucggaggaugccuag

SEQ ID NO: 1354651 - RNA, 19 nt, Homo sapiens
gcucugagaaaccucggga

SEQ ID NO: 1354652 - RNA, 19 nt, Homo sapiens
gcucugagcaguuguuaua

SEQ ID NO: 1354653 - RNA, 20 nt, Homo sapiens
gcucugagcaguuguuauau

SEQ ID NO: 1354654 - RNA, 14 nt, Homo sapiens
gcucugcacagaca

SEQ ID NO: 1354655 - RNA, 12 nt, Homo sapiens
gcucuguggcaa

SEQ ID NO: 1354656 - RNA, 18 nt, Homo sapiens
gcucuuaugugugccuuu

SEQ ID NO: 1354657 - RNA, 20 nt, Homo sapiens
gcucuuaugugugccuuugu

SEQ ID NO: 1354658 - RNA, 19 nt, Homo sapiens
gcucuuggcuccacuggga

SEQ ID NO: 1354659 - RNA, 17 nt, Homo sapiens
gcucuuguucuacugag

SEQ ID NO: 1354660 - RNA, 15 nt, Homo sapiens
gcucuuuaccaagga

SEQ ID NO: 1354661 - RNA, 21 nt, Homo sapiens
gcugaaagacucgagaaccaa

SEQ ID NO: 1354662 - RNA, 22 nt, Homo sapiens
gcugaauuauuggacagucuca

SEQ ID NO: 1354663 - RNA, 23 nt, Homo sapiens
gcugacaugcucacacauuacaa

SEQ ID NO: 1354664 - RNA, 19 nt, Homo sapiens
gcugaccccucuggugugu

SEQ ID NO: 1354665 - RNA, 15 nt, Homo sapiens
ucaguccacugcuga

SEQ ID NO: 1354666 - RNA, 17 nt, Homo sapiens
ucagucgcuagcauuuc

SEQ ID NO: 1354667 - RNA, 13 nt, Homo sapiens
ucagugcaguuuc

SEQ ID NO: 1354668 - RNA, 14 nt, Homo sapiens
ucagugcaguuucu

SEQ ID NO: 1354669 - RNA, 15 nt, Homo sapiens
ucaguggaucuucag

SEQ ID NO: 1354670 - RNA, 16 nt, Homo sapiens
ucaguuaacuauugca

SEQ ID NO: 1354671 - RNA, 14 nt, Homo sapiens
ucaguuacuuuccc

SEQ ID NO: 1354672 - RNA, 18 nt, Homo sapiens
ucaguucuuacacauucc

SEQ ID NO: 1354673 - RNA, 21 nt, Homo sapiens
ucaguucuuacacauuccauc

SEQ ID NO: 1354674 - RNA, 22 nt, Homo sapiens
ucaguugaaaaugcaacucuaa

SEQ ID NO: 1354675 - RNA, 16 nt, Homo sapiens
ucauaaagucuugccu

SEQ ID NO: 1354676 - RNA, 16 nt, Homo sapiens
ucauaacucugugauc

SEQ ID NO: 1354677 - RNA, 16 nt, Homo sapiens
ucauaauucagcacuu

SEQ ID NO: 1354678 - RNA, 14 nt, Homo sapiens
ucauaauucugaaa

SEQ ID NO: 1354679 - RNA, 17 nt, Homo sapiens
ucauauacaauugucau

SEQ ID NO: 1354680 - RNA, 16 nt, Homo sapiens
ucauaucucuugcccu

SEQ ID NO: 1354681 - RNA, 15 nt, Homo sapiens
ucauauuuacugguc

SEQ ID NO: 1354682 - RNA, 19 nt, Homo sapiens
ucaucacagggauuuagac

SEQ ID NO: 1354683 - RNA, 20 nt, Homo sapiens
ucaucacagggauuuagacu

SEQ ID NO: 1354684 - RNA, 15 nt, Homo sapiens
ucaucaggugcauag

SEQ ID NO: 1354685 - RNA, 19 nt, Homo sapiens
ucauccauccugagccaaa

SEQ ID NO: 1354686 - RNA, 15 nt, Homo sapiens
ucaucuugcuaccag

SEQ ID NO: 1354687 - RNA, 13 nt, Homo sapiens
ucaucuuugccau

SEQ ID NO: 1354688 - RNA, 17 nt, Homo sapiens
ucaugaugguaucuaua

SEQ ID NO: 1354689 - RNA, 10 nt, Homo sapiens
ucaugcccuc

SEQ ID NO: 1354690 - RNA, 17 nt, Homo sapiens
ucaugccuguaaucuca

SEQ ID NO: 1354691 - RNA, 23 nt, Homo sapiens
ucaugccuguaaucucagcacuu

SEQ ID NO: 1354692 - RNA, 19 nt, Homo sapiens
ucauggauauuugucaaca

SEQ ID NO: 1354693 - RNA, 17 nt, Homo sapiens
ucauggggaagcuucca

SEQ ID NO: 1354694 - RNA, 11 nt, Homo sapiens
ucauguaaaaa

SEQ ID NO: 1354695 - RNA, 18 nt, Homo sapiens
ucauguaaaaagugcagu

SEQ ID NO: 1354696 - RNA, 19 nt, Homo sapiens
ucauguaaaaagugcagua

SEQ ID NO: 1354697 - RNA, 14 nt, Homo sapiens
ucauguccagugag

SEQ ID NO: 1354698 - RNA, 16 nt, Homo sapiens
ucauguccagugagca

SEQ ID NO: 1354699 - RNA, 17 nt, Homo sapiens
ucauguuaugcagugaa

SEQ ID NO: 1354700 - RNA, 19 nt, Homo sapiens
ucauguuuuuaacuuuuaa

SEQ ID NO: 1354701 - RNA, 20 nt, Homo sapiens
ucauuaauaaaaauucuuau

SEQ ID NO: 1354702 - RNA, 11 nt, Homo sapiens
ucauuaucuca

SEQ ID NO: 1354703 - RNA, 20 nt, Homo sapiens
ucauuaucucaaaacugcac

SEQ ID NO: 1354704 - RNA, 22 nt, Homo sapiens
ucauuauuuuuguuagcaaaga

SEQ ID NO: 1354705 - RNA, 13 nt, Homo sapiens
ucauucacauuca

SEQ ID NO: 1354706 - RNA, 13 nt, Homo sapiens
ucauuccaccuuc

SEQ ID NO: 1354707 - RNA, 16 nt, Homo sapiens
ucauuccaccuuccca

SEQ ID NO: 1354708 - RNA, 18 nt, Homo sapiens
ucauucugaacccuccaa

SEQ ID NO: 1354709 - RNA, 20 nt, Homo sapiens
ucauucugguucccugcugc

SEQ ID NO: 1354710 - RNA, 18 nt, Homo sapiens
ucauucuguuagauacua

SEQ ID NO: 1354711 - RNA, 19 nt, Homo sapiens
ucauugcucuguuaauaau

SEQ ID NO: 1354712 - RNA, 15 nt, Homo sapiens
ucauuggaagccauc

SEQ ID NO: 1354713 - RNA, 20 nt, Homo sapiens
ucauuggacccugacuguau

SEQ ID NO: 1354714 - RNA, 21 nt, Homo sapiens
ucauuggacccugacuguaua

SEQ ID NO: 1354715 - RNA, 13 nt, Homo sapiens
ucauuuagcauug

SEQ ID NO: 1354716 - RNA, 12 nt, Homo sapiens
ucauuuagcuuu

SEQ ID NO: 1354717 - RNA, 17 nt, Homo sapiens
ucauuuagucaugugac

SEQ ID NO: 1354718 - RNA, 19 nt, Homo sapiens
ucauuucacuguagcucua

SEQ ID NO: 1354719 - RNA, 13 nt, Homo sapiens
ucauuucagccaa

SEQ ID NO: 1354720 - RNA, 20 nt, Homo sapiens
ucauuuuaaaaaauggaaca

SEQ ID NO: 1354721 - RNA, 19 nt, Homo sapiens
ucauuuuacacaaagggaa

SEQ ID NO: 1354722 - RNA, 15 nt, Homo sapiens
ucauuuugucagcag

SEQ ID NO: 1354723 - RNA, 18 nt, Homo sapiens
uccaaaauaaagcauaaa

SEQ ID NO: 1354724 - RNA, 15 nt, Homo sapiens
uccaaacccacucau

SEQ ID NO: 1354725 - RNA, 12 nt, Homo sapiens
uccaaaccucca

SEQ ID NO: 1354726 - RNA, 16 nt, Homo sapiens
uccaaagcuguuccau

SEQ ID NO: 1354727 - RNA, 16 nt, Homo sapiens
uccaaaugaacuugca

SEQ ID NO: 1354728 - RNA, 23 nt, Homo sapiens
uccaacaugaaaacaauucuuau

SEQ ID NO: 1354729 - RNA, 17 nt, Homo sapiens
uccaaccugcaaagauc

SEQ ID NO: 1354730 - RNA, 19 nt, Homo sapiens
uccaacugggcauuucaau

SEQ ID NO: 1354731 - RNA, 14 nt, Homo sapiens
uccaagaccagaga

SEQ ID NO: 1354732 - RNA, 16 nt, Homo sapiens
uccaagauguucuccu

SEQ ID NO: 1354733 - RNA, 14 nt, Homo sapiens
uccaagcauuucau

SEQ ID NO: 1354734 - RNA, 18 nt, Homo sapiens
uccaagcauuucaugaaa

SEQ ID NO: 1354735 - RNA, 12 nt, Homo sapiens
uccaagcugugu

SEQ ID NO: 1354736 - RNA, 13 nt, Homo sapiens
uccaagcuguguu

SEQ ID NO: 1354737 - RNA, 18 nt, Homo sapiens
uccaagugccccaccacu

SEQ ID NO: 1354738 - RNA, 14 nt, Homo sapiens
uccaauauuaaaag

SEQ ID NO: 1354739 - RNA, 19 nt, Homo sapiens
uccaauuucgggagccuug

SEQ ID NO: 1354740 - RNA, 20 nt, Homo sapiens
uccacacccacccccucugg

SEQ ID NO: 1354741 - RNA, 19 nt, Homo sapiens
uccacauaacccugucacc

SEQ ID NO: 1354742 - RNA, 18 nt, Homo sapiens
uccacauauuucagugag

SEQ ID NO: 1354743 - RNA, 13 nt, Homo sapiens
uccaccacagcaa

SEQ ID NO: 1354744 - RNA, 21 nt, Homo sapiens
uccaccgaccaacugcccuaa

SEQ ID NO: 1354745 - RNA, 20 nt, Homo sapiens
uccacucuugaucucucuug

SEQ ID NO: 1354746 - RNA, 22 nt, Homo sapiens
uccacugccuccugugacguga

SEQ ID NO: 1354747 - RNA, 20 nt, Homo sapiens
uccacugcugaggacacuca

SEQ ID NO: 1354748 - RNA, 15 nt, Homo sapiens
uccacuuacauauau

SEQ ID NO: 1354749 - RNA, 20 nt, Homo sapiens
uccacuuagaaauugcauuu

SEQ ID NO: 1354750 - RNA, 22 nt, Homo sapiens
uccacuuggagcuaaaacuggc

SEQ ID NO: 1354751 - RNA, 22 nt, Homo sapiens
uccagaagauagcuucacccca

SEQ ID NO: 1354752 - RNA, 19 nt, Homo sapiens
uccagacucagcagaguga

SEQ ID NO: 1354753 - RNA, 19 nt, Homo sapiens
uccagagauaaaaaucaua

SEQ ID NO: 1354754 - RNA, 13 nt, Homo sapiens
uccagauauacuu

SEQ ID NO: 1354755 - RNA, 14 nt, Homo sapiens
uccagcagauuucc

SEQ ID NO: 1354756 - RNA, 13 nt, Homo sapiens
uccagccuucuac

SEQ ID NO: 1354757 - RNA, 23 nt, Homo sapiens
uccagccuucuacugcucuccuc

SEQ ID NO: 1354758 - RNA, 23 nt, Homo sapiens
uccagcuccguucccaaggauac

SEQ ID NO: 1354759 - RNA, 18 nt, Homo sapiens
uccaggaaccacaccaca

SEQ ID NO: 1354760 - RNA, 20 nt, Homo sapiens
uccaggaauauaugucagug

SEQ ID NO: 1354761 - RNA, 16 nt, Homo sapiens
uccaggagagagccag

SEQ ID NO: 1354762 - RNA, 17 nt, Homo sapiens
uccaggcuggagugcaa

SEQ ID NO: 1354763 - RNA, 18 nt, Homo sapiens
uccaggcuggagugcaau

SEQ ID NO: 1354764 - RNA, 20 nt, Homo sapiens
uccagggcuauaggguguga

SEQ ID NO: 1354765 - RNA, 17 nt, Homo sapiens
uccagguuuaugaauga

SEQ ID NO: 1354766 - RNA, 17 nt, Homo sapiens
uccaguauccacuuugc

SEQ ID NO: 1354767 - RNA, 21 nt, Homo sapiens
uccaguggaauggagauuuca

SEQ ID NO: 1354768 - RNA, 15 nt, Homo sapiens
uccaguucaugagaa

SEQ ID NO: 1354769 - RNA, 20 nt, Homo sapiens
uccaguuugaagaccaauca

SEQ ID NO: 1354770 - RNA, 15 nt, Homo sapiens
uccauaccaucuggu

SEQ ID NO: 1354771 - RNA, 20 nt, Homo sapiens
uccauccauggggcugauug

SEQ ID NO: 1354772 - RNA, 15 nt, Homo sapiens
uccauccugcagaua

SEQ ID NO: 1354773 - RNA, 15 nt, Homo sapiens
uccaucuccacucca

SEQ ID NO: 1354774 - RNA, 17 nt, Homo sapiens
uccaucuuucuacagag

SEQ ID NO: 1354775 - RNA, 15 nt, Homo sapiens
uccaugaacaucaug

SEQ ID NO: 1354776 - RNA, 14 nt, Homo sapiens
uccaugaugacuua

SEQ ID NO: 1354777 - RNA, 22 nt, Homo sapiens
uccaugcaacuggaguuccuua

SEQ ID NO: 1354778 - RNA, 18 nt, Homo sapiens
ucuaacagcccuccucug

SEQ ID NO: 1354779 - RNA, 19 nt, Homo sapiens
ucuaacucaaagacuuccu

SEQ ID NO: 1354780 - RNA, 20 nt, Homo sapiens
ucuaagcauauucaaaaggg

SEQ ID NO: 1354781 - RNA, 16 nt, Homo sapiens
ucuaaguaaaaccaca

SEQ ID NO: 1354782 - RNA, 12 nt, Homo sapiens
ucuaagugauau

SEQ ID NO: 1354783 - RNA, 13 nt, Homo sapiens
ucuaagugcugcu

SEQ ID NO: 1354784 - RNA, 21 nt, Homo sapiens
ucuaauaguuuuucacuuugu

SEQ ID NO: 1354785 - RNA, 16 nt, Homo sapiens
ucuaauaucccagaaa

SEQ ID NO: 1354786 - RNA, 13 nt, Homo sapiens
ucuaaucagugau

SEQ ID NO: 1354787 - RNA, 18 nt, Homo sapiens
ucuaauccuuuuccuuau

SEQ ID NO: 1354788 - RNA, 14 nt, Homo sapiens
ucuaaugugucucu

SEQ ID NO: 1354789 - RNA, 19 nt, Homo sapiens
ucuacaaacucccacuugu

SEQ ID NO: 1354790 - RNA, 20 nt, Homo sapiens
ucuacagagaagauucuugu

SEQ ID NO: 1354791 - RNA, 20 nt, Homo sapiens
ucuacagauaaugucuauau

SEQ ID NO: 1354792 - RNA, 14 nt, Homo sapiens
ucuaccaagcuguc

SEQ ID NO: 1354793 - RNA, 20 nt, Homo sapiens
ucuacccaguagaugccacu

SEQ ID NO: 1354794 - RNA, 20 nt, Homo sapiens
ucuaccuucaaauaaagaua

SEQ ID NO: 1354795 - RNA, 18 nt, Homo sapiens
ucuaccuuuucuggcaaa

SEQ ID NO: 1354796 - RNA, 12 nt, Homo sapiens
ucuacugugguc

SEQ ID NO: 1354797 - RNA, 22 nt, Homo sapiens
ucuagaacacaggcaaaauccu

SEQ ID NO: 1354798 - RNA, 22 nt, Homo sapiens
ucuagacacugccacacagggu

SEQ ID NO: 1354799 - RNA, 18 nt, Homo sapiens
ucuagcuaguaauauauu

SEQ ID NO: 1354800 - RNA, 20 nt, Homo sapiens
ucuaggcccugugagcacaa

SEQ ID NO: 1354801 - RNA, 21 nt, Homo sapiens
ucuaggcccugugagcacaaa

SEQ ID NO: 1354802 - RNA, 23 nt, Homo sapiens
ucuaggcccugugagcacaaaga

SEQ ID NO: 1354803 - RNA, 22 nt, Homo sapiens
ucuauaaagaucauauauuacu

SEQ ID NO: 1354804 - RNA, 14 nt, Homo sapiens
ucuauaauuuaccu

SEQ ID NO: 1354805 - RNA, 12 nt, Homo sapiens
ucuauacugugg

SEQ ID NO: 1354806 - RNA, 12 nt, Homo sapiens
ucuaugugacau

SEQ ID NO: 1354807 - RNA, 18 nt, Homo sapiens
ucuauugauacaauauug

SEQ ID NO: 1354808 - RNA, 20 nt, Homo sapiens
ucucaaacuccugaccucaa

SEQ ID NO: 1354809 - RNA, 13 nt, Homo sapiens
ucucaaaucugcu

SEQ ID NO: 1354810 - RNA, 17 nt, Homo sapiens
ucucaaauuuguggucc

SEQ ID NO: 1354811 - RNA, 18 nt, Homo sapiens
ucucaauauuaagucauu

SEQ ID NO: 1354812 - RNA, 13 nt, Homo sapiens
ucucacauauaca

SEQ ID NO: 1354813 - RNA, 20 nt, Homo sapiens
ucucacccucaucacuagga

SEQ ID NO: 1354814 - RNA, 16 nt, Homo sapiens
ucucacugccauggaa

SEQ ID NO: 1354815 - RNA, 17 nt, Homo sapiens
ucucagccuccugagua

SEQ ID NO: 1354816 - RNA, 23 nt, Homo sapiens
ucucaggaaaucaaauaugcaaa

SEQ ID NO: 1354817 - RNA, 21 nt, Homo sapiens
ucucaggcucuugacuacuug

SEQ ID NO: 1354818 - RNA, 17 nt, Homo sapiens
ucucaugaccaaaugcu

SEQ ID NO: 1354819 - RNA, 13 nt, Homo sapiens
ucuccaaagaaga

SEQ ID NO: 1354820 - RNA, 22 nt, Homo sapiens
ucuccaaagcccucccuaccua

SEQ ID NO: 1354821 - RNA, 23 nt, Homo sapiens
ucuccacuggacccuugauucau

SEQ ID NO: 1354822 - RNA, 22 nt, Homo sapiens
ucuccagcaauaauguuuucua

SEQ ID NO: 1354823 - RNA, 17 nt, Homo sapiens
ucuccagcccugcagcu

SEQ ID NO: 1354824 - RNA, 20 nt, Homo sapiens
ucuccagucauuauguuaau

SEQ ID NO: 1354825 - RNA, 13 nt, Homo sapiens
ucuccauucagga

SEQ ID NO: 1354826 - RNA, 15 nt, Homo sapiens
ucucccaggucccag

SEQ ID NO: 1354827 - RNA, 21 nt, Homo sapiens
ucucccagugacaacaucgca

SEQ ID NO: 1354828 - RNA, 17 nt, Homo sapiens
ucuccccagcccagaga

SEQ ID NO: 1354829 - RNA, 16 nt, Homo sapiens
ucuccccgauggggca

SEQ ID NO: 1354830 - RNA, 21 nt, Homo sapiens
ucuccccucacacuuugccau

SEQ ID NO: 1354831 - RNA, 14 nt, Homo sapiens
ucuccgacucugca

SEQ ID NO: 1354832 - RNA, 17 nt, Homo sapiens
ucuccuaaagcuuuuau

SEQ ID NO: 1354833 - RNA, 20 nt, Homo sapiens
ucuccuccuaccagagugaa

SEQ ID NO: 1354834 - RNA, 15 nt, Homo sapiens
ucuccugccucagcc

SEQ ID NO: 1354835 - RNA, 17 nt, Homo sapiens
ucucgaaugcugagaag

SEQ ID NO: 1354836 - RNA, 20 nt, Homo sapiens
ucucggcucacugcaaccuc

SEQ ID NO: 1354837 - RNA, 15 nt, Homo sapiens
ucucuaaugcuugau

SEQ ID NO: 1354838 - RNA, 13 nt, Homo sapiens
ucucuacccagua

SEQ ID NO: 1354839 - RNA, 16 nt, Homo sapiens
ucucuacccaguagau

SEQ ID NO: 1354840 - RNA, 22 nt, Homo sapiens
ucucuauuauguuaucauccuc

SEQ ID NO: 1354841 - RNA, 17 nt, Homo sapiens
ucucucacggcuuguaa

SEQ ID NO: 1354842 - RNA, 23 nt, Homo sapiens
ucucucccaggucccagccccuu

SEQ ID NO: 1354843 - RNA, 14 nt, Homo sapiens
ucucucuccagggu

SEQ ID NO: 1354844 - RNA, 16 nt, Homo sapiens
ucucucuucucuccag

SEQ ID NO: 1354845 - RNA, 13 nt, Homo sapiens
ucucugaggacaa

SEQ ID NO: 1354846 - RNA, 12 nt, Homo sapiens
ucucugagucaa

SEQ ID NO: 1354847 - RNA, 21 nt, Homo sapiens
ucucugagucaaauccagugg

SEQ ID NO: 1354848 - RNA, 20 nt, Homo sapiens
ucucuggccuguacccagua

SEQ ID NO: 1354849 - RNA, 23 nt, Homo sapiens
ucucuggccuguacccaguagau

SEQ ID NO: 1354850 - RNA, 17 nt, Homo sapiens
ucucuggcuggggagca

SEQ ID NO: 1354851 - RNA, 22 nt, Homo sapiens
ucucuggcuggggagcagggag

SEQ ID NO: 1354852 - RNA, 17 nt, Homo sapiens
ucucuggcuggucuuca

SEQ ID NO: 1354853 - RNA, 21 nt, Homo sapiens
ucucuguggccauuugugaua

SEQ ID NO: 1354854 - RNA, 17 nt, Homo sapiens
ucucuguuggucugccu

SEQ ID NO: 1354855 - RNA, 13 nt, Homo sapiens
ucucuuccuccac

SEQ ID NO: 1354856 - RNA, 14 nt, Homo sapiens
ucucuucuuuaaag

SEQ ID NO: 1354857 - RNA, 19 nt, Homo sapiens
ucucuugucauucauccag

SEQ ID NO: 1354858 - RNA, 12 nt, Homo sapiens
ucucuuuggucu

SEQ ID NO: 1354859 - RNA, 18 nt, Homo sapiens
ucugaaaaagacauaaaa

SEQ ID NO: 1354860 - RNA, 22 nt, Homo sapiens
ucugacccagugcccccacuga

SEQ ID NO: 1354861 - RNA, 18 nt, Homo sapiens
ucugaccucuuggccaca

SEQ ID NO: 1354862 - RNA, 20 nt, Homo sapiens
ucugacuauaaccuuguucc

SEQ ID NO: 1354863 - RNA, 15 nt, Homo sapiens
ucugagacauuccac

SEQ ID NO: 1354864 - RNA, 14 nt, Homo sapiens
ucugagagacagaa

SEQ ID NO: 1354865 - RNA, 16 nt, Homo sapiens
ucugagagacagaauu

SEQ ID NO: 1354866 - RNA, 16 nt, Homo sapiens
ucugagcuaacuuaua

SEQ ID NO: 1354867 - RNA, 22 nt, Homo sapiens
ucugagggggugggggugcugc

SEQ ID NO: 1354868 - RNA, 16 nt, Homo sapiens
ucugaggggugggggu

SEQ ID NO: 1354869 - RNA, 17 nt, Homo sapiens
ucugaggggugggggug

SEQ ID NO: 1354870 - RNA, 19 nt, Homo sapiens
ucugaguaagcccucagga

SEQ ID NO: 1354871 - RNA, 11 nt, Homo sapiens
ucugaguauaa

SEQ ID NO: 1354872 - RNA, 22 nt, Homo sapiens
ucugauaaacacaaucugcuag

SEQ ID NO: 1354873 - RNA, 14 nt, Homo sapiens
ucugaugucuccac

SEQ ID NO: 1354874 - RNA, 16 nt, Homo sapiens
ucugcaacauuugaca

SEQ ID NO: 1354875 - RNA, 19 nt, Homo sapiens
ucugcagcacucuuaucua

SEQ ID NO: 1354876 - RNA, 20 nt, Homo sapiens
ucugcagcacucuuaucuac

SEQ ID NO: 1354877 - RNA, 18 nt, Homo sapiens
ucugcagcccauucccaa

SEQ ID NO: 1354878 - RNA, 15 nt, Homo sapiens
ucugcaguuuugaca

SEQ ID NO: 1354879 - RNA, 22 nt, Homo sapiens
ucugcauggaacagcauuaccc

SEQ ID NO: 1354880 - RNA, 18 nt, Homo sapiens
ucugccacaccucuccaa

SEQ ID NO: 1354881 - RNA, 16 nt, Homo sapiens
ucugcccgcuccaugg

SEQ ID NO: 1354882 - RNA, 21 nt, Homo sapiens
ucugccuagaguguagccuaa

SEQ ID NO: 1354883 - RNA, 22 nt, Homo sapiens
ucugccuagaguguagccuaaa

SEQ ID NO: 1354884 - RNA, 23 nt, Homo sapiens
ucugccuuaaacacacauugcag

SEQ ID NO: 1354885 - RNA, 14 nt, Homo sapiens
ucugccuuagccua

SEQ ID NO: 1354886 - RNA, 19 nt, Homo sapiens
ucugccuucugcugaaaga

SEQ ID NO: 1354887 - RNA, 19 nt, Homo sapiens
ucugcgccgagccucagaa

SEQ ID NO: 1354888 - RNA, 13 nt, Homo sapiens
ucugcgccugagu

SEQ ID NO: 1354889 - RNA, 16 nt, Homo sapiens
ucugcgcuguguacaa

SEQ ID NO: 1354890 - RNA, 12 nt, Homo sapiens
ucugcuagggaa

SEQ ID NO: 1354891 - RNA, 15 nt, Homo sapiens
ucugcugcaguuacc

SEQ ID NO: 1354892 - RNA, 12 nt, Homo sapiens
ucugcugcugag

SEQ ID NO: 1354893 - RNA, 16 nt, Homo sapiens
ucugcugggcucugcc

SEQ ID NO: 1354894 - RNA, 12 nt, Homo sapiens
ucugcugucuaa

SEQ ID NO: 1354895 - RNA, 12 nt, Homo sapiens
ucugcuuguauu

SEQ ID NO: 1354896 - RNA, 17 nt, Homo sapiens
ucugcuuuucccauugc

SEQ ID NO: 1354897 - RNA, 20 nt, Homo sapiens
ucccauaaacaaauguaaug

SEQ ID NO: 1354898 - RNA, 17 nt, Homo sapiens
ucccauaugggugaugu

SEQ ID NO: 1354899 - RNA, 15 nt, Homo sapiens
ucccaucccacugcu

SEQ ID NO: 1354900 - RNA, 23 nt, Homo sapiens
ucccauccuggggcagcacuccc

SEQ ID NO: 1354901 - RNA, 22 nt, Homo sapiens
ucccauuucaauuccugugauu

SEQ ID NO: 1354902 - RNA, 15 nt, Homo sapiens
uccccaagggcccug

SEQ ID NO: 1354903 - RNA, 13 nt, Homo sapiens
uccccacugcuga

SEQ ID NO: 1354904 - RNA, 17 nt, Homo sapiens
uccccacugcugagcug

SEQ ID NO: 1354905 - RNA, 13 nt, Homo sapiens
uccccagagcugu

SEQ ID NO: 1354906 - RNA, 14 nt, Homo sapiens
uccccagagcugug

SEQ ID NO: 1354907 - RNA, 16 nt, Homo sapiens
uccccagcccagagac

SEQ ID NO: 1354908 - RNA, 16 nt, Homo sapiens
uccccagucccagaca

SEQ ID NO: 1354909 - RNA, 23 nt, Homo sapiens
uccccagugacuccagggugaca

SEQ ID NO: 1354910 - RNA, 13 nt, Homo sapiens
ucccccagcacuu

SEQ ID NO: 1354911 - RNA, 19 nt, Homo sapiens
uccccccgagucuccggga

SEQ ID NO: 1354912 - RNA, 16 nt, Homo sapiens
ucccccgugaucuccc

SEQ ID NO: 1354913 - RNA, 23 nt, Homo sapiens
ucccccucccccagccacucccc

SEQ ID NO: 1354914 - RNA, 17 nt, Homo sapiens
ucccccugcuugucuuc

SEQ ID NO: 1354915 - RNA, 21 nt, Homo sapiens
uccccgcagugugcacuaagg

SEQ ID NO: 1354916 - RNA, 15 nt, Homo sapiens
uccccuaaaccaaaa

SEQ ID NO: 1354917 - RNA, 16 nt, Homo sapiens
uccccucagagugcaa

SEQ ID NO: 1354918 - RNA, 17 nt, Homo sapiens
uccccuccuuggcuuua

SEQ ID NO: 1354919 - RNA, 16 nt, Homo sapiens
uccccucucagcauuu

SEQ ID NO: 1354920 - RNA, 17 nt, Homo sapiens
uccccugacagggccag

SEQ ID NO: 1354921 - RNA, 22 nt, Homo sapiens
ucccgcccuuccaugugccuuu

SEQ ID NO: 1354922 - RNA, 22 nt, Homo sapiens
ucccgcuucugaagcugcugca

SEQ ID NO: 1354923 - RNA, 22 nt, Homo sapiens
ucccgggggccccaccucggca

SEQ ID NO: 1354924 - RNA, 20 nt, Homo sapiens
ucccuaauuuaucuucaugu

SEQ ID NO: 1354925 - RNA, 18 nt, Homo sapiens
ucccuacccuaaccaagu

SEQ ID NO: 1354926 - RNA, 20 nt, Homo sapiens
ucccuacccuaaccaaguuc

SEQ ID NO: 1354927 - RNA, 13 nt, Homo sapiens
ucccuaccuacca

SEQ ID NO: 1354928 - RNA, 23 nt, Homo sapiens
ucccucaccuuggcaccagacac

SEQ ID NO: 1354929 - RNA, 14 nt, Homo sapiens
ucccucauccauag

SEQ ID NO: 1354930 - RNA, 22 nt, Homo sapiens
ucccuccccuccccguccacag

SEQ ID NO: 1354931 - RNA, 15 nt, Homo sapiens
ucccugcugugccau

SEQ ID NO: 1354932 - RNA, 20 nt, Homo sapiens
ucccugucccucuagugccu

SEQ ID NO: 1354933 - RNA, 19 nt, Homo sapiens
ucccugucuccagcugccu

SEQ ID NO: 1354934 - RNA, 11 nt, Homo sapiens
ucccuguucuc

SEQ ID NO: 1354935 - RNA, 18 nt, Homo sapiens
ucccuuauuuugugaucu

SEQ ID NO: 1354936 - RNA, 18 nt, Homo sapiens
ucccuuccaagcuguguu

SEQ ID NO: 1354937 - RNA, 17 nt, Homo sapiens
ucccuugaggaaacaac

SEQ ID NO: 1354938 - RNA, 20 nt, Homo sapiens
ucccuuucuaagcaaccaca

SEQ ID NO: 1354939 - RNA, 21 nt, Homo sapiens
uccggaagcugucgacuucau

SEQ ID NO: 1354940 - RNA, 21 nt, Homo sapiens
uccgggagggugcggcugugc

SEQ ID NO: 1354941 - RNA, 21 nt, Homo sapiens
uccggggagaaacccagagau

SEQ ID NO: 1354942 - RNA, 18 nt, Homo sapiens
uccgguuugccauguugc

SEQ ID NO: 1354943 - RNA, 22 nt, Homo sapiens
uccguggccccgcccucaggcu

SEQ ID NO: 1354944 - RNA, 24 nt, Homo sapiens
uccguucccaaggauacucgugaa

SEQ ID NO: 1354945 - RNA, 21 nt, Homo sapiens
uccuaaacuguuuauuugcac

SEQ ID NO: 1354946 - RNA, 15 nt, Homo sapiens
uccuaaagcuuuuau

SEQ ID NO: 1354947 - RNA, 21 nt, Homo sapiens
uccuaaagcuuuuauuuaaca

SEQ ID NO: 1354948 - RNA, 16 nt, Homo sapiens
uccuaacguuugucau

SEQ ID NO: 1354949 - RNA, 15 nt, Homo sapiens
uccuacgcaccauuu

SEQ ID NO: 1354950 - RNA, 14 nt, Homo sapiens
uccuagacuugaaa

SEQ ID NO: 1354951 - RNA, 20 nt, Homo sapiens
uccuagacuugaaaguuuuc

SEQ ID NO: 1354952 - RNA, 13 nt, Homo sapiens
uccuagcauuugu

SEQ ID NO: 1354953 - RNA, 17 nt, Homo sapiens
uccuagucauucuuccc

SEQ ID NO: 1354954 - RNA, 14 nt, Homo sapiens
uccuagugaaagag

SEQ ID NO: 1354955 - RNA, 17 nt, Homo sapiens
uccuaugcuguucacug

SEQ ID NO: 1354956 - RNA, 22 nt, Homo sapiens
uccuauucugaugaaucucaaa

SEQ ID NO: 1354957 - RNA, 14 nt, Homo sapiens
uccuauuuaucaua

SEQ ID NO: 1354958 - RNA, 20 nt, Homo sapiens
uccuauuucuccaaagccuu

SEQ ID NO: 1354959 - RNA, 22 nt, Homo sapiens
uccucaaagggagagagugcua

SEQ ID NO: 1354960 - RNA, 18 nt, Homo sapiens
uccucaauaaacauuuca

SEQ ID NO: 1354961 - RNA, 16 nt, Homo sapiens
uccucacuguauccag

SEQ ID NO: 1354962 - RNA, 11 nt, Homo sapiens
uccuccagguu

SEQ ID NO: 1354963 - RNA, 15 nt, Homo sapiens
uccucccucauucca

SEQ ID NO: 1354964 - RNA, 15 nt, Homo sapiens
uccucccuccagaua

SEQ ID NO: 1354965 - RNA, 15 nt, Homo sapiens
uccucccugcaucug

SEQ ID NO: 1354966 - RNA, 18 nt, Homo sapiens
uccucuccacugccuucg

SEQ ID NO: 1354967 - RNA, 14 nt, Homo sapiens
uccucucccaguga

SEQ ID NO: 1354968 - RNA, 14 nt, Homo sapiens
uccucucugcacac

SEQ ID NO: 1354969 - RNA, 12 nt, Homo sapiens
uccucugugauu

SEQ ID NO: 1354970 - RNA, 13 nt, Homo sapiens
uccucuuagcuca

SEQ ID NO: 1354971 - RNA, 11 nt, Homo sapiens
uccucuucuau

SEQ ID NO: 1354972 - RNA, 13 nt, Homo sapiens
uccugaaagccac

SEQ ID NO: 1354973 - RNA, 19 nt, Homo sapiens
uccugaaagccacagacaa

SEQ ID NO: 1354974 - RNA, 15 nt, Homo sapiens
uccugaaauauccag

SEQ ID NO: 1354975 - RNA, 21 nt, Homo sapiens
uccugaaauuugagagacaaa

SEQ ID NO: 1354976 - RNA, 17 nt, Homo sapiens
uccugaagagcauuugg

SEQ ID NO: 1354977 - RNA, 23 nt, Homo sapiens
uccugaagguguuuuucauucac

SEQ ID NO: 1354978 - RNA, 22 nt, Homo sapiens
uccugaaguucacucagaggga

SEQ ID NO: 1354979 - RNA, 19 nt, Homo sapiens
uccugacuuuuaaugucau

SEQ ID NO: 1354980 - RNA, 19 nt, Homo sapiens
uccugccauggaucucuug

SEQ ID NO: 1354981 - RNA, 19 nt, Homo sapiens
uccugccuaagguugucua

SEQ ID NO: 1354982 - RNA, 18 nt, Homo sapiens
uccugccuuuaagccaaa

SEQ ID NO: 1354983 - RNA, 15 nt, Homo sapiens
uccugggagcacugc

SEQ ID NO: 1354984 - RNA, 13 nt, Homo sapiens
uccugucccucau

SEQ ID NO: 1354985 - RNA, 19 nt, Homo sapiens
uccugucccucauccauag

SEQ ID NO: 1354986 - RNA, 18 nt, Homo sapiens
uccugugauuuaugccaa

SEQ ID NO: 1354987 - RNA, 21 nt, Homo sapiens
uccuuaaaacaauucugugac

SEQ ID NO: 1354988 - RNA, 12 nt, Homo sapiens
uccuuaaguaua

SEQ ID NO: 1354989 - RNA, 15 nt, Homo sapiens
uccuuauuugccuuc

SEQ ID NO: 1354990 - RNA, 19 nt, Homo sapiens
uccuucccucucaugacuu

SEQ ID NO: 1354991 - RNA, 20 nt, Homo sapiens
uccuucucacugccauggaa

SEQ ID NO: 1354992 - RNA, 13 nt, Homo sapiens
uccuugacucuua

SEQ ID NO: 1354993 - RNA, 13 nt, Homo sapiens
uccuuggcuuuau

SEQ ID NO: 1354994 - RNA, 15 nt, Homo sapiens
uccuuggcuuuaugc

SEQ ID NO: 1354995 - RNA, 18 nt, Homo sapiens
uccuugggcuuuagccuu

SEQ ID NO: 1354996 - RNA, 13 nt, Homo sapiens
uccuuuacacaua

SEQ ID NO: 1354997 - RNA, 20 nt, Homo sapiens
uccuuuaccuuucagugcag

SEQ ID NO: 1354998 - RNA, 21 nt, Homo sapiens
uccuuugaauagcagguaguu

SEQ ID NO: 1354999 - RNA, 13 nt, Homo sapiens
uccuuuuaucucc

SEQ ID NO: 1355000 - RNA, 19 nt, Homo sapiens
uccuuuuuuauacaggaaa

SEQ ID NO: 1355001 - RNA, 20 nt, Homo sapiens
ucgaaccuugaccgacauga

SEQ ID NO: 1355002 - RNA, 19 nt, Homo sapiens
ucgacucagccucagggac

SEQ ID NO: 1355003 - RNA, 15 nt, Homo sapiens
ucgcagccuagauau

SEQ ID NO: 1355004 - RNA, 20 nt, Homo sapiens
ucgcaguguucaaggccauc

SEQ ID NO: 1355005 - RNA, 13 nt, Homo sapiens
ucgcaucucagcc

SEQ ID NO: 1355006 - RNA, 21 nt, Homo sapiens
ucgcccaggcuggagugcagu

SEQ ID NO: 1355007 - RNA, 12 nt, Homo sapiens
ucgcgcuggaau

SEQ ID NO: 1355008 - RNA, 15 nt, Homo sapiens
ucgcuugaaccuggg

SEQ ID NO: 1355009 - RNA, 16 nt, Homo sapiens
ucggagagcagcagca

SEQ ID NO: 1355010 - RNA, 17 nt, Homo sapiens
ucggagcggcgucccuu

SEQ ID NO: 1355011 - RNA, 13 nt, Homo sapiens
acauacaaugaag

SEQ ID NO: 1355012 - RNA, 15 nt, Homo sapiens
acauacguacuuuuc

SEQ ID NO: 1355013 - RNA, 19 nt, Homo sapiens
acauacuugaagggccaga

SEQ ID NO: 1355014 - RNA, 18 nt, Homo sapiens
acauauauauacuauuaa

SEQ ID NO: 1355015 - RNA, 13 nt, Homo sapiens
acauauauauuac

SEQ ID NO: 1355016 - RNA, 17 nt, Homo sapiens
acauccauucuucccuu

SEQ ID NO: 1355017 - RNA, 17 nt, Homo sapiens
acauccuuaagucaaaa

SEQ ID NO: 1355018 - RNA, 16 nt, Homo sapiens
acaugaaaaauaaucc

SEQ ID NO: 1355019 - RNA, 23 nt, Homo sapiens
acaugagggcugguguucauuaa

SEQ ID NO: 1355020 - RNA, 22 nt, Homo sapiens
acauguaauugcagauaacuuu

SEQ ID NO: 1355021 - RNA, 14 nt, Homo sapiens
acauguggcccaac

SEQ ID NO: 1355022 - RNA, 23 nt, Homo sapiens
acauguuaggaagguacugucau

SEQ ID NO: 1355023 - RNA, 18 nt, Homo sapiens
acauuagaagacaauuga

SEQ ID NO: 1355024 - RNA, 24 nt, Homo sapiens
acauucguuacuguugugaaaauc

SEQ ID NO: 1355025 - RNA, 17 nt, Homo sapiens
acauuggagcugacugu

SEQ ID NO: 1355026 - RNA, 22 nt, Homo sapiens
acauuggcaccuaauccaggca

SEQ ID NO: 1355027 - RNA, 22 nt, Homo sapiens
acauuguuuuguguaacauauu

SEQ ID NO: 1355028 - RNA, 14 nt, Homo sapiens
acauuuaaauucca

SEQ ID NO: 1355029 - RNA, 18 nt, Homo sapiens
acauuuauauauuuccau

SEQ ID NO: 1355030 - RNA, 23 nt, Homo sapiens
acauuucucuaacuccugccauu

SEQ ID NO: 1355031 - RNA, 22 nt, Homo sapiens
acauuugaaaucuaugaaauau

SEQ ID NO: 1355032 - RNA, 19 nt, Homo sapiens
acauuuuugucuguccuac

SEQ ID NO: 1355033 - RNA, 21 nt, Homo sapiens
accaaaaacaaaaaccaaaug

SEQ ID NO: 1355034 - RNA, 19 nt, Homo sapiens
accaaaucucaaaauaucc

SEQ ID NO: 1355035 - RNA, 11 nt, Homo sapiens
accaaccuggg

SEQ ID NO: 1355036 - RNA, 18 nt, Homo sapiens
accaacugggcccaagac

SEQ ID NO: 1355037 - RNA, 20 nt, Homo sapiens
accaagauauaccugauaua

SEQ ID NO: 1355038 - RNA, 18 nt, Homo sapiens
accaagcaggaagcucag

SEQ ID NO: 1355039 - RNA, 13 nt, Homo sapiens
accaauguucucu

SEQ ID NO: 1355040 - RNA, 16 nt, Homo sapiens
accacaagccugagaa

SEQ ID NO: 1355041 - RNA, 21 nt, Homo sapiens
accaccccaacaaaccaucca

SEQ ID NO: 1355042 - RNA, 21 nt, Homo sapiens
accacggccaccacugcagcc

SEQ ID NO: 1355043 - RNA, 20 nt, Homo sapiens
accacgggacaucacagggu

SEQ ID NO: 1355044 - RNA, 21 nt, Homo sapiens
accacuacaugcagcccaugc

SEQ ID NO: 1355045 - RNA, 19 nt, Homo sapiens
accaggauagagacuggaa

SEQ ID NO: 1355046 - RNA, 16 nt, Homo sapiens
accaggccaccucccc

SEQ ID NO: 1355047 - RNA, 14 nt, Homo sapiens
accaggcugcucag

SEQ ID NO: 1355048 - RNA, 22 nt, Homo sapiens
accagguagaacacaaggucau

SEQ ID NO: 1355049 - RNA, 14 nt, Homo sapiens
accaggucagggag

SEQ ID NO: 1355050 - RNA, 16 nt, Homo sapiens
accagguuaccucacu

SEQ ID NO: 1355051 - RNA, 22 nt, Homo sapiens
accaguaucgcucauagaucag

SEQ ID NO: 1355052 - RNA, 15 nt, Homo sapiens
accauccaggcauau

SEQ ID NO: 1355053 - RNA, 15 nt, Homo sapiens
accauccagugacaa

SEQ ID NO: 1355054 - RNA, 20 nt, Homo sapiens
accaugauuaaccacuucag

SEQ ID NO: 1355055 - RNA, 22 nt, Homo sapiens
accauggcaugguuauugauga

SEQ ID NO: 1355056 - RNA, 15 nt, Homo sapiens
accauguacauagcu

SEQ ID NO: 1355057 - RNA, 17 nt, Homo sapiens
accauguuagccaggau

SEQ ID NO: 1355058 - RNA, 21 nt, Homo sapiens
acccaaggaugucugccacac

SEQ ID NO: 1355059 - RNA, 19 nt, Homo sapiens
acccaaguugaagacuuug

SEQ ID NO: 1355060 - RNA, 14 nt, Homo sapiens
acccaccccagugc

SEQ ID NO: 1355061 - RNA, 19 nt, Homo sapiens
acccaccuuugccacaaag

SEQ ID NO: 1355062 - RNA, 16 nt, Homo sapiens
acccaguagaugccac

SEQ ID NO: 1355063 - RNA, 18 nt, Homo sapiens
acccaguaggguuugaca

SEQ ID NO: 1355064 - RNA, 18 nt, Homo sapiens
acccagucaccucugucu

SEQ ID NO: 1355065 - RNA, 16 nt, Homo sapiens
acccaguuagcucuca

SEQ ID NO: 1355066 - RNA, 18 nt, Homo sapiens
acccaguugugacaauua

SEQ ID NO: 1355067 - RNA, 19 nt, Homo sapiens
acccaugcaagcagaggac

SEQ ID NO: 1355068 - RNA, 13 nt, Homo sapiens
accccaacccugg

SEQ ID NO: 1355069 - RNA, 18 nt, Homo sapiens
accccaaggagggagaug

SEQ ID NO: 1355070 - RNA, 20 nt, Homo sapiens
acccccggaacaagccuaaa

SEQ ID NO: 1355071 - RNA, 14 nt, Homo sapiens
accccgggcucucu

SEQ ID NO: 1355072 - RNA, 15 nt, Homo sapiens
accccucuaccuccu

SEQ ID NO: 1355073 - RNA, 14 nt, Homo sapiens
accccuuagccucc

SEQ ID NO: 1355074 - RNA, 18 nt, Homo sapiens
accccuuagccucccuga

SEQ ID NO: 1355075 - RNA, 16 nt, Homo sapiens
acccguccauggcugg

SEQ ID NO: 1355076 - RNA, 17 nt, Homo sapiens
acccuagucuuuuaaac

SEQ ID NO: 1355077 - RNA, 19 nt, Homo sapiens
acccuccugcugagcugcc

SEQ ID NO: 1355078 - RNA, 21 nt, Homo sapiens
acccucugacuguauuugaga

SEQ ID NO: 1355079 - RNA, 18 nt, Homo sapiens
acccugccuuaucuugca

SEQ ID NO: 1355080 - RNA, 13 nt, Homo sapiens
acccuucccucac

SEQ ID NO: 1355081 - RNA, 18 nt, Homo sapiens
acccuucccuugagcccu

SEQ ID NO: 1355082 - RNA, 12 nt, Homo sapiens
acccuucugccu

SEQ ID NO: 1355083 - RNA, 19 nt, Homo sapiens
acccuuucauuagaacuuc

SEQ ID NO: 1355084 - RNA, 15 nt, Homo sapiens
acccuuugcugugag

SEQ ID NO: 1355085 - RNA, 19 nt, Homo sapiens
accgucugagcccagcuca

SEQ ID NO: 1355086 - RNA, 14 nt, Homo sapiens
accuaauccaggca

SEQ ID NO: 1355087 - RNA, 16 nt, Homo sapiens
accuaguaagugccug

SEQ ID NO: 1355088 - RNA, 15 nt, Homo sapiens
accucacgcaccucc

SEQ ID NO: 1355089 - RNA, 12 nt, Homo sapiens
accucacuuuag

SEQ ID NO: 1355090 - RNA, 22 nt, Homo sapiens
accucacuuuaggcagcuguaa

SEQ ID NO: 1355091 - RNA, 20 nt, Homo sapiens
accucagccuggccagacac

SEQ ID NO: 1355092 - RNA, 20 nt, Homo sapiens
accucaggugagaagcagag

SEQ ID NO: 1355093 - RNA, 19 nt, Homo sapiens
accuccaggcuuucccacu

SEQ ID NO: 1355094 - RNA, 17 nt, Homo sapiens
accucccuauacugcuu

SEQ ID NO: 1355095 - RNA, 20 nt, Homo sapiens
accucgugauccaccugccu

SEQ ID NO: 1355096 - RNA, 18 nt, Homo sapiens
accucugagaagacacaa

SEQ ID NO: 1355097 - RNA, 19 nt, Homo sapiens
accucugagaagacacaag

SEQ ID NO: 1355098 - RNA, 16 nt, Homo sapiens
accucuuugucacagg

SEQ ID NO: 1355099 - RNA, 17 nt, Homo sapiens
accugaaauuaacucag

SEQ ID NO: 1355100 - RNA, 22 nt, Homo sapiens
aauacccguugauaacucagug

SEQ ID NO: 1355101 - RNA, 15 nt, Homo sapiens
aauacugggugcugu

SEQ ID NO: 1355102 - RNA, 15 nt, Homo sapiens
aauagcccuguaaca

SEQ ID NO: 1355103 - RNA, 15 nt, Homo sapiens
aauagucuuugccag

SEQ ID NO: 1355104 - RNA, 14 nt, Homo sapiens
aauaguugcuguca

SEQ ID NO: 1355105 - RNA, 15 nt, Homo sapiens
aauauccugcuugau

SEQ ID NO: 1355106 - RNA, 14 nt, Homo sapiens
aauauugugcaaac

SEQ ID NO: 1355107 - RNA, 18 nt, Homo sapiens
aauauuuucucuguacuu

SEQ ID NO: 1355108 - RNA, 15 nt, Homo sapiens
aaucaaugcuauaac

SEQ ID NO: 1355109 - RNA, 12 nt, Homo sapiens
aaucacaguaua

SEQ ID NO: 1355110 - RNA, 13 nt, Homo sapiens
aaucacagucuca

SEQ ID NO: 1355111 - RNA, 22 nt, Homo sapiens
aaucaggacagguggugcaaau

SEQ ID NO: 1355112 - RNA, 16 nt, Homo sapiens
aauccaggcagaucca

SEQ ID NO: 1355113 - RNA, 22 nt, Homo sapiens
aaucggcuggggacugcuaccu

SEQ ID NO: 1355114 - RNA, 13 nt, Homo sapiens
aaucuaguaaugu

SEQ ID NO: 1355115 - RNA, 18 nt, Homo sapiens
aaucucggcucacugcaa

SEQ ID NO: 1355116 - RNA, 23 nt, Homo sapiens
aaucugaaauaaaaggugcuguu

SEQ ID NO: 1355117 - RNA, 13 nt, Homo sapiens
aaucugaccaaaa

SEQ ID NO: 1355118 - RNA, 17 nt, Homo sapiens
aaucugagaaacucuac

SEQ ID NO: 1355119 - RNA, 18 nt, Homo sapiens
aaucuggcuuagugccac

SEQ ID NO: 1355120 - RNA, 16 nt, Homo sapiens
aaucuuacaacaggcu

SEQ ID NO: 1355121 - RNA, 14 nt, Homo sapiens
aaugaucaacucau

SEQ ID NO: 1355122 - RNA, 13 nt, Homo sapiens
aaugcggcccaac

SEQ ID NO: 1355123 - RNA, 15 nt, Homo sapiens
aaugcucaccuuuau

SEQ ID NO: 1355124 - RNA, 15 nt, Homo sapiens
aauggggugcaugaa

SEQ ID NO: 1355125 - RNA, 17 nt, Homo sapiens
aauggggugcaugaagg

SEQ ID NO: 1355126 - RNA, 13 nt, Homo sapiens
aauguaaacauuu

SEQ ID NO: 1355127 - RNA, 21 nt, Homo sapiens
aaugucaagguucccucccac

SEQ ID NO: 1355128 - RNA, 20 nt, Homo sapiens
aauguuuuaaucuccucuga

SEQ ID NO: 1355129 - RNA, 16 nt, Homo sapiens
aauuaaaaaagcauac

SEQ ID NO: 1355130 - RNA, 20 nt, Homo sapiens
aauuaaaauuacacacuugc

SEQ ID NO: 1355131 - RNA, 23 nt, Homo sapiens
aauuaaaccagauuggagcaauu

SEQ ID NO: 1355132 - RNA, 12 nt, Homo sapiens
aauuaacacugc

SEQ ID NO: 1355133 - RNA, 15 nt, Homo sapiens
aauuaaccuuacuaa

SEQ ID NO: 1355134 - RNA, 14 nt, Homo sapiens
aauuaacucagaca

SEQ ID NO: 1355135 - RNA, 21 nt, Homo sapiens
aauuaguuccucauuagcauu

SEQ ID NO: 1355136 - RNA, 17 nt, Homo sapiens
aauuauaaucuguggau

SEQ ID NO: 1355137 - RNA, 23 nt, Homo sapiens
aauuaucuugaauguaguauuca

SEQ ID NO: 1355138 - RNA, 21 nt, Homo sapiens
aauucacucugaguguuuuau

SEQ ID NO: 1355139 - RNA, 12 nt, Homo sapiens
aauucuauuaca

SEQ ID NO: 1355140 - RNA, 21 nt, Homo sapiens
aauugcuuugccaaaauacca

SEQ ID NO: 1355141 - RNA, 15 nt, Homo sapiens
aauugggauuugcag

SEQ ID NO: 1355142 - RNA, 17 nt, Homo sapiens
aauuguacuaaagccaa

SEQ ID NO: 1355143 - RNA, 18 nt, Homo sapiens
aauuuaaaaucagacucu

SEQ ID NO: 1355144 - RNA, 15 nt, Homo sapiens
aauuuaaacagucuc

SEQ ID NO: 1355145 - RNA, 22 nt, Homo sapiens
aauuuauaguuaaggcuaaaaa

SEQ ID NO: 1355146 - RNA, 13 nt, Homo sapiens
aauuuuaagacca

SEQ ID NO: 1355147 - RNA, 20 nt, Homo sapiens
acaaaaaaaccucuaugcaa

SEQ ID NO: 1355148 - RNA, 19 nt, Homo sapiens
acaaaauagacaauuugca

SEQ ID NO: 1355149 - RNA, 14 nt, Homo sapiens
acaaacaaacagaa

SEQ ID NO: 1355150 - RNA, 13 nt, Homo sapiens
acaaacagugcac

SEQ ID NO: 1355151 - RNA, 14 nt, Homo sapiens
acaaacaugugguu

SEQ ID NO: 1355152 - RNA, 14 nt, Homo sapiens
acaaagauugagaa

SEQ ID NO: 1355153 - RNA, 19 nt, Homo sapiens
acaaagauugagaagccau

SEQ ID NO: 1355154 - RNA, 21 nt, Homo sapiens
acaaagauuugcaacauuaga

SEQ ID NO: 1355155 - RNA, 18 nt, Homo sapiens
acaaauuaagauguucag

SEQ ID NO: 1355156 - RNA, 21 nt, Homo sapiens
acaaauuuuucaaaucauucc

SEQ ID NO: 1355157 - RNA, 17 nt, Homo sapiens
acaacauguauaauauu

SEQ ID NO: 1355158 - RNA, 16 nt, Homo sapiens
acaaccaaaaaauucu

SEQ ID NO: 1355159 - RNA, 18 nt, Homo sapiens
acaacgaggaagcccuaa

SEQ ID NO: 1355160 - RNA, 20 nt, Homo sapiens
acaacuauuuucagauguga

SEQ ID NO: 1355161 - RNA, 12 nt, Homo sapiens
acaacucagucc

SEQ ID NO: 1355162 - RNA, 21 nt, Homo sapiens
acaagcauggaaaaucaguga

SEQ ID NO: 1355163 - RNA, 22 nt, Homo sapiens
acaagcauggaaaaucagugac

SEQ ID NO: 1355164 - RNA, 19 nt, Homo sapiens
acaaguagcacacugaguu

SEQ ID NO: 1355165 - RNA, 17 nt, Homo sapiens
acaauaaaaacauugcc

SEQ ID NO: 1355166 - RNA, 21 nt, Homo sapiens
acaauaauauuucaagugccu

SEQ ID NO: 1355167 - RNA, 15 nt, Homo sapiens
acaauagaaaccugu

SEQ ID NO: 1355168 - RNA, 16 nt, Homo sapiens
acaauccaucucucaa

SEQ ID NO: 1355169 - RNA, 15 nt, Homo sapiens
acaaucuguauauaa

SEQ ID NO: 1355170 - RNA, 14 nt, Homo sapiens
acaauggaguauuc

SEQ ID NO: 1355171 - RNA, 18 nt, Homo sapiens
acaauggcagaacaggug

SEQ ID NO: 1355172 - RNA, 15 nt, Homo sapiens
acaauguaagagccu

SEQ ID NO: 1355173 - RNA, 13 nt, Homo sapiens
acacacucaguga

SEQ ID NO: 1355174 - RNA, 21 nt, Homo sapiens
acacagacauccucuaugcca

SEQ ID NO: 1355175 - RNA, 14 nt, Homo sapiens
acacagaggaccca

SEQ ID NO: 1355176 - RNA, 15 nt, Homo sapiens
acacagaucacagcu

SEQ ID NO: 1355177 - RNA, 13 nt, Homo sapiens
acacagcuaacaa

SEQ ID NO: 1355178 - RNA, 19 nt, Homo sapiens
acaccagggacacauuucu

SEQ ID NO: 1355179 - RNA, 19 nt, Homo sapiens
acacccagagggaguagaa

SEQ ID NO: 1355180 - RNA, 17 nt, Homo sapiens
acaccuggaugucuggg

SEQ ID NO: 1355181 - RNA, 22 nt, Homo sapiens
acacguaaaagaaauguauuaa

SEQ ID NO: 1355182 - RNA, 20 nt, Homo sapiens
acacuaaccuggguucccuu

SEQ ID NO: 1355183 - RNA, 15 nt, Homo sapiens
acacuaauacaccag

SEQ ID NO: 1355184 - RNA, 17 nt, Homo sapiens
acacuaauacaccaggu

SEQ ID NO: 1355185 - RNA, 15 nt, Homo sapiens
acacuguucugaaag

SEQ ID NO: 1355186 - RNA, 15 nt, Homo sapiens
acacuugcaaccuac

SEQ ID NO: 1355187 - RNA, 15 nt, Homo sapiens
acacuugcugaguga

SEQ ID NO: 1355188 - RNA, 13 nt, Homo sapiens
acagaaaacccag

SEQ ID NO: 1355189 - RNA, 12 nt, Homo sapiens
acagaacaaagu

SEQ ID NO: 1355190 - RNA, 14 nt, Homo sapiens
acagaacacugucu

SEQ ID NO: 1355191 - RNA, 18 nt, Homo sapiens
acagaauuuuauggugca

SEQ ID NO: 1355192 - RNA, 22 nt, Homo sapiens
aaccuaagggggacacauccau

SEQ ID NO: 1355193 - RNA, 11 nt, Homo sapiens
aaccucagggc

SEQ ID NO: 1355194 - RNA, 13 nt, Homo sapiens
aaccucuaugcaa

SEQ ID NO: 1355195 - RNA, 23 nt, Homo sapiens
aaccuguaaagcaggugcccagg

SEQ ID NO: 1355196 - RNA, 13 nt, Homo sapiens
aaccuuaguuuca

SEQ ID NO: 1355197 - RNA, 20 nt, Homo sapiens
aaccuuguauaaauuauuca

SEQ ID NO: 1355198 - RNA, 18 nt, Homo sapiens
aaccuugugagcaaggug

SEQ ID NO: 1355199 - RNA, 17 nt, Homo sapiens
aacgcacacaguaucua

SEQ ID NO: 1355200 - RNA, 21 nt, Homo sapiens
aacgcacacaguaucuaguca

SEQ ID NO: 1355201 - RNA, 18 nt, Homo sapiens
aacguccuuccacuucag

SEQ ID NO: 1355202 - RNA, 14 nt, Homo sapiens
aacuaaacacguga

SEQ ID NO: 1355203 - RNA, 13 nt, Homo sapiens
aacuaccaggugg

SEQ ID NO: 1355204 - RNA, 16 nt, Homo sapiens
aacuaccauuguaaua

SEQ ID NO: 1355205 - RNA, 19 nt, Homo sapiens
aacuagggaagauaauauu

SEQ ID NO: 1355206 - RNA, 20 nt, Homo sapiens
aacucaauauuuuccaugaa

SEQ ID NO: 1355207 - RNA, 22 nt, Homo sapiens
aacucagagucggaacggagaa

SEQ ID NO: 1355208 - RNA, 23 nt, Homo sapiens
aacucagauccagggacagaggc

SEQ ID NO: 1355209 - RNA, 17 nt, Homo sapiens
aacucugugaucuugcu

SEQ ID NO: 1355210 - RNA, 14 nt, Homo sapiens
aacucuuaaaaccc

SEQ ID NO: 1355211 - RNA, 13 nt, Homo sapiens
aacucuucacucu

SEQ ID NO: 1355212 - RNA, 19 nt, Homo sapiens
aacugaaguaucugucuca

SEQ ID NO: 1355213 - RNA, 20 nt, Homo sapiens
aacugaauuuugggacuucu

SEQ ID NO: 1355214 - RNA, 20 nt, Homo sapiens
aacugcaagcccacagauga

SEQ ID NO: 1355215 - RNA, 17 nt, Homo sapiens
aacugcacacucagugg

SEQ ID NO: 1355216 - RNA, 16 nt, Homo sapiens
aacuggaugaggucau

SEQ ID NO: 1355217 - RNA, 23 nt, Homo sapiens
aacuggggaaugggguauggaag

SEQ ID NO: 1355218 - RNA, 9 nt, Homo sapiens
aacugucau

SEQ ID NO: 1355219 - RNA, 13 nt, Homo sapiens
aacugucauguaa

SEQ ID NO: 1355220 - RNA, 18 nt, Homo sapiens
aacugugaaauaccacaa

SEQ ID NO: 1355221 - RNA, 14 nt, Homo sapiens
aacuguguuuacuc

SEQ ID NO: 1355222 - RNA, 22 nt, Homo sapiens
aacuguuaaggagcuucaggga

SEQ ID NO: 1355223 - RNA, 13 nt, Homo sapiens
aacuguugucaua

SEQ ID NO: 1355224 - RNA, 20 nt, Homo sapiens
aacuucuacuucugcccuug

SEQ ID NO: 1355225 - RNA, 24 nt, Homo sapiens
aacuucuacuucugcccuugccaa

SEQ ID NO: 1355226 - RNA, 12 nt, Homo sapiens
aacuuggcugca

SEQ ID NO: 1355227 - RNA, 16 nt, Homo sapiens
aacuugggaacuacag

SEQ ID NO: 1355228 - RNA, 22 nt, Homo sapiens
aacuuuccucgccugacaacca

SEQ ID NO: 1355229 - RNA, 18 nt, Homo sapiens
aacuuugauacuuacuca

SEQ ID NO: 1355230 - RNA, 23 nt, Homo sapiens
aacuuuguuuagcccaaaaccaa

SEQ ID NO: 1355231 - RNA, 18 nt, Homo sapiens
aacuuuuaucacuguugc

SEQ ID NO: 1355232 - RNA, 14 nt, Homo sapiens
aagaaaaauaucuu

SEQ ID NO: 1355233 - RNA, 22 nt, Homo sapiens
aagaaaaaugagcauacaucuu

SEQ ID NO: 1355234 - RNA, 14 nt, Homo sapiens
aagaaaaauuaucu

SEQ ID NO: 1355235 - RNA, 15 nt, Homo sapiens
aagaaaaauuaucuu

SEQ ID NO: 1355236 - RNA, 23 nt, Homo sapiens
aagaaagagcaacaauccaucuc

SEQ ID NO: 1355237 - RNA, 12 nt, Homo sapiens
aagaaccuggaa

SEQ ID NO: 1355238 - RNA, 22 nt, Homo sapiens
aagaacggcuuggcagccaguc

SEQ ID NO: 1355239 - RNA, 15 nt, Homo sapiens
aagaagcucucuccu

SEQ ID NO: 1355240 - RNA, 22 nt, Homo sapiens
aagaaggaaaaaauaaaagauc

SEQ ID NO: 1355241 - RNA, 16 nt, Homo sapiens
aagaaugaacacuccc

SEQ ID NO: 1355242 - RNA, 18 nt, Homo sapiens
aagaauguguuuaaacuu

SEQ ID NO: 1355243 - RNA, 17 nt, Homo sapiens
aagacaacaggcauuuu

SEQ ID NO: 1355244 - RNA, 22 nt, Homo sapiens
aagacauuucucuaacuccugc

SEQ ID NO: 1355245 - RNA, 14 nt, Homo sapiens
aagacgacuguggu

SEQ ID NO: 1355246 - RNA, 13 nt, Homo sapiens
aagacuacugaag

SEQ ID NO: 1355247 - RNA, 17 nt, Homo sapiens
aagacugcaaacccuuu

SEQ ID NO: 1355248 - RNA, 18 nt, Homo sapiens
aagacugucagcuuccaa

SEQ ID NO: 1355249 - RNA, 13 nt, Homo sapiens
aagagcaaugugu

SEQ ID NO: 1355250 - RNA, 14 nt, Homo sapiens
aagagucauuguua

SEQ ID NO: 1355251 - RNA, 14 nt, Homo sapiens
aagauaacuaggaa

SEQ ID NO: 1355252 - RNA, 20 nt, Homo sapiens
aagaugcauuaucuaugaua

SEQ ID NO: 1355253 - RNA, 20 nt, Homo sapiens
aagaugcuucucacugccau

SEQ ID NO: 1355254 - RNA, 20 nt, Homo sapiens
aagauggguggaucacuuga

SEQ ID NO: 1355255 - RNA, 18 nt, Homo sapiens
aagauguuucaaaaaauc

SEQ ID NO: 1355256 - RNA, 16 nt, Homo sapiens
aagauugagaagccau

SEQ ID NO: 1355257 - RNA, 17 nt, Homo sapiens
aagauugagaagccaug

SEQ ID NO: 1355258 - RNA, 22 nt, Homo sapiens
aagcaacuuuacugagacaaug

SEQ ID NO: 1355259 - RNA, 15 nt, Homo sapiens
aagcaccccaugcca

SEQ ID NO: 1355260 - RNA, 16 nt, Homo sapiens
aagcacuuugugcugu

SEQ ID NO: 1355261 - RNA, 20 nt, Homo sapiens
aagcagacccaccucccagc

SEQ ID NO: 1355262 - RNA, 21 nt, Homo sapiens
aagcagaugcaaagaggcaag

SEQ ID NO: 1355263 - RNA, 18 nt, Homo sapiens
aagcagccaagcuccuug

SEQ ID NO: 1355264 - RNA, 15 nt, Homo sapiens
aagcagcucaaaggc

SEQ ID NO: 1355265 - RNA, 20 nt, Homo sapiens
aagcagucgugccugugucc

SEQ ID NO: 1355266 - RNA, 23 nt, Homo sapiens
aagcauaccauugaaacaugcca

SEQ ID NO: 1355267 - RNA, 18 nt, Homo sapiens
aagcccugugcuccaugg

SEQ ID NO: 1355268 - RNA, 15 nt, Homo sapiens
aagccgugauuuuca

SEQ ID NO: 1355269 - RNA, 16 nt, Homo sapiens
aagccuaugugccuuu

SEQ ID NO: 1355270 - RNA, 12 nt, Homo sapiens
aagccugagaac

SEQ ID NO: 1355271 - RNA, 16 nt, Homo sapiens
aagccugagaacugaa

SEQ ID NO: 1355272 - RNA, 19 nt, Homo sapiens
aagcgaccgaggcccuccc

SEQ ID NO: 1355273 - RNA, 20 nt, Homo sapiens
aagcggaugcuccauuucaa

SEQ ID NO: 1355274 - RNA, 12 nt, Homo sapiens
aagcgugaaggc

SEQ ID NO: 1355275 - RNA, 22 nt, Homo sapiens
aagcucaucucagcuccugaaa

SEQ ID NO: 1355276 - RNA, 17 nt, Homo sapiens
aagcugacauugccaaa

SEQ ID NO: 1355277 - RNA, 19 nt, Homo sapiens
aaggaaagauuugugaacu

SEQ ID NO: 1355278 - RNA, 24 nt, Homo sapiens
aaggagccaauugauuucaacaga

SEQ ID NO: 1355279 - RNA, 20 nt, Homo sapiens
aaggagggcagaucacuuca

SEQ ID NO: 1355280 - RNA, 12 nt, Homo sapiens
aaggaugucugc

SEQ ID NO: 1355281 - RNA, 15 nt, Homo sapiens
aaggcaccuauaaaa

SEQ ID NO: 1355282 - RNA, 15 nt, Homo sapiens
aaggcaguagaacuc

SEQ ID NO: 1355283 - RNA, 16 nt, Homo sapiens
aaggcuuuuggugaaa

SEQ ID NO: 1355284 - RNA, 23 nt, Homo sapiens
aagggauuugaggugaggguugg

SEQ ID NO: 1355285 - RNA, 21 nt, Homo sapiens
cuaaacacgugacacaaacac

SEQ ID NO: 1355286 - RNA, 21 nt, Homo sapiens
cuaaagaaaaauaucuuggcc

SEQ ID NO: 1355287 - RNA, 16 nt, Homo sapiens
cuaaagguuguauugc

SEQ ID NO: 1355288 - RNA, 11 nt, Homo sapiens
cuaaaguuaua

SEQ ID NO: 1355289 - RNA, 20 nt, Homo sapiens
cuaaauuuucugaaacugca

SEQ ID NO: 1355290 - RNA, 19 nt, Homo sapiens
cuaacaaguagcacacuga

SEQ ID NO: 1355291 - RNA, 22 nt, Homo sapiens
cuaacaaguagcacacugaguu

SEQ ID NO: 1355292 - RNA, 13 nt, Homo sapiens
cuaacuagcuugg

SEQ ID NO: 1355293 - RNA, 18 nt, Homo sapiens
cuaacuggacagccucuu

SEQ ID NO: 1355294 - RNA, 21 nt, Homo sapiens
cuaagcccccacuacaaguga

SEQ ID NO: 1355295 - RNA, 16 nt, Homo sapiens
cuaauagucuuugcca

SEQ ID NO: 1355296 - RNA, 19 nt, Homo sapiens
cuaaucauccaaugcucaa

SEQ ID NO: 1355297 - RNA, 14 nt, Homo sapiens
cuaaugcuaugcaa

SEQ ID NO: 1355298 - RNA, 16 nt, Homo sapiens
cuaauucucuguggaa

SEQ ID NO: 1355299 - RNA, 12 nt, Homo sapiens
cuacacacaaac

SEQ ID NO: 1355300 - RNA, 15 nt, Homo sapiens
cuaccuaccaagaua

SEQ ID NO: 1355301 - RNA, 23 nt, Homo sapiens
cuacggaacugcacacucagugg

SEQ ID NO: 1355302 - RNA, 17 nt, Homo sapiens
cuagacuguuacuuugg

SEQ ID NO: 1355303 - RNA, 20 nt, Homo sapiens
cuagcacuuugggaggccaa

SEQ ID NO: 1355304 - RNA, 19 nt, Homo sapiens
cuaggaaacucacacuccc

SEQ ID NO: 1355305 - RNA, 16 nt, Homo sapiens
cuaggaguauccucau

SEQ ID NO: 1355306 - RNA, 16 nt, Homo sapiens
cuaggaugguucugug

SEQ ID NO: 1355307 - RNA, 13 nt, Homo sapiens
cuaggugcccuug

SEQ ID NO: 1355308 - RNA, 13 nt, Homo sapiens
cuaguaagugccu

SEQ ID NO: 1355309 - RNA, 16 nt, Homo sapiens
cuaguauaucagugac

SEQ ID NO: 1355310 - RNA, 17 nt, Homo sapiens
cuaguauaucagugaca

SEQ ID NO: 1355311 - RNA, 14 nt, Homo sapiens
cuagucaagcuccu

SEQ ID NO: 1355312 - RNA, 14 nt, Homo sapiens
cuaguguacauuuc

SEQ ID NO: 1355313 - RNA, 16 nt, Homo sapiens
cuauaacuauguugau

SEQ ID NO: 1355314 - RNA, 16 nt, Homo sapiens
cuaucaggugccccuc

SEQ ID NO: 1355315 - RNA, 14 nt, Homo sapiens
cuaugcaaucugag

SEQ ID NO: 1355316 - RNA, 13 nt, Homo sapiens
cuauguugauaaa

SEQ ID NO: 1355317 - RNA, 23 nt, Homo sapiens
cuauuaaaaagguuuacagaauu

SEQ ID NO: 1355318 - RNA, 15 nt, Homo sapiens
cuauucaguuuucag

SEQ ID NO: 1355319 - RNA, 22 nt, Homo sapiens
cuauuuuuauuuguuugugcau

SEQ ID NO: 1355320 - RNA, 21 nt, Homo sapiens
cuauuuuuguuaagcgugucu

SEQ ID NO: 1355321 - RNA, 20 nt, Homo sapiens
cucaaaccaacucaguggug

SEQ ID NO: 1355322 - RNA, 19 nt, Homo sapiens
cucaaacucuuaaaaccca

SEQ ID NO: 1355323 - RNA, 13 nt, Homo sapiens
cucaaaggcacag

SEQ ID NO: 1355324 - RNA, 18 nt, Homo sapiens
cucaagaaacaacuucua

SEQ ID NO: 1355325 - RNA, 17 nt, Homo sapiens
cucaagccaagcagcca

SEQ ID NO: 1355326 - RNA, 16 nt, Homo sapiens
cucaagcccugcaguc

SEQ ID NO: 1355327 - RNA, 22 nt, Homo sapiens
cucaagcccugcagucacagcu

SEQ ID NO: 1355328 - RNA, 19 nt, Homo sapiens
cucacaccuguaaucccag

SEQ ID NO: 1355329 - RNA, 19 nt, Homo sapiens
cucacauccauucuucccu

SEQ ID NO: 1355330 - RNA, 12 nt, Homo sapiens
cucaccaaaacg

SEQ ID NO: 1355331 - RNA, 16 nt, Homo sapiens
cucacgcaccucccau

SEQ ID NO: 1355332 - RNA, 15 nt, Homo sapiens
cucacucccagucca

SEQ ID NO: 1355333 - RNA, 16 nt, Homo sapiens
cucacugccagugcag

SEQ ID NO: 1355334 - RNA, 14 nt, Homo sapiens
cucacuuaucccaa

SEQ ID NO: 1355335 - RNA, 20 nt, Homo sapiens
cucagacacaaauaaaggaa

SEQ ID NO: 1355336 - RNA, 23 nt, Homo sapiens
cucagauaagguaaaaugccaug

SEQ ID NO: 1355337 - RNA, 18 nt, Homo sapiens
cucagcacugugccagug

SEQ ID NO: 1355338 - RNA, 22 nt, Homo sapiens
cucagcauuugauuaacauuug

SEQ ID NO: 1355339 - RNA, 12 nt, Homo sapiens
cucagugcuguc

SEQ ID NO: 1355340 - RNA, 21 nt, Homo sapiens
cucauccaaaaagucugagcg

SEQ ID NO: 1355341 - RNA, 15 nt, Homo sapiens
cucaugcauaugcau

SEQ ID NO: 1355342 - RNA, 15 nt, Homo sapiens
cucauggauuugaau

SEQ ID NO: 1355343 - RNA, 18 nt, Homo sapiens
cucaugggaaggggagga

SEQ ID NO: 1355344 - RNA, 12 nt, Homo sapiens
cucauuuacaac

SEQ ID NO: 1355345 - RNA, 16 nt, Homo sapiens
cuccaagucacaaaga

SEQ ID NO: 1355346 - RNA, 17 nt, Homo sapiens
cuccaucauuaauguga

SEQ ID NO: 1355347 - RNA, 17 nt, Homo sapiens
cuccauuucuacugugu

SEQ ID NO: 1355348 - RNA, 20 nt, Homo sapiens
cucccaaagugcugggauua

SEQ ID NO: 1355349 - RNA, 15 nt, Homo sapiens
cucccaaaguguccu

SEQ ID NO: 1355350 - RNA, 20 nt, Homo sapiens
cucccaggcuggagugcagu

SEQ ID NO: 1355351 - RNA, 13 nt, Homo sapiens
cuccccaccucca

SEQ ID NO: 1355352 - RNA, 21 nt, Homo sapiens
cuccccagccuuugaucaggu

SEQ ID NO: 1355353 - RNA, 18 nt, Homo sapiens
cucccuccagauauacuu

SEQ ID NO: 1355354 - RNA, 22 nt, Homo sapiens
cucccucucucuucugcuccac

SEQ ID NO: 1355355 - RNA, 22 nt, Homo sapiens
cauuuuauuuuuucuugcaaau

SEQ ID NO: 1355356 - RNA, 15 nt, Homo sapiens
ccaaaauucauuucu

SEQ ID NO: 1355357 - RNA, 13 nt, Homo sapiens
ccaaagugcugcg

SEQ ID NO: 1355358 - RNA, 13 nt, Homo sapiens
ccaacaaaccauc

SEQ ID NO: 1355359 - RNA, 14 nt, Homo sapiens
ccaacaugugcuca

SEQ ID NO: 1355360 - RNA, 17 nt, Homo sapiens
ccaacguggcccagaga

SEQ ID NO: 1355361 - RNA, 19 nt, Homo sapiens
ccaagcaggaagcucagac

SEQ ID NO: 1355362 - RNA, 22 nt, Homo sapiens
ccaagcggaugcuccauuucaa

SEQ ID NO: 1355363 - RNA, 17 nt, Homo sapiens
ccaagggaucugccauu

SEQ ID NO: 1355364 - RNA, 16 nt, Homo sapiens
ccaagucucagaagag

SEQ ID NO: 1355365 - RNA, 24 nt, Homo sapiens
ccaagugaccgacucauuuacaac

SEQ ID NO: 1355366 - RNA, 21 nt, Homo sapiens
ccaauccuuaaauaugugaaa

SEQ ID NO: 1355367 - RNA, 16 nt, Homo sapiens
ccaaugcuuacgucaa

SEQ ID NO: 1355368 - RNA, 16 nt, Homo sapiens
ccaauggaaugugaug

SEQ ID NO: 1355369 - RNA, 18 nt, Homo sapiens
ccacaaccgaccagaugc

SEQ ID NO: 1355370 - RNA, 16 nt, Homo sapiens
ccaccaggcugcucag

SEQ ID NO: 1355371 - RNA, 19 nt, Homo sapiens
ccaccaggugccuuucaaa

SEQ ID NO: 1355372 - RNA, 15 nt, Homo sapiens
ccaccaucaccagac

SEQ ID NO: 1355373 - RNA, 22 nt, Homo sapiens
ccacccucauucuacugaaaag

SEQ ID NO: 1355374 - RNA, 21 nt, Homo sapiens
ccacccuggugggccaacaaa

SEQ ID NO: 1355375 - RNA, 17 nt, Homo sapiens
ccacgaacuugcugggu

SEQ ID NO: 1355376 - RNA, 19 nt, Homo sapiens
ccacgcgugccguggcacc

SEQ ID NO: 1355377 - RNA, 14 nt, Homo sapiens
ccacggugccucca

SEQ ID NO: 1355378 - RNA, 13 nt, Homo sapiens
ccacuccuaauau

SEQ ID NO: 1355379 - RNA, 10 nt, Homo sapiens
ccacucuguu

SEQ ID NO: 1355380 - RNA, 14 nt, Homo sapiens
ccacugugcuuuca

SEQ ID NO: 1355381 - RNA, 19 nt, Homo sapiens
ccacuuccccacaggugaa

SEQ ID NO: 1355382 - RNA, 12 nt, Homo sapiens
ccagagaccaag

SEQ ID NO: 1355383 - RNA, 23 nt, Homo sapiens
ccagagccucccuccggacaaug

SEQ ID NO: 1355384 - RNA, 13 nt, Homo sapiens
ccagaugccaggg

SEQ ID NO: 1355385 - RNA, 14 nt, Homo sapiens
ccagauucaugcac

SEQ ID NO: 1355386 - RNA, 22 nt, Homo sapiens
ccagauugacgacaagugcuga

SEQ ID NO: 1355387 - RNA, 19 nt, Homo sapiens
ccagcacgaguggccaguu

SEQ ID NO: 1355388 - RNA, 20 nt, Homo sapiens
ccagcacuuugggaggccaa

SEQ ID NO: 1355389 - RNA, 19 nt, Homo sapiens
ccagcagggaaaaugcagc

SEQ ID NO: 1355390 - RNA, 18 nt, Homo sapiens
ccagcuaagaaccuggaa

SEQ ID NO: 1355391 - RNA, 23 nt, Homo sapiens
ccagcucaggacagaugccacac

SEQ ID NO: 1355392 - RNA, 13 nt, Homo sapiens
ccaggacccugaa

SEQ ID NO: 1355393 - RNA, 16 nt, Homo sapiens
ccaggaugcugcugca

SEQ ID NO: 1355394 - RNA, 15 nt, Homo sapiens
ccaggcuggucuuga

SEQ ID NO: 1355395 - RNA, 14 nt, Homo sapiens
ccaguagaugccac

SEQ ID NO: 1355396 - RNA, 15 nt, Homo sapiens
ccaguauaagcauuu

SEQ ID NO: 1355397 - RNA, 11 nt, Homo sapiens
ccagugacacc

SEQ ID NO: 1355398 - RNA, 21 nt, Homo sapiens
ccaguggaagcagguguauug

SEQ ID NO: 1355399 - RNA, 20 nt, Homo sapiens
ccaguguguuucugaucuga

SEQ ID NO: 1355400 - RNA, 19 nt, Homo sapiens
ccauaauugcuuugccaaa

SEQ ID NO: 1355401 - RNA, 15 nt, Homo sapiens
ccauauagaaaucua

SEQ ID NO: 1355402 - RNA, 13 nt, Homo sapiens
ccauaucagugaa

SEQ ID NO: 1355403 - RNA, 15 nt, Homo sapiens
ccauaugaacauaua

SEQ ID NO: 1355404 - RNA, 15 nt, Homo sapiens
ccaucucgggcacag

SEQ ID NO: 1355405 - RNA, 22 nt, Homo sapiens
ccaucucgggcacaggcccacc

SEQ ID NO: 1355406 - RNA, 15 nt, Homo sapiens
ccaugaaaaugcaac

SEQ ID NO: 1355407 - RNA, 22 nt, Homo sapiens
ccaugcaggggucagugcagca

SEQ ID NO: 1355408 - RNA, 16 nt, Homo sapiens
ccauggcucagggugg

SEQ ID NO: 1355409 - RNA, 19 nt, Homo sapiens
ccauggcuguguuggugug

SEQ ID NO: 1355410 - RNA, 15 nt, Homo sapiens
ccaugucugcauuuc

SEQ ID NO: 1355411 - RNA, 15 nt, Homo sapiens
ccauuagaccaagcu

SEQ ID NO: 1355412 - RNA, 18 nt, Homo sapiens
ccauucaagucuuucuaa

SEQ ID NO: 1355413 - RNA, 21 nt, Homo sapiens
ccauuuagcugcccacgcugc

SEQ ID NO: 1355414 - RNA, 19 nt, Homo sapiens
ccauuucugaacuguuaca

SEQ ID NO: 1355415 - RNA, 16 nt, Homo sapiens
cccaacaaaccaucca

SEQ ID NO: 1355416 - RNA, 16 nt, Homo sapiens
cccaacccgugccccu

SEQ ID NO: 1355417 - RNA, 18 nt, Homo sapiens
cccaaggugcugauguca

SEQ ID NO: 1355418 - RNA, 22 nt, Homo sapiens
cccaaucucugccauaucagug

SEQ ID NO: 1355419 - RNA, 13 nt, Homo sapiens
cccacagguauga

SEQ ID NO: 1355420 - RNA, 18 nt, Homo sapiens
cccagagacauacuugaa

SEQ ID NO: 1355421 - RNA, 20 nt, Homo sapiens
cccagauucuucagcuugau

SEQ ID NO: 1355422 - RNA, 17 nt, Homo sapiens
cccagcacgugggucua

SEQ ID NO: 1355423 - RNA, 20 nt, Homo sapiens
cccagcucacaggagcuuaa

SEQ ID NO: 1355424 - RNA, 18 nt, Homo sapiens
cccaggacccugaagggg

SEQ ID NO: 1355425 - RNA, 15 nt, Homo sapiens
cccaggagcaaguga

SEQ ID NO: 1355426 - RNA, 21 nt, Homo sapiens
cccaggaguauccucuugcca

SEQ ID NO: 1355427 - RNA, 23 nt, Homo sapiens
cccaggcuggagagcacugccag

SEQ ID NO: 1355428 - RNA, 17 nt, Homo sapiens
cccagugcccccacuga

SEQ ID NO: 1355429 - RNA, 20 nt, Homo sapiens
cccagugcccccacugacca

SEQ ID NO: 1355430 - RNA, 18 nt, Homo sapiens
cugagaagugcacuuuaa

SEQ ID NO: 1355431 - RNA, 15 nt, Homo sapiens
cugagagaguagcag

SEQ ID NO: 1355432 - RNA, 14 nt, Homo sapiens
cugagauacauaca

SEQ ID NO: 1355433 - RNA, 19 nt, Homo sapiens
cugagauacauacagaauu

SEQ ID NO: 1355434 - RNA, 20 nt, Homo sapiens
cugagauacauacagaauua

SEQ ID NO: 1355435 - RNA, 18 nt, Homo sapiens
cugagauugggcaugggg

SEQ ID NO: 1355436 - RNA, 18 nt, Homo sapiens
cugagcacgcuaccaaau

SEQ ID NO: 1355437 - RNA, 14 nt, Homo sapiens
cugagcacugacug

SEQ ID NO: 1355438 - RNA, 19 nt, Homo sapiens
cugagcccaacccuucuaa

SEQ ID NO: 1355439 - RNA, 16 nt, Homo sapiens
cugagcgaggagugac

SEQ ID NO: 1355440 - RNA, 19 nt, Homo sapiens
cugagcuggccuccuaugc

SEQ ID NO: 1355441 - RNA, 22 nt, Homo sapiens
cugaggacguggugacuuccug

SEQ ID NO: 1355442 - RNA, 14 nt, Homo sapiens
cugaggcagggaag

SEQ ID NO: 1355443 - RNA, 17 nt, Homo sapiens
cugaggcccccaucucc

SEQ ID NO: 1355444 - RNA, 19 nt, Homo sapiens
cugaggccuggacuuuccu

SEQ ID NO: 1355445 - RNA, 20 nt, Homo sapiens
cugaggugggaggaucucuu

SEQ ID NO: 1355446 - RNA, 22 nt, Homo sapiens
cugagugaaggaaaugaaucuu

SEQ ID NO: 1355447 - RNA, 13 nt, Homo sapiens
cugagugcugaaa

SEQ ID NO: 1355448 - RNA, 18 nt, Homo sapiens
cugagugggggaucacag

SEQ ID NO: 1355449 - RNA, 16 nt, Homo sapiens
cugaguggugccaaac

SEQ ID NO: 1355450 - RNA, 20 nt, Homo sapiens
cugaguuuuccauggcagga

SEQ ID NO: 1355451 - RNA, 13 nt, Homo sapiens
cugauaaugcuca

SEQ ID NO: 1355452 - RNA, 14 nt, Homo sapiens
cugauaaugcucac

SEQ ID NO: 1355453 - RNA, 21 nt, Homo sapiens
cugaugaccgucugagcccag

SEQ ID NO: 1355454 - RNA, 15 nt, Homo sapiens
cugaugcugccccuc

SEQ ID NO: 1355455 - RNA, 15 nt, Homo sapiens
cugaugggaaaacug

SEQ ID NO: 1355456 - RNA, 14 nt, Homo sapiens
cugauuccuguugc

SEQ ID NO: 1355457 - RNA, 20 nt, Homo sapiens
cugcaaagaucuguccucag

SEQ ID NO: 1355458 - RNA, 12 nt, Homo sapiens
cugcacuuccag

SEQ ID NO: 1355459 - RNA, 15 nt, Homo sapiens
cugcagaaacagugc

SEQ ID NO: 1355460 - RNA, 21 nt, Homo sapiens
cugcagcuuuguuuguuguca

SEQ ID NO: 1355461 - RNA, 15 nt, Homo sapiens
cugcaggcagggcug

SEQ ID NO: 1355462 - RNA, 16 nt, Homo sapiens
cugcaggcggggcucc

SEQ ID NO: 1355463 - RNA, 12 nt, Homo sapiens
cugccaaaaagg

SEQ ID NO: 1355464 - RNA, 15 nt, Homo sapiens
cugccaaaaugcucu

SEQ ID NO: 1355465 - RNA, 22 nt, Homo sapiens
cugccaacacgcccggcuaauu

SEQ ID NO: 1355466 - RNA, 21 nt, Homo sapiens
cugccacccagaguggcuucc

SEQ ID NO: 1355467 - RNA, 22 nt, Homo sapiens
cugccaggacccaccacuggaa

SEQ ID NO: 1355468 - RNA, 21 nt, Homo sapiens
cugccagggcaccuacugaga

SEQ ID NO: 1355469 - RNA, 21 nt, Homo sapiens
cugcccacgcugcagugugag

SEQ ID NO: 1355470 - RNA, 20 nt, Homo sapiens
cugcccaugagucaggggag

SEQ ID NO: 1355471 - RNA, 13 nt, Homo sapiens
cugcgcagcaucc

SEQ ID NO: 1355472 - RNA, 15 nt, Homo sapiens
cugcggcgucugucu

SEQ ID NO: 1355473 - RNA, 15 nt, Homo sapiens
cugcuccagaccuga

SEQ ID NO: 1355474 - RNA, 12 nt, Homo sapiens
cugcuccagcug

SEQ ID NO: 1355475 - RNA, 15 nt, Homo sapiens
cugcucccgucuguc

SEQ ID NO: 1355476 - RNA, 23 nt, Homo sapiens
cugcuccgugcuuguuugcucac

SEQ ID NO: 1355477 - RNA, 21 nt, Homo sapiens
cugcucugucuucuuugccca

SEQ ID NO: 1355478 - RNA, 15 nt, Homo sapiens
cugcucuuucucugc

SEQ ID NO: 1355479 - RNA, 18 nt, Homo sapiens
cugcucuuuggaaauggc

SEQ ID NO: 1355480 - RNA, 23 nt, Homo sapiens
cugcugagaucuucucuguuauu

SEQ ID NO: 1355481 - RNA, 11 nt, Homo sapiens
cugcugagcug

SEQ ID NO: 1355482 - RNA, 21 nt, Homo sapiens
cugcuggggagacaaaucuca

SEQ ID NO: 1355483 - RNA, 16 nt, Homo sapiens
cuggaaaacagcugcu

SEQ ID NO: 1355484 - RNA, 17 nt, Homo sapiens
cuggaaccugcaaaaaa

SEQ ID NO: 1355485 - RNA, 20 nt, Homo sapiens
cuggaagaaagcaacaaaga

SEQ ID NO: 1355486 - RNA, 20 nt, Homo sapiens
cuggaaguuucuggugccau

SEQ ID NO: 1355487 - RNA, 15 nt, Homo sapiens
cuggacggggcgggc

SEQ ID NO: 1355488 - RNA, 16 nt, Homo sapiens
cuggagaaaaggcagu

SEQ ID NO: 1355489 - RNA, 14 nt, Homo sapiens
cuggagagcacugc

SEQ ID NO: 1355490 - RNA, 18 nt, Homo sapiens
cuggaguggccacuaagc

SEQ ID NO: 1355491 - RNA, 13 nt, Homo sapiens
cuggauuccucga

SEQ ID NO: 1355492 - RNA, 15 nt, Homo sapiens
cuggcaagaaugugu

SEQ ID NO: 1355493 - RNA, 17 nt, Homo sapiens
cuggcagcaggaugcuc

SEQ ID NO: 1355494 - RNA, 17 nt, Homo sapiens
cuggcgccccuuccuag

SEQ ID NO: 1355495 - RNA, 23 nt, Homo sapiens
cugggaagcccggacugaccaaa

SEQ ID NO: 1355496 - RNA, 15 nt, Homo sapiens
cugggcaauauagca

SEQ ID NO: 1355497 - RNA, 16 nt, Homo sapiens
cugggcagaaggccaa

SEQ ID NO: 1355498 - RNA, 16 nt, Homo sapiens
uccaugggaccacaac

SEQ ID NO: 1355499 - RNA, 12 nt, Homo sapiens
uccauguacuug

SEQ ID NO: 1355500 - RNA, 14 nt, Homo sapiens
uccauucuucccuu

SEQ ID NO: 1355501 - RNA, 15 nt, Homo sapiens
uccauugauucaggg

SEQ ID NO: 1355502 - RNA, 14 nt, Homo sapiens
ucccacccugagau

SEQ ID NO: 1355503 - RNA, 13 nt, Homo sapiens
ucccacucaagcc

SEQ ID NO: 1355504 - RNA, 18 nt, Homo sapiens
ucccagaacacacuccau

SEQ ID NO: 1355505 - RNA, 15 nt, Homo sapiens
ucccagcuacuagag

SEQ ID NO: 1355506 - RNA, 15 nt, Homo sapiens
ucccagcuacuuggg

SEQ ID NO: 1355507 - RNA, 19 nt, Homo sapiens
ucccauaauugcuuugcca

SEQ ID NO: 1355508 - RNA, 17 nt, Homo sapiens
ucccauagugugcauca

SEQ ID NO: 1355509 - RNA, 21 nt, Homo sapiens
uccccaccugcacuccaucca

SEQ ID NO: 1355510 - RNA, 21 nt, Homo sapiens
uccccgcagugugcacuaagg

SEQ ID NO: 1355511 - RNA, 22 nt, Homo sapiens
uccccucccuggcucccaugac

SEQ ID NO: 1355512 - RNA, 16 nt, Homo sapiens
uccccuugaaaacugc

SEQ ID NO: 1355513 - RNA, 20 nt, Homo sapiens
ucccuaaaaacacagacauu

SEQ ID NO: 1355514 - RNA, 19 nt, Homo sapiens
ucccuaagugcaacugcaa

SEQ ID NO: 1355515 - RNA, 12 nt, Homo sapiens
ucccuaccucag

SEQ ID NO: 1355516 - RNA, 15 nt, Homo sapiens
ucccuaggaaacuca

SEQ ID NO: 1355517 - RNA, 22 nt, Homo sapiens
ucccucccccccaugcacugug

SEQ ID NO: 1355518 - RNA, 19 nt, Homo sapiens
ucccugcgccugugaugcu

SEQ ID NO: 1355519 - RNA, 24 nt, Homo sapiens
ucccuggggaaaacuugcagcuaa

SEQ ID NO: 1355520 - RNA, 19 nt, Homo sapiens
ucccuugccucaaugccag

SEQ ID NO: 1355521 - RNA, 15 nt, Homo sapiens
ucccuugcuugccug

SEQ ID NO: 1355522 - RNA, 23 nt, Homo sapiens
ucccuuucaucacauuuguuuga

SEQ ID NO: 1355523 - RNA, 16 nt, Homo sapiens
uccgaggcugaggcag

SEQ ID NO: 1355524 - RNA, 15 nt, Homo sapiens
uccgccauucucaag

SEQ ID NO: 1355525 - RNA, 20 nt, Homo sapiens
uccguggucagagugccacu

SEQ ID NO: 1355526 - RNA, 19 nt, Homo sapiens
uccuaauauuuugauucau

SEQ ID NO: 1355527 - RNA, 19 nt, Homo sapiens
uccuaaugaaugcauaaaa

SEQ ID NO: 1355528 - RNA, 15 nt, Homo sapiens
uccuacugcugugag

SEQ ID NO: 1355529 - RNA, 13 nt, Homo sapiens
uccuagcacuuug

SEQ ID NO: 1355530 - RNA, 13 nt, Homo sapiens
uccuagcuguuag

SEQ ID NO: 1355531 - RNA, 21 nt, Homo sapiens
uccucagaagucaguugcaaa

SEQ ID NO: 1355532 - RNA, 19 nt, Homo sapiens
uccucagccuugccagaga

SEQ ID NO: 1355533 - RNA, 21 nt, Homo sapiens
uccucauuagcauuuugcuaa

SEQ ID NO: 1355534 - RNA, 22 nt, Homo sapiens
uccucauuuuugaauacaggca

SEQ ID NO: 1355535 - RNA, 13 nt, Homo sapiens
uccuccaacagcu

SEQ ID NO: 1355536 - RNA, 20 nt, Homo sapiens
uccuccagaagccucuggcu

SEQ ID NO: 1355537 - RNA, 19 nt, Homo sapiens
uccuccaucauuaauguga

SEQ ID NO: 1355538 - RNA, 15 nt, Homo sapiens
uccucccuccagaua

SEQ ID NO: 1355539 - RNA, 15 nt, Homo sapiens
uccucccuucugcua

SEQ ID NO: 1355540 - RNA, 16 nt, Homo sapiens
uccucgaaacugccau

SEQ ID NO: 1355541 - RNA, 19 nt, Homo sapiens
uccucucccauccuugaug

SEQ ID NO: 1355542 - RNA, 16 nt, Homo sapiens
uccugaaacaacuugg

SEQ ID NO: 1355543 - RNA, 14 nt, Homo sapiens
uccugauagccugu

SEQ ID NO: 1355544 - RNA, 18 nt, Homo sapiens
uccugaugcuuuugucua

SEQ ID NO: 1355545 - RNA, 15 nt, Homo sapiens
uccugccccaggugu

SEQ ID NO: 1355546 - RNA, 23 nt, Homo sapiens
uccuguccagcuccaaccugcaa

SEQ ID NO: 1355547 - RNA, 15 nt, Homo sapiens
uccugucugauucuc

SEQ ID NO: 1355548 - RNA, 20 nt, Homo sapiens
uccuguuuuugucauguuua

SEQ ID NO: 1355549 - RNA, 20 nt, Homo sapiens
uccuuaaauaugugaaagga

SEQ ID NO: 1355550 - RNA, 14 nt, Homo sapiens
uccuuccacuucag

SEQ ID NO: 1355551 - RNA, 16 nt, Homo sapiens
uccuuccaucccuacc

SEQ ID NO: 1355552 - RNA, 20 nt, Homo sapiens
uccuuccuguggguggggcu

SEQ ID NO: 1355553 - RNA, 10 nt, Homo sapiens
uccuuggcau

SEQ ID NO: 1355554 - RNA, 16 nt, Homo sapiens
uccuuugccugauccu

SEQ ID NO: 1355555 - RNA, 22 nt, Homo sapiens
uuacaucaugcuggaaccugca

SEQ ID NO: 1355556 - RNA, 16 nt, Homo sapiens
uuacgcggagcacuuu

SEQ ID NO: 1355557 - RNA, 17 nt, Homo sapiens
uuacuaauuauacuacu

SEQ ID NO: 1355558 - RNA, 13 nt, Homo sapiens
uuacugagacaau

SEQ ID NO: 1355559 - RNA, 19 nt, Homo sapiens
uuagaaaagguuucuuaaa

SEQ ID NO: 1355560 - RNA, 22 nt, Homo sapiens
uuagaaagcugacauugccaaa

SEQ ID NO: 1355561 - RNA, 15 nt, Homo sapiens
uuagaaugcaucuca

SEQ ID NO: 1355562 - RNA, 23 nt, Homo sapiens
uuagaaugccgguuaaauuccau

SEQ ID NO: 1355563 - RNA, 15 nt, Homo sapiens
uuagaauuauaucac

SEQ ID NO: 1355564 - RNA, 22 nt, Homo sapiens
uuagagcacaggaagugacaac

SEQ ID NO: 1355565 - RNA, 21 nt, Homo sapiens
uuaggaauacugggugcuguc

SEQ ID NO: 1355566 - RNA, 18 nt, Homo sapiens
uuaggauuuucacauucu

SEQ ID NO: 1355567 - RNA, 13 nt, Homo sapiens
uuagggaggacca

SEQ ID NO: 1355568 - RNA, 19 nt, Homo sapiens
uuagugguuacccaguuag

SEQ ID NO: 1355569 - RNA, 18 nt, Homo sapiens
uuagugucucauguggaa

SEQ ID NO: 1355570 - RNA, 15 nt, Homo sapiens
uuauaaaagaugcau

SEQ ID NO: 1355571 - RNA, 23 nt, Homo sapiens
uuauaaagggagauaacaaucug

SEQ ID NO: 1355572 - RNA, 13 nt, Homo sapiens
uuauaacaagugu

SEQ ID NO: 1355573 - RNA, 12 nt, Homo sapiens
uuauaaucuacu

SEQ ID NO: 1355574 - RNA, 14 nt, Homo sapiens
uuauacuacuuugu

SEQ ID NO: 1355575 - RNA, 13 nt, Homo sapiens
uuauacuguacaa

SEQ ID NO: 1355576 - RNA, 16 nt, Homo sapiens
uuauauauguaucuaa

SEQ ID NO: 1355577 - RNA, 21 nt, Homo sapiens
uuaucaacuuccuaaauauua

SEQ ID NO: 1355578 - RNA, 22 nt, Homo sapiens
uuaucagcaaaaaaguccaauu

SEQ ID NO: 1355579 - RNA, 14 nt, Homo sapiens
uuaucaucauuaga

SEQ ID NO: 1355580 - RNA, 22 nt, Homo sapiens
uuaugaaaaacagaagcacaaa

SEQ ID NO: 1355581 - RNA, 23 nt, Homo sapiens
uuaugaucaaggugaaauaaaca

SEQ ID NO: 1355582 - RNA, 22 nt, Homo sapiens
uuaugccuugguaaaaacugca

SEQ ID NO: 1355583 - RNA, 13 nt, Homo sapiens
uuaugggcacugg

SEQ ID NO: 1355584 - RNA, 14 nt, Homo sapiens
uuauuacauguaau

SEQ ID NO: 1355585 - RNA, 17 nt, Homo sapiens
uuauucaguaacuguca

SEQ ID NO: 1355586 - RNA, 13 nt, Homo sapiens
uucaagugccaaa

SEQ ID NO: 1355587 - RNA, 17 nt, Homo sapiens
uucacagaugugugauu

SEQ ID NO: 1355588 - RNA, 12 nt, Homo sapiens
uucagaagugcc

SEQ ID NO: 1355589 - RNA, 21 nt, Homo sapiens
uucagaaugucagaaguugau

SEQ ID NO: 1355590 - RNA, 23 nt, Homo sapiens
uucagacucccauuccugaagaa

SEQ ID NO: 1355591 - RNA, 12 nt, Homo sapiens
uucagacuguuu

SEQ ID NO: 1355592 - RNA, 19 nt, Homo sapiens
uucagagugacacccaaga

SEQ ID NO: 1355593 - RNA, 22 nt, Homo sapiens
uucagcacugucccuugccuca

SEQ ID NO: 1355594 - RNA, 17 nt, Homo sapiens
uucagcagcaggugcuu

SEQ ID NO: 1355595 - RNA, 23 nt, Homo sapiens
uucagcauacugacuccaggugu

SEQ ID NO: 1355596 - RNA, 14 nt, Homo sapiens
uucagccaggagau

SEQ ID NO: 1355597 - RNA, 16 nt, Homo sapiens
uucagugcuucgcaga

SEQ ID NO: 1355598 - RNA, 18 nt, Homo sapiens
uucauauuuauacuuugc

SEQ ID NO: 1355599 - RNA, 12 nt, Homo sapiens
uucaucagagga

SEQ ID NO: 1355600 - RNA, 19 nt, Homo sapiens
uucaugacacaaccuuuca

SEQ ID NO: 1355601 - RNA, 23 nt, Homo sapiens
uuuccaugggaccacaacuauuu

SEQ ID NO: 1355602 - RNA, 16 nt, Homo sapiens
uuuccucagugcauuu

SEQ ID NO: 1355603 - RNA, 22 nt, Homo sapiens
uuuccucagugcauuugugcua

SEQ ID NO: 1355604 - RNA, 15 nt, Homo sapiens
uuucuagagcacugc

SEQ ID NO: 1355605 - RNA, 17 nt, Homo sapiens
uuucucccccuuuccaa

SEQ ID NO: 1355606 - RNA, 22 nt, Homo sapiens
uuucucccccuuuccaaaaacu

SEQ ID NO: 1355607 - RNA, 18 nt, Homo sapiens
uuucucuaacuccugcca

SEQ ID NO: 1355608 - RNA, 16 nt, Homo sapiens
uuucucugccagugac

SEQ ID NO: 1355609 - RNA, 19 nt, Homo sapiens
uuucugaacuguuacaacu

SEQ ID NO: 1355610 - RNA, 16 nt, Homo sapiens
uuucugaucugaugca

SEQ ID NO: 1355611 - RNA, 20 nt, Homo sapiens
uuucugauuuuuauucucaa

SEQ ID NO: 1355612 - RNA, 13 nt, Homo sapiens
uuucuggugccau

SEQ ID NO: 1355613 - RNA, 12 nt, Homo sapiens
uuucugugaaua

SEQ ID NO: 1355614 - RNA, 22 nt, Homo sapiens
uuucuguggucuuacugaucuu

SEQ ID NO: 1355615 - RNA, 18 nt, Homo sapiens
uuucuuaaaacauuauga

SEQ ID NO: 1355616 - RNA, 12 nt, Homo sapiens
uuucuuccugag

SEQ ID NO: 1355617 - RNA, 13 nt, Homo sapiens
uuugacauuucau

SEQ ID NO: 1355618 - RNA, 20 nt, Homo sapiens
uuugacuuucuucugaauau

SEQ ID NO: 1355619 - RNA, 20 nt, Homo sapiens
uuugagauuaagaaugccag

SEQ ID NO: 1355620 - RNA, 19 nt, Homo sapiens
uuugagcugagugcugaaa

SEQ ID NO: 1355621 - RNA, 20 nt, Homo sapiens
uuugagcugcugacugccaa

SEQ ID NO: 1355622 - RNA, 19 nt, Homo sapiens
uuugcauaagugcaugaca

SEQ ID NO: 1355623 - RNA, 19 nt, Homo sapiens
uuugccaaaauaccagagc

SEQ ID NO: 1355624 - RNA, 22 nt, Homo sapiens
uuugccugauccuccaacagcu

SEQ ID NO: 1355625 - RNA, 20 nt, Homo sapiens
uuugcuuuaaagagcuuuua

SEQ ID NO: 1355626 - RNA, 13 nt, Homo sapiens
uuuggcuguccag

SEQ ID NO: 1355627 - RNA, 16 nt, Homo sapiens
uuuggggggcagagaa

SEQ ID NO: 1355628 - RNA, 13 nt, Homo sapiens
uuuguggccucag

SEQ ID NO: 1355629 - RNA, 20 nt, Homo sapiens
uuuguuuuguaucauuauga

SEQ ID NO: 1355630 - RNA, 24 nt, Homo sapiens
uuuuaaaaucaauagauucaucac

SEQ ID NO: 1355631 - RNA, 13 nt, Homo sapiens
uuuuaagaccaag

SEQ ID NO: 1355632 - RNA, 12 nt, Homo sapiens
uuuuacaccagu

SEQ ID NO: 1355633 - RNA, 18 nt, Homo sapiens
uuuuagcguuaaagucag

SEQ ID NO: 1355634 - RNA, 17 nt, Homo sapiens
uuuuauuagaaguuuca

SEQ ID NO: 1355635 - RNA, 19 nt, Homo sapiens
uuuuccauccuagugagaa

SEQ ID NO: 1355636 - RNA, 14 nt, Homo sapiens
uuuuccugccaggc

SEQ ID NO: 1355637 - RNA, 15 nt, Homo sapiens
uuuucuagucuucau

SEQ ID NO: 1355638 - RNA, 15 nt, Homo sapiens
uuuucuccucaugga

SEQ ID NO: 1355639 - RNA, 14 nt, Homo sapiens
uuuucugccaggga

SEQ ID NO: 1355640 - RNA, 19 nt, Homo sapiens
uuuuggcccaaucucugcc

SEQ ID NO: 1355641 - RNA, 18 nt, Homo sapiens
uuuuuagcucaucggcua

SEQ ID NO: 1355642 - RNA, 11 nt, Homo sapiens
aggacccugaa

SEQ ID NO: 1355643 - RNA, 14 nt, Homo sapiens
aggacccuucccuu

SEQ ID NO: 1355644 - RNA, 13 nt, Homo sapiens
aggacgagugcuu

SEQ ID NO: 1355645 - RNA, 19 nt, Homo sapiens
aggacguggugacuuccug

SEQ ID NO: 1355646 - RNA, 21 nt, Homo sapiens
aggacugacccuggauuccuc

SEQ ID NO: 1355647 - RNA, 18 nt, Homo sapiens
aggagacccacagguaug

SEQ ID NO: 1355648 - RNA, 12 nt, Homo sapiens
aggagagcaaga

SEQ ID NO: 1355649 - RNA, 22 nt, Homo sapiens
aggagcaaucuaagcuguguua

SEQ ID NO: 1355650 - RNA, 15 nt, Homo sapiens
aggagcaugcuuccu

SEQ ID NO: 1355651 - RNA, 21 nt, Homo sapiens
aggagcugcuggcuugcagug

SEQ ID NO: 1355652 - RNA, 21 nt, Homo sapiens
aggagggagggacacuuaccc

SEQ ID NO: 1355653 - RNA, 16 nt, Homo sapiens
aggagggcccuaccug

SEQ ID NO: 1355654 - RNA, 17 nt, Homo sapiens
aggagugacuuugcagg

SEQ ID NO: 1355655 - RNA, 22 nt, Homo sapiens
aggauacauaaugggccacuga

SEQ ID NO: 1355656 - RNA, 23 nt, Homo sapiens
aggauauuuacuauuacucccag

SEQ ID NO: 1355657 - RNA, 16 nt, Homo sapiens
aggaucuuugacugaa

SEQ ID NO: 1355658 - RNA, 17 nt, Homo sapiens
aggaucuuuugaaccca

SEQ ID NO: 1355659 - RNA, 21 nt, Homo sapiens
aggaugaaagugaccauguuu

SEQ ID NO: 1355660 - RNA, 15 nt, Homo sapiens
aggauuccuuggcau

SEQ ID NO: 1355661 - RNA, 18 nt, Homo sapiens
aggcagagguugcagugu

SEQ ID NO: 1355662 - RNA, 21 nt, Homo sapiens
aggcagcugugucugagccca

SEQ ID NO: 1355663 - RNA, 13 nt, Homo sapiens
aggcaugaaauga

SEQ ID NO: 1355664 - RNA, 20 nt, Homo sapiens
aggcaugagccaccgcgccu

SEQ ID NO: 1355665 - RNA, 23 nt, Homo sapiens
agggucugcucuuucucugccag

SEQ ID NO: 1355666 - RNA, 17 nt, Homo sapiens
agggugcuggacuguau

SEQ ID NO: 1355667 - RNA, 22 nt, Homo sapiens
aggguuuuaguuuuuaauuuau

SEQ ID NO: 1355668 - RNA, 22 nt, Homo sapiens
agguacugucaugggcuaggca

SEQ ID NO: 1355669 - RNA, 15 nt, Homo sapiens
agguauaugugauaa

SEQ ID NO: 1355670 - RNA, 21 nt, Homo sapiens
aggucauguuguaguuuaaau

SEQ ID NO: 1355671 - RNA, 22 nt, Homo sapiens
aggugagcgcuuugcagucaca

SEQ ID NO: 1355672 - RNA, 21 nt, Homo sapiens
aggugccccucuuccaaaggc

SEQ ID NO: 1355673 - RNA, 14 nt, Homo sapiens
agguggcaaaguac

SEQ ID NO: 1355674 - RNA, 20 nt, Homo sapiens
agguggcaaaguacuuguca

SEQ ID NO: 1355675 - RNA, 13 nt, Homo sapiens
agguggugcaaau

SEQ ID NO: 1355676 - RNA, 21 nt, Homo sapiens
aggugguggcagcaauggugu

SEQ ID NO: 1355677 - RNA, 12 nt, Homo sapiens
agguuaccucac

SEQ ID NO: 1355678 - RNA, 19 nt, Homo sapiens
agguucucagguguugcca

SEQ ID NO: 1355679 - RNA, 14 nt, Homo sapiens
agguuggcaaaaag

SEQ ID NO: 1355680 - RNA, 23 nt, Homo sapiens
agguuuuauucucuaaauaccau

SEQ ID NO: 1355681 - RNA, 17 nt, Homo sapiens
aguaagcaaagacuuuc

SEQ ID NO: 1355682 - RNA, 13 nt, Homo sapiens
aguaaguacgugu

SEQ ID NO: 1355683 - RNA, 13 nt, Homo sapiens
aguaaugaugucg

SEQ ID NO: 1355684 - RNA, 22 nt, Homo sapiens
aguaccaacucuccaaaacuaa

SEQ ID NO: 1355685 - RNA, 20 nt, Homo sapiens
aguacucacuaaaaguucuc

SEQ ID NO: 1355686 - RNA, 14 nt, Homo sapiens
aguagaaucucagu

SEQ ID NO: 1355687 - RNA, 11 nt, Homo sapiens
aguagaugcca

SEQ ID NO: 1355688 - RNA, 23 nt, Homo sapiens
aguaguuuuuacagcuguguuau

SEQ ID NO: 1355689 - RNA, 15 nt, Homo sapiens
aguauccucuugcca

SEQ ID NO: 1355690 - RNA, 12 nt, Homo sapiens
aguaucugagau

SEQ ID NO: 1355691 - RNA, 12 nt, Homo sapiens
aguauugugcau

SEQ ID NO: 1355692 - RNA, 18 nt, Homo sapiens
agucaaacuuucaccuca

SEQ ID NO: 1355693 - RNA, 20 nt, Homo sapiens
agucacuuauaauuaugcua

SEQ ID NO: 1355694 - RNA, 18 nt, Homo sapiens
agucauggagaaccaccu

SEQ ID NO: 1355695 - RNA, 15 nt, Homo sapiens
aguccacccugccug

SEQ ID NO: 1355696 - RNA, 21 nt, Homo sapiens
agucccuaaaaacacagacau

SEQ ID NO: 1355697 - RNA, 22 nt, Homo sapiens
agucuaaaaaaggaauccucug

SEQ ID NO: 1355698 - RNA, 15 nt, Homo sapiens
agucugagcuucuuu

SEQ ID NO: 1355699 - RNA, 17 nt, Homo sapiens
agucugcuuagagcaca

SEQ ID NO: 1355700 - RNA, 19 nt, Homo sapiens
agucuggagcacccugaga

SEQ ID NO: 1355701 - RNA, 13 nt, Homo sapiens
agucuuugccagu

SEQ ID NO: 1355702 - RNA, 13 nt, Homo sapiens
agugaacuugaaa

SEQ ID NO: 1355703 - RNA, 15 nt, Homo sapiens
gaggccgaggccaug

SEQ ID NO: 1355704 - RNA, 12 nt, Homo sapiens
gaggccuguccu

SEQ ID NO: 1355705 - RNA, 24 nt, Homo sapiens
gaggcuugcccaggagcaagugag

SEQ ID NO: 1355706 - RNA, 21 nt, Homo sapiens
gagggaagaaugaacacuccc

SEQ ID NO: 1355707 - RNA, 16 nt, Homo sapiens
gagggcagacuggggc

SEQ ID NO: 1355708 - RNA, 14 nt, Homo sapiens
gaggguuugcagaa

SEQ ID NO: 1355709 - RNA, 20 nt, Homo sapiens
gagguagcacuacaaacaca

SEQ ID NO: 1355710 - RNA, 23 nt, Homo sapiens
gagguccccucgucccauccagc

SEQ ID NO: 1355711 - RNA, 16 nt, Homo sapiens
gaguauccucuugcca

SEQ ID NO: 1355712 - RNA, 17 nt, Homo sapiens
gagucaggggagcucag

SEQ ID NO: 1355713 - RNA, 14 nt, Homo sapiens
gaguccucacuccc

SEQ ID NO: 1355714 - RNA, 18 nt, Homo sapiens
gagucugaacagcuguaa

SEQ ID NO: 1355715 - RNA, 12 nt, Homo sapiens
gagugacaccca

SEQ ID NO: 1355716 - RNA, 22 nt, Homo sapiens
gagugcugaaauaaaaugauaa

SEQ ID NO: 1355717 - RNA, 13 nt, Homo sapiens
gaguggcuuccau

SEQ ID NO: 1355718 - RNA, 19 nt, Homo sapiens
gaguguaguugaugacugu

SEQ ID NO: 1355719 - RNA, 19 nt, Homo sapiens
gaguuacuaauuaguuuau

SEQ ID NO: 1355720 - RNA, 21 nt, Homo sapiens
gaguugauucagcucugcaag

SEQ ID NO: 1355721 - RNA, 23 nt, Homo sapiens
gaguuggacuucagucuugccua

SEQ ID NO: 1355722 - RNA, 19 nt, Homo sapiens
gaguuuguuuacacuuguc

SEQ ID NO: 1355723 - RNA, 22 nt, Homo sapiens
gaguuuuauagccuggacugcu

SEQ ID NO: 1355724 - RNA, 21 nt, Homo sapiens
gauacauaaugggccacugaa

SEQ ID NO: 1355725 - RNA, 14 nt, Homo sapiens
gauagaccaaagac

SEQ ID NO: 1355726 - RNA, 12 nt, Homo sapiens
gauauggcuuuu

SEQ ID NO: 1355727 - RNA, 19 nt, Homo sapiens
gaucacuucaggucaggag

SEQ ID NO: 1355728 - RNA, 19 nt, Homo sapiens
gaucagccugggcaaugug

SEQ ID NO: 1355729 - RNA, 15 nt, Homo sapiens
gaucaucaagacaga

SEQ ID NO: 1355730 - RNA, 16 nt, Homo sapiens
gccaaggagcugcuau

SEQ ID NO: 1355731 - RNA, 18 nt, Homo sapiens
gccaauaauaaaugcccu

SEQ ID NO: 1355732 - RNA, 22 nt, Homo sapiens
gccacagaacguaggugugaca

SEQ ID NO: 1355733 - RNA, 22 nt, Homo sapiens
gccaccacccuacuucauuuuc

SEQ ID NO: 1355734 - RNA, 15 nt, Homo sapiens
gccacugacuugcuc

SEQ ID NO: 1355735 - RNA, 19 nt, Homo sapiens
gccagaguggccuggccag

SEQ ID NO: 1355736 - RNA, 17 nt, Homo sapiens
gccagccagugaccuga

SEQ ID NO: 1355737 - RNA, 17 nt, Homo sapiens
gccagcuuaucucaggg

SEQ ID NO: 1355738 - RNA, 18 nt, Homo sapiens
gccaggacacagacguac

SEQ ID NO: 1355739 - RNA, 16 nt, Homo sapiens
gccaggcuggucuuga

SEQ ID NO: 1355740 - RNA, 22 nt, Homo sapiens
gccagggaacccacagagucac

SEQ ID NO: 1355741 - RNA, 12 nt, Homo sapiens
gccaggugcuuu

SEQ ID NO: 1355742 - RNA, 23 nt, Homo sapiens
gccaucauugaugaucacuguga

SEQ ID NO: 1355743 - RNA, 20 nt, Homo sapiens
gccauucucaagcccugcag

SEQ ID NO: 1355744 - RNA, 14 nt, Homo sapiens
gccauuucucaggg

SEQ ID NO: 1355745 - RNA, 22 nt, Homo sapiens
gcccaaucucugccauaucagu

SEQ ID NO: 1355746 - RNA, 15 nt, Homo sapiens
gcccagagcccagcu

SEQ ID NO: 1355747 - RNA, 19 nt, Homo sapiens
gcccaggaccaucauccua

SEQ ID NO: 1355748 - RNA, 20 nt, Homo sapiens
gcccaggauggcuuugaaug

SEQ ID NO: 1355749 - RNA, 22 nt, Homo sapiens
gcccaucacaggguugggccca

SEQ ID NO: 1355750 - RNA, 15 nt, Homo sapiens
gccccaggaccagcu

SEQ ID NO: 1355751 - RNA, 18 nt, Homo sapiens
gccccagggguggaacaa

SEQ ID NO: 1355752 - RNA, 13 nt, Homo sapiens
gcccccacugacc

SEQ ID NO: 1355753 - RNA, 17 nt, Homo sapiens
gccccccccagagccag

SEQ ID NO: 1355754 - RNA, 18 nt, Homo sapiens
gccccgcugucacuugcc

SEQ ID NO: 1355755 - RNA, 13 nt, Homo sapiens
gaagugugugauc

SEQ ID NO: 1355756 - RNA, 17 nt, Homo sapiens
gaauauaaacacuauau

SEQ ID NO: 1355757 - RNA, 19 nt, Homo sapiens
gaauauacuaaauuaacuu

SEQ ID NO: 1355758 - RNA, 23 nt, Homo sapiens
gaauccuagcacuugucucagga

SEQ ID NO: 1355759 - RNA, 15 nt, Homo sapiens
gaaugaacacucccc

SEQ ID NO: 1355760 - RNA, 17 nt, Homo sapiens
gaauuaaaaaagcauac

SEQ ID NO: 1355761 - RNA, 20 nt, Homo sapiens
gaauuauaauuaguuccuca

SEQ ID NO: 1355762 - RNA, 15 nt, Homo sapiens
gaauuauagaacuaa

SEQ ID NO: 1355763 - RNA, 15 nt, Homo sapiens
gaauucagaagugga

SEQ ID NO: 1355764 - RNA, 18 nt, Homo sapiens
gaauuccuggaaccugga

SEQ ID NO: 1355765 - RNA, 21 nt, Homo sapiens
gaauuggcaaacuagaauuua

SEQ ID NO: 1355766 - RNA, 11 nt, Homo sapiens
gaauuugcacc

SEQ ID NO: 1355767 - RNA, 12 nt, Homo sapiens
gacaagggauuu

SEQ ID NO: 1355768 - RNA, 13 nt, Homo sapiens
gacaaucacuaca

SEQ ID NO: 1355769 - RNA, 17 nt, Homo sapiens
gacacagacauccucua

SEQ ID NO: 1355770 - RNA, 20 nt, Homo sapiens
gacaccugggagaaaucugg

SEQ ID NO: 1355771 - RNA, 19 nt, Homo sapiens
gacacugacuagagugaug

SEQ ID NO: 1355772 - RNA, 13 nt, Homo sapiens
gacagaacacugu

SEQ ID NO: 1355773 - RNA, 17 nt, Homo sapiens
gacagaugaaugccgug

SEQ ID NO: 1355774 - RNA, 18 nt, Homo sapiens
gacagauggaaaagggag

SEQ ID NO: 1355775 - RNA, 21 nt, Homo sapiens
gacagauguuaagcgcugugu

SEQ ID NO: 1355776 - RNA, 19 nt, Homo sapiens
gacagccucuucuguccca

SEQ ID NO: 1355777 - RNA, 15 nt, Homo sapiens
gacagcuuugcugcu

SEQ ID NO: 1355778 - RNA, 16 nt, Homo sapiens
gacaggccgggcagug

SEQ ID NO: 1355779 - RNA, 21 nt, Homo sapiens
gacauaaugggguccuggcca

SEQ ID NO: 1355780 - RNA, 18 nt, Homo sapiens
gacauuuccaagcuguua

SEQ ID NO: 1355781 - RNA, 20 nt, Homo sapiens
gaccaagacugagccagcuu

SEQ ID NO: 1355782 - RNA, 22 nt, Homo sapiens
gaccacaacuauuuucagaugu

SEQ ID NO: 1355783 - RNA, 21 nt, Homo sapiens
gaccacgcccccagcugugac

SEQ ID NO: 1355784 - RNA, 19 nt, Homo sapiens
gaccaggggcccuaccugg

SEQ ID NO: 1355785 - RNA, 18 nt, Homo sapiens
gacccaccacuggaagca

SEQ ID NO: 1355786 - RNA, 12 nt, Homo sapiens
gacccagugcag

SEQ ID NO: 1355787 - RNA, 20 nt, Homo sapiens
gaccccagcacgugggucua

SEQ ID NO: 1355788 - RNA, 19 nt, Homo sapiens
gaccgugaccagugcugcu

SEQ ID NO: 1355789 - RNA, 17 nt, Homo sapiens
gaccugaggcugugguc

SEQ ID NO: 1355790 - RNA, 13 nt, Homo sapiens
gaccuucuaggaa

SEQ ID NO: 1355791 - RNA, 22 nt, Homo sapiens
gaccuucuaggaagcuccaguu

SEQ ID NO: 1355792 - RNA, 22 nt, Homo sapiens
gacgggacagccuucagcugca

SEQ ID NO: 1355793 - RNA, 15 nt, Homo sapiens
gacguggguugcacu

SEQ ID NO: 1355794 - RNA, 17 nt, Homo sapiens
gacguggguugcacugg

SEQ ID NO: 1355795 - RNA, 23 nt, Homo sapiens
gacuaagccccgucugaccccag

SEQ ID NO: 1355796 - RNA, 13 nt, Homo sapiens
gacuagagugaug

SEQ ID NO: 1355797 - RNA, 14 nt, Homo sapiens
gacuagugagcaag

SEQ ID NO: 1355798 - RNA, 20 nt, Homo sapiens
gacuauggcucuacuuucag

SEQ ID NO: 1355799 - RNA, 22 nt, Homo sapiens
gacuaugucacccaaugcauau

SEQ ID NO: 1355800 - RNA, 18 nt, Homo sapiens
gacucuuuaugcuugcaa

SEQ ID NO: 1355801 - RNA, 13 nt, Homo sapiens
gacugaccaaauc

SEQ ID NO: 1355802 - RNA, 14 nt, Homo sapiens
gacuuaaugugauu

SEQ ID NO: 1355803 - RNA, 18 nt, Homo sapiens
gacuuauuuaaacucugu

SEQ ID NO: 1355804 - RNA, 20 nt, Homo sapiens
gacuuccaucuagucacaaa

SEQ ID NO: 1355805 - RNA, 20 nt, Homo sapiens
gacuucugggucuccaggga

SEQ ID NO: 1355806 - RNA, 20 nt, Homo sapiens
gacuugacagaacacugucu

SEQ ID NO: 1355807 - RNA, 22 nt, Homo sapiens
gacuuugagcugagugcugaaa

SEQ ID NO: 1355808 - RNA, 20 nt, Homo sapiens
gacuuuuuuuaaauaguaaa

SEQ ID NO: 1355809 - RNA, 16 nt, Homo sapiens
gagaaaaaguucuaua

SEQ ID NO: 1355810 - RNA, 21 nt, Homo sapiens
gagaaaacaggcucacagaga

SEQ ID NO: 1355811 - RNA, 15 nt, Homo sapiens
gagaagcaaggguug

SEQ ID NO: 1355812 - RNA, 20 nt, Homo sapiens
gagaagccaggaauuuccca

SEQ ID NO: 1355813 - RNA, 18 nt, Homo sapiens
gagaagcuccucucccca

SEQ ID NO: 1355814 - RNA, 15 nt, Homo sapiens
gagaaggcucuugcc

SEQ ID NO: 1355815 - RNA, 22 nt, Homo sapiens
gagaagguauuagcaaagcaaa

SEQ ID NO: 1355816 - RNA, 17 nt, Homo sapiens
gagaauccuuguggcuu

SEQ ID NO: 1355817 - RNA, 22 nt, Homo sapiens
gagacauacuugaagggccaga

SEQ ID NO: 1355818 - RNA, 19 nt, Homo sapiens
gagacaugagcauggcuga

SEQ ID NO: 1355819 - RNA, 14 nt, Homo sapiens
gagacucagugcag

SEQ ID NO: 1355820 - RNA, 13 nt, Homo sapiens
gagacugaucucg

SEQ ID NO: 1355821 - RNA, 15 nt, Homo sapiens
gagacugcugaguca

SEQ ID NO: 1355822 - RNA, 11 nt, Homo sapiens
gagacuugcca

SEQ ID NO: 1355823 - RNA, 20 nt, Homo sapiens
gagacuugugcucaaggaau

SEQ ID NO: 1355824 - RNA, 14 nt, Homo sapiens
gagagcaagacaga

SEQ ID NO: 1355825 - RNA, 23 nt, Homo sapiens
gagaggagaaggagggagacaug

SEQ ID NO: 1355826 - RNA, 16 nt, Homo sapiens
gagaugaaaaagacug

SEQ ID NO: 1355827 - RNA, 15 nt, Homo sapiens
gagcacagggcuguu

SEQ ID NO: 1355828 - RNA, 12 nt, Homo sapiens
gagcagccugug

SEQ ID NO: 1355829 - RNA, 17 nt, Homo sapiens
gagcaguggcuggucca

SEQ ID NO: 1355830 - RNA, 19 nt, Homo sapiens
gagcaguggcugguccagg

SEQ ID NO: 1355831 - RNA, 16 nt, Homo sapiens
gagcauuuguuuaaua

SEQ ID NO: 1355832 - RNA, 17 nt, Homo sapiens
gagccaauggcccggcc

SEQ ID NO: 1355833 - RNA, 13 nt, Homo sapiens
gagccagcaagag

SEQ ID NO: 1355834 - RNA, 14 nt, Homo sapiens
gagccugcagggaa

SEQ ID NO: 1355835 - RNA, 12 nt, Homo sapiens
gagccuggacaa

SEQ ID NO: 1355836 - RNA, 20 nt, Homo sapiens
gagccuucugugcugugagu

SEQ ID NO: 1355837 - RNA, 19 nt, Homo sapiens
gagcugccuccagccuggu

SEQ ID NO: 1355838 - RNA, 13 nt, Homo sapiens
gagcugggcagaa

SEQ ID NO: 1355839 - RNA, 16 nt, Homo sapiens
gaggaaaggccagcug

SEQ ID NO: 1355840 - RNA, 17 nt, Homo sapiens
gaggacaauacuggggu

SEQ ID NO: 1355841 - RNA, 15 nt, Homo sapiens
gaggaugacagugac

SEQ ID NO: 1355842 - RNA, 20 nt, Homo sapiens
gaggcaggagaauugcuuga

SEQ ID NO: 1355843 - RNA, 12 nt, Homo sapiens
gaggcagggaag

SEQ ID NO: 1355844 - RNA, 15 nt, Homo sapiens
auaggcaacuuggua

SEQ ID NO: 1355845 - RNA, 18 nt, Homo sapiens
auaggcauuaacacaaag

SEQ ID NO: 1355846 - RNA, 20 nt, Homo sapiens
auaguauucaugacuaugga

SEQ ID NO: 1355847 - RNA, 22 nt, Homo sapiens
auaguauugugcauagagccac

SEQ ID NO: 1355848 - RNA, 14 nt, Homo sapiens
auauaauacauuaa

SEQ ID NO: 1355849 - RNA, 23 nt, Homo sapiens
auauacauauguuaauucuaguc

SEQ ID NO: 1355850 - RNA, 16 nt, Homo sapiens
auauagcaagauccca

SEQ ID NO: 1355851 - RNA, 17 nt, Homo sapiens
auauaggugugugagac

SEQ ID NO: 1355852 - RNA, 14 nt, Homo sapiens
auauauauuacaag

SEQ ID NO: 1355853 - RNA, 13 nt, Homo sapiens
auauauuccacca

SEQ ID NO: 1355854 - RNA, 13 nt, Homo sapiens
auaucaugcucca

SEQ ID NO: 1355855 - RNA, 14 nt, Homo sapiens
auaucaugcuccau

SEQ ID NO: 1355856 - RNA, 22 nt, Homo sapiens
auaugaggcuguugucuuuucc

SEQ ID NO: 1355857 - RNA, 13 nt, Homo sapiens
auauuaugagaug

SEQ ID NO: 1355858 - RNA, 17 nt, Homo sapiens
auauuuaagcaacaucu

SEQ ID NO: 1355859 - RNA, 22 nt, Homo sapiens
auauuuguaugauccuaaugaa

SEQ ID NO: 1355860 - RNA, 18 nt, Homo sapiens
aucaaaauuucagcauua

SEQ ID NO: 1355861 - RNA, 19 nt, Homo sapiens
aucaacuuccuaaauauua

SEQ ID NO: 1355862 - RNA, 18 nt, Homo sapiens
aucaagacugcaaacccu

SEQ ID NO: 1355863 - RNA, 15 nt, Homo sapiens
aucaagucuguuuac

SEQ ID NO: 1355864 - RNA, 23 nt, Homo sapiens
aucacacgucuggcuucacagau

SEQ ID NO: 1355865 - RNA, 19 nt, Homo sapiens
aucacagcuucagccagga

SEQ ID NO: 1355866 - RNA, 21 nt, Homo sapiens
aucagcuccagcugcucuguc

SEQ ID NO: 1355867 - RNA, 18 nt, Homo sapiens
aucaggaauauuuuccaa

SEQ ID NO: 1355868 - RNA, 19 nt, Homo sapiens
aucaggaauauuuuccaaa

SEQ ID NO: 1355869 - RNA, 22 nt, Homo sapiens
aucaugaguuuguuuacacuug

SEQ ID NO: 1355870 - RNA, 23 nt, Homo sapiens
aucaugaugcuagccagcaaaga

SEQ ID NO: 1355871 - RNA, 15 nt, Homo sapiens
aucauuaugaaguca

SEQ ID NO: 1355872 - RNA, 23 nt, Homo sapiens
aucauuguaacaugacacuuaga

SEQ ID NO: 1355873 - RNA, 13 nt, Homo sapiens
auccaaauccauc

SEQ ID NO: 1355874 - RNA, 15 nt, Homo sapiens
auccaggcagaucca

SEQ ID NO: 1355875 - RNA, 15 nt, Homo sapiens
auccaggguaugacc

SEQ ID NO: 1355876 - RNA, 12 nt, Homo sapiens
auccaucucuca

SEQ ID NO: 1355877 - RNA, 12 nt, Homo sapiens
aucccaagagaa

SEQ ID NO: 1355878 - RNA, 17 nt, Homo sapiens
aucccaguucuuccugc

SEQ ID NO: 1355879 - RNA, 14 nt, Homo sapiens
auccccacaaucug

SEQ ID NO: 1355880 - RNA, 16 nt, Homo sapiens
aucccuuugucuguca

SEQ ID NO: 1355881 - RNA, 14 nt, Homo sapiens
ggggcccagugcau

SEQ ID NO: 1355882 - RNA, 16 nt, Homo sapiens
ggggccugaggucauc

SEQ ID NO: 1355883 - RNA, 17 nt, Homo sapiens
ggggcuuuuacaccagu

SEQ ID NO: 1355884 - RNA, 21 nt, Homo sapiens
gggggcaccaugugugccuuu

SEQ ID NO: 1355885 - RNA, 18 nt, Homo sapiens
gggguauaaaacuuuccu

SEQ ID NO: 1355886 - RNA, 22 nt, Homo sapiens
ggguaccuuaagagacacucca

SEQ ID NO: 1355887 - RNA, 14 nt, Homo sapiens
gggucuucagggga

SEQ ID NO: 1355888 - RNA, 19 nt, Homo sapiens
gggugacagagcaagugag

SEQ ID NO: 1355889 - RNA, 18 nt, Homo sapiens
gggugugggaucugagga

SEQ ID NO: 1355890 - RNA, 15 nt, Homo sapiens
ggguuuaaauaucca

SEQ ID NO: 1355891 - RNA, 16 nt, Homo sapiens
gguaaaaacugcagug

SEQ ID NO: 1355892 - RNA, 12 nt, Homo sapiens
gguaaaguauca

SEQ ID NO: 1355893 - RNA, 18 nt, Homo sapiens
gguauaguucaugucugc

SEQ ID NO: 1355894 - RNA, 17 nt, Homo sapiens
gguauuagcaaagcaaa

SEQ ID NO: 1355895 - RNA, 18 nt, Homo sapiens
gguauuagcaaagcaaaa

SEQ ID NO: 1355896 - RNA, 12 nt, Homo sapiens
ggucaccuggug

SEQ ID NO: 1355897 - RNA, 13 nt, Homo sapiens
ggucagagccacu

SEQ ID NO: 1355898 - RNA, 16 nt, Homo sapiens
gguccaccccauguca

SEQ ID NO: 1355899 - RNA, 13 nt, Homo sapiens
gguccuacccauc

SEQ ID NO: 1355900 - RNA, 15 nt, Homo sapiens
gguccuggcuccuga

SEQ ID NO: 1355901 - RNA, 20 nt, Homo sapiens
gguccuucccucucaugacu

SEQ ID NO: 1355902 - RNA, 21 nt, Homo sapiens
gguccuucccucucaugacuu

SEQ ID NO: 1355903 - RNA, 12 nt, Homo sapiens
ggucuaggccag

SEQ ID NO: 1355904 - RNA, 22 nt, Homo sapiens
ggucugaaauuugugauggaau

SEQ ID NO: 1355905 - RNA, 14 nt, Homo sapiens
gcuucuugccucug

SEQ ID NO: 1355906 - RNA, 20 nt, Homo sapiens
gcuucuugccucugugcugu

SEQ ID NO: 1355907 - RNA, 22 nt, Homo sapiens
gcuuggaaaggaccaguaugcu

SEQ ID NO: 1355908 - RNA, 22 nt, Homo sapiens
gcuuggacugaagggguucuca

SEQ ID NO: 1355909 - RNA, 22 nt, Homo sapiens
gcuuucugccaucuagccagcc

SEQ ID NO: 1355910 - RNA, 12 nt, Homo sapiens
gcuuugccaaaa

SEQ ID NO: 1355911 - RNA, 19 nt, Homo sapiens
gcuuugccccugagacaaa

SEQ ID NO: 1355912 - RNA, 16 nt, Homo sapiens
gcuuugcuuucugcuc

SEQ ID NO: 1355913 - RNA, 22 nt, Homo sapiens
ggaaaaaauaaaagaucuugaa

SEQ ID NO: 1355914 - RNA, 20 nt, Homo sapiens
ggaaaauaaaucaaugcuau

SEQ ID NO: 1355915 - RNA, 22 nt, Homo sapiens
ggaaaauaauacugcugagaua

SEQ ID NO: 1355916 - RNA, 17 nt, Homo sapiens
ggaaaaugcuucuuggc

SEQ ID NO: 1355917 - RNA, 22 nt, Homo sapiens
ggaaacggcucuuguuugaaag

SEQ ID NO: 1355918 - RNA, 20 nt, Homo sapiens
ggaaacuggaugaggucaua

SEQ ID NO: 1355919 - RNA, 16 nt, Homo sapiens
ggaacaagccuaaaaa

SEQ ID NO: 1355920 - RNA, 15 nt, Homo sapiens
ggaacaugaagccag

SEQ ID NO: 1355921 - RNA, 18 nt, Homo sapiens
ggaacccagacucagaca

SEQ ID NO: 1355922 - RNA, 20 nt, Homo sapiens
ggaaccucagccuggccaga

SEQ ID NO: 1355923 - RNA, 16 nt, Homo sapiens
ggaacucagauccagg

SEQ ID NO: 1355924 - RNA, 13 nt, Homo sapiens
ggaacugcaauaa

SEQ ID NO: 1355925 - RNA, 14 nt, Homo sapiens
ggaagaugugugau

SEQ ID NO: 1355926 - RNA, 11 nt, Homo sapiens
ggaagugcuuc

SEQ ID NO: 1355927 - RNA, 16 nt, Homo sapiens
ggaaguuucacuggcu

SEQ ID NO: 1355928 - RNA, 16 nt, Homo sapiens
ggaaguuuuccuacac

SEQ ID NO: 1355929 - RNA, 18 nt, Homo sapiens
auggcuuuuagcauuuau

SEQ ID NO: 1355930 - RNA, 22 nt, Homo sapiens
auggggcggguccuagcuguua

SEQ ID NO: 1355931 - RNA, 16 nt, Homo sapiens
auggugccccaggacc

SEQ ID NO: 1355932 - RNA, 20 nt, Homo sapiens
augguggcgcaugccuguag

SEQ ID NO: 1355933 - RNA, 15 nt, Homo sapiens
auguaagugggccca

SEQ ID NO: 1355934 - RNA, 19 nt, Homo sapiens
auguacagauauacuucag

SEQ ID NO: 1355935 - RNA, 16 nt, Homo sapiens
auguacauagcuugau

SEQ ID NO: 1355936 - RNA, 15 nt, Homo sapiens
auguauaugcaauau

SEQ ID NO: 1355937 - RNA, 20 nt, Homo sapiens
auguccagcaccuugugccu

SEQ ID NO: 1355938 - RNA, 21 nt, Homo sapiens
augucccuccaacacagaucc

SEQ ID NO: 1355939 - RNA, 19 nt, Homo sapiens
augucguuugaaucacagu

SEQ ID NO: 1355940 - RNA, 21 nt, Homo sapiens
augucguuugaaucacaguau

SEQ ID NO: 1355941 - RNA, 22 nt, Homo sapiens
augucuugcuguugacauauuu

SEQ ID NO: 1355942 - RNA, 20 nt, Homo sapiens
auguggcuggaagauccugc

SEQ ID NO: 1355943 - RNA, 19 nt, Homo sapiens
augugggucaaggaauuaa

SEQ ID NO: 1355944 - RNA, 15 nt, Homo sapiens
augugugaggagcug

SEQ ID NO: 1355945 - RNA, 23 nt, Homo sapiens
auguuaguuuauuugagcacuuu

SEQ ID NO: 1355946 - RNA, 14 nt, Homo sapiens
auguuaugcaaaaa

SEQ ID NO: 1355947 - RNA, 14 nt, Homo sapiens
auguucagcacugu

SEQ ID NO: 1355948 - RNA, 17 nt, Homo sapiens
auguucuuuuuucuguc

SEQ ID NO: 1355949 - RNA, 16 nt, Homo sapiens
auguugagcagcaucu

SEQ ID NO: 1355950 - RNA, 20 nt, Homo sapiens
auguugcccaguguguuucu

SEQ ID NO: 1355951 - RNA, 16 nt, Homo sapiens
auuaaaacacuuucaa

SEQ ID NO: 1355952 - RNA, 12 nt, Homo sapiens
auuaaacuacuu

SEQ ID NO: 1355953 - RNA, 20 nt, Homo sapiens
auuaaagugaauuguugaca

SEQ ID NO: 1355954 - RNA, 22 nt, Homo sapiens
auuaaccucugcacuacugaca

SEQ ID NO: 1355955 - RNA, 13 nt, Homo sapiens
auuaagaaugcca

SEQ ID NO: 1355956 - RNA, 18 nt, Homo sapiens
auuaaugagaauuccuua

SEQ ID NO: 1355957 - RNA, 14 nt, Homo sapiens
auuaaugucauuuc

SEQ ID NO: 1355958 - RNA, 18 nt, Homo sapiens
auuaauuacuucacuaua

SEQ ID NO: 1355959 - RNA, 14 nt, Homo sapiens
auuaccuugugcua

SEQ ID NO: 1355960 - RNA, 22 nt, Homo sapiens
auuaccuugugcuaauccucuu

SEQ ID NO: 1355961 - RNA, 19 nt, Homo sapiens
auuagaaaaauagcaacuu

SEQ ID NO: 1355962 - RNA, 23 nt, Homo sapiens
auuagauuucuauaggauuuuuc

SEQ ID NO: 1355963 - RNA, 17 nt, Homo sapiens
auuagccaaguguggua

SEQ ID NO: 1355964 - RNA, 16 nt, Homo sapiens
aucgcuggaaaacagc

SEQ ID NO: 1355965 - RNA, 18 nt, Homo sapiens
aucguacacacucaguga

SEQ ID NO: 1355966 - RNA, 14 nt, Homo sapiens
aucuagaagacugu

SEQ ID NO: 1355967 - RNA, 15 nt, Homo sapiens
aucuagaagacuguc

SEQ ID NO: 1355968 - RNA, 16 nt, Homo sapiens
aucuagucacaaagac

SEQ ID NO: 1355969 - RNA, 16 nt, Homo sapiens
aucuaugccuaaaaag

SEQ ID NO: 1355970 - RNA, 14 nt, Homo sapiens
aucucaccuccugc

SEQ ID NO: 1355971 - RNA, 13 nt, Homo sapiens
aucucagaaccuu

SEQ ID NO: 1355972 - RNA, 19 nt, Homo sapiens
aucucgccacugcacucca

SEQ ID NO: 1355973 - RNA, 20 nt, Homo sapiens
aucucggcucacugcaagcu

SEQ ID NO: 1355974 - RNA, 20 nt, Homo sapiens
aucucugccauaucagugaa

SEQ ID NO: 1355975 - RNA, 13 nt, Homo sapiens
aucugacccagug

SEQ ID NO: 1355976 - RNA, 23 nt, Homo sapiens
aucugaucgggggcguagcauca

SEQ ID NO: 1355977 - RNA, 17 nt, Homo sapiens
aucugcaugucuacuca

SEQ ID NO: 1355978 - RNA, 15 nt, Homo sapiens
aucugccacguguau

SEQ ID NO: 1355979 - RNA, 14 nt, Homo sapiens
aucuggaacccaga

SEQ ID NO: 1355980 - RNA, 16 nt, Homo sapiens
aucuggguaagaagaa

SEQ ID NO: 1355981 - RNA, 22 nt, Homo sapiens
aucuggguaagaagaaagcaaa

SEQ ID NO: 1355982 - RNA, 16 nt, Homo sapiens
aucuggucccuugcag

SEQ ID NO: 1355983 - RNA, 15 nt, Homo sapiens
aucugucaugagcau

SEQ ID NO: 1355984 - RNA, 20 nt, Homo sapiens
aucugucucauccaaaaagu

SEQ ID NO: 1355985 - RNA, 16 nt, Homo sapiens
aucuguucccuuccuc

SEQ ID NO: 1355986 - RNA, 21 nt, Homo sapiens
aucuuaaaaaucuaugccuaa

SEQ ID NO: 1355987 - RNA, 14 nt, Homo sapiens
aucuuaaguaccaa

SEQ ID NO: 1355988 - RNA, 20 nt, Homo sapiens
aucuuagaaaauuaaaugaa

SEQ ID NO: 1355989 - RNA, 19 nt, Homo sapiens
aucuuagaagcacuacacc

SEQ ID NO: 1355990 - RNA, 15 nt, Homo sapiens
aucuuauuucuguca

SEQ ID NO: 1355991 - RNA, 14 nt, Homo sapiens
aucuugaauagucu

SEQ ID NO: 1355992 - RNA, 17 nt, Homo sapiens
aucuugaauagucucau

SEQ ID NO: 1355993 - RNA, 19 nt, Homo sapiens
aucuugaauguaguauuca

SEQ ID NO: 1355994 - RNA, 19 nt, Homo sapiens
aucuugaccaagcaggaag

SEQ ID NO: 1355995 - RNA, 15 nt, Homo sapiens
aucuugauccuauga

SEQ ID NO: 1355996 - RNA, 22 nt, Homo sapiens
aucuugcucucggugcuuccaa

SEQ ID NO: 1355997 - RNA, 21 nt, Homo sapiens
aucuuucaggacucuaccuca

SEQ ID NO: 1355998 - RNA, 18 nt, Homo sapiens
agugacauuucuaucaca

SEQ ID NO: 1355999 - RNA, 18 nt, Homo sapiens
agugagaacccagcuguc

SEQ ID NO: 1356000 - RNA, 13 nt, Homo sapiens
agugagacccugu

SEQ ID NO: 1356001 - RNA, 17 nt, Homo sapiens
agugagcagugagcacu

SEQ ID NO: 1356002 - RNA, 12 nt, Homo sapiens
agugauccucag

SEQ ID NO: 1356003 - RNA, 23 nt, Homo sapiens
agugaucgccuccaacagcauca

SEQ ID NO: 1356004 - RNA, 23 nt, Homo sapiens
agugaugucaaauugacuguaau

SEQ ID NO: 1356005 - RNA, 14 nt, Homo sapiens
agugcaugguggcc

SEQ ID NO: 1356006 - RNA, 21 nt, Homo sapiens
agugccacccaccuuugccac

SEQ ID NO: 1356007 - RNA, 19 nt, Homo sapiens
agugccacccgcaggugug

SEQ ID NO: 1356008 - RNA, 21 nt, Homo sapiens
agugcugaaauaaaaugauaa

SEQ ID NO: 1356009 - RNA, 18 nt, Homo sapiens
agugcugggucugucaca

SEQ ID NO: 1356010 - RNA, 19 nt, Homo sapiens
aguggcgugggagccagcc

SEQ ID NO: 1356011 - RNA, 23 nt, Homo sapiens
aguggcucacaccuguaauccca

SEQ ID NO: 1356012 - RNA, 20 nt, Homo sapiens
agugggagcugaguggggga

SEQ ID NO: 1356013 - RNA, 14 nt, Homo sapiens
aguggggucagggc

SEQ ID NO: 1356014 - RNA, 16 nt, Homo sapiens
aguguaggccuuccag

SEQ ID NO: 1356015 - RNA, 20 nt, Homo sapiens
aguguuugucugucuugaca

SEQ ID NO: 1356016 - RNA, 21 nt, Homo sapiens
aguuaaucccuuugucuguca

SEQ ID NO: 1356017 - RNA, 19 nt, Homo sapiens
aguuaccacauuacucugc

SEQ ID NO: 1356018 - RNA, 20 nt, Homo sapiens
aguuagaauuauaucacuuc

SEQ ID NO: 1356019 - RNA, 23 nt, Homo sapiens
aguuaugaaaaauaagucacuua

SEQ ID NO: 1356020 - RNA, 18 nt, Homo sapiens
aguucagacucuaacuuc

SEQ ID NO: 1356021 - RNA, 21 nt, Homo sapiens
aguuccucauuagcauuuugc

SEQ ID NO: 1356022 - RNA, 18 nt, Homo sapiens
aguucucuugcuuucaca

SEQ ID NO: 1356023 - RNA, 20 nt, Homo sapiens
aguucucuugcuuucacauu

SEQ ID NO: 1356024 - RNA, 23 nt, Homo sapiens
aguucuuuaaaauguaaagccau

SEQ ID NO: 1356025 - RNA, 17 nt, Homo sapiens
aguucuuugggccagac

SEQ ID NO: 1356026 - RNA, 18 nt, Homo sapiens
aguucuuugggccagaca

SEQ ID NO: 1356027 - RNA, 18 nt, Homo sapiens
aguugauagguuguuaaa

SEQ ID NO: 1356028 - RNA, 14 nt, Homo sapiens
aguugaugacuguu

SEQ ID NO: 1356029 - RNA, 14 nt, Homo sapiens
aguugauucagcuc

SEQ ID NO: 1356030 - RNA, 17 nt, Homo sapiens
cacagaucacagcuuca

SEQ ID NO: 1356031 - RNA, 20 nt, Homo sapiens
cacagauccgcaagaguaaa

SEQ ID NO: 1356032 - RNA, 13 nt, Homo sapiens
cacagcacuucaa

SEQ ID NO: 1356033 - RNA, 15 nt, Homo sapiens
cacagcugugugagc

SEQ ID NO: 1356034 - RNA, 15 nt, Homo sapiens
cacaggguguuggaa

SEQ ID NO: 1356035 - RNA, 12 nt, Homo sapiens
cacagugugaau

SEQ ID NO: 1356036 - RNA, 23 nt, Homo sapiens
cacaguucuuugggccagacaug

SEQ ID NO: 1356037 - RNA, 22 nt, Homo sapiens
cacauacccucacuuaaacuuu

SEQ ID NO: 1356038 - RNA, 21 nt, Homo sapiens
cacauguaucacccccaaaaa

SEQ ID NO: 1356039 - RNA, 13 nt, Homo sapiens
cacauuguacuua

SEQ ID NO: 1356040 - RNA, 14 nt, Homo sapiens
cacauuguacuuaa

SEQ ID NO: 1356041 - RNA, 13 nt, Homo sapiens
caccacaaacugu

SEQ ID NO: 1356042 - RNA, 17 nt, Homo sapiens
caccacagccagcaccu

SEQ ID NO: 1356043 - RNA, 21 nt, Homo sapiens
caccaccgacugaagugugug

SEQ ID NO: 1356044 - RNA, 22 nt, Homo sapiens
caccacgcccacgucaacguga

SEQ ID NO: 1356045 - RNA, 20 nt, Homo sapiens
caccacugagccauccucag

SEQ ID NO: 1356046 - RNA, 18 nt, Homo sapiens
cacccaggaguauccucu

SEQ ID NO: 1356047 - RNA, 17 nt, Homo sapiens
cacccaguugugacaau

SEQ ID NO: 1356048 - RNA, 13 nt, Homo sapiens
cacccaugcaccu

SEQ ID NO: 1356049 - RNA, 23 nt, Homo sapiens
cacccccaaaaaaagagaaaaag

SEQ ID NO: 1356050 - RNA, 20 nt, Homo sapiens
cacccccuucucugcuccac

SEQ ID NO: 1356051 - RNA, 20 nt, Homo sapiens
cacccugcugcuggugcaca

SEQ ID NO: 1356052 - RNA, 20 nt, Homo sapiens
caccuaauccaggcagaucc

SEQ ID NO: 1356053 - RNA, 14 nt, Homo sapiens
caccucuuccuuga

SEQ ID NO: 1356054 - RNA, 15 nt, Homo sapiens
caccucuuccuugau

SEQ ID NO: 1356055 - RNA, 15 nt, Homo sapiens
caccucuuggcuuug

SEQ ID NO: 1356056 - RNA, 23 nt, Homo sapiens
caccugaccaggggcccuaccug

SEQ ID NO: 1356057 - RNA, 22 nt, Homo sapiens
caccuuggcaccagacacccag

SEQ ID NO: 1356058 - RNA, 12 nt, Homo sapiens
caccuuugccac

SEQ ID NO: 1356059 - RNA, 19 nt, Homo sapiens
caccuuuuuucaacaguga

SEQ ID NO: 1356060 - RNA, 12 nt, Homo sapiens
cacgagaucaag

SEQ ID NO: 1356061 - RNA, 18 nt, Homo sapiens
cacgcccccagcugugac

SEQ ID NO: 1356062 - RNA, 22 nt, Homo sapiens
cacgucugcagaaacagugcaa

SEQ ID NO: 1356063 - RNA, 21 nt, Homo sapiens
cacuaaguaaccucuacaggc

SEQ ID NO: 1356064 - RNA, 16 nt, Homo sapiens
cacuagacaagccaga

SEQ ID NO: 1356065 - RNA, 22 nt, Homo sapiens
cacuagguaggcuucuaccugc

SEQ ID NO: 1356066 - RNA, 17 nt, Homo sapiens
cacucaagccaagcagc

SEQ ID NO: 1356067 - RNA, 21 nt, Homo sapiens
cacucacacggacacucaaaa

SEQ ID NO: 1356068 - RNA, 15 nt, Homo sapiens
cacucuccugugaga

SEQ ID NO: 1356069 - RNA, 18 nt, Homo sapiens
cacucuucaaaugccuga

SEQ ID NO: 1356070 - RNA, 16 nt, Homo sapiens
cacugagccauccuca

SEQ ID NO: 1356071 - RNA, 15 nt, Homo sapiens
cacugccagugcaga

SEQ ID NO: 1356072 - RNA, 18 nt, Homo sapiens
cacuggagaaaaggcagu

SEQ ID NO: 1356073 - RNA, 23 nt, Homo sapiens
cacugugaagagaaccauaucaa

SEQ ID NO: 1356074 - RNA, 17 nt, Homo sapiens
cacuuccccacagguga

SEQ ID NO: 1356075 - RNA, 14 nt, Homo sapiens
cagaaaaacugugg

SEQ ID NO: 1356076 - RNA, 14 nt, Homo sapiens
cagaaaacaaaaaa

SEQ ID NO: 1356077 - RNA, 16 nt, Homo sapiens
cagaaagcucaucuca

SEQ ID NO: 1356078 - RNA, 17 nt, Homo sapiens
cagaaaugucauguggc

SEQ ID NO: 1356079 - RNA, 14 nt, Homo sapiens
cagaacacacucca

SEQ ID NO: 1356080 - RNA, 20 nt, Homo sapiens
cagaaccucuuccccagaaa

SEQ ID NO: 1356081 - RNA, 14 nt, Homo sapiens
cagaagacaaaaag

SEQ ID NO: 1356082 - RNA, 15 nt, Homo sapiens
cagaaggccaagagg

SEQ ID NO: 1356083 - RNA, 15 nt, Homo sapiens
cagaagugcccuucc

SEQ ID NO: 1356084 - RNA, 23 nt, Homo sapiens
cagaaguggagauuucaguucag

SEQ ID NO: 1356085 - RNA, 13 nt, Homo sapiens
cagacaugccaca

SEQ ID NO: 1356086 - RNA, 14 nt, Homo sapiens
cagacauucugcca

SEQ ID NO: 1356087 - RNA, 22 nt, Homo sapiens
cagacgaaacacaaacugaagu

SEQ ID NO: 1356088 - RNA, 23 nt, Homo sapiens
cagagaaaggggagcccacuguc

SEQ ID NO: 1356089 - RNA, 22 nt, Homo sapiens
cagagacgcagacaugugcacu

SEQ ID NO: 1356090 - RNA, 14 nt, Homo sapiens
cagagacucugaaa

SEQ ID NO: 1356091 - RNA, 19 nt, Homo sapiens
cagagauaauucuagcuuu

SEQ ID NO: 1356092 - RNA, 15 nt, Homo sapiens
cagagauccaaaaga

SEQ ID NO: 1356093 - RNA, 13 nt, Homo sapiens
cagagcaagugag

SEQ ID NO: 1356094 - RNA, 19 nt, Homo sapiens
cagagccuucaagugccaa

SEQ ID NO: 1356095 - RNA, 12 nt, Homo sapiens
cagaguacauga

SEQ ID NO: 1356096 - RNA, 13 nt, Homo sapiens
cagagucaucuga

SEQ ID NO: 1356097 - RNA, 11 nt, Homo sapiens
cagagugccac

SEQ ID NO: 1356098 - RNA, 19 nt, Homo sapiens
cagaguggcuuccaucuca

SEQ ID NO: 1356099 - RNA, 23 nt, Homo sapiens
cagauaacaaauuuuaagaccaa

SEQ ID NO: 1356100 - RNA, 14 nt, Homo sapiens
cagauaacuuugac

SEQ ID NO: 1356101 - RNA, 22 nt, Homo sapiens
cagauaagguaaaaugccauga

SEQ ID NO: 1356102 - RNA, 12 nt, Homo sapiens
cagauacuuggg

SEQ ID NO: 1356103 - RNA, 16 nt, Homo sapiens
cagaucacagcuucag

SEQ ID NO: 1356104 - RNA, 15 nt, Homo sapiens
cagaucacagugucu

SEQ ID NO: 1356105 - RNA, 16 nt, Homo sapiens
cagaucugugccccau

SEQ ID NO: 1356106 - RNA, 15 nt, Homo sapiens
cagauggcagguuug

SEQ ID NO: 1356107 - RNA, 15 nt, Homo sapiens
cagauucuucagcuu

SEQ ID NO: 1356108 - RNA, 18 nt, Homo sapiens
cagcacgaguggccaguu

SEQ ID NO: 1356109 - RNA, 23 nt, Homo sapiens
cagcacucugugggucuggugau

SEQ ID NO: 1356110 - RNA, 20 nt, Homo sapiens
cagcagacuguguuucguga

SEQ ID NO: 1356111 - RNA, 13 nt, Homo sapiens
cagcaggaugcuc

SEQ ID NO: 1356112 - RNA, 15 nt, Homo sapiens
cagcauacugacucc

SEQ ID NO: 1356113 - RNA, 21 nt, Homo sapiens
cagcaucaucugcacugccca

SEQ ID NO: 1356114 - RNA, 19 nt, Homo sapiens
cagcauugacucuguggcu

SEQ ID NO: 1356115 - RNA, 19 nt, Homo sapiens
cagccagugaccugaggaa

SEQ ID NO: 1356116 - RNA, 14 nt, Homo sapiens
cagcccaacuguga

SEQ ID NO: 1356117 - RNA, 15 nt, Homo sapiens
cagcccaacugugag

SEQ ID NO: 1356118 - RNA, 22 nt, Homo sapiens
cagcccaagauucuucagucug

SEQ ID NO: 1356119 - RNA, 23 nt, Homo sapiens
cagccucaccauacccuguugag

SEQ ID NO: 1356120 - RNA, 16 nt, Homo sapiens
cagccucacuccucag

SEQ ID NO: 1356121 - RNA, 18 nt, Homo sapiens
cagccucccugaagccuu

SEQ ID NO: 1356122 - RNA, 17 nt, Homo sapiens
cagccucccuuugauga

SEQ ID NO: 1356123 - RNA, 19 nt, Homo sapiens
cagccugggugacagagca

SEQ ID NO: 1356124 - RNA, 22 nt, Homo sapiens
cagccuuuaucaagcuuaguga

SEQ ID NO: 1356125 - RNA, 18 nt, Homo sapiens
cagcuccaaccugcaaag

SEQ ID NO: 1356126 - RNA, 11 nt, Homo sapiens
cagcucugcaa

SEQ ID NO: 1356127 - RNA, 15 nt, Homo sapiens
cagcucugcaagaau

SEQ ID NO: 1356128 - RNA, 19 nt, Homo sapiens
cagcugaagaacaucucga

SEQ ID NO: 1356129 - RNA, 23 nt, Homo sapiens
cagcuggguuggaaaacaguauu

SEQ ID NO: 1356130 - RNA, 22 nt, Homo sapiens
cagcuguucucauugccaguga

SEQ ID NO: 1356131 - RNA, 19 nt, Homo sapiens
cagcuuagaaugcaucuca

SEQ ID NO: 1356132 - RNA, 13 nt, Homo sapiens
cagcuuaucucag

SEQ ID NO: 1356133 - RNA, 15 nt, Homo sapiens
caggaaccacaccac

SEQ ID NO: 1356134 - RNA, 16 nt, Homo sapiens
caggaagccgugcccu

SEQ ID NO: 1356135 - RNA, 16 nt, Homo sapiens
caggacagaugccaca

SEQ ID NO: 1356136 - RNA, 17 nt, Homo sapiens
caggaccagcucaggac

SEQ ID NO: 1356137 - RNA, 13 nt, Homo sapiens
caggacucccacc

SEQ ID NO: 1356138 - RNA, 20 nt, Homo sapiens
caggaggcagagguugcagu

SEQ ID NO: 1356139 - RNA, 14 nt, Homo sapiens
caggaguucagggu

SEQ ID NO: 1356140 - RNA, 24 nt, Homo sapiens
caggauagagacuggaacacuaga

SEQ ID NO: 1356141 - RNA, 22 nt, Homo sapiens
caggauggagcugacuacggaa

SEQ ID NO: 1356142 - RNA, 19 nt, Homo sapiens
caggauggggaggggcucu

SEQ ID NO: 1356143 - RNA, 13 nt, Homo sapiens
caggcaccugcca

SEQ ID NO: 1356144 - RNA, 18 nt, Homo sapiens
caggcagccugccuuuaa

SEQ ID NO: 1356145 - RNA, 15 nt, Homo sapiens
caggccaaagugccg

SEQ ID NO: 1356146 - RNA, 19 nt, Homo sapiens
caggccaaagugccgguga

SEQ ID NO: 1356147 - RNA, 14 nt, Homo sapiens
auuucaagugccua

SEQ ID NO: 1356148 - RNA, 21 nt, Homo sapiens
auuucacacucauuuaaucug

SEQ ID NO: 1356149 - RNA, 22 nt, Homo sapiens
auuucauugcucagaaauguca

SEQ ID NO: 1356150 - RNA, 15 nt, Homo sapiens
auuuccaagcuguua

SEQ ID NO: 1356151 - RNA, 13 nt, Homo sapiens
auuuccacaaaau

SEQ ID NO: 1356152 - RNA, 16 nt, Homo sapiens
auuucuaccuaaguca

SEQ ID NO: 1356153 - RNA, 17 nt, Homo sapiens
auuucuccgaaugucaa

SEQ ID NO: 1356154 - RNA, 17 nt, Homo sapiens
auuucugaacuguuaca

SEQ ID NO: 1356155 - RNA, 13 nt, Homo sapiens
auuucuguguugc

SEQ ID NO: 1356156 - RNA, 14 nt, Homo sapiens
auuucuucacucaa

SEQ ID NO: 1356157 - RNA, 15 nt, Homo sapiens
auuugauaguauugu

SEQ ID NO: 1356158 - RNA, 14 nt, Homo sapiens
auuugaugcauguc

SEQ ID NO: 1356159 - RNA, 15 nt, Homo sapiens
auuugcaacauuaga

SEQ ID NO: 1356160 - RNA, 16 nt, Homo sapiens
auuugcugaauacaga

SEQ ID NO: 1356161 - RNA, 18 nt, Homo sapiens
auuuggaaaauaaaucaa

SEQ ID NO: 1356162 - RNA, 20 nt, Homo sapiens
auuuggguucugccugccag

SEQ ID NO: 1356163 - RNA, 18 nt, Homo sapiens
auuuuagucccauuugac

SEQ ID NO: 1356164 - RNA, 14 nt, Homo sapiens
auuuucagcauuaa

SEQ ID NO: 1356165 - RNA, 22 nt, Homo sapiens
auuuuccccccacucuccccac

SEQ ID NO: 1356166 - RNA, 20 nt, Homo sapiens
auuuuggagaguuuccugaa

SEQ ID NO: 1356167 - RNA, 14 nt, Homo sapiens
auuuuggcauugua

SEQ ID NO: 1356168 - RNA, 17 nt, Homo sapiens
auuuuguaagaaguuuc

SEQ ID NO: 1356169 - RNA, 21 nt, Homo sapiens
auuuuguuuuugucuuaaaaa

SEQ ID NO: 1356170 - RNA, 15 nt, Homo sapiens
auuuuuagaauuaaa

SEQ ID NO: 1356171 - RNA, 18 nt, Homo sapiens
auuuuuaguuacuugagu

SEQ ID NO: 1356172 - RNA, 14 nt, Homo sapiens
auuuuucugaagga

SEQ ID NO: 1356173 - RNA, 15 nt, Homo sapiens
auuuuuugguacaaa

SEQ ID NO: 1356174 - RNA, 19 nt, Homo sapiens
caaaaaaaccucuaugcaa

SEQ ID NO: 1356175 - RNA, 16 nt, Homo sapiens
caaaaaaagaaaaaga

SEQ ID NO: 1356176 - RNA, 11 nt, Homo sapiens
caaaaaaucug

SEQ ID NO: 1356177 - RNA, 17 nt, Homo sapiens
caaaaaaucugaccaaa

SEQ ID NO: 1356178 - RNA, 20 nt, Homo sapiens
caaaaacgcacugcaagaag

SEQ ID NO: 1356179 - RNA, 18 nt, Homo sapiens
caaaaauacucacauggc

SEQ ID NO: 1356180 - RNA, 17 nt, Homo sapiens
caaaacaaguuggaugc

SEQ ID NO: 1356181 - RNA, 16 nt, Homo sapiens
caaaacuaaauuugaa

SEQ ID NO: 1356182 - RNA, 19 nt, Homo sapiens
caaaagcacuuugugcugu

SEQ ID NO: 1356183 - RNA, 18 nt, Homo sapiens
caaaauagacaauuugca

SEQ ID NO: 1356184 - RNA, 17 nt, Homo sapiens
caaaaucaagcaagccu

SEQ ID NO: 1356185 - RNA, 20 nt, Homo sapiens
caaaauggacucaagagaga

SEQ ID NO: 1356186 - RNA, 20 nt, Homo sapiens
caaacaaagccagaagcuga

SEQ ID NO: 1356187 - RNA, 20 nt, Homo sapiens
caaacagccucacuccucag

SEQ ID NO: 1356188 - RNA, 12 nt, Homo sapiens
caaacagugcac

SEQ ID NO: 1356189 - RNA, 14 nt, Homo sapiens
caaacccuuucaua

SEQ ID NO: 1356190 - RNA, 22 nt, Homo sapiens
caaaccuucugccuuugauguu

SEQ ID NO: 1356191 - RNA, 12 nt, Homo sapiens
caaacugccuaa

SEQ ID NO: 1356192 - RNA, 21 nt, Homo sapiens
caaagaacuucuccuacugua

SEQ ID NO: 1356193 - RNA, 22 nt, Homo sapiens
caaagaacuucuccuacuguag

SEQ ID NO: 1356194 - RNA, 13 nt, Homo sapiens
caaagacuuuccu

SEQ ID NO: 1356195 - RNA, 14 nt, Homo sapiens
caaagaugacugug

SEQ ID NO: 1356196 - RNA, 16 nt, Homo sapiens
caaagaugacugugga

SEQ ID NO: 1356197 - RNA, 13 nt, Homo sapiens
caaagauuugcaa

SEQ ID NO: 1356198 - RNA, 23 nt, Homo sapiens
caaagccuccuccagccgccaug

SEQ ID NO: 1356199 - RNA, 18 nt, Homo sapiens
caaagccuucauugccuu

SEQ ID NO: 1356200 - RNA, 18 nt, Homo sapiens
caaagcuaggaugguucu

SEQ ID NO: 1356201 - RNA, 19 nt, Homo sapiens
caaauauuggguugggcac

SEQ ID NO: 1356202 - RNA, 22 nt, Homo sapiens
caaaucaccaccgacugaagug

SEQ ID NO: 1356203 - RNA, 13 nt, Homo sapiens
caaaucauuccuu

SEQ ID NO: 1356204 - RNA, 13 nt, Homo sapiens
caaauggggccag

SEQ ID NO: 1356205 - RNA, 19 nt, Homo sapiens
caaauggggccagauccag

SEQ ID NO: 1356206 - RNA, 17 nt, Homo sapiens
caaaugguguccaaaga

SEQ ID NO: 1356207 - RNA, 12 nt, Homo sapiens
caacacauuuca

SEQ ID NO: 1356208 - RNA, 18 nt, Homo sapiens
caacacccaaguugaaga

SEQ ID NO: 1356209 - RNA, 22 nt, Homo sapiens
caacaccucugcacaagcugca

SEQ ID NO: 1356210 - RNA, 18 nt, Homo sapiens
caacagaaucagaucuga

SEQ ID NO: 1356211 - RNA, 20 nt, Homo sapiens
caacaggagcugggauccua

SEQ ID NO: 1356212 - RNA, 19 nt, Homo sapiens
caacaggcuuaugaauaua

SEQ ID NO: 1356213 - RNA, 16 nt, Homo sapiens
caacauaguauucaug

SEQ ID NO: 1356214 - RNA, 16 nt, Homo sapiens
caacauccuuaaguca

SEQ ID NO: 1356215 - RNA, 22 nt, Homo sapiens
caacaucuuuuuaaccugcaaa

SEQ ID NO: 1356216 - RNA, 20 nt, Homo sapiens
caacauggcgaaaccccucu

SEQ ID NO: 1356217 - RNA, 16 nt, Homo sapiens
caaccaaaagucuuca

SEQ ID NO: 1356218 - RNA, 18 nt, Homo sapiens
caaccaauggaaugugau

SEQ ID NO: 1356219 - RNA, 18 nt, Homo sapiens
caaccgagaagguuuauc

SEQ ID NO: 1356220 - RNA, 17 nt, Homo sapiens
caaccugaaauuaacuc

SEQ ID NO: 1356221 - RNA, 14 nt, Homo sapiens
caaccuugcaucca

SEQ ID NO: 1356222 - RNA, 21 nt, Homo sapiens
caacuucuacuucugcccuug

SEQ ID NO: 1356223 - RNA, 20 nt, Homo sapiens
caagacucuuuggacacuca

SEQ ID NO: 1356224 - RNA, 14 nt, Homo sapiens
caagauucuucagu

SEQ ID NO: 1356225 - RNA, 15 nt, Homo sapiens
caagcauuuguggac

SEQ ID NO: 1356226 - RNA, 17 nt, Homo sapiens
caagccugugcaaaaaa

SEQ ID NO: 1356227 - RNA, 21 nt, Homo sapiens
caagcggaugcuccauuucaa

SEQ ID NO: 1356228 - RNA, 22 nt, Homo sapiens
caagcuccuccucccugcaucu

SEQ ID NO: 1356229 - RNA, 20 nt, Homo sapiens
caagcuuagugagcagugag

SEQ ID NO: 1356230 - RNA, 14 nt, Homo sapiens
caaggacuuugcag

SEQ ID NO: 1356231 - RNA, 17 nt, Homo sapiens
caaggaugucugccaca

SEQ ID NO: 1356232 - RNA, 18 nt, Homo sapiens
caaggcccccacugccug

SEQ ID NO: 1356233 - RNA, 17 nt, Homo sapiens
caaggcuggcaggucaa

SEQ ID NO: 1356234 - RNA, 19 nt, Homo sapiens
caaggcugggggaagaagc

SEQ ID NO: 1356235 - RNA, 21 nt, Homo sapiens
caaggugauuucagacugcag

SEQ ID NO: 1356236 - RNA, 16 nt, Homo sapiens
caaggugcugauguca

SEQ ID NO: 1356237 - RNA, 18 nt, Homo sapiens
caaguaagaauguuaaaa

SEQ ID NO: 1356238 - RNA, 15 nt, Homo sapiens
caaguagcacacuga

SEQ ID NO: 1356239 - RNA, 13 nt, Homo sapiens
caagucacaaaga

SEQ ID NO: 1356240 - RNA, 19 nt, Homo sapiens
caagugaacucagcacucu

SEQ ID NO: 1356241 - RNA, 20 nt, Homo sapiens
caagugaccgacucauuuac

SEQ ID NO: 1356242 - RNA, 15 nt, Homo sapiens
caagugccuuagcaa

SEQ ID NO: 1356243 - RNA, 13 nt, Homo sapiens
caagugccuucac

SEQ ID NO: 1356244 - RNA, 13 nt, Homo sapiens
caaguguucacaa

SEQ ID NO: 1356245 - RNA, 23 nt, Homo sapiens
caauaauauuucaagugccuaga

SEQ ID NO: 1356246 - RNA, 15 nt, Homo sapiens
caauccaucucucaa

SEQ ID NO: 1356247 - RNA, 22 nt, Homo sapiens
caaugcuauaacuauguugaua

SEQ ID NO: 1356248 - RNA, 17 nt, Homo sapiens
caaugcuucuagaguuu

SEQ ID NO: 1356249 - RNA, 13 nt, Homo sapiens
caauggaauguga

SEQ ID NO: 1356250 - RNA, 23 nt, Homo sapiens
caauggcccggccccuccugacu

SEQ ID NO: 1356251 - RNA, 22 nt, Homo sapiens
caaugguuugcaaggaagccac

SEQ ID NO: 1356252 - RNA, 13 nt, Homo sapiens
caauuagcuccuc

SEQ ID NO: 1356253 - RNA, 21 nt, Homo sapiens
caauuagcuccuccuuuuucc

SEQ ID NO: 1356254 - RNA, 13 nt, Homo sapiens
caauucuucuucc

SEQ ID NO: 1356255 - RNA, 14 nt, Homo sapiens
caauuucagacucc

SEQ ID NO: 1356256 - RNA, 13 nt, Homo sapiens
caauuucccuuca

SEQ ID NO: 1356257 - RNA, 13 nt, Homo sapiens
cacaaaccaguau

SEQ ID NO: 1356258 - RNA, 14 nt, Homo sapiens
cacaagccugagaa

SEQ ID NO: 1356259 - RNA, 15 nt, Homo sapiens
cacaaggugauuuca

SEQ ID NO: 1356260 - RNA, 10 nt, Homo sapiens
cacacacaaa

SEQ ID NO: 1356261 - RNA, 22 nt, Homo sapiens
cacacacuguucugaaagugac

SEQ ID NO: 1356262 - RNA, 16 nt, Homo sapiens
cacaccccaacacuuc

SEQ ID NO: 1356263 - RNA, 13 nt, Homo sapiens
cacacuugcauga

SEQ ID NO: 1356264 - RNA, 13 nt, Homo sapiens
gcauguccuuugc

SEQ ID NO: 1356265 - RNA, 22 nt, Homo sapiens
gcauguccuuugcgccugugac

SEQ ID NO: 1356266 - RNA, 17 nt, Homo sapiens
gcaugugugaaacauac

SEQ ID NO: 1356267 - RNA, 23 nt, Homo sapiens
gcauuauaaauaaauaccaaaaa

SEQ ID NO: 1356268 - RNA, 13 nt, Homo sapiens
gcauuggugcuca

SEQ ID NO: 1356269 - RNA, 15 nt, Homo sapiens
gcauuuaacugccuu

SEQ ID NO: 1356270 - RNA, 19 nt, Homo sapiens
gcauuucacaaaacagccu

SEQ ID NO: 1356271 - RNA, 17 nt, Homo sapiens
gcauuuggagagucuca

SEQ ID NO: 1356272 - RNA, 17 nt, Homo sapiens
gcauuuuccagcacuuu

SEQ ID NO: 1356273 - RNA, 22 nt, Homo sapiens
gccaaaaacaacaaauagccac

SEQ ID NO: 1356274 - RNA, 22 nt, Homo sapiens
gccaaccgugggguuagcucua

SEQ ID NO: 1356275 - RNA, 18 nt, Homo sapiens
gccaagaggcuguuccca

SEQ ID NO: 1356276 - RNA, 18 nt, Homo sapiens
gccaagagggacaucaga

SEQ ID NO: 1356277 - RNA, 19 nt, Homo sapiens
gccaagcagccaagcuccu

SEQ ID NO: 1356278 - RNA, 17 nt, Homo sapiens
gccaaggagcugcuaua

SEQ ID NO: 1356279 - RNA, 19 nt, Homo sapiens
gccaagggaaccugugucc

SEQ ID NO: 1356280 - RNA, 15 nt, Homo sapiens
gccacaccucuccaa

SEQ ID NO: 1356281 - RNA, 21 nt, Homo sapiens
gccacagcuggugguaucuga

SEQ ID NO: 1356282 - RNA, 14 nt, Homo sapiens
gccaccgcacucca

SEQ ID NO: 1356283 - RNA, 21 nt, Homo sapiens
gccacguauguuuuuguguau

SEQ ID NO: 1356284 - RNA, 22 nt, Homo sapiens
gccacuugaagauuucucugag

SEQ ID NO: 1356285 - RNA, 15 nt, Homo sapiens
gccagacaugccaca

SEQ ID NO: 1356286 - RNA, 17 nt, Homo sapiens
gccagagauccaaaaga

SEQ ID NO: 1356287 - RNA, 16 nt, Homo sapiens
gccagcccaacuguga

SEQ ID NO: 1356288 - RNA, 18 nt, Homo sapiens
gccaggcaugguggccca

SEQ ID NO: 1356289 - RNA, 20 nt, Homo sapiens
gccaggcugccaaggccaga

SEQ ID NO: 1356290 - RNA, 22 nt, Homo sapiens
gccagguaugacacccacucuc

SEQ ID NO: 1356291 - RNA, 14 nt, Homo sapiens
gccaucccaaaaau

SEQ ID NO: 1356292 - RNA, 20 nt, Homo sapiens
gccauggggaaguccugggu

SEQ ID NO: 1356293 - RNA, 21 nt, Homo sapiens
gccauuacugcauaaaauaga

SEQ ID NO: 1356294 - RNA, 15 nt, Homo sapiens
gcccaacgcaaauuc

SEQ ID NO: 1356295 - RNA, 16 nt, Homo sapiens
gcccacguguccugag

SEQ ID NO: 1356296 - RNA, 14 nt, Homo sapiens
gcccagagcccagc

SEQ ID NO: 1356297 - RNA, 17 nt, Homo sapiens
gcccagagcccagcucc

SEQ ID NO: 1356298 - RNA, 20 nt, Homo sapiens
gcccaggauggagugcaaug

SEQ ID NO: 1356299 - RNA, 19 nt, Homo sapiens
gcccaggcuggagugcagu

SEQ ID NO: 1356300 - RNA, 16 nt, Homo sapiens
gcccaguguccccuuu

SEQ ID NO: 1356301 - RNA, 23 nt, Homo sapiens
gccccagagcuguuuauggccuc

SEQ ID NO: 1356302 - RNA, 18 nt, Homo sapiens
gccccaucagcuccagcu

SEQ ID NO: 1356303 - RNA, 21 nt, Homo sapiens
gccccauccuccagcagggaa

SEQ ID NO: 1356304 - RNA, 13 nt, Homo sapiens
gcccccacuuccc

SEQ ID NO: 1356305 - RNA, 16 nt, Homo sapiens
gccccgucugacccca

SEQ ID NO: 1356306 - RNA, 22 nt, Homo sapiens
gccccucccagaacacacucca

SEQ ID NO: 1356307 - RNA, 18 nt, Homo sapiens
gccccuggcucugaccga

SEQ ID NO: 1356308 - RNA, 13 nt, Homo sapiens
gcccuacagaaaa

SEQ ID NO: 1356309 - RNA, 21 nt, Homo sapiens
gcccuaccugauuggugcaac

SEQ ID NO: 1356310 - RNA, 22 nt, Homo sapiens
gcccucccuaccuaccaagaua

SEQ ID NO: 1356311 - RNA, 23 nt, Homo sapiens
gccgguccuucccucucaugacu

SEQ ID NO: 1356312 - RNA, 17 nt, Homo sapiens
gccgugagcauguuugg

SEQ ID NO: 1356313 - RNA, 21 nt, Homo sapiens
gccuaaaaaguaucauuacau

SEQ ID NO: 1356314 - RNA, 13 nt, Homo sapiens
gccucaaugccag

SEQ ID NO: 1356315 - RNA, 22 nt, Homo sapiens
gccuccaacagcaucaucugca

SEQ ID NO: 1356316 - RNA, 15 nt, Homo sapiens
gccuccccaccacug

SEQ ID NO: 1356317 - RNA, 15 nt, Homo sapiens
gccucccugagcacu

SEQ ID NO: 1356318 - RNA, 16 nt, Homo sapiens
gccucguacguguguu

SEQ ID NO: 1356319 - RNA, 14 nt, Homo sapiens
gccucugugcugca

SEQ ID NO: 1356320 - RNA, 16 nt, Homo sapiens
gccugacaaccacugg

SEQ ID NO: 1356321 - RNA, 17 nt, Homo sapiens
gccugaugugagugugu

SEQ ID NO: 1356322 - RNA, 21 nt, Homo sapiens
gccugaugugaguguguggca

SEQ ID NO: 1356323 - RNA, 14 nt, Homo sapiens
gccugccucuucuc

SEQ ID NO: 1356324 - RNA, 17 nt, Homo sapiens
gccuggacuuuccugca

SEQ ID NO: 1356325 - RNA, 16 nt, Homo sapiens
uggcucagaacugcaa

SEQ ID NO: 1356326 - RNA, 15 nt, Homo sapiens
uggcucccaugacca

SEQ ID NO: 1356327 - RNA, 22 nt, Homo sapiens
uggcucucagcgccgucgccac

SEQ ID NO: 1356328 - RNA, 21 nt, Homo sapiens
uggcugucaaugggaccugug

SEQ ID NO: 1356329 - RNA, 14 nt, Homo sapiens
uggcuuacuccagg

SEQ ID NO: 1356330 - RNA, 16 nt, Homo sapiens
uggcuuuucuuuacca

SEQ ID NO: 1356331 - RNA, 18 nt, Homo sapiens
ugggaacuagacucccaa

SEQ ID NO: 1356332 - RNA, 17 nt, Homo sapiens
ugggaacuccuaaauca

SEQ ID NO: 1356333 - RNA, 23 nt, Homo sapiens
ugggaccaggcuccaauggggcg

SEQ ID NO: 1356334 - RNA, 16 nt, Homo sapiens
ugggagaaaucuggcu

SEQ ID NO: 1356335 - RNA, 19 nt, Homo sapiens
ugggagauguuagacucau

SEQ ID NO: 1356336 - RNA, 18 nt, Homo sapiens
ugggagccagggcugucu

SEQ ID NO: 1356337 - RNA, 14 nt, Homo sapiens
ugggagucaucuca

SEQ ID NO: 1356338 - RNA, 18 nt, Homo sapiens
ugggaguucuaacaaaac

SEQ ID NO: 1356339 - RNA, 15 nt, Homo sapiens
ugggauguucagcac

SEQ ID NO: 1356340 - RNA, 17 nt, Homo sapiens
ugggauguucagcacug

SEQ ID NO: 1356341 - RNA, 14 nt, Homo sapiens
ugggcccagaucug

SEQ ID NO: 1356342 - RNA, 17 nt, Homo sapiens
ugggccccuggcacucu

SEQ ID NO: 1356343 - RNA, 14 nt, Homo sapiens
ugggccgggaccca

SEQ ID NO: 1356344 - RNA, 14 nt, Homo sapiens
ugggccugcuccag

SEQ ID NO: 1356345 - RNA, 12 nt, Homo sapiens
ugggccuuggca

SEQ ID NO: 1356346 - RNA, 15 nt, Homo sapiens
uggggaaaacuugca

SEQ ID NO: 1356347 - RNA, 16 nt, Homo sapiens
uggggaaaacuugcag

SEQ ID NO: 1356348 - RNA, 16 nt, Homo sapiens
uggggacggggcuccc

SEQ ID NO: 1356349 - RNA, 14 nt, Homo sapiens
uggggagucaggga

SEQ ID NO: 1356350 - RNA, 20 nt, Homo sapiens
uggggcaggcagugaugcug

SEQ ID NO: 1356351 - RNA, 15 nt, Homo sapiens
uggggcuccuaccug

SEQ ID NO: 1356352 - RNA, 16 nt, Homo sapiens
uggggguggggcuccu

SEQ ID NO: 1356353 - RNA, 13 nt, Homo sapiens
uggguaccuguau

SEQ ID NO: 1356354 - RNA, 13 nt, Homo sapiens
ugggucuccaggg

SEQ ID NO: 1356355 - RNA, 11 nt, Homo sapiens
ugggugacaaa

SEQ ID NO: 1356356 - RNA, 20 nt, Homo sapiens
ugggugacagagcaagugag

SEQ ID NO: 1356357 - RNA, 14 nt, Homo sapiens
ugguaaaaacugca

SEQ ID NO: 1356358 - RNA, 21 nt, Homo sapiens
ugguauuaauaaacacauaca

SEQ ID NO: 1356359 - RNA, 22 nt, Homo sapiens
uggucugcaggcagggcugacu

SEQ ID NO: 1356360 - RNA, 14 nt, Homo sapiens
uggugccaaacaaa

SEQ ID NO: 1356361 - RNA, 17 nt, Homo sapiens
uggugccaaacaaaaag

SEQ ID NO: 1356362 - RNA, 16 nt, Homo sapiens
ugguggccggcagaag

SEQ ID NO: 1356363 - RNA, 21 nt, Homo sapiens
ugguggcucacaccuguaauc

SEQ ID NO: 1356364 - RNA, 17 nt, Homo sapiens
ugguguugacaugugcu

SEQ ID NO: 1356365 - RNA, 19 nt, Homo sapiens
ugguucugcaaugacugca

SEQ ID NO: 1356366 - RNA, 22 nt, Homo sapiens
ugguuuuuaaaaaacugcugac

SEQ ID NO: 1356367 - RNA, 19 nt, Homo sapiens
ugguuuuuaaguacucacu

SEQ ID NO: 1356368 - RNA, 12 nt, Homo sapiens
uguaaaauggag

SEQ ID NO: 1356369 - RNA, 12 nt, Homo sapiens
uguaacaugaca

SEQ ID NO: 1356370 - RNA, 14 nt, Homo sapiens
uguaagaaacacac

SEQ ID NO: 1356371 - RNA, 19 nt, Homo sapiens
uguaagaaacacacugagg

SEQ ID NO: 1356372 - RNA, 18 nt, Homo sapiens
uguaagguggucacuguu

SEQ ID NO: 1356373 - RNA, 19 nt, Homo sapiens
uguaaucccagcuacuugg

SEQ ID NO: 1356374 - RNA, 15 nt, Homo sapiens
uguaauuguauuuca

SEQ ID NO: 1356375 - RNA, 23 nt, Homo sapiens
uguacaauaaaaacauugccuuu

SEQ ID NO: 1356376 - RNA, 17 nt, Homo sapiens
uguacagacuucuuggu

SEQ ID NO: 1356377 - RNA, 15 nt, Homo sapiens
uguacucaaguacca

SEQ ID NO: 1356378 - RNA, 17 nt, Homo sapiens
uguagacuuaacacuuc

SEQ ID NO: 1356379 - RNA, 17 nt, Homo sapiens
uguaguugaugacuguu

SEQ ID NO: 1356380 - RNA, 18 nt, Homo sapiens
uguaucauuaugaaguca

SEQ ID NO: 1356381 - RNA, 17 nt, Homo sapiens
uguaucuuaaaaaucua

SEQ ID NO: 1356382 - RNA, 18 nt, Homo sapiens
uguauuuaauuuuaacug

SEQ ID NO: 1356383 - RNA, 20 nt, Homo sapiens
ugucaagccugugcaaaaaa

SEQ ID NO: 1356384 - RNA, 17 nt, Homo sapiens
ugucaaugggaccugug

SEQ ID NO: 1356385 - RNA, 15 nt, Homo sapiens
ugucacccaaugcau

SEQ ID NO: 1356386 - RNA, 12 nt, Homo sapiens
ugucaguugcca

SEQ ID NO: 1356387 - RNA, 14 nt, Homo sapiens
ugucauagacuccu

SEQ ID NO: 1356388 - RNA, 11 nt, Homo sapiens
ugucaucucag

SEQ ID NO: 1356389 - RNA, 20 nt, Homo sapiens
ugucaugagcauuuguuuaa

SEQ ID NO: 1356390 - RNA, 14 nt, Homo sapiens
uguccaaguucagg

SEQ ID NO: 1356391 - RNA, 20 nt, Homo sapiens
uguccagcaccuugugccug

SEQ ID NO: 1356392 - RNA, 21 nt, Homo sapiens
uguccccuuuuauugcugcuu

SEQ ID NO: 1356393 - RNA, 13 nt, Homo sapiens
ugucccucugccc

SEQ ID NO: 1356394 - RNA, 18 nt, Homo sapiens
uguccucucccugccaag

SEQ ID NO: 1356395 - RNA, 18 nt, Homo sapiens
uguccugaggggcugcuu

SEQ ID NO: 1356396 - RNA, 13 nt, Homo sapiens
uguccugggguau

SEQ ID NO: 1356397 - RNA, 23 nt, Homo sapiens
ugucgguuugcuuugauuucccu

SEQ ID NO: 1356398 - RNA, 17 nt, Homo sapiens
ugucucauccaaaaagu

SEQ ID NO: 1356399 - RNA, 20 nt, Homo sapiens
ugucugaacccaggcagcug

SEQ ID NO: 1356400 - RNA, 19 nt, Homo sapiens
ugucugaauggugcgugaa

SEQ ID NO: 1356401 - RNA, 20 nt, Homo sapiens
ugucugcgucgucaccaaau

SEQ ID NO: 1356402 - RNA, 21 nt, Homo sapiens
ugucugcgucgucaccaaauc

SEQ ID NO: 1356403 - RNA, 21 nt, Homo sapiens
ugucugucuacauuucugcag

SEQ ID NO: 1356404 - RNA, 12 nt, Homo sapiens
ugucugugccau

SEQ ID NO: 1356405 - RNA, 18 nt, Homo sapiens
ugucuguguacauguaca

SEQ ID NO: 1356406 - RNA, 19 nt, Homo sapiens
ugucuuuauaaucuacucc

SEQ ID NO: 1356407 - RNA, 23 nt, Homo sapiens
ugugaacuggaagaaagcaacaa

SEQ ID NO: 1356408 - RNA, 17 nt, Homo sapiens
ugugaauuguuccucag

SEQ ID NO: 1356409 - RNA, 17 nt, Homo sapiens
ugugauguuuggacaca

SEQ ID NO: 1356410 - RNA, 14 nt, Homo sapiens
ugugauuagugucu

SEQ ID NO: 1356411 - RNA, 17 nt, Homo sapiens
ugugauucacaguguga

SEQ ID NO: 1356412 - RNA, 16 nt, Homo sapiens
ugugccccaugccugu

SEQ ID NO: 1356413 - RNA, 12 nt, Homo sapiens
ugugcugugagu

SEQ ID NO: 1356414 - RNA, 23 nt, Homo sapiens
uguggaagacacuugcugaguga

SEQ ID NO: 1356415 - RNA, 20 nt, Homo sapiens
uguggacguggguugcacug

SEQ ID NO: 1356416 - RNA, 21 nt, Homo sapiens
uguggacguggguugcacugg

SEQ ID NO: 1356417 - RNA, 18 nt, Homo sapiens
uguggaggagcucaggac

SEQ ID NO: 1356418 - RNA, 16 nt, Homo sapiens
uguggaugagaggaac

SEQ ID NO: 1356419 - RNA, 18 nt, Homo sapiens
uguggcuggaagauccug

SEQ ID NO: 1356420 - RNA, 16 nt, Homo sapiens
uguggugagaucaugc

SEQ ID NO: 1356421 - RNA, 19 nt, Homo sapiens
ugugguuaaugccauggac

SEQ ID NO: 1356422 - RNA, 12 nt, Homo sapiens
ugugucagcaua

SEQ ID NO: 1356423 - RNA, 21 nt, Homo sapiens
ugugugagagcuguacauuaa

SEQ ID NO: 1356424 - RNA, 11 nt, Homo sapiens
ugugugcacau

SEQ ID NO: 1356425 - RNA, 11 nt, Homo sapiens
ugugugccuuu

SEQ ID NO: 1356426 - RNA, 15 nt, Homo sapiens
ugugugcgucacugu

SEQ ID NO: 1356427 - RNA, 18 nt, Homo sapiens
uguguuuacauuuacuga

SEQ ID NO: 1356428 - RNA, 16 nt, Homo sapiens
uguuaauuacaccaua

SEQ ID NO: 1356429 - RNA, 20 nt, Homo sapiens
uguuacaacuuguauuucca

SEQ ID NO: 1356430 - RNA, 19 nt, Homo sapiens
uguuacuuuggcaauuucc

SEQ ID NO: 1356431 - RNA, 18 nt, Homo sapiens
uguuagauguccucagaa

SEQ ID NO: 1356432 - RNA, 17 nt, Homo sapiens
uguuagugguuacccag

SEQ ID NO: 1356433 - RNA, 14 nt, Homo sapiens
uguuaugggcacug

SEQ ID NO: 1356434 - RNA, 17 nt, Homo sapiens
uguucacugcuccuugc

SEQ ID NO: 1356435 - RNA, 22 nt, Homo sapiens
uguuccccacuguaucuaggca

SEQ ID NO: 1356436 - RNA, 20 nt, Homo sapiens
uguucucaugcauuucaugg

SEQ ID NO: 1356437 - RNA, 21 nt, Homo sapiens
uguucuggggggacccagugc

SEQ ID NO: 1356438 - RNA, 17 nt, Homo sapiens
uguucuuuuuucugucu

SEQ ID NO: 1356439 - RNA, 13 nt, Homo sapiens
uguugacaugugc

SEQ ID NO: 1356440 - RNA, 15 nt, Homo sapiens
uguugagcagcaucu

SEQ ID NO: 1356441 - RNA, 17 nt, Homo sapiens
uguugagcaucacagaa

SEQ ID NO: 1356442 - RNA, 21 nt, Homo sapiens
uucuagccuuaagacauuuga

SEQ ID NO: 1356443 - RNA, 16 nt, Homo sapiens
uucuaggcucacugca

SEQ ID NO: 1356444 - RNA, 12 nt, Homo sapiens
uucuauaacaaa

SEQ ID NO: 1356445 - RNA, 17 nt, Homo sapiens
uucucagguguugccaa

SEQ ID NO: 1356446 - RNA, 19 nt, Homo sapiens
uucucagguguugccaaau

SEQ ID NO: 1356447 - RNA, 18 nt, Homo sapiens
uucucauaacucugugau

SEQ ID NO: 1356448 - RNA, 19 nt, Homo sapiens
uucucauaacucugugauc

SEQ ID NO: 1356449 - RNA, 16 nt, Homo sapiens
uucuccgugaugcugu

SEQ ID NO: 1356450 - RNA, 17 nt, Homo sapiens
uucuccugugugauuga

SEQ ID NO: 1356451 - RNA, 14 nt, Homo sapiens
uucucugagaucau

SEQ ID NO: 1356452 - RNA, 17 nt, Homo sapiens
uucucugagaucaugag

SEQ ID NO: 1356453 - RNA, 21 nt, Homo sapiens
uucucuuagaacauuguauua

SEQ ID NO: 1356454 - RNA, 15 nt, Homo sapiens
uucugaaacugcaua

SEQ ID NO: 1356455 - RNA, 23 nt, Homo sapiens
uucugccaggcccccaagccugc

SEQ ID NO: 1356456 - RNA, 23 nt, Homo sapiens
uucugccuaucuucuuucacaua

SEQ ID NO: 1356457 - RNA, 19 nt, Homo sapiens
uucugcuuauuucaucugu

SEQ ID NO: 1356458 - RNA, 17 nt, Homo sapiens
uucuggugcuacuccau

SEQ ID NO: 1356459 - RNA, 21 nt, Homo sapiens
uucuuaaacaaauguaugauu

SEQ ID NO: 1356460 - RNA, 18 nt, Homo sapiens
uucuuaacccuuuccaga

SEQ ID NO: 1356461 - RNA, 17 nt, Homo sapiens
uucuucagcuugauccu

SEQ ID NO: 1356462 - RNA, 14 nt, Homo sapiens
uucuucaugaggcc

SEQ ID NO: 1356463 - RNA, 12 nt, Homo sapiens
uucuuugcaaag

SEQ ID NO: 1356464 - RNA, 17 nt, Homo sapiens
uucuuugggccagacau

SEQ ID NO: 1356465 - RNA, 17 nt, Homo sapiens
uugaaagcccaaggugc

SEQ ID NO: 1356466 - RNA, 13 nt, Homo sapiens
uugaaaucuauga

SEQ ID NO: 1356467 - RNA, 20 nt, Homo sapiens
uugaaggacuacagguauuu

SEQ ID NO: 1356468 - RNA, 13 nt, Homo sapiens
uugaagggccaga

SEQ ID NO: 1356469 - RNA, 18 nt, Homo sapiens
uugaagugacuucacaga

SEQ ID NO: 1356470 - RNA, 22 nt, Homo sapiens
uugaaugacauuuuagggacau

SEQ ID NO: 1356471 - RNA, 17 nt, Homo sapiens
uugacaaauguaaacau

SEQ ID NO: 1356472 - RNA, 16 nt, Homo sapiens
uugacagaacacuguc

SEQ ID NO: 1356473 - RNA, 22 nt, Homo sapiens
uugacuagggauucaggcugcu

SEQ ID NO: 1356474 - RNA, 13 nt, Homo sapiens
uugagcagcaucu

SEQ ID NO: 1356475 - RNA, 20 nt, Homo sapiens
uugagcucaggaguuugaga

SEQ ID NO: 1356476 - RNA, 16 nt, Homo sapiens
uugagcugagugcuga

SEQ ID NO: 1356477 - RNA, 21 nt, Homo sapiens
uugaguuugucgcucaugugu

SEQ ID NO: 1356478 - RNA, 23 nt, Homo sapiens
uugauagaaaugccaagcacuuc

SEQ ID NO: 1356479 - RNA, 16 nt, Homo sapiens
uugauaguauugugca

SEQ ID NO: 1356480 - RNA, 21 nt, Homo sapiens
uugaucuggaacccagacuca

SEQ ID NO: 1356481 - RNA, 20 nt, Homo sapiens
uugauucugauaaugcucac

SEQ ID NO: 1356482 - RNA, 21 nt, Homo sapiens
uugauuucccugggagcuguu

SEQ ID NO: 1356483 - RNA, 24 nt, Homo sapiens
uugcaaccuaccuguugagcauca

SEQ ID NO: 1356484 - RNA, 14 nt, Homo sapiens
uugcaccacugcac

SEQ ID NO: 1356485 - RNA, 18 nt, Homo sapiens
uugcagacaggaaucuua

SEQ ID NO: 1356486 - RNA, 21 nt, Homo sapiens
uugcauauaccaguugugaua

SEQ ID NO: 1356487 - RNA, 21 nt, Homo sapiens
uugcaugugcugcagguguaa

SEQ ID NO: 1356488 - RNA, 13 nt, Homo sapiens
uugcccacaaugc

SEQ ID NO: 1356489 - RNA, 17 nt, Homo sapiens
uugcccccagacuuccu

SEQ ID NO: 1356490 - RNA, 15 nt, Homo sapiens
uugccgucugugaca

SEQ ID NO: 1356491 - RNA, 19 nt, Homo sapiens
uugccucaaugccaguaac

SEQ ID NO: 1356492 - RNA, 16 nt, Homo sapiens
uugcguagcucucaaa

SEQ ID NO: 1356493 - RNA, 20 nt, Homo sapiens
uugcuaaaccuauuucacaa

SEQ ID NO: 1356494 - RNA, 13 nt, Homo sapiens
uugcucuccuaga

SEQ ID NO: 1356495 - RNA, 21 nt, Homo sapiens
uugcugcauugauccaggaga

SEQ ID NO: 1356496 - RNA, 12 nt, Homo sapiens
uuggaaaucaca

SEQ ID NO: 1356497 - RNA, 19 nt, Homo sapiens
uuggaagugugugaucugu

SEQ ID NO: 1356498 - RNA, 18 nt, Homo sapiens
uuggauacauacaccagc

SEQ ID NO: 1356499 - RNA, 18 nt, Homo sapiens
uuggcaggcuggccaguc

SEQ ID NO: 1356500 - RNA, 17 nt, Homo sapiens
gagccuucugugcugug

SEQ ID NO: 1356501 - RNA, 15 nt, Homo sapiens
gagccuuuaccuuuu

SEQ ID NO: 1356502 - RNA, 23 nt, Homo sapiens
gagcuacugccgucagugcugug

SEQ ID NO: 1356503 - RNA, 13 nt, Homo sapiens
gagcugagugcug

SEQ ID NO: 1356504 - RNA, 19 nt, Homo sapiens
gagcugagugcugaaauaa

SEQ ID NO: 1356505 - RNA, 17 nt, Homo sapiens
gagcuggccuccuaugc

SEQ ID NO: 1356506 - RNA, 16 nt, Homo sapiens
gagcuggggaucccuc

SEQ ID NO: 1356507 - RNA, 14 nt, Homo sapiens
gagcuuaaacagcu

SEQ ID NO: 1356508 - RNA, 22 nt, Homo sapiens
gagcuugcaggguuucucgcca

SEQ ID NO: 1356509 - RNA, 20 nt, Homo sapiens
gaggaaaggccagcuggcag

SEQ ID NO: 1356510 - RNA, 22 nt, Homo sapiens
gaggacuuguuaaagagcacug

SEQ ID NO: 1356511 - RNA, 20 nt, Homo sapiens
gaggcagagguugcagugag

SEQ ID NO: 1356512 - RNA, 20 nt, Homo sapiens
gaggccugccuggcaggugu

SEQ ID NO: 1356513 - RNA, 21 nt, Homo sapiens
gaggcggaucaucuaauucuc

SEQ ID NO: 1356514 - RNA, 14 nt, Homo sapiens
gaggcuugugugaa

SEQ ID NO: 1356515 - RNA, 23 nt, Homo sapiens
gagggaagaaugaacacucccca

SEQ ID NO: 1356516 - RNA, 21 nt, Homo sapiens
gaggggaaguccagccuacca

SEQ ID NO: 1356517 - RNA, 20 nt, Homo sapiens
gaggucaaggcugcagugag

SEQ ID NO: 1356518 - RNA, 14 nt, Homo sapiens
gaggucuaaucuag

SEQ ID NO: 1356519 - RNA, 17 nt, Homo sapiens
gagguuauguguucuaa

SEQ ID NO: 1356520 - RNA, 14 nt, Homo sapiens
gagguugcagugag

SEQ ID NO: 1356521 - RNA, 13 nt, Homo sapiens
gaguaaugcauga

SEQ ID NO: 1356522 - RNA, 22 nt, Homo sapiens
gaguauuuuuguauuaaaaaca

SEQ ID NO: 1356523 - RNA, 19 nt, Homo sapiens
gagucuagcucuccugcca

SEQ ID NO: 1356524 - RNA, 14 nt, Homo sapiens
gagucugaagcaga

SEQ ID NO: 1356525 - RNA, 22 nt, Homo sapiens
gagugaaaaaucuuaaguacca

SEQ ID NO: 1356526 - RNA, 15 nt, Homo sapiens
gagugacacccaaga

SEQ ID NO: 1356527 - RNA, 16 nt, Homo sapiens
gaguguagacuguggc

SEQ ID NO: 1356528 - RNA, 15 nt, Homo sapiens
gaguuaacugugaaa

SEQ ID NO: 1356529 - RNA, 23 nt, Homo sapiens
gaguuccagcaaacaaaauggac

SEQ ID NO: 1356530 - RNA, 13 nt, Homo sapiens
gaguugaucugga

SEQ ID NO: 1356531 - RNA, 15 nt, Homo sapiens
gaguuguugcuuaua

SEQ ID NO: 1356532 - RNA, 20 nt, Homo sapiens
gauaaaauacuaaacuacau

SEQ ID NO: 1356533 - RNA, 16 nt, Homo sapiens
gauaaagaugcaagga

SEQ ID NO: 1356534 - RNA, 13 nt, Homo sapiens
gauaaagggccaa

SEQ ID NO: 1356535 - RNA, 17 nt, Homo sapiens
gauaacccuuauuccau

SEQ ID NO: 1356536 - RNA, 18 nt, Homo sapiens
gauaauuguuucauucau

SEQ ID NO: 1356537 - RNA, 22 nt, Homo sapiens
gauacuugaaggucuaggugcu

SEQ ID NO: 1356538 - RNA, 14 nt, Homo sapiens
gauagaugcuggcc

SEQ ID NO: 1356539 - RNA, 19 nt, Homo sapiens
gauauacuugguucucucc

SEQ ID NO: 1356540 - RNA, 21 nt, Homo sapiens
gauauacuugguucucuccac

SEQ ID NO: 1356541 - RNA, 13 nt, Homo sapiens
gauauauuccacc

SEQ ID NO: 1356542 - RNA, 22 nt, Homo sapiens
gauccaaaagaagcccccagcu

SEQ ID NO: 1356543 - RNA, 23 nt, Homo sapiens
gauccaaaagaagcccccagcua

SEQ ID NO: 1356544 - RNA, 20 nt, Homo sapiens
gaucucgccacugcacucca

SEQ ID NO: 1356545 - RNA, 17 nt, Homo sapiens
gaucugaugcaagcaag

SEQ ID NO: 1356546 - RNA, 23 nt, Homo sapiens
gaucuggaacccagacucagaca

SEQ ID NO: 1356547 - RNA, 14 nt, Homo sapiens
gaugacuggucucu

SEQ ID NO: 1356548 - RNA, 16 nt, Homo sapiens
gaugagaaaacaggcu

SEQ ID NO: 1356549 - RNA, 18 nt, Homo sapiens
gaugaguuaacugugaaa

SEQ ID NO: 1356550 - RNA, 13 nt, Homo sapiens
gaugauaaaacac

SEQ ID NO: 1356551 - RNA, 17 nt, Homo sapiens
gaugauauuaagaacug

SEQ ID NO: 1356552 - RNA, 15 nt, Homo sapiens
gaugaucacugugaa

SEQ ID NO: 1356553 - RNA, 13 nt, Homo sapiens
gaugcaagcaaga

SEQ ID NO: 1356554 - RNA, 14 nt, Homo sapiens
gaugggagguugug

SEQ ID NO: 1356555 - RNA, 18 nt, Homo sapiens
gauggggcaagggcacaa

SEQ ID NO: 1356556 - RNA, 18 nt, Homo sapiens
gaugucguuugaaucaca

SEQ ID NO: 1356557 - RNA, 14 nt, Homo sapiens
gauuaagaaugcca

SEQ ID NO: 1356558 - RNA, 14 nt, Homo sapiens
gauuaccugccaau

SEQ ID NO: 1356559 - RNA, 14 nt, Homo sapiens
gauucacaguguga

SEQ ID NO: 1356560 - RNA, 20 nt, Homo sapiens
gauucaggggucugaugaca

SEQ ID NO: 1356561 - RNA, 14 nt, Homo sapiens
gauucaugcacugu

SEQ ID NO: 1356562 - RNA, 21 nt, Homo sapiens
gauuccccaucucaggccaga

SEQ ID NO: 1356563 - RNA, 19 nt, Homo sapiens
gauucucuuaggugucaug

SEQ ID NO: 1356564 - RNA, 18 nt, Homo sapiens
caggcuggucuugaacuc

SEQ ID NO: 1356565 - RNA, 20 nt, Homo sapiens
caggcuugaaucaaagaacu

SEQ ID NO: 1356566 - RNA, 21 nt, Homo sapiens
cagggauuaaccucugcacua

SEQ ID NO: 1356567 - RNA, 15 nt, Homo sapiens
cagggccaggugcuu

SEQ ID NO: 1356568 - RNA, 14 nt, Homo sapiens
cagggccguugccc

SEQ ID NO: 1356569 - RNA, 14 nt, Homo sapiens
cagggcuggucuuu

SEQ ID NO: 1356570 - RNA, 20 nt, Homo sapiens
cagggcuggucuuuuaggac

SEQ ID NO: 1356571 - RNA, 14 nt, Homo sapiens
cagggcugucuucg

SEQ ID NO: 1356572 - RNA, 18 nt, Homo sapiens
cagggucccucuguguau

SEQ ID NO: 1356573 - RNA, 20 nt, Homo sapiens
cagggugugggaucugagga

SEQ ID NO: 1356574 - RNA, 20 nt, Homo sapiens
cagguagaacacaaggucau

SEQ ID NO: 1356575 - RNA, 21 nt, Homo sapiens
cagguagaacacaaggucauu

SEQ ID NO: 1356576 - RNA, 13 nt, Homo sapiens
caggucacuuuac

SEQ ID NO: 1356577 - RNA, 19 nt, Homo sapiens
caggucuggaggggccaug

SEQ ID NO: 1356578 - RNA, 16 nt, Homo sapiens
caggugcucuguggau

SEQ ID NO: 1356579 - RNA, 12 nt, Homo sapiens
cagguucuuagg

SEQ ID NO: 1356580 - RNA, 14 nt, Homo sapiens
caguagauuuucca

SEQ ID NO: 1356581 - RNA, 14 nt, Homo sapiens
caguagcauuugcu

SEQ ID NO: 1356582 - RNA, 19 nt, Homo sapiens
caguaggguuugacauuuc

SEQ ID NO: 1356583 - RNA, 12 nt, Homo sapiens
cagucagaggac

SEQ ID NO: 1356584 - RNA, 16 nt, Homo sapiens
caguccaauaggugua

SEQ ID NO: 1356585 - RNA, 19 nt, Homo sapiens
cagucccuaaaaacacaga

SEQ ID NO: 1356586 - RNA, 21 nt, Homo sapiens
caguccugguugucugaaccc

SEQ ID NO: 1356587 - RNA, 24 nt, Homo sapiens
cagucucugcugaucacaugugcc

SEQ ID NO: 1356588 - RNA, 14 nt, Homo sapiens
cagucuugccuagg

SEQ ID NO: 1356589 - RNA, 17 nt, Homo sapiens
cagugaagauuuaccuc

SEQ ID NO: 1356590 - RNA, 22 nt, Homo sapiens
cagugacaaccaaaagucuuca

SEQ ID NO: 1356591 - RNA, 17 nt, Homo sapiens
cagugacuuugagcuga

SEQ ID NO: 1356592 - RNA, 14 nt, Homo sapiens
cagugagcacugaa

SEQ ID NO: 1356593 - RNA, 20 nt, Homo sapiens
cagugagccgagaucgugcc

SEQ ID NO: 1356594 - RNA, 22 nt, Homo sapiens
cagugaugucaaauugacugua

SEQ ID NO: 1356595 - RNA, 13 nt, Homo sapiens
caguggauguaua

SEQ ID NO: 1356596 - RNA, 19 nt, Homo sapiens
caguguaacccaagcauuu

SEQ ID NO: 1356597 - RNA, 20 nt, Homo sapiens
caguguguuucugaucugau

SEQ ID NO: 1356598 - RNA, 20 nt, Homo sapiens
caguuaagacaacaggcauu

SEQ ID NO: 1356599 - RNA, 22 nt, Homo sapiens
caguuaagacaacaggcauuuu

SEQ ID NO: 1356600 - RNA, 19 nt, Homo sapiens
caguugccgucuaggauug

SEQ ID NO: 1356601 - RNA, 21 nt, Homo sapiens
caguuugauuguuguuuauaa

SEQ ID NO: 1356602 - RNA, 23 nt, Homo sapiens
caguuuuauauuuauaagccuua

SEQ ID NO: 1356603 - RNA, 23 nt, Homo sapiens
caguuuucaggaugauacacuau

SEQ ID NO: 1356604 - RNA, 14 nt, Homo sapiens
caguuuugucauug

SEQ ID NO: 1356605 - RNA, 15 nt, Homo sapiens
cauaaagucuugccu

SEQ ID NO: 1356606 - RNA, 14 nt, Homo sapiens
cauaacucugugau

SEQ ID NO: 1356607 - RNA, 20 nt, Homo sapiens
cauaacucugugaucuugcu

SEQ ID NO: 1356608 - RNA, 16 nt, Homo sapiens
cauaagugaaaaucuu

SEQ ID NO: 1356609 - RNA, 21 nt, Homo sapiens
cauaagugaaaaucuuacaac

SEQ ID NO: 1356610 - RNA, 22 nt, Homo sapiens
cauacuccuuuuaagcagugag

SEQ ID NO: 1356611 - RNA, 17 nt, Homo sapiens
cauagaguucagacuuu

SEQ ID NO: 1356612 - RNA, 22 nt, Homo sapiens
cauagugaccaacauagugaaa

SEQ ID NO: 1356613 - RNA, 20 nt, Homo sapiens
cauauagaaaucuagaauuu

SEQ ID NO: 1356614 - RNA, 14 nt, Homo sapiens
cauauauauuacaa

SEQ ID NO: 1356615 - RNA, 17 nt, Homo sapiens
cauaucagugaaccuuu

SEQ ID NO: 1356616 - RNA, 20 nt, Homo sapiens
cauaugaggcaaaguguagu

SEQ ID NO: 1356617 - RNA, 22 nt, Homo sapiens
caucagcccucauguuucauug

SEQ ID NO: 1356618 - RNA, 19 nt, Homo sapiens
cauccacuuuaugugcauc

SEQ ID NO: 1356619 - RNA, 14 nt, Homo sapiens
cauccagugacaaa

SEQ ID NO: 1356620 - RNA, 22 nt, Homo sapiens
caucccuagucucuacccagua

SEQ ID NO: 1356621 - RNA, 15 nt, Homo sapiens
cauccuaugcuuaau

SEQ ID NO: 1356622 - RNA, 21 nt, Homo sapiens
cauccuugaugcaagugcaac

SEQ ID NO: 1356623 - RNA, 15 nt, Homo sapiens
cauccuuuacguguu

SEQ ID NO: 1356624 - RNA, 20 nt, Homo sapiens
caucgcaggaugacagcucc

SEQ ID NO: 1356625 - RNA, 13 nt, Homo sapiens
caucuagcccuuu

SEQ ID NO: 1356626 - RNA, 19 nt, Homo sapiens
caucuagcgcaauugaagg

SEQ ID NO: 1356627 - RNA, 20 nt, Homo sapiens
caucuagucacaaagacucc

SEQ ID NO: 1356628 - RNA, 11 nt, Homo sapiens
caucucagugc

SEQ ID NO: 1356629 - RNA, 15 nt, Homo sapiens
caucucaucaacuua

SEQ ID NO: 1356630 - RNA, 13 nt, Homo sapiens
caucucuacaaaa

SEQ ID NO: 1356631 - RNA, 22 nt, Homo sapiens
caucucuggccuguacccagua

SEQ ID NO: 1356632 - RNA, 18 nt, Homo sapiens
caucugcaugucuacuca

SEQ ID NO: 1356633 - RNA, 21 nt, Homo sapiens
caucuuuuuaaccugcaaaau

SEQ ID NO: 1356634 - RNA, 15 nt, Homo sapiens
caugaaaaauaaucc

SEQ ID NO: 1356635 - RNA, 22 nt, Homo sapiens
caugaaauggacaaacagugca

SEQ ID NO: 1356636 - RNA, 18 nt, Homo sapiens
caugagacucagugcaga

SEQ ID NO: 1356637 - RNA, 20 nt, Homo sapiens
caugagacucagugcagaug

SEQ ID NO: 1356638 - RNA, 20 nt, Homo sapiens
caugaggccaccaguaaaag

SEQ ID NO: 1356639 - RNA, 19 nt, Homo sapiens
caugaguuuguuuacacuu

SEQ ID NO: 1356640 - RNA, 17 nt, Homo sapiens
gacacaggucuuuccua

SEQ ID NO: 1356641 - RNA, 21 nt, Homo sapiens
gacacccacucuccugugaga

SEQ ID NO: 1356642 - RNA, 23 nt, Homo sapiens
gacacugguuuuaccuccaggaa

SEQ ID NO: 1356643 - RNA, 14 nt, Homo sapiens
gacagagcugggau

SEQ ID NO: 1356644 - RNA, 19 nt, Homo sapiens
gacagaugccacacaagga

SEQ ID NO: 1356645 - RNA, 17 nt, Homo sapiens
gacagcuuugcugcuga

SEQ ID NO: 1356646 - RNA, 16 nt, Homo sapiens
gacauaaugggguccu

SEQ ID NO: 1356647 - RNA, 18 nt, Homo sapiens
gacaugcuucagugcugc

SEQ ID NO: 1356648 - RNA, 19 nt, Homo sapiens
gacaugcuucagugcugcu

SEQ ID NO: 1356649 - RNA, 23 nt, Homo sapiens
gacauuucucuaacuccugccau

SEQ ID NO: 1356650 - RNA, 13 nt, Homo sapiens
gaccacaacuauu

SEQ ID NO: 1356651 - RNA, 23 nt, Homo sapiens
gaccaccaccccaacaaaccauc

SEQ ID NO: 1356652 - RNA, 21 nt, Homo sapiens
gaccaugcucaucugcugguc

SEQ ID NO: 1356653 - RNA, 19 nt, Homo sapiens
gacccucuuugcugaagaa

SEQ ID NO: 1356654 - RNA, 15 nt, Homo sapiens
gaccugauccuggag

SEQ ID NO: 1356655 - RNA, 16 nt, Homo sapiens
gaccuggcagcucugg

SEQ ID NO: 1356656 - RNA, 13 nt, Homo sapiens
gaccuucaugccc

SEQ ID NO: 1356657 - RNA, 19 nt, Homo sapiens
gacgaggggugucuugggc

SEQ ID NO: 1356658 - RNA, 13 nt, Homo sapiens
gacuaacaaaggc

SEQ ID NO: 1356659 - RNA, 13 nt, Homo sapiens
gacucagugcaga

SEQ ID NO: 1356660 - RNA, 19 nt, Homo sapiens
gacucuccagaaagcucau

SEQ ID NO: 1356661 - RNA, 23 nt, Homo sapiens
gacugaucugagagccauugggc

SEQ ID NO: 1356662 - RNA, 14 nt, Homo sapiens
gacugccaaaaagg

SEQ ID NO: 1356663 - RNA, 22 nt, Homo sapiens
gacugcccucuuacuguuuuga

SEQ ID NO: 1356664 - RNA, 18 nt, Homo sapiens
gacugcuaccucugagaa

SEQ ID NO: 1356665 - RNA, 16 nt, Homo sapiens
gacugcuaccuuucaa

SEQ ID NO: 1356666 - RNA, 13 nt, Homo sapiens
gacuguagaagaa

SEQ ID NO: 1356667 - RNA, 21 nt, Homo sapiens
gacuuaacgugcucaugggcu

SEQ ID NO: 1356668 - RNA, 23 nt, Homo sapiens
gacuuauuuuaauuccacuuuaa

SEQ ID NO: 1356669 - RNA, 17 nt, Homo sapiens
gacuucagucuugccua

SEQ ID NO: 1356670 - RNA, 17 nt, Homo sapiens
gacuucugccuggagac

SEQ ID NO: 1356671 - RNA, 17 nt, Homo sapiens
gacuucuucuucuuugu

SEQ ID NO: 1356672 - RNA, 15 nt, Homo sapiens
gacuuuaucaugugu

SEQ ID NO: 1356673 - RNA, 20 nt, Homo sapiens
gacuuugagcugagugcuga

SEQ ID NO: 1356674 - RNA, 15 nt, Homo sapiens
gacuuuuaaugucau

SEQ ID NO: 1356675 - RNA, 19 nt, Homo sapiens
gagaaaacaggcucacaga

SEQ ID NO: 1356676 - RNA, 19 nt, Homo sapiens
gagaaagguggacuggaag

SEQ ID NO: 1356677 - RNA, 13 nt, Homo sapiens
gagaaaucuggcu

SEQ ID NO: 1356678 - RNA, 16 nt, Homo sapiens
gagaaaucuggcuucu

SEQ ID NO: 1356679 - RNA, 16 nt, Homo sapiens
gagaagauucaauuua

SEQ ID NO: 1356680 - RNA, 13 nt, Homo sapiens
gagaagccaaaag

SEQ ID NO: 1356681 - RNA, 19 nt, Homo sapiens
gagaaguugaggggagcau

SEQ ID NO: 1356682 - RNA, 13 nt, Homo sapiens
gagacaaaucuca

SEQ ID NO: 1356683 - RNA, 18 nt, Homo sapiens
gagacgguguuuugccau

SEQ ID NO: 1356684 - RNA, 18 nt, Homo sapiens
gagaguugagacuugcca

SEQ ID NO: 1356685 - RNA, 15 nt, Homo sapiens
gagauaauuguuuca

SEQ ID NO: 1356686 - RNA, 11 nt, Homo sapiens
gagauccuccu

SEQ ID NO: 1356687 - RNA, 21 nt, Homo sapiens
gagaugcuaaaauucuucgca

SEQ ID NO: 1356688 - RNA, 15 nt, Homo sapiens
gagcagaacuuucac

SEQ ID NO: 1356689 - RNA, 15 nt, Homo sapiens
gagccaaaaucucaa

SEQ ID NO: 1356690 - RNA, 19 nt, Homo sapiens
gagccuucaagugccaaac

SEQ ID NO: 1356691 - RNA, 15 nt, Homo sapiens
aaaaaacaaucugga

SEQ ID NO: 1356692 - RNA, 21 nt, Homo sapiens
aaaaacauagaaaaauucagc

SEQ ID NO: 1356693 - RNA, 11 nt, Homo sapiens
aaaaacugcag

SEQ ID NO: 1356694 - RNA, 13 nt, Homo sapiens
aaaaagcauacuu

SEQ ID NO: 1356695 - RNA, 12 nt, Homo sapiens
aaaaaggcaccu

SEQ ID NO: 1356696 - RNA, 19 nt, Homo sapiens
aaaaauaaaagaucuugaa

SEQ ID NO: 1356697 - RNA, 16 nt, Homo sapiens
aaaaauaaacacuucc

SEQ ID NO: 1356698 - RNA, 21 nt, Homo sapiens
aaaaauagccugccucuucuc

SEQ ID NO: 1356699 - RNA, 17 nt, Homo sapiens
aaaaaucugagaaacuc

SEQ ID NO: 1356700 - RNA, 11 nt, Homo sapiens
aaaaaugaaga

SEQ ID NO: 1356701 - RNA, 23 nt, Homo sapiens
aaaaauguaaaauccuacaguga

SEQ ID NO: 1356702 - RNA, 14 nt, Homo sapiens
aaaacacagacauu

SEQ ID NO: 1356703 - RNA, 23 nt, Homo sapiens
aaaaccccaucucuacaaaaagc

SEQ ID NO: 1356704 - RNA, 22 nt, Homo sapiens
aaaacuguggguagagacuuug

SEQ ID NO: 1356705 - RNA, 16 nt, Homo sapiens
aaaacuucaguaagua

SEQ ID NO: 1356706 - RNA, 11 nt, Homo sapiens
aaaagaccaag

SEQ ID NO: 1356707 - RNA, 18 nt, Homo sapiens
aaaagcaagggaccuuca

SEQ ID NO: 1356708 - RNA, 20 nt, Homo sapiens
aaaaggaauccucugugucu

SEQ ID NO: 1356709 - RNA, 23 nt, Homo sapiens
aaaaggcaccuauaaaacagguc

SEQ ID NO: 1356710 - RNA, 13 nt, Homo sapiens
aaaaggcugagaa

SEQ ID NO: 1356711 - RNA, 22 nt, Homo sapiens
aaaagucaaacuuucaccucag

SEQ ID NO: 1356712 - RNA, 18 nt, Homo sapiens
aaaauaaaagaucuugaa

SEQ ID NO: 1356713 - RNA, 19 nt, Homo sapiens
aaaauaaaagaucuugaau

SEQ ID NO: 1356714 - RNA, 22 nt, Homo sapiens
aaaauaguuuggauuacuuaaa

SEQ ID NO: 1356715 - RNA, 12 nt, Homo sapiens
aaaaucugucca

SEQ ID NO: 1356716 - RNA, 22 nt, Homo sapiens
aaaaugcagcagggaugcccug

SEQ ID NO: 1356717 - RNA, 19 nt, Homo sapiens
aaaauggagguggaaagac

SEQ ID NO: 1356718 - RNA, 22 nt, Homo sapiens
aaaauguaugugucucccaggu

SEQ ID NO: 1356719 - RNA, 21 nt, Homo sapiens
aaaauucuauuacaguauguc

SEQ ID NO: 1356720 - RNA, 18 nt, Homo sapiens
aaaauucugagugaucca

SEQ ID NO: 1356721 - RNA, 17 nt, Homo sapiens
aaacaaaacaccaggga

SEQ ID NO: 1356722 - RNA, 13 nt, Homo sapiens
aaacaaagccaga

SEQ ID NO: 1356723 - RNA, 14 nt, Homo sapiens
aaacagccucacuc

SEQ ID NO: 1356724 - RNA, 19 nt, Homo sapiens
aaacagccucacuccucag

SEQ ID NO: 1356725 - RNA, 19 nt, Homo sapiens
aaacagccuuugggaaaug

SEQ ID NO: 1356726 - RNA, 20 nt, Homo sapiens
aaacagugcaaggaagggca

SEQ ID NO: 1356727 - RNA, 21 nt, Homo sapiens
aaacauaccaacauguuuaaa

SEQ ID NO: 1356728 - RNA, 14 nt, Homo sapiens
aaaccccacuuccc

SEQ ID NO: 1356729 - RNA, 21 nt, Homo sapiens
aaaccccggcgugugcagugc

SEQ ID NO: 1356730 - RNA, 20 nt, Homo sapiens
aaaccgccccaaucccucag

SEQ ID NO: 1356731 - RNA, 14 nt, Homo sapiens
aaaccucuaugcaa

SEQ ID NO: 1356732 - RNA, 19 nt, Homo sapiens
aaacguuaguuaaucccuu

SEQ ID NO: 1356733 - RNA, 11 nt, Homo sapiens
aaacucuucag

SEQ ID NO: 1356734 - RNA, 20 nt, Homo sapiens
aaacugagaaauuuacuaca

SEQ ID NO: 1356735 - RNA, 12 nt, Homo sapiens
aaacugcagugu

SEQ ID NO: 1356736 - RNA, 21 nt, Homo sapiens
aaacugucgguuugcuuugau

SEQ ID NO: 1356737 - RNA, 18 nt, Homo sapiens
aaacugucuuuaaaagag

SEQ ID NO: 1356738 - RNA, 19 nt, Homo sapiens
aaacuuagugacaaaauag

SEQ ID NO: 1356739 - RNA, 11 nt, Homo sapiens
aaacuugccug

SEQ ID NO: 1356740 - RNA, 20 nt, Homo sapiens
aaacuuuucuaauacucuac

SEQ ID NO: 1356741 - RNA, 19 nt, Homo sapiens
aaagaaaaauuaucuugaa

SEQ ID NO: 1356742 - RNA, 17 nt, Homo sapiens
aaagaacccaucuggaa

SEQ ID NO: 1356743 - RNA, 15 nt, Homo sapiens
aaagaauucugugag

SEQ ID NO: 1356744 - RNA, 21 nt, Homo sapiens
aaagagcaacaauccaucucu

SEQ ID NO: 1356745 - RNA, 15 nt, Homo sapiens
aaagaggacaucaga

SEQ ID NO: 1356746 - RNA, 22 nt, Homo sapiens
aaagaugcaaggaccaggacuc

SEQ ID NO: 1356747 - RNA, 19 nt, Homo sapiens
aaagauuugcaacauuaga

SEQ ID NO: 1356748 - RNA, 20 nt, Homo sapiens
aaagauuugugaacuggaag

SEQ ID NO: 1356749 - RNA, 13 nt, Homo sapiens
aaagcaaaagcaa

SEQ ID NO: 1356750 - RNA, 22 nt, Homo sapiens
aaagcaaguguucacugcuccu

SEQ ID NO: 1356751 - RNA, 15 nt, Homo sapiens
aaagcaggugcccag

SEQ ID NO: 1356752 - RNA, 23 nt, Homo sapiens
aaagcccucccuaccuaccaaga

SEQ ID NO: 1356753 - RNA, 12 nt, Homo sapiens
aaagccucugau

SEQ ID NO: 1356754 - RNA, 19 nt, Homo sapiens
aaagcgagacuccaucuca

SEQ ID NO: 1356755 - RNA, 15 nt, Homo sapiens
aaagcucacuguagc

SEQ ID NO: 1356756 - RNA, 13 nt, Homo sapiens
aaagcucaucuca

SEQ ID NO: 1356757 - RNA, 15 nt, Homo sapiens
aaaggaccaguaugc

SEQ ID NO: 1356758 - RNA, 22 nt, Homo sapiens
aaaggucaagaacacagugauu

SEQ ID NO: 1356759 - RNA, 18 nt, Homo sapiens
aaaggugguguuucugua

SEQ ID NO: 1356760 - RNA, 19 nt, Homo sapiens
aaaggugguguuucuguaa

SEQ ID NO: 1356761 - RNA, 17 nt, Homo sapiens
aaagguuuacagaauuu

SEQ ID NO: 1356762 - RNA, 15 nt, Homo sapiens
aaaguaguccuguga

SEQ ID NO: 1356763 - RNA, 17 nt, Homo sapiens
aaaguaucugagauuac

SEQ ID NO: 1356764 - RNA, 20 nt, Homo sapiens
aaagucaaacuuucaccuca

SEQ ID NO: 1356765 - RNA, 22 nt, Homo sapiens
aaagucuuugaagugacuucac

SEQ ID NO: 1356766 - RNA, 23 nt, Homo sapiens
aaagucuuugaagugacuucaca

SEQ ID NO: 1356767 - RNA, 14 nt, Homo sapiens
aaagugacuauuca

SEQ ID NO: 1356768 - RNA, 15 nt, Homo sapiens
aaauaaaaaccaaga

SEQ ID NO: 1356769 - RNA, 21 nt, Homo sapiens
aaauaaaaauuacuguguuag

SEQ ID NO: 1356770 - RNA, 23 nt, Homo sapiens
aaauaaaagaucuugaauagucu

SEQ ID NO: 1356771 - RNA, 21 nt, Homo sapiens
aaauaaaaugauaaacaaguc

SEQ ID NO: 1356772 - RNA, 14 nt, Homo sapiens
aaauaaauggaaua

SEQ ID NO: 1356773 - RNA, 14 nt, Homo sapiens
aaauaagucacuua

SEQ ID NO: 1356774 - RNA, 17 nt, Homo sapiens
aaauaccacaagccuga

SEQ ID NO: 1356775 - RNA, 18 nt, Homo sapiens
aaauaccauuuacaguau

SEQ ID NO: 1356776 - RNA, 22 nt, Homo sapiens
aaauaguugcugucauccacuu

SEQ ID NO: 1356777 - RNA, 23 nt, Homo sapiens
aaauaguugcugucauccacuuu

SEQ ID NO: 1356778 - RNA, 16 nt, Homo sapiens
aaauaguuuggauuac

SEQ ID NO: 1356779 - RNA, 12 nt, Homo sapiens
aaauauacauaa

SEQ ID NO: 1356780 - RNA, 22 nt, Homo sapiens
aaauauuuuggcauuguacuaa

SEQ ID NO: 1356781 - RNA, 13 nt, Homo sapiens
aaaucaacuugcu

SEQ ID NO: 1356782 - RNA, 16 nt, Homo sapiens
aaaucaacuugcuuau

SEQ ID NO: 1356783 - RNA, 16 nt, Homo sapiens
aaaucuagaagacugu

SEQ ID NO: 1356784 - RNA, 17 nt, Homo sapiens
aaaucuagaagacuguc

SEQ ID NO: 1356785 - RNA, 18 nt, Homo sapiens
aaaucuaugaaauaucau

SEQ ID NO: 1356786 - RNA, 23 nt, Homo sapiens
aaaucuaugccuaaaaaguauca

SEQ ID NO: 1356787 - RNA, 22 nt, Homo sapiens
aaaucucaaugaagccagcuca

SEQ ID NO: 1356788 - RNA, 21 nt, Homo sapiens
aaaugagcagcccuuacagua

SEQ ID NO: 1356789 - RNA, 16 nt, Homo sapiens
aaaugauaaacaaguc

SEQ ID NO: 1356790 - RNA, 20 nt, Homo sapiens
aaaugcuguauuagucacag

SEQ ID NO: 1356791 - RNA, 21 nt, Homo sapiens
aaauggggccagauccagccu

SEQ ID NO: 1356792 - RNA, 14 nt, Homo sapiens
aaauguaaagccau

SEQ ID NO: 1356793 - RNA, 16 nt, Homo sapiens
aaauuacuuggcuuuu

SEQ ID NO: 1356794 - RNA, 19 nt, Homo sapiens
aaauuauagucuuuugcca

SEQ ID NO: 1356795 - RNA, 22 nt, Homo sapiens
aaauucauucaacaagcaccua

SEQ ID NO: 1356796 - RNA, 19 nt, Homo sapiens
aaauuccacagauuaucaa

SEQ ID NO: 1356797 - RNA, 16 nt, Homo sapiens
aaauugaccaagugau

SEQ ID NO: 1356798 - RNA, 20 nt, Homo sapiens
aaauuguaagugaaguaaaa

SEQ ID NO: 1356799 - RNA, 16 nt, Homo sapiens
aaauuuuaagaccaag

SEQ ID NO: 1356800 - RNA, 20 nt, Homo sapiens
aaauuuuucaaaucauuccu

SEQ ID NO: 1356801 - RNA, 16 nt, Homo sapiens
aaauuuuuguuuauaa

SEQ ID NO: 1356802 - RNA, 13 nt, Homo sapiens
aacaaaauggacu

SEQ ID NO: 1356803 - RNA, 17 nt, Homo sapiens
aacaaguagcacacuga

SEQ ID NO: 1356804 - RNA, 16 nt, Homo sapiens
aacaauggaguauucu

SEQ ID NO: 1356805 - RNA, 19 nt, Homo sapiens
aacacaauucuucuuccaa

SEQ ID NO: 1356806 - RNA, 19 nt, Homo sapiens
aacacagacauucugccag

SEQ ID NO: 1356807 - RNA, 16 nt, Homo sapiens
aacacauacaaugaag

SEQ ID NO: 1356808 - RNA, 12 nt, Homo sapiens
aacacauuucac

SEQ ID NO: 1356809 - RNA, 12 nt, Homo sapiens
aacacuaacuuu

SEQ ID NO: 1356810 - RNA, 13 nt, Homo sapiens
aacagaucuggaa

SEQ ID NO: 1356811 - RNA, 20 nt, Homo sapiens
aacagcuguggcucacguga

SEQ ID NO: 1356812 - RNA, 22 nt, Homo sapiens
aacauagugaaaccccaucucu

SEQ ID NO: 1356813 - RNA, 24 nt, Homo sapiens
aacauauuuauauauguaucuaaa

SEQ ID NO: 1356814 - RNA, 22 nt, Homo sapiens
aacaucagcuucaauccuccau

SEQ ID NO: 1356815 - RNA, 15 nt, Homo sapiens
aacaucuagcccuuu

SEQ ID NO: 1356816 - RNA, 16 nt, Homo sapiens
aacauguaauugcaga

SEQ ID NO: 1356817 - RNA, 13 nt, Homo sapiens
aacaugugcucag

SEQ ID NO: 1356818 - RNA, 22 nt, Homo sapiens
aacauuguuuuguguaacauau

SEQ ID NO: 1356819 - RNA, 16 nt, Homo sapiens
aacauuuaaauuccac

SEQ ID NO: 1356820 - RNA, 21 nt, Homo sapiens
aacauuuaaauuccacagauu

SEQ ID NO: 1356821 - RNA, 18 nt, Homo sapiens
aacccagcucacaggagc

SEQ ID NO: 1356822 - RNA, 22 nt, Homo sapiens
aacccagcucuaauacauucca

SEQ ID NO: 1356823 - RNA, 16 nt, Homo sapiens
aaccccaucucuacaa

SEQ ID NO: 1356824 - RNA, 19 nt, Homo sapiens
aaccccaucucuacugaaa

SEQ ID NO: 1356825 - RNA, 18 nt, Homo sapiens
aacccuggugguugcugu

SEQ ID NO: 1356826 - RNA, 14 nt, Homo sapiens
aacccuuauuccau

SEQ ID NO: 1356827 - RNA, 23 nt, Homo sapiens
aacccuucccucaccuuggcacc

SEQ ID NO: 1356828 - RNA, 23 nt, Homo sapiens
aacccuuucauaaagucuugccu

SEQ ID NO: 1356829 - RNA, 18 nt, Homo sapiens
aaccuauuucacaaauca

SEQ ID NO: 1356830 - RNA, 22 nt, Homo sapiens
aaccucacauacccucacuuaa

SEQ ID NO: 1356831 - RNA, 20 nt, Homo sapiens
aaccucagccuggccagaca

SEQ ID NO: 1356832 - RNA, 21 nt, Homo sapiens
aaccucaguuauuacauguaa

SEQ ID NO: 1356833 - RNA, 14 nt, Homo sapiens
aaccucuaugcaau

SEQ ID NO: 1356834 - RNA, 23 nt, Homo sapiens
aacguccuuccacuucaggguuc

SEQ ID NO: 1356835 - RNA, 16 nt, Homo sapiens
aacgugcucaugggcu

SEQ ID NO: 1356836 - RNA, 12 nt, Homo sapiens
aacuacagaugg

SEQ ID NO: 1356837 - RNA, 19 nt, Homo sapiens
aacuacccccagcugugcu

SEQ ID NO: 1356838 - RNA, 18 nt, Homo sapiens
aacuagcuuggaaacugg

SEQ ID NO: 1356839 - RNA, 13 nt, Homo sapiens
aacucacuuuccc

SEQ ID NO: 1356840 - RNA, 13 nt, Homo sapiens
aacucagauccag

SEQ ID NO: 1356841 - RNA, 14 nt, Homo sapiens
aacuccuaccugaa

SEQ ID NO: 1356842 - RNA, 14 nt, Homo sapiens
aacuccugccauuc

SEQ ID NO: 1356843 - RNA, 18 nt, Homo sapiens
aacucugugaucuugcuc

SEQ ID NO: 1356844 - RNA, 23 nt, Homo sapiens
aacucuucacucuucaaaugccu

SEQ ID NO: 1356845 - RNA, 15 nt, Homo sapiens
aacucuucaguuaau

SEQ ID NO: 1356846 - RNA, 22 nt, Homo sapiens
aacugcaggcccuggccucccc

SEQ ID NO: 1356847 - RNA, 19 nt, Homo sapiens
aacugcagugauguauaca

SEQ ID NO: 1356848 - RNA, 23 nt, Homo sapiens
aacugcauaagugaaaaucuuac

SEQ ID NO: 1356849 - RNA, 21 nt, Homo sapiens
aacuguugcccuucuguccaa

SEQ ID NO: 1356850 - RNA, 13 nt, Homo sapiens
aacuuagugacaa

SEQ ID NO: 1356851 - RNA, 19 nt, Homo sapiens
aacuucuccuacuguagca

SEQ ID NO: 1356852 - RNA, 16 nt, Homo sapiens
aacuugaaauauccug

SEQ ID NO: 1356853 - RNA, 20 nt, Homo sapiens
aacuugccuuucaguauuga

SEQ ID NO: 1356854 - RNA, 22 nt, Homo sapiens
aacuugccuuucaguauugaca

SEQ ID NO: 1356855 - RNA, 19 nt, Homo sapiens
aacuuuccucgccugacaa

SEQ ID NO: 1356856 - RNA, 14 nt, Homo sapiens
aacuuugacuuucu

SEQ ID NO: 1356857 - RNA, 20 nt, Homo sapiens
aacuuuguuuagcccaaaac

SEQ ID NO: 1356858 - RNA, 13 nt, Homo sapiens
aagaaaacuuuga

SEQ ID NO: 1356859 - RNA, 14 nt, Homo sapiens
aagaaaagaccuuu

SEQ ID NO: 1356860 - RNA, 19 nt, Homo sapiens
aagaaagcaacuuuacuga

SEQ ID NO: 1356861 - RNA, 13 nt, Homo sapiens
aagaaauauucug

SEQ ID NO: 1356862 - RNA, 21 nt, Homo sapiens
aagaacuucuccuacuguagc

SEQ ID NO: 1356863 - RNA, 19 nt, Homo sapiens
aagaagccucacacguaaa

SEQ ID NO: 1356864 - RNA, 15 nt, Homo sapiens
aagaauacacaggau

SEQ ID NO: 1356865 - RNA, 16 nt, Homo sapiens
aagacagaugccccag

SEQ ID NO: 1356866 - RNA, 16 nt, Homo sapiens
aagagaaccauaucaa

SEQ ID NO: 1356867 - RNA, 21 nt, Homo sapiens
aagagaaugaaauugcugaaa

SEQ ID NO: 1356868 - RNA, 13 nt, Homo sapiens
aagagacacucca

SEQ ID NO: 1356869 - RNA, 14 nt, Homo sapiens
aagagacacuccaa

SEQ ID NO: 1356870 - RNA, 22 nt, Homo sapiens
aagagauguccuuguaauauuc

SEQ ID NO: 1356871 - RNA, 23 nt, Homo sapiens
aagagcagucacaacagagugaa

SEQ ID NO: 1356872 - RNA, 21 nt, Homo sapiens
aagagguuuuaaaaaaauccc

SEQ ID NO: 1356873 - RNA, 13 nt, Homo sapiens
aagaguaguuaua

SEQ ID NO: 1356874 - RNA, 24 nt, Homo sapiens
aagaucuuucaggacucuaccuca

SEQ ID NO: 1356875 - RNA, 14 nt, Homo sapiens
aagaugugugauaa

SEQ ID NO: 1356876 - RNA, 14 nt, Homo sapiens
aagcaaaagcaagg

SEQ ID NO: 1356877 - RNA, 16 nt, Homo sapiens
aagcaagggaccuuca

SEQ ID NO: 1356878 - RNA, 12 nt, Homo sapiens
aagcacuuugug

SEQ ID NO: 1356879 - RNA, 16 nt, Homo sapiens
aagcagccaagcuccu

SEQ ID NO: 1356880 - RNA, 19 nt, Homo sapiens
aagcaggacuaaaugucua

SEQ ID NO: 1356881 - RNA, 16 nt, Homo sapiens
aagcagggaauuccug

SEQ ID NO: 1356882 - RNA, 22 nt, Homo sapiens
aagcaguagcauuugcuuccuc

SEQ ID NO: 1356883 - RNA, 13 nt, Homo sapiens
aagcauacuuugu

SEQ ID NO: 1356884 - RNA, 22 nt, Homo sapiens
aagcauggcuuuggcuuugcaa

SEQ ID NO: 1356885 - RNA, 20 nt, Homo sapiens
aagccacagcuggugguauc

SEQ ID NO: 1356886 - RNA, 19 nt, Homo sapiens
aagcccccacuacaaguga

SEQ ID NO: 1356887 - RNA, 15 nt, Homo sapiens
aagcccugugcucca

SEQ ID NO: 1356888 - RNA, 22 nt, Homo sapiens
aagccugacccuguaaaaugga

SEQ ID NO: 1356889 - RNA, 13 nt, Homo sapiens
aagcuaggauggu

SEQ ID NO: 1356890 - RNA, 17 nt, Homo sapiens
aagcucaaguguucaca

SEQ ID NO: 1356891 - RNA, 19 nt, Homo sapiens
aagcucgugacaagugccu

SEQ ID NO: 1356892 - RNA, 15 nt, Homo sapiens
aagcugacauugcca

SEQ ID NO: 1356893 - RNA, 14 nt, Homo sapiens
aagcuggucuuuga

SEQ ID NO: 1356894 - RNA, 13 nt, Homo sapiens
aaggaaacccagc

SEQ ID NO: 1356895 - RNA, 15 nt, Homo sapiens
aaggaagccacagcu

SEQ ID NO: 1356896 - RNA, 22 nt, Homo sapiens
aaggaauuuguuuaaauaacau

SEQ ID NO: 1356897 - RNA, 12 nt, Homo sapiens
aaggagugacuu

SEQ ID NO: 1356898 - RNA, 13 nt, Homo sapiens
aaggcacagugaa

SEQ ID NO: 1356899 - RNA, 14 nt, Homo sapiens
aaggcacagugaag

SEQ ID NO: 1356900 - RNA, 14 nt, Homo sapiens
aaggcagggcuccu

SEQ ID NO: 1356901 - RNA, 17 nt, Homo sapiens
aaggccgagaagcaaga

SEQ ID NO: 1356902 - RNA, 15 nt, Homo sapiens
aaggccuccugugac

SEQ ID NO: 1356903 - RNA, 16 nt, Homo sapiens
aaggcugcaagguuua

SEQ ID NO: 1356904 - RNA, 20 nt, Homo sapiens
aaggcuuuguauaaucccac

SEQ ID NO: 1356905 - RNA, 16 nt, Homo sapiens
aagggagguggcaaga

SEQ ID NO: 1356906 - RNA, 20 nt, Homo sapiens
aagggccagcuggaggugaa

SEQ ID NO: 1356907 - RNA, 17 nt, Homo sapiens
aaggggacaauggcaga

SEQ ID NO: 1356908 - RNA, 22 nt, Homo sapiens
aaggguucaccaggucagggag

SEQ ID NO: 1356909 - RNA, 19 nt, Homo sapiens
aaggucaagaacacaguga

SEQ ID NO: 1356910 - RNA, 19 nt, Homo sapiens
aagguucccucccacucua

SEQ ID NO: 1356911 - RNA, 23 nt, Homo sapiens
aagguugaaaagacaauagccca

SEQ ID NO: 1356912 - RNA, 19 nt, Homo sapiens
aaguaacacuaacuuugaa

SEQ ID NO: 1356913 - RNA, 18 nt, Homo sapiens
aaguagaggggacgugag

SEQ ID NO: 1356914 - RNA, 13 nt, Homo sapiens
aagucagcuccag

SEQ ID NO: 1356915 - RNA, 13 nt, Homo sapiens
aagucaguaucau

SEQ ID NO: 1356916 - RNA, 18 nt, Homo sapiens
aagucuggagcacccuga

SEQ ID NO: 1356917 - RNA, 11 nt, Homo sapiens
aagucuugccu

SEQ ID NO: 1356918 - RNA, 18 nt, Homo sapiens
aagucuuugaagugacuu

SEQ ID NO: 1356919 - RNA, 13 nt, Homo sapiens
aagugacuauuca

SEQ ID NO: 1356920 - RNA, 12 nt, Homo sapiens
aagugauccuca

SEQ ID NO: 1356921 - RNA, 16 nt, Homo sapiens
aagugauccucaggca

SEQ ID NO: 1356922 - RNA, 11 nt, Homo sapiens
aagugccaaac

SEQ ID NO: 1356923 - RNA, 15 nt, Homo sapiens
aagugucuuuugaca

SEQ ID NO: 1356924 - RNA, 20 nt, Homo sapiens
aaguuaaugcaaaugacugu

SEQ ID NO: 1356925 - RNA, 13 nt, Homo sapiens
aaguucaagagaa

SEQ ID NO: 1356926 - RNA, 16 nt, Homo sapiens
aaguucauggaacuca

SEQ ID NO: 1356927 - RNA, 13 nt, Homo sapiens
aaguugaggggag

SEQ ID NO: 1356928 - RNA, 14 nt, Homo sapiens
aaguuggcuucuaa

SEQ ID NO: 1356929 - RNA, 23 nt, Homo sapiens
aaguuucacuggcugguggcugu

SEQ ID NO: 1356930 - RNA, 19 nt, Homo sapiens
aauaaaagaucuugaauag

SEQ ID NO: 1356931 - RNA, 11 nt, Homo sapiens
aauaaagccuc

SEQ ID NO: 1356932 - RNA, 19 nt, Homo sapiens
aauaaaucugacccagugc

SEQ ID NO: 1356933 - RNA, 20 nt, Homo sapiens
aauaacacguccacuuucaa

SEQ ID NO: 1356934 - RNA, 19 nt, Homo sapiens
aauaacauuuaaauuccac

SEQ ID NO: 1356935 - RNA, 13 nt, Homo sapiens
aauaagagcaguc

SEQ ID NO: 1356936 - RNA, 22 nt, Homo sapiens
aauaagcacuccuugcagagag

SEQ ID NO: 1356937 - RNA, 14 nt, Homo sapiens
aauaagcaggaugu

SEQ ID NO: 1356938 - RNA, 21 nt, Homo sapiens
aauacagacuacuucuucccc

SEQ ID NO: 1356939 - RNA, 17 nt, Homo sapiens
aauacaguaucucaggg

SEQ ID NO: 1356940 - RNA, 23 nt, Homo sapiens
aauacgcagaacuaccagguggc

SEQ ID NO: 1356941 - RNA, 21 nt, Homo sapiens
aauacuaagaaaaauuuguau

SEQ ID NO: 1356942 - RNA, 14 nt, Homo sapiens
aauaucaaaugcag

SEQ ID NO: 1356943 - RNA, 23 nt, Homo sapiens
aauauguuucucccccuuuccaa

SEQ ID NO: 1356944 - RNA, 14 nt, Homo sapiens
aauauuuaccagac

SEQ ID NO: 1356945 - RNA, 15 nt, Homo sapiens
aauauuuuccaugaa

SEQ ID NO: 1356946 - RNA, 23 nt, Homo sapiens
aauauuuuccaugaaaaugcaac

SEQ ID NO: 1356947 - RNA, 17 nt, Homo sapiens
aaucaaagaacuucucc

SEQ ID NO: 1356948 - RNA, 18 nt, Homo sapiens
aaucaacuugcuuaucaa

SEQ ID NO: 1356949 - RNA, 22 nt, Homo sapiens
aaucaaguuggcuucuaaucaa

SEQ ID NO: 1356950 - RNA, 23 nt, Homo sapiens
aaucacacgucuggcuucacaga

SEQ ID NO: 1356951 - RNA, 23 nt, Homo sapiens
aaucaccacaaacuguaauacaa

SEQ ID NO: 1356952 - RNA, 19 nt, Homo sapiens
aaucaggaauauuuuccaa

SEQ ID NO: 1356953 - RNA, 22 nt, Homo sapiens
aaucauuccuuagauaccuuga

SEQ ID NO: 1356954 - RNA, 21 nt, Homo sapiens
aaucauuuguuuacauuugau

SEQ ID NO: 1356955 - RNA, 18 nt, Homo sapiens
aaucauuuucauuccuaa

SEQ ID NO: 1356956 - RNA, 19 nt, Homo sapiens
aauccaauggguuuuuccc

SEQ ID NO: 1356957 - RNA, 20 nt, Homo sapiens
aauccaggcagauccaggac

SEQ ID NO: 1356958 - RNA, 16 nt, Homo sapiens
aaucccaguucuuccu

SEQ ID NO: 1356959 - RNA, 22 nt, Homo sapiens
aaucccgauucacccuguccaa

SEQ ID NO: 1356960 - RNA, 21 nt, Homo sapiens
aauccucucuaucacaucccc

SEQ ID NO: 1356961 - RNA, 20 nt, Homo sapiens
aaucuccauuucuacugugu

SEQ ID NO: 1356962 - RNA, 16 nt, Homo sapiens
aaucucggcucacugc

SEQ ID NO: 1356963 - RNA, 17 nt, Homo sapiens
aaucuggcuuagugcca

SEQ ID NO: 1356964 - RNA, 16 nt, Homo sapiens
aaucuuagaaaauuaa

SEQ ID NO: 1356965 - RNA, 13 nt, Homo sapiens
aaucuuaugcucu

SEQ ID NO: 1356966 - RNA, 14 nt, Homo sapiens
aaucuuccuuuuau

SEQ ID NO: 1356967 - RNA, 21 nt, Homo sapiens
aaugaaacaagcuuacaaaga

SEQ ID NO: 1356968 - RNA, 13 nt, Homo sapiens
aaugaacacuccc

SEQ ID NO: 1356969 - RNA, 17 nt, Homo sapiens
aaugaagaaaacagaua

SEQ ID NO: 1356970 - RNA, 14 nt, Homo sapiens
aaugaauaaauccu

SEQ ID NO: 1356971 - RNA, 22 nt, Homo sapiens
aaugaauaaauccucucuauca

SEQ ID NO: 1356972 - RNA, 21 nt, Homo sapiens
aaugagcagcccuuacaguau

SEQ ID NO: 1356973 - RNA, 15 nt, Homo sapiens
aaugagccuggcaag

SEQ ID NO: 1356974 - RNA, 21 nt, Homo sapiens
aaugaugucguuugaaucaca

SEQ ID NO: 1356975 - RNA, 16 nt, Homo sapiens
aaugcaacaacaugua

SEQ ID NO: 1356976 - RNA, 20 nt, Homo sapiens
aaugcagcagggaugcccug

SEQ ID NO: 1356977 - RNA, 19 nt, Homo sapiens
aaugcauauccaacaugug

SEQ ID NO: 1356978 - RNA, 20 nt, Homo sapiens
aaugcauauccaacaugugc

SEQ ID NO: 1356979 - RNA, 23 nt, Homo sapiens
aaugcauauccaacaugugcuca

SEQ ID NO: 1356980 - RNA, 15 nt, Homo sapiens
aaugcaucucaucaa

SEQ ID NO: 1356981 - RNA, 23 nt, Homo sapiens
aaugccugacuagggagccaugu

SEQ ID NO: 1356982 - RNA, 15 nt, Homo sapiens
aaugcucaagaaaca

SEQ ID NO: 1356983 - RNA, 10 nt, Homo sapiens
aaugcucacc

SEQ ID NO: 1356984 - RNA, 14 nt, Homo sapiens
aauggaacuaucuc

SEQ ID NO: 1356985 - RNA, 19 nt, Homo sapiens
aauggacaaacagugcacu

SEQ ID NO: 1356986 - RNA, 21 nt, Homo sapiens
aauggugauacauucuagccu

SEQ ID NO: 1356987 - RNA, 14 nt, Homo sapiens
aaugguuugaauau

SEQ ID NO: 1356988 - RNA, 13 nt, Homo sapiens
aauguaaagccau

SEQ ID NO: 1356989 - RNA, 16 nt, Homo sapiens
aauguacagacauauu

SEQ ID NO: 1356990 - RNA, 17 nt, Homo sapiens
aauguacagacauauuu

SEQ ID NO: 1356991 - RNA, 19 nt, Homo sapiens
aaugucuugcuguugacau

SEQ ID NO: 1356992 - RNA, 23 nt, Homo sapiens
aaugugauuacugcucuauucca

SEQ ID NO: 1356993 - RNA, 23 nt, Homo sapiens
aaugugguugaagagcaaugugu

SEQ ID NO: 1356994 - RNA, 19 nt, Homo sapiens
aauguguuuuguacaugaa

SEQ ID NO: 1356995 - RNA, 23 nt, Homo sapiens
aauguuaaguugauggugaugaa

SEQ ID NO: 1356996 - RNA, 18 nt, Homo sapiens
aauuacuguaacugauua

SEQ ID NO: 1356997 - RNA, 18 nt, Homo sapiens
aauuacuugagcccagga

SEQ ID NO: 1356998 - RNA, 19 nt, Homo sapiens
aauuauaagaggauaugaa

SEQ ID NO: 1356999 - RNA, 13 nt, Homo sapiens
aauuauaucacuu

SEQ ID NO: 1357000 - RNA, 18 nt, Homo sapiens
aauucaaguuaaugcaaa

SEQ ID NO: 1357001 - RNA, 13 nt, Homo sapiens
aauucucugugga

SEQ ID NO: 1357002 - RNA, 21 nt, Homo sapiens
aauucuguuuuuaaugcuauu

SEQ ID NO: 1357003 - RNA, 19 nt, Homo sapiens
aauucuuacaaacaugugg

SEQ ID NO: 1357004 - RNA, 15 nt, Homo sapiens
aauugaccaagugau

SEQ ID NO: 1357005 - RNA, 15 nt, Homo sapiens
aauugcuuugugacu

SEQ ID NO: 1357006 - RNA, 18 nt, Homo sapiens
aauuuagaccccauacaa

SEQ ID NO: 1357007 - RNA, 15 nt, Homo sapiens
aauuuauugaguuuu

SEQ ID NO: 1357008 - RNA, 20 nt, Homo sapiens
aauuuauugaguuuuuacaa

SEQ ID NO: 1357009 - RNA, 23 nt, Homo sapiens
aauuuauugucugucuacauuuc

SEQ ID NO: 1357010 - RNA, 14 nt, Homo sapiens
aauuucagcauuau

SEQ ID NO: 1357011 - RNA, 16 nt, Homo sapiens
aauuuggguucugccu

SEQ ID NO: 1357012 - RNA, 22 nt, Homo sapiens
aauuugugugagagcuguacau

SEQ ID NO: 1357013 - RNA, 20 nt, Homo sapiens
aauuuuauucaagaaugcca

SEQ ID NO: 1357014 - RNA, 19 nt, Homo sapiens
aauuuuuuaaauaaaugga

SEQ ID NO: 1357015 - RNA, 20 nt, Homo sapiens
aauuuuuuaaauaaauggaa

SEQ ID NO: 1357016 - RNA, 16 nt, Homo sapiens
aauuuuuugguacaaa

SEQ ID NO: 1357017 - RNA, 16 nt, Homo sapiens
acaaaaaaaccucuau

SEQ ID NO: 1357018 - RNA, 14 nt, Homo sapiens
acaaaaugauggca

SEQ ID NO: 1357019 - RNA, 22 nt, Homo sapiens
acaaacagccucacuccucagc

SEQ ID NO: 1357020 - RNA, 14 nt, Homo sapiens
acaaagaugacugu

SEQ ID NO: 1357021 - RNA, 16 nt, Homo sapiens
acaaauuuuucaaauc

SEQ ID NO: 1357022 - RNA, 13 nt, Homo sapiens
acaacagagugaa

SEQ ID NO: 1357023 - RNA, 19 nt, Homo sapiens
acaacauccuuaagucaaa

SEQ ID NO: 1357024 - RNA, 16 nt, Homo sapiens
acaacuaugauuugga

SEQ ID NO: 1357025 - RNA, 17 nt, Homo sapiens
acaacucagucccuaaa

SEQ ID NO: 1357026 - RNA, 16 nt, Homo sapiens
acaacuuguauuucca

SEQ ID NO: 1357027 - RNA, 20 nt, Homo sapiens
acaagugcugggucugucac

SEQ ID NO: 1357028 - RNA, 12 nt, Homo sapiens
acaagugguggu

SEQ ID NO: 1357029 - RNA, 23 nt, Homo sapiens
acaaguuggaugcggccauucaa

SEQ ID NO: 1357030 - RNA, 17 nt, Homo sapiens
acaauagcccaaagcca

SEQ ID NO: 1357031 - RNA, 15 nt, Homo sapiens
acaauauucaaucaa

SEQ ID NO: 1357032 - RNA, 13 nt, Homo sapiens
acaaucauuuuau

SEQ ID NO: 1357033 - RNA, 13 nt, Homo sapiens
acaaucucagcuc

SEQ ID NO: 1357034 - RNA, 15 nt, Homo sapiens
acaauggaguauucu

SEQ ID NO: 1357035 - RNA, 13 nt, Homo sapiens
acaaugugaaaag

SEQ ID NO: 1357036 - RNA, 23 nt, Homo sapiens
acaauuaaaagugucuugagacu

SEQ ID NO: 1357037 - RNA, 14 nt, Homo sapiens
acaauuaauauuaa

SEQ ID NO: 1357038 - RNA, 20 nt, Homo sapiens
acacaaacgggcucagcaaa

SEQ ID NO: 1357039 - RNA, 21 nt, Homo sapiens
acacagaggacccaggggaaa

SEQ ID NO: 1357040 - RNA, 12 nt, Homo sapiens
acacagcacuuc

SEQ ID NO: 1357041 - RNA, 23 nt, Homo sapiens
acacagcuaacaaguagcacacu

SEQ ID NO: 1357042 - RNA, 16 nt, Homo sapiens
acacauccaucuugca

SEQ ID NO: 1357043 - RNA, 19 nt, Homo sapiens
acaccauuuuccugccuca

SEQ ID NO: 1357044 - RNA, 16 nt, Homo sapiens
acaccucaguucccuu

SEQ ID NO: 1357045 - RNA, 20 nt, Homo sapiens
acacggaggucucuguaaaa

SEQ ID NO: 1357046 - RNA, 14 nt, Homo sapiens
acacuaauuuccaa

SEQ ID NO: 1357047 - RNA, 22 nt, Homo sapiens
acacuagacaagccagaacuug

SEQ ID NO: 1357048 - RNA, 18 nt, Homo sapiens
acacugaguuugaacaca

SEQ ID NO: 1357049 - RNA, 15 nt, Homo sapiens
acacugucuugaaga

SEQ ID NO: 1357050 - RNA, 22 nt, Homo sapiens
acacuguucugaaagugacuca

SEQ ID NO: 1357051 - RNA, 19 nt, Homo sapiens
acacuucugugagaccccc

SEQ ID NO: 1357052 - RNA, 20 nt, Homo sapiens
acagagauaauucuagcuuu

SEQ ID NO: 1357053 - RNA, 17 nt, Homo sapiens
acagagaucucagaggu

SEQ ID NO: 1357054 - RNA, 15 nt, Homo sapiens
acagagucugugucc

SEQ ID NO: 1357055 - RNA, 18 nt, Homo sapiens
acagauaucagugucucc

SEQ ID NO: 1357056 - RNA, 22 nt, Homo sapiens
acagaucacagcuucagccagg

SEQ ID NO: 1357057 - RNA, 22 nt, Homo sapiens
acagaugugugauucacagugu

SEQ ID NO: 1357058 - RNA, 16 nt, Homo sapiens
acagccucacuccuca

SEQ ID NO: 1357059 - RNA, 17 nt, Homo sapiens
acagcuaacaaguagca

SEQ ID NO: 1357060 - RNA, 14 nt, Homo sapiens
acagcugugugagc

SEQ ID NO: 1357061 - RNA, 15 nt, Homo sapiens
acagcugugugagcu

SEQ ID NO: 1357062 - RNA, 14 nt, Homo sapiens
acaggaagugacaa

SEQ ID NO: 1357063 - RNA, 15 nt, Homo sapiens
acagguggugcaaau

SEQ ID NO: 1357064 - RNA, 23 nt, Homo sapiens
acagguguuuuuccacaagugcc

SEQ ID NO: 1357065 - RNA, 20 nt, Homo sapiens
acaguagagagaacauggag

SEQ ID NO: 1357066 - RNA, 17 nt, Homo sapiens
acaguauacgcuccauc

SEQ ID NO: 1357067 - RNA, 12 nt, Homo sapiens
acaguaucucag

SEQ ID NO: 1357068 - RNA, 15 nt, Homo sapiens
acagugacacccaga

SEQ ID NO: 1357069 - RNA, 16 nt, Homo sapiens
acaguuaagacaacag

SEQ ID NO: 1357070 - RNA, 17 nt, Homo sapiens
acaguucuuugggccag

SEQ ID NO: 1357071 - RNA, 17 nt, Homo sapiens
acauacccucacuuaaa

SEQ ID NO: 1357072 - RNA, 20 nt, Homo sapiens
acauagaaaguucauggaac

SEQ ID NO: 1357073 - RNA, 15 nt, Homo sapiens
acaucauuacuauaa

SEQ ID NO: 1357074 - RNA, 19 nt, Homo sapiens
acauccgcgugugccugug

SEQ ID NO: 1357075 - RNA, 17 nt, Homo sapiens
acaugcagcccaugccc

SEQ ID NO: 1357076 - RNA, 14 nt, Homo sapiens
acaugcuucagugc

SEQ ID NO: 1357077 - RNA, 22 nt, Homo sapiens
acauggacaugcuucagugcug

SEQ ID NO: 1357078 - RNA, 21 nt, Homo sapiens
acauggcuaaagaagguuuca

SEQ ID NO: 1357079 - RNA, 18 nt, Homo sapiens
acauuaaugagaauuccu

SEQ ID NO: 1357080 - RNA, 15 nt, Homo sapiens
acauuagccuaugug

SEQ ID NO: 1357081 - RNA, 16 nt, Homo sapiens
acauucgaguguuuca

SEQ ID NO: 1357082 - RNA, 14 nt, Homo sapiens
acauugccaaaaag

SEQ ID NO: 1357083 - RNA, 13 nt, Homo sapiens
acauuguacuuaa

SEQ ID NO: 1357084 - RNA, 16 nt, Homo sapiens
acauuuaaauuccaca

SEQ ID NO: 1357085 - RNA, 17 nt, Homo sapiens
acauuuaaauuccacag

SEQ ID NO: 1357086 - RNA, 21 nt, Homo sapiens
acauuucucuaacuccugcca

SEQ ID NO: 1357087 - RNA, 19 nt, Homo sapiens
accaaaucuggaagccaaa

SEQ ID NO: 1357088 - RNA, 20 nt, Homo sapiens
accaagaucaucaagacaga

SEQ ID NO: 1357089 - RNA, 17 nt, Homo sapiens
accaagggaucugccau

SEQ ID NO: 1357090 - RNA, 17 nt, Homo sapiens
accacgcccccagcugu

SEQ ID NO: 1357091 - RNA, 18 nt, Homo sapiens
accacuacaugcagccca

SEQ ID NO: 1357092 - RNA, 23 nt, Homo sapiens
accacuacaugcagcccaugccc

SEQ ID NO: 1357093 - RNA, 14 nt, Homo sapiens
accagagacucuga

SEQ ID NO: 1357094 - RNA, 21 nt, Homo sapiens
accagagccuucaagugccaa

SEQ ID NO: 1357095 - RNA, 13 nt, Homo sapiens
accaggucaggga

SEQ ID NO: 1357096 - RNA, 15 nt, Homo sapiens
accagguuaccucac

SEQ ID NO: 1357097 - RNA, 13 nt, Homo sapiens
accagugcugcug

SEQ ID NO: 1357098 - RNA, 24 nt, Homo sapiens
accaugauuaaccacuucagcuga

SEQ ID NO: 1357099 - RNA, 19 nt, Homo sapiens
accauggcaugguuauuga

SEQ ID NO: 1357100 - RNA, 16 nt, Homo sapiens
accauguacauagcuu

SEQ ID NO: 1357101 - RNA, 20 nt, Homo sapiens
accauuaaccagaucuaguc

SEQ ID NO: 1357102 - RNA, 14 nt, Homo sapiens
accauuuacaguau

SEQ ID NO: 1357103 - RNA, 18 nt, Homo sapiens
acccaauaguuguugauu

SEQ ID NO: 1357104 - RNA, 19 nt, Homo sapiens
acccaauauuuaccagacc

SEQ ID NO: 1357105 - RNA, 22 nt, Homo sapiens
acccagccuaucaggugccccu

SEQ ID NO: 1357106 - RNA, 14 nt, Homo sapiens
acccagcucacagg

SEQ ID NO: 1357107 - RNA, 22 nt, Homo sapiens
acccaggaguauccucuugcca

SEQ ID NO: 1357108 - RNA, 21 nt, Homo sapiens
acccaggggaaacgagcugug

SEQ ID NO: 1357109 - RNA, 9 nt, Homo sapiens
acccagugc

SEQ ID NO: 1357110 - RNA, 11 nt, Homo sapiens
acccagugcag

SEQ ID NO: 1357111 - RNA, 19 nt, Homo sapiens
acccaguugugacaauuaa

SEQ ID NO: 1357112 - RNA, 12 nt, Homo sapiens
accccagauuca

SEQ ID NO: 1357113 - RNA, 22 nt, Homo sapiens
accccagugcuuguuccucuca

SEQ ID NO: 1357114 - RNA, 14 nt, Homo sapiens
accccaugccaaag

SEQ ID NO: 1357115 - RNA, 15 nt, Homo sapiens
accccuuagccuccc

SEQ ID NO: 1357116 - RNA, 17 nt, Homo sapiens
acccguggcugauggug

SEQ ID NO: 1357117 - RNA, 22 nt, Homo sapiens
acccguggcugaugguguggcc

SEQ ID NO: 1357118 - RNA, 20 nt, Homo sapiens
acccguugauaacucagugg

SEQ ID NO: 1357119 - RNA, 21 nt, Homo sapiens
acccucaaguggacagugaau

SEQ ID NO: 1357120 - RNA, 19 nt, Homo sapiens
acccucauucuacugaaaa

SEQ ID NO: 1357121 - RNA, 17 nt, Homo sapiens
acccugaaggggccaug

SEQ ID NO: 1357122 - RNA, 19 nt, Homo sapiens
acccugcugcuggugcaca

SEQ ID NO: 1357123 - RNA, 20 nt, Homo sapiens
acccugcugcuggugcacag

SEQ ID NO: 1357124 - RNA, 21 nt, Homo sapiens
acccuggugggccaacaaaga

SEQ ID NO: 1357125 - RNA, 14 nt, Homo sapiens
acccuuucauaaag

SEQ ID NO: 1357126 - RNA, 14 nt, Homo sapiens
acccuuugcuguga

SEQ ID NO: 1357127 - RNA, 23 nt, Homo sapiens
accggggccuacuagagucugaa

SEQ ID NO: 1357128 - RNA, 16 nt, Homo sapiens
accgugaccagugcug

SEQ ID NO: 1357129 - RNA, 15 nt, Homo sapiens
accguggguguggcu

SEQ ID NO: 1357130 - RNA, 18 nt, Homo sapiens
accuaauccaggcagauc

SEQ ID NO: 1357131 - RNA, 18 nt, Homo sapiens
accuaguauaucagugac

SEQ ID NO: 1357132 - RNA, 14 nt, Homo sapiens
accucacauacccu

SEQ ID NO: 1357133 - RNA, 12 nt, Homo sapiens
accucaccaaaa

SEQ ID NO: 1357134 - RNA, 17 nt, Homo sapiens
accucacgcaccuccca

SEQ ID NO: 1357135 - RNA, 24 nt, Homo sapiens
accucacuuuuaauuagugaugca

SEQ ID NO: 1357136 - RNA, 19 nt, Homo sapiens
accucagccuggccagaca

SEQ ID NO: 1357137 - RNA, 22 nt, Homo sapiens
accucagggcuguguguacuaa

SEQ ID NO: 1357138 - RNA, 22 nt, Homo sapiens
accucauaucaguuugcuagca

SEQ ID NO: 1357139 - RNA, 13 nt, Homo sapiens
accucauucugaa

SEQ ID NO: 1357140 - RNA, 23 nt, Homo sapiens
accuccaggcuuucccacuuccc

SEQ ID NO: 1357141 - RNA, 19 nt, Homo sapiens
accucccugccuccaggaa

SEQ ID NO: 1357142 - RNA, 19 nt, Homo sapiens
accuccucccuaaugcuca

SEQ ID NO: 1357143 - RNA, 20 nt, Homo sapiens
accuccucccuaaugcucac

SEQ ID NO: 1357144 - RNA, 19 nt, Homo sapiens
accucgugauccaccugcc

SEQ ID NO: 1357145 - RNA, 14 nt, Homo sapiens
accucugcacuacu

SEQ ID NO: 1357146 - RNA, 17 nt, Homo sapiens
accucuggacuggcuag

SEQ ID NO: 1357147 - RNA, 14 nt, Homo sapiens
accucuuccuugau

SEQ ID NO: 1357148 - RNA, 18 nt, Homo sapiens
accugaaauuaacucaga

SEQ ID NO: 1357149 - RNA, 21 nt, Homo sapiens
accugaagugagaacccagcu

SEQ ID NO: 1357150 - RNA, 19 nt, Homo sapiens
accugaggcccccaucucc

SEQ ID NO: 1357151 - RNA, 15 nt, Homo sapiens
accugauauauucca

SEQ ID NO: 1357152 - RNA, 16 nt, Homo sapiens
accuucguccuuuuaa

SEQ ID NO: 1357153 - RNA, 19 nt, Homo sapiens
accuugagaagacauagau

SEQ ID NO: 1357154 - RNA, 17 nt, Homo sapiens
accuuggcaccagacac

SEQ ID NO: 1357155 - RNA, 22 nt, Homo sapiens
accuuggcaccagacacccagg

SEQ ID NO: 1357156 - RNA, 23 nt, Homo sapiens
accuuggcaccagacacccagga

SEQ ID NO: 1357157 - RNA, 17 nt, Homo sapiens
acgaggaggagugcaug

SEQ ID NO: 1357158 - RNA, 23 nt, Homo sapiens
acgagugcuuccgcugcggugau

SEQ ID NO: 1357159 - RNA, 22 nt, Homo sapiens
acgaguggccaguucauugugg

SEQ ID NO: 1357160 - RNA, 23 nt, Homo sapiens
acgcacacagugucuguguacau

SEQ ID NO: 1357161 - RNA, 16 nt, Homo sapiens
acgcggagcacuuucg

SEQ ID NO: 1357162 - RNA, 21 nt, Homo sapiens
acgcguauuuacagccagugg

SEQ ID NO: 1357163 - RNA, 17 nt, Homo sapiens
acgcgugccguggcacc

SEQ ID NO: 1357164 - RNA, 16 nt, Homo sapiens
acggccaccacugcag

SEQ ID NO: 1357165 - RNA, 18 nt, Homo sapiens
acggccagggagaagcuc

SEQ ID NO: 1357166 - RNA, 13 nt, Homo sapiens
acggcuuacaugu

SEQ ID NO: 1357167 - RNA, 14 nt, Homo sapiens
acgggcucagcaaa

SEQ ID NO: 1357168 - RNA, 20 nt, Homo sapiens
acgguggcucacgccuguaa

SEQ ID NO: 1357169 - RNA, 13 nt, Homo sapiens
acguccacuuuca

SEQ ID NO: 1357170 - RNA, 18 nt, Homo sapiens
acgucuguucacugaaau

SEQ ID NO: 1357171 - RNA, 22 nt, Homo sapiens
acguggcccagagaagccaaaa

SEQ ID NO: 1357172 - RNA, 12 nt, Homo sapiens
acguggccucuu

SEQ ID NO: 1357173 - RNA, 16 nt, Homo sapiens
acguguagauaauuaa

SEQ ID NO: 1357174 - RNA, 18 nt, Homo sapiens
acguugccucuacuuuau

SEQ ID NO: 1357175 - RNA, 16 nt, Homo sapiens
acguuuauagccgaaa

SEQ ID NO: 1357176 - RNA, 18 nt, Homo sapiens
acuaaacacgugacacaa

SEQ ID NO: 1357177 - RNA, 19 nt, Homo sapiens
acuaacaaaggcagcugug

SEQ ID NO: 1357178 - RNA, 15 nt, Homo sapiens
acuaacuuugaaugu

SEQ ID NO: 1357179 - RNA, 21 nt, Homo sapiens
acuacaaccaauggaauguga

SEQ ID NO: 1357180 - RNA, 14 nt, Homo sapiens
acuacaagucagcu

SEQ ID NO: 1357181 - RNA, 16 nt, Homo sapiens
acuacaggcaccugcc

SEQ ID NO: 1357182 - RNA, 22 nt, Homo sapiens
acuagaauuuaguuuguacuca

SEQ ID NO: 1357183 - RNA, 12 nt, Homo sapiens
aacaaaauggac

SEQ ID NO: 1357184 - RNA, 14 nt, Homo sapiens
aacaaaggcagcug

SEQ ID NO: 1357185 - RNA, 13 nt, Homo sapiens
aacacacacuguu

SEQ ID NO: 1357186 - RNA, 17 nt, Homo sapiens
aacacguucauauucca

SEQ ID NO: 1357187 - RNA, 16 nt, Homo sapiens
aacacuagacaagcca

SEQ ID NO: 1357188 - RNA, 16 nt, Homo sapiens
aacagaaaaauaugua

SEQ ID NO: 1357189 - RNA, 18 nt, Homo sapiens
aacagauaucagugucuc

SEQ ID NO: 1357190 - RNA, 18 nt, Homo sapiens
aacagguguuggugacaa

SEQ ID NO: 1357191 - RNA, 20 nt, Homo sapiens
aacaucccugccagcucuuc

SEQ ID NO: 1357192 - RNA, 12 nt, Homo sapiens
aacaugacacuu

SEQ ID NO: 1357193 - RNA, 11 nt, Homo sapiens
aacauguaauu

SEQ ID NO: 1357194 - RNA, 14 nt, Homo sapiens
aacaugugcucagg

SEQ ID NO: 1357195 - RNA, 19 nt, Homo sapiens
aacaugugguuaaugccau

SEQ ID NO: 1357196 - RNA, 23 nt, Homo sapiens
aacauuguuuuguguaacauauu

SEQ ID NO: 1357197 - RNA, 19 nt, Homo sapiens
aacauuuaaauuccacaga

SEQ ID NO: 1357198 - RNA, 22 nt, Homo sapiens
aacauuuauauauuuccauuca

SEQ ID NO: 1357199 - RNA, 18 nt, Homo sapiens
aaccaaaagaauuugcac

SEQ ID NO: 1357200 - RNA, 20 nt, Homo sapiens
aaccaaaucuggaagccaaa

SEQ ID NO: 1357201 - RNA, 11 nt, Homo sapiens
aaccaccaaaa

SEQ ID NO: 1357202 - RNA, 14 nt, Homo sapiens
aaccacuucagcug

SEQ ID NO: 1357203 - RNA, 20 nt, Homo sapiens
aaccaguccccccacccuca

SEQ ID NO: 1357204 - RNA, 17 nt, Homo sapiens
aaccauaugaacauaua

SEQ ID NO: 1357205 - RNA, 12 nt, Homo sapiens
aacccagacuca

SEQ ID NO: 1357206 - RNA, 11 nt, Homo sapiens
aacccagcugu

SEQ ID NO: 1357207 - RNA, 21 nt, Homo sapiens
aacccagcuguccguccucag

SEQ ID NO: 1357208 - RNA, 21 nt, Homo sapiens
aacccaggaguucagggucau

SEQ ID NO: 1357209 - RNA, 14 nt, Homo sapiens
aacccaggcagcug

SEQ ID NO: 1357210 - RNA, 17 nt, Homo sapiens
aaccccagauucaugca

SEQ ID NO: 1357211 - RNA, 19 nt, Homo sapiens
aacccuauugguaaagaau

SEQ ID NO: 1357212 - RNA, 17 nt, Homo sapiens
aaccgcaggaagcugcu

SEQ ID NO: 1357213 - RNA, 19 nt, Homo sapiens
aaccgcaggaagcugcucc

SEQ ID NO: 1357214 - RNA, 17 nt, Homo sapiens
aaccggggccuacuaga

SEQ ID NO: 1357215 - RNA, 13 nt, Homo sapiens
aaccucaaaguga

SEQ ID NO: 1357216 - RNA, 21 nt, Homo sapiens
aaccucagccuggccagacac

SEQ ID NO: 1357217 - RNA, 20 nt, Homo sapiens
aaccugcaaagaucuguccu

SEQ ID NO: 1357218 - RNA, 20 nt, Homo sapiens
aaccuggguaacuagggaag

SEQ ID NO: 1357219 - RNA, 22 nt, Homo sapiens
aaccuuacuaauuauacuacuu

SEQ ID NO: 1357220 - RNA, 19 nt, Homo sapiens
aaccuugucccagccagug

SEQ ID NO: 1357221 - RNA, 19 nt, Homo sapiens
aacggagagcgccugcccc

SEQ ID NO: 1357222 - RNA, 18 nt, Homo sapiens
aacguaggugugacacuu

SEQ ID NO: 1357223 - RNA, 12 nt, Homo sapiens
aacguggcccag

SEQ ID NO: 1357224 - RNA, 16 nt, Homo sapiens
aacucaaacucuuaaa

SEQ ID NO: 1357225 - RNA, 20 nt, Homo sapiens
aacucaaacucuuaaaaccc

SEQ ID NO: 1357226 - RNA, 23 nt, Homo sapiens
aacucacuuucccuugugucaag

SEQ ID NO: 1357227 - RNA, 20 nt, Homo sapiens
aacucauccacguccugucu

SEQ ID NO: 1357228 - RNA, 13 nt, Homo sapiens
aacuccccuugaa

SEQ ID NO: 1357229 - RNA, 12 nt, Homo sapiens
aacuccuaccug

SEQ ID NO: 1357230 - RNA, 23 nt, Homo sapiens
aacucuucaguuaauucuuagau

SEQ ID NO: 1357231 - RNA, 11 nt, Homo sapiens
aacugcaguga

SEQ ID NO: 1357232 - RNA, 14 nt, Homo sapiens
aacugcagugaugu

SEQ ID NO: 1357233 - RNA, 11 nt, Homo sapiens
aacugcagugu

SEQ ID NO: 1357234 - RNA, 15 nt, Homo sapiens
aacugugaaauacca

SEQ ID NO: 1357235 - RNA, 22 nt, Homo sapiens
aacugugaaauaccacaagccu

SEQ ID NO: 1357236 - RNA, 19 nt, Homo sapiens
aacuuaaaagucaguauca

SEQ ID NO: 1357237 - RNA, 17 nt, Homo sapiens
aacuucuacuucugccc

SEQ ID NO: 1357238 - RNA, 22 nt, Homo sapiens
aacuucugccucccaugcuuac

SEQ ID NO: 1357239 - RNA, 12 nt, Homo sapiens
aacuugggccac

SEQ ID NO: 1357240 - RNA, 23 nt, Homo sapiens
aacuugguacuaucuuauucuga

SEQ ID NO: 1357241 - RNA, 17 nt, Homo sapiens
aagaaaaagguuugcau

SEQ ID NO: 1357242 - RNA, 12 nt, Homo sapiens
aagaagaaagca

SEQ ID NO: 1357243 - RNA, 15 nt, Homo sapiens
aagaaggggacaaug

SEQ ID NO: 1357244 - RNA, 15 nt, Homo sapiens
aagaaguuuuguucc

SEQ ID NO: 1357245 - RNA, 17 nt, Homo sapiens
aagaauaugacuuuuua

SEQ ID NO: 1357246 - RNA, 16 nt, Homo sapiens
aagaauuauuuacuga

SEQ ID NO: 1357247 - RNA, 17 nt, Homo sapiens
aagacagaaguuugcac

SEQ ID NO: 1357248 - RNA, 16 nt, Homo sapiens
aagacagagcugggau

SEQ ID NO: 1357249 - RNA, 23 nt, Homo sapiens
aagacugauuuuaauagggaaua

SEQ ID NO: 1357250 - RNA, 19 nt, Homo sapiens
aagagaaaaaauauuuucc

SEQ ID NO: 1357251 - RNA, 20 nt, Homo sapiens
aagagagguccagcccccca

SEQ ID NO: 1357252 - RNA, 12 nt, Homo sapiens
aagaggcuggau

SEQ ID NO: 1357253 - RNA, 13 nt, Homo sapiens
aagaggugggagc

SEQ ID NO: 1357254 - RNA, 15 nt, Homo sapiens
aagaguaguuauaua

SEQ ID NO: 1357255 - RNA, 13 nt, Homo sapiens
aagagucuucaaa

SEQ ID NO: 1357256 - RNA, 18 nt, Homo sapiens
aagaucucgguuugccaa

SEQ ID NO: 1357257 - RNA, 18 nt, Homo sapiens
aagaucuguccucagccu

SEQ ID NO: 1357258 - RNA, 18 nt, Homo sapiens
aagaucuugaauagucuc

SEQ ID NO: 1357259 - RNA, 17 nt, Homo sapiens
aagauuucucugagauc

SEQ ID NO: 1357260 - RNA, 17 nt, Homo sapiens
aagauuugugaacugga

SEQ ID NO: 1357261 - RNA, 14 nt, Homo sapiens
aagcaaagcucuuu

SEQ ID NO: 1357262 - RNA, 17 nt, Homo sapiens
aagcaacuuuacugaga

SEQ ID NO: 1357263 - RNA, 19 nt, Homo sapiens
aagcaacuuuacugagaca

SEQ ID NO: 1357264 - RNA, 14 nt, Homo sapiens
aagcacuacaccuu

SEQ ID NO: 1357265 - RNA, 18 nt, Homo sapiens
aagcacuacaccuugccu

SEQ ID NO: 1357266 - RNA, 19 nt, Homo sapiens
aagcacuacaccuugccuu

SEQ ID NO: 1357267 - RNA, 19 nt, Homo sapiens
aagcagaaggugugcuauu

SEQ ID NO: 1357268 - RNA, 16 nt, Homo sapiens
aagcaggaagcucaga

SEQ ID NO: 1357269 - RNA, 16 nt, Homo sapiens
aagcauuuugugaugu

SEQ ID NO: 1357270 - RNA, 17 nt, Homo sapiens
aagccucugaucuggca

SEQ ID NO: 1357271 - RNA, 16 nt, Homo sapiens
aagccugacccuguaa

SEQ ID NO: 1357272 - RNA, 19 nt, Homo sapiens
aagcgagacuccaucucaa

SEQ ID NO: 1357273 - RNA, 13 nt, Homo sapiens
aagcucaucucag

SEQ ID NO: 1357274 - RNA, 18 nt, Homo sapiens
aagcucaucucagcuccu

SEQ ID NO: 1357275 - RNA, 20 nt, Homo sapiens
aagcugagcaccaggggaug

SEQ ID NO: 1357276 - RNA, 17 nt, Homo sapiens
aagcuggggauguuuag

SEQ ID NO: 1357277 - RNA, 13 nt, Homo sapiens
aagcuugcugcuc

SEQ ID NO: 1357278 - RNA, 15 nt, Homo sapiens
aaggcaguaugccaa

SEQ ID NO: 1357279 - RNA, 22 nt, Homo sapiens
aagggccagcuggaggugaaga

SEQ ID NO: 1357280 - RNA, 18 nt, Homo sapiens
aaggggaaucagaacuca

SEQ ID NO: 1357281 - RNA, 20 nt, Homo sapiens
aaggggagccaaaaucucaa

SEQ ID NO: 1357282 - RNA, 16 nt, Homo sapiens
aaggggauacuguaau

SEQ ID NO: 1357283 - RNA, 13 nt, Homo sapiens
aagggguucucac

SEQ ID NO: 1357284 - RNA, 18 nt, Homo sapiens
aaggguucaccaggucag

SEQ ID NO: 1357285 - RNA, 14 nt, Homo sapiens
aagguaaaaugcca

SEQ ID NO: 1357286 - RNA, 18 nt, Homo sapiens
aagguacugucaugggcu

SEQ ID NO: 1357287 - RNA, 18 nt, Homo sapiens
aagguauuagcaaagcaa

SEQ ID NO: 1357288 - RNA, 19 nt, Homo sapiens
aagguauuagcaaagcaaa

SEQ ID NO: 1357289 - RNA, 15 nt, Homo sapiens
aaggucuauauucug

SEQ ID NO: 1357290 - RNA, 19 nt, Homo sapiens
aaguagaucuuuucuugac

SEQ ID NO: 1357291 - RNA, 16 nt, Homo sapiens
aaguagcacacugagu

SEQ ID NO: 1357292 - RNA, 22 nt, Homo sapiens
aaguagcguuggagacauacac

SEQ ID NO: 1357293 - RNA, 23 nt, Homo sapiens
aaguauacaauaaagucuuaccu

SEQ ID NO: 1357294 - RNA, 22 nt, Homo sapiens
aagucagcuccagcuuucugcc

SEQ ID NO: 1357295 - RNA, 18 nt, Homo sapiens
aagucaguaucauauuau

SEQ ID NO: 1357296 - RNA, 18 nt, Homo sapiens
aagucgucacuaauacac

SEQ ID NO: 1357297 - RNA, 23 nt, Homo sapiens
aagucugagcgaggagugacugc

SEQ ID NO: 1357298 - RNA, 16 nt, Homo sapiens
aagucuguuuacugca

SEQ ID NO: 1357299 - RNA, 22 nt, Homo sapiens
aagucuugccuugcugaacucc

SEQ ID NO: 1357300 - RNA, 18 nt, Homo sapiens
acagccucugaaaaccaa

SEQ ID NO: 1357301 - RNA, 18 nt, Homo sapiens
acagcuacacagaucaca

SEQ ID NO: 1357302 - RNA, 20 nt, Homo sapiens
acagcuuugcugcugaaggc

SEQ ID NO: 1357303 - RNA, 18 nt, Homo sapiens
acaggagcuuaaacagcu

SEQ ID NO: 1357304 - RNA, 19 nt, Homo sapiens
acaggccucaucuuuuugg

SEQ ID NO: 1357305 - RNA, 17 nt, Homo sapiens
acaggugaaugugccac

SEQ ID NO: 1357306 - RNA, 16 nt, Homo sapiens
acaguagauuuuccaa

SEQ ID NO: 1357307 - RNA, 22 nt, Homo sapiens
acaguaguuagaauuauaucac

SEQ ID NO: 1357308 - RNA, 14 nt, Homo sapiens
acaguaucucaggg

SEQ ID NO: 1357309 - RNA, 17 nt, Homo sapiens
acagugcagugcgcugu

SEQ ID NO: 1357310 - RNA, 21 nt, Homo sapiens
acagugcuguugaagauuuga

SEQ ID NO: 1357311 - RNA, 22 nt, Homo sapiens
acaguugaaaaacagcugaggg

SEQ ID NO: 1357312 - RNA, 14 nt, Homo sapiens
acauaauucacucu

SEQ ID NO: 1357313 - RNA, 20 nt, Homo sapiens
acauacacaaaugggcauac

SEQ ID NO: 1357314 - RNA, 15 nt, Homo sapiens
acaucagaaagggag

SEQ ID NO: 1357315 - RNA, 21 nt, Homo sapiens
acaugcauaagaaauguagcu

SEQ ID NO: 1357316 - RNA, 14 nt, Homo sapiens
acaugccacaagga

SEQ ID NO: 1357317 - RNA, 14 nt, Homo sapiens
acaugccacuugaa

SEQ ID NO: 1357318 - RNA, 17 nt, Homo sapiens
acaugccccguuuuuga

SEQ ID NO: 1357319 - RNA, 19 nt, Homo sapiens
acaugcgugaccagcagua

SEQ ID NO: 1357320 - RNA, 19 nt, Homo sapiens
acaugcuucagugcugcuc

SEQ ID NO: 1357321 - RNA, 16 nt, Homo sapiens
acaugcuuugaaguuu

SEQ ID NO: 1357322 - RNA, 23 nt, Homo sapiens
acauggcuccggccucugccuuu

SEQ ID NO: 1357323 - RNA, 15 nt, Homo sapiens
acauguaacauuaaa

SEQ ID NO: 1357324 - RNA, 17 nt, Homo sapiens
acaugugcccucugcca

SEQ ID NO: 1357325 - RNA, 20 nt, Homo sapiens
acauguggcccaacacaauu

SEQ ID NO: 1357326 - RNA, 21 nt, Homo sapiens
acauguuuguuucuguagaaa

SEQ ID NO: 1357327 - RNA, 12 nt, Homo sapiens
acauucuuggcu

SEQ ID NO: 1357328 - RNA, 19 nt, Homo sapiens
acauuggagcugacuguuc

SEQ ID NO: 1357329 - RNA, 15 nt, Homo sapiens
acauuuaaauuccac

SEQ ID NO: 1357330 - RNA, 15 nt, Homo sapiens
acauuuuuuaccaaa

SEQ ID NO: 1357331 - RNA, 13 nt, Homo sapiens
accaaaccccacu

SEQ ID NO: 1357332 - RNA, 19 nt, Homo sapiens
accaagaaagcucacugua

SEQ ID NO: 1357333 - RNA, 16 nt, Homo sapiens
accaagacugagccag

SEQ ID NO: 1357334 - RNA, 13 nt, Homo sapiens
accaagcaggaag

SEQ ID NO: 1357335 - RNA, 15 nt, Homo sapiens
accaagcuuguccaa

SEQ ID NO: 1357336 - RNA, 19 nt, Homo sapiens
accaagggaucugccauug

SEQ ID NO: 1357337 - RNA, 13 nt, Homo sapiens
accacaacuauuu

SEQ ID NO: 1357338 - RNA, 11 nt, Homo sapiens
accacacaaag

SEQ ID NO: 1357339 - RNA, 17 nt, Homo sapiens
accacauccuccgucca

SEQ ID NO: 1357340 - RNA, 15 nt, Homo sapiens
accaccaccaucacc

SEQ ID NO: 1357341 - RNA, 19 nt, Homo sapiens
accacugagccauccucag

SEQ ID NO: 1357342 - RNA, 15 nt, Homo sapiens
accagacacccagga

SEQ ID NO: 1357343 - RNA, 18 nt, Homo sapiens
accagcgugugacuacuc

SEQ ID NO: 1357344 - RNA, 22 nt, Homo sapiens
accaggcaccucuuccuugaug

SEQ ID NO: 1357345 - RNA, 14 nt, Homo sapiens
accagguuaccuca

SEQ ID NO: 1357346 - RNA, 21 nt, Homo sapiens
accagguuaccucacuuuuaa

SEQ ID NO: 1357347 - RNA, 14 nt, Homo sapiens
accauacugaggga

SEQ ID NO: 1357348 - RNA, 16 nt, Homo sapiens
accauaugaacauaua

SEQ ID NO: 1357349 - RNA, 23 nt, Homo sapiens
accaugauuaaccacuucagcug

SEQ ID NO: 1357350 - RNA, 15 nt, Homo sapiens
accauggguguggau

SEQ ID NO: 1357351 - RNA, 23 nt, Homo sapiens
accauuuguguuuugaaagccca

SEQ ID NO: 1357352 - RNA, 14 nt, Homo sapiens
acccaagcauuugu

SEQ ID NO: 1357353 - RNA, 18 nt, Homo sapiens
acccacucuccugugaga

SEQ ID NO: 1357354 - RNA, 22 nt, Homo sapiens
acccaggggaaacgagcugugu

SEQ ID NO: 1357355 - RNA, 12 nt, Homo sapiens
acccagugcaga

SEQ ID NO: 1357356 - RNA, 12 nt, Homo sapiens
acccaucugcac

SEQ ID NO: 1357357 - RNA, 15 nt, Homo sapiens
acccauggcuguguu

SEQ ID NO: 1357358 - RNA, 15 nt, Homo sapiens
accccaacacuucca

SEQ ID NO: 1357359 - RNA, 13 nt, Homo sapiens
accccacccaagu

SEQ ID NO: 1357360 - RNA, 19 nt, Homo sapiens
accccccugggcugagaga

SEQ ID NO: 1357361 - RNA, 16 nt, Homo sapiens
accccucaacaccucu

SEQ ID NO: 1357362 - RNA, 15 nt, Homo sapiens
accccuuagcaauaa

SEQ ID NO: 1357363 - RNA, 20 nt, Homo sapiens
accccuugccggugaaggau

SEQ ID NO: 1357364 - RNA, 21 nt, Homo sapiens
acccgggaggcagagguugca

SEQ ID NO: 1357365 - RNA, 13 nt, Homo sapiens
acccuagucccuu

SEQ ID NO: 1357366 - RNA, 18 nt, Homo sapiens
acccucacuuaaacuuuu

SEQ ID NO: 1357367 - RNA, 20 nt, Homo sapiens
acccuccugcugagcugccc

SEQ ID NO: 1357368 - RNA, 19 nt, Homo sapiens
acccugaaggggccaugau

SEQ ID NO: 1357369 - RNA, 19 nt, Homo sapiens
acccugccuuaucuugcac

SEQ ID NO: 1357370 - RNA, 18 nt, Homo sapiens
acccugguuauugaugug

SEQ ID NO: 1357371 - RNA, 16 nt, Homo sapiens
acccuguaaaauggag

SEQ ID NO: 1357372 - RNA, 22 nt, Homo sapiens
acccuucauuuaacaaguaaga

SEQ ID NO: 1357373 - RNA, 18 nt, Homo sapiens
accgacugaagugugugu

SEQ ID NO: 1357374 - RNA, 22 nt, Homo sapiens
accuaaacggggcaguacuccu

SEQ ID NO: 1357375 - RNA, 20 nt, Homo sapiens
accuaaauggccucaugugg

SEQ ID NO: 1357376 - RNA, 23 nt, Homo sapiens
accuacgguggucggugggaccc

SEQ ID NO: 1357377 - RNA, 22 nt, Homo sapiens
accuacugauaaccacuccuaa

SEQ ID NO: 1357378 - RNA, 20 nt, Homo sapiens
accuagcaaagcuccugccu

SEQ ID NO: 1357379 - RNA, 16 nt, Homo sapiens
accucagccuggccag

SEQ ID NO: 1357380 - RNA, 11 nt, Homo sapiens
accucagggcu

SEQ ID NO: 1357381 - RNA, 12 nt, Homo sapiens
accuccacaccc

SEQ ID NO: 1357382 - RNA, 15 nt, Homo sapiens
accuccacagcuucc

SEQ ID NO: 1357383 - RNA, 17 nt, Homo sapiens
accucccauccuaauca

SEQ ID NO: 1357384 - RNA, 17 nt, Homo sapiens
accucuacaggcauuua

SEQ ID NO: 1357385 - RNA, 10 nt, Homo sapiens
accucugaga

SEQ ID NO: 1357386 - RNA, 18 nt, Homo sapiens
accuuaagagacacucca

SEQ ID NO: 1357387 - RNA, 22 nt, Homo sapiens
accuuacauuugaaaucuauga

SEQ ID NO: 1357388 - RNA, 16 nt, Homo sapiens
accuuaggcagggaag

SEQ ID NO: 1357389 - RNA, 20 nt, Homo sapiens
accuucaugcccuucugauu

SEQ ID NO: 1357390 - RNA, 21 nt, Homo sapiens
accuucuaggaagcuccaguu

SEQ ID NO: 1357391 - RNA, 16 nt, Homo sapiens
accuuggacauccucc

SEQ ID NO: 1357392 - RNA, 19 nt, Homo sapiens
accuuguauaaauuauuca

SEQ ID NO: 1357393 - RNA, 17 nt, Homo sapiens
accuugucccagccagu

SEQ ID NO: 1357394 - RNA, 13 nt, Homo sapiens
accuugugccugg

SEQ ID NO: 1357395 - RNA, 15 nt, Homo sapiens
accuuuagugccaac

SEQ ID NO: 1357396 - RNA, 19 nt, Homo sapiens
acgacuguggugugcagug

SEQ ID NO: 1357397 - RNA, 16 nt, Homo sapiens
acgccuguaauccuag

SEQ ID NO: 1357398 - RNA, 13 nt, Homo sapiens
acgcuaccaaauc

SEQ ID NO: 1357399 - RNA, 17 nt, Homo sapiens
acgcuaccaaaucucaa

SEQ ID NO: 1357400 - RNA, 14 nt, Homo sapiens
acggaggccugcga

SEQ ID NO: 1357401 - RNA, 20 nt, Homo sapiens
acggcucacgcuuaccucaa

SEQ ID NO: 1357402 - RNA, 18 nt, Homo sapiens
acggucuccugacuggug

SEQ ID NO: 1357403 - RNA, 20 nt, Homo sapiens
acgugauccucucaccucag

SEQ ID NO: 1357404 - RNA, 17 nt, Homo sapiens
acguggccucuugagca

SEQ ID NO: 1357405 - RNA, 20 nt, Homo sapiens
acguggccucuugagcagug

SEQ ID NO: 1357406 - RNA, 18 nt, Homo sapiens
acuaaaguaucugagauu

SEQ ID NO: 1357407 - RNA, 18 nt, Homo sapiens
acuaaauuugaacuuaaa

SEQ ID NO: 1357408 - RNA, 18 nt, Homo sapiens
acuaaccuggguucccuu

SEQ ID NO: 1357409 - RNA, 20 nt, Homo sapiens
acuaauuauacuacuuuguu

SEQ ID NO: 1357410 - RNA, 15 nt, Homo sapiens
acuaauuuuacaugu

SEQ ID NO: 1357411 - RNA, 17 nt, Homo sapiens
acuacaaacacaauauu

SEQ ID NO: 1357412 - RNA, 17 nt, Homo sapiens
acuacaggcaccugcca

SEQ ID NO: 1357413 - RNA, 15 nt, Homo sapiens
acuacugacaugugg

SEQ ID NO: 1357414 - RNA, 19 nt, Homo sapiens
acuagagucugaacagcug

SEQ ID NO: 1357415 - RNA, 21 nt, Homo sapiens
acuagguaggcuucuaccugc

SEQ ID NO: 1357416 - RNA, 22 nt, Homo sapiens
acuauagagaaccaagugaccg

SEQ ID NO: 1357417 - RNA, 15 nt, Homo sapiens
auaaugcucacuugg

SEQ ID NO: 1357418 - RNA, 13 nt, Homo sapiens
auaauuaauuacu

SEQ ID NO: 1357419 - RNA, 15 nt, Homo sapiens
auaauuauuacaugg

SEQ ID NO: 1357420 - RNA, 15 nt, Homo sapiens
auaauugcuuugcca

SEQ ID NO: 1357421 - RNA, 17 nt, Homo sapiens
auacaaaaauacucaga

SEQ ID NO: 1357422 - RNA, 14 nt, Homo sapiens
auacaaaacccuuu

SEQ ID NO: 1357423 - RNA, 18 nt, Homo sapiens
auacacuaaaaaucugag

SEQ ID NO: 1357424 - RNA, 17 nt, Homo sapiens
auacagaauuacuguaa

SEQ ID NO: 1357425 - RNA, 14 nt, Homo sapiens
auacaguaucucag

SEQ ID NO: 1357426 - RNA, 19 nt, Homo sapiens
auacaugcuuugaaguuuc

SEQ ID NO: 1357427 - RNA, 16 nt, Homo sapiens
auaccagagccuucaa

SEQ ID NO: 1357428 - RNA, 23 nt, Homo sapiens
auaccagagccuucaagugccaa

SEQ ID NO: 1357429 - RNA, 16 nt, Homo sapiens
auaccagguuaccuca

SEQ ID NO: 1357430 - RNA, 20 nt, Homo sapiens
auacccuguugaggugugaa

SEQ ID NO: 1357431 - RNA, 23 nt, Homo sapiens
auaccgggaacaugaagccaggu

SEQ ID NO: 1357432 - RNA, 22 nt, Homo sapiens
auaccuccucccuaaugcucac

SEQ ID NO: 1357433 - RNA, 17 nt, Homo sapiens
auacuugaagggccaga

SEQ ID NO: 1357434 - RNA, 18 nt, Homo sapiens
auacuugguucucuccac

SEQ ID NO: 1357435 - RNA, 16 nt, Homo sapiens
auacuuugcaauccaa

SEQ ID NO: 1357436 - RNA, 13 nt, Homo sapiens
auagaaaccucuc

SEQ ID NO: 1357437 - RNA, 14 nt, Homo sapiens
auagaaaugccaag

SEQ ID NO: 1357438 - RNA, 22 nt, Homo sapiens
auagaacuaaaguaucugagau

SEQ ID NO: 1357439 - RNA, 12 nt, Homo sapiens
auagaccaaaga

SEQ ID NO: 1357440 - RNA, 23 nt, Homo sapiens
auagaucagcaaaccggggccua

SEQ ID NO: 1357441 - RNA, 15 nt, Homo sapiens
auagaugcuguguau

SEQ ID NO: 1357442 - RNA, 14 nt, Homo sapiens
auaguauugugcau

SEQ ID NO: 1357443 - RNA, 18 nt, Homo sapiens
auagucuuugccagucau

SEQ ID NO: 1357444 - RNA, 16 nt, Homo sapiens
auagucuuuugccaga

SEQ ID NO: 1357445 - RNA, 19 nt, Homo sapiens
auauaaaguaguccuguga

SEQ ID NO: 1357446 - RNA, 19 nt, Homo sapiens
auauacuugguucucucca

SEQ ID NO: 1357447 - RNA, 20 nt, Homo sapiens
auauacuugguucucuccac

SEQ ID NO: 1357448 - RNA, 14 nt, Homo sapiens
auauauacuauuaa

SEQ ID NO: 1357449 - RNA, 14 nt, Homo sapiens
auauauuuuaucuc

SEQ ID NO: 1357450 - RNA, 22 nt, Homo sapiens
auauccaacaugugcucaggga

SEQ ID NO: 1357451 - RNA, 14 nt, Homo sapiens
auauccucccucca

SEQ ID NO: 1357452 - RNA, 13 nt, Homo sapiens
auaugaacauaua

SEQ ID NO: 1357453 - RNA, 11 nt, Homo sapiens
auaugcaauau

SEQ ID NO: 1357454 - RNA, 22 nt, Homo sapiens
auauguaucuaaaccauaugaa

SEQ ID NO: 1357455 - RNA, 19 nt, Homo sapiens
auaugugaaauuaauacac

SEQ ID NO: 1357456 - RNA, 21 nt, Homo sapiens
auauuaaggaagacaauguga

SEQ ID NO: 1357457 - RNA, 17 nt, Homo sapiens
auauucagaaaaugaag

SEQ ID NO: 1357458 - RNA, 23 nt, Homo sapiens
auauuguucuuguaagcuuuaac

SEQ ID NO: 1357459 - RNA, 22 nt, Homo sapiens
auauuuaacuggugcacuuugu

SEQ ID NO: 1357460 - RNA, 17 nt, Homo sapiens
auauuuaccagaccaca

SEQ ID NO: 1357461 - RNA, 19 nt, Homo sapiens
auauuugggccugcuccag

SEQ ID NO: 1357462 - RNA, 19 nt, Homo sapiens
auauuuuuuaaaaaacacu

SEQ ID NO: 1357463 - RNA, 16 nt, Homo sapiens
aucacagccucugaaa

SEQ ID NO: 1357464 - RNA, 13 nt, Homo sapiens
aucacagcugcca

SEQ ID NO: 1357465 - RNA, 19 nt, Homo sapiens
aucacagucucaguucucu

SEQ ID NO: 1357466 - RNA, 20 nt, Homo sapiens
aucacaugugcccucugcca

SEQ ID NO: 1357467 - RNA, 19 nt, Homo sapiens
aucacauucgaguguuuca

SEQ ID NO: 1357468 - RNA, 18 nt, Homo sapiens
aucaccuuaggcagggaa

SEQ ID NO: 1357469 - RNA, 17 nt, Homo sapiens
aucagccugcuccagcu

SEQ ID NO: 1357470 - RNA, 16 nt, Homo sapiens
aucagcuuaggggcug

SEQ ID NO: 1357471 - RNA, 21 nt, Homo sapiens
aucaggacagguggugcaaau

SEQ ID NO: 1357472 - RNA, 21 nt, Homo sapiens
aucauuuguuuacauuugaug

SEQ ID NO: 1357473 - RNA, 15 nt, Homo sapiens
aucccaguucuuccu

SEQ ID NO: 1357474 - RNA, 19 nt, Homo sapiens
auccccuccguggcaucac

SEQ ID NO: 1357475 - RNA, 19 nt, Homo sapiens
aucccgccgauagagggac

SEQ ID NO: 1357476 - RNA, 14 nt, Homo sapiens
auccuaaucaucca

SEQ ID NO: 1357477 - RNA, 15 nt, Homo sapiens
auccuacagugaaau

SEQ ID NO: 1357478 - RNA, 22 nt, Homo sapiens
auccuacuguaauaaagaugau

SEQ ID NO: 1357479 - RNA, 21 nt, Homo sapiens
auccuagcacuugucucagga

SEQ ID NO: 1357480 - RNA, 15 nt, Homo sapiens
auccuagcacuuugg

SEQ ID NO: 1357481 - RNA, 15 nt, Homo sapiens
auccuaggcauuugc

SEQ ID NO: 1357482 - RNA, 20 nt, Homo sapiens
auccucucuaucacaucccc

SEQ ID NO: 1357483 - RNA, 21 nt, Homo sapiens
auccucuugccaaaucaaaag

SEQ ID NO: 1357484 - RNA, 13 nt, Homo sapiens
auccuucuacuug

SEQ ID NO: 1357485 - RNA, 15 nt, Homo sapiens
aucgcugucaucuca

SEQ ID NO: 1357486 - RNA, 22 nt, Homo sapiens
aucgcugucaucucagcuggau

SEQ ID NO: 1357487 - RNA, 19 nt, Homo sapiens
aucggcuggggacugcuac

SEQ ID NO: 1357488 - RNA, 16 nt, Homo sapiens
aucggcuuugcagugc

SEQ ID NO: 1357489 - RNA, 22 nt, Homo sapiens
aucgucuaaacuuuagaauuaa

SEQ ID NO: 1357490 - RNA, 22 nt, Homo sapiens
aucuacuccuuguaaagacugu

SEQ ID NO: 1357491 - RNA, 16 nt, Homo sapiens
aucuaugauaugcuaa

SEQ ID NO: 1357492 - RNA, 19 nt, Homo sapiens
aucucagcuggaucuccau

SEQ ID NO: 1357493 - RNA, 13 nt, Homo sapiens
aucuccugaccuc

SEQ ID NO: 1357494 - RNA, 22 nt, Homo sapiens
aucucugauucugucaaugucu

SEQ ID NO: 1357495 - RNA, 17 nt, Homo sapiens
aucucugccauaucagu

SEQ ID NO: 1357496 - RNA, 22 nt, Homo sapiens
aucucugcuuuggaaaucacac

SEQ ID NO: 1357497 - RNA, 13 nt, Homo sapiens
aucugaccaaaac

SEQ ID NO: 1357498 - RNA, 21 nt, Homo sapiens
aucugagcacgcuaccaaauc

SEQ ID NO: 1357499 - RNA, 20 nt, Homo sapiens
aucugaguugacuugacaga

SEQ ID NO: 1357500 - RNA, 22 nt, Homo sapiens
aucuggcuuagugccacccacc

SEQ ID NO: 1357501 - RNA, 22 nt, Homo sapiens
aucugggcuaccccacccaagu

SEQ ID NO: 1357502 - RNA, 19 nt, Homo sapiens
aucuguucuaugcuuccuc

SEQ ID NO: 1357503 - RNA, 14 nt, Homo sapiens
aucuuaagauucca

SEQ ID NO: 1357504 - RNA, 17 nt, Homo sapiens
aucuuaagauuccauuu

SEQ ID NO: 1357505 - RNA, 16 nt, Homo sapiens
aucuugaauagucuca

SEQ ID NO: 1357506 - RNA, 18 nt, Homo sapiens
aucuugaauagucucauc

SEQ ID NO: 1357507 - RNA, 16 nt, Homo sapiens
aucuuucugauuccgc

SEQ ID NO: 1357508 - RNA, 23 nt, Homo sapiens
aucuuugggccuuuccucagugu

SEQ ID NO: 1357509 - RNA, 12 nt, Homo sapiens
aucuuuguauau

SEQ ID NO: 1357510 - RNA, 18 nt, Homo sapiens
aucuuuguauauuacaua

SEQ ID NO: 1357511 - RNA, 19 nt, Homo sapiens
augaaaaaacggucugccg

SEQ ID NO: 1357512 - RNA, 16 nt, Homo sapiens
augaaauguaaauacu

SEQ ID NO: 1357513 - RNA, 20 nt, Homo sapiens
augaaauuauaaucugugga

SEQ ID NO: 1357514 - RNA, 16 nt, Homo sapiens
augaaauugcugaaag

SEQ ID NO: 1357515 - RNA, 18 nt, Homo sapiens
augaaguuaugcugucau

SEQ ID NO: 1357516 - RNA, 17 nt, Homo sapiens
augaccgucugagccca

SEQ ID NO: 1357517 - RNA, 23 nt, Homo sapiens
augagaaaacaggcucacagaga

SEQ ID NO: 1357518 - RNA, 16 nt, Homo sapiens
augagacucagugcag

SEQ ID NO: 1357519 - RNA, 13 nt, Homo sapiens
augaguggaauac

SEQ ID NO: 1357520 - RNA, 21 nt, Homo sapiens
augaguguaguugaugacugu

SEQ ID NO: 1357521 - RNA, 16 nt, Homo sapiens
augaguuaacugugaa

SEQ ID NO: 1357522 - RNA, 15 nt, Homo sapiens
augauaaaauacuaa

SEQ ID NO: 1357523 - RNA, 14 nt, Homo sapiens
augaucaaggugaa

SEQ ID NO: 1357524 - RNA, 18 nt, Homo sapiens
augauccuaaugaaugca

SEQ ID NO: 1357525 - RNA, 22 nt, Homo sapiens
augauccuaaugaaugcauaaa

SEQ ID NO: 1357526 - RNA, 22 nt, Homo sapiens
augauccuaggcauuugcugaa

SEQ ID NO: 1357527 - RNA, 13 nt, Homo sapiens
augaucuuuucaa

SEQ ID NO: 1357528 - RNA, 18 nt, Homo sapiens
augaugcuagccagcaaa

SEQ ID NO: 1357529 - RNA, 15 nt, Homo sapiens
augcaacaacaugua

SEQ ID NO: 1357530 - RNA, 21 nt, Homo sapiens
augcaagcaagaaacacuggg

SEQ ID NO: 1357531 - RNA, 19 nt, Homo sapiens
augcagcagggaugcccug

SEQ ID NO: 1357532 - RNA, 12 nt, Homo sapiens
augcaguuucau

SEQ ID NO: 1357533 - RNA, 17 nt, Homo sapiens
gauagccuguuacagga

SEQ ID NO: 1357534 - RNA, 17 nt, Homo sapiens
gauaguggggucagggc

SEQ ID NO: 1357535 - RNA, 18 nt, Homo sapiens
gauauccucccuccagau

SEQ ID NO: 1357536 - RNA, 23 nt, Homo sapiens
gaucacagccucugaaaaccaau

SEQ ID NO: 1357537 - RNA, 20 nt, Homo sapiens
gaucagccugggcaauguga

SEQ ID NO: 1357538 - RNA, 17 nt, Homo sapiens
gaucaucuaauucucug

SEQ ID NO: 1357539 - RNA, 19 nt, Homo sapiens
gaucaugaaucacugcacc

SEQ ID NO: 1357540 - RNA, 19 nt, Homo sapiens
gauccuccaacagcuguca

SEQ ID NO: 1357541 - RNA, 18 nt, Homo sapiens
gauccuccccgacugugg

SEQ ID NO: 1357542 - RNA, 19 nt, Homo sapiens
gaucuggaacccagacuca

SEQ ID NO: 1357543 - RNA, 17 nt, Homo sapiens
gaucuggucccuugcag

SEQ ID NO: 1357544 - RNA, 17 nt, Homo sapiens
gaucuugaauagucuca

SEQ ID NO: 1357545 - RNA, 18 nt, Homo sapiens
gaucuugcucucggugcu

SEQ ID NO: 1357546 - RNA, 18 nt, Homo sapiens
gaucuuuguauauuacau

SEQ ID NO: 1357547 - RNA, 16 nt, Homo sapiens
gaugauaaaacacaaa

SEQ ID NO: 1357548 - RNA, 16 nt, Homo sapiens
gaugccagggacccac

SEQ ID NO: 1357549 - RNA, 13 nt, Homo sapiens
gauggauuuccag

SEQ ID NO: 1357550 - RNA, 21 nt, Homo sapiens
gaugguaucuggguaagaaga

SEQ ID NO: 1357551 - RNA, 17 nt, Homo sapiens
gauggucccuauuccuc

SEQ ID NO: 1357552 - RNA, 18 nt, Homo sapiens
gauguggcccuggcugcc

SEQ ID NO: 1357553 - RNA, 18 nt, Homo sapiens
gauguuuccaaugcugaa

SEQ ID NO: 1357554 - RNA, 23 nt, Homo sapiens
gauuaccuucauagagcuuugga

SEQ ID NO: 1357555 - RNA, 15 nt, Homo sapiens
gauucaggggucuga

SEQ ID NO: 1357556 - RNA, 16 nt, Homo sapiens
gauucaugcacuguag

SEQ ID NO: 1357557 - RNA, 22 nt, Homo sapiens
gauuccucggggauagaccaaa

SEQ ID NO: 1357558 - RNA, 18 nt, Homo sapiens
gauuugaaugaaaugcca

SEQ ID NO: 1357559 - RNA, 21 nt, Homo sapiens
gcaaaacucuacuuaauccaa

SEQ ID NO: 1357560 - RNA, 23 nt, Homo sapiens
gcaaaaucuguucuaacauguaa

SEQ ID NO: 1357561 - RNA, 14 nt, Homo sapiens
gcaaaccauuuuua

SEQ ID NO: 1357562 - RNA, 17 nt, Homo sapiens
gcaaagaucuguccuca

SEQ ID NO: 1357563 - RNA, 14 nt, Homo sapiens
gcaaaugacuguca

SEQ ID NO: 1357564 - RNA, 17 nt, Homo sapiens
gcaacaaaaauuacucu

SEQ ID NO: 1357565 - RNA, 14 nt, Homo sapiens
gcaagaaacacugg

SEQ ID NO: 1357566 - RNA, 15 nt, Homo sapiens
gcaagagaauuacuu

SEQ ID NO: 1357567 - RNA, 17 nt, Homo sapiens
gcaagagaauuacuuga

SEQ ID NO: 1357568 - RNA, 23 nt, Homo sapiens
gcaagguuuaggcugguggccca

SEQ ID NO: 1357569 - RNA, 21 nt, Homo sapiens
gcaauugaaggaucaucugaa

SEQ ID NO: 1357570 - RNA, 22 nt, Homo sapiens
gcacauuagccuaugugcaugc

SEQ ID NO: 1357571 - RNA, 16 nt, Homo sapiens
gcaccaccaagccaag

SEQ ID NO: 1357572 - RNA, 17 nt, Homo sapiens
gcaccccaaagcuuucc

SEQ ID NO: 1357573 - RNA, 15 nt, Homo sapiens
gcacugaaacauuau

SEQ ID NO: 1357574 - RNA, 13 nt, Homo sapiens
gcacuucaucuga

SEQ ID NO: 1357575 - RNA, 17 nt, Homo sapiens
gcacuuuuccuuuccaa

SEQ ID NO: 1357576 - RNA, 14 nt, Homo sapiens
gcagacagugcaca

SEQ ID NO: 1357577 - RNA, 18 nt, Homo sapiens
gcagaccccucuaccucc

SEQ ID NO: 1357578 - RNA, 17 nt, Homo sapiens
gcagagcaaaaggggaa

SEQ ID NO: 1357579 - RNA, 23 nt, Homo sapiens
gcagcaucccuagucucuaccca

SEQ ID NO: 1357580 - RNA, 16 nt, Homo sapiens
gcagccacaaccaaaa

SEQ ID NO: 1357581 - RNA, 13 nt, Homo sapiens
gcagcccaugccc

SEQ ID NO: 1357582 - RNA, 14 nt, Homo sapiens
gcagcccaugccca

SEQ ID NO: 1357583 - RNA, 18 nt, Homo sapiens
gcagccuggggucugaca

SEQ ID NO: 1357584 - RNA, 19 nt, Homo sapiens
gcagccuggggucugacaa

SEQ ID NO: 1357585 - RNA, 14 nt, Homo sapiens
gcagcugugucuga

SEQ ID NO: 1357586 - RNA, 17 nt, Homo sapiens
gcaggagaauugcuuga

SEQ ID NO: 1357587 - RNA, 12 nt, Homo sapiens
gcaggugcgauu

SEQ ID NO: 1357588 - RNA, 13 nt, Homo sapiens
gcagucacagcua

SEQ ID NO: 1357589 - RNA, 17 nt, Homo sapiens
gcagucgugccuguguc

SEQ ID NO: 1357590 - RNA, 15 nt, Homo sapiens
gcagugaugcuggau

SEQ ID NO: 1357591 - RNA, 21 nt, Homo sapiens
gcagugaugcuggaugcuccu

SEQ ID NO: 1357592 - RNA, 11 nt, Homo sapiens
gcaguggugcu

SEQ ID NO: 1357593 - RNA, 22 nt, Homo sapiens
gcaguguaacccaagcauuugu

SEQ ID NO: 1357594 - RNA, 13 nt, Homo sapiens
gcaguuguccuga

SEQ ID NO: 1357595 - RNA, 16 nt, Homo sapiens
gcauaaaaacauuuua

SEQ ID NO: 1357596 - RNA, 18 nt, Homo sapiens
gcauagaguucagacuuu

SEQ ID NO: 1357597 - RNA, 16 nt, Homo sapiens
gcaucacagaauguga

SEQ ID NO: 1357598 - RNA, 13 nt, Homo sapiens
gcaucaucugcac

SEQ ID NO: 1357599 - RNA, 19 nt, Homo sapiens
gcaucaucugcacugccca

SEQ ID NO: 1357600 - RNA, 22 nt, Homo sapiens
gcauccgaaaccagcaucugca

SEQ ID NO: 1357601 - RNA, 22 nt, Homo sapiens
gcauccucuuuuuccaacuugg

SEQ ID NO: 1357602 - RNA, 17 nt, Homo sapiens
gcaugaagguuucugaa

SEQ ID NO: 1357603 - RNA, 14 nt, Homo sapiens
gcaugacauuggca

SEQ ID NO: 1357604 - RNA, 12 nt, Homo sapiens
gcaugcggccca

SEQ ID NO: 1357605 - RNA, 23 nt, Homo sapiens
gcauggcuuuggcuuugcaaaau

SEQ ID NO: 1357606 - RNA, 12 nt, Homo sapiens
gcaugugcugca

SEQ ID NO: 1357607 - RNA, 20 nt, Homo sapiens
gcauucuuaacaaacucuuc

SEQ ID NO: 1357608 - RNA, 21 nt, Homo sapiens
gcauucuuaacaaacucuuca

SEQ ID NO: 1357609 - RNA, 15 nt, Homo sapiens
gcauugauccaggag

SEQ ID NO: 1357610 - RNA, 14 nt, Homo sapiens
gccaacccuuucau

SEQ ID NO: 1357611 - RNA, 11 nt, Homo sapiens
gccaaggagcu

SEQ ID NO: 1357612 - RNA, 11 nt, Homo sapiens
gccacaaccaa

SEQ ID NO: 1357613 - RNA, 23 nt, Homo sapiens
gccacugagaagugcacuuuaag

SEQ ID NO: 1357614 - RNA, 13 nt, Homo sapiens
gccagaacuugac

SEQ ID NO: 1357615 - RNA, 19 nt, Homo sapiens
gccagacaugccacaagga

SEQ ID NO: 1357616 - RNA, 18 nt, Homo sapiens
gccagcccaacugugaga

SEQ ID NO: 1357617 - RNA, 15 nt, Homo sapiens
gccagcugcacugau

SEQ ID NO: 1357618 - RNA, 11 nt, Homo sapiens
gccaggagcuc

SEQ ID NO: 1357619 - RNA, 23 nt, Homo sapiens
gccaggucacccuuugcugugag

SEQ ID NO: 1357620 - RNA, 12 nt, Homo sapiens
gccagugacaga

SEQ ID NO: 1357621 - RNA, 11 nt, Homo sapiens
gccagugcaga

SEQ ID NO: 1357622 - RNA, 14 nt, Homo sapiens
gccauugcacucca

SEQ ID NO: 1357623 - RNA, 18 nt, Homo sapiens
gccauugcacuccagccu

SEQ ID NO: 1357624 - RNA, 17 nt, Homo sapiens
gcccagcuauuaccaca

SEQ ID NO: 1357625 - RNA, 17 nt, Homo sapiens
gcccaggauggcuuuga

SEQ ID NO: 1357626 - RNA, 20 nt, Homo sapiens
gcccaggcuggagugcagug

SEQ ID NO: 1357627 - RNA, 12 nt, Homo sapiens
gcccagugcaug

SEQ ID NO: 1357628 - RNA, 19 nt, Homo sapiens
gcccagugcaugguggcca

SEQ ID NO: 1357629 - RNA, 19 nt, Homo sapiens
gcccaugcccaccugccca

SEQ ID NO: 1357630 - RNA, 13 nt, Homo sapiens
gccccacaugucc

SEQ ID NO: 1357631 - RNA, 22 nt, Homo sapiens
gccccacauguccagcaccuug

SEQ ID NO: 1357632 - RNA, 15 nt, Homo sapiens
gccccaggaagccgu

SEQ ID NO: 1357633 - RNA, 15 nt, Homo sapiens
gccccaugccugucc

SEQ ID NO: 1357634 - RNA, 17 nt, Homo sapiens
gcccccagcugugaccg

SEQ ID NO: 1357635 - RNA, 18 nt, Homo sapiens
gccccucuuccaaaggca

SEQ ID NO: 1357636 - RNA, 22 nt, Homo sapiens
gccccucuuccaaaggcagcgu

SEQ ID NO: 1357637 - RNA, 22 nt, Homo sapiens
gccccucuuccccaaugcucca

SEQ ID NO: 1357638 - RNA, 16 nt, Homo sapiens
gccccuggcacucuug

SEQ ID NO: 1357639 - RNA, 15 nt, Homo sapiens
gcccggacugaccaa

SEQ ID NO: 1357640 - RNA, 19 nt, Homo sapiens
gcccuguaacaggcuugaa

SEQ ID NO: 1357641 - RNA, 16 nt, Homo sapiens
gccgggcugacugccc

SEQ ID NO: 1357642 - RNA, 16 nt, Homo sapiens
gccgucaaaagguaaa

SEQ ID NO: 1357643 - RNA, 15 nt, Homo sapiens
gccuagacuguuacu

SEQ ID NO: 1357644 - RNA, 15 nt, Homo sapiens
gccucaaugccagua

SEQ ID NO: 1357645 - RNA, 14 nt, Homo sapiens
gccucacuccucag

SEQ ID NO: 1357646 - RNA, 16 nt, Homo sapiens
gccucagccuccugag

SEQ ID NO: 1357647 - RNA, 20 nt, Homo sapiens
gccuccugugacuggcagca

SEQ ID NO: 1357648 - RNA, 13 nt, Homo sapiens
gccucuacuuuau

SEQ ID NO: 1357649 - RNA, 23 nt, Homo sapiens
gccucuuugugugcgucacugug

SEQ ID NO: 1357650 - RNA, 17 nt, Homo sapiens
uaaagccucugugcugc

SEQ ID NO: 1357651 - RNA, 18 nt, Homo sapiens
uaaaguaguccugugaau

SEQ ID NO: 1357652 - RNA, 14 nt, Homo sapiens
uaaagucuugccuu

SEQ ID NO: 1357653 - RNA, 13 nt, Homo sapiens
uaaauaaauggaa

SEQ ID NO: 1357654 - RNA, 13 nt, Homo sapiens
uaaauacauuuau

SEQ ID NO: 1357655 - RNA, 13 nt, Homo sapiens
uaaauauccaggu

SEQ ID NO: 1357656 - RNA, 18 nt, Homo sapiens
uaaauauuuuucacauaa

SEQ ID NO: 1357657 - RNA, 14 nt, Homo sapiens
uaaaucaaugcuau

SEQ ID NO: 1357658 - RNA, 16 nt, Homo sapiens
uaaaucuuuucaauua

SEQ ID NO: 1357659 - RNA, 21 nt, Homo sapiens
uaaaugugaaugaugauccua

SEQ ID NO: 1357660 - RNA, 12 nt, Homo sapiens
uaaaugugccua

SEQ ID NO: 1357661 - RNA, 15 nt, Homo sapiens
uaaauuccacagauu

SEQ ID NO: 1357662 - RNA, 19 nt, Homo sapiens
uaaauuccacagauuauca

SEQ ID NO: 1357663 - RNA, 21 nt, Homo sapiens
uaacagcggcaggguguccca

SEQ ID NO: 1357664 - RNA, 19 nt, Homo sapiens
uaacauuuaaauuccacag

SEQ ID NO: 1357665 - RNA, 22 nt, Homo sapiens
uaacauuuaaauuccacagauu

SEQ ID NO: 1357666 - RNA, 23 nt, Homo sapiens
uaacauuuguguaauaugaaaua

SEQ ID NO: 1357667 - RNA, 14 nt, Homo sapiens
uaaccucugcacua

SEQ ID NO: 1357668 - RNA, 18 nt, Homo sapiens
uaaccucugcacuacuga

SEQ ID NO: 1357669 - RNA, 14 nt, Homo sapiens
uaacuauguugaua

SEQ ID NO: 1357670 - RNA, 14 nt, Homo sapiens
uaacuauuucuuca

SEQ ID NO: 1357671 - RNA, 19 nt, Homo sapiens
uaacugauuaccugccaau

SEQ ID NO: 1357672 - RNA, 20 nt, Homo sapiens
uaacugugaaauaccacaag

SEQ ID NO: 1357673 - RNA, 23 nt, Homo sapiens
uaacuguuaaggagcuucaggga

SEQ ID NO: 1357674 - RNA, 22 nt, Homo sapiens
uaacuucucccaaaguguccua

SEQ ID NO: 1357675 - RNA, 17 nt, Homo sapiens
uaagaaaaaugagcaua

SEQ ID NO: 1357676 - RNA, 22 nt, Homo sapiens
uaagaaaaauuuguauacuaau

SEQ ID NO: 1357677 - RNA, 15 nt, Homo sapiens
uaagaaacacacuga

SEQ ID NO: 1357678 - RNA, 18 nt, Homo sapiens
uaagacaacaggcauuuu

SEQ ID NO: 1357679 - RNA, 13 nt, Homo sapiens
uaagaccuggcag

SEQ ID NO: 1357680 - RNA, 15 nt, Homo sapiens
uaagagacacuccaa

SEQ ID NO: 1357681 - RNA, 14 nt, Homo sapiens
uaagauaugcauua

SEQ ID NO: 1357682 - RNA, 21 nt, Homo sapiens
uaagccccgucugaccccagc

SEQ ID NO: 1357683 - RNA, 22 nt, Homo sapiens
uaagcugcucggagcucagugc

SEQ ID NO: 1357684 - RNA, 17 nt, Homo sapiens
uaaggcguggcuucugc

SEQ ID NO: 1357685 - RNA, 21 nt, Homo sapiens
uaagggguugguaucucaggu

SEQ ID NO: 1357686 - RNA, 18 nt, Homo sapiens
uaaguaaccucuacaggc

SEQ ID NO: 1357687 - RNA, 23 nt, Homo sapiens
uaaguaaccucuacaggcauuua

SEQ ID NO: 1357688 - RNA, 15 nt, Homo sapiens
uaagugcaacugcaa

SEQ ID NO: 1357689 - RNA, 14 nt, Homo sapiens
uaagugcaugacau

SEQ ID NO: 1357690 - RNA, 19 nt, Homo sapiens
uaaguuagggaauggcaca

SEQ ID NO: 1357691 - RNA, 19 nt, Homo sapiens
uaaguugauggugaugaaa

SEQ ID NO: 1357692 - RNA, 16 nt, Homo sapiens
uaauagucuuugccag

SEQ ID NO: 1357693 - RNA, 19 nt, Homo sapiens
uaauauggggaugcagcau

SEQ ID NO: 1357694 - RNA, 21 nt, Homo sapiens
uaauauuccaggaugcugcug

SEQ ID NO: 1357695 - RNA, 18 nt, Homo sapiens
uaauccaggcagauccag

SEQ ID NO: 1357696 - RNA, 23 nt, Homo sapiens
uaaucccgauucacccuguccaa

SEQ ID NO: 1357697 - RNA, 19 nt, Homo sapiens
uaaugagaauuccuuagca

SEQ ID NO: 1357698 - RNA, 14 nt, Homo sapiens
uaauguauucccua

SEQ ID NO: 1357699 - RNA, 22 nt, Homo sapiens
uaauuaagcauuuugugauguu

SEQ ID NO: 1357700 - RNA, 14 nt, Homo sapiens
uaauuccacuuuaa

SEQ ID NO: 1357701 - RNA, 16 nt, Homo sapiens
uaauugcuuugccaaa

SEQ ID NO: 1357702 - RNA, 18 nt, Homo sapiens
uaauuguacuaaagccaa

SEQ ID NO: 1357703 - RNA, 15 nt, Homo sapiens
uaauuguauuucaaa

SEQ ID NO: 1357704 - RNA, 14 nt, Homo sapiens
uaauuuaugcagaa

SEQ ID NO: 1357705 - RNA, 16 nt, Homo sapiens
uaauuuuuaacuuauu

SEQ ID NO: 1357706 - RNA, 20 nt, Homo sapiens
uacaaaaauuagcugggcau

SEQ ID NO: 1357707 - RNA, 12 nt, Homo sapiens
uacaaacaugug

SEQ ID NO: 1357708 - RNA, 17 nt, Homo sapiens
uacaaagaaaaagccaa

SEQ ID NO: 1357709 - RNA, 18 nt, Homo sapiens
uacaauaaaaacauugcc

SEQ ID NO: 1357710 - RNA, 20 nt, Homo sapiens
uacacacauauauauuacaa

SEQ ID NO: 1357711 - RNA, 16 nt, Homo sapiens
uacacacgcacacagu

SEQ ID NO: 1357712 - RNA, 21 nt, Homo sapiens
uacacacucagugacauuucu

SEQ ID NO: 1357713 - RNA, 18 nt, Homo sapiens
uacacacuugcaugacaa

SEQ ID NO: 1357714 - RNA, 19 nt, Homo sapiens
uacacaguaagucauuuaa

SEQ ID NO: 1357715 - RNA, 21 nt, Homo sapiens
uacacggaggucucuguaaaa

SEQ ID NO: 1357716 - RNA, 23 nt, Homo sapiens
uacaggaagcaccccaugccaaa

SEQ ID NO: 1357717 - RNA, 15 nt, Homo sapiens
uacaggcagcacaga

SEQ ID NO: 1357718 - RNA, 16 nt, Homo sapiens
uacaguaaauguuugu

SEQ ID NO: 1357719 - RNA, 14 nt, Homo sapiens
uacaguuuaucuau

SEQ ID NO: 1357720 - RNA, 22 nt, Homo sapiens
uacauauuaaaggaagcacucu

SEQ ID NO: 1357721 - RNA, 21 nt, Homo sapiens
uacaucuuaaaucuuuucaau

SEQ ID NO: 1357722 - RNA, 18 nt, Homo sapiens
uacaugcagcccaugccc

SEQ ID NO: 1357723 - RNA, 16 nt, Homo sapiens
uacaugcuggggucaa

SEQ ID NO: 1357724 - RNA, 15 nt, Homo sapiens
uacauguggcccaac

SEQ ID NO: 1357725 - RNA, 21 nt, Homo sapiens
uacauguuuauaaaucuuaug

SEQ ID NO: 1357726 - RNA, 21 nt, Homo sapiens
uacauuccaacucguauagca

SEQ ID NO: 1357727 - RNA, 22 nt, Homo sapiens
uacauuguucuuauucuggcau

SEQ ID NO: 1357728 - RNA, 20 nt, Homo sapiens
uacauuucugcagaucuucc

SEQ ID NO: 1357729 - RNA, 20 nt, Homo sapiens
uacauuuugaaggugaugca

SEQ ID NO: 1357730 - RNA, 21 nt, Homo sapiens
uacauuuugaaggugaugcau

SEQ ID NO: 1357731 - RNA, 13 nt, Homo sapiens
uaccaacuuuuag

SEQ ID NO: 1357732 - RNA, 18 nt, Homo sapiens
uaccaaugcuuacgucaa

SEQ ID NO: 1357733 - RNA, 16 nt, Homo sapiens
uaccacaguggaugua

SEQ ID NO: 1357734 - RNA, 13 nt, Homo sapiens
uaccacucuggca

SEQ ID NO: 1357735 - RNA, 15 nt, Homo sapiens
uaccagagacucuga

SEQ ID NO: 1357736 - RNA, 16 nt, Homo sapiens
uaccagguuaccucac

SEQ ID NO: 1357737 - RNA, 15 nt, Homo sapiens
uacccagagaccaag

SEQ ID NO: 1357738 - RNA, 23 nt, Homo sapiens
uacccagagaccaagaucaucaa

SEQ ID NO: 1357739 - RNA, 17 nt, Homo sapiens
uacccaguagaugccac

SEQ ID NO: 1357740 - RNA, 18 nt, Homo sapiens
uacccucacuuaaacuuu

SEQ ID NO: 1357741 - RNA, 19 nt, Homo sapiens
uaccuaccaagauauaccu

SEQ ID NO: 1357742 - RNA, 21 nt, Homo sapiens
uaccuagcaaagcuccugccu

SEQ ID NO: 1357743 - RNA, 20 nt, Homo sapiens
uaccucugagaagacacaag

SEQ ID NO: 1357744 - RNA, 14 nt, Homo sapiens
uacgcaucagacag

SEQ ID NO: 1357745 - RNA, 20 nt, Homo sapiens
uacuagagcgacugaggcag

SEQ ID NO: 1357746 - RNA, 22 nt, Homo sapiens
uacuaguuuuaguuuucucuua

SEQ ID NO: 1357747 - RNA, 14 nt, Homo sapiens
uacuaucaugucaa

SEQ ID NO: 1357748 - RNA, 13 nt, Homo sapiens
uacucagcauuug

SEQ ID NO: 1357749 - RNA, 19 nt, Homo sapiens
uacucaguggacagugcug

SEQ ID NO: 1357750 - RNA, 21 nt, Homo sapiens
uacugaaaaggaggggucugg

SEQ ID NO: 1357751 - RNA, 17 nt, Homo sapiens
uacugaucuuuguauau

SEQ ID NO: 1357752 - RNA, 21 nt, Homo sapiens
uacugcaagguucaacuuauu

SEQ ID NO: 1357753 - RNA, 23 nt, Homo sapiens
uacugcagcuuuguuuguuguca

SEQ ID NO: 1357754 - RNA, 13 nt, Homo sapiens
uacugcugugagc

SEQ ID NO: 1357755 - RNA, 14 nt, Homo sapiens
uacuugaaggucua

SEQ ID NO: 1357756 - RNA, 20 nt, Homo sapiens
uacuugagaggcugaggcaa

SEQ ID NO: 1357757 - RNA, 17 nt, Homo sapiens
uacuuuaaaaugccaau

SEQ ID NO: 1357758 - RNA, 15 nt, Homo sapiens
uacuuuguuaggauu

SEQ ID NO: 1357759 - RNA, 12 nt, Homo sapiens
uagaaaaaccac

SEQ ID NO: 1357760 - RNA, 19 nt, Homo sapiens
uagaaagcugacauugcca

SEQ ID NO: 1357761 - RNA, 13 nt, Homo sapiens
uagaaccaggcaa

SEQ ID NO: 1357762 - RNA, 13 nt, Homo sapiens
uagaagucagcca

SEQ ID NO: 1357763 - RNA, 15 nt, Homo sapiens
uagaaugcaucucau

SEQ ID NO: 1357764 - RNA, 17 nt, Homo sapiens
uagaauuauaucacuuc

SEQ ID NO: 1357765 - RNA, 13 nt, Homo sapiens
uagacaauuugca

SEQ ID NO: 1357766 - RNA, 16 nt, Homo sapiens
ugacuguucuugguaa

SEQ ID NO: 1357767 - RNA, 16 nt, Homo sapiens
ugagaaaacaggcuca

SEQ ID NO: 1357768 - RNA, 22 nt, Homo sapiens
ugagaaacucuacauguaacua

SEQ ID NO: 1357769 - RNA, 16 nt, Homo sapiens
ugagacccugucucaa

SEQ ID NO: 1357770 - RNA, 13 nt, Homo sapiens
ugagagaaccuca

SEQ ID NO: 1357771 - RNA, 12 nt, Homo sapiens
ugagagcccuuu

SEQ ID NO: 1357772 - RNA, 14 nt, Homo sapiens
ugagauacauacag

SEQ ID NO: 1357773 - RNA, 15 nt, Homo sapiens
ugagcaccaggggau

SEQ ID NO: 1357774 - RNA, 18 nt, Homo sapiens
ugagcacgcuaccaaauc

SEQ ID NO: 1357775 - RNA, 20 nt, Homo sapiens
ugagcugccccugcugcuua

SEQ ID NO: 1357776 - RNA, 18 nt, Homo sapiens
ugaggcaagagaauuacu

SEQ ID NO: 1357777 - RNA, 16 nt, Homo sapiens
ugaggcccacucuguu

SEQ ID NO: 1357778 - RNA, 18 nt, Homo sapiens
ugaggccuggacuuuccu

SEQ ID NO: 1357779 - RNA, 22 nt, Homo sapiens
ugaguuucuuaacccuuuccag

SEQ ID NO: 1357780 - RNA, 15 nt, Homo sapiens
ugauaaaauacuaaa

SEQ ID NO: 1357781 - RNA, 14 nt, Homo sapiens
ugauacacuaugaa

SEQ ID NO: 1357782 - RNA, 20 nt, Homo sapiens
ugauacuggaggaacacuug

SEQ ID NO: 1357783 - RNA, 18 nt, Homo sapiens
ugauagccuguuacagga

SEQ ID NO: 1357784 - RNA, 23 nt, Homo sapiens
ugaucauuuuccccccacucucc

SEQ ID NO: 1357785 - RNA, 20 nt, Homo sapiens
ugauccuaaugaaugcauaa

SEQ ID NO: 1357786 - RNA, 12 nt, Homo sapiens
ugaucugaugca

SEQ ID NO: 1357787 - RNA, 21 nt, Homo sapiens
ugaugcgggccagugcuccag

SEQ ID NO: 1357788 - RNA, 12 nt, Homo sapiens
ugaugcuagcca

SEQ ID NO: 1357789 - RNA, 18 nt, Homo sapiens
ugauggaagugggccagu

SEQ ID NO: 1357790 - RNA, 15 nt, Homo sapiens
ugauggcuggaucuu

SEQ ID NO: 1357791 - RNA, 15 nt, Homo sapiens
ugauuaccugccaau

SEQ ID NO: 1357792 - RNA, 15 nt, Homo sapiens
ugauucacaguguga

SEQ ID NO: 1357793 - RNA, 19 nt, Homo sapiens
ugauucugauaaugcucac

SEQ ID NO: 1357794 - RNA, 16 nt, Homo sapiens
ugauugugccuacgaa

SEQ ID NO: 1357795 - RNA, 23 nt, Homo sapiens
ugcaaagucaaaacuauagccau

SEQ ID NO: 1357796 - RNA, 14 nt, Homo sapiens
ugcaacaacaugua

SEQ ID NO: 1357797 - RNA, 18 nt, Homo sapiens
ugcaaccacucuguggcc

SEQ ID NO: 1357798 - RNA, 19 nt, Homo sapiens
ugcaagcaagaaacacugg

SEQ ID NO: 1357799 - RNA, 20 nt, Homo sapiens
ugcaagguucaacuuauuaa

SEQ ID NO: 1357800 - RNA, 22 nt, Homo sapiens
ugcaauaaaucugacccagugc

SEQ ID NO: 1357801 - RNA, 17 nt, Homo sapiens
ugcaccaccaagccaag

SEQ ID NO: 1357802 - RNA, 14 nt, Homo sapiens
ugcaccacugcacu

SEQ ID NO: 1357803 - RNA, 20 nt, Homo sapiens
ugcaccccaaagcuuuccug

SEQ ID NO: 1357804 - RNA, 14 nt, Homo sapiens
ugcacuuacuugcu

SEQ ID NO: 1357805 - RNA, 21 nt, Homo sapiens
ugcagcccuugugaugugauu

SEQ ID NO: 1357806 - RNA, 14 nt, Homo sapiens
ugcagcgagugugc

SEQ ID NO: 1357807 - RNA, 16 nt, Homo sapiens
ugcaggaccucaggug

SEQ ID NO: 1357808 - RNA, 16 nt, Homo sapiens
ugcaggcggggcuccu

SEQ ID NO: 1357809 - RNA, 23 nt, Homo sapiens
ugcaggguuucucgccacugggg

SEQ ID NO: 1357810 - RNA, 15 nt, Homo sapiens
ugcagucacagcuac

SEQ ID NO: 1357811 - RNA, 20 nt, Homo sapiens
ugcagucacagcuacacaga

SEQ ID NO: 1357812 - RNA, 19 nt, Homo sapiens
ugcagucaucuugaccaag

SEQ ID NO: 1357813 - RNA, 16 nt, Homo sapiens
ugcauaagugcaugac

SEQ ID NO: 1357814 - RNA, 19 nt, Homo sapiens
ugcauagagccacguaugu

SEQ ID NO: 1357815 - RNA, 17 nt, Homo sapiens
ugcauaugcauucacuc

SEQ ID NO: 1357816 - RNA, 20 nt, Homo sapiens
ugcauccauguaaucuauuc

SEQ ID NO: 1357817 - RNA, 14 nt, Homo sapiens
ugcaugucuacuca

SEQ ID NO: 1357818 - RNA, 13 nt, Homo sapiens
ugcaugugcugca

SEQ ID NO: 1357819 - RNA, 16 nt, Homo sapiens
ugccaaauaucuugau

SEQ ID NO: 1357820 - RNA, 23 nt, Homo sapiens
ugccacccaccuuugccacaaag

SEQ ID NO: 1357821 - RNA, 19 nt, Homo sapiens
ugccacccaguugugacaa

SEQ ID NO: 1357822 - RNA, 20 nt, Homo sapiens
ugccacccaguugugacaau

SEQ ID NO: 1357823 - RNA, 18 nt, Homo sapiens
ugccacccauuccaucuc

SEQ ID NO: 1357824 - RNA, 19 nt, Homo sapiens
ugccagcccaacugugaga

SEQ ID NO: 1357825 - RNA, 20 nt, Homo sapiens
ugccagcccaacugugagac

SEQ ID NO: 1357826 - RNA, 18 nt, Homo sapiens
ugccagcugugugagaag

SEQ ID NO: 1357827 - RNA, 24 nt, Homo sapiens
ugccauaucagugaaccuuuagaa

SEQ ID NO: 1357828 - RNA, 21 nt, Homo sapiens
ugccaucauuguaacaugaca

SEQ ID NO: 1357829 - RNA, 15 nt, Homo sapiens
ugccaucccaaaaau

SEQ ID NO: 1357830 - RNA, 18 nt, Homo sapiens
ugccaucguuuccaugac

SEQ ID NO: 1357831 - RNA, 15 nt, Homo sapiens
ugccaugccagcuua

SEQ ID NO: 1357832 - RNA, 20 nt, Homo sapiens
ugccauucuucuggugcuac

SEQ ID NO: 1357833 - RNA, 17 nt, Homo sapiens
ugccauuucugaacugu

SEQ ID NO: 1357834 - RNA, 16 nt, Homo sapiens
ugcccaguguguuucu

SEQ ID NO: 1357835 - RNA, 14 nt, Homo sapiens
ugcccaugagucag

SEQ ID NO: 1357836 - RNA, 15 nt, Homo sapiens
ugccccagagcuguu

SEQ ID NO: 1357837 - RNA, 18 nt, Homo sapiens
ugccccaggccugaaaga

SEQ ID NO: 1357838 - RNA, 17 nt, Homo sapiens
ugccccaugccugucca

SEQ ID NO: 1357839 - RNA, 19 nt, Homo sapiens
ugcccccuccacagcugug

SEQ ID NO: 1357840 - RNA, 18 nt, Homo sapiens
ugcccggcaggguccuag

SEQ ID NO: 1357841 - RNA, 19 nt, Homo sapiens
ugcccguguaguccccaac

SEQ ID NO: 1357842 - RNA, 16 nt, Homo sapiens
ugcccuaggugagaac

SEQ ID NO: 1357843 - RNA, 16 nt, Homo sapiens
ugcccugguccaggga

SEQ ID NO: 1357844 - RNA, 21 nt, Homo sapiens
ugcccuuggaggccagccagu

SEQ ID NO: 1357845 - RNA, 22 nt, Homo sapiens
ugccggugagacccauggcugu

SEQ ID NO: 1357846 - RNA, 18 nt, Homo sapiens
ugccuugguaaaaacugc

SEQ ID NO: 1357847 - RNA, 14 nt, Homo sapiens
ugccuuucacuuua

SEQ ID NO: 1357848 - RNA, 11 nt, Homo sapiens
ugcgucacugu

SEQ ID NO: 1357849 - RNA, 16 nt, Homo sapiens
ugcgucgucaccaaau

SEQ ID NO: 1357850 - RNA, 23 nt, Homo sapiens
ugcuaauauauguauaugcaaua

SEQ ID NO: 1357851 - RNA, 21 nt, Homo sapiens
ugcuauaacuauguugauaaa

SEQ ID NO: 1357852 - RNA, 14 nt, Homo sapiens
ugcuaugcaaaaaa

SEQ ID NO: 1357853 - RNA, 17 nt, Homo sapiens
ugcucacugccagugca

SEQ ID NO: 1357854 - RNA, 20 nt, Homo sapiens
ugcucacuugguccuaccua

SEQ ID NO: 1357855 - RNA, 17 nt, Homo sapiens
ugcucagguacuuguaa

SEQ ID NO: 1357856 - RNA, 16 nt, Homo sapiens
ugcucuuucucugcca

SEQ ID NO: 1357857 - RNA, 23 nt, Homo sapiens
ugcucuuuguagcuaacagugaa

SEQ ID NO: 1357858 - RNA, 19 nt, Homo sapiens
ugcugaaauaaaaugauaa

SEQ ID NO: 1357859 - RNA, 21 nt, Homo sapiens
ugcugagauacauacagaauu

SEQ ID NO: 1357860 - RNA, 17 nt, Homo sapiens
ugcugcuuuaacagugg

SEQ ID NO: 1357861 - RNA, 20 nt, Homo sapiens
ugcugggcacuucaucugau

SEQ ID NO: 1357862 - RNA, 13 nt, Homo sapiens
ugcugugcuaugg

SEQ ID NO: 1357863 - RNA, 14 nt, Homo sapiens
ugcuucaaacugag

SEQ ID NO: 1357864 - RNA, 23 nt, Homo sapiens
ugcuuccccuuuugccaaucuca

SEQ ID NO: 1357865 - RNA, 19 nt, Homo sapiens
ugcuuccucccaacaagca

SEQ ID NO: 1357866 - RNA, 22 nt, Homo sapiens
ugcuuccucccaacaagcagcu

SEQ ID NO: 1357867 - RNA, 16 nt, Homo sapiens
ugcuugcaugugcugc

SEQ ID NO: 1357868 - RNA, 13 nt, Homo sapiens
ugcuuuaaccuca

SEQ ID NO: 1357869 - RNA, 20 nt, Homo sapiens
ugcuuucacauuguacuuaa

SEQ ID NO: 1357870 - RNA, 15 nt, Homo sapiens
ugcuuucugguggug

SEQ ID NO: 1357871 - RNA, 17 nt, Homo sapiens
uggaaagacaagcucaa

SEQ ID NO: 1357872 - RNA, 18 nt, Homo sapiens
uggaaagacaagcucaag

SEQ ID NO: 1357873 - RNA, 22 nt, Homo sapiens
uggaagaaaaaaaccacacaaa

SEQ ID NO: 1357874 - RNA, 15 nt, Homo sapiens
uggaaguaagucugc

SEQ ID NO: 1357875 - RNA, 18 nt, Homo sapiens
uggaagucugucucagga

SEQ ID NO: 1357876 - RNA, 20 nt, Homo sapiens
uggaaguuucuggugccauu

SEQ ID NO: 1357877 - RNA, 16 nt, Homo sapiens
uggaaucagauuuuaa

SEQ ID NO: 1357878 - RNA, 23 nt, Homo sapiens
uggaauguuuuaaucuccucuga

SEQ ID NO: 1357879 - RNA, 13 nt, Homo sapiens
uggaauugugcug

SEQ ID NO: 1357880 - RNA, 15 nt, Homo sapiens
uggaauuuguucaag

SEQ ID NO: 1357881 - RNA, 17 nt, Homo sapiens
uggacaugcgugaccag

SEQ ID NO: 1357882 - RNA, 17 nt, Homo sapiens
ucaaacuuucaccucag

SEQ ID NO: 1357883 - RNA, 16 nt, Homo sapiens
ucaaagcaaagcucuu

SEQ ID NO: 1357884 - RNA, 14 nt, Homo sapiens
ucaaaucauuccuu

SEQ ID NO: 1357885 - RNA, 16 nt, Homo sapiens
ucaacaccucugcaca

SEQ ID NO: 1357886 - RNA, 23 nt, Homo sapiens
ucaaccauccccuccguggcauc

SEQ ID NO: 1357887 - RNA, 23 nt, Homo sapiens
ucaaccuucuuauuaaugucauu

SEQ ID NO: 1357888 - RNA, 15 nt, Homo sapiens
ucaagaacacaguga

SEQ ID NO: 1357889 - RNA, 13 nt, Homo sapiens
ucaagaaugccag

SEQ ID NO: 1357890 - RNA, 13 nt, Homo sapiens
ucaagacauuucu

SEQ ID NO: 1357891 - RNA, 15 nt, Homo sapiens
ucaagaccauaguga

SEQ ID NO: 1357892 - RNA, 16 nt, Homo sapiens
ucaagagagauuugau

SEQ ID NO: 1357893 - RNA, 18 nt, Homo sapiens
ucaagaguaguuauauaa

SEQ ID NO: 1357894 - RNA, 16 nt, Homo sapiens
ucaagcagucgugccu

SEQ ID NO: 1357895 - RNA, 18 nt, Homo sapiens
ucaagccugugcaaaaaa

SEQ ID NO: 1357896 - RNA, 21 nt, Homo sapiens
ucaagcucuccaaaggcucag

SEQ ID NO: 1357897 - RNA, 18 nt, Homo sapiens
ucaagcuucuugccaguu

SEQ ID NO: 1357898 - RNA, 19 nt, Homo sapiens
ucaaggcaguagaacucca

SEQ ID NO: 1357899 - RNA, 20 nt, Homo sapiens
ucaaggcaguagaacuccag

SEQ ID NO: 1357900 - RNA, 16 nt, Homo sapiens
ucaaggcggugcuuga

SEQ ID NO: 1357901 - RNA, 22 nt, Homo sapiens
ucaaguagcguuggagacauac

SEQ ID NO: 1357902 - RNA, 21 nt, Homo sapiens
ucaagugccuagacuguuacu

SEQ ID NO: 1357903 - RNA, 16 nt, Homo sapiens
ucaaguuggcuucuaa

SEQ ID NO: 1357904 - RNA, 21 nt, Homo sapiens
ucaaguuuuggguauguuuaa

SEQ ID NO: 1357905 - RNA, 16 nt, Homo sapiens
ucaaucacagucucag

SEQ ID NO: 1357906 - RNA, 18 nt, Homo sapiens
ucaaucucugauucuguc

SEQ ID NO: 1357907 - RNA, 24 nt, Homo sapiens
ucaaugaagccagcucacagugcu

SEQ ID NO: 1357908 - RNA, 22 nt, Homo sapiens
ucaaugcuauaacuauguugau

SEQ ID NO: 1357909 - RNA, 12 nt, Homo sapiens
ucaaugggaccu

SEQ ID NO: 1357910 - RNA, 13 nt, Homo sapiens
ucacagaauguga

SEQ ID NO: 1357911 - RNA, 16 nt, Homo sapiens
ucacagaugugugauu

SEQ ID NO: 1357912 - RNA, 14 nt, Homo sapiens
ucacagccucugaa

SEQ ID NO: 1357913 - RNA, 20 nt, Homo sapiens
ucacaggagcuuaaacagcu

SEQ ID NO: 1357914 - RNA, 18 nt, Homo sapiens
ucacauccauucuucccu

SEQ ID NO: 1357915 - RNA, 19 nt, Homo sapiens
ucacauccauucuucccuu

SEQ ID NO: 1357916 - RNA, 22 nt, Homo sapiens
ucacauuguacuuaaaccuccu

SEQ ID NO: 1357917 - RNA, 15 nt, Homo sapiens
ucacgcaggagccau

SEQ ID NO: 1357918 - RNA, 21 nt, Homo sapiens
ucacuaggcccccacuugccu

SEQ ID NO: 1357919 - RNA, 18 nt, Homo sapiens
ucacugcaacuucugccu

SEQ ID NO: 1357920 - RNA, 16 nt, Homo sapiens
ucacuucacuguucuc

SEQ ID NO: 1357921 - RNA, 21 nt, Homo sapiens
ucacuuuuaauuagugaugca

SEQ ID NO: 1357922 - RNA, 12 nt, Homo sapiens
ucagauaaggua

SEQ ID NO: 1357923 - RNA, 22 nt, Homo sapiens
ucagauaagguaaaaugccaug

SEQ ID NO: 1357924 - RNA, 19 nt, Homo sapiens
ucagauggaaccgcaggaa

SEQ ID NO: 1357925 - RNA, 19 nt, Homo sapiens
ucagcaaaagaugcuucuc

SEQ ID NO: 1357926 - RNA, 19 nt, Homo sapiens
ucagcaauacagacuacuu

SEQ ID NO: 1357927 - RNA, 19 nt, Homo sapiens
ucagcacugucccuugccu

SEQ ID NO: 1357928 - RNA, 21 nt, Homo sapiens
ucagccuugccagagauccaa

SEQ ID NO: 1357929 - RNA, 14 nt, Homo sapiens
ucagcuggaucucc

SEQ ID NO: 1357930 - RNA, 17 nt, Homo sapiens
ucaggauguaauaaaga

SEQ ID NO: 1357931 - RNA, 20 nt, Homo sapiens
ucagggagaguuugggaacu

SEQ ID NO: 1357932 - RNA, 12 nt, Homo sapiens
ucagugcugcuc

SEQ ID NO: 1357933 - RNA, 21 nt, Homo sapiens
ucagugcuucgcagauguccu

SEQ ID NO: 1357934 - RNA, 18 nt, Homo sapiens
ucaguuaauucuuagaua

SEQ ID NO: 1357935 - RNA, 19 nt, Homo sapiens
ucaguuguuuaauaauuua

SEQ ID NO: 1357936 - RNA, 19 nt, Homo sapiens
ucauccccaggggucccag

SEQ ID NO: 1357937 - RNA, 17 nt, Homo sapiens
ucaucugcaugucuacu

SEQ ID NO: 1357938 - RNA, 20 nt, Homo sapiens
ucaucuugaccaagcaggaa

SEQ ID NO: 1357939 - RNA, 18 nt, Homo sapiens
ucauguugaucauguacu

SEQ ID NO: 1357940 - RNA, 12 nt, Homo sapiens
ucauuaauguga

SEQ ID NO: 1357941 - RNA, 13 nt, Homo sapiens
ucauuacauauag

SEQ ID NO: 1357942 - RNA, 20 nt, Homo sapiens
ucauuagaacuucaagcucu

SEQ ID NO: 1357943 - RNA, 19 nt, Homo sapiens
ucauuuguuuacauuugau

SEQ ID NO: 1357944 - RNA, 22 nt, Homo sapiens
ucauuuuuuuguacuaauguga

SEQ ID NO: 1357945 - RNA, 18 nt, Homo sapiens
uccaaaacuaaauuugaa

SEQ ID NO: 1357946 - RNA, 19 nt, Homo sapiens
uccaaacuaccuuccaguu

SEQ ID NO: 1357947 - RNA, 14 nt, Homo sapiens
uccaacaugugcuc

SEQ ID NO: 1357948 - RNA, 17 nt, Homo sapiens
uccaaccugcaaagauc

SEQ ID NO: 1357949 - RNA, 20 nt, Homo sapiens
uccaauauucgcugugucag

SEQ ID NO: 1357950 - RNA, 13 nt, Homo sapiens
uccaaugcucaag

SEQ ID NO: 1357951 - RNA, 14 nt, Homo sapiens
uccaaugcucaaga

SEQ ID NO: 1357952 - RNA, 12 nt, Homo sapiens
uccaauggggcg

SEQ ID NO: 1357953 - RNA, 13 nt, Homo sapiens
uccacagcugugu

SEQ ID NO: 1357954 - RNA, 13 nt, Homo sapiens
uccagauauacuu

SEQ ID NO: 1357955 - RNA, 19 nt, Homo sapiens
uccagcaaacaaaauggac

SEQ ID NO: 1357956 - RNA, 19 nt, Homo sapiens
uccagcagaagacaaaaag

SEQ ID NO: 1357957 - RNA, 19 nt, Homo sapiens
uccagcugcucugucuucu

SEQ ID NO: 1357958 - RNA, 21 nt, Homo sapiens
uccagcuuagaaugcaucuca

SEQ ID NO: 1357959 - RNA, 15 nt, Homo sapiens
uccagcuuucugcca

SEQ ID NO: 1357960 - RNA, 15 nt, Homo sapiens
uccaggcagauccag

SEQ ID NO: 1357961 - RNA, 11 nt, Homo sapiens
uccagugcagg

SEQ ID NO: 1357962 - RNA, 14 nt, Homo sapiens
uccaguucaaauaa

SEQ ID NO: 1357963 - RNA, 18 nt, Homo sapiens
uccaucgcugucaucuca

SEQ ID NO: 1357964 - RNA, 14 nt, Homo sapiens
uccaucuccaucca

SEQ ID NO: 1357965 - RNA, 20 nt, Homo sapiens
uccauggcaggaaggcuugu

SEQ ID NO: 1357966 - RNA, 18 nt, Homo sapiens
uccauggcugccaucuca

SEQ ID NO: 1357967 - RNA, 21 nt, Homo sapiens
ucccaacuacgcugauuugau

SEQ ID NO: 1357968 - RNA, 15 nt, Homo sapiens
ucccaagcugugcug

SEQ ID NO: 1357969 - RNA, 13 nt, Homo sapiens
ucccacacaggcu

SEQ ID NO: 1357970 - RNA, 16 nt, Homo sapiens
ucccagagucaucuga

SEQ ID NO: 1357971 - RNA, 21 nt, Homo sapiens
ucccagcacgaguggccaguu

SEQ ID NO: 1357972 - RNA, 14 nt, Homo sapiens
ucccaggacccuga

SEQ ID NO: 1357973 - RNA, 18 nt, Homo sapiens
ucccaggacccugaaggg

SEQ ID NO: 1357974 - RNA, 19 nt, Homo sapiens
ucccaggcccagugcaguc

SEQ ID NO: 1357975 - RNA, 14 nt, Homo sapiens
ucccaggcugaggc

SEQ ID NO: 1357976 - RNA, 23 nt, Homo sapiens
ucccaggcuggagagcacugcca

SEQ ID NO: 1357977 - RNA, 19 nt, Homo sapiens
ucccagugacaaccaaaag

SEQ ID NO: 1357978 - RNA, 13 nt, Homo sapiens
ucccauccuugau

SEQ ID NO: 1357979 - RNA, 19 nt, Homo sapiens
uccguggucagagugccac

SEQ ID NO: 1357980 - RNA, 14 nt, Homo sapiens
uccuaagggcucac

SEQ ID NO: 1357981 - RNA, 13 nt, Homo sapiens
uccuaaucaucca

SEQ ID NO: 1357982 - RNA, 10 nt, Homo sapiens
uccuaccugg

SEQ ID NO: 1357983 - RNA, 19 nt, Homo sapiens
uccuacgauacgcuacuau

SEQ ID NO: 1357984 - RNA, 21 nt, Homo sapiens
uccuacuuagggaagaaaaag

SEQ ID NO: 1357985 - RNA, 18 nt, Homo sapiens
uccuaggcauuugcugaa

SEQ ID NO: 1357986 - RNA, 20 nt, Homo sapiens
uccucaccucuggacuggcu

SEQ ID NO: 1357987 - RNA, 11 nt, Homo sapiens
uccucacuccc

SEQ ID NO: 1357988 - RNA, 15 nt, Homo sapiens
uccucucccagugac

SEQ ID NO: 1357989 - RNA, 18 nt, Homo sapiens
uccucucccagugacaac

SEQ ID NO: 1357990 - RNA, 16 nt, Homo sapiens
uccucucuaucacauc

SEQ ID NO: 1357991 - RNA, 19 nt, Homo sapiens
uccugaccucgugauccac

SEQ ID NO: 1357992 - RNA, 21 nt, Homo sapiens
uccugaggaaggaagauuuga

SEQ ID NO: 1357993 - RNA, 13 nt, Homo sapiens
uccugcaacucaa

SEQ ID NO: 1357994 - RNA, 18 nt, Homo sapiens
uccugccauucuucuggu

SEQ ID NO: 1357995 - RNA, 20 nt, Homo sapiens
uccugccucagccuccugag

SEQ ID NO: 1357996 - RNA, 16 nt, Homo sapiens
uccugggccugcagaa

SEQ ID NO: 1357997 - RNA, 22 nt, Homo sapiens
uccuguacauugugggauguuc

SEQ ID NO: 1357998 - RNA, 13 nt, Homo sapiens
uccugugccacua

SEQ ID NO: 1357999 - RNA, 14 nt, Homo sapiens
uccuuaagggacaa

SEQ ID NO: 1358000 - RNA, 19 nt, Homo sapiens
uccuucccucucaugacuu

SEQ ID NO: 1358001 - RNA, 14 nt, Homo sapiens
uccuugauggcugg

SEQ ID NO: 1358002 - RNA, 16 nt, Homo sapiens
uccuugauggcuggau

SEQ ID NO: 1358003 - RNA, 18 nt, Homo sapiens
uccuugggcuuuagccuu

SEQ ID NO: 1358004 - RNA, 17 nt, Homo sapiens
uccuuguaaagacugua

SEQ ID NO: 1358005 - RNA, 16 nt, Homo sapiens
uccuuuuaagcaguga

SEQ ID NO: 1358006 - RNA, 17 nt, Homo sapiens
uccuuuuaagcagugag

SEQ ID NO: 1358007 - RNA, 18 nt, Homo sapiens
uccuuuuaggaauacugg

SEQ ID NO: 1358008 - RNA, 12 nt, Homo sapiens
ucgaguguuuca

SEQ ID NO: 1358009 - RNA, 23 nt, Homo sapiens
ucgccaagagggacaucagaaag

SEQ ID NO: 1358010 - RNA, 19 nt, Homo sapiens
ucgggaagaaggggacaau

SEQ ID NO: 1358011 - RNA, 21 nt, Homo sapiens
ucgguauccccccaucuugcu

SEQ ID NO: 1358012 - RNA, 18 nt, Homo sapiens
ucgugacaagugccuuca

SEQ ID NO: 1358013 - RNA, 23 nt, Homo sapiens
ucuaaaccccggcgugugcagug

SEQ ID NO: 1358014 - RNA, 14 nt, Homo sapiens
ucuacgccagggga

SEQ ID NO: 1358015 - RNA, 15 nt, Homo sapiens
ucuacuuuaucaauu

SEQ ID NO: 1358016 - RNA, 14 nt, Homo sapiens
ucuacuuugauucu

SEQ ID NO: 1358017 - RNA, 15 nt, Homo sapiens
ucuagaagacuguca

SEQ ID NO: 1358018 - RNA, 16 nt, Homo sapiens
ucuagagcacugccac

SEQ ID NO: 1358019 - RNA, 16 nt, Homo sapiens
ucuagagcagggauua

SEQ ID NO: 1358020 - RNA, 15 nt, Homo sapiens
ucuaggccagguaug

SEQ ID NO: 1358021 - RNA, 22 nt, Homo sapiens
ucuagggacaggccgggcagug

SEQ ID NO: 1358022 - RNA, 19 nt, Homo sapiens
ucuauaaauagaugcugug

SEQ ID NO: 1358023 - RNA, 17 nt, Homo sapiens
ucuauauuaaggcagua

SEQ ID NO: 1358024 - RNA, 21 nt, Homo sapiens
ucuaugccuaaaaaguaucau

SEQ ID NO: 1358025 - RNA, 18 nt, Homo sapiens
ucuauggcacccaugcac

SEQ ID NO: 1358026 - RNA, 21 nt, Homo sapiens
ucuauuuuaagacugauuuua

SEQ ID NO: 1358027 - RNA, 22 nt, Homo sapiens
ucucaacuuugauacuuacuca

SEQ ID NO: 1358028 - RNA, 17 nt, Homo sapiens
ucucagcgccgucgcca

SEQ ID NO: 1358029 - RNA, 21 nt, Homo sapiens
ucucagcuggaucuccauucu

SEQ ID NO: 1358030 - RNA, 16 nt, Homo sapiens
ucucagguguugccaa

SEQ ID NO: 1358031 - RNA, 18 nt, Homo sapiens
ucucagguguugccaaau

SEQ ID NO: 1358032 - RNA, 18 nt, Homo sapiens
ucucauaacucugugauc

SEQ ID NO: 1358033 - RNA, 17 nt, Homo sapiens
ucucaugggaaggggag

SEQ ID NO: 1358034 - RNA, 15 nt, Homo sapiens
ucucauugccaguga

SEQ ID NO: 1358035 - RNA, 17 nt, Homo sapiens
ucucauuucccuuugau

SEQ ID NO: 1358036 - RNA, 22 nt, Homo sapiens
ucuccaaagcccucccuaccua

SEQ ID NO: 1358037 - RNA, 21 nt, Homo sapiens
ucuccagggaggguauuuauu

SEQ ID NO: 1358038 - RNA, 18 nt, Homo sapiens
ucuccccagcccagagac

SEQ ID NO: 1358039 - RNA, 14 nt, Homo sapiens
ucucccugccaagu

SEQ ID NO: 1358040 - RNA, 16 nt, Homo sapiens
ucuccuuggaggacag

SEQ ID NO: 1358041 - RNA, 18 nt, Homo sapiens
ucucgccacugcacucca

SEQ ID NO: 1358042 - RNA, 14 nt, Homo sapiens
ucucgccaucagcu

SEQ ID NO: 1358043 - RNA, 15 nt, Homo sapiens
ucucgggcacaggcc

SEQ ID NO: 1358044 - RNA, 15 nt, Homo sapiens
ucucgguuugccaaa

SEQ ID NO: 1358045 - RNA, 18 nt, Homo sapiens
ucucuaacuccugccauu

SEQ ID NO: 1358046 - RNA, 12 nt, Homo sapiens
ucucugccagug

SEQ ID NO: 1358047 - RNA, 15 nt, Homo sapiens
ucucugccagugaca

SEQ ID NO: 1358048 - RNA, 18 nt, Homo sapiens
ucucugcuccaccacauc

SEQ ID NO: 1358049 - RNA, 23 nt, Homo sapiens
ucucuggccuguacccaguagau

SEQ ID NO: 1358050 - RNA, 12 nt, Homo sapiens
ucucuguacuuu

SEQ ID NO: 1358051 - RNA, 12 nt, Homo sapiens
ucucuucuaaug

SEQ ID NO: 1358052 - RNA, 12 nt, Homo sapiens
ucucuugugcau

SEQ ID NO: 1358053 - RNA, 20 nt, Homo sapiens
ucucuuucacauuguuugcu

SEQ ID NO: 1358054 - RNA, 12 nt, Homo sapiens
ucugaaaaccaa

SEQ ID NO: 1358055 - RNA, 23 nt, Homo sapiens
ucugaaacugcauaagugaaaau

SEQ ID NO: 1358056 - RNA, 14 nt, Homo sapiens
ucugaacuguuaca

SEQ ID NO: 1358057 - RNA, 13 nt, Homo sapiens
ucugaccaaaaca

SEQ ID NO: 1358058 - RNA, 13 nt, Homo sapiens
ucugaugcaagca

SEQ ID NO: 1358059 - RNA, 21 nt, Homo sapiens
ucugaugcaagcaagaaacac

SEQ ID NO: 1358060 - RNA, 18 nt, Homo sapiens
ucugauuuuuauucucaa

SEQ ID NO: 1358061 - RNA, 13 nt, Homo sapiens
ucugcacugccca

SEQ ID NO: 1358062 - RNA, 16 nt, Homo sapiens
ucugccauaucaguga

SEQ ID NO: 1358063 - RNA, 17 nt, Homo sapiens
ucugccauaucagugaa

SEQ ID NO: 1358064 - RNA, 24 nt, Homo sapiens
ucugcuuaauacaucuacaaccau

SEQ ID NO: 1358065 - RNA, 18 nt, Homo sapiens
ucuggaacccagacucag

SEQ ID NO: 1358066 - RNA, 19 nt, Homo sapiens
ucuggacuauauugggacu

SEQ ID NO: 1358067 - RNA, 18 nt, Homo sapiens
ucuggcaucuuagaccuc

SEQ ID NO: 1358068 - RNA, 23 nt, Homo sapiens
ucuggcugcaacuuaaugcucug

SEQ ID NO: 1358069 - RNA, 20 nt, Homo sapiens
ucuggggggacccagugcag

SEQ ID NO: 1358070 - RNA, 13 nt, Homo sapiens
ucuguagggauuu

SEQ ID NO: 1358071 - RNA, 15 nt, Homo sapiens
ucugucuucuuugcc

SEQ ID NO: 1358072 - RNA, 17 nt, Homo sapiens
ucugucuuuauaaucua

SEQ ID NO: 1358073 - RNA, 16 nt, Homo sapiens
ucugugccccaugccu

SEQ ID NO: 1358074 - RNA, 12 nt, Homo sapiens
ucugugcugcac

SEQ ID NO: 1358075 - RNA, 18 nt, Homo sapiens
ucuguguacauguacaga

SEQ ID NO: 1358076 - RNA, 14 nt, Homo sapiens
ucuguuauguacua

SEQ ID NO: 1358077 - RNA, 16 nt, Homo sapiens
ugaaaauuaacacugc

SEQ ID NO: 1358078 - RNA, 18 nt, Homo sapiens
ugaaaauuaugucaguuu

SEQ ID NO: 1358079 - RNA, 20 nt, Homo sapiens
ugaaaccccaucucuacuga

SEQ ID NO: 1358080 - RNA, 11 nt, Homo sapiens
ugaaagaucuu

SEQ ID NO: 1358081 - RNA, 13 nt, Homo sapiens
ugaaauuaacuca

SEQ ID NO: 1358082 - RNA, 15 nt, Homo sapiens
ugaaauuauaaucug

SEQ ID NO: 1358083 - RNA, 16 nt, Homo sapiens
ugaaccauuaaccaga

SEQ ID NO: 1358084 - RNA, 23 nt, Homo sapiens
ugaaccuauuucuuaaacacuug

SEQ ID NO: 1358085 - RNA, 15 nt, Homo sapiens
ugaagaauauuuaac

SEQ ID NO: 1358086 - RNA, 14 nt, Homo sapiens
ugaagauuauuuca

SEQ ID NO: 1358087 - RNA, 22 nt, Homo sapiens
ugaagauuuaccucguucugcu

SEQ ID NO: 1358088 - RNA, 20 nt, Homo sapiens
ugaaggaaaugaaucuuuga

SEQ ID NO: 1358089 - RNA, 14 nt, Homo sapiens
ugaaggacuacagg

SEQ ID NO: 1358090 - RNA, 14 nt, Homo sapiens
ugaaggcuguccuu

SEQ ID NO: 1358091 - RNA, 14 nt, Homo sapiens
ugaaggggccauga

SEQ ID NO: 1358092 - RNA, 15 nt, Homo sapiens
ugaagggguucucac

SEQ ID NO: 1358093 - RNA, 14 nt, Homo sapiens
ugaaguaagcaaag

SEQ ID NO: 1358094 - RNA, 23 nt, Homo sapiens
ugaagucaugcguuuaaucacau

SEQ ID NO: 1358095 - RNA, 14 nt, Homo sapiens
ugaauaacauuuaa

SEQ ID NO: 1358096 - RNA, 13 nt, Homo sapiens
ugaauaauacagu

SEQ ID NO: 1358097 - RNA, 13 nt, Homo sapiens
ugaauagucucau

SEQ ID NO: 1358098 - RNA, 16 nt, Homo sapiens
ugaauuguuccucaga

SEQ ID NO: 1358099 - RNA, 15 nt, Homo sapiens
ugacaaagauuugca

SEQ ID NO: 1358100 - RNA, 14 nt, Homo sapiens
ugacagaacacugu

SEQ ID NO: 1358101 - RNA, 15 nt, Homo sapiens
ugacagaacacuguc

SEQ ID NO: 1358102 - RNA, 19 nt, Homo sapiens
ugacagacaggcucuuagc

SEQ ID NO: 1358103 - RNA, 20 nt, Homo sapiens
ugacagcggaaagcccugug

SEQ ID NO: 1358104 - RNA, 19 nt, Homo sapiens
ugacagcucccgggucccc

SEQ ID NO: 1358105 - RNA, 16 nt, Homo sapiens
ugacauaauauauucu

SEQ ID NO: 1358106 - RNA, 15 nt, Homo sapiens
ugacauugccaaaaa

SEQ ID NO: 1358107 - RNA, 22 nt, Homo sapiens
ugacauuucauuagccaugcaa

SEQ ID NO: 1358108 - RNA, 16 nt, Homo sapiens
ugaccccagcccagac

SEQ ID NO: 1358109 - RNA, 14 nt, Homo sapiens
ugaccucacuuuag

SEQ ID NO: 1358110 - RNA, 18 nt, Homo sapiens
ugaccugaggaagcguga

SEQ ID NO: 1358111 - RNA, 19 nt, Homo sapiens
ugaccugaggaagcgugaa

SEQ ID NO: 1358112 - RNA, 12 nt, Homo sapiens
ugaccuugagaa

SEQ ID NO: 1358113 - RNA, 18 nt, Homo sapiens
ugaccuuuagugccaacu

SEQ ID NO: 1358114 - RNA, 21 nt, Homo sapiens
ugacucggucugagaagauuc

SEQ ID NO: 1358115 - RNA, 23 nt, Homo sapiens
ugacucuccagaaagcucaucuc

SEQ ID NO: 1358116 - RNA, 14 nt, Homo sapiens
ugacugccaaaaag

SEQ ID NO: 1358117 - RNA, 15 nt, Homo sapiens
ugacugccaaaaagg

SEQ ID NO: 1358118 - RNA, 11 nt, Homo sapiens
ugacuggugcu

SEQ ID NO: 1358119 - RNA, 22 nt, Homo sapiens
ugagaaaacaggcucacagaga

SEQ ID NO: 1358120 - RNA, 14 nt, Homo sapiens
ugagaaauuuacua

SEQ ID NO: 1358121 - RNA, 13 nt, Homo sapiens
ugagaagugcacu

SEQ ID NO: 1358122 - RNA, 17 nt, Homo sapiens
ugagaagugcacuuuaa

SEQ ID NO: 1358123 - RNA, 15 nt, Homo sapiens
ugagaccaaccuggg

SEQ ID NO: 1358124 - RNA, 17 nt, Homo sapiens
ugagacccauggcugug

SEQ ID NO: 1358125 - RNA, 22 nt, Homo sapiens
ugagacuacaagugugugccac

SEQ ID NO: 1358126 - RNA, 20 nt, Homo sapiens
ugagacucagugcagaugga

SEQ ID NO: 1358127 - RNA, 19 nt, Homo sapiens
ugagaggagagagacucca

SEQ ID NO: 1358128 - RNA, 17 nt, Homo sapiens
ugagcacgcuaccaaau

SEQ ID NO: 1358129 - RNA, 14 nt, Homo sapiens
ugagcccaacccuu

SEQ ID NO: 1358130 - RNA, 23 nt, Homo sapiens
ugagcccucuaugguguggcaaa

SEQ ID NO: 1358131 - RNA, 21 nt, Homo sapiens
ugagcuuaagaauuuugagca

SEQ ID NO: 1358132 - RNA, 21 nt, Homo sapiens
ugaggaaaggccagcuggcag

SEQ ID NO: 1358133 - RNA, 17 nt, Homo sapiens
ugaggacguggugacuu

SEQ ID NO: 1358134 - RNA, 22 nt, Homo sapiens
ugaggaugacagugacacccag

SEQ ID NO: 1358135 - RNA, 15 nt, Homo sapiens
ugaggaugucacuca

SEQ ID NO: 1358136 - RNA, 15 nt, Homo sapiens
ugaggcccacucugu

SEQ ID NO: 1358137 - RNA, 16 nt, Homo sapiens
ugaggcccccaucucc

SEQ ID NO: 1358138 - RNA, 17 nt, Homo sapiens
ugagggcagacuggggc

SEQ ID NO: 1358139 - RNA, 23 nt, Homo sapiens
ugaguagcucuccugacuuuuaa

SEQ ID NO: 1358140 - RNA, 23 nt, Homo sapiens
ugaguuguugcuuauacuguugu

SEQ ID NO: 1358141 - RNA, 16 nt, Homo sapiens
ugaguuugaacacaga

SEQ ID NO: 1358142 - RNA, 14 nt, Homo sapiens
ugauaaaauacuaa

SEQ ID NO: 1358143 - RNA, 15 nt, Homo sapiens
ugaucauuacucugc

SEQ ID NO: 1358144 - RNA, 16 nt, Homo sapiens
ugauccuaagucaugu

SEQ ID NO: 1358145 - RNA, 18 nt, Homo sapiens
ugauccuaaugaaugcau

SEQ ID NO: 1358146 - RNA, 20 nt, Homo sapiens
ugauccuggaggcccaguuc

SEQ ID NO: 1358147 - RNA, 17 nt, Homo sapiens
ugauggcaacagaucug

SEQ ID NO: 1358148 - RNA, 22 nt, Homo sapiens
ugauguucauggguauaguuca

SEQ ID NO: 1358149 - RNA, 14 nt, Homo sapiens
ugauguugugaaau

SEQ ID NO: 1358150 - RNA, 20 nt, Homo sapiens
ugauguuuguggccucagaa

SEQ ID NO: 1358151 - RNA, 17 nt, Homo sapiens
ugauuucagacugcaga

SEQ ID NO: 1358152 - RNA, 16 nt, Homo sapiens
ugcaaacccuuucaua

SEQ ID NO: 1358153 - RNA, 15 nt, Homo sapiens
ugcaaaugacuguca

SEQ ID NO: 1358154 - RNA, 23 nt, Homo sapiens
ugcaaauuuuagcguuaaaguca

SEQ ID NO: 1358155 - RNA, 16 nt, Homo sapiens
ugcaacccuuaccccu

SEQ ID NO: 1358156 - RNA, 14 nt, Homo sapiens
ugcaacuucugccu

SEQ ID NO: 1358157 - RNA, 16 nt, Homo sapiens
ugcaauguaagcauac

SEQ ID NO: 1358158 - RNA, 21 nt, Homo sapiens
ugcacagccugcugucugcag

SEQ ID NO: 1358159 - RNA, 14 nt, Homo sapiens
ugcaccaccaagcc

SEQ ID NO: 1358160 - RNA, 17 nt, Homo sapiens
ugcacguggccucuuga

SEQ ID NO: 1358161 - RNA, 20 nt, Homo sapiens
ugcacuagaggaacccuaca

SEQ ID NO: 1358162 - RNA, 16 nt, Homo sapiens
ugcacuccagccuggg

SEQ ID NO: 1358163 - RNA, 20 nt, Homo sapiens
ugcacuccagccugggcaac

SEQ ID NO: 1358164 - RNA, 23 nt, Homo sapiens
ugcacuccagccugggugacaaa

SEQ ID NO: 1358165 - RNA, 15 nt, Homo sapiens
ugcacugugaaggac

SEQ ID NO: 1358166 - RNA, 15 nt, Homo sapiens
ugcagaaacagugca

SEQ ID NO: 1358167 - RNA, 14 nt, Homo sapiens
ugcagaguacauga

SEQ ID NO: 1358168 - RNA, 18 nt, Homo sapiens
ugcagcagggaugcccug

SEQ ID NO: 1358169 - RNA, 13 nt, Homo sapiens
ugcagccagcuca

SEQ ID NO: 1358170 - RNA, 14 nt, Homo sapiens
ugcagcccaugccc

SEQ ID NO: 1358171 - RNA, 15 nt, Homo sapiens
ugcagcccaugccca

SEQ ID NO: 1358172 - RNA, 17 nt, Homo sapiens
ugcagcccuugugaugu

SEQ ID NO: 1358173 - RNA, 17 nt, Homo sapiens
ugcagggacggagcuga

SEQ ID NO: 1358174 - RNA, 23 nt, Homo sapiens
ugcagggcugggaagaagcugca

SEQ ID NO: 1358175 - RNA, 12 nt, Homo sapiens
ugcaggguccca

SEQ ID NO: 1358176 - RNA, 14 nt, Homo sapiens
ugcagugcacuuug

SEQ ID NO: 1358177 - RNA, 16 nt, Homo sapiens
ugccccugcugcuuaa

SEQ ID NO: 1358178 - RNA, 19 nt, Homo sapiens
ugccccuugacaacuggca

SEQ ID NO: 1358179 - RNA, 16 nt, Homo sapiens
ugcccgggcucccaca

SEQ ID NO: 1358180 - RNA, 22 nt, Homo sapiens
ugccuacgaauagccacugcau

SEQ ID NO: 1358181 - RNA, 15 nt, Homo sapiens
ugccucaaugccagu

SEQ ID NO: 1358182 - RNA, 16 nt, Homo sapiens
ugccucacuuccuaca

SEQ ID NO: 1358183 - RNA, 21 nt, Homo sapiens
ugccucauuaccuugugcuaa

SEQ ID NO: 1358184 - RNA, 22 nt, Homo sapiens
ugccucauuaccuugugcuaau

SEQ ID NO: 1358185 - RNA, 22 nt, Homo sapiens
ugccucuacuuugauucugaua

SEQ ID NO: 1358186 - RNA, 14 nt, Homo sapiens
ugccugacuaggga

SEQ ID NO: 1358187 - RNA, 17 nt, Homo sapiens
ugccugggccuuggcaa

SEQ ID NO: 1358188 - RNA, 14 nt, Homo sapiens
ugccuuaacuggag

SEQ ID NO: 1358189 - RNA, 19 nt, Homo sapiens
ugccuuacagacagaauau

SEQ ID NO: 1358190 - RNA, 14 nt, Homo sapiens
ugccuuaucuugca

SEQ ID NO: 1358191 - RNA, 21 nt, Homo sapiens
ugccuuugcccacguguccug

SEQ ID NO: 1358192 - RNA, 23 nt, Homo sapiens
ugcggagcuuuccaccucgccug

SEQ ID NO: 1358193 - RNA, 18 nt, Homo sapiens
ugcggccuuuggcuucac

SEQ ID NO: 1358194 - RNA, 17 nt, Homo sapiens
ugcgucgucaccaaauc

SEQ ID NO: 1358195 - RNA, 15 nt, Homo sapiens
ugcgucugcacugau

SEQ ID NO: 1358196 - RNA, 14 nt, Homo sapiens
ugcgugcgcaucuu

SEQ ID NO: 1358197 - RNA, 17 nt, Homo sapiens
ugcuauaacuauguuga

SEQ ID NO: 1358198 - RNA, 20 nt, Homo sapiens
ugcucaccuuuaucaccuca

SEQ ID NO: 1358199 - RNA, 22 nt, Homo sapiens
ugcucagggaauaauccagaaa

SEQ ID NO: 1358200 - RNA, 20 nt, Homo sapiens
ugcuccuuaugaugcccuaa

SEQ ID NO: 1358201 - RNA, 12 nt, Homo sapiens
ugcuccuuccaa

SEQ ID NO: 1358202 - RNA, 14 nt, Homo sapiens
ugcugaagaauauu

SEQ ID NO: 1358203 - RNA, 16 nt, Homo sapiens
ugcugaucacaugugc

SEQ ID NO: 1358204 - RNA, 15 nt, Homo sapiens
ugcugcuggugcaca

SEQ ID NO: 1358205 - RNA, 19 nt, Homo sapiens
ugcugcuugaggcaacuca

SEQ ID NO: 1358206 - RNA, 19 nt, Homo sapiens
ugcuggaaccugcaaaaaa

SEQ ID NO: 1358207 - RNA, 12 nt, Homo sapiens
ugcuggugcaca

SEQ ID NO: 1358208 - RNA, 20 nt, Homo sapiens
ugcugugccucgcauccuau

SEQ ID NO: 1358209 - RNA, 21 nt, Homo sapiens
ugcuguggagcuccacugcca

SEQ ID NO: 1358210 - RNA, 19 nt, Homo sapiens
ugcuuaagugcaugcauug

SEQ ID NO: 1358211 - RNA, 16 nt, Homo sapiens
ugcuucagugcugcuc

SEQ ID NO: 1358212 - RNA, 22 nt, Homo sapiens
ugcuucgggaagaaggggacaa

SEQ ID NO: 1358213 - RNA, 16 nt, Homo sapiens
ugcuugagcucaggag

SEQ ID NO: 1358214 - RNA, 15 nt, Homo sapiens
ugcuugucaucugca

SEQ ID NO: 1358215 - RNA, 21 nt, Homo sapiens
ugcuuguuugcucaccugggg

SEQ ID NO: 1358216 - RNA, 12 nt, Homo sapiens
ugcuuucugcuc

SEQ ID NO: 1358217 - RNA, 15 nt, Homo sapiens
uggaagacacuugcu

SEQ ID NO: 1358218 - RNA, 14 nt, Homo sapiens
uggaagauguguga

SEQ ID NO: 1358219 - RNA, 23 nt, Homo sapiens
uggaauuuucucacgcaggagcc

SEQ ID NO: 1358220 - RNA, 23 nt, Homo sapiens
uggacaaacagccucacuccuca

SEQ ID NO: 1358221 - RNA, 17 nt, Homo sapiens
uggacaaacagugcacu

SEQ ID NO: 1358222 - RNA, 19 nt, Homo sapiens
uggacguggguugcacugg

SEQ ID NO: 1358223 - RNA, 21 nt, Homo sapiens
uggacuauggcucuacuuuca

SEQ ID NO: 1358224 - RNA, 22 nt, Homo sapiens
uggacugguuuucacauuagaa

SEQ ID NO: 1358225 - RNA, 17 nt, Homo sapiens
uggagaccgugaccagu

SEQ ID NO: 1358226 - RNA, 19 nt, Homo sapiens
uggagauaccagagacucu

SEQ ID NO: 1358227 - RNA, 22 nt, Homo sapiens
uggaggcccaguucacccugau

SEQ ID NO: 1358228 - RNA, 23 nt, Homo sapiens
uggaggccuguccugaccugucu

SEQ ID NO: 1358229 - RNA, 18 nt, Homo sapiens
uggaguccgaugauucuc

SEQ ID NO: 1358230 - RNA, 19 nt, Homo sapiens
uggaucuccauucucucag

SEQ ID NO: 1358231 - RNA, 17 nt, Homo sapiens
uggaugcggccauucaa

SEQ ID NO: 1358232 - RNA, 13 nt, Homo sapiens
uggauucagaaua

SEQ ID NO: 1358233 - RNA, 14 nt, Homo sapiens
uggauugggguccc

SEQ ID NO: 1358234 - RNA, 21 nt, Homo sapiens
uggauuuuacauguggcccaa

SEQ ID NO: 1358235 - RNA, 13 nt, Homo sapiens
uggcaaaagaaaa

SEQ ID NO: 1358236 - RNA, 14 nt, Homo sapiens
uggcaaagccuuca

SEQ ID NO: 1358237 - RNA, 15 nt, Homo sapiens
uggcaaugaaacaaa

SEQ ID NO: 1358238 - RNA, 22 nt, Homo sapiens
uggcagaugagcuuauuucaaa

SEQ ID NO: 1358239 - RNA, 20 nt, Homo sapiens
uggcagcagaguguggccuu

SEQ ID NO: 1358240 - RNA, 15 nt, Homo sapiens
uggcagugguuugaa

SEQ ID NO: 1358241 - RNA, 19 nt, Homo sapiens
uggccaaggagcugcuaua

SEQ ID NO: 1358242 - RNA, 22 nt, Homo sapiens
uggcccauggcuguugguggga

SEQ ID NO: 1358243 - RNA, 15 nt, Homo sapiens
uggccuccuaugccu

SEQ ID NO: 1358244 - RNA, 19 nt, Homo sapiens
uggcguaucaucguacaca

SEQ ID NO: 1358245 - RNA, 16 nt, Homo sapiens
uggcuaagaguguccu

SEQ ID NO: 1358246 - RNA, 17 nt, Homo sapiens
uggcuacacacaaacca

SEQ ID NO: 1358247 - RNA, 16 nt, Homo sapiens
uggcucacaccuguaa

SEQ ID NO: 1358248 - RNA, 21 nt, Homo sapiens
uggcuccggccucugccuuug

SEQ ID NO: 1358249 - RNA, 14 nt, Homo sapiens
uggcucugaccgaa

SEQ ID NO: 1358250 - RNA, 19 nt, Homo sapiens
uggcuguugacgcaccugu

SEQ ID NO: 1358251 - RNA, 21 nt, Homo sapiens
uggcuucacagaugugugauu

SEQ ID NO: 1358252 - RNA, 23 nt, Homo sapiens
uggcuucacagaugugugauuca

SEQ ID NO: 1358253 - RNA, 21 nt, Homo sapiens
ugggaaggggagcacaauuuc

SEQ ID NO: 1358254 - RNA, 17 nt, Homo sapiens
ugggaauuaagcaaaau

SEQ ID NO: 1358255 - RNA, 18 nt, Homo sapiens
ugggagguugugggcauu

SEQ ID NO: 1358256 - RNA, 19 nt, Homo sapiens
ugggauggccgcugcucag

SEQ ID NO: 1358257 - RNA, 19 nt, Homo sapiens
ugggcaacaagagcaaaac

SEQ ID NO: 1358258 - RNA, 16 nt, Homo sapiens
ugggcaauauagcaag

SEQ ID NO: 1358259 - RNA, 17 nt, Homo sapiens
ugggcacacacacccgc

SEQ ID NO: 1358260 - RNA, 15 nt, Homo sapiens
ugggcagaaggccaa

SEQ ID NO: 1358261 - RNA, 14 nt, Homo sapiens
ugggccacugugaa

SEQ ID NO: 1358262 - RNA, 21 nt, Homo sapiens
ugggcccacccggugggaccc

SEQ ID NO: 1358263 - RNA, 22 nt, Homo sapiens
uggggacagagcagaacuuuca

SEQ ID NO: 1358264 - RNA, 23 nt, Homo sapiens
uggggacagagcagaacuuucac

SEQ ID NO: 1358265 - RNA, 16 nt, Homo sapiens
uggggcaggucacuuu

SEQ ID NO: 1358266 - RNA, 22 nt, Homo sapiens
uggggcaggucacuuuaccucu

SEQ ID NO: 1358267 - RNA, 13 nt, Homo sapiens
uggggcccagugc

SEQ ID NO: 1358268 - RNA, 16 nt, Homo sapiens
uggggcuccuaccugg

SEQ ID NO: 1358269 - RNA, 18 nt, Homo sapiens
uggggcuuuuacaccagu

SEQ ID NO: 1358270 - RNA, 12 nt, Homo sapiens
ugggggaaaaua

SEQ ID NO: 1358271 - RNA, 12 nt, Homo sapiens
uggggggaccca

SEQ ID NO: 1358272 - RNA, 19 nt, Homo sapiens
uggggggacccagugcaga

SEQ ID NO: 1358273 - RNA, 15 nt, Homo sapiens
uggggucaugcccuc

SEQ ID NO: 1358274 - RNA, 19 nt, Homo sapiens
uggguaagaagaaagcaaa

SEQ ID NO: 1358275 - RNA, 14 nt, Homo sapiens
uggguccaggggau

SEQ ID NO: 1358276 - RNA, 20 nt, Homo sapiens
ugggugaauaauacaguauc

SEQ ID NO: 1358277 - RNA, 15 nt, Homo sapiens
acugagccauccuca

SEQ ID NO: 1358278 - RNA, 18 nt, Homo sapiens
acugaguuugaacacaga

SEQ ID NO: 1358279 - RNA, 14 nt, Homo sapiens
acugauaaccacuc

SEQ ID NO: 1358280 - RNA, 22 nt, Homo sapiens
acugaucucgaugcagguggau

SEQ ID NO: 1358281 - RNA, 24 nt, Homo sapiens
acugaugaccgucugagcccagcu

SEQ ID NO: 1358282 - RNA, 17 nt, Homo sapiens
acugauuaccugccaau

SEQ ID NO: 1358283 - RNA, 17 nt, Homo sapiens
acugccaaaaugcucua

SEQ ID NO: 1358284 - RNA, 19 nt, Homo sapiens
acugccuuacagacagaau

SEQ ID NO: 1358285 - RNA, 22 nt, Homo sapiens
acugcugcugaggcuccuguua

SEQ ID NO: 1358286 - RNA, 13 nt, Homo sapiens
acugcugugagca

SEQ ID NO: 1358287 - RNA, 21 nt, Homo sapiens
acuggaagaaagcaacaaaga

SEQ ID NO: 1358288 - RNA, 19 nt, Homo sapiens
acuggagccccaucagcuc

SEQ ID NO: 1358289 - RNA, 15 nt, Homo sapiens
acuggaugaggucau

SEQ ID NO: 1358290 - RNA, 19 nt, Homo sapiens
acuggccccuacuuugugg

SEQ ID NO: 1358291 - RNA, 21 nt, Homo sapiens
acuguagcaaccugaaauuaa

SEQ ID NO: 1358292 - RNA, 14 nt, Homo sapiens
acuguagcuuuuag

SEQ ID NO: 1358293 - RNA, 16 nt, Homo sapiens
acugucuugaagacaa

SEQ ID NO: 1358294 - RNA, 21 nt, Homo sapiens
acugugaaauaccacaagccu

SEQ ID NO: 1358295 - RNA, 18 nt, Homo sapiens
acugugaaccggcuccca

SEQ ID NO: 1358296 - RNA, 22 nt, Homo sapiens
acugugaagagaaccauaucaa

SEQ ID NO: 1358297 - RNA, 23 nt, Homo sapiens
acuguuacaacuuguauuuccaa

SEQ ID NO: 1358298 - RNA, 13 nt, Homo sapiens
acuguuacuuugg

SEQ ID NO: 1358299 - RNA, 23 nt, Homo sapiens
acuguugugaaaaucugucauga

SEQ ID NO: 1358300 - RNA, 11 nt, Homo sapiens
acuuacccaag

SEQ ID NO: 1358301 - RNA, 14 nt, Homo sapiens
acuucaaagaagcu

SEQ ID NO: 1358302 - RNA, 13 nt, Homo sapiens
acuucaaggguuu

SEQ ID NO: 1358303 - RNA, 22 nt, Homo sapiens
acuucaaggguuuguugaacaa

SEQ ID NO: 1358304 - RNA, 22 nt, Homo sapiens
acuucauacaauguaaggucag

SEQ ID NO: 1358305 - RNA, 21 nt, Homo sapiens
acuucauagaaaccucucuau

SEQ ID NO: 1358306 - RNA, 21 nt, Homo sapiens
acuuccaucuagucacaaaga

SEQ ID NO: 1358307 - RNA, 14 nt, Homo sapiens
acuugcaagccuca

SEQ ID NO: 1358308 - RNA, 13 nt, Homo sapiens
acuugggaacuag

SEQ ID NO: 1358309 - RNA, 17 nt, Homo sapiens
acuuggucagagccacu

SEQ ID NO: 1358310 - RNA, 18 nt, Homo sapiens
acuugucauagacuccuu

SEQ ID NO: 1358311 - RNA, 14 nt, Homo sapiens
acuugucucaggac

SEQ ID NO: 1358312 - RNA, 16 nt, Homo sapiens
acuugugucccaugau

SEQ ID NO: 1358313 - RNA, 23 nt, Homo sapiens
acuugugugugcgugucaguuac

SEQ ID NO: 1358314 - RNA, 14 nt, Homo sapiens
acuuuaaaaugcca

SEQ ID NO: 1358315 - RNA, 19 nt, Homo sapiens
acuuuacugagacaaugua

SEQ ID NO: 1358316 - RNA, 19 nt, Homo sapiens
acuuuaggugaacaaauaa

SEQ ID NO: 1358317 - RNA, 23 nt, Homo sapiens
acuuugacuuucuucugaauauu

SEQ ID NO: 1358318 - RNA, 16 nt, Homo sapiens
acuuugagcuacugcc

SEQ ID NO: 1358319 - RNA, 15 nt, Homo sapiens
acuuugagcugagug

SEQ ID NO: 1358320 - RNA, 22 nt, Homo sapiens
acuuuuacacgaccauuugaua

SEQ ID NO: 1358321 - RNA, 13 nt, Homo sapiens
acuuuuaucacug

SEQ ID NO: 1358322 - RNA, 17 nt, Homo sapiens
acuuuuuaaaacacaac

SEQ ID NO: 1358323 - RNA, 19 nt, Homo sapiens
agaaaaaaaccacacaaag

SEQ ID NO: 1358324 - RNA, 17 nt, Homo sapiens
agaaaaauaucuuggcc

SEQ ID NO: 1358325 - RNA, 13 nt, Homo sapiens
agaaaaauuaauu

SEQ ID NO: 1358326 - RNA, 12 nt, Homo sapiens
agaaagcaaaag

SEQ ID NO: 1358327 - RNA, 17 nt, Homo sapiens
agaaagcucaucucagc

SEQ ID NO: 1358328 - RNA, 12 nt, Homo sapiens
agaaaggcauga

SEQ ID NO: 1358329 - RNA, 21 nt, Homo sapiens
agaaagggcggugaacucugg

SEQ ID NO: 1358330 - RNA, 14 nt, Homo sapiens
agaaaguauuuuca

SEQ ID NO: 1358331 - RNA, 21 nt, Homo sapiens
agaaauaaggacaagccuaac

SEQ ID NO: 1358332 - RNA, 22 nt, Homo sapiens
agaaaucuagaauuuuuacuua

SEQ ID NO: 1358333 - RNA, 22 nt, Homo sapiens
agaaccuugucccagccaguga

SEQ ID NO: 1358334 - RNA, 15 nt, Homo sapiens
agaacuaaaguaucu

SEQ ID NO: 1358335 - RNA, 19 nt, Homo sapiens
agaagacuauauuguacac

SEQ ID NO: 1358336 - RNA, 13 nt, Homo sapiens
agaaggagggaga

SEQ ID NO: 1358337 - RNA, 14 nt, Homo sapiens
agaaggcggcacuu

SEQ ID NO: 1358338 - RNA, 15 nt, Homo sapiens
agaaggcucuugcca

SEQ ID NO: 1358339 - RNA, 12 nt, Homo sapiens
agaaggggacaa

SEQ ID NO: 1358340 - RNA, 19 nt, Homo sapiens
agaaggugugcuauucaca

SEQ ID NO: 1358341 - RNA, 13 nt, Homo sapiens
agaauaugacuuu

SEQ ID NO: 1358342 - RNA, 21 nt, Homo sapiens
agaaugcaucucaucaacuua

SEQ ID NO: 1358343 - RNA, 20 nt, Homo sapiens
agaaugccgguuaaauucca

SEQ ID NO: 1358344 - RNA, 15 nt, Homo sapiens
agaaugugacaggca

SEQ ID NO: 1358345 - RNA, 18 nt, Homo sapiens
agaauuaaaaaagcauac

SEQ ID NO: 1358346 - RNA, 22 nt, Homo sapiens
agaauuauagaacuaaaguauc

SEQ ID NO: 1358347 - RNA, 12 nt, Homo sapiens
agacaagugauu

SEQ ID NO: 1358348 - RNA, 16 nt, Homo sapiens
agacaauagcccaaag

SEQ ID NO: 1358349 - RNA, 21 nt, Homo sapiens
agacaauggcuuacuccagga

SEQ ID NO: 1358350 - RNA, 13 nt, Homo sapiens
agacaauuugcac

SEQ ID NO: 1358351 - RNA, 19 nt, Homo sapiens
agacacccaggacuuauuu

SEQ ID NO: 1358352 - RNA, 12 nt, Homo sapiens
agacaccugguu

SEQ ID NO: 1358353 - RNA, 16 nt, Homo sapiens
agacaggcucuuagca

SEQ ID NO: 1358354 - RNA, 22 nt, Homo sapiens
agacagggugggaguagugcuu

SEQ ID NO: 1358355 - RNA, 21 nt, Homo sapiens
agacauacuugaagggccaga

SEQ ID NO: 1358356 - RNA, 21 nt, Homo sapiens
agacauuucucuaacuccugc

SEQ ID NO: 1358357 - RNA, 14 nt, Homo sapiens
agaccugauccugg

SEQ ID NO: 1358358 - RNA, 14 nt, Homo sapiens
agacgacuguggug

SEQ ID NO: 1358359 - RNA, 20 nt, Homo sapiens
agacgcagacaugugcacuu

SEQ ID NO: 1358360 - RNA, 15 nt, Homo sapiens
agacuagauugccuu

SEQ ID NO: 1358361 - RNA, 15 nt, Homo sapiens
agacuaugucaccca

SEQ ID NO: 1358362 - RNA, 22 nt, Homo sapiens
agacucaugguguguuacacaa

SEQ ID NO: 1358363 - RNA, 20 nt, Homo sapiens
agacucuuuaguugauuuaa

SEQ ID NO: 1358364 - RNA, 17 nt, Homo sapiens
agacuuaaaaacuugaa

SEQ ID NO: 1358365 - RNA, 18 nt, Homo sapiens
agacuuccucuguucuca

SEQ ID NO: 1358366 - RNA, 14 nt, Homo sapiens
agagaaacugaggu

SEQ ID NO: 1358367 - RNA, 18 nt, Homo sapiens
agagacgcagacaugugc

SEQ ID NO: 1358368 - RNA, 17 nt, Homo sapiens
agagaucccaaguagaa

SEQ ID NO: 1358369 - RNA, 15 nt, Homo sapiens
agugaauuguugaca

SEQ ID NO: 1358370 - RNA, 16 nt, Homo sapiens
agugacaaaccaucca

SEQ ID NO: 1358371 - RNA, 16 nt, Homo sapiens
agugacacaaucucag

SEQ ID NO: 1358372 - RNA, 20 nt, Homo sapiens
agugacaguugcagcccuug

SEQ ID NO: 1358373 - RNA, 19 nt, Homo sapiens
agugacauaauauauucua

SEQ ID NO: 1358374 - RNA, 22 nt, Homo sapiens
agugacauuucuaucacaauca

SEQ ID NO: 1358375 - RNA, 22 nt, Homo sapiens
agugacuugugucccaugaucc

SEQ ID NO: 1358376 - RNA, 16 nt, Homo sapiens
agugacuuugagcuga

SEQ ID NO: 1358377 - RNA, 19 nt, Homo sapiens
agugacuuugagcugagug

SEQ ID NO: 1358378 - RNA, 20 nt, Homo sapiens
agugacuuugagcugagugc

SEQ ID NO: 1358379 - RNA, 15 nt, Homo sapiens
agugaggaaagccuc

SEQ ID NO: 1358380 - RNA, 23 nt, Homo sapiens
agugauuuuauuagaaguuucau

SEQ ID NO: 1358381 - RNA, 20 nt, Homo sapiens
agugcaugcauugagcugcc

SEQ ID NO: 1358382 - RNA, 13 nt, Homo sapiens
agugcccuuccug

SEQ ID NO: 1358383 - RNA, 20 nt, Homo sapiens
agugccuucuaaagguguug

SEQ ID NO: 1358384 - RNA, 15 nt, Homo sapiens
agugcugaacagugg

SEQ ID NO: 1358385 - RNA, 19 nt, Homo sapiens
agugcugugcugugcuaug

SEQ ID NO: 1358386 - RNA, 21 nt, Homo sapiens
agugcuugauugcguggaauu

SEQ ID NO: 1358387 - RNA, 22 nt, Homo sapiens
agugcuuguuccucucaucucc

SEQ ID NO: 1358388 - RNA, 14 nt, Homo sapiens
aguggaauacuaaa

SEQ ID NO: 1358389 - RNA, 23 nt, Homo sapiens
aguggcugcacaggcacugugca

SEQ ID NO: 1358390 - RNA, 22 nt, Homo sapiens
aguggucaauguagauuucaag

SEQ ID NO: 1358391 - RNA, 13 nt, Homo sapiens
aguggugccaaac

SEQ ID NO: 1358392 - RNA, 15 nt, Homo sapiens
aguguagacuguggc

SEQ ID NO: 1358393 - RNA, 22 nt, Homo sapiens
aguguaggccuuccagugcagg

SEQ ID NO: 1358394 - RNA, 17 nt, Homo sapiens
aguguaugacugcacau

SEQ ID NO: 1358395 - RNA, 19 nt, Homo sapiens
agugucuugagacuuuauc

SEQ ID NO: 1358396 - RNA, 14 nt, Homo sapiens
agugucuuuugaca

SEQ ID NO: 1358397 - RNA, 17 nt, Homo sapiens
aguguucacaaccugga

SEQ ID NO: 1358398 - RNA, 20 nt, Homo sapiens
aguuauuacauguaauuuga

SEQ ID NO: 1358399 - RNA, 12 nt, Homo sapiens
aguucaagagaa

SEQ ID NO: 1358400 - RNA, 13 nt, Homo sapiens
aguucagacuuuu

SEQ ID NO: 1358401 - RNA, 12 nt, Homo sapiens
aguucauugugg

SEQ ID NO: 1358402 - RNA, 13 nt, Homo sapiens
aguucccuuggcc

SEQ ID NO: 1358403 - RNA, 23 nt, Homo sapiens
aguuccucauuuuugaauacagg

SEQ ID NO: 1358404 - RNA, 16 nt, Homo sapiens
aguuccuuucaauggu

SEQ ID NO: 1358405 - RNA, 16 nt, Homo sapiens
aguucuuugggccaga

SEQ ID NO: 1358406 - RNA, 19 nt, Homo sapiens
aguucuuugggccagacau

SEQ ID NO: 1358407 - RNA, 13 nt, Homo sapiens
aguugaucuggaa

SEQ ID NO: 1358408 - RNA, 19 nt, Homo sapiens
aguugaucuggaacccaga

SEQ ID NO: 1358409 - RNA, 23 nt, Homo sapiens
aguuugaguuacuaucaugucaa

SEQ ID NO: 1358410 - RNA, 18 nt, Homo sapiens
aguuuguacucaguggac

SEQ ID NO: 1358411 - RNA, 21 nt, Homo sapiens
aguuuguuuacacuugucuca

SEQ ID NO: 1358412 - RNA, 16 nt, Homo sapiens
auaaaacaggucaaua

SEQ ID NO: 1358413 - RNA, 23 nt, Homo sapiens
auaaaagaucuugaauagucuca

SEQ ID NO: 1358414 - RNA, 20 nt, Homo sapiens
auaaaaguacuagcuuacuu

SEQ ID NO: 1358415 - RNA, 21 nt, Homo sapiens
auaaaauuaaagcugaaaacu

SEQ ID NO: 1358416 - RNA, 19 nt, Homo sapiens
auaaaggaaacccagcuca

SEQ ID NO: 1358417 - RNA, 18 nt, Homo sapiens
auaaaguaguccugugaa

SEQ ID NO: 1358418 - RNA, 21 nt, Homo sapiens
auaaauccucucuaucacauc

SEQ ID NO: 1358419 - RNA, 18 nt, Homo sapiens
auaaaucugacccagugc

SEQ ID NO: 1358420 - RNA, 14 nt, Homo sapiens
auaaccacuccuaa

SEQ ID NO: 1358421 - RNA, 16 nt, Homo sapiens
auaacuuuaacuuuua

SEQ ID NO: 1358422 - RNA, 20 nt, Homo sapiens
auaacuuuguuuagcccaaa

SEQ ID NO: 1358423 - RNA, 15 nt, Homo sapiens
auaagaggauaugaa

SEQ ID NO: 1358424 - RNA, 16 nt, Homo sapiens
auaauacaguaucuca

SEQ ID NO: 1358425 - RNA, 15 nt, Homo sapiens
auaauuaguuccuca

SEQ ID NO: 1358426 - RNA, 13 nt, Homo sapiens
auaauuauuacau

SEQ ID NO: 1358427 - RNA, 16 nt, Homo sapiens
auaauuauuacauggu

SEQ ID NO: 1358428 - RNA, 13 nt, Homo sapiens
auaauuguuucau

SEQ ID NO: 1358429 - RNA, 17 nt, Homo sapiens
auaauuguuucauucau

SEQ ID NO: 1358430 - RNA, 20 nt, Homo sapiens
auaauuguuucauucauccu

SEQ ID NO: 1358431 - RNA, 20 nt, Homo sapiens
auaauuuagaccccauacaa

SEQ ID NO: 1358432 - RNA, 20 nt, Homo sapiens
auacaaaacccuuucugccc

SEQ ID NO: 1358433 - RNA, 15 nt, Homo sapiens
auacacuaugaagau

SEQ ID NO: 1358434 - RNA, 15 nt, Homo sapiens
auacaguaucucagg

SEQ ID NO: 1358435 - RNA, 16 nt, Homo sapiens
auacaguaucucaggg

SEQ ID NO: 1358436 - RNA, 17 nt, Homo sapiens
auaccagagacucugaa

SEQ ID NO: 1358437 - RNA, 20 nt, Homo sapiens
auaccagguuaccucacuuu

SEQ ID NO: 1358438 - RNA, 15 nt, Homo sapiens
auaccugauauauuc

SEQ ID NO: 1358439 - RNA, 17 nt, Homo sapiens
auaccugauauauucca

SEQ ID NO: 1358440 - RNA, 13 nt, Homo sapiens
auacgcaucagac

SEQ ID NO: 1358441 - RNA, 15 nt, Homo sapiens
auacugggugcuguc

SEQ ID NO: 1358442 - RNA, 21 nt, Homo sapiens
auacuguugucagguacagua

SEQ ID NO: 1358443 - RNA, 18 nt, Homo sapiens
auacuuugcaauccaaau

SEQ ID NO: 1358444 - RNA, 14 nt, Homo sapiens
auagaaaucuagaa

SEQ ID NO: 1358445 - RNA, 12 nt, Homo sapiens
auagaaaugcca

SEQ ID NO: 1358446 - RNA, 22 nt, Homo sapiens
auagaugcuggcccagggccca

SEQ ID NO: 1358447 - RNA, 19 nt, Homo sapiens
auagcaugcaucuguuuau

SEQ ID NO: 1358448 - RNA, 23 nt, Homo sapiens
auuagugguuuaucagcaaaaaa

SEQ ID NO: 1358449 - RNA, 13 nt, Homo sapiens
auuauauuugaca

SEQ ID NO: 1358450 - RNA, 14 nt, Homo sapiens
auuauauuugacau

SEQ ID NO: 1358451 - RNA, 18 nt, Homo sapiens
auuaucuaugauaugcua

SEQ ID NO: 1358452 - RNA, 22 nt, Homo sapiens
auuaugacacuagauacaguaa

SEQ ID NO: 1358453 - RNA, 13 nt, Homo sapiens
auuauuuacugaa

SEQ ID NO: 1358454 - RNA, 23 nt, Homo sapiens
auucaaaagcacuuugugcugug

SEQ ID NO: 1358455 - RNA, 13 nt, Homo sapiens
auucaacaaauau

SEQ ID NO: 1358456 - RNA, 12 nt, Homo sapiens
auucaaggggag

SEQ ID NO: 1358457 - RNA, 18 nt, Homo sapiens
auucacaaaauuuccaca

SEQ ID NO: 1358458 - RNA, 16 nt, Homo sapiens
auucagccaggagaug

SEQ ID NO: 1358459 - RNA, 17 nt, Homo sapiens
auucagcucugcaagaa

SEQ ID NO: 1358460 - RNA, 16 nt, Homo sapiens
auucaguuuucaggau

SEQ ID NO: 1358461 - RNA, 17 nt, Homo sapiens
auucauccugaccaaga

SEQ ID NO: 1358462 - RNA, 14 nt, Homo sapiens
auuccaggaugcug

SEQ ID NO: 1358463 - RNA, 18 nt, Homo sapiens
auucuaacuuuuuugcua

SEQ ID NO: 1358464 - RNA, 22 nt, Homo sapiens
auucuggcaucuuagaccucca

SEQ ID NO: 1358465 - RNA, 19 nt, Homo sapiens
auugacgacaagugcugaa

SEQ ID NO: 1358466 - RNA, 15 nt, Homo sapiens
auugaguuuuuacaa

SEQ ID NO: 1358467 - RNA, 18 nt, Homo sapiens
auugauuucaacagaauc

SEQ ID NO: 1358468 - RNA, 20 nt, Homo sapiens
auugcagauaacuuugacuu

SEQ ID NO: 1358469 - RNA, 18 nt, Homo sapiens
auugcagcaggugguaau

SEQ ID NO: 1358470 - RNA, 12 nt, Homo sapiens
auugcuuugcca

SEQ ID NO: 1358471 - RNA, 20 nt, Homo sapiens
auuggcaccuaauccaggca

SEQ ID NO: 1358472 - RNA, 21 nt, Homo sapiens
auuggcaccuaauccaggcag

SEQ ID NO: 1358473 - RNA, 20 nt, Homo sapiens
auuggccggcuaguguuucc

SEQ ID NO: 1358474 - RNA, 14 nt, Homo sapiens
auuggcucugcuca

SEQ ID NO: 1358475 - RNA, 22 nt, Homo sapiens
auugggacccuccagugcugga

SEQ ID NO: 1358476 - RNA, 18 nt, Homo sapiens
auuggugcucacugccag

SEQ ID NO: 1358477 - RNA, 15 nt, Homo sapiens
auugguuaaggucuu

SEQ ID NO: 1358478 - RNA, 21 nt, Homo sapiens
auuguacuuaaaccuccugcu

SEQ ID NO: 1358479 - RNA, 14 nt, Homo sapiens
auugucuuaauguc

SEQ ID NO: 1358480 - RNA, 18 nt, Homo sapiens
auuguucuuguaagcuuu

SEQ ID NO: 1358481 - RNA, 14 nt, Homo sapiens
auuuaaaacuugcc

SEQ ID NO: 1358482 - RNA, 13 nt, Homo sapiens
auuuaaauuccac

SEQ ID NO: 1358483 - RNA, 16 nt, Homo sapiens
auuuaaauuccacaga

SEQ ID NO: 1358484 - RNA, 13 nt, Homo sapiens
auuuaaucuccau

SEQ ID NO: 1358485 - RNA, 20 nt, Homo sapiens
auuuacuauuacucccagga

SEQ ID NO: 1358486 - RNA, 12 nt, Homo sapiens
auuucagacucc

SEQ ID NO: 1358487 - RNA, 14 nt, Homo sapiens
auuucagcauuauu

SEQ ID NO: 1358488 - RNA, 21 nt, Homo sapiens
auuucauaagaaccucaaaau

SEQ ID NO: 1358489 - RNA, 14 nt, Homo sapiens
auuucauugcucag

SEQ ID NO: 1358490 - RNA, 21 nt, Homo sapiens
auuuccacaaaaucuguccaa

SEQ ID NO: 1358491 - RNA, 12 nt, Homo sapiens
auuucccaggac

SEQ ID NO: 1358492 - RNA, 14 nt, Homo sapiens
auuucucugagauc

SEQ ID NO: 1358493 - RNA, 20 nt, Homo sapiens
auuugggccugcuccagacc

SEQ ID NO: 1358494 - RNA, 14 nt, Homo sapiens
auuuuaaaaacaua

SEQ ID NO: 1358495 - RNA, 18 nt, Homo sapiens
auuuuacauguggcccaa

SEQ ID NO: 1358496 - RNA, 19 nt, Homo sapiens
auuuuauucaagaaugcca

SEQ ID NO: 1358497 - RNA, 23 nt, Homo sapiens
auuuuauuuuuguaucuuaaaaa

SEQ ID NO: 1358498 - RNA, 22 nt, Homo sapiens
auuuucaagagucuaauagucu

SEQ ID NO: 1358499 - RNA, 21 nt, Homo sapiens
auuuucagagugacacccaag

SEQ ID NO: 1358500 - RNA, 23 nt, Homo sapiens
auuuugaaaugaaacaagcuuac

SEQ ID NO: 1358501 - RNA, 14 nt, Homo sapiens
auuuugucuaccau

SEQ ID NO: 1358502 - RNA, 20 nt, Homo sapiens
auuuuguguaaaaaaaccac

SEQ ID NO: 1358503 - RNA, 16 nt, Homo sapiens
auuuuuaauuaauuuc

SEQ ID NO: 1358504 - RNA, 21 nt, Homo sapiens
auuuuuuuagguuaaaguuaa

SEQ ID NO: 1358505 - RNA, 19 nt, Homo sapiens
caaaaaaauuaaaauggau

SEQ ID NO: 1358506 - RNA, 21 nt, Homo sapiens
caaaaaaauuaaaauggaugc

SEQ ID NO: 1358507 - RNA, 24 nt, Homo sapiens
caaaaaacauuguuuuguguaaca

SEQ ID NO: 1358508 - RNA, 10 nt, Homo sapiens
caaaaaccaa

SEQ ID NO: 1358509 - RNA, 13 nt, Homo sapiens
caaaaaccaaaug

SEQ ID NO: 1358510 - RNA, 10 nt, Homo sapiens
caaaaacugu

SEQ ID NO: 1358511 - RNA, 21 nt, Homo sapiens
caaaacaccagggacacauuu

SEQ ID NO: 1358512 - RNA, 14 nt, Homo sapiens
caaaacccuuucug

SEQ ID NO: 1358513 - RNA, 15 nt, Homo sapiens
caaaacugcauuuca

SEQ ID NO: 1358514 - RNA, 13 nt, Homo sapiens
caaaagcaaggga

SEQ ID NO: 1358515 - RNA, 17 nt, Homo sapiens
caaaauagaaaaguuau

SEQ ID NO: 1358516 - RNA, 23 nt, Homo sapiens
caaacuaccuuccaguuccucau

SEQ ID NO: 1358517 - RNA, 16 nt, Homo sapiens
caaagagagaaaguuu

SEQ ID NO: 1358518 - RNA, 21 nt, Homo sapiens
caaagcccucccuaccuacca

SEQ ID NO: 1358519 - RNA, 20 nt, Homo sapiens
caaagccuucauugccuuaa

SEQ ID NO: 1358520 - RNA, 14 nt, Homo sapiens
caaagcuguuauug

SEQ ID NO: 1358521 - RNA, 15 nt, Homo sapiens
caaagcuuuccugcc

SEQ ID NO: 1358522 - RNA, 19 nt, Homo sapiens
caaaggcagcugugucuga

SEQ ID NO: 1358523 - RNA, 15 nt, Homo sapiens
caaaguacuugucau

SEQ ID NO: 1358524 - RNA, 23 nt, Homo sapiens
caaagucccaggcccagugcagu

SEQ ID NO: 1358525 - RNA, 23 nt, Homo sapiens
caaauaaaugggaaaaaaaugaa

SEQ ID NO: 1358526 - RNA, 14 nt, Homo sapiens
caaaucaccacaaa

SEQ ID NO: 1358527 - RNA, 22 nt, Homo sapiens
caaauccuuagaucuggcaugu

SEQ ID NO: 1358528 - RNA, 14 nt, Homo sapiens
caaaugcccagcuu

SEQ ID NO: 1358529 - RNA, 23 nt, Homo sapiens
auccucaggcagguaaccccaga

SEQ ID NO: 1358530 - RNA, 17 nt, Homo sapiens
auccucucuaucacauc

SEQ ID NO: 1358531 - RNA, 21 nt, Homo sapiens
aucgacuuguuuuugcacaug

SEQ ID NO: 1358532 - RNA, 16 nt, Homo sapiens
aucgcugucaucucag

SEQ ID NO: 1358533 - RNA, 17 nt, Homo sapiens
aucggucagaagcacca

SEQ ID NO: 1358534 - RNA, 22 nt, Homo sapiens
aucuaaaccauaugaacauaua

SEQ ID NO: 1358535 - RNA, 17 nt, Homo sapiens
aucuagaagacugucag

SEQ ID NO: 1358536 - RNA, 21 nt, Homo sapiens
aucuaugccuaaaaaguauca

SEQ ID NO: 1358537 - RNA, 20 nt, Homo sapiens
aucucagaaccuugucccag

SEQ ID NO: 1358538 - RNA, 15 nt, Homo sapiens
aucucagcacucugu

SEQ ID NO: 1358539 - RNA, 23 nt, Homo sapiens
aucucagcuccugaaaaaugccu

SEQ ID NO: 1358540 - RNA, 19 nt, Homo sapiens
aucucuacugaaaguacaa

SEQ ID NO: 1358541 - RNA, 13 nt, Homo sapiens
aucucugacuuaa

SEQ ID NO: 1358542 - RNA, 13 nt, Homo sapiens
aucucugccauau

SEQ ID NO: 1358543 - RNA, 14 nt, Homo sapiens
aucugagaaacucu

SEQ ID NO: 1358544 - RNA, 11 nt, Homo sapiens
aucugccauug

SEQ ID NO: 1358545 - RNA, 15 nt, Homo sapiens
aucuggaaccucagc

SEQ ID NO: 1358546 - RNA, 16 nt, Homo sapiens
aucuggcuuagugcca

SEQ ID NO: 1358547 - RNA, 18 nt, Homo sapiens
aucuggcuuagugccacc

SEQ ID NO: 1358548 - RNA, 15 nt, Homo sapiens
aucuguaguaauuua

SEQ ID NO: 1358549 - RNA, 17 nt, Homo sapiens
aucugugccccaugccu

SEQ ID NO: 1358550 - RNA, 15 nt, Homo sapiens
aucuuaauacuugaa

SEQ ID NO: 1358551 - RNA, 17 nt, Homo sapiens
aucuuagauguuucaca

SEQ ID NO: 1358552 - RNA, 18 nt, Homo sapiens
aucuuauacuguacaaua

SEQ ID NO: 1358553 - RNA, 19 nt, Homo sapiens
aucuuauacuguacaauaa

SEQ ID NO: 1358554 - RNA, 23 nt, Homo sapiens
aucuuccguggucagagugccac

SEQ ID NO: 1358555 - RNA, 18 nt, Homo sapiens
aucuugccuccaggugca

SEQ ID NO: 1358556 - RNA, 15 nt, Homo sapiens
aucuuugacugaaaa

SEQ ID NO: 1358557 - RNA, 18 nt, Homo sapiens
aucuuuguggccaaggag

SEQ ID NO: 1358558 - RNA, 15 nt, Homo sapiens
augaaacaaacugga

SEQ ID NO: 1358559 - RNA, 15 nt, Homo sapiens
augaaauacucaggg

SEQ ID NO: 1358560 - RNA, 22 nt, Homo sapiens
augaaauggacaaacagugcac

SEQ ID NO: 1358561 - RNA, 17 nt, Homo sapiens
augaaauuauaaucugu

SEQ ID NO: 1358562 - RNA, 11 nt, Homo sapiens
augaacauaua

SEQ ID NO: 1358563 - RNA, 21 nt, Homo sapiens
augaauauauuuaagcaacau

SEQ ID NO: 1358564 - RNA, 17 nt, Homo sapiens
augaaugggagugaggg

SEQ ID NO: 1358565 - RNA, 14 nt, Homo sapiens
augacaucagcaau

SEQ ID NO: 1358566 - RNA, 19 nt, Homo sapiens
augacaucagcaauacaga

SEQ ID NO: 1358567 - RNA, 15 nt, Homo sapiens
augacugcagggcug

SEQ ID NO: 1358568 - RNA, 12 nt, Homo sapiens
augagcauuugu

SEQ ID NO: 1358569 - RNA, 20 nt, Homo sapiens
augagccuggcaagaaugug

SEQ ID NO: 1358570 - RNA, 23 nt, Homo sapiens
augaucaacucauuccagcuuuc

SEQ ID NO: 1358571 - RNA, 16 nt, Homo sapiens
augaucaaggugaaau

SEQ ID NO: 1358572 - RNA, 22 nt, Homo sapiens
augaugcgggccagugcuccag

SEQ ID NO: 1358573 - RNA, 21 nt, Homo sapiens
augaugcuagccagcaaagau

SEQ ID NO: 1358574 - RNA, 16 nt, Homo sapiens
augauggcaacagauc

SEQ ID NO: 1358575 - RNA, 16 nt, Homo sapiens
augauggcagugguuu

SEQ ID NO: 1358576 - RNA, 19 nt, Homo sapiens
augaugucguuugaaucac

SEQ ID NO: 1358577 - RNA, 22 nt, Homo sapiens
augauuaggcccgccaaacuuc

SEQ ID NO: 1358578 - RNA, 15 nt, Homo sapiens
augcaaaagguuuau

SEQ ID NO: 1358579 - RNA, 12 nt, Homo sapiens
augcaagugcaa

SEQ ID NO: 1358580 - RNA, 19 nt, Homo sapiens
augcaauguaagcauacuu

SEQ ID NO: 1358581 - RNA, 13 nt, Homo sapiens
augcagcagggau

SEQ ID NO: 1358582 - RNA, 15 nt, Homo sapiens
augcauaaaauguua

SEQ ID NO: 1358583 - RNA, 23 nt, Homo sapiens
augcauauccaacaugugcucag

SEQ ID NO: 1358584 - RNA, 16 nt, Homo sapiens
augcauggugccccag

SEQ ID NO: 1358585 - RNA, 22 nt, Homo sapiens
augcauuagaagucagccagcg

SEQ ID NO: 1358586 - RNA, 23 nt, Homo sapiens
augccacaaggacuuccugucca

SEQ ID NO: 1358587 - RNA, 17 nt, Homo sapiens
augccgccucaaggguc

SEQ ID NO: 1358588 - RNA, 18 nt, Homo sapiens
augccuaaaaaguaucau

SEQ ID NO: 1358589 - RNA, 18 nt, Homo sapiens
augcgggccagugcucca

SEQ ID NO: 1358590 - RNA, 15 nt, Homo sapiens
augcguuuaaucaca

SEQ ID NO: 1358591 - RNA, 18 nt, Homo sapiens
augcuauaacuauguuga

SEQ ID NO: 1358592 - RNA, 21 nt, Homo sapiens
augcuccaucccaaccaggca

SEQ ID NO: 1358593 - RNA, 17 nt, Homo sapiens
augcuccuuccaacagg

SEQ ID NO: 1358594 - RNA, 19 nt, Homo sapiens
augcuggaaccugcaaaaa

SEQ ID NO: 1358595 - RNA, 19 nt, Homo sapiens
augcugugauugugccuac

SEQ ID NO: 1358596 - RNA, 18 nt, Homo sapiens
augcuguguccacggggu

SEQ ID NO: 1358597 - RNA, 19 nt, Homo sapiens
augcuuacgucaaaacagc

SEQ ID NO: 1358598 - RNA, 11 nt, Homo sapiens
augcuuccaac

SEQ ID NO: 1358599 - RNA, 18 nt, Homo sapiens
augcuuccucgugccaau

SEQ ID NO: 1358600 - RNA, 14 nt, Homo sapiens
augcuugucuggca

SEQ ID NO: 1358601 - RNA, 15 nt, Homo sapiens
auggaaccauuuuag

SEQ ID NO: 1358602 - RNA, 18 nt, Homo sapiens
auggaagccaacacauca

SEQ ID NO: 1358603 - RNA, 15 nt, Homo sapiens
auggagaccgugacc

SEQ ID NO: 1358604 - RNA, 17 nt, Homo sapiens
auggaugggggaacuca

SEQ ID NO: 1358605 - RNA, 19 nt, Homo sapiens
auggaugggggaacucaga

SEQ ID NO: 1358606 - RNA, 21 nt, Homo sapiens
auggaugggggaacucagauc

SEQ ID NO: 1358607 - RNA, 18 nt, Homo sapiens
auggcaugagaaauacaa

SEQ ID NO: 1358608 - RNA, 23 nt, Homo sapiens
auggcuuuggcuuugcaaaauaa

SEQ ID NO: 1358609 - RNA, 22 nt, Homo sapiens
gaucucugcuuuggaaaucaca

SEQ ID NO: 1358610 - RNA, 18 nt, Homo sapiens
gaucuggaaccucagccu

SEQ ID NO: 1358611 - RNA, 15 nt, Homo sapiens
gaucuggcagacuca

SEQ ID NO: 1358612 - RNA, 23 nt, Homo sapiens
gaucuuccguggucagagugcca

SEQ ID NO: 1358613 - RNA, 9 nt, Homo sapiens
gaucuugaa

SEQ ID NO: 1358614 - RNA, 18 nt, Homo sapiens
gaucuugaauagucucau

SEQ ID NO: 1358615 - RNA, 15 nt, Homo sapiens
gaugaggcuuuccau

SEQ ID NO: 1358616 - RNA, 16 nt, Homo sapiens
gaugauacacuaugaa

SEQ ID NO: 1358617 - RNA, 14 nt, Homo sapiens
gaugcaagugcaac

SEQ ID NO: 1358618 - RNA, 14 nt, Homo sapiens
gaugccgccucaag

SEQ ID NO: 1358619 - RNA, 17 nt, Homo sapiens
gaugccgccucaagggu

SEQ ID NO: 1358620 - RNA, 20 nt, Homo sapiens
gauggcgccaccgcacucca

SEQ ID NO: 1358621 - RNA, 18 nt, Homo sapiens
gauggcgggcagcuggug

SEQ ID NO: 1358622 - RNA, 17 nt, Homo sapiens
gaugucugggugaccuc

SEQ ID NO: 1358623 - RNA, 19 nt, Homo sapiens
gauguuauuagauguuaca

SEQ ID NO: 1358624 - RNA, 17 nt, Homo sapiens
gauguuguagacugaga

SEQ ID NO: 1358625 - RNA, 22 nt, Homo sapiens
gauuaaugaaucguaaugaagu

SEQ ID NO: 1358626 - RNA, 19 nt, Homo sapiens
gauuacaggcaugagccac

SEQ ID NO: 1358627 - RNA, 18 nt, Homo sapiens
gauuagugucucaugugg

SEQ ID NO: 1358628 - RNA, 13 nt, Homo sapiens
gauucaauuuaaa

SEQ ID NO: 1358629 - RNA, 22 nt, Homo sapiens
gauucauuuuaccuuugacaag

SEQ ID NO: 1358630 - RNA, 18 nt, Homo sapiens
gauucugauaaugcucac

SEQ ID NO: 1358631 - RNA, 17 nt, Homo sapiens
gauucugguuccagggu

SEQ ID NO: 1358632 - RNA, 15 nt, Homo sapiens
gauucuucagcuuga

SEQ ID NO: 1358633 - RNA, 19 nt, Homo sapiens
gauuggccggcuaguguuu

SEQ ID NO: 1358634 - RNA, 17 nt, Homo sapiens
gauuuaaguguuuugua

SEQ ID NO: 1358635 - RNA, 15 nt, Homo sapiens
gauuuaauacaguuu

SEQ ID NO: 1358636 - RNA, 14 nt, Homo sapiens
gauuugaggacuug

SEQ ID NO: 1358637 - RNA, 22 nt, Homo sapiens
gauuugguuaagcucacacagc

SEQ ID NO: 1358638 - RNA, 14 nt, Homo sapiens
gcaaaaagaccaag

SEQ ID NO: 1358639 - RNA, 14 nt, Homo sapiens
gcaaacccuuucau

SEQ ID NO: 1358640 - RNA, 16 nt, Homo sapiens
gcaaagacuuuccucu

SEQ ID NO: 1358641 - RNA, 17 nt, Homo sapiens
gcaaagccuucauugcc

SEQ ID NO: 1358642 - RNA, 20 nt, Homo sapiens
gcaaaguauuguaaauuaua

SEQ ID NO: 1358643 - RNA, 19 nt, Homo sapiens
gcaaaugaccaaauggugu

SEQ ID NO: 1358644 - RNA, 13 nt, Homo sapiens
gcaaaugacuguc

SEQ ID NO: 1358645 - RNA, 19 nt, Homo sapiens
gcaaauuuucagcauuaag

SEQ ID NO: 1358646 - RNA, 15 nt, Homo sapiens
gcaacaaaaauuacu

SEQ ID NO: 1358647 - RNA, 23 nt, Homo sapiens
gcaagggaccuucaugcccuucu

SEQ ID NO: 1358648 - RNA, 19 nt, Homo sapiens
gcaauaaaucugacccagu

SEQ ID NO: 1358649 - RNA, 17 nt, Homo sapiens
gcaauacagacuacuuc

SEQ ID NO: 1358650 - RNA, 17 nt, Homo sapiens
gcaauuacggggugacc

SEQ ID NO: 1358651 - RNA, 22 nt, Homo sapiens
gcacaauuucccuucauacucc

SEQ ID NO: 1358652 - RNA, 17 nt, Homo sapiens
gcacagggucucuacca

SEQ ID NO: 1358653 - RNA, 17 nt, Homo sapiens
gcaccagacacccagga

SEQ ID NO: 1358654 - RNA, 13 nt, Homo sapiens
gcaccauucugac

SEQ ID NO: 1358655 - RNA, 15 nt, Homo sapiens
gcaccuaauccaggc

SEQ ID NO: 1358656 - RNA, 21 nt, Homo sapiens
gcaccuaauccaggcagaucc

SEQ ID NO: 1358657 - RNA, 13 nt, Homo sapiens
gcaccucuuccuu

SEQ ID NO: 1358658 - RNA, 20 nt, Homo sapiens
gcaccuggcggggucuugcu

SEQ ID NO: 1358659 - RNA, 16 nt, Homo sapiens
gcacggcccguggcug

SEQ ID NO: 1358660 - RNA, 16 nt, Homo sapiens
gcacucugugggucug

SEQ ID NO: 1358661 - RNA, 20 nt, Homo sapiens
gcacugaugcugccccucau

SEQ ID NO: 1358662 - RNA, 17 nt, Homo sapiens
gcacuggccacccaagg

SEQ ID NO: 1358663 - RNA, 20 nt, Homo sapiens
gcacuuugggaggccaagga

SEQ ID NO: 1358664 - RNA, 22 nt, Homo sapiens
gcacuuugggaggcugaggcag

SEQ ID NO: 1358665 - RNA, 15 nt, Homo sapiens
gcagcaggaugcuca

SEQ ID NO: 1358666 - RNA, 17 nt, Homo sapiens
gcagcgccuuucccaac

SEQ ID NO: 1358667 - RNA, 15 nt, Homo sapiens
gcagcuggugcugug

SEQ ID NO: 1358668 - RNA, 19 nt, Homo sapiens
gcaggaagcucagacuggu

SEQ ID NO: 1358669 - RNA, 12 nt, Homo sapiens
gcaggaccucag

SEQ ID NO: 1358670 - RNA, 17 nt, Homo sapiens
gcaggagaaucgcuuga

SEQ ID NO: 1358671 - RNA, 18 nt, Homo sapiens
gcaggauguuggccacca

SEQ ID NO: 1358672 - RNA, 19 nt, Homo sapiens
gcaggucuggaggggccau

SEQ ID NO: 1358673 - RNA, 13 nt, Homo sapiens
gcaggugugcgug

SEQ ID NO: 1358674 - RNA, 23 nt, Homo sapiens
gcagguuggugggggccucggug

SEQ ID NO: 1358675 - RNA, 15 nt, Homo sapiens
gcagugagcacugaa

SEQ ID NO: 1358676 - RNA, 17 nt, Homo sapiens
gcagugagcacugaaac

SEQ ID NO: 1358677 - RNA, 13 nt, Homo sapiens
gcagugguuugaa

SEQ ID NO: 1358678 - RNA, 19 nt, Homo sapiens
gcagugucuuuggaccuga

SEQ ID NO: 1358679 - RNA, 19 nt, Homo sapiens
gcaguucugggugcucccu

SEQ ID NO: 1358680 - RNA, 20 nt, Homo sapiens
gcauaagaaauguagcugaa

SEQ ID NO: 1358681 - RNA, 21 nt, Homo sapiens
gcauaccauugaaacaugcca

SEQ ID NO: 1358682 - RNA, 19 nt, Homo sapiens
gcauacugacuccaggugu

SEQ ID NO: 1358683 - RNA, 19 nt, Homo sapiens
gcauagaguucagacuuuu

SEQ ID NO: 1358684 - RNA, 22 nt, Homo sapiens
gcauagaucccauagugugcau

SEQ ID NO: 1358685 - RNA, 15 nt, Homo sapiens
gcauauauacauaua

SEQ ID NO: 1358686 - RNA, 14 nt, Homo sapiens
gcaucacagaaugu

SEQ ID NO: 1358687 - RNA, 22 nt, Homo sapiens
gcauccaucugggcuaccccac

SEQ ID NO: 1358688 - RNA, 23 nt, Homo sapiens
gcaucccuagucucuacccagua

SEQ ID NO: 1358689 - RNA, 17 nt, Homo sapiens
gcauggaaaaucaguga

SEQ ID NO: 1358690 - RNA, 14 nt, Homo sapiens
gcauggcugccucu

SEQ ID NO: 1358691 - RNA, 22 nt, Homo sapiens
gcaugucuacucagcauuugau

SEQ ID NO: 1358692 - RNA, 22 nt, Homo sapiens
gcauuaucuaugauaugcuaau

SEQ ID NO: 1358693 - RNA, 16 nt, Homo sapiens
gcauucagccaggaga

SEQ ID NO: 1358694 - RNA, 14 nt, Homo sapiens
gcauuuaggagaua

SEQ ID NO: 1358695 - RNA, 13 nt, Homo sapiens
gccaaaaugcucu

SEQ ID NO: 1358696 - RNA, 15 nt, Homo sapiens
gccaacccuuucauu

SEQ ID NO: 1358697 - RNA, 16 nt, Homo sapiens
gccaagccaaccgugg

SEQ ID NO: 1358698 - RNA, 14 nt, Homo sapiens
gccaaggagcugcu

SEQ ID NO: 1358699 - RNA, 16 nt, Homo sapiens
ggaauaacuuuuacac

SEQ ID NO: 1358700 - RNA, 14 nt, Homo sapiens
ggaauaauccagaa

SEQ ID NO: 1358701 - RNA, 23 nt, Homo sapiens
ggaaucagaacucaaauggggcc

SEQ ID NO: 1358702 - RNA, 13 nt, Homo sapiens
ggaaugauagugu

SEQ ID NO: 1358703 - RNA, 12 nt, Homo sapiens
ggaauguaggga

SEQ ID NO: 1358704 - RNA, 16 nt, Homo sapiens
ggacaaacagugcacu

SEQ ID NO: 1358705 - RNA, 22 nt, Homo sapiens
ggacagaauuggauacauacac

SEQ ID NO: 1358706 - RNA, 17 nt, Homo sapiens
ggacagaugaaugccgu

SEQ ID NO: 1358707 - RNA, 18 nt, Homo sapiens
ggacaucagaaagggaga

SEQ ID NO: 1358708 - RNA, 13 nt, Homo sapiens
ggacccagugcag

SEQ ID NO: 1358709 - RNA, 19 nt, Homo sapiens
ggacuauauuugggccugc

SEQ ID NO: 1358710 - RNA, 18 nt, Homo sapiens
ggacuucugggucuccag

SEQ ID NO: 1358711 - RNA, 13 nt, Homo sapiens
ggagaggggcaca

SEQ ID NO: 1358712 - RNA, 11 nt, Homo sapiens
ggagcacuuuc

SEQ ID NO: 1358713 - RNA, 22 nt, Homo sapiens
ggagccccaggggacaagggau

SEQ ID NO: 1358714 - RNA, 20 nt, Homo sapiens
ggagccuucugugcugugag

SEQ ID NO: 1358715 - RNA, 11 nt, Homo sapiens
ggagcugcuau

SEQ ID NO: 1358716 - RNA, 15 nt, Homo sapiens
ggagcuuaaacagcu

SEQ ID NO: 1358717 - RNA, 22 nt, Homo sapiens
ggaggaccauuggcuugccaag

SEQ ID NO: 1358718 - RNA, 20 nt, Homo sapiens
ggaggcagagguugcaguga

SEQ ID NO: 1358719 - RNA, 17 nt, Homo sapiens
ggagggcagguccagcu

SEQ ID NO: 1358720 - RNA, 19 nt, Homo sapiens
ggagguggcuggguuuaca

SEQ ID NO: 1358721 - RNA, 17 nt, Homo sapiens
ggaguauccucuugcca

SEQ ID NO: 1358722 - RNA, 13 nt, Homo sapiens
ggagucaucucaa

SEQ ID NO: 1358723 - RNA, 19 nt, Homo sapiens
ggauauccucccuccagau

SEQ ID NO: 1358724 - RNA, 15 nt, Homo sapiens
ggaugguucugugac

SEQ ID NO: 1358725 - RNA, 14 nt, Homo sapiens
ggauuagaaugccg

SEQ ID NO: 1358726 - RNA, 23 nt, Homo sapiens
ggcaacuugggaacuagacuccc

SEQ ID NO: 1358727 - RNA, 19 nt, Homo sapiens
ggcacagggucugcucuuu

SEQ ID NO: 1358728 - RNA, 20 nt, Homo sapiens
ggcacagggucugcucuuuc

SEQ ID NO: 1358729 - RNA, 19 nt, Homo sapiens
ggcaccagacacccaggac

SEQ ID NO: 1358730 - RNA, 22 nt, Homo sapiens
ggcacucgccgguuaagacagg

SEQ ID NO: 1358731 - RNA, 20 nt, Homo sapiens
ggcagacucuuuaugcuugc

SEQ ID NO: 1358732 - RNA, 20 nt, Homo sapiens
ggcagcagaggcuccucuga

SEQ ID NO: 1358733 - RNA, 21 nt, Homo sapiens
ggcagccuccugcucugugaa

SEQ ID NO: 1358734 - RNA, 20 nt, Homo sapiens
ggcagggagcugggcccgac

SEQ ID NO: 1358735 - RNA, 15 nt, Homo sapiens
ggcaggucacuuuac

SEQ ID NO: 1358736 - RNA, 15 nt, Homo sapiens
ggcaucauugugacg

SEQ ID NO: 1358737 - RNA, 22 nt, Homo sapiens
ggcaucuuugccuugggcugcu

SEQ ID NO: 1358738 - RNA, 16 nt, Homo sapiens
ggcaugagacucagug

SEQ ID NO: 1358739 - RNA, 23 nt, Homo sapiens
ggccacccaaggaugucugccac

SEQ ID NO: 1358740 - RNA, 22 nt, Homo sapiens
ggccagguaugcauggaaaaug

SEQ ID NO: 1358741 - RNA, 19 nt, Homo sapiens
ggcccagagcccagcucca

SEQ ID NO: 1358742 - RNA, 18 nt, Homo sapiens
ggcccaguucacccugau

SEQ ID NO: 1358743 - RNA, 18 nt, Homo sapiens
ggcccauggcuguuggug

SEQ ID NO: 1358744 - RNA, 13 nt, Homo sapiens
ggccccacugggg

SEQ ID NO: 1358745 - RNA, 17 nt, Homo sapiens
ggccccagggggucuca

SEQ ID NO: 1358746 - RNA, 17 nt, Homo sapiens
ggccccuggcacucuug

SEQ ID NO: 1358747 - RNA, 11 nt, Homo sapiens
ggcccuaccug

SEQ ID NO: 1358748 - RNA, 12 nt, Homo sapiens
ggcccuaccugg

SEQ ID NO: 1358749 - RNA, 19 nt, Homo sapiens
ggccgggcgcgguggcuca

SEQ ID NO: 1358750 - RNA, 13 nt, Homo sapiens
ggccugcuccaga

SEQ ID NO: 1358751 - RNA, 14 nt, Homo sapiens
ggccugcuccagac

SEQ ID NO: 1358752 - RNA, 15 nt, Homo sapiens
ggccuguacccagua

SEQ ID NO: 1358753 - RNA, 18 nt, Homo sapiens
ggcggguccuagcuguua

SEQ ID NO: 1358754 - RNA, 17 nt, Homo sapiens
ggcuaccccacccaagu

SEQ ID NO: 1358755 - RNA, 16 nt, Homo sapiens
ggcuaucguuagugcu

SEQ ID NO: 1358756 - RNA, 13 nt, Homo sapiens
ggcucccaugacc

SEQ ID NO: 1358757 - RNA, 12 nt, Homo sapiens
ggcuccuaccug

SEQ ID NO: 1358758 - RNA, 20 nt, Homo sapiens
ggcucucuugugcauuguag

SEQ ID NO: 1358759 - RNA, 19 nt, Homo sapiens
ggcugacucuaggugcccu

SEQ ID NO: 1358760 - RNA, 19 nt, Homo sapiens
ggcuggagugcaguggcgu

SEQ ID NO: 1358761 - RNA, 21 nt, Homo sapiens
ggcugggaagaagcugcacuu

SEQ ID NO: 1358762 - RNA, 14 nt, Homo sapiens
ggcuuagugccacc

SEQ ID NO: 1358763 - RNA, 15 nt, Homo sapiens
ggcuuggcagccagu

SEQ ID NO: 1358764 - RNA, 14 nt, Homo sapiens
ggcuuuccagcuua

SEQ ID NO: 1358765 - RNA, 17 nt, Homo sapiens
ggcuuucccacuuccca

SEQ ID NO: 1358766 - RNA, 18 nt, Homo sapiens
gggaaagcuucauucucc

SEQ ID NO: 1358767 - RNA, 16 nt, Homo sapiens
gggacaacguccuucc

SEQ ID NO: 1358768 - RNA, 14 nt, Homo sapiens
gggacacuuaccca

SEQ ID NO: 1358769 - RNA, 15 nt, Homo sapiens
gggacccagugcaga

SEQ ID NO: 1358770 - RNA, 15 nt, Homo sapiens
gggaccgacuuucca

SEQ ID NO: 1358771 - RNA, 15 nt, Homo sapiens
gggacucguggcugu

SEQ ID NO: 1358772 - RNA, 11 nt, Homo sapiens
gggagccagcc

SEQ ID NO: 1358773 - RNA, 15 nt, Homo sapiens
gggagccauguuuca

SEQ ID NO: 1358774 - RNA, 22 nt, Homo sapiens
gggagcccacuguccugggccu

SEQ ID NO: 1358775 - RNA, 22 nt, Homo sapiens
gggagccuucugugcugugagu

SEQ ID NO: 1358776 - RNA, 20 nt, Homo sapiens
gggagcggaaagcagcucaa

SEQ ID NO: 1358777 - RNA, 21 nt, Homo sapiens
gggagucugaagcagaugcaa

SEQ ID NO: 1358778 - RNA, 23 nt, Homo sapiens
gggauaaagagagagaaggacug

SEQ ID NO: 1358779 - RNA, 22 nt, Homo sapiens
gggauguucagcacugucccuu

SEQ ID NO: 1358780 - RNA, 14 nt, Homo sapiens
gggauuucauuuga

SEQ ID NO: 1358781 - RNA, 15 nt, Homo sapiens
gggauuucauuugaa

SEQ ID NO: 1358782 - RNA, 15 nt, Homo sapiens
gggcaccuacugaga

SEQ ID NO: 1358783 - RNA, 20 nt, Homo sapiens
gggcaggagggcccuaccug

SEQ ID NO: 1358784 - RNA, 19 nt, Homo sapiens
gggcauccugugccacuaa

SEQ ID NO: 1358785 - RNA, 14 nt, Homo sapiens
gggccaguccuggu

SEQ ID NO: 1358786 - RNA, 14 nt, Homo sapiens
gggcccagagccca

SEQ ID NO: 1358787 - RNA, 21 nt, Homo sapiens
gggcgccaccgccacccgcag

SEQ ID NO: 1358788 - RNA, 18 nt, Homo sapiens
gggcucuaggauggggca

SEQ ID NO: 1358789 - RNA, 23 nt, Homo sapiens
ggggagccuucugugcugugagu

SEQ ID NO: 1358790 - RNA, 17 nt, Homo sapiens
ggggagucugaagcaga

SEQ ID NO: 1358791 - RNA, 14 nt, Homo sapiens
ggggaucccucccc

SEQ ID NO: 1358792 - RNA, 16 nt, Homo sapiens
uuaccuugugcuaauc

SEQ ID NO: 1358793 - RNA, 16 nt, Homo sapiens
uuacgcaaugcuucua

SEQ ID NO: 1358794 - RNA, 13 nt, Homo sapiens
uuacgucaaaaca

SEQ ID NO: 1358795 - RNA, 18 nt, Homo sapiens
uuacucuugcugagucag

SEQ ID NO: 1358796 - RNA, 19 nt, Homo sapiens
uuagaaaaaccaccaccau

SEQ ID NO: 1358797 - RNA, 19 nt, Homo sapiens
uuagaaacucaaaaacuga

SEQ ID NO: 1358798 - RNA, 22 nt, Homo sapiens
uuagaccccauacaaguuuaua

SEQ ID NO: 1358799 - RNA, 23 nt, Homo sapiens
uuagacucaugguguguuacaca

SEQ ID NO: 1358800 - RNA, 20 nt, Homo sapiens
uuagagaaaagagacacaaa

SEQ ID NO: 1358801 - RNA, 20 nt, Homo sapiens
uuagagaagggggauaaaga

SEQ ID NO: 1358802 - RNA, 12 nt, Homo sapiens
uuagaucuggca

SEQ ID NO: 1358803 - RNA, 14 nt, Homo sapiens
uuagauguuucaca

SEQ ID NO: 1358804 - RNA, 16 nt, Homo sapiens
uuagcagcauggcugc

SEQ ID NO: 1358805 - RNA, 16 nt, Homo sapiens
uuagccagauuugucu

SEQ ID NO: 1358806 - RNA, 15 nt, Homo sapiens
uuagccagugaugcu

SEQ ID NO: 1358807 - RNA, 20 nt, Homo sapiens
uuagcuaggcuaaaacaccu

SEQ ID NO: 1358808 - RNA, 19 nt, Homo sapiens
uuaggaauacugggugcug

SEQ ID NO: 1358809 - RNA, 18 nt, Homo sapiens
uuaguugaggccuucuag

SEQ ID NO: 1358810 - RNA, 18 nt, Homo sapiens
uuaguuuuuaacaaucua

SEQ ID NO: 1358811 - RNA, 24 nt, Homo sapiens
uuauaaaagaugcauuaucuauga

SEQ ID NO: 1358812 - RNA, 17 nt, Homo sapiens
uuauauaauuguugaac

SEQ ID NO: 1358813 - RNA, 24 nt, Homo sapiens
uuauauauguaucuaaaccauaug

SEQ ID NO: 1358814 - RNA, 17 nt, Homo sapiens
uuauauuaauguacuug

SEQ ID NO: 1358815 - RNA, 12 nt, Homo sapiens
uuaucaccucau

SEQ ID NO: 1358816 - RNA, 18 nt, Homo sapiens
uuaucaccucauucugaa

SEQ ID NO: 1358817 - RNA, 16 nt, Homo sapiens
uuauccuucuacuugu

SEQ ID NO: 1358818 - RNA, 13 nt, Homo sapiens
uuaucuauggcac

SEQ ID NO: 1358819 - RNA, 18 nt, Homo sapiens
uuaugcuccuuaugaugc

SEQ ID NO: 1358820 - RNA, 19 nt, Homo sapiens
uuaugugugaggagcugcu

SEQ ID NO: 1358821 - RNA, 13 nt, Homo sapiens
uuauuacauguaa

SEQ ID NO: 1358822 - RNA, 21 nt, Homo sapiens
uuauucucaauauauuuuugc

SEQ ID NO: 1358823 - RNA, 15 nt, Homo sapiens
uuauuuaaucuccau

SEQ ID NO: 1358824 - RNA, 22 nt, Homo sapiens
uuauuuagagacagagucucac

SEQ ID NO: 1358825 - RNA, 17 nt, Homo sapiens
uuauuuuuguaucuuaa

SEQ ID NO: 1358826 - RNA, 21 nt, Homo sapiens
uucaaaagcacuuugugcugu

SEQ ID NO: 1358827 - RNA, 17 nt, Homo sapiens
uucaaagcaaagcucuu

SEQ ID NO: 1358828 - RNA, 12 nt, Homo sapiens
uucaaaguuuag

SEQ ID NO: 1358829 - RNA, 12 nt, Homo sapiens
uucaagcucucc

SEQ ID NO: 1358830 - RNA, 12 nt, Homo sapiens
uucaagugccua

SEQ ID NO: 1358831 - RNA, 16 nt, Homo sapiens
uucaaucaaaauuuca

SEQ ID NO: 1358832 - RNA, 18 nt, Homo sapiens
uucacaaaacagccuuug

SEQ ID NO: 1358833 - RNA, 21 nt, Homo sapiens
uucacaaggucuuuaaaguga

SEQ ID NO: 1358834 - RNA, 21 nt, Homo sapiens
uucacaguucuuugggccaga

SEQ ID NO: 1358835 - RNA, 14 nt, Homo sapiens
uucacauuguacuu

SEQ ID NO: 1358836 - RNA, 15 nt, Homo sapiens
uucacccuguccaaa

SEQ ID NO: 1358837 - RNA, 13 nt, Homo sapiens
uucagaaagaagu

SEQ ID NO: 1358838 - RNA, 23 nt, Homo sapiens
uucagauaauugaauaaguaccu

SEQ ID NO: 1358839 - RNA, 20 nt, Homo sapiens
uucagcccaccagccaccuc

SEQ ID NO: 1358840 - RNA, 16 nt, Homo sapiens
uucaggacucuaccuc

SEQ ID NO: 1358841 - RNA, 19 nt, Homo sapiens
uucauaauuucuucacuca

SEQ ID NO: 1358842 - RNA, 15 nt, Homo sapiens
uucauagaaaccucu

SEQ ID NO: 1358843 - RNA, 18 nt, Homo sapiens
uucauauauuuguaugau

SEQ ID NO: 1358844 - RNA, 12 nt, Homo sapiens
uucaugcacugu

SEQ ID NO: 1358845 - RNA, 17 nt, Homo sapiens
uucauuagccaugcaac

SEQ ID NO: 1358846 - RNA, 19 nt, Homo sapiens
uuccaacguggcccagaga

SEQ ID NO: 1358847 - RNA, 18 nt, Homo sapiens
uuccacuuuaacauuuua

SEQ ID NO: 1358848 - RNA, 18 nt, Homo sapiens
uuccauccuagugagaag

SEQ ID NO: 1358849 - RNA, 21 nt, Homo sapiens
uuccaucuccauccaagcaaa

SEQ ID NO: 1358850 - RNA, 16 nt, Homo sapiens
uuccaugggaccacaa

SEQ ID NO: 1358851 - RNA, 21 nt, Homo sapiens
uucccaccaggcugcucaggg

SEQ ID NO: 1358852 - RNA, 16 nt, Homo sapiens
uuccccaaugcuccau

SEQ ID NO: 1358853 - RNA, 11 nt, Homo sapiens
uuccccaguga

SEQ ID NO: 1358854 - RNA, 19 nt, Homo sapiens
uucccuuugauacagucaa

SEQ ID NO: 1358855 - RNA, 21 nt, Homo sapiens
uuccuaugcuuugaaacagaa

SEQ ID NO: 1358856 - RNA, 15 nt, Homo sapiens
uuccucccaacaagc

SEQ ID NO: 1358857 - RNA, 14 nt, Homo sapiens
uuccucgccugaca

SEQ ID NO: 1358858 - RNA, 18 nt, Homo sapiens
uuccucgccugacaacca

SEQ ID NO: 1358859 - RNA, 12 nt, Homo sapiens
uuccucuguaua

SEQ ID NO: 1358860 - RNA, 16 nt, Homo sapiens
uucuaggaagcuccag

SEQ ID NO: 1358861 - RNA, 14 nt, Homo sapiens
uucuaggauagcua

SEQ ID NO: 1358862 - RNA, 14 nt, Homo sapiens
uucuaguuaccaca

SEQ ID NO: 1358863 - RNA, 12 nt, Homo sapiens
uucucauuguag

SEQ ID NO: 1358864 - RNA, 15 nt, Homo sapiens
uucucgccacugggg

SEQ ID NO: 1358865 - RNA, 15 nt, Homo sapiens
uucucucuucuccac

SEQ ID NO: 1358866 - RNA, 15 nt, Homo sapiens
uucucugccagugac

SEQ ID NO: 1358867 - RNA, 11 nt, Homo sapiens
uucucugggcc

SEQ ID NO: 1358868 - RNA, 17 nt, Homo sapiens
uucucuuucuuuuacug

SEQ ID NO: 1358869 - RNA, 15 nt, Homo sapiens
uucugagccugccuu

SEQ ID NO: 1358870 - RNA, 22 nt, Homo sapiens
uucugauuccccuccaccaaac

SEQ ID NO: 1358871 - RNA, 19 nt, Homo sapiens
uucugauuuuuauucucaa

SEQ ID NO: 1358872 - RNA, 15 nt, Homo sapiens
uucugcaaugacugc

SEQ ID NO: 1358873 - RNA, 13 nt, Homo sapiens
uucuggacaggau

SEQ ID NO: 1358874 - RNA, 14 nt, Homo sapiens
uucugggucuccag

SEQ ID NO: 1358875 - RNA, 18 nt, Homo sapiens
uucugguuuguaaggugg

SEQ ID NO: 1358876 - RNA, 20 nt, Homo sapiens
uucuguccgagcuuugaaaa

SEQ ID NO: 1358877 - RNA, 18 nt, Homo sapiens
uucugucuuuauaaucua

SEQ ID NO: 1358878 - RNA, 22 nt, Homo sapiens
uucuguuuuuaaugcuauuuga

SEQ ID NO: 1358879 - RNA, 13 nt, Homo sapiens
uucuuacaaacau

SEQ ID NO: 1358880 - RNA, 16 nt, Homo sapiens
uucuuacaaacaugug

SEQ ID NO: 1358881 - RNA, 17 nt, Homo sapiens
uucuuauuaaugucauu

SEQ ID NO: 1358882 - RNA, 16 nt, Homo sapiens
uucuucccuacaguug

SEQ ID NO: 1358883 - RNA, 22 nt, Homo sapiens
uucuuuaaaauguaaagccaug

SEQ ID NO: 1358884 - RNA, 12 nt, Homo sapiens
uucuuugcccac

SEQ ID NO: 1358885 - RNA, 21 nt, Homo sapiens
uugaacauucccuugaucuca

SEQ ID NO: 1358886 - RNA, 21 nt, Homo sapiens
uugaagcucgugacaagugcc

SEQ ID NO: 1358887 - RNA, 16 nt, Homo sapiens
uugaaggacuacaggu

SEQ ID NO: 1358888 - RNA, 16 nt, Homo sapiens
uugaaggaucaucuga

SEQ ID NO: 1358889 - RNA, 13 nt, Homo sapiens
uugaauagucuca

SEQ ID NO: 1358890 - RNA, 14 nt, Homo sapiens
uugaauagucucau

SEQ ID NO: 1358891 - RNA, 18 nt, Homo sapiens
uugaauuucuccgaaugu

SEQ ID NO: 1358892 - RNA, 13 nt, Homo sapiens
uugacaacaguua

SEQ ID NO: 1358893 - RNA, 13 nt, Homo sapiens
uugacaacuggca

SEQ ID NO: 1358894 - RNA, 14 nt, Homo sapiens
uugacgcaccugug

SEQ ID NO: 1358895 - RNA, 15 nt, Homo sapiens
uugacgcaccugugg

SEQ ID NO: 1358896 - RNA, 20 nt, Homo sapiens
uugagcaguggcugguccag

SEQ ID NO: 1358897 - RNA, 12 nt, Homo sapiens
uugaggggagca

SEQ ID NO: 1358898 - RNA, 11 nt, Homo sapiens
uugaugacugu

SEQ ID NO: 1358899 - RNA, 18 nt, Homo sapiens
uugaugaguuaacuguga

SEQ ID NO: 1358900 - RNA, 14 nt, Homo sapiens
uugauggugaugaa

SEQ ID NO: 1358901 - RNA, 13 nt, Homo sapiens
uugcaugugcugc

SEQ ID NO: 1358902 - RNA, 14 nt, Homo sapiens
uugcaugugcugca

SEQ ID NO: 1358903 - RNA, 17 nt, Homo sapiens
uugcaugugcugcaggu

SEQ ID NO: 1358904 - RNA, 18 nt, Homo sapiens
uugccaaaauaccagagc

SEQ ID NO: 1358905 - RNA, 12 nt, Homo sapiens
uugccacaaagc

SEQ ID NO: 1358906 - RNA, 14 nt, Homo sapiens
uugccuccaggugc

SEQ ID NO: 1358907 - RNA, 19 nt, Homo sapiens
uugccugcagggccauggc

SEQ ID NO: 1358908 - RNA, 16 nt, Homo sapiens
uugcuucaaacugaga

SEQ ID NO: 1358909 - RNA, 19 nt, Homo sapiens
uugcuuccagaccuaggcu

SEQ ID NO: 1358910 - RNA, 20 nt, Homo sapiens
uugcuuccccuuuugccaau

SEQ ID NO: 1358911 - RNA, 23 nt, Homo sapiens
uugcuuucucuucuaauggaaua

SEQ ID NO: 1358912 - RNA, 14 nt, Homo sapiens
uuggaaagcagucc

SEQ ID NO: 1358913 - RNA, 19 nt, Homo sapiens
uuggaaaggaccaguaugc

SEQ ID NO: 1358914 - RNA, 15 nt, Homo sapiens
uuggaagucugucuc

SEQ ID NO: 1358915 - RNA, 19 nt, Homo sapiens
uuggacuguaagggauuga

SEQ ID NO: 1358916 - RNA, 20 nt, Homo sapiens
uuggaggcucucuugugcau

SEQ ID NO: 1358917 - RNA, 19 nt, Homo sapiens
uuggauacauacaccagca

SEQ ID NO: 1358918 - RNA, 13 nt, Homo sapiens
uuggcaccagaca

SEQ ID NO: 1358919 - RNA, 22 nt, Homo sapiens
uuggcaccagacacccaggacu

SEQ ID NO: 1358920 - RNA, 16 nt, Homo sapiens
uugggcugcuccucau

SEQ ID NO: 1358921 - RNA, 19 nt, Homo sapiens
uuggugugugugacaauuc

SEQ ID NO: 1358922 - RNA, 14 nt, Homo sapiens
uugguucucuccac

SEQ ID NO: 1358923 - RNA, 15 nt, Homo sapiens
uuguaaauaggauuu

SEQ ID NO: 1358924 - RNA, 15 nt, Homo sapiens
uuguaaugaauuccu

SEQ ID NO: 1358925 - RNA, 19 nt, Homo sapiens
uuguauaaucccacccacc

SEQ ID NO: 1358926 - RNA, 20 nt, Homo sapiens
uuguauuaguauugugaaua

SEQ ID NO: 1358927 - RNA, 20 nt, Homo sapiens
uuguauuuuuuuucuuguau

SEQ ID NO: 1358928 - RNA, 18 nt, Homo sapiens
uuguccugagauggaaaa

SEQ ID NO: 1358929 - RNA, 23 nt, Homo sapiens
uugucuaauuaaaacacuuucaa

SEQ ID NO: 1358930 - RNA, 15 nt, Homo sapiens
uugucuaccauuugu

SEQ ID NO: 1358931 - RNA, 10 nt, Homo sapiens
uugucuccca

SEQ ID NO: 1358932 - RNA, 17 nt, Homo sapiens
uuguguaauaugaaaua

SEQ ID NO: 1358933 - RNA, 19 nt, Homo sapiens
uuguuguuuauaaagggag

SEQ ID NO: 1358934 - RNA, 19 nt, Homo sapiens
uuguuuguaaaugccucuu

SEQ ID NO: 1358935 - RNA, 19 nt, Homo sapiens
uuguuuuguguaacauauu

SEQ ID NO: 1358936 - RNA, 22 nt, Homo sapiens
uuuaaacacuuaucuucuggau

SEQ ID NO: 1358937 - RNA, 14 nt, Homo sapiens
uuuaaauaaaugga

SEQ ID NO: 1358938 - RNA, 16 nt, Homo sapiens
uuuaaauuccacagau

SEQ ID NO: 1358939 - RNA, 15 nt, Homo sapiens
uuuaacaacuaugau

SEQ ID NO: 1358940 - RNA, 19 nt, Homo sapiens
uuuaacugccaauccuuaa

SEQ ID NO: 1358941 - RNA, 12 nt, Homo sapiens
uuuacagaauuu

SEQ ID NO: 1358942 - RNA, 23 nt, Homo sapiens
uuuacagccagugggagauguua

SEQ ID NO: 1358943 - RNA, 21 nt, Homo sapiens
uuuacgcggagcacuuucgag

SEQ ID NO: 1358944 - RNA, 16 nt, Homo sapiens
uuuagaccccauacaa

SEQ ID NO: 1358945 - RNA, 14 nt, Homo sapiens
uuuaguaaauguua

SEQ ID NO: 1358946 - RNA, 14 nt, Homo sapiens
uuuaguuacuugag

SEQ ID NO: 1358947 - RNA, 13 nt, Homo sapiens
uuuauaauguugu

SEQ ID NO: 1358948 - RNA, 23 nt, Homo sapiens
uuuauagagcagaacccuagucu

SEQ ID NO: 1358949 - RNA, 13 nt, Homo sapiens
uuuaucaccucau

SEQ ID NO: 1358950 - RNA, 18 nt, Homo sapiens
uuuaucuauggcacccau

SEQ ID NO: 1358951 - RNA, 13 nt, Homo sapiens
uuuauggccucag

SEQ ID NO: 1358952 - RNA, 18 nt, Homo sapiens
uuuauucaagaaugccag

SEQ ID NO: 1358953 - RNA, 20 nt, Homo sapiens
uuuauuuaguuuuuaacaau

SEQ ID NO: 1358954 - RNA, 16 nt, Homo sapiens
uuucaaaaaaucugac

SEQ ID NO: 1358955 - RNA, 14 nt, Homo sapiens
uuucaaaucauucc

SEQ ID NO: 1358956 - RNA, 21 nt, Homo sapiens
uuucacauuguuugcugcuau

SEQ ID NO: 1358957 - RNA, 13 nt, Homo sapiens
uuucaccucagau

SEQ ID NO: 1358958 - RNA, 14 nt, Homo sapiens
uuucaccuucauau

SEQ ID NO: 1358959 - RNA, 22 nt, Homo sapiens
uuucacuuaaguugagauuuuu

SEQ ID NO: 1358960 - RNA, 16 nt, Homo sapiens
uuucaggccacauggc

SEQ ID NO: 1358961 - RNA, 19 nt, Homo sapiens
uuucagugaaagcaucacu

SEQ ID NO: 1358962 - RNA, 18 nt, Homo sapiens
uuucauaaagucuugccu

SEQ ID NO: 1358963 - RNA, 21 nt, Homo sapiens
uuucaucagaggaaaagggca

SEQ ID NO: 1358964 - RNA, 21 nt, Homo sapiens
uuucauugcucagaaauguca

SEQ ID NO: 1358965 - RNA, 12 nt, Homo sapiens
uuucauugcugg

SEQ ID NO: 1358966 - RNA, 21 nt, Homo sapiens
uuuccaaugcugaaugccugu

SEQ ID NO: 1358967 - RNA, 15 nt, Homo sapiens
uuuccacuccauugu

SEQ ID NO: 1358968 - RNA, 17 nt, Homo sapiens
uuuccauuaaacuacuu

SEQ ID NO: 1358969 - RNA, 15 nt, Homo sapiens
uuuccccagugacac

SEQ ID NO: 1358970 - RNA, 19 nt, Homo sapiens
uuuccccagugacaccuca

SEQ ID NO: 1358971 - RNA, 21 nt, Homo sapiens
uuucccugggagcuguucucu

SEQ ID NO: 1358972 - RNA, 18 nt, Homo sapiens
uuuccucccuucugcuac

SEQ ID NO: 1358973 - RNA, 22 nt, Homo sapiens
uuucuacugugugaucaggaug

SEQ ID NO: 1358974 - RNA, 14 nt, Homo sapiens
uuucucauuguaga

SEQ ID NO: 1358975 - RNA, 19 nt, Homo sapiens
uuucucccccuuuccaaaa

SEQ ID NO: 1358976 - RNA, 17 nt, Homo sapiens
uuucucuagggagaaaa

SEQ ID NO: 1358977 - RNA, 18 nt, Homo sapiens
uuucucugagaucaugag

SEQ ID NO: 1358978 - RNA, 19 nt, Homo sapiens
uuucucugagaucaugagu

SEQ ID NO: 1358979 - RNA, 19 nt, Homo sapiens
uuucucuguuguaagaaua

SEQ ID NO: 1358980 - RNA, 17 nt, Homo sapiens
uuucugcaaacaccaac

SEQ ID NO: 1358981 - RNA, 16 nt, Homo sapiens
uuucugucacaucagc

SEQ ID NO: 1358982 - RNA, 14 nt, Homo sapiens
uuugaaaucuauga

SEQ ID NO: 1358983 - RNA, 15 nt, Homo sapiens
uuugaaaucuaugaa

SEQ ID NO: 1358984 - RNA, 14 nt, Homo sapiens
uuugcagaaagcca

SEQ ID NO: 1358985 - RNA, 18 nt, Homo sapiens
uuugccagugggaacucc

SEQ ID NO: 1358986 - RNA, 21 nt, Homo sapiens
uuugcuaaaugugaaugauga

SEQ ID NO: 1358987 - RNA, 18 nt, Homo sapiens
uuugcuagcagaaaucua

SEQ ID NO: 1358988 - RNA, 14 nt, Homo sapiens
uuugggccagacau

SEQ ID NO: 1358989 - RNA, 20 nt, Homo sapiens
uuugggguagcggcccugag

SEQ ID NO: 1358990 - RNA, 16 nt, Homo sapiens
uuuguaauauggaaug

SEQ ID NO: 1358991 - RNA, 16 nt, Homo sapiens
uuuguaucauuaugaa

SEQ ID NO: 1358992 - RNA, 20 nt, Homo sapiens
uuuguaucauuaugaaguca

SEQ ID NO: 1358993 - RNA, 23 nt, Homo sapiens
uuuguguaaaaaaaccaccaaaa

SEQ ID NO: 1358994 - RNA, 17 nt, Homo sapiens
uuuuaacaacuaugauu

SEQ ID NO: 1358995 - RNA, 22 nt, Homo sapiens
uuuuagaauuaaaaaagcauac

SEQ ID NO: 1358996 - RNA, 19 nt, Homo sapiens
uuuuagacccuauugcugc

SEQ ID NO: 1358997 - RNA, 12 nt, Homo sapiens
uuuuccuuccag

SEQ ID NO: 1358998 - RNA, 20 nt, Homo sapiens
uuuucucuuagaacauugua

SEQ ID NO: 1358999 - RNA, 21 nt, Homo sapiens
uuuucuuguccucauucuugc

SEQ ID NO: 1359000 - RNA, 17 nt, Homo sapiens
uuuuuagggauuaccuu

SEQ ID NO: 1359001 - RNA, 15 nt, Homo sapiens
uuuuucuaaugagga

SEQ ID NO: 1359002 - RNA, 15 nt, Homo sapiens
uuuuucuguggucuu

SEQ ID NO: 1359003 - RNA, 22 nt, Homo sapiens
gcccucuaugguguggcaaagc

SEQ ID NO: 1359004 - RNA, 23 nt, Homo sapiens
gcccucuaugguguggcaaagcc

SEQ ID NO: 1359005 - RNA, 19 nt, Homo sapiens
gcccucugccagggcaccu

SEQ ID NO: 1359006 - RNA, 15 nt, Homo sapiens
gcccuguaacaggcu

SEQ ID NO: 1359007 - RNA, 21 nt, Homo sapiens
gccgagauugcaccacugcac

SEQ ID NO: 1359008 - RNA, 19 nt, Homo sapiens
gccggcagaaguuugccau

SEQ ID NO: 1359009 - RNA, 22 nt, Homo sapiens
gccgggacccagggcccucggu

SEQ ID NO: 1359010 - RNA, 20 nt, Homo sapiens
gccgugauuuucauugcugg

SEQ ID NO: 1359011 - RNA, 22 nt, Homo sapiens
gccguggggccgccgccucuuu

SEQ ID NO: 1359012 - RNA, 19 nt, Homo sapiens
gccuaaaaaguaucauuac

SEQ ID NO: 1359013 - RNA, 22 nt, Homo sapiens
gccuaaaaaguaucauuacaua

SEQ ID NO: 1359014 - RNA, 14 nt, Homo sapiens
gccuaugugcaugc

SEQ ID NO: 1359015 - RNA, 18 nt, Homo sapiens
gccucccugaagccuuug

SEQ ID NO: 1359016 - RNA, 22 nt, Homo sapiens
gccuccucgggagggagcgccu

SEQ ID NO: 1359017 - RNA, 10 nt, Homo sapiens
gccucugugc

SEQ ID NO: 1359018 - RNA, 22 nt, Homo sapiens
gccugagcuggccuccuaugcc

SEQ ID NO: 1359019 - RNA, 18 nt, Homo sapiens
gccugaugcucccucccc

SEQ ID NO: 1359020 - RNA, 14 nt, Homo sapiens
gccuggacccugug

SEQ ID NO: 1359021 - RNA, 20 nt, Homo sapiens
gccuggaguguaugacugca

SEQ ID NO: 1359022 - RNA, 23 nt, Homo sapiens
gccuggggucugacaauaccucg

SEQ ID NO: 1359023 - RNA, 16 nt, Homo sapiens
gccuggucguuuucaa

SEQ ID NO: 1359024 - RNA, 14 nt, Homo sapiens
gccuggugcagugg

SEQ ID NO: 1359025 - RNA, 23 nt, Homo sapiens
gccugguggcccagcuauuacca

SEQ ID NO: 1359026 - RNA, 23 nt, Homo sapiens
gccuguggcgccgucuccagggg

SEQ ID NO: 1359027 - RNA, 18 nt, Homo sapiens
gccuuccagaaaacaaaa

SEQ ID NO: 1359028 - RNA, 16 nt, Homo sapiens
gccuugaguuccaguu

SEQ ID NO: 1359029 - RNA, 18 nt, Homo sapiens
gccuugccagagauccaa

SEQ ID NO: 1359030 - RNA, 12 nt, Homo sapiens
gccuuggcagcc

SEQ ID NO: 1359031 - RNA, 14 nt, Homo sapiens
gccuugggcugcuc

SEQ ID NO: 1359032 - RNA, 16 nt, Homo sapiens
gccuugggcuuucccg

SEQ ID NO: 1359033 - RNA, 21 nt, Homo sapiens
gccuugguaaaaacugcagug

SEQ ID NO: 1359034 - RNA, 15 nt, Homo sapiens
gccuuuccucagugu

SEQ ID NO: 1359035 - RNA, 19 nt, Homo sapiens
gcgaaaccccucucuacua

SEQ ID NO: 1359036 - RNA, 20 nt, Homo sapiens
gcgcaauugaaggaucaucu

SEQ ID NO: 1359037 - RNA, 14 nt, Homo sapiens
gcgcucagggccau

SEQ ID NO: 1359038 - RNA, 22 nt, Homo sapiens
gcggaucaucuaauucucugug

SEQ ID NO: 1359039 - RNA, 20 nt, Homo sapiens
gcggcccugagcuugcaggg

SEQ ID NO: 1359040 - RNA, 19 nt, Homo sapiens
gcgguccuacugcugugag

SEQ ID NO: 1359041 - RNA, 13 nt, Homo sapiens
gcguauauacuua

SEQ ID NO: 1359042 - RNA, 15 nt, Homo sapiens
gcgugccguggcacc

SEQ ID NO: 1359043 - RNA, 20 nt, Homo sapiens
gcguuaaagucaggauuuau

SEQ ID NO: 1359044 - RNA, 13 nt, Homo sapiens
gcuaagaaccugg

SEQ ID NO: 1359045 - RNA, 22 nt, Homo sapiens
gcuaccaaaucucaaaauaucc

SEQ ID NO: 1359046 - RNA, 14 nt, Homo sapiens
gcuagaguccucac

SEQ ID NO: 1359047 - RNA, 19 nt, Homo sapiens
gcuaggguggcccuugcag

SEQ ID NO: 1359048 - RNA, 20 nt, Homo sapiens
gcuaggguggcccuugcagu

SEQ ID NO: 1359049 - RNA, 22 nt, Homo sapiens
gcuauagacccgaggaaacuca

SEQ ID NO: 1359050 - RNA, 17 nt, Homo sapiens
gcucaaaggcacaguga

SEQ ID NO: 1359051 - RNA, 15 nt, Homo sapiens
gcucaccuuuaucac

SEQ ID NO: 1359052 - RNA, 18 nt, Homo sapiens
gcucaggacacaguggga

SEQ ID NO: 1359053 - RNA, 20 nt, Homo sapiens
gcucaggacacagugggaca

SEQ ID NO: 1359054 - RNA, 16 nt, Homo sapiens
gcucauagaucagcaa

SEQ ID NO: 1359055 - RNA, 21 nt, Homo sapiens
gcucauaugcauguagucacu

SEQ ID NO: 1359056 - RNA, 20 nt, Homo sapiens
gcuccaucgcugucaucuca

SEQ ID NO: 1359057 - RNA, 21 nt, Homo sapiens
gcuccaucgcugucaucucag

SEQ ID NO: 1359058 - RNA, 21 nt, Homo sapiens
gcuccgugcuuguuugcucac

SEQ ID NO: 1359059 - RNA, 19 nt, Homo sapiens
gcucucagaccuuacacac

SEQ ID NO: 1359060 - RNA, 20 nt, Homo sapiens
gcucugguggccacugagcu

SEQ ID NO: 1359061 - RNA, 19 nt, Homo sapiens
gcucugucuucuuugccca

SEQ ID NO: 1359062 - RNA, 20 nt, Homo sapiens
gcucugucuucuuugcccac

SEQ ID NO: 1359063 - RNA, 15 nt, Homo sapiens
gcucuuucucugcca

SEQ ID NO: 1359064 - RNA, 16 nt, Homo sapiens
gcugaaauaaaaugau

SEQ ID NO: 1359065 - RNA, 20 nt, Homo sapiens
gcugaauaaccaggggcaca

SEQ ID NO: 1359066 - RNA, 19 nt, Homo sapiens
gcugacacagacauccucu

SEQ ID NO: 1359067 - RNA, 22 nt, Homo sapiens
gcugaccacgcccccagcugug

SEQ ID NO: 1359068 - RNA, 18 nt, Homo sapiens
gcugagcacagggcuguu

SEQ ID NO: 1359069 - RNA, 12 nt, Homo sapiens
gcugagugcuga

SEQ ID NO: 1359070 - RNA, 22 nt, Homo sapiens
gcugcaggccccggggacccca

SEQ ID NO: 1359071 - RNA, 13 nt, Homo sapiens
gcugcagugugag

SEQ ID NO: 1359072 - RNA, 19 nt, Homo sapiens
gcugcauugauccaggaga

SEQ ID NO: 1359073 - RNA, 16 nt, Homo sapiens
gcugccaugcuuccaa

SEQ ID NO: 1359074 - RNA, 14 nt, Homo sapiens
gcugcugaccucca

SEQ ID NO: 1359075 - RNA, 18 nt, Homo sapiens
gcuggaaccugcaaaaaa

SEQ ID NO: 1359076 - RNA, 17 nt, Homo sapiens
gcuggcccugcaggugg

SEQ ID NO: 1359077 - RNA, 13 nt, Homo sapiens
gcuggcuugcagu

SEQ ID NO: 1359078 - RNA, 14 nt, Homo sapiens
gcuggggagacaaa

SEQ ID NO: 1359079 - RNA, 13 nt, Homo sapiens
gcuggguuuacac

SEQ ID NO: 1359080 - RNA, 20 nt, Homo sapiens
gcugguucugcaaugacugc

SEQ ID NO: 1359081 - RNA, 22 nt, Homo sapiens
gcuguguccacggggugucaca

SEQ ID NO: 1359082 - RNA, 15 nt, Homo sapiens
gcuguguuggugugg

SEQ ID NO: 1359083 - RNA, 19 nt, Homo sapiens
gcuguguugguguggccca

SEQ ID NO: 1359084 - RNA, 18 nt, Homo sapiens
gcuguucucugucgugag

SEQ ID NO: 1359085 - RNA, 15 nt, Homo sapiens
gcuguugacauauuu

SEQ ID NO: 1359086 - RNA, 15 nt, Homo sapiens
gcuuagagaggacaa

SEQ ID NO: 1359087 - RNA, 18 nt, Homo sapiens
gcuuagauuguagcuguu

SEQ ID NO: 1359088 - RNA, 17 nt, Homo sapiens
gcuuagugagcagugag

SEQ ID NO: 1359089 - RNA, 16 nt, Homo sapiens
gcuuaguuuguguguu

SEQ ID NO: 1359090 - RNA, 19 nt, Homo sapiens
gcuucacagaugugugauu

SEQ ID NO: 1359091 - RNA, 19 nt, Homo sapiens
gcuucccuaaucuaugguc

SEQ ID NO: 1359092 - RNA, 18 nt, Homo sapiens
gcuuccucuggccaggua

SEQ ID NO: 1359093 - RNA, 16 nt, Homo sapiens
gcuucuccugugugau

SEQ ID NO: 1359094 - RNA, 21 nt, Homo sapiens
gucugcacugaugaccgucug

SEQ ID NO: 1359095 - RNA, 19 nt, Homo sapiens
gucugccacaccucuccaa

SEQ ID NO: 1359096 - RNA, 16 nt, Homo sapiens
gucuggagcacccuga

SEQ ID NO: 1359097 - RNA, 22 nt, Homo sapiens
gucugugcauuucugguugcac

SEQ ID NO: 1359098 - RNA, 20 nt, Homo sapiens
gucugugccauuucucaggg

SEQ ID NO: 1359099 - RNA, 13 nt, Homo sapiens
gucuucagcaccc

SEQ ID NO: 1359100 - RNA, 22 nt, Homo sapiens
gucuucauaauuucuucacuca

SEQ ID NO: 1359101 - RNA, 21 nt, Homo sapiens
gucuuccugaguggugccaaa

SEQ ID NO: 1359102 - RNA, 22 nt, Homo sapiens
gucuuccugaguggugccaaac

SEQ ID NO: 1359103 - RNA, 22 nt, Homo sapiens
gucuugauuucacacucauuua

SEQ ID NO: 1359104 - RNA, 15 nt, Homo sapiens
gucuugcuggaagac

SEQ ID NO: 1359105 - RNA, 19 nt, Homo sapiens
gucuuuccuaaggcugcaa

SEQ ID NO: 1359106 - RNA, 14 nt, Homo sapiens
gugaaaaucuguca

SEQ ID NO: 1359107 - RNA, 19 nt, Homo sapiens
gugacacuugguccuugcu

SEQ ID NO: 1359108 - RNA, 21 nt, Homo sapiens
gugacagacaggcucuuagca

SEQ ID NO: 1359109 - RNA, 16 nt, Homo sapiens
gugaccagugcugcug

SEQ ID NO: 1359110 - RNA, 19 nt, Homo sapiens
gugaccgcaaguucugcac

SEQ ID NO: 1359111 - RNA, 19 nt, Homo sapiens
gugacuaauggcaugagaa

SEQ ID NO: 1359112 - RNA, 21 nt, Homo sapiens
gugcacauccgcgugugccug

SEQ ID NO: 1359113 - RNA, 17 nt, Homo sapiens
gugcagacgaaacacaa

SEQ ID NO: 1359114 - RNA, 19 nt, Homo sapiens
gugccccaugccuguccag

SEQ ID NO: 1359115 - RNA, 22 nt, Homo sapiens
gugccccuccaagucacaaaga

SEQ ID NO: 1359116 - RNA, 14 nt, Homo sapiens
gugccuagacuguu

SEQ ID NO: 1359117 - RNA, 16 nt, Homo sapiens
gugcuggauuugauga

SEQ ID NO: 1359118 - RNA, 17 nt, Homo sapiens
gugcugggaagcccgga

SEQ ID NO: 1359119 - RNA, 15 nt, Homo sapiens
guggaauugugcuga

SEQ ID NO: 1359120 - RNA, 17 nt, Homo sapiens
guggacaugcgugacca

SEQ ID NO: 1359121 - RNA, 21 nt, Homo sapiens
guggacaugcgugaccagcag

SEQ ID NO: 1359122 - RNA, 17 nt, Homo sapiens
guggagcuccacugcca

SEQ ID NO: 1359123 - RNA, 18 nt, Homo sapiens
guggagcuccacugccau

SEQ ID NO: 1359124 - RNA, 21 nt, Homo sapiens
guggauauuaaaaaucuguaa

SEQ ID NO: 1359125 - RNA, 14 nt, Homo sapiens
guggccacuaagca

SEQ ID NO: 1359126 - RNA, 20 nt, Homo sapiens
guggccacugagcuggcuga

SEQ ID NO: 1359127 - RNA, 18 nt, Homo sapiens
guggcccagagaagccaa

SEQ ID NO: 1359128 - RNA, 21 nt, Homo sapiens
guggcccagcuauuaccacac

SEQ ID NO: 1359129 - RNA, 14 nt, Homo sapiens
guggccuguggcug

SEQ ID NO: 1359130 - RNA, 15 nt, Homo sapiens
guggcuuugcauuuc

SEQ ID NO: 1359131 - RNA, 19 nt, Homo sapiens
gugggaacucacuuucccu

SEQ ID NO: 1359132 - RNA, 19 nt, Homo sapiens
gugggacccccguggggca

SEQ ID NO: 1359133 - RNA, 15 nt, Homo sapiens
gugggaguagugcuu

SEQ ID NO: 1359134 - RNA, 16 nt, Homo sapiens
guggucagagugccac

SEQ ID NO: 1359135 - RNA, 23 nt, Homo sapiens
guggugacuuccugaacaucagc

SEQ ID NO: 1359136 - RNA, 19 nt, Homo sapiens
gugguuuaucagcaaaaaa

SEQ ID NO: 1359137 - RNA, 12 nt, Homo sapiens
gugguuugaaaa

SEQ ID NO: 1359138 - RNA, 15 nt, Homo sapiens
guguaaaaaaaccac

SEQ ID NO: 1359139 - RNA, 12 nt, Homo sapiens
guguaacauauu

SEQ ID NO: 1359140 - RNA, 23 nt, Homo sapiens
guguauuuaaccuugaaggguuc

SEQ ID NO: 1359141 - RNA, 17 nt, Homo sapiens
gugugaguaaugcucag

SEQ ID NO: 1359142 - RNA, 15 nt, Homo sapiens
gugugcgucacugug

SEQ ID NO: 1359143 - RNA, 19 nt, Homo sapiens
guguggugagaucaugcca

SEQ ID NO: 1359144 - RNA, 16 nt, Homo sapiens
guguuggcacaugccu

SEQ ID NO: 1359145 - RNA, 22 nt, Homo sapiens
guguuuggaaaauuguguauga

SEQ ID NO: 1359146 - RNA, 17 nt, Homo sapiens
guguuuuuuuacauacg

SEQ ID NO: 1359147 - RNA, 14 nt, Homo sapiens
guuaaugguuugaa

SEQ ID NO: 1359148 - RNA, 22 nt, Homo sapiens
guuaauuuuuccuauauugcau

SEQ ID NO: 1359149 - RNA, 21 nt, Homo sapiens
guuaauuuuuugguacaaaaa

SEQ ID NO: 1359150 - RNA, 14 nt, Homo sapiens
guuacaaguuuaua

SEQ ID NO: 1359151 - RNA, 18 nt, Homo sapiens
guuacaucucagugcugu

SEQ ID NO: 1359152 - RNA, 23 nt, Homo sapiens
guuacuuuuuuaguaacaauuca

SEQ ID NO: 1359153 - RNA, 22 nt, Homo sapiens
guuagugcuaguggauuuuaca

SEQ ID NO: 1359154 - RNA, 14 nt, Homo sapiens
guuauugccucuac

SEQ ID NO: 1359155 - RNA, 19 nt, Homo sapiens
guucauauuuauacuuugc

SEQ ID NO: 1359156 - RNA, 20 nt, Homo sapiens
guuccagcaaacaaaaugga

SEQ ID NO: 1359157 - RNA, 13 nt, Homo sapiens
guuccccagagaa

SEQ ID NO: 1359158 - RNA, 19 nt, Homo sapiens
guucuacagagugagaccu

SEQ ID NO: 1359159 - RNA, 16 nt, Homo sapiens
guucucacagugggag

SEQ ID NO: 1359160 - RNA, 21 nt, Homo sapiens
guucucacagugggagccagg

SEQ ID NO: 1359161 - RNA, 20 nt, Homo sapiens
guucucagguguugccaaau

SEQ ID NO: 1359162 - RNA, 14 nt, Homo sapiens
guucucauaacucu

SEQ ID NO: 1359163 - RNA, 18 nt, Homo sapiens
guucucauaacucuguga

SEQ ID NO: 1359164 - RNA, 20 nt, Homo sapiens
guucucauaacucugugauc

SEQ ID NO: 1359165 - RNA, 15 nt, Homo sapiens
guucugaaagugacu

SEQ ID NO: 1359166 - RNA, 17 nt, Homo sapiens
guucuuuaaaauguaaa

SEQ ID NO: 1359167 - RNA, 16 nt, Homo sapiens
guucuuugggccagac

SEQ ID NO: 1359168 - RNA, 21 nt, Homo sapiens
guugaaaagacaauagcccaa

SEQ ID NO: 1359169 - RNA, 12 nt, Homo sapiens
guugacugcugg

SEQ ID NO: 1359170 - RNA, 18 nt, Homo sapiens
guugauuacagugcagug

SEQ ID NO: 1359171 - RNA, 13 nt, Homo sapiens
guugcacuggcca

SEQ ID NO: 1359172 - RNA, 14 nt, Homo sapiens
guugcccagugugu

SEQ ID NO: 1359173 - RNA, 21 nt, Homo sapiens
guuggacuguaagggauugaa

SEQ ID NO: 1359174 - RNA, 12 nt, Homo sapiens
guuggcuucuaa

SEQ ID NO: 1359175 - RNA, 18 nt, Homo sapiens
guuuagcccaaaaccaag

SEQ ID NO: 1359176 - RNA, 23 nt, Homo sapiens
guuuauucuuccaacacauuuca

SEQ ID NO: 1359177 - RNA, 22 nt, Homo sapiens
guuucauucauccugaccaaga

SEQ ID NO: 1359178 - RNA, 12 nt, Homo sapiens
guuuccugaaac

SEQ ID NO: 1359179 - RNA, 22 nt, Homo sapiens
guuucucccccuuuccaaaaac

SEQ ID NO: 1359180 - RNA, 17 nt, Homo sapiens
guuugaaucacaguaua

SEQ ID NO: 1359181 - RNA, 18 nt, Homo sapiens
guuugagguccacacuga

SEQ ID NO: 1359182 - RNA, 13 nt, Homo sapiens
guuuggcuuucag

SEQ ID NO: 1359183 - RNA, 15 nt, Homo sapiens
guuuguaaaugccuc

SEQ ID NO: 1359184 - RNA, 19 nt, Homo sapiens
guuuguguguugucucuug

SEQ ID NO: 1359185 - RNA, 18 nt, Homo sapiens
guuuuacaaugucauaua

SEQ ID NO: 1359186 - RNA, 20 nt, Homo sapiens
guuuuccucccuucugcuac

SEQ ID NO: 1359187 - RNA, 15 nt, Homo sapiens
guuuucuagaauuua

SEQ ID NO: 1359188 - RNA, 17 nt, Homo sapiens
uaaaaaaaccaccaaaa

SEQ ID NO: 1359189 - RNA, 13 nt, Homo sapiens
uaaaaacaaacag

SEQ ID NO: 1359190 - RNA, 19 nt, Homo sapiens
uaaaaacaaacagaacaaa

SEQ ID NO: 1359191 - RNA, 15 nt, Homo sapiens
uaaaaacugcagugu

SEQ ID NO: 1359192 - RNA, 14 nt, Homo sapiens
uaaaaaucugagaa

SEQ ID NO: 1359193 - RNA, 18 nt, Homo sapiens
uaaaacauuaugaguuuc

SEQ ID NO: 1359194 - RNA, 23 nt, Homo sapiens
uaaaagaugcauuaucuaugaua

SEQ ID NO: 1359195 - RNA, 19 nt, Homo sapiens
uaaaauacuaaacuacauu

SEQ ID NO: 1359196 - RNA, 17 nt, Homo sapiens
uaaaaucagacucuuua

SEQ ID NO: 1359197 - RNA, 18 nt, Homo sapiens
uaaaaugauaaacaaguc

SEQ ID NO: 1359198 - RNA, 18 nt, Homo sapiens
uaaacagccucuuuuuga

SEQ ID NO: 1359199 - RNA, 21 nt, Homo sapiens
uaaacuaaugagcaaguaaca

SEQ ID NO: 1359200 - RNA, 20 nt, Homo sapiens
uaaacuuaaaaagaaaaccu

SEQ ID NO: 1359201 - RNA, 21 nt, Homo sapiens
uaaagauaacccuuauuccau

SEQ ID NO: 1359202 - RNA, 19 nt, Homo sapiens
uaaagcaacaaaaauuacu

SEQ ID NO: 1359203 - RNA, 17 nt, Homo sapiens
uaaaguaucugagauua

SEQ ID NO: 1359204 - RNA, 20 nt, Homo sapiens
uaaagugacuaauggcauga

SEQ ID NO: 1359205 - RNA, 13 nt, Homo sapiens
uaaauaccaaaaa

SEQ ID NO: 1359206 - RNA, 12 nt, Homo sapiens
uaaauacuguuu

SEQ ID NO: 1359207 - RNA, 16 nt, Homo sapiens
uaaauccucucuauca

SEQ ID NO: 1359208 - RNA, 18 nt, Homo sapiens
uaaauccucucuaucaca

SEQ ID NO: 1359209 - RNA, 22 nt, Homo sapiens
uaaaugugccuauuggugucua

SEQ ID NO: 1359210 - RNA, 15 nt, Homo sapiens
uuagucgagccaagu

SEQ ID NO: 1359211 - RNA, 17 nt, Homo sapiens
uuauaaaagaugcauua

SEQ ID NO: 1359212 - RNA, 13 nt, Homo sapiens
uuauaacuguugu

SEQ ID NO: 1359213 - RNA, 12 nt, Homo sapiens
uuauaacuuuaa

SEQ ID NO: 1359214 - RNA, 14 nt, Homo sapiens
uuauagaauuaugc

SEQ ID NO: 1359215 - RNA, 14 nt, Homo sapiens
uuauaucacuucac

SEQ ID NO: 1359216 - RNA, 14 nt, Homo sapiens
uuaucagcaaaaaa

SEQ ID NO: 1359217 - RNA, 13 nt, Homo sapiens
uuaucucaggggu

SEQ ID NO: 1359218 - RNA, 17 nt, Homo sapiens
uuaugcuaccuacugau

SEQ ID NO: 1359219 - RNA, 20 nt, Homo sapiens
uuaugcuguuaaaacuacuu

SEQ ID NO: 1359220 - RNA, 20 nt, Homo sapiens
uuaugguaccagaugcagcu

SEQ ID NO: 1359221 - RNA, 13 nt, Homo sapiens
uuauguguucuaa

SEQ ID NO: 1359222 - RNA, 19 nt, Homo sapiens
uuauuacauguaauuugau

SEQ ID NO: 1359223 - RNA, 23 nt, Homo sapiens
uuauucuuccaacacauuucacu

SEQ ID NO: 1359224 - RNA, 15 nt, Homo sapiens
uuauuggucagggug

SEQ ID NO: 1359225 - RNA, 22 nt, Homo sapiens
uucaaaaacgcacugcaagaag

SEQ ID NO: 1359226 - RNA, 21 nt, Homo sapiens
uucaaaaauacucacauggcu

SEQ ID NO: 1359227 - RNA, 22 nt, Homo sapiens
uucaaaauauguauucaguguu

SEQ ID NO: 1359228 - RNA, 19 nt, Homo sapiens
uucaagagucuaaacccca

SEQ ID NO: 1359229 - RNA, 16 nt, Homo sapiens
uucacagaugugugau

SEQ ID NO: 1359230 - RNA, 12 nt, Homo sapiens
uucacaguguga

SEQ ID NO: 1359231 - RNA, 17 nt, Homo sapiens
uucacauuagaagacaa

SEQ ID NO: 1359232 - RNA, 15 nt, Homo sapiens
uucacggcaggacaa

SEQ ID NO: 1359233 - RNA, 14 nt, Homo sapiens
uucacucaaucucu

SEQ ID NO: 1359234 - RNA, 22 nt, Homo sapiens
uucagcauuauugaaauuguaa

SEQ ID NO: 1359235 - RNA, 15 nt, Homo sapiens
uucagcugguugagg

SEQ ID NO: 1359236 - RNA, 22 nt, Homo sapiens
uucaggcaccugaagugagaac

SEQ ID NO: 1359237 - RNA, 15 nt, Homo sapiens
uucaguuaauucuua

SEQ ID NO: 1359238 - RNA, 17 nt, Homo sapiens
uucauaaagucuugccu

SEQ ID NO: 1359239 - RNA, 13 nt, Homo sapiens
uucauggaacuca

SEQ ID NO: 1359240 - RNA, 14 nt, Homo sapiens
uucauuuauaucgc

SEQ ID NO: 1359241 - RNA, 21 nt, Homo sapiens
uucauuucuuuuucauuugac

SEQ ID NO: 1359242 - RNA, 14 nt, Homo sapiens
uuccaagcuguuag

SEQ ID NO: 1359243 - RNA, 15 nt, Homo sapiens
uuccacagauuauca

SEQ ID NO: 1359244 - RNA, 16 nt, Homo sapiens
uuccacagauuaucaa

SEQ ID NO: 1359245 - RNA, 23 nt, Homo sapiens
uuccagcuuagaaugcaucucau

SEQ ID NO: 1359246 - RNA, 16 nt, Homo sapiens
uuccaucucugacuua

SEQ ID NO: 1359247 - RNA, 16 nt, Homo sapiens
uuccaugaaaaugcaa

SEQ ID NO: 1359248 - RNA, 15 nt, Homo sapiens
uuccaugacaacaga

SEQ ID NO: 1359249 - RNA, 16 nt, Homo sapiens
uuccauuaaacuacuu

SEQ ID NO: 1359250 - RNA, 15 nt, Homo sapiens
uuccauuuuggaaaa

SEQ ID NO: 1359251 - RNA, 17 nt, Homo sapiens
uucccagagucaucuga

SEQ ID NO: 1359252 - RNA, 13 nt, Homo sapiens
uucccaucgcugg

SEQ ID NO: 1359253 - RNA, 19 nt, Homo sapiens
uuccccacaggugaaaguu

SEQ ID NO: 1359254 - RNA, 18 nt, Homo sapiens
uucccuaggaaacucaca

SEQ ID NO: 1359255 - RNA, 23 nt, Homo sapiens
uucccuaggaaacucacacuccc

SEQ ID NO: 1359256 - RNA, 20 nt, Homo sapiens
uucccuauuuugccaguggg

SEQ ID NO: 1359257 - RNA, 21 nt, Homo sapiens
uucccuauuuugccaguggga

SEQ ID NO: 1359258 - RNA, 14 nt, Homo sapiens
uuccgagaggacca

SEQ ID NO: 1359259 - RNA, 12 nt, Homo sapiens
uuccguaucucc

SEQ ID NO: 1359260 - RNA, 21 nt, Homo sapiens
uuccuacauuuugaaggugau

SEQ ID NO: 1359261 - RNA, 12 nt, Homo sapiens
uuccuaggucau

SEQ ID NO: 1359262 - RNA, 18 nt, Homo sapiens
uuccucauuagcauuuug

SEQ ID NO: 1359263 - RNA, 15 nt, Homo sapiens
uuccuguccagcucc

SEQ ID NO: 1359264 - RNA, 14 nt, Homo sapiens
uuccuugggcuuua

SEQ ID NO: 1359265 - RNA, 21 nt, Homo sapiens
uucguagauauuggacaaaga

SEQ ID NO: 1359266 - RNA, 23 nt, Homo sapiens
uucuaaaauuuggggggucuugc

SEQ ID NO: 1359267 - RNA, 15 nt, Homo sapiens
uucuaaacggugacc

SEQ ID NO: 1359268 - RNA, 17 nt, Homo sapiens
uucuaagacuacuauga

SEQ ID NO: 1359269 - RNA, 17 nt, Homo sapiens
ugauucauuuucugccu

SEQ ID NO: 1359270 - RNA, 16 nt, Homo sapiens
ugauuuaaacucuuag

SEQ ID NO: 1359271 - RNA, 14 nt, Homo sapiens
ugauuuaaaucagc

SEQ ID NO: 1359272 - RNA, 15 nt, Homo sapiens
ugauuucagacugca

SEQ ID NO: 1359273 - RNA, 13 nt, Homo sapiens
ugcaacuuguaaa

SEQ ID NO: 1359274 - RNA, 22 nt, Homo sapiens
ugcaagaauugaagcaggacua

SEQ ID NO: 1359275 - RNA, 19 nt, Homo sapiens
ugcacagaauauguaugua

SEQ ID NO: 1359276 - RNA, 18 nt, Homo sapiens
ugcaccucuuugucacag

SEQ ID NO: 1359277 - RNA, 13 nt, Homo sapiens
ugcacuacugaca

SEQ ID NO: 1359278 - RNA, 13 nt, Homo sapiens
ugcacuguagggu

SEQ ID NO: 1359279 - RNA, 15 nt, Homo sapiens
ugcagaauguugauu

SEQ ID NO: 1359280 - RNA, 23 nt, Homo sapiens
ugcagacaggaaucuuaaggugu

SEQ ID NO: 1359281 - RNA, 22 nt, Homo sapiens
ugcagaggggaaagacuuccau

SEQ ID NO: 1359282 - RNA, 16 nt, Homo sapiens
ugcagaguacaugaua

SEQ ID NO: 1359283 - RNA, 21 nt, Homo sapiens
ugcagcaccgaggggccuuug

SEQ ID NO: 1359284 - RNA, 22 nt, Homo sapiens
ugcagguuccgauguuauuaga

SEQ ID NO: 1359285 - RNA, 18 nt, Homo sapiens
ugcagucaucuugaccaa

SEQ ID NO: 1359286 - RNA, 20 nt, Homo sapiens
ugcauaagugcaugacauau

SEQ ID NO: 1359287 - RNA, 19 nt, Homo sapiens
ugcaucguuucaucuucca

SEQ ID NO: 1359288 - RNA, 15 nt, Homo sapiens
ugcaucugaccagca

SEQ ID NO: 1359289 - RNA, 16 nt, Homo sapiens
ugcaugcagcaucuaa

SEQ ID NO: 1359290 - RNA, 12 nt, Homo sapiens
ugcauuaucuau

SEQ ID NO: 1359291 - RNA, 14 nt, Homo sapiens
ugcauuaucuauga

SEQ ID NO: 1359292 - RNA, 20 nt, Homo sapiens
ugcauuuggauugggguccc

SEQ ID NO: 1359293 - RNA, 18 nt, Homo sapiens
ugccacccaccuuugcca

SEQ ID NO: 1359294 - RNA, 16 nt, Homo sapiens
ugccagcuuaucucag

SEQ ID NO: 1359295 - RNA, 19 nt, Homo sapiens
ugccagcuuaucucagggg

SEQ ID NO: 1359296 - RNA, 15 nt, Homo sapiens
ugccauaucagugaa

SEQ ID NO: 1359297 - RNA, 19 nt, Homo sapiens
ugccauuucugaacuguua

SEQ ID NO: 1359298 - RNA, 18 nt, Homo sapiens
ugcccaccugucaaacaa

SEQ ID NO: 1359299 - RNA, 22 nt, Homo sapiens
ugcccacgcugcagugugagua

SEQ ID NO: 1359300 - RNA, 18 nt, Homo sapiens
ugcccacuucacugcucg

SEQ ID NO: 1359301 - RNA, 12 nt, Homo sapiens
ugcccagugugu

SEQ ID NO: 1359302 - RNA, 20 nt, Homo sapiens
ugccccuccaagucacaaag

SEQ ID NO: 1359303 - RNA, 22 nt, Homo sapiens
ugccccucccagaacacacucc

SEQ ID NO: 1359304 - RNA, 16 nt, Homo sapiens
ugccccuggcucugac

SEQ ID NO: 1359305 - RNA, 14 nt, Homo sapiens
ugccccuugacaac

SEQ ID NO: 1359306 - RNA, 13 nt, Homo sapiens
ugcccgggcuccc

SEQ ID NO: 1359307 - RNA, 22 nt, Homo sapiens
ugccgaaccaaaagaauuugca

SEQ ID NO: 1359308 - RNA, 21 nt, Homo sapiens
ugccgccucaagggucuucag

SEQ ID NO: 1359309 - RNA, 14 nt, Homo sapiens
ugccgucugugcuu

SEQ ID NO: 1359310 - RNA, 15 nt, Homo sapiens
ugccuagacuguuac

SEQ ID NO: 1359311 - RNA, 20 nt, Homo sapiens
ugccuagacuguuacuuugg

SEQ ID NO: 1359312 - RNA, 22 nt, Homo sapiens
ugccucagccuccugaguaguu

SEQ ID NO: 1359313 - RNA, 12 nt, Homo sapiens
ugccucagggau

SEQ ID NO: 1359314 - RNA, 13 nt, Homo sapiens
ugccucuacuuug

SEQ ID NO: 1359315 - RNA, 19 nt, Homo sapiens
ugccugauccuccaacagc

SEQ ID NO: 1359316 - RNA, 18 nt, Homo sapiens
ugccuuucaaauuuagaa

SEQ ID NO: 1359317 - RNA, 21 nt, Homo sapiens
ugcgacccugggggcacagga

SEQ ID NO: 1359318 - RNA, 22 nt, Homo sapiens
ugcgauuuuguuaacccagcga

SEQ ID NO: 1359319 - RNA, 15 nt, Homo sapiens
ugcgcucccaccuca

SEQ ID NO: 1359320 - RNA, 16 nt, Homo sapiens
ugcgcuguaguaggca

SEQ ID NO: 1359321 - RNA, 13 nt, Homo sapiens
ugcggccauucaa

SEQ ID NO: 1359322 - RNA, 20 nt, Homo sapiens
ugcgugccucguacgugugu

SEQ ID NO: 1359323 - RNA, 13 nt, Homo sapiens
ugcuaaaugugaa

SEQ ID NO: 1359324 - RNA, 22 nt, Homo sapiens
ugcuaacuagcuuggaaacugg

SEQ ID NO: 1359325 - RNA, 12 nt, Homo sapiens
gcuggugcugug

SEQ ID NO: 1359326 - RNA, 17 nt, Homo sapiens
gcugucauccacuuuau

SEQ ID NO: 1359327 - RNA, 19 nt, Homo sapiens
gcugucccuugcuugccug

SEQ ID NO: 1359328 - RNA, 16 nt, Homo sapiens
gcuguccuuacccauc

SEQ ID NO: 1359329 - RNA, 20 nt, Homo sapiens
gcugucgagaaacagccugu

SEQ ID NO: 1359330 - RNA, 20 nt, Homo sapiens
gcuguggagcuccacugcca

SEQ ID NO: 1359331 - RNA, 21 nt, Homo sapiens
gcuguggagcuccacugccau

SEQ ID NO: 1359332 - RNA, 15 nt, Homo sapiens
gcuguggcucugggu

SEQ ID NO: 1359333 - RNA, 15 nt, Homo sapiens
gcuguuccuguucag

SEQ ID NO: 1359334 - RNA, 22 nt, Homo sapiens
gcuguugcgcucccaccucagc

SEQ ID NO: 1359335 - RNA, 19 nt, Homo sapiens
gcuuauaccagguuaccuc

SEQ ID NO: 1359336 - RNA, 21 nt, Homo sapiens
gcuuauaccagguuaccucac

SEQ ID NO: 1359337 - RNA, 18 nt, Homo sapiens
gcuucagguccaggcugu

SEQ ID NO: 1359338 - RNA, 15 nt, Homo sapiens
gcuucccuaaucuau

SEQ ID NO: 1359339 - RNA, 17 nt, Homo sapiens
gcuucuagaaccaggca

SEQ ID NO: 1359340 - RNA, 22 nt, Homo sapiens
gcuucucacugccaugccagcu

SEQ ID NO: 1359341 - RNA, 12 nt, Homo sapiens
gcuucucuggga

SEQ ID NO: 1359342 - RNA, 11 nt, Homo sapiens
gcuucugccau

SEQ ID NO: 1359343 - RNA, 23 nt, Homo sapiens
gcuucuggaauuuguucaaguuu

SEQ ID NO: 1359344 - RNA, 16 nt, Homo sapiens
gcuucuggccaggaag

SEQ ID NO: 1359345 - RNA, 18 nt, Homo sapiens
gcuugauagaaaugccaa

SEQ ID NO: 1359346 - RNA, 23 nt, Homo sapiens
gcuugcaaaaacuacaaccaaug

SEQ ID NO: 1359347 - RNA, 15 nt, Homo sapiens
gcuugcaugugcugc

SEQ ID NO: 1359348 - RNA, 23 nt, Homo sapiens
gcuugccugcagggccauggcuc

SEQ ID NO: 1359349 - RNA, 23 nt, Homo sapiens
gcuuggaaacuggaugaggucau

SEQ ID NO: 1359350 - RNA, 18 nt, Homo sapiens
gcuuguuauugccucuac

SEQ ID NO: 1359351 - RNA, 16 nt, Homo sapiens
gcuuguugugcuuuua

SEQ ID NO: 1359352 - RNA, 14 nt, Homo sapiens
gcuuucacauugua

SEQ ID NO: 1359353 - RNA, 14 nt, Homo sapiens
gcuuucucuucuaa

SEQ ID NO: 1359354 - RNA, 19 nt, Homo sapiens
gcuuugaaugcggcccaac

SEQ ID NO: 1359355 - RNA, 17 nt, Homo sapiens
ggaaacuggaugagguc

SEQ ID NO: 1359356 - RNA, 19 nt, Homo sapiens
ggaaacuggaugaggucau

SEQ ID NO: 1359357 - RNA, 14 nt, Homo sapiens
ggaacccagacuca

SEQ ID NO: 1359358 - RNA, 14 nt, Homo sapiens
ggaacucacuuucc

SEQ ID NO: 1359359 - RNA, 18 nt, Homo sapiens
ggaagaaugaacacuccc

SEQ ID NO: 1359360 - RNA, 24 nt, Homo sapiens
ggaagagugguuaagacuacugaa

SEQ ID NO: 1359361 - RNA, 14 nt, Homo sapiens
ggaagucugucuca

SEQ ID NO: 1359362 - RNA, 17 nt, Homo sapiens
ggaagugugugaucugu

SEQ ID NO: 1359363 - RNA, 16 nt, Homo sapiens
ggaauaauuauuacau

SEQ ID NO: 1359364 - RNA, 21 nt, Homo sapiens
ggaauccuagcacuugucuca

SEQ ID NO: 1359365 - RNA, 20 nt, Homo sapiens
ggaauccuuuggugccaacu

SEQ ID NO: 1359366 - RNA, 16 nt, Homo sapiens
ggaauuaagcaaaauc

SEQ ID NO: 1359367 - RNA, 13 nt, Homo sapiens
ggaauucaucucu

SEQ ID NO: 1359368 - RNA, 23 nt, Homo sapiens
ggacaaacagccucacuccucag

SEQ ID NO: 1359369 - RNA, 20 nt, Homo sapiens
ggacagaugaaugccgugga

SEQ ID NO: 1359370 - RNA, 18 nt, Homo sapiens
ggacagccccacccuggu

SEQ ID NO: 1359371 - RNA, 13 nt, Homo sapiens
ggacagguggugc

SEQ ID NO: 1359372 - RNA, 23 nt, Homo sapiens
ggacauaaugggguccuggccau

SEQ ID NO: 1359373 - RNA, 16 nt, Homo sapiens
ggacaucacagggugg

SEQ ID NO: 1359374 - RNA, 17 nt, Homo sapiens
ggaccugagaguggcua

SEQ ID NO: 1359375 - RNA, 19 nt, Homo sapiens
ggacugaagggguucucac

SEQ ID NO: 1359376 - RNA, 15 nt, Homo sapiens
ggacuguaagggauu

SEQ ID NO: 1359377 - RNA, 15 nt, Homo sapiens
ggagaauuagauuuc

SEQ ID NO: 1359378 - RNA, 17 nt, Homo sapiens
ggagacaaaucucagaa

SEQ ID NO: 1359379 - RNA, 13 nt, Homo sapiens
ggagacugcugag

SEQ ID NO: 1359380 - RNA, 14 nt, Homo sapiens
ggagagcacugcca

SEQ ID NO: 1359381 - RNA, 14 nt, Homo sapiens
ggagauaccagaga

SEQ ID NO: 1359382 - RNA, 17 nt, Homo sapiens
ggagcucaggucccagg

SEQ ID NO: 1359383 - RNA, 16 nt, Homo sapiens
ggagcuuaaacagcug

SEQ ID NO: 1359384 - RNA, 20 nt, Homo sapiens
ggaggcagagcuugcaguga

SEQ ID NO: 1359385 - RNA, 13 nt, Homo sapiens
ggaggccagagga

SEQ ID NO: 1359386 - RNA, 16 nt, Homo sapiens
acuagagucugaacag

SEQ ID NO: 1359387 - RNA, 19 nt, Homo sapiens
acuauggcucuacuuucag

SEQ ID NO: 1359388 - RNA, 22 nt, Homo sapiens
acuauuaaaaagguuuacagaa

SEQ ID NO: 1359389 - RNA, 19 nt, Homo sapiens
acucaagccaagcagccaa

SEQ ID NO: 1359390 - RNA, 15 nt, Homo sapiens
acucaaguaccacca

SEQ ID NO: 1359391 - RNA, 21 nt, Homo sapiens
acucacacggacacucaaaag

SEQ ID NO: 1359392 - RNA, 23 nt, Homo sapiens
acucacacggacacucaaaagcu

SEQ ID NO: 1359393 - RNA, 12 nt, Homo sapiens
acucacacuccc

SEQ ID NO: 1359394 - RNA, 18 nt, Homo sapiens
acucagauggaaccgcag

SEQ ID NO: 1359395 - RNA, 21 nt, Homo sapiens
acucauagauguuaugcaaaa

SEQ ID NO: 1359396 - RNA, 15 nt, Homo sapiens
acucccauuccugaa

SEQ ID NO: 1359397 - RNA, 20 nt, Homo sapiens
acucccuccucaccucugga

SEQ ID NO: 1359398 - RNA, 13 nt, Homo sapiens
acuccuaaaucaa

SEQ ID NO: 1359399 - RNA, 16 nt, Homo sapiens
acuccuaccugaaggc

SEQ ID NO: 1359400 - RNA, 13 nt, Homo sapiens
acuccugccauuc

SEQ ID NO: 1359401 - RNA, 19 nt, Homo sapiens
acuccuuguaaagacugua

SEQ ID NO: 1359402 - RNA, 19 nt, Homo sapiens
acucgcuagguucuuauca

SEQ ID NO: 1359403 - RNA, 12 nt, Homo sapiens
acucgcuguaug

SEQ ID NO: 1359404 - RNA, 18 nt, Homo sapiens
acucuagggaaaaaccag

SEQ ID NO: 1359405 - RNA, 13 nt, Homo sapiens
acucuccugccuc

SEQ ID NO: 1359406 - RNA, 15 nt, Homo sapiens
acucuccugugagau

SEQ ID NO: 1359407 - RNA, 21 nt, Homo sapiens
acucugauguugggauggaau

SEQ ID NO: 1359408 - RNA, 12 nt, Homo sapiens
acugaaaccuag

SEQ ID NO: 1359409 - RNA, 17 nt, Homo sapiens
acugacuagagugauga

SEQ ID NO: 1359410 - RNA, 11 nt, Homo sapiens
acugagccauc

SEQ ID NO: 1359411 - RNA, 18 nt, Homo sapiens
agagaucucagagguuau

SEQ ID NO: 1359412 - RNA, 17 nt, Homo sapiens
agagauuauaacaaauu

SEQ ID NO: 1359413 - RNA, 22 nt, Homo sapiens
agagcaacaauccaucucucaa

SEQ ID NO: 1359414 - RNA, 18 nt, Homo sapiens
agagcagaacccuagucu

SEQ ID NO: 1359415 - RNA, 15 nt, Homo sapiens
agaggaaaaggcugg

SEQ ID NO: 1359416 - RNA, 21 nt, Homo sapiens
agaggagagagacuccagcug

SEQ ID NO: 1359417 - RNA, 17 nt, Homo sapiens
agaggcagucagaggac

SEQ ID NO: 1359418 - RNA, 22 nt, Homo sapiens
agagggcgagcaugaacuggcc

SEQ ID NO: 1359419 - RNA, 20 nt, Homo sapiens
agaggugaaaacuugucaga

SEQ ID NO: 1359420 - RNA, 17 nt, Homo sapiens
agagucucauguagcug

SEQ ID NO: 1359421 - RNA, 20 nt, Homo sapiens
agagugagacucccucucaa

SEQ ID NO: 1359422 - RNA, 16 nt, Homo sapiens
agagugcuaugaagac

SEQ ID NO: 1359423 - RNA, 18 nt, Homo sapiens
agaguggcuuccaucuca

SEQ ID NO: 1359424 - RNA, 20 nt, Homo sapiens
agauaacaaucuguauauaa

SEQ ID NO: 1359425 - RNA, 14 nt, Homo sapiens
agauagacaaucac

SEQ ID NO: 1359426 - RNA, 21 nt, Homo sapiens
agauauacuugguucucucca

SEQ ID NO: 1359427 - RNA, 17 nt, Homo sapiens
agauauuggacaaagaa

SEQ ID NO: 1359428 - RNA, 16 nt, Homo sapiens
agaucgcaguuugccu

SEQ ID NO: 1359429 - RNA, 22 nt, Homo sapiens
agaucuggucccuugcagcuag

SEQ ID NO: 1359430 - RNA, 23 nt, Homo sapiens
agaucuucucuguuauuccugau

SEQ ID NO: 1359431 - RNA, 18 nt, Homo sapiens
agaucuugaauagucuca

SEQ ID NO: 1359432 - RNA, 20 nt, Homo sapiens
agaucuugaauagucucauc

SEQ ID NO: 1359433 - RNA, 14 nt, Homo sapiens
agaugaaugggagu

SEQ ID NO: 1359434 - RNA, 20 nt, Homo sapiens
caaaaaaguccaauuuuaau

SEQ ID NO: 1359435 - RNA, 14 nt, Homo sapiens
caaaaaaucugacc

SEQ ID NO: 1359436 - RNA, 22 nt, Homo sapiens
caaaagcaagggaccuucaugc

SEQ ID NO: 1359437 - RNA, 16 nt, Homo sapiens
caaaagucuggccuuu

SEQ ID NO: 1359438 - RNA, 20 nt, Homo sapiens
caaaauaaaaaccaagaaga

SEQ ID NO: 1359439 - RNA, 16 nt, Homo sapiens
caaaauuucagcauua

SEQ ID NO: 1359440 - RNA, 23 nt, Homo sapiens
caaagaaccuucucuauggggca

SEQ ID NO: 1359441 - RNA, 17 nt, Homo sapiens
caaagaacuucuccuac

SEQ ID NO: 1359442 - RNA, 19 nt, Homo sapiens
caaagaagcugucuuggaa

SEQ ID NO: 1359443 - RNA, 18 nt, Homo sapiens
caaaggcacagugaaggc

SEQ ID NO: 1359444 - RNA, 16 nt, Homo sapiens
caaauaaagauaaccc

SEQ ID NO: 1359445 - RNA, 22 nt, Homo sapiens
caaauaaaggaaacccagcuca

SEQ ID NO: 1359446 - RNA, 23 nt, Homo sapiens
caaauauaaaauuaaaaacuuaa

SEQ ID NO: 1359447 - RNA, 20 nt, Homo sapiens
caaauauucagaaaaugaag

SEQ ID NO: 1359448 - RNA, 17 nt, Homo sapiens
caaaucuggaagccaaa

SEQ ID NO: 1359449 - RNA, 17 nt, Homo sapiens
caaauggggccagaucc

SEQ ID NO: 1359450 - RNA, 14 nt, Homo sapiens
caaauguccuccag

SEQ ID NO: 1359451 - RNA, 20 nt, Homo sapiens
caaauuuucuuccauuucau

SEQ ID NO: 1359452 - RNA, 11 nt, Homo sapiens
caacaaaccau

SEQ ID NO: 1359453 - RNA, 19 nt, Homo sapiens
caacaaacuucaaggguuu

SEQ ID NO: 1359454 - RNA, 21 nt, Homo sapiens
caacaaagauugagaagccau

SEQ ID NO: 1359455 - RNA, 23 nt, Homo sapiens
caacaaagauugagaagccaugu

SEQ ID NO: 1359456 - RNA, 17 nt, Homo sapiens
caacaauccaucucuca

SEQ ID NO: 1359457 - RNA, 21 nt, Homo sapiens
caacaauccaucucucaagua

SEQ ID NO: 1359458 - RNA, 21 nt, Homo sapiens
caacacaauucuucuuccaac

SEQ ID NO: 1359459 - RNA, 13 nt, Homo sapiens
caacacacacugu

SEQ ID NO: 1359460 - RNA, 17 nt, Homo sapiens
caacaugugcucaggga

SEQ ID NO: 1359461 - RNA, 13 nt, Homo sapiens
caaccagcaaaac

SEQ ID NO: 1359462 - RNA, 20 nt, Homo sapiens
caacccaauaguuguugauu

SEQ ID NO: 1359463 - RNA, 15 nt, Homo sapiens
caacccuucauuuaa

SEQ ID NO: 1359464 - RNA, 14 nt, Homo sapiens
caacccuucccuca

SEQ ID NO: 1359465 - RNA, 20 nt, Homo sapiens
caacccuuucauuagaacuu

SEQ ID NO: 1359466 - RNA, 22 nt, Homo sapiens
caacuuccccucuaacuggaca

SEQ ID NO: 1359467 - RNA, 14 nt, Homo sapiens
caagaacacaguga

SEQ ID NO: 1359468 - RNA, 14 nt, Homo sapiens
caagacaagugauu

SEQ ID NO: 1359469 - RNA, 14 nt, Homo sapiens
caagagacucuccu

SEQ ID NO: 1359470 - RNA, 20 nt, Homo sapiens
caagaggaaggggugcugug

SEQ ID NO: 1359471 - RNA, 21 nt, Homo sapiens
caagcauggaaaaucagugac

SEQ ID NO: 1359472 - RNA, 18 nt, Homo sapiens
caagcccuguugacacag

SEQ ID NO: 1359473 - RNA, 16 nt, Homo sapiens
caagcuggacuauggc

SEQ ID NO: 1359474 - RNA, 19 nt, Homo sapiens
caagcuuagugagcaguga

SEQ ID NO: 1359475 - RNA, 16 nt, Homo sapiens
caaggagacugcauuc

SEQ ID NO: 1359476 - RNA, 20 nt, Homo sapiens
caaggagggcagaucacuuc

SEQ ID NO: 1359477 - RNA, 16 nt, Homo sapiens
caaggaugucugccac

SEQ ID NO: 1359478 - RNA, 14 nt, Homo sapiens
caauagaucuccag

SEQ ID NO: 1359479 - RNA, 19 nt, Homo sapiens
caaucucagcucacuguga

SEQ ID NO: 1359480 - RNA, 18 nt, Homo sapiens
caaucucugccauaucag

SEQ ID NO: 1359481 - RNA, 20 nt, Homo sapiens
caaugauccuguauucagac

SEQ ID NO: 1359482 - RNA, 19 nt, Homo sapiens
caaugcugaaugccuguua

SEQ ID NO: 1359483 - RNA, 16 nt, Homo sapiens
caauggcuuacuccag

SEQ ID NO: 1359484 - RNA, 17 nt, Homo sapiens
caauggggcggggcuuc

SEQ ID NO: 1359485 - RNA, 14 nt, Homo sapiens
caauguaagcauac

SEQ ID NO: 1359486 - RNA, 22 nt, Homo sapiens
caauguacaguugaaauaacug

SEQ ID NO: 1359487 - RNA, 19 nt, Homo sapiens
caauguuaaagaugcacag

SEQ ID NO: 1359488 - RNA, 21 nt, Homo sapiens
caauuucccuucauacuccuu

SEQ ID NO: 1359489 - RNA, 18 nt, Homo sapiens
cacaaaagccugugcagg

SEQ ID NO: 1359490 - RNA, 14 nt, Homo sapiens
cacaaaggcaugcu

SEQ ID NO: 1359491 - RNA, 14 nt, Homo sapiens
cacaacacaguucu

SEQ ID NO: 1359492 - RNA, 12 nt, Homo sapiens
cacaaccaaaaa

SEQ ID NO: 1359493 - RNA, 21 nt, Homo sapiens
cacaaggugauuucagacugc

SEQ ID NO: 1359494 - RNA, 15 nt, Homo sapiens
cacaauuucccuuca

SEQ ID NO: 1359495 - RNA, 13 nt, Homo sapiens
cacacacacaaac

SEQ ID NO: 1359496 - RNA, 19 nt, Homo sapiens
cacacccccuuugcauguu

SEQ ID NO: 1359497 - RNA, 22 nt, Homo sapiens
cacaccuuauauuuacguauga

SEQ ID NO: 1359498 - RNA, 20 nt, Homo sapiens
cacacuggagaaaaggcagu

SEQ ID NO: 1359499 - RNA, 19 nt, Homo sapiens
cacacuguucugaaaguga

SEQ ID NO: 1359500 - RNA, 18 nt, Homo sapiens
cacacuuucaugcagugc

SEQ ID NO: 1359501 - RNA, 19 nt, Homo sapiens
cacagaauauguauguaua

SEQ ID NO: 1359502 - RNA, 21 nt, Homo sapiens
cacagacauccucuaugccag

SEQ ID NO: 1359503 - RNA, 13 nt, Homo sapiens
cacagauuaucaa

SEQ ID NO: 1359504 - RNA, 15 nt, Homo sapiens
cacagcgugggaacu

SEQ ID NO: 1359505 - RNA, 15 nt, Homo sapiens
cacagcuacacagau

SEQ ID NO: 1359506 - RNA, 23 nt, Homo sapiens
cacaggauauuuuggggggcaga

SEQ ID NO: 1359507 - RNA, 15 nt, Homo sapiens
cacaguaagucauuu

SEQ ID NO: 1359508 - RNA, 23 nt, Homo sapiens
cacagugugaaucuuggugucua

SEQ ID NO: 1359509 - RNA, 20 nt, Homo sapiens
cacauggcggagaguuuuaa

SEQ ID NO: 1359510 - RNA, 22 nt, Homo sapiens
caccaaaaacaaaaaccaaaug

SEQ ID NO: 1359511 - RNA, 24 nt, Homo sapiens
caccaacccuucauuuaacaagua

SEQ ID NO: 1359512 - RNA, 18 nt, Homo sapiens
caccacgggacaucacag

SEQ ID NO: 1359513 - RNA, 15 nt, Homo sapiens
caccaggugccuuuc

SEQ ID NO: 1359514 - RNA, 16 nt, Homo sapiens
caccaguuccuuucaa

SEQ ID NO: 1359515 - RNA, 19 nt, Homo sapiens
cacccaaggaugucugcca

SEQ ID NO: 1359516 - RNA, 18 nt, Homo sapiens
cacccacucuccugugag

SEQ ID NO: 1359517 - RNA, 19 nt, Homo sapiens
cacccacucuccugugaga

SEQ ID NO: 1359518 - RNA, 19 nt, Homo sapiens
cacccagagggaguagaau

SEQ ID NO: 1359519 - RNA, 12 nt, Homo sapiens
caccgcaguuuu

SEQ ID NO: 1359520 - RNA, 22 nt, Homo sapiens
caccuaauccaggcagauccag

SEQ ID NO: 1359521 - RNA, 18 nt, Homo sapiens
caccuauaaaacagguca

SEQ ID NO: 1359522 - RNA, 14 nt, Homo sapiens
caccucaccaaaac

SEQ ID NO: 1359523 - RNA, 19 nt, Homo sapiens
caccucauucugaacccuu

SEQ ID NO: 1359524 - RNA, 23 nt, Homo sapiens
caccuccaggcuuucccacuucc

SEQ ID NO: 1359525 - RNA, 13 nt, Homo sapiens
caccucugcacaa

SEQ ID NO: 1359526 - RNA, 19 nt, Homo sapiens
caccucugcacaagcugca

SEQ ID NO: 1359527 - RNA, 19 nt, Homo sapiens
caccugggagaaaucuggc

SEQ ID NO: 1359528 - RNA, 16 nt, Homo sapiens
caccuuggcaccagac

SEQ ID NO: 1359529 - RNA, 14 nt, Homo sapiens
cacgcuaccaaauc

SEQ ID NO: 1359530 - RNA, 12 nt, Homo sapiens
cacgcugcagug

SEQ ID NO: 1359531 - RNA, 17 nt, Homo sapiens
cacggcccguggcuguu

SEQ ID NO: 1359532 - RNA, 15 nt, Homo sapiens
cacguccacuuucaa

SEQ ID NO: 1359533 - RNA, 21 nt, Homo sapiens
cacgucugcagaaacagugca

SEQ ID NO: 1359534 - RNA, 18 nt, Homo sapiens
cacgucuggcuucacaga

SEQ ID NO: 1359535 - RNA, 16 nt, Homo sapiens
cacuaaguaaccucua

SEQ ID NO: 1359536 - RNA, 19 nt, Homo sapiens
cacuacaagugauccucag

SEQ ID NO: 1359537 - RNA, 22 nt, Homo sapiens
cacuagcccuccucucccagug

SEQ ID NO: 1359538 - RNA, 19 nt, Homo sapiens
cacucaaggcggugcuuga

SEQ ID NO: 1359539 - RNA, 20 nt, Homo sapiens
cacucgccgguuaagacagg

SEQ ID NO: 1359540 - RNA, 22 nt, Homo sapiens
cacucgccgguuaagacagggu

SEQ ID NO: 1359541 - RNA, 15 nt, Homo sapiens
cacucugugggucug

SEQ ID NO: 1359542 - RNA, 21 nt, Homo sapiens
cacugcaccucuuugucacag

SEQ ID NO: 1359543 - RNA, 13 nt, Homo sapiens
cacugcauaccaa

SEQ ID NO: 1359544 - RNA, 19 nt, Homo sapiens
cacugcauaccaaccuggg

SEQ ID NO: 1359545 - RNA, 18 nt, Homo sapiens
cacugcgggagcucugua

SEQ ID NO: 1359546 - RNA, 22 nt, Homo sapiens
cacugggcuucuagaaccaggc

SEQ ID NO: 1359547 - RNA, 21 nt, Homo sapiens
cacuguccugggccugcagaa

SEQ ID NO: 1359548 - RNA, 13 nt, Homo sapiens
cacugugaccucc

SEQ ID NO: 1359549 - RNA, 20 nt, Homo sapiens
cacuuagaaugauguaauau

SEQ ID NO: 1359550 - RNA, 20 nt, Homo sapiens
cacuugggguuuaaauaucc

SEQ ID NO: 1359551 - RNA, 18 nt, Homo sapiens
cacuuuaccucuguggac

SEQ ID NO: 1359552 - RNA, 17 nt, Homo sapiens
cagaaaaaaaaauggaa

SEQ ID NO: 1359553 - RNA, 17 nt, Homo sapiens
cagaaaaacugugggua

SEQ ID NO: 1359554 - RNA, 18 nt, Homo sapiens
cagaaaacaaaacugcau

SEQ ID NO: 1359555 - RNA, 19 nt, Homo sapiens
cagaaaucuagaagacugu

SEQ ID NO: 1359556 - RNA, 13 nt, Homo sapiens
cagaacacugucu

SEQ ID NO: 1359557 - RNA, 16 nt, Homo sapiens
cagaacacugucuuga

SEQ ID NO: 1359558 - RNA, 20 nt, Homo sapiens
cagaacuaccauuguaauau

SEQ ID NO: 1359559 - RNA, 23 nt, Homo sapiens
cagaagagguugggcuuccaugc

SEQ ID NO: 1359560 - RNA, 13 nt, Homo sapiens
cagagacauacuu

SEQ ID NO: 1359561 - RNA, 15 nt, Homo sapiens
cagagaugaaaaaga

SEQ ID NO: 1359562 - RNA, 16 nt, Homo sapiens
cagagcagaacuuuca

SEQ ID NO: 1359563 - RNA, 17 nt, Homo sapiens
cagagcagaacuuucac

SEQ ID NO: 1359564 - RNA, 22 nt, Homo sapiens
cagaggccuugcuguggagcuc

SEQ ID NO: 1359565 - RNA, 16 nt, Homo sapiens
cagagggugacugugu

SEQ ID NO: 1359566 - RNA, 16 nt, Homo sapiens
cagagguuauguguuc

SEQ ID NO: 1359567 - RNA, 20 nt, Homo sapiens
cagagguugcagugagccga

SEQ ID NO: 1359568 - RNA, 19 nt, Homo sapiens
cagagucaggcuguugcgc

SEQ ID NO: 1359569 - RNA, 19 nt, Homo sapiens
cagauccgcaagaguaaag

SEQ ID NO: 1359570 - RNA, 14 nt, Homo sapiens
cagaugaaugggag

SEQ ID NO: 1359571 - RNA, 19 nt, Homo sapiens
cagaugccccagagcuguu

SEQ ID NO: 1359572 - RNA, 20 nt, Homo sapiens
cagauguccuugaugcucau

SEQ ID NO: 1359573 - RNA, 17 nt, Homo sapiens
cagaugugaaccauuaa

SEQ ID NO: 1359574 - RNA, 18 nt, Homo sapiens
cagauuagcuaggggaca

SEQ ID NO: 1359575 - RNA, 22 nt, Homo sapiens
cagcagaaucggcuuugcagug

SEQ ID NO: 1359576 - RNA, 17 nt, Homo sapiens
cagcagcaaauuuucag

SEQ ID NO: 1359577 - RNA, 18 nt, Homo sapiens
cagcaggaugcucaguga

SEQ ID NO: 1359578 - RNA, 17 nt, Homo sapiens
cagcaucaucugcacug

SEQ ID NO: 1359579 - RNA, 16 nt, Homo sapiens
cagccaacccuuucau

SEQ ID NO: 1359580 - RNA, 12 nt, Homo sapiens
cagccagugacc

SEQ ID NO: 1359581 - RNA, 19 nt, Homo sapiens
cagccagugaggaugacag

SEQ ID NO: 1359582 - RNA, 17 nt, Homo sapiens
cagccaugucugcauuu

SEQ ID NO: 1359583 - RNA, 16 nt, Homo sapiens
cagcccaacugugaga

SEQ ID NO: 1359584 - RNA, 15 nt, Homo sapiens
cagcccacccugcug

SEQ ID NO: 1359585 - RNA, 19 nt, Homo sapiens
cagcccugaggugaaaggg

SEQ ID NO: 1359586 - RNA, 22 nt, Homo sapiens
cagccucugaaaaccaauguuc

SEQ ID NO: 1359587 - RNA, 13 nt, Homo sapiens
cagccugccuuua

SEQ ID NO: 1359588 - RNA, 18 nt, Homo sapiens
cagccugggcaaugugau

SEQ ID NO: 1359589 - RNA, 20 nt, Homo sapiens
cagccugggugacagagcaa

SEQ ID NO: 1359590 - RNA, 14 nt, Homo sapiens
cagccuugccagag

SEQ ID NO: 1359591 - RNA, 16 nt, Homo sapiens
cagccuugccagagau

SEQ ID NO: 1359592 - RNA, 23 nt, Homo sapiens
cagccuugccagagauccaaaag

SEQ ID NO: 1359593 - RNA, 14 nt, Homo sapiens
cagcggggaugcuu

SEQ ID NO: 1359594 - RNA, 13 nt, Homo sapiens
cagcuaaauuuuc

SEQ ID NO: 1359595 - RNA, 22 nt, Homo sapiens
cagcuaacaaguagcacacuga

SEQ ID NO: 1359596 - RNA, 15 nt, Homo sapiens
cagcucaaaggcaca

SEQ ID NO: 1359597 - RNA, 17 nt, Homo sapiens
cagcucuaauacauucc

SEQ ID NO: 1359598 - RNA, 23 nt, Homo sapiens
cagcugaccgggucacacaaagg

SEQ ID NO: 1359599 - RNA, 24 nt, Homo sapiens
cagcugacuuuucuguccgagcuu

SEQ ID NO: 1359600 - RNA, 21 nt, Homo sapiens
cagcugcucccuggcauucaa

SEQ ID NO: 1359601 - RNA, 15 nt, Homo sapiens
cagcuggaucuccau

SEQ ID NO: 1359602 - RNA, 23 nt, Homo sapiens
cagcuuuguuuguugucagcuga

SEQ ID NO: 1359603 - RNA, 14 nt, Homo sapiens
caggaaacaugaaa

SEQ ID NO: 1359604 - RNA, 16 nt, Homo sapiens
caggaacccuucucca

SEQ ID NO: 1359605 - RNA, 21 nt, Homo sapiens
caggaagggcaggaaggagag

SEQ ID NO: 1359606 - RNA, 15 nt, Homo sapiens
caggaauauuuucca

SEQ ID NO: 1359607 - RNA, 13 nt, Homo sapiens
caggacaagagaa

SEQ ID NO: 1359608 - RNA, 19 nt, Homo sapiens
caggacagguggugcaaau

SEQ ID NO: 1359609 - RNA, 19 nt, Homo sapiens
caggacuauauuugggccu

SEQ ID NO: 1359610 - RNA, 12 nt, Homo sapiens
caggacucugaa

SEQ ID NO: 1359611 - RNA, 11 nt, Homo sapiens
caggagcucuu

SEQ ID NO: 1359612 - RNA, 17 nt, Homo sapiens
caggagcuuaaacagcu

SEQ ID NO: 1359613 - RNA, 23 nt, Homo sapiens
caggaguuggaagugugugaucu

SEQ ID NO: 1359614 - RNA, 17 nt, Homo sapiens
caggaguuugaauccau

SEQ ID NO: 1359615 - RNA, 17 nt, Homo sapiens
caggaugcagcacugcg

SEQ ID NO: 1359616 - RNA, 15 nt, Homo sapiens
caggaugcucaguga

SEQ ID NO: 1359617 - RNA, 12 nt, Homo sapiens
caggcaccugcc

SEQ ID NO: 1359618 - RNA, 16 nt, Homo sapiens
caggcagaucugugcc

SEQ ID NO: 1359619 - RNA, 20 nt, Homo sapiens
caggcagaucugugccccau

SEQ ID NO: 1359620 - RNA, 17 nt, Homo sapiens
caggccgcagcuccauu

SEQ ID NO: 1359621 - RNA, 17 nt, Homo sapiens
caggccgggcagugucc

SEQ ID NO: 1359622 - RNA, 15 nt, Homo sapiens
caggcucacagagau

SEQ ID NO: 1359623 - RNA, 18 nt, Homo sapiens
caggcuggagugcaguga

SEQ ID NO: 1359624 - RNA, 12 nt, Homo sapiens
caggcuugaauc

SEQ ID NO: 1359625 - RNA, 14 nt, Homo sapiens
cagggaauggagcu

SEQ ID NO: 1359626 - RNA, 21 nt, Homo sapiens
cagggagacgguuuccaggga

SEQ ID NO: 1359627 - RNA, 18 nt, Homo sapiens
cagggauuaaccucugca

SEQ ID NO: 1359628 - RNA, 18 nt, Homo sapiens
cagggccaggugcuuuag

SEQ ID NO: 1359629 - RNA, 19 nt, Homo sapiens
cagggcccagagcccagcu

SEQ ID NO: 1359630 - RNA, 13 nt, Homo sapiens
cagggcuagugac

SEQ ID NO: 1359631 - RNA, 15 nt, Homo sapiens
cagggcuguguguac

SEQ ID NO: 1359632 - RNA, 14 nt, Homo sapiens
caggggacaaggga

SEQ ID NO: 1359633 - RNA, 12 nt, Homo sapiens
cagggugggccu

SEQ ID NO: 1359634 - RNA, 14 nt, Homo sapiens
cagggugucccagg

SEQ ID NO: 1359635 - RNA, 20 nt, Homo sapiens
caggguucuaaccuuucuaa

SEQ ID NO: 1359636 - RNA, 13 nt, Homo sapiens
cagguacuuguaa

SEQ ID NO: 1359637 - RNA, 16 nt, Homo sapiens
cagguagacuuuugua

SEQ ID NO: 1359638 - RNA, 17 nt, Homo sapiens
caggucaauacaguaca

SEQ ID NO: 1359639 - RNA, 16 nt, Homo sapiens
caggugagagcccuuu

SEQ ID NO: 1359640 - RNA, 11 nt, Homo sapiens
caggugcagag

SEQ ID NO: 1359641 - RNA, 17 nt, Homo sapiens
cagguuaccacucuggc

SEQ ID NO: 1359642 - RNA, 14 nt, Homo sapiens
caguagaugccacc

SEQ ID NO: 1359643 - RNA, 12 nt, Homo sapiens
caguaugcuugg

SEQ ID NO: 1359644 - RNA, 17 nt, Homo sapiens
caguauugacacugacu

SEQ ID NO: 1359645 - RNA, 13 nt, Homo sapiens
cagucacaacaga

SEQ ID NO: 1359646 - RNA, 17 nt, Homo sapiens
cagucccccaacuaccc

SEQ ID NO: 1359647 - RNA, 23 nt, Homo sapiens
cagucuaaaaaaggaauccucug

SEQ ID NO: 1359648 - RNA, 15 nt, Homo sapiens
cagucuggagaaggu

SEQ ID NO: 1359649 - RNA, 10 nt, Homo sapiens
cagugacacc

SEQ ID NO: 1359650 - RNA, 19 nt, Homo sapiens
cagugagcuuggaaaggac

SEQ ID NO: 1359651 - RNA, 20 nt, Homo sapiens
cagugaugcuggaugcuccu

SEQ ID NO: 1359652 - RNA, 19 nt, Homo sapiens
cagugauguauacaucuua

SEQ ID NO: 1359653 - RNA, 15 nt, Homo sapiens
cagugcgcuguagua

SEQ ID NO: 1359654 - RNA, 17 nt, Homo sapiens
cagugcucuuuguagcu

SEQ ID NO: 1359655 - RNA, 20 nt, Homo sapiens
caguggacagugcuguugaa

SEQ ID NO: 1359656 - RNA, 19 nt, Homo sapiens
cagugucuguguacaugua

SEQ ID NO: 1359657 - RNA, 17 nt, Homo sapiens
cagugucuuuccaccuu

SEQ ID NO: 1359658 - RNA, 19 nt, Homo sapiens
caguguguuucugaucuga

SEQ ID NO: 1359659 - RNA, 15 nt, Homo sapiens
caguuacauaauuca

SEQ ID NO: 1359660 - RNA, 14 nt, Homo sapiens
caguuagcucucaa

SEQ ID NO: 1359661 - RNA, 14 nt, Homo sapiens
caguucucccaucc

SEQ ID NO: 1359662 - RNA, 19 nt, Homo sapiens
caguucugucauauguuaa

SEQ ID NO: 1359663 - RNA, 21 nt, Homo sapiens
caguugagcugacauauacug

SEQ ID NO: 1359664 - RNA, 12 nt, Homo sapiens
caguugugauac

SEQ ID NO: 1359665 - RNA, 18 nt, Homo sapiens
cauaaaauagagugcauu

SEQ ID NO: 1359666 - RNA, 18 nt, Homo sapiens
cauaagugcaugacauau

SEQ ID NO: 1359667 - RNA, 18 nt, Homo sapiens
cauaauuucuucacucaa

SEQ ID NO: 1359668 - RNA, 23 nt, Homo sapiens
cauaauuucuucacucaaucucu

SEQ ID NO: 1359669 - RNA, 12 nt, Homo sapiens
cauacagaauua

SEQ ID NO: 1359670 - RNA, 13 nt, Homo sapiens
cauaccauugaaa

SEQ ID NO: 1359671 - RNA, 15 nt, Homo sapiens
cauagacuccuuugc

SEQ ID NO: 1359672 - RNA, 15 nt, Homo sapiens
cauagcagugcuuga

SEQ ID NO: 1359673 - RNA, 18 nt, Homo sapiens
cauagcuugauaaagggc

SEQ ID NO: 1359674 - RNA, 13 nt, Homo sapiens
cauauauauuaca

SEQ ID NO: 1359675 - RNA, 20 nt, Homo sapiens
cauauccaacaugugcucag

SEQ ID NO: 1359676 - RNA, 11 nt, Homo sapiens
cauauguuaau

SEQ ID NO: 1359677 - RNA, 15 nt, Homo sapiens
cauauucuaaaacca

SEQ ID NO: 1359678 - RNA, 12 nt, Homo sapiens
caucaagacaga

SEQ ID NO: 1359679 - RNA, 15 nt, Homo sapiens
caucagacagaugga

SEQ ID NO: 1359680 - RNA, 14 nt, Homo sapiens
caucagcuccagcu

SEQ ID NO: 1359681 - RNA, 18 nt, Homo sapiens
caucagcuguucucauug

SEQ ID NO: 1359682 - RNA, 15 nt, Homo sapiens
caucauuaaugugaa

SEQ ID NO: 1359683 - RNA, 16 nt, Homo sapiens
cauccaagcaaacuga

SEQ ID NO: 1359684 - RNA, 17 nt, Homo sapiens
cauccaaugcucaagaa

SEQ ID NO: 1359685 - RNA, 13 nt, Homo sapiens
cauccacuuuaug

SEQ ID NO: 1359686 - RNA, 12 nt, Homo sapiens
cauccauucuuc

SEQ ID NO: 1359687 - RNA, 14 nt, Homo sapiens
caucccuagucucu

SEQ ID NO: 1359688 - RNA, 19 nt, Homo sapiens
caucccuagucucuaccca

SEQ ID NO: 1359689 - RNA, 20 nt, Homo sapiens
cauccgcaaauuuucuucca

SEQ ID NO: 1359690 - RNA, 13 nt, Homo sapiens
cauccuagugaga

SEQ ID NO: 1359691 - RNA, 14 nt, Homo sapiens
cauccuagugagaa

SEQ ID NO: 1359692 - RNA, 20 nt, Homo sapiens
cauccuaugcuuaauaaaag

SEQ ID NO: 1359693 - RNA, 20 nt, Homo sapiens
cauccugggcagcauacuga

SEQ ID NO: 1359694 - RNA, 22 nt, Homo sapiens
caucguacacacucagugacau

SEQ ID NO: 1359695 - RNA, 14 nt, Homo sapiens
caucucucuuuaau

SEQ ID NO: 1359696 - RNA, 14 nt, Homo sapiens
caucugaccagcag

SEQ ID NO: 1359697 - RNA, 14 nt, Homo sapiens
caucuuccaacuca

SEQ ID NO: 1359698 - RNA, 23 nt, Homo sapiens
caugaaaaauaauccaaauccau

SEQ ID NO: 1359699 - RNA, 15 nt, Homo sapiens
caugagacucagugc

SEQ ID NO: 1359700 - RNA, 17 nt, Homo sapiens
caugagacucagugcag

SEQ ID NO: 1359701 - RNA, 18 nt, Homo sapiens
caugccacuugaagauuu

SEQ ID NO: 1359702 - RNA, 17 nt, Homo sapiens
caugcguuuaaucacau

SEQ ID NO: 1359703 - RNA, 17 nt, Homo sapiens
caugcuggaguacccag

SEQ ID NO: 1359704 - RNA, 17 nt, Homo sapiens
cauggagaccgugacca

SEQ ID NO: 1359705 - RNA, 15 nt, Homo sapiens
cauggagccugcuga

SEQ ID NO: 1359706 - RNA, 18 nt, Homo sapiens
cauggcgaaaggagugac

SEQ ID NO: 1359707 - RNA, 15 nt, Homo sapiens
cauggcgacacuaaa

SEQ ID NO: 1359708 - RNA, 19 nt, Homo sapiens
cauggcugccucugaagag

SEQ ID NO: 1359709 - RNA, 20 nt, Homo sapiens
cauggcuguuggugggaccc

SEQ ID NO: 1359710 - RNA, 20 nt, Homo sapiens
caugggaaggggaggacccc

SEQ ID NO: 1359711 - RNA, 22 nt, Homo sapiens
cauggugccccaggaccagcuc

SEQ ID NO: 1359712 - RNA, 21 nt, Homo sapiens
caugguguguguguccagagg

SEQ ID NO: 1359713 - RNA, 22 nt, Homo sapiens
caugguuauugaugaguuucuu

SEQ ID NO: 1359714 - RNA, 16 nt, Homo sapiens
cauguacauagcuuga

SEQ ID NO: 1359715 - RNA, 12 nt, Homo sapiens
caugugcugcag

SEQ ID NO: 1359716 - RNA, 20 nt, Homo sapiens
cauguuuguuucuguagaaa

SEQ ID NO: 1359717 - RNA, 13 nt, Homo sapiens
cauuaaugcaaug

SEQ ID NO: 1359718 - RNA, 12 nt, Homo sapiens
cauuacugcaua

SEQ ID NO: 1359719 - RNA, 17 nt, Homo sapiens
cauuacugcauaaaaua

SEQ ID NO: 1359720 - RNA, 20 nt, Homo sapiens
cauuagccuaugugcaugca

SEQ ID NO: 1359721 - RNA, 12 nt, Homo sapiens
cauuaucuauga

SEQ ID NO: 1359722 - RNA, 19 nt, Homo sapiens
cauuccugaagaaccaguc

SEQ ID NO: 1359723 - RNA, 18 nt, Homo sapiens
cauucuuaacaaacucuu

SEQ ID NO: 1359724 - RNA, 17 nt, Homo sapiens
cauucuucccuugaugg

SEQ ID NO: 1359725 - RNA, 14 nt, Homo sapiens
cauugaaacaugcc

SEQ ID NO: 1359726 - RNA, 19 nt, Homo sapiens
cauugacucuguggcuuug

SEQ ID NO: 1359727 - RNA, 13 nt, Homo sapiens
cauugagcugccu

SEQ ID NO: 1359728 - RNA, 19 nt, Homo sapiens
cauugaugaucacugugaa

SEQ ID NO: 1359729 - RNA, 18 nt, Homo sapiens
cauuuaaaaaaaaucccu

SEQ ID NO: 1359730 - RNA, 19 nt, Homo sapiens
cauuuaaaacauugcaaau

SEQ ID NO: 1359731 - RNA, 23 nt, Homo sapiens
cauuucucuaacuccugccauuc

SEQ ID NO: 1359732 - RNA, 17 nt, Homo sapiens
cauuugcuuccucccaa

SEQ ID NO: 1359733 - RNA, 16 nt, Homo sapiens
cauuuguuaaaauaca

SEQ ID NO: 1359734 - RNA, 21 nt, Homo sapiens
cauuuuaggcaaauguuuaaa

SEQ ID NO: 1359735 - RNA, 21 nt, Homo sapiens
cauuuuauuuuuucuugcaaa

SEQ ID NO: 1359736 - RNA, 13 nt, Homo sapiens
ccaaaagaagccc

SEQ ID NO: 1359737 - RNA, 12 nt, Homo sapiens
ccaaaaucucaa

SEQ ID NO: 1359738 - RNA, 12 nt, Homo sapiens
ccaaaguguccu

SEQ ID NO: 1359739 - RNA, 18 nt, Homo sapiens
ccaaagugucuuuugaca

SEQ ID NO: 1359740 - RNA, 19 nt, Homo sapiens
ccaaaucaaaagacuuuuu

SEQ ID NO: 1359741 - RNA, 18 nt, Homo sapiens
ccaacacuuccagcauuu

SEQ ID NO: 1359742 - RNA, 18 nt, Homo sapiens
ccaacaugugcucaggga

SEQ ID NO: 1359743 - RNA, 14 nt, Homo sapiens
ccaacucauccacg

SEQ ID NO: 1359744 - RNA, 19 nt, Homo sapiens
ccaagaaagcucacuguag

SEQ ID NO: 1359745 - RNA, 23 nt, Homo sapiens
ccaaggagggcagaucacuucag

SEQ ID NO: 1359746 - RNA, 15 nt, Homo sapiens
ccaaggggaaucaga

SEQ ID NO: 1359747 - RNA, 20 nt, Homo sapiens
ccaaggggaaucagaacuca

SEQ ID NO: 1359748 - RNA, 18 nt, Homo sapiens
ccaaguugaagacuuugu

SEQ ID NO: 1359749 - RNA, 15 nt, Homo sapiens
ccaauuucagacucc

SEQ ID NO: 1359750 - RNA, 16 nt, Homo sapiens
ccacaaccgaccagau

SEQ ID NO: 1359751 - RNA, 22 nt, Homo sapiens
ccacaaucuggcuuagugccac

SEQ ID NO: 1359752 - RNA, 11 nt, Homo sapiens
ccacaccucag

SEQ ID NO: 1359753 - RNA, 23 nt, Homo sapiens
ccacacuugggguuuaaauaucc

SEQ ID NO: 1359754 - RNA, 10 nt, Homo sapiens
ccacagauua

SEQ ID NO: 1359755 - RNA, 18 nt, Homo sapiens
ccaccaagggaucugcca

SEQ ID NO: 1359756 - RNA, 13 nt, Homo sapiens
ccaccacugcagc

SEQ ID NO: 1359757 - RNA, 20 nt, Homo sapiens
ccacccugagauugggcaug

SEQ ID NO: 1359758 - RNA, 13 nt, Homo sapiens
ccaccgcacucca

SEQ ID NO: 1359759 - RNA, 14 nt, Homo sapiens
ccaccucaccaaaa

SEQ ID NO: 1359760 - RNA, 21 nt, Homo sapiens
ccaccucccugccuccaggaa

SEQ ID NO: 1359761 - RNA, 15 nt, Homo sapiens
ccaccugcccaucac

SEQ ID NO: 1359762 - RNA, 19 nt, Homo sapiens
ccaccuuugccacaaagcu

SEQ ID NO: 1359763 - RNA, 19 nt, Homo sapiens
ccacgaacuugcugggugg

SEQ ID NO: 1359764 - RNA, 19 nt, Homo sapiens
ccacgcccccagcugugac

SEQ ID NO: 1359765 - RNA, 17 nt, Homo sapiens
ccacggugccuccagau

SEQ ID NO: 1359766 - RNA, 20 nt, Homo sapiens
ccacguugccucuacuuuau

SEQ ID NO: 1359767 - RNA, 22 nt, Homo sapiens
ccacugccuucgcuucuugccu

SEQ ID NO: 1359768 - RNA, 13 nt, Homo sapiens
ccacuggucugua

SEQ ID NO: 1359769 - RNA, 19 nt, Homo sapiens
ccacugugaagagaaccau

SEQ ID NO: 1359770 - RNA, 18 nt, Homo sapiens
ccacuuucaacguguagu

SEQ ID NO: 1359771 - RNA, 15 nt, Homo sapiens
ccagaacacacucca

SEQ ID NO: 1359772 - RNA, 17 nt, Homo sapiens
ccagaagcugagcacca

SEQ ID NO: 1359773 - RNA, 15 nt, Homo sapiens
ccagacucagacauu

SEQ ID NO: 1359774 - RNA, 14 nt, Homo sapiens
ccagagcccagcuc

SEQ ID NO: 1359775 - RNA, 17 nt, Homo sapiens
ccagagcccagcuccaa

SEQ ID NO: 1359776 - RNA, 12 nt, Homo sapiens
ccagagguugug

SEQ ID NO: 1359777 - RNA, 17 nt, Homo sapiens
ccagagguugugcacug

SEQ ID NO: 1359778 - RNA, 12 nt, Homo sapiens
ccagauccagcc

SEQ ID NO: 1359779 - RNA, 19 nt, Homo sapiens
ccagcaaaacauaaacuga

SEQ ID NO: 1359780 - RNA, 10 nt, Homo sapiens
ccagcacuuu

SEQ ID NO: 1359781 - RNA, 15 nt, Homo sapiens
ccagcagcgccuuuc

SEQ ID NO: 1359782 - RNA, 22 nt, Homo sapiens
ccagccaccccgggcucucugc

SEQ ID NO: 1359783 - RNA, 17 nt, Homo sapiens
ccagccaugucugcauu

SEQ ID NO: 1359784 - RNA, 20 nt, Homo sapiens
ccagccugggcagccaggcu

SEQ ID NO: 1359785 - RNA, 20 nt, Homo sapiens
ccagccugggugacagagca

SEQ ID NO: 1359786 - RNA, 13 nt, Homo sapiens
ccagcucacagga

SEQ ID NO: 1359787 - RNA, 18 nt, Homo sapiens
ccagcugcucugucuucu

SEQ ID NO: 1359788 - RNA, 12 nt, Homo sapiens
ccagcuuucuaa

SEQ ID NO: 1359789 - RNA, 22 nt, Homo sapiens
ccaggacccugaaggggccaug

SEQ ID NO: 1359790 - RNA, 13 nt, Homo sapiens
ccaggagcucuuc

SEQ ID NO: 1359791 - RNA, 17 nt, Homo sapiens
ccagggagaagcuccuc

SEQ ID NO: 1359792 - RNA, 16 nt, Homo sapiens
ccaggggcggugcagg

SEQ ID NO: 1359793 - RNA, 13 nt, Homo sapiens
ccagguagacuuu

SEQ ID NO: 1359794 - RNA, 12 nt, Homo sapiens
ccagguggcaaa

SEQ ID NO: 1359795 - RNA, 21 nt, Homo sapiens
ccaguaggguuugacauuuca

SEQ ID NO: 1359796 - RNA, 11 nt, Homo sapiens
ccagugcucca

SEQ ID NO: 1359797 - RNA, 15 nt, Homo sapiens
ccaguucuacagagu

SEQ ID NO: 1359798 - RNA, 19 nt, Homo sapiens
ccaguugugauacaauaaa

SEQ ID NO: 1359799 - RNA, 16 nt, Homo sapiens
ccauagugaccaacau

SEQ ID NO: 1359800 - RNA, 12 nt, Homo sapiens
ccaucaccagac

SEQ ID NO: 1359801 - RNA, 22 nt, Homo sapiens
ccaucauugaugaucacuguga

SEQ ID NO: 1359802 - RNA, 13 nt, Homo sapiens
ccaucccaaaaau

SEQ ID NO: 1359803 - RNA, 17 nt, Homo sapiens
ccaucgcaggaugacag

SEQ ID NO: 1359804 - RNA, 23 nt, Homo sapiens
ccaugaaaaugcaacaacaugua

SEQ ID NO: 1359805 - RNA, 17 nt, Homo sapiens
ccauggacccaauauuu

SEQ ID NO: 1359806 - RNA, 11 nt, Homo sapiens
ccauggcuguu

SEQ ID NO: 1359807 - RNA, 15 nt, Homo sapiens
ccaugggaccacaac

SEQ ID NO: 1359808 - RNA, 13 nt, Homo sapiens
ccauguuucacaa

SEQ ID NO: 1359809 - RNA, 23 nt, Homo sapiens
ccauguuucacaaggucuuuaaa

SEQ ID NO: 1359810 - RNA, 12 nt, Homo sapiens
ccauuguaauau

SEQ ID NO: 1359811 - RNA, 15 nt, Homo sapiens
ccauuucauugcuca

SEQ ID NO: 1359812 - RNA, 14 nt, Homo sapiens
ccauuucucaggga

SEQ ID NO: 1359813 - RNA, 20 nt, Homo sapiens
cccaaauccuuagaucuggc

SEQ ID NO: 1359814 - RNA, 13 nt, Homo sapiens
cccaacugugaga

SEQ ID NO: 1359815 - RNA, 16 nt, Homo sapiens
cccaagucuccagaga

SEQ ID NO: 1359816 - RNA, 23 nt, Homo sapiens
cccacaaucuggcuuagugccac

SEQ ID NO: 1359817 - RNA, 19 nt, Homo sapiens
cccaccugucaaacaaagc

SEQ ID NO: 1359818 - RNA, 13 nt, Homo sapiens
cccacuucccacc

SEQ ID NO: 1359819 - RNA, 14 nt, Homo sapiens
cccagagaagccaa

SEQ ID NO: 1359820 - RNA, 22 nt, Homo sapiens
cccagagacauacuugaagggc

SEQ ID NO: 1359821 - RNA, 17 nt, Homo sapiens
cccagagggaguagaau

SEQ ID NO: 1359822 - RNA, 16 nt, Homo sapiens
cccagagucaucugau

SEQ ID NO: 1359823 - RNA, 18 nt, Homo sapiens
cccagauucaugcacugu

SEQ ID NO: 1359824 - RNA, 15 nt, Homo sapiens
cccagcccagagaca

SEQ ID NO: 1359825 - RNA, 15 nt, Homo sapiens
cccagccucccugaa

SEQ ID NO: 1359826 - RNA, 18 nt, Homo sapiens
cccagcgacgaacuuucc

SEQ ID NO: 1359827 - RNA, 20 nt, Homo sapiens
cccagcugcucuguacugca

SEQ ID NO: 1359828 - RNA, 13 nt, Homo sapiens
cccaggaccagcu

SEQ ID NO: 1359829 - RNA, 14 nt, Homo sapiens
cccaggaccagcuc

SEQ ID NO: 1359830 - RNA, 16 nt, Homo sapiens
cccaggaguauccucu

SEQ ID NO: 1359831 - RNA, 12 nt, Homo sapiens
cccaggcagcug

SEQ ID NO: 1359832 - RNA, 13 nt, Homo sapiens
cccaggugcauuu

SEQ ID NO: 1359833 - RNA, 20 nt, Homo sapiens
cccaguaagggcguggcucu

SEQ ID NO: 1359834 - RNA, 23 nt, Homo sapiens
cccaguagaugccacuagcccuc

SEQ ID NO: 1359835 - RNA, 23 nt, Homo sapiens
cccaguaggguuugacauuucau

SEQ ID NO: 1359836 - RNA, 21 nt, Homo sapiens
cccaguguguuucugaucuga

SEQ ID NO: 1359837 - RNA, 16 nt, Homo sapiens
cccaucagcuccagcu

SEQ ID NO: 1359838 - RNA, 15 nt, Homo sapiens
cccaucgcuggaaaa

SEQ ID NO: 1359839 - RNA, 15 nt, Homo sapiens
cccaucucuacugaa

SEQ ID NO: 1359840 - RNA, 16 nt, Homo sapiens
cccauguguggcagca

SEQ ID NO: 1359841 - RNA, 18 nt, Homo sapiens
ccccaaaggaaacuacuc

SEQ ID NO: 1359842 - RNA, 13 nt, Homo sapiens
ccccaacacuucc

SEQ ID NO: 1359843 - RNA, 16 nt, Homo sapiens
ccccaccaccacuuac

SEQ ID NO: 1359844 - RNA, 22 nt, Homo sapiens
ccccacguugccucuacuuuau

SEQ ID NO: 1359845 - RNA, 21 nt, Homo sapiens
ccccagcaaaguuaacuacac

SEQ ID NO: 1359846 - RNA, 14 nt, Homo sapiens
ccccagcccagaga

SEQ ID NO: 1359847 - RNA, 19 nt, Homo sapiens
ccccaggggacaagggauu

SEQ ID NO: 1359848 - RNA, 17 nt, Homo sapiens
ccccaggggucccagcc

SEQ ID NO: 1359849 - RNA, 13 nt, Homo sapiens
ccccaugcacugu

SEQ ID NO: 1359850 - RNA, 23 nt, Homo sapiens
cccccaucuccuuaaagagugug

SEQ ID NO: 1359851 - RNA, 23 nt, Homo sapiens
cccccgugaggaugucacucaga

SEQ ID NO: 1359852 - RNA, 14 nt, Homo sapiens
cccccugggcugag

SEQ ID NO: 1359853 - RNA, 18 nt, Homo sapiens
ccccucaacaccucugca

SEQ ID NO: 1359854 - RNA, 17 nt, Homo sapiens
ccccucagagacugaaa

SEQ ID NO: 1359855 - RNA, 16 nt, Homo sapiens
ccccuuuccaaaaacu

SEQ ID NO: 1359856 - RNA, 20 nt, Homo sapiens
cccuaggaaacucacacucc

SEQ ID NO: 1359857 - RNA, 21 nt, Homo sapiens
cccuauugcugcuugaggcaa

SEQ ID NO: 1359858 - RNA, 18 nt, Homo sapiens
cccucaacaccucugcac

SEQ ID NO: 1359859 - RNA, 21 nt, Homo sapiens
cccucagccucugccacugug

SEQ ID NO: 1359860 - RNA, 18 nt, Homo sapiens
cccuccguggcaucaccu

SEQ ID NO: 1359861 - RNA, 17 nt, Homo sapiens
cccuccucucccaguga

SEQ ID NO: 1359862 - RNA, 22 nt, Homo sapiens
cccucuggaguggccacuaagc

SEQ ID NO: 1359863 - RNA, 14 nt, Homo sapiens
cccucuucauggau

SEQ ID NO: 1359864 - RNA, 18 nt, Homo sapiens
cccugagcuuucugcuau

SEQ ID NO: 1359865 - RNA, 22 nt, Homo sapiens
cccuggauuccucgaaacugcc

SEQ ID NO: 1359866 - RNA, 22 nt, Homo sapiens
cccuggcucugaccgaaacagc

SEQ ID NO: 1359867 - RNA, 13 nt, Homo sapiens
cccuucacaaagc

SEQ ID NO: 1359868 - RNA, 17 nt, Homo sapiens
cccuugguucucauaac

SEQ ID NO: 1359869 - RNA, 15 nt, Homo sapiens
ccggcccugugugca

SEQ ID NO: 1359870 - RNA, 15 nt, Homo sapiens
ccggcgugugcagug

SEQ ID NO: 1359871 - RNA, 14 nt, Homo sapiens
ccgggcaguguccc

SEQ ID NO: 1359872 - RNA, 23 nt, Homo sapiens
ccgguuaaauuccauaugcucca

SEQ ID NO: 1359873 - RNA, 19 nt, Homo sapiens
ccgugaggaugucacucag

SEQ ID NO: 1359874 - RNA, 14 nt, Homo sapiens
ccgugcguggcacu

SEQ ID NO: 1359875 - RNA, 14 nt, Homo sapiens
ccuaaaaacacaga

SEQ ID NO: 1359876 - RNA, 19 nt, Homo sapiens
ccuaaaaaguaucauuaca

SEQ ID NO: 1359877 - RNA, 15 nt, Homo sapiens
ccuaaagacuguaua

SEQ ID NO: 1359878 - RNA, 22 nt, Homo sapiens
ccuaaaucaaguuggcuucuaa

SEQ ID NO: 1359879 - RNA, 20 nt, Homo sapiens
ccuaauccaggcagauccag

SEQ ID NO: 1359880 - RNA, 22 nt, Homo sapiens
ccuaaucuauggucgggagaca

SEQ ID NO: 1359881 - RNA, 20 nt, Homo sapiens
ccuaaugcucaccuuuauca

SEQ ID NO: 1359882 - RNA, 23 nt, Homo sapiens
ccuacaguugaaaaacagcugag

SEQ ID NO: 1359883 - RNA, 21 nt, Homo sapiens
ccuaccaagauauaccugaua

SEQ ID NO: 1359884 - RNA, 16 nt, Homo sapiens
ccuaccuaccaagaua

SEQ ID NO: 1359885 - RNA, 22 nt, Homo sapiens
ccuacgguggucggugggaccc

SEQ ID NO: 1359886 - RNA, 15 nt, Homo sapiens
ccuacugcugugagc

SEQ ID NO: 1359887 - RNA, 17 nt, Homo sapiens
ccuauaaaacaggucaa

SEQ ID NO: 1359888 - RNA, 14 nt, Homo sapiens
ccuauuucuuaaac

SEQ ID NO: 1359889 - RNA, 23 nt, Homo sapiens
ccucagauuuucuggacuuaguc

SEQ ID NO: 1359890 - RNA, 19 nt, Homo sapiens
ccucagccuggccagacac

SEQ ID NO: 1359891 - RNA, 19 nt, Homo sapiens
ccucagccuugccagagau

SEQ ID NO: 1359892 - RNA, 18 nt, Homo sapiens
ccucaucucucugcccaa

SEQ ID NO: 1359893 - RNA, 19 nt, Homo sapiens
ccucauuagcauuuugcua

SEQ ID NO: 1359894 - RNA, 20 nt, Homo sapiens
ccucauuagcauuuugcuaa

SEQ ID NO: 1359895 - RNA, 15 nt, Homo sapiens
ccucauucuacugaa

SEQ ID NO: 1359896 - RNA, 12 nt, Homo sapiens
ccuccaccaaac

SEQ ID NO: 1359897 - RNA, 21 nt, Homo sapiens
ccucccauaauugcuuugcca

SEQ ID NO: 1359898 - RNA, 16 nt, Homo sapiens
ccucccccccaugcac

SEQ ID NO: 1359899 - RNA, 19 nt, Homo sapiens
ccucccuaccuaccaagau

SEQ ID NO: 1359900 - RNA, 20 nt, Homo sapiens
ccucccuguuccccagagaa

SEQ ID NO: 1359901 - RNA, 13 nt, Homo sapiens
ccuccucaccucu

SEQ ID NO: 1359902 - RNA, 17 nt, Homo sapiens
ccuccuccccuagggaa

SEQ ID NO: 1359903 - RNA, 13 nt, Homo sapiens
ccucucaugacuu

SEQ ID NO: 1359904 - RNA, 15 nt, Homo sapiens
ccucucccugccaag

SEQ ID NO: 1359905 - RNA, 12 nt, Homo sapiens
ccucugacugua

SEQ ID NO: 1359906 - RNA, 16 nt, Homo sapiens
ccucugaggggcacuc

SEQ ID NO: 1359907 - RNA, 21 nt, Homo sapiens
ccucuguauacaaaacccuuu

SEQ ID NO: 1359908 - RNA, 11 nt, Homo sapiens
ccucuguggac

SEQ ID NO: 1359909 - RNA, 17 nt, Homo sapiens
ccucuuagaaaaaccac

SEQ ID NO: 1359910 - RNA, 16 nt, Homo sapiens
ccucuugccaaaucaa

SEQ ID NO: 1359911 - RNA, 20 nt, Homo sapiens
ccucuuuuucuagucuucau

SEQ ID NO: 1359912 - RNA, 16 nt, Homo sapiens
ccugaaauuaacucag

SEQ ID NO: 1359913 - RNA, 13 nt, Homo sapiens
ccugaacaucagc

SEQ ID NO: 1359914 - RNA, 21 nt, Homo sapiens
ccugaaguaagcaaagacuuu

SEQ ID NO: 1359915 - RNA, 21 nt, Homo sapiens
ccugaggugaaagggagcuau

SEQ ID NO: 1359916 - RNA, 19 nt, Homo sapiens
ccugcagucaucuugacca

SEQ ID NO: 1359917 - RNA, 19 nt, Homo sapiens
ccugccuguggcgccgucu

SEQ ID NO: 1359918 - RNA, 14 nt, Homo sapiens
ccugcugagcugcc

SEQ ID NO: 1359919 - RNA, 13 nt, Homo sapiens
ccuggacuuuccu

SEQ ID NO: 1359920 - RNA, 14 nt, Homo sapiens
ccuggcaucaguuu

SEQ ID NO: 1359921 - RNA, 14 nt, Homo sapiens
ccuggccaggagcu

SEQ ID NO: 1359922 - RNA, 17 nt, Homo sapiens
ccuggccaggagcucuu

SEQ ID NO: 1359923 - RNA, 15 nt, Homo sapiens
ccuggccuaggcagu

SEQ ID NO: 1359924 - RNA, 16 nt, Homo sapiens
ccuggggacauuggga

SEQ ID NO: 1359925 - RNA, 17 nt, Homo sapiens
ccuggguaacuagggaa

SEQ ID NO: 1359926 - RNA, 12 nt, Homo sapiens
ccugggugacaa

SEQ ID NO: 1359927 - RNA, 21 nt, Homo sapiens
ccugucaaacaaagccagaag

SEQ ID NO: 1359928 - RNA, 15 nt, Homo sapiens
ccuguccagcuccaa

SEQ ID NO: 1359929 - RNA, 13 nt, Homo sapiens
ccugugaaugcca

SEQ ID NO: 1359930 - RNA, 13 nt, Homo sapiens
ccugugacuggca

SEQ ID NO: 1359931 - RNA, 18 nt, Homo sapiens
ccugugacuggcagcauu

SEQ ID NO: 1359932 - RNA, 21 nt, Homo sapiens
ccugugugauugacagcuuug

SEQ ID NO: 1359933 - RNA, 23 nt, Homo sapiens
ccuguuccccagagaaaggggag

SEQ ID NO: 1359934 - RNA, 18 nt, Homo sapiens
ccuguugagcaucacaga

SEQ ID NO: 1359935 - RNA, 16 nt, Homo sapiens
ccuucaagugccaaac

SEQ ID NO: 1359936 - RNA, 18 nt, Homo sapiens
ccuucccucucaugacuu

SEQ ID NO: 1359937 - RNA, 21 nt, Homo sapiens
ccuuccugcugcgcaguucuc

SEQ ID NO: 1359938 - RNA, 17 nt, Homo sapiens
ccuucugugcugugagu

SEQ ID NO: 1359939 - RNA, 14 nt, Homo sapiens
ccuugaugcucaua

SEQ ID NO: 1359940 - RNA, 20 nt, Homo sapiens
ccuugcauccaucugggcua

SEQ ID NO: 1359941 - RNA, 15 nt, Homo sapiens
ccuuggcuuguuauu

SEQ ID NO: 1359942 - RNA, 17 nt, Homo sapiens
ccuugguaaaaacugca

SEQ ID NO: 1359943 - RNA, 13 nt, Homo sapiens
ccuugguucucau

SEQ ID NO: 1359944 - RNA, 16 nt, Homo sapiens
ccuuguaaagacugua

SEQ ID NO: 1359945 - RNA, 21 nt, Homo sapiens
ccuuuaccuuuuaugcaaaag

SEQ ID NO: 1359946 - RNA, 18 nt, Homo sapiens
ccuuuaucaccucauucu

SEQ ID NO: 1359947 - RNA, 21 nt, Homo sapiens
ccuuuaucaccucauucugaa

SEQ ID NO: 1359948 - RNA, 13 nt, Homo sapiens
ccuuuccaaaaac

SEQ ID NO: 1359949 - RNA, 16 nt, Homo sapiens
ccuuuccaaaaacugu

SEQ ID NO: 1359950 - RNA, 23 nt, Homo sapiens
ccuuuccagaguccuccuuugcc

SEQ ID NO: 1359951 - RNA, 19 nt, Homo sapiens
ccuuuccuuccaucccuac

SEQ ID NO: 1359952 - RNA, 18 nt, Homo sapiens
ccuuuccuuuucuuuaaa

SEQ ID NO: 1359953 - RNA, 15 nt, Homo sapiens
ccuuugcuaaugcua

SEQ ID NO: 1359954 - RNA, 21 nt, Homo sapiens
ccuuugcuaaugcuaugcaaa

SEQ ID NO: 1359955 - RNA, 14 nt, Homo sapiens
ccuuuuaaaaaccu

SEQ ID NO: 1359956 - RNA, 13 nt, Homo sapiens
ccuuuuaugcaaa

SEQ ID NO: 1359957 - RNA, 19 nt, Homo sapiens
cgaagucgccacguggccu

SEQ ID NO: 1359958 - RNA, 16 nt, Homo sapiens
cgaauagccacugcau

SEQ ID NO: 1359959 - RNA, 20 nt, Homo sapiens
cgacaagugcugaacagugg

SEQ ID NO: 1359960 - RNA, 18 nt, Homo sapiens
cgacuguggugugcagug

SEQ ID NO: 1359961 - RNA, 18 nt, Homo sapiens
cgacuuucugccuggagu

SEQ ID NO: 1359962 - RNA, 20 nt, Homo sapiens
cgagacuugguuucaaaaaa

SEQ ID NO: 1359963 - RNA, 17 nt, Homo sapiens
cgagcaugaacuggccc

SEQ ID NO: 1359964 - RNA, 19 nt, Homo sapiens
cgagccaaguuaagaaugu

SEQ ID NO: 1359965 - RNA, 17 nt, Homo sapiens
cgaggagugacugccaa

SEQ ID NO: 1359966 - RNA, 17 nt, Homo sapiens
cgaugcagguggaucuc

SEQ ID NO: 1359967 - RNA, 17 nt, Homo sapiens
cgcaaauuuucuuccau

SEQ ID NO: 1359968 - RNA, 21 nt, Homo sapiens
cgcagaacuaccagguggcaa

SEQ ID NO: 1359969 - RNA, 15 nt, Homo sapiens
cgcagacagugcaca

SEQ ID NO: 1359970 - RNA, 14 nt, Homo sapiens
cgcaucuugccucc

SEQ ID NO: 1359971 - RNA, 22 nt, Homo sapiens
cgccccaaucccucaggauucc

SEQ ID NO: 1359972 - RNA, 16 nt, Homo sapiens
cgccccuuccuagguc

SEQ ID NO: 1359973 - RNA, 16 nt, Homo sapiens
cgcugcagugugagua

SEQ ID NO: 1359974 - RNA, 20 nt, Homo sapiens
cgcugcgucugcacugauga

SEQ ID NO: 1359975 - RNA, 18 nt, Homo sapiens
cgcugugucagcauagaa

SEQ ID NO: 1359976 - RNA, 19 nt, Homo sapiens
cgcuugcuggccaguccac

SEQ ID NO: 1359977 - RNA, 13 nt, Homo sapiens
cggacucacuucu

SEQ ID NO: 1359978 - RNA, 13 nt, Homo sapiens
cggaguuccagca

SEQ ID NO: 1359979 - RNA, 22 nt, Homo sapiens
cggcagcugguucugcaaugac

SEQ ID NO: 1359980 - RNA, 19 nt, Homo sapiens
cggcaggugcucuguggau

SEQ ID NO: 1359981 - RNA, 20 nt, Homo sapiens
cggccacggugccuccagau

SEQ ID NO: 1359982 - RNA, 16 nt, Homo sapiens
cggcccaacgcaaauu

SEQ ID NO: 1359983 - RNA, 15 nt, Homo sapiens
cggccccucccacac

SEQ ID NO: 1359984 - RNA, 17 nt, Homo sapiens
cggccucugccuuugca

SEQ ID NO: 1359985 - RNA, 11 nt, Homo sapiens
cggcugaccau

SEQ ID NO: 1359986 - RNA, 20 nt, Homo sapiens
cgggcgguccuacugcugug

SEQ ID NO: 1359987 - RNA, 21 nt, Homo sapiens
cgggcgguccuacugcuguga

SEQ ID NO: 1359988 - RNA, 15 nt, Homo sapiens
cgggggggguugcuu

SEQ ID NO: 1359989 - RNA, 18 nt, Homo sapiens
cggucagaagcaccaaga

SEQ ID NO: 1359990 - RNA, 18 nt, Homo sapiens
cgguccuacugcugugag

SEQ ID NO: 1359991 - RNA, 22 nt, Homo sapiens
cggugcuugauagaaaugccaa

SEQ ID NO: 1359992 - RNA, 16 nt, Homo sapiens
cguacacacucaguga

SEQ ID NO: 1359993 - RNA, 11 nt, Homo sapiens
cgucaccaaau

SEQ ID NO: 1359994 - RNA, 15 nt, Homo sapiens
cgucacuaauacaca

SEQ ID NO: 1359995 - RNA, 18 nt, Homo sapiens
cgugaaggccgagaagca

SEQ ID NO: 1359996 - RNA, 14 nt, Homo sapiens
cgugacaagugccu

SEQ ID NO: 1359997 - RNA, 16 nt, Homo sapiens
cgugaccagugcugcu

SEQ ID NO: 1359998 - RNA, 22 nt, Homo sapiens
cgugagaccgcagucugcuuag

SEQ ID NO: 1359999 - RNA, 18 nt, Homo sapiens
cgugcccgugugcauguc

SEQ ID NO: 1360000 - RNA, 17 nt, Homo sapiens
guguaucuuuaagaaaa

SEQ ID NO: 1360001 - RNA, 14 nt, Homo sapiens
gugugugcacaucc

SEQ ID NO: 1360002 - RNA, 15 nt, Homo sapiens
guguuaaaacugaau

SEQ ID NO: 1360003 - RNA, 15 nt, Homo sapiens
guguuuacauuuacu

SEQ ID NO: 1360004 - RNA, 12 nt, Homo sapiens
guguuuugccau

SEQ ID NO: 1360005 - RNA, 11 nt, Homo sapiens
guuaaugccau

SEQ ID NO: 1360006 - RNA, 17 nt, Homo sapiens
guuaccacauuacucug

SEQ ID NO: 1360007 - RNA, 13 nt, Homo sapiens
guuacuugggagg

SEQ ID NO: 1360008 - RNA, 18 nt, Homo sapiens
guuagaagacgacugugg

SEQ ID NO: 1360009 - RNA, 22 nt, Homo sapiens
guuagggacauuuccaagcugu

SEQ ID NO: 1360010 - RNA, 20 nt, Homo sapiens
guuaguuuauuugagcacuu

SEQ ID NO: 1360011 - RNA, 15 nt, Homo sapiens
guuaugggcacuggu

SEQ ID NO: 1360012 - RNA, 17 nt, Homo sapiens
guuauugccucuacuuu

SEQ ID NO: 1360013 - RNA, 20 nt, Homo sapiens
guucauauuuauacuuugca

SEQ ID NO: 1360014 - RNA, 23 nt, Homo sapiens
guucccacaccccaacacuucca

SEQ ID NO: 1360015 - RNA, 16 nt, Homo sapiens
guucccuauuuugcca

SEQ ID NO: 1360016 - RNA, 16 nt, Homo sapiens
guucccuuggccucag

SEQ ID NO: 1360017 - RNA, 22 nt, Homo sapiens
guucccuuggccucagaauuca

SEQ ID NO: 1360018 - RNA, 17 nt, Homo sapiens
guuccuggacaaacagc

SEQ ID NO: 1360019 - RNA, 20 nt, Homo sapiens
guucguucuguacuguuacu

SEQ ID NO: 1360020 - RNA, 21 nt, Homo sapiens
guucuauauaaaaaacauaau

SEQ ID NO: 1360021 - RNA, 18 nt, Homo sapiens
guucucggggcucaggag

SEQ ID NO: 1360022 - RNA, 16 nt, Homo sapiens
guucugccagaaccag

SEQ ID NO: 1360023 - RNA, 19 nt, Homo sapiens
guucuggggggacccagug

SEQ ID NO: 1360024 - RNA, 23 nt, Homo sapiens
guucuggggggacccagugcaga

SEQ ID NO: 1360025 - RNA, 14 nt, Homo sapiens
guucuuccugcaac

SEQ ID NO: 1360026 - RNA, 22 nt, Homo sapiens
guucuuuaaaauguaaagccau

SEQ ID NO: 1360027 - RNA, 14 nt, Homo sapiens
guucuuugggccag

SEQ ID NO: 1360028 - RNA, 19 nt, Homo sapiens
guugaucuggaacccagac

SEQ ID NO: 1360029 - RNA, 12 nt, Homo sapiens
guugaugacugu

SEQ ID NO: 1360030 - RNA, 22 nt, Homo sapiens
guugcagcccuugugaugugau

SEQ ID NO: 1360031 - RNA, 21 nt, Homo sapiens
guugcauauaccaguugugau

SEQ ID NO: 1360032 - RNA, 17 nt, Homo sapiens
guugcccuucuguccaa

SEQ ID NO: 1360033 - RNA, 22 nt, Homo sapiens
guugcuguuauuauauuugaca

SEQ ID NO: 1360034 - RNA, 14 nt, Homo sapiens
guugcuguuucaca

SEQ ID NO: 1360035 - RNA, 20 nt, Homo sapiens
guuggacuucagucuugccu

SEQ ID NO: 1360036 - RNA, 19 nt, Homo sapiens
guuggaugcggaacccaaa

SEQ ID NO: 1360037 - RNA, 20 nt, Homo sapiens
guugguucguucuguacugu

SEQ ID NO: 1360038 - RNA, 22 nt, Homo sapiens
guugguucguucuguacuguua

SEQ ID NO: 1360039 - RNA, 21 nt, Homo sapiens
guugguuguuuuuuccuuugc

SEQ ID NO: 1360040 - RNA, 14 nt, Homo sapiens
guuguauugcauau

SEQ ID NO: 1360041 - RNA, 19 nt, Homo sapiens
guugugaaaaucugucaug

SEQ ID NO: 1360042 - RNA, 16 nt, Homo sapiens
guuuaaguacuucaca

SEQ ID NO: 1360043 - RNA, 20 nt, Homo sapiens
guuuacaaccuugugagcaa

SEQ ID NO: 1360044 - RNA, 13 nt, Homo sapiens
guuuacagaauuu

SEQ ID NO: 1360045 - RNA, 17 nt, Homo sapiens
guuuaggaauccuuugg

SEQ ID NO: 1360046 - RNA, 18 nt, Homo sapiens
guuuaguaauacagccug

SEQ ID NO: 1360047 - RNA, 18 nt, Homo sapiens
guuuauaaaagaugcauu

SEQ ID NO: 1360048 - RNA, 19 nt, Homo sapiens
guuucaaaauaaaaaccaa

SEQ ID NO: 1360049 - RNA, 16 nt, Homo sapiens
guuucacuggcuggug

SEQ ID NO: 1360050 - RNA, 13 nt, Homo sapiens
guuuccucuguau

SEQ ID NO: 1360051 - RNA, 14 nt, Homo sapiens
guuuccucuguaua

SEQ ID NO: 1360052 - RNA, 23 nt, Homo sapiens
guuucguguguaaagagagcaag

SEQ ID NO: 1360053 - RNA, 17 nt, Homo sapiens
guuucugguggucuguu

SEQ ID NO: 1360054 - RNA, 13 nt, Homo sapiens
guuugaacacaga

SEQ ID NO: 1360055 - RNA, 14 nt, Homo sapiens
guuugaguuacuau

SEQ ID NO: 1360056 - RNA, 17 nt, Homo sapiens
guuugccgucugugaca

SEQ ID NO: 1360057 - RNA, 14 nt, Homo sapiens
guuugcuagcagaa

SEQ ID NO: 1360058 - RNA, 17 nt, Homo sapiens
guuuggaaaaguggcgu

SEQ ID NO: 1360059 - RNA, 15 nt, Homo sapiens
guuuggacacacugg

SEQ ID NO: 1360060 - RNA, 22 nt, Homo sapiens
guuugggaauauccauguacuu

SEQ ID NO: 1360061 - RNA, 20 nt, Homo sapiens
guuuguggccucagaauuga

SEQ ID NO: 1360062 - RNA, 23 nt, Homo sapiens
guuuuaccuccaggaaacaugaa

SEQ ID NO: 1360063 - RNA, 17 nt, Homo sapiens
guuuuguguaacauauu

SEQ ID NO: 1360064 - RNA, 20 nt, Homo sapiens
guuuuuauauuaauguacuu

SEQ ID NO: 1360065 - RNA, 13 nt, Homo sapiens
uaaaaaagcauac

SEQ ID NO: 1360066 - RNA, 19 nt, Homo sapiens
uaaaaaccaagaagauguc

SEQ ID NO: 1360067 - RNA, 21 nt, Homo sapiens
uaaaaaccugcuuggugugua

SEQ ID NO: 1360068 - RNA, 17 nt, Homo sapiens
uaaaaacugcagugucu

SEQ ID NO: 1360069 - RNA, 20 nt, Homo sapiens
uaaaaagguuuacagaauuu

SEQ ID NO: 1360070 - RNA, 11 nt, Homo sapiens
uaaaacacuua

SEQ ID NO: 1360071 - RNA, 16 nt, Homo sapiens
uaaaacccaagugccu

SEQ ID NO: 1360072 - RNA, 12 nt, Homo sapiens
uaaaacuuuccu

SEQ ID NO: 1360073 - RNA, 11 nt, Homo sapiens
uaaaagaucuu

SEQ ID NO: 1360074 - RNA, 14 nt, Homo sapiens
uaaaagaucuugaa

SEQ ID NO: 1360075 - RNA, 15 nt, Homo sapiens
uaaaagaucuugaau

SEQ ID NO: 1360076 - RNA, 17 nt, Homo sapiens
uaaaagaucuugaauag

SEQ ID NO: 1360077 - RNA, 22 nt, Homo sapiens
uaaaagaucuugaauagucuca

SEQ ID NO: 1360078 - RNA, 23 nt, Homo sapiens
uaaaagcaaaaggauauucacuu

SEQ ID NO: 1360079 - RNA, 19 nt, Homo sapiens
uaaaagccuaugugccuuu

SEQ ID NO: 1360080 - RNA, 22 nt, Homo sapiens
uaaaagccuaugugccuuucac

SEQ ID NO: 1360081 - RNA, 22 nt, Homo sapiens
uaaaauacuaaacuacauuuua

SEQ ID NO: 1360082 - RNA, 19 nt, Homo sapiens
uaaaaugccaugaugccuc

SEQ ID NO: 1360083 - RNA, 16 nt, Homo sapiens
uaaaaugcugugucca

SEQ ID NO: 1360084 - RNA, 15 nt, Homo sapiens
uaaaauggaugccuu

SEQ ID NO: 1360085 - RNA, 18 nt, Homo sapiens
uaaaauggaugccuugaa

SEQ ID NO: 1360086 - RNA, 16 nt, Homo sapiens
uaaaauguaaagccau

SEQ ID NO: 1360087 - RNA, 14 nt, Homo sapiens
uaaacaaauguaug

SEQ ID NO: 1360088 - RNA, 18 nt, Homo sapiens
uaaacaaauguaugauua

SEQ ID NO: 1360089 - RNA, 16 nt, Homo sapiens
uaaacacuuaucuucu

SEQ ID NO: 1360090 - RNA, 20 nt, Homo sapiens
uaaaccauaugaacauauau

SEQ ID NO: 1360091 - RNA, 15 nt, Homo sapiens
uaaaccugacaaugg

SEQ ID NO: 1360092 - RNA, 22 nt, Homo sapiens
uaaacguccauuaagcugagag

SEQ ID NO: 1360093 - RNA, 17 nt, Homo sapiens
uaaacuucauacaaugu

SEQ ID NO: 1360094 - RNA, 21 nt, Homo sapiens
uaaacuuuagaauuaauuuau

SEQ ID NO: 1360095 - RNA, 13 nt, Homo sapiens
uaaagcaggauuu

SEQ ID NO: 1360096 - RNA, 18 nt, Homo sapiens
uaaagccucugugcugca

SEQ ID NO: 1360097 - RNA, 22 nt, Homo sapiens
uaaagcuauuuaugggccccug

SEQ ID NO: 1360098 - RNA, 16 nt, Homo sapiens
uaaagcugaaaacugc

SEQ ID NO: 1360099 - RNA, 15 nt, Homo sapiens
uaaagucaggauuua

SEQ ID NO: 1360100 - RNA, 16 nt, Homo sapiens
uaaagucaggauuuau

SEQ ID NO: 1360101 - RNA, 13 nt, Homo sapiens
uaaagucuugccu

SEQ ID NO: 1360102 - RNA, 14 nt, Homo sapiens
uaaauaaauaccaa

SEQ ID NO: 1360103 - RNA, 15 nt, Homo sapiens
uaaauaaauggaaua

SEQ ID NO: 1360104 - RNA, 17 nt, Homo sapiens
uaaauagaugcugugua

SEQ ID NO: 1360105 - RNA, 15 nt, Homo sapiens
uaaaucaaugcuaua

SEQ ID NO: 1360106 - RNA, 20 nt, Homo sapiens
uaaaucaggacagguggugc

SEQ ID NO: 1360107 - RNA, 23 nt, Homo sapiens
uaaaucauguugaucauguacuu

SEQ ID NO: 1360108 - RNA, 17 nt, Homo sapiens
uaaaugaagaaggaaua

SEQ ID NO: 1360109 - RNA, 16 nt, Homo sapiens
uaaauuccacagauua

SEQ ID NO: 1360110 - RNA, 21 nt, Homo sapiens
uaacaaagcccuuauucucuu

SEQ ID NO: 1360111 - RNA, 19 nt, Homo sapiens
uaacaccaugauuaaccac

SEQ ID NO: 1360112 - RNA, 22 nt, Homo sapiens
uaacagauggaaaaacugaggc

SEQ ID NO: 1360113 - RNA, 14 nt, Homo sapiens
uaacagugaagauu

SEQ ID NO: 1360114 - RNA, 16 nt, Homo sapiens
uaacaugacacuuaga

SEQ ID NO: 1360115 - RNA, 17 nt, Homo sapiens
uaacauuuaaauuccac

SEQ ID NO: 1360116 - RNA, 21 nt, Homo sapiens
uaacauuuaaauuccacagau

SEQ ID NO: 1360117 - RNA, 20 nt, Homo sapiens
cguggaauugugcugaguug

SEQ ID NO: 1360118 - RNA, 19 nt, Homo sapiens
cguggcuaagaguguccua

SEQ ID NO: 1360119 - RNA, 15 nt, Homo sapiens
cguggguugcacugg

SEQ ID NO: 1360120 - RNA, 20 nt, Homo sapiens
cguguccucucccugccaag

SEQ ID NO: 1360121 - RNA, 18 nt, Homo sapiens
cguuaccgccacacuuga

SEQ ID NO: 1360122 - RNA, 13 nt, Homo sapiens
cuaaaaaguauca

SEQ ID NO: 1360123 - RNA, 15 nt, Homo sapiens
cuaaaaaucugagaa

SEQ ID NO: 1360124 - RNA, 16 nt, Homo sapiens
cuaaaauuuaaugcau

SEQ ID NO: 1360125 - RNA, 22 nt, Homo sapiens
cuaaaccccggcgugugcagug

SEQ ID NO: 1360126 - RNA, 15 nt, Homo sapiens
cuaaagaagguuuca

SEQ ID NO: 1360127 - RNA, 22 nt, Homo sapiens
cuaaagaagguuucagaaagaa

SEQ ID NO: 1360128 - RNA, 22 nt, Homo sapiens
cuaaaugugaaugaugauccua

SEQ ID NO: 1360129 - RNA, 21 nt, Homo sapiens
cuaaauuuucugaaacugcau

SEQ ID NO: 1360130 - RNA, 16 nt, Homo sapiens
cuaacaaaggcagcug

SEQ ID NO: 1360131 - RNA, 17 nt, Homo sapiens
cuaacauguaauugcag

SEQ ID NO: 1360132 - RNA, 16 nt, Homo sapiens
cuaagaaaauacugga

SEQ ID NO: 1360133 - RNA, 18 nt, Homo sapiens
cuaagacuaacaaaggca

SEQ ID NO: 1360134 - RNA, 15 nt, Homo sapiens
cuaaggaggggaaaa

SEQ ID NO: 1360135 - RNA, 15 nt, Homo sapiens
cuaagucauguauau

SEQ ID NO: 1360136 - RNA, 21 nt, Homo sapiens
cuaauccucuuuuucuagucu

SEQ ID NO: 1360137 - RNA, 16 nt, Homo sapiens
cuaaugcucaccuuua

SEQ ID NO: 1360138 - RNA, 20 nt, Homo sapiens
cuaauggaauaugcguaguu

SEQ ID NO: 1360139 - RNA, 20 nt, Homo sapiens
cuacaaacacaauauucaau

SEQ ID NO: 1360140 - RNA, 17 nt, Homo sapiens
cuacaagugauccucag

SEQ ID NO: 1360141 - RNA, 20 nt, Homo sapiens
cuacaagugauccucaggca

SEQ ID NO: 1360142 - RNA, 17 nt, Homo sapiens
cuacacagaggacccag

SEQ ID NO: 1360143 - RNA, 14 nt, Homo sapiens
cuacacagaucaca

SEQ ID NO: 1360144 - RNA, 23 nt, Homo sapiens
cuacagaaaagacaaacaguaga

SEQ ID NO: 1360145 - RNA, 13 nt, Homo sapiens
cuacauuacacag

SEQ ID NO: 1360146 - RNA, 17 nt, Homo sapiens
cuacauuucugcagauc

SEQ ID NO: 1360147 - RNA, 21 nt, Homo sapiens
cuacauuuugaaggugaugca

SEQ ID NO: 1360148 - RNA, 11 nt, Homo sapiens
cuaccaggugg

SEQ ID NO: 1360149 - RNA, 20 nt, Homo sapiens
cuacuccuuguaaagacugu

SEQ ID NO: 1360150 - RNA, 20 nt, Homo sapiens
cuacucuagggaaaaaccag

SEQ ID NO: 1360151 - RNA, 13 nt, Homo sapiens
cuacugcugugag

SEQ ID NO: 1360152 - RNA, 12 nt, Homo sapiens
cuacuucucacc

SEQ ID NO: 1360153 - RNA, 18 nt, Homo sapiens
cuacuucugcccuugcca

SEQ ID NO: 1360154 - RNA, 13 nt, Homo sapiens
cuagaagacuguc

SEQ ID NO: 1360155 - RNA, 15 nt, Homo sapiens
cuagagggggucuca

SEQ ID NO: 1360156 - RNA, 23 nt, Homo sapiens
cuagauugcuuugaaaacaugac

SEQ ID NO: 1360157 - RNA, 14 nt, Homo sapiens
cuagcacuugucuc

SEQ ID NO: 1360158 - RNA, 15 nt, Homo sapiens
cuagcacuugucuca

SEQ ID NO: 1360159 - RNA, 14 nt, Homo sapiens
cuaguaagugccug

SEQ ID NO: 1360160 - RNA, 13 nt, Homo sapiens
cuagucacaaaga

SEQ ID NO: 1360161 - RNA, 17 nt, Homo sapiens
cuagucucuacccagua

SEQ ID NO: 1360162 - RNA, 22 nt, Homo sapiens
cuaguguacauuucuauaaaua

SEQ ID NO: 1360163 - RNA, 20 nt, Homo sapiens
cuauaacuauguugauaaaa

SEQ ID NO: 1360164 - RNA, 23 nt, Homo sapiens
cuauaguuauuaaguucuuuaaa

SEQ ID NO: 1360165 - RNA, 19 nt, Homo sapiens
cuauauaaaaaacauaaua

SEQ ID NO: 1360166 - RNA, 11 nt, Homo sapiens
cuauccagcua

SEQ ID NO: 1360167 - RNA, 21 nt, Homo sapiens
cuaugaaauaucaugcuccau

SEQ ID NO: 1360168 - RNA, 17 nt, Homo sapiens
cuauggcucuacuuuca

SEQ ID NO: 1360169 - RNA, 14 nt, Homo sapiens
cuaugugcaugcag

SEQ ID NO: 1360170 - RNA, 21 nt, Homo sapiens
cuaugugcaugcagcaucuaa

SEQ ID NO: 1360171 - RNA, 14 nt, Homo sapiens
cucaaaacuuucaa

SEQ ID NO: 1360172 - RNA, 12 nt, Homo sapiens
cucaaaauaucc

SEQ ID NO: 1360173 - RNA, 19 nt, Homo sapiens
cucaaggacuuugcagccg

SEQ ID NO: 1360174 - RNA, 15 nt, Homo sapiens
cucaaguaccaccaa

SEQ ID NO: 1360175 - RNA, 14 nt, Homo sapiens
cucaaugccaguaa

SEQ ID NO: 1360176 - RNA, 19 nt, Homo sapiens
cucacaccuguaaucccaa

SEQ ID NO: 1360177 - RNA, 22 nt, Homo sapiens
cucacacggacacucaaaagcu

SEQ ID NO: 1360178 - RNA, 20 nt, Homo sapiens
cucacauacccucacuuaaa

SEQ ID NO: 1360179 - RNA, 19 nt, Homo sapiens
cucaccuagccugaugaga

SEQ ID NO: 1360180 - RNA, 21 nt, Homo sapiens
cucacucccuucccauaagcu

SEQ ID NO: 1360181 - RNA, 21 nt, Homo sapiens
cucacuguagcuuuuaggaau

SEQ ID NO: 1360182 - RNA, 19 nt, Homo sapiens
cucacuuucccuuguguca

SEQ ID NO: 1360183 - RNA, 22 nt, Homo sapiens
cucagaaacugcgaggccaguu

SEQ ID NO: 1360184 - RNA, 13 nt, Homo sapiens
cucagaacugcaa

SEQ ID NO: 1360185 - RNA, 18 nt, Homo sapiens
cucagaggccuugcugug

SEQ ID NO: 1360186 - RNA, 17 nt, Homo sapiens
cucagcacucugcagug

SEQ ID NO: 1360187 - RNA, 19 nt, Homo sapiens
cucagccuggccagacaca

SEQ ID NO: 1360188 - RNA, 16 nt, Homo sapiens
cucagcuggaucucca

SEQ ID NO: 1360189 - RNA, 18 nt, Homo sapiens
cucaggaguuugagacca

SEQ ID NO: 1360190 - RNA, 15 nt, Homo sapiens
cucagugcugucuug

SEQ ID NO: 1360191 - RNA, 19 nt, Homo sapiens
cucaguucucuugcuuuca

SEQ ID NO: 1360192 - RNA, 19 nt, Homo sapiens
cucauaacucugugaucuu

SEQ ID NO: 1360193 - RNA, 14 nt, Homo sapiens
cucauccaaaaagu

SEQ ID NO: 1360194 - RNA, 20 nt, Homo sapiens
cucaugccuguaaucccagc

SEQ ID NO: 1360195 - RNA, 22 nt, Homo sapiens
cucauggauuugaaugaaaugc

SEQ ID NO: 1360196 - RNA, 18 nt, Homo sapiens
cucauuaccuugugcuaa

SEQ ID NO: 1360197 - RNA, 18 nt, Homo sapiens
cucauuguagacaugggu

SEQ ID NO: 1360198 - RNA, 16 nt, Homo sapiens
cuccaauggggcgggg

SEQ ID NO: 1360199 - RNA, 17 nt, Homo sapiens
cuccaauugcaguggau

SEQ ID NO: 1360200 - RNA, 17 nt, Homo sapiens
cuccagaccugauccug

SEQ ID NO: 1360201 - RNA, 17 nt, Homo sapiens
cucccagaacacacucc

SEQ ID NO: 1360202 - RNA, 20 nt, Homo sapiens
cucccagaacacacuccauc

SEQ ID NO: 1360203 - RNA, 15 nt, Homo sapiens
cucccaucagggucc

SEQ ID NO: 1360204 - RNA, 17 nt, Homo sapiens
cucccauccuaaucauc

SEQ ID NO: 1360205 - RNA, 21 nt, Homo sapiens
cucccauccuugaugcaagug

SEQ ID NO: 1360206 - RNA, 15 nt, Homo sapiens
cuccccaccacugag

SEQ ID NO: 1360207 - RNA, 17 nt, Homo sapiens
cuccccagcccagagac

SEQ ID NO: 1360208 - RNA, 20 nt, Homo sapiens
cuccccuagggggagaagaa

SEQ ID NO: 1360209 - RNA, 16 nt, Homo sapiens
cucccugaagccuuug

SEQ ID NO: 1360210 - RNA, 17 nt, Homo sapiens
cucccugaaguaagcaa

SEQ ID NO: 1360211 - RNA, 19 nt, Homo sapiens
cucccugaaguaagcaaag

SEQ ID NO: 1360212 - RNA, 17 nt, Homo sapiens
cucccuguuccccagag

SEQ ID NO: 1360213 - RNA, 19 nt, Homo sapiens
cuccguggcaucaccuuag

SEQ ID NO: 1360214 - RNA, 19 nt, Homo sapiens
cuccuccuuuuuccuucca

SEQ ID NO: 1360215 - RNA, 20 nt, Homo sapiens
cuccugaguaguugggauua

SEQ ID NO: 1360216 - RNA, 18 nt, Homo sapiens
cuccugcccaccugucaa

SEQ ID NO: 1360217 - RNA, 16 nt, Homo sapiens
cuccugcugagcugcc

SEQ ID NO: 1360218 - RNA, 23 nt, Homo sapiens
cuccuguguucuggacuugcaga

SEQ ID NO: 1360219 - RNA, 18 nt, Homo sapiens
cuccuucccuugcuucuu

SEQ ID NO: 1360220 - RNA, 19 nt, Homo sapiens
cuccuugggaggccccacu

SEQ ID NO: 1360221 - RNA, 17 nt, Homo sapiens
cuccuuguaaaagccua

SEQ ID NO: 1360222 - RNA, 16 nt, Homo sapiens
cuccuuuuuccuucca

SEQ ID NO: 1360223 - RNA, 12 nt, Homo sapiens
cucgccacuggg

SEQ ID NO: 1360224 - RNA, 19 nt, Homo sapiens
cucgcuagguucuuaucaa

SEQ ID NO: 1360225 - RNA, 15 nt, Homo sapiens
cucggagcucagugc

SEQ ID NO: 1360226 - RNA, 21 nt, Homo sapiens
cucggcccugcccagcuuugu

SEQ ID NO: 1360227 - RNA, 20 nt, Homo sapiens
cucggcucaccgugagaaag

SEQ ID NO: 1360228 - RNA, 12 nt, Homo sapiens
cucguggcuguc

SEQ ID NO: 1360229 - RNA, 16 nt, Homo sapiens
cucuaauacauuccaa

SEQ ID NO: 1360230 - RNA, 14 nt, Homo sapiens
cucuacaaaaagca

SEQ ID NO: 1360231 - RNA, 22 nt, Homo sapiens
cucuacccucuuagaaaaacca

SEQ ID NO: 1360232 - RNA, 21 nt, Homo sapiens
cucuacugaaaguacaaaaau

SEQ ID NO: 1360233 - RNA, 21 nt, Homo sapiens
cucuaugguguggcaaagccu

SEQ ID NO: 1360234 - RNA, 12 nt, Homo sapiens
cucucccaguga

SEQ ID NO: 1360235 - RNA, 16 nt, Homo sapiens
cucucccagugacaac

SEQ ID NO: 1360236 - RNA, 21 nt, Homo sapiens
cucucccagugacaaccaaaa

SEQ ID NO: 1360237 - RNA, 15 nt, Homo sapiens
cucucggugcuucca

SEQ ID NO: 1360238 - RNA, 19 nt, Homo sapiens
cucucuuuaaaaugcaaaa

SEQ ID NO: 1360239 - RNA, 19 nt, Homo sapiens
cucugagaagacacaaggu

SEQ ID NO: 1360240 - RNA, 13 nt, Homo sapiens
cucugccagugac

SEQ ID NO: 1360241 - RNA, 19 nt, Homo sapiens
cucuggccuguacccagua

SEQ ID NO: 1360242 - RNA, 15 nt, Homo sapiens
cucugugucuucaaa

SEQ ID NO: 1360243 - RNA, 14 nt, Homo sapiens
cucuuccaaaggca

SEQ ID NO: 1360244 - RNA, 21 nt, Homo sapiens
cucuucuuggggcccagugca

SEQ ID NO: 1360245 - RNA, 18 nt, Homo sapiens
cucuuguucccacacccc

SEQ ID NO: 1360246 - RNA, 18 nt, Homo sapiens
cucuuuaaaaugcaaaau

SEQ ID NO: 1360247 - RNA, 19 nt, Homo sapiens
cugaaagacuucacuaaaa

SEQ ID NO: 1360248 - RNA, 16 nt, Homo sapiens
cugaaagaucuuucag

SEQ ID NO: 1360249 - RNA, 13 nt, Homo sapiens
cugaaaguacaaa

SEQ ID NO: 1360250 - RNA, 19 nt, Homo sapiens
cugaaauaaaaggugcugu

SEQ ID NO: 1360251 - RNA, 20 nt, Homo sapiens
cugaaauaaaaggugcuguu

SEQ ID NO: 1360252 - RNA, 24 nt, Homo sapiens
cugaaaucugucaagaguaguuau

SEQ ID NO: 1360253 - RNA, 15 nt, Homo sapiens
cugaacaggaugcug

SEQ ID NO: 1360254 - RNA, 12 nt, Homo sapiens
cugaacagugga

SEQ ID NO: 1360255 - RNA, 19 nt, Homo sapiens
cugaagaugggagccuuua

SEQ ID NO: 1360256 - RNA, 15 nt, Homo sapiens
cugaagggguucuca

SEQ ID NO: 1360257 - RNA, 17 nt, Homo sapiens
cugaagugagaacccag

SEQ ID NO: 1360258 - RNA, 11 nt, Homo sapiens
cugaccaaaac

SEQ ID NO: 1360259 - RNA, 16 nt, Homo sapiens
cugaccaaaacaaaca

SEQ ID NO: 1360260 - RNA, 20 nt, Homo sapiens
cugaccuggaaagaaaaagc

SEQ ID NO: 1360261 - RNA, 13 nt, Homo sapiens
cugaccugucuca

SEQ ID NO: 1360262 - RNA, 19 nt, Homo sapiens
cugacuacggaacugcaca

SEQ ID NO: 1360263 - RNA, 18 nt, Homo sapiens
cugacugccaauaacauu

SEQ ID NO: 1360264 - RNA, 17 nt, Homo sapiens
cugacuuuuaaugucau

SEQ ID NO: 1360265 - RNA, 17 nt, Homo sapiens
cugagaaggaacaggga

SEQ ID NO: 1360266 - RNA, 17 nt, Homo sapiens
cugagaccaaaguagau

SEQ ID NO: 1360267 - RNA, 19 nt, Homo sapiens
cugagcaaaucaccacaaa

SEQ ID NO: 1360268 - RNA, 20 nt, Homo sapiens
cugagcaaaucaccacaaac

SEQ ID NO: 1360269 - RNA, 17 nt, Homo sapiens
cugagcacgcuaccaaa

SEQ ID NO: 1360270 - RNA, 19 nt, Homo sapiens
cugagcacgcuaccaaauc

SEQ ID NO: 1360271 - RNA, 20 nt, Homo sapiens
cugagccuccacagcagugg

SEQ ID NO: 1360272 - RNA, 17 nt, Homo sapiens
cugagcgggucaugggg

SEQ ID NO: 1360273 - RNA, 22 nt, Homo sapiens
cugaggcaagagaauuacuuga

SEQ ID NO: 1360274 - RNA, 16 nt, Homo sapiens
cugagggcagacuggg

SEQ ID NO: 1360275 - RNA, 16 nt, Homo sapiens
cugaggggcaucugcc

SEQ ID NO: 1360276 - RNA, 18 nt, Homo sapiens
cugagguaacugucauua

SEQ ID NO: 1360277 - RNA, 22 nt, Homo sapiens
cugaggucaucggcguggccca

SEQ ID NO: 1360278 - RNA, 18 nt, Homo sapiens
cugaguaguugggauuac

SEQ ID NO: 1360279 - RNA, 17 nt, Homo sapiens
cugaguuugaacacaga

SEQ ID NO: 1360280 - RNA, 17 nt, Homo sapiens
cugauagguagcauuuu

SEQ ID NO: 1360281 - RNA, 15 nt, Homo sapiens
cugaucacaugugcc

SEQ ID NO: 1360282 - RNA, 21 nt, Homo sapiens
cugauccuccaacagcuguca

SEQ ID NO: 1360283 - RNA, 13 nt, Homo sapiens
cugaucugaugca

SEQ ID NO: 1360284 - RNA, 21 nt, Homo sapiens
cugaugacacaggcugacuca

SEQ ID NO: 1360285 - RNA, 23 nt, Homo sapiens
cugaugagggggaauuccuggaa

SEQ ID NO: 1360286 - RNA, 13 nt, Homo sapiens
cugaugcaagcaa

SEQ ID NO: 1360287 - RNA, 20 nt, Homo sapiens
cugaugguguggccuguggc

SEQ ID NO: 1360288 - RNA, 22 nt, Homo sapiens
cugauucugucaaugucuugaa

SEQ ID NO: 1360289 - RNA, 22 nt, Homo sapiens
cugcacugaugcugccccucau

SEQ ID NO: 1360290 - RNA, 19 nt, Homo sapiens
cugcagugugaguaaugcu

SEQ ID NO: 1360291 - RNA, 17 nt, Homo sapiens
cugcaguucuuguggaa

SEQ ID NO: 1360292 - RNA, 16 nt, Homo sapiens
cugccagcugcacuga

SEQ ID NO: 1360293 - RNA, 20 nt, Homo sapiens
cugccaucauuguaacauga

SEQ ID NO: 1360294 - RNA, 17 nt, Homo sapiens
cugccauugggacccuc

SEQ ID NO: 1360295 - RNA, 13 nt, Homo sapiens
cugccauugugau

SEQ ID NO: 1360296 - RNA, 15 nt, Homo sapiens
cugccauugugauca

SEQ ID NO: 1360297 - RNA, 14 nt, Homo sapiens
cugcccaccuguca

SEQ ID NO: 1360298 - RNA, 20 nt, Homo sapiens
cugcccaccugucaaacaaa

SEQ ID NO: 1360299 - RNA, 21 nt, Homo sapiens
cugcccagcuuuguucugagg

SEQ ID NO: 1360300 - RNA, 18 nt, Homo sapiens
cugcccaggcacugcaaa

SEQ ID NO: 1360301 - RNA, 19 nt, Homo sapiens
cugccccaggccugaaaga

SEQ ID NO: 1360302 - RNA, 18 nt, Homo sapiens
cugcccugguccagggaa

SEQ ID NO: 1360303 - RNA, 16 nt, Homo sapiens
cugcccuugucccacu

SEQ ID NO: 1360304 - RNA, 14 nt, Homo sapiens
cugcuccaccacau

SEQ ID NO: 1360305 - RNA, 13 nt, Homo sapiens
cugcucccuggca

SEQ ID NO: 1360306 - RNA, 18 nt, Homo sapiens
cugcucggagcucagugc

SEQ ID NO: 1360307 - RNA, 13 nt, Homo sapiens
cugcugaccucca

SEQ ID NO: 1360308 - RNA, 14 nt, Homo sapiens
cugcugaccuccac

SEQ ID NO: 1360309 - RNA, 18 nt, Homo sapiens
cugcugaccuccacagcu

SEQ ID NO: 1360310 - RNA, 21 nt, Homo sapiens
cugcugccucuuucccuagga

SEQ ID NO: 1360311 - RNA, 12 nt, Homo sapiens
cugcugcuggug

SEQ ID NO: 1360312 - RNA, 20 nt, Homo sapiens
cuggaacacuagacaagcca

SEQ ID NO: 1360313 - RNA, 23 nt, Homo sapiens
cuggaagaaaaaaaccacacaaa

SEQ ID NO: 1360314 - RNA, 17 nt, Homo sapiens
cuggacaaacagccuca

SEQ ID NO: 1360315 - RNA, 12 nt, Homo sapiens
cuggacuuuccu

SEQ ID NO: 1360316 - RNA, 15 nt, Homo sapiens
cuggaggaacacuug

SEQ ID NO: 1360317 - RNA, 22 nt, Homo sapiens
cuggaggcccaguucacccuga

SEQ ID NO: 1360318 - RNA, 19 nt, Homo sapiens
cuggauuccucgaaacugc

SEQ ID NO: 1360319 - RNA, 16 nt, Homo sapiens
cuggcucuuugcugug

SEQ ID NO: 1360320 - RNA, 20 nt, Homo sapiens
cuggcuucacagauguguga

SEQ ID NO: 1360321 - RNA, 15 nt, Homo sapiens
cuggcuuuccagcuu

SEQ ID NO: 1360322 - RNA, 15 nt, Homo sapiens
cugggacuucugggu

SEQ ID NO: 1360323 - RNA, 21 nt, Homo sapiens
cugggauccuaagggcucacc

SEQ ID NO: 1360324 - RNA, 16 nt, Homo sapiens
cugggcccaagacaga

SEQ ID NO: 1360325 - RNA, 14 nt, Homo sapiens
cugggccgggaccc

SEQ ID NO: 1360326 - RNA, 16 nt, Homo sapiens
cuggggacggggcucc

SEQ ID NO: 1360327 - RNA, 19 nt, Homo sapiens
cuggggagacaaaucucag

SEQ ID NO: 1360328 - RNA, 16 nt, Homo sapiens
cuggggcauccugugc

SEQ ID NO: 1360329 - RNA, 19 nt, Homo sapiens
cuggggggacccagugcag

SEQ ID NO: 1360330 - RNA, 21 nt, Homo sapiens
cuggggguggaggccugccug

SEQ ID NO: 1360331 - RNA, 16 nt, Homo sapiens
cuggggguggggcucc

SEQ ID NO: 1360332 - RNA, 21 nt, Homo sapiens
cugggguuggacuguaaggga

SEQ ID NO: 1360333 - RNA, 14 nt, Homo sapiens
cugggugggcgggg

SEQ ID NO: 1360334 - RNA, 16 nt, Homo sapiens
cuggugcugugugacc

SEQ ID NO: 1360335 - RNA, 19 nt, Homo sapiens
cuguaaauauuuuucacau

SEQ ID NO: 1360336 - RNA, 23 nt, Homo sapiens
cuguaacagcggcaggguguccc

SEQ ID NO: 1360337 - RNA, 21 nt, Homo sapiens
cuguaaucccagcacuuuggg

SEQ ID NO: 1360338 - RNA, 18 nt, Homo sapiens
cugucaaacaaagccaga

SEQ ID NO: 1360339 - RNA, 14 nt, Homo sapiens
cugucaacuuguau

SEQ ID NO: 1360340 - RNA, 15 nt, Homo sapiens
cugucaccagguuug

SEQ ID NO: 1360341 - RNA, 14 nt, Homo sapiens
cugucauccacuuu

SEQ ID NO: 1360342 - RNA, 12 nt, Homo sapiens
cuguccagcucc

SEQ ID NO: 1360343 - RNA, 21 nt, Homo sapiens
cuguccuuucuagagcacugc

SEQ ID NO: 1360344 - RNA, 14 nt, Homo sapiens
cugucuacauuucu

SEQ ID NO: 1360345 - RNA, 16 nt, Homo sapiens
cugucuacuugcucag

SEQ ID NO: 1360346 - RNA, 20 nt, Homo sapiens
cugucuuuauaaucuacucc

SEQ ID NO: 1360347 - RNA, 23 nt, Homo sapiens
cugugaaaauugaccaagugaug

SEQ ID NO: 1360348 - RNA, 16 nt, Homo sapiens
cugugaggcuugccca

SEQ ID NO: 1360349 - RNA, 19 nt, Homo sapiens
cugugcaacggucuccuga

SEQ ID NO: 1360350 - RNA, 20 nt, Homo sapiens
cugugccauuucucagggaa

SEQ ID NO: 1360351 - RNA, 16 nt, Homo sapiens
cuguggcaucuuugcc

SEQ ID NO: 1360352 - RNA, 13 nt, Homo sapiens
cugugugagcugc

SEQ ID NO: 1360353 - RNA, 15 nt, Homo sapiens
cugugugcgugcgca

SEQ ID NO: 1360354 - RNA, 19 nt, Homo sapiens
cugugugguaacucagugu

SEQ ID NO: 1360355 - RNA, 21 nt, Homo sapiens
cuguguugccaagcuccaagc

SEQ ID NO: 1360356 - RNA, 17 nt, Homo sapiens
cuguucagcugguugag

SEQ ID NO: 1360357 - RNA, 22 nt, Homo sapiens
cuguucccaccaggcugcucag

SEQ ID NO: 1360358 - RNA, 16 nt, Homo sapiens
cuguucugaaaccuua

SEQ ID NO: 1360359 - RNA, 20 nt, Homo sapiens
cuguuugagguccacacuga

SEQ ID NO: 1360360 - RNA, 13 nt, Homo sapiens
cuguuuugaggaa

SEQ ID NO: 1360361 - RNA, 15 nt, Homo sapiens
cuuaaacacuugcaa

SEQ ID NO: 1360362 - RNA, 14 nt, Homo sapiens
cuuagaaaaaccac

SEQ ID NO: 1360363 - RNA, 17 nt, Homo sapiens
cuuagguuggcaaaaag

SEQ ID NO: 1360364 - RNA, 22 nt, Homo sapiens
cuuagugagcagugagcacuga

SEQ ID NO: 1360365 - RNA, 14 nt, Homo sapiens
cuuauacuguacaa

SEQ ID NO: 1360366 - RNA, 15 nt, Homo sapiens
cuuaucaacauuugg

SEQ ID NO: 1360367 - RNA, 21 nt, Homo sapiens
cuuauuaacaauuaggcagac

SEQ ID NO: 1360368 - RNA, 23 nt, Homo sapiens
cuucaacuuuuuuaaaaacuaga

SEQ ID NO: 1360369 - RNA, 14 nt, Homo sapiens
cuucaagugccaaa

SEQ ID NO: 1360370 - RNA, 15 nt, Homo sapiens
cuucacucaaucucu

SEQ ID NO: 1360371 - RNA, 13 nt, Homo sapiens
cuucagucuugau

SEQ ID NO: 1360372 - RNA, 20 nt, Homo sapiens
cuucauacaauguaagguca

SEQ ID NO: 1360373 - RNA, 17 nt, Homo sapiens
cuucauagaaaccucuc

SEQ ID NO: 1360374 - RNA, 14 nt, Homo sapiens
cuucauugccuuaa

SEQ ID NO: 1360375 - RNA, 16 nt, Homo sapiens
cuuccaacguggccca

SEQ ID NO: 1360376 - RNA, 23 nt, Homo sapiens
cuuccagcauuuagcuggccaca

SEQ ID NO: 1360377 - RNA, 16 nt, Homo sapiens
cuucccauuggcuuuc

SEQ ID NO: 1360378 - RNA, 20 nt, Homo sapiens
cuucccuugcuucuuggacu

SEQ ID NO: 1360379 - RNA, 20 nt, Homo sapiens
cuuccguggucagagugcca

SEQ ID NO: 1360380 - RNA, 21 nt, Homo sapiens
cuuccuaaauauuaugagaug

SEQ ID NO: 1360381 - RNA, 16 nt, Homo sapiens
cuuccuggauggggca

SEQ ID NO: 1360382 - RNA, 15 nt, Homo sapiens
cuuccuguccagcuc

SEQ ID NO: 1360383 - RNA, 14 nt, Homo sapiens
cuucuaaucaaagc

SEQ ID NO: 1360384 - RNA, 13 nt, Homo sapiens
cuucuagaaccag

SEQ ID NO: 1360385 - RNA, 21 nt, Homo sapiens
cuucucccuggggacggggcu

SEQ ID NO: 1360386 - RNA, 14 nt, Homo sapiens
cuucuccuacuuag

SEQ ID NO: 1360387 - RNA, 12 nt, Homo sapiens
cuucugcuaaaa

SEQ ID NO: 1360388 - RNA, 20 nt, Homo sapiens
cuucuuggggcccagugcau

SEQ ID NO: 1360389 - RNA, 22 nt, Homo sapiens
cuugaagauuucucugagauca

SEQ ID NO: 1360390 - RNA, 18 nt, Homo sapiens
cuugaagggccagagcca

SEQ ID NO: 1360391 - RNA, 19 nt, Homo sapiens
cuugaagggccagagccag

SEQ ID NO: 1360392 - RNA, 16 nt, Homo sapiens
cuugaauagucucauc

SEQ ID NO: 1360393 - RNA, 19 nt, Homo sapiens
cuugacccugagcugacca

SEQ ID NO: 1360394 - RNA, 16 nt, Homo sapiens
cuugaggcaacucauc

SEQ ID NO: 1360395 - RNA, 16 nt, Homo sapiens
cuugauagaaaugcca

SEQ ID NO: 1360396 - RNA, 21 nt, Homo sapiens
cuugauagaaaugccaagcac

SEQ ID NO: 1360397 - RNA, 18 nt, Homo sapiens
cuugaucaugaaucacug

SEQ ID NO: 1360398 - RNA, 15 nt, Homo sapiens
cuugcaugugcugca

SEQ ID NO: 1360399 - RNA, 12 nt, Homo sapiens
cuugcugccaaa

SEQ ID NO: 1360400 - RNA, 20 nt, Homo sapiens
cuuggaagucugucucagga

SEQ ID NO: 1360401 - RNA, 15 nt, Homo sapiens
cuuggcagcccugau

SEQ ID NO: 1360402 - RNA, 19 nt, Homo sapiens
cuuggcuuuguugaugcuc

SEQ ID NO: 1360403 - RNA, 14 nt, Homo sapiens
cuugggaacuacag

SEQ ID NO: 1360404 - RNA, 20 nt, Homo sapiens
cuuggggcaggcagugaugc

SEQ ID NO: 1360405 - RNA, 15 nt, Homo sapiens
cuugguaaaaacugc

SEQ ID NO: 1360406 - RNA, 22 nt, Homo sapiens
cuuggugggggagccucuggaa

SEQ ID NO: 1360407 - RNA, 22 nt, Homo sapiens
cuuguagguaugucugugccau

SEQ ID NO: 1360408 - RNA, 14 nt, Homo sapiens
cuugugcucaagga

SEQ ID NO: 1360409 - RNA, 15 nt, Homo sapiens
cuugugucccaugau

SEQ ID NO: 1360410 - RNA, 14 nt, Homo sapiens
cuuguguuuuuaac

SEQ ID NO: 1360411 - RNA, 13 nt, Homo sapiens
cuuguucccacac

SEQ ID NO: 1360412 - RNA, 17 nt, Homo sapiens
cuuguuguuauugaugu

SEQ ID NO: 1360413 - RNA, 15 nt, Homo sapiens
cuuuaaagugacuaa

SEQ ID NO: 1360414 - RNA, 23 nt, Homo sapiens
cuuuaacauuuuacugugcuguu

SEQ ID NO: 1360415 - RNA, 18 nt, Homo sapiens
cuuuaaccucacauaccc

SEQ ID NO: 1360416 - RNA, 17 nt, Homo sapiens
cuuuaguugauuuaaac

SEQ ID NO: 1360417 - RNA, 19 nt, Homo sapiens
cuuuauaaucuacuccuug

SEQ ID NO: 1360418 - RNA, 15 nt, Homo sapiens
cuuuauauaucugcu

SEQ ID NO: 1360419 - RNA, 21 nt, Homo sapiens
cuuucacugagccuccacagc

SEQ ID NO: 1360420 - RNA, 19 nt, Homo sapiens
cuuucauaaagucuugccu

SEQ ID NO: 1360421 - RNA, 15 nt, Homo sapiens
cuuuccagcuuagaa

SEQ ID NO: 1360422 - RNA, 14 nt, Homo sapiens
cuuuccccagugac

SEQ ID NO: 1360423 - RNA, 22 nt, Homo sapiens
cuuucucugccagugacagaca

SEQ ID NO: 1360424 - RNA, 22 nt, Homo sapiens
cuuugaaaacaugacucaauaa

SEQ ID NO: 1360425 - RNA, 18 nt, Homo sapiens
cuuugaaugcggcccaac

SEQ ID NO: 1360426 - RNA, 21 nt, Homo sapiens
cuuugagcugcugacugccaa

SEQ ID NO: 1360427 - RNA, 19 nt, Homo sapiens
cuuugcuaaugcuaugcaa

SEQ ID NO: 1360428 - RNA, 11 nt, Homo sapiens
cuuugcugcug

SEQ ID NO: 1360429 - RNA, 15 nt, Homo sapiens
cuuuggaaaucacac

SEQ ID NO: 1360430 - RNA, 17 nt, Homo sapiens
cuuuggcuuugcaaaau

SEQ ID NO: 1360431 - RNA, 11 nt, Homo sapiens
cuuugggucua

SEQ ID NO: 1360432 - RNA, 15 nt, Homo sapiens
cuuuguauauuacau

SEQ ID NO: 1360433 - RNA, 12 nt, Homo sapiens
cuuugucugucg

SEQ ID NO: 1360434 - RNA, 21 nt, Homo sapiens
cuuuuaaacccuauugguaaa

SEQ ID NO: 1360435 - RNA, 14 nt, Homo sapiens
cuuuuaauccuggc

SEQ ID NO: 1360436 - RNA, 22 nt, Homo sapiens
cuuuuaaugucauuuguuaaaa

SEQ ID NO: 1360437 - RNA, 23 nt, Homo sapiens
cuuuuauaggugagaaaaaaaca

SEQ ID NO: 1360438 - RNA, 16 nt, Homo sapiens
cuuuuccacuccauug

SEQ ID NO: 1360439 - RNA, 19 nt, Homo sapiens
cuuuuccugauaaagcaca

SEQ ID NO: 1360440 - RNA, 15 nt, Homo sapiens
cuuuugaacccagga

SEQ ID NO: 1360441 - RNA, 14 nt, Homo sapiens
cuuuugacauuuua

SEQ ID NO: 1360442 - RNA, 19 nt, Homo sapiens
cuuuugguuacagcacaaa

SEQ ID NO: 1360443 - RNA, 14 nt, Homo sapiens
cuuuugucuaauua

SEQ ID NO: 1360444 - RNA, 22 nt, Homo sapiens
cuuuugugcaaagccaaaaccu

SEQ ID NO: 1360445 - RNA, 20 nt, Homo sapiens
cuuuuuuucuuguccucauu

SEQ ID NO: 1360446 - RNA, 20 nt, Homo sapiens
gaaaaagguuugcauucuca

SEQ ID NO: 1360447 - RNA, 16 nt, Homo sapiens
gaaaaauaagucacuu

SEQ ID NO: 1360448 - RNA, 15 nt, Homo sapiens
gaaaacugcaacuug

SEQ ID NO: 1360449 - RNA, 15 nt, Homo sapiens
gaaaacuuugaaaag

SEQ ID NO: 1360450 - RNA, 19 nt, Homo sapiens
gaaaaguguccuucuugcu

SEQ ID NO: 1360451 - RNA, 11 nt, Homo sapiens
gaaaaguuauu

SEQ ID NO: 1360452 - RNA, 19 nt, Homo sapiens
gaaaaguuauuagugguuu

SEQ ID NO: 1360453 - RNA, 14 nt, Homo sapiens
gaaaauaacaaagc

SEQ ID NO: 1360454 - RNA, 20 nt, Homo sapiens
gaaaauaguuuggauuacuu

SEQ ID NO: 1360455 - RNA, 22 nt, Homo sapiens
gaaaaugcagcagggaugcccu

SEQ ID NO: 1360456 - RNA, 12 nt, Homo sapiens
gaaaaugcuucu

SEQ ID NO: 1360457 - RNA, 14 nt, Homo sapiens
gaaaauuaacacug

SEQ ID NO: 1360458 - RNA, 20 nt, Homo sapiens
gaaacagggccaggugcuuu

SEQ ID NO: 1360459 - RNA, 17 nt, Homo sapiens
gaaacaugccacuugaa

SEQ ID NO: 1360460 - RNA, 16 nt, Homo sapiens
gaaaccuuaguuucaa

SEQ ID NO: 1360461 - RNA, 16 nt, Homo sapiens
gaaacucacacucccc

SEQ ID NO: 1360462 - RNA, 16 nt, Homo sapiens
gaaagacaagcucaag

SEQ ID NO: 1360463 - RNA, 15 nt, Homo sapiens
gaaagauuugugaac

SEQ ID NO: 1360464 - RNA, 18 nt, Homo sapiens
gaaagcaucacuugggau

SEQ ID NO: 1360465 - RNA, 18 nt, Homo sapiens
gaaagcugacauugccaa

SEQ ID NO: 1360466 - RNA, 19 nt, Homo sapiens
gaaaggagugacuuugcag

SEQ ID NO: 1360467 - RNA, 12 nt, Homo sapiens
gaaagguggugu

SEQ ID NO: 1360468 - RNA, 15 nt, Homo sapiens
gaaagugaccauguu

SEQ ID NO: 1360469 - RNA, 14 nt, Homo sapiens
gaaauaaaaugaua

SEQ ID NO: 1360470 - RNA, 15 nt, Homo sapiens
gaaauaaacagucua

SEQ ID NO: 1360471 - RNA, 17 nt, Homo sapiens
gaaauaccacaagccug

SEQ ID NO: 1360472 - RNA, 13 nt, Homo sapiens
gaaauagugacau

SEQ ID NO: 1360473 - RNA, 12 nt, Homo sapiens
gaaaucaagggc

SEQ ID NO: 1360474 - RNA, 18 nt, Homo sapiens
gaaaucuagaagacuguc

SEQ ID NO: 1360475 - RNA, 19 nt, Homo sapiens
gaaaucuggcuucuggcca

SEQ ID NO: 1360476 - RNA, 19 nt, Homo sapiens
gguucaccaggucagggag

SEQ ID NO: 1360477 - RNA, 19 nt, Homo sapiens
gguucguucuguacuguua

SEQ ID NO: 1360478 - RNA, 12 nt, Homo sapiens
gguucucuccac

SEQ ID NO: 1360479 - RNA, 22 nt, Homo sapiens
gguuggaaaacaguauuuucca

SEQ ID NO: 1360480 - RNA, 21 nt, Homo sapiens
gguuugccaaaauucauuucu

SEQ ID NO: 1360481 - RNA, 23 nt, Homo sapiens
gguuugucgggcaccagccagcg

SEQ ID NO: 1360482 - RNA, 17 nt, Homo sapiens
guaaaagccuaugugcc

SEQ ID NO: 1360483 - RNA, 21 nt, Homo sapiens
guaaagacucuaucuugaaag

SEQ ID NO: 1360484 - RNA, 21 nt, Homo sapiens
guaaaucauguugaucaugua

SEQ ID NO: 1360485 - RNA, 21 nt, Homo sapiens
guaaauguuaucuuauacugu

SEQ ID NO: 1360486 - RNA, 19 nt, Homo sapiens
guaaauuauauuugugcua

SEQ ID NO: 1360487 - RNA, 16 nt, Homo sapiens
guaaccucuacaggca

SEQ ID NO: 1360488 - RNA, 22 nt, Homo sapiens
guaagucugcguugguucugaa

SEQ ID NO: 1360489 - RNA, 15 nt, Homo sapiens
guaagugccugcugu

SEQ ID NO: 1360490 - RNA, 16 nt, Homo sapiens
guaaucccagcacuuu

SEQ ID NO: 1360491 - RNA, 15 nt, Homo sapiens
guaaucucggcucac

SEQ ID NO: 1360492 - RNA, 21 nt, Homo sapiens
guaauuguacuaaagccaaac

SEQ ID NO: 1360493 - RNA, 20 nt, Homo sapiens
guacacacucagugacauuu

SEQ ID NO: 1360494 - RNA, 16 nt, Homo sapiens
guacccagagaccaag

SEQ ID NO: 1360495 - RNA, 22 nt, Homo sapiens
guaccuuuguguccuuguucau

SEQ ID NO: 1360496 - RNA, 12 nt, Homo sapiens
guacuaaagcca

SEQ ID NO: 1360497 - RNA, 13 nt, Homo sapiens
guacuaaagccaa

SEQ ID NO: 1360498 - RNA, 21 nt, Homo sapiens
guacuaauacagacuauguca

SEQ ID NO: 1360499 - RNA, 13 nt, Homo sapiens
guacuaaugugaa

SEQ ID NO: 1360500 - RNA, 12 nt, Homo sapiens
guagacuguggc

SEQ ID NO: 1360501 - RNA, 19 nt, Homo sapiens
guagaguaaaaugcugugu

SEQ ID NO: 1360502 - RNA, 23 nt, Homo sapiens
guagcagguuaccacucuggcag

SEQ ID NO: 1360503 - RNA, 16 nt, Homo sapiens
guagcauuuuccagca

SEQ ID NO: 1360504 - RNA, 21 nt, Homo sapiens
guaggaccaagcaucuugggg

SEQ ID NO: 1360505 - RNA, 13 nt, Homo sapiens
guagggcgcugca

SEQ ID NO: 1360506 - RNA, 23 nt, Homo sapiens
guaguccucccaagcugugcugg

SEQ ID NO: 1360507 - RNA, 16 nt, Homo sapiens
guaguugaugacuguu

SEQ ID NO: 1360508 - RNA, 20 nt, Homo sapiens
guaguuuacgcggagcacuu

SEQ ID NO: 1360509 - RNA, 18 nt, Homo sapiens
guauaccuaucacuuaca

SEQ ID NO: 1360510 - RNA, 19 nt, Homo sapiens
guauccccccaucuugcuu

SEQ ID NO: 1360511 - RNA, 23 nt, Homo sapiens
guaucuuaaaaaucuaugccuaa

SEQ ID NO: 1360512 - RNA, 23 nt, Homo sapiens
guaugauccuaaugaaugcauaa

SEQ ID NO: 1360513 - RNA, 19 nt, Homo sapiens
guaugugugccagcugugu

SEQ ID NO: 1360514 - RNA, 16 nt, Homo sapiens
guauuaauaaacacau

SEQ ID NO: 1360515 - RNA, 16 nt, Homo sapiens
gucaaacuuucaccuc

SEQ ID NO: 1360516 - RNA, 20 nt, Homo sapiens
gucaaacuuucaccucagau

SEQ ID NO: 1360517 - RNA, 17 nt, Homo sapiens
gucaacgugagcuggug

SEQ ID NO: 1360518 - RNA, 17 nt, Homo sapiens
gucaaguuggauuugaa

SEQ ID NO: 1360519 - RNA, 16 nt, Homo sapiens
gucaaucacagucuca

SEQ ID NO: 1360520 - RNA, 14 nt, Homo sapiens
gucacacaaaggca

SEQ ID NO: 1360521 - RNA, 20 nt, Homo sapiens
gucacagaucacagugucuu

SEQ ID NO: 1360522 - RNA, 18 nt, Homo sapiens
gucagaggacgagugcuu

SEQ ID NO: 1360523 - RNA, 14 nt, Homo sapiens
gucaucuugcacac

SEQ ID NO: 1360524 - RNA, 21 nt, Homo sapiens
gucaucuugcacacacuuuca

SEQ ID NO: 1360525 - RNA, 16 nt, Homo sapiens
guccaaacugccuaag

SEQ ID NO: 1360526 - RNA, 13 nt, Homo sapiens
guccgagcuuuga

SEQ ID NO: 1360527 - RNA, 14 nt, Homo sapiens
guccuagcuguuag

SEQ ID NO: 1360528 - RNA, 19 nt, Homo sapiens
guccucagccuugccagag

SEQ ID NO: 1360529 - RNA, 21 nt, Homo sapiens
guccucagccuugccagagau

SEQ ID NO: 1360530 - RNA, 16 nt, Homo sapiens
guccugaccugucuca

SEQ ID NO: 1360531 - RNA, 16 nt, Homo sapiens
guccugaccuugagaa

SEQ ID NO: 1360532 - RNA, 16 nt, Homo sapiens
guccugccccaggugu

SEQ ID NO: 1360533 - RNA, 17 nt, Homo sapiens
guccuuggcucguuuga

SEQ ID NO: 1360534 - RNA, 14 nt, Homo sapiens
gucgugagugucuc

SEQ ID NO: 1360535 - RNA, 17 nt, Homo sapiens
gucuacguuaccaggca

SEQ ID NO: 1360536 - RNA, 21 nt, Homo sapiens
gucuacuugcucagguacuug

SEQ ID NO: 1360537 - RNA, 16 nt, Homo sapiens
gucucaagccuaucua

SEQ ID NO: 1360538 - RNA, 16 nt, Homo sapiens
gucucauccaaaaagu

SEQ ID NO: 1360539 - RNA, 13 nt, Homo sapiens
gucucauguggaa

SEQ ID NO: 1360540 - RNA, 17 nt, Homo sapiens
gucucuacccaguagau

SEQ ID NO: 1360541 - RNA, 18 nt, Homo sapiens
gucucuucuuggggccca

SEQ ID NO: 1360542 - RNA, 18 nt, Homo sapiens
gucugaacaggaugcuga

SEQ ID NO: 1360543 - RNA, 12 nt, Homo sapiens
gucugaugacac

SEQ ID NO: 1360544 - RNA, 22 nt, Homo sapiens
gucuggagaagguauuagcaaa

SEQ ID NO: 1360545 - RNA, 14 nt, Homo sapiens
gucuucccuaccuc

SEQ ID NO: 1360546 - RNA, 16 nt, Homo sapiens
gucuucguauucccau

SEQ ID NO: 1360547 - RNA, 21 nt, Homo sapiens
gucuuucccauuucuaccuaa

SEQ ID NO: 1360548 - RNA, 20 nt, Homo sapiens
gucuuuccuaaggcugcaag

SEQ ID NO: 1360549 - RNA, 20 nt, Homo sapiens
gugaaagcaucacuugggau

SEQ ID NO: 1360550 - RNA, 20 nt, Homo sapiens
gugaaauaccacaagccuga

SEQ ID NO: 1360551 - RNA, 20 nt, Homo sapiens
gugaagcaaaacacaaaaac

SEQ ID NO: 1360552 - RNA, 21 nt, Homo sapiens
gugaauaagccuuacgggaaa

SEQ ID NO: 1360553 - RNA, 13 nt, Homo sapiens
gugacacccaaga

SEQ ID NO: 1360554 - RNA, 14 nt, Homo sapiens
gugaccagugcugc

SEQ ID NO: 1360555 - RNA, 22 nt, Homo sapiens
gugacuuugagcugagugcuga

SEQ ID NO: 1360556 - RNA, 14 nt, Homo sapiens
gugagaucaugcca

SEQ ID NO: 1360557 - RNA, 16 nt, Homo sapiens
gugagcaaagggcuca

SEQ ID NO: 1360558 - RNA, 18 nt, Homo sapiens
gugaggaugucacucaga

SEQ ID NO: 1360559 - RNA, 18 nt, Homo sapiens
gugauggcagggcuguga

SEQ ID NO: 1360560 - RNA, 18 nt, Homo sapiens
gugauguguuuacauuua

SEQ ID NO: 1360561 - RNA, 23 nt, Homo sapiens
gugauugacagcuuugcugcuga

SEQ ID NO: 1360562 - RNA, 16 nt, Homo sapiens
gugauuuuuaaucgcu

SEQ ID NO: 1360563 - RNA, 22 nt, Homo sapiens
gugcacuuuaagaggugggagc

SEQ ID NO: 1360564 - RNA, 15 nt, Homo sapiens
gugcaucccugagac

SEQ ID NO: 1360565 - RNA, 20 nt, Homo sapiens
gugcaugcagcaucuaagua

SEQ ID NO: 1360566 - RNA, 19 nt, Homo sapiens
gugccacccaccuuugcca

SEQ ID NO: 1360567 - RNA, 13 nt, Homo sapiens
gugccccaugccu

SEQ ID NO: 1360568 - RNA, 21 nt, Homo sapiens
gugccuagacuguuacuuugg

SEQ ID NO: 1360569 - RNA, 23 nt, Homo sapiens
gugccuagacuguuacuuuggca

SEQ ID NO: 1360570 - RNA, 12 nt, Homo sapiens
gugccuccagau

SEQ ID NO: 1360571 - RNA, 15 nt, Homo sapiens
gugccugggguguua

SEQ ID NO: 1360572 - RNA, 18 nt, Homo sapiens
gugcuaaacgcacacagu

SEQ ID NO: 1360573 - RNA, 18 nt, Homo sapiens
gugcucugucuacuugcu

SEQ ID NO: 1360574 - RNA, 15 nt, Homo sapiens
gugcugcagguguaa

SEQ ID NO: 1360575 - RNA, 16 nt, Homo sapiens
gugcugugcugugcua

SEQ ID NO: 1360576 - RNA, 11 nt, Homo sapiens
guggacaugcg

SEQ ID NO: 1360577 - RNA, 12 nt, Homo sapiens
guggagaacucc

SEQ ID NO: 1360578 - RNA, 22 nt, Homo sapiens
guggcagaauggggugcaugaa

SEQ ID NO: 1360579 - RNA, 19 nt, Homo sapiens
guggccaaggagcugcuau

SEQ ID NO: 1360580 - RNA, 16 nt, Homo sapiens
guggcugucgguggga

SEQ ID NO: 1360581 - RNA, 20 nt, Homo sapiens
gugguucucugggccucagu

SEQ ID NO: 1360582 - RNA, 19 nt, Homo sapiens
gugguugaagagcaaugug

SEQ ID NO: 1360583 - RNA, 20 nt, Homo sapiens
guguaaaaaaaccaccaaaa

SEQ ID NO: 1360584 - RNA, 15 nt, Homo sapiens
guguaacagauauca

SEQ ID NO: 1360585 - RNA, 18 nt, Homo sapiens
guguagcccucacacugu

SEQ ID NO: 1360586 - RNA, 23 nt, Homo sapiens
uaaccccagauucaugcacugua

SEQ ID NO: 1360587 - RNA, 20 nt, Homo sapiens
uaaccucuacaggcauuuaa

SEQ ID NO: 1360588 - RNA, 22 nt, Homo sapiens
uaaccugcaaaaucuguucuaa

SEQ ID NO: 1360589 - RNA, 17 nt, Homo sapiens
uaacucagacacaaaua

SEQ ID NO: 1360590 - RNA, 14 nt, Homo sapiens
uaacuccugccauu

SEQ ID NO: 1360591 - RNA, 20 nt, Homo sapiens
uaacuggagccccaucagcu

SEQ ID NO: 1360592 - RNA, 19 nt, Homo sapiens
uaacugugaaauaccacaa

SEQ ID NO: 1360593 - RNA, 17 nt, Homo sapiens
uaacuuggucagagcca

SEQ ID NO: 1360594 - RNA, 16 nt, Homo sapiens
uaacuuugacuuucuu

SEQ ID NO: 1360595 - RNA, 19 nt, Homo sapiens
uaacuuuucggucuuuccc

SEQ ID NO: 1360596 - RNA, 14 nt, Homo sapiens
uaagacaacaggca

SEQ ID NO: 1360597 - RNA, 13 nt, Homo sapiens
uaagacauuugaa

SEQ ID NO: 1360598 - RNA, 20 nt, Homo sapiens
uaagccugcauucuuaacaa

SEQ ID NO: 1360599 - RNA, 14 nt, Homo sapiens
uaagcucacacagc

SEQ ID NO: 1360600 - RNA, 19 nt, Homo sapiens
uaaggcugaggaaaggcca

SEQ ID NO: 1360601 - RNA, 17 nt, Homo sapiens
uaaguacuccauuguaa

SEQ ID NO: 1360602 - RNA, 14 nt, Homo sapiens
uaagucauguauau

SEQ ID NO: 1360603 - RNA, 24 nt, Homo sapiens
uaagugaaaaucuuacaacaggcu

SEQ ID NO: 1360604 - RNA, 23 nt, Homo sapiens
uaaguggggugggaaggggagca

SEQ ID NO: 1360605 - RNA, 21 nt, Homo sapiens
uaauaaaaccggucacugaug

SEQ ID NO: 1360606 - RNA, 18 nt, Homo sapiens
uaauacagacuaugucac

SEQ ID NO: 1360607 - RNA, 14 nt, Homo sapiens
uaauacuuccaaau

SEQ ID NO: 1360608 - RNA, 17 nt, Homo sapiens
uaauagucuuugccagu

SEQ ID NO: 1360609 - RNA, 22 nt, Homo sapiens
uaauauauguauaugcaauaua

SEQ ID NO: 1360610 - RNA, 18 nt, Homo sapiens
uaauaucuaaaguuauau

SEQ ID NO: 1360611 - RNA, 15 nt, Homo sapiens
uaauauugugcaaac

SEQ ID NO: 1360612 - RNA, 19 nt, Homo sapiens
uaauauuucaagugccuag

SEQ ID NO: 1360613 - RNA, 22 nt, Homo sapiens
uaaucaguuguuuaauaauuua

SEQ ID NO: 1360614 - RNA, 23 nt, Homo sapiens
uaaucauuuguuuacauuugaug

SEQ ID NO: 1360615 - RNA, 17 nt, Homo sapiens
uaauccaaauccaucaa

SEQ ID NO: 1360616 - RNA, 19 nt, Homo sapiens
uaauccucuuuuucuaguc

SEQ ID NO: 1360617 - RNA, 14 nt, Homo sapiens
uaaucuaugaauuc

SEQ ID NO: 1360618 - RNA, 20 nt, Homo sapiens
uaaugaguuuuucuguuauc

SEQ ID NO: 1360619 - RNA, 21 nt, Homo sapiens
uaaugauaaaauacuaaacua

SEQ ID NO: 1360620 - RNA, 23 nt, Homo sapiens
uaaugaugucguuugaaucacag

SEQ ID NO: 1360621 - RNA, 14 nt, Homo sapiens
uaauuaguuccuca

SEQ ID NO: 1360622 - RNA, 15 nt, Homo sapiens
uaauucucuguggaa

SEQ ID NO: 1360623 - RNA, 19 nt, Homo sapiens
uaauucucuguggaaugaa

SEQ ID NO: 1360624 - RNA, 22 nt, Homo sapiens
uaauucuuagauacacuaaaaa

SEQ ID NO: 1360625 - RNA, 18 nt, Homo sapiens
uaauugcuuugagcacaa

SEQ ID NO: 1360626 - RNA, 13 nt, Homo sapiens
uaauugcuuugcc

SEQ ID NO: 1360627 - RNA, 17 nt, Homo sapiens
uaauugcuuugccaaaa

SEQ ID NO: 1360628 - RNA, 14 nt, Homo sapiens
uaauuuuacauguu

SEQ ID NO: 1360629 - RNA, 19 nt, Homo sapiens
uaauuuuuccuauauugca

SEQ ID NO: 1360630 - RNA, 22 nt, Homo sapiens
uaauuuuuccuauauugcauua

SEQ ID NO: 1360631 - RNA, 19 nt, Homo sapiens
uacaaaaauagcugggcau

SEQ ID NO: 1360632 - RNA, 15 nt, Homo sapiens
uacacagaucacagc

SEQ ID NO: 1360633 - RNA, 16 nt, Homo sapiens
uacacagaucacagcu

SEQ ID NO: 1360634 - RNA, 19 nt, Homo sapiens
uacacuaaaaaucugagaa

SEQ ID NO: 1360635 - RNA, 21 nt, Homo sapiens
uacagaaaagacaaacaguag

SEQ ID NO: 1360636 - RNA, 14 nt, Homo sapiens
uacagacagaauau

SEQ ID NO: 1360637 - RNA, 14 nt, Homo sapiens
uacagaccagguga

SEQ ID NO: 1360638 - RNA, 13 nt, Homo sapiens
uacagagugagac

SEQ ID NO: 1360639 - RNA, 22 nt, Homo sapiens
uacagauugggcggggcuucuc

SEQ ID NO: 1360640 - RNA, 21 nt, Homo sapiens
uacaggaagcaccccaugcca

SEQ ID NO: 1360641 - RNA, 21 nt, Homo sapiens
uacaguaaauguuugugaugu

SEQ ID NO: 1360642 - RNA, 16 nt, Homo sapiens
uacaguucugucauau

SEQ ID NO: 1360643 - RNA, 16 nt, Homo sapiens
uacauacagaauuacu

SEQ ID NO: 1360644 - RNA, 18 nt, Homo sapiens
uacaugccccguuuuuga

SEQ ID NO: 1360645 - RNA, 16 nt, Homo sapiens
uacauguaauuugaug

SEQ ID NO: 1360646 - RNA, 14 nt, Homo sapiens
uacauuucugcaga

SEQ ID NO: 1360647 - RNA, 23 nt, Homo sapiens
uaccaccaagggaucugccauug

SEQ ID NO: 1360648 - RNA, 22 nt, Homo sapiens
uaccagagccuucaagugccaa

SEQ ID NO: 1360649 - RNA, 20 nt, Homo sapiens
uaccaggcacgucugcagaa

SEQ ID NO: 1360650 - RNA, 22 nt, Homo sapiens
uaccagguggcaaaguacuugu

SEQ ID NO: 1360651 - RNA, 23 nt, Homo sapiens
uaccauggguguggauggcagug

SEQ ID NO: 1360652 - RNA, 20 nt, Homo sapiens
uaccauugaaacaugccacu

SEQ ID NO: 1360653 - RNA, 12 nt, Homo sapiens
uaccucacuuuu

SEQ ID NO: 1360654 - RNA, 12 nt, Homo sapiens
uaccucugagaa

SEQ ID NO: 1360655 - RNA, 20 nt, Homo sapiens
uacgguggucggugggaccc

SEQ ID NO: 1360656 - RNA, 15 nt, Homo sapiens
uacuaucaugucaaa

SEQ ID NO: 1360657 - RNA, 23 nt, Homo sapiens
uacucagauaagguaaaaugcca

SEQ ID NO: 1360658 - RNA, 17 nt, Homo sapiens
uacuccaggagacccac

SEQ ID NO: 1360659 - RNA, 20 nt, Homo sapiens
uacucgggaggcugaggcag

SEQ ID NO: 1360660 - RNA, 22 nt, Homo sapiens
uacugcaagguucaacuuauua

SEQ ID NO: 1360661 - RNA, 13 nt, Homo sapiens
uacugcacuuaga

SEQ ID NO: 1360662 - RNA, 19 nt, Homo sapiens
uacugcugagauacauaca

SEQ ID NO: 1360663 - RNA, 16 nt, Homo sapiens
uacuuagauacuaaua

SEQ ID NO: 1360664 - RNA, 20 nt, Homo sapiens
uacuucagucuugaugcagu

SEQ ID NO: 1360665 - RNA, 19 nt, Homo sapiens
uacuucauuuucagaguga

SEQ ID NO: 1360666 - RNA, 19 nt, Homo sapiens
uacuucucgccaucagcuu

SEQ ID NO: 1360667 - RNA, 23 nt, Homo sapiens
uacuugaaggucuaggugcuuua

SEQ ID NO: 1360668 - RNA, 19 nt, Homo sapiens
uacuugucauagacuccuu

SEQ ID NO: 1360669 - RNA, 22 nt, Homo sapiens
uacuuugcaauccaaauaaaga

SEQ ID NO: 1360670 - RNA, 20 nt, Homo sapiens
uagaaaauaaaacugagcua

SEQ ID NO: 1360671 - RNA, 15 nt, Homo sapiens
uagaaaauuaaauga

SEQ ID NO: 1360672 - RNA, 20 nt, Homo sapiens
uagaaacuaagagaaugaua

SEQ ID NO: 1360673 - RNA, 14 nt, Homo sapiens
uagaagcacuacac

SEQ ID NO: 1360674 - RNA, 22 nt, Homo sapiens
uagaagggccaguccugccugg

SEQ ID NO: 1360675 - RNA, 17 nt, Homo sapiens
uagaagggucacuuuaa

SEQ ID NO: 1360676 - RNA, 20 nt, Homo sapiens
uagaauaaucuugcucacag

SEQ ID NO: 1360677 - RNA, 22 nt, Homo sapiens
uagaccuccacacccgugagaa

SEQ ID NO: 1360678 - RNA, 24 nt, Homo sapiens
uagacuccuuugcuaaugcuaugc

SEQ ID NO: 1360679 - RNA, 18 nt, Homo sapiens
uagagaggacaauacugg

SEQ ID NO: 1360680 - RNA, 16 nt, Homo sapiens
uagagggggucucaga

SEQ ID NO: 1360681 - RNA, 16 nt, Homo sapiens
uagaguucagacuuuu

SEQ ID NO: 1360682 - RNA, 21 nt, Homo sapiens
uagaucccauagugugcauca

SEQ ID NO: 1360683 - RNA, 11 nt, Homo sapiens
uagaucuggca

SEQ ID NO: 1360684 - RNA, 17 nt, Homo sapiens
uagauucaucaccuuag

SEQ ID NO: 1360685 - RNA, 21 nt, Homo sapiens
uagauuucuauaggauuuuuc

SEQ ID NO: 1360686 - RNA, 23 nt, Homo sapiens
uagauuuuagacccuauugcugc

SEQ ID NO: 1360687 - RNA, 21 nt, Homo sapiens
uagcaacuuguguuacaaaaa

SEQ ID NO: 1360688 - RNA, 22 nt, Homo sapiens
uagcagcagggagggcuucugc

SEQ ID NO: 1360689 - RNA, 14 nt, Homo sapiens
uagcaugcugugau

SEQ ID NO: 1360690 - RNA, 21 nt, Homo sapiens
uagccagauuugucuuuuugu

SEQ ID NO: 1360691 - RNA, 22 nt, Homo sapiens
uagccagccccucuuccccaau

SEQ ID NO: 1360692 - RNA, 14 nt, Homo sapiens
uagcuaacagugaa

SEQ ID NO: 1360693 - RNA, 20 nt, Homo sapiens
uagcucuaggguauauaucc

SEQ ID NO: 1360694 - RNA, 12 nt, Homo sapiens
uaggcagggaag

SEQ ID NO: 1360695 - RNA, 14 nt, Homo sapiens
uaggcauuugcuga

SEQ ID NO: 1360696 - RNA, 15 nt, Homo sapiens
uaggcauuugcugaa

SEQ ID NO: 1360697 - RNA, 22 nt, Homo sapiens
uaggccuggggacggcuuuuac

SEQ ID NO: 1360698 - RNA, 19 nt, Homo sapiens
uaggccuuccagugcagga

SEQ ID NO: 1360699 - RNA, 23 nt, Homo sapiens
uagggaaugaacuagcuaugaaa

SEQ ID NO: 1360700 - RNA, 19 nt, Homo sapiens
uaggguaauugcugaggug

SEQ ID NO: 1360701 - RNA, 23 nt, Homo sapiens
uaguaauuuauugucugucuaca

SEQ ID NO: 1360702 - RNA, 14 nt, Homo sapiens
uaguauaaacucau

SEQ ID NO: 1360703 - RNA, 13 nt, Homo sapiens
uagucacaaagac

SEQ ID NO: 1360704 - RNA, 21 nt, Homo sapiens
uaguccgugcugacagcugcu

SEQ ID NO: 1360705 - RNA, 17 nt, Homo sapiens
uaguccuggaugacucg

SEQ ID NO: 1360706 - RNA, 23 nt, Homo sapiens
uagucucuacccaguagaugcca

SEQ ID NO: 1360707 - RNA, 13 nt, Homo sapiens
uagugaacuugaa

SEQ ID NO: 1360708 - RNA, 16 nt, Homo sapiens
uagugcuaguggauuu

SEQ ID NO: 1360709 - RNA, 14 nt, Homo sapiens
uaguucaugucugc

SEQ ID NO: 1360710 - RNA, 21 nt, Homo sapiens
uaguugggggcuguccagagc

SEQ ID NO: 1360711 - RNA, 16 nt, Homo sapiens
uauaaauaaauaccaa

SEQ ID NO: 1360712 - RNA, 19 nt, Homo sapiens
uauaaauagaugcugugua

SEQ ID NO: 1360713 - RNA, 23 nt, Homo sapiens
uauaaauuauucaguaacuguca

SEQ ID NO: 1360714 - RNA, 18 nt, Homo sapiens
uauaacuauguugauaaa

SEQ ID NO: 1360715 - RNA, 13 nt, Homo sapiens
uauaacuguuguc

SEQ ID NO: 1360716 - RNA, 23 nt, Homo sapiens
uauacaauaaagucuuaccucag

SEQ ID NO: 1360717 - RNA, 18 nt, Homo sapiens
uauaccagguuaccucac

SEQ ID NO: 1360718 - RNA, 12 nt, Homo sapiens
uauauacauaua

SEQ ID NO: 1360719 - RNA, 12 nt, Homo sapiens
uauauacuuaag

SEQ ID NO: 1360720 - RNA, 22 nt, Homo sapiens
uauauccgccuggcauuucaca

SEQ ID NO: 1360721 - RNA, 12 nt, Homo sapiens
uauaugcaauau

SEQ ID NO: 1360722 - RNA, 16 nt, Homo sapiens
uauauguugaaugaca

SEQ ID NO: 1360723 - RNA, 12 nt, Homo sapiens
uauauuucacau

SEQ ID NO: 1360724 - RNA, 19 nt, Homo sapiens
uaucaaaugaauaaauccu

SEQ ID NO: 1360725 - RNA, 19 nt, Homo sapiens
uaucacagcggggaugcuu

SEQ ID NO: 1360726 - RNA, 15 nt, Homo sapiens
uaucaggguauucca

SEQ ID NO: 1360727 - RNA, 20 nt, Homo sapiens
uaucauauuauuauccuccu

SEQ ID NO: 1360728 - RNA, 14 nt, Homo sapiens
uauccaacaugugc

SEQ ID NO: 1360729 - RNA, 20 nt, Homo sapiens
uauccaugccccaaguguua

SEQ ID NO: 1360730 - RNA, 13 nt, Homo sapiens
uauccucuugcca

SEQ ID NO: 1360731 - RNA, 14 nt, Homo sapiens
uauccuucuacuug

SEQ ID NO: 1360732 - RNA, 14 nt, Homo sapiens
uaucuaaaccauau

SEQ ID NO: 1360733 - RNA, 16 nt, Homo sapiens
uaucuugcaccccaaa

SEQ ID NO: 1360734 - RNA, 19 nt, Homo sapiens
uaucuugcaccccaaagcu

SEQ ID NO: 1360735 - RNA, 19 nt, Homo sapiens
uaugaaauuauaaucugug

SEQ ID NO: 1360736 - RNA, 12 nt, Homo sapiens
uaugcaaucuga

SEQ ID NO: 1360737 - RNA, 20 nt, Homo sapiens
uaugccuugguaaaaacugc

SEQ ID NO: 1360738 - RNA, 16 nt, Homo sapiens
uaugcuaccuacugau

SEQ ID NO: 1360739 - RNA, 18 nt, Homo sapiens
uauggaagaugugugaua

SEQ ID NO: 1360740 - RNA, 16 nt, Homo sapiens
uauggcacccaugcac

SEQ ID NO: 1360741 - RNA, 19 nt, Homo sapiens
uauggcagugucuuuccac

SEQ ID NO: 1360742 - RNA, 17 nt, Homo sapiens
uauggcucuacuuucag

SEQ ID NO: 1360743 - RNA, 19 nt, Homo sapiens
uauggcuuuuagcauuuau

SEQ ID NO: 1360744 - RNA, 16 nt, Homo sapiens
uauguaccaagaaucu

SEQ ID NO: 1360745 - RNA, 18 nt, Homo sapiens
uauguaccaagaaucuug

SEQ ID NO: 1360746 - RNA, 19 nt, Homo sapiens
uauguaggagcugcaguuc

SEQ ID NO: 1360747 - RNA, 20 nt, Homo sapiens
uaugucacccaaugcauauc

SEQ ID NO: 1360748 - RNA, 23 nt, Homo sapiens
uaugucugugccauuucucaggg

SEQ ID NO: 1360749 - RNA, 19 nt, Homo sapiens
uaugugccuuucacuuuag

SEQ ID NO: 1360750 - RNA, 18 nt, Homo sapiens
uaugugugccagcugugu

SEQ ID NO: 1360751 - RNA, 16 nt, Homo sapiens
uauuaacaauuaggca

SEQ ID NO: 1360752 - RNA, 21 nt, Homo sapiens
uauuaacgcgacugaacuaca

SEQ ID NO: 1360753 - RNA, 20 nt, Homo sapiens
uauuacaguuuaucuauggc

SEQ ID NO: 1360754 - RNA, 22 nt, Homo sapiens
uauuacaguuuaucuauggcac

SEQ ID NO: 1360755 - RNA, 21 nt, Homo sapiens
uauuauuugcagucauggaga

SEQ ID NO: 1360756 - RNA, 13 nt, Homo sapiens
uauucacuugagu

SEQ ID NO: 1360757 - RNA, 16 nt, Homo sapiens
uauuccaggaugcugc

SEQ ID NO: 1360758 - RNA, 18 nt, Homo sapiens
uauuccaggaugcugcug

SEQ ID NO: 1360759 - RNA, 13 nt, Homo sapiens
uauugugcauaga

SEQ ID NO: 1360760 - RNA, 16 nt, Homo sapiens
uauuuaagcaacaucu

SEQ ID NO: 1360761 - RNA, 13 nt, Homo sapiens
uauuuaccagacc

SEQ ID NO: 1360762 - RNA, 20 nt, Homo sapiens
uauuuagagacagagucuca

SEQ ID NO: 1360763 - RNA, 14 nt, Homo sapiens
uauuuauuggucag

SEQ ID NO: 1360764 - RNA, 12 nt, Homo sapiens
uauuucagaaau

SEQ ID NO: 1360765 - RNA, 19 nt, Homo sapiens
uauuucaggugaagcugga

SEQ ID NO: 1360766 - RNA, 22 nt, Homo sapiens
uauuugguucuccgugaugcug

SEQ ID NO: 1360767 - RNA, 17 nt, Homo sapiens
uauuuuauagagcagaa

SEQ ID NO: 1360768 - RNA, 13 nt, Homo sapiens
uauuuuaucucuu

SEQ ID NO: 1360769 - RNA, 12 nt, Homo sapiens
uauuuuccaaag

SEQ ID NO: 1360770 - RNA, 15 nt, Homo sapiens
uauuuuuucuugcaa

SEQ ID NO: 1360771 - RNA, 23 nt, Homo sapiens
uauuuuuuuucuuguauuuuucc

SEQ ID NO: 1360772 - RNA, 13 nt, Homo sapiens
ucaaaaauacuca

SEQ ID NO: 1360773 - RNA, 20 nt, Homo sapiens
ucaaaaauacucacauggcu

SEQ ID NO: 1360774 - RNA, 15 nt, Homo sapiens
ucaaaagcacuuugu

SEQ ID NO: 1360775 - RNA, 20 nt, Homo sapiens
ucaaaauaaaaaccaagaag

SEQ ID NO: 1360776 - RNA, 17 nt, Homo sapiens
ucaaagugacuauucag

SEQ ID NO: 1360777 - RNA, 12 nt, Homo sapiens
ucaaaugccuga

SEQ ID NO: 1360778 - RNA, 15 nt, Homo sapiens
ucaaggcugcaguga

SEQ ID NO: 1360779 - RNA, 21 nt, Homo sapiens
ucaagguucccucccacucua

SEQ ID NO: 1360780 - RNA, 16 nt, Homo sapiens
ucaaguaccaccaagg

SEQ ID NO: 1360781 - RNA, 20 nt, Homo sapiens
ucaaguaguguaucacagua

SEQ ID NO: 1360782 - RNA, 18 nt, Homo sapiens
ucaaguggacagugaaug

SEQ ID NO: 1360783 - RNA, 22 nt, Homo sapiens
ucaaguuggcuucuaaucaaag

SEQ ID NO: 1360784 - RNA, 12 nt, Homo sapiens
ucaaugcuauaa

SEQ ID NO: 1360785 - RNA, 13 nt, Homo sapiens
ucaaugggaccug

SEQ ID NO: 1360786 - RNA, 22 nt, Homo sapiens
ucaauuuaaaaucagacucuuu

SEQ ID NO: 1360787 - RNA, 14 nt, Homo sapiens
ucacacaaaggcau

SEQ ID NO: 1360788 - RNA, 22 nt, Homo sapiens
ucacacuccccuagggggagaa

SEQ ID NO: 1360789 - RNA, 12 nt, Homo sapiens
ucacacuguaag

SEQ ID NO: 1360790 - RNA, 21 nt, Homo sapiens
ucacagagauaauucuagcuu

SEQ ID NO: 1360791 - RNA, 18 nt, Homo sapiens
ucacauucgaguguuuca

SEQ ID NO: 1360792 - RNA, 14 nt, Homo sapiens
ucacauucuuggcu

SEQ ID NO: 1360793 - RNA, 19 nt, Homo sapiens
ucacauuguuugcugcuau

SEQ ID NO: 1360794 - RNA, 21 nt, Homo sapiens
ucacauuguuugcugcuauug

SEQ ID NO: 1360795 - RNA, 15 nt, Homo sapiens
ucaccacaaacugua

SEQ ID NO: 1360796 - RNA, 17 nt, Homo sapiens
ucaccacaaacuguaau

SEQ ID NO: 1360797 - RNA, 14 nt, Homo sapiens
ucacccaaugcaua

SEQ ID NO: 1360798 - RNA, 18 nt, Homo sapiens
ucaccuuggcaccagaca

SEQ ID NO: 1360799 - RNA, 22 nt, Homo sapiens
ucaccuuggcaccagacaccca

SEQ ID NO: 1360800 - RNA, 18 nt, Homo sapiens
ucacucuucaaaugccug

SEQ ID NO: 1360801 - RNA, 15 nt, Homo sapiens
ucacugccagugcag

SEQ ID NO: 1360802 - RNA, 19 nt, Homo sapiens
ucacugcucggaaggggaa

SEQ ID NO: 1360803 - RNA, 15 nt, Homo sapiens
ucacuuaaacuuuua

SEQ ID NO: 1360804 - RNA, 19 nt, Homo sapiens
ucagaaccucuuccccaga

SEQ ID NO: 1360805 - RNA, 17 nt, Homo sapiens
ucagaaccuugucccag

SEQ ID NO: 1360806 - RNA, 22 nt, Homo sapiens
ucagaagagguugggcuuccau

SEQ ID NO: 1360807 - RNA, 16 nt, Homo sapiens
ucagaagugcccuucc

SEQ ID NO: 1360808 - RNA, 13 nt, Homo sapiens
ucagagugccacu

SEQ ID NO: 1360809 - RNA, 15 nt, Homo sapiens
ucagauuuucuggac

SEQ ID NO: 1360810 - RNA, 13 nt, Homo sapiens
ucagcaaaccauu

SEQ ID NO: 1360811 - RNA, 21 nt, Homo sapiens
ucagcacugucccuugccuca

SEQ ID NO: 1360812 - RNA, 18 nt, Homo sapiens
ucagccuugccagagauc

SEQ ID NO: 1360813 - RNA, 21 nt, Homo sapiens
ucaggacacuaauacaccagg

SEQ ID NO: 1360814 - RNA, 16 nt, Homo sapiens
ucaggacagaugccac

SEQ ID NO: 1360815 - RNA, 14 nt, Homo sapiens
ucaggacucugaaa

SEQ ID NO: 1360816 - RNA, 19 nt, Homo sapiens
ucagggaaaaggguccagg

SEQ ID NO: 1360817 - RNA, 11 nt, Homo sapiens
ucagggucccc

SEQ ID NO: 1360818 - RNA, 23 nt, Homo sapiens
ucagggugggguggucucugaua

SEQ ID NO: 1360819 - RNA, 17 nt, Homo sapiens
ucaggucccaggccagc

SEQ ID NO: 1360820 - RNA, 16 nt, Homo sapiens
ucagguguugccaaau

SEQ ID NO: 1360821 - RNA, 22 nt, Homo sapiens
ucagguuugaggguuugcagaa

SEQ ID NO: 1360822 - RNA, 20 nt, Homo sapiens
ucaguaacugucaggcugaa

SEQ ID NO: 1360823 - RNA, 19 nt, Homo sapiens
ucaguaauaaaaccgguca

SEQ ID NO: 1360824 - RNA, 15 nt, Homo sapiens
ucaguuauuacaugu

SEQ ID NO: 1360825 - RNA, 12 nt, Homo sapiens
ucaguugcaaau

SEQ ID NO: 1360826 - RNA, 16 nt, Homo sapiens
ucaguuuuuuguuuua

SEQ ID NO: 1360827 - RNA, 16 nt, Homo sapiens
ucauaaagucuugccu

SEQ ID NO: 1360828 - RNA, 19 nt, Homo sapiens
ucauaauuucuucacucaa

SEQ ID NO: 1360829 - RNA, 18 nt, Homo sapiens
ucauccaaugcucaagaa

SEQ ID NO: 1360830 - RNA, 20 nt, Homo sapiens
ucauccacguccugucuguu

SEQ ID NO: 1360831 - RNA, 21 nt, Homo sapiens
ucauccgcaaauuuucuucca

SEQ ID NO: 1360832 - RNA, 14 nt, Homo sapiens
ucaucuuuguggau

SEQ ID NO: 1360833 - RNA, 12 nt, Homo sapiens
ucaugaugcuag

SEQ ID NO: 1360834 - RNA, 11 nt, Homo sapiens
ucaugcacugu

SEQ ID NO: 1360835 - RNA, 22 nt, Homo sapiens
ucaugcuggaaccugcaaaaaa

SEQ ID NO: 1360836 - RNA, 14 nt, Homo sapiens
ucaugcuucacuua

SEQ ID NO: 1360837 - RNA, 18 nt, Homo sapiens
ucaugguggguucagggg

SEQ ID NO: 1360838 - RNA, 14 nt, Homo sapiens
ucauguaaacauac

SEQ ID NO: 1360839 - RNA, 12 nt, Homo sapiens
ucauguuccuua

SEQ ID NO: 1360840 - RNA, 18 nt, Homo sapiens
ucauuccuuagauaccuu

SEQ ID NO: 1360841 - RNA, 18 nt, Homo sapiens
uccaaacauuaaugcaau

SEQ ID NO: 1360842 - RNA, 16 nt, Homo sapiens
uccaaaugcccagcuu

SEQ ID NO: 1360843 - RNA, 16 nt, Homo sapiens
uccaacaugugcucag

SEQ ID NO: 1360844 - RNA, 20 nt, Homo sapiens
uccaacaugugcucagggaa

SEQ ID NO: 1360845 - RNA, 22 nt, Homo sapiens
uccaaugcugaaugccuguuag

SEQ ID NO: 1360846 - RNA, 22 nt, Homo sapiens
uccaauuuuaauuuaguaaaug

SEQ ID NO: 1360847 - RNA, 14 nt, Homo sapiens
uccacagauuauca

SEQ ID NO: 1360848 - RNA, 18 nt, Homo sapiens
uccagcuccaaccugcaa

SEQ ID NO: 1360849 - RNA, 15 nt, Homo sapiens
uccaggaaacaugaa

SEQ ID NO: 1360850 - RNA, 16 nt, Homo sapiens
uccaggaucuuugacu

SEQ ID NO: 1360851 - RNA, 16 nt, Homo sapiens
uccaggccaaagugcc

SEQ ID NO: 1360852 - RNA, 19 nt, Homo sapiens
uccagggaauggagcucag

SEQ ID NO: 1360853 - RNA, 18 nt, Homo sapiens
uccagggucccucugugu

SEQ ID NO: 1360854 - RNA, 12 nt, Homo sapiens
uccaggugcaga

SEQ ID NO: 1360855 - RNA, 21 nt, Homo sapiens
uccagguuuccuuaagggaca

SEQ ID NO: 1360856 - RNA, 16 nt, Homo sapiens
uccaucauuaauguga

SEQ ID NO: 1360857 - RNA, 20 nt, Homo sapiens
uccauccuuuacguguuuaa

SEQ ID NO: 1360858 - RNA, 16 nt, Homo sapiens
uccaucucugacuuaa

SEQ ID NO: 1360859 - RNA, 18 nt, Homo sapiens
uccaugggaccacaacua

SEQ ID NO: 1360860 - RNA, 15 nt, Homo sapiens
ucccaaaccagacac

SEQ ID NO: 1360861 - RNA, 18 nt, Homo sapiens
ucccaaguagaaucucag

SEQ ID NO: 1360862 - RNA, 22 nt, Homo sapiens
ucccaauuucagacucccauuc

SEQ ID NO: 1360863 - RNA, 22 nt, Homo sapiens
ucccacccugagauugggcaug

SEQ ID NO: 1360864 - RNA, 15 nt, Homo sapiens
ucccacucaagccaa

SEQ ID NO: 1360865 - RNA, 15 nt, Homo sapiens
ucccagcuacucggg

SEQ ID NO: 1360866 - RNA, 18 nt, Homo sapiens
ucccaggcccagugcagu

SEQ ID NO: 1360867 - RNA, 20 nt, Homo sapiens
ucccaggcuggagugcagug

SEQ ID NO: 1360868 - RNA, 9 nt, Homo sapiens
ucccagugc

SEQ ID NO: 1360869 - RNA, 20 nt, Homo sapiens
ucccauaauugcuuugccaa

SEQ ID NO: 1360870 - RNA, 21 nt, Homo sapiens
ucccauaauugcuuugccaaa

SEQ ID NO: 1360871 - RNA, 14 nt, Homo sapiens
ucccauccuugaug

SEQ ID NO: 1360872 - RNA, 21 nt, Homo sapiens
uccccagcccagagacauacu

SEQ ID NO: 1360873 - RNA, 12 nt, Homo sapiens
uccccaucucag

SEQ ID NO: 1360874 - RNA, 17 nt, Homo sapiens
ucccccagcagccuggg

SEQ ID NO: 1360875 - RNA, 15 nt, Homo sapiens
ucccccuucacaaag

SEQ ID NO: 1360876 - RNA, 19 nt, Homo sapiens
uccccucccuggcucccau

SEQ ID NO: 1360877 - RNA, 20 nt, Homo sapiens
uccccuccguggcaucaccu

SEQ ID NO: 1360878 - RNA, 22 nt, Homo sapiens
ucccuaggaaacucacacuccc

SEQ ID NO: 1360879 - RNA, 21 nt, Homo sapiens
ucccucucaugacuugcaggg

SEQ ID NO: 1360880 - RNA, 19 nt, Homo sapiens
ucccuggggaaaacuugca

SEQ ID NO: 1360881 - RNA, 22 nt, Homo sapiens
ucccuguacaguagauuuucca

SEQ ID NO: 1360882 - RNA, 16 nt, Homo sapiens
ucccuuggccucagaa

SEQ ID NO: 1360883 - RNA, 13 nt, Homo sapiens
ucccuuucuuccc

SEQ ID NO: 1360884 - RNA, 19 nt, Homo sapiens
uccgagaggugggccaguc

SEQ ID NO: 1360885 - RNA, 17 nt, Homo sapiens
uccgagugggauuuucu

SEQ ID NO: 1360886 - RNA, 22 nt, Homo sapiens
uccgcugcgucugcacugauga

SEQ ID NO: 1360887 - RNA, 17 nt, Homo sapiens
uccggccucugccuuug

SEQ ID NO: 1360888 - RNA, 13 nt, Homo sapiens
uccuacacuugag

SEQ ID NO: 1360889 - RNA, 18 nt, Homo sapiens
uccuaucuuuacaucuau

SEQ ID NO: 1360890 - RNA, 19 nt, Homo sapiens
uccuaugcuuugaaacaga

SEQ ID NO: 1360891 - RNA, 12 nt, Homo sapiens
uccuccaacagc

SEQ ID NO: 1360892 - RNA, 12 nt, Homo sapiens
uccucccaacaa

SEQ ID NO: 1360893 - RNA, 19 nt, Homo sapiens
uccuccugcccaccuguca

SEQ ID NO: 1360894 - RNA, 23 nt, Homo sapiens
uccuccuguucugaaaccuuagu

SEQ ID NO: 1360895 - RNA, 14 nt, Homo sapiens
uccucucccaguga

SEQ ID NO: 1360896 - RNA, 19 nt, Homo sapiens
uccugacuuuuaaugucau

SEQ ID NO: 1360897 - RNA, 16 nt, Homo sapiens
uccugcaacucaagga

SEQ ID NO: 1360898 - RNA, 21 nt, Homo sapiens
uccuggcccuccacuccucau

SEQ ID NO: 1360899 - RNA, 21 nt, Homo sapiens
uccugggcagcauacugagac

SEQ ID NO: 1360900 - RNA, 22 nt, Homo sapiens
uccuggguguggggacacaguc

SEQ ID NO: 1360901 - RNA, 12 nt, Homo sapiens
uccuuccauccc

SEQ ID NO: 1360902 - RNA, 18 nt, Homo sapiens
uccuucugagccugccuu

SEQ ID NO: 1360903 - RNA, 14 nt, Homo sapiens
uccuugacccuggg

SEQ ID NO: 1360904 - RNA, 19 nt, Homo sapiens
uccuugcugccaccugcuu

SEQ ID NO: 1360905 - RNA, 20 nt, Homo sapiens
uccuuggagggacaugacua

SEQ ID NO: 1360906 - RNA, 22 nt, Homo sapiens
uccuugggaggccccacugggg

SEQ ID NO: 1360907 - RNA, 15 nt, Homo sapiens
ucgaaacugccauug

SEQ ID NO: 1360908 - RNA, 17 nt, Homo sapiens
ucgaaucucugugccuu

SEQ ID NO: 1360909 - RNA, 13 nt, Homo sapiens
ucgaccaaaagga

SEQ ID NO: 1360910 - RNA, 19 nt, Homo sapiens
ucgacgaggaggagugcau

SEQ ID NO: 1360911 - RNA, 21 nt, Homo sapiens
ucgagccacaaccgaccagau

SEQ ID NO: 1360912 - RNA, 21 nt, Homo sapiens
ucgcaacuguccacgcgugcc

SEQ ID NO: 1360913 - RNA, 13 nt, Homo sapiens
ucgcuucuugccu

SEQ ID NO: 1360914 - RNA, 15 nt, Homo sapiens
ucggcugaccaugcu

SEQ ID NO: 1360915 - RNA, 12 nt, Homo sapiens
ucggugggaccc

SEQ ID NO: 1360916 - RNA, 19 nt, Homo sapiens
ucguuugaaucacaguaua

SEQ ID NO: 1360917 - RNA, 22 nt, Homo sapiens
ucuaaaaacaguuaagacaaca

SEQ ID NO: 1360918 - RNA, 17 nt, Homo sapiens
ucuaaaccauaugaaca

SEQ ID NO: 1360919 - RNA, 16 nt, Homo sapiens
ucuaaacuuuaauuca

SEQ ID NO: 1360920 - RNA, 17 nt, Homo sapiens
ucuaaauaccauucccu

SEQ ID NO: 1360921 - RNA, 15 nt, Homo sapiens
ucuaacuauuaucaa

SEQ ID NO: 1360922 - RNA, 17 nt, Homo sapiens
ucuaaguaaugaugucg

SEQ ID NO: 1360923 - RNA, 13 nt, Homo sapiens
ucuaauugcugug

SEQ ID NO: 1360924 - RNA, 14 nt, Homo sapiens
ucuacaggcauuua

SEQ ID NO: 1360925 - RNA, 15 nt, Homo sapiens
ucuacaggcauuuaa

SEQ ID NO: 1360926 - RNA, 20 nt, Homo sapiens
ucuacccaguagaugccacu

SEQ ID NO: 1360927 - RNA, 14 nt, Homo sapiens
ucuaggauggggca

SEQ ID NO: 1360928 - RNA, 19 nt, Homo sapiens
ucuaugaaauaucaugcuc

SEQ ID NO: 1360929 - RNA, 18 nt, Homo sapiens
ucuaugaguuggacuuca

SEQ ID NO: 1360930 - RNA, 16 nt, Homo sapiens
ucuauggcacccaugc

SEQ ID NO: 1360931 - RNA, 14 nt, Homo sapiens
ucucaacuuugaua

SEQ ID NO: 1360932 - RNA, 18 nt, Homo sapiens
ucucaaguuaucagggua

SEQ ID NO: 1360933 - RNA, 17 nt, Homo sapiens
ucucaaugaagccagcu

SEQ ID NO: 1360934 - RNA, 21 nt, Homo sapiens
ucucaccugggccuaucuucu

SEQ ID NO: 1360935 - RNA, 12 nt, Homo sapiens
ucucagaaccuu

SEQ ID NO: 1360936 - RNA, 16 nt, Homo sapiens
ucucagcucacuguga

SEQ ID NO: 1360937 - RNA, 14 nt, Homo sapiens
ucucaggacucuga

SEQ ID NO: 1360938 - RNA, 15 nt, Homo sapiens
ucucagguguugcca

SEQ ID NO: 1360939 - RNA, 13 nt, Homo sapiens
ucucaucaguucu

SEQ ID NO: 1360940 - RNA, 19 nt, Homo sapiens
ucucaugggaaggggagga

SEQ ID NO: 1360941 - RNA, 15 nt, Homo sapiens
ucuccaaaacuaaau

SEQ ID NO: 1360942 - RNA, 14 nt, Homo sapiens
ucuccacugugcuu

SEQ ID NO: 1360943 - RNA, 19 nt, Homo sapiens
ucucccaaaguguccuaag

SEQ ID NO: 1360944 - RNA, 15 nt, Homo sapiens
ucucccccuuuccaa

SEQ ID NO: 1360945 - RNA, 21 nt, Homo sapiens
ucuccuacuguagcaaccuga

SEQ ID NO: 1360946 - RNA, 12 nt, Homo sapiens
ucuccuacuuag

SEQ ID NO: 1360947 - RNA, 18 nt, Homo sapiens
ucuccugauggaagugua

SEQ ID NO: 1360948 - RNA, 16 nt, Homo sapiens
ucucuaacuccugcca

SEQ ID NO: 1360949 - RNA, 19 nt, Homo sapiens
ucucuaacuccugccauuc

SEQ ID NO: 1360950 - RNA, 13 nt, Homo sapiens
ucucuacccagua

SEQ ID NO: 1360951 - RNA, 16 nt, Homo sapiens
ucucuacccaguagau

SEQ ID NO: 1360952 - RNA, 17 nt, Homo sapiens
ucucugagaucaugagu

SEQ ID NO: 1360953 - RNA, 23 nt, Homo sapiens
ucucugauagguagcauuuucca

SEQ ID NO: 1360954 - RNA, 23 nt, Homo sapiens
ucucuucccugcgccugugaugc

SEQ ID NO: 1360955 - RNA, 19 nt, Homo sapiens
ucugaaaauuaacacugcu

SEQ ID NO: 1360956 - RNA, 20 nt, Homo sapiens
ucugaaagggcacaguguca

SEQ ID NO: 1360957 - RNA, 12 nt, Homo sapiens
ucugacccagug

SEQ ID NO: 1360958 - RNA, 22 nt, Homo sapiens
ucugacccagugcccccacuga

SEQ ID NO: 1360959 - RNA, 15 nt, Homo sapiens
ucugagaagacacaa

SEQ ID NO: 1360960 - RNA, 20 nt, Homo sapiens
ucugagaagacacaagguga

SEQ ID NO: 1360961 - RNA, 23 nt, Homo sapiens
ucugagaagacacaaggugauuu

SEQ ID NO: 1360962 - RNA, 14 nt, Homo sapiens
ucugagaccaaagu

SEQ ID NO: 1360963 - RNA, 16 nt, Homo sapiens
ucugaggacgugguga

SEQ ID NO: 1360964 - RNA, 15 nt, Homo sapiens
ucugauaaugcucac

SEQ ID NO: 1360965 - RNA, 16 nt, Homo sapiens
ucugaugcaagcaaga

SEQ ID NO: 1360966 - RNA, 19 nt, Homo sapiens
ucugcucaaaacuuucaaa

SEQ ID NO: 1360967 - RNA, 10 nt, Homo sapiens
ucugcuccac

SEQ ID NO: 1360968 - RNA, 21 nt, Homo sapiens
ucuggccuguacccaguagau

SEQ ID NO: 1360969 - RNA, 22 nt, Homo sapiens
ucuggccuguacccaguagaug

SEQ ID NO: 1360970 - RNA, 17 nt, Homo sapiens
ucuggcuuagugccacc

SEQ ID NO: 1360971 - RNA, 21 nt, Homo sapiens
ucuggggggacccagugcaga

SEQ ID NO: 1360972 - RNA, 15 nt, Homo sapiens
ucugggugaccucac

SEQ ID NO: 1360973 - RNA, 18 nt, Homo sapiens
ucugucaugagcauuugu

SEQ ID NO: 1360974 - RNA, 18 nt, Homo sapiens
ucugucccacugcugcuu

SEQ ID NO: 1360975 - RNA, 19 nt, Homo sapiens
ucugucucauccaaaaagu

SEQ ID NO: 1360976 - RNA, 18 nt, Homo sapiens
ucugugacccaucuguag

SEQ ID NO: 1360977 - RNA, 14 nt, Homo sapiens
ucugugccccaugc

SEQ ID NO: 1360978 - RNA, 13 nt, Homo sapiens
ucugugcugugag

SEQ ID NO: 1360979 - RNA, 21 nt, Homo sapiens
ucuguggaucagagaugcacc

SEQ ID NO: 1360980 - RNA, 22 nt, Homo sapiens
ucuguuggcaggcuggccaguc

SEQ ID NO: 1360981 - RNA, 19 nt, Homo sapiens
ucuuaaaaaucuaugccua

SEQ ID NO: 1360982 - RNA, 21 nt, Homo sapiens
ucuuagcagcuuccagauuga

SEQ ID NO: 1360983 - RNA, 15 nt, Homo sapiens
ucuuauagaugcaaa

SEQ ID NO: 1360984 - RNA, 18 nt, Homo sapiens
ucuucaaagcaaagcucu

SEQ ID NO: 1360985 - RNA, 23 nt, Homo sapiens
ucuucaggcaccugaagugagaa

SEQ ID NO: 1360986 - RNA, 16 nt, Homo sapiens
ucuucaggccucccuc

SEQ ID NO: 1360987 - RNA, 21 nt, Homo sapiens
ucuucauaauuucuucacuca

SEQ ID NO: 1360988 - RNA, 14 nt, Homo sapiens
ucuuccaaaggcag

SEQ ID NO: 1360989 - RNA, 21 nt, Homo sapiens
ucuuccaacguggcccagaga

SEQ ID NO: 1360990 - RNA, 13 nt, Homo sapiens
ucuuccccagaua

SEQ ID NO: 1360991 - RNA, 15 nt, Homo sapiens
ucuucccuaccucag

SEQ ID NO: 1360992 - RNA, 18 nt, Homo sapiens
ucuucccuaccucaggca

SEQ ID NO: 1360993 - RNA, 23 nt, Homo sapiens
ucuuccguggucagagugccacu

SEQ ID NO: 1360994 - RNA, 13 nt, Homo sapiens
ucuuccugaggaa

SEQ ID NO: 1360995 - RNA, 14 nt, Homo sapiens
ucuucucuacucua

SEQ ID NO: 1360996 - RNA, 18 nt, Homo sapiens
ucuucucuguuauuccug

SEQ ID NO: 1360997 - RNA, 19 nt, Homo sapiens
ucuucuggacugguuuuca

SEQ ID NO: 1360998 - RNA, 21 nt, Homo sapiens
ucuucuuggggcccagugcau

SEQ ID NO: 1360999 - RNA, 24 nt, Homo sapiens
ucuucuuugcccacaaugcuuugc

SEQ ID NO: 1361000 - RNA, 14 nt, Homo sapiens
ucuugaaggugcug

SEQ ID NO: 1361001 - RNA, 13 nt, Homo sapiens
ucuugaauagucu

SEQ ID NO: 1361002 - RNA, 15 nt, Homo sapiens
ucuugaauagucuca

SEQ ID NO: 1361003 - RNA, 23 nt, Homo sapiens
ucuugaauguaguauucaaugau

SEQ ID NO: 1361004 - RNA, 16 nt, Homo sapiens
ucuuggccuaaaccuc

SEQ ID NO: 1361005 - RNA, 18 nt, Homo sapiens
ucuuggggcccagugcau

SEQ ID NO: 1361006 - RNA, 20 nt, Homo sapiens
ucuuucacauuguuugcugc

SEQ ID NO: 1361007 - RNA, 21 nt, Homo sapiens
ucuuucaggacucuaccucau

SEQ ID NO: 1361008 - RNA, 14 nt, Homo sapiens
ucuuugcaaaguau

SEQ ID NO: 1361009 - RNA, 17 nt, Homo sapiens
ucuuugccagucauuca

SEQ ID NO: 1361010 - RNA, 17 nt, Homo sapiens
ucuuuggaaauggcugu

SEQ ID NO: 1361011 - RNA, 13 nt, Homo sapiens
ugaaaaaugccuc

SEQ ID NO: 1361012 - RNA, 14 nt, Homo sapiens
ugaaaacaauguaa

SEQ ID NO: 1361013 - RNA, 18 nt, Homo sapiens
ugaaacaugccacuugaa

SEQ ID NO: 1361014 - RNA, 15 nt, Homo sapiens
ugaaagacuucacua

SEQ ID NO: 1361015 - RNA, 20 nt, Homo sapiens
ugaaauaaaauuacacagua

SEQ ID NO: 1361016 - RNA, 14 nt, Homo sapiens
ugaaauaccacaag

SEQ ID NO: 1361017 - RNA, 18 nt, Homo sapiens
ugaaauaccacaagccug

SEQ ID NO: 1361018 - RNA, 14 nt, Homo sapiens
ugaaauacucaggg

SEQ ID NO: 1361019 - RNA, 19 nt, Homo sapiens
ugaaauuaacucagacaca

SEQ ID NO: 1361020 - RNA, 19 nt, Homo sapiens
ugaaauuacggguaccuga

SEQ ID NO: 1361021 - RNA, 22 nt, Homo sapiens
ugaaauuguaagugaaguaaaa

SEQ ID NO: 1361022 - RNA, 13 nt, Homo sapiens
ugaacagguguuu

SEQ ID NO: 1361023 - RNA, 19 nt, Homo sapiens
ugaacaucgagaugccuga

SEQ ID NO: 1361024 - RNA, 16 nt, Homo sapiens
ugaacccaggcagcug

SEQ ID NO: 1361025 - RNA, 16 nt, Homo sapiens
ugaaccggcucccacc

SEQ ID NO: 1361026 - RNA, 24 nt, Homo sapiens
ugaacuaaauuuaagcuuaagcca

SEQ ID NO: 1361027 - RNA, 14 nt, Homo sapiens
ugaacugcagugau

SEQ ID NO: 1361028 - RNA, 16 nt, Homo sapiens
ugaagaaaagaccuuu

SEQ ID NO: 1361029 - RNA, 23 nt, Homo sapiens
ugaagaacugcaggcccuggccu

SEQ ID NO: 1361030 - RNA, 20 nt, Homo sapiens
ugaagauuucucugagauca

SEQ ID NO: 1361031 - RNA, 17 nt, Homo sapiens
ugaaggaaauaaugcaa

SEQ ID NO: 1361032 - RNA, 21 nt, Homo sapiens
ugaauaacauuuaaauuccac

SEQ ID NO: 1361033 - RNA, 22 nt, Homo sapiens
ugaauaacauuuaaauuccaca

SEQ ID NO: 1361034 - RNA, 16 nt, Homo sapiens
ugaauaauacaguauc

SEQ ID NO: 1361035 - RNA, 17 nt, Homo sapiens
ugaauauaaacacuaua

SEQ ID NO: 1361036 - RNA, 22 nt, Homo sapiens
ugaaucacaguauacgcuccau

SEQ ID NO: 1361037 - RNA, 17 nt, Homo sapiens
ugaaucuuggugucuac

SEQ ID NO: 1361038 - RNA, 18 nt, Homo sapiens
ugaaugaaaugccaauaa

SEQ ID NO: 1361039 - RNA, 22 nt, Homo sapiens
ugaauuuugggacuucuaccca

SEQ ID NO: 1361040 - RNA, 19 nt, Homo sapiens
ugacaaccaaaagucuuca

SEQ ID NO: 1361041 - RNA, 15 nt, Homo sapiens
ugacaagugccuuca

SEQ ID NO: 1361042 - RNA, 19 nt, Homo sapiens
ugacaccauuuuccugccu

SEQ ID NO: 1361043 - RNA, 17 nt, Homo sapiens
ugacaguugcagcccuu

SEQ ID NO: 1361044 - RNA, 18 nt, Homo sapiens
ugacaucagcaauacaga

SEQ ID NO: 1361045 - RNA, 21 nt, Homo sapiens
ugacauggagaccgugaccag

SEQ ID NO: 1361046 - RNA, 12 nt, Homo sapiens
ugacaugugcuu

SEQ ID NO: 1361047 - RNA, 14 nt, Homo sapiens
ugacaugugcuuug

SEQ ID NO: 1361048 - RNA, 15 nt, Homo sapiens
ugacauguggggcca

SEQ ID NO: 1361049 - RNA, 19 nt, Homo sapiens
ugaccaggggcccuaccug

SEQ ID NO: 1361050 - RNA, 14 nt, Homo sapiens
ugacgcaccugugg

SEQ ID NO: 1361051 - RNA, 22 nt, Homo sapiens
ugacggcagcugguucugcaau

SEQ ID NO: 1361052 - RNA, 17 nt, Homo sapiens
ugacugucaguugccaa

SEQ ID NO: 1361053 - RNA, 17 nt, Homo sapiens
ugacuuuagaaagcuga

SEQ ID NO: 1361054 - RNA, 15 nt, Homo sapiens
ugacuuuuaauguca

SEQ ID NO: 1361055 - RNA, 18 nt, Homo sapiens
ugagaaacucuacaugua

SEQ ID NO: 1361056 - RNA, 23 nt, Homo sapiens
ugagaaauuuacuacaguaguua

SEQ ID NO: 1361057 - RNA, 17 nt, Homo sapiens
ugagaacccuugcacua

SEQ ID NO: 1361058 - RNA, 23 nt, Homo sapiens
ugagaagauucaauuuaaaauca

SEQ ID NO: 1361059 - RNA, 16 nt, Homo sapiens
ugagaagugcacuuua

SEQ ID NO: 1361060 - RNA, 15 nt, Homo sapiens
ugagacagucuugcu

SEQ ID NO: 1361061 - RNA, 15 nt, Homo sapiens
ugagacucagugcag

SEQ ID NO: 1361062 - RNA, 20 nt, Homo sapiens
ugagaggaagggugggucug

SEQ ID NO: 1361063 - RNA, 23 nt, Homo sapiens
ugagaggagagagacuccagcug

SEQ ID NO: 1361064 - RNA, 19 nt, Homo sapiens
ugagauccugauagccugu

SEQ ID NO: 1361065 - RNA, 19 nt, Homo sapiens
ugagauuacagagaucuca

SEQ ID NO: 1361066 - RNA, 11 nt, Homo sapiens
ugagcacugac

SEQ ID NO: 1361067 - RNA, 17 nt, Homo sapiens
ugagcagugagcacuga

SEQ ID NO: 1361068 - RNA, 19 nt, Homo sapiens
ugagcagugagcacugaaa

SEQ ID NO: 1361069 - RNA, 13 nt, Homo sapiens
ugagccacugcac

SEQ ID NO: 1361070 - RNA, 13 nt, Homo sapiens
ugagcccagcuca

SEQ ID NO: 1361071 - RNA, 15 nt, Homo sapiens
ugagcugagugcuga

SEQ ID NO: 1361072 - RNA, 16 nt, Homo sapiens
ugagcugagugcugaa

SEQ ID NO: 1361073 - RNA, 16 nt, Homo sapiens
ugagcuggcugacuaa

SEQ ID NO: 1361074 - RNA, 19 nt, Homo sapiens
ugagcuggcugacuaagcc

SEQ ID NO: 1361075 - RNA, 16 nt, Homo sapiens
ugagcuucuuuagcua

SEQ ID NO: 1361076 - RNA, 20 nt, Homo sapiens
ugaggaagagaauaaauuaa

SEQ ID NO: 1361077 - RNA, 20 nt, Homo sapiens
ugaggaaggaagauuugaug

SEQ ID NO: 1361078 - RNA, 18 nt, Homo sapiens
ugaggagggcagcuggag

SEQ ID NO: 1361079 - RNA, 16 nt, Homo sapiens
ugaggcaaaguguagu

SEQ ID NO: 1361080 - RNA, 16 nt, Homo sapiens
ugaggggcacucgccg

SEQ ID NO: 1361081 - RNA, 19 nt, Homo sapiens
ugagguccacacugacaca

SEQ ID NO: 1361082 - RNA, 13 nt, Homo sapiens
ugaguaucuccuc

SEQ ID NO: 1361083 - RNA, 15 nt, Homo sapiens
ugagugggugaauaa

SEQ ID NO: 1361084 - RNA, 15 nt, Homo sapiens
ugaguggugccaaac

SEQ ID NO: 1361085 - RNA, 21 nt, Homo sapiens
ugaguugguguugacaugugc

SEQ ID NO: 1361086 - RNA, 18 nt, Homo sapiens
ugaguuucuuaacccuuu

SEQ ID NO: 1361087 - RNA, 19 nt, Homo sapiens
ugaguuuuuacaagaugua

SEQ ID NO: 1361088 - RNA, 14 nt, Homo sapiens
ugauagaaaugcca

SEQ ID NO: 1361089 - RNA, 23 nt, Homo sapiens
ugauagguuguuaaauacauuua

SEQ ID NO: 1361090 - RNA, 20 nt, Homo sapiens
ugauauauuccaccaggaua

SEQ ID NO: 1361091 - RNA, 22 nt, Homo sapiens
ugaucacaugugcccucugcca

SEQ ID NO: 1361092 - RNA, 23 nt, Homo sapiens
ugaucacaugugcccucugccag

SEQ ID NO: 1361093 - RNA, 17 nt, Homo sapiens
ugauccggggguccagg

SEQ ID NO: 1361094 - RNA, 19 nt, Homo sapiens
ugauccuaggcauuugcug

SEQ ID NO: 1361095 - RNA, 19 nt, Homo sapiens
ugaucucgaugcaggugga

SEQ ID NO: 1361096 - RNA, 18 nt, Homo sapiens
ugaugaaauguaaauacu

SEQ ID NO: 1361097 - RNA, 14 nt, Homo sapiens
ugaugcaggcagug

SEQ ID NO: 1361098 - RNA, 17 nt, Homo sapiens
ugaugcaguuucauagu

SEQ ID NO: 1361099 - RNA, 20 nt, Homo sapiens
ugaugcauagaucccauagu

SEQ ID NO: 1361100 - RNA, 23 nt, Homo sapiens
ugaugcucccuccccugcccugg

SEQ ID NO: 1361101 - RNA, 23 nt, Homo sapiens
ugaugguguggccuguggcuguc

SEQ ID NO: 1361102 - RNA, 15 nt, Homo sapiens
ugauuacugcucuau

SEQ ID NO: 1361103 - RNA, 16 nt, Homo sapiens
ugauucugucaauguc

SEQ ID NO: 1361104 - RNA, 21 nt, Homo sapiens
ugcaaaaaaaaaaaaagcaau

SEQ ID NO: 1361105 - RNA, 14 nt, Homo sapiens
ugcaaauaccuccu

SEQ ID NO: 1361106 - RNA, 14 nt, Homo sapiens
ugcaaaugacuguc

SEQ ID NO: 1361107 - RNA, 13 nt, Homo sapiens
ugcaacaacaugu

SEQ ID NO: 1361108 - RNA, 22 nt, Homo sapiens
ugcaaccuaccuguugagcauc

SEQ ID NO: 1361109 - RNA, 21 nt, Homo sapiens
ugcaacucaaggacuuugcag

SEQ ID NO: 1361110 - RNA, 15 nt, Homo sapiens
ugcaauguaagcaua

SEQ ID NO: 1361111 - RNA, 12 nt, Homo sapiens
ugcacagccacu

SEQ ID NO: 1361112 - RNA, 15 nt, Homo sapiens
ugcacauauuggcaa

SEQ ID NO: 1361113 - RNA, 21 nt, Homo sapiens
ugcacauccgcgugugccugu

SEQ ID NO: 1361114 - RNA, 21 nt, Homo sapiens
ugcagauuagcuaggggacag

SEQ ID NO: 1361115 - RNA, 18 nt, Homo sapiens
ugcagggcugggaagaag

SEQ ID NO: 1361116 - RNA, 18 nt, Homo sapiens
ugcaggguuucucgccac

SEQ ID NO: 1361117 - RNA, 18 nt, Homo sapiens
ugcaguucagcaccaccc

SEQ ID NO: 1361118 - RNA, 18 nt, Homo sapiens
ugcauaagugcaugacau

SEQ ID NO: 1361119 - RNA, 20 nt, Homo sapiens
ugcauauccaacaugugcuc

SEQ ID NO: 1361120 - RNA, 21 nt, Homo sapiens
ugcauauccaacaugugcuca

SEQ ID NO: 1361121 - RNA, 23 nt, Homo sapiens
ugcaucuguuuauucuauaguua

SEQ ID NO: 1361122 - RNA, 17 nt, Homo sapiens
ugcaucuuauuucuguc

SEQ ID NO: 1361123 - RNA, 18 nt, Homo sapiens
ugcaugcauugagcugcc

SEQ ID NO: 1361124 - RNA, 14 nt, Homo sapiens
ugcauugagcugcc

SEQ ID NO: 1361125 - RNA, 23 nt, Homo sapiens
ugcauuguaggauguugagcagc

SEQ ID NO: 1361126 - RNA, 19 nt, Homo sapiens
ugccaaaaaggauacauaa

SEQ ID NO: 1361127 - RNA, 22 nt, Homo sapiens
ugccaaaauaccagagccuuca

SEQ ID NO: 1361128 - RNA, 24 nt, Homo sapiens
ugccaaauaucuugauccuaugag

SEQ ID NO: 1361129 - RNA, 16 nt, Homo sapiens
ugccaaauauguccug

SEQ ID NO: 1361130 - RNA, 12 nt, Homo sapiens
ugccacccaguu

SEQ ID NO: 1361131 - RNA, 14 nt, Homo sapiens
ugccacugccuucg

SEQ ID NO: 1361132 - RNA, 17 nt, Homo sapiens
ugccagcugugugagaa

SEQ ID NO: 1361133 - RNA, 20 nt, Homo sapiens
ugccagcuuaucucaggggu

SEQ ID NO: 1361134 - RNA, 12 nt, Homo sapiens
ugccagugcaga

SEQ ID NO: 1361135 - RNA, 13 nt, Homo sapiens
ugccauaucagug

SEQ ID NO: 1361136 - RNA, 17 nt, Homo sapiens
ugccaucgcugugaugc

SEQ ID NO: 1361137 - RNA, 23 nt, Homo sapiens
ugccaugccagcuuaucucaggg

SEQ ID NO: 1361138 - RNA, 15 nt, Homo sapiens
ugccauugcacucca

SEQ ID NO: 1361139 - RNA, 15 nt, Homo sapiens
ugccauuucucaggg

SEQ ID NO: 1361140 - RNA, 17 nt, Homo sapiens
ugcccacguguccugag

SEQ ID NO: 1361141 - RNA, 19 nt, Homo sapiens
ugcccaggaaccucagggc

SEQ ID NO: 1361142 - RNA, 15 nt, Homo sapiens
ugcccaggcacugca

SEQ ID NO: 1361143 - RNA, 17 nt, Homo sapiens
ugccccucuuccaaagg

SEQ ID NO: 1361144 - RNA, 20 nt, Homo sapiens
ugccccugagacaaauggag

SEQ ID NO: 1361145 - RNA, 13 nt, Homo sapiens
ugcccucugccag

SEQ ID NO: 1361146 - RNA, 16 nt, Homo sapiens
ugccgucugugacauu

SEQ ID NO: 1361147 - RNA, 16 nt, Homo sapiens
ugccuagacuguuacu

SEQ ID NO: 1361148 - RNA, 18 nt, Homo sapiens
ugccuaucuucuuucaca

SEQ ID NO: 1361149 - RNA, 20 nt, Homo sapiens
ugccugauccuccaacagcu

SEQ ID NO: 1361150 - RNA, 16 nt, Homo sapiens
ugccuggcaggugugc

SEQ ID NO: 1361151 - RNA, 20 nt, Homo sapiens
ugccuggccaggcagaucug

SEQ ID NO: 1361152 - RNA, 17 nt, Homo sapiens
ugccuguuguuaugggu

SEQ ID NO: 1361153 - RNA, 15 nt, Homo sapiens
ugccuuagugugaaa

SEQ ID NO: 1361154 - RNA, 13 nt, Homo sapiens
ugcgucacuguga

SEQ ID NO: 1361155 - RNA, 23 nt, Homo sapiens
ugcuaaacgcacacaguaucuag

SEQ ID NO: 1361156 - RNA, 22 nt, Homo sapiens
ugcuaauccucuuuuucuaguc

SEQ ID NO: 1361157 - RNA, 17 nt, Homo sapiens
ugcuaaugcuaugcaaa

SEQ ID NO: 1361158 - RNA, 14 nt, Homo sapiens
ugcuauaucaguuu

SEQ ID NO: 1361159 - RNA, 19 nt, Homo sapiens
ugcucacugccagugcaga

SEQ ID NO: 1361160 - RNA, 13 nt, Homo sapiens
ugcuccauuucaa

SEQ ID NO: 1361161 - RNA, 18 nt, Homo sapiens
ugcucccccugguggugg

SEQ ID NO: 1361162 - RNA, 21 nt, Homo sapiens
ugcuccuagagggaggggccu

SEQ ID NO: 1361163 - RNA, 18 nt, Homo sapiens
ugcucucggugcuuccaa

SEQ ID NO: 1361164 - RNA, 14 nt, Homo sapiens
ugcucuguacugca

SEQ ID NO: 1361165 - RNA, 18 nt, Homo sapiens
ugcugaccuccacagcuu

SEQ ID NO: 1361166 - RNA, 12 nt, Homo sapiens
ugcugagcugcc

SEQ ID NO: 1361167 - RNA, 13 nt, Homo sapiens
ugcugagcugccc

SEQ ID NO: 1361168 - RNA, 23 nt, Homo sapiens
gaacaaaaacaaaacaccaggga

SEQ ID NO: 1361169 - RNA, 18 nt, Homo sapiens
gaacaucccugccagcuc

SEQ ID NO: 1361170 - RNA, 18 nt, Homo sapiens
gaaccaggcaacuuggga

SEQ ID NO: 1361171 - RNA, 14 nt, Homo sapiens
gaacccuugcacua

SEQ ID NO: 1361172 - RNA, 20 nt, Homo sapiens
gaaccuggaccccagccuug

SEQ ID NO: 1361173 - RNA, 19 nt, Homo sapiens
gaaccuugucccagccagu

SEQ ID NO: 1361174 - RNA, 21 nt, Homo sapiens
gaaccuugucccagccaguga

SEQ ID NO: 1361175 - RNA, 17 nt, Homo sapiens
gaacuaaaaagagacug

SEQ ID NO: 1361176 - RNA, 23 nt, Homo sapiens
gaacuaaaaagagacugugccau

SEQ ID NO: 1361177 - RNA, 20 nt, Homo sapiens
gaacuccccuugaaaacugc

SEQ ID NO: 1361178 - RNA, 11 nt, Homo sapiens
gaacuguuaca

SEQ ID NO: 1361179 - RNA, 20 nt, Homo sapiens
gaagaaagagcaacaaucca

SEQ ID NO: 1361180 - RNA, 13 nt, Homo sapiens
gaagacaauguga

SEQ ID NO: 1361181 - RNA, 19 nt, Homo sapiens
gaagacacuugcugaguga

SEQ ID NO: 1361182 - RNA, 18 nt, Homo sapiens
gaagacuuuuguuaugag

SEQ ID NO: 1361183 - RNA, 16 nt, Homo sapiens
gaagagaaugugacag

SEQ ID NO: 1361184 - RNA, 14 nt, Homo sapiens
gaagagcuuggaaa

SEQ ID NO: 1361185 - RNA, 21 nt, Homo sapiens
gaagaugcagucucugcugau

SEQ ID NO: 1361186 - RNA, 23 nt, Homo sapiens
gaagcagggaauuccugggguaa

SEQ ID NO: 1361187 - RNA, 22 nt, Homo sapiens
gaagcucccugaaguaagcaaa

SEQ ID NO: 1361188 - RNA, 20 nt, Homo sapiens
gaagcuuuggugagaaccug

SEQ ID NO: 1361189 - RNA, 15 nt, Homo sapiens
gaaggaaauaaugca

SEQ ID NO: 1361190 - RNA, 22 nt, Homo sapiens
gaaggguucaccaggucaggga

SEQ ID NO: 1361191 - RNA, 19 nt, Homo sapiens
gaaggugaaagugcaguuc

SEQ ID NO: 1361192 - RNA, 20 nt, Homo sapiens
gaagguucuacgccagggga

SEQ ID NO: 1361193 - RNA, 16 nt, Homo sapiens
gaagucugucucagga

SEQ ID NO: 1361194 - RNA, 16 nt, Homo sapiens
gaagugagaacccagc

SEQ ID NO: 1361195 - RNA, 22 nt, Homo sapiens
gaaguggagagggugucaucua

SEQ ID NO: 1361196 - RNA, 16 nt, Homo sapiens
gaaguuaugcugucau

SEQ ID NO: 1361197 - RNA, 22 nt, Homo sapiens
gaauaaaacguuaguuaauccc

SEQ ID NO: 1361198 - RNA, 12 nt, Homo sapiens
gaauaaagccuc

SEQ ID NO: 1361199 - RNA, 21 nt, Homo sapiens
gaauaacauuuaaauuccaca

SEQ ID NO: 1361200 - RNA, 19 nt, Homo sapiens
gaauaaguaccuuuguguc

SEQ ID NO: 1361201 - RNA, 20 nt, Homo sapiens
gaaucaggaauauuuuccaa

SEQ ID NO: 1361202 - RNA, 23 nt, Homo sapiens
gaauccuuuggugccaacuggug

SEQ ID NO: 1361203 - RNA, 22 nt, Homo sapiens
gaaucggcuuugcagugcacuu

SEQ ID NO: 1361204 - RNA, 15 nt, Homo sapiens
gaaucucugugccuu

SEQ ID NO: 1361205 - RNA, 13 nt, Homo sapiens
gaaugaacacucc

SEQ ID NO: 1361206 - RNA, 12 nt, Homo sapiens
gaaugcggccca

SEQ ID NO: 1361207 - RNA, 17 nt, Homo sapiens
gaauggagcucaggucc

SEQ ID NO: 1361208 - RNA, 19 nt, Homo sapiens
gaauggggugcaugaaggu

SEQ ID NO: 1361209 - RNA, 22 nt, Homo sapiens
gaauguuaauuuuuugguacaa

SEQ ID NO: 1361210 - RNA, 23 nt, Homo sapiens
gaauuaaguuagggaauggcaca

SEQ ID NO: 1361211 - RNA, 14 nt, Homo sapiens
gaauucuaagugaa

SEQ ID NO: 1361212 - RNA, 12 nt, Homo sapiens
gaauuguuacau

SEQ ID NO: 1361213 - RNA, 13 nt, Homo sapiens
gaauuguuuagaa

SEQ ID NO: 1361214 - RNA, 13 nt, Homo sapiens
gaauuugaggcag

SEQ ID NO: 1361215 - RNA, 21 nt, Homo sapiens
gaauuuugggacuucuaccca

SEQ ID NO: 1361216 - RNA, 22 nt, Homo sapiens
gaauuuuuacuuagauacuaau

SEQ ID NO: 1361217 - RNA, 22 nt, Homo sapiens
gacaaacagccucacuccucag

SEQ ID NO: 1361218 - RNA, 15 nt, Homo sapiens
gacaaacagugcacu

SEQ ID NO: 1361219 - RNA, 22 nt, Homo sapiens
gacaagcauggaaaaucaguga

SEQ ID NO: 1361220 - RNA, 17 nt, Homo sapiens
gacacauccaucuugca

SEQ ID NO: 1361221 - RNA, 17 nt, Homo sapiens
gacagacaggcucuuag

SEQ ID NO: 1361222 - RNA, 15 nt, Homo sapiens
gacagagcaagugag

SEQ ID NO: 1361223 - RNA, 23 nt, Homo sapiens
gacagaugaggcuuuccauggga

SEQ ID NO: 1361224 - RNA, 23 nt, Homo sapiens
gacaggcacagaugaaugggagu

SEQ ID NO: 1361225 - RNA, 13 nt, Homo sapiens
gacaggcucuuag

SEQ ID NO: 1361226 - RNA, 16 nt, Homo sapiens
gacauguggggccagg

SEQ ID NO: 1361227 - RNA, 15 nt, Homo sapiens
gacauuuccaagcug

SEQ ID NO: 1361228 - RNA, 15 nt, Homo sapiens
gaccaaaucacccaa

SEQ ID NO: 1361229 - RNA, 23 nt, Homo sapiens
gacccacggagcccuuaugacau

SEQ ID NO: 1361230 - RNA, 14 nt, Homo sapiens
gacccuauugcugc

SEQ ID NO: 1361231 - RNA, 15 nt, Homo sapiens
gacccuucccuugag

SEQ ID NO: 1361232 - RNA, 16 nt, Homo sapiens
gaccuaggcucaugga

SEQ ID NO: 1361233 - RNA, 21 nt, Homo sapiens
gaccuguuuaugagaugcugg

SEQ ID NO: 1361234 - RNA, 14 nt, Homo sapiens
gacgacaagugcug

SEQ ID NO: 1361235 - RNA, 17 nt, Homo sapiens
gacgacaagugcugaac

SEQ ID NO: 1361236 - RNA, 18 nt, Homo sapiens
gacgaggaggagugcaug

SEQ ID NO: 1361237 - RNA, 22 nt, Homo sapiens
gacgagugcuuccgcugcggug

SEQ ID NO: 1361238 - RNA, 13 nt, Homo sapiens
gacgccacucuga

SEQ ID NO: 1361239 - RNA, 16 nt, Homo sapiens
gacguggguugcacug

SEQ ID NO: 1361240 - RNA, 19 nt, Homo sapiens
gacgugugagggaggacag

SEQ ID NO: 1361241 - RNA, 22 nt, Homo sapiens
gacuaagccccgucugacccca

SEQ ID NO: 1361242 - RNA, 18 nt, Homo sapiens
gacucauggccgggcuga

SEQ ID NO: 1361243 - RNA, 17 nt, Homo sapiens
gacucuuuggacacuca

SEQ ID NO: 1361244 - RNA, 13 nt, Homo sapiens
gacugccaaaaag

SEQ ID NO: 1361245 - RNA, 13 nt, Homo sapiens
gacugcuaccucu

SEQ ID NO: 1361246 - RNA, 17 nt, Homo sapiens
gacugcuaccucugaga

SEQ ID NO: 1361247 - RNA, 14 nt, Homo sapiens
gacugcuaccuuuc

SEQ ID NO: 1361248 - RNA, 22 nt, Homo sapiens
gacuggcagcauugacucugug

SEQ ID NO: 1361249 - RNA, 23 nt, Homo sapiens
gacuguggacguggguugcacug

SEQ ID NO: 1361250 - RNA, 23 nt, Homo sapiens
gacuucacuaaaaugaccaggau

SEQ ID NO: 1361251 - RNA, 16 nt, Homo sapiens
gacuucagucuugccu

SEQ ID NO: 1361252 - RNA, 13 nt, Homo sapiens
gacuuccugaaca

SEQ ID NO: 1361253 - RNA, 16 nt, Homo sapiens
gacuugucaagccugu

SEQ ID NO: 1361254 - RNA, 15 nt, Homo sapiens
gacuuugagcugagu

SEQ ID NO: 1361255 - RNA, 21 nt, Homo sapiens
gacuuugagcugagugcugaa

SEQ ID NO: 1361256 - RNA, 20 nt, Homo sapiens
gagaacuccuaggguggcug

SEQ ID NO: 1361257 - RNA, 13 nt, Homo sapiens
gagaagcaccagc

SEQ ID NO: 1361258 - RNA, 22 nt, Homo sapiens
gagaauaaaacguuaguuaauc

SEQ ID NO: 1361259 - RNA, 11 nt, Homo sapiens
gagacacucca

SEQ ID NO: 1361260 - RNA, 23 nt, Homo sapiens
gagacauacuugaagggccagag

SEQ ID NO: 1361261 - RNA, 23 nt, Homo sapiens
gagacccccacaccucaguuccc

SEQ ID NO: 1361262 - RNA, 21 nt, Homo sapiens
gagacccugccuuuaaaaaca

SEQ ID NO: 1361263 - RNA, 16 nt, Homo sapiens
gagagcgccugccccu

SEQ ID NO: 1361264 - RNA, 22 nt, Homo sapiens
gagaggcccucuggaguggcca

SEQ ID NO: 1361265 - RNA, 19 nt, Homo sapiens
gagagugucuucacggcag

SEQ ID NO: 1361266 - RNA, 21 nt, Homo sapiens
gagaucaugccacuacacucc

SEQ ID NO: 1361267 - RNA, 21 nt, Homo sapiens
gagaucgugccauugcacucc

SEQ ID NO: 1361268 - RNA, 21 nt, Homo sapiens
gagaucuuaagauuccauuuu

SEQ ID NO: 1361269 - RNA, 18 nt, Homo sapiens
gagauuacagagaucuca

SEQ ID NO: 1361270 - RNA, 18 nt, Homo sapiens
gagcaagugagacccugu

SEQ ID NO: 1361271 - RNA, 21 nt, Homo sapiens
gagcacgggguagccggagaa

SEQ ID NO: 1361272 - RNA, 15 nt, Homo sapiens
gagcagccacaacca

SEQ ID NO: 1361273 - RNA, 19 nt, Homo sapiens
gagcagccacaaccaaaaa

SEQ ID NO: 1361274 - RNA, 17 nt, Homo sapiens
gagcagcccuuacagua

SEQ ID NO: 1361275 - RNA, 11 nt, Homo sapiens
uucaugcacug

SEQ ID NO: 1361276 - RNA, 23 nt, Homo sapiens
uucauuccuaaagaaaaauaucu

SEQ ID NO: 1361277 - RNA, 16 nt, Homo sapiens
uuccaaaaacuguuaa

SEQ ID NO: 1361278 - RNA, 16 nt, Homo sapiens
uuccaacguggcccag

SEQ ID NO: 1361279 - RNA, 19 nt, Homo sapiens
uuccacuucaggguucuaa

SEQ ID NO: 1361280 - RNA, 16 nt, Homo sapiens
uuccagcacuuugcaa

SEQ ID NO: 1361281 - RNA, 22 nt, Homo sapiens
uuccagcuuagaaugcaucuca

SEQ ID NO: 1361282 - RNA, 11 nt, Homo sapiens
uuccagugcag

SEQ ID NO: 1361283 - RNA, 13 nt, Homo sapiens
uuccauugauuca

SEQ ID NO: 1361284 - RNA, 17 nt, Homo sapiens
uucccuacaguugaaaa

SEQ ID NO: 1361285 - RNA, 22 nt, Homo sapiens
uucccuacaguugaaaaacagc

SEQ ID NO: 1361286 - RNA, 20 nt, Homo sapiens
uucccuggggaaaacuugca

SEQ ID NO: 1361287 - RNA, 15 nt, Homo sapiens
uuccguggucagagu

SEQ ID NO: 1361288 - RNA, 17 nt, Homo sapiens
uuccucccuucugcuac

SEQ ID NO: 1361289 - RNA, 16 nt, Homo sapiens
uuccucuggccaggua

SEQ ID NO: 1361290 - RNA, 19 nt, Homo sapiens
uuccugaguggugccaaac

SEQ ID NO: 1361291 - RNA, 21 nt, Homo sapiens
uuccugcaacucaaggacuuu

SEQ ID NO: 1361292 - RNA, 15 nt, Homo sapiens
uuccuguucaguaau

SEQ ID NO: 1361293 - RNA, 13 nt, Homo sapiens
uuccuucauuuca

SEQ ID NO: 1361294 - RNA, 16 nt, Homo sapiens
uucggacaacucaguc

SEQ ID NO: 1361295 - RNA, 22 nt, Homo sapiens
uucuaaaaacaguuaagacaac

SEQ ID NO: 1361296 - RNA, 13 nt, Homo sapiens
uucuaaucaaagc

SEQ ID NO: 1361297 - RNA, 21 nt, Homo sapiens
uucuaauucuucucaugcaua

SEQ ID NO: 1361298 - RNA, 17 nt, Homo sapiens
uucuaggaagcuccagu

SEQ ID NO: 1361299 - RNA, 23 nt, Homo sapiens
uucucaagcccugcagucacagc

SEQ ID NO: 1361300 - RNA, 12 nt, Homo sapiens
uucucaugcauu

SEQ ID NO: 1361301 - RNA, 19 nt, Homo sapiens
uucuccucucuaaaagugu

SEQ ID NO: 1361302 - RNA, 22 nt, Homo sapiens
uucuccuuggaggacaguggga

SEQ ID NO: 1361303 - RNA, 14 nt, Homo sapiens
uucucuccaccagg

SEQ ID NO: 1361304 - RNA, 12 nt, Homo sapiens
uucucugagauc

SEQ ID NO: 1361305 - RNA, 17 nt, Homo sapiens
uucucugcuccaccaca

SEQ ID NO: 1361306 - RNA, 12 nt, Homo sapiens
uucugaaagugu

SEQ ID NO: 1361307 - RNA, 16 nt, Homo sapiens
uucugaucugaugcaa

SEQ ID NO: 1361308 - RNA, 17 nt, Homo sapiens
uucuggaaguuucuggu

SEQ ID NO: 1361309 - RNA, 17 nt, Homo sapiens
uucugucaacuuguauu

SEQ ID NO: 1361310 - RNA, 15 nt, Homo sapiens
uucuguguugccaag

SEQ ID NO: 1361311 - RNA, 20 nt, Homo sapiens
uucuuagauacacuaaaaau

SEQ ID NO: 1361312 - RNA, 17 nt, Homo sapiens
uucuucacucaaucucu

SEQ ID NO: 1361313 - RNA, 18 nt, Homo sapiens
uucuuccuggauggggca

SEQ ID NO: 1361314 - RNA, 18 nt, Homo sapiens
uucuugccuugaguucca

SEQ ID NO: 1361315 - RNA, 16 nt, Homo sapiens
uucuuuaccaguuucu

SEQ ID NO: 1361316 - RNA, 22 nt, Homo sapiens
uugaaaaacuaaaacagaaaaa

SEQ ID NO: 1361317 - RNA, 12 nt, Homo sapiens
uugaaaguaaaa

SEQ ID NO: 1361318 - RNA, 16 nt, Homo sapiens
uugaaauagucugugu

SEQ ID NO: 1361319 - RNA, 17 nt, Homo sapiens
uugaaauuguaagugaa

SEQ ID NO: 1361320 - RNA, 19 nt, Homo sapiens
uugaagauuucucugagau

SEQ ID NO: 1361321 - RNA, 20 nt, Homo sapiens
uugaaggugcugacggccag

SEQ ID NO: 1361322 - RNA, 17 nt, Homo sapiens
uugaauaauaagcagga

SEQ ID NO: 1361323 - RNA, 16 nt, Homo sapiens
uugaauauaaacacua

SEQ ID NO: 1361324 - RNA, 23 nt, Homo sapiens
uugaauuguuacaucaugcugga

SEQ ID NO: 1361325 - RNA, 16 nt, Homo sapiens
uugacgcaccuguggu

SEQ ID NO: 1361326 - RNA, 15 nt, Homo sapiens
uugacucuccagaaa

SEQ ID NO: 1361327 - RNA, 22 nt, Homo sapiens
uugagcaguggcugguccaggg

SEQ ID NO: 1361328 - RNA, 18 nt, Homo sapiens
uugagcugagugcugaaa

SEQ ID NO: 1361329 - RNA, 19 nt, Homo sapiens
uugagcuuaagaauuuuga

SEQ ID NO: 1361330 - RNA, 14 nt, Homo sapiens
uugaggugagucag

SEQ ID NO: 1361331 - RNA, 20 nt, Homo sapiens
uugaguccagaaguuugaga

SEQ ID NO: 1361332 - RNA, 12 nt, Homo sapiens
uugauacaguca

SEQ ID NO: 1361333 - RNA, 22 nt, Homo sapiens
uugaucuggaacccagacucag

SEQ ID NO: 1361334 - RNA, 20 nt, Homo sapiens
uugauugcguggaauugugc

SEQ ID NO: 1361335 - RNA, 15 nt, Homo sapiens
uugcaaaaacuacaa

SEQ ID NO: 1361336 - RNA, 22 nt, Homo sapiens
uugcaccccaaagcuuuccugc

SEQ ID NO: 1361337 - RNA, 17 nt, Homo sapiens
uugcagauaacuuugac

SEQ ID NO: 1361338 - RNA, 16 nt, Homo sapiens
uugcagcaggugguaa

SEQ ID NO: 1361339 - RNA, 18 nt, Homo sapiens
uugcaggaccucagguga

SEQ ID NO: 1361340 - RNA, 20 nt, Homo sapiens
uugccagagaaacugaggua

SEQ ID NO: 1361341 - RNA, 16 nt, Homo sapiens
uugccaucccaaaaau

SEQ ID NO: 1361342 - RNA, 13 nt, Homo sapiens
uugcccagugugu

SEQ ID NO: 1361343 - RNA, 15 nt, Homo sapiens
uugccccugagacaa

SEQ ID NO: 1361344 - RNA, 11 nt, Homo sapiens
gccaaucucaa

SEQ ID NO: 1361345 - RNA, 19 nt, Homo sapiens
gccacauggcggagaguuu

SEQ ID NO: 1361346 - RNA, 22 nt, Homo sapiens
gccacccaaggaugucugccac

SEQ ID NO: 1361347 - RNA, 23 nt, Homo sapiens
gccaccucccuauacugcuugga

SEQ ID NO: 1361348 - RNA, 21 nt, Homo sapiens
gccacuagcccuccucuccca

SEQ ID NO: 1361349 - RNA, 22 nt, Homo sapiens
gccacugagaagugcacuuuaa

SEQ ID NO: 1361350 - RNA, 20 nt, Homo sapiens
gccacugagcuggcugacua

SEQ ID NO: 1361351 - RNA, 20 nt, Homo sapiens
ggaaccacaccacaucuaag

SEQ ID NO: 1361352 - RNA, 22 nt, Homo sapiens
ggaaccucagccuggccagaca

SEQ ID NO: 1361353 - RNA, 14 nt, Homo sapiens
ggaacucagaucca

SEQ ID NO: 1361354 - RNA, 16 nt, Homo sapiens
ggaagaugugugauaa

SEQ ID NO: 1361355 - RNA, 22 nt, Homo sapiens
ggaagccucccacgacugcccg

SEQ ID NO: 1361356 - RNA, 22 nt, Homo sapiens
ggaaggagaggagaggggcaca

SEQ ID NO: 1361357 - RNA, 17 nt, Homo sapiens
ggaagguucuacgccag

SEQ ID NO: 1361358 - RNA, 18 nt, Homo sapiens
ggaaguuucuggugccau

SEQ ID NO: 1361359 - RNA, 21 nt, Homo sapiens
ggaaguuuuguggaggagcuc

SEQ ID NO: 1361360 - RNA, 15 nt, Homo sapiens
ggaauccucuguguc

SEQ ID NO: 1361361 - RNA, 15 nt, Homo sapiens
ggacaacauccuuaa

SEQ ID NO: 1361362 - RNA, 21 nt, Homo sapiens
ggacaacucagucccuaaaaa

SEQ ID NO: 1361363 - RNA, 18 nt, Homo sapiens
ggacacuaauacaccagg

SEQ ID NO: 1361364 - RNA, 22 nt, Homo sapiens
ggacaggauguguuugcuuucu

SEQ ID NO: 1361365 - RNA, 19 nt, Homo sapiens
ggacaugcuucagugcugc

SEQ ID NO: 1361366 - RNA, 14 nt, Homo sapiens
ggacccagugcaga

SEQ ID NO: 1361367 - RNA, 14 nt, Homo sapiens
ggacggagcugacu

SEQ ID NO: 1361368 - RNA, 14 nt, Homo sapiens
ggacuguaagggau

SEQ ID NO: 1361369 - RNA, 15 nt, Homo sapiens
ggagagcacugccag

SEQ ID NO: 1361370 - RNA, 16 nt, Homo sapiens
ggagauaauuguuuca

SEQ ID NO: 1361371 - RNA, 18 nt, Homo sapiens
ggagccaaaaucucaaga

SEQ ID NO: 1361372 - RNA, 23 nt, Homo sapiens
ggagcucuucaggccucccucuc

SEQ ID NO: 1361373 - RNA, 23 nt, Homo sapiens
ggagcugggcccgacauggcucc

SEQ ID NO: 1361374 - RNA, 15 nt, Homo sapiens
ggaggaucaguuuuu

SEQ ID NO: 1361375 - RNA, 20 nt, Homo sapiens
ggaggcagaggcugcauuga

SEQ ID NO: 1361376 - RNA, 16 nt, Homo sapiens
ggaggccagccaguga

SEQ ID NO: 1361377 - RNA, 19 nt, Homo sapiens
ggaggccagccagugaccu

SEQ ID NO: 1361378 - RNA, 20 nt, Homo sapiens
ggagggacacuuacccaagg

SEQ ID NO: 1361379 - RNA, 14 nt, Homo sapiens
ggaggucucuguaa

SEQ ID NO: 1361380 - RNA, 17 nt, Homo sapiens
ggaguucaggaacccuu

SEQ ID NO: 1361381 - RNA, 20 nt, Homo sapiens
ggauauccucccuccagaua

SEQ ID NO: 1361382 - RNA, 13 nt, Homo sapiens
ggaugaggucaua

SEQ ID NO: 1361383 - RNA, 21 nt, Homo sapiens
ggaugcuccauuucaauugcu

SEQ ID NO: 1361384 - RNA, 23 nt, Homo sapiens
ggaugucugccacaccucuccaa

SEQ ID NO: 1361385 - RNA, 16 nt, Homo sapiens
ggauuaccaguagaug

SEQ ID NO: 1361386 - RNA, 20 nt, Homo sapiens
ggcaaaguacuugucauaga

SEQ ID NO: 1361387 - RNA, 13 nt, Homo sapiens
ggcaaaguguagu

SEQ ID NO: 1361388 - RNA, 18 nt, Homo sapiens
ggcaaaguguaguguuau

SEQ ID NO: 1361389 - RNA, 15 nt, Homo sapiens
ggcaagagaauuacu

SEQ ID NO: 1361390 - RNA, 18 nt, Homo sapiens
ggcaauauagcaagaucc

SEQ ID NO: 1361391 - RNA, 21 nt, Homo sapiens
ggcacggcccguggcuguuga

SEQ ID NO: 1361392 - RNA, 20 nt, Homo sapiens
ggcagagguugcaguguggu

SEQ ID NO: 1361393 - RNA, 16 nt, Homo sapiens
ggcagcaggaugcuca

SEQ ID NO: 1361394 - RNA, 20 nt, Homo sapiens
ggcagcaggaugcucaguga

SEQ ID NO: 1361395 - RNA, 18 nt, Homo sapiens
ggcagcauccccuugaac

SEQ ID NO: 1361396 - RNA, 22 nt, Homo sapiens
ggcaggaagggaagcguauaua

SEQ ID NO: 1361397 - RNA, 16 nt, Homo sapiens
ggcaguagaacuccag

SEQ ID NO: 1361398 - RNA, 13 nt, Homo sapiens
ggcagucagagga

SEQ ID NO: 1361399 - RNA, 23 nt, Homo sapiens
ggcagugaugcuggaugcuccuu

SEQ ID NO: 1361400 - RNA, 20 nt, Homo sapiens
ggcaugagacucagugcaga

SEQ ID NO: 1361401 - RNA, 22 nt, Homo sapiens
ggcauuucacaaaacagccuuu

SEQ ID NO: 1361402 - RNA, 12 nt, Homo sapiens
ggccaacaaaga

SEQ ID NO: 1361403 - RNA, 15 nt, Homo sapiens
ggccaauaaauauga

SEQ ID NO: 1361404 - RNA, 13 nt, Homo sapiens
ggccagauccagc

SEQ ID NO: 1361405 - RNA, 12 nt, Homo sapiens
ggcccagugcau

SEQ ID NO: 1361406 - RNA, 17 nt, Homo sapiens
ggccccucccacaccca

SEQ ID NO: 1361407 - RNA, 15 nt, Homo sapiens
ggcccggccagccau

SEQ ID NO: 1361408 - RNA, 22 nt, Homo sapiens
ggcccgugggagucaucucaac

SEQ ID NO: 1361409 - RNA, 14 nt, Homo sapiens
ggcccuaccugggg

SEQ ID NO: 1361410 - RNA, 12 nt, Homo sapiens
ggccuacuucuc

SEQ ID NO: 1361411 - RNA, 22 nt, Homo sapiens
ggccugcgacccugggggcaca

SEQ ID NO: 1361412 - RNA, 21 nt, Homo sapiens
ggccuguuugccgucugugac

SEQ ID NO: 1361413 - RNA, 21 nt, Homo sapiens
ggccuuaaaauuacuuggcuu

SEQ ID NO: 1361414 - RNA, 17 nt, Homo sapiens
ggcuacacacaaaccag

SEQ ID NO: 1361415 - RNA, 22 nt, Homo sapiens
ggcuacuccgugguuuugugac

SEQ ID NO: 1361416 - RNA, 22 nt, Homo sapiens
ggcugccggcacggcccguggc

SEQ ID NO: 1361417 - RNA, 23 nt, Homo sapiens
ggcuggguccccuucgcaguguu

SEQ ID NO: 1361418 - RNA, 14 nt, Homo sapiens
ggcuggguggcacc

SEQ ID NO: 1361419 - RNA, 22 nt, Homo sapiens
ggcugguccagggcuagugacu

SEQ ID NO: 1361420 - RNA, 21 nt, Homo sapiens
ggcugucaaugggaccugugg

SEQ ID NO: 1361421 - RNA, 13 nt, Homo sapiens
ggcuuugcagugc

SEQ ID NO: 1361422 - RNA, 14 nt, Homo sapiens
ggcuuugcauuucu

SEQ ID NO: 1361423 - RNA, 17 nt, Homo sapiens
gggacaucacagggugg

SEQ ID NO: 1361424 - RNA, 20 nt, Homo sapiens
gggacauuuccaagcuguua

SEQ ID NO: 1361425 - RNA, 14 nt, Homo sapiens
gggacccugcacag

SEQ ID NO: 1361426 - RNA, 13 nt, Homo sapiens
gggacucccaggc

SEQ ID NO: 1361427 - RNA, 18 nt, Homo sapiens
gggacucguggcugucaa

SEQ ID NO: 1361428 - RNA, 17 nt, Homo sapiens
gggagagggcgagcaug

SEQ ID NO: 1361429 - RNA, 14 nt, Homo sapiens
gggagccucuggaa

SEQ ID NO: 1361430 - RNA, 14 nt, Homo sapiens
gggaucugccauug

SEQ ID NO: 1361431 - RNA, 15 nt, Homo sapiens
gggcacagugucagu

SEQ ID NO: 1361432 - RNA, 18 nt, Homo sapiens
gggcaucugccccucccc

SEQ ID NO: 1361433 - RNA, 13 nt, Homo sapiens
gggccauggcuca

SEQ ID NO: 1361434 - RNA, 15 nt, Homo sapiens
gggcccucgguggga

SEQ ID NO: 1361435 - RNA, 21 nt, Homo sapiens
gggcccucggugggagccaug

SEQ ID NO: 1361436 - RNA, 22 nt, Homo sapiens
gggcgguccuacugcugugagc

SEQ ID NO: 1361437 - RNA, 13 nt, Homo sapiens
gggcugcuuccca

SEQ ID NO: 1361438 - RNA, 17 nt, Homo sapiens
gggcuguugucauuugu

SEQ ID NO: 1361439 - RNA, 12 nt, Homo sapiens
ggggagacaaau

SEQ ID NO: 1361440 - RNA, 20 nt, Homo sapiens
ggggagccuucugugcugug

SEQ ID NO: 1361441 - RNA, 14 nt, Homo sapiens
ggggcaggcaguga

SEQ ID NO: 1361442 - RNA, 22 nt, Homo sapiens
ggggcaugugcugccuguuguu

SEQ ID NO: 1361443 - RNA, 15 nt, Homo sapiens
ggggccagauccagc

SEQ ID NO: 1361444 - RNA, 23 nt, Homo sapiens
ggggccaggucacccuuugcugu

SEQ ID NO: 1361445 - RNA, 15 nt, Homo sapiens
ggggcgucaccucca

SEQ ID NO: 1361446 - RNA, 23 nt, Homo sapiens
gggguaccuuaagagacacucca

SEQ ID NO: 1361447 - RNA, 11 nt, Homo sapiens
ggggucucaga

SEQ ID NO: 1361448 - RNA, 22 nt, Homo sapiens
ggguacuucuugaaggugcuga

SEQ ID NO: 1361449 - RNA, 20 nt, Homo sapiens
ggguauaguucaugucugcu

SEQ ID NO: 1361450 - RNA, 13 nt, Homo sapiens
gggucauggggca

SEQ ID NO: 1361451 - RNA, 23 nt, Homo sapiens
gggucuugcucugucucccaggc

SEQ ID NO: 1361452 - RNA, 21 nt, Homo sapiens
ggguggcccuugcaguucagc

SEQ ID NO: 1361453 - RNA, 20 nt, Homo sapiens
ggguggggcuccuaccuggg

SEQ ID NO: 1361454 - RNA, 19 nt, Homo sapiens
ggguuggacuguaagggau

SEQ ID NO: 1361455 - RNA, 18 nt, Homo sapiens
gguaagaagaaagcaaaa

SEQ ID NO: 1361456 - RNA, 16 nt, Homo sapiens
gguacccagucaccuc

SEQ ID NO: 1361457 - RNA, 13 nt, Homo sapiens
gguauaugugaua

SEQ ID NO: 1361458 - RNA, 11 nt, Homo sapiens
ggucauuugcu

SEQ ID NO: 1361459 - RNA, 18 nt, Homo sapiens
gguccuacugcugugagc

SEQ ID NO: 1361460 - RNA, 22 nt, Homo sapiens
ggucucugauagguagcauuuu

SEQ ID NO: 1361461 - RNA, 16 nt, Homo sapiens
uauugccucuacuuug

SEQ ID NO: 1361462 - RNA, 14 nt, Homo sapiens
uauugcgcugcuac

SEQ ID NO: 1361463 - RNA, 16 nt, Homo sapiens
uauuuaccagaccaca

SEQ ID NO: 1361464 - RNA, 15 nt, Homo sapiens
uauuuaugugugagg

SEQ ID NO: 1361465 - RNA, 20 nt, Homo sapiens
uauuucugucaacuuguauu

SEQ ID NO: 1361466 - RNA, 15 nt, Homo sapiens
uauuuguuugugcau

SEQ ID NO: 1361467 - RNA, 19 nt, Homo sapiens
uauuuuaauuccacuuuaa

SEQ ID NO: 1361468 - RNA, 21 nt, Homo sapiens
uauuuucagaugugaaccauu

SEQ ID NO: 1361469 - RNA, 15 nt, Homo sapiens
uauuuuuguaucuua

SEQ ID NO: 1361470 - RNA, 20 nt, Homo sapiens
uauuuuuucuugcaaauacc

SEQ ID NO: 1361471 - RNA, 17 nt, Homo sapiens
ucaaaaaaucugaccaa

SEQ ID NO: 1361472 - RNA, 20 nt, Homo sapiens
ucaaaaaaucugaccaaaac

SEQ ID NO: 1361473 - RNA, 16 nt, Homo sapiens
ucaaaaauacucacau

SEQ ID NO: 1361474 - RNA, 19 nt, Homo sapiens
ucaaaagucuggccuuuca

SEQ ID NO: 1361475 - RNA, 18 nt, Homo sapiens
ucaaaauaaaaaccaaga

SEQ ID NO: 1361476 - RNA, 13 nt, Homo sapiens
ucaaacaaagcca

SEQ ID NO: 1361477 - RNA, 19 nt, Homo sapiens
ucaaagcuuccucuggcca

SEQ ID NO: 1361478 - RNA, 13 nt, Homo sapiens
ucaaaguguaaca

SEQ ID NO: 1361479 - RNA, 17 nt, Homo sapiens
ucaacagugaagacaga

SEQ ID NO: 1361480 - RNA, 17 nt, Homo sapiens
ucaacuuauuaacaauu

SEQ ID NO: 1361481 - RNA, 19 nt, Homo sapiens
ucaagaaaugacugaggua

SEQ ID NO: 1361482 - RNA, 21 nt, Homo sapiens
ucaagcccugcagucacagcu

SEQ ID NO: 1361483 - RNA, 20 nt, Homo sapiens
ucaagcuuagugagcaguga

SEQ ID NO: 1361484 - RNA, 16 nt, Homo sapiens
ucaaggcugcagugag

SEQ ID NO: 1361485 - RNA, 23 nt, Homo sapiens
ucaaguagcguuggagacauaca

SEQ ID NO: 1361486 - RNA, 13 nt, Homo sapiens
ucaagugccaaac

SEQ ID NO: 1361487 - RNA, 20 nt, Homo sapiens
ucaaguuggcuucuaaucaa

SEQ ID NO: 1361488 - RNA, 15 nt, Homo sapiens
ucaauagaucuccag

SEQ ID NO: 1361489 - RNA, 16 nt, Homo sapiens
ucaaucucugauucug

SEQ ID NO: 1361490 - RNA, 16 nt, Homo sapiens
ucaaugggaccugugg

SEQ ID NO: 1361491 - RNA, 15 nt, Homo sapiens
ucaauuuugacuuaa

SEQ ID NO: 1361492 - RNA, 20 nt, Homo sapiens
ucacaauaccucaugcuuca

SEQ ID NO: 1361493 - RNA, 13 nt, Homo sapiens
ucacaccuguaau

SEQ ID NO: 1361494 - RNA, 24 nt, Homo sapiens
ucacagagauuugguuaagcucac

SEQ ID NO: 1361495 - RNA, 18 nt, Homo sapiens
ucacagucucaguucucu

SEQ ID NO: 1361496 - RNA, 19 nt, Homo sapiens
ucacagucucaguucucuu

SEQ ID NO: 1361497 - RNA, 19 nt, Homo sapiens
ucacauucgaguguuucag

SEQ ID NO: 1361498 - RNA, 21 nt, Homo sapiens
ucacccacuucuacaugcuca

SEQ ID NO: 1361499 - RNA, 13 nt, Homo sapiens
ucacccugccuua

SEQ ID NO: 1361500 - RNA, 20 nt, Homo sapiens
ucacccugccuuaucuugca

SEQ ID NO: 1361501 - RNA, 14 nt, Homo sapiens
ucacccuguccaaa

SEQ ID NO: 1361502 - RNA, 18 nt, Homo sapiens
ucacccuguccaaacugc

SEQ ID NO: 1361503 - RNA, 17 nt, Homo sapiens
ucaccuuaggcagggaa

SEQ ID NO: 1361504 - RNA, 12 nt, Homo sapiens
ucaccuuauuca

SEQ ID NO: 1361505 - RNA, 19 nt, Homo sapiens
ucaccuuggcaccagacac

SEQ ID NO: 1361506 - RNA, 22 nt, Homo sapiens
ucacuaggcccccacuugccuc

SEQ ID NO: 1361507 - RNA, 18 nt, Homo sapiens
ucacucaaucucugauuc

SEQ ID NO: 1361508 - RNA, 22 nt, Homo sapiens
ucacucaaucucugauucuguc

SEQ ID NO: 1361509 - RNA, 17 nt, Homo sapiens
ucacucugaguguuuua

SEQ ID NO: 1361510 - RNA, 19 nt, Homo sapiens
ucacucuggccacagguga

SEQ ID NO: 1361511 - RNA, 19 nt, Homo sapiens
ucacucuucaaaugccuga

SEQ ID NO: 1361512 - RNA, 18 nt, Homo sapiens
ucacugaguuuuccaugg

SEQ ID NO: 1361513 - RNA, 16 nt, Homo sapiens
ucacugccagugcaga

SEQ ID NO: 1361514 - RNA, 23 nt, Homo sapiens
ucacugccagugcagauguuuua

SEQ ID NO: 1361515 - RNA, 13 nt, Homo sapiens
ucacuguugcaua

SEQ ID NO: 1361516 - RNA, 13 nt, Homo sapiens
ucacuuccuacaa

SEQ ID NO: 1361517 - RNA, 13 nt, Homo sapiens
uacauucuagccu

SEQ ID NO: 1361518 - RNA, 15 nt, Homo sapiens
uacauuuacugaaau

SEQ ID NO: 1361519 - RNA, 13 nt, Homo sapiens
uaccaaagugucu

SEQ ID NO: 1361520 - RNA, 13 nt, Homo sapiens
uaccaaaucucaa

SEQ ID NO: 1361521 - RNA, 18 nt, Homo sapiens
uaccacaagccugagaac

SEQ ID NO: 1361522 - RNA, 22 nt, Homo sapiens
uaccaccaagggaucugccauu

SEQ ID NO: 1361523 - RNA, 23 nt, Homo sapiens
uaccagagccuucaagugccaaa

SEQ ID NO: 1361524 - RNA, 22 nt, Homo sapiens
uaccagguuaccucacuuuuaa

SEQ ID NO: 1361525 - RNA, 20 nt, Homo sapiens
uaccaugaggcuugugugaa

SEQ ID NO: 1361526 - RNA, 17 nt, Homo sapiens
uacccaaggcucuucuc

SEQ ID NO: 1361527 - RNA, 18 nt, Homo sapiens
uaccuuaagagacacucc

SEQ ID NO: 1361528 - RNA, 19 nt, Homo sapiens
uaccuuaagagacacucca

SEQ ID NO: 1361529 - RNA, 14 nt, Homo sapiens
uacgaaagugcaga

SEQ ID NO: 1361530 - RNA, 20 nt, Homo sapiens
uacgcagaacuaccaggugg

SEQ ID NO: 1361531 - RNA, 13 nt, Homo sapiens
uacgccaggggaa

SEQ ID NO: 1361532 - RNA, 20 nt, Homo sapiens
uacgugauccucucaccuca

SEQ ID NO: 1361533 - RNA, 15 nt, Homo sapiens
uacguuaccaggcag

SEQ ID NO: 1361534 - RNA, 13 nt, Homo sapiens
uacuaaagccaaa

SEQ ID NO: 1361535 - RNA, 18 nt, Homo sapiens
uacuacaggauauuuacu

SEQ ID NO: 1361536 - RNA, 13 nt, Homo sapiens
uacucaaguacca

SEQ ID NO: 1361537 - RNA, 19 nt, Homo sapiens
uacucaaguaccaccaagg

SEQ ID NO: 1361538 - RNA, 14 nt, Homo sapiens
uacucagcauuuga

SEQ ID NO: 1361539 - RNA, 20 nt, Homo sapiens
uacucagcauuugauuaaca

SEQ ID NO: 1361540 - RNA, 18 nt, Homo sapiens
uacuccuuuuaagcagug

SEQ ID NO: 1361541 - RNA, 14 nt, Homo sapiens
uacugagacaaugu

SEQ ID NO: 1361542 - RNA, 11 nt, Homo sapiens
uacuguguuag

SEQ ID NO: 1361543 - RNA, 14 nt, Homo sapiens
uacuguugugaaaa

SEQ ID NO: 1361544 - RNA, 14 nt, Homo sapiens
uacuuagauacuaa

SEQ ID NO: 1361545 - RNA, 18 nt, Homo sapiens
uacuucagucuugaugca

SEQ ID NO: 1361546 - RNA, 20 nt, Homo sapiens
uacuuucucuagggagaaaa

SEQ ID NO: 1361547 - RNA, 18 nt, Homo sapiens
uacuuuguaaauaggauu

SEQ ID NO: 1361548 - RNA, 13 nt, Homo sapiens
uagaaaaaccacc

SEQ ID NO: 1361549 - RNA, 11 nt, Homo sapiens
uagaaaugcca

SEQ ID NO: 1361550 - RNA, 21 nt, Homo sapiens
uagaagaggguuuuagguaga

SEQ ID NO: 1361551 - RNA, 14 nt, Homo sapiens
uagaauuaugcugu

SEQ ID NO: 1361552 - RNA, 14 nt, Homo sapiens
uagacaagccagaa

SEQ ID NO: 1361553 - RNA, 15 nt, Homo sapiens
uagacaauuugcaca

SEQ ID NO: 1361554 - RNA, 20 nt, Homo sapiens
uagacucaugguguguuaca

SEQ ID NO: 1361555 - RNA, 19 nt, Homo sapiens
uagagaacacgcguauuua

SEQ ID NO: 1361556 - RNA, 20 nt, Homo sapiens
uagagaguugagacuugcca

SEQ ID NO: 1361557 - RNA, 18 nt, Homo sapiens
uagaggcuugaucaugaa

SEQ ID NO: 1361558 - RNA, 15 nt, Homo sapiens
uagagggggucucag

SEQ ID NO: 1361559 - RNA, 17 nt, Homo sapiens
uagagugaugacugcuu

SEQ ID NO: 1361560 - RNA, 18 nt, Homo sapiens
uagaguguagacuguggc

SEQ ID NO: 1361561 - RNA, 16 nt, Homo sapiens
uagauuaaagcuuauu

SEQ ID NO: 1361562 - RNA, 14 nt, Homo sapiens
uagauucauuuuac

SEQ ID NO: 1361563 - RNA, 15 nt, Homo sapiens
uagcacuacaaacac

SEQ ID NO: 1361564 - RNA, 13 nt, Homo sapiens
uagcagaaaucua

SEQ ID NO: 1361565 - RNA, 15 nt, Homo sapiens
uagccaaguguggua

SEQ ID NO: 1361566 - RNA, 16 nt, Homo sapiens
uagccacugacuugcu

SEQ ID NO: 1361567 - RNA, 15 nt, Homo sapiens
uagcccucacacugu

SEQ ID NO: 1361568 - RNA, 21 nt, Homo sapiens
uagcccuccucucccagugac

SEQ ID NO: 1361569 - RNA, 16 nt, Homo sapiens
uagccugggguggggu

SEQ ID NO: 1361570 - RNA, 14 nt, Homo sapiens
uagcucuccugcca

SEQ ID NO: 1361571 - RNA, 15 nt, Homo sapiens
uagcuuggaaacugg

SEQ ID NO: 1361572 - RNA, 21 nt, Homo sapiens
uagcuuuccuggucccucacc

SEQ ID NO: 1361573 - RNA, 15 nt, Homo sapiens
uaggagcuuacugaa

SEQ ID NO: 1361574 - RNA, 22 nt, Homo sapiens
ucuguaagaaaccuacugccca

SEQ ID NO: 1361575 - RNA, 13 nt, Homo sapiens
ucuguacuguuac

SEQ ID NO: 1361576 - RNA, 14 nt, Homo sapiens
ucuguagugucacu

SEQ ID NO: 1361577 - RNA, 14 nt, Homo sapiens
ucugucaaucacag

SEQ ID NO: 1361578 - RNA, 15 nt, Homo sapiens
ucugucaaugucuug

SEQ ID NO: 1361579 - RNA, 11 nt, Homo sapiens
ucugugacauu

SEQ ID NO: 1361580 - RNA, 19 nt, Homo sapiens
ucuguggauuggccuuuaa

SEQ ID NO: 1361581 - RNA, 14 nt, Homo sapiens
ucuguuuacugcaa

SEQ ID NO: 1361582 - RNA, 16 nt, Homo sapiens
ucuguuuccucuguau

SEQ ID NO: 1361583 - RNA, 20 nt, Homo sapiens
ucuuaauacuugaacuguug

SEQ ID NO: 1361584 - RNA, 22 nt, Homo sapiens
ucuucaaaugccugacuaggga

SEQ ID NO: 1361585 - RNA, 16 nt, Homo sapiens
ucuucauaauuucuuc

SEQ ID NO: 1361586 - RNA, 21 nt, Homo sapiens
ucuucauauucuaaaaccauu

SEQ ID NO: 1361587 - RNA, 18 nt, Homo sapiens
ucuuccaacacauuucac

SEQ ID NO: 1361588 - RNA, 13 nt, Homo sapiens
ucuucccuaccuc

SEQ ID NO: 1361589 - RNA, 19 nt, Homo sapiens
ucuuccugaguggugccaa

SEQ ID NO: 1361590 - RNA, 20 nt, Homo sapiens
ucuuccugaguggugccaaa

SEQ ID NO: 1361591 - RNA, 18 nt, Homo sapiens
ucuucuggugcuacucca

SEQ ID NO: 1361592 - RNA, 16 nt, Homo sapiens
ucuugaauagucucau

SEQ ID NO: 1361593 - RNA, 21 nt, Homo sapiens
ucuugauccuaugaguguagu

SEQ ID NO: 1361594 - RNA, 18 nt, Homo sapiens
ucuugcaauaaaugaaga

SEQ ID NO: 1361595 - RNA, 18 nt, Homo sapiens
ucuugcuguugacauauu

SEQ ID NO: 1361596 - RNA, 17 nt, Homo sapiens
ucuuggcuuaaucauuu

SEQ ID NO: 1361597 - RNA, 16 nt, Homo sapiens
ucuuggggcccagugc

SEQ ID NO: 1361598 - RNA, 23 nt, Homo sapiens
ucuuggggggguggccgcugagu

SEQ ID NO: 1361599 - RNA, 21 nt, Homo sapiens
ucuuuaaagcaggauuucuca

SEQ ID NO: 1361600 - RNA, 15 nt, Homo sapiens
ucuuuaaccuuguau

SEQ ID NO: 1361601 - RNA, 12 nt, Homo sapiens
ucuuuacuuucc

SEQ ID NO: 1361602 - RNA, 18 nt, Homo sapiens
ucuuuauaaucuacuccu

SEQ ID NO: 1361603 - RNA, 18 nt, Homo sapiens
ucuuucaggacucuaccu

SEQ ID NO: 1361604 - RNA, 20 nt, Homo sapiens
ucuuucaggacucuaccuca

SEQ ID NO: 1361605 - RNA, 17 nt, Homo sapiens
ucuuucucugccaguga

SEQ ID NO: 1361606 - RNA, 23 nt, Homo sapiens
ucuuugacugaaaaaaaaaaaga

SEQ ID NO: 1361607 - RNA, 23 nt, Homo sapiens
ucuuugacugaagccgugccugu

SEQ ID NO: 1361608 - RNA, 17 nt, Homo sapiens
ucuuugcccacaaugcu

SEQ ID NO: 1361609 - RNA, 19 nt, Homo sapiens
ucuuuuccauuaaacuacu

SEQ ID NO: 1361610 - RNA, 16 nt, Homo sapiens
ucuuuugaacccagga

SEQ ID NO: 1361611 - RNA, 21 nt, Homo sapiens
ucuuuugggggucaacaguuu

SEQ ID NO: 1361612 - RNA, 23 nt, Homo sapiens
ugaaaaaauacccucugacugua

SEQ ID NO: 1361613 - RNA, 17 nt, Homo sapiens
ugaaaaauaagucacuu

SEQ ID NO: 1361614 - RNA, 12 nt, Homo sapiens
ugaaaaaugccu

SEQ ID NO: 1361615 - RNA, 15 nt, Homo sapiens
ugaaaacaugacuca

SEQ ID NO: 1361616 - RNA, 19 nt, Homo sapiens
ugaaaauguuuuucugcca

SEQ ID NO: 1361617 - RNA, 13 nt, Homo sapiens
ugaaacugcauaa

SEQ ID NO: 1361618 - RNA, 21 nt, Homo sapiens
ugaaauggacaaacagugcac

SEQ ID NO: 1361619 - RNA, 19 nt, Homo sapiens
ugaaauuugugauggaauc

SEQ ID NO: 1361620 - RNA, 11 nt, Homo sapiens
ugaacacuccc

SEQ ID NO: 1361621 - RNA, 13 nt, Homo sapiens
ugaacugcaguga

SEQ ID NO: 1361622 - RNA, 11 nt, Homo sapiens
ugaacuggaag

SEQ ID NO: 1361623 - RNA, 23 nt, Homo sapiens
ugaagauguuucaaaaaaucuga

SEQ ID NO: 1361624 - RNA, 19 nt, Homo sapiens
ugaagauuucucugagauc

SEQ ID NO: 1361625 - RNA, 15 nt, Homo sapiens
ugaaggacuacaggu

SEQ ID NO: 1361626 - RNA, 22 nt, Homo sapiens
ugaaggaugcggcaggugcucu

SEQ ID NO: 1361627 - RNA, 15 nt, Homo sapiens
ugaaggggaggucac

SEQ ID NO: 1361628 - RNA, 16 nt, Homo sapiens
ugaaggggaggucaca

SEQ ID NO: 1361629 - RNA, 23 nt, Homo sapiens
ugaaggguucaccaggucaggga

SEQ ID NO: 1361630 - RNA, 15 nt, Homo sapiens
aagugacuucacaga

SEQ ID NO: 1361631 - RNA, 19 nt, Homo sapiens
aagugagacccugucucaa

SEQ ID NO: 1361632 - RNA, 20 nt, Homo sapiens
aagugagacccugucucaaa

SEQ ID NO: 1361633 - RNA, 13 nt, Homo sapiens
aagugcacuuuaa

SEQ ID NO: 1361634 - RNA, 19 nt, Homo sapiens
aaguggcagaacacuggau

SEQ ID NO: 1361635 - RNA, 22 nt, Homo sapiens
aaguguaagaaacacacugagg

SEQ ID NO: 1361636 - RNA, 19 nt, Homo sapiens
aaguguuuuguaacuucau

SEQ ID NO: 1361637 - RNA, 17 nt, Homo sapiens
aaguuucuggugccauu

SEQ ID NO: 1361638 - RNA, 11 nt, Homo sapiens
aauaaauggaa

SEQ ID NO: 1361639 - RNA, 22 nt, Homo sapiens
aauaacauuuaaauuccacaga

SEQ ID NO: 1361640 - RNA, 23 nt, Homo sapiens
aauaacauuuaaauuccacagau

SEQ ID NO: 1361641 - RNA, 20 nt, Homo sapiens
aauaauacaguaucucaggg

SEQ ID NO: 1361642 - RNA, 17 nt, Homo sapiens
aauacaaugauccugua

SEQ ID NO: 1361643 - RNA, 14 nt, Homo sapiens
aauacaguaucuca

SEQ ID NO: 1361644 - RNA, 16 nt, Homo sapiens
aauacccucugacugu

SEQ ID NO: 1361645 - RNA, 15 nt, Homo sapiens
aauacuaaacuacau

SEQ ID NO: 1361646 - RNA, 21 nt, Homo sapiens
aauacugcugagauacauaca

SEQ ID NO: 1361647 - RNA, 16 nt, Homo sapiens
aauagacaauuugcac

SEQ ID NO: 1361648 - RNA, 15 nt, Homo sapiens
aauagcaacuugugu

SEQ ID NO: 1361649 - RNA, 13 nt, Homo sapiens
aauagccacugca

SEQ ID NO: 1361650 - RNA, 21 nt, Homo sapiens
aauagucuagauggcuccucu

SEQ ID NO: 1361651 - RNA, 14 nt, Homo sapiens
aauauaaacacuau

SEQ ID NO: 1361652 - RNA, 12 nt, Homo sapiens
aauaucuuggcc

SEQ ID NO: 1361653 - RNA, 19 nt, Homo sapiens
aauauggaaugggcucagu

SEQ ID NO: 1361654 - RNA, 16 nt, Homo sapiens
aauauuaacuacagaa

SEQ ID NO: 1361655 - RNA, 23 nt, Homo sapiens
aauauucagaaaaugaagcacga

SEQ ID NO: 1361656 - RNA, 22 nt, Homo sapiens
aauauuuuggcauuguacuaau

SEQ ID NO: 1361657 - RNA, 21 nt, Homo sapiens
aaucaagacugcaaacccuuu

SEQ ID NO: 1361658 - RNA, 20 nt, Homo sapiens
aaucacacgucuggcuucac

SEQ ID NO: 1361659 - RNA, 22 nt, Homo sapiens
aaucacagucucaguucucuug

SEQ ID NO: 1361660 - RNA, 20 nt, Homo sapiens
aaucauuuucauuccuaaag

SEQ ID NO: 1361661 - RNA, 18 nt, Homo sapiens
aaucccuuugucugucaa

SEQ ID NO: 1361662 - RNA, 19 nt, Homo sapiens
aaucggcuggggacugcua

SEQ ID NO: 1361663 - RNA, 19 nt, Homo sapiens
aaucucaaugaagccagcu

SEQ ID NO: 1361664 - RNA, 14 nt, Homo sapiens
aaucucggcucacu

SEQ ID NO: 1361665 - RNA, 14 nt, Homo sapiens
aaucugaccaaaac

SEQ ID NO: 1361666 - RNA, 18 nt, Homo sapiens
aaugaaguaaaggucagu

SEQ ID NO: 1361667 - RNA, 20 nt, Homo sapiens
aaugaguuuuucuguuauca

SEQ ID NO: 1361668 - RNA, 16 nt, Homo sapiens
aaugauaaaauacuaa

SEQ ID NO: 1361669 - RNA, 13 nt, Homo sapiens
aaugauccuguau

SEQ ID NO: 1361670 - RNA, 19 nt, Homo sapiens
aaugaugauccuaggcauu

SEQ ID NO: 1361671 - RNA, 16 nt, Homo sapiens
aaugcagcagggaugc

SEQ ID NO: 1361672 - RNA, 17 nt, Homo sapiens
aaugcuauaacuauguu

SEQ ID NO: 1361673 - RNA, 23 nt, Homo sapiens
aaugcucaagaaacaacuucuac

SEQ ID NO: 1361674 - RNA, 16 nt, Homo sapiens
aaugcucagacuucau

SEQ ID NO: 1361675 - RNA, 10 nt, Homo sapiens
aaugcuccau

SEQ ID NO: 1361676 - RNA, 18 nt, Homo sapiens
aaugcugggacucagccu

SEQ ID NO: 1361677 - RNA, 17 nt, Homo sapiens
aaugcuucuagaguuuu

SEQ ID NO: 1361678 - RNA, 12 nt, Homo sapiens
aauggagcucag

SEQ ID NO: 1361679 - RNA, 22 nt, Homo sapiens
aaugggccacugaaaucuguca

SEQ ID NO: 1361680 - RNA, 12 nt, Homo sapiens
aauggggccaga

SEQ ID NO: 1361681 - RNA, 16 nt, Homo sapiens
aaugguuuacagagag

SEQ ID NO: 1361682 - RNA, 15 nt, Homo sapiens
aauguaaagccaugc

SEQ ID NO: 1361683 - RNA, 14 nt, Homo sapiens
aauguaagcauacu

SEQ ID NO: 1361684 - RNA, 17 nt, Homo sapiens
aauguguggcugaagac

SEQ ID NO: 1361685 - RNA, 17 nt, Homo sapiens
aauuaaaacacuuucaa

SEQ ID NO: 1361686 - RNA, 18 nt, Homo sapiens
aauuaaaauggaugccuu

SEQ ID NO: 1361687 - RNA, 22 nt, Homo sapiens
aauuacacaguaagucauuuaa

SEQ ID NO: 1361688 - RNA, 21 nt, Homo sapiens
aauuauuacaugguacuacau

SEQ ID NO: 1361689 - RNA, 17 nt, Homo sapiens
aauucaucucucuuuaa

SEQ ID NO: 1361690 - RNA, 23 nt, Homo sapiens
aauucguucuguaaggagcacca

SEQ ID NO: 1361691 - RNA, 20 nt, Homo sapiens
aauucuagcuuugagcuuaa

SEQ ID NO: 1361692 - RNA, 15 nt, Homo sapiens
aauucuggcacauuu

SEQ ID NO: 1361693 - RNA, 18 nt, Homo sapiens
aauucuuacaaacaugug

SEQ ID NO: 1361694 - RNA, 13 nt, Homo sapiens
aauucuucugccu

SEQ ID NO: 1361695 - RNA, 12 nt, Homo sapiens
aauugcugaaag

SEQ ID NO: 1361696 - RNA, 15 nt, Homo sapiens
aauugcuuugccaaa

SEQ ID NO: 1361697 - RNA, 18 nt, Homo sapiens
aauuucuccgaaugucaa

SEQ ID NO: 1361698 - RNA, 15 nt, Homo sapiens
aauuuucagcauuaa

SEQ ID NO: 1361699 - RNA, 22 nt, Homo sapiens
aauuuugagauuaagaaugcca

SEQ ID NO: 1361700 - RNA, 14 nt, Homo sapiens
acaaaaauuugcca

SEQ ID NO: 1361701 - RNA, 15 nt, Homo sapiens
acaaacaaacagaaa

SEQ ID NO: 1361702 - RNA, 12 nt, Homo sapiens
acaaacaugugg

SEQ ID NO: 1361703 - RNA, 18 nt, Homo sapiens
acaaagauugagaagcca

SEQ ID NO: 1361704 - RNA, 20 nt, Homo sapiens
acaaauuuuucaaaucauuc

SEQ ID NO: 1361705 - RNA, 22 nt, Homo sapiens
acaaauuuuucaaaucauuccu

SEQ ID NO: 1361706 - RNA, 14 nt, Homo sapiens
acaacacaguucuc

SEQ ID NO: 1361707 - RNA, 20 nt, Homo sapiens
acaaccaaaagucuucauca

SEQ ID NO: 1361708 - RNA, 13 nt, Homo sapiens
acaagccaagaaa

SEQ ID NO: 1361709 - RNA, 17 nt, Homo sapiens
acaagccagaacuugac

SEQ ID NO: 1361710 - RNA, 16 nt, Homo sapiens
acaagcugcacccuca

SEQ ID NO: 1361711 - RNA, 19 nt, Homo sapiens
acaaguuggaugcggccau

SEQ ID NO: 1361712 - RNA, 23 nt, Homo sapiens
acaauacugggguuggacuguaa

SEQ ID NO: 1361713 - RNA, 16 nt, Homo sapiens
acaauauucaaucaaa

SEQ ID NO: 1361714 - RNA, 23 nt, Homo sapiens
acaauccaucucucaaguagugu

SEQ ID NO: 1361715 - RNA, 23 nt, Homo sapiens
acaaucucagcucacugugaccu

SEQ ID NO: 1361716 - RNA, 22 nt, Homo sapiens
acaauugacaacaguuacauaa

SEQ ID NO: 1361717 - RNA, 13 nt, Homo sapiens
acacaaagacauu

SEQ ID NO: 1361718 - RNA, 23 nt, Homo sapiens
acacaaauaaaggaaacccagcu

SEQ ID NO: 1361719 - RNA, 12 nt, Homo sapiens
acacaaggucau

SEQ ID NO: 1361720 - RNA, 17 nt, Homo sapiens
acacaauucuucuucca

SEQ ID NO: 1361721 - RNA, 17 nt, Homo sapiens
acacacucagugacauu

SEQ ID NO: 1361722 - RNA, 10 nt, Homo sapiens
acacacucca

SEQ ID NO: 1361723 - RNA, 14 nt, Homo sapiens
acacauacaaugaa

SEQ ID NO: 1361724 - RNA, 20 nt, Homo sapiens
acaccacaccugauuccugu

SEQ ID NO: 1361725 - RNA, 23 nt, Homo sapiens
acaccacaucuaagccugaaggg

SEQ ID NO: 1361726 - RNA, 17 nt, Homo sapiens
acaccauuuuccugccu

SEQ ID NO: 1361727 - RNA, 23 nt, Homo sapiens
acaccucaguucccuuggccuca

SEQ ID NO: 1361728 - RNA, 12 nt, Homo sapiens
acaccucuccaa

SEQ ID NO: 1361729 - RNA, 15 nt, Homo sapiens
acaccuguaauccca

SEQ ID NO: 1361730 - RNA, 17 nt, Homo sapiens
acaccuguaaucccagc

SEQ ID NO: 1361731 - RNA, 20 nt, Homo sapiens
acaccuuuuuucaacaguga

SEQ ID NO: 1361732 - RNA, 15 nt, Homo sapiens
acacguccacuuuca

SEQ ID NO: 1361733 - RNA, 14 nt, Homo sapiens
acacucagugacau

SEQ ID NO: 1361734 - RNA, 16 nt, Homo sapiens
acacuuccagcauuua

SEQ ID NO: 1361735 - RNA, 17 nt, Homo sapiens
acacuugcaaccuaccu

SEQ ID NO: 1361736 - RNA, 21 nt, Homo sapiens
acacuugggguuuaaauaucc

SEQ ID NO: 1361737 - RNA, 21 nt, Homo sapiens
acagaacacugucuugaagac

SEQ ID NO: 1361738 - RNA, 15 nt, Homo sapiens
acagacuucuuggua

SEQ ID NO: 1361739 - RNA, 12 nt, Homo sapiens
acagacuuuguu

SEQ ID NO: 1361740 - RNA, 23 nt, Homo sapiens
acagagauuugguuaagcucaca

SEQ ID NO: 1361741 - RNA, 18 nt, Homo sapiens
acagagcagaacuuucac

SEQ ID NO: 1361742 - RNA, 15 nt, Homo sapiens
acagauaucaguguc

SEQ ID NO: 1361743 - RNA, 22 nt, Homo sapiens
acagaugagaauccuuguggcu

SEQ ID NO: 1361744 - RNA, 18 nt, Homo sapiens
acagaugccacacaagga

SEQ ID NO: 1361745 - RNA, 13 nt, Homo sapiens
acagaugccccag

SEQ ID NO: 1361746 - RNA, 19 nt, Homo sapiens
aggccccagccucccugaa

SEQ ID NO: 1361747 - RNA, 16 nt, Homo sapiens
aggcccccacuugccu

SEQ ID NO: 1361748 - RNA, 22 nt, Homo sapiens
aggccuccugugacuggcagca

SEQ ID NO: 1361749 - RNA, 21 nt, Homo sapiens
aggccugggccgcugccacgu

SEQ ID NO: 1361750 - RNA, 22 nt, Homo sapiens
aggcuaaaacaccuuggcuugu

SEQ ID NO: 1361751 - RNA, 19 nt, Homo sapiens
aggcucacugcaacuucug

SEQ ID NO: 1361752 - RNA, 20 nt, Homo sapiens
aggcucuuagcagcuuccag

SEQ ID NO: 1361753 - RNA, 17 nt, Homo sapiens
aggcugaggcaagagaa

SEQ ID NO: 1361754 - RNA, 20 nt, Homo sapiens
aggcugcauugagcuaugau

SEQ ID NO: 1361755 - RNA, 15 nt, Homo sapiens
aggcuggccagucca

SEQ ID NO: 1361756 - RNA, 15 nt, Homo sapiens
aggcuggcuuguccc

SEQ ID NO: 1361757 - RNA, 12 nt, Homo sapiens
aggcugggagac

SEQ ID NO: 1361758 - RNA, 14 nt, Homo sapiens
aggcuucuaccugc

SEQ ID NO: 1361759 - RNA, 15 nt, Homo sapiens
agggaaccugugucc

SEQ ID NO: 1361760 - RNA, 20 nt, Homo sapiens
agggaagaaugaacacuccc

SEQ ID NO: 1361761 - RNA, 16 nt, Homo sapiens
agggaauggagcucag

SEQ ID NO: 1361762 - RNA, 17 nt, Homo sapiens
agggaccccugcccuug

SEQ ID NO: 1361763 - RNA, 21 nt, Homo sapiens
agggaccccugcccuuguccc

SEQ ID NO: 1361764 - RNA, 13 nt, Homo sapiens
agggaccuaggca

SEQ ID NO: 1361765 - RNA, 21 nt, Homo sapiens
agggagcuaucaggaacagcu

SEQ ID NO: 1361766 - RNA, 19 nt, Homo sapiens
agggauuugaggugagggu

SEQ ID NO: 1361767 - RNA, 18 nt, Homo sapiens
agggauuuguuuugucaa

SEQ ID NO: 1361768 - RNA, 19 nt, Homo sapiens
agggcggugaacucuggcu

SEQ ID NO: 1361769 - RNA, 23 nt, Homo sapiens
agggcugacucuaggugcccuug

SEQ ID NO: 1361770 - RNA, 19 nt, Homo sapiens
aggggcugcugaccuccac

SEQ ID NO: 1361771 - RNA, 15 nt, Homo sapiens
aggggugcugugagg

SEQ ID NO: 1361772 - RNA, 17 nt, Homo sapiens
aggguaauugcugaggu

SEQ ID NO: 1361773 - RNA, 15 nt, Homo sapiens
agggucccucugugu

SEQ ID NO: 1361774 - RNA, 18 nt, Homo sapiens
aggguggcccuugcaguu

SEQ ID NO: 1361775 - RNA, 18 nt, Homo sapiens
aggguugguaagggguug

SEQ ID NO: 1361776 - RNA, 23 nt, Homo sapiens
agguagauuuaaaauggggugcu

SEQ ID NO: 1361777 - RNA, 16 nt, Homo sapiens
agguccagcucugugg

SEQ ID NO: 1361778 - RNA, 17 nt, Homo sapiens
aggucuaggugcuuuaa

SEQ ID NO: 1361779 - RNA, 16 nt, Homo sapiens
aggugauuccagugaa

SEQ ID NO: 1361780 - RNA, 13 nt, Homo sapiens
aggugcucugugg

SEQ ID NO: 1361781 - RNA, 20 nt, Homo sapiens
aggugguauguuugggagac

SEQ ID NO: 1361782 - RNA, 23 nt, Homo sapiens
agguuaaaaucuuagaaaauuaa

SEQ ID NO: 1361783 - RNA, 19 nt, Homo sapiens
agguugggcuuccaugccu

SEQ ID NO: 1361784 - RNA, 21 nt, Homo sapiens
agguuguucuagggacaggcc

SEQ ID NO: 1361785 - RNA, 19 nt, Homo sapiens
aguaaccucuacaggcauu

SEQ ID NO: 1361786 - RNA, 17 nt, Homo sapiens
aguaagggcguggcucu

SEQ ID NO: 1361787 - RNA, 19 nt, Homo sapiens
aguaauauagcugagacua

SEQ ID NO: 1361788 - RNA, 21 nt, Homo sapiens
aguacguguuauuuuuuucaa

SEQ ID NO: 1361789 - RNA, 20 nt, Homo sapiens
aguaggguuugacauuucau

SEQ ID NO: 1361790 - RNA, 23 nt, Homo sapiens
aguaguugggauuaccaguagau

SEQ ID NO: 1361791 - RNA, 17 nt, Homo sapiens
aguaucauuacauauag

SEQ ID NO: 1361792 - RNA, 23 nt, Homo sapiens
aguaucugucucauccaaaaagu

SEQ ID NO: 1361793 - RNA, 19 nt, Homo sapiens
agucaaacuuucaccucag

SEQ ID NO: 1361794 - RNA, 13 nt, Homo sapiens
agucacagagaua

SEQ ID NO: 1361795 - RNA, 20 nt, Homo sapiens
agucacagagauaauucuag

SEQ ID NO: 1361796 - RNA, 12 nt, Homo sapiens
agucaguugcaa

SEQ ID NO: 1361797 - RNA, 19 nt, Homo sapiens
agucaguugcaaauuuuag

SEQ ID NO: 1361798 - RNA, 18 nt, Homo sapiens
agucaucuugaccaagca

SEQ ID NO: 1361799 - RNA, 20 nt, Homo sapiens
agucaugcguuuaaucacau

SEQ ID NO: 1361800 - RNA, 23 nt, Homo sapiens
agucauucagcagcaaauuuuca

SEQ ID NO: 1361801 - RNA, 22 nt, Homo sapiens
agucccuucucucuuccuugcu

SEQ ID NO: 1361802 - RNA, 15 nt, Homo sapiens
aguccucuguggcca

SEQ ID NO: 1361803 - RNA, 19 nt, Homo sapiens
agucucccuggccuaggca

SEQ ID NO: 1361804 - RNA, 14 nt, Homo sapiens
agucugaaccuauu

SEQ ID NO: 1361805 - RNA, 13 nt, Homo sapiens
agucuugccuugc

SEQ ID NO: 1361806 - RNA, 16 nt, Homo sapiens
agucuugccuugcuga

SEQ ID NO: 1361807 - RNA, 20 nt, Homo sapiens
agugaaagcaucacuuggga

SEQ ID NO: 1361808 - RNA, 16 nt, Homo sapiens
agugaaauauaugcua

SEQ ID NO: 1361809 - RNA, 17 nt, Homo sapiens
agugaaggcuguccuua

SEQ ID NO: 1361810 - RNA, 17 nt, Homo sapiens
agugacugccaaaaagg

SEQ ID NO: 1361811 - RNA, 17 nt, Homo sapiens
agugacuucacagagac

SEQ ID NO: 1361812 - RNA, 18 nt, Homo sapiens
agugaggaugacagugac

SEQ ID NO: 1361813 - RNA, 19 nt, Homo sapiens
agugaugcaggcaguguaa

SEQ ID NO: 1361814 - RNA, 17 nt, Homo sapiens
agugcuuguuccucuca

SEQ ID NO: 1361815 - RNA, 14 nt, Homo sapiens
aguggcaaaacacu

SEQ ID NO: 1361816 - RNA, 20 nt, Homo sapiens
aguggcacaaucucggcuca

SEQ ID NO: 1361817 - RNA, 23 nt, Homo sapiens
aguggcuuccaucucagcacucu

SEQ ID NO: 1361818 - RNA, 20 nt, Homo sapiens
agugggaauguccuuggcau

SEQ ID NO: 1361819 - RNA, 17 nt, Homo sapiens
agugggagccagggcug

SEQ ID NO: 1361820 - RNA, 15 nt, Homo sapiens
agugggggaucacag

SEQ ID NO: 1361821 - RNA, 13 nt, Homo sapiens
agugggugaauaa

SEQ ID NO: 1361822 - RNA, 19 nt, Homo sapiens
agugggugaauaauacagu

SEQ ID NO: 1361823 - RNA, 21 nt, Homo sapiens
agugguggcaggacaagagaa

SEQ ID NO: 1361824 - RNA, 13 nt, Homo sapiens
agugguuacccag

SEQ ID NO: 1361825 - RNA, 18 nt, Homo sapiens
aguguaugacugcacaug

SEQ ID NO: 1361826 - RNA, 17 nt, Homo sapiens
aguguccuucuugcucc

SEQ ID NO: 1361827 - RNA, 18 nt, Homo sapiens
agugucuccccguguccu

SEQ ID NO: 1361828 - RNA, 14 nt, Homo sapiens
aguuaaaaagucaa

SEQ ID NO: 1361829 - RNA, 23 nt, Homo sapiens
aguuaacugugaaauaccacaag

SEQ ID NO: 1361830 - RNA, 16 nt, Homo sapiens
aguuacaucucagugc

SEQ ID NO: 1361831 - RNA, 15 nt, Homo sapiens
aguugacuugacaga

SEQ ID NO: 1361832 - RNA, 14 nt, Homo sapiens
aguugagacuugcc

SEQ ID NO: 1361833 - RNA, 21 nt, Homo sapiens
aguugaucuggaacccagacu

SEQ ID NO: 1361834 - RNA, 13 nt, Homo sapiens
aguugaugacugu

SEQ ID NO: 1361835 - RNA, 17 nt, Homo sapiens
aguugauggugaugaaa

SEQ ID NO: 1361836 - RNA, 22 nt, Homo sapiens
aguugcuugauuuuaguggcuc

SEQ ID NO: 1361837 - RNA, 18 nt, Homo sapiens
aguuggaagugugugauc

SEQ ID NO: 1361838 - RNA, 20 nt, Homo sapiens
aguuggacuucagucuugcc

SEQ ID NO: 1361839 - RNA, 19 nt, Homo sapiens
aguuguugcuuauacuguu

SEQ ID NO: 1361840 - RNA, 21 nt, Homo sapiens
aguuucugauuuuuauucuca

SEQ ID NO: 1361841 - RNA, 21 nt, Homo sapiens
aguuucuuaacccuuuccaga

SEQ ID NO: 1361842 - RNA, 14 nt, Homo sapiens
aguuugauacgugu

SEQ ID NO: 1361843 - RNA, 21 nt, Homo sapiens
aguuuuuaauuuaucagagac

SEQ ID NO: 1361844 - RNA, 17 nt, Homo sapiens
auaaaaccccaucucua

SEQ ID NO: 1361845 - RNA, 14 nt, Homo sapiens
auaaaagaucuuga

SEQ ID NO: 1361846 - RNA, 19 nt, Homo sapiens
auaaaagaucuugaauagu

SEQ ID NO: 1361847 - RNA, 12 nt, Homo sapiens
auaaaaugauaa

SEQ ID NO: 1361848 - RNA, 17 nt, Homo sapiens
auaaacagucuaaagaa

SEQ ID NO: 1361849 - RNA, 19 nt, Homo sapiens
auaaagccucugugcugca

SEQ ID NO: 1361850 - RNA, 17 nt, Homo sapiens
auaaauuaaaauuacac

SEQ ID NO: 1361851 - RNA, 19 nt, Homo sapiens
auaacacguccacuuucaa

SEQ ID NO: 1361852 - RNA, 16 nt, Homo sapiens
auaacauuuaaauucc

SEQ ID NO: 1361853 - RNA, 22 nt, Homo sapiens
auaacauuuaaauuccacagau

SEQ ID NO: 1361854 - RNA, 22 nt, Homo sapiens
auaaccucaaagugacuauuca

SEQ ID NO: 1361855 - RNA, 15 nt, Homo sapiens
auaacucugugaucu

SEQ ID NO: 1361856 - RNA, 20 nt, Homo sapiens
auaagcuauagacccgagga

SEQ ID NO: 1361857 - RNA, 16 nt, Homo sapiens
auaauaauggcuaacu

SEQ ID NO: 1361858 - RNA, 23 nt, Homo sapiens
auaauauuaaggaagacaaugug

SEQ ID NO: 1361859 - RNA, 12 nt, Homo sapiens
auaaucuacucc

SEQ ID NO: 1361860 - RNA, 15 nt, Homo sapiens
auaaucuugcucaca

SEQ ID NO: 1361861 - RNA, 14 nt, Homo sapiens
cacgcacacgagaa

SEQ ID NO: 1361862 - RNA, 21 nt, Homo sapiens
cacgccucccugagcacugac

SEQ ID NO: 1361863 - RNA, 16 nt, Homo sapiens
cacggcuuauaccagg

SEQ ID NO: 1361864 - RNA, 12 nt, Homo sapiens
cacggggcacag

SEQ ID NO: 1361865 - RNA, 18 nt, Homo sapiens
cacuacaccuugccuugc

SEQ ID NO: 1361866 - RNA, 13 nt, Homo sapiens
cacuagacaagcc

SEQ ID NO: 1361867 - RNA, 22 nt, Homo sapiens
cacucagauggaaccgcaggaa

SEQ ID NO: 1361868 - RNA, 18 nt, Homo sapiens
cacugaguuugaacacag

SEQ ID NO: 1361869 - RNA, 14 nt, Homo sapiens
cacugccagugcag

SEQ ID NO: 1361870 - RNA, 14 nt, Homo sapiens
cacuguaucuaggc

SEQ ID NO: 1361871 - RNA, 18 nt, Homo sapiens
cacugucccuugccucaa

SEQ ID NO: 1361872 - RNA, 14 nt, Homo sapiens
cacugugcuuucag

SEQ ID NO: 1361873 - RNA, 21 nt, Homo sapiens
cacuucaggguucuaaccuuu

SEQ ID NO: 1361874 - RNA, 15 nt, Homo sapiens
cacuuccagcauuua

SEQ ID NO: 1361875 - RNA, 15 nt, Homo sapiens
cacuugguaauugua

SEQ ID NO: 1361876 - RNA, 14 nt, Homo sapiens
cacuugucucagga

SEQ ID NO: 1361877 - RNA, 20 nt, Homo sapiens
cacuuuaccucuguggaccu

SEQ ID NO: 1361878 - RNA, 16 nt, Homo sapiens
cacuuucaugcagugc

SEQ ID NO: 1361879 - RNA, 21 nt, Homo sapiens
cagaaaucuagaagacuguca

SEQ ID NO: 1361880 - RNA, 12 nt, Homo sapiens
cagaacacacuc

SEQ ID NO: 1361881 - RNA, 18 nt, Homo sapiens
cagaacacacuccaucag

SEQ ID NO: 1361882 - RNA, 19 nt, Homo sapiens
cagaacacacuccaucagc

SEQ ID NO: 1361883 - RNA, 14 nt, Homo sapiens
cagaauauacuaaa

SEQ ID NO: 1361884 - RNA, 15 nt, Homo sapiens
cagaaucagaucuga

SEQ ID NO: 1361885 - RNA, 19 nt, Homo sapiens
cagaaucggcuuugcagug

SEQ ID NO: 1361886 - RNA, 13 nt, Homo sapiens
cagaauuacugua

SEQ ID NO: 1361887 - RNA, 23 nt, Homo sapiens
cagacacugaccauccacucuac

SEQ ID NO: 1361888 - RNA, 10 nt, Homo sapiens
cagacauauu

SEQ ID NO: 1361889 - RNA, 18 nt, Homo sapiens
cagacauccucuaugcca

SEQ ID NO: 1361890 - RNA, 17 nt, Homo sapiens
cagacaugccacaagga

SEQ ID NO: 1361891 - RNA, 21 nt, Homo sapiens
cagacuacuucuuccccagau

SEQ ID NO: 1361892 - RNA, 14 nt, Homo sapiens
cagacucccauucc

SEQ ID NO: 1361893 - RNA, 13 nt, Homo sapiens
cagagaagccaaa

SEQ ID NO: 1361894 - RNA, 17 nt, Homo sapiens
cagagacauacuugaag

SEQ ID NO: 1361895 - RNA, 21 nt, Homo sapiens
cagagauaauucuagcuuuga

SEQ ID NO: 1361896 - RNA, 10 nt, Homo sapiens
cagagcaaaa

SEQ ID NO: 1361897 - RNA, 19 nt, Homo sapiens
cagaggacccaggggaaac

SEQ ID NO: 1361898 - RNA, 16 nt, Homo sapiens
cagaggacgagugcuu

SEQ ID NO: 1361899 - RNA, 22 nt, Homo sapiens
cagaggaggggccgcugccacc

SEQ ID NO: 1361900 - RNA, 19 nt, Homo sapiens
cagaggccuugcuguggag

SEQ ID NO: 1361901 - RNA, 21 nt, Homo sapiens
cagagggaucggaagagucuu

SEQ ID NO: 1361902 - RNA, 18 nt, Homo sapiens
cagagugagaccuaucua

SEQ ID NO: 1361903 - RNA, 13 nt, Homo sapiens
cagagugccacug

SEQ ID NO: 1361904 - RNA, 12 nt, Homo sapiens
cagauccaggga

SEQ ID NO: 1361905 - RNA, 18 nt, Homo sapiens
cagaucuuccguggucag

SEQ ID NO: 1361906 - RNA, 17 nt, Homo sapiens
cagaugccacacaagga

SEQ ID NO: 1361907 - RNA, 17 nt, Homo sapiens
cagauggaaaagggaga

SEQ ID NO: 1361908 - RNA, 23 nt, Homo sapiens
cagauguaauguuuucuuugcaa

SEQ ID NO: 1361909 - RNA, 13 nt, Homo sapiens
cagaugugugauu

SEQ ID NO: 1361910 - RNA, 22 nt, Homo sapiens
cagauuauaacuguugucauau

SEQ ID NO: 1361911 - RNA, 13 nt, Homo sapiens
cagcacuuugcaa

SEQ ID NO: 1361912 - RNA, 16 nt, Homo sapiens
cagcagggaugcccug

SEQ ID NO: 1361913 - RNA, 14 nt, Homo sapiens
cagcaucuaaguaa

SEQ ID NO: 1361914 - RNA, 14 nt, Homo sapiens
cagcauuauugaaa

SEQ ID NO: 1361915 - RNA, 24 nt, Homo sapiens
cagcauuggugcucacugccagug

SEQ ID NO: 1361916 - RNA, 16 nt, Homo sapiens
cagcauuugauuaaca

SEQ ID NO: 1361917 - RNA, 18 nt, Homo sapiens
cagccacuccccggcaug

SEQ ID NO: 1361918 - RNA, 14 nt, Homo sapiens
cagccaggcugcca

SEQ ID NO: 1361919 - RNA, 23 nt, Homo sapiens
cagcccuuacaguauuguuacca

SEQ ID NO: 1361920 - RNA, 15 nt, Homo sapiens
cagcccuugugaugu

SEQ ID NO: 1361921 - RNA, 17 nt, Homo sapiens
cagccuggccaacaugg

SEQ ID NO: 1361922 - RNA, 14 nt, Homo sapiens
cagccuggccagac

SEQ ID NO: 1361923 - RNA, 15 nt, Homo sapiens
cagccugguggccca

SEQ ID NO: 1361924 - RNA, 11 nt, Homo sapiens
cagcucaaagg

SEQ ID NO: 1361925 - RNA, 20 nt, Homo sapiens
cagcucaaaggcacagugaa

SEQ ID NO: 1361926 - RNA, 23 nt, Homo sapiens
cagcugccagcccaacugugaga

SEQ ID NO: 1361927 - RNA, 12 nt, Homo sapiens
cagcugcuccua

SEQ ID NO: 1361928 - RNA, 22 nt, Homo sapiens
cagcugguucugcaaugacugc

SEQ ID NO: 1361929 - RNA, 22 nt, Homo sapiens
cagcuuaucucaggggugugcg

SEQ ID NO: 1361930 - RNA, 14 nt, Homo sapiens
cagcuuccaaacau

SEQ ID NO: 1361931 - RNA, 17 nt, Homo sapiens
caggaacccuucuccau

SEQ ID NO: 1361932 - RNA, 23 nt, Homo sapiens
caggaaccucagggcugugugua

SEQ ID NO: 1361933 - RNA, 15 nt, Homo sapiens
caggaaugaaguaaa

SEQ ID NO: 1361934 - RNA, 16 nt, Homo sapiens
caggagggcccuaccu

SEQ ID NO: 1361935 - RNA, 19 nt, Homo sapiens
caggaguauccucuugcca

SEQ ID NO: 1361936 - RNA, 21 nt, Homo sapiens
caggaguucagggucauagca

SEQ ID NO: 1361937 - RNA, 18 nt, Homo sapiens
caggaguuggaagugugu

SEQ ID NO: 1361938 - RNA, 12 nt, Homo sapiens
caggaugcugcu

SEQ ID NO: 1361939 - RNA, 13 nt, Homo sapiens
caggauggagcug

SEQ ID NO: 1361940 - RNA, 14 nt, Homo sapiens
caggcacgucugca

SEQ ID NO: 1361941 - RNA, 16 nt, Homo sapiens
caggcagauccaggac

SEQ ID NO: 1361942 - RNA, 11 nt, Homo sapiens
caggcauuuaa

SEQ ID NO: 1361943 - RNA, 15 nt, Homo sapiens
caggccacauggcua

SEQ ID NO: 1361944 - RNA, 22 nt, Homo sapiens
caggcccuggccuccccugcca

SEQ ID NO: 1361945 - RNA, 14 nt, Homo sapiens
caggccggccuuuc

SEQ ID NO: 1361946 - RNA, 19 nt, Homo sapiens
caggcucccagggacaccu

SEQ ID NO: 1361947 - RNA, 18 nt, Homo sapiens
caggcugaaaacaaugga

SEQ ID NO: 1361948 - RNA, 19 nt, Homo sapiens
caggcuggagugcagugac

SEQ ID NO: 1361949 - RNA, 14 nt, Homo sapiens
caggcuggccaguc

SEQ ID NO: 1361950 - RNA, 15 nt, Homo sapiens
caggcuggccagucc

SEQ ID NO: 1361951 - RNA, 14 nt, Homo sapiens
caggcuuaugaaua

SEQ ID NO: 1361952 - RNA, 15 nt, Homo sapiens
caggcuuaugaauau

SEQ ID NO: 1361953 - RNA, 17 nt, Homo sapiens
caggcuuaugaauauau

SEQ ID NO: 1361954 - RNA, 17 nt, Homo sapiens
cagggaccccugcccuu

SEQ ID NO: 1361955 - RNA, 19 nt, Homo sapiens
cagggagguggcuggguuu

SEQ ID NO: 1361956 - RNA, 17 nt, Homo sapiens
cagggcaccuacugaga

SEQ ID NO: 1361957 - RNA, 22 nt, Homo sapiens
cagggccccgcugucacuugcc

SEQ ID NO: 1361958 - RNA, 17 nt, Homo sapiens
cagggcuguugucauuu

SEQ ID NO: 1361959 - RNA, 15 nt, Homo sapiens
cagggggaugugucc

SEQ ID NO: 1361960 - RNA, 14 nt, Homo sapiens
cagggucauagcau

SEQ ID NO: 1361961 - RNA, 20 nt, Homo sapiens
cagggucugcucuuucucug

SEQ ID NO: 1361962 - RNA, 23 nt, Homo sapiens
cagggucugcucuuucucugcca

SEQ ID NO: 1361963 - RNA, 20 nt, Homo sapiens
cagguagaaaauuauuugua

SEQ ID NO: 1361964 - RNA, 20 nt, Homo sapiens
caggucuuuccuaaggcugc

SEQ ID NO: 1361965 - RNA, 18 nt, Homo sapiens
caggugccccucuuccaa

SEQ ID NO: 1361966 - RNA, 20 nt, Homo sapiens
caggugguggcagcaauggu

SEQ ID NO: 1361967 - RNA, 23 nt, Homo sapiens
cagguguaguuacaucucagugc

SEQ ID NO: 1361968 - RNA, 20 nt, Homo sapiens
caggugugagccacugcacc

SEQ ID NO: 1361969 - RNA, 15 nt, Homo sapiens
cagguuaccucacuu

SEQ ID NO: 1361970 - RNA, 21 nt, Homo sapiens
caguaagaauuauuuacugaa

SEQ ID NO: 1361971 - RNA, 22 nt, Homo sapiens
caguaagaauuauuuacugaaa

SEQ ID NO: 1361972 - RNA, 14 nt, Homo sapiens
caguauaagcauuu

SEQ ID NO: 1361973 - RNA, 19 nt, Homo sapiens
cagucacaacagagugaaa

SEQ ID NO: 1361974 - RNA, 15 nt, Homo sapiens
cagucccugcacuuu

SEQ ID NO: 1361975 - RNA, 17 nt, Homo sapiens
caguccugguugucuga

SEQ ID NO: 1361976 - RNA, 14 nt, Homo sapiens
cagucuaaagaaga

SEQ ID NO: 1361977 - RNA, 20 nt, Homo sapiens
cagucuugaugcaguuucau

SEQ ID NO: 1361978 - RNA, 12 nt, Homo sapiens
guaucauuacau

SEQ ID NO: 1361979 - RNA, 21 nt, Homo sapiens
guaucugucucauccaaaaag

SEQ ID NO: 1361980 - RNA, 12 nt, Homo sapiens
guauuagucaca

SEQ ID NO: 1361981 - RNA, 19 nt, Homo sapiens
guauucaugacuauggaua

SEQ ID NO: 1361982 - RNA, 21 nt, Homo sapiens
guauuucaggugaagcuggag

SEQ ID NO: 1361983 - RNA, 22 nt, Homo sapiens
guauuuucaucaaguagcguug

SEQ ID NO: 1361984 - RNA, 19 nt, Homo sapiens
gucaagccugugcaaaaaa

SEQ ID NO: 1361985 - RNA, 20 nt, Homo sapiens
gucacaugcccccacuuccc

SEQ ID NO: 1361986 - RNA, 20 nt, Homo sapiens
gucagggaccccugcccuug

SEQ ID NO: 1361987 - RNA, 22 nt, Homo sapiens
gucaguugccaaauaucuugau

SEQ ID NO: 1361988 - RNA, 14 nt, Homo sapiens
gucaugagcauuug

SEQ ID NO: 1361989 - RNA, 13 nt, Homo sapiens
gucauggacugua

SEQ ID NO: 1361990 - RNA, 14 nt, Homo sapiens
gucauuguauguua

SEQ ID NO: 1361991 - RNA, 21 nt, Homo sapiens
guccacgcgugccguggcacc

SEQ ID NO: 1361992 - RNA, 22 nt, Homo sapiens
guccauuaagcugagagugcua

SEQ ID NO: 1361993 - RNA, 17 nt, Homo sapiens
gucccaagucuccagag

SEQ ID NO: 1361994 - RNA, 15 nt, Homo sapiens
gucccaggcagggag

SEQ ID NO: 1361995 - RNA, 17 nt, Homo sapiens
guccucacucccagucc

SEQ ID NO: 1361996 - RNA, 12 nt, Homo sapiens
guccucauucuu

SEQ ID NO: 1361997 - RNA, 14 nt, Homo sapiens
guccugaggggcug

SEQ ID NO: 1361998 - RNA, 15 nt, Homo sapiens
guccuguacauugug

SEQ ID NO: 1361999 - RNA, 20 nt, Homo sapiens
guccuuagccccaucugcca

SEQ ID NO: 1362000 - RNA, 14 nt, Homo sapiens
gucgucaccaaauc

SEQ ID NO: 1362001 - RNA, 19 nt, Homo sapiens
gucuaaacuuuagaauuaa

SEQ ID NO: 1362002 - RNA, 23 nt, Homo sapiens
gucucagaaacugcgaggccagu

SEQ ID NO: 1362003 - RNA, 14 nt, Homo sapiens
gucucuacccagua

SEQ ID NO: 1362004 - RNA, 11 nt, Homo sapiens
gucuguuggca

SEQ ID NO: 1362005 - RNA, 21 nt, Homo sapiens
gugaaaaaucuuaaguaccaa

SEQ ID NO: 1362006 - RNA, 17 nt, Homo sapiens
gugaaauaaacagucua

SEQ ID NO: 1362007 - RNA, 15 nt, Homo sapiens
gugaacugcagugau

SEQ ID NO: 1362008 - RNA, 16 nt, Homo sapiens
gugaagcaaaacacaa

SEQ ID NO: 1362009 - RNA, 21 nt, Homo sapiens
gugacaauuaaaagugucuug

SEQ ID NO: 1362010 - RNA, 16 nt, Homo sapiens
gugacacaaucucagc

SEQ ID NO: 1362011 - RNA, 13 nt, Homo sapiens
gugaccaugagaa

SEQ ID NO: 1362012 - RNA, 16 nt, Homo sapiens
gugacuaauggcauga

SEQ ID NO: 1362013 - RNA, 18 nt, Homo sapiens
gugagaacccuugcacua

SEQ ID NO: 1362014 - RNA, 12 nt, Homo sapiens
gugagcacugaa

SEQ ID NO: 1362015 - RNA, 15 nt, Homo sapiens
gugaggcccguguga

SEQ ID NO: 1362016 - RNA, 19 nt, Homo sapiens
gugaggcuguccuguacau

SEQ ID NO: 1362017 - RNA, 23 nt, Homo sapiens
gugagggauaguggggucagggc

SEQ ID NO: 1362018 - RNA, 22 nt, Homo sapiens
gugauugacagcuuugcugcug

SEQ ID NO: 1362019 - RNA, 17 nt, Homo sapiens
gugauuuucauugcugg

SEQ ID NO: 1362020 - RNA, 18 nt, Homo sapiens
gugcauagagccacguau

SEQ ID NO: 1362021 - RNA, 16 nt, Homo sapiens
gugccauugcacucca

SEQ ID NO: 1362022 - RNA, 16 nt, Homo sapiens
gugccauuucucaggg

SEQ ID NO: 1362023 - RNA, 20 nt, Homo sapiens
gugcgugcgcaucuugccuc

SEQ ID NO: 1362024 - RNA, 20 nt, Homo sapiens
gugcgugcuugcaugugcug

SEQ ID NO: 1362025 - RNA, 21 nt, Homo sapiens
gugcuuuaaccucacauaccc

SEQ ID NO: 1362026 - RNA, 19 nt, Homo sapiens
guggaauuccuucauuuca

SEQ ID NO: 1362027 - RNA, 20 nt, Homo sapiens
guggacguggguugcacugg

SEQ ID NO: 1362028 - RNA, 12 nt, Homo sapiens
guggauguauaa

SEQ ID NO: 1362029 - RNA, 21 nt, Homo sapiens
guggauguauggggaaucuaa

SEQ ID NO: 1362030 - RNA, 12 nt, Homo sapiens
guggccucagaa

SEQ ID NO: 1362031 - RNA, 18 nt, Homo sapiens
guggcucuccaguguaaa

SEQ ID NO: 1362032 - RNA, 18 nt, Homo sapiens
guggcugcacaggcacug

SEQ ID NO: 1362033 - RNA, 21 nt, Homo sapiens
guggggagaugggcauuugga

SEQ ID NO: 1362034 - RNA, 14 nt, Homo sapiens
guggguugcacugg

SEQ ID NO: 1362035 - RNA, 22 nt, Homo sapiens
guguacacggaggucucuguaa

SEQ ID NO: 1362036 - RNA, 14 nt, Homo sapiens
guguacauuucuau

SEQ ID NO: 1362037 - RNA, 21 nt, Homo sapiens
guguccccgcugcugugcaac

SEQ ID NO: 1362038 - RNA, 17 nt, Homo sapiens
gugucucccaggugcau

SEQ ID NO: 1362039 - RNA, 17 nt, Homo sapiens
gugucuuacgugccacc

SEQ ID NO: 1362040 - RNA, 13 nt, Homo sapiens
gugucuuuugaca

SEQ ID NO: 1362041 - RNA, 19 nt, Homo sapiens
gugugggggaagcaccaua

SEQ ID NO: 1362042 - RNA, 16 nt, Homo sapiens
guguguuuacugaugc

SEQ ID NO: 1362043 - RNA, 13 nt, Homo sapiens
guuaaaaagucaa

SEQ ID NO: 1362044 - RNA, 19 nt, Homo sapiens
guuaacugugaaauaccac

SEQ ID NO: 1362045 - RNA, 17 nt, Homo sapiens
guuaauauugugcaaac

SEQ ID NO: 1362046 - RNA, 17 nt, Homo sapiens
guuaugaaaaacagaag

SEQ ID NO: 1362047 - RNA, 14 nt, Homo sapiens
guucacugcuccuu

SEQ ID NO: 1362048 - RNA, 14 nt, Homo sapiens
guucagaugcuucu

SEQ ID NO: 1362049 - RNA, 24 nt, Homo sapiens
guucagcacugucccuugccucaa

SEQ ID NO: 1362050 - RNA, 21 nt, Homo sapiens
guuccagcaaacaaaauggac

SEQ ID NO: 1362051 - RNA, 13 nt, Homo sapiens
guuccccucugcu

SEQ ID NO: 1362052 - RNA, 13 nt, Homo sapiens
guuccuacuggag

SEQ ID NO: 1362053 - RNA, 19 nt, Homo sapiens
guucuaacaaaacaaguug

SEQ ID NO: 1362054 - RNA, 16 nt, Homo sapiens
guucuaacauguaauu

SEQ ID NO: 1362055 - RNA, 15 nt, Homo sapiens
guucucagagacuca

SEQ ID NO: 1362056 - RNA, 19 nt, Homo sapiens
guucucagguguugccaaa

SEQ ID NO: 1362057 - RNA, 19 nt, Homo sapiens
guucucauaacucugugau

SEQ ID NO: 1362058 - RNA, 15 nt, Homo sapiens
guucuuugggccaga

SEQ ID NO: 1362059 - RNA, 14 nt, Homo sapiens
guugaagacuuugu

SEQ ID NO: 1362060 - RNA, 22 nt, Homo sapiens
guugacccagggcugucucccu

SEQ ID NO: 1362061 - RNA, 17 nt, Homo sapiens
guugauuacagugcagu

SEQ ID NO: 1362062 - RNA, 19 nt, Homo sapiens
guugauucagcucugcaag

SEQ ID NO: 1362063 - RNA, 19 nt, Homo sapiens
guugcaggaccucagguga

SEQ ID NO: 1362064 - RNA, 19 nt, Homo sapiens
guugcuucaaacugagaca

SEQ ID NO: 1362065 - RNA, 23 nt, Homo sapiens
guuggacuucagucuugccuagg

SEQ ID NO: 1362066 - RNA, 13 nt, Homo sapiens
guugggcuuccau

SEQ ID NO: 1362067 - RNA, 17 nt, Homo sapiens
guugggcuuccaugccu

SEQ ID NO: 1362068 - RNA, 13 nt, Homo sapiens
guuggugacaauu

SEQ ID NO: 1362069 - RNA, 19 nt, Homo sapiens
guugucucuagagcaggga

SEQ ID NO: 1362070 - RNA, 14 nt, Homo sapiens
guuuaucagcaaaa

SEQ ID NO: 1362071 - RNA, 14 nt, Homo sapiens
guuuccugauuuuu

SEQ ID NO: 1362072 - RNA, 23 nt, Homo sapiens
guuucucccccuuuccaaaaacu

SEQ ID NO: 1362073 - RNA, 20 nt, Homo sapiens
guuucugaucugaugcaagc

SEQ ID NO: 1362074 - RNA, 14 nt, Homo sapiens
guuuguccugagau

SEQ ID NO: 1362075 - RNA, 23 nt, Homo sapiens
guuugugauguuuccaaugcuga

SEQ ID NO: 1362076 - RNA, 16 nt, Homo sapiens
guuuguuuaacuguga

SEQ ID NO: 1362077 - RNA, 14 nt, Homo sapiens
guuuuacugcagcu

SEQ ID NO: 1362078 - RNA, 16 nt, Homo sapiens
guuuuuaaguacucac

SEQ ID NO: 1362079 - RNA, 15 nt, Homo sapiens
guuuuuucuccucau

SEQ ID NO: 1362080 - RNA, 22 nt, Homo sapiens
uaaaaagucaaacuuucaccuc

SEQ ID NO: 1362081 - RNA, 21 nt, Homo sapiens
uaaaaauggauagcucauuaa

SEQ ID NO: 1362082 - RNA, 22 nt, Homo sapiens
uaaaaaugucuugcuguugaca

SEQ ID NO: 1362083 - RNA, 16 nt, Homo sapiens
uaaaacaaaauuugac

SEQ ID NO: 1362084 - RNA, 13 nt, Homo sapiens
uaaaacauuauga

SEQ ID NO: 1362085 - RNA, 23 nt, Homo sapiens
uaaaagaucuugaauagucucau

SEQ ID NO: 1362086 - RNA, 21 nt, Homo sapiens
uaaaagaugcauuaucuauga

SEQ ID NO: 1362087 - RNA, 16 nt, Homo sapiens
uaaaauccuacaguga

SEQ ID NO: 1362088 - RNA, 17 nt, Homo sapiens
uaaaauccuacagugaa

SEQ ID NO: 1362089 - RNA, 17 nt, Homo sapiens
uaaaauguaaagccaug

SEQ ID NO: 1362090 - RNA, 16 nt, Homo sapiens
uaaacgcugucccuag

SEQ ID NO: 1362091 - RNA, 14 nt, Homo sapiens
uaaacuacauuuua

SEQ ID NO: 1362092 - RNA, 17 nt, Homo sapiens
uaaagaaaagacgaaua

SEQ ID NO: 1362093 - RNA, 16 nt, Homo sapiens
uaaagccaaacauaua

SEQ ID NO: 1362094 - RNA, 21 nt, Homo sapiens
uagagcagccacaaccaaaaa

SEQ ID NO: 1362095 - RNA, 15 nt, Homo sapiens
uagaguucagacuuu

SEQ ID NO: 1362096 - RNA, 20 nt, Homo sapiens
uagauuuaugcuccuuauga

SEQ ID NO: 1362097 - RNA, 22 nt, Homo sapiens
uagccacugcauaccaaccugg

SEQ ID NO: 1362098 - RNA, 14 nt, Homo sapiens
uagcccaaaaccaa

SEQ ID NO: 1362099 - RNA, 22 nt, Homo sapiens
uagccugccucuucucuacucu

SEQ ID NO: 1362100 - RNA, 16 nt, Homo sapiens
uagcuggccacauggc

SEQ ID NO: 1362101 - RNA, 13 nt, Homo sapiens
uaggacuuuuugu

SEQ ID NO: 1362102 - RNA, 13 nt, Homo sapiens
uaggagauuuauu

SEQ ID NO: 1362103 - RNA, 19 nt, Homo sapiens
uaggagcugcaguucuugu

SEQ ID NO: 1362104 - RNA, 12 nt, Homo sapiens
uaggcauguaaa

SEQ ID NO: 1362105 - RNA, 21 nt, Homo sapiens
uaggcauuugcugaauacaga

SEQ ID NO: 1362106 - RNA, 17 nt, Homo sapiens
uaggccuuccagugcag

SEQ ID NO: 1362107 - RNA, 18 nt, Homo sapiens
uaggccuuccagugcagg

SEQ ID NO: 1362108 - RNA, 14 nt, Homo sapiens
uagggaacugggga

SEQ ID NO: 1362109 - RNA, 24 nt, Homo sapiens
uagggauuuuuggcuacacacaaa

SEQ ID NO: 1362110 - RNA, 15 nt, Homo sapiens
uagguaggcuucuac

SEQ ID NO: 1362111 - RNA, 19 nt, Homo sapiens
uagguaugucugugccauu

SEQ ID NO: 1362112 - RNA, 23 nt, Homo sapiens
uaggugaccaugagaauugcugu

SEQ ID NO: 1362113 - RNA, 21 nt, Homo sapiens
uagucgcccuacagaaaaccc

SEQ ID NO: 1362114 - RNA, 20 nt, Homo sapiens
uagucucuacccaguagaug

SEQ ID NO: 1362115 - RNA, 21 nt, Homo sapiens
uagugccacccaccuuugcca

SEQ ID NO: 1362116 - RNA, 22 nt, Homo sapiens
uagugccacccaccuuugccac

SEQ ID NO: 1362117 - RNA, 13 nt, Homo sapiens
uagugcuuuccag

SEQ ID NO: 1362118 - RNA, 21 nt, Homo sapiens
uagugguuuaucagcaaaaaa

SEQ ID NO: 1362119 - RNA, 17 nt, Homo sapiens
uagugucucauguggaa

SEQ ID NO: 1362120 - RNA, 20 nt, Homo sapiens
uaguuagaauuauaucacuu

SEQ ID NO: 1362121 - RNA, 16 nt, Homo sapiens
uauaaaagcaaaagga

SEQ ID NO: 1362122 - RNA, 17 nt, Homo sapiens
uauaaaucaugaugcua

SEQ ID NO: 1362123 - RNA, 12 nt, Homo sapiens
uauaacauauau

SEQ ID NO: 1362124 - RNA, 16 nt, Homo sapiens
uauaacuauguugaua

SEQ ID NO: 1362125 - RNA, 17 nt, Homo sapiens
uauaauguuguauuuaa

SEQ ID NO: 1362126 - RNA, 16 nt, Homo sapiens
uauacugcuuggagcu

SEQ ID NO: 1362127 - RNA, 21 nt, Homo sapiens
uauacuguugucagguacagu

SEQ ID NO: 1362128 - RNA, 13 nt, Homo sapiens
uauacuuugcaau

SEQ ID NO: 1362129 - RNA, 21 nt, Homo sapiens
uauagaacuaaaguaucugag

SEQ ID NO: 1362130 - RNA, 17 nt, Homo sapiens
uauagaugcaaaguauu

SEQ ID NO: 1362131 - RNA, 21 nt, Homo sapiens
uauaguuguuggccuuuuugc

SEQ ID NO: 1362132 - RNA, 13 nt, Homo sapiens
uauauaucugcuu

SEQ ID NO: 1362133 - RNA, 16 nt, Homo sapiens
uauauaucugcuucua

SEQ ID NO: 1362134 - RNA, 12 nt, Homo sapiens
uauaugugauaa

SEQ ID NO: 1362135 - RNA, 18 nt, Homo sapiens
uauauuugggccugcucc

SEQ ID NO: 1362136 - RNA, 19 nt, Homo sapiens
uaucacuucacuguucucu

SEQ ID NO: 1362137 - RNA, 14 nt, Homo sapiens
uaucauuacauaua

SEQ ID NO: 1362138 - RNA, 17 nt, Homo sapiens
uauccuccuguucugaa

SEQ ID NO: 1362139 - RNA, 21 nt, Homo sapiens
uaucuauggcacccaugcacc

SEQ ID NO: 1362140 - RNA, 11 nt, Homo sapiens
uaucugagauu

SEQ ID NO: 1362141 - RNA, 14 nt, Homo sapiens
uaucugagauuaca

SEQ ID NO: 1362142 - RNA, 18 nt, Homo sapiens
uaucugagauuacagaga

SEQ ID NO: 1362143 - RNA, 18 nt, Homo sapiens
uaugaacauuagaaaaau

SEQ ID NO: 1362144 - RNA, 19 nt, Homo sapiens
uaugaaucacagcugccag

SEQ ID NO: 1362145 - RNA, 22 nt, Homo sapiens
uaugacacccacucuccuguga

SEQ ID NO: 1362146 - RNA, 15 nt, Homo sapiens
uaugacaucagcaau

SEQ ID NO: 1362147 - RNA, 22 nt, Homo sapiens
uaugaguguaguugaugacugu

SEQ ID NO: 1362148 - RNA, 17 nt, Homo sapiens
uaugaguuucuuuuugc

SEQ ID NO: 1362149 - RNA, 19 nt, Homo sapiens
uaugucugugccauuucuc

SEQ ID NO: 1362150 - RNA, 18 nt, Homo sapiens
uaugugugaggagcugcu

SEQ ID NO: 1362151 - RNA, 22 nt, Homo sapiens
uaugugugccagcugugugaga

SEQ ID NO: 1362152 - RNA, 17 nt, Homo sapiens
uauguugcccagugugu

SEQ ID NO: 1362153 - RNA, 12 nt, Homo sapiens
uauuaagauaug

SEQ ID NO: 1362154 - RNA, 16 nt, Homo sapiens
uauuauaaaaguacua

SEQ ID NO: 1362155 - RNA, 13 nt, Homo sapiens
uauucaucugauu

SEQ ID NO: 1362156 - RNA, 13 nt, Homo sapiens
uauucccauuaga

SEQ ID NO: 1362157 - RNA, 18 nt, Homo sapiens
uauucccauuagaccaag

SEQ ID NO: 1362158 - RNA, 15 nt, Homo sapiens
uauucuugugcuuuu

SEQ ID NO: 1362159 - RNA, 21 nt, Homo sapiens
uauuggagccccaggggacaa

SEQ ID NO: 1362160 - RNA, 15 nt, Homo sapiens
uauuggucagggugu

SEQ ID NO: 1362161 - RNA, 20 nt, Homo sapiens
uauuuaauuuuaacugccaa

SEQ ID NO: 1362162 - RNA, 17 nt, Homo sapiens
uauuuaccagaccacaa

SEQ ID NO: 1362163 - RNA, 22 nt, Homo sapiens
uauuuaguuuuuaacaaucuaa

SEQ ID NO: 1362164 - RNA, 16 nt, Homo sapiens
uauuuauacuuugcaa

SEQ ID NO: 1362165 - RNA, 22 nt, Homo sapiens
uauuucaagugccuagacuguu

SEQ ID NO: 1362166 - RNA, 22 nt, Homo sapiens
uauuuugccagugggaacuccu

SEQ ID NO: 1362167 - RNA, 22 nt, Homo sapiens
ucaaaauauccuaagacuaaca

SEQ ID NO: 1362168 - RNA, 15 nt, Homo sapiens
ucaaacaaagccaga

SEQ ID NO: 1362169 - RNA, 22 nt, Homo sapiens
ucaaacgugaaaaugcuguauu

SEQ ID NO: 1362170 - RNA, 15 nt, Homo sapiens
ucaaaggcacaguga

SEQ ID NO: 1362171 - RNA, 16 nt, Homo sapiens
ucaaaguguaacagau

SEQ ID NO: 1362172 - RNA, 20 nt, Homo sapiens
ucaaauggggccagauccag

SEQ ID NO: 1362173 - RNA, 19 nt, Homo sapiens
ucaaauuuagaaacuaauu

SEQ ID NO: 1362174 - RNA, 19 nt, Homo sapiens
ucaacucguuuuuauauua

SEQ ID NO: 1362175 - RNA, 16 nt, Homo sapiens
ucaacuugcuuaucaa

SEQ ID NO: 1362176 - RNA, 15 nt, Homo sapiens
ucaacuuugauacuu

SEQ ID NO: 1362177 - RNA, 19 nt, Homo sapiens
ucaagaccauagugaccaa

SEQ ID NO: 1362178 - RNA, 22 nt, Homo sapiens
ucaagcccugcagucacagcua

SEQ ID NO: 1362179 - RNA, 22 nt, Homo sapiens
ucaaggugaaauaaacagucua

SEQ ID NO: 1362180 - RNA, 14 nt, Homo sapiens
ucaaguuaaugcaa

SEQ ID NO: 1362181 - RNA, 12 nt, Homo sapiens
ucaaugccagua

SEQ ID NO: 1362182 - RNA, 17 nt, Homo sapiens
ucaaugggaccuguggc

SEQ ID NO: 1362183 - RNA, 11 nt, Homo sapiens
ucacacaaagg

SEQ ID NO: 1362184 - RNA, 18 nt, Homo sapiens
ucacagaugugugauuca

SEQ ID NO: 1362185 - RNA, 14 nt, Homo sapiens
ucacagcuacacag

SEQ ID NO: 1362186 - RNA, 16 nt, Homo sapiens
ucacagcuacacagau

SEQ ID NO: 1362187 - RNA, 18 nt, Homo sapiens
ucacagcuucagccagga

SEQ ID NO: 1362188 - RNA, 18 nt, Homo sapiens
ucacagugggagccaggg

SEQ ID NO: 1362189 - RNA, 23 nt, Homo sapiens
ucacaguucuuugggccagacau

SEQ ID NO: 1362190 - RNA, 16 nt, Homo sapiens
ucaccaggucagggag

SEQ ID NO: 1362191 - RNA, 14 nt, Homo sapiens
ucaccauguacaua

SEQ ID NO: 1362192 - RNA, 15 nt, Homo sapiens
ucaccauguacauag

SEQ ID NO: 1362193 - RNA, 17 nt, Homo sapiens
ucaccauguacauagcu

SEQ ID NO: 1362194 - RNA, 20 nt, Homo sapiens
ucaccauguacauagcuuga

SEQ ID NO: 1362195 - RNA, 15 nt, Homo sapiens
ucaccucauucugaa

SEQ ID NO: 1362196 - RNA, 15 nt, Homo sapiens
ucacuaauacacagu

SEQ ID NO: 1362197 - RNA, 14 nt, Homo sapiens
ucacucccagucca

SEQ ID NO: 1362198 - RNA, 17 nt, Homo sapiens
ucacucuucaaaugccu

SEQ ID NO: 1362199 - RNA, 23 nt, Homo sapiens
ucacugaugggaaaacugccaau

SEQ ID NO: 1362200 - RNA, 17 nt, Homo sapiens
ucacugcaccucuuugu

SEQ ID NO: 1362201 - RNA, 24 nt, Homo sapiens
ucacuggccccuacuuuguggcaa

SEQ ID NO: 1362202 - RNA, 18 nt, Homo sapiens
ucacuugguccuaccuau

SEQ ID NO: 1362203 - RNA, 21 nt, Homo sapiens
ucagaacuaccauuguaauau

SEQ ID NO: 1362204 - RNA, 16 nt, Homo sapiens
ucagacauuggcaccu

SEQ ID NO: 1362205 - RNA, 21 nt, Homo sapiens
ucagacuucauaagcgcagca

SEQ ID NO: 1362206 - RNA, 13 nt, Homo sapiens
ucagacuugucaa

SEQ ID NO: 1362207 - RNA, 19 nt, Homo sapiens
ucagacuugucaagccugu

SEQ ID NO: 1362208 - RNA, 23 nt, Homo sapiens
ucagauaagguaaaaugccauga

SEQ ID NO: 1362209 - RNA, 15 nt, Homo sapiens
ucagauccagggaca

SEQ ID NO: 1362210 - RNA, 12 nt, Homo sapiens
ugugcucaggga

SEQ ID NO: 1362211 - RNA, 22 nt, Homo sapiens
ugugcugaguugguguugacau

SEQ ID NO: 1362212 - RNA, 20 nt, Homo sapiens
ugugcugccuguuguuaugg

SEQ ID NO: 1362213 - RNA, 14 nt, Homo sapiens
ugugcuuccuccug

SEQ ID NO: 1362214 - RNA, 17 nt, Homo sapiens
uguggaugauaaaacac

SEQ ID NO: 1362215 - RNA, 22 nt, Homo sapiens
ugugguuaaugccauggacaga

SEQ ID NO: 1362216 - RNA, 21 nt, Homo sapiens
uguguccccucacgcaagugc

SEQ ID NO: 1362217 - RNA, 17 nt, Homo sapiens
ugugucucccaggugca

SEQ ID NO: 1362218 - RNA, 10 nt, Homo sapiens
ugugugcaca

SEQ ID NO: 1362219 - RNA, 13 nt, Homo sapiens
ugugugugcacau

SEQ ID NO: 1362220 - RNA, 14 nt, Homo sapiens
ugugugugugcaca

SEQ ID NO: 1362221 - RNA, 16 nt, Homo sapiens
ugugugugugcacauc

SEQ ID NO: 1362222 - RNA, 13 nt, Homo sapiens
ugugugugugcgu

SEQ ID NO: 1362223 - RNA, 15 nt, Homo sapiens
uguguuggcacaugc

SEQ ID NO: 1362224 - RNA, 14 nt, Homo sapiens
uguuaaaacuacuu

SEQ ID NO: 1362225 - RNA, 19 nt, Homo sapiens
uguuaauuuuuugguacaa

SEQ ID NO: 1362226 - RNA, 20 nt, Homo sapiens
uguuaucuuauacuguacaa

SEQ ID NO: 1362227 - RNA, 17 nt, Homo sapiens
uguuaugaggagcugca

SEQ ID NO: 1362228 - RNA, 14 nt, Homo sapiens
uguuaugcaaaaaa

SEQ ID NO: 1362229 - RNA, 13 nt, Homo sapiens
uguucagaugcuu

SEQ ID NO: 1362230 - RNA, 15 nt, Homo sapiens
uguucccuauuuugc

SEQ ID NO: 1362231 - RNA, 21 nt, Homo sapiens
uguucccuuccucugugccac

SEQ ID NO: 1362232 - RNA, 14 nt, Homo sapiens
uguuccuacuggag

SEQ ID NO: 1362233 - RNA, 13 nt, Homo sapiens
uguugagguguga

SEQ ID NO: 1362234 - RNA, 14 nt, Homo sapiens
uguugaggugugaa

SEQ ID NO: 1362235 - RNA, 11 nt, Homo sapiens
uguugccaaau

SEQ ID NO: 1362236 - RNA, 17 nt, Homo sapiens
uguugcgcucccaccuc

SEQ ID NO: 1362237 - RNA, 13 nt, Homo sapiens
uguuggugacaau

SEQ ID NO: 1362238 - RNA, 22 nt, Homo sapiens
uguugguguggcccauggcugu

SEQ ID NO: 1362239 - RNA, 13 nt, Homo sapiens
uguuguagacuua

SEQ ID NO: 1362240 - RNA, 17 nt, Homo sapiens
uguuuccuaauaucaaa

SEQ ID NO: 1362241 - RNA, 20 nt, Homo sapiens
uguuucgugaacugcaguga

SEQ ID NO: 1362242 - RNA, 18 nt, Homo sapiens
uguuucugaucugaugca

SEQ ID NO: 1362243 - RNA, 20 nt, Homo sapiens
uguuuuucucauuguagaca

SEQ ID NO: 1362244 - RNA, 13 nt, Homo sapiens
uuaaaaacuuaag

SEQ ID NO: 1362245 - RNA, 20 nt, Homo sapiens
uuaaaaaugucuugcuguug

SEQ ID NO: 1362246 - RNA, 17 nt, Homo sapiens
uuaaaagguccaguucu

SEQ ID NO: 1362247 - RNA, 23 nt, Homo sapiens
uuaaaaugcaaaauaaugucuua

SEQ ID NO: 1362248 - RNA, 16 nt, Homo sapiens
uuaaagaugcacagaa

SEQ ID NO: 1362249 - RNA, 17 nt, Homo sapiens
uuaaagucaggauuuau

SEQ ID NO: 1362250 - RNA, 12 nt, Homo sapiens
uuaaauuccaca

SEQ ID NO: 1362251 - RNA, 17 nt, Homo sapiens
uuaaauucuucuugaaa

SEQ ID NO: 1362252 - RNA, 21 nt, Homo sapiens
uuaaauuuuaauucuucagaa

SEQ ID NO: 1362253 - RNA, 11 nt, Homo sapiens
uuaacaaucua

SEQ ID NO: 1362254 - RNA, 16 nt, Homo sapiens
uuaacucagacacaaa

SEQ ID NO: 1362255 - RNA, 15 nt, Homo sapiens
uuaacuggugcacuu

SEQ ID NO: 1362256 - RNA, 14 nt, Homo sapiens
uuaagacuacugaa

SEQ ID NO: 1362257 - RNA, 14 nt, Homo sapiens
uuaaguguuuugua

SEQ ID NO: 1362258 - RNA, 16 nt, Homo sapiens
uuaaguugauggugau

SEQ ID NO: 1362259 - RNA, 18 nt, Homo sapiens
uuaaucuguuauguacua

SEQ ID NO: 1362260 - RNA, 19 nt, Homo sapiens
uuaaugcaaaugacuguca

SEQ ID NO: 1362261 - RNA, 19 nt, Homo sapiens
uuacaacuuguauuuccaa

SEQ ID NO: 1362262 - RNA, 21 nt, Homo sapiens
uuacaagauguauuuguugua

SEQ ID NO: 1362263 - RNA, 12 nt, Homo sapiens
uuacacauaccc

SEQ ID NO: 1362264 - RNA, 18 nt, Homo sapiens
uuacauacaugcuuugaa

SEQ ID NO: 1362265 - RNA, 20 nt, Homo sapiens
uuaccuggcagugaugucaa

SEQ ID NO: 1362266 - RNA, 21 nt, Homo sapiens
uuacuauaagaacuuugagcu

SEQ ID NO: 1362267 - RNA, 16 nt, Homo sapiens
uuacuaucaugucaaa

SEQ ID NO: 1362268 - RNA, 21 nt, Homo sapiens
uuacucccaggaucagcagaa

SEQ ID NO: 1362269 - RNA, 13 nt, Homo sapiens
uuagaaaaaccac

SEQ ID NO: 1362270 - RNA, 21 nt, Homo sapiens
uuagaaacuaagagaaugaua

SEQ ID NO: 1362271 - RNA, 19 nt, Homo sapiens
uuagaccccauacaaguuu

SEQ ID NO: 1362272 - RNA, 16 nt, Homo sapiens
uuagucuugauuucac

SEQ ID NO: 1362273 - RNA, 23 nt, Homo sapiens
uuauaagcagguguauacuuuua

SEQ ID NO: 1362274 - RNA, 14 nt, Homo sapiens
uuauaauauccaua

SEQ ID NO: 1362275 - RNA, 19 nt, Homo sapiens
uuauaccagguuaccucac

SEQ ID NO: 1362276 - RNA, 14 nt, Homo sapiens
uuauacuguacaau

SEQ ID NO: 1362277 - RNA, 19 nt, Homo sapiens
uuauagaacuaaaguaucu

SEQ ID NO: 1362278 - RNA, 18 nt, Homo sapiens
uuauagccgaaaugaucu

SEQ ID NO: 1362279 - RNA, 18 nt, Homo sapiens
uuauauuaaaacacuuag

SEQ ID NO: 1362280 - RNA, 23 nt, Homo sapiens
uuaucaagcuuagugagcaguga

SEQ ID NO: 1362281 - RNA, 19 nt, Homo sapiens
uuaucacacuucugugaga

SEQ ID NO: 1362282 - RNA, 17 nt, Homo sapiens
uuaucuguuuccugaca

SEQ ID NO: 1362283 - RNA, 20 nt, Homo sapiens
uuaucuugcaccccaaagcu

SEQ ID NO: 1362284 - RNA, 21 nt, Homo sapiens
uuaugaaaaauaagucacuua

SEQ ID NO: 1362285 - RNA, 15 nt, Homo sapiens
uuaugagaaacugca

SEQ ID NO: 1362286 - RNA, 11 nt, Homo sapiens
uuaugcugcua

SEQ ID NO: 1362287 - RNA, 12 nt, Homo sapiens
uuaugcugucau

SEQ ID NO: 1362288 - RNA, 14 nt, Homo sapiens
uuauggugcauuac

SEQ ID NO: 1362289 - RNA, 12 nt, Homo sapiens
uuauuauauucc

SEQ ID NO: 1362290 - RNA, 22 nt, Homo sapiens
uuauuccggaaacuaguguaca

SEQ ID NO: 1362291 - RNA, 15 nt, Homo sapiens
uuauugcgcugcuac

SEQ ID NO: 1362292 - RNA, 16 nt, Homo sapiens
uuauuggcuucuuaac

SEQ ID NO: 1362293 - RNA, 20 nt, Homo sapiens
uucaaaaacgaugucguauu

SEQ ID NO: 1362294 - RNA, 23 nt, Homo sapiens
uucaagcagucgugccugugucc

SEQ ID NO: 1362295 - RNA, 15 nt, Homo sapiens
uucaagugccaaaca

SEQ ID NO: 1362296 - RNA, 20 nt, Homo sapiens
uucaagugccuagacuguua

SEQ ID NO: 1362297 - RNA, 23 nt, Homo sapiens
uucaaguuaaugcaaaugacugu

SEQ ID NO: 1362298 - RNA, 16 nt, Homo sapiens
uucacauuguacuuaa

SEQ ID NO: 1362299 - RNA, 12 nt, Homo sapiens
uucagaugugaa

SEQ ID NO: 1362300 - RNA, 14 nt, Homo sapiens
uucagcucugcaag

SEQ ID NO: 1362301 - RNA, 18 nt, Homo sapiens
uucagguccaggcugugu

SEQ ID NO: 1362302 - RNA, 21 nt, Homo sapiens
uucaggugaagcuggagcuca

SEQ ID NO: 1362303 - RNA, 13 nt, Homo sapiens
uucagucuugccu

SEQ ID NO: 1362304 - RNA, 16 nt, Homo sapiens
uucauacuccuuuuaa

SEQ ID NO: 1362305 - RNA, 20 nt, Homo sapiens
uucauauauuuguaugaucc

SEQ ID NO: 1362306 - RNA, 22 nt, Homo sapiens
uucaucaaguagcguuggagac

SEQ ID NO: 1362307 - RNA, 19 nt, Homo sapiens
uucauggcugaagucaccu

SEQ ID NO: 1362308 - RNA, 13 nt, Homo sapiens
uuccaaaaacugu

SEQ ID NO: 1362309 - RNA, 13 nt, Homo sapiens
uuccaaaagcaaa

SEQ ID NO: 1362310 - RNA, 18 nt, Homo sapiens
uuccaaaagcaaaugaua

SEQ ID NO: 1362311 - RNA, 20 nt, Homo sapiens
uuccagaaaacaaaacugca

SEQ ID NO: 1362312 - RNA, 17 nt, Homo sapiens
uuccagaguccuccuuu

SEQ ID NO: 1362313 - RNA, 18 nt, Homo sapiens
uuccauuuccaagcacuu

SEQ ID NO: 1362314 - RNA, 21 nt, Homo sapiens
uucccaucuuaaauuucuaaa

SEQ ID NO: 1362315 - RNA, 15 nt, Homo sapiens
uuccccacaggugaa

SEQ ID NO: 1362316 - RNA, 12 nt, Homo sapiens
uuccccagagaa

SEQ ID NO: 1362317 - RNA, 19 nt, Homo sapiens
uucccucucaugacuugca

SEQ ID NO: 1362318 - RNA, 12 nt, Homo sapiens
uuccuacuggag

SEQ ID NO: 1362319 - RNA, 23 nt, Homo sapiens
uuccucauuagcauuuugcuaaa

SEQ ID NO: 1362320 - RNA, 15 nt, Homo sapiens
uuccucgaaacugcc

SEQ ID NO: 1362321 - RNA, 16 nt, Homo sapiens
uuccucucauuucccu

SEQ ID NO: 1362322 - RNA, 18 nt, Homo sapiens
uuccugggguaaaguauc

SEQ ID NO: 1362323 - RNA, 20 nt, Homo sapiens
uuccuuggggcaggcaguga

SEQ ID NO: 1362324 - RNA, 20 nt, Homo sapiens
uucgagaccagccuggccaa

SEQ ID NO: 1362325 - RNA, 14 nt, Homo sapiens
uucggucuuuccca

SEQ ID NO: 1362326 - RNA, 17 nt, Homo sapiens
uucguauucccauuaga

SEQ ID NO: 1362327 - RNA, 17 nt, Homo sapiens
uuuccuggucccucacc

SEQ ID NO: 1362328 - RNA, 20 nt, Homo sapiens
uuucucuaacuccugccauu

SEQ ID NO: 1362329 - RNA, 18 nt, Homo sapiens
uuucugucuugucuucaa

SEQ ID NO: 1362330 - RNA, 18 nt, Homo sapiens
uuucuuuuaaaauuuuga

SEQ ID NO: 1362331 - RNA, 20 nt, Homo sapiens
uuugaaauagucugugugaa

SEQ ID NO: 1362332 - RNA, 19 nt, Homo sapiens
uuugaauacaggcauagag

SEQ ID NO: 1362333 - RNA, 16 nt, Homo sapiens
uuugaaucacaguaua

SEQ ID NO: 1362334 - RNA, 16 nt, Homo sapiens
uuugaaugcggcccaa

SEQ ID NO: 1362335 - RNA, 17 nt, Homo sapiens
uuugaggugaggguugg

SEQ ID NO: 1362336 - RNA, 19 nt, Homo sapiens
uuugauagggaacugggga

SEQ ID NO: 1362337 - RNA, 19 nt, Homo sapiens
uuugcuaaaugugaaugau

SEQ ID NO: 1362338 - RNA, 15 nt, Homo sapiens
uuugcuagcagaaau

SEQ ID NO: 1362339 - RNA, 21 nt, Homo sapiens
uuugcuuccucccaacaagca

SEQ ID NO: 1362340 - RNA, 17 nt, Homo sapiens
uuuggauauaagugaua

SEQ ID NO: 1362341 - RNA, 15 nt, Homo sapiens
uuuggauuacuuaaa

SEQ ID NO: 1362342 - RNA, 16 nt, Homo sapiens
uuuggauugggguccc

SEQ ID NO: 1362343 - RNA, 12 nt, Homo sapiens
uuuggcaauuuc

SEQ ID NO: 1362344 - RNA, 19 nt, Homo sapiens
uuuggcuuuucuuuaccag

SEQ ID NO: 1362345 - RNA, 13 nt, Homo sapiens
uuugggccagaca

SEQ ID NO: 1362346 - RNA, 15 nt, Homo sapiens
uuuggggggcagaga

SEQ ID NO: 1362347 - RNA, 19 nt, Homo sapiens
uuuguagcuaacagugaag

SEQ ID NO: 1362348 - RNA, 12 nt, Homo sapiens
uuugugaacugg

SEQ ID NO: 1362349 - RNA, 14 nt, Homo sapiens
uuugugugcgucac

SEQ ID NO: 1362350 - RNA, 22 nt, Homo sapiens
uuuguuuugauguuuguggccu

SEQ ID NO: 1362351 - RNA, 16 nt, Homo sapiens
uuuuaacuuauugaca

SEQ ID NO: 1362352 - RNA, 17 nt, Homo sapiens
uuuuaaugcuauuugaa

SEQ ID NO: 1362353 - RNA, 23 nt, Homo sapiens
uuuuaccaaagugucuuuugaca

SEQ ID NO: 1362354 - RNA, 11 nt, Homo sapiens
uuuuagcucau

SEQ ID NO: 1362355 - RNA, 15 nt, Homo sapiens
uuuuaugaucaaggu

SEQ ID NO: 1362356 - RNA, 17 nt, Homo sapiens
uuuuccaacuuggcugc

SEQ ID NO: 1362357 - RNA, 20 nt, Homo sapiens
uuuucuccucauggauuuga

SEQ ID NO: 1362358 - RNA, 15 nt, Homo sapiens
uuuugccaaucucaa

SEQ ID NO: 1362359 - RNA, 22 nt, Homo sapiens
uuuugcuaaaccuauuucacaa

SEQ ID NO: 1362360 - RNA, 17 nt, Homo sapiens
uuuugugcaaagccaaa

SEQ ID NO: 1362361 - RNA, 18 nt, Homo sapiens
uuuuugcugcugccucuu

SEQ ID NO: 1362362 - RNA, 13 nt, Homo sapiens
cuucugugcugug

SEQ ID NO: 1362363 - RNA, 15 nt, Homo sapiens
cuucugugcugugag

SEQ ID NO: 1362364 - RNA, 15 nt, Homo sapiens
cuucuuaauucucca

SEQ ID NO: 1362365 - RNA, 14 nt, Homo sapiens
cuucuucauauucu

SEQ ID NO: 1362366 - RNA, 22 nt, Homo sapiens
cuucuuggacuucuugaaauca

SEQ ID NO: 1362367 - RNA, 13 nt, Homo sapiens
cuucuuugcccac

SEQ ID NO: 1362368 - RNA, 12 nt, Homo sapiens
cuugaaaacugc

SEQ ID NO: 1362369 - RNA, 13 nt, Homo sapiens
cuugaaaguuuuc

SEQ ID NO: 1362370 - RNA, 15 nt, Homo sapiens
cuugaacuguugccc

SEQ ID NO: 1362371 - RNA, 16 nt, Homo sapiens
cuugaaggugcugacg

SEQ ID NO: 1362372 - RNA, 14 nt, Homo sapiens
cuugaagguggcua

SEQ ID NO: 1362373 - RNA, 14 nt, Homo sapiens
cuugaauagucuca

SEQ ID NO: 1362374 - RNA, 17 nt, Homo sapiens
cuugacagaacacuguc

SEQ ID NO: 1362375 - RNA, 18 nt, Homo sapiens
cuugauaaagggccaaua

SEQ ID NO: 1362376 - RNA, 19 nt, Homo sapiens
cuugaucaugaaucacugc

SEQ ID NO: 1362377 - RNA, 16 nt, Homo sapiens
cuugaugcaguuucau

SEQ ID NO: 1362378 - RNA, 19 nt, Homo sapiens
cuugcaaccuaccuguuga

SEQ ID NO: 1362379 - RNA, 17 nt, Homo sapiens
cuugcagaguacaugau

SEQ ID NO: 1362380 - RNA, 17 nt, Homo sapiens
cuugcagcuaguuuucu

SEQ ID NO: 1362381 - RNA, 14 nt, Homo sapiens
cuugcagggccguu

SEQ ID NO: 1362382 - RNA, 22 nt, Homo sapiens
cuugcaugacaaaggccuguga

SEQ ID NO: 1362383 - RNA, 22 nt, Homo sapiens
cuugccaaaucaaaagacuuuu

SEQ ID NO: 1362384 - RNA, 19 nt, Homo sapiens
cuugccuccaggugcagag

SEQ ID NO: 1362385 - RNA, 18 nt, Homo sapiens
cuugcucacagcugugcu

SEQ ID NO: 1362386 - RNA, 18 nt, Homo sapiens
cuugcucagguacuugua

SEQ ID NO: 1362387 - RNA, 18 nt, Homo sapiens
cuugcucauaugcaugua

SEQ ID NO: 1362388 - RNA, 15 nt, Homo sapiens
cuugcucugucuccc

SEQ ID NO: 1362389 - RNA, 18 nt, Homo sapiens
cuugcugccaaaagccuu

SEQ ID NO: 1362390 - RNA, 17 nt, Homo sapiens
cuugcuguugacauauu

SEQ ID NO: 1362391 - RNA, 19 nt, Homo sapiens
gaacucaaauggggccaga

SEQ ID NO: 1362392 - RNA, 23 nt, Homo sapiens
gaacucaaauggggccagaucca

SEQ ID NO: 1362393 - RNA, 21 nt, Homo sapiens
gaacuccccuugaaaacugcu

SEQ ID NO: 1362394 - RNA, 13 nt, Homo sapiens
gaacuccuaccug

SEQ ID NO: 1362395 - RNA, 18 nt, Homo sapiens
gaacucgcuagguucuua

SEQ ID NO: 1362396 - RNA, 14 nt, Homo sapiens
gaacugcagugaug

SEQ ID NO: 1362397 - RNA, 14 nt, Homo sapiens
gaacuuugagcuac

SEQ ID NO: 1362398 - RNA, 20 nt, Homo sapiens
gaagaaaacagauaacaaau

SEQ ID NO: 1362399 - RNA, 12 nt, Homo sapiens
gaagaaagcaaa

SEQ ID NO: 1362400 - RNA, 13 nt, Homo sapiens
gaagaaagcaaca

SEQ ID NO: 1362401 - RNA, 14 nt, Homo sapiens
gaagaaagcaacaa

SEQ ID NO: 1362402 - RNA, 17 nt, Homo sapiens
gaagacuauauuguaca

SEQ ID NO: 1362403 - RNA, 19 nt, Homo sapiens
gaagagguugggcuuccau

SEQ ID NO: 1362404 - RNA, 20 nt, Homo sapiens
gaagauguuucaaaaaaucu

SEQ ID NO: 1362405 - RNA, 22 nt, Homo sapiens
gaagauuugauguugugaaaua

SEQ ID NO: 1362406 - RNA, 16 nt, Homo sapiens
gaagcaccccaugcca

SEQ ID NO: 1362407 - RNA, 12 nt, Homo sapiens
gaagcacuacac

SEQ ID NO: 1362408 - RNA, 15 nt, Homo sapiens
gaagccaguuaguaa

SEQ ID NO: 1362409 - RNA, 23 nt, Homo sapiens
gaagccauguacucaaguaccac

SEQ ID NO: 1362410 - RNA, 16 nt, Homo sapiens
gaagccucuggcuaga

SEQ ID NO: 1362411 - RNA, 19 nt, Homo sapiens
gaagcuggcacaucuugga

SEQ ID NO: 1362412 - RNA, 14 nt, Homo sapiens
gaagcugucuugga

SEQ ID NO: 1362413 - RNA, 18 nt, Homo sapiens
gaagggauuucauuugaa

SEQ ID NO: 1362414 - RNA, 12 nt, Homo sapiens
gaagggccagag

SEQ ID NO: 1362415 - RNA, 15 nt, Homo sapiens
gaaggggacaauggc

SEQ ID NO: 1362416 - RNA, 21 nt, Homo sapiens
gaagggguguuuauucuucca

SEQ ID NO: 1362417 - RNA, 17 nt, Homo sapiens
gaagguggcuacaaaga

SEQ ID NO: 1362418 - RNA, 16 nt, Homo sapiens
gaagucuggagcaccc

SEQ ID NO: 1362419 - RNA, 20 nt, Homo sapiens
gugggagauguuagacucau

SEQ ID NO: 1362420 - RNA, 13 nt, Homo sapiens
guggucgguggga

SEQ ID NO: 1362421 - RNA, 16 nt, Homo sapiens
gugguguuucuguaag

SEQ ID NO: 1362422 - RNA, 14 nt, Homo sapiens
guguaagaaacaca

SEQ ID NO: 1362423 - RNA, 16 nt, Homo sapiens
gugucaagacauuucu

SEQ ID NO: 1362424 - RNA, 22 nt, Homo sapiens
gugucacucaaggcggugcuug

SEQ ID NO: 1362425 - RNA, 22 nt, Homo sapiens
gugucaguuacuuuuuuaguaa

SEQ ID NO: 1362426 - RNA, 20 nt, Homo sapiens
guguccccucacgcaagugc

SEQ ID NO: 1362427 - RNA, 15 nt, Homo sapiens
gugugugacaauucu

SEQ ID NO: 1362428 - RNA, 14 nt, Homo sapiens
gugugugugcacau

SEQ ID NO: 1362429 - RNA, 16 nt, Homo sapiens
guguuccccacuguau

SEQ ID NO: 1362430 - RNA, 17 nt, Homo sapiens
guguugacaugugcuuu

SEQ ID NO: 1362431 - RNA, 18 nt, Homo sapiens
guguugaggugagucaga

SEQ ID NO: 1362432 - RNA, 18 nt, Homo sapiens
guguuuacauuuacugaa

SEQ ID NO: 1362433 - RNA, 14 nt, Homo sapiens
guuaaaacuacuuu

SEQ ID NO: 1362434 - RNA, 23 nt, Homo sapiens
guuaaaaucuuagaaaauuaaau

SEQ ID NO: 1362435 - RNA, 18 nt, Homo sapiens
guuaaugcaaaugacugu

SEQ ID NO: 1362436 - RNA, 14 nt, Homo sapiens
guuacagcacaaaa

SEQ ID NO: 1362437 - RNA, 16 nt, Homo sapiens
guuacagcacaaaaug

SEQ ID NO: 1362438 - RNA, 16 nt, Homo sapiens
guuacugggcccugag

SEQ ID NO: 1362439 - RNA, 14 nt, Homo sapiens
guuacugucuucag

SEQ ID NO: 1362440 - RNA, 13 nt, Homo sapiens
guuagauguccuc

SEQ ID NO: 1362441 - RNA, 17 nt, Homo sapiens
guuagauguccucagaa

SEQ ID NO: 1362442 - RNA, 18 nt, Homo sapiens
cugcacagcuuacacugu

SEQ ID NO: 1362443 - RNA, 15 nt, Homo sapiens
cugcacaggcacugu

SEQ ID NO: 1362444 - RNA, 14 nt, Homo sapiens
cugcacuacugaca

SEQ ID NO: 1362445 - RNA, 14 nt, Homo sapiens
cugcacuccagccu

SEQ ID NO: 1362446 - RNA, 22 nt, Homo sapiens
cugcaggccccggggaccccag

SEQ ID NO: 1362447 - RNA, 11 nt, Homo sapiens
cugcagggucc

SEQ ID NO: 1362448 - RNA, 20 nt, Homo sapiens
cugcagucaucuugaccaag

SEQ ID NO: 1362449 - RNA, 13 nt, Homo sapiens
cugccagggagcu

SEQ ID NO: 1362450 - RNA, 15 nt, Homo sapiens
cugccagggcaccua

SEQ ID NO: 1362451 - RNA, 13 nt, Homo sapiens
cugccagugcaga

SEQ ID NO: 1362452 - RNA, 17 nt, Homo sapiens
cugccaucuagccagcc

SEQ ID NO: 1362453 - RNA, 15 nt, Homo sapiens
cugccaugccagcuu

SEQ ID NO: 1362454 - RNA, 13 nt, Homo sapiens
cugccaugcuucc

SEQ ID NO: 1362455 - RNA, 13 nt, Homo sapiens
cugccauguacua

SEQ ID NO: 1362456 - RNA, 20 nt, Homo sapiens
cugcccaacccuucccucac

SEQ ID NO: 1362457 - RNA, 13 nt, Homo sapiens
cugcccacuucac

SEQ ID NO: 1362458 - RNA, 17 nt, Homo sapiens
cugccgaaccaaaagaa

SEQ ID NO: 1362459 - RNA, 18 nt, Homo sapiens
cugccucuuucccuagga

SEQ ID NO: 1362460 - RNA, 16 nt, Homo sapiens
cugccuggcaggugug

SEQ ID NO: 1362461 - RNA, 19 nt, Homo sapiens
cugccuuugcaccacggga

SEQ ID NO: 1362462 - RNA, 21 nt, Homo sapiens
cugcuacuggcaaaaggaucu

SEQ ID NO: 1362463 - RNA, 14 nt, Homo sapiens
cugcucagggcugg

SEQ ID NO: 1362464 - RNA, 13 nt, Homo sapiens
cugcuccacccuu

SEQ ID NO: 1362465 - RNA, 22 nt, Homo sapiens
cugcucugucuucuuugcccac

SEQ ID NO: 1362466 - RNA, 22 nt, Homo sapiens
cugcucuuucucugccagugac

SEQ ID NO: 1362467 - RNA, 14 nt, Homo sapiens
cugcugacugccaa

SEQ ID NO: 1362468 - RNA, 13 nt, Homo sapiens
cugcugaggcucc

SEQ ID NO: 1362469 - RNA, 17 nt, Homo sapiens
cugcuuuggaaaucaca

SEQ ID NO: 1362470 - RNA, 16 nt, Homo sapiens
cuggaaccugcaaaaa

SEQ ID NO: 1362471 - RNA, 12 nt, Homo sapiens
cuggaagccaaa

SEQ ID NO: 1362472 - RNA, 19 nt, Homo sapiens
cuggaaguuucacuggcug

SEQ ID NO: 1362473 - RNA, 12 nt, Homo sapiens
cuggagauccuc

SEQ ID NO: 1362474 - RNA, 17 nt, Homo sapiens
cuggaggggccaugggg

SEQ ID NO: 1362475 - RNA, 19 nt, Homo sapiens
cuggagugcaguggcgcau

SEQ ID NO: 1362476 - RNA, 19 nt, Homo sapiens
cuggaugucugggugaccu

SEQ ID NO: 1362477 - RNA, 21 nt, Homo sapiens
cuggauuccucgaaacugcca

SEQ ID NO: 1362478 - RNA, 17 nt, Homo sapiens
cuggcccuccacuccuc

SEQ ID NO: 1362479 - RNA, 19 nt, Homo sapiens
cuggccuccuaugccucau

SEQ ID NO: 1362480 - RNA, 15 nt, Homo sapiens
cuggccuguacccag

SEQ ID NO: 1362481 - RNA, 22 nt, Homo sapiens
cuggcuagaguccucacuccca

SEQ ID NO: 1362482 - RNA, 15 nt, Homo sapiens
cuggcuuagugccac

SEQ ID NO: 1362483 - RNA, 17 nt, Homo sapiens
cugggaccaggcuccaa

SEQ ID NO: 1362484 - RNA, 18 nt, Homo sapiens
cugggcagaaggccaaga

SEQ ID NO: 1362485 - RNA, 19 nt, Homo sapiens
cuggggcaggucacuuuac

SEQ ID NO: 1362486 - RNA, 17 nt, Homo sapiens
cuggggggacccagugc

SEQ ID NO: 1362487 - RNA, 22 nt, Homo sapiens
cuggguccccuucgcaguguuu

SEQ ID NO: 1362488 - RNA, 14 nt, Homo sapiens
cugggugaccucac

SEQ ID NO: 1362489 - RNA, 19 nt, Homo sapiens
cugggugaccucacuuuag

SEQ ID NO: 1362490 - RNA, 12 nt, Homo sapiens
cugggugcuccc

SEQ ID NO: 1362491 - RNA, 15 nt, Homo sapiens
cuggguguggggaca

SEQ ID NO: 1362492 - RNA, 20 nt, Homo sapiens
cuggguucccuuuccuucca

SEQ ID NO: 1362493 - RNA, 11 nt, Homo sapiens
cuggugcacag

SEQ ID NO: 1362494 - RNA, 12 nt, Homo sapiens
cuggugccauuu

SEQ ID NO: 1362495 - RNA, 13 nt, Homo sapiens
cuggugccauuuc

SEQ ID NO: 1362496 - RNA, 17 nt, Homo sapiens
cuggugcuacuccaugc

SEQ ID NO: 1362497 - RNA, 19 nt, Homo sapiens
cugguucugcaaugacugc

SEQ ID NO: 1362498 - RNA, 13 nt, Homo sapiens
cugguuuucacau

SEQ ID NO: 1362499 - RNA, 18 nt, Homo sapiens
cuguaaucccagcauuuu

SEQ ID NO: 1362500 - RNA, 14 nt, Homo sapiens
cuguaaucccagcu

SEQ ID NO: 1362501 - RNA, 17 nt, Homo sapiens
cuguaauuguauuucaa

SEQ ID NO: 1362502 - RNA, 12 nt, Homo sapiens
cuguacuguuac

SEQ ID NO: 1362503 - RNA, 14 nt, Homo sapiens
cuguagacugccau

SEQ ID NO: 1362504 - RNA, 17 nt, Homo sapiens
cuguauuagucacagag

SEQ ID NO: 1362505 - RNA, 12 nt, Homo sapiens
cugucaaacaaa

SEQ ID NO: 1362506 - RNA, 21 nt, Homo sapiens
cugucaaacaaagccagaagc

SEQ ID NO: 1362507 - RNA, 22 nt, Homo sapiens
cugucaaacaaagccagaagcu

SEQ ID NO: 1362508 - RNA, 18 nt, Homo sapiens
cugucagcuuccaaacau

SEQ ID NO: 1362509 - RNA, 12 nt, Homo sapiens
cugucauccacu

SEQ ID NO: 1362510 - RNA, 13 nt, Homo sapiens
cugucaugguccu

SEQ ID NO: 1362511 - RNA, 23 nt, Homo sapiens
cuguccacgcgugccguggcacc

SEQ ID NO: 1362512 - RNA, 14 nt, Homo sapiens
cugucccuucuccc

SEQ ID NO: 1362513 - RNA, 15 nt, Homo sapiens
cuguccucagccuug

SEQ ID NO: 1362514 - RNA, 15 nt, Homo sapiens
cugucggugggacuc

SEQ ID NO: 1362515 - RNA, 21 nt, Homo sapiens
cugucuuggaagucugucuca

SEQ ID NO: 1362516 - RNA, 14 nt, Homo sapiens
cugucuugucuuca

SEQ ID NO: 1362517 - RNA, 16 nt, Homo sapiens
cugugaaauaccacaa

SEQ ID NO: 1362518 - RNA, 17 nt, Homo sapiens
cugugaaauaccacaag

SEQ ID NO: 1362519 - RNA, 16 nt, Homo sapiens
cugugacccaucugua

SEQ ID NO: 1362520 - RNA, 24 nt, Homo sapiens
cugugacuggcagcauugacucug

SEQ ID NO: 1362521 - RNA, 19 nt, Homo sapiens
cugugcuauggugcucugu

SEQ ID NO: 1362522 - RNA, 17 nt, Homo sapiens
cuguggccagccuggca

SEQ ID NO: 1362523 - RNA, 13 nt, Homo sapiens
cugugggggaaac

SEQ ID NO: 1362524 - RNA, 21 nt, Homo sapiens
cuguuccccucugcuacuagc

SEQ ID NO: 1362525 - RNA, 23 nt, Homo sapiens
cuguugaaggacuacagguauuu

SEQ ID NO: 1362526 - RNA, 14 nt, Homo sapiens
cuguuggugggacc

SEQ ID NO: 1362527 - RNA, 23 nt, Homo sapiens
cuguuuguuuggcuguccagcga

SEQ ID NO: 1362528 - RNA, 15 nt, Homo sapiens
cuguuuuucagggag

SEQ ID NO: 1362529 - RNA, 23 nt, Homo sapiens
cuuaaaccgccaaggcuggggga

SEQ ID NO: 1362530 - RNA, 14 nt, Homo sapiens
cuuaaauaugugaa

SEQ ID NO: 1362531 - RNA, 13 nt, Homo sapiens
cuuaagaauacac

SEQ ID NO: 1362532 - RNA, 16 nt, Homo sapiens
cuuaagagacacucca

SEQ ID NO: 1362533 - RNA, 14 nt, Homo sapiens
cuuaagcaaaagaa

SEQ ID NO: 1362534 - RNA, 16 nt, Homo sapiens
cuuaagccauaaaaua

SEQ ID NO: 1362535 - RNA, 15 nt, Homo sapiens
cuuacuuaggugugg

SEQ ID NO: 1362536 - RNA, 17 nt, Homo sapiens
cuuagcagcuuccagau

SEQ ID NO: 1362537 - RNA, 14 nt, Homo sapiens
cuuaggcagggaag

SEQ ID NO: 1362538 - RNA, 16 nt, Homo sapiens
cuuagugacaaaauag

SEQ ID NO: 1362539 - RNA, 21 nt, Homo sapiens
cuuagugccacccaccuuugc

SEQ ID NO: 1362540 - RNA, 16 nt, Homo sapiens
cuuauacuguacaaua

SEQ ID NO: 1362541 - RNA, 14 nt, Homo sapiens
cuuauuucaucugu

SEQ ID NO: 1362542 - RNA, 18 nt, Homo sapiens
cuucaaaugccugacuag

SEQ ID NO: 1362543 - RNA, 13 nt, Homo sapiens
cuucacuauacaa

SEQ ID NO: 1362544 - RNA, 14 nt, Homo sapiens
cuucaggcaccuga

SEQ ID NO: 1362545 - RNA, 18 nt, Homo sapiens
cuucagucuugaugcagu

SEQ ID NO: 1362546 - RNA, 16 nt, Homo sapiens
cuucauagaaaccucu

SEQ ID NO: 1362547 - RNA, 17 nt, Homo sapiens
cuucauuuaacaaguaa

SEQ ID NO: 1362548 - RNA, 18 nt, Homo sapiens
cuuccaaaugucccucca

SEQ ID NO: 1362549 - RNA, 14 nt, Homo sapiens
cuuccaucuaguca

SEQ ID NO: 1362550 - RNA, 17 nt, Homo sapiens
cuucccucucaugacuu

SEQ ID NO: 1362551 - RNA, 19 nt, Homo sapiens
cuucccugguaccuagcaa

SEQ ID NO: 1362552 - RNA, 18 nt, Homo sapiens
cuuccguucauugcucuc

SEQ ID NO: 1362553 - RNA, 23 nt, Homo sapiens
cuuccuuuuauuccucacucggg

SEQ ID NO: 1362554 - RNA, 17 nt, Homo sapiens
cuucuaaucaaagcuuu

SEQ ID NO: 1362555 - RNA, 18 nt, Homo sapiens
cuucuaggguuauugcau

SEQ ID NO: 1362556 - RNA, 17 nt, Homo sapiens
cuucucccaaagugucc

SEQ ID NO: 1362557 - RNA, 12 nt, Homo sapiens
cuucuccugacc

SEQ ID NO: 1362558 - RNA, 13 nt, Homo sapiens
cuucucugcucca

SEQ ID NO: 1362559 - RNA, 14 nt, Homo sapiens
cuucuggccaggaa

SEQ ID NO: 1362560 - RNA, 16 nt, Homo sapiens
uaaugcucaccuuuau

SEQ ID NO: 1362561 - RNA, 15 nt, Homo sapiens
uaaugcucugauaug

SEQ ID NO: 1362562 - RNA, 17 nt, Homo sapiens
uaaugugaagcaaaaca

SEQ ID NO: 1362563 - RNA, 14 nt, Homo sapiens
uaauuacuucacua

SEQ ID NO: 1362564 - RNA, 17 nt, Homo sapiens
uaauuauacuacuuugu

SEQ ID NO: 1362565 - RNA, 14 nt, Homo sapiens
uaauucaaaagcac

SEQ ID NO: 1362566 - RNA, 14 nt, Homo sapiens
uaauugcuuugcca

SEQ ID NO: 1362567 - RNA, 10 nt, Homo sapiens
uaauuucaaa

SEQ ID NO: 1362568 - RNA, 15 nt, Homo sapiens
uacaaauucuucuaa

SEQ ID NO: 1362569 - RNA, 17 nt, Homo sapiens
uacaacuuguauuucca

SEQ ID NO: 1362570 - RNA, 16 nt, Homo sapiens
uacaagucagcuccag

SEQ ID NO: 1362571 - RNA, 16 nt, Homo sapiens
uacacacucagugaca

SEQ ID NO: 1362572 - RNA, 17 nt, Homo sapiens
uacacacucagugacau

SEQ ID NO: 1362573 - RNA, 15 nt, Homo sapiens
uacacacuugcauga

SEQ ID NO: 1362574 - RNA, 18 nt, Homo sapiens
uacaccuuccuacauuuu

SEQ ID NO: 1362575 - RNA, 12 nt, Homo sapiens
uacacuaugaag

SEQ ID NO: 1362576 - RNA, 17 nt, Homo sapiens
uacaggaagcaccccau

SEQ ID NO: 1362577 - RNA, 20 nt, Homo sapiens
uacaggcauagaguucagac

SEQ ID NO: 1362578 - RNA, 16 nt, Homo sapiens
uacaguaucucagggc

SEQ ID NO: 1362579 - RNA, 15 nt, Homo sapiens
uacaguucugucaua

SEQ ID NO: 1362580 - RNA, 13 nt, Homo sapiens
uacaucucagugc

SEQ ID NO: 1362581 - RNA, 19 nt, Homo sapiens
uacauugugggauguucag

SEQ ID NO: 1362582 - RNA, 21 nt, Homo sapiens
ucuuaaaaaucuaugccuaaa

SEQ ID NO: 1362583 - RNA, 20 nt, Homo sapiens
ucuuagaagcacuacaccuu

SEQ ID NO: 1362584 - RNA, 16 nt, Homo sapiens
ucuuagucgagccaag

SEQ ID NO: 1362585 - RNA, 23 nt, Homo sapiens
ucuuauuuuuuucgccuucacug

SEQ ID NO: 1362586 - RNA, 15 nt, Homo sapiens
ucuucaccuuauuca

SEQ ID NO: 1362587 - RNA, 20 nt, Homo sapiens
ucuucagucuggacuauauu

SEQ ID NO: 1362588 - RNA, 17 nt, Homo sapiens
ucuuccaaaggcagcgu

SEQ ID NO: 1362589 - RNA, 22 nt, Homo sapiens
ucuuccguggucagagugccac

SEQ ID NO: 1362590 - RNA, 22 nt, Homo sapiens
ucuucugaauauuuuaucuuuc

SEQ ID NO: 1362591 - RNA, 19 nt, Homo sapiens
ucuucuuggggcccagugc

SEQ ID NO: 1362592 - RNA, 16 nt, Homo sapiens
ucuugagcaguggcug

SEQ ID NO: 1362593 - RNA, 16 nt, Homo sapiens
ucuuguuguuauugau

SEQ ID NO: 1362594 - RNA, 17 nt, Homo sapiens
ucuuuaccaguuucuga

SEQ ID NO: 1362595 - RNA, 22 nt, Homo sapiens
ucuuucucugccagugacagac

SEQ ID NO: 1362596 - RNA, 22 nt, Homo sapiens
ucuuugggccagacaugccaca

SEQ ID NO: 1362597 - RNA, 22 nt, Homo sapiens
ugaaaaaauacccucugacugu

SEQ ID NO: 1362598 - RNA, 20 nt, Homo sapiens
ugaaaaaucuuaaguaccaa

SEQ ID NO: 1362599 - RNA, 21 nt, Homo sapiens
ugcauaaaauagagugcauuu

SEQ ID NO: 1362600 - RNA, 20 nt, Homo sapiens
ugcauaaaauguuaaguuga

SEQ ID NO: 1362601 - RNA, 16 nt, Homo sapiens
ugcauaagaaauguag

SEQ ID NO: 1362602 - RNA, 22 nt, Homo sapiens
ugcauaagugaaaaucuuacaa

SEQ ID NO: 1362603 - RNA, 13 nt, Homo sapiens
ugcauauauacau

SEQ ID NO: 1362604 - RNA, 16 nt, Homo sapiens
ugcaucugaccagcag

SEQ ID NO: 1362605 - RNA, 24 nt, Homo sapiens
ugcauguagucacuuuauaaguca

SEQ ID NO: 1362606 - RNA, 17 nt, Homo sapiens
ugcauuaucuaugauau

SEQ ID NO: 1362607 - RNA, 21 nt, Homo sapiens
ugcauuuuuguaaauguguac

SEQ ID NO: 1362608 - RNA, 14 nt, Homo sapiens
ugccaaaaugcucu

SEQ ID NO: 1362609 - RNA, 16 nt, Homo sapiens
ugccacuaaacuacau

SEQ ID NO: 1362610 - RNA, 15 nt, Homo sapiens
ugccagugacagaca

SEQ ID NO: 1362611 - RNA, 11 nt, Homo sapiens
ugccagugcag

SEQ ID NO: 1362612 - RNA, 17 nt, Homo sapiens
ugccagugggaacuccu

SEQ ID NO: 1362613 - RNA, 22 nt, Homo sapiens
ugcccaugguguguguguccag

SEQ ID NO: 1362614 - RNA, 12 nt, Homo sapiens
ugccccugagac

SEQ ID NO: 1362615 - RNA, 20 nt, Homo sapiens
uggguucacagaucuuucug

SEQ ID NO: 1362616 - RNA, 23 nt, Homo sapiens
uggguugcaggaccucaggugag

SEQ ID NO: 1362617 - RNA, 15 nt, Homo sapiens
ugguaaaaacugcag

SEQ ID NO: 1362618 - RNA, 22 nt, Homo sapiens
ugguaaaaacugcagugucuuu

SEQ ID NO: 1362619 - RNA, 23 nt, Homo sapiens
ugguaacugauuaccugccaauu

SEQ ID NO: 1362620 - RNA, 21 nt, Homo sapiens
ugguaauuguacuaaagccaa

SEQ ID NO: 1362621 - RNA, 17 nt, Homo sapiens
uggucagagugccacug

SEQ ID NO: 1362622 - RNA, 20 nt, Homo sapiens
ugguccuuagccccaucugc

SEQ ID NO: 1362623 - RNA, 15 nt, Homo sapiens
uggucggugggaccc

SEQ ID NO: 1362624 - RNA, 22 nt, Homo sapiens
uggugccauuucugaacuguua

SEQ ID NO: 1362625 - RNA, 19 nt, Homo sapiens
ugguggcgggcgccuguag

SEQ ID NO: 1362626 - RNA, 17 nt, Homo sapiens
ugguuaaauaauugaca

SEQ ID NO: 1362627 - RNA, 23 nt, Homo sapiens
ugguucauauuuauacuuugcaa

SEQ ID NO: 1362628 - RNA, 20 nt, Homo sapiens
uguaaagagagcaagacaga

SEQ ID NO: 1362629 - RNA, 15 nt, Homo sapiens
uguaaagcaggugcc

SEQ ID NO: 1362630 - RNA, 21 nt, Homo sapiens
uguaaagcaggugcccaggaa

SEQ ID NO: 1362631 - RNA, 17 nt, Homo sapiens
uguaagaaguuucuuaa

SEQ ID NO: 1362632 - RNA, 15 nt, Homo sapiens
uguaagugggcccac

SEQ ID NO: 1362633 - RNA, 21 nt, Homo sapiens
uguacaauaaaaacauugccu

SEQ ID NO: 1362634 - RNA, 15 nt, Homo sapiens
uguacagacauauuu

SEQ ID NO: 1362635 - RNA, 15 nt, Homo sapiens
uguacauugugggau

SEQ ID NO: 1362636 - RNA, 12 nt, Homo sapiens
uguacucagugg

SEQ ID NO: 1362637 - RNA, 20 nt, Homo sapiens
uguagaaaauaaaacugagc

SEQ ID NO: 1362638 - RNA, 22 nt, Homo sapiens
uguagagacgguguuuugccau

SEQ ID NO: 1362639 - RNA, 10 nt, Homo sapiens
uguagagugg

SEQ ID NO: 1362640 - RNA, 15 nt, Homo sapiens
uguagcuaacaguga

SEQ ID NO: 1362641 - RNA, 16 nt, Homo sapiens
uguagcuaacagugaa

SEQ ID NO: 1362642 - RNA, 20 nt, Homo sapiens
uguagcucuaggguauauau

SEQ ID NO: 1362643 - RNA, 17 nt, Homo sapiens
uguaguccgugcugaca

SEQ ID NO: 1362644 - RNA, 23 nt, Homo sapiens
uguauaaauuauucaguaacugu

SEQ ID NO: 1362645 - RNA, 12 nt, Homo sapiens
uguauauuacau

SEQ ID NO: 1362646 - RNA, 21 nt, Homo sapiens
uguaugauccuaaugaaugca

SEQ ID NO: 1362647 - RNA, 17 nt, Homo sapiens
uguauuagucacagaga

SEQ ID NO: 1362648 - RNA, 17 nt, Homo sapiens
ugucaaucacagucuca

SEQ ID NO: 1362649 - RNA, 15 nt, Homo sapiens
ugucagaaguugaua

SEQ ID NO: 1362650 - RNA, 20 nt, Homo sapiens
ugucagugacuuugagcuga

SEQ ID NO: 1362651 - RNA, 16 nt, Homo sapiens
ugucauccacuuuaug

SEQ ID NO: 1362652 - RNA, 13 nt, Homo sapiens
uguccagcaccuu

SEQ ID NO: 1362653 - RNA, 14 nt, Homo sapiens
uguccagcaccuug

SEQ ID NO: 1362654 - RNA, 16 nt, Homo sapiens
ugucccacugcugcuu

SEQ ID NO: 1362655 - RNA, 23 nt, Homo sapiens
ugucccuucucccaucagggucc

SEQ ID NO: 1362656 - RNA, 19 nt, Homo sapiens
uguccggucccugucccag

SEQ ID NO: 1362657 - RNA, 13 nt, Homo sapiens
uguccguccucag

SEQ ID NO: 1362658 - RNA, 19 nt, Homo sapiens
uguccucagccuugccaga

SEQ ID NO: 1362659 - RNA, 21 nt, Homo sapiens
uguccuguacauugugggaug

SEQ ID NO: 1362660 - RNA, 18 nt, Homo sapiens
ugucguauaggcauguaa

SEQ ID NO: 1362661 - RNA, 18 nt, Homo sapiens
ugucuacguuaccaggca

SEQ ID NO: 1362662 - RNA, 19 nt, Homo sapiens
ugucugaacaggaugcuga

SEQ ID NO: 1362663 - RNA, 22 nt, Homo sapiens
ugucugggugaccucacuuuag

SEQ ID NO: 1362664 - RNA, 19 nt, Homo sapiens
ugucuguuuccucuguaua

SEQ ID NO: 1362665 - RNA, 15 nt, Homo sapiens
ugucuucuuugccca

SEQ ID NO: 1362666 - RNA, 23 nt, Homo sapiens
ugugauuuuuaaucgcuuugaua

SEQ ID NO: 1362667 - RNA, 10 nt, Homo sapiens
ugugcacauc

SEQ ID NO: 1362668 - RNA, 13 nt, Homo sapiens
ugugcuacagaug

SEQ ID NO: 1362669 - RNA, 13 nt, Homo sapiens
ugugcucagggaa

SEQ ID NO: 1362670 - RNA, 19 nt, Homo sapiens
uguggaggcuccuguggua

SEQ ID NO: 1362671 - RNA, 23 nt, Homo sapiens
uguggauggugucuccuuuacua

SEQ ID NO: 1362672 - RNA, 20 nt, Homo sapiens
uguggccuucggacaacuca

SEQ ID NO: 1362673 - RNA, 12 nt, Homo sapiens
uguggcuuugau

SEQ ID NO: 1362674 - RNA, 21 nt, Homo sapiens
uguggggagggcagguccagc

SEQ ID NO: 1362675 - RNA, 15 nt, Homo sapiens
uguggguaccuguau

SEQ ID NO: 1362676 - RNA, 21 nt, Homo sapiens
uguguaaaaaaaccaccaaaa

SEQ ID NO: 1362677 - RNA, 19 nt, Homo sapiens
ugugucccaggcagggaga

SEQ ID NO: 1362678 - RNA, 21 nt, Homo sapiens
ugugucucccaggugcauuuc

SEQ ID NO: 1362679 - RNA, 12 nt, Homo sapiens
ugugugaucugu

SEQ ID NO: 1362680 - RNA, 18 nt, Homo sapiens
ugugugaucugugggcac

SEQ ID NO: 1362681 - RNA, 21 nt, Homo sapiens
ugugugaucugugggcacauu

SEQ ID NO: 1362682 - RNA, 16 nt, Homo sapiens
ugugugugugugcaca

SEQ ID NO: 1362683 - RNA, 18 nt, Homo sapiens
uguguuuugaaagcccaa

SEQ ID NO: 1362684 - RNA, 19 nt, Homo sapiens
uguguuuuguuuuguauca

SEQ ID NO: 1362685 - RNA, 13 nt, Homo sapiens
uguuaaaacuacu

SEQ ID NO: 1362686 - RNA, 15 nt, Homo sapiens
uguuacugucuucag

SEQ ID NO: 1362687 - RNA, 23 nt, Homo sapiens
uguuauuauauuccguagguaga

SEQ ID NO: 1362688 - RNA, 16 nt, Homo sapiens
uguuauugauguugcu

SEQ ID NO: 1362689 - RNA, 13 nt, Homo sapiens
uguuccccagaga

SEQ ID NO: 1362690 - RNA, 23 nt, Homo sapiens
uguucccuauuuugccaguggga

SEQ ID NO: 1362691 - RNA, 17 nt, Homo sapiens
uguuccugcuuuucuaa

SEQ ID NO: 1362692 - RNA, 23 nt, Homo sapiens
uguucuggggggacccagugcag

SEQ ID NO: 1362693 - RNA, 19 nt, Homo sapiens
uguucuucuucauauucua

SEQ ID NO: 1362694 - RNA, 14 nt, Homo sapiens
uguuggugggaccc

SEQ ID NO: 1362695 - RNA, 20 nt, Homo sapiens
uguuuggauccugacucaaa

SEQ ID NO: 1362696 - RNA, 15 nt, Homo sapiens
uguuuggcuguccag

SEQ ID NO: 1362697 - RNA, 17 nt, Homo sapiens
uguuuguuucuguagaa

SEQ ID NO: 1362698 - RNA, 15 nt, Homo sapiens
uguuuucuuugcaaa

SEQ ID NO: 1362699 - RNA, 18 nt, Homo sapiens
uguuuuguguaacauauu

SEQ ID NO: 1362700 - RNA, 19 nt, Homo sapiens
uuaaaaacuuaaguaccaa

SEQ ID NO: 1362701 - RNA, 14 nt, Homo sapiens
uuaaaacacuuuca

SEQ ID NO: 1362702 - RNA, 15 nt, Homo sapiens
uuaaaacuacuuuag

SEQ ID NO: 1362703 - RNA, 19 nt, Homo sapiens
uuaaaacuggaccuguaua

SEQ ID NO: 1362704 - RNA, 16 nt, Homo sapiens
uuaaaagucaguauca

SEQ ID NO: 1362705 - RNA, 17 nt, Homo sapiens
uuaaacaaauguaugau

SEQ ID NO: 1362706 - RNA, 13 nt, Homo sapiens
uuaaagagcacug

SEQ ID NO: 1362707 - RNA, 14 nt, Homo sapiens
uuaaauaaauggaa

SEQ ID NO: 1362708 - RNA, 12 nt, Homo sapiens
uuaaauaguaaa

SEQ ID NO: 1362709 - RNA, 21 nt, Homo sapiens
uuaaauauuuuggcauuguac

SEQ ID NO: 1362710 - RNA, 14 nt, Homo sapiens
uuaaauuacaauuu

SEQ ID NO: 1362711 - RNA, 17 nt, Homo sapiens
uuaaauuacaauuuuau

SEQ ID NO: 1362712 - RNA, 14 nt, Homo sapiens
uuaaauuccacaga

SEQ ID NO: 1362713 - RNA, 15 nt, Homo sapiens
uuaaauuccacagau

SEQ ID NO: 1362714 - RNA, 17 nt, Homo sapiens
uuaaauuccacagauua

SEQ ID NO: 1362715 - RNA, 17 nt, Homo sapiens
uuaaauuuuaauucuuc

SEQ ID NO: 1362716 - RNA, 13 nt, Homo sapiens
uuaaccugcaaaa

SEQ ID NO: 1362717 - RNA, 21 nt, Homo sapiens
uuaacugugaaauaccacaag

SEQ ID NO: 1362718 - RNA, 22 nt, Homo sapiens
uuaacugugaaauaccacaagc

SEQ ID NO: 1362719 - RNA, 20 nt, Homo sapiens
uuaagaauguucuuauguug

SEQ ID NO: 1362720 - RNA, 18 nt, Homo sapiens
uuaagacaacaggcauuu

SEQ ID NO: 1362721 - RNA, 15 nt, Homo sapiens
uuaagagacacucca

SEQ ID NO: 1362722 - RNA, 17 nt, Homo sapiens
uuaaguugauggugaug

SEQ ID NO: 1362723 - RNA, 18 nt, Homo sapiens
uuaauagggaauauaucu

SEQ ID NO: 1362724 - RNA, 16 nt, Homo sapiens
uuaaucccuuugucug

SEQ ID NO: 1362725 - RNA, 17 nt, Homo sapiens
uuaaugcaaaugacugu

SEQ ID NO: 1362726 - RNA, 21 nt, Homo sapiens
uuaaugugaagcaaaacacaa

SEQ ID NO: 1362727 - RNA, 20 nt, Homo sapiens
uuacaaaaccaucauuucaa

SEQ ID NO: 1362728 - RNA, 17 nt, Homo sapiens
uuacacacaugagggcu

SEQ ID NO: 1362729 - RNA, 17 nt, Homo sapiens
uuacauuugaaaucuau

SEQ ID NO: 1362730 - RNA, 19 nt, Homo sapiens
uuacauuugaaaucuauga

SEQ ID NO: 1362731 - RNA, 18 nt, Homo sapiens
ugcugcggagcuuuccac

SEQ ID NO: 1362732 - RNA, 17 nt, Homo sapiens
ugcuggaaccugcaaaa

SEQ ID NO: 1362733 - RNA, 19 nt, Homo sapiens
ugcuguuagauguccucag

SEQ ID NO: 1362734 - RNA, 21 nt, Homo sapiens
ugcuguuucacaauaccucau

SEQ ID NO: 1362735 - RNA, 15 nt, Homo sapiens
ugcuuaagugcaugc

SEQ ID NO: 1362736 - RNA, 23 nt, Homo sapiens
ugcuucauuucuuuuucauuuga

SEQ ID NO: 1362737 - RNA, 18 nt, Homo sapiens
ugcuuccaacucauccac

SEQ ID NO: 1362738 - RNA, 23 nt, Homo sapiens
ugcuuccagaccuaggcucaugg

SEQ ID NO: 1362739 - RNA, 21 nt, Homo sapiens
ugcuuccucccaacaagcagc

SEQ ID NO: 1362740 - RNA, 18 nt, Homo sapiens
ugcuuguaguuauaguga

SEQ ID NO: 1362741 - RNA, 22 nt, Homo sapiens
ugcuuugaaaacaugacucaau

SEQ ID NO: 1362742 - RNA, 14 nt, Homo sapiens
ugcuuugugacuuc

SEQ ID NO: 1362743 - RNA, 19 nt, Homo sapiens
uggaaaacaguauuuucca

SEQ ID NO: 1362744 - RNA, 22 nt, Homo sapiens
uggaaacagggccaggugcuuu

SEQ ID NO: 1362745 - RNA, 17 nt, Homo sapiens
uggaaagaaaaagcaau

SEQ ID NO: 1362746 - RNA, 15 nt, Homo sapiens
uggaacccagacuca

SEQ ID NO: 1362747 - RNA, 20 nt, Homo sapiens
uggaaccucagccuggccag

SEQ ID NO: 1362748 - RNA, 16 nt, Homo sapiens
uggaaccugcaaaaaa

SEQ ID NO: 1362749 - RNA, 13 nt, Homo sapiens
uggaaccuggacc

SEQ ID NO: 1362750 - RNA, 16 nt, Homo sapiens
uggaagaaagcaacaa

SEQ ID NO: 1362751 - RNA, 16 nt, Homo sapiens
uggaagaugugugaua

SEQ ID NO: 1362752 - RNA, 15 nt, Homo sapiens
uggaagugugugauc

SEQ ID NO: 1362753 - RNA, 16 nt, Homo sapiens
uggaauacuaaaguua

SEQ ID NO: 1362754 - RNA, 16 nt, Homo sapiens
uggacaaagaaccuuc

SEQ ID NO: 1362755 - RNA, 22 nt, Homo sapiens
uggacaugcuucagugcugcuc

SEQ ID NO: 1362756 - RNA, 15 nt, Homo sapiens
uggagaaaaggcagu

SEQ ID NO: 1362757 - RNA, 17 nt, Homo sapiens
uggagaaaguauuuuca

SEQ ID NO: 1362758 - RNA, 23 nt, Homo sapiens
uggagaccgugaccagugcugcu

SEQ ID NO: 1362759 - RNA, 19 nt, Homo sapiens
uggagagggugucaucuag

SEQ ID NO: 1362760 - RNA, 21 nt, Homo sapiens
uggagauaccagagacucuga

SEQ ID NO: 1362761 - RNA, 17 nt, Homo sapiens
uggagaucuuaagauuc

SEQ ID NO: 1362762 - RNA, 16 nt, Homo sapiens
uggagggacaugacua

SEQ ID NO: 1362763 - RNA, 13 nt, Homo sapiens
uggaggggccaug

SEQ ID NO: 1362764 - RNA, 22 nt, Homo sapiens
uggauauuaaaaaucuguaaau

SEQ ID NO: 1362765 - RNA, 16 nt, Homo sapiens
uggaugggggaacuca

SEQ ID NO: 1362766 - RNA, 18 nt, Homo sapiens
uggauuccccaucucagg

SEQ ID NO: 1362767 - RNA, 15 nt, Homo sapiens
uggauugcacguggc

SEQ ID NO: 1362768 - RNA, 22 nt, Homo sapiens
uggauugcacguggccucuuga

SEQ ID NO: 1362769 - RNA, 21 nt, Homo sapiens
uggcaauuuccuggcccucca

SEQ ID NO: 1362770 - RNA, 16 nt, Homo sapiens
uggccaaggagcugcu

SEQ ID NO: 1362771 - RNA, 17 nt, Homo sapiens
uggccaaggagcugcua

SEQ ID NO: 1362772 - RNA, 15 nt, Homo sapiens
uggccagguaugcau

SEQ ID NO: 1362773 - RNA, 15 nt, Homo sapiens
uggcccaacacaauu

SEQ ID NO: 1362774 - RNA, 22 nt, Homo sapiens
uggcccaaucucugccauauca

SEQ ID NO: 1362775 - RNA, 17 nt, Homo sapiens
uggcccagagaagccaa

SEQ ID NO: 1362776 - RNA, 16 nt, Homo sapiens
uggcccugcagggucc

SEQ ID NO: 1362777 - RNA, 13 nt, Homo sapiens
uggccuaggcagu

SEQ ID NO: 1362778 - RNA, 22 nt, Homo sapiens
uggcgccccuuccuaggucaug

SEQ ID NO: 1362779 - RNA, 21 nt, Homo sapiens
uggcgcuuagagaggacaaua

SEQ ID NO: 1362780 - RNA, 18 nt, Homo sapiens
uggcgggugccuguaauc

SEQ ID NO: 1362781 - RNA, 19 nt, Homo sapiens
uggcuacacacaaaccagu

SEQ ID NO: 1362782 - RNA, 17 nt, Homo sapiens
uggcuggcugggucccc

SEQ ID NO: 1362783 - RNA, 20 nt, Homo sapiens
uggcugucaaugggaccugu

SEQ ID NO: 1362784 - RNA, 20 nt, Homo sapiens
uggcuguugacgcaccugug

SEQ ID NO: 1362785 - RNA, 22 nt, Homo sapiens
uggcuuccaucucagcacucug

SEQ ID NO: 1362786 - RNA, 14 nt, Homo sapiens
uggcuuugcauuuc

SEQ ID NO: 1362787 - RNA, 15 nt, Homo sapiens
ugggaacugcaauaa

SEQ ID NO: 1362788 - RNA, 16 nt, Homo sapiens
ugggaagaagcugcac

SEQ ID NO: 1362789 - RNA, 17 nt, Homo sapiens
ugggaaggggaggaccc

SEQ ID NO: 1362790 - RNA, 17 nt, Homo sapiens
ugggaauguccuuggca

SEQ ID NO: 1362791 - RNA, 14 nt, Homo sapiens
ugggagugagggau

SEQ ID NO: 1362792 - RNA, 15 nt, Homo sapiens
ugggauggauuucca

SEQ ID NO: 1362793 - RNA, 14 nt, Homo sapiens
ugggcaaugugaua

SEQ ID NO: 1362794 - RNA, 16 nt, Homo sapiens
ugggcacuucaucuga

SEQ ID NO: 1362795 - RNA, 15 nt, Homo sapiens
ugggcagcauacuga

SEQ ID NO: 1362796 - RNA, 16 nt, Homo sapiens
ugggccagacaugcca

SEQ ID NO: 1362797 - RNA, 19 nt, Homo sapiens
ugggccccuggcacucuug

SEQ ID NO: 1362798 - RNA, 22 nt, Homo sapiens
ugggcuaggcauaggucucuuu

SEQ ID NO: 1362799 - RNA, 15 nt, Homo sapiens
uggggcccagugcau

SEQ ID NO: 1362800 - RNA, 10 nt, Homo sapiens
uggggcuccu

SEQ ID NO: 1362801 - RNA, 15 nt, Homo sapiens
ugggggagaagcaag

SEQ ID NO: 1362802 - RNA, 22 nt, Homo sapiens
ugggggaucacagccucugaaa

SEQ ID NO: 1362803 - RNA, 13 nt, Homo sapiens
uggggucaugccc

SEQ ID NO: 1362804 - RNA, 17 nt, Homo sapiens
uggggucuuugagcucc

SEQ ID NO: 1362805 - RNA, 15 nt, Homo sapiens
uggguacuucuugaa

SEQ ID NO: 1362806 - RNA, 22 nt, Homo sapiens
uggguccucgcugcuggcugcu

SEQ ID NO: 1362807 - RNA, 22 nt, Homo sapiens
uggguugcagacaggaaucuua

SEQ ID NO: 1362808 - RNA, 23 nt, Homo sapiens
ugguaaacaguuuggaaaagugg

SEQ ID NO: 1362809 - RNA, 17 nt, Homo sapiens
ugguaguccucccaagc

SEQ ID NO: 1362810 - RNA, 14 nt, Homo sapiens
uggucagagugcca

SEQ ID NO: 1362811 - RNA, 15 nt, Homo sapiens
uggucagagugccac

SEQ ID NO: 1362812 - RNA, 22 nt, Homo sapiens
ugguccgguuauucacuugagu

SEQ ID NO: 1362813 - RNA, 20 nt, Homo sapiens
uggucgagaccuguucacgg

SEQ ID NO: 1362814 - RNA, 16 nt, Homo sapiens
uggucggugggacccu

SEQ ID NO: 1362815 - RNA, 22 nt, Homo sapiens
uggugaaaaugaagggauuuca

SEQ ID NO: 1362816 - RNA, 15 nt, Homo sapiens
ugguggcccagcuau

SEQ ID NO: 1362817 - RNA, 20 nt, Homo sapiens
uggugggccucggguccagc

SEQ ID NO: 1362818 - RNA, 16 nt, Homo sapiens
ugguggguucagggga

SEQ ID NO: 1362819 - RNA, 17 nt, Homo sapiens
uggugucuccuuuacua

SEQ ID NO: 1362820 - RNA, 17 nt, Homo sapiens
ugguuaagacuacugaa

SEQ ID NO: 1362821 - RNA, 14 nt, Homo sapiens
ugguuauauaguca

SEQ ID NO: 1362822 - RNA, 19 nt, Homo sapiens
uguaaaaaaaccaccaaaa

SEQ ID NO: 1362823 - RNA, 23 nt, Homo sapiens
uguaacagcggcaggguguccca

SEQ ID NO: 1362824 - RNA, 16 nt, Homo sapiens
uguaacaugacacuua

SEQ ID NO: 1362825 - RNA, 16 nt, Homo sapiens
uguaagcauacuuugu

SEQ ID NO: 1362826 - RNA, 20 nt, Homo sapiens
uguaauauuccaggaugcug

SEQ ID NO: 1362827 - RNA, 20 nt, Homo sapiens
uguaaucccaacauuuuggg

SEQ ID NO: 1362828 - RNA, 20 nt, Homo sapiens
uguaaucccagcauuuuggg

SEQ ID NO: 1362829 - RNA, 17 nt, Homo sapiens
uguaauuguauuucaaa

SEQ ID NO: 1362830 - RNA, 21 nt, Homo sapiens
uguacaguagauuuuccaaau

SEQ ID NO: 1362831 - RNA, 18 nt, Homo sapiens
uguacauguaacauuaaa

SEQ ID NO: 1362832 - RNA, 18 nt, Homo sapiens
uguacucaaguaccacca

SEQ ID NO: 1362833 - RNA, 15 nt, Homo sapiens
uguacuuaaaccucc

SEQ ID NO: 1362834 - RNA, 22 nt, Homo sapiens
uguagacuguggcuagugacaa

SEQ ID NO: 1362835 - RNA, 13 nt, Homo sapiens
uguagauuucaag

SEQ ID NO: 1362836 - RNA, 19 nt, Homo sapiens
uguaggccuuccagugcag

SEQ ID NO: 1362837 - RNA, 20 nt, Homo sapiens
uguaggccuuccagugcagg

SEQ ID NO: 1362838 - RNA, 20 nt, Homo sapiens
uguagucccagcuacuugag

SEQ ID NO: 1362839 - RNA, 16 nt, Homo sapiens
uguaguccgugcugac

SEQ ID NO: 1362840 - RNA, 19 nt, Homo sapiens
uguaguuacaucucagugc

SEQ ID NO: 1362841 - RNA, 21 nt, Homo sapiens
uguauauuuuuuucauuuggc

SEQ ID NO: 1362842 - RNA, 17 nt, Homo sapiens
uguaucuaaaccauaug

SEQ ID NO: 1362843 - RNA, 20 nt, Homo sapiens
uguaugauuacaucaaggcu

SEQ ID NO: 1362844 - RNA, 22 nt, Homo sapiens
uguauugggcagcagacugugu

SEQ ID NO: 1362845 - RNA, 12 nt, Homo sapiens
ugucaaugucuu

SEQ ID NO: 1362846 - RNA, 21 nt, Homo sapiens
uguccccuuuccccagugaca

SEQ ID NO: 1362847 - RNA, 18 nt, Homo sapiens
agaugaggcuuuccaugg

SEQ ID NO: 1362848 - RNA, 20 nt, Homo sapiens
agaugcauuaucuaugauau

SEQ ID NO: 1362849 - RNA, 20 nt, Homo sapiens
agaugcuaaaauucuucgca

SEQ ID NO: 1362850 - RNA, 21 nt, Homo sapiens
agauggaaaagggagauucag

SEQ ID NO: 1362851 - RNA, 19 nt, Homo sapiens
agauggcagguuugcaauc

SEQ ID NO: 1362852 - RNA, 17 nt, Homo sapiens
agauguuacaaguuuau

SEQ ID NO: 1362853 - RNA, 22 nt, Homo sapiens
agauuaggucuugcuggaagac

SEQ ID NO: 1362854 - RNA, 17 nt, Homo sapiens
agauuccauuuuggaaa

SEQ ID NO: 1362855 - RNA, 17 nt, Homo sapiens
agauucuucagcuugau

SEQ ID NO: 1362856 - RNA, 22 nt, Homo sapiens
agauugcuuugaaaacaugacu

SEQ ID NO: 1362857 - RNA, 20 nt, Homo sapiens
agauugggcggggcuucucu

SEQ ID NO: 1362858 - RNA, 16 nt, Homo sapiens
agauuucucugagauc

SEQ ID NO: 1362859 - RNA, 16 nt, Homo sapiens
agcaaaaggcugagaa

SEQ ID NO: 1362860 - RNA, 19 nt, Homo sapiens
agcaaaaggggaagggaag

SEQ ID NO: 1362861 - RNA, 23 nt, Homo sapiens
agcaacugcuggggagacaaauc

SEQ ID NO: 1362862 - RNA, 16 nt, Homo sapiens
agcaacuuguguuaca

SEQ ID NO: 1362863 - RNA, 18 nt, Homo sapiens
agcaauacagacuacuuc

SEQ ID NO: 1362864 - RNA, 18 nt, Homo sapiens
agcacacucccuguggga

SEQ ID NO: 1362865 - RNA, 16 nt, Homo sapiens
agcacagcuugaccug

SEQ ID NO: 1362866 - RNA, 15 nt, Homo sapiens
agcaccacccuaguc

SEQ ID NO: 1362867 - RNA, 14 nt, Homo sapiens
agcaccaggggaug

SEQ ID NO: 1362868 - RNA, 14 nt, Homo sapiens
agcaccccaugcca

SEQ ID NO: 1362869 - RNA, 22 nt, Homo sapiens
agcacgcacacgagaacgacau

SEQ ID NO: 1362870 - RNA, 18 nt, Homo sapiens
agcacugucccuugccuc

SEQ ID NO: 1362871 - RNA, 16 nt, Homo sapiens
agcagccacaaccaaa

SEQ ID NO: 1362872 - RNA, 18 nt, Homo sapiens
agcagccacaaccaaaaa

SEQ ID NO: 1362873 - RNA, 19 nt, Homo sapiens
agcagggauuaaccucugc

SEQ ID NO: 1362874 - RNA, 14 nt, Homo sapiens
agcagguggcagaa

SEQ ID NO: 1362875 - RNA, 19 nt, Homo sapiens
agcagguuaccacucuggc

SEQ ID NO: 1362876 - RNA, 15 nt, Homo sapiens
agcagugagcacuga

SEQ ID NO: 1362877 - RNA, 21 nt, Homo sapiens
agcaucacuugggauuaauau

SEQ ID NO: 1362878 - RNA, 21 nt, Homo sapiens
agcaugcugugauugugccua

SEQ ID NO: 1362879 - RNA, 18 nt, Homo sapiens
agcauuaugauguggguc

SEQ ID NO: 1362880 - RNA, 21 nt, Homo sapiens
agcauugacucuguggcuuug

SEQ ID NO: 1362881 - RNA, 22 nt, Homo sapiens
agcauuuguuuaauaagcauac

SEQ ID NO: 1362882 - RNA, 20 nt, Homo sapiens
agcauuuugcuaaaugugaa

SEQ ID NO: 1362883 - RNA, 16 nt, Homo sapiens
agccacaaccaaaaaa

SEQ ID NO: 1362884 - RNA, 15 nt, Homo sapiens
agccacaccaggaua

SEQ ID NO: 1362885 - RNA, 13 nt, Homo sapiens
agccagcaagagg

SEQ ID NO: 1362886 - RNA, 17 nt, Homo sapiens
agcccacagaugagaau

SEQ ID NO: 1362887 - RNA, 22 nt, Homo sapiens
agcccccagcuaagaaccugga

SEQ ID NO: 1362888 - RNA, 16 nt, Homo sapiens
agcccucccuaccuac

SEQ ID NO: 1362889 - RNA, 20 nt, Homo sapiens
agcccuccgccauucucaag

SEQ ID NO: 1362890 - RNA, 20 nt, Homo sapiens
agcccuccucucccagugac

SEQ ID NO: 1362891 - RNA, 15 nt, Homo sapiens
agcccuguugacaca

SEQ ID NO: 1362892 - RNA, 16 nt, Homo sapiens
agccgaggccuacccc

SEQ ID NO: 1362893 - RNA, 13 nt, Homo sapiens
agccucacuccuc

SEQ ID NO: 1362894 - RNA, 17 nt, Homo sapiens
agccucucaaguaauau

SEQ ID NO: 1362895 - RNA, 15 nt, Homo sapiens
agccucugugcugca

SEQ ID NO: 1362896 - RNA, 13 nt, Homo sapiens
agccuggccagac

SEQ ID NO: 1362897 - RNA, 12 nt, Homo sapiens
agccugguggcc

SEQ ID NO: 1362898 - RNA, 19 nt, Homo sapiens
agccuuauuuaugauguau

SEQ ID NO: 1362899 - RNA, 16 nt, Homo sapiens
agccuucaagugccaa

SEQ ID NO: 1362900 - RNA, 14 nt, Homo sapiens
agccuucauugccu

SEQ ID NO: 1362901 - RNA, 15 nt, Homo sapiens
agccuuuaucaagcu

SEQ ID NO: 1362902 - RNA, 19 nt, Homo sapiens
agcgagugugccucaggga

SEQ ID NO: 1362903 - RNA, 16 nt, Homo sapiens
agcggaaagcagcuca

SEQ ID NO: 1362904 - RNA, 17 nt, Homo sapiens
agcggaaagcagcucaa

SEQ ID NO: 1362905 - RNA, 22 nt, Homo sapiens
agcggaaagcccugugcuccau

SEQ ID NO: 1362906 - RNA, 23 nt, Homo sapiens
agcggcuggcagcccaccccuca

SEQ ID NO: 1362907 - RNA, 14 nt, Homo sapiens
agcuaacagugaag

SEQ ID NO: 1362908 - RNA, 21 nt, Homo sapiens
agcuacugccgucagugcugu

SEQ ID NO: 1362909 - RNA, 19 nt, Homo sapiens
agcuaggaugguucuguga

SEQ ID NO: 1362910 - RNA, 15 nt, Homo sapiens
agcuccaaccugcaa

SEQ ID NO: 1362911 - RNA, 16 nt, Homo sapiens
agcucuccugacuuuu

SEQ ID NO: 1362912 - RNA, 19 nt, Homo sapiens
agcucucuucaaugacaua

SEQ ID NO: 1362913 - RNA, 23 nt, Homo sapiens
agcucuggacagccccacccugg

SEQ ID NO: 1362914 - RNA, 13 nt, Homo sapiens
agcugacuguucu

SEQ ID NO: 1362915 - RNA, 22 nt, Homo sapiens
agcugagacuacaagugugugc

SEQ ID NO: 1362916 - RNA, 14 nt, Homo sapiens
agcugagccugcag

SEQ ID NO: 1362917 - RNA, 14 nt, Homo sapiens
agcugagugcugaa

SEQ ID NO: 1362918 - RNA, 19 nt, Homo sapiens
agcugcacugaugcugccc

SEQ ID NO: 1362919 - RNA, 22 nt, Homo sapiens
agcugccagcccaacugugaga

SEQ ID NO: 1362920 - RNA, 16 nt, Homo sapiens
agcugccucacuuccu

SEQ ID NO: 1362921 - RNA, 19 nt, Homo sapiens
agcugcuguuagauguccu

SEQ ID NO: 1362922 - RNA, 15 nt, Homo sapiens
agcuggagaucuuaa

SEQ ID NO: 1362923 - RNA, 21 nt, Homo sapiens
agcugggccgggacccagggc

SEQ ID NO: 1362924 - RNA, 21 nt, Homo sapiens
agcuggguuggaaaacaguau

SEQ ID NO: 1362925 - RNA, 13 nt, Homo sapiens
agcuggugcugug

SEQ ID NO: 1362926 - RNA, 18 nt, Homo sapiens
agcuggugcuucgugugc

SEQ ID NO: 1362927 - RNA, 16 nt, Homo sapiens
agcuggugguaucuga

SEQ ID NO: 1362928 - RNA, 12 nt, Homo sapiens
agcuguggcuca

SEQ ID NO: 1362929 - RNA, 15 nt, Homo sapiens
agcuguuagggacau

SEQ ID NO: 1362930 - RNA, 18 nt, Homo sapiens
agcuguuuauggccucag

SEQ ID NO: 1362931 - RNA, 12 nt, Homo sapiens
agcuucuugcca

SEQ ID NO: 1362932 - RNA, 14 nt, Homo sapiens
agcuuggaaacugg

SEQ ID NO: 1362933 - RNA, 13 nt, Homo sapiens
agcuuucugccau

SEQ ID NO: 1362934 - RNA, 19 nt, Homo sapiens
agcuuucugcuaucaaaga

SEQ ID NO: 1362935 - RNA, 14 nt, Homo sapiens
aggaaccucagggc

SEQ ID NO: 1362936 - RNA, 15 nt, Homo sapiens
aggaagacaauguga

SEQ ID NO: 1362937 - RNA, 20 nt, Homo sapiens
aggaagccucccacgacugc

SEQ ID NO: 1362938 - RNA, 16 nt, Homo sapiens
aggacaauacuggggu

SEQ ID NO: 1362939 - RNA, 14 nt, Homo sapiens
aggacacaguggga

SEQ ID NO: 1362940 - RNA, 21 nt, Homo sapiens
aggccaagaggcuguucccac

SEQ ID NO: 1362941 - RNA, 12 nt, Homo sapiens
aggccagguaug

SEQ ID NO: 1362942 - RNA, 14 nt, Homo sapiens
aggcccacucuguu

SEQ ID NO: 1362943 - RNA, 23 nt, Homo sapiens
aggcccacucuguuccuacugga

SEQ ID NO: 1362944 - RNA, 23 nt, Homo sapiens
aggcccgcccugcccgggcuccc

SEQ ID NO: 1362945 - RNA, 20 nt, Homo sapiens
aggccuggacuuuccugcaa

SEQ ID NO: 1362946 - RNA, 19 nt, Homo sapiens
aggccuuggcuugauggaa

SEQ ID NO: 1362947 - RNA, 15 nt, Homo sapiens
aggcggaucaucuaa

SEQ ID NO: 1362948 - RNA, 20 nt, Homo sapiens
aggcggcggcggaggggcug

SEQ ID NO: 1362949 - RNA, 14 nt, Homo sapiens
aggcugagaaggaa

SEQ ID NO: 1362950 - RNA, 16 nt, Homo sapiens
aggcugcucagggcug

SEQ ID NO: 1362951 - RNA, 14 nt, Homo sapiens
aggcugcucccuga

SEQ ID NO: 1362952 - RNA, 16 nt, Homo sapiens
aggcuggagagcacug

SEQ ID NO: 1362953 - RNA, 12 nt, Homo sapiens
aggcuggcuugu

SEQ ID NO: 1362954 - RNA, 24 nt, Homo sapiens
aggcuugcccaggagcaagugagg

SEQ ID NO: 1362955 - RNA, 13 nt, Homo sapiens
agggaaaaaccag

SEQ ID NO: 1362956 - RNA, 14 nt, Homo sapiens
agggaagccgugaa

SEQ ID NO: 1362957 - RNA, 15 nt, Homo sapiens
agggaauaauccaga

SEQ ID NO: 1362958 - RNA, 23 nt, Homo sapiens
agggacauuuccaagcuguuagu

SEQ ID NO: 1362959 - RNA, 16 nt, Homo sapiens
agggaccuucaugccc

SEQ ID NO: 1362960 - RNA, 15 nt, Homo sapiens
agggacuaccaaugc

SEQ ID NO: 1362961 - RNA, 23 nt, Homo sapiens
agggagcgccuccccaccacuga

SEQ ID NO: 1362962 - RNA, 22 nt, Homo sapiens
agggaggaccauuggcuugcca

SEQ ID NO: 1362963 - RNA, 16 nt, Homo sapiens
agggcaaaaagaccaa

SEQ ID NO: 1362964 - RNA, 13 nt, Homo sapiens
agggccaggugcu

SEQ ID NO: 1362965 - RNA, 14 nt, Homo sapiens
agggcccuaccuga

SEQ ID NO: 1362966 - RNA, 15 nt, Homo sapiens
agggcuagugacuug

SEQ ID NO: 1362967 - RNA, 20 nt, Homo sapiens
aggggacucagcccugaggu

SEQ ID NO: 1362968 - RNA, 13 nt, Homo sapiens
agggucauagcau

SEQ ID NO: 1362969 - RNA, 13 nt, Homo sapiens
agggugacugugu

SEQ ID NO: 1362970 - RNA, 16 nt, Homo sapiens
aggguggcccuugcag

SEQ ID NO: 1362971 - RNA, 23 nt, Homo sapiens
aggguggcuggguccaggggaug

SEQ ID NO: 1362972 - RNA, 15 nt, Homo sapiens
aggguugccuuggca

SEQ ID NO: 1362973 - RNA, 16 nt, Homo sapiens
aggguugguaaggggu

SEQ ID NO: 1362974 - RNA, 16 nt, Homo sapiens
aggguuugcagaaagc

SEQ ID NO: 1362975 - RNA, 16 nt, Homo sapiens
agguaaaaugccauga

SEQ ID NO: 1362976 - RNA, 22 nt, Homo sapiens
agguaaccccagauucaugcac

SEQ ID NO: 1362977 - RNA, 12 nt, Homo sapiens
agguagcacuac

SEQ ID NO: 1362978 - RNA, 20 nt, Homo sapiens
agguagcugccccuggcucu

SEQ ID NO: 1362979 - RNA, 17 nt, Homo sapiens
aggucauagcagugcuu

SEQ ID NO: 1362980 - RNA, 19 nt, Homo sapiens
aggucugaaucuucaccau

SEQ ID NO: 1362981 - RNA, 14 nt, Homo sapiens
aggugaacaaauaa

SEQ ID NO: 1362982 - RNA, 20 nt, Homo sapiens
aggugggaggauugcuugag

SEQ ID NO: 1362983 - RNA, 16 nt, Homo sapiens
agguguugccaaauau

SEQ ID NO: 1362984 - RNA, 15 nt, Homo sapiens
agguguuggugacaa

SEQ ID NO: 1362985 - RNA, 17 nt, Homo sapiens
agguugugggcauugau

SEQ ID NO: 1362986 - RNA, 17 nt, Homo sapiens
aguaacgcgucuuccug

SEQ ID NO: 1362987 - RNA, 17 nt, Homo sapiens
aguaccaccaagggauc

SEQ ID NO: 1362988 - RNA, 20 nt, Homo sapiens
aguagaauacgcagaacuac

SEQ ID NO: 1362989 - RNA, 21 nt, Homo sapiens
aguagagcagccacaaccaaa

SEQ ID NO: 1362990 - RNA, 15 nt, Homo sapiens
aguauccaugcucuu

SEQ ID NO: 1362991 - RNA, 21 nt, Homo sapiens
aguaucugagauuacagagau

SEQ ID NO: 1362992 - RNA, 18 nt, Homo sapiens
aguauguccgaugguauc

SEQ ID NO: 1362993 - RNA, 16 nt, Homo sapiens
agucaaaagagagaag

SEQ ID NO: 1362994 - RNA, 16 nt, Homo sapiens
agucacagcuacacag

SEQ ID NO: 1362995 - RNA, 13 nt, Homo sapiens
agucaggauuuau

SEQ ID NO: 1362996 - RNA, 19 nt, Homo sapiens
aguccccccucuugucucc

SEQ ID NO: 1362997 - RNA, 22 nt, Homo sapiens
aguccggcuaaguggagcucag

SEQ ID NO: 1362998 - RNA, 21 nt, Homo sapiens
aguccuugcggccccuggaau

SEQ ID NO: 1362999 - RNA, 11 nt, Homo sapiens
agucuauggcc

SEQ ID NO: 1363000 - RNA, 22 nt, Homo sapiens
agucucuacccaguagaugcca

SEQ ID NO: 1363001 - RNA, 13 nt, Homo sapiens
agucugaacagcu

SEQ ID NO: 1363002 - RNA, 13 nt, Homo sapiens
agucuggcucugu

SEQ ID NO: 1363003 - RNA, 23 nt, Homo sapiens
agucuucaaaaacgcacugcaag

SEQ ID NO: 1363004 - RNA, 22 nt, Homo sapiens
agucuucauaauuucuucacuc

SEQ ID NO: 1363005 - RNA, 17 nt, Homo sapiens
agucuuucuaacugaau

SEQ ID NO: 1363006 - RNA, 13 nt, Homo sapiens
agugaaccuuuag

SEQ ID NO: 1363007 - RNA, 13 nt, Homo sapiens
agugacauuucua

SEQ ID NO: 1363008 - RNA, 16 nt, Homo sapiens
agugacuaauggcaug

SEQ ID NO: 1363009 - RNA, 16 nt, Homo sapiens
agugacugccaaaaag

SEQ ID NO: 1363010 - RNA, 12 nt, Homo sapiens
agugacuuugca

SEQ ID NO: 1363011 - RNA, 13 nt, Homo sapiens
agugacuuugcag

SEQ ID NO: 1363012 - RNA, 14 nt, Homo sapiens
agugaggaaagccu

SEQ ID NO: 1363013 - RNA, 20 nt, Homo sapiens
agugcaaccucgcugagggc

SEQ ID NO: 1363014 - RNA, 18 nt, Homo sapiens
agugcaauaaaucugacc

SEQ ID NO: 1363015 - RNA, 19 nt, Homo sapiens
agugcaauggcacaaucuu

SEQ ID NO: 1363016 - RNA, 19 nt, Homo sapiens
agugcacuuuaagaggugg

SEQ ID NO: 1363017 - RNA, 14 nt, Homo sapiens
agugcagugacaca

SEQ ID NO: 1363018 - RNA, 16 nt, Homo sapiens
agugcauuugugcuag

SEQ ID NO: 1363019 - RNA, 16 nt, Homo sapiens
agugcccuuccugcug

SEQ ID NO: 1363020 - RNA, 16 nt, Homo sapiens
agugccuagacuguua

SEQ ID NO: 1363021 - RNA, 22 nt, Homo sapiens
agugcugaaauaaaaugauaaa

SEQ ID NO: 1363022 - RNA, 13 nt, Homo sapiens
agugcugugcugu

SEQ ID NO: 1363023 - RNA, 14 nt, Homo sapiens
aguggauuuuacau

SEQ ID NO: 1363024 - RNA, 19 nt, Homo sapiens
aguggcaggggacaggagu

SEQ ID NO: 1363025 - RNA, 12 nt, Homo sapiens
aguggccaguuc

SEQ ID NO: 1363026 - RNA, 14 nt, Homo sapiens
aguggccuggccag

SEQ ID NO: 1363027 - RNA, 20 nt, Homo sapiens
aguggcguaaucucggcuca

SEQ ID NO: 1363028 - RNA, 17 nt, Homo sapiens
aguggcucacaccugua

SEQ ID NO: 1363029 - RNA, 17 nt, Homo sapiens
aguguaacagauaucag

SEQ ID NO: 1363030 - RNA, 20 nt, Homo sapiens
agugucugaacaggaugcug

SEQ ID NO: 1363031 - RNA, 15 nt, Homo sapiens
agugucuuuugacau

SEQ ID NO: 1363032 - RNA, 10 nt, Homo sapiens
aguguucacu

SEQ ID NO: 1363033 - RNA, 19 nt, Homo sapiens
aguguuugaaaaagcuggu

SEQ ID NO: 1363034 - RNA, 22 nt, Homo sapiens
ugucccuugccucaaugccagu

SEQ ID NO: 1363035 - RNA, 17 nt, Homo sapiens
ugucccuugcuugccug

SEQ ID NO: 1363036 - RNA, 22 nt, Homo sapiens
uguccucagccuugccagagau

SEQ ID NO: 1363037 - RNA, 20 nt, Homo sapiens
uguccugaugcuuuugucua

SEQ ID NO: 1363038 - RNA, 21 nt, Homo sapiens
uguccugaugcuuuugucuaa

SEQ ID NO: 1363039 - RNA, 18 nt, Homo sapiens
uguccuuuuucaggagaa

SEQ ID NO: 1363040 - RNA, 18 nt, Homo sapiens
ugucugcuaucauuauuc

SEQ ID NO: 1363041 - RNA, 20 nt, Homo sapiens
ugucuucagcacccucauaa

SEQ ID NO: 1363042 - RNA, 23 nt, Homo sapiens
ugugaaugaugauccuaggcauu

SEQ ID NO: 1363043 - RNA, 13 nt, Homo sapiens
ugugauaaaaccc

SEQ ID NO: 1363044 - RNA, 22 nt, Homo sapiens
ugugauuuuuaaucgcuuugau

SEQ ID NO: 1363045 - RNA, 17 nt, Homo sapiens
ugugccugaagucccag

SEQ ID NO: 1363046 - RNA, 23 nt, Homo sapiens
ugugccugggguguuaguggcac

SEQ ID NO: 1363047 - RNA, 20 nt, Homo sapiens
ugugcuccauggcugccauc

SEQ ID NO: 1363048 - RNA, 19 nt, Homo sapiens
ugugcuuucagaagugccc

SEQ ID NO: 1363049 - RNA, 20 nt, Homo sapiens
uguggacaaugaguggaaua

SEQ ID NO: 1363050 - RNA, 18 nt, Homo sapiens
uguggaugauaaaacaca

SEQ ID NO: 1363051 - RNA, 20 nt, Homo sapiens
uguggcaaagccuucauugc

SEQ ID NO: 1363052 - RNA, 17 nt, Homo sapiens
uguggccagccuggcau

SEQ ID NO: 1363053 - RNA, 17 nt, Homo sapiens
uguggcucacgugagag

SEQ ID NO: 1363054 - RNA, 14 nt, Homo sapiens
uguggguaccugua

SEQ ID NO: 1363055 - RNA, 16 nt, Homo sapiens
ugugguaacucagugu

SEQ ID NO: 1363056 - RNA, 13 nt, Homo sapiens
ugugugagcugcc

SEQ ID NO: 1363057 - RNA, 18 nt, Homo sapiens
ugugugauugacagcuuu

SEQ ID NO: 1363058 - RNA, 16 nt, Homo sapiens
ugugugcgugcgcauc

SEQ ID NO: 1363059 - RNA, 15 nt, Homo sapiens
ugugugugugcacau

SEQ ID NO: 1363060 - RNA, 19 nt, Homo sapiens
uguuaaggagcuucaggga

SEQ ID NO: 1363061 - RNA, 13 nt, Homo sapiens
uguuaaguugaug

SEQ ID NO: 1363062 - RNA, 21 nt, Homo sapiens
uguuaggaagguacugucaug

SEQ ID NO: 1363063 - RNA, 20 nt, Homo sapiens
uguuauuauaaaaguacuag

SEQ ID NO: 1363064 - RNA, 21 nt, Homo sapiens
uguuauugccucuacuuugau

SEQ ID NO: 1363065 - RNA, 15 nt, Homo sapiens
uguucacugcuccuu

SEQ ID NO: 1363066 - RNA, 22 nt, Homo sapiens
uguucccacaccccaacacuuc

SEQ ID NO: 1363067 - RNA, 13 nt, Homo sapiens
uguugaacaauag

SEQ ID NO: 1363068 - RNA, 14 nt, Homo sapiens
uguugacaugugcu

SEQ ID NO: 1363069 - RNA, 14 nt, Homo sapiens
uguugcauauacca

SEQ ID NO: 1363070 - RNA, 23 nt, Homo sapiens
uguuuaauaagcauaccauugaa

SEQ ID NO: 1363071 - RNA, 18 nt, Homo sapiens
uguuuagcccaaaaccaa

SEQ ID NO: 1363072 - RNA, 18 nt, Homo sapiens
uguuucaaaaaaucugac

SEQ ID NO: 1363073 - RNA, 14 nt, Homo sapiens
uguuucugaucuga

SEQ ID NO: 1363074 - RNA, 21 nt, Homo sapiens
uguuugagguccacacugaca

SEQ ID NO: 1363075 - RNA, 23 nt, Homo sapiens
uguuuuaaagaauaugacuuuuu

SEQ ID NO: 1363076 - RNA, 17 nt, Homo sapiens
uguuuuaaauguacaga

SEQ ID NO: 1363077 - RNA, 14 nt, Homo sapiens
uguuuucucuugag

SEQ ID NO: 1363078 - RNA, 16 nt, Homo sapiens
uguuuuuuucuagccu

SEQ ID NO: 1363079 - RNA, 20 nt, Homo sapiens
uuaaaaagguuuacagaauu

SEQ ID NO: 1363080 - RNA, 16 nt, Homo sapiens
uuaaaaaucuguaaau

SEQ ID NO: 1363081 - RNA, 18 nt, Homo sapiens
uuaaaauauuaguauaaa

SEQ ID NO: 1363082 - RNA, 14 nt, Homo sapiens
uuaaaaucuuagaa

SEQ ID NO: 1363083 - RNA, 11 nt, Homo sapiens
uuaaacucugu

SEQ ID NO: 1363084 - RNA, 13 nt, Homo sapiens
uuaacaaacucuu

SEQ ID NO: 1363085 - RNA, 21 nt, Homo sapiens
uuaacagauggaaaaacugag

SEQ ID NO: 1363086 - RNA, 17 nt, Homo sapiens
uuaagaacugcuguuuc

SEQ ID NO: 1363087 - RNA, 18 nt, Homo sapiens
uuaagaauuuuuuccuaa

SEQ ID NO: 1363088 - RNA, 19 nt, Homo sapiens
uuaagacaacaggcauuuu

SEQ ID NO: 1363089 - RNA, 11 nt, Homo sapiens
uuaagaccaag

SEQ ID NO: 1363090 - RNA, 14 nt, Homo sapiens
uuaagagacacucc

SEQ ID NO: 1363091 - RNA, 23 nt, Homo sapiens
uuaagaggacauaaugggguccu

SEQ ID NO: 1363092 - RNA, 21 nt, Homo sapiens
uuaagauuccauuuuggaaaa

SEQ ID NO: 1363093 - RNA, 16 nt, Homo sapiens
uuaagcgugucuguau

SEQ ID NO: 1363094 - RNA, 14 nt, Homo sapiens
uuaaguaccaaugg

SEQ ID NO: 1363095 - RNA, 20 nt, Homo sapiens
uuaaucaguuguuuaauaau

SEQ ID NO: 1363096 - RNA, 20 nt, Homo sapiens
uuaaucccuuugucugucaa

SEQ ID NO: 1363097 - RNA, 12 nt, Homo sapiens
uuaauucuuaga

SEQ ID NO: 1363098 - RNA, 18 nt, Homo sapiens
uuaauuugauaguauugu

SEQ ID NO: 1363099 - RNA, 17 nt, Homo sapiens
uuaauuuuaacugccaa

SEQ ID NO: 1363100 - RNA, 18 nt, Homo sapiens
uuacaaguuuauauauau

SEQ ID NO: 1363101 - RNA, 14 nt, Homo sapiens
uuacacuugucuca

SEQ ID NO: 1363102 - RNA, 21 nt, Homo sapiens
uuacagacagaauauacauau

SEQ ID NO: 1363103 - RNA, 18 nt, Homo sapiens
uuacaguauuauugugaa

SEQ ID NO: 1363104 - RNA, 15 nt, Homo sapiens
uugccucugugcugu

SEQ ID NO: 1363105 - RNA, 13 nt, Homo sapiens
uugcuuugccaaa

SEQ ID NO: 1363106 - RNA, 16 nt, Homo sapiens
uugcuuuuuucugggg

SEQ ID NO: 1363107 - RNA, 17 nt, Homo sapiens
uuggaaaauaaaucaau

SEQ ID NO: 1363108 - RNA, 18 nt, Homo sapiens
uuggacuguaagggauug

SEQ ID NO: 1363109 - RNA, 14 nt, Homo sapiens
uuggacuucuugaa

SEQ ID NO: 1363110 - RNA, 20 nt, Homo sapiens
uuggauacauacaccagcau

SEQ ID NO: 1363111 - RNA, 15 nt, Homo sapiens
uuggcuacacacaaa

SEQ ID NO: 1363112 - RNA, 22 nt, Homo sapiens
uuggcucguuugauccaguuga

SEQ ID NO: 1363113 - RNA, 16 nt, Homo sapiens
uuggcuucuaaucaaa

SEQ ID NO: 1363114 - RNA, 22 nt, Homo sapiens
uugggcagagcuggcucugagc

SEQ ID NO: 1363115 - RNA, 16 nt, Homo sapiens
uugggccagacaugcc

SEQ ID NO: 1363116 - RNA, 13 nt, Homo sapiens
uuggggcuuuuac

SEQ ID NO: 1363117 - RNA, 16 nt, Homo sapiens
uugguccuugcugcca

SEQ ID NO: 1363118 - RNA, 19 nt, Homo sapiens
uugguccuuuaaauucugg

SEQ ID NO: 1363119 - RNA, 14 nt, Homo sapiens
uuggugggggagcc

SEQ ID NO: 1363120 - RNA, 16 nt, Homo sapiens
uuguaaauauuugacu

SEQ ID NO: 1363121 - RNA, 18 nt, Homo sapiens
uuguaguuuaaauucuuc

SEQ ID NO: 1363122 - RNA, 15 nt, Homo sapiens
uuguauugcauauau

SEQ ID NO: 1363123 - RNA, 16 nt, Homo sapiens
uugucauagacuccuu

SEQ ID NO: 1363124 - RNA, 16 nt, Homo sapiens
uugucauauacugcuu

SEQ ID NO: 1363125 - RNA, 17 nt, Homo sapiens
uugucccacucaagcca

SEQ ID NO: 1363126 - RNA, 11 nt, Homo sapiens
uugucucagga

SEQ ID NO: 1363127 - RNA, 20 nt, Homo sapiens
uugucucuagagcagggauu

SEQ ID NO: 1363128 - RNA, 13 nt, Homo sapiens
uugugacgugugu

SEQ ID NO: 1363129 - RNA, 17 nt, Homo sapiens
uuguuacuucugaggua

SEQ ID NO: 1363130 - RNA, 13 nt, Homo sapiens
uuguugugugugc

SEQ ID NO: 1363131 - RNA, 14 nt, Homo sapiens
uuguuuaacuguga

SEQ ID NO: 1363132 - RNA, 19 nt, Homo sapiens
uuuaaaaaugucuugcugu

SEQ ID NO: 1363133 - RNA, 14 nt, Homo sapiens
uuuaaauuccacag

SEQ ID NO: 1363134 - RNA, 12 nt, Homo sapiens
uuuaagaccaag

SEQ ID NO: 1363135 - RNA, 14 nt, Homo sapiens
uuuaaucacauucg

SEQ ID NO: 1363136 - RNA, 21 nt, Homo sapiens
uuuacaacucaaaaaacauug

SEQ ID NO: 1363137 - RNA, 15 nt, Homo sapiens
uuuacauguggccca

SEQ ID NO: 1363138 - RNA, 12 nt, Homo sapiens
uuuacauuuacu

SEQ ID NO: 1363139 - RNA, 12 nt, Homo sapiens
uuuacauuugau

SEQ ID NO: 1363140 - RNA, 21 nt, Homo sapiens
uuuaccuccaggaaacaugaa

SEQ ID NO: 1363141 - RNA, 16 nt, Homo sapiens
uuuacuagaaaggcau

SEQ ID NO: 1363142 - RNA, 17 nt, Homo sapiens
uuuagaguaaugcauga

SEQ ID NO: 1363143 - RNA, 17 nt, Homo sapiens
uuuagcagcauggcugc

SEQ ID NO: 1363144 - RNA, 14 nt, Homo sapiens
uuuauaaaagcaaa

SEQ ID NO: 1363145 - RNA, 23 nt, Homo sapiens
uuuauaaagggagauaacaaucu

SEQ ID NO: 1363146 - RNA, 19 nt, Homo sapiens
uuuauaaaucuuaugcucu

SEQ ID NO: 1363147 - RNA, 18 nt, Homo sapiens
uuuauaaggcugauguca

SEQ ID NO: 1363148 - RNA, 18 nt, Homo sapiens
uuuaucaccucauucuga

SEQ ID NO: 1363149 - RNA, 18 nt, Homo sapiens
uuuaucuguuuccugaca

SEQ ID NO: 1363150 - RNA, 22 nt, Homo sapiens
uuucaaaaaaucugaccaaaac

SEQ ID NO: 1363151 - RNA, 13 nt, Homo sapiens
uuucaagugccua

SEQ ID NO: 1363152 - RNA, 16 nt, Homo sapiens
uuucacauuguacuua

SEQ ID NO: 1363153 - RNA, 19 nt, Homo sapiens
aguuaagacaacaggcauu

SEQ ID NO: 1363154 - RNA, 19 nt, Homo sapiens
aguuaugcugucauggucc

SEQ ID NO: 1363155 - RNA, 17 nt, Homo sapiens
aguucccuuggccucag

SEQ ID NO: 1363156 - RNA, 22 nt, Homo sapiens
aguuccuuggagggacaugacu

SEQ ID NO: 1363157 - RNA, 18 nt, Homo sapiens
aguucuaacaaaacaagu

SEQ ID NO: 1363158 - RNA, 22 nt, Homo sapiens
aguucuuuaaaauguaaagcca

SEQ ID NO: 1363159 - RNA, 22 nt, Homo sapiens
aguugacuugacagaacacugu

SEQ ID NO: 1363160 - RNA, 17 nt, Homo sapiens
aguugagacuugccagu

SEQ ID NO: 1363161 - RNA, 18 nt, Homo sapiens
aguugcugucauccacuu

SEQ ID NO: 1363162 - RNA, 19 nt, Homo sapiens
aguuuccgugcguggcacu

SEQ ID NO: 1363163 - RNA, 15 nt, Homo sapiens
aguuucuggugccau

SEQ ID NO: 1363164 - RNA, 18 nt, Homo sapiens
aguuugucauauacugcu

SEQ ID NO: 1363165 - RNA, 16 nt, Homo sapiens
aguuuuuucuccucau

SEQ ID NO: 1363166 - RNA, 13 nt, Homo sapiens
auaaaacuuuccu

SEQ ID NO: 1363167 - RNA, 15 nt, Homo sapiens
auaaaagaucuugaa

SEQ ID NO: 1363168 - RNA, 14 nt, Homo sapiens
auaaacacuuccuu

SEQ ID NO: 1363169 - RNA, 19 nt, Homo sapiens
auaaagacaccugguugcu

SEQ ID NO: 1363170 - RNA, 14 nt, Homo sapiens
auaaagcagcucag

SEQ ID NO: 1363171 - RNA, 14 nt, Homo sapiens
auaaagucuugccu

SEQ ID NO: 1363172 - RNA, 17 nt, Homo sapiens
auaacauuuaaauucca

SEQ ID NO: 1363173 - RNA, 15 nt, Homo sapiens
auaacuauguugaua

SEQ ID NO: 1363174 - RNA, 11 nt, Homo sapiens
auaacucugug

SEQ ID NO: 1363175 - RNA, 18 nt, Homo sapiens
auaagcauaccauugaaa

SEQ ID NO: 1363176 - RNA, 15 nt, Homo sapiens
auaagugcaugacau

SEQ ID NO: 1363177 - RNA, 17 nt, Homo sapiens
auaauacaguaucucag

SEQ ID NO: 1363178 - RNA, 13 nt, Homo sapiens
auaauacuuccaa

SEQ ID NO: 1363179 - RNA, 19 nt, Homo sapiens
auaauauuucaagugccua

SEQ ID NO: 1363180 - RNA, 15 nt, Homo sapiens
auaaucccacccacc

SEQ ID NO: 1363181 - RNA, 19 nt, Homo sapiens
auaauugcuuugccaaaau

SEQ ID NO: 1363182 - RNA, 13 nt, Homo sapiens
auacacuaugaag

SEQ ID NO: 1363183 - RNA, 20 nt, Homo sapiens
auaccauugaaacaugccac

SEQ ID NO: 1363184 - RNA, 23 nt, Homo sapiens
auacccucacuuaaacuuuuauc

SEQ ID NO: 1363185 - RNA, 19 nt, Homo sapiens
auacugggugcugucacca

SEQ ID NO: 1363186 - RNA, 22 nt, Homo sapiens
auacuugguucucuccaccagg

SEQ ID NO: 1363187 - RNA, 23 nt, Homo sapiens
auagaugcuggcccagggcccag

SEQ ID NO: 1363188 - RNA, 15 nt, Homo sapiens
auagauuuuuucaga

SEQ ID NO: 1363189 - RNA, 14 nt, Homo sapiens
auagcccuguaaca

SEQ ID NO: 1363190 - RNA, 18 nt, Homo sapiens
auaggaagccacaaauuu

SEQ ID NO: 1363191 - RNA, 19 nt, Homo sapiens
auagugaaaccccaucucu

SEQ ID NO: 1363192 - RNA, 17 nt, Homo sapiens
auaguggggucagggcu

SEQ ID NO: 1363193 - RNA, 17 nt, Homo sapiens
auaguucaugucugcua

SEQ ID NO: 1363194 - RNA, 21 nt, Homo sapiens
auaguugcugucauccacuuu

SEQ ID NO: 1363195 - RNA, 13 nt, Homo sapiens
auauauauuacaa

SEQ ID NO: 1363196 - RNA, 19 nt, Homo sapiens
auauauucaguauuguaga

SEQ ID NO: 1363197 - RNA, 15 nt, Homo sapiens
auauauuccaccagg

SEQ ID NO: 1363198 - RNA, 20 nt, Homo sapiens
auauauuuuugcuaaaccua

SEQ ID NO: 1363199 - RNA, 14 nt, Homo sapiens
auauauuuuuuaga

SEQ ID NO: 1363200 - RNA, 20 nt, Homo sapiens
auaucaguuugcuagcagaa

SEQ ID NO: 1363201 - RNA, 19 nt, Homo sapiens
auaucgcuggccagcauua

SEQ ID NO: 1363202 - RNA, 15 nt, Homo sapiens
auauuaaaacacuua

SEQ ID NO: 1363203 - RNA, 21 nt, Homo sapiens
auauuaaagucagaauauuaa

SEQ ID NO: 1363204 - RNA, 18 nt, Homo sapiens
auauuaaggcaguaugcc

SEQ ID NO: 1363205 - RNA, 17 nt, Homo sapiens
auauuccaccaggauau

SEQ ID NO: 1363206 - RNA, 22 nt, Homo sapiens
auauuuuaggacuuuuugucaa

SEQ ID NO: 1363207 - RNA, 23 nt, Homo sapiens
auauuuuggggggcagagaauaa

SEQ ID NO: 1363208 - RNA, 22 nt, Homo sapiens
aucaaaauuucagcauuauuga

SEQ ID NO: 1363209 - RNA, 23 nt, Homo sapiens
aucaacuugcuuaucaacuuccu

SEQ ID NO: 1363210 - RNA, 20 nt, Homo sapiens
aucaagacugcaaacccuuu

SEQ ID NO: 1363211 - RNA, 22 nt, Homo sapiens
aucacaugugcccucugccagg

SEQ ID NO: 1363212 - RNA, 11 nt, Homo sapiens
aucaccagaca

SEQ ID NO: 1363213 - RNA, 22 nt, Homo sapiens
aucacugcaccucuuugucaca

SEQ ID NO: 1363214 - RNA, 18 nt, Homo sapiens
aucacuucacuguucucu

SEQ ID NO: 1363215 - RNA, 14 nt, Homo sapiens
aucagaaagggaga

SEQ ID NO: 1363216 - RNA, 21 nt, Homo sapiens
aucagccugggcaaugugaua

SEQ ID NO: 1363217 - RNA, 18 nt, Homo sapiens
aucaggacagguggugca

SEQ ID NO: 1363218 - RNA, 19 nt, Homo sapiens
aucaucguacacacucagu

SEQ ID NO: 1363219 - RNA, 23 nt, Homo sapiens
aucauucuccuuguaaaagccua

SEQ ID NO: 1363220 - RNA, 20 nt, Homo sapiens
auccaacaugugcucaggga

SEQ ID NO: 1363221 - RNA, 15 nt, Homo sapiens
auccaaugcucaaga

SEQ ID NO: 1363222 - RNA, 18 nt, Homo sapiens
auccaauggguuuuuccc

SEQ ID NO: 1363223 - RNA, 16 nt, Homo sapiens
auccaggugugccccu

SEQ ID NO: 1363224 - RNA, 15 nt, Homo sapiens
auccauucacaguuc

SEQ ID NO: 1363225 - RNA, 20 nt, Homo sapiens
aucccaaguagaaucucagu

SEQ ID NO: 1363226 - RNA, 20 nt, Homo sapiens
auccccgcagugugcacuaa

SEQ ID NO: 1363227 - RNA, 12 nt, Homo sapiens
aucccuaccccc

SEQ ID NO: 1363228 - RNA, 16 nt, Homo sapiens
aucccuuaccucggug

SEQ ID NO: 1363229 - RNA, 13 nt, Homo sapiens
auccuagcacuug

SEQ ID NO: 1363230 - RNA, 14 nt, Homo sapiens
auccuagcacuuug

SEQ ID NO: 1363231 - RNA, 14 nt, Homo sapiens
auccuaggcauuug

SEQ ID NO: 1363232 - RNA, 15 nt, Homo sapiens
auccuucuacuuguc

SEQ ID NO: 1363233 - RNA, 18 nt, Homo sapiens
aucgcucauagaucagca

SEQ ID NO: 1363234 - RNA, 16 nt, Homo sapiens
aucgucuaaacuuuag

SEQ ID NO: 1363235 - RNA, 13 nt, Homo sapiens
aucuaaaccauau

SEQ ID NO: 1363236 - RNA, 22 nt, Homo sapiens
aucuaugaaauaucaugcucca

SEQ ID NO: 1363237 - RNA, 17 nt, Homo sapiens
aucucaaccauccccuc

SEQ ID NO: 1363238 - RNA, 15 nt, Homo sapiens
aucuccauucucuca

SEQ ID NO: 1363239 - RNA, 22 nt, Homo sapiens
aucugagauuacagagaucuca

SEQ ID NO: 1363240 - RNA, 16 nt, Homo sapiens
aucugccauugggacc

SEQ ID NO: 1363241 - RNA, 18 nt, Homo sapiens
aucuggaacccagacuca

SEQ ID NO: 1363242 - RNA, 19 nt, Homo sapiens
aucuggaacccagacucag

SEQ ID NO: 1363243 - RNA, 19 nt, Homo sapiens
aucuggcagacucauugca

SEQ ID NO: 1363244 - RNA, 17 nt, Homo sapiens
aucuggcuuagugccac

SEQ ID NO: 1363245 - RNA, 13 nt, Homo sapiens
aucugucaugagc

SEQ ID NO: 1363246 - RNA, 16 nt, Homo sapiens
aucugucucauccaaa

SEQ ID NO: 1363247 - RNA, 19 nt, Homo sapiens
aucugucucauccaaaaag

SEQ ID NO: 1363248 - RNA, 19 nt, Homo sapiens
aucuguucuaacauguaau

SEQ ID NO: 1363249 - RNA, 17 nt, Homo sapiens
aucuguucuaugcuucc

SEQ ID NO: 1363250 - RNA, 20 nt, Homo sapiens
aucuuacaagguugcaagag

SEQ ID NO: 1363251 - RNA, 14 nt, Homo sapiens
aucuugcaccccaa

SEQ ID NO: 1363252 - RNA, 17 nt, Homo sapiens
aucuuuguauauuacau

SEQ ID NO: 1363253 - RNA, 22 nt, Homo sapiens
augaaaaaacggucugccggug

SEQ ID NO: 1363254 - RNA, 16 nt, Homo sapiens
augaaauaucaugcuc

SEQ ID NO: 1363255 - RNA, 21 nt, Homo sapiens
augaagguuucugaaaauuaa

SEQ ID NO: 1363256 - RNA, 21 nt, Homo sapiens
augaauaaauccucucuauca

SEQ ID NO: 1363257 - RNA, 21 nt, Homo sapiens
augaauaacauuuaaauucca

SEQ ID NO: 1363258 - RNA, 18 nt, Homo sapiens
augacagugacacccaga

SEQ ID NO: 1363259 - RNA, 13 nt, Homo sapiens
augacugcacaug

SEQ ID NO: 1363260 - RNA, 16 nt, Homo sapiens
augaggcggagcucca

SEQ ID NO: 1363261 - RNA, 20 nt, Homo sapiens
augaguggagguuaaggcug

SEQ ID NO: 1363262 - RNA, 16 nt, Homo sapiens
augaguuggacuucag

SEQ ID NO: 1363263 - RNA, 20 nt, Homo sapiens
augaguuggacuucagucuu

SEQ ID NO: 1363264 - RNA, 16 nt, Homo sapiens
augauccuaaugaaug

SEQ ID NO: 1363265 - RNA, 18 nt, Homo sapiens
augaugugggucaaggaa

SEQ ID NO: 1363266 - RNA, 17 nt, Homo sapiens
augauuuuuuaugauca

SEQ ID NO: 1363267 - RNA, 16 nt, Homo sapiens
augcaacaacauguau

SEQ ID NO: 1363268 - RNA, 17 nt, Homo sapiens
augcaacaacauguaua

SEQ ID NO: 1363269 - RNA, 18 nt, Homo sapiens
gagcagggauuaaccucu

SEQ ID NO: 1363270 - RNA, 15 nt, Homo sapiens
gagcauacaucuuaa

SEQ ID NO: 1363271 - RNA, 19 nt, Homo sapiens
gagcaucacagaaugugau

SEQ ID NO: 1363272 - RNA, 14 nt, Homo sapiens
gagcauuuguuuaa

SEQ ID NO: 1363273 - RNA, 21 nt, Homo sapiens
gagccgagauugcaccacugc

SEQ ID NO: 1363274 - RNA, 19 nt, Homo sapiens
gagccuccaauugcagugg

SEQ ID NO: 1363275 - RNA, 18 nt, Homo sapiens
gagccuucugugcuguga

SEQ ID NO: 1363276 - RNA, 15 nt, Homo sapiens
gagcugagugcugaa

SEQ ID NO: 1363277 - RNA, 19 nt, Homo sapiens
ggaaacuaguguacauuuc

SEQ ID NO: 1363278 - RNA, 17 nt, Homo sapiens
ggaaacucacacucccc

SEQ ID NO: 1363279 - RNA, 17 nt, Homo sapiens
ggaaagaaaaagcaaua

SEQ ID NO: 1363280 - RNA, 16 nt, Homo sapiens
ggaaagaacugucaug

SEQ ID NO: 1363281 - RNA, 11 nt, Homo sapiens
ggaaaucacac

SEQ ID NO: 1363282 - RNA, 21 nt, Homo sapiens
ggaacacuagacaagccagaa

SEQ ID NO: 1363283 - RNA, 13 nt, Homo sapiens
auuucucugagau

SEQ ID NO: 1363284 - RNA, 16 nt, Homo sapiens
auuucugaacuguuac

SEQ ID NO: 1363285 - RNA, 20 nt, Homo sapiens
auuucuuaaacacuugcaac

SEQ ID NO: 1363286 - RNA, 19 nt, Homo sapiens
auuucuucacucaaucucu

SEQ ID NO: 1363287 - RNA, 18 nt, Homo sapiens
auuucuuuuucauuugac

SEQ ID NO: 1363288 - RNA, 15 nt, Homo sapiens
auuugauguugugaa

SEQ ID NO: 1363289 - RNA, 21 nt, Homo sapiens
auuuggccggcucugguggcc

SEQ ID NO: 1363290 - RNA, 20 nt, Homo sapiens
auuugugcuagaaauuuuca

SEQ ID NO: 1363291 - RNA, 14 nt, Homo sapiens
auuuguuugugcau

SEQ ID NO: 1363292 - RNA, 18 nt, Homo sapiens
auuuuaauuccacuuuaa

SEQ ID NO: 1363293 - RNA, 19 nt, Homo sapiens
auuuuagcguuaaagucag

SEQ ID NO: 1363294 - RNA, 17 nt, Homo sapiens
auuuuagugaacuugaa

SEQ ID NO: 1363295 - RNA, 12 nt, Homo sapiens
auuuugacuuaa

SEQ ID NO: 1363296 - RNA, 19 nt, Homo sapiens
auuuugcuaaaugugaaug

SEQ ID NO: 1363297 - RNA, 18 nt, Homo sapiens
auuuuggaaaaugauuag

SEQ ID NO: 1363298 - RNA, 20 nt, Homo sapiens
auuuugggacuucuacccag

SEQ ID NO: 1363299 - RNA, 20 nt, Homo sapiens
auuuuucacuuaaguugaga

SEQ ID NO: 1363300 - RNA, 19 nt, Homo sapiens
auuuuugaauacaggcaua

SEQ ID NO: 1363301 - RNA, 21 nt, Homo sapiens
caaaaaaaccucuaugcaauc

SEQ ID NO: 1363302 - RNA, 12 nt, Homo sapiens
aaaaaaauggaa

SEQ ID NO: 1363303 - RNA, 12 nt, Homo sapiens
aaaaaaucugac

SEQ ID NO: 1363304 - RNA, 19 nt, Homo sapiens
aaaaacacagacauucugc

SEQ ID NO: 1363305 - RNA, 22 nt, Homo sapiens
aaaaaccucuaugcaaucugag

SEQ ID NO: 1363306 - RNA, 16 nt, Homo sapiens
aaaaaggaauccucug

SEQ ID NO: 1363307 - RNA, 15 nt, Homo sapiens
aaaaagucaaacuuu

SEQ ID NO: 1363308 - RNA, 16 nt, Homo sapiens
aaaaauggauagcuca

SEQ ID NO: 1363309 - RNA, 17 nt, Homo sapiens
aaaacaucgucuaaacu

SEQ ID NO: 1363310 - RNA, 21 nt, Homo sapiens
aaaacauuguuuuguguaaca

SEQ ID NO: 1363311 - RNA, 18 nt, Homo sapiens
acagacauccucuaugcc

SEQ ID NO: 1363312 - RNA, 17 nt, Homo sapiens
acagacuaugucaccca

SEQ ID NO: 1363313 - RNA, 24 nt, Homo sapiens
acagacuaugucacccaaugcaua

SEQ ID NO: 1363314 - RNA, 18 nt, Homo sapiens
acagagaaaacuugccuu

SEQ ID NO: 1363315 - RNA, 15 nt, Homo sapiens
acagagcagaacuuu

SEQ ID NO: 1363316 - RNA, 23 nt, Homo sapiens
acagccagugggagauguuagac

SEQ ID NO: 1363317 - RNA, 20 nt, Homo sapiens
acagccucuucugucccaag

SEQ ID NO: 1363318 - RNA, 23 nt, Homo sapiens
acagcggaaagcccugugcucca

SEQ ID NO: 1363319 - RNA, 19 nt, Homo sapiens
acagcuacacagaucacag

SEQ ID NO: 1363320 - RNA, 14 nt, Homo sapiens
acagcugcuccuag

SEQ ID NO: 1363321 - RNA, 13 nt, Homo sapiens
acagcuucagcca

SEQ ID NO: 1363322 - RNA, 23 nt, Homo sapiens
acaggagcugggauccuaagggc

SEQ ID NO: 1363323 - RNA, 13 nt, Homo sapiens
acaggcaccugcc

SEQ ID NO: 1363324 - RNA, 19 nt, Homo sapiens
acaggccgggcaguguccc

SEQ ID NO: 1363325 - RNA, 21 nt, Homo sapiens
acaggcucuuagcagcuucca

SEQ ID NO: 1363326 - RNA, 12 nt, Homo sapiens
acagggcuucuc

SEQ ID NO: 1363327 - RNA, 13 nt, Homo sapiens
acaggugugagcc

SEQ ID NO: 1363328 - RNA, 19 nt, Homo sapiens
acaguacaggcagcacaga

SEQ ID NO: 1363329 - RNA, 21 nt, Homo sapiens
acaguacaggcagcacagaga

SEQ ID NO: 1363330 - RNA, 17 nt, Homo sapiens
acagucucaguucucuu

SEQ ID NO: 1363331 - RNA, 21 nt, Homo sapiens
acaguggaggaagagggacag

SEQ ID NO: 1363332 - RNA, 15 nt, Homo sapiens
acagugggagccagg

SEQ ID NO: 1363333 - RNA, 17 nt, Homo sapiens
acagugucuguguacau

SEQ ID NO: 1363334 - RNA, 21 nt, Homo sapiens
acaguucuuugggccagacau

SEQ ID NO: 1363335 - RNA, 16 nt, Homo sapiens
acaguugcagcccuug

SEQ ID NO: 1363336 - RNA, 19 nt, Homo sapiens
ccuagaagggucacuuuaa

SEQ ID NO: 1363337 - RNA, 20 nt, Homo sapiens
ccuagcacuuugggaggcca

SEQ ID NO: 1363338 - RNA, 18 nt, Homo sapiens
ccuagcggaguuccagca

SEQ ID NO: 1363339 - RNA, 22 nt, Homo sapiens
ccuaguauaucagugacaguug

SEQ ID NO: 1363340 - RNA, 22 nt, Homo sapiens
ccucaccuagccugaugagauu

SEQ ID NO: 1363341 - RNA, 21 nt, Homo sapiens
ccucaccuuggcaccagacac

SEQ ID NO: 1363342 - RNA, 15 nt, Homo sapiens
ccucacuuaaacuuu

SEQ ID NO: 1363343 - RNA, 11 nt, Homo sapiens
ccucacuuuag

SEQ ID NO: 1363344 - RNA, 17 nt, Homo sapiens
ccucagaauugaucauu

SEQ ID NO: 1363345 - RNA, 14 nt, Homo sapiens
ccucagccagagaa

SEQ ID NO: 1363346 - RNA, 15 nt, Homo sapiens
ccucagccuugccag

SEQ ID NO: 1363347 - RNA, 20 nt, Homo sapiens
ccucagcugccucacuuccu

SEQ ID NO: 1363348 - RNA, 22 nt, Homo sapiens
ccucaggcagguaaccccagau

SEQ ID NO: 1363349 - RNA, 20 nt, Homo sapiens
ccucaguuucccuccucugc

SEQ ID NO: 1363350 - RNA, 16 nt, Homo sapiens
ccuccaagucacaaag

SEQ ID NO: 1363351 - RNA, 14 nt, Homo sapiens
ccuccacagcagug

SEQ ID NO: 1363352 - RNA, 13 nt, Homo sapiens
ccucccacucuau

SEQ ID NO: 1363353 - RNA, 20 nt, Homo sapiens
ccucccauaauugcuuugcc

SEQ ID NO: 1363354 - RNA, 15 nt, Homo sapiens
ccucccuaaugcuca

SEQ ID NO: 1363355 - RNA, 13 nt, Homo sapiens
ccucccuccagau

SEQ ID NO: 1363356 - RNA, 18 nt, Homo sapiens
ccucccugccuccaggaa

SEQ ID NO: 1363357 - RNA, 17 nt, Homo sapiens
ccucccugggggcggga

SEQ ID NO: 1363358 - RNA, 15 nt, Homo sapiens
ccuccgccauucuca

SEQ ID NO: 1363359 - RNA, 23 nt, Homo sapiens
ccuccuccagccgccaugcuccu

SEQ ID NO: 1363360 - RNA, 18 nt, Homo sapiens
ccuccucccuaaugcuca

SEQ ID NO: 1363361 - RNA, 15 nt, Homo sapiens
ccucucaguacuuug

SEQ ID NO: 1363362 - RNA, 19 nt, Homo sapiens
ccucucucuucugcuccac

SEQ ID NO: 1363363 - RNA, 14 nt, Homo sapiens
ccucugaaaaccaa

SEQ ID NO: 1363364 - RNA, 16 nt, Homo sapiens
ccucugcuguucagga

SEQ ID NO: 1363365 - RNA, 22 nt, Homo sapiens
ccucuuccccagaaaggagacu

SEQ ID NO: 1363366 - RNA, 13 nt, Homo sapiens
ccucuuugcuuug

SEQ ID NO: 1363367 - RNA, 19 nt, Homo sapiens
ccugaaauuaacucagaca

SEQ ID NO: 1363368 - RNA, 15 nt, Homo sapiens
ccugaagaaccaguc

SEQ ID NO: 1363369 - RNA, 14 nt, Homo sapiens
ccugacaaccacug

SEQ ID NO: 1363370 - RNA, 14 nt, Homo sapiens
ccugagcacugacu

SEQ ID NO: 1363371 - RNA, 21 nt, Homo sapiens
ccugcacagcuuacacuguca

SEQ ID NO: 1363372 - RNA, 15 nt, Homo sapiens
ccugcaucugaccag

SEQ ID NO: 1363373 - RNA, 17 nt, Homo sapiens
ccugccacccauuccau

SEQ ID NO: 1363374 - RNA, 19 nt, Homo sapiens
ccugcccuugucccacuca

SEQ ID NO: 1363375 - RNA, 17 nt, Homo sapiens
ccugcugcuggugcaca

SEQ ID NO: 1363376 - RNA, 12 nt, Homo sapiens
ccuggaccccag

SEQ ID NO: 1363377 - RNA, 15 nt, Homo sapiens
ccuggacuuuccugc

SEQ ID NO: 1363378 - RNA, 15 nt, Homo sapiens
ccuggcagcucugga

SEQ ID NO: 1363379 - RNA, 20 nt, Homo sapiens
ccuggcccacugcaucguuu

SEQ ID NO: 1363380 - RNA, 16 nt, Homo sapiens
ccuggcggggucuugc

SEQ ID NO: 1363381 - RNA, 22 nt, Homo sapiens
ccugggugacagagcaagugag

SEQ ID NO: 1363382 - RNA, 18 nt, Homo sapiens
ccugguaccuagcaaagc

SEQ ID NO: 1363383 - RNA, 22 nt, Homo sapiens
ccugguugagcuucugcuaaaa

SEQ ID NO: 1363384 - RNA, 22 nt, Homo sapiens
ccuguagucccagcuacuugag

SEQ ID NO: 1363385 - RNA, 17 nt, Homo sapiens
ccugucaaacaaagcca

SEQ ID NO: 1363386 - RNA, 16 nt, Homo sapiens
ccugucuaaaaauuca

SEQ ID NO: 1363387 - RNA, 13 nt, Homo sapiens
ccugugcaaaaaa

SEQ ID NO: 1363388 - RNA, 16 nt, Homo sapiens
ccugugugcgugcgca

SEQ ID NO: 1363389 - RNA, 21 nt, Homo sapiens
ccuguguugucucuagagcag

SEQ ID NO: 1363390 - RNA, 22 nt, Homo sapiens
ccuguguuuuucuuugggucua

SEQ ID NO: 1363391 - RNA, 16 nt, Homo sapiens
ccuguuuuauaauuca

SEQ ID NO: 1363392 - RNA, 12 nt, Homo sapiens
ccuuaaauaugu

SEQ ID NO: 1363393 - RNA, 14 nt, Homo sapiens
ccuucaagugccaa

SEQ ID NO: 1363394 - RNA, 15 nt, Homo sapiens
ccuucaagugccaaa

SEQ ID NO: 1363395 - RNA, 23 nt, Homo sapiens
ccuuccacgggggcuguggcucu

SEQ ID NO: 1363396 - RNA, 15 nt, Homo sapiens
ccuucucugcuccac

SEQ ID NO: 1363397 - RNA, 22 nt, Homo sapiens
ccuucuuucaagcuucuugcca

SEQ ID NO: 1363398 - RNA, 19 nt, Homo sapiens
ccuugccucaaugccagua

SEQ ID NO: 1363399 - RNA, 11 nt, Homo sapiens
ccuugcucccc

SEQ ID NO: 1363400 - RNA, 21 nt, Homo sapiens
ccuugcuucuuggacuucuug

SEQ ID NO: 1363401 - RNA, 17 nt, Homo sapiens
ccuuggcaccagacacc

SEQ ID NO: 1363402 - RNA, 16 nt, Homo sapiens
ccuuggcagcccugau

SEQ ID NO: 1363403 - RNA, 16 nt, Homo sapiens
ccuugggcugcuccuc

SEQ ID NO: 1363404 - RNA, 16 nt, Homo sapiens
ccuugguaaaaacugc

SEQ ID NO: 1363405 - RNA, 21 nt, Homo sapiens
ccuugguaggggacuaauuca

SEQ ID NO: 1363406 - RNA, 20 nt, Homo sapiens
ccuuucauaaagucuugccu

SEQ ID NO: 1363407 - RNA, 14 nt, Homo sapiens
ccuuuccucagugu

SEQ ID NO: 1363408 - RNA, 20 nt, Homo sapiens
cuccgagaggugggccaguc

SEQ ID NO: 1363409 - RNA, 17 nt, Homo sapiens
cuccgugaugcuguuuu

SEQ ID NO: 1363410 - RNA, 23 nt, Homo sapiens
cuccgugaugcuguuuuucucau

SEQ ID NO: 1363411 - RNA, 18 nt, Homo sapiens
cuccucccuaaugcucac

SEQ ID NO: 1363412 - RNA, 12 nt, Homo sapiens
cuccucccuggg

SEQ ID NO: 1363413 - RNA, 20 nt, Homo sapiens
cuccuccugcccaccuguca

SEQ ID NO: 1363414 - RNA, 13 nt, Homo sapiens
cuccucgcaagcu

SEQ ID NO: 1363415 - RNA, 19 nt, Homo sapiens
cuccucucccagugacaac

SEQ ID NO: 1363416 - RNA, 19 nt, Homo sapiens
cuccucucccauccuugau

SEQ ID NO: 1363417 - RNA, 11 nt, Homo sapiens
cuccugaagga

SEQ ID NO: 1363418 - RNA, 14 nt, Homo sapiens
cuccugacuuuuaa

SEQ ID NO: 1363419 - RNA, 22 nt, Homo sapiens
cuccugcgggggcgaggccccu

SEQ ID NO: 1363420 - RNA, 16 nt, Homo sapiens
cuccuugcugcauuga

SEQ ID NO: 1363421 - RNA, 22 nt, Homo sapiens
cuccuugggaggccccacuggg

SEQ ID NO: 1363422 - RNA, 13 nt, Homo sapiens
cuccuuuacuaaa

SEQ ID NO: 1363423 - RNA, 22 nt, Homo sapiens
cucguucuuauuuaaucuccau

SEQ ID NO: 1363424 - RNA, 19 nt, Homo sapiens
cucuaaauaccauucccuu

SEQ ID NO: 1363425 - RNA, 17 nt, Homo sapiens
cucuaacuccugccauu

SEQ ID NO: 1363426 - RNA, 21 nt, Homo sapiens
cucuacucuagggaaaaacca

SEQ ID NO: 1363427 - RNA, 15 nt, Homo sapiens
cucuacuuaauccaa

SEQ ID NO: 1363428 - RNA, 12 nt, Homo sapiens
cucuauggugug

SEQ ID NO: 1363429 - RNA, 15 nt, Homo sapiens
cucuauuccaaaaag

SEQ ID NO: 1363430 - RNA, 13 nt, Homo sapiens
cucuccugugaga

SEQ ID NO: 1363431 - RNA, 11 nt, Homo sapiens
cucugaaaugu

SEQ ID NO: 1363432 - RNA, 11 nt, Homo sapiens
cucugacugua

SEQ ID NO: 1363433 - RNA, 16 nt, Homo sapiens
cucugagaucaugagu

SEQ ID NO: 1363434 - RNA, 13 nt, Homo sapiens
cucugauauggcu

SEQ ID NO: 1363435 - RNA, 16 nt, Homo sapiens
cucugcacuacugaca

SEQ ID NO: 1363436 - RNA, 15 nt, Homo sapiens
cucuggagcaggucu

SEQ ID NO: 1363437 - RNA, 15 nt, Homo sapiens
cucuguacuuuucau

SEQ ID NO: 1363438 - RNA, 18 nt, Homo sapiens
cucuguauacaaaacccu

SEQ ID NO: 1363439 - RNA, 17 nt, Homo sapiens
cucugucgugagugucu

SEQ ID NO: 1363440 - RNA, 13 nt, Homo sapiens
cucugugcugcac

SEQ ID NO: 1363441 - RNA, 21 nt, Homo sapiens
cucuguggaaugaauacacac

SEQ ID NO: 1363442 - RNA, 16 nt, Homo sapiens
cucuucaguuaauucu

SEQ ID NO: 1363443 - RNA, 12 nt, Homo sapiens
cucuucccuggg

SEQ ID NO: 1363444 - RNA, 11 nt, Homo sapiens
cugaaaaccaa

SEQ ID NO: 1363445 - RNA, 16 nt, Homo sapiens
cugaaacaacuuggaa

SEQ ID NO: 1363446 - RNA, 15 nt, Homo sapiens
cugaaauuaacucag

SEQ ID NO: 1363447 - RNA, 17 nt, Homo sapiens
cugaaggaaauaaugca

SEQ ID NO: 1363448 - RNA, 21 nt, Homo sapiens
cugaagucaccucuugguuac

SEQ ID NO: 1363449 - RNA, 16 nt, Homo sapiens
cugacacagacauccu

SEQ ID NO: 1363450 - RNA, 11 nt, Homo sapiens
cugacauugcc

SEQ ID NO: 1363451 - RNA, 16 nt, Homo sapiens
cugacauugccaaaaa

SEQ ID NO: 1363452 - RNA, 23 nt, Homo sapiens
cugaccacgcccccagcugugac

SEQ ID NO: 1363453 - RNA, 20 nt, Homo sapiens
cugaccauccaggcauauag

SEQ ID NO: 1363454 - RNA, 23 nt, Homo sapiens
cugaccucgugauccaccugccu

SEQ ID NO: 1363455 - RNA, 16 nt, Homo sapiens
cugacuuuuaauguca

SEQ ID NO: 1363456 - RNA, 21 nt, Homo sapiens
caugaugcgggccagugcucc

SEQ ID NO: 1363457 - RNA, 22 nt, Homo sapiens
caugaugcgggccagugcucca

SEQ ID NO: 1363458 - RNA, 19 nt, Homo sapiens
caugaugcuagccagcaaa

SEQ ID NO: 1363459 - RNA, 16 nt, Homo sapiens
caugccacaaggacuu

SEQ ID NO: 1363460 - RNA, 22 nt, Homo sapiens
caugcuccuggcccacugcauc

SEQ ID NO: 1363461 - RNA, 20 nt, Homo sapiens
caugcuggaaccugcaaaaa

SEQ ID NO: 1363462 - RNA, 18 nt, Homo sapiens
caugcuucagugcugcuc

SEQ ID NO: 1363463 - RNA, 19 nt, Homo sapiens
cauggaaaaucagugacau

SEQ ID NO: 1363464 - RNA, 19 nt, Homo sapiens
cauggcuuuggcuuugcaa

SEQ ID NO: 1363465 - RNA, 22 nt, Homo sapiens
cauggcuuuggcuuugcaaaau

SEQ ID NO: 1363466 - RNA, 15 nt, Homo sapiens
caugguuauugauga

SEQ ID NO: 1363467 - RNA, 15 nt, Homo sapiens
cauguaauugcagau

SEQ ID NO: 1363468 - RNA, 19 nt, Homo sapiens
cauguaucacccccaaaaa

SEQ ID NO: 1363469 - RNA, 20 nt, Homo sapiens
caugucccaaaccagacacc

SEQ ID NO: 1363470 - RNA, 14 nt, Homo sapiens
caugugcacuugaa

SEQ ID NO: 1363471 - RNA, 17 nt, Homo sapiens
cauguuuaaaccugaca

SEQ ID NO: 1363472 - RNA, 23 nt, Homo sapiens
cauguuuauaaaucuuaugcucu

SEQ ID NO: 1363473 - RNA, 14 nt, Homo sapiens
cauuaaacuacuuu

SEQ ID NO: 1363474 - RNA, 15 nt, Homo sapiens
cauuacacaguucag

SEQ ID NO: 1363475 - RNA, 16 nt, Homo sapiens
cauuaccuugugcuaa

SEQ ID NO: 1363476 - RNA, 18 nt, Homo sapiens
cauuagaccaagcuuguc

SEQ ID NO: 1363477 - RNA, 22 nt, Homo sapiens
cauuauaaauaaauaccaaaaa

SEQ ID NO: 1363478 - RNA, 14 nt, Homo sapiens
cauuauaugcaaau

SEQ ID NO: 1363479 - RNA, 19 nt, Homo sapiens
cauucagcagcaggugcuu

SEQ ID NO: 1363480 - RNA, 19 nt, Homo sapiens
cauucgucuuguuguuauu

SEQ ID NO: 1363481 - RNA, 14 nt, Homo sapiens
cauucuacugaaaa

SEQ ID NO: 1363482 - RNA, 23 nt, Homo sapiens
cauuggauccuccccgacugugg

SEQ ID NO: 1363483 - RNA, 12 nt, Homo sapiens
cauuguaacaug

SEQ ID NO: 1363484 - RNA, 13 nt, Homo sapiens
cauuguagacaug

SEQ ID NO: 1363485 - RNA, 22 nt, Homo sapiens
cauugucguauaggcauguaaa

SEQ ID NO: 1363486 - RNA, 14 nt, Homo sapiens
cauuuaaauuccac

SEQ ID NO: 1363487 - RNA, 22 nt, Homo sapiens
cauuuaacugccuuacagacag

SEQ ID NO: 1363488 - RNA, 13 nt, Homo sapiens
cauuuaaucugcu

SEQ ID NO: 1363489 - RNA, 19 nt, Homo sapiens
cauuucaauugcuuuguga

SEQ ID NO: 1363490 - RNA, 18 nt, Homo sapiens
cauuucacaaaacagccu

SEQ ID NO: 1363491 - RNA, 15 nt, Homo sapiens
cauuuccaagcacuu

SEQ ID NO: 1363492 - RNA, 19 nt, Homo sapiens
cauuucuuuuucauuugac

SEQ ID NO: 1363493 - RNA, 20 nt, Homo sapiens
cauuuggggcuagacaguuc

SEQ ID NO: 1363494 - RNA, 20 nt, Homo sapiens
cauuuguguuuugaaagccc

SEQ ID NO: 1363495 - RNA, 22 nt, Homo sapiens
cauuuguguuuugaaagcccaa

SEQ ID NO: 1363496 - RNA, 18 nt, Homo sapiens
aagggcguggcucugggu

SEQ ID NO: 1363497 - RNA, 14 nt, Homo sapiens
aagggucacuuuaa

SEQ ID NO: 1363498 - RNA, 16 nt, Homo sapiens
aaggugaaagugcagu

SEQ ID NO: 1363499 - RNA, 23 nt, Homo sapiens
aagguuuuauaaggcugauguca

SEQ ID NO: 1363500 - RNA, 15 nt, Homo sapiens
aaguaaaacuuaaga

SEQ ID NO: 1363501 - RNA, 17 nt, Homo sapiens
aaguaaccucuacaggc

SEQ ID NO: 1363502 - RNA, 19 nt, Homo sapiens
aaguacuagcuuacuuuug

SEQ ID NO: 1363503 - RNA, 13 nt, Homo sapiens
aaguacuugucau

SEQ ID NO: 1363504 - RNA, 14 nt, Homo sapiens
aaguaucugagauu

SEQ ID NO: 1363505 - RNA, 13 nt, Homo sapiens
aagucagcuuuca

SEQ ID NO: 1363506 - RNA, 16 nt, Homo sapiens
aagugaauuguugaca

SEQ ID NO: 1363507 - RNA, 22 nt, Homo sapiens
aagugagacccugucucaaaaa

SEQ ID NO: 1363508 - RNA, 16 nt, Homo sapiens
aaguguacaauaccac

SEQ ID NO: 1363509 - RNA, 16 nt, Homo sapiens
aaguguccuucuugcu

SEQ ID NO: 1363510 - RNA, 20 nt, Homo sapiens
aaguuaaaaagucaaacuuu

SEQ ID NO: 1363511 - RNA, 19 nt, Homo sapiens
aaguugaggggagcaugcu

SEQ ID NO: 1363512 - RNA, 12 nt, Homo sapiens
aaguuucauccg

SEQ ID NO: 1363513 - RNA, 19 nt, Homo sapiens
aaguuucuggugccauuuc

SEQ ID NO: 1363514 - RNA, 20 nt, Homo sapiens
aauaaacuguguuuacucag

SEQ ID NO: 1363515 - RNA, 12 nt, Homo sapiens
aauaaagccucu

SEQ ID NO: 1363516 - RNA, 17 nt, Homo sapiens
aauaaaucugacccagu

SEQ ID NO: 1363517 - RNA, 18 nt, Homo sapiens
aauaacauuuaaauucca

SEQ ID NO: 1363518 - RNA, 19 nt, Homo sapiens
aauaauccaaauccaucaa

SEQ ID NO: 1363519 - RNA, 20 nt, Homo sapiens
aauacccguugauaacucag

SEQ ID NO: 1363520 - RNA, 20 nt, Homo sapiens
uccuuugccugauccuccaa

SEQ ID NO: 1363521 - RNA, 18 nt, Homo sapiens
ucgacuucauuuugccac

SEQ ID NO: 1363522 - RNA, 15 nt, Homo sapiens
ucgcugucaucucag

SEQ ID NO: 1363523 - RNA, 14 nt, Homo sapiens
ucgcuucuugccuc

SEQ ID NO: 1363524 - RNA, 15 nt, Homo sapiens
ucggcuuugcagugc

SEQ ID NO: 1363525 - RNA, 14 nt, Homo sapiens
ucggugggacccug

SEQ ID NO: 1363526 - RNA, 16 nt, Homo sapiens
ucgugaacugcaguga

SEQ ID NO: 1363527 - RNA, 19 nt, Homo sapiens
ucuaaacuuuagaauuaau

SEQ ID NO: 1363528 - RNA, 15 nt, Homo sapiens
ucuaacaucuagccc

SEQ ID NO: 1363529 - RNA, 20 nt, Homo sapiens
ucuaagacuacuaugaacag

SEQ ID NO: 1363530 - RNA, 15 nt, Homo sapiens
ucuacagagugagac

SEQ ID NO: 1363531 - RNA, 16 nt, Homo sapiens
ucuacugugugaucag

SEQ ID NO: 1363532 - RNA, 17 nt, Homo sapiens
ucuacuuugauucugau

SEQ ID NO: 1363533 - RNA, 20 nt, Homo sapiens
ucuagaaccaggcaacuugg

SEQ ID NO: 1363534 - RNA, 15 nt, Homo sapiens
ucuagagcacugcca

SEQ ID NO: 1363535 - RNA, 16 nt, Homo sapiens
ucuaggcaacauagua

SEQ ID NO: 1363536 - RNA, 16 nt, Homo sapiens
ucuagggaaaaaccag

SEQ ID NO: 1363537 - RNA, 14 nt, Homo sapiens
ucuaggugcccuug

SEQ ID NO: 1363538 - RNA, 15 nt, Homo sapiens
ucuaggugcuuuaac

SEQ ID NO: 1363539 - RNA, 19 nt, Homo sapiens
ucuagucaggggaaaagac

SEQ ID NO: 1363540 - RNA, 17 nt, Homo sapiens
ucuaugaaauaucaugc

SEQ ID NO: 1363541 - RNA, 17 nt, Homo sapiens
ucucaaaggaaauaagg

SEQ ID NO: 1363542 - RNA, 18 nt, Homo sapiens
ucucaugggaaggggagg

SEQ ID NO: 1363543 - RNA, 20 nt, Homo sapiens
ucuccagaaagcucaucuca

SEQ ID NO: 1363544 - RNA, 20 nt, Homo sapiens
ucucccaucaggguccccag

SEQ ID NO: 1363545 - RNA, 14 nt, Homo sapiens
ucucccauccuuga

SEQ ID NO: 1363546 - RNA, 21 nt, Homo sapiens
ucucccugccaagucucagaa

SEQ ID NO: 1363547 - RNA, 21 nt, Homo sapiens
ucuccuuguaaaagccuaugu

SEQ ID NO: 1363548 - RNA, 21 nt, Homo sapiens
ucucggcccugcccagcuuug

SEQ ID NO: 1363549 - RNA, 18 nt, Homo sapiens
ucucuacugaaaguacaa

SEQ ID NO: 1363550 - RNA, 19 nt, Homo sapiens
ucucuccacugugcuuuca

SEQ ID NO: 1363551 - RNA, 20 nt, Homo sapiens
ucucuccacugugcuuucag

SEQ ID NO: 1363552 - RNA, 13 nt, Homo sapiens
ucucucuucucca

SEQ ID NO: 1363553 - RNA, 21 nt, Homo sapiens
ucucugcuuuggaaaucacac

SEQ ID NO: 1363554 - RNA, 18 nt, Homo sapiens
ucugaaaauuaacacugc

SEQ ID NO: 1363555 - RNA, 18 nt, Homo sapiens
ucugaacccaggcagcug

SEQ ID NO: 1363556 - RNA, 21 nt, Homo sapiens
ucugaagcagaugcaaagagg

SEQ ID NO: 1363557 - RNA, 13 nt, Homo sapiens
ucugaccagcagc

SEQ ID NO: 1363558 - RNA, 12 nt, Homo sapiens
ucugaccccagc

SEQ ID NO: 1363559 - RNA, 19 nt, Homo sapiens
ucugacuuaagcaaaagaa

SEQ ID NO: 1363560 - RNA, 13 nt, Homo sapiens
ucugagaaacucu

SEQ ID NO: 1363561 - RNA, 19 nt, Homo sapiens
ucugagaaacucuacaugu

SEQ ID NO: 1363562 - RNA, 14 nt, Homo sapiens
ucugauaaugcuca

SEQ ID NO: 1363563 - RNA, 16 nt, Homo sapiens
ucugaucugaugcaag

SEQ ID NO: 1363564 - RNA, 22 nt, Homo sapiens
ucugcaugucuacucagcauuu

SEQ ID NO: 1363565 - RNA, 21 nt, Homo sapiens
ucugcauuucgguggcuaguc

SEQ ID NO: 1363566 - RNA, 23 nt, Homo sapiens
ucugcauuucgguggcuagucaa

SEQ ID NO: 1363567 - RNA, 18 nt, Homo sapiens
ucugccacaccucuccaa

SEQ ID NO: 1363568 - RNA, 20 nt, Homo sapiens
ucugccacaccucuccaaag

SEQ ID NO: 1363569 - RNA, 20 nt, Homo sapiens
ucugccggcccuggggcuag

SEQ ID NO: 1363570 - RNA, 23 nt, Homo sapiens
ucugcucuuucucugccagugac

SEQ ID NO: 1363571 - RNA, 14 nt, Homo sapiens
ucugcuguucagga

SEQ ID NO: 1363572 - RNA, 14 nt, Homo sapiens
ucuggaaauagccc

SEQ ID NO: 1363573 - RNA, 18 nt, Homo sapiens
ucuggaaugguuuacaga

SEQ ID NO: 1363574 - RNA, 20 nt, Homo sapiens
ucuggcaucuuagaccucca

SEQ ID NO: 1363575 - RNA, 22 nt, Homo sapiens
ucuggggggacccagugcagaa

SEQ ID NO: 1363576 - RNA, 18 nt, Homo sapiens
ucuggguacuucuugaag

SEQ ID NO: 1363577 - RNA, 19 nt, Homo sapiens
ucugggugaccucacuuua

SEQ ID NO: 1363578 - RNA, 16 nt, Homo sapiens
ucuggucgcuccugcc

SEQ ID NO: 1363579 - RNA, 13 nt, Homo sapiens
ucuggugccauuu

SEQ ID NO: 1363580 - RNA, 18 nt, Homo sapiens
ucacuugaguuguugcuu

SEQ ID NO: 1363581 - RNA, 18 nt, Homo sapiens
ucagaacuaccauuguaa

SEQ ID NO: 1363582 - RNA, 21 nt, Homo sapiens
ucagaagagguugggcuucca

SEQ ID NO: 1363583 - RNA, 18 nt, Homo sapiens
ucagaagucaguugcaaa

SEQ ID NO: 1363584 - RNA, 13 nt, Homo sapiens
ucagaaugucaga

SEQ ID NO: 1363585 - RNA, 21 nt, Homo sapiens
ucagaggaaaagggcaaaaag

SEQ ID NO: 1363586 - RNA, 22 nt, Homo sapiens
ucagaggaaaagggcaaaaaga

SEQ ID NO: 1363587 - RNA, 12 nt, Homo sapiens
ucagagugccac

SEQ ID NO: 1363588 - RNA, 21 nt, Homo sapiens
ucagauaagguaaaaugccau

SEQ ID NO: 1363589 - RNA, 12 nt, Homo sapiens
ucagauucauga

SEQ ID NO: 1363590 - RNA, 11 nt, Homo sapiens
ucagcaaaaaa

SEQ ID NO: 1363591 - RNA, 16 nt, Homo sapiens
ucagccuggccagaca

SEQ ID NO: 1363592 - RNA, 15 nt, Homo sapiens
ucagcugaaccuggg

SEQ ID NO: 1363593 - RNA, 15 nt, Homo sapiens
ucagcuggaucucca

SEQ ID NO: 1363594 - RNA, 18 nt, Homo sapiens
ucaggacagaugccacac

SEQ ID NO: 1363595 - RNA, 20 nt, Homo sapiens
ucaggacagguggugcaaau

SEQ ID NO: 1363596 - RNA, 18 nt, Homo sapiens
ucaggaguucgagaccag

SEQ ID NO: 1363597 - RNA, 16 nt, Homo sapiens
ucaggaugcagcacug

SEQ ID NO: 1363598 - RNA, 12 nt, Homo sapiens
ucaggcaccuga

SEQ ID NO: 1363599 - RNA, 17 nt, Homo sapiens
ucaggcaccugaaguga

SEQ ID NO: 1363600 - RNA, 23 nt, Homo sapiens
ucaggccacauggcuaaagaagg

SEQ ID NO: 1363601 - RNA, 14 nt, Homo sapiens
ucaggggacucagc

SEQ ID NO: 1363602 - RNA, 16 nt, Homo sapiens
ucagggugugggaucu

SEQ ID NO: 1363603 - RNA, 20 nt, Homo sapiens
ucagucccuaaaaacacaga

SEQ ID NO: 1363604 - RNA, 15 nt, Homo sapiens
ucagugacaucugau

SEQ ID NO: 1363605 - RNA, 18 nt, Homo sapiens
ucagugacuuugagcuga

SEQ ID NO: 1363606 - RNA, 15 nt, Homo sapiens
ucaguguggaaaauu

SEQ ID NO: 1363607 - RNA, 20 nt, Homo sapiens
ucaguucccuuggccucaga

SEQ ID NO: 1363608 - RNA, 13 nt, Homo sapiens
ucaguuuaggccu

SEQ ID NO: 1363609 - RNA, 22 nt, Homo sapiens
ucaguuugcuagcagaaaucua

SEQ ID NO: 1363610 - RNA, 21 nt, Homo sapiens
ucauaacucugugaucuugcu

SEQ ID NO: 1363611 - RNA, 22 nt, Homo sapiens
ucauacuccuuuuaagcaguga

SEQ ID NO: 1363612 - RNA, 15 nt, Homo sapiens
ucauauacugccaug

SEQ ID NO: 1363613 - RNA, 17 nt, Homo sapiens
ucauccccacaaucugg

SEQ ID NO: 1363614 - RNA, 19 nt, Homo sapiens
ucaucuaauucucugugga

SEQ ID NO: 1363615 - RNA, 16 nt, Homo sapiens
ucaucucucugcccaa

SEQ ID NO: 1363616 - RNA, 21 nt, Homo sapiens
ucaucugaaggggcaaauucu

SEQ ID NO: 1363617 - RNA, 18 nt, Homo sapiens
ucaugaagaaaagaccuu

SEQ ID NO: 1363618 - RNA, 17 nt, Homo sapiens
ucaugaguuuguuuaca

SEQ ID NO: 1363619 - RNA, 10 nt, Homo sapiens
ucaugcccuc

SEQ ID NO: 1363620 - RNA, 11 nt, Homo sapiens
ucaugccugua

SEQ ID NO: 1363621 - RNA, 20 nt, Homo sapiens
ucauggaugggggaacucag

SEQ ID NO: 1363622 - RNA, 16 nt, Homo sapiens
ucauguggcuaccugu

SEQ ID NO: 1363623 - RNA, 17 nt, Homo sapiens
ucauuagcauuuugcua

SEQ ID NO: 1363624 - RNA, 11 nt, Homo sapiens
ucauucuugcc

SEQ ID NO: 1363625 - RNA, 14 nt, Homo sapiens
uccaaacugccuaa

SEQ ID NO: 1363626 - RNA, 15 nt, Homo sapiens
uccaaauguccucca

SEQ ID NO: 1363627 - RNA, 15 nt, Homo sapiens
uccaacacauuucac

SEQ ID NO: 1363628 - RNA, 13 nt, Homo sapiens
uccaacagcauca

SEQ ID NO: 1363629 - RNA, 16 nt, Homo sapiens
uccaacguggcccaga

SEQ ID NO: 1363630 - RNA, 23 nt, Homo sapiens
uccaacguggcccagagaagcca

SEQ ID NO: 1363631 - RNA, 17 nt, Homo sapiens
uccaauuuuaauuuagu

SEQ ID NO: 1363632 - RNA, 15 nt, Homo sapiens
uccacagauuaucaa

SEQ ID NO: 1363633 - RNA, 17 nt, Homo sapiens
uccacagcugugugagc

SEQ ID NO: 1363634 - RNA, 13 nt, Homo sapiens
uccacccuuggcc

SEQ ID NO: 1363635 - RNA, 11 nt, Homo sapiens
uccacugccau

SEQ ID NO: 1363636 - RNA, 20 nt, Homo sapiens
uccagaaaacaaaacugcau

SEQ ID NO: 1363637 - RNA, 16 nt, Homo sapiens
uccagcauuuagcugg

SEQ ID NO: 1363638 - RNA, 17 nt, Homo sapiens
uccagccgccauugcca

SEQ ID NO: 1363639 - RNA, 17 nt, Homo sapiens
uccaggggcggugcagg

SEQ ID NO: 1363640 - RNA, 14 nt, Homo sapiens
uccaucccuacccc

SEQ ID NO: 1363641 - RNA, 14 nt, Homo sapiens
uagggaaaaaccag

SEQ ID NO: 1363642 - RNA, 23 nt, Homo sapiens
uagggaguuagaggcuguacaag

SEQ ID NO: 1363643 - RNA, 22 nt, Homo sapiens
uagggguuaacuuggucagagc

SEQ ID NO: 1363644 - RNA, 16 nt, Homo sapiens
uaggguggcccuugca

SEQ ID NO: 1363645 - RNA, 12 nt, Homo sapiens
uaguauucauga

SEQ ID NO: 1363646 - RNA, 22 nt, Homo sapiens
uagucacagagauaauucuagc

SEQ ID NO: 1363647 - RNA, 20 nt, Homo sapiens
uagucccagcuacuugagag

SEQ ID NO: 1363648 - RNA, 14 nt, Homo sapiens
uagucccauuugac

SEQ ID NO: 1363649 - RNA, 16 nt, Homo sapiens
uagucucuacccagua

SEQ ID NO: 1363650 - RNA, 14 nt, Homo sapiens
uagugaaaucuugu

SEQ ID NO: 1363651 - RNA, 21 nt, Homo sapiens
uagugacuugugucccaugau

SEQ ID NO: 1363652 - RNA, 20 nt, Homo sapiens
uagugagcagugagcacuga

SEQ ID NO: 1363653 - RNA, 20 nt, Homo sapiens
uagugccacccaccuuugcc

SEQ ID NO: 1363654 - RNA, 17 nt, Homo sapiens
uagugcuuuccaguuca

SEQ ID NO: 1363655 - RNA, 20 nt, Homo sapiens
uaguuagacuuaaaaacuug

SEQ ID NO: 1363656 - RNA, 17 nt, Homo sapiens
uaguugcugucauccac

SEQ ID NO: 1363657 - RNA, 13 nt, Homo sapiens
uauaaaaguacua

SEQ ID NO: 1363658 - RNA, 16 nt, Homo sapiens
uauaaucccacccacc

SEQ ID NO: 1363659 - RNA, 12 nt, Homo sapiens
uauaaucuacuc

SEQ ID NO: 1363660 - RNA, 16 nt, Homo sapiens
uauaccagguuaccuc

SEQ ID NO: 1363661 - RNA, 19 nt, Homo sapiens
uauacuuaagaauacacag

SEQ ID NO: 1363662 - RNA, 21 nt, Homo sapiens
uauaggaaaacaauaauuuua

SEQ ID NO: 1363663 - RNA, 15 nt, Homo sapiens
uauauaauacauuaa

SEQ ID NO: 1363664 - RNA, 17 nt, Homo sapiens
uauauaggugugugaga

SEQ ID NO: 1363665 - RNA, 13 nt, Homo sapiens
uauauauuacaag

SEQ ID NO: 1363666 - RNA, 18 nt, Homo sapiens
uauaucacuucacuguuc

SEQ ID NO: 1363667 - RNA, 17 nt, Homo sapiens
uauauuacaagggauaa

SEQ ID NO: 1363668 - RNA, 21 nt, Homo sapiens
uauauuccaccaggauauccu

SEQ ID NO: 1363669 - RNA, 18 nt, Homo sapiens
uauauuuguaaagcuauu

SEQ ID NO: 1363670 - RNA, 13 nt, Homo sapiens
uaucaaaugaaua

SEQ ID NO: 1363671 - RNA, 20 nt, Homo sapiens
uaucaaaugaauaaauccuc

SEQ ID NO: 1363672 - RNA, 13 nt, Homo sapiens
uaucaacuuccua

SEQ ID NO: 1363673 - RNA, 22 nt, Homo sapiens
uaucaccucauucugaacccuu

SEQ ID NO: 1363674 - RNA, 20 nt, Homo sapiens
uaucacuguugcauauacca

SEQ ID NO: 1363675 - RNA, 13 nt, Homo sapiens
uaucagcaaaaaa

SEQ ID NO: 1363676 - RNA, 21 nt, Homo sapiens
uauccaacaugugcucaggga

SEQ ID NO: 1363677 - RNA, 16 nt, Homo sapiens
uauccuaagacuaaca

SEQ ID NO: 1363678 - RNA, 23 nt, Homo sapiens
uauccuaagacuaacaaaggcag

SEQ ID NO: 1363679 - RNA, 18 nt, Homo sapiens
uauccuccuguucugaaa

SEQ ID NO: 1363680 - RNA, 14 nt, Homo sapiens
uauccucuugccaa

SEQ ID NO: 1363681 - RNA, 14 nt, Homo sapiens
uaucugaguugacu

SEQ ID NO: 1363682 - RNA, 20 nt, Homo sapiens
uaucuugaauguaguauuca

SEQ ID NO: 1363683 - RNA, 22 nt, Homo sapiens
uaugaaauaaaauuacacagua

SEQ ID NO: 1363684 - RNA, 17 nt, Homo sapiens
uaugaaauuauaaucug

SEQ ID NO: 1363685 - RNA, 19 nt, Homo sapiens
uaugaggagaugauaacug

SEQ ID NO: 1363686 - RNA, 15 nt, Homo sapiens
uaugaggcuguuguc

SEQ ID NO: 1363687 - RNA, 15 nt, Homo sapiens
uaugcaaaagguuua

SEQ ID NO: 1363688 - RNA, 20 nt, Homo sapiens
uaugguauauauacauauau

SEQ ID NO: 1363689 - RNA, 19 nt, Homo sapiens
uaugucacccaaugcauau

SEQ ID NO: 1363690 - RNA, 17 nt, Homo sapiens
uauguccgaugguaucu

SEQ ID NO: 1363691 - RNA, 21 nt, Homo sapiens
uaugugaucaauuuugacuua

SEQ ID NO: 1363692 - RNA, 21 nt, Homo sapiens
uauguguucuaacuauuauca

SEQ ID NO: 1363693 - RNA, 12 nt, Homo sapiens
uauguuucuccc

SEQ ID NO: 1363694 - RNA, 20 nt, Homo sapiens
uauuaaacauuuuucacuua

SEQ ID NO: 1363695 - RNA, 14 nt, Homo sapiens
uauuauauuugaca

SEQ ID NO: 1363696 - RNA, 17 nt, Homo sapiens
uauuauguaaauuuugc

SEQ ID NO: 1363697 - RNA, 11 nt, Homo sapiens
uauucagaaaa

SEQ ID NO: 1363698 - RNA, 23 nt, Homo sapiens
uauucaugaagcggucacagauc

SEQ ID NO: 1363699 - RNA, 20 nt, Homo sapiens
uauuccaggaugcugcugca

SEQ ID NO: 1363700 - RNA, 15 nt, Homo sapiens
uauucuaaaaccauu

SEQ ID NO: 1363701 - RNA, 15 nt, Homo sapiens
uauugacacugacua

SEQ ID NO: 1363702 - RNA, 17 nt, Homo sapiens
uaaauguuugugauguu

SEQ ID NO: 1363703 - RNA, 19 nt, Homo sapiens
uaacaaagcccuuauucuc

SEQ ID NO: 1363704 - RNA, 15 nt, Homo sapiens
uaacaaaggcagcug

SEQ ID NO: 1363705 - RNA, 14 nt, Homo sapiens
uaacaacuaugauu

SEQ ID NO: 1363706 - RNA, 14 nt, Homo sapiens
uaacaccaugauua

SEQ ID NO: 1363707 - RNA, 18 nt, Homo sapiens
uaacacguccacuuucaa

SEQ ID NO: 1363708 - RNA, 15 nt, Homo sapiens
uaacauuuaaauucc

SEQ ID NO: 1363709 - RNA, 11 nt, Homo sapiens
uaacauuuuac

SEQ ID NO: 1363710 - RNA, 14 nt, Homo sapiens
uaacccuuauucca

SEQ ID NO: 1363711 - RNA, 17 nt, Homo sapiens
uaaccucaaagugacua

SEQ ID NO: 1363712 - RNA, 14 nt, Homo sapiens
uaacgcgucuuccu

SEQ ID NO: 1363713 - RNA, 16 nt, Homo sapiens
uaacuacacagaggac

SEQ ID NO: 1363714 - RNA, 17 nt, Homo sapiens
uaacucaauauuuucca

SEQ ID NO: 1363715 - RNA, 16 nt, Homo sapiens
uaacugccaauccuua

SEQ ID NO: 1363716 - RNA, 18 nt, Homo sapiens
uaacugugaaauaccaca

SEQ ID NO: 1363717 - RNA, 14 nt, Homo sapiens
uaacuguugucaua

SEQ ID NO: 1363718 - RNA, 18 nt, Homo sapiens
uaacuuggucagagccac

SEQ ID NO: 1363719 - RNA, 19 nt, Homo sapiens
uaacuuuuuaaaacacaac

SEQ ID NO: 1363720 - RNA, 13 nt, Homo sapiens
uaagaacugcugu

SEQ ID NO: 1363721 - RNA, 13 nt, Homo sapiens
uaagacuacugaa

SEQ ID NO: 1363722 - RNA, 14 nt, Homo sapiens
uaagagacacucca

SEQ ID NO: 1363723 - RNA, 17 nt, Homo sapiens
uaagagccauuuagggg

SEQ ID NO: 1363724 - RNA, 19 nt, Homo sapiens
uaagagccuaacuccaucc

SEQ ID NO: 1363725 - RNA, 14 nt, Homo sapiens
uaagcauacuuugu

SEQ ID NO: 1363726 - RNA, 17 nt, Homo sapiens
uaagcauuuugugaugu

SEQ ID NO: 1363727 - RNA, 17 nt, Homo sapiens
uaagcccccacuacaag

SEQ ID NO: 1363728 - RNA, 13 nt, Homo sapiens
uaaggaacauaaa

SEQ ID NO: 1363729 - RNA, 14 nt, Homo sapiens
uaagggacaacauc

SEQ ID NO: 1363730 - RNA, 15 nt, Homo sapiens
uaagguaaaaugcca

SEQ ID NO: 1363731 - RNA, 18 nt, Homo sapiens
uaagguaaaaugccauga

SEQ ID NO: 1363732 - RNA, 16 nt, Homo sapiens
uaagguguagccacac

SEQ ID NO: 1363733 - RNA, 14 nt, Homo sapiens
uaagguuccaucca

SEQ ID NO: 1363734 - RNA, 23 nt, Homo sapiens
uaaguacucacuaaaaguucuca

SEQ ID NO: 1363735 - RNA, 22 nt, Homo sapiens
uaauaauuuacagguucuuagg

SEQ ID NO: 1363736 - RNA, 22 nt, Homo sapiens
uaauacauuaaauaugugaaau

SEQ ID NO: 1363737 - RNA, 12 nt, Homo sapiens
uaauacuuccaa

SEQ ID NO: 1363738 - RNA, 19 nt, Homo sapiens
uaauaucaaaugcaguaua

SEQ ID NO: 1363739 - RNA, 18 nt, Homo sapiens
uaauccagaaaaacugug

SEQ ID NO: 1363740 - RNA, 20 nt, Homo sapiens
uaaucccagcuacuugggag

SEQ ID NO: 1363741 - RNA, 19 nt, Homo sapiens
uaaucccuuugucugucaa

SEQ ID NO: 1363742 - RNA, 20 nt, Homo sapiens
uaaugauaaaauacuaaacu

SEQ ID NO: 1363743 - RNA, 14 nt, Homo sapiens
uaauuaauuucaaa

SEQ ID NO: 1363744 - RNA, 13 nt, Homo sapiens
uaauuacaccaua

SEQ ID NO: 1363745 - RNA, 16 nt, Homo sapiens
uaauucuagcuuugag

SEQ ID NO: 1363746 - RNA, 20 nt, Homo sapiens
uaauuuagaccccauacaag

SEQ ID NO: 1363747 - RNA, 21 nt, Homo sapiens
uaauuugauaguauugugcau

SEQ ID NO: 1363748 - RNA, 20 nt, Homo sapiens
uacaaaaccaucauuucaac

SEQ ID NO: 1363749 - RNA, 18 nt, Homo sapiens
uacaaacacaauauucaa

SEQ ID NO: 1363750 - RNA, 15 nt, Homo sapiens
uacaacacacacugu

SEQ ID NO: 1363751 - RNA, 21 nt, Homo sapiens
uacaaccaauggaaugugaug

SEQ ID NO: 1363752 - RNA, 19 nt, Homo sapiens
uacaagucagcuccagcuu

SEQ ID NO: 1363753 - RNA, 18 nt, Homo sapiens
uacaauaaagucuuaccu

SEQ ID NO: 1363754 - RNA, 14 nt, Homo sapiens
uacacacucaguga

SEQ ID NO: 1363755 - RNA, 18 nt, Homo sapiens
uacacacucagugacauu

SEQ ID NO: 1363756 - RNA, 17 nt, Homo sapiens
uacacagaucacagcuu

SEQ ID NO: 1363757 - RNA, 18 nt, Homo sapiens
uacacaguaagucauuua

SEQ ID NO: 1363758 - RNA, 13 nt, Homo sapiens
uacacgacucagu

SEQ ID NO: 1363759 - RNA, 18 nt, Homo sapiens
uacaggccuccucgggag

SEQ ID NO: 1363760 - RNA, 14 nt, Homo sapiens
uacaggugaggcaa

SEQ ID NO: 1363761 - RNA, 15 nt, Homo sapiens
uacauacaccagcau

SEQ ID NO: 1363762 - RNA, 19 nt, Homo sapiens
uacaugcagcccaugccca

SEQ ID NO: 1363763 - RNA, 21 nt, Homo sapiens
ggucugugugugugugugugc

SEQ ID NO: 1363764 - RNA, 15 nt, Homo sapiens
ggucuuuucuagucu

SEQ ID NO: 1363765 - RNA, 21 nt, Homo sapiens
ggugccccucuuccaaaggca

SEQ ID NO: 1363766 - RNA, 22 nt, Homo sapiens
gguggauauuaaaaaucuguaa

SEQ ID NO: 1363767 - RNA, 11 nt, Homo sapiens
gguggggcuuc

SEQ ID NO: 1363768 - RNA, 18 nt, Homo sapiens
gguguacacggaggucuc

SEQ ID NO: 1363769 - RNA, 13 nt, Homo sapiens
cagugaagacaga

SEQ ID NO: 1363770 - RNA, 21 nt, Homo sapiens
cagugaugcuggaugcuccuu

SEQ ID NO: 1363771 - RNA, 15 nt, Homo sapiens
cagugcccaucuucc

SEQ ID NO: 1363772 - RNA, 14 nt, Homo sapiens
cagugcuggauuug

SEQ ID NO: 1363773 - RNA, 16 nt, Homo sapiens
caguuccuuucaaugg

SEQ ID NO: 1363774 - RNA, 13 nt, Homo sapiens
caguugugacaau

SEQ ID NO: 1363775 - RNA, 14 nt, Homo sapiens
cauaaaauguuaag

SEQ ID NO: 1363776 - RNA, 21 nt, Homo sapiens
cauaaagucuuugaagugacu

SEQ ID NO: 1363777 - RNA, 16 nt, Homo sapiens
cauaacucugugaucu

SEQ ID NO: 1363778 - RNA, 21 nt, Homo sapiens
cauaagucgucacuaauacac

SEQ ID NO: 1363779 - RNA, 20 nt, Homo sapiens
cauaauugcuuugccaaaau

SEQ ID NO: 1363780 - RNA, 13 nt, Homo sapiens
cauacaccagcau

SEQ ID NO: 1363781 - RNA, 19 nt, Homo sapiens
cauacauggaaccauuuua

SEQ ID NO: 1363782 - RNA, 17 nt, Homo sapiens
cauacuugaagggccag

SEQ ID NO: 1363783 - RNA, 23 nt, Homo sapiens
cauagaaaaauucagcaaaccau

SEQ ID NO: 1363784 - RNA, 18 nt, Homo sapiens
cauauaccaguugugaua

SEQ ID NO: 1363785 - RNA, 23 nt, Homo sapiens
cauauacugccauguacuaguuu

SEQ ID NO: 1363786 - RNA, 13 nt, Homo sapiens
cauauauggaaga

SEQ ID NO: 1363787 - RNA, 13 nt, Homo sapiens
cauaucagugaac

SEQ ID NO: 1363788 - RNA, 14 nt, Homo sapiens
cauauccaacaugu

SEQ ID NO: 1363789 - RNA, 18 nt, Homo sapiens
cauauccaacaugugcuc

SEQ ID NO: 1363790 - RNA, 13 nt, Homo sapiens
cauaugaacauau

SEQ ID NO: 1363791 - RNA, 14 nt, Homo sapiens
cauaugaacauaua

SEQ ID NO: 1363792 - RNA, 17 nt, Homo sapiens
caucaaccuucuuauua

SEQ ID NO: 1363793 - RNA, 16 nt, Homo sapiens
caucacagaaugugau

SEQ ID NO: 1363794 - RNA, 13 nt, Homo sapiens
caucacagggugg

SEQ ID NO: 1363795 - RNA, 19 nt, Homo sapiens
caucagaggaaaagggcaa

SEQ ID NO: 1363796 - RNA, 20 nt, Homo sapiens
caucauguuccuuauaugaa

SEQ ID NO: 1363797 - RNA, 19 nt, Homo sapiens
caucauugaugaucacugu

SEQ ID NO: 1363798 - RNA, 12 nt, Homo sapiens
cauccaaaaagu

SEQ ID NO: 1363799 - RNA, 19 nt, Homo sapiens
cauccaaugcucaagaaac

SEQ ID NO: 1363800 - RNA, 13 nt, Homo sapiens
cauccagugacaa

SEQ ID NO: 1363801 - RNA, 17 nt, Homo sapiens
cauccagugacaaacca

SEQ ID NO: 1363802 - RNA, 13 nt, Homo sapiens
cauccugugccac

SEQ ID NO: 1363803 - RNA, 13 nt, Homo sapiens
caucuaagccuga

SEQ ID NO: 1363804 - RNA, 20 nt, Homo sapiens
caucucuacugaaaguacaa

SEQ ID NO: 1363805 - RNA, 21 nt, Homo sapiens
caugaauaacauuuaaauucc

SEQ ID NO: 1363806 - RNA, 22 nt, Homo sapiens
caugaauaacauuuaaauucca

SEQ ID NO: 1363807 - RNA, 21 nt, Homo sapiens
caugacucggggguggggaaa

SEQ ID NO: 1363808 - RNA, 15 nt, Homo sapiens
caugaguuuguuuac

SEQ ID NO: 1363809 - RNA, 23 nt, Homo sapiens
caugaugcgggccagugcuccag

SEQ ID NO: 1363810 - RNA, 18 nt, Homo sapiens
caugauggcaacagaucu

SEQ ID NO: 1363811 - RNA, 15 nt, Homo sapiens
caugcauugagcugc

SEQ ID NO: 1363812 - RNA, 17 nt, Homo sapiens
caugccuguagucccag

SEQ ID NO: 1363813 - RNA, 17 nt, Homo sapiens
caugcuucagugcugcu

SEQ ID NO: 1363814 - RNA, 23 nt, Homo sapiens
cauggaaaaucagugacaucuga

SEQ ID NO: 1363815 - RNA, 21 nt, Homo sapiens
cauggacaugcuucagugcug

SEQ ID NO: 1363816 - RNA, 23 nt, Homo sapiens
cauggacaugcuucagugcugcu

SEQ ID NO: 1363817 - RNA, 20 nt, Homo sapiens
cauggcgaaaggagugacuu

SEQ ID NO: 1363818 - RNA, 14 nt, Homo sapiens
cauggcugaaguca

SEQ ID NO: 1363819 - RNA, 16 nt, Homo sapiens
cauggcugccaucuca

SEQ ID NO: 1363820 - RNA, 17 nt, Homo sapiens
cauggcugccaucucac

SEQ ID NO: 1363821 - RNA, 14 nt, Homo sapiens
caugggaaggggag

SEQ ID NO: 1363822 - RNA, 16 nt, Homo sapiens
cauggugccccaggac

SEQ ID NO: 1363823 - RNA, 14 nt, Homo sapiens
caugucugcauuuc

SEQ ID NO: 1363824 - RNA, 11 nt, Homo sapiens
caugugcugca

SEQ ID NO: 1363825 - RNA, 22 nt, Homo sapiens
cauguuaggaagguacugucau

SEQ ID NO: 1363826 - RNA, 13 nt, Homo sapiens
cauuaacacaaag

SEQ ID NO: 1363827 - RNA, 12 nt, Homo sapiens
cauuaugcugcu

SEQ ID NO: 1363828 - RNA, 13 nt, Homo sapiens
cauucacaguucu

SEQ ID NO: 1363829 - RNA, 12 nt, Homo sapiens
cauucauccuga

SEQ ID NO: 1363830 - RNA, 21 nt, Homo sapiens
cauucuccuuguaaaagccua

SEQ ID NO: 1363831 - RNA, 16 nt, Homo sapiens
cauucuuaacaaacuc

SEQ ID NO: 1363832 - RNA, 15 nt, Homo sapiens
cauugaaacaugcca

SEQ ID NO: 1363833 - RNA, 16 nt, Homo sapiens
cauugauggggaagga

SEQ ID NO: 1363834 - RNA, 22 nt, Homo sapiens
cauugcucagaaaugucaugug

SEQ ID NO: 1363835 - RNA, 18 nt, Homo sapiens
cauuguaacaugacacuu

SEQ ID NO: 1363836 - RNA, 15 nt, Homo sapiens
cauuguaggauguug

SEQ ID NO: 1363837 - RNA, 11 nt, Homo sapiens
cauugugauca

SEQ ID NO: 1363838 - RNA, 21 nt, Homo sapiens
cauuguuuuguguaacauauu

SEQ ID NO: 1363839 - RNA, 15 nt, Homo sapiens
cauuuaaauuccaca

SEQ ID NO: 1363840 - RNA, 16 nt, Homo sapiens
cauuuaaauuccacag

SEQ ID NO: 1363841 - RNA, 20 nt, Homo sapiens
cauuuaaauuccacagauua

SEQ ID NO: 1363842 - RNA, 16 nt, Homo sapiens
cauuucugagaucaaa

SEQ ID NO: 1363843 - RNA, 23 nt, Homo sapiens
cauuugaaaucuaugaaauauca

SEQ ID NO: 1363844 - RNA, 13 nt, Homo sapiens
cauuuuaaaaaca

SEQ ID NO: 1363845 - RNA, 19 nt, Homo sapiens
cauuuuagucccauuugac

SEQ ID NO: 1363846 - RNA, 14 nt, Homo sapiens
cauuuucugccuau

SEQ ID NO: 1363847 - RNA, 20 nt, Homo sapiens
ccaaaaaauaaacacuuccu

SEQ ID NO: 1363848 - RNA, 17 nt, Homo sapiens
ccaaaauaccagagccu

SEQ ID NO: 1363849 - RNA, 19 nt, Homo sapiens
ccaaagcccucccuaccua

SEQ ID NO: 1363850 - RNA, 16 nt, Homo sapiens
ccaaagugucuuuuga

SEQ ID NO: 1363851 - RNA, 19 nt, Homo sapiens
ccaaaucacccaaucccag

SEQ ID NO: 1363852 - RNA, 14 nt, Homo sapiens
ccaaauuacgugua

SEQ ID NO: 1363853 - RNA, 20 nt, Homo sapiens
ccaaauuacguguacuacaa

SEQ ID NO: 1363854 - RNA, 14 nt, Homo sapiens
ccaacacauuucac

SEQ ID NO: 1363855 - RNA, 22 nt, Homo sapiens
ccaagcuccuugggaggcccca

SEQ ID NO: 1363856 - RNA, 16 nt, Homo sapiens
ccaaggaugucugcca

SEQ ID NO: 1363857 - RNA, 18 nt, Homo sapiens
ccaaggccuccugugacu

SEQ ID NO: 1363858 - RNA, 22 nt, Homo sapiens
ccaaggugcugaugucaaagug

SEQ ID NO: 1363859 - RNA, 12 nt, Homo sapiens
ccaaggugggag

SEQ ID NO: 1363860 - RNA, 22 nt, Homo sapiens
ccaauaacacguccacuuucaa

SEQ ID NO: 1363861 - RNA, 16 nt, Homo sapiens
ccaauauuuaccagac

SEQ ID NO: 1363862 - RNA, 23 nt, Homo sapiens
ccaaucucugccauaucagugaa

SEQ ID NO: 1363863 - RNA, 22 nt, Homo sapiens
ccacaaacuguaauacaaugau

SEQ ID NO: 1363864 - RNA, 21 nt, Homo sapiens
ccacaaucuggcuuagugcca

SEQ ID NO: 1363865 - RNA, 12 nt, Homo sapiens
ccacacuugaau

SEQ ID NO: 1363866 - RNA, 21 nt, Homo sapiens
ccacacuuguuccagcucuuu

SEQ ID NO: 1363867 - RNA, 14 nt, Homo sapiens
ccacagauuaucaa

SEQ ID NO: 1363868 - RNA, 20 nt, Homo sapiens
ccaccaagggaucugccauu

SEQ ID NO: 1363869 - RNA, 13 nt, Homo sapiens
ccaccaggauauc

SEQ ID NO: 1363870 - RNA, 16 nt, Homo sapiens
ccacccaccuuugcca

SEQ ID NO: 1363871 - RNA, 13 nt, Homo sapiens
ccacccggcccau

SEQ ID NO: 1363872 - RNA, 13 nt, Homo sapiens
ccacccuaguccc

SEQ ID NO: 1363873 - RNA, 17 nt, Homo sapiens
ccaccuccccagccuuu

SEQ ID NO: 1363874 - RNA, 14 nt, Homo sapiens
ccaccugucccacu

SEQ ID NO: 1363875 - RNA, 16 nt, Homo sapiens
ccaccuuugccacaaa

SEQ ID NO: 1363876 - RNA, 18 nt, Homo sapiens
ccacggacgccaccugcg

SEQ ID NO: 1363877 - RNA, 12 nt, Homo sapiens
ccacuaaacuac

SEQ ID NO: 1363878 - RNA, 22 nt, Homo sapiens
ccacucuguuccuacuggagau

SEQ ID NO: 1363879 - RNA, 12 nt, Homo sapiens
ccacugaccaga

SEQ ID NO: 1363880 - RNA, 21 nt, Homo sapiens
ccacugagaagugcacuuuaa

SEQ ID NO: 1363881 - RNA, 20 nt, Homo sapiens
ccacugagcuggcugacuaa

SEQ ID NO: 1363882 - RNA, 22 nt, Homo sapiens
ccacuggucuguagggauuuuu

SEQ ID NO: 1363883 - RNA, 17 nt, Homo sapiens
ccagaaagcucaucuca

SEQ ID NO: 1363884 - RNA, 20 nt, Homo sapiens
ccagagacauacuugaaggg

SEQ ID NO: 1363885 - RNA, 22 nt, Homo sapiens
ccagagccaggggggugaggag

SEQ ID NO: 1363886 - RNA, 18 nt, Homo sapiens
ccuagucucuacccagua

SEQ ID NO: 1363887 - RNA, 20 nt, Homo sapiens
ccuagucuuuuaaacaguuu

SEQ ID NO: 1363888 - RNA, 18 nt, Homo sapiens
ccuauauugcauuaauuu

SEQ ID NO: 1363889 - RNA, 13 nt, Homo sapiens
ccuaugcuuaaua

SEQ ID NO: 1363890 - RNA, 13 nt, Homo sapiens
ccucacauacccu

SEQ ID NO: 1363891 - RNA, 18 nt, Homo sapiens
ccucagccuugccagaga

SEQ ID NO: 1363892 - RNA, 14 nt, Homo sapiens
ccucaggcaggugg

SEQ ID NO: 1363893 - RNA, 17 nt, Homo sapiens
ccucaggcaggugggau

SEQ ID NO: 1363894 - RNA, 12 nt, Homo sapiens
ccucagugcauu

SEQ ID NO: 1363895 - RNA, 20 nt, Homo sapiens
ccucauuaccuugugcuaau

SEQ ID NO: 1363896 - RNA, 13 nt, Homo sapiens
ccucauuagcauu

SEQ ID NO: 1363897 - RNA, 13 nt, Homo sapiens
ccuccagauauac

SEQ ID NO: 1363898 - RNA, 18 nt, Homo sapiens
ccuccaggaaacaugaaa

SEQ ID NO: 1363899 - RNA, 22 nt, Homo sapiens
ccuccaggaaccacaccacauc

SEQ ID NO: 1363900 - RNA, 18 nt, Homo sapiens
ccucccagaacacacucc

SEQ ID NO: 1363901 - RNA, 18 nt, Homo sapiens
ccucccuggcucccauga

SEQ ID NO: 1363902 - RNA, 19 nt, Homo sapiens
ccucccuguuccccagaga

SEQ ID NO: 1363903 - RNA, 13 nt, Homo sapiens
ccucccuuugaug

SEQ ID NO: 1363904 - RNA, 15 nt, Homo sapiens
ccuccgcccugccac

SEQ ID NO: 1363905 - RNA, 20 nt, Homo sapiens
ccuccucgugaaagugcauu

SEQ ID NO: 1363906 - RNA, 13 nt, Homo sapiens
ccucgaaacugcc

SEQ ID NO: 1363907 - RNA, 18 nt, Homo sapiens
ccucggccccucccacac

SEQ ID NO: 1363908 - RNA, 14 nt, Homo sapiens
ccucuacaggcauu

SEQ ID NO: 1363909 - RNA, 16 nt, Homo sapiens
ccucucaugacuugca

SEQ ID NO: 1363910 - RNA, 20 nt, Homo sapiens
ccucucauuucccuuugaua

SEQ ID NO: 1363911 - RNA, 16 nt, Homo sapiens
ccucugcuacuagcca

SEQ ID NO: 1363912 - RNA, 21 nt, Homo sapiens
ccucuggucgcuccugcccac

SEQ ID NO: 1363913 - RNA, 17 nt, Homo sapiens
ccucuucaccuuauuca

SEQ ID NO: 1363914 - RNA, 14 nt, Homo sapiens
ccucuuccccagaa

SEQ ID NO: 1363915 - RNA, 21 nt, Homo sapiens
ccucuucucuacucuagggaa

SEQ ID NO: 1363916 - RNA, 16 nt, Homo sapiens
ccucuuuuucuagucu

SEQ ID NO: 1363917 - RNA, 21 nt, Homo sapiens
ccugaaacaacuuggaaagau

SEQ ID NO: 1363918 - RNA, 12 nt, Homo sapiens
ccugaagaacca

SEQ ID NO: 1363919 - RNA, 19 nt, Homo sapiens
ccugaagaugggagccuuu

SEQ ID NO: 1363920 - RNA, 22 nt, Homo sapiens
ccugaaguaagcaaagacuuuc

SEQ ID NO: 1363921 - RNA, 22 nt, Homo sapiens
ccugaccaggggcccuaccugg

SEQ ID NO: 1363922 - RNA, 14 nt, Homo sapiens
ccugaccugucuca

SEQ ID NO: 1363923 - RNA, 15 nt, Homo sapiens
ccugagacaaaugga

SEQ ID NO: 1363924 - RNA, 18 nt, Homo sapiens
ccugaggcccccaucucc

SEQ ID NO: 1363925 - RNA, 23 nt, Homo sapiens
ccugaguggugccaaacaaaaag

SEQ ID NO: 1363926 - RNA, 22 nt, Homo sapiens
ccugaugagggggaauuccugg

SEQ ID NO: 1363927 - RNA, 13 nt, Homo sapiens
ccugcaaaaucug

SEQ ID NO: 1363928 - RNA, 10 nt, Homo sapiens
ccugccaagu

SEQ ID NO: 1363929 - RNA, 10 nt, Homo sapiens
ccugccauuc

SEQ ID NO: 1363930 - RNA, 16 nt, Homo sapiens
ccugccgucugugcuu

SEQ ID NO: 1363931 - RNA, 14 nt, Homo sapiens
ccugccugccgucu

SEQ ID NO: 1363932 - RNA, 20 nt, Homo sapiens
ccugcgacccugggggcaca

SEQ ID NO: 1363933 - RNA, 13 nt, Homo sapiens
ccugcugagcugc

SEQ ID NO: 1363934 - RNA, 14 nt, Homo sapiens
ccuggagauccucc

SEQ ID NO: 1363935 - RNA, 23 nt, Homo sapiens
ccuggaguguaugacugcacaug

SEQ ID NO: 1363936 - RNA, 22 nt, Homo sapiens
ccuggcacucuuguucccacac

SEQ ID NO: 1363937 - RNA, 14 nt, Homo sapiens
ccugggcaauguga

SEQ ID NO: 1363938 - RNA, 15 nt, Homo sapiens
ccugggcaaugugau

SEQ ID NO: 1363939 - RNA, 20 nt, Homo sapiens
ccuggggcaggucacuuuac

SEQ ID NO: 1363940 - RNA, 13 nt, Homo sapiens
ccugggugacaaa

SEQ ID NO: 1363941 - RNA, 15 nt, Homo sapiens
ccuguaaucccagcu

SEQ ID NO: 1363942 - RNA, 22 nt, Homo sapiens
ccuguacccaguagaugccacc

SEQ ID NO: 1363943 - RNA, 16 nt, Homo sapiens
ccugucuguuuccucu

SEQ ID NO: 1363944 - RNA, 12 nt, Homo sapiens
ccugugauggca

SEQ ID NO: 1363945 - RNA, 15 nt, Homo sapiens
ccugugcuccauggc

SEQ ID NO: 1363946 - RNA, 15 nt, Homo sapiens
ccuguggauguauau

SEQ ID NO: 1363947 - RNA, 17 nt, Homo sapiens
ccuguuugaaaguaaaa

SEQ ID NO: 1363948 - RNA, 16 nt, Homo sapiens
ccuuaagggaaaggua

SEQ ID NO: 1363949 - RNA, 17 nt, Homo sapiens
ccuuaagucaaaagaga

SEQ ID NO: 1363950 - RNA, 16 nt, Homo sapiens
ccuuagauaccuugaa

SEQ ID NO: 1363951 - RNA, 17 nt, Homo sapiens
ccuuagauaccuugaaa

SEQ ID NO: 1363952 - RNA, 20 nt, Homo sapiens
ccuucacaaagcccaaggga

SEQ ID NO: 1363953 - RNA, 14 nt, Homo sapiens
ccuuccagugcagg

SEQ ID NO: 1363954 - RNA, 20 nt, Homo sapiens
ccuucucugcuccaccacau

SEQ ID NO: 1363955 - RNA, 23 nt, Homo sapiens
ccuucuuuugggggucaacaguu

SEQ ID NO: 1363956 - RNA, 13 nt, Homo sapiens
ccuugaaggguuc

SEQ ID NO: 1363957 - RNA, 15 nt, Homo sapiens
ccuugcuuucucuuc

SEQ ID NO: 1363958 - RNA, 18 nt, Homo sapiens
ccuuuaagccugcauucu

SEQ ID NO: 1363959 - RNA, 21 nt, Homo sapiens
ccuuuaagccugcauucuuaa

SEQ ID NO: 1363960 - RNA, 20 nt, Homo sapiens
ccuuuagaaacucaaaaacu

SEQ ID NO: 1363961 - RNA, 12 nt, Homo sapiens
ccuuucacuuua

SEQ ID NO: 1363962 - RNA, 22 nt, Homo sapiens
ccuuucacuuuagaggcuugau

SEQ ID NO: 1363963 - RNA, 19 nt, Homo sapiens
ccuuuccaaaaacuguuaa

SEQ ID NO: 1363964 - RNA, 22 nt, Homo sapiens
ccuuuccaaaugcccagcuuaa

SEQ ID NO: 1363965 - RNA, 22 nt, Homo sapiens
ccuuugagcugcugacugccaa

SEQ ID NO: 1363966 - RNA, 22 nt, Homo sapiens
cgaagaucgugccauugcacuc

SEQ ID NO: 1363967 - RNA, 14 nt, Homo sapiens
cgacugaagugugu

SEQ ID NO: 1363968 - RNA, 19 nt, Homo sapiens
cgacuuguuuuugcacaug

SEQ ID NO: 1363969 - RNA, 17 nt, Homo sapiens
cgagaggugggccaguc

SEQ ID NO: 1363970 - RNA, 20 nt, Homo sapiens
cgagaucgugccauugcacu

SEQ ID NO: 1363971 - RNA, 21 nt, Homo sapiens
cgagaucucgccacugcacuc

SEQ ID NO: 1363972 - RNA, 20 nt, Homo sapiens
cgagggcaaagcggccucau

SEQ ID NO: 1363973 - RNA, 17 nt, Homo sapiens
cgagggggucagcccaa

SEQ ID NO: 1363974 - RNA, 22 nt, Homo sapiens
cgcaaugcuucuagaguuuuau

SEQ ID NO: 1363975 - RNA, 13 nt, Homo sapiens
cgcaucuugccuc

SEQ ID NO: 1363976 - RNA, 15 nt, Homo sapiens
cgccugacaaccacu

SEQ ID NO: 1363977 - RNA, 21 nt, Homo sapiens
cgcggccguggccucugaggg

SEQ ID NO: 1363978 - RNA, 12 nt, Homo sapiens
cgcuucuugccu

SEQ ID NO: 1363979 - RNA, 17 nt, Homo sapiens
cgcuuucccaucuuaaa

SEQ ID NO: 1363980 - RNA, 15 nt, Homo sapiens
cggacugaccaaauc

SEQ ID NO: 1363981 - RNA, 17 nt, Homo sapiens
cggaggucucuguaaaa

SEQ ID NO: 1363982 - RNA, 21 nt, Homo sapiens
cggcagggugucccaggagcc

SEQ ID NO: 1363983 - RNA, 20 nt, Homo sapiens
cggcaguucugggugcuccc

SEQ ID NO: 1363984 - RNA, 15 nt, Homo sapiens
cggcucugguggcca

SEQ ID NO: 1363985 - RNA, 20 nt, Homo sapiens
cgggagcucuguauggucag

SEQ ID NO: 1363986 - RNA, 18 nt, Homo sapiens
cgggcagcuggugcugug

SEQ ID NO: 1363987 - RNA, 18 nt, Homo sapiens
cgggucacacaaaggcau

SEQ ID NO: 1363988 - RNA, 16 nt, Homo sapiens
cguaggugugacacuu

SEQ ID NO: 1363989 - RNA, 19 nt, Homo sapiens
cguaguuuuuucuccucau

SEQ ID NO: 1363990 - RNA, 12 nt, Homo sapiens
cgucaccuccag

SEQ ID NO: 1363991 - RNA, 15 nt, Homo sapiens
cgucagcugcucccu

SEQ ID NO: 1363992 - RNA, 16 nt, Homo sapiens
cgucgccacucgggag

SEQ ID NO: 1363993 - RNA, 20 nt, Homo sapiens
cgucugccggacccggaggc

SEQ ID NO: 1363994 - RNA, 23 nt, Homo sapiens
cgucuuccugaguggugccaaac

SEQ ID NO: 1363995 - RNA, 16 nt, Homo sapiens
cgugaaaaugcuguau

SEQ ID NO: 1363996 - RNA, 16 nt, Homo sapiens
cgugaacugcagugau

SEQ ID NO: 1363997 - RNA, 17 nt, Homo sapiens
cgugaacugcagugaug

SEQ ID NO: 1363998 - RNA, 15 nt, Homo sapiens
cgugacaagugccuu

SEQ ID NO: 1363999 - RNA, 16 nt, Homo sapiens
cgugacacaaacacac

SEQ ID NO: 1364000 - RNA, 13 nt, Homo sapiens
cgugcguggcacu

SEQ ID NO: 1364001 - RNA, 18 nt, Homo sapiens
cgugcuuguuugcucacc

SEQ ID NO: 1364002 - RNA, 16 nt, Homo sapiens
cguggauugcacgugg

SEQ ID NO: 1364003 - RNA, 22 nt, Homo sapiens
cucuacuugcaagccucaaaga

SEQ ID NO: 1364004 - RNA, 15 nt, Homo sapiens
cucuaggauggggca

SEQ ID NO: 1364005 - RNA, 23 nt, Homo sapiens
cucucagcgccgucgccacucgg

SEQ ID NO: 1364006 - RNA, 22 nt, Homo sapiens
cucucauguuuucaacugccaa

SEQ ID NO: 1364007 - RNA, 13 nt, Homo sapiens
cucuccaccaggu

SEQ ID NO: 1364008 - RNA, 16 nt, Homo sapiens
cucuccaccagguucu

SEQ ID NO: 1364009 - RNA, 22 nt, Homo sapiens
cucucccagugacaaccaaaag

SEQ ID NO: 1364010 - RNA, 18 nt, Homo sapiens
cucuccccagcccagaga

SEQ ID NO: 1364011 - RNA, 14 nt, Homo sapiens
cucucccugccaag

SEQ ID NO: 1364012 - RNA, 15 nt, Homo sapiens
cucucccugccaagu

SEQ ID NO: 1364013 - RNA, 16 nt, Homo sapiens
cucucccugccaaguc

SEQ ID NO: 1364014 - RNA, 16 nt, Homo sapiens
cucuccugacuuuuaa

SEQ ID NO: 1364015 - RNA, 15 nt, Homo sapiens
cucucuucugcucca

SEQ ID NO: 1364016 - RNA, 22 nt, Homo sapiens
cucugcacaagcugcacccuca

SEQ ID NO: 1364017 - RNA, 17 nt, Homo sapiens
cucugcacuacugacau

SEQ ID NO: 1364018 - RNA, 12 nt, Homo sapiens
cucugugcugca

SEQ ID NO: 1364019 - RNA, 13 nt, Homo sapiens
cucuguggccagc

SEQ ID NO: 1364020 - RNA, 22 nt, Homo sapiens
cucuguggccagcugcaucugu

SEQ ID NO: 1364021 - RNA, 23 nt, Homo sapiens
cucuucaggcaccugaagugaga

SEQ ID NO: 1364022 - RNA, 12 nt, Homo sapiens
cucuuccaaagg

SEQ ID NO: 1364023 - RNA, 15 nt, Homo sapiens
cucuuccaaaggcag

SEQ ID NO: 1364024 - RNA, 23 nt, Homo sapiens
cucuuccuugcuuucucuucuaa

SEQ ID NO: 1364025 - RNA, 23 nt, Homo sapiens
cucuugccaaaucaaaagacuuu

SEQ ID NO: 1364026 - RNA, 14 nt, Homo sapiens
cucuugcuuucaca

SEQ ID NO: 1364027 - RNA, 12 nt, Homo sapiens
cucuugucuccc

SEQ ID NO: 1364028 - RNA, 14 nt, Homo sapiens
cucuuguucccaca

SEQ ID NO: 1364029 - RNA, 23 nt, Homo sapiens
cucuuuaguugauuuaaacucuu

SEQ ID NO: 1364030 - RNA, 17 nt, Homo sapiens
cucuuucucugccagug

SEQ ID NO: 1364031 - RNA, 12 nt, Homo sapiens
cucuuuggugua

SEQ ID NO: 1364032 - RNA, 21 nt, Homo sapiens
cucuuuguagcuaacagugaa

SEQ ID NO: 1364033 - RNA, 15 nt, Homo sapiens
cucuuuuucuagucu

SEQ ID NO: 1364034 - RNA, 16 nt, Homo sapiens
cucuuuuuuucuuguc

SEQ ID NO: 1364035 - RNA, 19 nt, Homo sapiens
cugaaaaccaauguucucu

SEQ ID NO: 1364036 - RNA, 17 nt, Homo sapiens
cugaaaauuaacacugc

SEQ ID NO: 1364037 - RNA, 13 nt, Homo sapiens
cugaaacuauaga

SEQ ID NO: 1364038 - RNA, 19 nt, Homo sapiens
cugaaauaaaaugauaaac

SEQ ID NO: 1364039 - RNA, 22 nt, Homo sapiens
cugaaauaaaaugauaaacaag

SEQ ID NO: 1364040 - RNA, 20 nt, Homo sapiens
cugaaggggaggucacagcc

SEQ ID NO: 1364041 - RNA, 16 nt, Homo sapiens
cugaaguaagcaaaga

SEQ ID NO: 1364042 - RNA, 17 nt, Homo sapiens
cugaaguaagcaaagac

SEQ ID NO: 1364043 - RNA, 23 nt, Homo sapiens
cugaccaaaucacccaaucccag

SEQ ID NO: 1364044 - RNA, 20 nt, Homo sapiens
cugaccagggcaaggccccu

SEQ ID NO: 1364045 - RNA, 19 nt, Homo sapiens
cugaccgggucacacaaag

SEQ ID NO: 1364046 - RNA, 15 nt, Homo sapiens
cugaccuccacagcu

SEQ ID NO: 1364047 - RNA, 19 nt, Homo sapiens
cugacuuuuaaugucauuu

SEQ ID NO: 1364048 - RNA, 20 nt, Homo sapiens
cugagcgggucauggggcaa

SEQ ID NO: 1364049 - RNA, 14 nt, Homo sapiens
cugagcugccccug

SEQ ID NO: 1364050 - RNA, 19 nt, Homo sapiens
cugaggaaggaagauuuga

SEQ ID NO: 1364051 - RNA, 18 nt, Homo sapiens
cugaguggcaggggacag

SEQ ID NO: 1364052 - RNA, 14 nt, Homo sapiens
cugaguggugccaa

SEQ ID NO: 1364053 - RNA, 21 nt, Homo sapiens
cugauaauuauuuuaaagggg

SEQ ID NO: 1364054 - RNA, 14 nt, Homo sapiens
cugauauggcuuuu

SEQ ID NO: 1364055 - RNA, 18 nt, Homo sapiens
cugauccuccaacagcug

SEQ ID NO: 1364056 - RNA, 16 nt, Homo sapiens
cugauuaccugccaau

SEQ ID NO: 1364057 - RNA, 15 nt, Homo sapiens
cugcaaacccuuuca

SEQ ID NO: 1364058 - RNA, 14 nt, Homo sapiens
cugcaacucaagga

SEQ ID NO: 1364059 - RNA, 20 nt, Homo sapiens
cugcaacuuaaugcucugau

SEQ ID NO: 1364060 - RNA, 13 nt, Homo sapiens
cugcaaugacugc

SEQ ID NO: 1364061 - RNA, 15 nt, Homo sapiens
cugcacugaugcugc

SEQ ID NO: 1364062 - RNA, 13 nt, Homo sapiens
cugcagaucuucc

SEQ ID NO: 1364063 - RNA, 22 nt, Homo sapiens
cugcagauuagcuaggggacag

SEQ ID NO: 1364064 - RNA, 12 nt, Homo sapiens
cugcagccagcu

SEQ ID NO: 1364065 - RNA, 21 nt, Homo sapiens
cugcagccagcucacguccag

SEQ ID NO: 1364066 - RNA, 19 nt, Homo sapiens
cugcaggcagccugccuuu

SEQ ID NO: 1364067 - RNA, 21 nt, Homo sapiens
cugcaggcagccugccuuuaa

SEQ ID NO: 1364068 - RNA, 22 nt, Homo sapiens
cugcagggccauggcucagggu

SEQ ID NO: 1364069 - RNA, 21 nt, Homo sapiens
cugcagugauguauacaucuu

SEQ ID NO: 1364070 - RNA, 21 nt, Homo sapiens
cugcauaaaauagagugcauu

SEQ ID NO: 1364071 - RNA, 21 nt, Homo sapiens
cugcauaccaaccugggcaau

SEQ ID NO: 1364072 - RNA, 11 nt, Homo sapiens
cugccaaaaag

SEQ ID NO: 1364073 - RNA, 20 nt, Homo sapiens
cugccaacacgcccggcuaa

SEQ ID NO: 1364074 - RNA, 12 nt, Homo sapiens
cugccagugcag

SEQ ID NO: 1364075 - RNA, 14 nt, Homo sapiens
cugccaucauugau

SEQ ID NO: 1364076 - RNA, 23 nt, Homo sapiens
cugccaucauugaugaucacugu

SEQ ID NO: 1364077 - RNA, 15 nt, Homo sapiens
cugccaucauuguaa

SEQ ID NO: 1364078 - RNA, 18 nt, Homo sapiens
cugccaucgcugugaugc

SEQ ID NO: 1364079 - RNA, 18 nt, Homo sapiens
cugccauuucugagauca

SEQ ID NO: 1364080 - RNA, 19 nt, Homo sapiens
cugcccagcggccuuccac

SEQ ID NO: 1364081 - RNA, 21 nt, Homo sapiens
cugccccuggcucugaccgaa

SEQ ID NO: 1364082 - RNA, 15 nt, Homo sapiens
cugccgucugugcuu

SEQ ID NO: 1364083 - RNA, 18 nt, Homo sapiens
cugccuccagccuggugg

SEQ ID NO: 1364084 - RNA, 15 nt, Homo sapiens
cugccuuacagacag

SEQ ID NO: 1364085 - RNA, 18 nt, Homo sapiens
cugccuuaucuugcaccc

SEQ ID NO: 1364086 - RNA, 15 nt, Homo sapiens
cugcgcuuccaaaag

SEQ ID NO: 1364087 - RNA, 21 nt, Homo sapiens
cugcgcuuccaaaagcaaaug

SEQ ID NO: 1364088 - RNA, 19 nt, Homo sapiens
cugcucccccugguggugg

SEQ ID NO: 1364089 - RNA, 16 nt, Homo sapiens
cugcucccgucugucu

SEQ ID NO: 1364090 - RNA, 23 nt, Homo sapiens
cugcucuuucucugccagugaca

SEQ ID NO: 1364091 - RNA, 22 nt, Homo sapiens
cugcugacugccaauaacauuc

SEQ ID NO: 1364092 - RNA, 16 nt, Homo sapiens
cugcuggcugcucccc

SEQ ID NO: 1364093 - RNA, 20 nt, Homo sapiens
cuggaaauagcccuguaaca

SEQ ID NO: 1364094 - RNA, 12 nt, Homo sapiens
cuggaacccaga

SEQ ID NO: 1364095 - RNA, 23 nt, Homo sapiens
cuggacaaacagccucacuccuc

SEQ ID NO: 1364096 - RNA, 12 nt, Homo sapiens
cuggacgcauca

SEQ ID NO: 1364097 - RNA, 19 nt, Homo sapiens
cuggacuugcagaguacau

SEQ ID NO: 1364098 - RNA, 16 nt, Homo sapiens
cuggagagcacugcca

SEQ ID NO: 1364099 - RNA, 23 nt, Homo sapiens
cuggaggcccaguucacccugau

SEQ ID NO: 1364100 - RNA, 22 nt, Homo sapiens
cuggaguugaucuggaacccag

SEQ ID NO: 1364101 - RNA, 21 nt, Homo sapiens
cuggaugucugggugaccuca

SEQ ID NO: 1364102 - RNA, 20 nt, Homo sapiens
cuggcacauuuuuaguuacu

SEQ ID NO: 1364103 - RNA, 17 nt, Homo sapiens
cuggcaccgcaguuuug

SEQ ID NO: 1364104 - RNA, 21 nt, Homo sapiens
cuggcacucuuguucccacac

SEQ ID NO: 1364105 - RNA, 22 nt, Homo sapiens
cuggcagcaggaugcucaguga

SEQ ID NO: 1364106 - RNA, 17 nt, Homo sapiens
cuggccuguacccagua

SEQ ID NO: 1364107 - RNA, 20 nt, Homo sapiens
cuggcuuagugccacccacc

SEQ ID NO: 1364108 - RNA, 14 nt, Homo sapiens
cuggcuucuggcca

SEQ ID NO: 1364109 - RNA, 14 nt, Homo sapiens
cugggcagaaggcc

SEQ ID NO: 1364110 - RNA, 23 nt, Homo sapiens
cugggcagaccccucuaccuccu

SEQ ID NO: 1364111 - RNA, 18 nt, Homo sapiens
cugggcagcauacugaga

SEQ ID NO: 1364112 - RNA, 21 nt, Homo sapiens
cugggcagggggcaugaugcg

SEQ ID NO: 1364113 - RNA, 15 nt, Homo sapiens
cugggccucaguuuc

SEQ ID NO: 1364114 - RNA, 15 nt, Homo sapiens
cugggcuugucugua

SEQ ID NO: 1364115 - RNA, 20 nt, Homo sapiens
cuggggggacccagugcaga

SEQ ID NO: 1364116 - RNA, 22 nt, Homo sapiens
cuggggguggggcuccuaccug

SEQ ID NO: 1364117 - RNA, 21 nt, Homo sapiens
cugggguggggucaugcccuc

SEQ ID NO: 1364118 - RNA, 20 nt, Homo sapiens
cuggguaagaagaaagcaaa

SEQ ID NO: 1364119 - RNA, 20 nt, Homo sapiens
cuuucuucccuacaguugaa

SEQ ID NO: 1364120 - RNA, 15 nt, Homo sapiens
cuuugagcugagugc

SEQ ID NO: 1364121 - RNA, 18 nt, Homo sapiens
cuuugagcugagugcuga

SEQ ID NO: 1364122 - RNA, 19 nt, Homo sapiens
cuuugagcugagugcugaa

SEQ ID NO: 1364123 - RNA, 22 nt, Homo sapiens
cuuugagcugagugcugaaaua

SEQ ID NO: 1364124 - RNA, 22 nt, Homo sapiens
cuuugauacagucaacaagccu

SEQ ID NO: 1364125 - RNA, 16 nt, Homo sapiens
cuuugcccacgugucc

SEQ ID NO: 1364126 - RNA, 23 nt, Homo sapiens
cuuugccccugagacaaauggag

SEQ ID NO: 1364127 - RNA, 22 nt, Homo sapiens
cuuugcuaaugcuaugcaaaaa

SEQ ID NO: 1364128 - RNA, 14 nt, Homo sapiens
cuuuguauauuaca

SEQ ID NO: 1364129 - RNA, 19 nt, Homo sapiens
cuuugucugucaaucacag

SEQ ID NO: 1364130 - RNA, 20 nt, Homo sapiens
cuuugugugcgucacuguga

SEQ ID NO: 1364131 - RNA, 21 nt, Homo sapiens
cuuuguuuagcccaaaaccaa

SEQ ID NO: 1364132 - RNA, 14 nt, Homo sapiens
cuuuuacaccaguu

SEQ ID NO: 1364133 - RNA, 18 nt, Homo sapiens
cuuuuccauccuagugag

SEQ ID NO: 1364134 - RNA, 21 nt, Homo sapiens
cuuuugucuaauuaaaacacu

SEQ ID NO: 1364135 - RNA, 17 nt, Homo sapiens
cuuuuuaaccugcaaaa

SEQ ID NO: 1364136 - RNA, 14 nt, Homo sapiens
cuuuuugcauauaa

SEQ ID NO: 1364137 - RNA, 15 nt, Homo sapiens
cuuuuugcuggagaa

SEQ ID NO: 1364138 - RNA, 14 nt, Homo sapiens
gaaaaagacugggu

SEQ ID NO: 1364139 - RNA, 22 nt, Homo sapiens
gaaaaagagguagcacuacaaa

SEQ ID NO: 1364140 - RNA, 17 nt, Homo sapiens
gaaaaagcaaguguuca

SEQ ID NO: 1364141 - RNA, 20 nt, Homo sapiens
gaaaaagcaaguguucacug

SEQ ID NO: 1364142 - RNA, 22 nt, Homo sapiens
gaaaaagguauaugugauaaau

SEQ ID NO: 1364143 - RNA, 23 nt, Homo sapiens
gaaaaauagcaacuuguguuaca

SEQ ID NO: 1364144 - RNA, 20 nt, Homo sapiens
gaaaaauuaauuuacuagaa

SEQ ID NO: 1364145 - RNA, 12 nt, Homo sapiens
gaaaacaggcuc

SEQ ID NO: 1364146 - RNA, 17 nt, Homo sapiens
gaaaacaguauuuucca

SEQ ID NO: 1364147 - RNA, 14 nt, Homo sapiens
gaaaaggcaaauuu

SEQ ID NO: 1364148 - RNA, 21 nt, Homo sapiens
gaaaagggcaaaaagaccaag

SEQ ID NO: 1364149 - RNA, 22 nt, Homo sapiens
gaaaaucugucaugagcauuug

SEQ ID NO: 1364150 - RNA, 14 nt, Homo sapiens
gaaacaaacuggag

SEQ ID NO: 1364151 - RNA, 13 nt, Homo sapiens
gaaacaacuucua

SEQ ID NO: 1364152 - RNA, 12 nt, Homo sapiens
gaaacaacuugg

SEQ ID NO: 1364153 - RNA, 18 nt, Homo sapiens
gaaacacugggcuucuag

SEQ ID NO: 1364154 - RNA, 15 nt, Homo sapiens
gaaacagcgcugggu

SEQ ID NO: 1364155 - RNA, 18 nt, Homo sapiens
gaaacgcuucuuuuccau

SEQ ID NO: 1364156 - RNA, 15 nt, Homo sapiens
gaaacucacacuccc

SEQ ID NO: 1364157 - RNA, 22 nt, Homo sapiens
gaaacucuacauguaacuauuu

SEQ ID NO: 1364158 - RNA, 22 nt, Homo sapiens
gaaagacaagcucaaguguuca

SEQ ID NO: 1364159 - RNA, 15 nt, Homo sapiens
gaaagcaacaaagau

SEQ ID NO: 1364160 - RNA, 19 nt, Homo sapiens
gaaagcaacaaagauugag

SEQ ID NO: 1364161 - RNA, 14 nt, Homo sapiens
gaaaggaacauuuu

SEQ ID NO: 1364162 - RNA, 22 nt, Homo sapiens
gaaaggcagagggugacugugu

SEQ ID NO: 1364163 - RNA, 15 nt, Homo sapiens
gaaaguucauggaac

SEQ ID NO: 1364164 - RNA, 17 nt, Homo sapiens
gaaauaucaugcuccau

SEQ ID NO: 1364165 - RNA, 14 nt, Homo sapiens
gaaauauuuggaaa

SEQ ID NO: 1364166 - RNA, 19 nt, Homo sapiens
gaaaucuagaagacuguca

SEQ ID NO: 1364167 - RNA, 23 nt, Homo sapiens
gaaaugagcagcccuuacaguau

SEQ ID NO: 1364168 - RNA, 15 nt, Homo sapiens
gaaaugccaauaaca

SEQ ID NO: 1364169 - RNA, 18 nt, Homo sapiens
gaaauuaacucagacaca

SEQ ID NO: 1364170 - RNA, 14 nt, Homo sapiens
gaacacaaggucau

SEQ ID NO: 1364171 - RNA, 15 nt, Homo sapiens
gaacacaaggucauu

SEQ ID NO: 1364172 - RNA, 17 nt, Homo sapiens
gaacagcuguaaucuau

SEQ ID NO: 1364173 - RNA, 15 nt, Homo sapiens
gaaccaggcaacuug

SEQ ID NO: 1364174 - RNA, 16 nt, Homo sapiens
gaaccaggcaacuugg

SEQ ID NO: 1364175 - RNA, 23 nt, Homo sapiens
gaaccauuuuagucccauuugac

SEQ ID NO: 1364176 - RNA, 14 nt, Homo sapiens
gaacccacccggcc

SEQ ID NO: 1364177 - RNA, 15 nt, Homo sapiens
gaacccagacucaga

SEQ ID NO: 1364178 - RNA, 15 nt, Homo sapiens
gaacccuacacccca

SEQ ID NO: 1364179 - RNA, 13 nt, Homo sapiens
gaaccgcccuccu

SEQ ID NO: 1364180 - RNA, 12 nt, Homo sapiens
gaaccucagggc

SEQ ID NO: 1364181 - RNA, 15 nt, Homo sapiens
gaaccuggaacuugg

SEQ ID NO: 1364182 - RNA, 18 nt, Homo sapiens
gaaccuggguugcagaca

SEQ ID NO: 1364183 - RNA, 14 nt, Homo sapiens
gaacuaccaggugg

SEQ ID NO: 1364184 - RNA, 19 nt, Homo sapiens
gaacuggaagaaagcaaca

SEQ ID NO: 1364185 - RNA, 18 nt, Homo sapiens
gaacuucuccuacuguag

SEQ ID NO: 1364186 - RNA, 22 nt, Homo sapiens
gaacuucuccuacuguagcaac

SEQ ID NO: 1364187 - RNA, 16 nt, Homo sapiens
gaacuuucaccuucau

SEQ ID NO: 1364188 - RNA, 16 nt, Homo sapiens
gaagaaagcaacaaag

SEQ ID NO: 1364189 - RNA, 23 nt, Homo sapiens
gaagacaauggcuuacuccagga

SEQ ID NO: 1364190 - RNA, 17 nt, Homo sapiens
gaagagaaugugacagg

SEQ ID NO: 1364191 - RNA, 23 nt, Homo sapiens
gaagagccuugcggaagguucua

SEQ ID NO: 1364192 - RNA, 18 nt, Homo sapiens
gaagaggaguugcuugau

SEQ ID NO: 1364193 - RNA, 17 nt, Homo sapiens
gaagagggacagaugaa

SEQ ID NO: 1364194 - RNA, 17 nt, Homo sapiens
gaagagucuucaaaaac

SEQ ID NO: 1364195 - RNA, 13 nt, Homo sapiens
gaagaugugugau

SEQ ID NO: 1364196 - RNA, 14 nt, Homo sapiens
gaagaugugugaua

SEQ ID NO: 1364197 - RNA, 17 nt, Homo sapiens
gaagauuucucugagau

SEQ ID NO: 1364198 - RNA, 19 nt, Homo sapiens
gaagcaccaagacugagaa

SEQ ID NO: 1364199 - RNA, 19 nt, Homo sapiens
gaagcacuacaccuugccu

SEQ ID NO: 1364200 - RNA, 18 nt, Homo sapiens
gaagccaggaauuuccca

SEQ ID NO: 1364201 - RNA, 17 nt, Homo sapiens
gaagcccggacugacca

SEQ ID NO: 1364202 - RNA, 21 nt, Homo sapiens
gaagcccggacugaccaaauc

SEQ ID NO: 1364203 - RNA, 14 nt, Homo sapiens
gaagccgugcccug

SEQ ID NO: 1364204 - RNA, 14 nt, Homo sapiens
gaagccgugccugu

SEQ ID NO: 1364205 - RNA, 12 nt, Homo sapiens
gaaggagggaga

SEQ ID NO: 1364206 - RNA, 12 nt, Homo sapiens
gaaggccaagag

SEQ ID NO: 1364207 - RNA, 18 nt, Homo sapiens
gaaggccgagaagcaaga

SEQ ID NO: 1364208 - RNA, 16 nt, Homo sapiens
gaaggcuuguugugcu

SEQ ID NO: 1364209 - RNA, 15 nt, Homo sapiens
gaagggucacuuuaa

SEQ ID NO: 1364210 - RNA, 22 nt, Homo sapiens
gaagucuggagcacccugagaa

SEQ ID NO: 1364211 - RNA, 20 nt, Homo sapiens
gaaguuucuggugccauuuc

SEQ ID NO: 1364212 - RNA, 20 nt, Homo sapiens
gaauaacauuuaaauuccac

SEQ ID NO: 1364213 - RNA, 18 nt, Homo sapiens
gaauaauacaguaucuca

SEQ ID NO: 1364214 - RNA, 13 nt, Homo sapiens
gaauaauccagaa

SEQ ID NO: 1364215 - RNA, 17 nt, Homo sapiens
gaauacugggugcuguc

SEQ ID NO: 1364216 - RNA, 13 nt, Homo sapiens
gaauagucucauc

SEQ ID NO: 1364217 - RNA, 14 nt, Homo sapiens
gaauauccauguac

SEQ ID NO: 1364218 - RNA, 16 nt, Homo sapiens
gaaucagauuuuaaca

SEQ ID NO: 1364219 - RNA, 15 nt, Homo sapiens
gaauccuagcacuug

SEQ ID NO: 1364220 - RNA, 22 nt, Homo sapiens
gaaucggcuggggacugcuacc

SEQ ID NO: 1364221 - RNA, 18 nt, Homo sapiens
gaaugauaguguaucuca

SEQ ID NO: 1364222 - RNA, 15 nt, Homo sapiens
gaaugccacugccuu

SEQ ID NO: 1364223 - RNA, 16 nt, Homo sapiens
gaauguaguauucaau

SEQ ID NO: 1364224 - RNA, 12 nt, Homo sapiens
gaauuaagcaaa

SEQ ID NO: 1364225 - RNA, 21 nt, Homo sapiens
gaauuagauuucuauaggauu

SEQ ID NO: 1364226 - RNA, 14 nt, Homo sapiens
gaauuaugcuguua

SEQ ID NO: 1364227 - RNA, 23 nt, Homo sapiens
gaauuggauacauacaccagcau

SEQ ID NO: 1364228 - RNA, 11 nt, Homo sapiens
gacaacaggca

SEQ ID NO: 1364229 - RNA, 12 nt, Homo sapiens
gacaaccaaaag

SEQ ID NO: 1364230 - RNA, 13 nt, Homo sapiens
gacaagcauggaa

SEQ ID NO: 1364231 - RNA, 15 nt, Homo sapiens
gacaagccagaacuu

SEQ ID NO: 1364232 - RNA, 14 nt, Homo sapiens
gacacaaacacaca

SEQ ID NO: 1364233 - RNA, 16 nt, Homo sapiens
gacacaaauaaaggaa

SEQ ID NO: 1364234 - RNA, 21 nt, Homo sapiens
gacacucacacggacacucaa

SEQ ID NO: 1364235 - RNA, 15 nt, Homo sapiens
gacacuuacccaagg

SEQ ID NO: 1364236 - RNA, 11 nt, Homo sapiens
accugacaaug

SEQ ID NO: 1364237 - RNA, 23 nt, Homo sapiens
accugaccaggggcccuaccugg

SEQ ID NO: 1364238 - RNA, 20 nt, Homo sapiens
accugaggcccccaucuccu

SEQ ID NO: 1364239 - RNA, 22 nt, Homo sapiens
accugcaaagaucuguccucag

SEQ ID NO: 1364240 - RNA, 14 nt, Homo sapiens
accugggacccugc

SEQ ID NO: 1364241 - RNA, 18 nt, Homo sapiens
accugggcaauauagcaa

SEQ ID NO: 1364242 - RNA, 17 nt, Homo sapiens
accuuaagagacacucc

SEQ ID NO: 1364243 - RNA, 23 nt, Homo sapiens
accuuacauuugaaaucuaugaa

SEQ ID NO: 1364244 - RNA, 20 nt, Homo sapiens
accuuaugagaaacugcaug

SEQ ID NO: 1364245 - RNA, 21 nt, Homo sapiens
accuucgacuucauuuugcca

SEQ ID NO: 1364246 - RNA, 22 nt, Homo sapiens
accuugagaagacauagaugaa

SEQ ID NO: 1364247 - RNA, 16 nt, Homo sapiens
accuuggcaccagaca

SEQ ID NO: 1364248 - RNA, 15 nt, Homo sapiens
accuuggcuuguuau

SEQ ID NO: 1364249 - RNA, 21 nt, Homo sapiens
acgacccuuucaucagaggaa

SEQ ID NO: 1364250 - RNA, 23 nt, Homo sapiens
acgagcuguguagccacugacuu

SEQ ID NO: 1364251 - RNA, 16 nt, Homo sapiens
acgcccccagcuguga

SEQ ID NO: 1364252 - RNA, 12 nt, Homo sapiens
acggacacucaa

SEQ ID NO: 1364253 - RNA, 15 nt, Homo sapiens
acgucaacgugagcu

SEQ ID NO: 1364254 - RNA, 14 nt, Homo sapiens
acguccugucuguu

SEQ ID NO: 1364255 - RNA, 21 nt, Homo sapiens
acgugacacaaacacacacaa

SEQ ID NO: 1364256 - RNA, 11 nt, Homo sapiens
acuaaagccaa

SEQ ID NO: 1364257 - RNA, 20 nt, Homo sapiens
acuaacaaaggcagcugugu

SEQ ID NO: 1364258 - RNA, 19 nt, Homo sapiens
acuaacuaugcauggugcc

SEQ ID NO: 1364259 - RNA, 22 nt, Homo sapiens
acuaagccccgucugaccccag

SEQ ID NO: 1364260 - RNA, 19 nt, Homo sapiens
acuacaagugauccucagg

SEQ ID NO: 1364261 - RNA, 21 nt, Homo sapiens
acuacagguauuuucaucaag

SEQ ID NO: 1364262 - RNA, 22 nt, Homo sapiens
acuacauuuuauuuuuguaucu

SEQ ID NO: 1364263 - RNA, 14 nt, Homo sapiens
aggaugcucaguga

SEQ ID NO: 1364264 - RNA, 16 nt, Homo sapiens
aggaugcugugugaga

SEQ ID NO: 1364265 - RNA, 14 nt, Homo sapiens
aggauuccuuggca

SEQ ID NO: 1364266 - RNA, 22 nt, Homo sapiens
aggauuucucaacuuugauacu

SEQ ID NO: 1364267 - RNA, 21 nt, Homo sapiens
aggauuuucacauucuuggcu

SEQ ID NO: 1364268 - RNA, 18 nt, Homo sapiens
aggcaccucuuccuugau

SEQ ID NO: 1364269 - RNA, 16 nt, Homo sapiens
aggcacgucugcagaa

SEQ ID NO: 1364270 - RNA, 15 nt, Homo sapiens
aggcagacucuuuau

SEQ ID NO: 1364271 - RNA, 12 nt, Homo sapiens
aggcagaucugu

SEQ ID NO: 1364272 - RNA, 20 nt, Homo sapiens
aggcagcagugagcuaugau

SEQ ID NO: 1364273 - RNA, 20 nt, Homo sapiens
aggcaggaggaucacuugag

SEQ ID NO: 1364274 - RNA, 16 nt, Homo sapiens
aggcaguagaacucca

SEQ ID NO: 1364275 - RNA, 21 nt, Homo sapiens
aggcagucagaggacgagugc

SEQ ID NO: 1364276 - RNA, 18 nt, Homo sapiens
aggcauauaguauuuuca

SEQ ID NO: 1364277 - RNA, 17 nt, Homo sapiens
aggccaguaugauuuau

SEQ ID NO: 1364278 - RNA, 15 nt, Homo sapiens
aggcccccaucuccu

SEQ ID NO: 1364279 - RNA, 18 nt, Homo sapiens
aggccgagaagcaagaaa

SEQ ID NO: 1364280 - RNA, 18 nt, Homo sapiens
aggccugggccgcugcca

SEQ ID NO: 1364281 - RNA, 16 nt, Homo sapiens
aggccuuccagugcag

SEQ ID NO: 1364282 - RNA, 20 nt, Homo sapiens
aggcgugguggcgggugccu

SEQ ID NO: 1364283 - RNA, 13 nt, Homo sapiens
aggcucuuagcag

SEQ ID NO: 1364284 - RNA, 22 nt, Homo sapiens
aggcugaggccuggacuuuccu

SEQ ID NO: 1364285 - RNA, 23 nt, Homo sapiens
aggcuugaucaugaaucacugca

SEQ ID NO: 1364286 - RNA, 17 nt, Homo sapiens
aggcuuguugugcuuuu

SEQ ID NO: 1364287 - RNA, 18 nt, Homo sapiens
agggaaaaguccuuggcu

SEQ ID NO: 1364288 - RNA, 21 nt, Homo sapiens
agggaaugaacuagcuaugaa

SEQ ID NO: 1364289 - RNA, 14 nt, Homo sapiens
agggagauucagac

SEQ ID NO: 1364290 - RNA, 20 nt, Homo sapiens
agggaggcaagcccuguuga

SEQ ID NO: 1364291 - RNA, 22 nt, Homo sapiens
agggagggacacuuacccaagg

SEQ ID NO: 1364292 - RNA, 18 nt, Homo sapiens
agggcaaaaagaccaaga

SEQ ID NO: 1364293 - RNA, 19 nt, Homo sapiens
agggcuccugcacuuacuu

SEQ ID NO: 1364294 - RNA, 18 nt, Homo sapiens
aggggaaagacuuccauc

SEQ ID NO: 1364295 - RNA, 16 nt, Homo sapiens
aggggcccuaccuggg

SEQ ID NO: 1364296 - RNA, 19 nt, Homo sapiens
aggggccuaggccucagcc

SEQ ID NO: 1364297 - RNA, 22 nt, Homo sapiens
agggggacacauccaucuugca

SEQ ID NO: 1364298 - RNA, 18 nt, Homo sapiens
agggucuucccuaccuca

SEQ ID NO: 1364299 - RNA, 19 nt, Homo sapiens
agggugaggcccacucugu

SEQ ID NO: 1364300 - RNA, 19 nt, Homo sapiens
aggguguuggaagaugcau

SEQ ID NO: 1364301 - RNA, 21 nt, Homo sapiens
aggguucaccaggucagggag

SEQ ID NO: 1364302 - RNA, 22 nt, Homo sapiens
aggguucaccaggucagggaga

SEQ ID NO: 1364303 - RNA, 20 nt, Homo sapiens
aggguugggcccagaucugg

SEQ ID NO: 1364304 - RNA, 20 nt, Homo sapiens
agguaggcuucuaccugcag

SEQ ID NO: 1364305 - RNA, 21 nt, Homo sapiens
agguaguuuugguuuccugau

SEQ ID NO: 1364306 - RNA, 18 nt, Homo sapiens
agguauuagcaaagcaaa

SEQ ID NO: 1364307 - RNA, 18 nt, Homo sapiens
aggucaagaacacaguga

SEQ ID NO: 1364308 - RNA, 20 nt, Homo sapiens
aggucacuuuaccucugugg

SEQ ID NO: 1364309 - RNA, 20 nt, Homo sapiens
aggucaucggcguggcccaa

SEQ ID NO: 1364310 - RNA, 11 nt, Homo sapiens
aggucaugccu

SEQ ID NO: 1364311 - RNA, 15 nt, Homo sapiens
agguccagcucugga

SEQ ID NO: 1364312 - RNA, 16 nt, Homo sapiens
aggucugaaucuucac

SEQ ID NO: 1364313 - RNA, 15 nt, Homo sapiens
aggugagagcccuuu

SEQ ID NO: 1364314 - RNA, 13 nt, Homo sapiens
aggugagcgcuuu

SEQ ID NO: 1364315 - RNA, 22 nt, Homo sapiens
aggugcccaggaaccucagggc

SEQ ID NO: 1364316 - RNA, 20 nt, Homo sapiens
aggugggaggaucucuugag

SEQ ID NO: 1364317 - RNA, 20 nt, Homo sapiens
aggugggccagucuguggau

SEQ ID NO: 1364318 - RNA, 20 nt, Homo sapiens
agguucucagguguugccaa

SEQ ID NO: 1364319 - RNA, 16 nt, Homo sapiens
agguucuuaucaacau

SEQ ID NO: 1364320 - RNA, 17 nt, Homo sapiens
agguugaaaagacaaua

SEQ ID NO: 1364321 - RNA, 23 nt, Homo sapiens
aguaagaauguuaaaaagugaaa

SEQ ID NO: 1364322 - RNA, 20 nt, Homo sapiens
aguaagaauuauuuacugaa

SEQ ID NO: 1364323 - RNA, 17 nt, Homo sapiens
aguacaggcagcacaga

SEQ ID NO: 1364324 - RNA, 19 nt, Homo sapiens
aguaccaacucuccaaaac

SEQ ID NO: 1364325 - RNA, 22 nt, Homo sapiens
aguaccaccaagggaucugcca

SEQ ID NO: 1364326 - RNA, 13 nt, Homo sapiens
aguacuugucaua

SEQ ID NO: 1364327 - RNA, 23 nt, Homo sapiens
aguauacaauaaagucuuaccuc

SEQ ID NO: 1364328 - RNA, 13 nt, Homo sapiens
aguaucugagauu

SEQ ID NO: 1364329 - RNA, 16 nt, Homo sapiens
aguauucaugacuaug

SEQ ID NO: 1364330 - RNA, 21 nt, Homo sapiens
aguauuuuagugaacuugaaa

SEQ ID NO: 1364331 - RNA, 22 nt, Homo sapiens
agucacaacagagugaaaaauc

SEQ ID NO: 1364332 - RNA, 14 nt, Homo sapiens
agucaucucaacca

SEQ ID NO: 1364333 - RNA, 14 nt, Homo sapiens
aguccauauuucaa

SEQ ID NO: 1364334 - RNA, 16 nt, Homo sapiens
agucccagcuacuuga

SEQ ID NO: 1364335 - RNA, 13 nt, Homo sapiens
agucccauuugac

SEQ ID NO: 1364336 - RNA, 20 nt, Homo sapiens
agucccuaaaaacacagaca

SEQ ID NO: 1364337 - RNA, 18 nt, Homo sapiens
agucguggggugugcugg

SEQ ID NO: 1364338 - RNA, 14 nt, Homo sapiens
agucucaguucucu

SEQ ID NO: 1364339 - RNA, 14 nt, Homo sapiens
agucugucucagga

SEQ ID NO: 1364340 - RNA, 15 nt, Homo sapiens
agucuguuuacugca

SEQ ID NO: 1364341 - RNA, 11 nt, Homo sapiens
agucuugccuu

SEQ ID NO: 1364342 - RNA, 18 nt, Homo sapiens
agugaaaccccaucucua

SEQ ID NO: 1364343 - RNA, 21 nt, Homo sapiens
agugaacuugaaauauccugc

SEQ ID NO: 1364344 - RNA, 23 nt, Homo sapiens
agugacaaaauagacaauuugca

SEQ ID NO: 1364345 - RNA, 15 nt, Homo sapiens
agugacaaccaaaag

SEQ ID NO: 1364346 - RNA, 16 nt, Homo sapiens
acuacgcugauuugau

SEQ ID NO: 1364347 - RNA, 21 nt, Homo sapiens
acuagagugaugacugcuugu

SEQ ID NO: 1364348 - RNA, 14 nt, Homo sapiens
acuagauacaguaa

SEQ ID NO: 1364349 - RNA, 20 nt, Homo sapiens
acuaggcccccacuugccuc

SEQ ID NO: 1364350 - RNA, 15 nt, Homo sapiens
acuagggagccaugu

SEQ ID NO: 1364351 - RNA, 17 nt, Homo sapiens
acuaguuuuuauuccuu

SEQ ID NO: 1364352 - RNA, 20 nt, Homo sapiens
acuaucuuucagcuccaguu

SEQ ID NO: 1364353 - RNA, 21 nt, Homo sapiens
acucaaauggggccagaucca

SEQ ID NO: 1364354 - RNA, 23 nt, Homo sapiens
acucaauaaaaguuuccuuucaa

SEQ ID NO: 1364355 - RNA, 16 nt, Homo sapiens
acucagacacaaauaa

SEQ ID NO: 1364356 - RNA, 13 nt, Homo sapiens
acucagcacucca

SEQ ID NO: 1364357 - RNA, 19 nt, Homo sapiens
acuccagccugggugacaa

SEQ ID NO: 1364358 - RNA, 23 nt, Homo sapiens
acuccccauuaacagauggaaaa

SEQ ID NO: 1364359 - RNA, 22 nt, Homo sapiens
acuccuuguaaagacuguagaa

SEQ ID NO: 1364360 - RNA, 14 nt, Homo sapiens
acuccuuugcuaau

SEQ ID NO: 1364361 - RNA, 21 nt, Homo sapiens
acucguauagcaugcaucugu

SEQ ID NO: 1364362 - RNA, 17 nt, Homo sapiens
acucuaccucauaucag

SEQ ID NO: 1364363 - RNA, 21 nt, Homo sapiens
acucuaugaguuggacuucag

SEQ ID NO: 1364364 - RNA, 18 nt, Homo sapiens
acucuuuaguugauuuaa

SEQ ID NO: 1364365 - RNA, 21 nt, Homo sapiens
acugaaauuacggguaccuga

SEQ ID NO: 1364366 - RNA, 16 nt, Homo sapiens
acugaauuuugggacu

SEQ ID NO: 1364367 - RNA, 12 nt, Homo sapiens
acugaccaaauc

SEQ ID NO: 1364368 - RNA, 21 nt, Homo sapiens
acugcaauuuaauucuuguuc

SEQ ID NO: 1364369 - RNA, 12 nt, Homo sapiens
acugccaaaaag

SEQ ID NO: 1364370 - RNA, 13 nt, Homo sapiens
acugccaaaaagg

SEQ ID NO: 1364371 - RNA, 15 nt, Homo sapiens
acugccaugccagcu

SEQ ID NO: 1364372 - RNA, 21 nt, Homo sapiens
acugccuucgcuucuugccuc

SEQ ID NO: 1364373 - RNA, 22 nt, Homo sapiens
acugcugggcccgauucugaua

SEQ ID NO: 1364374 - RNA, 17 nt, Homo sapiens
acugcuuguagguaugu

SEQ ID NO: 1364375 - RNA, 15 nt, Homo sapiens
acuggccacccaagg

SEQ ID NO: 1364376 - RNA, 17 nt, Homo sapiens
acuggggcgucaccucc

SEQ ID NO: 1364377 - RNA, 14 nt, Homo sapiens
acuggucucuggcu

SEQ ID NO: 1364378 - RNA, 17 nt, Homo sapiens
acuguaagaguucacau

SEQ ID NO: 1364379 - RNA, 13 nt, Homo sapiens
acuguaagggauu

SEQ ID NO: 1364380 - RNA, 14 nt, Homo sapiens
acuguaagggauug

SEQ ID NO: 1364381 - RNA, 16 nt, Homo sapiens
acuguaaucagguuau

SEQ ID NO: 1364382 - RNA, 14 nt, Homo sapiens
acugucccuugccu

SEQ ID NO: 1364383 - RNA, 21 nt, Homo sapiens
acugucuugaagacaauggcu

SEQ ID NO: 1364384 - RNA, 20 nt, Homo sapiens
acuguugcccuucuguccaa

SEQ ID NO: 1364385 - RNA, 22 nt, Homo sapiens
acuuaccacucgugcaucccug

SEQ ID NO: 1364386 - RNA, 16 nt, Homo sapiens
acuuagauacuaauaa

SEQ ID NO: 1364387 - RNA, 21 nt, Homo sapiens
acuuauauuuaaaacuugccu

SEQ ID NO: 1364388 - RNA, 23 nt, Homo sapiens
acuuccugguugagcuucugcua

SEQ ID NO: 1364389 - RNA, 19 nt, Homo sapiens
acuucucccaaaguguccu

SEQ ID NO: 1364390 - RNA, 19 nt, Homo sapiens
acuucuugguacccaguca

SEQ ID NO: 1364391 - RNA, 22 nt, Homo sapiens
acuugaguuguugcuuauacug

SEQ ID NO: 1364392 - RNA, 19 nt, Homo sapiens
acuugcucagguacuugua

SEQ ID NO: 1364393 - RNA, 21 nt, Homo sapiens
acuuggucagagccacucuau

SEQ ID NO: 1364394 - RNA, 22 nt, Homo sapiens
acuugucucaagccuaucuaua

SEQ ID NO: 1364395 - RNA, 16 nt, Homo sapiens
acuugugugugcgugu

SEQ ID NO: 1364396 - RNA, 21 nt, Homo sapiens
acuuuaucaauuaacugagua

SEQ ID NO: 1364397 - RNA, 19 nt, Homo sapiens
acuuucccuugugucaaga

SEQ ID NO: 1364398 - RNA, 15 nt, Homo sapiens
acuuucuucugaaua

SEQ ID NO: 1364399 - RNA, 13 nt, Homo sapiens
acuuugacuuucu

SEQ ID NO: 1364400 - RNA, 17 nt, Homo sapiens
acuuugagcugagugcu

SEQ ID NO: 1364401 - RNA, 23 nt, Homo sapiens
acuuugagcugagugcugaaaua

SEQ ID NO: 1364402 - RNA, 22 nt, Homo sapiens
acuuugauucugauaaugcuca

SEQ ID NO: 1364403 - RNA, 20 nt, Homo sapiens
acuuugcuugcucauaugca

SEQ ID NO: 1364404 - RNA, 16 nt, Homo sapiens
acuuuggcaauuuccu

SEQ ID NO: 1364405 - RNA, 19 nt, Homo sapiens
acuuuguggcaaucugugg

SEQ ID NO: 1364406 - RNA, 17 nt, Homo sapiens
acuuuuaauuagugaug

SEQ ID NO: 1364407 - RNA, 19 nt, Homo sapiens
agaaaaauuuguauacuaa

SEQ ID NO: 1364408 - RNA, 18 nt, Homo sapiens
agaaaacuugccuuucag

SEQ ID NO: 1364409 - RNA, 12 nt, Homo sapiens
agaaaagaccuu

SEQ ID NO: 1364410 - RNA, 14 nt, Homo sapiens
agaaaagaccuuuu

SEQ ID NO: 1364411 - RNA, 21 nt, Homo sapiens
agaaaaguuauuagugguuua

SEQ ID NO: 1364412 - RNA, 17 nt, Homo sapiens
agaaacagccugugucu

SEQ ID NO: 1364413 - RNA, 15 nt, Homo sapiens
agaaaucuagaauuu

SEQ ID NO: 1364414 - RNA, 23 nt, Homo sapiens
agaaaugucauguggcuaccugu

SEQ ID NO: 1364415 - RNA, 12 nt, Homo sapiens
agaacaaaaaca

SEQ ID NO: 1364416 - RNA, 13 nt, Homo sapiens
agaaccucuuccc

SEQ ID NO: 1364417 - RNA, 19 nt, Homo sapiens
agaacguuuuuuccucagu

SEQ ID NO: 1364418 - RNA, 23 nt, Homo sapiens
agaacguuuuuuccucagugcau

SEQ ID NO: 1364419 - RNA, 21 nt, Homo sapiens
agaacuccccuugaaaacugc

SEQ ID NO: 1364420 - RNA, 20 nt, Homo sapiens
agaacuucuccuacuguagc

SEQ ID NO: 1364421 - RNA, 13 nt, Homo sapiens
agaagagguguuu

SEQ ID NO: 1364422 - RNA, 20 nt, Homo sapiens
agaagagguugggcuuccau

SEQ ID NO: 1364423 - RNA, 16 nt, Homo sapiens
agaagcuggcccugca

SEQ ID NO: 1364424 - RNA, 23 nt, Homo sapiens
agaaggggacaauggcagaacag

SEQ ID NO: 1364425 - RNA, 22 nt, Homo sapiens
agaaguugaggggagcaugcuu

SEQ ID NO: 1364426 - RNA, 13 nt, Homo sapiens
agaauaaagccuc

SEQ ID NO: 1364427 - RNA, 13 nt, Homo sapiens
agaauauacuaaa

SEQ ID NO: 1364428 - RNA, 18 nt, Homo sapiens
agaaucggcuuugcagug

SEQ ID NO: 1364429 - RNA, 15 nt, Homo sapiens
agaaugaacacuccc

SEQ ID NO: 1364430 - RNA, 15 nt, Homo sapiens
agaaugccaggaaua

SEQ ID NO: 1364431 - RNA, 19 nt, Homo sapiens
agaauguuguguucugugu

SEQ ID NO: 1364432 - RNA, 21 nt, Homo sapiens
agacaagcucaaguguucaca

SEQ ID NO: 1364433 - RNA, 21 nt, Homo sapiens
agacaccuuggacauccuccu

SEQ ID NO: 1364434 - RNA, 13 nt, Homo sapiens
agacauacuugaa

SEQ ID NO: 1364435 - RNA, 16 nt, Homo sapiens
agacaugugcacuuga

SEQ ID NO: 1364436 - RNA, 17 nt, Homo sapiens
agacauuucucuaacuc

SEQ ID NO: 1364437 - RNA, 20 nt, Homo sapiens
agaccgugaccagugcugcu

SEQ ID NO: 1364438 - RNA, 23 nt, Homo sapiens
agaccuuuuggcccaaucucugc

SEQ ID NO: 1364439 - RNA, 17 nt, Homo sapiens
agacgguguuuugccau

SEQ ID NO: 1364440 - RNA, 15 nt, Homo sapiens
agacucagugcagau

SEQ ID NO: 1364441 - RNA, 22 nt, Homo sapiens
agacucauugcagcagguggua

SEQ ID NO: 1364442 - RNA, 15 nt, Homo sapiens
agacucuaacuucuc

SEQ ID NO: 1364443 - RNA, 18 nt, Homo sapiens
agacucuuuaugcuugca

SEQ ID NO: 1364444 - RNA, 18 nt, Homo sapiens
agacuguuacuuuggcaa

SEQ ID NO: 1364445 - RNA, 14 nt, Homo sapiens
agacuugguuucaa

SEQ ID NO: 1364446 - RNA, 20 nt, Homo sapiens
agagaaccucacgcaccucc

SEQ ID NO: 1364447 - RNA, 14 nt, Homo sapiens
agagaauaaauuaa

SEQ ID NO: 1364448 - RNA, 13 nt, Homo sapiens
agagacacuccaa

SEQ ID NO: 1364449 - RNA, 13 nt, Homo sapiens
agagagaggaauu

SEQ ID NO: 1364450 - RNA, 15 nt, Homo sapiens
agagaguugagacuu

SEQ ID NO: 1364451 - RNA, 20 nt, Homo sapiens
agagcaaaacucugucucaa

SEQ ID NO: 1364452 - RNA, 13 nt, Homo sapiens
agagcagggauua

SEQ ID NO: 1364453 - RNA, 23 nt, Homo sapiens
agagccaggggggugaggagcug

SEQ ID NO: 1364454 - RNA, 17 nt, Homo sapiens
agagccuuuugugcaaa

SEQ ID NO: 1364455 - RNA, 11 nt, Homo sapiens
agagcuucucc

SEQ ID NO: 1364456 - RNA, 15 nt, Homo sapiens
agaggagaaggaggg

SEQ ID NO: 1364457 - RNA, 20 nt, Homo sapiens
agaggccuugcuguggagcu

SEQ ID NO: 1364458 - RNA, 13 nt, Homo sapiens
agagggaggaaga

SEQ ID NO: 1364459 - RNA, 14 nt, Homo sapiens
agagguagcacuac

SEQ ID NO: 1364460 - RNA, 22 nt, Homo sapiens
agagguguuuuuauaauaucca

SEQ ID NO: 1364461 - RNA, 12 nt, Homo sapiens
agagucaucuga

SEQ ID NO: 1364462 - RNA, 20 nt, Homo sapiens
augaaaaauaagucacuuau

SEQ ID NO: 1364463 - RNA, 17 nt, Homo sapiens
augaaauaucaugcucc

SEQ ID NO: 1364464 - RNA, 12 nt, Homo sapiens
augaagccagcu

SEQ ID NO: 1364465 - RNA, 12 nt, Homo sapiens
augaaucacugc

SEQ ID NO: 1364466 - RNA, 19 nt, Homo sapiens
augacacaggcugacucau

SEQ ID NO: 1364467 - RNA, 23 nt, Homo sapiens
augacacccacucuccugugaga

SEQ ID NO: 1364468 - RNA, 17 nt, Homo sapiens
augacuggucucuggcu

SEQ ID NO: 1364469 - RNA, 14 nt, Homo sapiens
augacuguuuguua

SEQ ID NO: 1364470 - RNA, 17 nt, Homo sapiens
augaggagcugcagauu

SEQ ID NO: 1364471 - RNA, 16 nt, Homo sapiens
augaggcuguugucuu

SEQ ID NO: 1364472 - RNA, 22 nt, Homo sapiens
augaggucauagcagugcuuga

SEQ ID NO: 1364473 - RNA, 21 nt, Homo sapiens
augaguccccccucuugucuc

SEQ ID NO: 1364474 - RNA, 19 nt, Homo sapiens
augaguuucuuaacccuuu

SEQ ID NO: 1364475 - RNA, 23 nt, Homo sapiens
augauaaaauacuaaacuacauu

SEQ ID NO: 1364476 - RNA, 14 nt, Homo sapiens
augauaaacaaguc

SEQ ID NO: 1364477 - RNA, 15 nt, Homo sapiens
augauacacuaugaa

SEQ ID NO: 1364478 - RNA, 20 nt, Homo sapiens
augaucccuguguugucucu

SEQ ID NO: 1364479 - RNA, 16 nt, Homo sapiens
augaugcccuaacuug

SEQ ID NO: 1364480 - RNA, 21 nt, Homo sapiens
augaugcgggccagugcucca

SEQ ID NO: 1364481 - RNA, 13 nt, Homo sapiens
augcagcaucuaa

SEQ ID NO: 1364482 - RNA, 14 nt, Homo sapiens
augcagcaucuaag

SEQ ID NO: 1364483 - RNA, 16 nt, Homo sapiens
augcagcaucuaagua

SEQ ID NO: 1364484 - RNA, 15 nt, Homo sapiens
augcagcccaugccc

SEQ ID NO: 1364485 - RNA, 21 nt, Homo sapiens
augccaauaauaaaugcccuc

SEQ ID NO: 1364486 - RNA, 17 nt, Homo sapiens
augccagcuuaucucag

SEQ ID NO: 1364487 - RNA, 18 nt, Homo sapiens
augccagcuuaucucagg

SEQ ID NO: 1364488 - RNA, 13 nt, Homo sapiens
augccguggauug

SEQ ID NO: 1364489 - RNA, 19 nt, Homo sapiens
augccucauuaccuugugc

SEQ ID NO: 1364490 - RNA, 21 nt, Homo sapiens
augccugacuagggagccaug

SEQ ID NO: 1364491 - RNA, 16 nt, Homo sapiens
augcguuuaaucacau

SEQ ID NO: 1364492 - RNA, 12 nt, Homo sapiens
augcucaagaaa

SEQ ID NO: 1364493 - RNA, 20 nt, Homo sapiens
augcugggauuacaggcgua

SEQ ID NO: 1364494 - RNA, 19 nt, Homo sapiens
augcuguguccacggggug

SEQ ID NO: 1364495 - RNA, 13 nt, Homo sapiens
augcuucuuggcu

SEQ ID NO: 1364496 - RNA, 17 nt, Homo sapiens
augcuuggacuagugag

SEQ ID NO: 1364497 - RNA, 19 nt, Homo sapiens
auggaaugugauguucaug

SEQ ID NO: 1364498 - RNA, 20 nt, Homo sapiens
auggcaaaggaagguggaug

SEQ ID NO: 1364499 - RNA, 23 nt, Homo sapiens
auggcaacagaucuggaaccuca

SEQ ID NO: 1364500 - RNA, 17 nt, Homo sapiens
auggcacccaugcaccu

SEQ ID NO: 1364501 - RNA, 19 nt, Homo sapiens
auggcccggccccuccuga

SEQ ID NO: 1364502 - RNA, 17 nt, Homo sapiens
auggccucauguggcug

SEQ ID NO: 1364503 - RNA, 14 nt, Homo sapiens
auggcucagggugg

SEQ ID NO: 1364504 - RNA, 16 nt, Homo sapiens
auggcucuacuuucag

SEQ ID NO: 1364505 - RNA, 11 nt, Homo sapiens
auggcugccau

SEQ ID NO: 1364506 - RNA, 15 nt, Homo sapiens
augggcacacacacc

SEQ ID NO: 1364507 - RNA, 17 nt, Homo sapiens
augggggaacucagauc

SEQ ID NO: 1364508 - RNA, 14 nt, Homo sapiens
auggugaugaaaug

SEQ ID NO: 1364509 - RNA, 19 nt, Homo sapiens
augguggcgcaugccugua

SEQ ID NO: 1364510 - RNA, 12 nt, Homo sapiens
auguaaagccau

SEQ ID NO: 1364511 - RNA, 15 nt, Homo sapiens
auguacagacauauu

SEQ ID NO: 1364512 - RNA, 19 nt, Homo sapiens
auguacucaaguaccacca

SEQ ID NO: 1364513 - RNA, 20 nt, Homo sapiens
auguaguccgugcugacagc

SEQ ID NO: 1364514 - RNA, 17 nt, Homo sapiens
auguauggggaaucuaa

SEQ ID NO: 1364515 - RNA, 18 nt, Homo sapiens
augucauguggcuaccug

SEQ ID NO: 1364516 - RNA, 17 nt, Homo sapiens
auguccagcaccuugug

SEQ ID NO: 1364517 - RNA, 17 nt, Homo sapiens
augucguuugaaucaca

SEQ ID NO: 1364518 - RNA, 16 nt, Homo sapiens
augugcauaguuucuu

SEQ ID NO: 1364519 - RNA, 14 nt, Homo sapiens
augugcucagggaa

SEQ ID NO: 1364520 - RNA, 12 nt, Homo sapiens
auguggcccaac

SEQ ID NO: 1364521 - RNA, 16 nt, Homo sapiens
auguggcccaacacaa

SEQ ID NO: 1364522 - RNA, 14 nt, Homo sapiens
augugugaggagcu

SEQ ID NO: 1364523 - RNA, 16 nt, Homo sapiens
augugugauucacagu

SEQ ID NO: 1364524 - RNA, 20 nt, Homo sapiens
auguguuuacauuuacugaa

SEQ ID NO: 1364525 - RNA, 12 nt, Homo sapiens
auguuacagauu

SEQ ID NO: 1364526 - RNA, 15 nt, Homo sapiens
auguugaucauguac

SEQ ID NO: 1364527 - RNA, 20 nt, Homo sapiens
auguugugaaauaacauucg

SEQ ID NO: 1364528 - RNA, 13 nt, Homo sapiens
auguuucaaaaaa

SEQ ID NO: 1364529 - RNA, 20 nt, Homo sapiens
auguuucucccccuuuccaa

SEQ ID NO: 1364530 - RNA, 13 nt, Homo sapiens
auuaaaacacuua

SEQ ID NO: 1364531 - RNA, 19 nt, Homo sapiens
auuaaaauuacacacuugc

SEQ ID NO: 1364532 - RNA, 14 nt, Homo sapiens
auuaagaaugccag

SEQ ID NO: 1364533 - RNA, 16 nt, Homo sapiens
auuaaggcaguaugcc

SEQ ID NO: 1364534 - RNA, 20 nt, Homo sapiens
auuaauauggggaugcagca

SEQ ID NO: 1364535 - RNA, 18 nt, Homo sapiens
auuaauauuaacuacaga

SEQ ID NO: 1364536 - RNA, 17 nt, Homo sapiens
auuacaggugugagcca

SEQ ID NO: 1364537 - RNA, 21 nt, Homo sapiens
auuaccugccaauugcuaccg

SEQ ID NO: 1364538 - RNA, 17 nt, Homo sapiens
auuacuauaagaacuuu

SEQ ID NO: 1364539 - RNA, 15 nt, Homo sapiens
auuagcaaagcaaaa

SEQ ID NO: 1364540 - RNA, 18 nt, Homo sapiens
auuaggcagacucuuuau

SEQ ID NO: 1364541 - RNA, 17 nt, Homo sapiens
auuauaaauaaauacca

SEQ ID NO: 1364542 - RNA, 13 nt, Homo sapiens
auuauauauuaac

SEQ ID NO: 1364543 - RNA, 17 nt, Homo sapiens
auuauauuugugcuaua

SEQ ID NO: 1364544 - RNA, 20 nt, Homo sapiens
agcugggcccgacauggcuc

SEQ ID NO: 1364545 - RNA, 16 nt, Homo sapiens
agcuggggauguuuag

SEQ ID NO: 1364546 - RNA, 21 nt, Homo sapiens
agcuggggauguuuaguaaua

SEQ ID NO: 1364547 - RNA, 22 nt, Homo sapiens
agcuggguuggaaaacaguauu

SEQ ID NO: 1364548 - RNA, 17 nt, Homo sapiens
agcuguucucauugcca

SEQ ID NO: 1364549 - RNA, 17 nt, Homo sapiens
agcuguuuauggccuca

SEQ ID NO: 1364550 - RNA, 22 nt, Homo sapiens
agcuuaaacagcuggucagccc

SEQ ID NO: 1364551 - RNA, 13 nt, Homo sapiens
agcuuaagaauuu

SEQ ID NO: 1364552 - RNA, 14 nt, Homo sapiens
agcuuaucucaggg

SEQ ID NO: 1364553 - RNA, 22 nt, Homo sapiens
agcuuggaaacuggaugagguc

SEQ ID NO: 1364554 - RNA, 19 nt, Homo sapiens
agcuuggaaaggaccagua

SEQ ID NO: 1364555 - RNA, 14 nt, Homo sapiens
aggaagccgugccc

SEQ ID NO: 1364556 - RNA, 14 nt, Homo sapiens
aggaagcucagacu

SEQ ID NO: 1364557 - RNA, 19 nt, Homo sapiens
aggaaggcuuguugugcuu

SEQ ID NO: 1364558 - RNA, 12 nt, Homo sapiens
aggaauacucau

SEQ ID NO: 1364559 - RNA, 19 nt, Homo sapiens
aggaauccucugugucuuc

SEQ ID NO: 1364560 - RNA, 17 nt, Homo sapiens
aggaauuaaguuaggga

SEQ ID NO: 1364561 - RNA, 21 nt, Homo sapiens
aggacccugaaggggccauga

SEQ ID NO: 1364562 - RNA, 22 nt, Homo sapiens
aggacccugaaggggccaugau

SEQ ID NO: 1364563 - RNA, 18 nt, Homo sapiens
aggacggacucacuucuc

SEQ ID NO: 1364564 - RNA, 21 nt, Homo sapiens
aggacuuguuaaagagcacug

SEQ ID NO: 1364565 - RNA, 21 nt, Homo sapiens
aggagaaccacuacaugcagc

SEQ ID NO: 1364566 - RNA, 15 nt, Homo sapiens
aggagacccacaggu

SEQ ID NO: 1364567 - RNA, 21 nt, Homo sapiens
aggagauaauuguuucauuca

SEQ ID NO: 1364568 - RNA, 14 nt, Homo sapiens
aggagcuuacugaa

SEQ ID NO: 1364569 - RNA, 15 nt, Homo sapiens
aggagcuuacugaaa

SEQ ID NO: 1364570 - RNA, 20 nt, Homo sapiens
aggaggcagagguugcagug

SEQ ID NO: 1364571 - RNA, 23 nt, Homo sapiens
aggaggggucuggguacuucuug

SEQ ID NO: 1364572 - RNA, 16 nt, Homo sapiens
aggaggguugugcuac

SEQ ID NO: 1364573 - RNA, 18 nt, Homo sapiens
aggaguuugagaccaacc

SEQ ID NO: 1364574 - RNA, 17 nt, Homo sapiens
aggauauccucccucca

SEQ ID NO: 1364575 - RNA, 22 nt, Homo sapiens
uuggcauccgaaaccagcaucu

SEQ ID NO: 1364576 - RNA, 16 nt, Homo sapiens
uuggggcccagugcau

SEQ ID NO: 1364577 - RNA, 17 nt, Homo sapiens
uugggguuuaaauaucc

SEQ ID NO: 1364578 - RNA, 19 nt, Homo sapiens
uugguccgguuauucacuu

SEQ ID NO: 1364579 - RNA, 21 nt, Homo sapiens
uugguccgguuauucacuuga

SEQ ID NO: 1364580 - RNA, 21 nt, Homo sapiens
uugguccuaccuauuauccuu

SEQ ID NO: 1364581 - RNA, 23 nt, Homo sapiens
uuguaaauuauauuugugcuaua

SEQ ID NO: 1364582 - RNA, 18 nt, Homo sapiens
uuguaagguggucacugu

SEQ ID NO: 1364583 - RNA, 24 nt, Homo sapiens
uuguaagugaaguaaaacuuaaga

SEQ ID NO: 1364584 - RNA, 14 nt, Homo sapiens
uugucauccuuuga

SEQ ID NO: 1364585 - RNA, 15 nt, Homo sapiens
uugucaucugcaugu

SEQ ID NO: 1364586 - RNA, 14 nt, Homo sapiens
uugucccucugccc

SEQ ID NO: 1364587 - RNA, 17 nt, Homo sapiens
uuguccugaccuugaga

SEQ ID NO: 1364588 - RNA, 17 nt, Homo sapiens
uugucgcucaugugugc

SEQ ID NO: 1364589 - RNA, 12 nt, Homo sapiens
uugugaacugga

SEQ ID NO: 1364590 - RNA, 15 nt, Homo sapiens
uugugcaaagccaaa

SEQ ID NO: 1364591 - RNA, 20 nt, Homo sapiens
uuguguuuuguuuuguauca

SEQ ID NO: 1364592 - RNA, 11 nt, Homo sapiens
uuguugacaaa

SEQ ID NO: 1364593 - RNA, 14 nt, Homo sapiens
uuguuucuguagaa

SEQ ID NO: 1364594 - RNA, 18 nt, Homo sapiens
uuguuuuguguaacauau

SEQ ID NO: 1364595 - RNA, 18 nt, Homo sapiens
uuuaaaaauaguugcugu

SEQ ID NO: 1364596 - RNA, 21 nt, Homo sapiens
uuuaaacauuuuuaucuauca

SEQ ID NO: 1364597 - RNA, 17 nt, Homo sapiens
uuuaaagaaagcaacuu

SEQ ID NO: 1364598 - RNA, 15 nt, Homo sapiens
uuuaaauaaauggaa

SEQ ID NO: 1364599 - RNA, 22 nt, Homo sapiens
uuuaaauuacaauuuuaucugu

SEQ ID NO: 1364600 - RNA, 13 nt, Homo sapiens
uuuaaauuccaca

SEQ ID NO: 1364601 - RNA, 20 nt, Homo sapiens
uuuaaccccacacagcacuu

SEQ ID NO: 1364602 - RNA, 13 nt, Homo sapiens
uuuaaguacucac

SEQ ID NO: 1364603 - RNA, 16 nt, Homo sapiens
uuuaauuugauaguau

SEQ ID NO: 1364604 - RNA, 13 nt, Homo sapiens
uuuacacacauga

SEQ ID NO: 1364605 - RNA, 24 nt, Homo sapiens
uuuacaucuauguguauguugacu

SEQ ID NO: 1364606 - RNA, 20 nt, Homo sapiens
uuuaguggcucagaacugca

SEQ ID NO: 1364607 - RNA, 13 nt, Homo sapiens
uuuauaagucauu

SEQ ID NO: 1364608 - RNA, 15 nt, Homo sapiens
uuuauacuuugcaau

SEQ ID NO: 1364609 - RNA, 16 nt, Homo sapiens
uuuauauaauaucuaa

SEQ ID NO: 1364610 - RNA, 19 nt, Homo sapiens
uuuaucacacuucugugag

SEQ ID NO: 1364611 - RNA, 14 nt, Homo sapiens
uuuaucacuguugc

SEQ ID NO: 1364612 - RNA, 21 nt, Homo sapiens
uuuaucuauggcacccaugca

SEQ ID NO: 1364613 - RNA, 20 nt, Homo sapiens
uuuauggaagaugugugaua

SEQ ID NO: 1364614 - RNA, 21 nt, Homo sapiens
uuuauugucugucuacauuuc

SEQ ID NO: 1364615 - RNA, 16 nt, Homo sapiens
uuucacaauaccucau

SEQ ID NO: 1364616 - RNA, 16 nt, Homo sapiens
uuucacauucuuggcu

SEQ ID NO: 1364617 - RNA, 19 nt, Homo sapiens
uuucagaugugaaccauua

SEQ ID NO: 1364618 - RNA, 16 nt, Homo sapiens
uuucaucagaggaaaa

SEQ ID NO: 1364619 - RNA, 16 nt, Homo sapiens
uuuccaauuagcuccu

SEQ ID NO: 1364620 - RNA, 19 nt, Homo sapiens
uuuccauccuagugagaag

SEQ ID NO: 1364621 - RNA, 19 nt, Homo sapiens
uuucccagagucaucugau

SEQ ID NO: 1364622 - RNA, 23 nt, Homo sapiens
uuucccuaggaaacucacacucc

SEQ ID NO: 1364623 - RNA, 23 nt, Homo sapiens
uuuccuugggcuuuagccuuaaa

SEQ ID NO: 1364624 - RNA, 15 nt, Homo sapiens
uuucucugccaguga

SEQ ID NO: 1364625 - RNA, 13 nt, Homo sapiens
uuucugccuaucu

SEQ ID NO: 1364626 - RNA, 19 nt, Homo sapiens
uuucuggaaaguagaucuu

SEQ ID NO: 1364627 - RNA, 14 nt, Homo sapiens
uuucuggugccauu

SEQ ID NO: 1364628 - RNA, 15 nt, Homo sapiens
uuucuggugccauuu

SEQ ID NO: 1364629 - RNA, 22 nt, Homo sapiens
uuucugucacaucagcuccacu

SEQ ID NO: 1364630 - RNA, 23 nt, Homo sapiens
uuucuucccgaaccccaaggagg

SEQ ID NO: 1364631 - RNA, 18 nt, Homo sapiens
uuucuuguauuuuuccaa

SEQ ID NO: 1364632 - RNA, 12 nt, Homo sapiens
aaaaaaaauccc

SEQ ID NO: 1364633 - RNA, 13 nt, Homo sapiens
aaaaacacagaca

SEQ ID NO: 1364634 - RNA, 23 nt, Homo sapiens
aaaaaccucuaugcaaucugagu

SEQ ID NO: 1364635 - RNA, 14 nt, Homo sapiens
aaaaauaaaagauc

SEQ ID NO: 1364636 - RNA, 15 nt, Homo sapiens
aaaaaucccuuaccu

SEQ ID NO: 1364637 - RNA, 21 nt, Homo sapiens
aaaaaugagcauacaucuuaa

SEQ ID NO: 1364638 - RNA, 14 nt, Homo sapiens
aaaaauguaucaaa

SEQ ID NO: 1364639 - RNA, 13 nt, Homo sapiens
aaaacaauaauuu

SEQ ID NO: 1364640 - RNA, 14 nt, Homo sapiens
aaaacauaaacuga

SEQ ID NO: 1364641 - RNA, 13 nt, Homo sapiens
aaaaccaccaaaa

SEQ ID NO: 1364642 - RNA, 17 nt, Homo sapiens
aaaaccagcgugugacu

SEQ ID NO: 1364643 - RNA, 13 nt, Homo sapiens
aaaacugcagugu

SEQ ID NO: 1364644 - RNA, 19 nt, Homo sapiens
aaaacuucaguaaguacgu

SEQ ID NO: 1364645 - RNA, 23 nt, Homo sapiens
aaaacuuuucuaauacucuaccc

SEQ ID NO: 1364646 - RNA, 20 nt, Homo sapiens
aaaagaucuugaauagucuc

SEQ ID NO: 1364647 - RNA, 21 nt, Homo sapiens
aaaagaucuugaauagucuca

SEQ ID NO: 1364648 - RNA, 22 nt, Homo sapiens
aaaagaugcauuaucuaugaua

SEQ ID NO: 1364649 - RNA, 19 nt, Homo sapiens
aaaagcaagggaccuucau

SEQ ID NO: 1364650 - RNA, 13 nt, Homo sapiens
aaaagcugggcag

SEQ ID NO: 1364651 - RNA, 20 nt, Homo sapiens
aaaagggagauucagacugu

SEQ ID NO: 1364652 - RNA, 15 nt, Homo sapiens
aaaauagaagacaua

SEQ ID NO: 1364653 - RNA, 15 nt, Homo sapiens
aaaauccuacaguga

SEQ ID NO: 1364654 - RNA, 15 nt, Homo sapiens
aaaaugcaacaacau

SEQ ID NO: 1364655 - RNA, 23 nt, Homo sapiens
aaaauuaaaaacuuaaguaccaa

SEQ ID NO: 1364656 - RNA, 19 nt, Homo sapiens
aaaauugaccaagugaugu

SEQ ID NO: 1364657 - RNA, 13 nt, Homo sapiens
aaacacaaaaacc

SEQ ID NO: 1364658 - RNA, 19 nt, Homo sapiens
aaacacagacauucugcca

SEQ ID NO: 1364659 - RNA, 13 nt, Homo sapiens
aaacacuugcaac

SEQ ID NO: 1364660 - RNA, 14 nt, Homo sapiens
aaacagaguauguc

SEQ ID NO: 1364661 - RNA, 14 nt, Homo sapiens
aaacagcugagggu

SEQ ID NO: 1364662 - RNA, 12 nt, Homo sapiens
aaacaggucaau

SEQ ID NO: 1364663 - RNA, 17 nt, Homo sapiens
aaacaucauuacuauaa

SEQ ID NO: 1364664 - RNA, 20 nt, Homo sapiens
aaacaugugguuaaugccau

SEQ ID NO: 1364665 - RNA, 16 nt, Homo sapiens
aaaccuaggucuccag

SEQ ID NO: 1364666 - RNA, 13 nt, Homo sapiens
aaacuacauuuua

SEQ ID NO: 1364667 - RNA, 19 nt, Homo sapiens
aaacucuucaggcaccuga

SEQ ID NO: 1364668 - RNA, 22 nt, Homo sapiens
aaacugagaaauuuacuacagu

SEQ ID NO: 1364669 - RNA, 13 nt, Homo sapiens
aaacuucaagggu

SEQ ID NO: 1364670 - RNA, 23 nt, Homo sapiens
aaagaaaaauaucuuggccuaaa

SEQ ID NO: 1364671 - RNA, 21 nt, Homo sapiens
aaagaagcugucuuggaaguc

SEQ ID NO: 1364672 - RNA, 13 nt, Homo sapiens
aaagaagguuuca

SEQ ID NO: 1364673 - RNA, 14 nt, Homo sapiens
aaagaaguggggac

SEQ ID NO: 1364674 - RNA, 14 nt, Homo sapiens
aaagacuguagaag

SEQ ID NO: 1364675 - RNA, 13 nt, Homo sapiens
aaagagaaaaaga

SEQ ID NO: 1364676 - RNA, 16 nt, Homo sapiens
aaagagguagcacuac

SEQ ID NO: 1364677 - RNA, 19 nt, Homo sapiens
aaagagguagcacuacaaa

SEQ ID NO: 1364678 - RNA, 18 nt, Homo sapiens
aaagaucuugaauagucu

SEQ ID NO: 1364679 - RNA, 20 nt, Homo sapiens
aaagaucuugaauagucuca

SEQ ID NO: 1364680 - RNA, 22 nt, Homo sapiens
aaagaucuugaauagucucauc

SEQ ID NO: 1364681 - RNA, 21 nt, Homo sapiens
aaagaucuuucaggacucuac

SEQ ID NO: 1364682 - RNA, 22 nt, Homo sapiens
aaagaugcauuaucuaugauau

SEQ ID NO: 1364683 - RNA, 15 nt, Homo sapiens
aaagauuugugaacu

SEQ ID NO: 1364684 - RNA, 19 nt, Homo sapiens
aaagcaaaaggcugagaag

SEQ ID NO: 1364685 - RNA, 21 nt, Homo sapiens
aaagcaacaaagauugagaag

SEQ ID NO: 1364686 - RNA, 14 nt, Homo sapiens
aaagcccaaggugc

SEQ ID NO: 1364687 - RNA, 17 nt, Homo sapiens
aaagccucugugcugca

SEQ ID NO: 1364688 - RNA, 16 nt, Homo sapiens
aaagcugagccugcag

SEQ ID NO: 1364689 - RNA, 23 nt, Homo sapiens
aaagcuuggagggaagccgugaa

SEQ ID NO: 1364690 - RNA, 13 nt, Homo sapiens
aaaggaaacuacu

SEQ ID NO: 1364691 - RNA, 22 nt, Homo sapiens
aaaggaaauaagagcagucaca

SEQ ID NO: 1364692 - RNA, 16 nt, Homo sapiens
aaaggaauccucugug

SEQ ID NO: 1364693 - RNA, 17 nt, Homo sapiens
aaaggaauccucugugu

SEQ ID NO: 1364694 - RNA, 23 nt, Homo sapiens
aaaggaguaugugugccagcugu

SEQ ID NO: 1364695 - RNA, 15 nt, Homo sapiens
aaaggcugguggcaa

SEQ ID NO: 1364696 - RNA, 22 nt, Homo sapiens
aaaggucauuuacaguuccaaa

SEQ ID NO: 1364697 - RNA, 12 nt, Homo sapiens
aaaggugcuguu

SEQ ID NO: 1364698 - RNA, 15 nt, Homo sapiens
aaaguaucugagauu

SEQ ID NO: 1364699 - RNA, 12 nt, Homo sapiens
aaaguauuguaa

SEQ ID NO: 1364700 - RNA, 15 nt, Homo sapiens
aaagucuugccuugc

SEQ ID NO: 1364701 - RNA, 15 nt, Homo sapiens
aaagugacuauucag

SEQ ID NO: 1364702 - RNA, 21 nt, Homo sapiens
aaagugacucacuuaucccaa

SEQ ID NO: 1364703 - RNA, 23 nt, Homo sapiens
aaagugacucacuuaucccaaga

SEQ ID NO: 1364704 - RNA, 14 nt, Homo sapiens
aaaguuaacuacac

SEQ ID NO: 1364705 - RNA, 17 nt, Homo sapiens
aaauaagagcagucaca

SEQ ID NO: 1364706 - RNA, 19 nt, Homo sapiens
aaauaccacaagccugaga

SEQ ID NO: 1364707 - RNA, 18 nt, Homo sapiens
aaauagaagacauauaaa

SEQ ID NO: 1364708 - RNA, 18 nt, Homo sapiens
aaauagagugcauuugaa

SEQ ID NO: 1364709 - RNA, 16 nt, Homo sapiens
aaauagcccuguaaca

SEQ ID NO: 1364710 - RNA, 21 nt, Homo sapiens
aaauaguuuggauuacuuaaa

SEQ ID NO: 1364711 - RNA, 14 nt, Homo sapiens
aaauauguccuggg

SEQ ID NO: 1364712 - RNA, 21 nt, Homo sapiens
aaaucaaguuggcuucuaauc

SEQ ID NO: 1364713 - RNA, 23 nt, Homo sapiens
aaaucaggacagguggugcaaau

SEQ ID NO: 1364714 - RNA, 22 nt, Homo sapiens
aaaucccuaagugcaacugcaa

SEQ ID NO: 1364715 - RNA, 15 nt, Homo sapiens
aaauccuacagugaa

SEQ ID NO: 1364716 - RNA, 21 nt, Homo sapiens
aaauccuuagaucuggcaugu

SEQ ID NO: 1364717 - RNA, 12 nt, Homo sapiens
aaaucuagaaga

SEQ ID NO: 1364718 - RNA, 12 nt, Homo sapiens
aaaucuaugaaa

SEQ ID NO: 1364719 - RNA, 20 nt, Homo sapiens
aaaucugagaaacucuacau

SEQ ID NO: 1364720 - RNA, 12 nt, Homo sapiens
aaaucuguaaau

SEQ ID NO: 1364721 - RNA, 11 nt, Homo sapiens
aaaugcaaaau

SEQ ID NO: 1364722 - RNA, 12 nt, Homo sapiens
aaaugcaaaaua

SEQ ID NO: 1364723 - RNA, 23 nt, Homo sapiens
aaaugcccagcuuaaaggggcua

SEQ ID NO: 1364724 - RNA, 22 nt, Homo sapiens
aaauggaacuaucuccaaauuu

SEQ ID NO: 1364725 - RNA, 15 nt, Homo sapiens
aaauggaggccuguc

SEQ ID NO: 1364726 - RNA, 13 nt, Homo sapiens
aaauggggccaga

SEQ ID NO: 1364727 - RNA, 21 nt, Homo sapiens
aaauguaaaauccuacaguga

SEQ ID NO: 1364728 - RNA, 14 nt, Homo sapiens
aaauguuugugaug

SEQ ID NO: 1364729 - RNA, 13 nt, Homo sapiens
aaauuaaagcuga

SEQ ID NO: 1364730 - RNA, 14 nt, Homo sapiens
aaauuauccaugcc

SEQ ID NO: 1364731 - RNA, 13 nt, Homo sapiens
aaauuccacagau

SEQ ID NO: 1364732 - RNA, 16 nt, Homo sapiens
aaauuccacagauuau

SEQ ID NO: 1364733 - RNA, 21 nt, Homo sapiens
aaauucuguuuuucuaggccu

SEQ ID NO: 1364734 - RNA, 15 nt, Homo sapiens
aaauuuugagauuaa

SEQ ID NO: 1364735 - RNA, 21 nt, Homo sapiens
aacaaaaaaaccucuaugcaa

SEQ ID NO: 1364736 - RNA, 13 nt, Homo sapiens
agaugcagucucu

SEQ ID NO: 1364737 - RNA, 23 nt, Homo sapiens
agaugcagucucugcugaucaca

SEQ ID NO: 1364738 - RNA, 10 nt, Homo sapiens
agaugcauua

SEQ ID NO: 1364739 - RNA, 20 nt, Homo sapiens
agaugccacccaguugugac

SEQ ID NO: 1364740 - RNA, 19 nt, Homo sapiens
agaugccacuagcccuccu

SEQ ID NO: 1364741 - RNA, 20 nt, Homo sapiens
agaugcugguuuucuaccca

SEQ ID NO: 1364742 - RNA, 21 nt, Homo sapiens
agauggagucuggcucugucu

SEQ ID NO: 1364743 - RNA, 19 nt, Homo sapiens
agauguccucagaagucag

SEQ ID NO: 1364744 - RNA, 19 nt, Homo sapiens
agauguuguagacugagau

SEQ ID NO: 1364745 - RNA, 12 nt, Homo sapiens
agauuacccaaa

SEQ ID NO: 1364746 - RNA, 12 nt, Homo sapiens
agauuaggucuu

SEQ ID NO: 1364747 - RNA, 19 nt, Homo sapiens
agauucuuuggcuguguuu

SEQ ID NO: 1364748 - RNA, 19 nt, Homo sapiens
agauuuaugcuccuuauga

SEQ ID NO: 1364749 - RNA, 15 nt, Homo sapiens
agauuucucugagau

SEQ ID NO: 1364750 - RNA, 17 nt, Homo sapiens
agcaaacaaaauggacu

SEQ ID NO: 1364751 - RNA, 12 nt, Homo sapiens
agcaaagacuuu

SEQ ID NO: 1364752 - RNA, 17 nt, Homo sapiens
agcaaagcuccugccuc

SEQ ID NO: 1364753 - RNA, 13 nt, Homo sapiens
agcaaagggcuca

SEQ ID NO: 1364754 - RNA, 19 nt, Homo sapiens
agcaagaucccaucucuuu

SEQ ID NO: 1364755 - RNA, 13 nt, Homo sapiens
agcaaguguucac

SEQ ID NO: 1364756 - RNA, 14 nt, Homo sapiens
agcaauaagcacuc

SEQ ID NO: 1364757 - RNA, 15 nt, Homo sapiens
agcaauucucuuucu

SEQ ID NO: 1364758 - RNA, 20 nt, Homo sapiens
agcacgcuaccaaaucucaa

SEQ ID NO: 1364759 - RNA, 12 nt, Homo sapiens
agcacuuugcaa

SEQ ID NO: 1364760 - RNA, 14 nt, Homo sapiens
agcagaacuuucac

SEQ ID NO: 1364761 - RNA, 20 nt, Homo sapiens
agcagaggaccagggccuuu

SEQ ID NO: 1364762 - RNA, 19 nt, Homo sapiens
agcagaugcaaagaggcaa

SEQ ID NO: 1364763 - RNA, 15 nt, Homo sapiens
agcaggaagcucaga

SEQ ID NO: 1364764 - RNA, 19 nt, Homo sapiens
agcaggacuuugaggcaag

SEQ ID NO: 1364765 - RNA, 17 nt, Homo sapiens
agcaggaugcucaguga

SEQ ID NO: 1364766 - RNA, 24 nt, Homo sapiens
agcaguuggcuggaauguguucac

SEQ ID NO: 1364767 - RNA, 21 nt, Homo sapiens
agcauggaaaaucagugacau

SEQ ID NO: 1364768 - RNA, 14 nt, Homo sapiens
agccagaagcugag

SEQ ID NO: 1364769 - RNA, 14 nt, Homo sapiens
agccagugggagau

SEQ ID NO: 1364770 - RNA, 14 nt, Homo sapiens
agcccaaagccaag

SEQ ID NO: 1364771 - RNA, 15 nt, Homo sapiens
agcccaacugugaga

SEQ ID NO: 1364772 - RNA, 13 nt, Homo sapiens
agcccaccccuca

SEQ ID NO: 1364773 - RNA, 22 nt, Homo sapiens
agcccacccugcugcuggugca

SEQ ID NO: 1364774 - RNA, 22 nt, Homo sapiens
agcccagggcuccugcacuuac

SEQ ID NO: 1364775 - RNA, 15 nt, Homo sapiens
agccccaucagcucc

SEQ ID NO: 1364776 - RNA, 16 nt, Homo sapiens
agcccuaagacguccc

SEQ ID NO: 1364777 - RNA, 19 nt, Homo sapiens
agcccuccucucccaguga

SEQ ID NO: 1364778 - RNA, 15 nt, Homo sapiens
agcccugagcuuucu

SEQ ID NO: 1364779 - RNA, 15 nt, Homo sapiens
agccgccauugccac

SEQ ID NO: 1364780 - RNA, 14 nt, Homo sapiens
agccggcacagggu

SEQ ID NO: 1364781 - RNA, 23 nt, Homo sapiens
agccucugaucuggcagacucau

SEQ ID NO: 1364782 - RNA, 13 nt, Homo sapiens
agccucuggcuag

SEQ ID NO: 1364783 - RNA, 13 nt, Homo sapiens
agccugcagggaa

SEQ ID NO: 1364784 - RNA, 13 nt, Homo sapiens
agccugcagucau

SEQ ID NO: 1364785 - RNA, 14 nt, Homo sapiens
agccugcagucauc

SEQ ID NO: 1364786 - RNA, 13 nt, Homo sapiens
agccugccuuuaa

SEQ ID NO: 1364787 - RNA, 17 nt, Homo sapiens
agccugcuccagcuguu

SEQ ID NO: 1364788 - RNA, 14 nt, Homo sapiens
agccugcugcaugg

SEQ ID NO: 1364789 - RNA, 15 nt, Homo sapiens
agccuggacugcuac

SEQ ID NO: 1364790 - RNA, 16 nt, Homo sapiens
agccuggacugcuacc

SEQ ID NO: 1364791 - RNA, 20 nt, Homo sapiens
agccuggccagacacaggcc

SEQ ID NO: 1364792 - RNA, 22 nt, Homo sapiens
agccugguuuuuaaguacucac

SEQ ID NO: 1364793 - RNA, 15 nt, Homo sapiens
agccugugcaaaaaa

SEQ ID NO: 1364794 - RNA, 23 nt, Homo sapiens
agccugugucuuuaaaugcugcu

SEQ ID NO: 1364795 - RNA, 21 nt, Homo sapiens
agccuguuacaggaaugaagu

SEQ ID NO: 1364796 - RNA, 19 nt, Homo sapiens
agccuuaaagauacuugaa

SEQ ID NO: 1364797 - RNA, 17 nt, Homo sapiens
agccuucaagugccaaa

SEQ ID NO: 1364798 - RNA, 23 nt, Homo sapiens
agcggccacggugccuccagaug

SEQ ID NO: 1364799 - RNA, 14 nt, Homo sapiens
agcuaggaugguuc

SEQ ID NO: 1364800 - RNA, 15 nt, Homo sapiens
agcuaggaugguucu

SEQ ID NO: 1364801 - RNA, 13 nt, Homo sapiens
agcucaucucagc

SEQ ID NO: 1364802 - RNA, 16 nt, Homo sapiens
agcuccacugccaugu

SEQ ID NO: 1364803 - RNA, 21 nt, Homo sapiens
agcuccauggcgaaaggagug

SEQ ID NO: 1364804 - RNA, 13 nt, Homo sapiens
agcuccugccucu

SEQ ID NO: 1364805 - RNA, 18 nt, Homo sapiens
agcucugcggcuugccac

SEQ ID NO: 1364806 - RNA, 23 nt, Homo sapiens
agcucugcggcuugccacucuga

SEQ ID NO: 1364807 - RNA, 13 nt, Homo sapiens
agcugaaccuggg

SEQ ID NO: 1364808 - RNA, 16 nt, Homo sapiens
agcugaccagccguga

SEQ ID NO: 1364809 - RNA, 14 nt, Homo sapiens
agcugacuacggaa

SEQ ID NO: 1364810 - RNA, 15 nt, Homo sapiens
agcugagugcugaaa

SEQ ID NO: 1364811 - RNA, 22 nt, Homo sapiens
agcugaucgacgaggaggagug

SEQ ID NO: 1364812 - RNA, 19 nt, Homo sapiens
agcugcuccuagagggagg

SEQ ID NO: 1364813 - RNA, 15 nt, Homo sapiens
agcugcugacugcca

SEQ ID NO: 1364814 - RNA, 20 nt, Homo sapiens
agcuggcccugcagguggug

SEQ ID NO: 1364815 - RNA, 23 nt, Homo sapiens
agcugucccuugcuugccugcag

SEQ ID NO: 1364816 - RNA, 12 nt, Homo sapiens
agcuguucucug

SEQ ID NO: 1364817 - RNA, 22 nt, Homo sapiens
agcuuaggggcugcugaccucc

SEQ ID NO: 1364818 - RNA, 12 nt, Homo sapiens
agcuuaucucag

SEQ ID NO: 1364819 - RNA, 12 nt, Homo sapiens
agcuuugcugcu

SEQ ID NO: 1364820 - RNA, 19 nt, Homo sapiens
aggaaaaaauaaaagaucu

SEQ ID NO: 1364821 - RNA, 13 nt, Homo sapiens
aggaaaaccucaa

SEQ ID NO: 1364822 - RNA, 18 nt, Homo sapiens
aggaaaagggcaaaaaga

SEQ ID NO: 1364823 - RNA, 20 nt, Homo sapiens
aggaaacccagcucacagga

SEQ ID NO: 1364824 - RNA, 22 nt, Homo sapiens
aggaaagauuugugaacuggaa

SEQ ID NO: 1364825 - RNA, 23 nt, Homo sapiens
aggaaauccauucacaguucuuu

SEQ ID NO: 1364826 - RNA, 18 nt, Homo sapiens
aggaagcaccccaugcca

SEQ ID NO: 1364827 - RNA, 20 nt, Homo sapiens
aggaagcucagacugguuga

SEQ ID NO: 1364828 - RNA, 16 nt, Homo sapiens
aggaaggguggcuuug

SEQ ID NO: 1364829 - RNA, 21 nt, Homo sapiens
aggaauccucugugucuucaa

SEQ ID NO: 1364830 - RNA, 16 nt, Homo sapiens
aggaauuaaugugauu

SEQ ID NO: 1364831 - RNA, 15 nt, Homo sapiens
aggaccuuuccacca

SEQ ID NO: 1364832 - RNA, 13 nt, Homo sapiens
aggacgcgcacuc

SEQ ID NO: 1364833 - RNA, 13 nt, Homo sapiens
aggacucaaaagu

SEQ ID NO: 1364834 - RNA, 19 nt, Homo sapiens
aggacucccuccucaccuc

SEQ ID NO: 1364835 - RNA, 15 nt, Homo sapiens
aggagacuagauugc

SEQ ID NO: 1364836 - RNA, 15 nt, Homo sapiens
aggagcaagcuugcu

SEQ ID NO: 1364837 - RNA, 21 nt, Homo sapiens
aggagccauugcucuccuaga

SEQ ID NO: 1364838 - RNA, 13 nt, Homo sapiens
aggaggagugcau

SEQ ID NO: 1364839 - RNA, 17 nt, Homo sapiens
aggaggcuggcagguau

SEQ ID NO: 1364840 - RNA, 18 nt, Homo sapiens
aggagggcagaucacuuc

SEQ ID NO: 1364841 - RNA, 16 nt, Homo sapiens
aggagguggguggaaa

SEQ ID NO: 1364842 - RNA, 15 nt, Homo sapiens
aggaguggggugguu

SEQ ID NO: 1364843 - RNA, 14 nt, Homo sapiens
aggauagaugcugg

SEQ ID NO: 1364844 - RNA, 17 nt, Homo sapiens
aggaugcagcacugcgc

SEQ ID NO: 1364845 - RNA, 13 nt, Homo sapiens
aggcacagaugaa

SEQ ID NO: 1364846 - RNA, 23 nt, Homo sapiens
aggcagaucugugccccaugccu

SEQ ID NO: 1364847 - RNA, 23 nt, Homo sapiens
aggcagugaugcuggaugcuccu

SEQ ID NO: 1364848 - RNA, 17 nt, Homo sapiens
aggcaucucuguacuuu

SEQ ID NO: 1364849 - RNA, 14 nt, Homo sapiens
aggcaugcuggagu

SEQ ID NO: 1364850 - RNA, 14 nt, Homo sapiens
aggccagagccaag

SEQ ID NO: 1364851 - RNA, 19 nt, Homo sapiens
aggccagcuggcagcagag

SEQ ID NO: 1364852 - RNA, 20 nt, Homo sapiens
aggcccaguucacccugauu

SEQ ID NO: 1364853 - RNA, 14 nt, Homo sapiens
augcauggaaaaug

SEQ ID NO: 1364854 - RNA, 22 nt, Homo sapiens
augcauggugccccaggaccag

SEQ ID NO: 1364855 - RNA, 23 nt, Homo sapiens
augccaauaacacguccacuuuc

SEQ ID NO: 1364856 - RNA, 16 nt, Homo sapiens
augccagcuuaucuca

SEQ ID NO: 1364857 - RNA, 19 nt, Homo sapiens
augccagcuuaucucaggg

SEQ ID NO: 1364858 - RNA, 18 nt, Homo sapiens
augccgguuaaauuccau

SEQ ID NO: 1364859 - RNA, 14 nt, Homo sapiens
augcggccauucaa

SEQ ID NO: 1364860 - RNA, 13 nt, Homo sapiens
augcuccuuccaa

SEQ ID NO: 1364861 - RNA, 20 nt, Homo sapiens
augcugaccauccaggcaua

SEQ ID NO: 1364862 - RNA, 22 nt, Homo sapiens
augcuggaaaauaauacugcug

SEQ ID NO: 1364863 - RNA, 20 nt, Homo sapiens
augcuggaaccugcaaaaaa

SEQ ID NO: 1364864 - RNA, 12 nt, Homo sapiens
augcuuugcccc

SEQ ID NO: 1364865 - RNA, 22 nt, Homo sapiens
augcuuuguucagccugccuuc

SEQ ID NO: 1364866 - RNA, 17 nt, Homo sapiens
auggaaaaacugaggcu

SEQ ID NO: 1364867 - RNA, 17 nt, Homo sapiens
auggaaaagggagauuc

SEQ ID NO: 1364868 - RNA, 20 nt, Homo sapiens
auggaaguuuuccuacacuu

SEQ ID NO: 1364869 - RNA, 23 nt, Homo sapiens
auggacaugcuucagugcugcuc

SEQ ID NO: 1364870 - RNA, 13 nt, Homo sapiens
auggacuguacua

SEQ ID NO: 1364871 - RNA, 18 nt, Homo sapiens
auggaugggggaacucag

SEQ ID NO: 1364872 - RNA, 14 nt, Homo sapiens
auggauuuccagcc

SEQ ID NO: 1364873 - RNA, 21 nt, Homo sapiens
auggauuugaaugaaaugcca

SEQ ID NO: 1364874 - RNA, 22 nt, Homo sapiens
auggcacagcccaaagaaggaa

SEQ ID NO: 1364875 - RNA, 15 nt, Homo sapiens
auggcugccaucuca

SEQ ID NO: 1364876 - RNA, 15 nt, Homo sapiens
augggaagcagggaa

SEQ ID NO: 1364877 - RNA, 21 nt, Homo sapiens
augggagccuuuaccuuuuau

SEQ ID NO: 1364878 - RNA, 18 nt, Homo sapiens
auggggugggguagggcu

SEQ ID NO: 1364879 - RNA, 16 nt, Homo sapiens
augguccuuucuggaa

SEQ ID NO: 1364880 - RNA, 22 nt, Homo sapiens
auggugccccaggaccagcuca

SEQ ID NO: 1364881 - RNA, 15 nt, Homo sapiens
auggugugugugucc

SEQ ID NO: 1364882 - RNA, 19 nt, Homo sapiens
auguaaaauccuacaguga

SEQ ID NO: 1364883 - RNA, 13 nt, Homo sapiens
auguaaagccaug

SEQ ID NO: 1364884 - RNA, 16 nt, Homo sapiens
auguacuuguuugcaa

SEQ ID NO: 1364885 - RNA, 22 nt, Homo sapiens
auguagggguuaacuuggucag

SEQ ID NO: 1364886 - RNA, 14 nt, Homo sapiens
augucacucagaug

SEQ ID NO: 1364887 - RNA, 12 nt, Homo sapiens
augucugugcca

SEQ ID NO: 1364888 - RNA, 13 nt, Homo sapiens
augucuuaagauu

SEQ ID NO: 1364889 - RNA, 17 nt, Homo sapiens
augugaguguguggcac

SEQ ID NO: 1364890 - RNA, 21 nt, Homo sapiens
augugcucagggaauaaucca

SEQ ID NO: 1364891 - RNA, 15 nt, Homo sapiens
auguggcccuggcug

SEQ ID NO: 1364892 - RNA, 13 nt, Homo sapiens
augugugauucac

SEQ ID NO: 1364893 - RNA, 16 nt, Homo sapiens
auguguuuuuuuacau

SEQ ID NO: 1364894 - RNA, 16 nt, Homo sapiens
auguuaaaaagugaaa

SEQ ID NO: 1364895 - RNA, 19 nt, Homo sapiens
auguuaauauugugcaaac

SEQ ID NO: 1364896 - RNA, 22 nt, Homo sapiens
auguuaauuuuuugguacaaaa

SEQ ID NO: 1364897 - RNA, 23 nt, Homo sapiens
auguucuuuuuucugucuugucu

SEQ ID NO: 1364898 - RNA, 14 nt, Homo sapiens
auguugcccagugu

SEQ ID NO: 1364899 - RNA, 16 nt, Homo sapiens
auguugcccagugugu

SEQ ID NO: 1364900 - RNA, 21 nt, Homo sapiens
auguuuauaaaucuuaugcuc

SEQ ID NO: 1364901 - RNA, 17 nt, Homo sapiens
auguuuggacacacugg

SEQ ID NO: 1364902 - RNA, 14 nt, Homo sapiens
auguuuuaaucucc

SEQ ID NO: 1364903 - RNA, 16 nt, Homo sapiens
auuaaccacuucagcu

SEQ ID NO: 1364904 - RNA, 22 nt, Homo sapiens
auuaaccuuacuaauuauacua

SEQ ID NO: 1364905 - RNA, 21 nt, Homo sapiens
auuaauuacuucacuauacaa

SEQ ID NO: 1364906 - RNA, 15 nt, Homo sapiens
auuacagagaucuca

SEQ ID NO: 1364907 - RNA, 14 nt, Homo sapiens
auuacugcauaaaa

SEQ ID NO: 1364908 - RNA, 18 nt, Homo sapiens
auuagaacuucaagcucu

SEQ ID NO: 1364909 - RNA, 13 nt, Homo sapiens
auuagaccaagcu

SEQ ID NO: 1364910 - RNA, 16 nt, Homo sapiens
auuagaccaagcuugu

SEQ ID NO: 1364911 - RNA, 19 nt, Homo sapiens
auuagccuaugugcaugca

SEQ ID NO: 1364912 - RNA, 21 nt, Homo sapiens
auuauaaauaaauaccaaaaa

SEQ ID NO: 1364913 - RNA, 18 nt, Homo sapiens
auuauaauuaguuccuca

SEQ ID NO: 1364914 - RNA, 22 nt, Homo sapiens
auuaucuugaauguaguauuca

SEQ ID NO: 1364915 - RNA, 13 nt, Homo sapiens
auuaugaagucau

SEQ ID NO: 1364916 - RNA, 13 nt, Homo sapiens
auuauuaauugca

SEQ ID NO: 1364917 - RNA, 15 nt, Homo sapiens
auucaagaaugccag

SEQ ID NO: 1364918 - RNA, 22 nt, Homo sapiens
auucacucauguuucgugugua

SEQ ID NO: 1364919 - RNA, 22 nt, Homo sapiens
auucagacuguuuuucagggag

SEQ ID NO: 1364920 - RNA, 19 nt, Homo sapiens
auucaucucucuuuaauau

SEQ ID NO: 1364921 - RNA, 16 nt, Homo sapiens
auuccaggaugcugcu

SEQ ID NO: 1364922 - RNA, 13 nt, Homo sapiens
auucuaagugaaa

SEQ ID NO: 1364923 - RNA, 19 nt, Homo sapiens
auucucaugggaaggggag

SEQ ID NO: 1364924 - RNA, 21 nt, Homo sapiens
auucucucaggcuugcugcca

SEQ ID NO: 1364925 - RNA, 18 nt, Homo sapiens
auucugauaaugcucacu

SEQ ID NO: 1364926 - RNA, 16 nt, Homo sapiens
auucugucaaugucuu

SEQ ID NO: 1364927 - RNA, 18 nt, Homo sapiens
auucuguuuuuaaugcua

SEQ ID NO: 1364928 - RNA, 18 nt, Homo sapiens
auucuuuagagauuauaa

SEQ ID NO: 1364929 - RNA, 22 nt, Homo sapiens
auucuuuagagauuauaacaaa

SEQ ID NO: 1364930 - RNA, 21 nt, Homo sapiens
auugacaaccgagaagguuua

SEQ ID NO: 1364931 - RNA, 14 nt, Homo sapiens
auugaccaagugau

SEQ ID NO: 1364932 - RNA, 15 nt, Homo sapiens
auugagaagccaugu

SEQ ID NO: 1364933 - RNA, 21 nt, Homo sapiens
auugagaagccauguacucaa

SEQ ID NO: 1364934 - RNA, 14 nt, Homo sapiens
auugauccaggaga

SEQ ID NO: 1364935 - RNA, 12 nt, Homo sapiens
auugccaaaaag

SEQ ID NO: 1364936 - RNA, 20 nt, Homo sapiens
auugccaccaggagaaccac

SEQ ID NO: 1364937 - RNA, 23 nt, Homo sapiens
auugcuuugccaaaauaccagag

SEQ ID NO: 1364938 - RNA, 14 nt, Homo sapiens
auuggcaaacuaga

SEQ ID NO: 1364939 - RNA, 15 nt, Homo sapiens
auuggcaucagcuga

SEQ ID NO: 1364940 - RNA, 17 nt, Homo sapiens
auuggguaugaacuaaa

SEQ ID NO: 1364941 - RNA, 16 nt, Homo sapiens
auuguacuaaagccaa

SEQ ID NO: 1364942 - RNA, 14 nt, Homo sapiens
auuguacuaauacc

SEQ ID NO: 1364943 - RNA, 15 nt, Homo sapiens
auugucccucugccc

SEQ ID NO: 1364944 - RNA, 20 nt, Homo sapiens
auuuaaaaucagacucuuua

SEQ ID NO: 1364945 - RNA, 15 nt, Homo sapiens
auuuaaauuccacag

SEQ ID NO: 1364946 - RNA, 15 nt, Homo sapiens
auuuaauccgucaca

SEQ ID NO: 1364947 - RNA, 20 nt, Homo sapiens
auuuaguuuguacucagugg

SEQ ID NO: 1364948 - RNA, 21 nt, Homo sapiens
auuuauacuuugcaauccaaa

SEQ ID NO: 1364949 - RNA, 18 nt, Homo sapiens
auuuauauaauacauuaa

SEQ ID NO: 1364950 - RNA, 16 nt, Homo sapiens
auuuauuuacaacuca

SEQ ID NO: 1364951 - RNA, 16 nt, Homo sapiens
auuucaagugccuaga

SEQ ID NO: 1364952 - RNA, 20 nt, Homo sapiens
auuucccuucauacuccuuu

SEQ ID NO: 1364953 - RNA, 19 nt, Homo sapiens
auuucucuaacuccugcca

SEQ ID NO: 1364954 - RNA, 13 nt, Homo sapiens
auuucuucacuca

SEQ ID NO: 1364955 - RNA, 17 nt, Homo sapiens
auuugggccugcuccag

SEQ ID NO: 1364956 - RNA, 17 nt, Homo sapiens
auuuguaaagcuauuua

SEQ ID NO: 1364957 - RNA, 18 nt, Homo sapiens
auuugugaacuggaagaa

SEQ ID NO: 1364958 - RNA, 20 nt, Homo sapiens
auuuguuaaugguuugaaua

SEQ ID NO: 1364959 - RNA, 23 nt, Homo sapiens
auuuuaauagggaauauaucucu

SEQ ID NO: 1364960 - RNA, 14 nt, Homo sapiens
auuuuaauuugaua

SEQ ID NO: 1364961 - RNA, 18 nt, Homo sapiens
auuuuagugaacuugaaa

SEQ ID NO: 1364962 - RNA, 18 nt, Homo sapiens
auuuugggacuucuaccc

SEQ ID NO: 1364963 - RNA, 19 nt, Homo sapiens
auuuuguuuuugucuuaaa

SEQ ID NO: 1364964 - RNA, 13 nt, Homo sapiens
auuuuugaauaca

SEQ ID NO: 1364965 - RNA, 23 nt, Homo sapiens
auuuuuuaaaacaagccaagaaa

SEQ ID NO: 1364966 - RNA, 16 nt, Homo sapiens
caaaaagaccaagaag

SEQ ID NO: 1364967 - RNA, 23 nt, Homo sapiens
caaaacauaaacugagaaaaagu

SEQ ID NO: 1364968 - RNA, 20 nt, Homo sapiens
caaaaggaaggguggcuuug

SEQ ID NO: 1364969 - RNA, 16 nt, Homo sapiens
gccuggacuuuccugc

SEQ ID NO: 1364970 - RNA, 15 nt, Homo sapiens
gccuggcauuucaca

SEQ ID NO: 1364971 - RNA, 22 nt, Homo sapiens
gccugguuuuuaaguacucacu

SEQ ID NO: 1364972 - RNA, 22 nt, Homo sapiens
gccuguacccaguagaugccac

SEQ ID NO: 1364973 - RNA, 11 nt, Homo sapiens
gccuguggcau

SEQ ID NO: 1364974 - RNA, 15 nt, Homo sapiens
gccuucaagugccaa

SEQ ID NO: 1364975 - RNA, 18 nt, Homo sapiens
gccuucuaguuaccacau

SEQ ID NO: 1364976 - RNA, 18 nt, Homo sapiens
gccuugguaaaaacugca

SEQ ID NO: 1364977 - RNA, 13 nt, Homo sapiens
gcgaguucugcca

SEQ ID NO: 1364978 - RNA, 16 nt, Homo sapiens
gcgauuacaggcauga

SEQ ID NO: 1364979 - RNA, 19 nt, Homo sapiens
gcgcagcaucccuagucuc

SEQ ID NO: 1364980 - RNA, 14 nt, Homo sapiens
gcgcgguggcucac

SEQ ID NO: 1364981 - RNA, 15 nt, Homo sapiens
gcggaaagcccugug

SEQ ID NO: 1364982 - RNA, 19 nt, Homo sapiens
gcggagucuguccugugac

SEQ ID NO: 1364983 - RNA, 13 nt, Homo sapiens
gcggaucaucuaa

SEQ ID NO: 1364984 - RNA, 15 nt, Homo sapiens
gcgguuuaucuuuga

SEQ ID NO: 1364985 - RNA, 15 nt, Homo sapiens
gcgucaccuccaggc

SEQ ID NO: 1364986 - RNA, 12 nt, Homo sapiens
gcgucacuguga

SEQ ID NO: 1364987 - RNA, 14 nt, Homo sapiens
gcgucugcacugau

SEQ ID NO: 1364988 - RNA, 16 nt, Homo sapiens
gcgucugcacugauga

SEQ ID NO: 1364989 - RNA, 16 nt, Homo sapiens
gcgugaccagcaguac

SEQ ID NO: 1364990 - RNA, 14 nt, Homo sapiens
gcguggcacucgcu

SEQ ID NO: 1364991 - RNA, 13 nt, Homo sapiens
gcguuaaagucag

SEQ ID NO: 1364992 - RNA, 15 nt, Homo sapiens
gcguuggagacauac

SEQ ID NO: 1364993 - RNA, 22 nt, Homo sapiens
gcuaacuuuuauuaucuucuau

SEQ ID NO: 1364994 - RNA, 12 nt, Homo sapiens
gcucacacagcu

SEQ ID NO: 1364995 - RNA, 14 nt, Homo sapiens
gcucacaccuguaa

SEQ ID NO: 1364996 - RNA, 14 nt, Homo sapiens
gcucagacugguug

SEQ ID NO: 1364997 - RNA, 22 nt, Homo sapiens
gcucagcaaaagaugcuucuca

SEQ ID NO: 1364998 - RNA, 19 nt, Homo sapiens
gcucagggaauaauccaga

SEQ ID NO: 1364999 - RNA, 17 nt, Homo sapiens
gcucauagaucagcaaa

SEQ ID NO: 1365000 - RNA, 22 nt, Homo sapiens
gcuccaaccugcaaagaucugu

SEQ ID NO: 1365001 - RNA, 12 nt, Homo sapiens
gcucccaugacc

SEQ ID NO: 1365002 - RNA, 12 nt, Homo sapiens
gcuccuaccugg

SEQ ID NO: 1365003 - RNA, 21 nt, Homo sapiens
gcuccucuccccagcccagag

SEQ ID NO: 1365004 - RNA, 15 nt, Homo sapiens
gcuccugaggggcau

SEQ ID NO: 1365005 - RNA, 19 nt, Homo sapiens
gcucugcguuggcuucucc

SEQ ID NO: 1365006 - RNA, 21 nt, Homo sapiens
gcucugguggccacugagcug

SEQ ID NO: 1365007 - RNA, 19 nt, Homo sapiens
gcucuguacugcacuuaga

SEQ ID NO: 1365008 - RNA, 16 nt, Homo sapiens
gcucugucuucuuugc

SEQ ID NO: 1365009 - RNA, 18 nt, Homo sapiens
gcucuuucucugccagug

SEQ ID NO: 1365010 - RNA, 14 nt, Homo sapiens
gcugagagugcuau

SEQ ID NO: 1365011 - RNA, 16 nt, Homo sapiens
gcugagcaccagggga

SEQ ID NO: 1365012 - RNA, 16 nt, Homo sapiens
gcugaggcaagagaau

SEQ ID NO: 1365013 - RNA, 18 nt, Homo sapiens
gcugaguugguguugaca

SEQ ID NO: 1365014 - RNA, 13 nt, Homo sapiens
gcugauggugugg

SEQ ID NO: 1365015 - RNA, 19 nt, Homo sapiens
gcugccuguuguuaugggu

SEQ ID NO: 1365016 - RNA, 19 nt, Homo sapiens
gcugcuuccuccuggaaau

SEQ ID NO: 1365017 - RNA, 12 nt, Homo sapiens
gcuggaaccugc

SEQ ID NO: 1365018 - RNA, 15 nt, Homo sapiens
gcuggaauuaugcug

SEQ ID NO: 1365019 - RNA, 15 nt, Homo sapiens
gcuggagagcacugc

SEQ ID NO: 1365020 - RNA, 16 nt, Homo sapiens
gcugggcagaccccuc

SEQ ID NO: 1365021 - RNA, 15 nt, Homo sapiens
gcugggccccuucca

SEQ ID NO: 1365022 - RNA, 21 nt, Homo sapiens
gcugguucugcaaugacugca

SEQ ID NO: 1365023 - RNA, 15 nt, Homo sapiens
gcugucacuugccca

SEQ ID NO: 1365024 - RNA, 14 nt, Homo sapiens
gcuguggacuauua

SEQ ID NO: 1365025 - RNA, 20 nt, Homo sapiens
gcuuaaaggggcuagaguga

SEQ ID NO: 1365026 - RNA, 13 nt, Homo sapiens
gcuucagugcugc

SEQ ID NO: 1365027 - RNA, 21 nt, Homo sapiens
gcuucccagcaccaacaugua

SEQ ID NO: 1365028 - RNA, 13 nt, Homo sapiens
gcuuccuccugcc

SEQ ID NO: 1365029 - RNA, 12 nt, Homo sapiens
gcuucuaccugc

SEQ ID NO: 1365030 - RNA, 17 nt, Homo sapiens
gcuucuagaguuuuaua

SEQ ID NO: 1365031 - RNA, 18 nt, Homo sapiens
gcuucucugacuucugcc

SEQ ID NO: 1365032 - RNA, 23 nt, Homo sapiens
gcuugauugcguggaauugugcu

SEQ ID NO: 1365033 - RNA, 22 nt, Homo sapiens
gcuuguccccuccucacucccu

SEQ ID NO: 1365034 - RNA, 14 nt, Homo sapiens
gcuuuaacuauauc

SEQ ID NO: 1365035 - RNA, 18 nt, Homo sapiens
gcuuucacauuguacuua

SEQ ID NO: 1365036 - RNA, 21 nt, Homo sapiens
gcuuuccuggucccucacccc

SEQ ID NO: 1365037 - RNA, 15 nt, Homo sapiens
gcuuuggaguuuuaa

SEQ ID NO: 1365038 - RNA, 20 nt, Homo sapiens
gcuuuggugagaaccugggu

SEQ ID NO: 1365039 - RNA, 12 nt, Homo sapiens
gcuuuguucuga

SEQ ID NO: 1365040 - RNA, 13 nt, Homo sapiens
ggaaaacaguauu

SEQ ID NO: 1365041 - RNA, 15 nt, Homo sapiens
ggaaacgagcugugu

SEQ ID NO: 1365042 - RNA, 15 nt, Homo sapiens
ggaaagaacugucau

SEQ ID NO: 1365043 - RNA, 16 nt, Homo sapiens
ggaaagauuugugaac

SEQ ID NO: 1365044 - RNA, 15 nt, Homo sapiens
ggaaagcagcucaaa

SEQ ID NO: 1365045 - RNA, 21 nt, Homo sapiens
ggaaaggagggaggaugcugu

SEQ ID NO: 1365046 - RNA, 17 nt, Homo sapiens
ggaaaggugguguuucu

SEQ ID NO: 1365047 - RNA, 16 nt, Homo sapiens
ggaaaguucuugacag

SEQ ID NO: 1365048 - RNA, 23 nt, Homo sapiens
ggaaauagcccuguaacaggcuu

SEQ ID NO: 1365049 - RNA, 21 nt, Homo sapiens
ggaacauuggagcugacuguu

SEQ ID NO: 1365050 - RNA, 16 nt, Homo sapiens
ggaacccagacucaga

SEQ ID NO: 1365051 - RNA, 23 nt, Homo sapiens
ggaaccgcaggaagcugcuccgu

SEQ ID NO: 1365052 - RNA, 21 nt, Homo sapiens
ggaaccucagccuggccagac

SEQ ID NO: 1365053 - RNA, 21 nt, Homo sapiens
ggaagaaaaagcaaguguuca

SEQ ID NO: 1365054 - RNA, 15 nt, Homo sapiens
ggaagacaaugugaa

SEQ ID NO: 1365055 - RNA, 12 nt, Homo sapiens
ggaagagguggc

SEQ ID NO: 1365056 - RNA, 17 nt, Homo sapiens
ggaagucugucucagga

SEQ ID NO: 1365057 - RNA, 20 nt, Homo sapiens
ggaaguuucuggugccauuu

SEQ ID NO: 1365058 - RNA, 21 nt, Homo sapiens
ggaauagaucguagauguugu

SEQ ID NO: 1365059 - RNA, 23 nt, Homo sapiens
ggaaucucugcaaucugugucau

SEQ ID NO: 1365060 - RNA, 12 nt, Homo sapiens
ggacaagggauu

SEQ ID NO: 1365061 - RNA, 17 nt, Homo sapiens
ggacaggauguguuugc

SEQ ID NO: 1365062 - RNA, 17 nt, Homo sapiens
ggacauaaugggguccu

SEQ ID NO: 1365063 - RNA, 15 nt, Homo sapiens
ggacaucacagggug

SEQ ID NO: 1365064 - RNA, 15 nt, Homo sapiens
ggaccagcucaggac

SEQ ID NO: 1365065 - RNA, 14 nt, Homo sapiens
ggaccccugcccuu

SEQ ID NO: 1365066 - RNA, 17 nt, Homo sapiens
ggacguggguugcacug

SEQ ID NO: 1365067 - RNA, 21 nt, Homo sapiens
ggacuauggcucuacuuucag

SEQ ID NO: 1365068 - RNA, 18 nt, Homo sapiens
ggacuuccuguccagcuc

SEQ ID NO: 1365069 - RNA, 16 nt, Homo sapiens
ggacuuuccugcaacu

SEQ ID NO: 1365070 - RNA, 18 nt, Homo sapiens
ggagaaguugaggggagc

SEQ ID NO: 1365071 - RNA, 19 nt, Homo sapiens
ggagacugcauucccugcc

SEQ ID NO: 1365072 - RNA, 14 nt, Homo sapiens
ggagagagacucca

SEQ ID NO: 1365073 - RNA, 19 nt, Homo sapiens
ggagccuccaauugcagug

SEQ ID NO: 1365074 - RNA, 12 nt, Homo sapiens
ggagcucagagc

SEQ ID NO: 1365075 - RNA, 15 nt, Homo sapiens
ggagcuccacugcca

SEQ ID NO: 1365076 - RNA, 20 nt, Homo sapiens
ggagcugggcagaaggccaa

SEQ ID NO: 1365077 - RNA, 21 nt, Homo sapiens
ggaggagccggggacucccag

SEQ ID NO: 1365078 - RNA, 17 nt, Homo sapiens
ggaggcugcgugccagu

SEQ ID NO: 1365079 - RNA, 17 nt, Homo sapiens
ggagggacacuuaccca

SEQ ID NO: 1365080 - RNA, 17 nt, Homo sapiens
ggaggugauuccaguga

SEQ ID NO: 1365081 - RNA, 15 nt, Homo sapiens
ggaguggccacuaag

SEQ ID NO: 1365082 - RNA, 21 nt, Homo sapiens
ggauacauaaugggccacuga

SEQ ID NO: 1365083 - RNA, 20 nt, Homo sapiens
ggauauaagugauaguuuau

SEQ ID NO: 1365084 - RNA, 13 nt, Homo sapiens
ggaugucugccac

SEQ ID NO: 1365085 - RNA, 23 nt, Homo sapiens
ggauuccccaucucaggccagag

SEQ ID NO: 1365086 - RNA, 18 nt, Homo sapiens
ucagauuauaacuguugu

SEQ ID NO: 1365087 - RNA, 14 nt, Homo sapiens
ucagauucaugaaa

SEQ ID NO: 1365088 - RNA, 22 nt, Homo sapiens
ucagccuggccagacacaggcc

SEQ ID NO: 1365089 - RNA, 12 nt, Homo sapiens
ucagcugccuca

SEQ ID NO: 1365090 - RNA, 18 nt, Homo sapiens
ucagcuggaucuccauuc

SEQ ID NO: 1365091 - RNA, 21 nt, Homo sapiens
ucagcuggaucuccauucucu

SEQ ID NO: 1365092 - RNA, 14 nt, Homo sapiens
ucaggacagaugcc

SEQ ID NO: 1365093 - RNA, 17 nt, Homo sapiens
ucaggacagaugccaca

SEQ ID NO: 1365094 - RNA, 20 nt, Homo sapiens
ucaggaugauacacuaugaa

SEQ ID NO: 1365095 - RNA, 19 nt, Homo sapiens
ucagggaccccugcccuug

SEQ ID NO: 1365096 - RNA, 18 nt, Homo sapiens
ucagggcugagaggagaa

SEQ ID NO: 1365097 - RNA, 19 nt, Homo sapiens
ucaggugaagcuggagcuc

SEQ ID NO: 1365098 - RNA, 17 nt, Homo sapiens
ucaguuaauucuuagau

SEQ ID NO: 1365099 - RNA, 23 nt, Homo sapiens
ucauaaagucuuugaagugacuu

SEQ ID NO: 1365100 - RNA, 16 nt, Homo sapiens
ucauaacucugugauc

SEQ ID NO: 1365101 - RNA, 18 nt, Homo sapiens
ucauaauuucuucacuca

SEQ ID NO: 1365102 - RNA, 20 nt, Homo sapiens
ucauauuuauacuuugcaau

SEQ ID NO: 1365103 - RNA, 13 nt, Homo sapiens
ucauccaaaaagu

SEQ ID NO: 1365104 - RNA, 15 nt, Homo sapiens
ucaucuagcgcaauu

SEQ ID NO: 1365105 - RNA, 20 nt, Homo sapiens
ucaugagcauuuguuuaaua

SEQ ID NO: 1365106 - RNA, 22 nt, Homo sapiens
ucaugaugcuagccagcaaaga

SEQ ID NO: 1365107 - RNA, 19 nt, Homo sapiens
ucaugggaaggggaggacc

SEQ ID NO: 1365108 - RNA, 13 nt, Homo sapiens
ucauucauccuga

SEQ ID NO: 1365109 - RNA, 20 nt, Homo sapiens
ucauuccuuagauaccuuga

SEQ ID NO: 1365110 - RNA, 21 nt, Homo sapiens
ucauuccuuagauaccuugaa

SEQ ID NO: 1365111 - RNA, 13 nt, Homo sapiens
ucauucuacugaa

SEQ ID NO: 1365112 - RNA, 22 nt, Homo sapiens
ucauuuuauggaagauguguga

SEQ ID NO: 1365113 - RNA, 12 nt, Homo sapiens
uccaaaaacugu

SEQ ID NO: 1365114 - RNA, 18 nt, Homo sapiens
uccaaagcccucccuacc

SEQ ID NO: 1365115 - RNA, 12 nt, Homo sapiens
uccaaaggcagc

SEQ ID NO: 1365116 - RNA, 12 nt, Homo sapiens
uccaaauccauc

SEQ ID NO: 1365117 - RNA, 15 nt, Homo sapiens
uccaacaugugcuca

SEQ ID NO: 1365118 - RNA, 13 nt, Homo sapiens
uccaagcuguuag

SEQ ID NO: 1365119 - RNA, 17 nt, Homo sapiens
uccacaaaaucugucca

SEQ ID NO: 1365120 - RNA, 14 nt, Homo sapiens
uccaccccauguca

SEQ ID NO: 1365121 - RNA, 21 nt, Homo sapiens
uccacccuuggccugucucau

SEQ ID NO: 1365122 - RNA, 17 nt, Homo sapiens
uccacucuacccuccca

SEQ ID NO: 1365123 - RNA, 18 nt, Homo sapiens
uccacuuuaugugcaucu

SEQ ID NO: 1365124 - RNA, 19 nt, Homo sapiens
uccagaaaacaaaacugca

SEQ ID NO: 1365125 - RNA, 14 nt, Homo sapiens
uccagaacacggcu

SEQ ID NO: 1365126 - RNA, 17 nt, Homo sapiens
uccagcuaccaccacgg

SEQ ID NO: 1365127 - RNA, 23 nt, Homo sapiens
uccagcugcucugucuucuuugc

SEQ ID NO: 1365128 - RNA, 18 nt, Homo sapiens
uccaggaaccacaccaca

SEQ ID NO: 1365129 - RNA, 14 nt, Homo sapiens
uccaggaucuuuga

SEQ ID NO: 1365130 - RNA, 19 nt, Homo sapiens
uccauacccacaaucugag

SEQ ID NO: 1365131 - RNA, 19 nt, Homo sapiens
uccaucccccguggccauu

SEQ ID NO: 1365132 - RNA, 18 nt, Homo sapiens
uccaucuagucacaaaga

SEQ ID NO: 1365133 - RNA, 15 nt, Homo sapiens
uccaugcucuugacc

SEQ ID NO: 1365134 - RNA, 16 nt, Homo sapiens
ucccaaagaccuccac

SEQ ID NO: 1365135 - RNA, 14 nt, Homo sapiens
ucccaaaguguccu

SEQ ID NO: 1365136 - RNA, 19 nt, Homo sapiens
ucccaggcuggagugcagu

SEQ ID NO: 1365137 - RNA, 13 nt, Homo sapiens
ucccagugacaac

SEQ ID NO: 1365138 - RNA, 17 nt, Homo sapiens
ucccauccuugaugcaa

SEQ ID NO: 1365139 - RNA, 15 nt, Homo sapiens
uccccaacaauguga

SEQ ID NO: 1365140 - RNA, 13 nt, Homo sapiens
uccccacaaucug

SEQ ID NO: 1365141 - RNA, 12 nt, Homo sapiens
ucccccccaugc

SEQ ID NO: 1365142 - RNA, 18 nt, Homo sapiens
uccccuggguucacagau

SEQ ID NO: 1365143 - RNA, 19 nt, Homo sapiens
uccccuuuugccaaucuca

SEQ ID NO: 1365144 - RNA, 22 nt, Homo sapiens
ucccgcgggcgaguucugccag

SEQ ID NO: 1365145 - RNA, 14 nt, Homo sapiens
ucccuaaaaacaca

SEQ ID NO: 1365146 - RNA, 14 nt, Homo sapiens
ucccuaaugcucac

SEQ ID NO: 1365147 - RNA, 13 nt, Homo sapiens
ucccuaccuacca

SEQ ID NO: 1365148 - RNA, 21 nt, Homo sapiens
ucccucaggauuccuuggcau

SEQ ID NO: 1365149 - RNA, 18 nt, Homo sapiens
ucccucccccccaugcac

SEQ ID NO: 1365150 - RNA, 14 nt, Homo sapiens
ucccucucaugacu

SEQ ID NO: 1365151 - RNA, 19 nt, Homo sapiens
ucccucucaugacuugcag

SEQ ID NO: 1365152 - RNA, 21 nt, Homo sapiens
ucccuggcucccaugaccaua

SEQ ID NO: 1365153 - RNA, 18 nt, Homo sapiens
ucccuguguugucucuag

SEQ ID NO: 1365154 - RNA, 16 nt, Homo sapiens
ucccuucccauaagcu

SEQ ID NO: 1365155 - RNA, 14 nt, Homo sapiens
uccgcccugccacu

SEQ ID NO: 1365156 - RNA, 16 nt, Homo sapiens
uccgguuauucacuug

SEQ ID NO: 1365157 - RNA, 13 nt, Homo sapiens
uccgucacauuca

SEQ ID NO: 1365158 - RNA, 22 nt, Homo sapiens
uccgugcugacagcugcuccua

SEQ ID NO: 1365159 - RNA, 23 nt, Homo sapiens
uccuaaagaaaaauaucuuggcc

SEQ ID NO: 1365160 - RNA, 24 nt, Homo sapiens
uccuaaagaaaaauaucuuggccu

SEQ ID NO: 1365161 - RNA, 21 nt, Homo sapiens
uccuaauaucaaaugcaguau

SEQ ID NO: 1365162 - RNA, 12 nt, Homo sapiens
uccuacacuuga

SEQ ID NO: 1365163 - RNA, 15 nt, Homo sapiens
uccuaggucaugccu

SEQ ID NO: 1365164 - RNA, 12 nt, Homo sapiens
uccucaucagcu

SEQ ID NO: 1365165 - RNA, 17 nt, Homo sapiens
uccucauccccacaauc

SEQ ID NO: 1365166 - RNA, 19 nt, Homo sapiens
uccucauccccacaaucug

SEQ ID NO: 1365167 - RNA, 16 nt, Homo sapiens
uccucccaagcugugc

SEQ ID NO: 1365168 - RNA, 15 nt, Homo sapiens
uccucccugcaucug

SEQ ID NO: 1365169 - RNA, 17 nt, Homo sapiens
uccucgugaaagugcau

SEQ ID NO: 1365170 - RNA, 19 nt, Homo sapiens
uccugaggggcaucugccc

SEQ ID NO: 1365171 - RNA, 20 nt, Homo sapiens
uccugaguaguugggauuac

SEQ ID NO: 1365172 - RNA, 20 nt, Homo sapiens
uccugcccaccugucaaaca

SEQ ID NO: 1365173 - RNA, 14 nt, Homo sapiens
uccugccuggccag

SEQ ID NO: 1365174 - RNA, 20 nt, Homo sapiens
uccugccugggccuuggcaa

SEQ ID NO: 1365175 - RNA, 19 nt, Homo sapiens
uccuguacauugugggaug

SEQ ID NO: 1365176 - RNA, 14 nt, Homo sapiens
uccuguccagcucc

SEQ ID NO: 1365177 - RNA, 22 nt, Homo sapiens
uccugucuguuuccucuguaua

SEQ ID NO: 1365178 - RNA, 20 nt, Homo sapiens
uccugugaaugccacugccu

SEQ ID NO: 1365179 - RNA, 15 nt, Homo sapiens
uccugugguaguccu

SEQ ID NO: 1365180 - RNA, 22 nt, Homo sapiens
uccuucccucucaugacuugca

SEQ ID NO: 1365181 - RNA, 19 nt, Homo sapiens
uccuugugaagaugauaua

SEQ ID NO: 1365182 - RNA, 23 nt, Homo sapiens
uccuuuaaaaaacuuagugacaa

SEQ ID NO: 1365183 - RNA, 20 nt, Homo sapiens
uccuuuuaaaaaccuagguc

SEQ ID NO: 1365184 - RNA, 12 nt, Homo sapiens
ucgcaacugucc

SEQ ID NO: 1365185 - RNA, 16 nt, Homo sapiens
ucgccacugcacucca

SEQ ID NO: 1365186 - RNA, 14 nt, Homo sapiens
ucggagcucagugc

SEQ ID NO: 1365187 - RNA, 22 nt, Homo sapiens
ucggugggacucguggcuguca

SEQ ID NO: 1365188 - RNA, 15 nt, Homo sapiens
ucgucuaaacuuuag

SEQ ID NO: 1365189 - RNA, 15 nt, Homo sapiens
ucgugcuaaacgcac

SEQ ID NO: 1365190 - RNA, 15 nt, Homo sapiens
ucguuugaaucacag

SEQ ID NO: 1365191 - RNA, 22 nt, Homo sapiens
ucuaaaaaaggaauccucugug

SEQ ID NO: 1365192 - RNA, 17 nt, Homo sapiens
ucuaacaaaacaaguug

SEQ ID NO: 1365193 - RNA, 15 nt, Homo sapiens
ucuaaccuuucuaac

SEQ ID NO: 1365194 - RNA, 17 nt, Homo sapiens
ucuaagagagcugccau

SEQ ID NO: 1365195 - RNA, 13 nt, Homo sapiens
ucuaauacauucc

SEQ ID NO: 1365196 - RNA, 16 nt, Homo sapiens
ucuacuucugcccuug

SEQ ID NO: 1365197 - RNA, 14 nt, Homo sapiens
ucuaggugcuuuaa

SEQ ID NO: 1365198 - RNA, 20 nt, Homo sapiens
ucuauggcacccaugcaccu

SEQ ID NO: 1365199 - RNA, 20 nt, Homo sapiens
ucuauucccaucgcuggaaa

SEQ ID NO: 1365200 - RNA, 13 nt, Homo sapiens
ucucaaaauaucc

SEQ ID NO: 1365201 - RNA, 23 nt, Homo sapiens
ucucaguugauuuucuggauucc

SEQ ID NO: 1365202 - RNA, 15 nt, Homo sapiens
ucucauaacucugug

SEQ ID NO: 1365203 - RNA, 18 nt, Homo sapiens
uggacguggguugcacug

SEQ ID NO: 1365204 - RNA, 18 nt, Homo sapiens
uggacuucagucuugccu

SEQ ID NO: 1365205 - RNA, 13 nt, Homo sapiens
uggagagcacugc

SEQ ID NO: 1365206 - RNA, 17 nt, Homo sapiens
uggagccccaggggaca

SEQ ID NO: 1365207 - RNA, 18 nt, Homo sapiens
uggagccccaucagcucc

SEQ ID NO: 1365208 - RNA, 15 nt, Homo sapiens
uggagcugacuguuc

SEQ ID NO: 1365209 - RNA, 17 nt, Homo sapiens
uggaggcuccuguggua

SEQ ID NO: 1365210 - RNA, 23 nt, Homo sapiens
uggauccuccccgacuguggcua

SEQ ID NO: 1365211 - RNA, 18 nt, Homo sapiens
uggaucuccauucucuca

SEQ ID NO: 1365212 - RNA, 18 nt, Homo sapiens
uggaugccuugaauaaua

SEQ ID NO: 1365213 - RNA, 13 nt, Homo sapiens
uggaugcuccuuc

SEQ ID NO: 1365214 - RNA, 23 nt, Homo sapiens
uggaugggggaacucagauccag

SEQ ID NO: 1365215 - RNA, 23 nt, Homo sapiens
uggauguauggggaaucuaagag

SEQ ID NO: 1365216 - RNA, 19 nt, Homo sapiens
uggauuccucgaaacugcc

SEQ ID NO: 1365217 - RNA, 22 nt, Homo sapiens
uggauuuuacauguggcccaac

SEQ ID NO: 1365218 - RNA, 23 nt, Homo sapiens
uggcaaagccuucauugccuuaa

SEQ ID NO: 1365219 - RNA, 12 nt, Homo sapiens
uggcaccagcag

SEQ ID NO: 1365220 - RNA, 17 nt, Homo sapiens
uggcaccaggcgcugcc

SEQ ID NO: 1365221 - RNA, 15 nt, Homo sapiens
uggcacccaugcacc

SEQ ID NO: 1365222 - RNA, 20 nt, Homo sapiens
uggcaggccccagcccugca

SEQ ID NO: 1365223 - RNA, 19 nt, Homo sapiens
uggcccaacacaauucuuc

SEQ ID NO: 1365224 - RNA, 13 nt, Homo sapiens
uggcccacgcacu

SEQ ID NO: 1365225 - RNA, 16 nt, Homo sapiens
uggcccacgcacuucg

SEQ ID NO: 1365226 - RNA, 13 nt, Homo sapiens
uggcccacugcau

SEQ ID NO: 1365227 - RNA, 17 nt, Homo sapiens
uggccuccccugccacc

SEQ ID NO: 1365228 - RNA, 18 nt, Homo sapiens
uggcuacacacaaaccag

SEQ ID NO: 1365229 - RNA, 21 nt, Homo sapiens
uggcuacacacaaaccaguau

SEQ ID NO: 1365230 - RNA, 13 nt, Homo sapiens
uggcuaccuguaa

SEQ ID NO: 1365231 - RNA, 18 nt, Homo sapiens
uggcuccacccucuuuag

SEQ ID NO: 1365232 - RNA, 22 nt, Homo sapiens
uggcuccaggccaaagugccgg

SEQ ID NO: 1365233 - RNA, 15 nt, Homo sapiens
uggcucuacuuucag

SEQ ID NO: 1365234 - RNA, 19 nt, Homo sapiens
uggcuguuggugggacccg

SEQ ID NO: 1365235 - RNA, 14 nt, Homo sapiens
uggcuuagugccac

SEQ ID NO: 1365236 - RNA, 21 nt, Homo sapiens
uggcuuugaaugcggcccaac

SEQ ID NO: 1365237 - RNA, 18 nt, Homo sapiens
ugggaaccgcccuccuga

SEQ ID NO: 1365238 - RNA, 13 nt, Homo sapiens
ugggaacuccuaa

SEQ ID NO: 1365239 - RNA, 16 nt, Homo sapiens
ugggaaggggaggacc

SEQ ID NO: 1365240 - RNA, 21 nt, Homo sapiens
ugggaaugauaguguaucuca

SEQ ID NO: 1365241 - RNA, 18 nt, Homo sapiens
ugggagacugcugaguca

SEQ ID NO: 1365242 - RNA, 16 nt, Homo sapiens
ugggaggccaaggugg

SEQ ID NO: 1365243 - RNA, 20 nt, Homo sapiens
ugggauccuaagggcucacc

SEQ ID NO: 1365244 - RNA, 18 nt, Homo sapiens
ugggcaacagagcaagac

SEQ ID NO: 1365245 - RNA, 18 nt, Homo sapiens
ugggcaauauagcaagau

SEQ ID NO: 1365246 - RNA, 19 nt, Homo sapiens
ugggccagacaugccacaa

SEQ ID NO: 1365247 - RNA, 22 nt, Homo sapiens
ugggcccacccggugggacccc

SEQ ID NO: 1365248 - RNA, 18 nt, Homo sapiens
ugggccuuuccucagugu

SEQ ID NO: 1365249 - RNA, 11 nt, Homo sapiens
ugggcuucuag

SEQ ID NO: 1365250 - RNA, 13 nt, Homo sapiens
ugggcuucuagaa

SEQ ID NO: 1365251 - RNA, 17 nt, Homo sapiens
uggggagacaaaucuca

SEQ ID NO: 1365252 - RNA, 22 nt, Homo sapiens
uggggagggcagguccagcucu

SEQ ID NO: 1365253 - RNA, 15 nt, Homo sapiens
uggggagucagggac

SEQ ID NO: 1365254 - RNA, 16 nt, Homo sapiens
uggggauaugauuuaa

SEQ ID NO: 1365255 - RNA, 16 nt, Homo sapiens
uggggcaggcagugau

SEQ ID NO: 1365256 - RNA, 14 nt, Homo sapiens
uggggccagaucca

SEQ ID NO: 1365257 - RNA, 15 nt, Homo sapiens
uggggccagauccag

SEQ ID NO: 1365258 - RNA, 19 nt, Homo sapiens
ugggguaaaguaucacuuu

SEQ ID NO: 1365259 - RNA, 21 nt, Homo sapiens
uggggucuuugugguagcuua

SEQ ID NO: 1365260 - RNA, 14 nt, Homo sapiens
ugggguggggucau

SEQ ID NO: 1365261 - RNA, 20 nt, Homo sapiens
ugggugaggcccgugugagg

SEQ ID NO: 1365262 - RNA, 19 nt, Homo sapiens
uggguuggaaaacaguauu

SEQ ID NO: 1365263 - RNA, 13 nt, Homo sapiens
ugguaaaaacugc

SEQ ID NO: 1365264 - RNA, 14 nt, Homo sapiens
ugguaacucagugu

SEQ ID NO: 1365265 - RNA, 20 nt, Homo sapiens
ugguagcugggauuacaggu

SEQ ID NO: 1365266 - RNA, 20 nt, Homo sapiens
uggucguuuucaacagaauu

SEQ ID NO: 1365267 - RNA, 22 nt, Homo sapiens
uggucucugauagguagcauuu

SEQ ID NO: 1365268 - RNA, 19 nt, Homo sapiens
uggugaauugggauuugca

SEQ ID NO: 1365269 - RNA, 19 nt, Homo sapiens
uggugccccaggaccagcu

SEQ ID NO: 1365270 - RNA, 22 nt, Homo sapiens
uggugccccaggaccagcucag

SEQ ID NO: 1365271 - RNA, 19 nt, Homo sapiens
ugguggcucaugccuguaa

SEQ ID NO: 1365272 - RNA, 21 nt, Homo sapiens
uggugggggagccucuggaau

SEQ ID NO: 1365273 - RNA, 16 nt, Homo sapiens
uggugugugccuguag

SEQ ID NO: 1365274 - RNA, 14 nt, Homo sapiens
ugguguguuacaca

SEQ ID NO: 1365275 - RNA, 18 nt, Homo sapiens
ugguucguucuguacugu

SEQ ID NO: 1365276 - RNA, 18 nt, Homo sapiens
ugguucucugggccucag

SEQ ID NO: 1365277 - RNA, 15 nt, Homo sapiens
ugguugagguuucaa

SEQ ID NO: 1365278 - RNA, 17 nt, Homo sapiens
ugguugaguucagguag

SEQ ID NO: 1365279 - RNA, 14 nt, Homo sapiens
uguaaaaaaaccac

SEQ ID NO: 1365280 - RNA, 19 nt, Homo sapiens
uguaaagagagcaagacag

SEQ ID NO: 1365281 - RNA, 20 nt, Homo sapiens
uguaaauacuguuuuuaaca

SEQ ID NO: 1365282 - RNA, 20 nt, Homo sapiens
uguaacagauaucagugucu

SEQ ID NO: 1365283 - RNA, 23 nt, Homo sapiens
uguaacuugaagguggcuacaaa

SEQ ID NO: 1365284 - RNA, 17 nt, Homo sapiens
uguaagaaacacacuga

SEQ ID NO: 1365285 - RNA, 17 nt, Homo sapiens
uguaagguggucacugu

SEQ ID NO: 1365286 - RNA, 22 nt, Homo sapiens
uguaagugaaguaaaacuuaag

SEQ ID NO: 1365287 - RNA, 20 nt, Homo sapiens
uguacaguagauuuuccaaa

SEQ ID NO: 1365288 - RNA, 14 nt, Homo sapiens
uguacuaaagccaa

SEQ ID NO: 1365289 - RNA, 20 nt, Homo sapiens
uguagaagaaagagcaacaa

SEQ ID NO: 1365290 - RNA, 18 nt, Homo sapiens
uguagauuaggucuugcu

SEQ ID NO: 1365291 - RNA, 16 nt, Homo sapiens
uguauauuacauacau

SEQ ID NO: 1365292 - RNA, 11 nt, Homo sapiens
uguauguauag

SEQ ID NO: 1365293 - RNA, 14 nt, Homo sapiens
uguaugugucuccc

SEQ ID NO: 1365294 - RNA, 17 nt, Homo sapiens
ugucaaacaaagccaga

SEQ ID NO: 1365295 - RNA, 14 nt, Homo sapiens
ugucaaugggaccu

SEQ ID NO: 1365296 - RNA, 16 nt, Homo sapiens
ugucagcuuccaaaca

SEQ ID NO: 1365297 - RNA, 18 nt, Homo sapiens
ugucauagacuccuuugc

SEQ ID NO: 1365298 - RNA, 21 nt, Homo sapiens
ugucaucucagcuggaucucc

SEQ ID NO: 1365299 - RNA, 22 nt, Homo sapiens
ugucauguggcuaccuguaacu

SEQ ID NO: 1365300 - RNA, 22 nt, Homo sapiens
ugucccaaaccagacaccugga

SEQ ID NO: 1365301 - RNA, 22 nt, Homo sapiens
ugucccacucaagccaagcagc

SEQ ID NO: 1365302 - RNA, 12 nt, Homo sapiens
ugucccuaguaa

SEQ ID NO: 1365303 - RNA, 15 nt, Homo sapiens
ugucccuucucccau

SEQ ID NO: 1365304 - RNA, 19 nt, Homo sapiens
uguccuaagaaaauacugg

SEQ ID NO: 1365305 - RNA, 18 nt, Homo sapiens
uguccucagccuugccag

SEQ ID NO: 1365306 - RNA, 22 nt, Homo sapiens
uguccuuucuagagcacugcca

SEQ ID NO: 1365307 - RNA, 22 nt, Homo sapiens
ugucuaauuaaaacacuuucaa

SEQ ID NO: 1365308 - RNA, 18 nt, Homo sapiens
ugucucaagccuaucuau

SEQ ID NO: 1365309 - RNA, 16 nt, Homo sapiens
ugucucauccaaaaag

SEQ ID NO: 1365310 - RNA, 20 nt, Homo sapiens
ugucuucaaagcaaagcucu

SEQ ID NO: 1365311 - RNA, 23 nt, Homo sapiens
ugugaagggauuuguuuugucaa

SEQ ID NO: 1365312 - RNA, 15 nt, Homo sapiens
ugugagcaugacuua

SEQ ID NO: 1365313 - RNA, 12 nt, Homo sapiens
ugugauguuugg

SEQ ID NO: 1365314 - RNA, 13 nt, Homo sapiens
ugugccagcugug

SEQ ID NO: 1365315 - RNA, 19 nt, Homo sapiens
ugugccauuucucagggaa

SEQ ID NO: 1365316 - RNA, 23 nt, Homo sapiens
ugugccccuccaagucacaaaga

SEQ ID NO: 1365317 - RNA, 21 nt, Homo sapiens
ugugccccuugacaacuggca

SEQ ID NO: 1365318 - RNA, 15 nt, Homo sapiens
ugugcccucugccag

SEQ ID NO: 1365319 - RNA, 12 nt, Homo sapiens
aaaaaacaugag

SEQ ID NO: 1365320 - RNA, 13 nt, Homo sapiens
aaaaagaccaaga

SEQ ID NO: 1365321 - RNA, 20 nt, Homo sapiens
aaaaaggaaagaacugucau

SEQ ID NO: 1365322 - RNA, 21 nt, Homo sapiens
aaaaagugaaaacaauguaag

SEQ ID NO: 1365323 - RNA, 17 nt, Homo sapiens
aaaaauacucacauggc

SEQ ID NO: 1365324 - RNA, 17 nt, Homo sapiens
aaaaauagcaacuugug

SEQ ID NO: 1365325 - RNA, 22 nt, Homo sapiens
aaaaauauguaccaagaaucuu

SEQ ID NO: 1365326 - RNA, 20 nt, Homo sapiens
aaaacaauguaagagccuaa

SEQ ID NO: 1365327 - RNA, 13 nt, Homo sapiens
aaaacccuuucug

SEQ ID NO: 1365328 - RNA, 16 nt, Homo sapiens
aaaaccucuaugcaau

SEQ ID NO: 1365329 - RNA, 19 nt, Homo sapiens
aaaacuacaaccaauggaa

SEQ ID NO: 1365330 - RNA, 16 nt, Homo sapiens
aaaacugcauuucacu

SEQ ID NO: 1365331 - RNA, 16 nt, Homo sapiens
aaaacuuagugacaaa

SEQ ID NO: 1365332 - RNA, 18 nt, Homo sapiens
aaaacuuuucuaauacuc

SEQ ID NO: 1365333 - RNA, 22 nt, Homo sapiens
aaaagaucuugaauagucucau

SEQ ID NO: 1365334 - RNA, 23 nt, Homo sapiens
aaaagaugcuucucacugccaug

SEQ ID NO: 1365335 - RNA, 15 nt, Homo sapiens
aaaagguuuacagaa

SEQ ID NO: 1365336 - RNA, 14 nt, Homo sapiens
aaaagucaguauca

SEQ ID NO: 1365337 - RNA, 15 nt, Homo sapiens
aaaauaaaagaucuu

SEQ ID NO: 1365338 - RNA, 16 nt, Homo sapiens
aaaauaaaagaucuug

SEQ ID NO: 1365339 - RNA, 13 nt, Homo sapiens
aaaauaccauuua

SEQ ID NO: 1365340 - RNA, 16 nt, Homo sapiens
aaaauaucugcucaaa

SEQ ID NO: 1365341 - RNA, 14 nt, Homo sapiens
aaaaucuguucuaa

SEQ ID NO: 1365342 - RNA, 18 nt, Homo sapiens
aaaaugcaacaacaugua

SEQ ID NO: 1365343 - RNA, 23 nt, Homo sapiens
aaaauguaaaauccuacagugaa

SEQ ID NO: 1365344 - RNA, 18 nt, Homo sapiens
aaaauucauuucuaauua

SEQ ID NO: 1365345 - RNA, 18 nt, Homo sapiens
aaaauugccaucauucua

SEQ ID NO: 1365346 - RNA, 22 nt, Homo sapiens
aaacaaaaaaaccucuaugcaa

SEQ ID NO: 1365347 - RNA, 17 nt, Homo sapiens
aaacauaccaacauguu

SEQ ID NO: 1365348 - RNA, 23 nt, Homo sapiens
aaacaugugguuaaugccaugga

SEQ ID NO: 1365349 - RNA, 15 nt, Homo sapiens
aaacauuaaugcaau

SEQ ID NO: 1365350 - RNA, 18 nt, Homo sapiens
aaacauuuuuaucuauca

SEQ ID NO: 1365351 - RNA, 16 nt, Homo sapiens
aaaccagcaucugcac

SEQ ID NO: 1365352 - RNA, 20 nt, Homo sapiens
aaaccagcaucugcaccuaa

SEQ ID NO: 1365353 - RNA, 20 nt, Homo sapiens
aaacccccacccuucugccu

SEQ ID NO: 1365354 - RNA, 15 nt, Homo sapiens
aaacccuuucauaaa

SEQ ID NO: 1365355 - RNA, 15 nt, Homo sapiens
aaaccuuaguuucaa

SEQ ID NO: 1365356 - RNA, 21 nt, Homo sapiens
aaacguaaguacuccauugua

SEQ ID NO: 1365357 - RNA, 17 nt, Homo sapiens
aaacguuaguuaauccc

SEQ ID NO: 1365358 - RNA, 13 nt, Homo sapiens
aaacuaaaacaga

SEQ ID NO: 1365359 - RNA, 18 nt, Homo sapiens
aaacucuacuuaauccaa

SEQ ID NO: 1365360 - RNA, 16 nt, Homo sapiens
aaacugaauccauuca

SEQ ID NO: 1365361 - RNA, 17 nt, Homo sapiens
aaacugccauugugauc

SEQ ID NO: 1365362 - RNA, 23 nt, Homo sapiens
aaacuuggcucgaaucucugugc

SEQ ID NO: 1365363 - RNA, 22 nt, Homo sapiens
aaacuuuauauuguucuuguaa

SEQ ID NO: 1365364 - RNA, 17 nt, Homo sapiens
aaacuuucaccucagau

SEQ ID NO: 1365365 - RNA, 19 nt, Homo sapiens
aaagaaaaauaucuuggcc

SEQ ID NO: 1365366 - RNA, 15 nt, Homo sapiens
aaagacaaacaguag

SEQ ID NO: 1365367 - RNA, 21 nt, Homo sapiens
aaagacaagcucaaguguuca

SEQ ID NO: 1365368 - RNA, 14 nt, Homo sapiens
aaagacugcauuua

SEQ ID NO: 1365369 - RNA, 11 nt, Homo sapiens
aaagacuguag

SEQ ID NO: 1365370 - RNA, 19 nt, Homo sapiens
aaagacuuuccucuuaguc

SEQ ID NO: 1365371 - RNA, 17 nt, Homo sapiens
aaagagagcaagacaga

SEQ ID NO: 1365372 - RNA, 19 nt, Homo sapiens
aaagaucuugaauagucuc

SEQ ID NO: 1365373 - RNA, 21 nt, Homo sapiens
aaagaucuugaauagucucau

SEQ ID NO: 1365374 - RNA, 13 nt, Homo sapiens
aaagauguauaua

SEQ ID NO: 1365375 - RNA, 18 nt, Homo sapiens
aaagcaagggaccuucau

SEQ ID NO: 1365376 - RNA, 19 nt, Homo sapiens
aaagcagcucaaaggcaca

SEQ ID NO: 1365377 - RNA, 11 nt, Homo sapiens
aaagcccuccc

SEQ ID NO: 1365378 - RNA, 18 nt, Homo sapiens
aaagcccucccuaccuac

SEQ ID NO: 1365379 - RNA, 17 nt, Homo sapiens
aaagcccugugcuccau

SEQ ID NO: 1365380 - RNA, 23 nt, Homo sapiens
aaagcuaggaugguucugugacc

SEQ ID NO: 1365381 - RNA, 13 nt, Homo sapiens
aaaggcacaguga

SEQ ID NO: 1365382 - RNA, 21 nt, Homo sapiens
aaaggcagcugugucugagcc

SEQ ID NO: 1365383 - RNA, 13 nt, Homo sapiens
aaaggcugagaag

SEQ ID NO: 1365384 - RNA, 16 nt, Homo sapiens
aaaguaucauuacaua

SEQ ID NO: 1365385 - RNA, 15 nt, Homo sapiens
aaagucuuaccucag

SEQ ID NO: 1365386 - RNA, 15 nt, Homo sapiens
aaagugcuccugaga

SEQ ID NO: 1365387 - RNA, 21 nt, Homo sapiens
aaaguuauauuucagauguaa

SEQ ID NO: 1365388 - RNA, 12 nt, Homo sapiens
aaaguuaugaaa

SEQ ID NO: 1365389 - RNA, 16 nt, Homo sapiens
aaauaaaaaucucuuu

SEQ ID NO: 1365390 - RNA, 17 nt, Homo sapiens
aaauaaaagaucuugaa

SEQ ID NO: 1365391 - RNA, 20 nt, Homo sapiens
aaauaauccaaauccaucaa

SEQ ID NO: 1365392 - RNA, 13 nt, Homo sapiens
aaauacucagggu

SEQ ID NO: 1365393 - RNA, 18 nt, Homo sapiens
aaauaucuuggccuaaac

SEQ ID NO: 1365394 - RNA, 13 nt, Homo sapiens
aaauauuaugaga

SEQ ID NO: 1365395 - RNA, 18 nt, Homo sapiens
aaauauuaugcugcuuua

SEQ ID NO: 1365396 - RNA, 15 nt, Homo sapiens
aaauauuugacuuua

SEQ ID NO: 1365397 - RNA, 19 nt, Homo sapiens
aaaucaaucaagacugcaa

SEQ ID NO: 1365398 - RNA, 21 nt, Homo sapiens
aaaucaccaccgacugaagug

SEQ ID NO: 1365399 - RNA, 18 nt, Homo sapiens
aaaucacucagcacucca

SEQ ID NO: 1365400 - RNA, 15 nt, Homo sapiens
aaaucugacccagug

SEQ ID NO: 1365401 - RNA, 15 nt, Homo sapiens
aaaucuuaaguacca

SEQ ID NO: 1365402 - RNA, 17 nt, Homo sapiens
aaaugcaacaacaugua

SEQ ID NO: 1365403 - RNA, 22 nt, Homo sapiens
aaaugcaauguaagcauacuuu

SEQ ID NO: 1365404 - RNA, 21 nt, Homo sapiens
aaaugcagcagggaugcccug

SEQ ID NO: 1365405 - RNA, 14 nt, Homo sapiens
aaaugccaagcacu

SEQ ID NO: 1365406 - RNA, 14 nt, Homo sapiens
aaaugccaauaaca

SEQ ID NO: 1365407 - RNA, 19 nt, Homo sapiens
aaauggacaaacagugcac

SEQ ID NO: 1365408 - RNA, 16 nt, Homo sapiens
aaauguacagacauau

SEQ ID NO: 1365409 - RNA, 20 nt, Homo sapiens
aaaugucccuccaacacaga

SEQ ID NO: 1365410 - RNA, 22 nt, Homo sapiens
aaaugucuugcuguugacauau

SEQ ID NO: 1365411 - RNA, 19 nt, Homo sapiens
aaauuauauuugugcuaua

SEQ ID NO: 1365412 - RNA, 17 nt, Homo sapiens
aaauucauuaugcugcu

SEQ ID NO: 1365413 - RNA, 15 nt, Homo sapiens
aaauucgcaaacuuu

SEQ ID NO: 1365414 - RNA, 19 nt, Homo sapiens
aaauucuucuaauugcugu

SEQ ID NO: 1365415 - RNA, 13 nt, Homo sapiens
aaauuguguauga

SEQ ID NO: 1365416 - RNA, 14 nt, Homo sapiens
aaauuuaagcuuaa

SEQ ID NO: 1365417 - RNA, 19 nt, Homo sapiens
aaauuuggggggucuugca

SEQ ID NO: 1365418 - RNA, 12 nt, Homo sapiens
aacaaaaaccaa

SEQ ID NO: 1365419 - RNA, 12 nt, Homo sapiens
aacaaagccaga

SEQ ID NO: 1365420 - RNA, 12 nt, Homo sapiens
aacaaagcccuu

SEQ ID NO: 1365421 - RNA, 13 nt, Homo sapiens
aacaaagcccuua

SEQ ID NO: 1365422 - RNA, 13 nt, Homo sapiens
aacaagccuaaaa

SEQ ID NO: 1365423 - RNA, 14 nt, Homo sapiens
aacaauccaucucu

SEQ ID NO: 1365424 - RNA, 19 nt, Homo sapiens
aacacacacuguucugaaa

SEQ ID NO: 1365425 - RNA, 18 nt, Homo sapiens
aacacaucacucauuuua

SEQ ID NO: 1365426 - RNA, 16 nt, Homo sapiens
aacacgcguauuuaca

SEQ ID NO: 1365427 - RNA, 17 nt, Homo sapiens
aacacuuccagcauuua

SEQ ID NO: 1365428 - RNA, 15 nt, Homo sapiens
aacagccucacuccu

SEQ ID NO: 1365429 - RNA, 20 nt, Homo sapiens
aacagcgcuggguccacccc

SEQ ID NO: 1365430 - RNA, 20 nt, Homo sapiens
aacagcuguaaucuaugaau

SEQ ID NO: 1365431 - RNA, 18 nt, Homo sapiens
aacaggcucacagagauu

SEQ ID NO: 1365432 - RNA, 14 nt, Homo sapiens
aacaggcuugaauc

SEQ ID NO: 1365433 - RNA, 18 nt, Homo sapiens
aacaggcuugaaucaaag

SEQ ID NO: 1365434 - RNA, 23 nt, Homo sapiens
aacauaguauucaugacuaugga

SEQ ID NO: 1365435 - RNA, 20 nt, Homo sapiens
aacaucgucuaaacuuuaga

SEQ ID NO: 1365436 - RNA, 21 nt, Homo sapiens
aacaucuuuuuaaccugcaaa

SEQ ID NO: 1365437 - RNA, 21 nt, Homo sapiens
aacaugaaaauuaugucaguu

SEQ ID NO: 1365438 - RNA, 14 nt, Homo sapiens
aacauuuaaauucc

SEQ ID NO: 1365439 - RNA, 15 nt, Homo sapiens
aacauuuaaauucca

SEQ ID NO: 1365440 - RNA, 19 nt, Homo sapiens
aacauuuuacugugcuguu

SEQ ID NO: 1365441 - RNA, 15 nt, Homo sapiens
aacauuuuucacuua

SEQ ID NO: 1365442 - RNA, 17 nt, Homo sapiens
aaccacacaaagacauu

SEQ ID NO: 1365443 - RNA, 20 nt, Homo sapiens
aaccagaucuagucaaucaa

SEQ ID NO: 1365444 - RNA, 18 nt, Homo sapiens
aaccauaugaacauauau

SEQ ID NO: 1365445 - RNA, 17 nt, Homo sapiens
aaccauccagugacaaa

SEQ ID NO: 1365446 - RNA, 19 nt, Homo sapiens
aacccaggaguucaggguc

SEQ ID NO: 1365447 - RNA, 21 nt, Homo sapiens
aaccccuuagcaauaagcacu

SEQ ID NO: 1365448 - RNA, 16 nt, Homo sapiens
aaccgagaagguuuau

SEQ ID NO: 1365449 - RNA, 16 nt, Homo sapiens
aaccucaaagugacua

SEQ ID NO: 1365450 - RNA, 15 nt, Homo sapiens
aaccucaagcaguaa

SEQ ID NO: 1365451 - RNA, 17 nt, Homo sapiens
aaccucacgcaccuccc

SEQ ID NO: 1365452 - RNA, 18 nt, Homo sapiens
aaccucuaugcaaucuga

SEQ ID NO: 1365453 - RNA, 15 nt, Homo sapiens
aaccucugcacuacu

SEQ ID NO: 1365454 - RNA, 16 nt, Homo sapiens
aaccugaaauuaacuc

SEQ ID NO: 1365455 - RNA, 19 nt, Homo sapiens
aacggcuuggcagccaguc

SEQ ID NO: 1365456 - RNA, 18 nt, Homo sapiens
aacuaaaguaucugagau

SEQ ID NO: 1365457 - RNA, 18 nt, Homo sapiens
aacucaaauggggccaga

SEQ ID NO: 1365458 - RNA, 23 nt, Homo sapiens
aacucaaauggggccagauccag

SEQ ID NO: 1365459 - RNA, 18 nt, Homo sapiens
aacucaaggacuuugcag

SEQ ID NO: 1365460 - RNA, 11 nt, Homo sapiens
aacucaauauu

SEQ ID NO: 1365461 - RNA, 19 nt, Homo sapiens
aacucaauauuuuccauga

SEQ ID NO: 1365462 - RNA, 13 nt, Homo sapiens
aacucacacuccc

SEQ ID NO: 1365463 - RNA, 18 nt, Homo sapiens
aacucuucaggcaccuga

SEQ ID NO: 1365464 - RNA, 21 nt, Homo sapiens
aacucuucaguuaauucuuag

SEQ ID NO: 1365465 - RNA, 13 nt, Homo sapiens
aacugcaagccca

SEQ ID NO: 1365466 - RNA, 17 nt, Homo sapiens
aacugccauugugauca

SEQ ID NO: 1365467 - RNA, 16 nt, Homo sapiens
aacuggaagaaagcaa

SEQ ID NO: 1365468 - RNA, 17 nt, Homo sapiens
aacuggaagaaagcaac

SEQ ID NO: 1365469 - RNA, 14 nt, Homo sapiens
aacuuagugacaaa

SEQ ID NO: 1365470 - RNA, 15 nt, Homo sapiens
aacuuguauuuccaa

SEQ ID NO: 1365471 - RNA, 11 nt, Homo sapiens
aagaaagcaaa

SEQ ID NO: 1365472 - RNA, 21 nt, Homo sapiens
aagaaggaaaagauacccaaa

SEQ ID NO: 1365473 - RNA, 18 nt, Homo sapiens
aagaauaauaauggcuaa

SEQ ID NO: 1365474 - RNA, 13 nt, Homo sapiens
aagacaauggcuu

SEQ ID NO: 1365475 - RNA, 11 nt, Homo sapiens
aagacauuucu

SEQ ID NO: 1365476 - RNA, 12 nt, Homo sapiens
aagacauuugaa

SEQ ID NO: 1365477 - RNA, 20 nt, Homo sapiens
aagaccuggcagcucuggac

SEQ ID NO: 1365478 - RNA, 17 nt, Homo sapiens
aagacuauauuguacac

SEQ ID NO: 1365479 - RNA, 19 nt, Homo sapiens
aagacugucagcuuccaaa

SEQ ID NO: 1365480 - RNA, 22 nt, Homo sapiens
aagagaucccaaguagaaucuc

SEQ ID NO: 1365481 - RNA, 13 nt, Homo sapiens
aagagcaacaauc

SEQ ID NO: 1365482 - RNA, 19 nt, Homo sapiens
aagaggcaccacuaaaaga

SEQ ID NO: 1365483 - RNA, 19 nt, Homo sapiens
aagaucuugaauagucuca

SEQ ID NO: 1365484 - RNA, 20 nt, Homo sapiens
aagaucuugaauagucucau

SEQ ID NO: 1365485 - RNA, 14 nt, Homo sapiens
aagaugcagucucu

SEQ ID NO: 1365486 - RNA, 22 nt, Homo sapiens
aagaugcuucucacugccaugc

SEQ ID NO: 1365487 - RNA, 15 nt, Homo sapiens
aagaugggagccuuu

SEQ ID NO: 1365488 - RNA, 19 nt, Homo sapiens
aagauuugugaacuggaag

SEQ ID NO: 1365489 - RNA, 16 nt, Homo sapiens
aagcaauaaccucaaa

SEQ ID NO: 1365490 - RNA, 18 nt, Homo sapiens
aagcagaugcaaagaggc

SEQ ID NO: 1365491 - RNA, 12 nt, Homo sapiens
aagcaggauuuc

SEQ ID NO: 1365492 - RNA, 14 nt, Homo sapiens
aagcagucgugccu

SEQ ID NO: 1365493 - RNA, 20 nt, Homo sapiens
aagcauaaaaauuagccaag

SEQ ID NO: 1365494 - RNA, 13 nt, Homo sapiens
aagcauacuucua

SEQ ID NO: 1365495 - RNA, 12 nt, Homo sapiens
aagcauacuuug

SEQ ID NO: 1365496 - RNA, 14 nt, Homo sapiens
aagcauacuuugua

SEQ ID NO: 1365497 - RNA, 16 nt, Homo sapiens
aagcaucacuugggau

SEQ ID NO: 1365498 - RNA, 19 nt, Homo sapiens
aagcauggaaaaucaguga

SEQ ID NO: 1365499 - RNA, 15 nt, Homo sapiens
aagcauuuugugaug

SEQ ID NO: 1365500 - RNA, 23 nt, Homo sapiens
aagccaagaaagaaaaauuaucu

SEQ ID NO: 1365501 - RNA, 17 nt, Homo sapiens
aagccagaagcugagca

SEQ ID NO: 1365502 - RNA, 20 nt, Homo sapiens
aagcccuccgccauucucaa

SEQ ID NO: 1365503 - RNA, 16 nt, Homo sapiens
aagccucugugcugca

SEQ ID NO: 1365504 - RNA, 22 nt, Homo sapiens
aagccugcagucaucuugacca

SEQ ID NO: 1365505 - RNA, 14 nt, Homo sapiens
aagccugugcaggu

SEQ ID NO: 1365506 - RNA, 21 nt, Homo sapiens
aagcuaggguggcccuugcag

SEQ ID NO: 1365507 - RNA, 19 nt, Homo sapiens
aagcuccugccucuuugug

SEQ ID NO: 1365508 - RNA, 14 nt, Homo sapiens
aagcugacauugcc

SEQ ID NO: 1365509 - RNA, 23 nt, Homo sapiens
aagcugagucucccuaaggcaug

SEQ ID NO: 1365510 - RNA, 21 nt, Homo sapiens
aagcugcucggagcucagugc

SEQ ID NO: 1365511 - RNA, 11 nt, Homo sapiens
aagcugugcug

SEQ ID NO: 1365512 - RNA, 18 nt, Homo sapiens
aaggaaaaaauaaaagau

SEQ ID NO: 1365513 - RNA, 17 nt, Homo sapiens
aaggaagacaaugugaa

SEQ ID NO: 1365514 - RNA, 20 nt, Homo sapiens
aaggacuuccuguccagcuc

SEQ ID NO: 1365515 - RNA, 15 nt, Homo sapiens
aaggacuuugcagcc

SEQ ID NO: 1365516 - RNA, 21 nt, Homo sapiens
aaggaugcggcaggugcucug

SEQ ID NO: 1365517 - RNA, 14 nt, Homo sapiens
aaggaugucugcca

SEQ ID NO: 1365518 - RNA, 23 nt, Homo sapiens
aaggcaccuauaaaacaggucaa

SEQ ID NO: 1365519 - RNA, 14 nt, Homo sapiens
aaggcauaaaugac

SEQ ID NO: 1365520 - RNA, 22 nt, Homo sapiens
aaggccaagaggcuguucccac

SEQ ID NO: 1365521 - RNA, 16 nt, Homo sapiens
aaggccuccugugacu

SEQ ID NO: 1365522 - RNA, 22 nt, Homo sapiens
aagggagguucaccugcagcga

SEQ ID NO: 1365523 - RNA, 17 nt, Homo sapiens
aagggauuucauuugaa

SEQ ID NO: 1365524 - RNA, 18 nt, Homo sapiens
aagggcucacgcauucag

SEQ ID NO: 1365525 - RNA, 16 nt, Homo sapiens
aagguaaaaugccaug

SEQ ID NO: 1365526 - RNA, 21 nt, Homo sapiens
aagguccaguucuacagagug

SEQ ID NO: 1365527 - RNA, 17 nt, Homo sapiens
aaggugagcaaagggcu

SEQ ID NO: 1365528 - RNA, 14 nt, Homo sapiens
aagguggucacugu

SEQ ID NO: 1365529 - RNA, 15 nt, Homo sapiens
aagguggucacuguu

SEQ ID NO: 1365530 - RNA, 17 nt, Homo sapiens
aagguucccucccacuc

SEQ ID NO: 1365531 - RNA, 20 nt, Homo sapiens
aagguucucagguguugcca

SEQ ID NO: 1365532 - RNA, 22 nt, Homo sapiens
aagguucucagguguugccaaa

SEQ ID NO: 1365533 - RNA, 18 nt, Homo sapiens
aagguugaaaagacaaua

SEQ ID NO: 1365534 - RNA, 22 nt, Homo sapiens
aaguaaccucuacaggcauuua

SEQ ID NO: 1365535 - RNA, 18 nt, Homo sapiens
aaguagaucuuuucuuga

SEQ ID NO: 1365536 - RNA, 15 nt, Homo sapiens
aagucaaacuuucac

SEQ ID NO: 1365537 - RNA, 23 nt, Homo sapiens
aagucaaacuuucaccucagauu

SEQ ID NO: 1365538 - RNA, 21 nt, Homo sapiens
aagugcaugcauugagcugcc

SEQ ID NO: 1365539 - RNA, 18 nt, Homo sapiens
aagugccuagacuguuac

SEQ ID NO: 1365540 - RNA, 20 nt, Homo sapiens
aagugcugcgauuacaggca

SEQ ID NO: 1365541 - RNA, 18 nt, Homo sapiens
aagugggcccacccggug

SEQ ID NO: 1365542 - RNA, 17 nt, Homo sapiens
aaguguaacagauauca

SEQ ID NO: 1365543 - RNA, 19 nt, Homo sapiens
aagugucuugagacuuuau

SEQ ID NO: 1365544 - RNA, 12 nt, Homo sapiens
aagugugugauc

SEQ ID NO: 1365545 - RNA, 15 nt, Homo sapiens
aagugugugaucugu

SEQ ID NO: 1365546 - RNA, 23 nt, Homo sapiens
aagugugugccaccaugccucac

SEQ ID NO: 1365547 - RNA, 15 nt, Homo sapiens
aaguuaaaaagucaa

SEQ ID NO: 1365548 - RNA, 22 nt, Homo sapiens
aaguuagggaauggcacagccc

SEQ ID NO: 1365549 - RNA, 14 nt, Homo sapiens
aaguucuugacaga

SEQ ID NO: 1365550 - RNA, 13 nt, Homo sapiens
aaguuugagauca

SEQ ID NO: 1365551 - RNA, 23 nt, Homo sapiens
aaguuuucagaaccucuucccca

SEQ ID NO: 1365552 - RNA, 21 nt, Homo sapiens
aaguuuuguggaggagcucag

SEQ ID NO: 1365553 - RNA, 16 nt, Homo sapiens
aauaaaaacauugccu

SEQ ID NO: 1365554 - RNA, 16 nt, Homo sapiens
aauaaaaagaagagag

SEQ ID NO: 1365555 - RNA, 14 nt, Homo sapiens
aauaaaacugagcu

SEQ ID NO: 1365556 - RNA, 15 nt, Homo sapiens
aauaaaagaacaugc

SEQ ID NO: 1365557 - RNA, 16 nt, Homo sapiens
aauaaaagaucuugaa

SEQ ID NO: 1365558 - RNA, 19 nt, Homo sapiens
aauaaacacauacaaugaa

SEQ ID NO: 1365559 - RNA, 15 nt, Homo sapiens
aauaaauaccaaaaa

SEQ ID NO: 1365560 - RNA, 19 nt, Homo sapiens
aauaagcauaccauugaaa

SEQ ID NO: 1365561 - RNA, 16 nt, Homo sapiens
aauaauccaaauccau

SEQ ID NO: 1365562 - RNA, 13 nt, Homo sapiens
aauaauccagaaa

SEQ ID NO: 1365563 - RNA, 20 nt, Homo sapiens
aauaauccagaaaaacugug

SEQ ID NO: 1365564 - RNA, 11 nt, Homo sapiens
aauaaugcaaa

SEQ ID NO: 1365565 - RNA, 10 nt, Homo sapiens
aauagaucuc

SEQ ID NO: 1365566 - RNA, 14 nt, Homo sapiens
aauaguauuugcau

SEQ ID NO: 1365567 - RNA, 20 nt, Homo sapiens
aauauaauaggacaaucauc

SEQ ID NO: 1365568 - RNA, 15 nt, Homo sapiens
aauaucaugcuccau

SEQ ID NO: 1365569 - RNA, 13 nt, Homo sapiens
aauauccauauag

SEQ ID NO: 1365570 - RNA, 19 nt, Homo sapiens
aauauuccaggaugcugcu

SEQ ID NO: 1365571 - RNA, 18 nt, Homo sapiens
aauauuuaaaaaugucuu

SEQ ID NO: 1365572 - RNA, 23 nt, Homo sapiens
aauauuuaaccccacacagcacu

SEQ ID NO: 1365573 - RNA, 15 nt, Homo sapiens
aauauuuuaucuuuc

SEQ ID NO: 1365574 - RNA, 18 nt, Homo sapiens
aaucaaguuggcuucuaa

SEQ ID NO: 1365575 - RNA, 15 nt, Homo sapiens
aaucagacucuuuag

SEQ ID NO: 1365576 - RNA, 18 nt, Homo sapiens
aaucaggaauauuuucca

SEQ ID NO: 1365577 - RNA, 21 nt, Homo sapiens
aaucauguugaucauguacuu

SEQ ID NO: 1365578 - RNA, 22 nt, Homo sapiens
aauccuagcacuugucucagga

SEQ ID NO: 1365579 - RNA, 12 nt, Homo sapiens
aauccucucuau

SEQ ID NO: 1365580 - RNA, 16 nt, Homo sapiens
aaucuaugccuaaaaa

SEQ ID NO: 1365581 - RNA, 22 nt, Homo sapiens
aaucuaugccuaaaaaguauca

SEQ ID NO: 1365582 - RNA, 12 nt, Homo sapiens
aaucuccucuga

SEQ ID NO: 1365583 - RNA, 21 nt, Homo sapiens
aaucugaccaaaacaaacaaa

SEQ ID NO: 1365584 - RNA, 22 nt, Homo sapiens
aaucugaguagagcagccacaa

SEQ ID NO: 1365585 - RNA, 14 nt, Homo sapiens
aaucuuaugcucuc

SEQ ID NO: 1365586 - RNA, 16 nt, Homo sapiens
aaucuugcucacagcu

SEQ ID NO: 1365587 - RNA, 15 nt, Homo sapiens
aaugagguaaauaag

SEQ ID NO: 1365588 - RNA, 17 nt, Homo sapiens
aaugauguaauauucca

SEQ ID NO: 1365589 - RNA, 19 nt, Homo sapiens
aaugaugucguuugaauca

SEQ ID NO: 1365590 - RNA, 13 nt, Homo sapiens
aauggggccagau

SEQ ID NO: 1365591 - RNA, 19 nt, Homo sapiens
aauggggcggggcuucucu

SEQ ID NO: 1365592 - RNA, 21 nt, Homo sapiens
aauguaaaauccuacagugaa

SEQ ID NO: 1365593 - RNA, 18 nt, Homo sapiens
aauguauuauaacuuuaa

SEQ ID NO: 1365594 - RNA, 16 nt, Homo sapiens
aauguccuuggcauca

SEQ ID NO: 1365595 - RNA, 23 nt, Homo sapiens
aaugucuugcuguugacauauuu

SEQ ID NO: 1365596 - RNA, 15 nt, Homo sapiens
aauguuuaaacauuu

SEQ ID NO: 1365597 - RNA, 17 nt, Homo sapiens
aauguuuucuuugcaaa

SEQ ID NO: 1365598 - RNA, 17 nt, Homo sapiens
aauuaaaaaagcauacu

SEQ ID NO: 1365599 - RNA, 18 nt, Homo sapiens
aauuaaaacacuuucaaa

SEQ ID NO: 1365600 - RNA, 18 nt, Homo sapiens
aauuaaaauucucaaaaa

SEQ ID NO: 1365601 - RNA, 22 nt, Homo sapiens
aauuaaagugaauuguugacaa

SEQ ID NO: 1365602 - RNA, 16 nt, Homo sapiens
aauuaauuuacuagaa

SEQ ID NO: 1365603 - RNA, 23 nt, Homo sapiens
aauuacacacuugcaugacaaag

SEQ ID NO: 1365604 - RNA, 15 nt, Homo sapiens
aauuacuuggcuuuu

SEQ ID NO: 1365605 - RNA, 16 nt, Homo sapiens
aauuauacuacuuugu

SEQ ID NO: 1365606 - RNA, 15 nt, Homo sapiens
aauuauaucacuuca

SEQ ID NO: 1365607 - RNA, 21 nt, Homo sapiens
aauuauaucacuucacuguuc

SEQ ID NO: 1365608 - RNA, 17 nt, Homo sapiens
aauuccacagauuauca

SEQ ID NO: 1365609 - RNA, 14 nt, Homo sapiens
aauugggauuugca

SEQ ID NO: 1365610 - RNA, 16 nt, Homo sapiens
aauuguacuaaagcca

SEQ ID NO: 1365611 - RNA, 16 nt, Homo sapiens
aauuguauuucaaaaa

SEQ ID NO: 1365612 - RNA, 18 nt, Homo sapiens
aauuguuucauucauccu

SEQ ID NO: 1365613 - RNA, 23 nt, Homo sapiens
aauuuaauucuuguucuuugcac

SEQ ID NO: 1365614 - RNA, 21 nt, Homo sapiens
aauuuaguuuguacucagugg

SEQ ID NO: 1365615 - RNA, 16 nt, Homo sapiens
aauuugugauggaauc

SEQ ID NO: 1365616 - RNA, 20 nt, Homo sapiens
aauuuucugaaacugcauaa

SEQ ID NO: 1365617 - RNA, 18 nt, Homo sapiens
aauuuucuuccauuucau

SEQ ID NO: 1365618 - RNA, 21 nt, Homo sapiens
aauuuuuacuuagauacuaau

SEQ ID NO: 1365619 - RNA, 14 nt, Homo sapiens
acaaaaaccaaaug

SEQ ID NO: 1365620 - RNA, 14 nt, Homo sapiens
acaaaacccuuucu

SEQ ID NO: 1365621 - RNA, 17 nt, Homo sapiens
acaaaagccugugcagg

SEQ ID NO: 1365622 - RNA, 13 nt, Homo sapiens
acaaagauuugca

SEQ ID NO: 1365623 - RNA, 24 nt, Homo sapiens
acaaaggagagcuagcagcaggga

SEQ ID NO: 1365624 - RNA, 17 nt, Homo sapiens
acaaauauaaaauuaaa

SEQ ID NO: 1365625 - RNA, 13 nt, Homo sapiens
acaaauguaugau

SEQ ID NO: 1365626 - RNA, 20 nt, Homo sapiens
acaaccaaaaaauucuacaa

SEQ ID NO: 1365627 - RNA, 19 nt, Homo sapiens
acaacuuguauuuccaaac

SEQ ID NO: 1365628 - RNA, 21 nt, Homo sapiens
acaacuuguauuuccaaaccu

SEQ ID NO: 1365629 - RNA, 15 nt, Homo sapiens
acaagccaagaaaga

SEQ ID NO: 1365630 - RNA, 14 nt, Homo sapiens
acaagccugagaac

SEQ ID NO: 1365631 - RNA, 15 nt, Homo sapiens
acaagcuuacaaaga

SEQ ID NO: 1365632 - RNA, 18 nt, Homo sapiens
acaaggauagaugcuggc

SEQ ID NO: 1365633 - RNA, 13 nt, Homo sapiens
acaaguagcacac

SEQ ID NO: 1365634 - RNA, 18 nt, Homo sapiens
acaaguagcacacugagu

SEQ ID NO: 1365635 - RNA, 14 nt, Homo sapiens
acaagugauuuuca

SEQ ID NO: 1365636 - RNA, 15 nt, Homo sapiens
acaagugcugaacag

SEQ ID NO: 1365637 - RNA, 21 nt, Homo sapiens
acaauaaacgguacuugucau

SEQ ID NO: 1365638 - RNA, 15 nt, Homo sapiens
acaauccaucucuca

SEQ ID NO: 1365639 - RNA, 24 nt, Homo sapiens
acaauccaucucucaaguagugua

SEQ ID NO: 1365640 - RNA, 20 nt, Homo sapiens
acaaucuggcuuagugccac

SEQ ID NO: 1365641 - RNA, 15 nt, Homo sapiens
acaaugcuuugcccc

SEQ ID NO: 1365642 - RNA, 17 nt, Homo sapiens
acaauggcuuacuccag

SEQ ID NO: 1365643 - RNA, 16 nt, Homo sapiens
acaauugacaacaguu

SEQ ID NO: 1365644 - RNA, 18 nt, Homo sapiens
acacaaagacauugauuc

SEQ ID NO: 1365645 - RNA, 18 nt, Homo sapiens
acacaaggauagaugcug

SEQ ID NO: 1365646 - RNA, 20 nt, Homo sapiens
acacaaggauagaugcuggc

SEQ ID NO: 1365647 - RNA, 12 nt, Homo sapiens
acacacacaaac

SEQ ID NO: 1365648 - RNA, 13 nt, Homo sapiens
acacacuccauca

SEQ ID NO: 1365649 - RNA, 18 nt, Homo sapiens
acacacugaggcagggaa

SEQ ID NO: 1365650 - RNA, 20 nt, Homo sapiens
acacagagcuuuggucugug

SEQ ID NO: 1365651 - RNA, 16 nt, Homo sapiens
acaccagguagaacac

SEQ ID NO: 1365652 - RNA, 17 nt, Homo sapiens
acaccaugauuaaccac

SEQ ID NO: 1365653 - RNA, 23 nt, Homo sapiens
acacccaaguugaagacuuuguu

SEQ ID NO: 1365654 - RNA, 15 nt, Homo sapiens
acaccccaacacuuc

SEQ ID NO: 1365655 - RNA, 14 nt, Homo sapiens
acacuaacuaugca

SEQ ID NO: 1365656 - RNA, 20 nt, Homo sapiens
acacuaugaagauguuucaa

SEQ ID NO: 1365657 - RNA, 16 nt, Homo sapiens
acacucaaaagcuggg

SEQ ID NO: 1365658 - RNA, 21 nt, Homo sapiens
acacugggcuucuagaaccag

SEQ ID NO: 1365659 - RNA, 23 nt, Homo sapiens
acacuguaagaguucacauggaa

SEQ ID NO: 1365660 - RNA, 14 nt, Homo sapiens
acacuuacccaagg

SEQ ID NO: 1365661 - RNA, 17 nt, Homo sapiens
acacuuucaugcagugc

SEQ ID NO: 1365662 - RNA, 14 nt, Homo sapiens
acagacaggcucuu

SEQ ID NO: 1365663 - RNA, 11 nt, Homo sapiens
acagacauauu

SEQ ID NO: 1365664 - RNA, 17 nt, Homo sapiens
acagagcagaacuuuca

SEQ ID NO: 1365665 - RNA, 18 nt, Homo sapiens
acagaucuggaaccucag

SEQ ID NO: 1365666 - RNA, 22 nt, Homo sapiens
acagcaagguguggaggcuccu

SEQ ID NO: 1365667 - RNA, 23 nt, Homo sapiens
acagccccacccuggugggccaa

SEQ ID NO: 1365668 - RNA, 17 nt, Homo sapiens
acagccucacuccucag

SEQ ID NO: 1365669 - RNA, 15 nt, Homo sapiens
acagcuacacagauc

SEQ ID NO: 1365670 - RNA, 14 nt, Homo sapiens
acagcugugcucug

SEQ ID NO: 1365671 - RNA, 20 nt, Homo sapiens
acagcuuccccucucuccuc

SEQ ID NO: 1365672 - RNA, 20 nt, Homo sapiens
acaggaagcaccccaugcca

SEQ ID NO: 1365673 - RNA, 14 nt, Homo sapiens
acaggagcugggau

SEQ ID NO: 1365674 - RNA, 17 nt, Homo sapiens
acaggaggcaggcaugg

SEQ ID NO: 1365675 - RNA, 17 nt, Homo sapiens
acaggcaccugccaaca

SEQ ID NO: 1365676 - RNA, 21 nt, Homo sapiens
acagggcuguugucauuugua

SEQ ID NO: 1365677 - RNA, 19 nt, Homo sapiens
acagggucugcucuuucuc

SEQ ID NO: 1365678 - RNA, 24 nt, Homo sapiens
acagggucugcucuuucucugcca

SEQ ID NO: 1365679 - RNA, 17 nt, Homo sapiens
acagguguuggugacaa

SEQ ID NO: 1365680 - RNA, 19 nt, Homo sapiens
acagucuggagaagguauu

SEQ ID NO: 1365681 - RNA, 18 nt, Homo sapiens
acagugaaggcuguccuu

SEQ ID NO: 1365682 - RNA, 22 nt, Homo sapiens
acaguggaggaagagggacaga

SEQ ID NO: 1365683 - RNA, 13 nt, Homo sapiens
acagugucugugu

SEQ ID NO: 1365684 - RNA, 22 nt, Homo sapiens
acaguucagccuuuaucaagcu

SEQ ID NO: 1365685 - RNA, 16 nt, Homo sapiens
acaguucugucauaug

SEQ ID NO: 1365686 - RNA, 23 nt, Homo sapiens
acauagaaauggaaauuuugcua

SEQ ID NO: 1365687 - RNA, 23 nt, Homo sapiens
acauagugaaaccccaucucuac

SEQ ID NO: 1365688 - RNA, 15 nt, Homo sapiens
acauauauauuacaa

SEQ ID NO: 1365689 - RNA, 23 nt, Homo sapiens
acaucaugcuggaaccugcaaaa

SEQ ID NO: 1365690 - RNA, 12 nt, Homo sapiens
acaucucagugc

SEQ ID NO: 1365691 - RNA, 16 nt, Homo sapiens
acaucucagugcuguc

SEQ ID NO: 1365692 - RNA, 17 nt, Homo sapiens
acaugaaaaauaaucca

SEQ ID NO: 1365693 - RNA, 16 nt, Homo sapiens
acaugcuucagugcug

SEQ ID NO: 1365694 - RNA, 15 nt, Homo sapiens
acaugcuugaauauc

SEQ ID NO: 1365695 - RNA, 15 nt, Homo sapiens
acauguaauuugaug

SEQ ID NO: 1365696 - RNA, 15 nt, Homo sapiens
acaugugcacuugaa

SEQ ID NO: 1365697 - RNA, 10 nt, Homo sapiens
acaugugcuu

SEQ ID NO: 1365698 - RNA, 17 nt, Homo sapiens
acauguggggccagguc

SEQ ID NO: 1365699 - RNA, 17 nt, Homo sapiens
acauucccuugaucuca

SEQ ID NO: 1365700 - RNA, 17 nt, Homo sapiens
acauuggcaccuaaucc

SEQ ID NO: 1365701 - RNA, 20 nt, Homo sapiens
acauugugggauguucagca

SEQ ID NO: 1365702 - RNA, 21 nt, Homo sapiens
acauuguuuuguguaacauau

SEQ ID NO: 1365703 - RNA, 20 nt, Homo sapiens
acauuuauauaauacauuaa

SEQ ID NO: 1365704 - RNA, 23 nt, Homo sapiens
acauuuguguuuuuuucuagccu

SEQ ID NO: 1365705 - RNA, 22 nt, Homo sapiens
acauuuuauuuuuucuugcaaa

SEQ ID NO: 1365706 - RNA, 13 nt, Homo sapiens
accaagacugagc

SEQ ID NO: 1365707 - RNA, 19 nt, Homo sapiens
accaagacugagccagcuu

SEQ ID NO: 1365708 - RNA, 16 nt, Homo sapiens
accacaaaacuuuucu

SEQ ID NO: 1365709 - RNA, 14 nt, Homo sapiens
accaccaagccaag

SEQ ID NO: 1365710 - RNA, 16 nt, Homo sapiens
accacccuagucccuu

SEQ ID NO: 1365711 - RNA, 18 nt, Homo sapiens
accacugagccauccuca

SEQ ID NO: 1365712 - RNA, 14 nt, Homo sapiens
accacuucagcuga

SEQ ID NO: 1365713 - RNA, 14 nt, Homo sapiens
accagcagcgccuu

SEQ ID NO: 1365714 - RNA, 15 nt, Homo sapiens
accagcaguacucag

SEQ ID NO: 1365715 - RNA, 20 nt, Homo sapiens
accaggacucccuccucacc

SEQ ID NO: 1365716 - RNA, 20 nt, Homo sapiens
accaggauagagacuggaac

SEQ ID NO: 1365717 - RNA, 19 nt, Homo sapiens
accaggcugcucagggcug

SEQ ID NO: 1365718 - RNA, 11 nt, Homo sapiens
accagggacac

SEQ ID NO: 1365719 - RNA, 17 nt, Homo sapiens
accaggggcccuaccug

SEQ ID NO: 1365720 - RNA, 20 nt, Homo sapiens
accaguugugauacaauaaa

SEQ ID NO: 1365721 - RNA, 22 nt, Homo sapiens
accauuccauuuccaagcacuu

SEQ ID NO: 1365722 - RNA, 17 nt, Homo sapiens
accauugaaacaugcca

SEQ ID NO: 1365723 - RNA, 15 nt, Homo sapiens
accauuggcuugcca

SEQ ID NO: 1365724 - RNA, 23 nt, Homo sapiens
accauuugauagggaacugggga

SEQ ID NO: 1365725 - RNA, 14 nt, Homo sapiens
acccagaguggcuu

SEQ ID NO: 1365726 - RNA, 15 nt, Homo sapiens
acccaguagaugcca

SEQ ID NO: 1365727 - RNA, 19 nt, Homo sapiens
acccaguagaugccacuag

SEQ ID NO: 1365728 - RNA, 13 nt, Homo sapiens
acccagugcagaa

SEQ ID NO: 1365729 - RNA, 17 nt, Homo sapiens
acccaguuagcucucaa

SEQ ID NO: 1365730 - RNA, 15 nt, Homo sapiens
accccaaagcuuucc

SEQ ID NO: 1365731 - RNA, 22 nt, Homo sapiens
accccagauucaugcacuguag

SEQ ID NO: 1365732 - RNA, 16 nt, Homo sapiens
accccaucucuacuga

SEQ ID NO: 1365733 - RNA, 21 nt, Homo sapiens
accccucucuacuaaaaauac

SEQ ID NO: 1365734 - RNA, 20 nt, Homo sapiens
acccggcugcagaggccaga

SEQ ID NO: 1365735 - RNA, 19 nt, Homo sapiens
acccucuuagaaaaaccac

SEQ ID NO: 1365736 - RNA, 14 nt, Homo sapiens
acccugggggcaca

SEQ ID NO: 1365737 - RNA, 21 nt, Homo sapiens
acccugguuauugauguggcc

SEQ ID NO: 1365738 - RNA, 13 nt, Homo sapiens
acccuguccaaac

SEQ ID NO: 1365739 - RNA, 19 nt, Homo sapiens
acccuuguuuacacauacc

SEQ ID NO: 1365740 - RNA, 22 nt, Homo sapiens
acccuuucauaaagucuugccu

SEQ ID NO: 1365741 - RNA, 23 nt, Homo sapiens
acccuuucauaaagucuugccuu

SEQ ID NO: 1365742 - RNA, 11 nt, Homo sapiens
accgcacucca

SEQ ID NO: 1365743 - RNA, 15 nt, Homo sapiens
accuaauccaggcag

SEQ ID NO: 1365744 - RNA, 16 nt, Homo sapiens
accuagggaaugaacu

SEQ ID NO: 1365745 - RNA, 13 nt, Homo sapiens
accucaccaaaac

SEQ ID NO: 1365746 - RNA, 18 nt, Homo sapiens
accucaguuauuacaugu

SEQ ID NO: 1365747 - RNA, 18 nt, Homo sapiens
accuccaggaaacaugaa

SEQ ID NO: 1365748 - RNA, 21 nt, Homo sapiens
accuccucccuaaugcucacc

SEQ ID NO: 1365749 - RNA, 13 nt, Homo sapiens
accucuaugcaau

SEQ ID NO: 1365750 - RNA, 15 nt, Homo sapiens
accucugcacaagcu

SEQ ID NO: 1365751 - RNA, 12 nt, Homo sapiens
accucuguggac

SEQ ID NO: 1365752 - RNA, 14 nt, Homo sapiens
accucuuggcuuug

SEQ ID NO: 1365753 - RNA, 13 nt, Homo sapiens
accugauccugga

SEQ ID NO: 1365754 - RNA, 22 nt, Homo sapiens
accugauuccuguugcuuccag

SEQ ID NO: 1365755 - RNA, 12 nt, Homo sapiens
accugcaaaaaa

SEQ ID NO: 1365756 - RNA, 14 nt, Homo sapiens
accuggaccccagc

SEQ ID NO: 1365757 - RNA, 19 nt, Homo sapiens
accuggcagcucuggacag

SEQ ID NO: 1365758 - RNA, 13 nt, Homo sapiens
accuguauuccca

SEQ ID NO: 1365759 - RNA, 11 nt, Homo sapiens
accuguugaag

SEQ ID NO: 1365760 - RNA, 18 nt, Homo sapiens
acgacaagugcugaacag

SEQ ID NO: 1365761 - RNA, 16 nt, Homo sapiens
acgagaacgacaucac

SEQ ID NO: 1365762 - RNA, 18 nt, Homo sapiens
acgcaucagacagaugga

SEQ ID NO: 1365763 - RNA, 17 nt, Homo sapiens
acgccucccugagcacu

SEQ ID NO: 1365764 - RNA, 17 nt, Homo sapiens
acggacacucaaaagcu

SEQ ID NO: 1365765 - RNA, 16 nt, Homo sapiens
acggcggcaguauuga

SEQ ID NO: 1365766 - RNA, 23 nt, Homo sapiens
acggcuuccucauuccuugucuu

SEQ ID NO: 1365767 - RNA, 14 nt, Homo sapiens
acggggucuugcuc

SEQ ID NO: 1365768 - RNA, 20 nt, Homo sapiens
acggggucuugcucugucuc

SEQ ID NO: 1365769 - RNA, 15 nt, Homo sapiens
acgguguuuugccau

SEQ ID NO: 1365770 - RNA, 18 nt, Homo sapiens
acguaggugugacacuuu

SEQ ID NO: 1365771 - RNA, 16 nt, Homo sapiens
acguccugucuguuuc

SEQ ID NO: 1365772 - RNA, 15 nt, Homo sapiens
acguccuuccacuuc

SEQ ID NO: 1365773 - RNA, 22 nt, Homo sapiens
acgucugcagaaacagugcaag

SEQ ID NO: 1365774 - RNA, 15 nt, Homo sapiens
acguggguugcacug

SEQ ID NO: 1365775 - RNA, 23 nt, Homo sapiens
acuaaguaaccucuacaggcauu

SEQ ID NO: 1365776 - RNA, 16 nt, Homo sapiens
acuaauacagacuaug

SEQ ID NO: 1365777 - RNA, 13 nt, Homo sapiens
acuaaugagcaag

SEQ ID NO: 1365778 - RNA, 22 nt, Homo sapiens
acuaauggcaugagaaauacaa

SEQ ID NO: 1365779 - RNA, 19 nt, Homo sapiens
acuaauuauacuacuuugu

SEQ ID NO: 1365780 - RNA, 18 nt, Homo sapiens
acuacaagugauccucag

SEQ ID NO: 1365781 - RNA, 18 nt, Homo sapiens
acuacaauuuaaagcaaa

SEQ ID NO: 1365782 - RNA, 21 nt, Homo sapiens
acuacugacauguggggccag

SEQ ID NO: 1365783 - RNA, 16 nt, Homo sapiens
acuagaagggccaguc

SEQ ID NO: 1365784 - RNA, 23 nt, Homo sapiens
acuagagucugaacagcuguaau

SEQ ID NO: 1365785 - RNA, 16 nt, Homo sapiens
acuagccacugagaag

SEQ ID NO: 1365786 - RNA, 17 nt, Homo sapiens
acuauuguaaggucuau

SEQ ID NO: 1365787 - RNA, 17 nt, Homo sapiens
acucaaauggggccaga

SEQ ID NO: 1365788 - RNA, 20 nt, Homo sapiens
acucaaguaccaccaaggga

SEQ ID NO: 1365789 - RNA, 19 nt, Homo sapiens
acucacauccauucuuccc

SEQ ID NO: 1365790 - RNA, 20 nt, Homo sapiens
acucacuuaucccaagagaa

SEQ ID NO: 1365791 - RNA, 21 nt, Homo sapiens
acucacuuucccuugugucaa

SEQ ID NO: 1365792 - RNA, 19 nt, Homo sapiens
acucaguggacagugcugu

SEQ ID NO: 1365793 - RNA, 21 nt, Homo sapiens
acucaguggacagugcuguug

SEQ ID NO: 1365794 - RNA, 20 nt, Homo sapiens
acucgcaccucuuggcuuug

SEQ ID NO: 1365795 - RNA, 22 nt, Homo sapiens
acucuccagaaagcucaucuca

SEQ ID NO: 1365796 - RNA, 17 nt, Homo sapiens
acucugccucuguauau

SEQ ID NO: 1365797 - RNA, 17 nt, Homo sapiens
acucugugaucuugcuc

SEQ ID NO: 1365798 - RNA, 22 nt, Homo sapiens
acucuguuccuacuggagauac

SEQ ID NO: 1365799 - RNA, 17 nt, Homo sapiens
acugaagggguucucac

SEQ ID NO: 1365800 - RNA, 19 nt, Homo sapiens
acugagaagugcacuuuaa

SEQ ID NO: 1365801 - RNA, 17 nt, Homo sapiens
acugagccauccucagc

SEQ ID NO: 1365802 - RNA, 20 nt, Homo sapiens
acugagccuccacagcagug

SEQ ID NO: 1365803 - RNA, 15 nt, Homo sapiens
acugaggcagggaag

SEQ ID NO: 1365804 - RNA, 22 nt, Homo sapiens
acugaguagcucuccugacuuu

SEQ ID NO: 1365805 - RNA, 19 nt, Homo sapiens
acugaugaccgucugagcc

SEQ ID NO: 1365806 - RNA, 17 nt, Homo sapiens
acugcaaacccuuucau

SEQ ID NO: 1365807 - RNA, 14 nt, Homo sapiens
acugcaaaccgcca

SEQ ID NO: 1365808 - RNA, 20 nt, Homo sapiens
acugcacuccagccugggug

SEQ ID NO: 1365809 - RNA, 13 nt, Homo sapiens
acugcagcuuugu

SEQ ID NO: 1365810 - RNA, 20 nt, Homo sapiens
acugcauaccaaccugggca

SEQ ID NO: 1365811 - RNA, 22 nt, Homo sapiens
acugcaucguuucaucuuccaa

SEQ ID NO: 1365812 - RNA, 14 nt, Homo sapiens
acugccagugcaga

SEQ ID NO: 1365813 - RNA, 23 nt, Homo sapiens
acugccccccugccuugcucccc

SEQ ID NO: 1365814 - RNA, 14 nt, Homo sapiens
acugccuaagcccu

SEQ ID NO: 1365815 - RNA, 20 nt, Homo sapiens
acugccuucgcuucuugccu

SEQ ID NO: 1365816 - RNA, 18 nt, Homo sapiens
acugcugagauacauaca

SEQ ID NO: 1365817 - RNA, 23 nt, Homo sapiens
acugcuggggagacaaaucucag

SEQ ID NO: 1365818 - RNA, 12 nt, Homo sapiens
acugcugugagc

SEQ ID NO: 1365819 - RNA, 17 nt, Homo sapiens
acuggaagaaagcaaca

SEQ ID NO: 1365820 - RNA, 13 nt, Homo sapiens
acugggcuucuag

SEQ ID NO: 1365821 - RNA, 17 nt, Homo sapiens
acuggugcacuuuguaa

SEQ ID NO: 1365822 - RNA, 20 nt, Homo sapiens
acugguuuuaccuccaggaa

SEQ ID NO: 1365823 - RNA, 20 nt, Homo sapiens
acugugaaauaccacaagcc

SEQ ID NO: 1365824 - RNA, 21 nt, Homo sapiens
acuguggcuagugacaaauaa

SEQ ID NO: 1365825 - RNA, 16 nt, Homo sapiens
acuguggugugcagug

SEQ ID NO: 1365826 - RNA, 20 nt, Homo sapiens
acuguuauagaauagccuga

SEQ ID NO: 1365827 - RNA, 17 nt, Homo sapiens
acuguuuuucagggagg

SEQ ID NO: 1365828 - RNA, 20 nt, Homo sapiens
acuuaaaaagaaaaccucau

SEQ ID NO: 1365829 - RNA, 19 nt, Homo sapiens
acuuaaacuuuuaucacug

SEQ ID NO: 1365830 - RNA, 14 nt, Homo sapiens
acuuagucaugagg

SEQ ID NO: 1365831 - RNA, 16 nt, Homo sapiens
acuuauuaacaauuag

SEQ ID NO: 1365832 - RNA, 14 nt, Homo sapiens
acuuauuuuaauuc

SEQ ID NO: 1365833 - RNA, 17 nt, Homo sapiens
acuucauagaaaccucu

SEQ ID NO: 1365834 - RNA, 14 nt, Homo sapiens
acuuccagcauuua

SEQ ID NO: 1365835 - RNA, 17 nt, Homo sapiens
acuuccccacaggugaa

SEQ ID NO: 1365836 - RNA, 20 nt, Homo sapiens
acuucucccaaaguguccua

SEQ ID NO: 1365837 - RNA, 20 nt, Homo sapiens
acuucucuaacaucuagccc

SEQ ID NO: 1365838 - RNA, 14 nt, Homo sapiens
acuugaagauuucu

SEQ ID NO: 1365839 - RNA, 11 nt, Homo sapiens
acuugccaguu

SEQ ID NO: 1365840 - RNA, 17 nt, Homo sapiens
acuugcccuucagcuca

SEQ ID NO: 1365841 - RNA, 19 nt, Homo sapiens
acuugcuuaucaacuuccu

SEQ ID NO: 1365842 - RNA, 23 nt, Homo sapiens
acuuggcucgaaucucugugccu

SEQ ID NO: 1365843 - RNA, 23 nt, Homo sapiens
acuuggggaguuaagaccuggca

SEQ ID NO: 1365844 - RNA, 16 nt, Homo sapiens
acuuguuccagcucuu

SEQ ID NO: 1365845 - RNA, 13 nt, Homo sapiens
acuuuagaauuaa

SEQ ID NO: 1365846 - RNA, 13 nt, Homo sapiens
acuuuaucaauua

SEQ ID NO: 1365847 - RNA, 17 nt, Homo sapiens
acuuuccucgccugaca

SEQ ID NO: 1365848 - RNA, 19 nt, Homo sapiens
acuuugagcugagugcuga

SEQ ID NO: 1365849 - RNA, 22 nt, Homo sapiens
acuuuguuuagcccaaaaccaa

SEQ ID NO: 1365850 - RNA, 13 nt, Homo sapiens
acuuuuaauguca

SEQ ID NO: 1365851 - RNA, 18 nt, Homo sapiens
acuuuucggucuuuccca

SEQ ID NO: 1365852 - RNA, 21 nt, Homo sapiens
agaaaauaguuuggauuacuu

SEQ ID NO: 1365853 - RNA, 13 nt, Homo sapiens
agaaacacugggc

SEQ ID NO: 1365854 - RNA, 14 nt, Homo sapiens
agaaacagccugug

SEQ ID NO: 1365855 - RNA, 13 nt, Homo sapiens
agaaacagugcaa

SEQ ID NO: 1365856 - RNA, 22 nt, Homo sapiens
agaaagaaaaauuaucuugaau

SEQ ID NO: 1365857 - RNA, 15 nt, Homo sapiens
agaaagcucaucuca

SEQ ID NO: 1365858 - RNA, 18 nt, Homo sapiens
agaaaucuagaagacugu

SEQ ID NO: 1365859 - RNA, 23 nt, Homo sapiens
agaaaucuggcuucuggccagga

SEQ ID NO: 1365860 - RNA, 20 nt, Homo sapiens
agaaauucauuaugcugcua

SEQ ID NO: 1365861 - RNA, 19 nt, Homo sapiens
agaacacagugauuuuauu

SEQ ID NO: 1365862 - RNA, 19 nt, Homo sapiens
agaacagguguuggugaca

SEQ ID NO: 1365863 - RNA, 21 nt, Homo sapiens
agaacagguguuggugacaau

SEQ ID NO: 1365864 - RNA, 21 nt, Homo sapiens
agaacucaaauggggccagau

SEQ ID NO: 1365865 - RNA, 14 nt, Homo sapiens
agaacuccuaccug

SEQ ID NO: 1365866 - RNA, 18 nt, Homo sapiens
agaacugucauguaaaca

SEQ ID NO: 1365867 - RNA, 18 nt, Homo sapiens
agaagacauauaaauuaa

SEQ ID NO: 1365868 - RNA, 13 nt, Homo sapiens
agaagcacuacac

SEQ ID NO: 1365869 - RNA, 23 nt, Homo sapiens
agaaggaaaaaauaaaagaucuu

SEQ ID NO: 1365870 - RNA, 20 nt, Homo sapiens
agaaguggagauuucaguuc

SEQ ID NO: 1365871 - RNA, 22 nt, Homo sapiens
agaauaaagccucugugcugca

SEQ ID NO: 1365872 - RNA, 23 nt, Homo sapiens
agaauaaagccucugugcugcac

SEQ ID NO: 1365873 - RNA, 13 nt, Homo sapiens
agaauacacagga

SEQ ID NO: 1365874 - RNA, 23 nt, Homo sapiens
agaaucggcuuugcagugcacuu

SEQ ID NO: 1365875 - RNA, 17 nt, Homo sapiens
agaaucuugguuugccu

SEQ ID NO: 1365876 - RNA, 13 nt, Homo sapiens
agaaugcaucuca

SEQ ID NO: 1365877 - RNA, 15 nt, Homo sapiens
agaauggaaggugga

SEQ ID NO: 1365878 - RNA, 19 nt, Homo sapiens
agaauguuaaaaagugaaa

SEQ ID NO: 1365879 - RNA, 16 nt, Homo sapiens
agaauuagauuucuau

SEQ ID NO: 1365880 - RNA, 21 nt, Homo sapiens
agaauuauaauuaguuccuca

SEQ ID NO: 1365881 - RNA, 22 nt, Homo sapiens
agaauuauaucacuucacuguu

SEQ ID NO: 1365882 - RNA, 17 nt, Homo sapiens
agaauuaugcuguuaaa

SEQ ID NO: 1365883 - RNA, 23 nt, Homo sapiens
agaauuuaguuuguacucagugg

SEQ ID NO: 1365884 - RNA, 24 nt, Homo sapiens
agaauuuaguuuguacucagugga

SEQ ID NO: 1365885 - RNA, 11 nt, Homo sapiens
agaauuugcac

SEQ ID NO: 1365886 - RNA, 22 nt, Homo sapiens
agacaaugugaaaagaaaaaug

SEQ ID NO: 1365887 - RNA, 15 nt, Homo sapiens
agacacaaggugauu

SEQ ID NO: 1365888 - RNA, 17 nt, Homo sapiens
agacacuugcugaguga

SEQ ID NO: 1365889 - RNA, 15 nt, Homo sapiens
agacagcuacacaga

SEQ ID NO: 1365890 - RNA, 18 nt, Homo sapiens
agacaugagcauggcuga

SEQ ID NO: 1365891 - RNA, 21 nt, Homo sapiens
agaccacgcccguccugccug

SEQ ID NO: 1365892 - RNA, 22 nt, Homo sapiens
agaccacgcccguccugccugu

SEQ ID NO: 1365893 - RNA, 15 nt, Homo sapiens
agaccauagugacca

SEQ ID NO: 1365894 - RNA, 17 nt, Homo sapiens
agacccccacaccucag

SEQ ID NO: 1365895 - RNA, 17 nt, Homo sapiens
agacgaaauagugacau

SEQ ID NO: 1365896 - RNA, 19 nt, Homo sapiens
agacuaacaaaggcagcug

SEQ ID NO: 1365897 - RNA, 19 nt, Homo sapiens
agacucagacauuggcacc

SEQ ID NO: 1365898 - RNA, 16 nt, Homo sapiens
agacucccaagcugga

SEQ ID NO: 1365899 - RNA, 17 nt, Homo sapiens
agacucccaagcuggac

SEQ ID NO: 1365900 - RNA, 19 nt, Homo sapiens
agacuccuuugcuaaugcu

SEQ ID NO: 1365901 - RNA, 20 nt, Homo sapiens
agacugcaaacccuuucaua

SEQ ID NO: 1365902 - RNA, 17 nt, Homo sapiens
agacugucagcuuccaa

SEQ ID NO: 1365903 - RNA, 19 nt, Homo sapiens
agacuguggcuagugacaa

SEQ ID NO: 1365904 - RNA, 15 nt, Homo sapiens
agacuuaacacuucu

SEQ ID NO: 1365905 - RNA, 17 nt, Homo sapiens
agacuuccaucuaguca

SEQ ID NO: 1365906 - RNA, 21 nt, Homo sapiens
agacuuccaucuagucacaaa

SEQ ID NO: 1365907 - RNA, 12 nt, Homo sapiens
agacuuugacuc

SEQ ID NO: 1365908 - RNA, 21 nt, Homo sapiens
agacuuuuguuaugaggagcu

SEQ ID NO: 1365909 - RNA, 16 nt, Homo sapiens
agagacgcagacaugu

SEQ ID NO: 1365910 - RNA, 18 nt, Homo sapiens
agagacgguguuuugcca

SEQ ID NO: 1365911 - RNA, 23 nt, Homo sapiens
agagacucuccugccucagccuc

SEQ ID NO: 1365912 - RNA, 16 nt, Homo sapiens
agagacugugccaugg

SEQ ID NO: 1365913 - RNA, 20 nt, Homo sapiens
agagagaaaguuucguuaua

SEQ ID NO: 1365914 - RNA, 13 nt, Homo sapiens
agagagcugccau

SEQ ID NO: 1365915 - RNA, 20 nt, Homo sapiens
agagauuugguuaagcucac

SEQ ID NO: 1365916 - RNA, 21 nt, Homo sapiens
agagcaacaauccaucucuca

SEQ ID NO: 1365917 - RNA, 20 nt, Homo sapiens
agagcaagacucugucucaa

SEQ ID NO: 1365918 - RNA, 18 nt, Homo sapiens
agagccuucaagugccaa

SEQ ID NO: 1365919 - RNA, 23 nt, Homo sapiens
agagcugggauguuucugucaca

SEQ ID NO: 1365920 - RNA, 15 nt, Homo sapiens
agaggcuguucccac

SEQ ID NO: 1365921 - RNA, 22 nt, Homo sapiens
agagggacagaugaaugccgug

SEQ ID NO: 1365922 - RNA, 23 nt, Homo sapiens
agaggugucacccaaaccggcag

SEQ ID NO: 1365923 - RNA, 22 nt, Homo sapiens
agagucuaauagucuuugccag

SEQ ID NO: 1365924 - RNA, 20 nt, Homo sapiens
agagugagaccccaucucua

SEQ ID NO: 1365925 - RNA, 21 nt, Homo sapiens
agaguggccuggccaggagcu

SEQ ID NO: 1365926 - RNA, 23 nt, Homo sapiens
agagugucuucacggcaggacaa

SEQ ID NO: 1365927 - RNA, 24 nt, Homo sapiens
agaguuuccugaaacaacuuggaa

SEQ ID NO: 1365928 - RNA, 15 nt, Homo sapiens
agauaauuguuucau

SEQ ID NO: 1365929 - RNA, 17 nt, Homo sapiens
agauaauuguuucauuc

SEQ ID NO: 1365930 - RNA, 17 nt, Homo sapiens
agauacauacagaauua

SEQ ID NO: 1365931 - RNA, 19 nt, Homo sapiens
agauaccagagacucugaa

SEQ ID NO: 1365932 - RNA, 12 nt, Homo sapiens
agaucacagugu

SEQ ID NO: 1365933 - RNA, 16 nt, Homo sapiens
agaucacgagaucaag

SEQ ID NO: 1365934 - RNA, 22 nt, Homo sapiens
agaucacuucaggucaggaguu

SEQ ID NO: 1365935 - RNA, 21 nt, Homo sapiens
agaucagccugggcaauguga

SEQ ID NO: 1365936 - RNA, 15 nt, Homo sapiens
agaucaugaguuugu

SEQ ID NO: 1365937 - RNA, 15 nt, Homo sapiens
agauccuuaaaaccu

SEQ ID NO: 1365938 - RNA, 19 nt, Homo sapiens
agaucuggaaccucagccu

SEQ ID NO: 1365939 - RNA, 17 nt, Homo sapiens
agaucuguccucagccu

SEQ ID NO: 1365940 - RNA, 14 nt, Homo sapiens
agaucuuaagauuc

SEQ ID NO: 1365941 - RNA, 17 nt, Homo sapiens
agaucuuaagauuccau

SEQ ID NO: 1365942 - RNA, 19 nt, Homo sapiens
agaucuugaauagucucau

SEQ ID NO: 1365943 - RNA, 22 nt, Homo sapiens
agaugagaaaacaggcucacag

SEQ ID NO: 1365944 - RNA, 22 nt, Homo sapiens
agaugcacagaauauguaugua

SEQ ID NO: 1365945 - RNA, 15 nt, Homo sapiens
agaugcauccaugua

SEQ ID NO: 1365946 - RNA, 19 nt, Homo sapiens
agaugcauuaucuaugaua

SEQ ID NO: 1365947 - RNA, 15 nt, Homo sapiens
agauggaaaaacuga

SEQ ID NO: 1365948 - RNA, 22 nt, Homo sapiens
agaugugugauucacaguguga

SEQ ID NO: 1365949 - RNA, 18 nt, Homo sapiens
agauuagcuaggggacag

SEQ ID NO: 1365950 - RNA, 15 nt, Homo sapiens
agauuauaacaaauu

SEQ ID NO: 1365951 - RNA, 15 nt, Homo sapiens
agauucaugcacugu

SEQ ID NO: 1365952 - RNA, 22 nt, Homo sapiens
agauugagaagccauguacuca

SEQ ID NO: 1365953 - RNA, 12 nt, Homo sapiens
agauuguagcug

SEQ ID NO: 1365954 - RNA, 20 nt, Homo sapiens
agauuugauguugugaaaua

SEQ ID NO: 1365955 - RNA, 13 nt, Homo sapiens
agcaaagcaaaag

SEQ ID NO: 1365956 - RNA, 21 nt, Homo sapiens
agcaaagcaaaaggcugagaa

SEQ ID NO: 1365957 - RNA, 17 nt, Homo sapiens
agcaacaaaaauuacuc

SEQ ID NO: 1365958 - RNA, 22 nt, Homo sapiens
agcaacaucuuuuuaaccugca

SEQ ID NO: 1365959 - RNA, 22 nt, Homo sapiens
agcaagaggaaggggugcugug

SEQ ID NO: 1365960 - RNA, 18 nt, Homo sapiens
agcaaguguucacugcuc

SEQ ID NO: 1365961 - RNA, 13 nt, Homo sapiens
agcacacugaguu

SEQ ID NO: 1365962 - RNA, 14 nt, Homo sapiens
agcaccccuugccg

SEQ ID NO: 1365963 - RNA, 17 nt, Homo sapiens
agcacuacaccuugccu

SEQ ID NO: 1365964 - RNA, 15 nt, Homo sapiens
agcacugccaccagu

SEQ ID NO: 1365965 - RNA, 23 nt, Homo sapiens
agcagaaaucuagaagacuguca

SEQ ID NO: 1365966 - RNA, 23 nt, Homo sapiens
agcagccagccaacccuuucauu

SEQ ID NO: 1365967 - RNA, 14 nt, Homo sapiens
agcaggauuucuca

SEQ ID NO: 1365968 - RNA, 16 nt, Homo sapiens
agcagguuaagaauuu

SEQ ID NO: 1365969 - RNA, 18 nt, Homo sapiens
agcagguuaccacucugg

SEQ ID NO: 1365970 - RNA, 20 nt, Homo sapiens
agcagguuaccacucuggca

SEQ ID NO: 1365971 - RNA, 21 nt, Homo sapiens
agcaucccuagucucuaccca

SEQ ID NO: 1365972 - RNA, 14 nt, Homo sapiens
agcaugaacuggcc

SEQ ID NO: 1365973 - RNA, 23 nt, Homo sapiens
agcaugaauaacauuuaaauucc

SEQ ID NO: 1365974 - RNA, 21 nt, Homo sapiens
agcaugacauuggcaucagcu

SEQ ID NO: 1365975 - RNA, 14 nt, Homo sapiens
agcauuuaaaaugg

SEQ ID NO: 1365976 - RNA, 19 nt, Homo sapiens
agcauuugauuaacauuug

SEQ ID NO: 1365977 - RNA, 15 nt, Homo sapiens
agccaaguuaagaau

SEQ ID NO: 1365978 - RNA, 15 nt, Homo sapiens
agccacaaccaaaaa

SEQ ID NO: 1365979 - RNA, 15 nt, Homo sapiens
agccacgaacuugcu

SEQ ID NO: 1365980 - RNA, 13 nt, Homo sapiens
agccagaacuuga

SEQ ID NO: 1365981 - RNA, 14 nt, Homo sapiens
agccagaacuugac

SEQ ID NO: 1365982 - RNA, 16 nt, Homo sapiens
agccaggcugccaagg

SEQ ID NO: 1365983 - RNA, 18 nt, Homo sapiens
agccagggcugucuucgu

SEQ ID NO: 1365984 - RNA, 18 nt, Homo sapiens
agccagugaggaugacag

SEQ ID NO: 1365985 - RNA, 20 nt, Homo sapiens
agcccagagacauacuugaa

SEQ ID NO: 1365986 - RNA, 16 nt, Homo sapiens
agccccaggggacaag

SEQ ID NO: 1365987 - RNA, 13 nt, Homo sapiens
agccccaucagcu

SEQ ID NO: 1365988 - RNA, 15 nt, Homo sapiens
agcccggacugacca

SEQ ID NO: 1365989 - RNA, 19 nt, Homo sapiens
agcccggacugaccaaauc

SEQ ID NO: 1365990 - RNA, 15 nt, Homo sapiens
agcccuccucuccca

SEQ ID NO: 1365991 - RNA, 23 nt, Homo sapiens
agcccuccucucccagugacaac

SEQ ID NO: 1365992 - RNA, 19 nt, Homo sapiens
agcccugcagucacagcua

SEQ ID NO: 1365993 - RNA, 20 nt, Homo sapiens
agccgacaccuuuuuucaac

SEQ ID NO: 1365994 - RNA, 19 nt, Homo sapiens
agccgagaucgugccauug

SEQ ID NO: 1365995 - RNA, 15 nt, Homo sapiens
agccgccaggacaca

SEQ ID NO: 1365996 - RNA, 18 nt, Homo sapiens
agccgugaauucaguugg

SEQ ID NO: 1365997 - RNA, 16 nt, Homo sapiens
agccuaacuccauccc

SEQ ID NO: 1365998 - RNA, 15 nt, Homo sapiens
agccucacuccucag

SEQ ID NO: 1365999 - RNA, 16 nt, Homo sapiens
agccuccagguuuccu

SEQ ID NO: 1366000 - RNA, 16 nt, Homo sapiens
agccucugaaaaccaa

SEQ ID NO: 1366001 - RNA, 14 nt, Homo sapiens
agccucugugcugc

SEQ ID NO: 1366002 - RNA, 14 nt, Homo sapiens
agccuggacccugu

SEQ ID NO: 1366003 - RNA, 16 nt, Homo sapiens
agccuggccaacaugg

SEQ ID NO: 1366004 - RNA, 15 nt, Homo sapiens
agccugggcaaugug

SEQ ID NO: 1366005 - RNA, 14 nt, Homo sapiens
agccugggugacaa

SEQ ID NO: 1366006 - RNA, 13 nt, Homo sapiens
agccugugcaaaa

SEQ ID NO: 1366007 - RNA, 14 nt, Homo sapiens
agccugugcaaaaa

SEQ ID NO: 1366008 - RNA, 19 nt, Homo sapiens
agccuucugugcugugagu

SEQ ID NO: 1366009 - RNA, 15 nt, Homo sapiens
agcgaggagugacug

SEQ ID NO: 1366010 - RNA, 23 nt, Homo sapiens
agcgcugugugguaacucagugu

SEQ ID NO: 1366011 - RNA, 12 nt, Homo sapiens
agcggcccugag

SEQ ID NO: 1366012 - RNA, 16 nt, Homo sapiens
agcgugugacuacucc

SEQ ID NO: 1366013 - RNA, 17 nt, Homo sapiens
agcuaacaaguagcaca

SEQ ID NO: 1366014 - RNA, 14 nt, Homo sapiens
agcuaagaaccugg

SEQ ID NO: 1366015 - RNA, 19 nt, Homo sapiens
agcuacacagaucacagcu

SEQ ID NO: 1366016 - RNA, 19 nt, Homo sapiens
agcuagaggaaccaacccc

SEQ ID NO: 1366017 - RNA, 21 nt, Homo sapiens
agcuaggaugguucugugacc

SEQ ID NO: 1366018 - RNA, 17 nt, Homo sapiens
agcuaugggagccccag

SEQ ID NO: 1366019 - RNA, 20 nt, Homo sapiens
agcucaggucccaggccagc

SEQ ID NO: 1366020 - RNA, 12 nt, Homo sapiens
agcucaucucag

SEQ ID NO: 1366021 - RNA, 18 nt, Homo sapiens
agcuccacuuucagugaa

SEQ ID NO: 1366022 - RNA, 18 nt, Homo sapiens
agcucuguauggucagga

SEQ ID NO: 1366023 - RNA, 21 nt, Homo sapiens
agcucuucaggccucccucuc

SEQ ID NO: 1366024 - RNA, 17 nt, Homo sapiens
agcugaauuuucuggaa

SEQ ID NO: 1366025 - RNA, 17 nt, Homo sapiens
agcugacauugccaaaa

SEQ ID NO: 1366026 - RNA, 19 nt, Homo sapiens
agcugaccgggucacacaa

SEQ ID NO: 1366027 - RNA, 13 nt, Homo sapiens
agcugagugcuga

SEQ ID NO: 1366028 - RNA, 20 nt, Homo sapiens
agcugcaccccggacgggcg

SEQ ID NO: 1366029 - RNA, 13 nt, Homo sapiens
agcugcacccuca

SEQ ID NO: 1366030 - RNA, 22 nt, Homo sapiens
agcugcaguucuuguggaagac

SEQ ID NO: 1366031 - RNA, 14 nt, Homo sapiens
agcugccucacuuc

SEQ ID NO: 1366032 - RNA, 20 nt, Homo sapiens
agcugcucggagcucagugc

SEQ ID NO: 1366033 - RNA, 16 nt, Homo sapiens
agcugcuggcuugcag

SEQ ID NO: 1366034 - RNA, 14 nt, Homo sapiens
caagugccaaacag

SEQ ID NO: 1366035 - RNA, 21 nt, Homo sapiens
caagugugggccacuguggug

SEQ ID NO: 1366036 - RNA, 12 nt, Homo sapiens
caaguguucacu

SEQ ID NO: 1366037 - RNA, 19 nt, Homo sapiens
caaguguucacugcuccuu

SEQ ID NO: 1366038 - RNA, 21 nt, Homo sapiens
caaguuaaugcaaaugacugu

SEQ ID NO: 1366039 - RNA, 22 nt, Homo sapiens
caaguuaaugcaaaugacuguc

SEQ ID NO: 1366040 - RNA, 20 nt, Homo sapiens
caaguuggcuucuaaucaaa

SEQ ID NO: 1366041 - RNA, 16 nt, Homo sapiens
caauaauuuuaacuuu

SEQ ID NO: 1366042 - RNA, 18 nt, Homo sapiens
caauauagcaagauccca

SEQ ID NO: 1366043 - RNA, 11 nt, Homo sapiens
caaucuaguaa

SEQ ID NO: 1366044 - RNA, 18 nt, Homo sapiens
caaucucugauucuguca

SEQ ID NO: 1366045 - RNA, 19 nt, Homo sapiens
caaucuggcuuagugccac

SEQ ID NO: 1366046 - RNA, 21 nt, Homo sapiens
caaucugugucauggacugua

SEQ ID NO: 1366047 - RNA, 23 nt, Homo sapiens
caaugcuauaacuauguugauaa

SEQ ID NO: 1366048 - RNA, 16 nt, Homo sapiens
caaugcuccaucccaa

SEQ ID NO: 1366049 - RNA, 11 nt, Homo sapiens
caaugggaccu

SEQ ID NO: 1366050 - RNA, 19 nt, Homo sapiens
caauucuuacaaacaugug

SEQ ID NO: 1366051 - RNA, 14 nt, Homo sapiens
caauugacaacagu

SEQ ID NO: 1366052 - RNA, 14 nt, Homo sapiens
caauugacugcccu

SEQ ID NO: 1366053 - RNA, 15 nt, Homo sapiens
caauuucagacuccc

SEQ ID NO: 1366054 - RNA, 15 nt, Homo sapiens
cacaaaacagccuuu

SEQ ID NO: 1366055 - RNA, 16 nt, Homo sapiens
cacaaagacuccuucg

SEQ ID NO: 1366056 - RNA, 13 nt, Homo sapiens
cacaaauuuguau

SEQ ID NO: 1366057 - RNA, 15 nt, Homo sapiens
cacaacacaguucuc

SEQ ID NO: 1366058 - RNA, 16 nt, Homo sapiens
cacaaggacuuccugu

SEQ ID NO: 1366059 - RNA, 18 nt, Homo sapiens
cacacaccuguagcacuu

SEQ ID NO: 1366060 - RNA, 16 nt, Homo sapiens
cacacccgugagaaau

SEQ ID NO: 1366061 - RNA, 21 nt, Homo sapiens
cacacgucuggcuucacagau

SEQ ID NO: 1366062 - RNA, 17 nt, Homo sapiens
cacacugaguuugaaca

SEQ ID NO: 1366063 - RNA, 21 nt, Homo sapiens
cacacuggagaaaaggcagua

SEQ ID NO: 1366064 - RNA, 14 nt, Homo sapiens
cacagaaugugaua

SEQ ID NO: 1366065 - RNA, 21 nt, Homo sapiens
cacagagauaauucuagcuuu

SEQ ID NO: 1366066 - RNA, 13 nt, Homo sapiens
cacaggaagugac

SEQ ID NO: 1366067 - RNA, 16 nt, Homo sapiens
cacaguaagucauuua

SEQ ID NO: 1366068 - RNA, 19 nt, Homo sapiens
cacagugucuguguacaug

SEQ ID NO: 1366069 - RNA, 18 nt, Homo sapiens
cacauacccucacuuaaa

SEQ ID NO: 1366070 - RNA, 22 nt, Homo sapiens
cacauauauauuacaagggaua

SEQ ID NO: 1366071 - RNA, 17 nt, Homo sapiens
cacauucgaguguuuca

SEQ ID NO: 1366072 - RNA, 15 nt, Homo sapiens
caccaaaacgaugaa

SEQ ID NO: 1366073 - RNA, 15 nt, Homo sapiens
caccaagacugagaa

SEQ ID NO: 1366074 - RNA, 20 nt, Homo sapiens
caccaagggaucugccauug

SEQ ID NO: 1366075 - RNA, 17 nt, Homo sapiens
caccaccgacugaagug

SEQ ID NO: 1366076 - RNA, 15 nt, Homo sapiens
caccaggucagggag

SEQ ID NO: 1366077 - RNA, 20 nt, Homo sapiens
caccauguacauagcuugau

SEQ ID NO: 1366078 - RNA, 21 nt, Homo sapiens
cacccaagagggcugcuuccc

SEQ ID NO: 1366079 - RNA, 14 nt, Homo sapiens
cacccaaugcauau

SEQ ID NO: 1366080 - RNA, 16 nt, Homo sapiens
cacccaccucaccaaa

SEQ ID NO: 1366081 - RNA, 16 nt, Homo sapiens
cacccaguugugacaa

SEQ ID NO: 1366082 - RNA, 15 nt, Homo sapiens
cacccugaaagcccu

SEQ ID NO: 1366083 - RNA, 23 nt, Homo sapiens
caccgccuccccaccuccaggcu

SEQ ID NO: 1366084 - RNA, 12 nt, Homo sapiens
caccuaauccag

SEQ ID NO: 1366085 - RNA, 16 nt, Homo sapiens
caccucugcacaagcu

SEQ ID NO: 1366086 - RNA, 18 nt, Homo sapiens
caccugcagccuguugaa

SEQ ID NO: 1366087 - RNA, 21 nt, Homo sapiens
caccuggaugucugggugacc

SEQ ID NO: 1366088 - RNA, 21 nt, Homo sapiens
caccugucaaacaaagccaga

SEQ ID NO: 1366089 - RNA, 17 nt, Homo sapiens
caccuugccuugcuguu

SEQ ID NO: 1366090 - RNA, 20 nt, Homo sapiens
caccuuggcuuguuauugcc

SEQ ID NO: 1366091 - RNA, 17 nt, Homo sapiens
caccuuugccacaaagc

SEQ ID NO: 1366092 - RNA, 19 nt, Homo sapiens
cacgacugcccggcagggu

SEQ ID NO: 1366093 - RNA, 16 nt, Homo sapiens
cacgagaucaagagau

SEQ ID NO: 1366094 - RNA, 19 nt, Homo sapiens
cacgcggaugccgccucaa

SEQ ID NO: 1366095 - RNA, 19 nt, Homo sapiens
cacggccaccacugcagcc

SEQ ID NO: 1366096 - RNA, 18 nt, Homo sapiens
cacggcguuguaccugua

SEQ ID NO: 1366097 - RNA, 19 nt, Homo sapiens
cacgguuuggaaauauuca

SEQ ID NO: 1366098 - RNA, 16 nt, Homo sapiens
cacuaaaagaucgcag

SEQ ID NO: 1366099 - RNA, 15 nt, Homo sapiens
cacuaaguaaccucu

SEQ ID NO: 1366100 - RNA, 19 nt, Homo sapiens
cacuaugaagauguuucaa

SEQ ID NO: 1366101 - RNA, 14 nt, Homo sapiens
cacucccaguccaa

SEQ ID NO: 1366102 - RNA, 13 nt, Homo sapiens
cacuccccuaggg

SEQ ID NO: 1366103 - RNA, 23 nt, Homo sapiens
cacuccgagaggugggccagucu

SEQ ID NO: 1366104 - RNA, 13 nt, Homo sapiens
cacucuguggcca

SEQ ID NO: 1366105 - RNA, 12 nt, Homo sapiens
cacugacuggaa

SEQ ID NO: 1366106 - RNA, 17 nt, Homo sapiens
cacugagccauccucag

SEQ ID NO: 1366107 - RNA, 14 nt, Homo sapiens
cacugcauaccaac

SEQ ID NO: 1366108 - RNA, 20 nt, Homo sapiens
cacugcuccuugcugcauug

SEQ ID NO: 1366109 - RNA, 14 nt, Homo sapiens
cacugggcuucuag

SEQ ID NO: 1366110 - RNA, 13 nt, Homo sapiens
cacuggucuguag

SEQ ID NO: 1366111 - RNA, 15 nt, Homo sapiens
cacugugaaaccccc

SEQ ID NO: 1366112 - RNA, 17 nt, Homo sapiens
cacuuaucccaagagaa

SEQ ID NO: 1366113 - RNA, 12 nt, Homo sapiens
cacuucaucuga

SEQ ID NO: 1366114 - RNA, 13 nt, Homo sapiens
cacuucaucugau

SEQ ID NO: 1366115 - RNA, 16 nt, Homo sapiens
cacuugaagaugcugc

SEQ ID NO: 1366116 - RNA, 21 nt, Homo sapiens
cuugcuuccccuuuugccaau

SEQ ID NO: 1366117 - RNA, 23 nt, Homo sapiens
cuuggacugaagggguucucaca

SEQ ID NO: 1366118 - RNA, 16 nt, Homo sapiens
cuuggcaccagacacc

SEQ ID NO: 1366119 - RNA, 20 nt, Homo sapiens
cuuggcaccagacacccagg

SEQ ID NO: 1366120 - RNA, 15 nt, Homo sapiens
cuuggggcccagugc

SEQ ID NO: 1366121 - RNA, 19 nt, Homo sapiens
cuugguaaaaacugcagug

SEQ ID NO: 1366122 - RNA, 23 nt, Homo sapiens
cuuguaaaugugguaaagaguua

SEQ ID NO: 1366123 - RNA, 17 nt, Homo sapiens
cuuguauuuccaaaccu

SEQ ID NO: 1366124 - RNA, 21 nt, Homo sapiens
cuugucaagccugugcaaaaa

SEQ ID NO: 1366125 - RNA, 23 nt, Homo sapiens
cuugucccacucaagccaagcag

SEQ ID NO: 1366126 - RNA, 16 nt, Homo sapiens
cuuguccucauucuug

SEQ ID NO: 1366127 - RNA, 19 nt, Homo sapiens
cuugugucaagacauuucu

SEQ ID NO: 1366128 - RNA, 20 nt, Homo sapiens
cuuguuauugccucuacuuu

SEQ ID NO: 1366129 - RNA, 16 nt, Homo sapiens
cuuguuuuugcacaug

SEQ ID NO: 1366130 - RNA, 16 nt, Homo sapiens
cuuuaaaaugcaaaau

SEQ ID NO: 1366131 - RNA, 14 nt, Homo sapiens
cuuuaaaaugccaa

SEQ ID NO: 1366132 - RNA, 17 nt, Homo sapiens
cuuuaacaguggagcug

SEQ ID NO: 1366133 - RNA, 16 nt, Homo sapiens
cuuuaggagauuuauu

SEQ ID NO: 1366134 - RNA, 14 nt, Homo sapiens
cuuuaucaccucau

SEQ ID NO: 1366135 - RNA, 22 nt, Homo sapiens
cuuuauuacaguuuaucuaugg

SEQ ID NO: 1366136 - RNA, 20 nt, Homo sapiens
cuuucaagcagucgugccug

SEQ ID NO: 1366137 - RNA, 21 nt, Homo sapiens
cuuucaggccacauggcuaaa

SEQ ID NO: 1366138 - RNA, 19 nt, Homo sapiens
cuuuccaugggaccacaac

SEQ ID NO: 1366139 - RNA, 20 nt, Homo sapiens
cuuucccauuucuaccuaag

SEQ ID NO: 1366140 - RNA, 17 nt, Homo sapiens
cuuuccuaaggcugcaa

SEQ ID NO: 1366141 - RNA, 20 nt, Homo sapiens
cuuuccucgccugacaacca

SEQ ID NO: 1366142 - RNA, 18 nt, Homo sapiens
cuuucucugccagugaca

SEQ ID NO: 1366143 - RNA, 20 nt, Homo sapiens
cuuucucugccagugacaga

SEQ ID NO: 1366144 - RNA, 14 nt, Homo sapiens
cuuucuucugaaua

SEQ ID NO: 1366145 - RNA, 22 nt, Homo sapiens
cuuugaagugacuucacagaga

SEQ ID NO: 1366146 - RNA, 14 nt, Homo sapiens
cuuugcaauccaaa

SEQ ID NO: 1366147 - RNA, 16 nt, Homo sapiens
cuuugccaaaauacca

SEQ ID NO: 1366148 - RNA, 14 nt, Homo sapiens
cuuugccacaaagc

SEQ ID NO: 1366149 - RNA, 21 nt, Homo sapiens
cuuugcccacaaugcuuugcc

SEQ ID NO: 1366150 - RNA, 22 nt, Homo sapiens
cuuugcccacguguccugaggg

SEQ ID NO: 1366151 - RNA, 14 nt, Homo sapiens
cuuugccccugaga

SEQ ID NO: 1366152 - RNA, 23 nt, Homo sapiens
cuuugcugugaggcuguccugua

SEQ ID NO: 1366153 - RNA, 20 nt, Homo sapiens
cuuugggccagacaugccac

SEQ ID NO: 1366154 - RNA, 21 nt, Homo sapiens
cuuugggccagacaugccaca

SEQ ID NO: 1366155 - RNA, 21 nt, Homo sapiens
cuuugggccuuuccucagugu

SEQ ID NO: 1366156 - RNA, 19 nt, Homo sapiens
cuuuguauauuacauacau

SEQ ID NO: 1366157 - RNA, 16 nt, Homo sapiens
cuuugucugucaauca

SEQ ID NO: 1366158 - RNA, 22 nt, Homo sapiens
cuuuguggauggugucuccuuu

SEQ ID NO: 1366159 - RNA, 14 nt, Homo sapiens
cuuuguuaggauuu

SEQ ID NO: 1366160 - RNA, 12 nt, Homo sapiens
cuuuguucucau

SEQ ID NO: 1366161 - RNA, 23 nt, Homo sapiens
cuuuguucuggggggacccagug

SEQ ID NO: 1366162 - RNA, 21 nt, Homo sapiens
cuuuuaguauuuuagugaacu

SEQ ID NO: 1366163 - RNA, 19 nt, Homo sapiens
cuuuucggucuuucccauu

SEQ ID NO: 1366164 - RNA, 21 nt, Homo sapiens
cuuuucuguccgagcuuugaa

SEQ ID NO: 1366165 - RNA, 15 nt, Homo sapiens
cuuuucuuuaccagu

SEQ ID NO: 1366166 - RNA, 19 nt, Homo sapiens
cuuuugcauaagugcauga

SEQ ID NO: 1366167 - RNA, 21 nt, Homo sapiens
cuuuugcauaagugcaugaca

SEQ ID NO: 1366168 - RNA, 14 nt, Homo sapiens
cuuuuucucaaaau

SEQ ID NO: 1366169 - RNA, 15 nt, Homo sapiens
gaaaaaaaaauggaa

SEQ ID NO: 1366170 - RNA, 18 nt, Homo sapiens
gaaaaaaaccacacaaag

SEQ ID NO: 1366171 - RNA, 22 nt, Homo sapiens
gaaaaaauguaugugucuccca

SEQ ID NO: 1366172 - RNA, 19 nt, Homo sapiens
gaaaaaccaccaccaucac

SEQ ID NO: 1366173 - RNA, 22 nt, Homo sapiens
gaaaagauacccaaaggucaag

SEQ ID NO: 1366174 - RNA, 23 nt, Homo sapiens
gaaaaguguccuucuugcucccc

SEQ ID NO: 1366175 - RNA, 13 nt, Homo sapiens
gaaacagccugug

SEQ ID NO: 1366176 - RNA, 17 nt, Homo sapiens
gaaaccagcaucugcac

SEQ ID NO: 1366177 - RNA, 18 nt, Homo sapiens
gaaacccgacagagggaa

SEQ ID NO: 1366178 - RNA, 19 nt, Homo sapiens
gaaacuaguguacauuucu

SEQ ID NO: 1366179 - RNA, 16 nt, Homo sapiens
gaaagaaaaagcaaua

SEQ ID NO: 1366180 - RNA, 14 nt, Homo sapiens
gaaagaacugucau

SEQ ID NO: 1366181 - RNA, 14 nt, Homo sapiens
gaaagaagugggga

SEQ ID NO: 1366182 - RNA, 19 nt, Homo sapiens
gaaagcaaaagcaagggac

SEQ ID NO: 1366183 - RNA, 17 nt, Homo sapiens
gaaagcccugugcucca

SEQ ID NO: 1366184 - RNA, 14 nt, Homo sapiens
gaaaggagacuaga

SEQ ID NO: 1366185 - RNA, 13 nt, Homo sapiens
gaaagggagcuau

SEQ ID NO: 1366186 - RNA, 19 nt, Homo sapiens
gaaagggcacagugucagu

SEQ ID NO: 1366187 - RNA, 13 nt, Homo sapiens
gaaaucuaugaaa

SEQ ID NO: 1366188 - RNA, 19 nt, Homo sapiens
gaaaucuaugaaauaucau

SEQ ID NO: 1366189 - RNA, 14 nt, Homo sapiens
gaaaugccaauaac

SEQ ID NO: 1366190 - RNA, 21 nt, Homo sapiens
gaaaugccaauaacacgucca

SEQ ID NO: 1366191 - RNA, 22 nt, Homo sapiens
gaaaugguccgcuuuccuggag

SEQ ID NO: 1366192 - RNA, 14 nt, Homo sapiens
gaaaugucaugugg

SEQ ID NO: 1366193 - RNA, 20 nt, Homo sapiens
gaacauggagccugcugaga

SEQ ID NO: 1366194 - RNA, 16 nt, Homo sapiens
gaacauuuuuuaccaa

SEQ ID NO: 1366195 - RNA, 19 nt, Homo sapiens
gaaccaaaagaauuugcac

SEQ ID NO: 1366196 - RNA, 20 nt, Homo sapiens
gaaccaaaucuggaagccaa

SEQ ID NO: 1366197 - RNA, 21 nt, Homo sapiens
gaaccaaaucuggaagccaaa

SEQ ID NO: 1366198 - RNA, 21 nt, Homo sapiens
gaaccacaccacaucuaagcc

SEQ ID NO: 1366199 - RNA, 14 nt, Homo sapiens
gaacccuucuccau

SEQ ID NO: 1366200 - RNA, 16 nt, Homo sapiens
gaacccuucuccauac

SEQ ID NO: 1366201 - RNA, 19 nt, Homo sapiens
gaaccucagccuggccaga

SEQ ID NO: 1366202 - RNA, 13 nt, Homo sapiens
gaacuagacuccc

SEQ ID NO: 1366203 - RNA, 21 nt, Homo sapiens
cucaaaagcugggcagguugg

SEQ ID NO: 1366204 - RNA, 17 nt, Homo sapiens
cucaaaauauccuaaga

SEQ ID NO: 1366205 - RNA, 20 nt, Homo sapiens
cucaaauggggccagaucca

SEQ ID NO: 1366206 - RNA, 21 nt, Homo sapiens
cucaagccaagcagccaagcu

SEQ ID NO: 1366207 - RNA, 21 nt, Homo sapiens
cucaauaaaaguuuccuuuca

SEQ ID NO: 1366208 - RNA, 15 nt, Homo sapiens
cucaaugccaguaac

SEQ ID NO: 1366209 - RNA, 22 nt, Homo sapiens
cucacacuguaagaguucacau

SEQ ID NO: 1366210 - RNA, 16 nt, Homo sapiens
cucacauccauucuuc

SEQ ID NO: 1366211 - RNA, 21 nt, Homo sapiens
cucacauuuggggcuagacag

SEQ ID NO: 1366212 - RNA, 22 nt, Homo sapiens
cucacuaggcccccacuugccu

SEQ ID NO: 1366213 - RNA, 17 nt, Homo sapiens
cucacugccagugcaga

SEQ ID NO: 1366214 - RNA, 17 nt, Homo sapiens
cucagaaccuuguccca

SEQ ID NO: 1366215 - RNA, 19 nt, Homo sapiens
cucagaagucaguugcaaa

SEQ ID NO: 1366216 - RNA, 20 nt, Homo sapiens
cucagaauugaucauuuucc

SEQ ID NO: 1366217 - RNA, 21 nt, Homo sapiens
cucagccuugccagagaucca

SEQ ID NO: 1366218 - RNA, 21 nt, Homo sapiens
cucagccuuggcagcccugau

SEQ ID NO: 1366219 - RNA, 19 nt, Homo sapiens
cucagcguuccuggacaaa

SEQ ID NO: 1366220 - RNA, 17 nt, Homo sapiens
cucagcuggaucuccau

SEQ ID NO: 1366221 - RNA, 19 nt, Homo sapiens
cucaggacacagugggaca

SEQ ID NO: 1366222 - RNA, 13 nt, Homo sapiens
cucaggacagaug

SEQ ID NO: 1366223 - RNA, 16 nt, Homo sapiens
cucagguguugccaaa

SEQ ID NO: 1366224 - RNA, 17 nt, Homo sapiens
cucagguguugccaaau

SEQ ID NO: 1366225 - RNA, 22 nt, Homo sapiens
cucaguaagaagagcuuggaaa

SEQ ID NO: 1366226 - RNA, 21 nt, Homo sapiens
cucagucccuaaaaacacaga

SEQ ID NO: 1366227 - RNA, 23 nt, Homo sapiens
cucaguuauuacauguaauuuga

SEQ ID NO: 1366228 - RNA, 21 nt, Homo sapiens
cucaguucucuugcuuucaca

SEQ ID NO: 1366229 - RNA, 22 nt, Homo sapiens
cucauaacucugugaucuugcu

SEQ ID NO: 1366230 - RNA, 19 nt, Homo sapiens
cucauagauguuaugcaaa

SEQ ID NO: 1366231 - RNA, 19 nt, Homo sapiens
cucauaugcauguagucac

SEQ ID NO: 1366232 - RNA, 18 nt, Homo sapiens
cucauccaaaaagucuga

SEQ ID NO: 1366233 - RNA, 16 nt, Homo sapiens
cucaugcuucacuuag

SEQ ID NO: 1366234 - RNA, 16 nt, Homo sapiens
cucauggagucaucuu

SEQ ID NO: 1366235 - RNA, 16 nt, Homo sapiens
cucaugggaaggggag

SEQ ID NO: 1366236 - RNA, 18 nt, Homo sapiens
cucauguuuuuaaagggc

SEQ ID NO: 1366237 - RNA, 15 nt, Homo sapiens
cucauuuuaggcaaa

SEQ ID NO: 1366238 - RNA, 18 nt, Homo sapiens
cuccaaaggcucagauua

SEQ ID NO: 1366239 - RNA, 13 nt, Homo sapiens
cuccaauggggcg

SEQ ID NO: 1366240 - RNA, 14 nt, Homo sapiens
cuccaccacauccu

SEQ ID NO: 1366241 - RNA, 19 nt, Homo sapiens
cuccagaaagcucaucuca

SEQ ID NO: 1366242 - RNA, 19 nt, Homo sapiens
cuccagcugcucugucuuc

SEQ ID NO: 1366243 - RNA, 12 nt, Homo sapiens
cuccaggcuuuc

SEQ ID NO: 1366244 - RNA, 22 nt, Homo sapiens
cucccaguccaaauguccucca

SEQ ID NO: 1366245 - RNA, 21 nt, Homo sapiens
cucccauaauugcuuugccaa

SEQ ID NO: 1366246 - RNA, 16 nt, Homo sapiens
cuccccagcccagaga

SEQ ID NO: 1366247 - RNA, 17 nt, Homo sapiens
cuccccugcccuggucc

SEQ ID NO: 1366248 - RNA, 18 nt, Homo sapiens
cuccccugcccuggucca

SEQ ID NO: 1366249 - RNA, 17 nt, Homo sapiens
cuccccuugaaaacugc

SEQ ID NO: 1366250 - RNA, 22 nt, Homo sapiens
cucccgucugucuguccugucu

SEQ ID NO: 1366251 - RNA, 22 nt, Homo sapiens
cucccuggagaagcaccagcaa

SEQ ID NO: 1366252 - RNA, 14 nt, Homo sapiens
cucccuuugaugau

SEQ ID NO: 1366253 - RNA, 22 nt, Homo sapiens
cuccucguucuuauuuaaucuc

SEQ ID NO: 1366254 - RNA, 16 nt, Homo sapiens
cuccucucccagugac

SEQ ID NO: 1366255 - RNA, 13 nt, Homo sapiens
cuccugacuuuua

SEQ ID NO: 1366256 - RNA, 15 nt, Homo sapiens
cuccugcugagcugc

SEQ ID NO: 1366257 - RNA, 16 nt, Homo sapiens
cuccuggcccacugca

SEQ ID NO: 1366258 - RNA, 22 nt, Homo sapiens
cuccugugugauugacagcuuu

SEQ ID NO: 1366259 - RNA, 18 nt, Homo sapiens
cuccuguucugaaaccuu

SEQ ID NO: 1366260 - RNA, 13 nt, Homo sapiens
cuccuuaugaugc

SEQ ID NO: 1366261 - RNA, 21 nt, Homo sapiens
cuccuugcugcauugauccag

SEQ ID NO: 1366262 - RNA, 19 nt, Homo sapiens
cuccuuguaaagacuguag

SEQ ID NO: 1366263 - RNA, 22 nt, Homo sapiens
cuccuuugcuaaugcuaugcaa

SEQ ID NO: 1366264 - RNA, 17 nt, Homo sapiens
cucgaaucucugugccu

SEQ ID NO: 1366265 - RNA, 20 nt, Homo sapiens
cucgagccgccaggacacag

SEQ ID NO: 1366266 - RNA, 18 nt, Homo sapiens
cucgccgguuaagacagg

SEQ ID NO: 1366267 - RNA, 18 nt, Homo sapiens
cucgcuagguucuuauca

SEQ ID NO: 1366268 - RNA, 17 nt, Homo sapiens
cucggggauagaccaaa

SEQ ID NO: 1366269 - RNA, 14 nt, Homo sapiens
cucggucugagaag

SEQ ID NO: 1366270 - RNA, 16 nt, Homo sapiens
cucuaacuccugccau

SEQ ID NO: 1366271 - RNA, 15 nt, Homo sapiens
cucuaauacauucca

SEQ ID NO: 1366272 - RNA, 12 nt, Homo sapiens
cucuacaaaaag

SEQ ID NO: 1366273 - RNA, 23 nt, Homo sapiens
cucuagcugggggugggccaggc

SEQ ID NO: 1366274 - RNA, 17 nt, Homo sapiens
cucuaugguguggcaaa

SEQ ID NO: 1366275 - RNA, 15 nt, Homo sapiens
cucuauuugagaaua

SEQ ID NO: 1366276 - RNA, 11 nt, Homo sapiens
cucucauuucc

SEQ ID NO: 1366277 - RNA, 13 nt, Homo sapiens
cucugaaaaccaa

SEQ ID NO: 1366278 - RNA, 23 nt, Homo sapiens
cucugaguaucuccucgcaagcu

SEQ ID NO: 1366279 - RNA, 13 nt, Homo sapiens
cucugcacaagcu

SEQ ID NO: 1366280 - RNA, 11 nt, Homo sapiens
cucugccagug

SEQ ID NO: 1366281 - RNA, 13 nt, Homo sapiens
cucugucuucuuu

SEQ ID NO: 1366282 - RNA, 14 nt, Homo sapiens
cucugugaucuugc

SEQ ID NO: 1366283 - RNA, 20 nt, Homo sapiens
cucuguggccagcugcaucu

SEQ ID NO: 1366284 - RNA, 16 nt, Homo sapiens
cucuuagaaaaaccac

SEQ ID NO: 1366285 - RNA, 14 nt, Homo sapiens
cucuucaaaugccu

SEQ ID NO: 1366286 - RNA, 23 nt, Homo sapiens
cucuucuccaccucccacaaagg

SEQ ID NO: 1366287 - RNA, 19 nt, Homo sapiens
cucuucuuggggcccagug

SEQ ID NO: 1366288 - RNA, 21 nt, Homo sapiens
cucuugagccugggaggucaa

SEQ ID NO: 1366289 - RNA, 20 nt, Homo sapiens
cucuugccaaaucaaaagac

SEQ ID NO: 1366290 - RNA, 18 nt, Homo sapiens
cugaaaccuuaguuucaa

SEQ ID NO: 1366291 - RNA, 22 nt, Homo sapiens
cugaaacuauagaauaaagccu

SEQ ID NO: 1366292 - RNA, 21 nt, Homo sapiens
cugaaagggcacagugucagu

SEQ ID NO: 1366293 - RNA, 16 nt, Homo sapiens
cugaaauuaacucaga

SEQ ID NO: 1366294 - RNA, 13 nt, Homo sapiens
cugaacccaggca

SEQ ID NO: 1366295 - RNA, 17 nt, Homo sapiens
cugaaggggaggucaca

SEQ ID NO: 1366296 - RNA, 15 nt, Homo sapiens
cugaauggcaaugaa

SEQ ID NO: 1366297 - RNA, 13 nt, Homo sapiens
cugaccaccugca

SEQ ID NO: 1366298 - RNA, 19 nt, Homo sapiens
cugaccagcagcgccuuuc

SEQ ID NO: 1366299 - RNA, 20 nt, Homo sapiens
cugaccagccgugagcaugu

SEQ ID NO: 1366300 - RNA, 17 nt, Homo sapiens
cugacccagugccccca

SEQ ID NO: 1366301 - RNA, 19 nt, Homo sapiens
cugacccuguaaaauggag

SEQ ID NO: 1366302 - RNA, 17 nt, Homo sapiens
cugaccucgugauccac

SEQ ID NO: 1366303 - RNA, 20 nt, Homo sapiens
cugacuagaagggccagucc

SEQ ID NO: 1366304 - RNA, 15 nt, Homo sapiens
cugacuggugcugca

SEQ ID NO: 1366305 - RNA, 15 nt, Homo sapiens
cugagagaaccucac

SEQ ID NO: 1366306 - RNA, 13 nt, Homo sapiens
cugagaucaugag

SEQ ID NO: 1366307 - RNA, 14 nt, Homo sapiens
cugaggcaagagaa

SEQ ID NO: 1366308 - RNA, 16 nt, Homo sapiens
cugaggugaaagggag

SEQ ID NO: 1366309 - RNA, 12 nt, Homo sapiens
cugaggugggag

SEQ ID NO: 1366310 - RNA, 16 nt, Homo sapiens
cugaguccugagcgaa

SEQ ID NO: 1366311 - RNA, 15 nt, Homo sapiens
cugagugcugaaaua

SEQ ID NO: 1366312 - RNA, 15 nt, Homo sapiens
cugaguggugccaaa

SEQ ID NO: 1366313 - RNA, 20 nt, Homo sapiens
cugauaaccacuccuaauau

SEQ ID NO: 1366314 - RNA, 15 nt, Homo sapiens
cugauaaugcucacu

SEQ ID NO: 1366315 - RNA, 23 nt, Homo sapiens
cugauagguagcauuuuccagca

SEQ ID NO: 1366316 - RNA, 17 nt, Homo sapiens
cugaucuggcagacuca

SEQ ID NO: 1366317 - RNA, 20 nt, Homo sapiens
cugauuccccuccaccaaac

SEQ ID NO: 1366318 - RNA, 22 nt, Homo sapiens
cugauuuaggagaagccaggaa

SEQ ID NO: 1366319 - RNA, 16 nt, Homo sapiens
ggucugcucuuucucu

SEQ ID NO: 1366320 - RNA, 21 nt, Homo sapiens
ggucuuuccuaaggcugcaag

SEQ ID NO: 1366321 - RNA, 22 nt, Homo sapiens
ggucuuuuccauuaaacuacuu

SEQ ID NO: 1366322 - RNA, 14 nt, Homo sapiens
ggugaaagugcagu

SEQ ID NO: 1366323 - RNA, 10 nt, Homo sapiens
ggugcacagc

SEQ ID NO: 1366324 - RNA, 19 nt, Homo sapiens
ggugcaugaagguuucuga

SEQ ID NO: 1366325 - RNA, 20 nt, Homo sapiens
gguggcaaaguacuugucau

SEQ ID NO: 1366326 - RNA, 19 nt, Homo sapiens
gguggcccuugcaguucag

SEQ ID NO: 1366327 - RNA, 19 nt, Homo sapiens
gguggccgcugaguggcag

SEQ ID NO: 1366328 - RNA, 15 nt, Homo sapiens
gguggcugucccuuc

SEQ ID NO: 1366329 - RNA, 17 nt, Homo sapiens
ggugggacccguggcug

SEQ ID NO: 1366330 - RNA, 22 nt, Homo sapiens
gguggucucuucuuggggccca

SEQ ID NO: 1366331 - RNA, 19 nt, Homo sapiens
gguuggacuguaagggauu

SEQ ID NO: 1366332 - RNA, 12 nt, Homo sapiens
gguuucauucug

SEQ ID NO: 1366333 - RNA, 12 nt, Homo sapiens
guaaaauggagg

SEQ ID NO: 1366334 - RNA, 12 nt, Homo sapiens
guaaagccaugc

SEQ ID NO: 1366335 - RNA, 18 nt, Homo sapiens
guaaaucaggacaggugg

SEQ ID NO: 1366336 - RNA, 16 nt, Homo sapiens
guaagaaacacacuga

SEQ ID NO: 1366337 - RNA, 16 nt, Homo sapiens
guaagaagaaagcaaa

SEQ ID NO: 1366338 - RNA, 21 nt, Homo sapiens
guaagggguugguaucucagg

SEQ ID NO: 1366339 - RNA, 14 nt, Homo sapiens
guaagucauuuaac

SEQ ID NO: 1366340 - RNA, 23 nt, Homo sapiens
guaauauucccuuuuaggugagg

SEQ ID NO: 1366341 - RNA, 20 nt, Homo sapiens
guaauugcagauaacuuuga

SEQ ID NO: 1366342 - RNA, 22 nt, Homo sapiens
guacaaaaauaaauuuauauga

SEQ ID NO: 1366343 - RNA, 21 nt, Homo sapiens
guacaaggcccccacugccug

SEQ ID NO: 1366344 - RNA, 24 nt, Homo sapiens
guacaauaaaaacauugccuuuga

SEQ ID NO: 1366345 - RNA, 11 nt, Homo sapiens
guacuguuacu

SEQ ID NO: 1366346 - RNA, 21 nt, Homo sapiens
guagaaaauaaaacugagcua

SEQ ID NO: 1366347 - RNA, 21 nt, Homo sapiens
guagagacgguguuuugccau

SEQ ID NO: 1366348 - RNA, 21 nt, Homo sapiens
guagaugccacccaguuguga

SEQ ID NO: 1366349 - RNA, 16 nt, Homo sapiens
guagcccucacacugu

SEQ ID NO: 1366350 - RNA, 19 nt, Homo sapiens
guagcugggauuacaggug

SEQ ID NO: 1366351 - RNA, 14 nt, Homo sapiens
guagugucacucaa

SEQ ID NO: 1366352 - RNA, 21 nt, Homo sapiens
guagugucacucaaggcggug

SEQ ID NO: 1366353 - RNA, 13 nt, Homo sapiens
guauaugcaauau

SEQ ID NO: 1366354 - RNA, 15 nt, Homo sapiens
guauguuugggagac

SEQ ID NO: 1366355 - RNA, 21 nt, Homo sapiens
guauguuugggagacugcuga

SEQ ID NO: 1366356 - RNA, 23 nt, Homo sapiens
guauguuugggagacugcugagu

SEQ ID NO: 1366357 - RNA, 13 nt, Homo sapiens
guauugugcauag

SEQ ID NO: 1366358 - RNA, 20 nt, Homo sapiens
guauuuuguuuuugucuuaa

SEQ ID NO: 1366359 - RNA, 16 nt, Homo sapiens
guauuuuuaguagaga

SEQ ID NO: 1366360 - RNA, 22 nt, Homo sapiens
gucaacccaauaguuguugauu

SEQ ID NO: 1366361 - RNA, 20 nt, Homo sapiens
gucaaggcaguagaacucca

SEQ ID NO: 1366362 - RNA, 20 nt, Homo sapiens
gucaaugggaccuguggcug

SEQ ID NO: 1366363 - RNA, 20 nt, Homo sapiens
gucacaggguguuggaagau

SEQ ID NO: 1366364 - RNA, 14 nt, Homo sapiens
gucacucacaucca

SEQ ID NO: 1366365 - RNA, 14 nt, Homo sapiens
gucagcugcucccu

SEQ ID NO: 1366366 - RNA, 16 nt, Homo sapiens
guccacccugccugcc

SEQ ID NO: 1366367 - RNA, 11 nt, Homo sapiens
guccagcaccu

SEQ ID NO: 1366368 - RNA, 13 nt, Homo sapiens
guccagcaccuug

SEQ ID NO: 1366369 - RNA, 17 nt, Homo sapiens
guccagggcuagugacu

SEQ ID NO: 1366370 - RNA, 18 nt, Homo sapiens
guccagggcuagugacuu

SEQ ID NO: 1366371 - RNA, 23 nt, Homo sapiens
guccauuaagcugagagugcuau

SEQ ID NO: 1366372 - RNA, 17 nt, Homo sapiens
gucccuaaaaacacaga

SEQ ID NO: 1366373 - RNA, 21 nt, Homo sapiens
gucccuucucccaucaggguc

SEQ ID NO: 1366374 - RNA, 22 nt, Homo sapiens
gucccuugcuugccugcagggc

SEQ ID NO: 1366375 - RNA, 16 nt, Homo sapiens
guccuacugcugugag

SEQ ID NO: 1366376 - RNA, 15 nt, Homo sapiens
guccucauucuugcc

SEQ ID NO: 1366377 - RNA, 20 nt, Homo sapiens
guccucccaauuucagacuc

SEQ ID NO: 1366378 - RNA, 17 nt, Homo sapiens
guccucucccugccaag

SEQ ID NO: 1366379 - RNA, 20 nt, Homo sapiens
guccugaugcuuuugucuaa

SEQ ID NO: 1366380 - RNA, 14 nt, Homo sapiens
guccuugaugcuca

SEQ ID NO: 1366381 - RNA, 20 nt, Homo sapiens
gucuaaaaaaggaauccucu

SEQ ID NO: 1366382 - RNA, 12 nt, Homo sapiens
gucuacauuucu

SEQ ID NO: 1366383 - RNA, 14 nt, Homo sapiens
gucugaaucuucac

SEQ ID NO: 1366384 - RNA, 16 nt, Homo sapiens
gucugagaagauucaa

SEQ ID NO: 1366385 - RNA, 19 nt, Homo sapiens
gucugcgucgucaccaaau

SEQ ID NO: 1366386 - RNA, 16 nt, Homo sapiens
gucugucuacauuucu

SEQ ID NO: 1366387 - RNA, 23 nt, Homo sapiens
gucuugccuugcugaacucccuc

SEQ ID NO: 1366388 - RNA, 13 nt, Homo sapiens
gucuugucuucaa

SEQ ID NO: 1366389 - RNA, 16 nt, Homo sapiens
gucuuucuaacugaau

SEQ ID NO: 1366390 - RNA, 23 nt, Homo sapiens
gucuuugaagugacuucacagag

SEQ ID NO: 1366391 - RNA, 19 nt, Homo sapiens
gucuuugccagucauucag

SEQ ID NO: 1366392 - RNA, 18 nt, Homo sapiens
gugaaauauaugcuauau

SEQ ID NO: 1366393 - RNA, 19 nt, Homo sapiens
gugacaauuaaaagugucu

SEQ ID NO: 1366394 - RNA, 21 nt, Homo sapiens
gugacuggcagcauugacucu

SEQ ID NO: 1366395 - RNA, 12 nt, Homo sapiens
gugagggguccc

SEQ ID NO: 1366396 - RNA, 16 nt, Homo sapiens
gugaguguguggcacc

SEQ ID NO: 1366397 - RNA, 17 nt, Homo sapiens
gugaucauuacucugcu

SEQ ID NO: 1366398 - RNA, 19 nt, Homo sapiens
gugauggaagaugcagucu

SEQ ID NO: 1366399 - RNA, 13 nt, Homo sapiens
gugauggggcaag

SEQ ID NO: 1366400 - RNA, 20 nt, Homo sapiens
gugaugucaaauugacugua

SEQ ID NO: 1366401 - RNA, 19 nt, Homo sapiens
gugcaguggcgcauucuag

SEQ ID NO: 1366402 - RNA, 17 nt, Homo sapiens
gugcaugcagcaucuaa

SEQ ID NO: 1366403 - RNA, 20 nt, Homo sapiens
gugcccuuggaggccagcca

SEQ ID NO: 1366404 - RNA, 13 nt, Homo sapiens
gugccguggcacc

SEQ ID NO: 1366405 - RNA, 13 nt, Homo sapiens
gugcggugcaaag

SEQ ID NO: 1366406 - RNA, 16 nt, Homo sapiens
gugcuauggugcucug

SEQ ID NO: 1366407 - RNA, 22 nt, Homo sapiens
gugcuccauggcugccaucuca

SEQ ID NO: 1366408 - RNA, 23 nt, Homo sapiens
guggcaccgccuccccaccucca

SEQ ID NO: 1366409 - RNA, 23 nt, Homo sapiens
guggccaaggagcugcuauagcc

SEQ ID NO: 1366410 - RNA, 14 nt, Homo sapiens
guggcccaacacaa

SEQ ID NO: 1366411 - RNA, 13 nt, Homo sapiens
guggcccagagaa

SEQ ID NO: 1366412 - RNA, 13 nt, Homo sapiens
guucaccagguca

SEQ ID NO: 1366413 - RNA, 21 nt, Homo sapiens
guucacugcuccuugcugcau

SEQ ID NO: 1366414 - RNA, 14 nt, Homo sapiens
guucagggucauag

SEQ ID NO: 1366415 - RNA, 21 nt, Homo sapiens
guucauauuuauacuuugcaa

SEQ ID NO: 1366416 - RNA, 21 nt, Homo sapiens
guucguucuguacuguuacug

SEQ ID NO: 1366417 - RNA, 22 nt, Homo sapiens
guucuaaaaacguaaguacucc

SEQ ID NO: 1366418 - RNA, 23 nt, Homo sapiens
guucuccgugaugcuguuuuucu

SEQ ID NO: 1366419 - RNA, 18 nt, Homo sapiens
guucugagcgggucaugg

SEQ ID NO: 1366420 - RNA, 12 nt, Homo sapiens
guucugucauau

SEQ ID NO: 1366421 - RNA, 20 nt, Homo sapiens
guucuuguggaagacacuug

SEQ ID NO: 1366422 - RNA, 22 nt, Homo sapiens
guugaucuggaacccagacuca

SEQ ID NO: 1366423 - RNA, 13 nt, Homo sapiens
guugaugacuguu

SEQ ID NO: 1366424 - RNA, 23 nt, Homo sapiens
guugcagcccuugugaugugauu

SEQ ID NO: 1366425 - RNA, 14 nt, Homo sapiens
guuggcacaugccu

SEQ ID NO: 1366426 - RNA, 13 nt, Homo sapiens
guuggggagcuga

SEQ ID NO: 1366427 - RNA, 21 nt, Homo sapiens
guugugaaaaucugucaugag

SEQ ID NO: 1366428 - RNA, 17 nt, Homo sapiens
guuucaaaaaaucugac

SEQ ID NO: 1366429 - RNA, 23 nt, Homo sapiens
guuucaaaaaaucugaccaaaac

SEQ ID NO: 1366430 - RNA, 19 nt, Homo sapiens
guuucaccauguuagccag

SEQ ID NO: 1366431 - RNA, 17 nt, Homo sapiens
guuucuuaaaauacuca

SEQ ID NO: 1366432 - RNA, 15 nt, Homo sapiens
guuugagaccagccu

SEQ ID NO: 1366433 - RNA, 15 nt, Homo sapiens
guuugauccaguuga

SEQ ID NO: 1366434 - RNA, 18 nt, Homo sapiens
guuugccaucccaaaaau

SEQ ID NO: 1366435 - RNA, 17 nt, Homo sapiens
guuuguaagguggucac

SEQ ID NO: 1366436 - RNA, 14 nt, Homo sapiens
guuuguggccucag

SEQ ID NO: 1366437 - RNA, 15 nt, Homo sapiens
guuuuaaucuccucu

SEQ ID NO: 1366438 - RNA, 19 nt, Homo sapiens
guuuuccucccuucugcua

SEQ ID NO: 1366439 - RNA, 19 nt, Homo sapiens
guuuuguggaggagcucag

SEQ ID NO: 1366440 - RNA, 19 nt, Homo sapiens
guuuuuaaaaaacugcuga

SEQ ID NO: 1366441 - RNA, 17 nt, Homo sapiens
guuuuuaaguacucacu

SEQ ID NO: 1366442 - RNA, 20 nt, Homo sapiens
guuuuuaauuuaucagagac

SEQ ID NO: 1366443 - RNA, 17 nt, Homo sapiens
guuuuuggaguguuaug

SEQ ID NO: 1366444 - RNA, 21 nt, Homo sapiens
guuuuuuguuuaaguacuuca

SEQ ID NO: 1366445 - RNA, 15 nt, Homo sapiens
uaaaaacauugccuu

SEQ ID NO: 1366446 - RNA, 14 nt, Homo sapiens
uaaaaagagacugu

SEQ ID NO: 1366447 - RNA, 17 nt, Homo sapiens
uaaaacaaaauuugacu

SEQ ID NO: 1366448 - RNA, 22 nt, Homo sapiens
uaaaacaaaauuugacuaauuu

SEQ ID NO: 1366449 - RNA, 18 nt, Homo sapiens
uaaaacccaagugccuua

SEQ ID NO: 1366450 - RNA, 14 nt, Homo sapiens
uaaaacuggaccug

SEQ ID NO: 1366451 - RNA, 12 nt, Homo sapiens
uaaaagacauua

SEQ ID NO: 1366452 - RNA, 16 nt, Homo sapiens
uaaaagaucuugaaua

SEQ ID NO: 1366453 - RNA, 21 nt, Homo sapiens
uaaaagaucuugaauagucuc

SEQ ID NO: 1366454 - RNA, 18 nt, Homo sapiens
uaaaauagagugcauuug

SEQ ID NO: 1366455 - RNA, 14 nt, Homo sapiens
uaaaaucagacucu

SEQ ID NO: 1366456 - RNA, 12 nt, Homo sapiens
uaaaaugauaaa

SEQ ID NO: 1366457 - RNA, 17 nt, Homo sapiens
uaaaauggaugccuuga

SEQ ID NO: 1366458 - RNA, 16 nt, Homo sapiens
uaaaauuuugagauua

SEQ ID NO: 1366459 - RNA, 23 nt, Homo sapiens
uaaacaaauguaugauuacauca

SEQ ID NO: 1366460 - RNA, 22 nt, Homo sapiens
uaaaccccggcgugugcagugc

SEQ ID NO: 1366461 - RNA, 22 nt, Homo sapiens
uaaaccucaguuauuacaugua

SEQ ID NO: 1366462 - RNA, 15 nt, Homo sapiens
uaaacucuguugcaa

SEQ ID NO: 1366463 - RNA, 22 nt, Homo sapiens
uaaacucuguugcaagugcaau

SEQ ID NO: 1366464 - RNA, 12 nt, Homo sapiens
uaaagacuguag

SEQ ID NO: 1366465 - RNA, 13 nt, Homo sapiens
uaaagagcacugg

SEQ ID NO: 1366466 - RNA, 16 nt, Homo sapiens
uaaagcaggugcccag

SEQ ID NO: 1366467 - RNA, 22 nt, Homo sapiens
uaaagggagauaacaaucugua

SEQ ID NO: 1366468 - RNA, 16 nt, Homo sapiens
uaaaguaucugagauu

SEQ ID NO: 1366469 - RNA, 14 nt, Homo sapiens
uaaaucaugaugcu

SEQ ID NO: 1366470 - RNA, 19 nt, Homo sapiens
uaaaugagacgagacaugu

SEQ ID NO: 1366471 - RNA, 16 nt, Homo sapiens
uaaauguacagacaua

SEQ ID NO: 1366472 - RNA, 12 nt, Homo sapiens
uaaaugugaaug

SEQ ID NO: 1366473 - RNA, 20 nt, Homo sapiens
uaaauuccacagauuaucaa

SEQ ID NO: 1366474 - RNA, 18 nt, Homo sapiens
uaaauucccuggggaaaa

SEQ ID NO: 1366475 - RNA, 15 nt, Homo sapiens
uaacacguccacuuu

SEQ ID NO: 1366476 - RNA, 21 nt, Homo sapiens
uaacagauggaaaaacugagg

SEQ ID NO: 1366477 - RNA, 18 nt, Homo sapiens
uaacagcuguggcucacg

SEQ ID NO: 1366478 - RNA, 16 nt, Homo sapiens
uaacaucuagcccuuu

SEQ ID NO: 1366479 - RNA, 16 nt, Homo sapiens
uaacauuuaaauucca

SEQ ID NO: 1366480 - RNA, 18 nt, Homo sapiens
uaacauuuaaauuccaca

SEQ ID NO: 1366481 - RNA, 20 nt, Homo sapiens
uaacauuuaaauuccacaga

SEQ ID NO: 1366482 - RNA, 22 nt, Homo sapiens
uaaccuagaagggucacuuuaa

SEQ ID NO: 1366483 - RNA, 15 nt, Homo sapiens
uaaccucacauaccc

SEQ ID NO: 1366484 - RNA, 14 nt, Homo sapiens
uaaccucuacaggc

SEQ ID NO: 1366485 - RNA, 16 nt, Homo sapiens
uaaccucuucaccuua

SEQ ID NO: 1366486 - RNA, 15 nt, Homo sapiens
uaacucagacacaaa

SEQ ID NO: 1366487 - RNA, 11 nt, Homo sapiens
uaacucagugg

SEQ ID NO: 1366488 - RNA, 21 nt, Homo sapiens
uaacugauuaccugccaauug

SEQ ID NO: 1366489 - RNA, 22 nt, Homo sapiens
uaacugugaaauaccacaagcc

SEQ ID NO: 1366490 - RNA, 23 nt, Homo sapiens
uaagaacuuugagcuacugccgu

SEQ ID NO: 1366491 - RNA, 19 nt, Homo sapiens
uaagagacacuccaaaccu

SEQ ID NO: 1366492 - RNA, 19 nt, Homo sapiens
uaagaucucgguuugccaa

SEQ ID NO: 1366493 - RNA, 15 nt, Homo sapiens
uaagcaaagacuuuc

SEQ ID NO: 1366494 - RNA, 21 nt, Homo sapiens
uaagcccccacuacaagugau

SEQ ID NO: 1366495 - RNA, 16 nt, Homo sapiens
uaagcucacacagcua

SEQ ID NO: 1366496 - RNA, 17 nt, Homo sapiens
uaaggacggacucacuu

SEQ ID NO: 1366497 - RNA, 15 nt, Homo sapiens
uaaguaaugaugucg

SEQ ID NO: 1366498 - RNA, 14 nt, Homo sapiens
uaauauccauauag

SEQ ID NO: 1366499 - RNA, 17 nt, Homo sapiens
uaauauuucaagugccu

SEQ ID NO: 1366500 - RNA, 18 nt, Homo sapiens
uaauauuucaagugccua

SEQ ID NO: 1366501 - RNA, 15 nt, Homo sapiens
uaauccaaauccauc

SEQ ID NO: 1366502 - RNA, 19 nt, Homo sapiens
uaaucccacccaccucacc

SEQ ID NO: 1366503 - RNA, 13 nt, Homo sapiens
uaaugaaugcaua

SEQ ID NO: 1366504 - RNA, 16 nt, Homo sapiens
uaaugagaauuccuua

SEQ ID NO: 1366505 - RNA, 16 nt, Homo sapiens
uaaugcaaaugacugu

SEQ ID NO: 1366506 - RNA, 22 nt, Homo sapiens
uacauuugaugcaugucuuuua

SEQ ID NO: 1366507 - RNA, 17 nt, Homo sapiens
uaccacaagccugagaa

SEQ ID NO: 1366508 - RNA, 20 nt, Homo sapiens
uaccaccaagggaucugcca

SEQ ID NO: 1366509 - RNA, 21 nt, Homo sapiens
uaccaccaagggaucugccau

SEQ ID NO: 1366510 - RNA, 21 nt, Homo sapiens
uaccagagccuucaagugcca

SEQ ID NO: 1366511 - RNA, 13 nt, Homo sapiens
uaccucacuuuua

SEQ ID NO: 1366512 - RNA, 13 nt, Homo sapiens
uaccucugagaag

SEQ ID NO: 1366513 - RNA, 21 nt, Homo sapiens
uaccucugagaagacacaagg

SEQ ID NO: 1366514 - RNA, 13 nt, Homo sapiens
uaccuugugcuaa

SEQ ID NO: 1366515 - RNA, 20 nt, Homo sapiens
uacgcuccaucgcugucauc

SEQ ID NO: 1366516 - RNA, 17 nt, Homo sapiens
uacguguagauaauuaa

SEQ ID NO: 1366517 - RNA, 12 nt, Homo sapiens
uacuaaagccaa

SEQ ID NO: 1366518 - RNA, 16 nt, Homo sapiens
uacuaauauuaagaaa

SEQ ID NO: 1366519 - RNA, 19 nt, Homo sapiens
uacugauaaccacuccuaa

SEQ ID NO: 1366520 - RNA, 13 nt, Homo sapiens
uacugccauguac

SEQ ID NO: 1366521 - RNA, 17 nt, Homo sapiens
uacugcugagauacaua

SEQ ID NO: 1366522 - RNA, 22 nt, Homo sapiens
uacuguaaauauuuuucacaua

SEQ ID NO: 1366523 - RNA, 21 nt, Homo sapiens
uacuguugugaaaaucuguca

SEQ ID NO: 1366524 - RNA, 17 nt, Homo sapiens
uacuugcaagccucaaa

SEQ ID NO: 1366525 - RNA, 20 nt, Homo sapiens
uacuugggaggcugaggcag

SEQ ID NO: 1366526 - RNA, 15 nt, Homo sapiens
uacuuuuuaguaauu

SEQ ID NO: 1366527 - RNA, 14 nt, Homo sapiens
uagaaaauucauaa

SEQ ID NO: 1366528 - RNA, 14 nt, Homo sapiens
uagaaauuccccac

SEQ ID NO: 1366529 - RNA, 18 nt, Homo sapiens
uagaacuaaaguaucuga

SEQ ID NO: 1366530 - RNA, 19 nt, Homo sapiens
uagaacuaaaguaucugag

SEQ ID NO: 1366531 - RNA, 21 nt, Homo sapiens
uagaacuaaaguaucugagau

SEQ ID NO: 1366532 - RNA, 22 nt, Homo sapiens
uagaacuaaaguaucugagauu

SEQ ID NO: 1366533 - RNA, 14 nt, Homo sapiens
uagaagacugucag

SEQ ID NO: 1366534 - RNA, 16 nt, Homo sapiens
uagaauuauagaacua

SEQ ID NO: 1366535 - RNA, 18 nt, Homo sapiens
uagaauuaugcuguuaaa

SEQ ID NO: 1366536 - RNA, 16 nt, Homo sapiens
uagacaaucacuacaa

SEQ ID NO: 1366537 - RNA, 14 nt, Homo sapiens
uagaccccauacaa

SEQ ID NO: 1366538 - RNA, 23 nt, Homo sapiens
uagacccgaggaaacucagaguc

SEQ ID NO: 1366539 - RNA, 11 nt, Homo sapiens
uagacugccau

SEQ ID NO: 1366540 - RNA, 22 nt, Homo sapiens
uagagacgggguuucaccaugu

SEQ ID NO: 1366541 - RNA, 20 nt, Homo sapiens
uagagacgguguuuugccau

SEQ ID NO: 1366542 - RNA, 19 nt, Homo sapiens
uagagaggacaauacuggg

SEQ ID NO: 1366543 - RNA, 21 nt, Homo sapiens
uagagaggacaauacuggggu

SEQ ID NO: 1366544 - RNA, 13 nt, Homo sapiens
uagagaguugaga

SEQ ID NO: 1366545 - RNA, 12 nt, Homo sapiens
uagagcacugcc

SEQ ID NO: 1366546 - RNA, 14 nt, Homo sapiens
uagagcacugccac

SEQ ID NO: 1366547 - RNA, 19 nt, Homo sapiens
uagagcagccacaaccaaa

SEQ ID NO: 1366548 - RNA, 18 nt, Homo sapiens
uagagucugaacagcugu

SEQ ID NO: 1366549 - RNA, 21 nt, Homo sapiens
uagauacacuaaaaaucugag

SEQ ID NO: 1366550 - RNA, 21 nt, Homo sapiens
uagauguccucagaagucagu

SEQ ID NO: 1366551 - RNA, 19 nt, Homo sapiens
uagauuuacagaacaaagu

SEQ ID NO: 1366552 - RNA, 21 nt, Homo sapiens
uagauuuuuucagacuuguca

SEQ ID NO: 1366553 - RNA, 13 nt, Homo sapiens
uagcaaagcaaaa

SEQ ID NO: 1366554 - RNA, 23 nt, Homo sapiens
uagcaaagcaaaaggcugagaag

SEQ ID NO: 1366555 - RNA, 22 nt, Homo sapiens
uagcaacugcuggggagacaaa

SEQ ID NO: 1366556 - RNA, 23 nt, Homo sapiens
uagcaacugcuggggagacaaau

SEQ ID NO: 1366557 - RNA, 20 nt, Homo sapiens
uagcaagcugccgaaccaaa

SEQ ID NO: 1366558 - RNA, 20 nt, Homo sapiens
uagcagcccacccugcugcu

SEQ ID NO: 1366559 - RNA, 16 nt, Homo sapiens
uagccgaaaugaucuu

SEQ ID NO: 1366560 - RNA, 15 nt, Homo sapiens
uagcucuccugccac

SEQ ID NO: 1366561 - RNA, 11 nt, Homo sapiens
uaggaaaaccu

SEQ ID NO: 1366562 - RNA, 18 nt, Homo sapiens
uaggaaacucacacuccc

SEQ ID NO: 1366563 - RNA, 16 nt, Homo sapiens
uaggcauuaacacaaa

SEQ ID NO: 1366564 - RNA, 22 nt, Homo sapiens
uaggggacuaauucacuggcga

SEQ ID NO: 1366565 - RNA, 20 nt, Homo sapiens
uagggugcugcgcagcaucc

SEQ ID NO: 1366566 - RNA, 16 nt, Homo sapiens
uagguagaugagaaaa

SEQ ID NO: 1366567 - RNA, 11 nt, Homo sapiens
uaggugucaug

SEQ ID NO: 1366568 - RNA, 22 nt, Homo sapiens
uaguccgugcugacagcugcuc

SEQ ID NO: 1366569 - RNA, 13 nt, Homo sapiens
uagucuuugccag

SEQ ID NO: 1366570 - RNA, 16 nt, Homo sapiens
uagugaugcaggcagu

SEQ ID NO: 1366571 - RNA, 14 nt, Homo sapiens
uagugccacccacc

SEQ ID NO: 1366572 - RNA, 16 nt, Homo sapiens
uaguggggucagggcu

SEQ ID NO: 1366573 - RNA, 14 nt, Homo sapiens
uagugguuacccag

SEQ ID NO: 1366574 - RNA, 21 nt, Homo sapiens
uagugugcaucauguuccuua

SEQ ID NO: 1366575 - RNA, 21 nt, Homo sapiens
uaguuaccacauuacucugcc

SEQ ID NO: 1366576 - RNA, 13 nt, Homo sapiens
uaguuacuugagu

SEQ ID NO: 1366577 - RNA, 17 nt, Homo sapiens
uaguuuggauuacuuaa

SEQ ID NO: 1366578 - RNA, 17 nt, Homo sapiens
uaguuuuuucuccucau

SEQ ID NO: 1366579 - RNA, 19 nt, Homo sapiens
uaguuuuuucuccucaugg

SEQ ID NO: 1366580 - RNA, 20 nt, Homo sapiens
uauaaaaaacagccuguuga

SEQ ID NO: 1366581 - RNA, 19 nt, Homo sapiens
uauaaauaaauaccaaaaa

SEQ ID NO: 1366582 - RNA, 19 nt, Homo sapiens
uauaaucccacccaccuca

SEQ ID NO: 1366583 - RNA, 22 nt, Homo sapiens
uauaauguuguauuuaauuuua

SEQ ID NO: 1366584 - RNA, 20 nt, Homo sapiens
uauacuuaagaauacacagg

SEQ ID NO: 1366585 - RNA, 21 nt, Homo sapiens
uauagaaaucuagaauuuuua

SEQ ID NO: 1366586 - RNA, 16 nt, Homo sapiens
uauagcaagaucccau

SEQ ID NO: 1366587 - RNA, 20 nt, Homo sapiens
uauagccuggggugggguca

SEQ ID NO: 1366588 - RNA, 16 nt, Homo sapiens
uauauaacaacaaacu

SEQ ID NO: 1366589 - RNA, 21 nt, Homo sapiens
uauauccgccuggcauuucac

SEQ ID NO: 1366590 - RNA, 20 nt, Homo sapiens
uauaucgcuggccagcauua

SEQ ID NO: 1366591 - RNA, 20 nt, Homo sapiens
uauaugguauauauacauau

SEQ ID NO: 1366592 - RNA, 16 nt, Homo sapiens
uauauguauaugcaau

SEQ ID NO: 1366593 - RNA, 14 nt, Homo sapiens
uauauuccaccagg

SEQ ID NO: 1366594 - RNA, 19 nt, Homo sapiens
uauauuuuugcuaaaccua

SEQ ID NO: 1366595 - RNA, 12 nt, Homo sapiens
uaucacuguugc

SEQ ID NO: 1366596 - RNA, 13 nt, Homo sapiens
uaucacuguugca

SEQ ID NO: 1366597 - RNA, 18 nt, Homo sapiens
uaucacuucacuguucuc

SEQ ID NO: 1366598 - RNA, 20 nt, Homo sapiens
uaucaggugccccucuucca

SEQ ID NO: 1366599 - RNA, 14 nt, Homo sapiens
uaucaugugucuuc

SEQ ID NO: 1366600 - RNA, 18 nt, Homo sapiens
uauccaggugugccccuc

SEQ ID NO: 1366601 - RNA, 21 nt, Homo sapiens
cacuuucagcgcuuauacuga

SEQ ID NO: 1366602 - RNA, 19 nt, Homo sapiens
cagaaacagugcaaggaag

SEQ ID NO: 1366603 - RNA, 15 nt, Homo sapiens
cagaaaguuaugaaa

SEQ ID NO: 1366604 - RNA, 15 nt, Homo sapiens
cagaacacuggauuu

SEQ ID NO: 1366605 - RNA, 22 nt, Homo sapiens
cagaacacugucuugaagacaa

SEQ ID NO: 1366606 - RNA, 13 nt, Homo sapiens
cagaacuccuacc

SEQ ID NO: 1366607 - RNA, 15 nt, Homo sapiens
cagaacuccuaccug

SEQ ID NO: 1366608 - RNA, 15 nt, Homo sapiens
cagaagauugcguag

SEQ ID NO: 1366609 - RNA, 16 nt, Homo sapiens
cagaaguuugagauca

SEQ ID NO: 1366610 - RNA, 21 nt, Homo sapiens
cagaaguuugagaucagccug

SEQ ID NO: 1366611 - RNA, 22 nt, Homo sapiens
cagaaucagaucugagcuucau

SEQ ID NO: 1366612 - RNA, 16 nt, Homo sapiens
cagacacaacacaguu

SEQ ID NO: 1366613 - RNA, 14 nt, Homo sapiens
cagacacccaggac

SEQ ID NO: 1366614 - RNA, 14 nt, Homo sapiens
cagacgaaacacaa

SEQ ID NO: 1366615 - RNA, 14 nt, Homo sapiens
cagacguacaggcc

SEQ ID NO: 1366616 - RNA, 23 nt, Homo sapiens
cagacuaugucacccaaugcaua

SEQ ID NO: 1366617 - RNA, 23 nt, Homo sapiens
cagagaugcaccaccaagccaag

SEQ ID NO: 1366618 - RNA, 21 nt, Homo sapiens
cagagauuugguuaagcucac

SEQ ID NO: 1366619 - RNA, 16 nt, Homo sapiens
cagagcccagcuccaa

SEQ ID NO: 1366620 - RNA, 20 nt, Homo sapiens
cagagccuucaagugccaaa

SEQ ID NO: 1366621 - RNA, 19 nt, Homo sapiens
cagaggggaaagacuucca

SEQ ID NO: 1366622 - RNA, 22 nt, Homo sapiens
cagauauacuugguucucucca

SEQ ID NO: 1366623 - RNA, 22 nt, Homo sapiens
cagaucacuucaggucaggagu

SEQ ID NO: 1366624 - RNA, 17 nt, Homo sapiens
cagaucuagucaaucaa

SEQ ID NO: 1366625 - RNA, 17 nt, Homo sapiens
cagauggaaaaacugag

SEQ ID NO: 1366626 - RNA, 19 nt, Homo sapiens
cagauggaaaaacugaggc

SEQ ID NO: 1366627 - RNA, 20 nt, Homo sapiens
cagauggcagguuugcaauc

SEQ ID NO: 1366628 - RNA, 16 nt, Homo sapiens
cagauucaugcacugu

SEQ ID NO: 1366629 - RNA, 12 nt, Homo sapiens
cagauucuucag

SEQ ID NO: 1366630 - RNA, 19 nt, Homo sapiens
cagauuuuaacagcucucu

SEQ ID NO: 1366631 - RNA, 17 nt, Homo sapiens
cagcaauucucuuucuu

SEQ ID NO: 1366632 - RNA, 20 nt, Homo sapiens
cagcacgaguggccaguuca

SEQ ID NO: 1366633 - RNA, 16 nt, Homo sapiens
cagcagaggacagucu

SEQ ID NO: 1366634 - RNA, 17 nt, Homo sapiens
cagcaggaugcucagug

SEQ ID NO: 1366635 - RNA, 16 nt, Homo sapiens
cagcauugacucugug

SEQ ID NO: 1366636 - RNA, 12 nt, Homo sapiens
cagccacaacca

SEQ ID NO: 1366637 - RNA, 16 nt, Homo sapiens
cagccacaaccaaaaa

SEQ ID NO: 1366638 - RNA, 14 nt, Homo sapiens
cagccucccugaag

SEQ ID NO: 1366639 - RNA, 15 nt, Homo sapiens
cagccucccuuugau

SEQ ID NO: 1366640 - RNA, 15 nt, Homo sapiens
cagccugcuccagcu

SEQ ID NO: 1366641 - RNA, 23 nt, Homo sapiens
cagccugggugacagugcaagac

SEQ ID NO: 1366642 - RNA, 21 nt, Homo sapiens
cagcggaaagcccugugcucc

SEQ ID NO: 1366643 - RNA, 22 nt, Homo sapiens
cagcggaaagcccugugcucca

SEQ ID NO: 1366644 - RNA, 23 nt, Homo sapiens
cagcggaaagcccugugcuccau

SEQ ID NO: 1366645 - RNA, 19 nt, Homo sapiens
cagcuaacaaguagcacac

SEQ ID NO: 1366646 - RNA, 14 nt, Homo sapiens
cagcucaaaggcac

SEQ ID NO: 1366647 - RNA, 20 nt, Homo sapiens
cagcuuagaaugcaucucau

SEQ ID NO: 1366648 - RNA, 20 nt, Homo sapiens
cagcuuaggggcugcugacc

SEQ ID NO: 1366649 - RNA, 15 nt, Homo sapiens
caggaaccucagggc

SEQ ID NO: 1366650 - RNA, 23 nt, Homo sapiens
caggaauuucccaggacccugaa

SEQ ID NO: 1366651 - RNA, 19 nt, Homo sapiens
caggacagaugccacacaa

SEQ ID NO: 1366652 - RNA, 15 nt, Homo sapiens
caggacagguggugc

SEQ ID NO: 1366653 - RNA, 17 nt, Homo sapiens
caggagaaccacuacau

SEQ ID NO: 1366654 - RNA, 14 nt, Homo sapiens
caggagaaguugag

SEQ ID NO: 1366655 - RNA, 14 nt, Homo sapiens
caggagcaagugag

SEQ ID NO: 1366656 - RNA, 19 nt, Homo sapiens
caggagcugggauccuaag

SEQ ID NO: 1366657 - RNA, 18 nt, Homo sapiens
caggaguauccucuugcc

SEQ ID NO: 1366658 - RNA, 21 nt, Homo sapiens
caggauauuuacuauuacucc

SEQ ID NO: 1366659 - RNA, 18 nt, Homo sapiens
caggaucuuugacugaaa

SEQ ID NO: 1366660 - RNA, 19 nt, Homo sapiens
caggcaccucuuccuugau

SEQ ID NO: 1366661 - RNA, 15 nt, Homo sapiens
caggcaccugaagug

SEQ ID NO: 1366662 - RNA, 16 nt, Homo sapiens
caggcaccugaaguga

SEQ ID NO: 1366663 - RNA, 15 nt, Homo sapiens
caggcagauccagga

SEQ ID NO: 1366664 - RNA, 22 nt, Homo sapiens
caggcagguaaccccagauuca

SEQ ID NO: 1366665 - RNA, 19 nt, Homo sapiens
caggcgcugcccaccugcc

SEQ ID NO: 1366666 - RNA, 16 nt, Homo sapiens
caggcucacagagauu

SEQ ID NO: 1366667 - RNA, 16 nt, Homo sapiens
caggcuggagugcagu

SEQ ID NO: 1366668 - RNA, 14 nt, Homo sapiens
cagggaacccacag

SEQ ID NO: 1366669 - RNA, 23 nt, Homo sapiens
cagggaauggagcucagguccca

SEQ ID NO: 1366670 - RNA, 19 nt, Homo sapiens
cagggccauggcucagggu

SEQ ID NO: 1366671 - RNA, 16 nt, Homo sapiens
cagggcuccugcacuu

SEQ ID NO: 1366672 - RNA, 23 nt, Homo sapiens
cagggcugucuucguauucccau

SEQ ID NO: 1366673 - RNA, 12 nt, Homo sapiens
cagggucugcuc

SEQ ID NO: 1366674 - RNA, 16 nt, Homo sapiens
cagggucugcucuuuc

SEQ ID NO: 1366675 - RNA, 14 nt, Homo sapiens
cagguacuccugcc

SEQ ID NO: 1366676 - RNA, 12 nt, Homo sapiens
cagguagacuuu

SEQ ID NO: 1366677 - RNA, 19 nt, Homo sapiens
caggucacccuuugcugug

SEQ ID NO: 1366678 - RNA, 14 nt, Homo sapiens
caggugccuuucaa

SEQ ID NO: 1366679 - RNA, 14 nt, Homo sapiens
cagguggugcaaau

SEQ ID NO: 1366680 - RNA, 14 nt, Homo sapiens
cagguguugccaaa

SEQ ID NO: 1366681 - RNA, 15 nt, Homo sapiens
cagguguuggugaca

SEQ ID NO: 1366682 - RNA, 13 nt, Homo sapiens
cagguuaccucac

SEQ ID NO: 1366683 - RNA, 16 nt, Homo sapiens
cagguuaccucacuuu

SEQ ID NO: 1366684 - RNA, 21 nt, Homo sapiens
cagguuagaagacgacugugg

SEQ ID NO: 1366685 - RNA, 15 nt, Homo sapiens
cagguuggugggggc

SEQ ID NO: 1366686 - RNA, 19 nt, Homo sapiens
caguaaauguuugugaugu

SEQ ID NO: 1366687 - RNA, 17 nt, Homo sapiens
caguaacgcgucuuccu

SEQ ID NO: 1366688 - RNA, 12 nt, Homo sapiens
caguaacuguca

SEQ ID NO: 1366689 - RNA, 14 nt, Homo sapiens
caguaaguggcaca

SEQ ID NO: 1366690 - RNA, 18 nt, Homo sapiens
caguacaggcagcacaga

SEQ ID NO: 1366691 - RNA, 17 nt, Homo sapiens
caguacccagagaccaa

SEQ ID NO: 1366692 - RNA, 18 nt, Homo sapiens
caguacccagagaccaag

SEQ ID NO: 1366693 - RNA, 14 nt, Homo sapiens
caguagaacuccag

SEQ ID NO: 1366694 - RNA, 14 nt, Homo sapiens
caguagaugccacu

SEQ ID NO: 1366695 - RNA, 22 nt, Homo sapiens
caguauuuuccaaacuaccuuc

SEQ ID NO: 1366696 - RNA, 14 nt, Homo sapiens
cagucaucuugacc

SEQ ID NO: 1366697 - RNA, 15 nt, Homo sapiens
cagucaucuugacca

SEQ ID NO: 1366698 - RNA, 18 nt, Homo sapiens
cagucccuaaaaacacag

SEQ ID NO: 1366699 - RNA, 14 nt, Homo sapiens
cagugaagauuuac

SEQ ID NO: 1366700 - RNA, 20 nt, Homo sapiens
cagugaaggcuguccuuacc

SEQ ID NO: 1366701 - RNA, 15 nt, Homo sapiens
cagugacaaccaaaa

SEQ ID NO: 1366702 - RNA, 16 nt, Homo sapiens
cagugacacaaucuca

SEQ ID NO: 1366703 - RNA, 15 nt, Homo sapiens
cagugagcacugaaa

SEQ ID NO: 1366704 - RNA, 16 nt, Homo sapiens
cagugcccccacugac

SEQ ID NO: 1366705 - RNA, 18 nt, Homo sapiens
cagugcucuuuguagcua

SEQ ID NO: 1366706 - RNA, 12 nt, Homo sapiens
caguguguuucu

SEQ ID NO: 1366707 - RNA, 14 nt, Homo sapiens
caguucugucauau

SEQ ID NO: 1366708 - RNA, 18 nt, Homo sapiens
caguucuuugggccagac

SEQ ID NO: 1366709 - RNA, 18 nt, Homo sapiens
caguugcagcccuuguga

SEQ ID NO: 1366710 - RNA, 17 nt, Homo sapiens
cauaaaauagagugcau

SEQ ID NO: 1366711 - RNA, 17 nt, Homo sapiens
cauaauugcuuugccaa

SEQ ID NO: 1366712 - RNA, 19 nt, Homo sapiens
cauacccucacuuaaacuu

SEQ ID NO: 1366713 - RNA, 16 nt, Homo sapiens
cauagauguuaugcaa

SEQ ID NO: 1366714 - RNA, 19 nt, Homo sapiens
cauagauguuaugcaaaaa

SEQ ID NO: 1366715 - RNA, 21 nt, Homo sapiens
cauauaggaaaacaauaauuu

SEQ ID NO: 1366716 - RNA, 19 nt, Homo sapiens
cauauauauauauaacaua

SEQ ID NO: 1366717 - RNA, 15 nt, Homo sapiens
cauauauuuguauga

SEQ ID NO: 1366718 - RNA, 13 nt, Homo sapiens
caucaacuuaaaa

SEQ ID NO: 1366719 - RNA, 19 nt, Homo sapiens
caucauugugacgugugug

SEQ ID NO: 1366720 - RNA, 17 nt, Homo sapiens
cauccaagcaaacugaa

SEQ ID NO: 1366721 - RNA, 18 nt, Homo sapiens
cauccauucuucccuuga

SEQ ID NO: 1366722 - RNA, 14 nt, Homo sapiens
cauccgcgugugcc

SEQ ID NO: 1366723 - RNA, 16 nt, Homo sapiens
cauccgcgugugccug

SEQ ID NO: 1366724 - RNA, 20 nt, Homo sapiens
cauccuguuuguaugaaauu

SEQ ID NO: 1366725 - RNA, 12 nt, Homo sapiens
cauccuugaugc

SEQ ID NO: 1366726 - RNA, 19 nt, Homo sapiens
caucguacacacucaguga

SEQ ID NO: 1366727 - RNA, 14 nt, Homo sapiens
caucuagucacaaa

SEQ ID NO: 1366728 - RNA, 15 nt, Homo sapiens
caucuuagaccucca

SEQ ID NO: 1366729 - RNA, 20 nt, Homo sapiens
caucuuauuucugucaacuu

SEQ ID NO: 1366730 - RNA, 21 nt, Homo sapiens
caucuugaccaagcaggaagc

SEQ ID NO: 1366731 - RNA, 17 nt, Homo sapiens
caugaaaauuaugucag

SEQ ID NO: 1366732 - RNA, 23 nt, Homo sapiens
caugaaauggacaaacagugcac

SEQ ID NO: 1366733 - RNA, 16 nt, Homo sapiens
caugaauaacauuuaa

SEQ ID NO: 1366734 - RNA, 19 nt, Homo sapiens
caugaaucacugcaccucu

SEQ ID NO: 1366735 - RNA, 20 nt, Homo sapiens
caugacauauuuuugcuuua

SEQ ID NO: 1366736 - RNA, 19 nt, Homo sapiens
caugagacucagugcagau

SEQ ID NO: 1366737 - RNA, 18 nt, Homo sapiens
caugaggccaccaguaaa

SEQ ID NO: 1366738 - RNA, 22 nt, Homo sapiens
caugaucccuguguugucucua

SEQ ID NO: 1366739 - RNA, 15 nt, Homo sapiens
caugcucuugaccuu

SEQ ID NO: 1366740 - RNA, 21 nt, Homo sapiens
caugcuuugaaguuucuggaa

SEQ ID NO: 1366741 - RNA, 16 nt, Homo sapiens
cauggaaaaucaguga

SEQ ID NO: 1366742 - RNA, 23 nt, Homo sapiens
cauggcgaaaccccucucuacua

SEQ ID NO: 1366743 - RNA, 21 nt, Homo sapiens
cauggugccccaggaccagcu

SEQ ID NO: 1366744 - RNA, 20 nt, Homo sapiens
caugguggcgcaugccugua

SEQ ID NO: 1366745 - RNA, 20 nt, Homo sapiens
caugguggugugugccugua

SEQ ID NO: 1366746 - RNA, 15 nt, Homo sapiens
cauguaaacauacca

SEQ ID NO: 1366747 - RNA, 20 nt, Homo sapiens
cauguaacuauuucuucaga

SEQ ID NO: 1366748 - RNA, 20 nt, Homo sapiens
cauguacucaaguaccacca

SEQ ID NO: 1366749 - RNA, 15 nt, Homo sapiens
caugugcucagggaa

SEQ ID NO: 1366750 - RNA, 19 nt, Homo sapiens
cauguggcuaccuguaacu

SEQ ID NO: 1366751 - RNA, 19 nt, Homo sapiens
cauguuuuuaaagggcuau

SEQ ID NO: 1366752 - RNA, 17 nt, Homo sapiens
cauuaaauaugugaaau

SEQ ID NO: 1366753 - RNA, 12 nt, Homo sapiens
cauuagaccaag

SEQ ID NO: 1366754 - RNA, 19 nt, Homo sapiens
cauuagaccaagcuugucc

SEQ ID NO: 1366755 - RNA, 13 nt, Homo sapiens
cauuaucuaugau

SEQ ID NO: 1366756 - RNA, 22 nt, Homo sapiens
cauucacaguucuuugggccag

SEQ ID NO: 1366757 - RNA, 15 nt, Homo sapiens
cauuccaacucguau

SEQ ID NO: 1366758 - RNA, 13 nt, Homo sapiens
cauuccugaagaa

SEQ ID NO: 1366759 - RNA, 19 nt, Homo sapiens
cauuccuuagauaccuuga

SEQ ID NO: 1366760 - RNA, 15 nt, Homo sapiens
cauucgaguguuuca

SEQ ID NO: 1366761 - RNA, 14 nt, Homo sapiens
cauucucaagcccu

SEQ ID NO: 1366762 - RNA, 18 nt, Homo sapiens
cauugaaacaugccacuu

SEQ ID NO: 1366763 - RNA, 16 nt, Homo sapiens
cauugccuuugaaugu

SEQ ID NO: 1366764 - RNA, 19 nt, Homo sapiens
cauugcucagaaaugucau

SEQ ID NO: 1366765 - RNA, 16 nt, Homo sapiens
cauugcucuccaguca

SEQ ID NO: 1366766 - RNA, 11 nt, Homo sapiens
cauuggcuuuc

SEQ ID NO: 1366767 - RNA, 20 nt, Homo sapiens
cauugggccaucaagccuuu

SEQ ID NO: 1366768 - RNA, 22 nt, Homo sapiens
cauuguaauaugacuccugugu

SEQ ID NO: 1366769 - RNA, 13 nt, Homo sapiens
cauuguacuuaaa

SEQ ID NO: 1366770 - RNA, 19 nt, Homo sapiens
cauuguucagaugcuucuu

SEQ ID NO: 1366771 - RNA, 21 nt, Homo sapiens
cauuuaaauuccacagauuau

SEQ ID NO: 1366772 - RNA, 20 nt, Homo sapiens
cauuucugagaucaaaacgg

SEQ ID NO: 1366773 - RNA, 16 nt, Homo sapiens
cauuugaaaucuauga

SEQ ID NO: 1366774 - RNA, 22 nt, Homo sapiens
cauuuguuuaauaagcauacca

SEQ ID NO: 1366775 - RNA, 20 nt, Homo sapiens
cauuuuagucaugcaaagau

SEQ ID NO: 1366776 - RNA, 20 nt, Homo sapiens
cauuuuauuuuuucuugcaa

SEQ ID NO: 1366777 - RNA, 21 nt, Homo sapiens
cauuuuuuuguacuaauguga

SEQ ID NO: 1366778 - RNA, 18 nt, Homo sapiens
ccaaaacaaacaaacaga

SEQ ID NO: 1366779 - RNA, 14 nt, Homo sapiens
ccaaaagucuucau

SEQ ID NO: 1366780 - RNA, 19 nt, Homo sapiens
ccaaaggucaagaacacag

SEQ ID NO: 1366781 - RNA, 15 nt, Homo sapiens
ccaaagugcugcgau

SEQ ID NO: 1366782 - RNA, 18 nt, Homo sapiens
ccaaaucucaaaauaucc

SEQ ID NO: 1366783 - RNA, 22 nt, Homo sapiens
ccaacaggagcugggauccuaa

SEQ ID NO: 1366784 - RNA, 16 nt, Homo sapiens
ccaagagggacaucag

SEQ ID NO: 1366785 - RNA, 16 nt, Homo sapiens
ccaagcaggaagcuca

SEQ ID NO: 1366786 - RNA, 23 nt, Homo sapiens
ccaagcggaugcuccauuucaau

SEQ ID NO: 1366787 - RNA, 17 nt, Homo sapiens
ccaauauuuaccagacc

SEQ ID NO: 1366788 - RNA, 21 nt, Homo sapiens
ccaauauuuaccagaccacaa

SEQ ID NO: 1366789 - RNA, 17 nt, Homo sapiens
ccaauuucagacuccca

SEQ ID NO: 1366790 - RNA, 14 nt, Homo sapiens
ccacaaacuguaau

SEQ ID NO: 1366791 - RNA, 13 nt, Homo sapiens
ccacaaccaaaaa

SEQ ID NO: 1366792 - RNA, 14 nt, Homo sapiens
ccacaaccaaaaaa

SEQ ID NO: 1366793 - RNA, 17 nt, Homo sapiens
ccacaaccaaaaaauuc

SEQ ID NO: 1366794 - RNA, 12 nt, Homo sapiens
ccacacccaaag

SEQ ID NO: 1366795 - RNA, 18 nt, Homo sapiens
ccaccaccaucaccagac

SEQ ID NO: 1366796 - RNA, 15 nt, Homo sapiens
ccacccaccuuugcc

SEQ ID NO: 1366797 - RNA, 13 nt, Homo sapiens
ccaccccacacuu

SEQ ID NO: 1366798 - RNA, 16 nt, Homo sapiens
ccaccugcagccuguu

SEQ ID NO: 1366799 - RNA, 19 nt, Homo sapiens
ccacggugccuccagaugg

SEQ ID NO: 1366800 - RNA, 19 nt, Homo sapiens
ccacguugccucuacuuua

SEQ ID NO: 1366801 - RNA, 22 nt, Homo sapiens
ccacucuaugaguuggacuuca

SEQ ID NO: 1366802 - RNA, 12 nt, Homo sapiens
ccacugagcugg

SEQ ID NO: 1366803 - RNA, 23 nt, Homo sapiens
ccacugugcuuucagaagugccc

SEQ ID NO: 1366804 - RNA, 20 nt, Homo sapiens
ccacugugguggcaguggag

SEQ ID NO: 1366805 - RNA, 21 nt, Homo sapiens
ccagaaaacaaaacugcauuu

SEQ ID NO: 1366806 - RNA, 20 nt, Homo sapiens
ccagaagccugaugugagug

SEQ ID NO: 1366807 - RNA, 18 nt, Homo sapiens
ccagacuuccuccuuucc

SEQ ID NO: 1366808 - RNA, 13 nt, Homo sapiens
ccagagaagccaa

SEQ ID NO: 1366809 - RNA, 19 nt, Homo sapiens
ccagaggugucacccaaac

SEQ ID NO: 1366810 - RNA, 21 nt, Homo sapiens
ccagauggcagguuugcaauc

SEQ ID NO: 1366811 - RNA, 19 nt, Homo sapiens
ccagauucaugcacuguag

SEQ ID NO: 1366812 - RNA, 18 nt, Homo sapiens
ccagauugacgacaagug

SEQ ID NO: 1366813 - RNA, 13 nt, Homo sapiens
ccagcccagagac

SEQ ID NO: 1366814 - RNA, 18 nt, Homo sapiens
ccagcgugugacuacucc

SEQ ID NO: 1366815 - RNA, 19 nt, Homo sapiens
ccagcuccaaccugcaaag

SEQ ID NO: 1366816 - RNA, 16 nt, Homo sapiens
ccagcuccaaggggaa

SEQ ID NO: 1366817 - RNA, 18 nt, Homo sapiens
ccagcugcacugaugcug

SEQ ID NO: 1366818 - RNA, 19 nt, Homo sapiens
ccagcuuagcaacugcugg

SEQ ID NO: 1366819 - RNA, 14 nt, Homo sapiens
ccagcuuaucucag

SEQ ID NO: 1366820 - RNA, 16 nt, Homo sapiens
ccaggaaccucagggc

SEQ ID NO: 1366821 - RNA, 23 nt, Homo sapiens
ccaggaagcuuuggugagaaccu

SEQ ID NO: 1366822 - RNA, 13 nt, Homo sapiens
ccaggcagaucca

SEQ ID NO: 1366823 - RNA, 22 nt, Homo sapiens
ccaggcuggagagcacugccag

SEQ ID NO: 1366824 - RNA, 17 nt, Homo sapiens
ccaggugagagcccuuu

SEQ ID NO: 1366825 - RNA, 20 nt, Homo sapiens
ccagguuaccucacuuuuaa

SEQ ID NO: 1366826 - RNA, 13 nt, Homo sapiens
ccaguaucgcuca

SEQ ID NO: 1366827 - RNA, 14 nt, Homo sapiens
ccagugagauauau

SEQ ID NO: 1366828 - RNA, 12 nt, Homo sapiens
ccagugcuccag

SEQ ID NO: 1366829 - RNA, 19 nt, Homo sapiens
ccaguggaagcagguguau

SEQ ID NO: 1366830 - RNA, 15 nt, Homo sapiens
ccaguucacccugau

SEQ ID NO: 1366831 - RNA, 23 nt, Homo sapiens
ccaguuucugauuuuuauucuca

SEQ ID NO: 1366832 - RNA, 13 nt, Homo sapiens
ccaucaagccuuu

SEQ ID NO: 1366833 - RNA, 14 nt, Homo sapiens
ccaucaccagacag

SEQ ID NO: 1366834 - RNA, 23 nt, Homo sapiens
ccaucagcuuaggggcugcugac

SEQ ID NO: 1366835 - RNA, 19 nt, Homo sapiens
ccauccuguuuguaugaaa

SEQ ID NO: 1366836 - RNA, 14 nt, Homo sapiens
ccaucucuacugaa

SEQ ID NO: 1366837 - RNA, 22 nt, Homo sapiens
ccaucucuacugaaaguacaaa

SEQ ID NO: 1366838 - RNA, 17 nt, Homo sapiens
ccaucuuaaauuucuaa

SEQ ID NO: 1366839 - RNA, 12 nt, Homo sapiens
ccaugacaugga

SEQ ID NO: 1366840 - RNA, 17 nt, Homo sapiens
ccauggcugccaucuca

SEQ ID NO: 1366841 - RNA, 19 nt, Homo sapiens
ccauggcugccaucucacc

SEQ ID NO: 1366842 - RNA, 20 nt, Homo sapiens
ccauggcuguguuggugugg

SEQ ID NO: 1366843 - RNA, 19 nt, Homo sapiens
ccauggcuguuggugggac

SEQ ID NO: 1366844 - RNA, 21 nt, Homo sapiens
ccauggcuguuggugggaccc

SEQ ID NO: 1366845 - RNA, 23 nt, Homo sapiens
ccauguacucaaguaccaccaag

SEQ ID NO: 1366846 - RNA, 15 nt, Homo sapiens
ccauucccuucucaa

SEQ ID NO: 1366847 - RNA, 13 nt, Homo sapiens
ccauugcacucca

SEQ ID NO: 1366848 - RNA, 17 nt, Homo sapiens
ccauuucugagaucaaa

SEQ ID NO: 1366849 - RNA, 19 nt, Homo sapiens
cccaaagaccuccacuugc

SEQ ID NO: 1366850 - RNA, 23 nt, Homo sapiens
cccaaauccuuagaucuggcaug

SEQ ID NO: 1366851 - RNA, 17 nt, Homo sapiens
cccaauauuuaccagac

SEQ ID NO: 1366852 - RNA, 22 nt, Homo sapiens
cccacaaucuggcuuagugcca

SEQ ID NO: 1366853 - RNA, 19 nt, Homo sapiens
cccacaccccaacacuucc

SEQ ID NO: 1366854 - RNA, 19 nt, Homo sapiens
cccacauguccagcaccuu

SEQ ID NO: 1366855 - RNA, 21 nt, Homo sapiens
cccacccccuucucugcucca

SEQ ID NO: 1366856 - RNA, 17 nt, Homo sapiens
cccagacagcaaggugu

SEQ ID NO: 1366857 - RNA, 15 nt, Homo sapiens
cccagaucugguccc

SEQ ID NO: 1366858 - RNA, 11 nt, Homo sapiens
cccagcauuuu

SEQ ID NO: 1366859 - RNA, 16 nt, Homo sapiens
cccagcccugcagcaa

SEQ ID NO: 1366860 - RNA, 18 nt, Homo sapiens
cccagcuaagaaccugga

SEQ ID NO: 1366861 - RNA, 14 nt, Homo sapiens
cccaggacccugaa

SEQ ID NO: 1366862 - RNA, 16 nt, Homo sapiens
cccagugacaaccaaa

SEQ ID NO: 1366863 - RNA, 18 nt, Homo sapiens
cccagugcaugguggcca

SEQ ID NO: 1366864 - RNA, 10 nt, Homo sapiens
cccagugugu

SEQ ID NO: 1366865 - RNA, 22 nt, Homo sapiens
cccaguucacccugauuuagga

SEQ ID NO: 1366866 - RNA, 17 nt, Homo sapiens
cccaguugugacaauua

SEQ ID NO: 1366867 - RNA, 22 nt, Homo sapiens
cccauaucccugguugccucau

SEQ ID NO: 1366868 - RNA, 17 nt, Homo sapiens
cccaucagcuccagcug

SEQ ID NO: 1366869 - RNA, 14 nt, Homo sapiens
cccaugcacuguga

SEQ ID NO: 1366870 - RNA, 22 nt, Homo sapiens
ccccaacaaugugagggguccc

SEQ ID NO: 1366871 - RNA, 23 nt, Homo sapiens
ccccacguugccucuacuuuauc

SEQ ID NO: 1366872 - RNA, 12 nt, Homo sapiens
ccccacugacca

SEQ ID NO: 1366873 - RNA, 22 nt, Homo sapiens
ccccaggcccagugggguggcc

SEQ ID NO: 1366874 - RNA, 16 nt, Homo sapiens
ccccaggccccaggaa

SEQ ID NO: 1366875 - RNA, 20 nt, Homo sapiens
ccccaucugccacguguauu

SEQ ID NO: 1366876 - RNA, 15 nt, Homo sapiens
ccccaugccugucca

SEQ ID NO: 1366877 - RNA, 18 nt, Homo sapiens
ccccaugccuguccagcc

SEQ ID NO: 1366878 - RNA, 16 nt, Homo sapiens
cccccacuacaaguga

SEQ ID NO: 1366879 - RNA, 11 nt, Homo sapiens
cccccaucucc

SEQ ID NO: 1366880 - RNA, 13 nt, Homo sapiens
cccccuucacaaa

SEQ ID NO: 1366881 - RNA, 16 nt, Homo sapiens
cccccuuuccaaaaac

SEQ ID NO: 1366882 - RNA, 13 nt, Homo sapiens
ccccggaacaagc

SEQ ID NO: 1366883 - RNA, 17 nt, Homo sapiens
ccccucccagaacacac

SEQ ID NO: 1366884 - RNA, 22 nt, Homo sapiens
ccccugggauccgagggccccu

SEQ ID NO: 1366885 - RNA, 22 nt, Homo sapiens
ccccuguagagugggagcugag

SEQ ID NO: 1366886 - RNA, 14 nt, Homo sapiens
cccgagaaacacag

SEQ ID NO: 1366887 - RNA, 18 nt, Homo sapiens
cccuacccuccugcugag

SEQ ID NO: 1366888 - RNA, 21 nt, Homo sapiens
cccuagcagcccacccugcug

SEQ ID NO: 1366889 - RNA, 17 nt, Homo sapiens
cccuagucuuuuaaaca

SEQ ID NO: 1366890 - RNA, 14 nt, Homo sapiens
cccucccacaccca

SEQ ID NO: 1366891 - RNA, 13 nt, Homo sapiens
cccuccucuccca

SEQ ID NO: 1366892 - RNA, 22 nt, Homo sapiens
cccugaaguaagcaaagacuuu

SEQ ID NO: 1366893 - RNA, 17 nt, Homo sapiens
cccugagcuugcagggu

SEQ ID NO: 1366894 - RNA, 15 nt, Homo sapiens
cccugccagcucuuc

SEQ ID NO: 1366895 - RNA, 21 nt, Homo sapiens
cccuggugggccaacaaagaa

SEQ ID NO: 1366896 - RNA, 14 nt, Homo sapiens
cccugucucaaaaa

SEQ ID NO: 1366897 - RNA, 17 nt, Homo sapiens
cccuuagccucccugaa

SEQ ID NO: 1366898 - RNA, 12 nt, Homo sapiens
cccuuccacggg

SEQ ID NO: 1366899 - RNA, 18 nt, Homo sapiens
cccuucucccaucagggu

SEQ ID NO: 1366900 - RNA, 20 nt, Homo sapiens
cccuugauuuaaacacacag

SEQ ID NO: 1366901 - RNA, 22 nt, Homo sapiens
ccgagcuuugaaaauucagugg

SEQ ID NO: 1366902 - RNA, 17 nt, Homo sapiens
ccgcaaauuuucuucca

SEQ ID NO: 1366903 - RNA, 13 nt, Homo sapiens
ccggggguccagg

SEQ ID NO: 1366904 - RNA, 18 nt, Homo sapiens
ccguggcuaagagugucc

SEQ ID NO: 1366905 - RNA, 15 nt, Homo sapiens
ccgugugaggacuga

SEQ ID NO: 1366906 - RNA, 16 nt, Homo sapiens
ccuaagacgucccuuu

SEQ ID NO: 1366907 - RNA, 16 nt, Homo sapiens
ccuaagacuaacaaag

SEQ ID NO: 1366908 - RNA, 18 nt, Homo sapiens
ccuaaugaaugcauaaaa

SEQ ID NO: 1366909 - RNA, 20 nt, Homo sapiens
ccuaccaggcacgucugcag

SEQ ID NO: 1366910 - RNA, 15 nt, Homo sapiens
ccuagaaguggcaga

SEQ ID NO: 1366911 - RNA, 17 nt, Homo sapiens
ccuaggaguauccucau

SEQ ID NO: 1366912 - RNA, 17 nt, Homo sapiens
ccuaggcauuugcugaa

SEQ ID NO: 1366913 - RNA, 23 nt, Homo sapiens
ccuagggaauggucccagcacga

SEQ ID NO: 1366914 - RNA, 23 nt, Homo sapiens
ccuaggugagaacccuugcacua

SEQ ID NO: 1366915 - RNA, 11 nt, Homo sapiens
ccucacacugu

SEQ ID NO: 1366916 - RNA, 13 nt, Homo sapiens
ccucacuccucag

SEQ ID NO: 1366917 - RNA, 10 nt, Homo sapiens
ccucagggcu

SEQ ID NO: 1366918 - RNA, 19 nt, Homo sapiens
ccucauuugggguagcuag

SEQ ID NO: 1366919 - RNA, 17 nt, Homo sapiens
ccuccaggaaacaugaa

SEQ ID NO: 1366920 - RNA, 20 nt, Homo sapiens
ccuccaucauuaaugugaag

SEQ ID NO: 1366921 - RNA, 17 nt, Homo sapiens
ccuccccaccacugagc

SEQ ID NO: 1366922 - RNA, 22 nt, Homo sapiens
ccucccucucucuucugcucca

SEQ ID NO: 1366923 - RNA, 15 nt, Homo sapiens
ccucccugcaucuga

SEQ ID NO: 1366924 - RNA, 13 nt, Homo sapiens
ccuccguccagcc

SEQ ID NO: 1366925 - RNA, 12 nt, Homo sapiens
ccucggugggag

SEQ ID NO: 1366926 - RNA, 17 nt, Homo sapiens
ccucuacaggcauuuaa

SEQ ID NO: 1366927 - RNA, 19 nt, Homo sapiens
ccucuacuuugauucugau

SEQ ID NO: 1366928 - RNA, 17 nt, Homo sapiens
ccucugcacuacugaca

SEQ ID NO: 1366929 - RNA, 14 nt, Homo sapiens
ccucugugcugcac

SEQ ID NO: 1366930 - RNA, 24 nt, Homo sapiens
ccucuuccccagaaaggagacuag

SEQ ID NO: 1366931 - RNA, 24 nt, Homo sapiens
ccucuuugugugcgucacugugaa

SEQ ID NO: 1366932 - RNA, 14 nt, Homo sapiens
ccugaagaaccagu

SEQ ID NO: 1366933 - RNA, 16 nt, Homo sapiens
ccugacuggugcugca

SEQ ID NO: 1366934 - RNA, 16 nt, Homo sapiens
ccugacuucuguuuag

SEQ ID NO: 1366935 - RNA, 17 nt, Homo sapiens
ccugacuuuuaauguca

SEQ ID NO: 1366936 - RNA, 17 nt, Homo sapiens
ccugaguggugccaaac

SEQ ID NO: 1366937 - RNA, 13 nt, Homo sapiens
ccugaugagauuu

SEQ ID NO: 1366938 - RNA, 22 nt, Homo sapiens
ccugaugugaguguguggcacc

SEQ ID NO: 1366939 - RNA, 19 nt, Homo sapiens
ccugauuuaggagaagcca

SEQ ID NO: 1366940 - RNA, 15 nt, Homo sapiens
ccugcccaccuguca

SEQ ID NO: 1366941 - RNA, 20 nt, Homo sapiens
ccuggaaagaaaaagcaaua

SEQ ID NO: 1366942 - RNA, 22 nt, Homo sapiens
ccuggaguguaugacugcacau

SEQ ID NO: 1366943 - RNA, 19 nt, Homo sapiens
ccuggaugucugggugacc

SEQ ID NO: 1366944 - RNA, 23 nt, Homo sapiens
ccuggauuccucgaaacugccau

SEQ ID NO: 1366945 - RNA, 12 nt, Homo sapiens
ccuggcaagaau

SEQ ID NO: 1366946 - RNA, 13 nt, Homo sapiens
ccuggccagacac

SEQ ID NO: 1366947 - RNA, 15 nt, Homo sapiens
ccugggccuuggcaa

SEQ ID NO: 1366948 - RNA, 20 nt, Homo sapiens
ccugggguguuaguggcacc

SEQ ID NO: 1366949 - RNA, 18 nt, Homo sapiens
ccuggguaacuagggaag

SEQ ID NO: 1366950 - RNA, 19 nt, Homo sapiens
ccugguugucugaacccag

SEQ ID NO: 1366951 - RNA, 18 nt, Homo sapiens
ccuguaaucccagcauuu

SEQ ID NO: 1366952 - RNA, 14 nt, Homo sapiens
ccugugaaugccac

SEQ ID NO: 1366953 - RNA, 20 nt, Homo sapiens
ccuguggcugucggugggac

SEQ ID NO: 1366954 - RNA, 20 nt, Homo sapiens
ccuguggguggggcuucucu

SEQ ID NO: 1366955 - RNA, 21 nt, Homo sapiens
ccuuaaagaguguggcaaaau

SEQ ID NO: 1366956 - RNA, 17 nt, Homo sapiens
ccuuaaagauacuugaa

SEQ ID NO: 1366957 - RNA, 21 nt, Homo sapiens
ccuuaagggacaacauccuua

SEQ ID NO: 1366958 - RNA, 22 nt, Homo sapiens
ccuuacauuugaaaucuaugaa

SEQ ID NO: 1366959 - RNA, 13 nt, Homo sapiens
ccuucaagugcca

SEQ ID NO: 1366960 - RNA, 12 nt, Homo sapiens
ccuucaugcccu

SEQ ID NO: 1366961 - RNA, 13 nt, Homo sapiens
ccuuccagugcag

SEQ ID NO: 1366962 - RNA, 17 nt, Homo sapiens
ccuucccauuggcuuuc

SEQ ID NO: 1366963 - RNA, 17 nt, Homo sapiens
ccuucgcuucuugccuc

SEQ ID NO: 1366964 - RNA, 16 nt, Homo sapiens
ccuucuaguuaccaca

SEQ ID NO: 1366965 - RNA, 13 nt, Homo sapiens
ccuugaaaacugc

SEQ ID NO: 1366966 - RNA, 21 nt, Homo sapiens
ccuugcugcauugauccagga

SEQ ID NO: 1366967 - RNA, 23 nt, Homo sapiens
ccuugcuuucucuucuaauggaa

SEQ ID NO: 1366968 - RNA, 19 nt, Homo sapiens
ccuuggagggacaugacua

SEQ ID NO: 1366969 - RNA, 15 nt, Homo sapiens
ccuuguaaaagccua

SEQ ID NO: 1366970 - RNA, 23 nt, Homo sapiens
ccuuguaucuauuuguggugaau

SEQ ID NO: 1366971 - RNA, 18 nt, Homo sapiens
ccuugucccagccaguga

SEQ ID NO: 1366972 - RNA, 14 nt, Homo sapiens
ccuuuaucaccuca

SEQ ID NO: 1366973 - RNA, 16 nt, Homo sapiens
ccuuuugccaaucuca

SEQ ID NO: 1366974 - RNA, 21 nt, Homo sapiens
ccuuuuuuguuuuuucaaaau

SEQ ID NO: 1366975 - RNA, 19 nt, Homo sapiens
cgaaaaagagguagcacua

SEQ ID NO: 1366976 - RNA, 12 nt, Homo sapiens
cgagaaacacag

SEQ ID NO: 1366977 - RNA, 20 nt, Homo sapiens
cgagauugcaccacugcacu

SEQ ID NO: 1366978 - RNA, 14 nt, Homo sapiens
cgaggaaacucaga

SEQ ID NO: 1366979 - RNA, 22 nt, Homo sapiens
cgaggagugacugccaaaaagg

SEQ ID NO: 1366980 - RNA, 17 nt, Homo sapiens
cgagugugccucaggga

SEQ ID NO: 1366981 - RNA, 19 nt, Homo sapiens
cgaugaaguuaugcuguca

SEQ ID NO: 1366982 - RNA, 21 nt, Homo sapiens
cgauguuauuagauguuacaa

SEQ ID NO: 1366983 - RNA, 20 nt, Homo sapiens
cgauugucugggcaaugaaa

SEQ ID NO: 1366984 - RNA, 18 nt, Homo sapiens
cgcagauguccuugaugc

SEQ ID NO: 1366985 - RNA, 17 nt, Homo sapiens
cgcagcauuggugcuca

SEQ ID NO: 1366986 - RNA, 20 nt, Homo sapiens
cgcccaggcuggagugcagu

SEQ ID NO: 1366987 - RNA, 21 nt, Homo sapiens
cgccuccccaccacugagcca

SEQ ID NO: 1366988 - RNA, 19 nt, Homo sapiens
cgcgcuugcuggccagucc

SEQ ID NO: 1366989 - RNA, 16 nt, Homo sapiens
cgcgugccguggcacc

SEQ ID NO: 1366990 - RNA, 21 nt, Homo sapiens
cgcugugugguaacucagugu

SEQ ID NO: 1366991 - RNA, 21 nt, Homo sapiens
cggaaacuaguguacauuucu

SEQ ID NO: 1366992 - RNA, 13 nt, Homo sapiens
cggagcucagugc

SEQ ID NO: 1366993 - RNA, 20 nt, Homo sapiens
cggcagcugguucugcaaug

SEQ ID NO: 1366994 - RNA, 19 nt, Homo sapiens
cggccccucccacacccaa

SEQ ID NO: 1366995 - RNA, 20 nt, Homo sapiens
cggccuuccacccugacugc

SEQ ID NO: 1366996 - RNA, 16 nt, Homo sapiens
cggcgugugcagugcc

SEQ ID NO: 1366997 - RNA, 14 nt, Homo sapiens
cggcuuugcagugc

SEQ ID NO: 1366998 - RNA, 16 nt, Homo sapiens
cgggaagaaggggaca

SEQ ID NO: 1366999 - RNA, 17 nt, Homo sapiens
cgggaagaaggggacaa

SEQ ID NO: 1367000 - RNA, 17 nt, Homo sapiens
cggggauagaccaaaga

SEQ ID NO: 1367001 - RNA, 13 nt, Homo sapiens
cggguaccugaag

SEQ ID NO: 1367002 - RNA, 15 nt, Homo sapiens
cgggucacacaaagg

SEQ ID NO: 1367003 - RNA, 23 nt, Homo sapiens
cggucugagaagauucaauuuaa

SEQ ID NO: 1367004 - RNA, 21 nt, Homo sapiens
cggugagacccauggcugugu

SEQ ID NO: 1367005 - RNA, 18 nt, Homo sapiens
cgucagugcugugcugug

SEQ ID NO: 1367006 - RNA, 21 nt, Homo sapiens
cgucccauccagcuaccacca

SEQ ID NO: 1367007 - RNA, 15 nt, Homo sapiens
cgucgucaccaaauc

SEQ ID NO: 1367008 - RNA, 14 nt, Homo sapiens
cgucugugcuuccu

SEQ ID NO: 1367009 - RNA, 15 nt, Homo sapiens
cgugaacugcaguga

SEQ ID NO: 1367010 - RNA, 15 nt, Homo sapiens
cgugauccaccugcc

SEQ ID NO: 1367011 - RNA, 23 nt, Homo sapiens
cguggauguauggggaaucuaag

SEQ ID NO: 1367012 - RNA, 20 nt, Homo sapiens
cgugguggcucaugccugua

SEQ ID NO: 1367013 - RNA, 22 nt, Homo sapiens
cgugucaguuacuuuuuuagua

SEQ ID NO: 1367014 - RNA, 20 nt, Homo sapiens
cguguccugaggggcugcuu

SEQ ID NO: 1367015 - RNA, 17 nt, Homo sapiens
cguugcccccagacuuc

SEQ ID NO: 1367016 - RNA, 13 nt, Homo sapiens
cguuuaaucacau

SEQ ID NO: 1367017 - RNA, 16 nt, Homo sapiens
cguuucugguggucug

SEQ ID NO: 1367018 - RNA, 20 nt, Homo sapiens
cuaaaaacacagacauucug

SEQ ID NO: 1367019 - RNA, 15 nt, Homo sapiens
cuaaacuacauuuua

SEQ ID NO: 1367020 - RNA, 22 nt, Homo sapiens
cuaaauuuaagcuuaagccaua

SEQ ID NO: 1367021 - RNA, 17 nt, Homo sapiens
cuaacaauaauauuuca

SEQ ID NO: 1367022 - RNA, 20 nt, Homo sapiens
cuaacauguaauugcagaua

SEQ ID NO: 1367023 - RNA, 16 nt, Homo sapiens
cuaacuccugccauuc

SEQ ID NO: 1367024 - RNA, 23 nt, Homo sapiens
cuaaggggcccggccagccaugu

SEQ ID NO: 1367025 - RNA, 17 nt, Homo sapiens
cuaauagucuuugccag

SEQ ID NO: 1367026 - RNA, 18 nt, Homo sapiens
cuaaucauccaaugcuca

SEQ ID NO: 1367027 - RNA, 11 nt, Homo sapiens
cuaaugcucac

SEQ ID NO: 1367028 - RNA, 18 nt, Homo sapiens
cuaauuauacuacuuugu

SEQ ID NO: 1367029 - RNA, 17 nt, Homo sapiens
cuaauuauuaagauaug

SEQ ID NO: 1367030 - RNA, 14 nt, Homo sapiens
cuacacacaaacca

SEQ ID NO: 1367031 - RNA, 17 nt, Homo sapiens
cuacacagaucacagcu

SEQ ID NO: 1367032 - RNA, 20 nt, Homo sapiens
cuacaggaagcaccccaugc

SEQ ID NO: 1367033 - RNA, 15 nt, Homo sapiens
cuacaggcauuuaac

SEQ ID NO: 1367034 - RNA, 22 nt, Homo sapiens
cuacaguaaauguuugugaugu

SEQ ID NO: 1367035 - RNA, 13 nt, Homo sapiens
cuaccaagauaua

SEQ ID NO: 1367036 - RNA, 16 nt, Homo sapiens
cuacgaaauacuaaga

SEQ ID NO: 1367037 - RNA, 14 nt, Homo sapiens
cuacuagagucuga

SEQ ID NO: 1367038 - RNA, 22 nt, Homo sapiens
cuacuagagucugaacagcugu

SEQ ID NO: 1367039 - RNA, 17 nt, Homo sapiens
cuacuggagauaccaga

SEQ ID NO: 1367040 - RNA, 11 nt, Homo sapiens
cuacuucucac

SEQ ID NO: 1367041 - RNA, 17 nt, Homo sapiens
cuacuugcucagguacu

SEQ ID NO: 1367042 - RNA, 22 nt, Homo sapiens
cuagagagggaggcaagcccug

SEQ ID NO: 1367043 - RNA, 14 nt, Homo sapiens
cuagagcacugcca

SEQ ID NO: 1367044 - RNA, 17 nt, Homo sapiens
cuagaguccucacuccc

SEQ ID NO: 1367045 - RNA, 14 nt, Homo sapiens
cuagcagaaaucua

SEQ ID NO: 1367046 - RNA, 14 nt, Homo sapiens
cuagccagcaaaga

SEQ ID NO: 1367047 - RNA, 18 nt, Homo sapiens
cuaggaaauccauucaca

SEQ ID NO: 1367048 - RNA, 17 nt, Homo sapiens
cuaggcauuugcugaau

SEQ ID NO: 1367049 - RNA, 20 nt, Homo sapiens
cuagguaggcuucuaccugc

SEQ ID NO: 1367050 - RNA, 20 nt, Homo sapiens
cuaguaaugucuaaguaaug

SEQ ID NO: 1367051 - RNA, 15 nt, Homo sapiens
cuagucucuacccag

SEQ ID NO: 1367052 - RNA, 17 nt, Homo sapiens
cuauagaauaaagccuc

SEQ ID NO: 1367053 - RNA, 14 nt, Homo sapiens
cuauaguauuugau

SEQ ID NO: 1367054 - RNA, 17 nt, Homo sapiens
cuauauuguacacaccu

SEQ ID NO: 1367055 - RNA, 20 nt, Homo sapiens
cuaucacagcggggaugcuu

SEQ ID NO: 1367056 - RNA, 23 nt, Homo sapiens
cuaucaggugccccucuuccaaa

SEQ ID NO: 1367057 - RNA, 18 nt, Homo sapiens
cuaucuucuuucacauau

SEQ ID NO: 1367058 - RNA, 13 nt, Homo sapiens
cuaugaaauauca

SEQ ID NO: 1367059 - RNA, 13 nt, Homo sapiens
cuaugaagacagg

SEQ ID NO: 1367060 - RNA, 23 nt, Homo sapiens
cuaugaguguaguugaugacugu

SEQ ID NO: 1367061 - RNA, 15 nt, Homo sapiens
cuaugauaugcuaau

SEQ ID NO: 1367062 - RNA, 16 nt, Homo sapiens
cuaugauaugcuaaua

SEQ ID NO: 1367063 - RNA, 12 nt, Homo sapiens
cuaugccuaaaa

SEQ ID NO: 1367064 - RNA, 16 nt, Homo sapiens
cuauggcacccaugca

SEQ ID NO: 1367065 - RNA, 18 nt, Homo sapiens
cuauggcucuacuuucag

SEQ ID NO: 1367066 - RNA, 20 nt, Homo sapiens
cuaugucacccaaugcauau

SEQ ID NO: 1367067 - RNA, 13 nt, Homo sapiens
cuaugugcaugca

SEQ ID NO: 1367068 - RNA, 14 nt, Homo sapiens
cuauuccaaaaagg

SEQ ID NO: 1367069 - RNA, 23 nt, Homo sapiens
ucccaugacauggagaccgugac

SEQ ID NO: 1367070 - RNA, 16 nt, Homo sapiens
ucccauuccugaagaa

SEQ ID NO: 1367071 - RNA, 16 nt, Homo sapiens
uccccagcccagagac

SEQ ID NO: 1367072 - RNA, 20 nt, Homo sapiens
uccccaguugccgucuagga

SEQ ID NO: 1367073 - RNA, 21 nt, Homo sapiens
ucccccucaauagaucuccag

SEQ ID NO: 1367074 - RNA, 14 nt, Homo sapiens
uccccggcaugaga

SEQ ID NO: 1367075 - RNA, 21 nt, Homo sapiens
ucccgauucacccuguccaaa

SEQ ID NO: 1367076 - RNA, 16 nt, Homo sapiens
ucccggcgcgcccucu

SEQ ID NO: 1367077 - RNA, 14 nt, Homo sapiens
ucccgucugucugu

SEQ ID NO: 1367078 - RNA, 13 nt, Homo sapiens
ucccuaagugcaa

SEQ ID NO: 1367079 - RNA, 16 nt, Homo sapiens
ucccuaggaaacucac

SEQ ID NO: 1367080 - RNA, 23 nt, Homo sapiens
ucccucaccuuggcaccagacac

SEQ ID NO: 1367081 - RNA, 23 nt, Homo sapiens
ucccuccagauauacuugguucu

SEQ ID NO: 1367082 - RNA, 17 nt, Homo sapiens
ucccucccccccaugca

SEQ ID NO: 1367083 - RNA, 23 nt, Homo sapiens
ucccugaaaauguuuuucugcca

SEQ ID NO: 1367084 - RNA, 23 nt, Homo sapiens
ucccugaaguaagcaaagacuuu

SEQ ID NO: 1367085 - RNA, 22 nt, Homo sapiens
ucccuuugucugucaaucacag

SEQ ID NO: 1367086 - RNA, 17 nt, Homo sapiens
uccgaugguaucugggu

SEQ ID NO: 1367087 - RNA, 23 nt, Homo sapiens
uccggcagguaagggacuaccaa

SEQ ID NO: 1367088 - RNA, 16 nt, Homo sapiens
uaucccuacauuacac

SEQ ID NO: 1367089 - RNA, 23 nt, Homo sapiens
uaugaacuaaaaagagacugugc

SEQ ID NO: 1367090 - RNA, 13 nt, Homo sapiens
uaugcaaucugag

SEQ ID NO: 1367091 - RNA, 14 nt, Homo sapiens
uaugcagaauguug

SEQ ID NO: 1367092 - RNA, 19 nt, Homo sapiens
uaugcauggugccccagga

SEQ ID NO: 1367093 - RNA, 22 nt, Homo sapiens
uaugcauuauaaauaaauacca

SEQ ID NO: 1367094 - RNA, 13 nt, Homo sapiens
uaugcauucacuc

SEQ ID NO: 1367095 - RNA, 23 nt, Homo sapiens
uauggauucagaauauacuaaau

SEQ ID NO: 1367096 - RNA, 18 nt, Homo sapiens
uauggcacccaugcaccu

SEQ ID NO: 1367097 - RNA, 20 nt, Homo sapiens
uauuaaggaagacaauguga

SEQ ID NO: 1367098 - RNA, 18 nt, Homo sapiens
uauuauccuucuacuugu

SEQ ID NO: 1367099 - RNA, 16 nt, Homo sapiens
uauucuaaaaccauuc

SEQ ID NO: 1367100 - RNA, 23 nt, Homo sapiens
uauugacacugacuagagugaug

SEQ ID NO: 1367101 - RNA, 15 nt, Homo sapiens
uauuuaacuggugca

SEQ ID NO: 1367102 - RNA, 15 nt, Homo sapiens
uauuuauacuuugca

SEQ ID NO: 1367103 - RNA, 17 nt, Homo sapiens
uauuugugcuauaguau

SEQ ID NO: 1367104 - RNA, 14 nt, Homo sapiens
uauuuuccaugaaa

SEQ ID NO: 1367105 - RNA, 22 nt, Homo sapiens
ucaaaagcacuuugugcugugu

SEQ ID NO: 1367106 - RNA, 18 nt, Homo sapiens
ucaaaauuucagcauuau

SEQ ID NO: 1367107 - RNA, 11 nt, Homo sapiens
ucaaacaaagc

SEQ ID NO: 1367108 - RNA, 20 nt, Homo sapiens
gccuggccaggagcucuuca

SEQ ID NO: 1367109 - RNA, 21 nt, Homo sapiens
gccuggggcaggucacuuuac

SEQ ID NO: 1367110 - RNA, 22 nt, Homo sapiens
gccugggguggggucaugcccu

SEQ ID NO: 1367111 - RNA, 23 nt, Homo sapiens
gccugggguggggucaugcccuc

SEQ ID NO: 1367112 - RNA, 21 nt, Homo sapiens
gccugggguguuaguggcacc

SEQ ID NO: 1367113 - RNA, 12 nt, Homo sapiens
gccuguacccag

SEQ ID NO: 1367114 - RNA, 14 nt, Homo sapiens
gccugugaugcugg

SEQ ID NO: 1367115 - RNA, 16 nt, Homo sapiens
gccuguugacugcugg

SEQ ID NO: 1367116 - RNA, 14 nt, Homo sapiens
gccuugaauuggga

SEQ ID NO: 1367117 - RNA, 21 nt, Homo sapiens
gccuuggugggggagccucug

SEQ ID NO: 1367118 - RNA, 19 nt, Homo sapiens
gccuuuugugcaaagccaa

SEQ ID NO: 1367119 - RNA, 17 nt, Homo sapiens
gcgacacccguccaugg

SEQ ID NO: 1367120 - RNA, 22 nt, Homo sapiens
gcgcagcgcgugcggugcaaag

SEQ ID NO: 1367121 - RNA, 14 nt, Homo sapiens
gcggaaagcccugu

SEQ ID NO: 1367122 - RNA, 19 nt, Homo sapiens
gcggcccugagcuccaugg

SEQ ID NO: 1367123 - RNA, 13 nt, Homo sapiens
gcggcuggcagcc

SEQ ID NO: 1367124 - RNA, 22 nt, Homo sapiens
gcgugaaggccgagaagcaaga

SEQ ID NO: 1367125 - RNA, 20 nt, Homo sapiens
gcgugagaccgcagucugcu

SEQ ID NO: 1367126 - RNA, 16 nt, Homo sapiens
gcgugugccugugugc

SEQ ID NO: 1367127 - RNA, 12 nt, Homo sapiens
gcuacucuugga

SEQ ID NO: 1367128 - RNA, 20 nt, Homo sapiens
gcuacugccgucagugcugu

SEQ ID NO: 1367129 - RNA, 23 nt, Homo sapiens
gcuacugccgucagugcugugcu

SEQ ID NO: 1367130 - RNA, 19 nt, Homo sapiens
gcuaggaugguucugugac

SEQ ID NO: 1367131 - RNA, 20 nt, Homo sapiens
gcuagugacuugugucccau

SEQ ID NO: 1367132 - RNA, 12 nt, Homo sapiens
gcuaguguuucc

SEQ ID NO: 1367133 - RNA, 17 nt, Homo sapiens
gcuauaacuauguugau

SEQ ID NO: 1367134 - RNA, 14 nt, Homo sapiens
gcuauagcuacagg

SEQ ID NO: 1367135 - RNA, 17 nt, Homo sapiens
gcucacaggagcuuaaa

SEQ ID NO: 1367136 - RNA, 21 nt, Homo sapiens
gcucaccuuuaucaccucauu

SEQ ID NO: 1367137 - RNA, 18 nt, Homo sapiens
gcucauauuguucccuau

SEQ ID NO: 1367138 - RNA, 19 nt, Homo sapiens
gcuccaucccaaccaggca

SEQ ID NO: 1367139 - RNA, 20 nt, Homo sapiens
gcuccauggcugccaucuca

SEQ ID NO: 1367140 - RNA, 17 nt, Homo sapiens
gcuccuugcugcauuga

SEQ ID NO: 1367141 - RNA, 17 nt, Homo sapiens
gcucuccugacuuuuaa

SEQ ID NO: 1367142 - RNA, 17 nt, Homo sapiens
gcucugaccgaaacagc

SEQ ID NO: 1367143 - RNA, 17 nt, Homo sapiens
gcucuguauggucagga

SEQ ID NO: 1367144 - RNA, 16 nt, Homo sapiens
gcucuuagcagcuucc

SEQ ID NO: 1367145 - RNA, 15 nt, Homo sapiens
gcucuuuguagcuaa

SEQ ID NO: 1367146 - RNA, 20 nt, Homo sapiens
gcugaaaacugcaacuugua

SEQ ID NO: 1367147 - RNA, 22 nt, Homo sapiens
gcugaaauaaaaugauaaacaa

SEQ ID NO: 1367148 - RNA, 18 nt, Homo sapiens
gcugaaugccuguuagca

SEQ ID NO: 1367149 - RNA, 16 nt, Homo sapiens
gcugagagaaccucac

SEQ ID NO: 1367150 - RNA, 17 nt, Homo sapiens
gcugagcacagggcugu

SEQ ID NO: 1367151 - RNA, 23 nt, Homo sapiens
gcugagggugagugggugaauaa

SEQ ID NO: 1367152 - RNA, 14 nt, Homo sapiens
gcugagugaaggaa

SEQ ID NO: 1367153 - RNA, 20 nt, Homo sapiens
gcugauggggguuugcucag

SEQ ID NO: 1367154 - RNA, 17 nt, Homo sapiens
gcugcacugaugcugcc

SEQ ID NO: 1367155 - RNA, 14 nt, Homo sapiens
gcugcccaccugcc

SEQ ID NO: 1367156 - RNA, 16 nt, Homo sapiens
gcugcgucugcacuga

SEQ ID NO: 1367157 - RNA, 16 nt, Homo sapiens
gcugcuccugagagag

SEQ ID NO: 1367158 - RNA, 15 nt, Homo sapiens
gcugcuggugcacag

SEQ ID NO: 1367159 - RNA, 23 nt, Homo sapiens
gcugcuuuaacaguggagcugaa

SEQ ID NO: 1367160 - RNA, 18 nt, Homo sapiens
gcuggagagcacugccag

SEQ ID NO: 1367161 - RNA, 18 nt, Homo sapiens
gcuggccuccuaugccuc

SEQ ID NO: 1367162 - RNA, 22 nt, Homo sapiens
gcugggaagcccggacugacca

SEQ ID NO: 1367163 - RNA, 22 nt, Homo sapiens
acuaugcauggugccccaggac

SEQ ID NO: 1367164 - RNA, 18 nt, Homo sapiens
acuauggcucuacuuuca

SEQ ID NO: 1367165 - RNA, 17 nt, Homo sapiens
acuauuggguaugaacu

SEQ ID NO: 1367166 - RNA, 19 nt, Homo sapiens
acucaaauggggccagauc

SEQ ID NO: 1367167 - RNA, 17 nt, Homo sapiens
acucaaguaccaccaag

SEQ ID NO: 1367168 - RNA, 13 nt, Homo sapiens
acucaaucucuga

SEQ ID NO: 1367169 - RNA, 21 nt, Homo sapiens
acucaaucucugauucuguca

SEQ ID NO: 1367170 - RNA, 20 nt, Homo sapiens
acucacuaaaaguucucaaa

SEQ ID NO: 1367171 - RNA, 17 nt, Homo sapiens
acucacuucucuuuuua

SEQ ID NO: 1367172 - RNA, 22 nt, Homo sapiens
acucagauggaaccgcaggaag

SEQ ID NO: 1367173 - RNA, 12 nt, Homo sapiens
acucagcauuug

SEQ ID NO: 1367174 - RNA, 21 nt, Homo sapiens
acucagucccuaaaaacacag

SEQ ID NO: 1367175 - RNA, 11 nt, Homo sapiens
acucagugcag

SEQ ID NO: 1367176 - RNA, 14 nt, Homo sapiens
acucagugcagaug

SEQ ID NO: 1367177 - RNA, 18 nt, Homo sapiens
acucaguggagccaggcu

SEQ ID NO: 1367178 - RNA, 22 nt, Homo sapiens
acucauccgccuggcccgggaa

SEQ ID NO: 1367179 - RNA, 18 nt, Homo sapiens
acucaugguguguuacac

SEQ ID NO: 1367180 - RNA, 20 nt, Homo sapiens
acuccagccugggugacaaa

SEQ ID NO: 1367181 - RNA, 14 nt, Homo sapiens
acuccuaaaucaag

SEQ ID NO: 1367182 - RNA, 21 nt, Homo sapiens
acuccucauccccacaaucug

SEQ ID NO: 1367183 - RNA, 18 nt, Homo sapiens
acucggucugagaagauu

SEQ ID NO: 1367184 - RNA, 15 nt, Homo sapiens
acucugaauccucag

SEQ ID NO: 1367185 - RNA, 18 nt, Homo sapiens
acucuucaggcaccugaa

SEQ ID NO: 1367186 - RNA, 20 nt, Homo sapiens
acugaauuuugggacuucua

SEQ ID NO: 1367187 - RNA, 12 nt, Homo sapiens
acugaugcugcc

SEQ ID NO: 1367188 - RNA, 10 nt, Homo sapiens
acugcaauaa

SEQ ID NO: 1367189 - RNA, 16 nt, Homo sapiens
acugcacacucagugg

SEQ ID NO: 1367190 - RNA, 12 nt, Homo sapiens
acugcagugaug

SEQ ID NO: 1367191 - RNA, 17 nt, Homo sapiens
acugcuggggagacaaa

SEQ ID NO: 1367192 - RNA, 14 nt, Homo sapiens
acuggcagcauuga

SEQ ID NO: 1367193 - RNA, 21 nt, Homo sapiens
acuggcccggaggacccagcu

SEQ ID NO: 1367194 - RNA, 21 nt, Homo sapiens
acugguuuuaccuccaggaaa

SEQ ID NO: 1367195 - RNA, 16 nt, Homo sapiens
acugucccuugccuca

SEQ ID NO: 1367196 - RNA, 22 nt, Homo sapiens
acugucuugaagacaauggcuu

SEQ ID NO: 1367197 - RNA, 18 nt, Homo sapiens
acuguggcuagugacaaa

SEQ ID NO: 1367198 - RNA, 13 nt, Homo sapiens
acuuaaaaacuug

SEQ ID NO: 1367199 - RNA, 13 nt, Homo sapiens
acuuaacacuucu

SEQ ID NO: 1367200 - RNA, 16 nt, Homo sapiens
acuuagguguggggga

SEQ ID NO: 1367201 - RNA, 12 nt, Homo sapiens
acuuagugacaa

SEQ ID NO: 1367202 - RNA, 22 nt, Homo sapiens
acuuauaauuaugcuaccuacu

SEQ ID NO: 1367203 - RNA, 22 nt, Homo sapiens
acuuaucccaagagaaugaaau

SEQ ID NO: 1367204 - RNA, 13 nt, Homo sapiens
acuucaagcucuc

SEQ ID NO: 1367205 - RNA, 14 nt, Homo sapiens
acuucagaccaucu

SEQ ID NO: 1367206 - RNA, 15 nt, Homo sapiens
acuucagucuugccu

SEQ ID NO: 1367207 - RNA, 17 nt, Homo sapiens
acuucauacaauguaag

SEQ ID NO: 1367208 - RNA, 20 nt, Homo sapiens
acuucugggucuccagggag

SEQ ID NO: 1367209 - RNA, 18 nt, Homo sapiens
acuugaagggccagagcc

SEQ ID NO: 1367210 - RNA, 17 nt, Homo sapiens
acuugacagaacacugu

SEQ ID NO: 1367211 - RNA, 18 nt, Homo sapiens
acuugcagaguacaugau

SEQ ID NO: 1367212 - RNA, 20 nt, Homo sapiens
acuugggccacugugaagag

SEQ ID NO: 1367213 - RNA, 21 nt, Homo sapiens
acuugucaagccugugcaaaa

SEQ ID NO: 1367214 - RNA, 16 nt, Homo sapiens
acuuguccaguucaaa

SEQ ID NO: 1367215 - RNA, 17 nt, Homo sapiens
acuuguuuuugcacaug

SEQ ID NO: 1367216 - RNA, 17 nt, Homo sapiens
acuuuaccucuguggac

SEQ ID NO: 1367217 - RNA, 18 nt, Homo sapiens
acuuuaugugcaucuuau

SEQ ID NO: 1367218 - RNA, 11 nt, Homo sapiens
acuuuccugca

SEQ ID NO: 1367219 - RNA, 18 nt, Homo sapiens
acuuugggaggccaagga

SEQ ID NO: 1367220 - RNA, 11 nt, Homo sapiens
agaaaaaccac

SEQ ID NO: 1367221 - RNA, 20 nt, Homo sapiens
agaaaacaggcucacagaga

SEQ ID NO: 1367222 - RNA, 21 nt, Homo sapiens
agaaacaacuucuacuucugc

SEQ ID NO: 1367223 - RNA, 14 nt, Homo sapiens
agaaagcucaucuc

SEQ ID NO: 1367224 - RNA, 13 nt, Homo sapiens
agaaaguuaugaa

SEQ ID NO: 1367225 - RNA, 13 nt, Homo sapiens
agaaaucuagaag

SEQ ID NO: 1367226 - RNA, 19 nt, Homo sapiens
agaaaucuagaagacuguc

SEQ ID NO: 1367227 - RNA, 13 nt, Homo sapiens
agaaaugucaugu

SEQ ID NO: 1367228 - RNA, 15 nt, Homo sapiens
agaaaugucaugugg

SEQ ID NO: 1367229 - RNA, 16 nt, Homo sapiens
agaacacaaggucauu

SEQ ID NO: 1367230 - RNA, 13 nt, Homo sapiens
agaaccagugcuu

SEQ ID NO: 1367231 - RNA, 15 nt, Homo sapiens
agaacccuugcacua

SEQ ID NO: 1367232 - RNA, 13 nt, Homo sapiens
agaaccuuguccc

SEQ ID NO: 1367233 - RNA, 19 nt, Homo sapiens
agaacucaaauggggccag

SEQ ID NO: 1367234 - RNA, 22 nt, Homo sapiens
agaacuccccuugaaaacugcu

SEQ ID NO: 1367235 - RNA, 20 nt, Homo sapiens
agaacuuagggaggaccauu

SEQ ID NO: 1367236 - RNA, 16 nt, Homo sapiens
agaacuucaagcucuc

SEQ ID NO: 1367237 - RNA, 14 nt, Homo sapiens
agaagaagaaggag

SEQ ID NO: 1367238 - RNA, 23 nt, Homo sapiens
agaagacugucagcuuccaaaca

SEQ ID NO: 1367239 - RNA, 20 nt, Homo sapiens
agaagcugagcaccagggga

SEQ ID NO: 1367240 - RNA, 18 nt, Homo sapiens
agaaggagggagacauga

SEQ ID NO: 1367241 - RNA, 16 nt, Homo sapiens
agaagucaguugcaaa

SEQ ID NO: 1367242 - RNA, 13 nt, Homo sapiens
agaaguuugcacu

SEQ ID NO: 1367243 - RNA, 20 nt, Homo sapiens
agaauauacuaaauuaacuu

SEQ ID NO: 1367244 - RNA, 19 nt, Homo sapiens
agaauauuuucaacauaaa

SEQ ID NO: 1367245 - RNA, 16 nt, Homo sapiens
agaaucggcuuugcag

SEQ ID NO: 1367246 - RNA, 23 nt, Homo sapiens
agaauguucuuauguugcccagu

SEQ ID NO: 1367247 - RNA, 10 nt, Homo sapiens
agaauuugca

SEQ ID NO: 1367248 - RNA, 22 nt, Homo sapiens
agaauuuuuacuuagauacuaa

SEQ ID NO: 1367249 - RNA, 19 nt, Homo sapiens
agacaauagcccaaagcca

SEQ ID NO: 1367250 - RNA, 13 nt, Homo sapiens
agacacaagguga

SEQ ID NO: 1367251 - RNA, 11 nt, Homo sapiens
agacacuugcu

SEQ ID NO: 1367252 - RNA, 15 nt, Homo sapiens
agacaugugcacuug

SEQ ID NO: 1367253 - RNA, 18 nt, Homo sapiens
agacauuggcaccuaauc

SEQ ID NO: 1367254 - RNA, 21 nt, Homo sapiens
agacauuggcaccuaauccag

SEQ ID NO: 1367255 - RNA, 23 nt, Homo sapiens
agacauuucucuaacuccugcca

SEQ ID NO: 1367256 - RNA, 21 nt, Homo sapiens
agaccgugaccagugcugcug

SEQ ID NO: 1367257 - RNA, 23 nt, Homo sapiens
agaccucgacgacccuuucauca

SEQ ID NO: 1367258 - RNA, 16 nt, Homo sapiens
agacgguuuccaggga

SEQ ID NO: 1367259 - RNA, 13 nt, Homo sapiens
agacucagugcag

SEQ ID NO: 1367260 - RNA, 19 nt, Homo sapiens
agacuggggcauccugugc

SEQ ID NO: 1367261 - RNA, 21 nt, Homo sapiens
agacugguugaguucagguag

SEQ ID NO: 1367262 - RNA, 20 nt, Homo sapiens
agacuguggcuagugacaaa

SEQ ID NO: 1367263 - RNA, 16 nt, Homo sapiens
agacuuuaucaugugu

SEQ ID NO: 1367264 - RNA, 20 nt, Homo sapiens
agacuuugacucuccagaaa

SEQ ID NO: 1367265 - RNA, 19 nt, Homo sapiens
agagacgguguuuugccau

SEQ ID NO: 1367266 - RNA, 19 nt, Homo sapiens
agagacuuugacucuccag

SEQ ID NO: 1367267 - RNA, 17 nt, Homo sapiens
agagcagucacaacaga

SEQ ID NO: 1367268 - RNA, 13 nt, Homo sapiens
agagcccagcucc

SEQ ID NO: 1367269 - RNA, 18 nt, Homo sapiens
agagcugccaucgcugug

SEQ ID NO: 1367270 - RNA, 17 nt, Homo sapiens
agagggggucucagaaa

SEQ ID NO: 1367271 - RNA, 16 nt, Homo sapiens
agagggugacugugug

SEQ ID NO: 1367272 - RNA, 10 nt, Homo sapiens
agagugccac

SEQ ID NO: 1367273 - RNA, 13 nt, Homo sapiens
agaguuuccugaa

SEQ ID NO: 1367274 - RNA, 17 nt, Homo sapiens
agauaauucuagcuuug

SEQ ID NO: 1367275 - RNA, 20 nt, Homo sapiens
agauaauugaauaaguaccu

SEQ ID NO: 1367276 - RNA, 22 nt, Homo sapiens
agauaauuguuucauucauccu

SEQ ID NO: 1367277 - RNA, 14 nt, Homo sapiens
agauacauacagaa

SEQ ID NO: 1367278 - RNA, 16 nt, Homo sapiens
agaucuugaauagucu

SEQ ID NO: 1367279 - RNA, 20 nt, Homo sapiens
agaugagaaaacaggcucac

SEQ ID NO: 1367280 - RNA, 14 nt, Homo sapiens
caaaaggcugagaa

SEQ ID NO: 1367281 - RNA, 10 nt, Homo sapiens
caaaagggga

SEQ ID NO: 1367282 - RNA, 23 nt, Homo sapiens
caaaauaauggugauacauucua

SEQ ID NO: 1367283 - RNA, 14 nt, Homo sapiens
caaacaaaauggac

SEQ ID NO: 1367284 - RNA, 19 nt, Homo sapiens
caaacagccucacuccuca

SEQ ID NO: 1367285 - RNA, 15 nt, Homo sapiens
caaaccagacaccug

SEQ ID NO: 1367286 - RNA, 14 nt, Homo sapiens
caaacuaccuucca

SEQ ID NO: 1367287 - RNA, 13 nt, Homo sapiens
caaacucuucagu

SEQ ID NO: 1367288 - RNA, 20 nt, Homo sapiens
caaacugaauggcaaugaaa

SEQ ID NO: 1367289 - RNA, 14 nt, Homo sapiens
caaacuucaagggu

SEQ ID NO: 1367290 - RNA, 16 nt, Homo sapiens
caaagacaaaggugag

SEQ ID NO: 1367291 - RNA, 22 nt, Homo sapiens
caaagaucuguccucagccuug

SEQ ID NO: 1367292 - RNA, 13 nt, Homo sapiens
caaagccaaaacc

SEQ ID NO: 1367293 - RNA, 22 nt, Homo sapiens
caaagcccucccuaccuaccaa

SEQ ID NO: 1367294 - RNA, 20 nt, Homo sapiens
caaaggucaagaacacagug

SEQ ID NO: 1367295 - RNA, 17 nt, Homo sapiens
caaaguacuugucauag

SEQ ID NO: 1367296 - RNA, 16 nt, Homo sapiens
caaagugacuauucag

SEQ ID NO: 1367297 - RNA, 17 nt, Homo sapiens
caaagugcugcgauuac

SEQ ID NO: 1367298 - RNA, 16 nt, Homo sapiens
caaaucaaaagacuuu

SEQ ID NO: 1367299 - RNA, 14 nt, Homo sapiens
caaaugacugucag

SEQ ID NO: 1367300 - RNA, 17 nt, Homo sapiens
caaauucuuuugaauug

SEQ ID NO: 1367301 - RNA, 16 nt, Homo sapiens
caaauuuuucaaauca

SEQ ID NO: 1367302 - RNA, 19 nt, Homo sapiens
caacaaaccauccagugac

SEQ ID NO: 1367303 - RNA, 12 nt, Homo sapiens
caacaacaugua

SEQ ID NO: 1367304 - RNA, 12 nt, Homo sapiens
caacaguuuucc

SEQ ID NO: 1367305 - RNA, 17 nt, Homo sapiens
caaccaauggaauguga

SEQ ID NO: 1367306 - RNA, 13 nt, Homo sapiens
caacccuuucauu

SEQ ID NO: 1367307 - RNA, 16 nt, Homo sapiens
caacguggcccagaga

SEQ ID NO: 1367308 - RNA, 21 nt, Homo sapiens
caacuuaaaagucaguaucau

SEQ ID NO: 1367309 - RNA, 15 nt, Homo sapiens
caacuuaaugcucug

SEQ ID NO: 1367310 - RNA, 17 nt, Homo sapiens
caacuuauuaacaauua

SEQ ID NO: 1367311 - RNA, 20 nt, Homo sapiens
caacuuccccucuaacugga

SEQ ID NO: 1367312 - RNA, 22 nt, Homo sapiens
caagaaagcucacuguagcuuu

SEQ ID NO: 1367313 - RNA, 17 nt, Homo sapiens
caagaaggaaagauuug

SEQ ID NO: 1367314 - RNA, 17 nt, Homo sapiens
caagacugagccagcuu

SEQ ID NO: 1367315 - RNA, 16 nt, Homo sapiens
caagaggcuguuccca

SEQ ID NO: 1367316 - RNA, 18 nt, Homo sapiens
caagcagccaagcuccuu

SEQ ID NO: 1367317 - RNA, 22 nt, Homo sapiens
caagcaguaauuaauaucuccu

SEQ ID NO: 1367318 - RNA, 20 nt, Homo sapiens
caagcauggaaaaucaguga

SEQ ID NO: 1367319 - RNA, 15 nt, Homo sapiens
caagcccacagauga

SEQ ID NO: 1367320 - RNA, 18 nt, Homo sapiens
caagcccacagaugagaa

SEQ ID NO: 1367321 - RNA, 17 nt, Homo sapiens
caagcugguauuuucau

SEQ ID NO: 1367322 - RNA, 14 nt, Homo sapiens
caaggaugucugcc

SEQ ID NO: 1367323 - RNA, 18 nt, Homo sapiens
caaggauuuuguaagaag

SEQ ID NO: 1367324 - RNA, 15 nt, Homo sapiens
caaggcugcagugag

SEQ ID NO: 1367325 - RNA, 15 nt, Homo sapiens
caagggaucugccau

SEQ ID NO: 1367326 - RNA, 17 nt, Homo sapiens
caagggaucugguccua

SEQ ID NO: 1367327 - RNA, 21 nt, Homo sapiens
caagggccagcuggaggugaa

SEQ ID NO: 1367328 - RNA, 16 nt, Homo sapiens
caaggguuuguugaac

SEQ ID NO: 1367329 - RNA, 15 nt, Homo sapiens
caaggucauuugcua

SEQ ID NO: 1367330 - RNA, 18 nt, Homo sapiens
caagucaagugaaaaagg

SEQ ID NO: 1367331 - RNA, 14 nt, Homo sapiens
caagucagcuccag

SEQ ID NO: 1367332 - RNA, 24 nt, Homo sapiens
caagugcugggucugucacagaga

SEQ ID NO: 1367333 - RNA, 14 nt, Homo sapiens
caagugugucuuac

SEQ ID NO: 1367334 - RNA, 17 nt, Homo sapiens
caaguguuaaaacugaa

SEQ ID NO: 1367335 - RNA, 16 nt, Homo sapiens
caaguguucacaaccu

SEQ ID NO: 1367336 - RNA, 16 nt, Homo sapiens
caauaaaaacauugcc

SEQ ID NO: 1367337 - RNA, 13 nt, Homo sapiens
caauaauauuuca

SEQ ID NO: 1367338 - RNA, 15 nt, Homo sapiens
caauaguuguugauu

SEQ ID NO: 1367339 - RNA, 18 nt, Homo sapiens
caaucuggcuuagugcca

SEQ ID NO: 1367340 - RNA, 14 nt, Homo sapiens
caaucugugucaug

SEQ ID NO: 1367341 - RNA, 11 nt, Homo sapiens
caaugccagua

SEQ ID NO: 1367342 - RNA, 17 nt, Homo sapiens
caaugguuaacaucuuc

SEQ ID NO: 1367343 - RNA, 23 nt, Homo sapiens
caauguaagagccuaacuccauc

SEQ ID NO: 1367344 - RNA, 17 nt, Homo sapiens
caauucagauccagugu

SEQ ID NO: 1367345 - RNA, 20 nt, Homo sapiens
caauucuaacuuuuuugcua

SEQ ID NO: 1367346 - RNA, 12 nt, Homo sapiens
caauugcagugg

SEQ ID NO: 1367347 - RNA, 19 nt, Homo sapiens
caauugcuaccgagaaggu

SEQ ID NO: 1367348 - RNA, 16 nt, Homo sapiens
cacaaaaucuguccaa

SEQ ID NO: 1367349 - RNA, 18 nt, Homo sapiens
cacaaaggcaugcuggag

SEQ ID NO: 1367350 - RNA, 20 nt, Homo sapiens
cacaaauaaaggaaacccag

SEQ ID NO: 1367351 - RNA, 16 nt, Homo sapiens
cacaagccugagaacu

SEQ ID NO: 1367352 - RNA, 19 nt, Homo sapiens
cacaaggucuuuaaaguga

SEQ ID NO: 1367353 - RNA, 22 nt, Homo sapiens
cacaaucugagcacgcuaccaa

SEQ ID NO: 1367354 - RNA, 17 nt, Homo sapiens
cacacaaaagggaaccc

SEQ ID NO: 1367355 - RNA, 13 nt, Homo sapiens
cacacaaaccagu

SEQ ID NO: 1367356 - RNA, 22 nt, Homo sapiens
cacacaaaggcaugcuggagua

SEQ ID NO: 1367357 - RNA, 12 nt, Homo sapiens
cacacacacaaa

SEQ ID NO: 1367358 - RNA, 23 nt, Homo sapiens
cacacagugucuguguacaugua

SEQ ID NO: 1367359 - RNA, 19 nt, Homo sapiens
cacaccccaacacuuccag

SEQ ID NO: 1367360 - RNA, 12 nt, Homo sapiens
cacacucaguga

SEQ ID NO: 1367361 - RNA, 13 nt, Homo sapiens
cacacucagugac

SEQ ID NO: 1367362 - RNA, 18 nt, Homo sapiens
cacacugaggcagggaag

SEQ ID NO: 1367363 - RNA, 12 nt, Homo sapiens
cacagaauguga

SEQ ID NO: 1367364 - RNA, 15 nt, Homo sapiens
cacagaucacagcuu

SEQ ID NO: 1367365 - RNA, 16 nt, Homo sapiens
cacagaugugugauuc

SEQ ID NO: 1367366 - RNA, 17 nt, Homo sapiens
cacagcggagucugucc

SEQ ID NO: 1367367 - RNA, 22 nt, Homo sapiens
cacagcuacacagaucacagcu

SEQ ID NO: 1367368 - RNA, 15 nt, Homo sapiens
cacagggucugcucu

SEQ ID NO: 1367369 - RNA, 13 nt, Homo sapiens
caccaccacuuac

SEQ ID NO: 1367370 - RNA, 16 nt, Homo sapiens
caccaccgacugaagu

SEQ ID NO: 1367371 - RNA, 19 nt, Homo sapiens
caccacggcguuguaccug

SEQ ID NO: 1367372 - RNA, 15 nt, Homo sapiens
caccagacacccagg

SEQ ID NO: 1367373 - RNA, 13 nt, Homo sapiens
caccagcagccug

SEQ ID NO: 1367374 - RNA, 21 nt, Homo sapiens
caccaggauagagacuggaac

SEQ ID NO: 1367375 - RNA, 18 nt, Homo sapiens
caccaucaccagacaggu

SEQ ID NO: 1367376 - RNA, 18 nt, Homo sapiens
caccauuuuccugccuca

SEQ ID NO: 1367377 - RNA, 21 nt, Homo sapiens
cacccaaguugaagacuuugu

SEQ ID NO: 1367378 - RNA, 13 nt, Homo sapiens
cacccaugcaagc

SEQ ID NO: 1367379 - RNA, 14 nt, Homo sapiens
caccccaacacuuc

SEQ ID NO: 1367380 - RNA, 13 nt, Homo sapiens
cacccgugagaaa

SEQ ID NO: 1367381 - RNA, 20 nt, Homo sapiens
cacccucauucuacugaaaa

SEQ ID NO: 1367382 - RNA, 21 nt, Homo sapiens
cacccuguccaaacugccuaa

SEQ ID NO: 1367383 - RNA, 23 nt, Homo sapiens
cacccugucuucuuaauucucca

SEQ ID NO: 1367384 - RNA, 22 nt, Homo sapiens
caccuaagaucucgguuugcca

SEQ ID NO: 1367385 - RNA, 23 nt, Homo sapiens
caccuaguaagugccugcuguau

SEQ ID NO: 1367386 - RNA, 14 nt, Homo sapiens
caccucauucugaa

SEQ ID NO: 1367387 - RNA, 21 nt, Homo sapiens
caccuccccagccuuugauca

SEQ ID NO: 1367388 - RNA, 17 nt, Homo sapiens
caccucuuccuugaugu

SEQ ID NO: 1367389 - RNA, 13 nt, Homo sapiens
caccucuuuguca

SEQ ID NO: 1367390 - RNA, 14 nt, Homo sapiens
caccucuuugucac

SEQ ID NO: 1367391 - RNA, 14 nt, Homo sapiens
caccugaagugaga

SEQ ID NO: 1367392 - RNA, 19 nt, Homo sapiens
caccugggacccugcacag

SEQ ID NO: 1367393 - RNA, 14 nt, Homo sapiens
caccuguaauccca

SEQ ID NO: 1367394 - RNA, 23 nt, Homo sapiens
caccugugauggcagggcuguga

SEQ ID NO: 1367395 - RNA, 13 nt, Homo sapiens
caccuugugccug

SEQ ID NO: 1367396 - RNA, 16 nt, Homo sapiens
cacgaccauuugauag

SEQ ID NO: 1367397 - RNA, 18 nt, Homo sapiens
ggauuccucgaaacugcc

SEQ ID NO: 1367398 - RNA, 19 nt, Homo sapiens
ggauuccucgaaacugcca

SEQ ID NO: 1367399 - RNA, 15 nt, Homo sapiens
ggauuuucacauucu

SEQ ID NO: 1367400 - RNA, 19 nt, Homo sapiens
ggcaaaguguaguguuaua

SEQ ID NO: 1367401 - RNA, 19 nt, Homo sapiens
ggcaccaugugugccuuug

SEQ ID NO: 1367402 - RNA, 12 nt, Homo sapiens
ggcagauccagg

SEQ ID NO: 1367403 - RNA, 15 nt, Homo sapiens
ggcagcaaugguguu

SEQ ID NO: 1367404 - RNA, 20 nt, Homo sapiens
ggcagcuggugcugugugac

SEQ ID NO: 1367405 - RNA, 16 nt, Homo sapiens
ggcaggcucccaggga

SEQ ID NO: 1367406 - RNA, 19 nt, Homo sapiens
ggcagguaagggacuacca

SEQ ID NO: 1367407 - RNA, 14 nt, Homo sapiens
ggcaucggggccau

SEQ ID NO: 1367408 - RNA, 18 nt, Homo sapiens
ggcaugaaaagugguccu

SEQ ID NO: 1367409 - RNA, 14 nt, Homo sapiens
ggcaugguggccca

SEQ ID NO: 1367410 - RNA, 15 nt, Homo sapiens
ggcauuucacaaaac

SEQ ID NO: 1367411 - RNA, 20 nt, Homo sapiens
ggccaaggagggcagaucac

SEQ ID NO: 1367412 - RNA, 16 nt, Homo sapiens
ggccagagccaagggg

SEQ ID NO: 1367413 - RNA, 13 nt, Homo sapiens
ggccagccaguga

SEQ ID NO: 1367414 - RNA, 20 nt, Homo sapiens
ggccaggcuggucuugaacu

SEQ ID NO: 1367415 - RNA, 23 nt, Homo sapiens
ggccaugauggcaacagaucugg

SEQ ID NO: 1367416 - RNA, 23 nt, Homo sapiens
ggcccuacccuccugcugagcug

SEQ ID NO: 1367417 - RNA, 18 nt, Homo sapiens
ggcccuccucucccaucc

SEQ ID NO: 1367418 - RNA, 16 nt, Homo sapiens
ggccgaggccaugugc

SEQ ID NO: 1367419 - RNA, 16 nt, Homo sapiens
ggccggcccugugugc

SEQ ID NO: 1367420 - RNA, 23 nt, Homo sapiens
ggccugcgacccugggggcacag

SEQ ID NO: 1367421 - RNA, 18 nt, Homo sapiens
ggccugcuccagaccuga

SEQ ID NO: 1367422 - RNA, 17 nt, Homo sapiens
ggccuggucguuuucaa

SEQ ID NO: 1367423 - RNA, 19 nt, Homo sapiens
ggccuguacccaguagaug

SEQ ID NO: 1367424 - RNA, 16 nt, Homo sapiens
ggccuuccagugcagg

SEQ ID NO: 1367425 - RNA, 14 nt, Homo sapiens
ggcgugugcagugc

SEQ ID NO: 1367426 - RNA, 16 nt, Homo sapiens
ggcuaagaguguccua

SEQ ID NO: 1367427 - RNA, 21 nt, Homo sapiens
ggcucccagggacaccuggga

SEQ ID NO: 1367428 - RNA, 14 nt, Homo sapiens
ggcucccaugacca

SEQ ID NO: 1367429 - RNA, 19 nt, Homo sapiens
ggcucuuagcagcuuccag

SEQ ID NO: 1367430 - RNA, 17 nt, Homo sapiens
ggcugacuaagccccgu

SEQ ID NO: 1367431 - RNA, 11 nt, Homo sapiens
ggcugcucccc

SEQ ID NO: 1367432 - RNA, 15 nt, Homo sapiens
ggcugcugaccucca

SEQ ID NO: 1367433 - RNA, 16 nt, Homo sapiens
ggcuggagcccaggga

SEQ ID NO: 1367434 - RNA, 11 nt, Homo sapiens
ggcugggagac

SEQ ID NO: 1367435 - RNA, 20 nt, Homo sapiens
ggcugguggcccaggaccau

SEQ ID NO: 1367436 - RNA, 21 nt, Homo sapiens
ggcuguguugguguggcccau

SEQ ID NO: 1367437 - RNA, 20 nt, Homo sapiens
ggcuguugacgcaccugugg

SEQ ID NO: 1367438 - RNA, 22 nt, Homo sapiens
ggcuguuggugggacccguggc

SEQ ID NO: 1367439 - RNA, 14 nt, Homo sapiens
ggcuuccaugccug

SEQ ID NO: 1367440 - RNA, 15 nt, Homo sapiens
ggcuucucccugggg

SEQ ID NO: 1367441 - RNA, 14 nt, Homo sapiens
ggcuugcagugcgc

SEQ ID NO: 1367442 - RNA, 18 nt, Homo sapiens
ggcuuucccggaggccag

SEQ ID NO: 1367443 - RNA, 14 nt, Homo sapiens
ggcuuugcaaaaua

SEQ ID NO: 1367444 - RNA, 14 nt, Homo sapiens
gggaaaagggucca

SEQ ID NO: 1367445 - RNA, 17 nt, Homo sapiens
gggaacucagauccagg

SEQ ID NO: 1367446 - RNA, 14 nt, Homo sapiens
gggaaucuaagaga

SEQ ID NO: 1367447 - RNA, 24 nt, Homo sapiens
gggagccuucugugcugugagucc

SEQ ID NO: 1367448 - RNA, 20 nt, Homo sapiens
gggaggucaaggcugcagug

SEQ ID NO: 1367449 - RNA, 18 nt, Homo sapiens
gggauacggggucuugcu

SEQ ID NO: 1367450 - RNA, 16 nt, Homo sapiens
gggccugcuccagacc

SEQ ID NO: 1367451 - RNA, 16 nt, Homo sapiens
gggcgaguucugccag

SEQ ID NO: 1367452 - RNA, 16 nt, Homo sapiens
gggcuagugacuugug

SEQ ID NO: 1367453 - RNA, 19 nt, Homo sapiens
gggcuucuagaaccaggca

SEQ ID NO: 1367454 - RNA, 16 nt, Homo sapiens
gggcuuuuacaccagu

SEQ ID NO: 1367455 - RNA, 19 nt, Homo sapiens
ggggaaacgagcuguguag

SEQ ID NO: 1367456 - RNA, 22 nt, Homo sapiens
ggggacugcuaccucugagaag

SEQ ID NO: 1367457 - RNA, 18 nt, Homo sapiens
gggggagaagaagccgag

SEQ ID NO: 1367458 - RNA, 14 nt, Homo sapiens
gggucacacaaagg

SEQ ID NO: 1367459 - RNA, 12 nt, Homo sapiens
gggucuucaggg

SEQ ID NO: 1367460 - RNA, 12 nt, Homo sapiens
gggucuuugugg

SEQ ID NO: 1367461 - RNA, 22 nt, Homo sapiens
gggugcucccuaccaccucccc

SEQ ID NO: 1367462 - RNA, 20 nt, Homo sapiens
gggugcugugaggcuugccc

SEQ ID NO: 1367463 - RNA, 18 nt, Homo sapiens
ggguggcuuugcauuucu

SEQ ID NO: 1367464 - RNA, 20 nt, Homo sapiens
ggguucaccaggucagggag

SEQ ID NO: 1367465 - RNA, 14 nt, Homo sapiens
ggguucucacagug

SEQ ID NO: 1367466 - RNA, 22 nt, Homo sapiens
ggguugcacuggccacccaagg

SEQ ID NO: 1367467 - RNA, 14 nt, Homo sapiens
ggguugguaucuca

SEQ ID NO: 1367468 - RNA, 21 nt, Homo sapiens
gguaaaaugccaugaugccuc

SEQ ID NO: 1367469 - RNA, 21 nt, Homo sapiens
gguaaccccagauucaugcac

SEQ ID NO: 1367470 - RNA, 18 nt, Homo sapiens
gguacuuguaaauuauua

SEQ ID NO: 1367471 - RNA, 14 nt, Homo sapiens
ggucacacaaaggc

SEQ ID NO: 1367472 - RNA, 15 nt, Homo sapiens
ggucacacaaaggca

SEQ ID NO: 1367473 - RNA, 14 nt, Homo sapiens
ggucagagugccac

SEQ ID NO: 1367474 - RNA, 16 nt, Homo sapiens
gguccagcggggguca

SEQ ID NO: 1367475 - RNA, 20 nt, Homo sapiens
gguccuacugcugugagcau

SEQ ID NO: 1367476 - RNA, 19 nt, Homo sapiens
ggucucuucuuggggccca

SEQ ID NO: 1367477 - RNA, 15 nt, Homo sapiens
ggucuguagggauuu

SEQ ID NO: 1367478 - RNA, 15 nt, Homo sapiens
ggucuucccuaccuc

SEQ ID NO: 1367479 - RNA, 22 nt, Homo sapiens
ggugagacccauggcuguguug

SEQ ID NO: 1367480 - RNA, 16 nt, Homo sapiens
ggugaggguuggcgcu

SEQ ID NO: 1367481 - RNA, 17 nt, Homo sapiens
gguggcccuugcaguuc

SEQ ID NO: 1367482 - RNA, 17 nt, Homo sapiens
ggugggacucguggcug

SEQ ID NO: 1367483 - RNA, 17 nt, Homo sapiens
ggugggccucgggucca

SEQ ID NO: 1367484 - RNA, 12 nt, Homo sapiens
gguguguuacac

SEQ ID NO: 1367485 - RNA, 13 nt, Homo sapiens
gguguuuugccau

SEQ ID NO: 1367486 - RNA, 16 nt, Homo sapiens
gguugugcacuguuua

SEQ ID NO: 1367487 - RNA, 22 nt, Homo sapiens
guaaaaaaguaugcuuguuaau

SEQ ID NO: 1367488 - RNA, 12 nt, Homo sapiens
guaaaaacugca

SEQ ID NO: 1367489 - RNA, 18 nt, Homo sapiens
guaaagaguuaguuugag

SEQ ID NO: 1367490 - RNA, 11 nt, Homo sapiens
guaaaugccuc

SEQ ID NO: 1367491 - RNA, 13 nt, Homo sapiens
guaacuuacuuag

SEQ ID NO: 1367492 - RNA, 20 nt, Homo sapiens
guaagaaaccuacugcccag

SEQ ID NO: 1367493 - RNA, 18 nt, Homo sapiens
guaagcaaagacuuuccu

SEQ ID NO: 1367494 - RNA, 16 nt, Homo sapiens
guaauaugacuccugu

SEQ ID NO: 1367495 - RNA, 20 nt, Homo sapiens
guaaucccagcuacuuggga

SEQ ID NO: 1367496 - RNA, 22 nt, Homo sapiens
guacacacucagugacauuucu

SEQ ID NO: 1367497 - RNA, 18 nt, Homo sapiens
guacauguaacauuaaag

SEQ ID NO: 1367498 - RNA, 23 nt, Homo sapiens
guacucaaguaccaccaagggau

SEQ ID NO: 1367499 - RNA, 14 nt, Homo sapiens
guacuuguuugcaa

SEQ ID NO: 1367500 - RNA, 19 nt, Homo sapiens
guacuuugcucuccuugcg

SEQ ID NO: 1367501 - RNA, 22 nt, Homo sapiens
guagacuggggcgucaccucca

SEQ ID NO: 1367502 - RNA, 20 nt, Homo sapiens
guagagacgguguuuugcca

SEQ ID NO: 1367503 - RNA, 18 nt, Homo sapiens
guagccggagaagggccu

SEQ ID NO: 1367504 - RNA, 13 nt, Homo sapiens
guagcggcccuga

SEQ ID NO: 1367505 - RNA, 16 nt, Homo sapiens
guagcucuccugacuu

SEQ ID NO: 1367506 - RNA, 19 nt, Homo sapiens
guaggccuuccagugcagg

SEQ ID NO: 1367507 - RNA, 16 nt, Homo sapiens
guaggcuuaguuugug

SEQ ID NO: 1367508 - RNA, 24 nt, Homo sapiens
guaguaauuuauugucugucuaca

SEQ ID NO: 1367509 - RNA, 14 nt, Homo sapiens
guagugcuuuccag

SEQ ID NO: 1367510 - RNA, 23 nt, Homo sapiens
guagugucacucaaggcggugcu

SEQ ID NO: 1367511 - RNA, 21 nt, Homo sapiens
guaguuuuuacagcuguguua

SEQ ID NO: 1367512 - RNA, 21 nt, Homo sapiens
guauacuuuuagcuuguaguu

SEQ ID NO: 1367513 - RNA, 16 nt, Homo sapiens
ucucaugggaagggga

SEQ ID NO: 1367514 - RNA, 16 nt, Homo sapiens
ucuccagaaagcucau

SEQ ID NO: 1367515 - RNA, 17 nt, Homo sapiens
ucuccccagcccagaga

SEQ ID NO: 1367516 - RNA, 13 nt, Homo sapiens
ucucccugccaag

SEQ ID NO: 1367517 - RNA, 15 nt, Homo sapiens
ucuccuuuacuaaau

SEQ ID NO: 1367518 - RNA, 14 nt, Homo sapiens
ucucgguuugccaa

SEQ ID NO: 1367519 - RNA, 17 nt, Homo sapiens
ucucuccaccagguucu

SEQ ID NO: 1367520 - RNA, 14 nt, Homo sapiens
ucucucuucuccac

SEQ ID NO: 1367521 - RNA, 20 nt, Homo sapiens
ucucuggccuguacccagua

SEQ ID NO: 1367522 - RNA, 20 nt, Homo sapiens
ucucugggauuuaugcucau

SEQ ID NO: 1367523 - RNA, 14 nt, Homo sapiens
ucucugugccuucg

SEQ ID NO: 1367524 - RNA, 16 nt, Homo sapiens
ucugaaacugcauaag

SEQ ID NO: 1367525 - RNA, 22 nt, Homo sapiens
ucugaaauuugugauggaauca

SEQ ID NO: 1367526 - RNA, 15 nt, Homo sapiens
ucugagcccagcuca

SEQ ID NO: 1367527 - RNA, 22 nt, Homo sapiens
ucugagcgaggagugacugcca

SEQ ID NO: 1367528 - RNA, 23 nt, Homo sapiens
ucugagcgaggagugacugccaa

SEQ ID NO: 1367529 - RNA, 22 nt, Homo sapiens
ucugauuccccuccaccaaacc

SEQ ID NO: 1367530 - RNA, 23 nt, Homo sapiens
ucugcaccccccugggcugagag

SEQ ID NO: 1367531 - RNA, 17 nt, Homo sapiens
ucugcaugucuacucag

SEQ ID NO: 1367532 - RNA, 22 nt, Homo sapiens
ucugccagggcaccuacugaga

SEQ ID NO: 1367533 - RNA, 21 nt, Homo sapiens
ucugccauaucagugaaccuu

SEQ ID NO: 1367534 - RNA, 13 nt, Homo sapiens
ucugcccuugcca

SEQ ID NO: 1367535 - RNA, 21 nt, Homo sapiens
ucugcccuugccaacggagag

SEQ ID NO: 1367536 - RNA, 18 nt, Homo sapiens
ucugcgucgucaccaaau

SEQ ID NO: 1367537 - RNA, 19 nt, Homo sapiens
ucugcucuuuggaaauggc

SEQ ID NO: 1367538 - RNA, 13 nt, Homo sapiens
ucuggaaccucag

SEQ ID NO: 1367539 - RNA, 22 nt, Homo sapiens
ucuggaaguuucuggugccauu

SEQ ID NO: 1367540 - RNA, 16 nt, Homo sapiens
ucuggaucuccugacc

SEQ ID NO: 1367541 - RNA, 20 nt, Homo sapiens
ucuggauuagaaugccgguu

SEQ ID NO: 1367542 - RNA, 18 nt, Homo sapiens
ucuggccuguacccagua

SEQ ID NO: 1367543 - RNA, 16 nt, Homo sapiens
ucuggcuuagugccac

SEQ ID NO: 1367544 - RNA, 14 nt, Homo sapiens
ucugguccuaccca

SEQ ID NO: 1367545 - RNA, 22 nt, Homo sapiens
ucuguaaaagcagacccaccuc

SEQ ID NO: 1367546 - RNA, 15 nt, Homo sapiens
ucuguacugcacuua

SEQ ID NO: 1367547 - RNA, 22 nt, Homo sapiens
ucuguagacugccaucauugau

SEQ ID NO: 1367548 - RNA, 23 nt, Homo sapiens
ucuguagacugccaucauugaug

SEQ ID NO: 1367549 - RNA, 17 nt, Homo sapiens
ucugucaaucacagucu

SEQ ID NO: 1367550 - RNA, 12 nt, Homo sapiens
ucugucaugagc

SEQ ID NO: 1367551 - RNA, 21 nt, Homo sapiens
ucugucugaauggugcgugaa

SEQ ID NO: 1367552 - RNA, 21 nt, Homo sapiens
ucugugagacccccacaccuc

SEQ ID NO: 1367553 - RNA, 21 nt, Homo sapiens
ucuguggccagcugcaucugu

SEQ ID NO: 1367554 - RNA, 21 nt, Homo sapiens
ucuguuuguuuggcuguccag

SEQ ID NO: 1367555 - RNA, 23 nt, Homo sapiens
ucuuaaaaucacucagcacucca

SEQ ID NO: 1367556 - RNA, 14 nt, Homo sapiens
ucuuaacaaacucu

SEQ ID NO: 1367557 - RNA, 23 nt, Homo sapiens
ucuuacaacaggcuuaugaauau

SEQ ID NO: 1367558 - RNA, 16 nt, Homo sapiens
ucuuagaaaaaccacc

SEQ ID NO: 1367559 - RNA, 15 nt, Homo sapiens
ucuuaggugucaugu

SEQ ID NO: 1367560 - RNA, 20 nt, Homo sapiens
ucuucaaaaacgcacugcaa

SEQ ID NO: 1367561 - RNA, 19 nt, Homo sapiens
ucuucaaagcaaagcucuu

SEQ ID NO: 1367562 - RNA, 18 nt, Homo sapiens
ucuucacucaaucucuga

SEQ ID NO: 1367563 - RNA, 11 nt, Homo sapiens
ucuucccuacc

SEQ ID NO: 1367564 - RNA, 14 nt, Homo sapiens
ucuucccuaccuca

SEQ ID NO: 1367565 - RNA, 17 nt, Homo sapiens
ucuuccuggauggggca

SEQ ID NO: 1367566 - RNA, 19 nt, Homo sapiens
ucuucguauucccauuaga

SEQ ID NO: 1367567 - RNA, 15 nt, Homo sapiens
ucuucuaaauggcaa

SEQ ID NO: 1367568 - RNA, 13 nt, Homo sapiens
ucuucucuacucu

SEQ ID NO: 1367569 - RNA, 16 nt, Homo sapiens
ucuucuggauuagaau

SEQ ID NO: 1367570 - RNA, 23 nt, Homo sapiens
ucuugaccuaguauaucagugac

SEQ ID NO: 1367571 - RNA, 13 nt, Homo sapiens
ucuugcaccccaa

SEQ ID NO: 1367572 - RNA, 16 nt, Homo sapiens
ucuugcuguugacaua

SEQ ID NO: 1367573 - RNA, 17 nt, Homo sapiens
ucuuggccuaaaccuca

SEQ ID NO: 1367574 - RNA, 22 nt, Homo sapiens
ucuuggcuaacucagauucaug

SEQ ID NO: 1367575 - RNA, 18 nt, Homo sapiens
ucuugguuuaugucuugu

SEQ ID NO: 1367576 - RNA, 16 nt, Homo sapiens
ucuugguuugccuucc

SEQ ID NO: 1367577 - RNA, 13 nt, Homo sapiens
ucuuuacaucuau

SEQ ID NO: 1367578 - RNA, 16 nt, Homo sapiens
ucuuuaguugauuuaa

SEQ ID NO: 1367579 - RNA, 17 nt, Homo sapiens
ucuuuauaaucuacucc

SEQ ID NO: 1367580 - RNA, 20 nt, Homo sapiens
ucuuucaagcuucuugccag

SEQ ID NO: 1367581 - RNA, 20 nt, Homo sapiens
ucuuucucugccagugacag

SEQ ID NO: 1367582 - RNA, 20 nt, Homo sapiens
ucuuuuuaauaaaaaggcac

SEQ ID NO: 1367583 - RNA, 20 nt, Homo sapiens
ugaaaaugcuguauuaguca

SEQ ID NO: 1367584 - RNA, 22 nt, Homo sapiens
ugaaaaugcuguauuagucaca

SEQ ID NO: 1367585 - RNA, 22 nt, Homo sapiens
ugaaacccccacccuucugccu

SEQ ID NO: 1367586 - RNA, 23 nt, Homo sapiens
ugaaaccuuaguuucaagagucu

SEQ ID NO: 1367587 - RNA, 17 nt, Homo sapiens
ugaaagcccaaggugcu

SEQ ID NO: 1367588 - RNA, 13 nt, Homo sapiens
ugaaagugcauuu

SEQ ID NO: 1367589 - RNA, 23 nt, Homo sapiens
ugaaaguuuuucugaaaguguug

SEQ ID NO: 1367590 - RNA, 20 nt, Homo sapiens
ugaaauaaaaugauaaacaa

SEQ ID NO: 1367591 - RNA, 16 nt, Homo sapiens
ugaaauaaacagucua

SEQ ID NO: 1367592 - RNA, 16 nt, Homo sapiens
ugaaauaucaugcucc

SEQ ID NO: 1367593 - RNA, 13 nt, Homo sapiens
ugaaaucuaugaa

SEQ ID NO: 1367594 - RNA, 20 nt, Homo sapiens
ugaaaugccccgucagaaau

SEQ ID NO: 1367595 - RNA, 12 nt, Homo sapiens
ugaacacucccc

SEQ ID NO: 1367596 - RNA, 15 nt, Homo sapiens
ugaacaggaugcuga

SEQ ID NO: 1367597 - RNA, 18 nt, Homo sapiens
ugaacaggaugcugaugu

SEQ ID NO: 1367598 - RNA, 19 nt, Homo sapiens
ugaacauucccuugaucuc

SEQ ID NO: 1367599 - RNA, 17 nt, Homo sapiens
ugaacuacaguaaaugu

SEQ ID NO: 1367600 - RNA, 23 nt, Homo sapiens
ugaacucgcuagguucuuaucaa

SEQ ID NO: 1367601 - RNA, 19 nt, Homo sapiens
ugaacucuucacucuucaa

SEQ ID NO: 1367602 - RNA, 16 nt, Homo sapiens
ugaacuguugcccuuc

SEQ ID NO: 1367603 - RNA, 19 nt, Homo sapiens
ugaagaagagaaugugaca

SEQ ID NO: 1367604 - RNA, 19 nt, Homo sapiens
ugaagaggaguugcuugau

SEQ ID NO: 1367605 - RNA, 15 nt, Homo sapiens
ugaagauuucucuga

SEQ ID NO: 1367606 - RNA, 17 nt, Homo sapiens
ugaaggaauguauuucu

SEQ ID NO: 1367607 - RNA, 16 nt, Homo sapiens
ugaaggcagggcuccu

SEQ ID NO: 1367608 - RNA, 13 nt, Homo sapiens
ugaaggggccaug

SEQ ID NO: 1367609 - RNA, 22 nt, Homo sapiens
ugaagucaugcguuuaaucaca

SEQ ID NO: 1367610 - RNA, 16 nt, Homo sapiens
ugaaguuaugcuguca

SEQ ID NO: 1367611 - RNA, 20 nt, Homo sapiens
ugaauaacauuuaaauucca

SEQ ID NO: 1367612 - RNA, 22 nt, Homo sapiens
ugaauaauacaguaucucaggg

SEQ ID NO: 1367613 - RNA, 14 nt, Homo sapiens
ugaaugaaaugcca

SEQ ID NO: 1367614 - RNA, 20 nt, Homo sapiens
ugaaugccguggauugcacg

SEQ ID NO: 1367615 - RNA, 20 nt, Homo sapiens
ugaauuucuccgaaugucaa

SEQ ID NO: 1367616 - RNA, 13 nt, Homo sapiens
ugacaagugccuu

SEQ ID NO: 1367617 - RNA, 23 nt, Homo sapiens
ugacacccacucuccugugagau

SEQ ID NO: 1367618 - RNA, 12 nt, Homo sapiens
ugacagaucucu

SEQ ID NO: 1367619 - RNA, 20 nt, Homo sapiens
ugaccaaaacaaacaaacag

SEQ ID NO: 1367620 - RNA, 18 nt, Homo sapiens
ugaccaagacugagccag

SEQ ID NO: 1367621 - RNA, 15 nt, Homo sapiens
ugaccaagcaggaag

SEQ ID NO: 1367622 - RNA, 21 nt, Homo sapiens
ugaccacgcccccagcuguga

SEQ ID NO: 1367623 - RNA, 14 nt, Homo sapiens
ugaccagugcugcu

SEQ ID NO: 1367624 - RNA, 15 nt, Homo sapiens
ugaccagugcugcug

SEQ ID NO: 1367625 - RNA, 18 nt, Homo sapiens
ugacccuguaaaauggag

SEQ ID NO: 1367626 - RNA, 15 nt, Homo sapiens
ugacgacaagugcug

SEQ ID NO: 1367627 - RNA, 18 nt, Homo sapiens
ugacuccagguguaguua

SEQ ID NO: 1367628 - RNA, 14 nt, Homo sapiens
ugacucuccagaaa

SEQ ID NO: 1367629 - RNA, 20 nt, Homo sapiens
uucuaaccuuucuaacccac

SEQ ID NO: 1367630 - RNA, 15 nt, Homo sapiens
uucuaauuaaccuua

SEQ ID NO: 1367631 - RNA, 16 nt, Homo sapiens
uucuacagagugagac

SEQ ID NO: 1367632 - RNA, 13 nt, Homo sapiens
uucuacguuucuu

SEQ ID NO: 1367633 - RNA, 17 nt, Homo sapiens
uucuaguccuggaugac

SEQ ID NO: 1367634 - RNA, 21 nt, Homo sapiens
uucucacagugggagccaggg

SEQ ID NO: 1367635 - RNA, 21 nt, Homo sapiens
uucucagguguugccaaauau

SEQ ID NO: 1367636 - RNA, 19 nt, Homo sapiens
uucucccaaaguguccuaa

SEQ ID NO: 1367637 - RNA, 20 nt, Homo sapiens
uucucccccuuuccaaaaac

SEQ ID NO: 1367638 - RNA, 13 nt, Homo sapiens
uucuccuacuuag

SEQ ID NO: 1367639 - RNA, 13 nt, Homo sapiens
uucuccuuguaaa

SEQ ID NO: 1367640 - RNA, 11 nt, Homo sapiens
uucucugagau

SEQ ID NO: 1367641 - RNA, 19 nt, Homo sapiens
uucucuuaggugucauguu

SEQ ID NO: 1367642 - RNA, 22 nt, Homo sapiens
uucucuugagaggguggaauau

SEQ ID NO: 1367643 - RNA, 11 nt, Homo sapiens
uucugagauca

SEQ ID NO: 1367644 - RNA, 16 nt, Homo sapiens
uucugccccugcugac

SEQ ID NO: 1367645 - RNA, 19 nt, Homo sapiens
uucuggauuccccaucuca

SEQ ID NO: 1367646 - RNA, 14 nt, Homo sapiens
uucuggugccauuu

SEQ ID NO: 1367647 - RNA, 14 nt, Homo sapiens
uucugguuggugua

SEQ ID NO: 1367648 - RNA, 16 nt, Homo sapiens
uucuuaaaauacucac

SEQ ID NO: 1367649 - RNA, 14 nt, Homo sapiens
uucuuaggccacau

SEQ ID NO: 1367650 - RNA, 17 nt, Homo sapiens
uucuuauguugcccagu

SEQ ID NO: 1367651 - RNA, 17 nt, Homo sapiens
uucuugguaacugauua

SEQ ID NO: 1367652 - RNA, 20 nt, Homo sapiens
uucuuguccucauucuugcc

SEQ ID NO: 1367653 - RNA, 21 nt, Homo sapiens
uucuuuaaaauguaaagccau

SEQ ID NO: 1367654 - RNA, 11 nt, Homo sapiens
uugaaaacugc

SEQ ID NO: 1367655 - RNA, 12 nt, Homo sapiens
uugaaaacugcu

SEQ ID NO: 1367656 - RNA, 18 nt, Homo sapiens
uugaagguggcuacaaag

SEQ ID NO: 1367657 - RNA, 15 nt, Homo sapiens
uugaauagucucauc

SEQ ID NO: 1367658 - RNA, 15 nt, Homo sapiens
uugacagaacacugu

SEQ ID NO: 1367659 - RNA, 19 nt, Homo sapiens
uugacagcuuugcugcuga

SEQ ID NO: 1367660 - RNA, 20 nt, Homo sapiens
uugacccagggcugucuccc

SEQ ID NO: 1367661 - RNA, 17 nt, Homo sapiens
uugacuugacagaacac

SEQ ID NO: 1367662 - RNA, 19 nt, Homo sapiens
uugacuuuagugaaagcgu

SEQ ID NO: 1367663 - RNA, 20 nt, Homo sapiens
uugagaaaguacagcaguag

SEQ ID NO: 1367664 - RNA, 20 nt, Homo sapiens
uugagcaucacagaauguga

SEQ ID NO: 1367665 - RNA, 18 nt, Homo sapiens
uugagcugacauauacug

SEQ ID NO: 1367666 - RNA, 18 nt, Homo sapiens
uugagcugcugacugcca

SEQ ID NO: 1367667 - RNA, 16 nt, Homo sapiens
uugagguccacacuga

SEQ ID NO: 1367668 - RNA, 15 nt, Homo sapiens
uugauaacucagugg

SEQ ID NO: 1367669 - RNA, 14 nt, Homo sapiens
uugauccaggagau

SEQ ID NO: 1367670 - RNA, 18 nt, Homo sapiens
uugauguuuguggccuca

SEQ ID NO: 1367671 - RNA, 14 nt, Homo sapiens
uugauucugauaau

SEQ ID NO: 1367672 - RNA, 21 nt, Homo sapiens
uugcaaauaccuccucccuaa

SEQ ID NO: 1367673 - RNA, 18 nt, Homo sapiens
uugcaccucucucuccac

SEQ ID NO: 1367674 - RNA, 18 nt, Homo sapiens
uugcacuaucuuucagcu

SEQ ID NO: 1367675 - RNA, 13 nt, Homo sapiens
uugcagacaggaa

SEQ ID NO: 1367676 - RNA, 14 nt, Homo sapiens
uugcagauuaaaga

SEQ ID NO: 1367677 - RNA, 20 nt, Homo sapiens
uugcaggaccucaggugaga

SEQ ID NO: 1367678 - RNA, 16 nt, Homo sapiens
uugcagggcgugagac

SEQ ID NO: 1367679 - RNA, 22 nt, Homo sapiens
uugcauggguggccagccagcu

SEQ ID NO: 1367680 - RNA, 15 nt, Homo sapiens
uugcaugugcugcag

SEQ ID NO: 1367681 - RNA, 20 nt, Homo sapiens
uugccccugagacaaaugga

SEQ ID NO: 1367682 - RNA, 15 nt, Homo sapiens
uugccucuacuuuga

SEQ ID NO: 1367683 - RNA, 22 nt, Homo sapiens
uugccucuacuuugauucugau

SEQ ID NO: 1367684 - RNA, 15 nt, Homo sapiens
uugccuugggcugcu

SEQ ID NO: 1367685 - RNA, 16 nt, Homo sapiens
uugccuuugaauguua

SEQ ID NO: 1367686 - RNA, 18 nt, Homo sapiens
uugcucucggugcuucca

SEQ ID NO: 1367687 - RNA, 19 nt, Homo sapiens
uugcucucggugcuuccaa

SEQ ID NO: 1367688 - RNA, 23 nt, Homo sapiens
uugcuguggacuauuauuacaua

SEQ ID NO: 1367689 - RNA, 13 nt, Homo sapiens
uuggacacacugg

SEQ ID NO: 1367690 - RNA, 19 nt, Homo sapiens
uuggaugcggccauucaag

SEQ ID NO: 1367691 - RNA, 15 nt, Homo sapiens
uuggauugggguccc

SEQ ID NO: 1367692 - RNA, 14 nt, Homo sapiens
uuggcaccagacac

SEQ ID NO: 1367693 - RNA, 19 nt, Homo sapiens
uuggcagcccugaugacug

SEQ ID NO: 1367694 - RNA, 19 nt, Homo sapiens
uuggccaccaggugccuuu

SEQ ID NO: 1367695 - RNA, 22 nt, Homo sapiens
uuggccucagaauucacaaaau

SEQ ID NO: 1367696 - RNA, 22 nt, Homo sapiens
uuggcuacacacaaaccaguau

SEQ ID NO: 1367697 - RNA, 18 nt, Homo sapiens
uuggcugcaggaaucuuu

SEQ ID NO: 1367698 - RNA, 15 nt, Homo sapiens
uuggcuuugcaaaau

SEQ ID NO: 1367699 - RNA, 15 nt, Homo sapiens
uugggaacugcaaua

SEQ ID NO: 1367700 - RNA, 23 nt, Homo sapiens
uugggauggaauggccucugaaa

SEQ ID NO: 1367701 - RNA, 15 nt, Homo sapiens
uugggccugcuccag

SEQ ID NO: 1367702 - RNA, 11 nt, Homo sapiens
uuggugacaau

SEQ ID NO: 1367703 - RNA, 22 nt, Homo sapiens
uugguucucauaacucugugau

SEQ ID NO: 1367704 - RNA, 20 nt, Homo sapiens
uuguaaaacaaaauuugacu

SEQ ID NO: 1367705 - RNA, 18 nt, Homo sapiens
uuguaugauccuaaugaa

SEQ ID NO: 1367706 - RNA, 18 nt, Homo sapiens
uugucaagccugugcaaa

SEQ ID NO: 1367707 - RNA, 21 nt, Homo sapiens
uugucaagccugugcaaaaaa

SEQ ID NO: 1367708 - RNA, 10 nt, Homo sapiens
uugugcaaac

SEQ ID NO: 1367709 - RNA, 14 nt, Homo sapiens
uuguguaacauauu

SEQ ID NO: 1367710 - RNA, 17 nt, Homo sapiens
uuguuaaagagcacugg

SEQ ID NO: 1367711 - RNA, 15 nt, Homo sapiens
uuguucagaugcuuc

SEQ ID NO: 1367712 - RNA, 15 nt, Homo sapiens
uuguuccucagaaac

SEQ ID NO: 1367713 - RNA, 16 nt, Homo sapiens
uuuaaaaaaaagcaua

SEQ ID NO: 1367714 - RNA, 19 nt, Homo sapiens
uuuaaaaaauauuuucucu

SEQ ID NO: 1367715 - RNA, 23 nt, Homo sapiens
uuuaaaaacuagauugcuuugaa

SEQ ID NO: 1367716 - RNA, 14 nt, Homo sapiens
uuuaaacaguuuag

SEQ ID NO: 1367717 - RNA, 18 nt, Homo sapiens
uuuaaaccugacaauggu

SEQ ID NO: 1367718 - RNA, 19 nt, Homo sapiens
uuuaaauuccacagauuau

SEQ ID NO: 1367719 - RNA, 14 nt, Homo sapiens
uuuaacagcucucu

SEQ ID NO: 1367720 - RNA, 18 nt, Homo sapiens
uuuaagccugcauucuua

SEQ ID NO: 1367721 - RNA, 21 nt, Homo sapiens
uuuaauagggaauauaucucu

SEQ ID NO: 1367722 - RNA, 20 nt, Homo sapiens
uuuaaucuccucugaaaugu

SEQ ID NO: 1367723 - RNA, 12 nt, Homo sapiens
uuuacaccaguu

SEQ ID NO: 1367724 - RNA, 14 nt, Homo sapiens
uuuacagaauuuua

SEQ ID NO: 1367725 - RNA, 22 nt, Homo sapiens
uuuaccaugaggcuugugugaa

SEQ ID NO: 1367726 - RNA, 17 nt, Homo sapiens
uuuacugagacaaugua

SEQ ID NO: 1367727 - RNA, 14 nt, Homo sapiens
uuuagaaacuaaga

SEQ ID NO: 1367728 - RNA, 18 nt, Homo sapiens
uuuagagauuauaacaaa

SEQ ID NO: 1367729 - RNA, 22 nt, Homo sapiens
uuuagagugaaauauaugcuau

SEQ ID NO: 1367730 - RNA, 12 nt, Homo sapiens
uuuauacuuugc

SEQ ID NO: 1367731 - RNA, 21 nt, Homo sapiens
uuuauuacaguuuaucuaugg

SEQ ID NO: 1367732 - RNA, 16 nt, Homo sapiens
uuuauuuccucaaaac

SEQ ID NO: 1367733 - RNA, 19 nt, Homo sapiens
uuuauuuuauagagcagaa

SEQ ID NO: 1367734 - RNA, 13 nt, Homo sapiens
uuucaacugccaa

SEQ ID NO: 1367735 - RNA, 21 nt, Homo sapiens
uuucaagaaaugacugaggua

SEQ ID NO: 1367736 - RNA, 14 nt, Homo sapiens
uuucacauaugugu

SEQ ID NO: 1367737 - RNA, 15 nt, Homo sapiens
uuucagaaauauuca

SEQ ID NO: 1367738 - RNA, 14 nt, Homo sapiens
uuucagaauuuugc

SEQ ID NO: 1367739 - RNA, 14 nt, Homo sapiens
uuucagagugacac

SEQ ID NO: 1367740 - RNA, 21 nt, Homo sapiens
uuucaggccacauggcuaaag

SEQ ID NO: 1367741 - RNA, 16 nt, Homo sapiens
uuucaucuuuguggau

SEQ ID NO: 1367742 - RNA, 15 nt, Homo sapiens
uuuccacucauuaga

SEQ ID NO: 1367743 - RNA, 17 nt, Homo sapiens
uuuccagcagaagacaa

SEQ ID NO: 1367744 - RNA, 20 nt, Homo sapiens
uuuccauuaaacuacuuuug

SEQ ID NO: 1367745 - RNA, 17 nt, Homo sapiens
uuuccgugcguggcacu

SEQ ID NO: 1367746 - RNA, 24 nt, Homo sapiens
aaaaccaauguucucucuucucca

SEQ ID NO: 1367747 - RNA, 23 nt, Homo sapiens
aaaaccaccaccaucaccagaca

SEQ ID NO: 1367748 - RNA, 15 nt, Homo sapiens
aaaaccucuaugcaa

SEQ ID NO: 1367749 - RNA, 21 nt, Homo sapiens
aaaacgaugaaguuaugcugu

SEQ ID NO: 1367750 - RNA, 22 nt, Homo sapiens
aaaagacuuuuuccuugggcuu

SEQ ID NO: 1367751 - RNA, 21 nt, Homo sapiens
aaaagauacccaaaggucaag

SEQ ID NO: 1367752 - RNA, 14 nt, Homo sapiens
aaaagaucuugaau

SEQ ID NO: 1367753 - RNA, 22 nt, Homo sapiens
aaaaggaucuccuuuuuuccca

SEQ ID NO: 1367754 - RNA, 14 nt, Homo sapiens
aaaagggagauuca

SEQ ID NO: 1367755 - RNA, 15 nt, Homo sapiens
aaaagucaguaucau

SEQ ID NO: 1367756 - RNA, 15 nt, Homo sapiens
aaaauaaaaaaugug

SEQ ID NO: 1367757 - RNA, 15 nt, Homo sapiens
aaaauaaagccauuu

SEQ ID NO: 1367758 - RNA, 17 nt, Homo sapiens
aaaauaacaaagcccuu

SEQ ID NO: 1367759 - RNA, 19 nt, Homo sapiens
aaaaucagccugcuccagc

SEQ ID NO: 1367760 - RNA, 17 nt, Homo sapiens
aaaauccuacagugaaa

SEQ ID NO: 1367761 - RNA, 17 nt, Homo sapiens
aaaaugauaaacaaguc

SEQ ID NO: 1367762 - RNA, 20 nt, Homo sapiens
aaaaugcaauguaagcauac

SEQ ID NO: 1367763 - RNA, 17 nt, Homo sapiens
aaaaugguuuguccuga

SEQ ID NO: 1367764 - RNA, 16 nt, Homo sapiens
aaaauguaaagccaug

SEQ ID NO: 1367765 - RNA, 16 nt, Homo sapiens
aaaauuaaaauggaug

SEQ ID NO: 1367766 - RNA, 20 nt, Homo sapiens
aaaauucuauuacaguaugu

SEQ ID NO: 1367767 - RNA, 14 nt, Homo sapiens
aaaauucugaguga

SEQ ID NO: 1367768 - RNA, 16 nt, Homo sapiens
aaaauuucagcauuau

SEQ ID NO: 1367769 - RNA, 17 nt, Homo sapiens
aaacaaaauuugacuaa

SEQ ID NO: 1367770 - RNA, 16 nt, Homo sapiens
aaacacagacauucug

SEQ ID NO: 1367771 - RNA, 22 nt, Homo sapiens
aaacacuauauggcagugucuu

SEQ ID NO: 1367772 - RNA, 22 nt, Homo sapiens
aaacagaaaaaaaaauggaagc

SEQ ID NO: 1367773 - RNA, 22 nt, Homo sapiens
aaacagccucuuuuugauacug

SEQ ID NO: 1367774 - RNA, 21 nt, Homo sapiens
aaacaguuaagacaacaggca

SEQ ID NO: 1367775 - RNA, 16 nt, Homo sapiens
aaacaucauuacuaua

SEQ ID NO: 1367776 - RNA, 14 nt, Homo sapiens
aaacauugccuuug

SEQ ID NO: 1367777 - RNA, 23 nt, Homo sapiens
aaacauugccuuugaauguuaau

SEQ ID NO: 1367778 - RNA, 20 nt, Homo sapiens
aaacauuguuuuguguaaca

SEQ ID NO: 1367779 - RNA, 18 nt, Homo sapiens
aaaccauaugaacauaua

SEQ ID NO: 1367780 - RNA, 14 nt, Homo sapiens
aaaccauccaguga

SEQ ID NO: 1367781 - RNA, 14 nt, Homo sapiens
aaaccuccugcugu

SEQ ID NO: 1367782 - RNA, 17 nt, Homo sapiens
aaacuaccuuccaguuc

SEQ ID NO: 1367783 - RNA, 18 nt, Homo sapiens
aaacuagauugcuuugaa

SEQ ID NO: 1367784 - RNA, 16 nt, Homo sapiens
aaacugcgaggccagu

SEQ ID NO: 1367785 - RNA, 19 nt, Homo sapiens
aaacuguuaaacuaaugag

SEQ ID NO: 1367786 - RNA, 14 nt, Homo sapiens
aaacuuucaccuca

SEQ ID NO: 1367787 - RNA, 13 nt, Homo sapiens
aaagaauuugcac

SEQ ID NO: 1367788 - RNA, 21 nt, Homo sapiens
aaagacuguagaagaaagagc

SEQ ID NO: 1367789 - RNA, 15 nt, Homo sapiens
aaagagucacucaca

SEQ ID NO: 1367790 - RNA, 13 nt, Homo sapiens
aaagauugagaag

SEQ ID NO: 1367791 - RNA, 18 nt, Homo sapiens
aaagauuugugaacugga

SEQ ID NO: 1367792 - RNA, 14 nt, Homo sapiens
aaagcaaagcucuu

SEQ ID NO: 1367793 - RNA, 14 nt, Homo sapiens
aaagcaauaaccuc

SEQ ID NO: 1367794 - RNA, 18 nt, Homo sapiens
aaagcagacccaccuccc

SEQ ID NO: 1367795 - RNA, 13 nt, Homo sapiens
aaagccugaaggg

SEQ ID NO: 1367796 - RNA, 17 nt, Homo sapiens
aaagccuucauugccuu

SEQ ID NO: 1367797 - RNA, 18 nt, Homo sapiens
aaaggaaacccagcucac

SEQ ID NO: 1367798 - RNA, 20 nt, Homo sapiens
aaaggaaacccagcucacag

SEQ ID NO: 1367799 - RNA, 22 nt, Homo sapiens
aaaggaauccucugugucuuca

SEQ ID NO: 1367800 - RNA, 21 nt, Homo sapiens
aaaggagccaauugauuucaa

SEQ ID NO: 1367801 - RNA, 20 nt, Homo sapiens
aaaggcaaauuuuauacaaa

SEQ ID NO: 1367802 - RNA, 14 nt, Homo sapiens
aaagggcaaaaaga

SEQ ID NO: 1367803 - RNA, 22 nt, Homo sapiens
aaagggccaauaaauaugaugu

SEQ ID NO: 1367804 - RNA, 19 nt, Homo sapiens
aaaggucaagaacacagug

SEQ ID NO: 1367805 - RNA, 15 nt, Homo sapiens
aaagguggacuggaa

SEQ ID NO: 1367806 - RNA, 15 nt, Homo sapiens
aaagguucucaggug

SEQ ID NO: 1367807 - RNA, 14 nt, Homo sapiens
aaaguacaaaaauu

SEQ ID NO: 1367808 - RNA, 17 nt, Homo sapiens
aaaguagggaccucaga

SEQ ID NO: 1367809 - RNA, 16 nt, Homo sapiens
aaaguaguccugugaa

SEQ ID NO: 1367810 - RNA, 14 nt, Homo sapiens
aaaguaucugagau

SEQ ID NO: 1367811 - RNA, 12 nt, Homo sapiens
aaagucuugccu

SEQ ID NO: 1367812 - RNA, 17 nt, Homo sapiens
aaagugaauuguugaca

SEQ ID NO: 1367813 - RNA, 21 nt, Homo sapiens
aaagugacuaauggcaugaga

SEQ ID NO: 1367814 - RNA, 20 nt, Homo sapiens
aaauaaaaaucucuuuucca

SEQ ID NO: 1367815 - RNA, 13 nt, Homo sapiens
aaauaaaacugag

SEQ ID NO: 1367816 - RNA, 15 nt, Homo sapiens
aaauaaacacuuccu

SEQ ID NO: 1367817 - RNA, 23 nt, Homo sapiens
aaauaaggacaagccuaacuuca

SEQ ID NO: 1367818 - RNA, 18 nt, Homo sapiens
aaauaccagagccuucaa

SEQ ID NO: 1367819 - RNA, 20 nt, Homo sapiens
aaauagcaacuuguguuaca

SEQ ID NO: 1367820 - RNA, 22 nt, Homo sapiens
aaauaucuugauccuaugagug

SEQ ID NO: 1367821 - RNA, 15 nt, Homo sapiens
aaauauuaguauaaa

SEQ ID NO: 1367822 - RNA, 14 nt, Homo sapiens
aaauccuacaguga

SEQ ID NO: 1367823 - RNA, 15 nt, Homo sapiens
aaauccucucuauca

SEQ ID NO: 1367824 - RNA, 13 nt, Homo sapiens
aaaugcaaaauaa

SEQ ID NO: 1367825 - RNA, 22 nt, Homo sapiens
aaaugcuguauuagucacagag

SEQ ID NO: 1367826 - RNA, 10 nt, Homo sapiens
aaaugcuucu

SEQ ID NO: 1367827 - RNA, 20 nt, Homo sapiens
aaauggaggccuguccugac

SEQ ID NO: 1367828 - RNA, 17 nt, Homo sapiens
aaauguacagacauauu

SEQ ID NO: 1367829 - RNA, 21 nt, Homo sapiens
aaaugucauguggcuaccugu

SEQ ID NO: 1367830 - RNA, 23 nt, Homo sapiens
aaaugucuugcuguugacauauu

SEQ ID NO: 1367831 - RNA, 15 nt, Homo sapiens
aaauuacacacuugc

SEQ ID NO: 1367832 - RNA, 15 nt, Homo sapiens
aaauuccacagauua

SEQ ID NO: 1367833 - RNA, 21 nt, Homo sapiens
aaauuuuagcguuaaagucag

SEQ ID NO: 1367834 - RNA, 12 nt, Homo sapiens
aacaaacuggag

SEQ ID NO: 1367835 - RNA, 15 nt, Homo sapiens
aacaaguagcacacu

SEQ ID NO: 1367836 - RNA, 20 nt, Homo sapiens
aacacaaacgggcucagcaa

SEQ ID NO: 1367837 - RNA, 17 nt, Homo sapiens
aacacaauucuucuucc

SEQ ID NO: 1367838 - RNA, 14 nt, Homo sapiens
aacacacugaggca

SEQ ID NO: 1367839 - RNA, 22 nt, Homo sapiens
aacacagauccgcaagaguaaa

SEQ ID NO: 1367840 - RNA, 18 nt, Homo sapiens
aacaccaacauguuggga

SEQ ID NO: 1367841 - RNA, 18 nt, Homo sapiens
aacaccagggacacauuu

SEQ ID NO: 1367842 - RNA, 13 nt, Homo sapiens
aacaccucugcac

SEQ ID NO: 1367843 - RNA, 19 nt, Homo sapiens
aacacgugacacaaacaca

SEQ ID NO: 1367844 - RNA, 18 nt, Homo sapiens
aacagccucacuccucag

SEQ ID NO: 1367845 - RNA, 17 nt, Homo sapiens
aacaggcucacagagau

SEQ ID NO: 1367846 - RNA, 18 nt, Homo sapiens
aacauauauauacuauua

SEQ ID NO: 1367847 - RNA, 19 nt, Homo sapiens
aacauauuuauauauguau

SEQ ID NO: 1367848 - RNA, 16 nt, Homo sapiens
aacaucacucuugucu

SEQ ID NO: 1367849 - RNA, 13 nt, Homo sapiens
aacaucgucuaaa

SEQ ID NO: 1367850 - RNA, 18 nt, Homo sapiens
aacaucgucuaaacuuua

SEQ ID NO: 1367851 - RNA, 17 nt, Homo sapiens
aacaugaagccaggugu

SEQ ID NO: 1367852 - RNA, 22 nt, Homo sapiens
aacaugcauaagaaauguagcu

SEQ ID NO: 1367853 - RNA, 22 nt, Homo sapiens
aacaugguaaacgcugucccua

SEQ ID NO: 1367854 - RNA, 16 nt, Homo sapiens
aacaugugcucaggga

SEQ ID NO: 1367855 - RNA, 21 nt, Homo sapiens
aacaugugguuaaugccaugg

SEQ ID NO: 1367856 - RNA, 16 nt, Homo sapiens
aaccaauggaauguga

SEQ ID NO: 1367857 - RNA, 13 nt, Homo sapiens
aaccacucugugg

SEQ ID NO: 1367858 - RNA, 22 nt, Homo sapiens
aaccacuucagcugacuuuucu

SEQ ID NO: 1367859 - RNA, 18 nt, Homo sapiens
aaccaggcaccucuuccu

SEQ ID NO: 1367860 - RNA, 19 nt, Homo sapiens
aaccauaugaacauauauu

SEQ ID NO: 1367861 - RNA, 16 nt, Homo sapiens
aaccauccagugacaa

SEQ ID NO: 1367862 - RNA, 13 nt, Homo sapiens
aacccuugcacua

SEQ ID NO: 1367863 - RNA, 15 nt, Homo sapiens
ccuuugcauguuugu

SEQ ID NO: 1367864 - RNA, 12 nt, Homo sapiens
ccuuugcuaaug

SEQ ID NO: 1367865 - RNA, 17 nt, Homo sapiens
ccuuuuauuucuuaaac

SEQ ID NO: 1367866 - RNA, 12 nt, Homo sapiens
ccuuuugugcaa

SEQ ID NO: 1367867 - RNA, 24 nt, Homo sapiens
cgacauggcuccggccucugccuu

SEQ ID NO: 1367868 - RNA, 19 nt, Homo sapiens
cgagaccagccuggccaac

SEQ ID NO: 1367869 - RNA, 14 nt, Homo sapiens
cgagaucaagagau

SEQ ID NO: 1367870 - RNA, 21 nt, Homo sapiens
cgagaucgugccauugcacuc

SEQ ID NO: 1367871 - RNA, 21 nt, Homo sapiens
cgagcuguguagccacugacu

SEQ ID NO: 1367872 - RNA, 14 nt, Homo sapiens
cgcaaauucgcaaa

SEQ ID NO: 1367873 - RNA, 16 nt, Homo sapiens
cgcaaauuuucuucca

SEQ ID NO: 1367874 - RNA, 17 nt, Homo sapiens
cgcaggagccauugcuc

SEQ ID NO: 1367875 - RNA, 17 nt, Homo sapiens
cgcagugugcacuaagg

SEQ ID NO: 1367876 - RNA, 16 nt, Homo sapiens
cgcauccuaugcuuaa

SEQ ID NO: 1367877 - RNA, 19 nt, Homo sapiens
cgcccccuccgcccugcca

SEQ ID NO: 1367878 - RNA, 17 nt, Homo sapiens
cgccuccccaccuccag

SEQ ID NO: 1367879 - RNA, 16 nt, Homo sapiens
cgccugacaaccacug

SEQ ID NO: 1367880 - RNA, 14 nt, Homo sapiens
cgcgcacuccagcg

SEQ ID NO: 1367881 - RNA, 21 nt, Homo sapiens
cgcuaccagggggucagaggg

SEQ ID NO: 1367882 - RNA, 21 nt, Homo sapiens
cgcuggcuuuccagcuuagaa

SEQ ID NO: 1367883 - RNA, 20 nt, Homo sapiens
cgcuuugauaauacuuccaa

SEQ ID NO: 1367884 - RNA, 16 nt, Homo sapiens
cggaaagcccugugcu

SEQ ID NO: 1367885 - RNA, 23 nt, Homo sapiens
cggacgcaccugggacccugcac

SEQ ID NO: 1367886 - RNA, 15 nt, Homo sapiens
cggacgccaccugcg

SEQ ID NO: 1367887 - RNA, 12 nt, Homo sapiens
cggagcacuuuc

SEQ ID NO: 1367888 - RNA, 11 nt, Homo sapiens
cggaggucucu

SEQ ID NO: 1367889 - RNA, 16 nt, Homo sapiens
cggccagccaugucug

SEQ ID NO: 1367890 - RNA, 15 nt, Homo sapiens
cggcgugugcagugc

SEQ ID NO: 1367891 - RNA, 21 nt, Homo sapiens
cggguccccaaaccuguuccc

SEQ ID NO: 1367892 - RNA, 14 nt, Homo sapiens
cggugaacucuggc

SEQ ID NO: 1367893 - RNA, 18 nt, Homo sapiens
cgguggcucaugccugua

SEQ ID NO: 1367894 - RNA, 14 nt, Homo sapiens
cgguguuuugccau

SEQ ID NO: 1367895 - RNA, 15 nt, Homo sapiens
cguacacacucagug

SEQ ID NO: 1367896 - RNA, 15 nt, Homo sapiens
cgucccauccagcua

SEQ ID NO: 1367897 - RNA, 14 nt, Homo sapiens
cguccccaguugcc

SEQ ID NO: 1367898 - RNA, 14 nt, Homo sapiens
cgucgucaccaaau

SEQ ID NO: 1367899 - RNA, 17 nt, Homo sapiens
cgugacacaaacacaca

SEQ ID NO: 1367900 - RNA, 14 nt, Homo sapiens
cgugaccagcagua

SEQ ID NO: 1367901 - RNA, 14 nt, Homo sapiens
cgugaccagugcug

SEQ ID NO: 1367902 - RNA, 17 nt, Homo sapiens
cguguacuacaauuuaa

SEQ ID NO: 1367903 - RNA, 15 nt, Homo sapiens
cgugugacuacuccc

SEQ ID NO: 1367904 - RNA, 17 nt, Homo sapiens
cguuauauuaaaacacu

SEQ ID NO: 1367905 - RNA, 20 nt, Homo sapiens
cguucuuauuuaaucuccau

SEQ ID NO: 1367906 - RNA, 17 nt, Homo sapiens
cguugauaacucagugg

SEQ ID NO: 1367907 - RNA, 14 nt, Homo sapiens
cguuugaaucacag

SEQ ID NO: 1367908 - RNA, 23 nt, Homo sapiens
cuaaaacagaaaaaaaaauggaa

SEQ ID NO: 1367909 - RNA, 22 nt, Homo sapiens
cccagugcccccacugaccaga

SEQ ID NO: 1367910 - RNA, 18 nt, Homo sapiens
cccauaauugcuuugcca

SEQ ID NO: 1367911 - RNA, 13 nt, Homo sapiens
cccauagugugca

SEQ ID NO: 1367912 - RNA, 17 nt, Homo sapiens
cccaucccccaccugcc

SEQ ID NO: 1367913 - RNA, 15 nt, Homo sapiens
ccccacccaggagua

SEQ ID NO: 1367914 - RNA, 22 nt, Homo sapiens
ccccacuggggaaauaacagcu

SEQ ID NO: 1367915 - RNA, 14 nt, Homo sapiens
ccccagagcuguuu

SEQ ID NO: 1367916 - RNA, 19 nt, Homo sapiens
ccccagauucaugcacugu

SEQ ID NO: 1367917 - RNA, 19 nt, Homo sapiens
ccccagcccagagacauac

SEQ ID NO: 1367918 - RNA, 22 nt, Homo sapiens
ccccguguccucucccugccaa

SEQ ID NO: 1367919 - RNA, 14 nt, Homo sapiens
ccccuaagagccau

SEQ ID NO: 1367920 - RNA, 12 nt, Homo sapiens
ccccucuuccaa

SEQ ID NO: 1367921 - RNA, 14 nt, Homo sapiens
ccccuggcucugac

SEQ ID NO: 1367922 - RNA, 23 nt, Homo sapiens
cccgagccacgaacuugcugggu

SEQ ID NO: 1367923 - RNA, 16 nt, Homo sapiens
cccggcgugugcagug

SEQ ID NO: 1367924 - RNA, 23 nt, Homo sapiens
cccguggccauuacugcauaaaa

SEQ ID NO: 1367925 - RNA, 18 nt, Homo sapiens
cccgugggagucaucuca

SEQ ID NO: 1367926 - RNA, 11 nt, Homo sapiens
cccgugugagg

SEQ ID NO: 1367927 - RNA, 19 nt, Homo sapiens
cccuauugguaaagaaugg

SEQ ID NO: 1367928 - RNA, 17 nt, Homo sapiens
cccucauucuacugaaa

SEQ ID NO: 1367929 - RNA, 18 nt, Homo sapiens
cccuccaagucacaaaga

SEQ ID NO: 1367930 - RNA, 20 nt, Homo sapiens
cccucccuguuccccagaga

SEQ ID NO: 1367931 - RNA, 15 nt, Homo sapiens
cccuccguggcauca

SEQ ID NO: 1367932 - RNA, 14 nt, Homo sapiens
cccuccugacucau

SEQ ID NO: 1367933 - RNA, 17 nt, Homo sapiens
cccucgucccauccagc

SEQ ID NO: 1367934 - RNA, 18 nt, Homo sapiens
cccucugcuguucaggau

SEQ ID NO: 1367935 - RNA, 16 nt, Homo sapiens
cccucuucauggaugg

SEQ ID NO: 1367936 - RNA, 16 nt, Homo sapiens
cccugcagucacagcu

SEQ ID NO: 1367937 - RNA, 16 nt, Homo sapiens
cccugcugcuggugca

SEQ ID NO: 1367938 - RNA, 19 nt, Homo sapiens
cccuggccuccccugccac

SEQ ID NO: 1367939 - RNA, 14 nt, Homo sapiens
cccuggugguggau

SEQ ID NO: 1367940 - RNA, 22 nt, Homo sapiens
cccuguccaaacugccuaagcc

SEQ ID NO: 1367941 - RNA, 13 nt, Homo sapiens
cccuugcagcuag

SEQ ID NO: 1367942 - RNA, 21 nt, Homo sapiens
cccuugugucaagacauuucu

SEQ ID NO: 1367943 - RNA, 19 nt, Homo sapiens
ccgacuuuccauugauuca

SEQ ID NO: 1367944 - RNA, 23 nt, Homo sapiens
ccgagccagcaagaggaaggggu

SEQ ID NO: 1367945 - RNA, 18 nt, Homo sapiens
ccgcugcgucugcacuga

SEQ ID NO: 1367946 - RNA, 23 nt, Homo sapiens
ccggcucugguggccacugagcu

SEQ ID NO: 1367947 - RNA, 17 nt, Homo sapiens
ccgugaccagugcugcu

SEQ ID NO: 1367948 - RNA, 16 nt, Homo sapiens
ccuaagggggacacau

SEQ ID NO: 1367949 - RNA, 21 nt, Homo sapiens
ccuacccccuaagagccauuu

SEQ ID NO: 1367950 - RNA, 23 nt, Homo sapiens
ccuacugcugugagcaugacuua

SEQ ID NO: 1367951 - RNA, 18 nt, Homo sapiens
augcaacaacauguauaa

SEQ ID NO: 1367952 - RNA, 12 nt, Homo sapiens
augcacugugaa

SEQ ID NO: 1367953 - RNA, 22 nt, Homo sapiens
augcagcucaagagaucccaag

SEQ ID NO: 1367954 - RNA, 21 nt, Homo sapiens
augcauggugccccaggacca

SEQ ID NO: 1367955 - RNA, 23 nt, Homo sapiens
augcauggugccccaggaccagc

SEQ ID NO: 1367956 - RNA, 19 nt, Homo sapiens
augcauuagaagucagcca

SEQ ID NO: 1367957 - RNA, 16 nt, Homo sapiens
augcauugagcugccu

SEQ ID NO: 1367958 - RNA, 21 nt, Homo sapiens
augccacccaguugugacaau

SEQ ID NO: 1367959 - RNA, 23 nt, Homo sapiens
augccacccaguugugacaauua

SEQ ID NO: 1367960 - RNA, 22 nt, Homo sapiens
augccagcagccagccaacccu

SEQ ID NO: 1367961 - RNA, 22 nt, Homo sapiens
augccaguaacgcgucuuccug

SEQ ID NO: 1367962 - RNA, 22 nt, Homo sapiens
augccucauuaccuugugcuaa

SEQ ID NO: 1367963 - RNA, 20 nt, Homo sapiens
augcggcccaggauggcuuu

SEQ ID NO: 1367964 - RNA, 23 nt, Homo sapiens
augcucccuccccugcccugguc

SEQ ID NO: 1367965 - RNA, 19 nt, Homo sapiens
augcugguuuucuacccaa

SEQ ID NO: 1367966 - RNA, 16 nt, Homo sapiens
augcugucaugguccu

SEQ ID NO: 1367967 - RNA, 18 nt, Homo sapiens
augcuguuaaaacuacuu

SEQ ID NO: 1367968 - RNA, 16 nt, Homo sapiens
augcuucagugcugcu

SEQ ID NO: 1367969 - RNA, 21 nt, Homo sapiens
augcuuugccccugagacaaa

SEQ ID NO: 1367970 - RNA, 13 nt, Homo sapiens
auggaaucagauu

SEQ ID NO: 1367971 - RNA, 18 nt, Homo sapiens
auggacaaacagugcacu

SEQ ID NO: 1367972 - RNA, 11 nt, Homo sapiens
auggacaugcu

SEQ ID NO: 1367973 - RNA, 16 nt, Homo sapiens
auggcacccaugcacc

SEQ ID NO: 1367974 - RNA, 20 nt, Homo sapiens
auggcuccggccucugccuu

SEQ ID NO: 1367975 - RNA, 17 nt, Homo sapiens
auggcugacaucaguca

SEQ ID NO: 1367976 - RNA, 16 nt, Homo sapiens
auggcugccaucucac

SEQ ID NO: 1367977 - RNA, 18 nt, Homo sapiens
augggaaggggaggaccc

SEQ ID NO: 1367978 - RNA, 18 nt, Homo sapiens
augggaccuguggcuguc

SEQ ID NO: 1367979 - RNA, 13 nt, Homo sapiens
auggggccagauc

SEQ ID NO: 1367980 - RNA, 20 nt, Homo sapiens
augguggcucacaccuguaa

SEQ ID NO: 1367981 - RNA, 19 nt, Homo sapiens
augguggugugugccugua

SEQ ID NO: 1367982 - RNA, 21 nt, Homo sapiens
augguguggccuguggcuguc

SEQ ID NO: 1367983 - RNA, 21 nt, Homo sapiens
augguuugcaaggaagccaca

SEQ ID NO: 1367984 - RNA, 13 nt, Homo sapiens
auguaaauacugu

SEQ ID NO: 1367985 - RNA, 16 nt, Homo sapiens
auguacagacauauuu

SEQ ID NO: 1367986 - RNA, 22 nt, Homo sapiens
auguaggagcugcaguucuugu

SEQ ID NO: 1367987 - RNA, 19 nt, Homo sapiens
augucauguggcuaccugu

SEQ ID NO: 1367988 - RNA, 18 nt, Homo sapiens
augucccuccaacacaga

SEQ ID NO: 1367989 - RNA, 18 nt, Homo sapiens
augugaaaggaacauuuu

SEQ ID NO: 1367990 - RNA, 20 nt, Homo sapiens
augugaaccauuaaccagau

SEQ ID NO: 1367991 - RNA, 22 nt, Homo sapiens
augugauaaaaccccaucucua

SEQ ID NO: 1367992 - RNA, 16 nt, Homo sapiens
augugauuagugucuc

SEQ ID NO: 1367993 - RNA, 23 nt, Homo sapiens
augugccuguagucccaggcuga

SEQ ID NO: 1367994 - RNA, 24 nt, Homo sapiens
augugguuaaugccauggacagaa

SEQ ID NO: 1367995 - RNA, 12 nt, Homo sapiens
augugugauuca

SEQ ID NO: 1367996 - RNA, 17 nt, Homo sapiens
auguuaaagaugcacag

SEQ ID NO: 1367997 - RNA, 21 nt, Homo sapiens
auguuaaagaugcacagaaua

SEQ ID NO: 1367998 - RNA, 22 nt, Homo sapiens
auguuaaugucauuagugacaa

SEQ ID NO: 1367999 - RNA, 21 nt, Homo sapiens
auguuaauuuuuugguacaaa

SEQ ID NO: 1368000 - RNA, 18 nt, Homo sapiens
auguugggaaacuuggcu

SEQ ID NO: 1368001 - RNA, 22 nt, Homo sapiens
auguuucugucacaucagcucc

SEQ ID NO: 1368002 - RNA, 17 nt, Homo sapiens
auguuuguggccucaga

SEQ ID NO: 1368003 - RNA, 17 nt, Homo sapiens
auguuuuagccagugau

SEQ ID NO: 1368004 - RNA, 21 nt, Homo sapiens
auguuuuuauaaaagcaaaag

SEQ ID NO: 1368005 - RNA, 21 nt, Homo sapiens
auuaacuuuuuaaaacacaac

SEQ ID NO: 1368006 - RNA, 16 nt, Homo sapiens
auuacggggugaccuu

SEQ ID NO: 1368007 - RNA, 16 nt, Homo sapiens
auuacucugcucuuug

SEQ ID NO: 1368008 - RNA, 14 nt, Homo sapiens
auuacuuggcuuuu

SEQ ID NO: 1368009 - RNA, 14 nt, Homo sapiens
auuagaacuucaag

SEQ ID NO: 1368010 - RNA, 22 nt, Homo sapiens
auuagaacuucaagcucuccaa

SEQ ID NO: 1368011 - RNA, 14 nt, Homo sapiens
auuagcaaagcaaa

SEQ ID NO: 1368012 - RNA, 18 nt, Homo sapiens
auuagcauuuugcuaaau

SEQ ID NO: 1368013 - RNA, 23 nt, Homo sapiens
auuagccaagugugguagagugu

SEQ ID NO: 1368014 - RNA, 22 nt, Homo sapiens
auuagguagaugagaaaacagg

SEQ ID NO: 1368015 - RNA, 17 nt, Homo sapiens
auuauccuucuacuugu

SEQ ID NO: 1368016 - RNA, 21 nt, Homo sapiens
auuaugcuguuaaaacuacuu

SEQ ID NO: 1368017 - RNA, 21 nt, Homo sapiens
auuaugggauugcaaccagca

SEQ ID NO: 1368018 - RNA, 14 nt, Homo sapiens
auuauuauccuccu

SEQ ID NO: 1368019 - RNA, 14 nt, Homo sapiens
auucaagaaugcca

SEQ ID NO: 1368020 - RNA, 14 nt, Homo sapiens
auucaaggggagcc

SEQ ID NO: 1368021 - RNA, 13 nt, Homo sapiens
auucacaguguga

SEQ ID NO: 1368022 - RNA, 15 nt, Homo sapiens
auucacccuguccaa

SEQ ID NO: 1368023 - RNA, 14 nt, Homo sapiens
auucagcucugcaa

SEQ ID NO: 1368024 - RNA, 16 nt, Homo sapiens
auucauccugaccaag

SEQ ID NO: 1368025 - RNA, 15 nt, Homo sapiens
auuccccaucucagg

SEQ ID NO: 1368026 - RNA, 21 nt, Homo sapiens
auuccggaaacuaguguacau

SEQ ID NO: 1368027 - RNA, 21 nt, Homo sapiens
auuccucggggauagaccaaa

SEQ ID NO: 1368028 - RNA, 21 nt, Homo sapiens
auuccugcagggacggagcug

SEQ ID NO: 1368029 - RNA, 22 nt, Homo sapiens
auuccugggguaaaguaucacu

SEQ ID NO: 1368030 - RNA, 16 nt, Homo sapiens
auuccuuagauaccuu

SEQ ID NO: 1368031 - RNA, 18 nt, Homo sapiens
auucguuacuguugugaa

SEQ ID NO: 1368032 - RNA, 20 nt, Homo sapiens
auucucuuuuuuucuugucc

SEQ ID NO: 1368033 - RNA, 17 nt, Homo sapiens
auucugauaaugcucac

SEQ ID NO: 1368034 - RNA, 20 nt, Homo sapiens
auucuuacaaacaugugguu

SEQ ID NO: 1368035 - RNA, 17 nt, Homo sapiens
auucuucagaaugucag

SEQ ID NO: 1368036 - RNA, 17 nt, Homo sapiens
auucuucagucuggacu

SEQ ID NO: 1368037 - RNA, 18 nt, Homo sapiens
auugacgacaagugcuga

SEQ ID NO: 1368038 - RNA, 13 nt, Homo sapiens
auugcaaccagca

SEQ ID NO: 1368039 - RNA, 16 nt, Homo sapiens
auugcagcagguggua

SEQ ID NO: 1368040 - RNA, 21 nt, Homo sapiens
auugccagugagauauauuca

SEQ ID NO: 1368041 - RNA, 14 nt, Homo sapiens
auugccucuacuuu

SEQ ID NO: 1368042 - RNA, 13 nt, Homo sapiens
auugcuuugccaa

SEQ ID NO: 1368043 - RNA, 20 nt, Homo sapiens
auuguaacaugacacuuaga

SEQ ID NO: 1368044 - RNA, 12 nt, Homo sapiens
auuguacuuaaa

SEQ ID NO: 1368045 - RNA, 15 nt, Homo sapiens
auuguauuacagaug

SEQ ID NO: 1368046 - RNA, 14 nt, Homo sapiens
auugucugucuaca

SEQ ID NO: 1368047 - RNA, 21 nt, Homo sapiens
auugugccuacgaauagccac

SEQ ID NO: 1368048 - RNA, 19 nt, Homo sapiens
auuguuucauucauccuga

SEQ ID NO: 1368049 - RNA, 23 nt, Homo sapiens
auuguuugaacccgggaggcaga

SEQ ID NO: 1368050 - RNA, 20 nt, Homo sapiens
auuguuuuguguaacauauu

SEQ ID NO: 1368051 - RNA, 14 nt, Homo sapiens
auuuaaauuccaca

SEQ ID NO: 1368052 - RNA, 23 nt, Homo sapiens
auuuaauccgucacauucaucuc

SEQ ID NO: 1368053 - RNA, 11 nt, Homo sapiens
auuuacuacag

SEQ ID NO: 1368054 - RNA, 21 nt, Homo sapiens
auuuagaccccauacaaguuu

SEQ ID NO: 1368055 - RNA, 23 nt, Homo sapiens
auuuagaccccauacaaguuuau

SEQ ID NO: 1368056 - RNA, 23 nt, Homo sapiens
auuuauaucgcuggccagcauua

SEQ ID NO: 1368057 - RNA, 17 nt, Homo sapiens
auuuauuggucagggug

SEQ ID NO: 1368058 - RNA, 16 nt, Homo sapiens
auuucacaaaucacca

SEQ ID NO: 1368059 - RNA, 13 nt, Homo sapiens
auuucagcauuau

SEQ ID NO: 1368060 - RNA, 23 nt, Homo sapiens
auuuccaagcacuuucaguccaa

SEQ ID NO: 1368061 - RNA, 19 nt, Homo sapiens
auuucccaggacccugaag

SEQ ID NO: 1368062 - RNA, 15 nt, Homo sapiens
auuucuauaaauaga

SEQ ID NO: 1368063 - RNA, 16 nt, Homo sapiens
auuucucaacuuugau

SEQ ID NO: 1368064 - RNA, 19 nt, Homo sapiens
auuucucagggaaguaaga

SEQ ID NO: 1368065 - RNA, 21 nt, Homo sapiens
auuucucccuuguccaaaguc

SEQ ID NO: 1368066 - RNA, 14 nt, Homo sapiens
gagcuuucugcuau

SEQ ID NO: 1368067 - RNA, 19 nt, Homo sapiens
gaggacauaaugggguccu

SEQ ID NO: 1368068 - RNA, 23 nt, Homo sapiens
gaggacuuguuaaagagcacugg

SEQ ID NO: 1368069 - RNA, 19 nt, Homo sapiens
gaggauugcuugagcucag

SEQ ID NO: 1368070 - RNA, 20 nt, Homo sapiens
gaggcaggaggaucacuuga

SEQ ID NO: 1368071 - RNA, 18 nt, Homo sapiens
gaggccagccagugaccu

SEQ ID NO: 1368072 - RNA, 16 nt, Homo sapiens
gaggccuguccugacc

SEQ ID NO: 1368073 - RNA, 15 nt, Homo sapiens
gaggcuccucugaug

SEQ ID NO: 1368074 - RNA, 17 nt, Homo sapiens
gaggcuccugucugaua

SEQ ID NO: 1368075 - RNA, 15 nt, Homo sapiens
gaggcuguucccacc

SEQ ID NO: 1368076 - RNA, 18 nt, Homo sapiens
gagggaggaugcugugug

SEQ ID NO: 1368077 - RNA, 22 nt, Homo sapiens
gagggauaguggggucagggcu

SEQ ID NO: 1368078 - RNA, 21 nt, Homo sapiens
gaggggccggcccugugugca

SEQ ID NO: 1368079 - RNA, 12 nt, Homo sapiens
gaguauccucuu

SEQ ID NO: 1368080 - RNA, 20 nt, Homo sapiens
gagucaucucaaccaucccc

SEQ ID NO: 1368081 - RNA, 19 nt, Homo sapiens
gagugccacccgcaggugu

SEQ ID NO: 1368082 - RNA, 24 nt, Homo sapiens
gagugcuaugaagacaggaucuag

SEQ ID NO: 1368083 - RNA, 16 nt, Homo sapiens
gaguuaguuugaguua

SEQ ID NO: 1368084 - RNA, 19 nt, Homo sapiens
gauacacuaaaaaucugag

SEQ ID NO: 1368085 - RNA, 19 nt, Homo sapiens
gauacacuaugaagauguu

SEQ ID NO: 1368086 - RNA, 13 nt, Homo sapiens
gauagaaaugcca

SEQ ID NO: 1368087 - RNA, 15 nt, Homo sapiens
gauagggaacugggg

SEQ ID NO: 1368088 - RNA, 16 nt, Homo sapiens
gauagggaacugggga

SEQ ID NO: 1368089 - RNA, 19 nt, Homo sapiens
gaucagcaaaccggggccu

SEQ ID NO: 1368090 - RNA, 20 nt, Homo sapiens
gaucaugccacuacacucca

SEQ ID NO: 1368091 - RNA, 20 nt, Homo sapiens
gaucgugccauugcacucca

SEQ ID NO: 1368092 - RNA, 16 nt, Homo sapiens
gaucucgguuugccaa

SEQ ID NO: 1368093 - RNA, 17 nt, Homo sapiens
gaucuuccguggucaga

SEQ ID NO: 1368094 - RNA, 21 nt, Homo sapiens
gaugaggucauagcagugcuu

SEQ ID NO: 1368095 - RNA, 17 nt, Homo sapiens
gaugaguuaacugugaa

SEQ ID NO: 1368096 - RNA, 15 nt, Homo sapiens
gaugcagcacugcgc

SEQ ID NO: 1368097 - RNA, 21 nt, Homo sapiens
gaugccugacggcagcugguu

SEQ ID NO: 1368098 - RNA, 16 nt, Homo sapiens
gaugcggccauucaag

SEQ ID NO: 1368099 - RNA, 13 nt, Homo sapiens
gaugcggcccuga

SEQ ID NO: 1368100 - RNA, 14 nt, Homo sapiens
gaugcggcccugag

SEQ ID NO: 1368101 - RNA, 20 nt, Homo sapiens
gaugcugccccucaucucuc

SEQ ID NO: 1368102 - RNA, 18 nt, Homo sapiens
gaugucugccacaccucu

SEQ ID NO: 1368103 - RNA, 16 nt, Homo sapiens
gaugugauuagugucu

SEQ ID NO: 1368104 - RNA, 18 nt, Homo sapiens
gauguuuaguaauacagc

SEQ ID NO: 1368105 - RNA, 15 nt, Homo sapiens
gauguuucaaaaaau

SEQ ID NO: 1368106 - RNA, 15 nt, Homo sapiens
gauguuucugucaca

SEQ ID NO: 1368107 - RNA, 14 nt, Homo sapiens
gauuaaccucugca

SEQ ID NO: 1368108 - RNA, 23 nt, Homo sapiens
gauuaaccucugcacuacugaca

SEQ ID NO: 1368109 - RNA, 16 nt, Homo sapiens
gauuacagagaucuca

SEQ ID NO: 1368110 - RNA, 19 nt, Homo sapiens
gauuaccugccaauugcua

SEQ ID NO: 1368111 - RNA, 15 nt, Homo sapiens
gauuccccaucucag

SEQ ID NO: 1368112 - RNA, 19 nt, Homo sapiens
gauucggagugucugaaca

SEQ ID NO: 1368113 - RNA, 23 nt, Homo sapiens
gauucuccuguauuucaggugaa

SEQ ID NO: 1368114 - RNA, 12 nt, Homo sapiens
gauucuucagcu

SEQ ID NO: 1368115 - RNA, 20 nt, Homo sapiens
gauugcacguggccucuuga

SEQ ID NO: 1368116 - RNA, 18 nt, Homo sapiens
gauuggcaggaguuggaa

SEQ ID NO: 1368117 - RNA, 12 nt, Homo sapiens
gauugggguccc

SEQ ID NO: 1368118 - RNA, 16 nt, Homo sapiens
gauuuaugcuccuuau

SEQ ID NO: 1368119 - RNA, 13 nt, Homo sapiens
gauuucauuugaa

SEQ ID NO: 1368120 - RNA, 23 nt, Homo sapiens
gauuugaacccagcugcucugua

SEQ ID NO: 1368121 - RNA, 16 nt, Homo sapiens
gauuugauuaaugaau

SEQ ID NO: 1368122 - RNA, 21 nt, Homo sapiens
gcaaaaggaucuuuguggcca

SEQ ID NO: 1368123 - RNA, 22 nt, Homo sapiens
gcaaaaggaucuuuguggccaa

SEQ ID NO: 1368124 - RNA, 24 nt, Homo sapiens
gcaaacuuucuuaaaacauuauga

SEQ ID NO: 1368125 - RNA, 11 nt, Homo sapiens
gcaaagccaaa

SEQ ID NO: 1368126 - RNA, 15 nt, Homo sapiens
gcaaagccaaaaccu

SEQ ID NO: 1368127 - RNA, 13 nt, Homo sapiens
gcaaaguacuugu

SEQ ID NO: 1368128 - RNA, 22 nt, Homo sapiens
gcaaagugaaaguaacuguuaa

SEQ ID NO: 1368129 - RNA, 23 nt, Homo sapiens
gcaaauuuuagcguuaaagucag

SEQ ID NO: 1368130 - RNA, 15 nt, Homo sapiens
gcaaauuuucuucca

SEQ ID NO: 1368131 - RNA, 16 nt, Homo sapiens
gcaagagaauuacuug

SEQ ID NO: 1368132 - RNA, 18 nt, Homo sapiens
gcaagaucccaucucuuu

SEQ ID NO: 1368133 - RNA, 16 nt, Homo sapiens
gcaagcccacagauga

SEQ ID NO: 1368134 - RNA, 17 nt, Homo sapiens
gcaagugagacccuguc

SEQ ID NO: 1368135 - RNA, 17 nt, Homo sapiens
gcaaguguucacugcuc

SEQ ID NO: 1368136 - RNA, 21 nt, Homo sapiens
gcaauaaaucugacccagugc

SEQ ID NO: 1368137 - RNA, 22 nt, Homo sapiens
gcaauacagacuacuucuuccc

SEQ ID NO: 1368138 - RNA, 19 nt, Homo sapiens
gcaaugggguccacuuccc

SEQ ID NO: 1368139 - RNA, 22 nt, Homo sapiens
gcaauguguggcugaagacuuu

SEQ ID NO: 1368140 - RNA, 18 nt, Homo sapiens
gcaauucuucugccucag

SEQ ID NO: 1368141 - RNA, 23 nt, Homo sapiens
gcacacagugucuguguacaugu

SEQ ID NO: 1368142 - RNA, 22 nt, Homo sapiens
gcacagugucaguugagcugac

SEQ ID NO: 1368143 - RNA, 15 nt, Homo sapiens
gcaccaagacugaga

SEQ ID NO: 1368144 - RNA, 20 nt, Homo sapiens
gcaccacugcacuccagccu

SEQ ID NO: 1368145 - RNA, 13 nt, Homo sapiens
gcaccucuuggcu

SEQ ID NO: 1368146 - RNA, 14 nt, Homo sapiens
gcaccucuuggcuu

SEQ ID NO: 1368147 - RNA, 20 nt, Homo sapiens
gcaccugggacccugcacag

SEQ ID NO: 1368148 - RNA, 15 nt, Homo sapiens
gcagacucauugcag

SEQ ID NO: 1368149 - RNA, 14 nt, Homo sapiens
gcagaggccagagg

SEQ ID NO: 1368150 - RNA, 17 nt, Homo sapiens
gcagaucugugccccau

SEQ ID NO: 1368151 - RNA, 15 nt, Homo sapiens
gcagcaaauuuucag

SEQ ID NO: 1368152 - RNA, 22 nt, Homo sapiens
gcagcagggagggcuucugcca

SEQ ID NO: 1368153 - RNA, 17 nt, Homo sapiens
gcagcauuggugcucac

SEQ ID NO: 1368154 - RNA, 19 nt, Homo sapiens
gcagccacaaccaaaaaau

SEQ ID NO: 1368155 - RNA, 20 nt, Homo sapiens
gcagcgcgugcggugcaaag

SEQ ID NO: 1368156 - RNA, 12 nt, Homo sapiens
gcagcuggagau

SEQ ID NO: 1368157 - RNA, 16 nt, Homo sapiens
gcaggggccuggagau

SEQ ID NO: 1368158 - RNA, 21 nt, Homo sapiens
gcagugagccgagaucgugcc

SEQ ID NO: 1368159 - RNA, 21 nt, Homo sapiens
gcauaggucucuuugcuuucu

SEQ ID NO: 1368160 - RNA, 21 nt, Homo sapiens
gcaucaccuuaggcagggaag

SEQ ID NO: 1368161 - RNA, 16 nt, Homo sapiens
gcauccuaugcuuaau

SEQ ID NO: 1368162 - RNA, 13 nt, Homo sapiens
gcaugauagacac

SEQ ID NO: 1368163 - RNA, 23 nt, Homo sapiens
gcaugaugcgggccagugcucca

SEQ ID NO: 1368164 - RNA, 20 nt, Homo sapiens
gcauuccagccccucugguc

SEQ ID NO: 1368165 - RNA, 14 nt, Homo sapiens
gcauugcagucaua

SEQ ID NO: 1368166 - RNA, 14 nt, Homo sapiens
gcauuuaacugccu

SEQ ID NO: 1368167 - RNA, 19 nt, Homo sapiens
gcauuugucuguguuugaa

SEQ ID NO: 1368168 - RNA, 21 nt, Homo sapiens
gcauuuuccagcacuuugcaa

SEQ ID NO: 1368169 - RNA, 13 nt, Homo sapiens
gccaaaagccuuu

SEQ ID NO: 1368170 - RNA, 13 nt, Homo sapiens
gccaaaauaccag

SEQ ID NO: 1368171 - RNA, 20 nt, Homo sapiens
gccaacaaagaacacuaacu

SEQ ID NO: 1368172 - RNA, 13 nt, Homo sapiens
gccaacccuuuca

SEQ ID NO: 1368173 - RNA, 21 nt, Homo sapiens
gccaaggagggcagaucacuu

SEQ ID NO: 1368174 - RNA, 17 nt, Homo sapiens
gccagaacaagugcugg

SEQ ID NO: 1368175 - RNA, 19 nt, Homo sapiens
gccagcuuaucucaggggu

SEQ ID NO: 1368176 - RNA, 14 nt, Homo sapiens
gccaggagugggcu

SEQ ID NO: 1368177 - RNA, 13 nt, Homo sapiens
gccagggcaccua

SEQ ID NO: 1368178 - RNA, 14 nt, Homo sapiens
gccagggcaccuac

SEQ ID NO: 1368179 - RNA, 20 nt, Homo sapiens
gccaguauaagcauuuccaa

SEQ ID NO: 1368180 - RNA, 19 nt, Homo sapiens
gccaguccugccuggccag

SEQ ID NO: 1368181 - RNA, 11 nt, Homo sapiens
gccagugacag

SEQ ID NO: 1368182 - RNA, 16 nt, Homo sapiens
gcccaaggugcugaug

SEQ ID NO: 1368183 - RNA, 19 nt, Homo sapiens
gcccacuguccugggccug

SEQ ID NO: 1368184 - RNA, 15 nt, Homo sapiens
gcccacuucacugcu

SEQ ID NO: 1368185 - RNA, 20 nt, Homo sapiens
gcccagagaagccaaaagau

SEQ ID NO: 1368186 - RNA, 23 nt, Homo sapiens
gcccagcuccaaggggaaucaga

SEQ ID NO: 1368187 - RNA, 21 nt, Homo sapiens
gcccaggaguuugaauccauc

SEQ ID NO: 1368188 - RNA, 11 nt, Homo sapiens
gcccagugcau

SEQ ID NO: 1368189 - RNA, 15 nt, Homo sapiens
gcccaguguguuucu

SEQ ID NO: 1368190 - RNA, 14 nt, Homo sapiens
gcccaugagucagg

SEQ ID NO: 1368191 - RNA, 13 nt, Homo sapiens
gccccucuuccaa

SEQ ID NO: 1368192 - RNA, 13 nt, Homo sapiens
gcccuaggugaga

SEQ ID NO: 1368193 - RNA, 14 nt, Homo sapiens
gcccuccgccauuc

SEQ ID NO: 1368194 - RNA, 15 nt, Homo sapiens
gcccugcagccagcu

SEQ ID NO: 1368195 - RNA, 22 nt, Homo sapiens
gcccuuacaguauuguuaccac

SEQ ID NO: 1368196 - RNA, 15 nt, Homo sapiens
gccgagagcauugga

SEQ ID NO: 1368197 - RNA, 23 nt, Homo sapiens
gccgccucaagggucuucagggg

SEQ ID NO: 1368198 - RNA, 18 nt, Homo sapiens
gccgcggacgcaccuggg

SEQ ID NO: 1368199 - RNA, 21 nt, Homo sapiens
gccguacucuuuggggcagcu

SEQ ID NO: 1368200 - RNA, 13 nt, Homo sapiens
gccgucugugcuu

SEQ ID NO: 1368201 - RNA, 22 nt, Homo sapiens
gccucacucuggccacagguga

SEQ ID NO: 1368202 - RNA, 15 nt, Homo sapiens
gccucagccagagaa

SEQ ID NO: 1368203 - RNA, 17 nt, Homo sapiens
gccuccaauugcagugg

SEQ ID NO: 1368204 - RNA, 21 nt, Homo sapiens
gccuccccaccacugagccau

SEQ ID NO: 1368205 - RNA, 16 nt, Homo sapiens
gccucccugagcacug

SEQ ID NO: 1368206 - RNA, 18 nt, Homo sapiens
gccuccugcucugugaag

SEQ ID NO: 1368207 - RNA, 19 nt, Homo sapiens
gccucgcauccuaugcuua

SEQ ID NO: 1368208 - RNA, 14 nt, Homo sapiens
gccucuacuuuauc

SEQ ID NO: 1368209 - RNA, 14 nt, Homo sapiens
gccucuacuuugau

SEQ ID NO: 1368210 - RNA, 20 nt, Homo sapiens
gccucuacuuugauucugau

SEQ ID NO: 1368211 - RNA, 17 nt, Homo sapiens
gccucugccuuugcacc

SEQ ID NO: 1368212 - RNA, 13 nt, Homo sapiens
gccugacaaccac

SEQ ID NO: 1368213 - RNA, 13 nt, Homo sapiens
gccuggacugcua

SEQ ID NO: 1368214 - RNA, 15 nt, Homo sapiens
gccuggacuuuccug

SEQ ID NO: 1368215 - RNA, 17 nt, Homo sapiens
gccuggggucugacaau

SEQ ID NO: 1368216 - RNA, 15 nt, Homo sapiens
gccuggggucuggag

SEQ ID NO: 1368217 - RNA, 20 nt, Homo sapiens
gccuguuugccgucugugac

SEQ ID NO: 1368218 - RNA, 17 nt, Homo sapiens
gccuuaagacauuugaa

SEQ ID NO: 1368219 - RNA, 14 nt, Homo sapiens
gccuuaucuugcac

SEQ ID NO: 1368220 - RNA, 16 nt, Homo sapiens
gccuucaagugccaaa

SEQ ID NO: 1368221 - RNA, 17 nt, Homo sapiens
gccuucaagugccaaac

SEQ ID NO: 1368222 - RNA, 22 nt, Homo sapiens
gccuugguaaaaacugcagugu

SEQ ID NO: 1368223 - RNA, 15 nt, Homo sapiens
gccuuucaguauuga

SEQ ID NO: 1368224 - RNA, 21 nt, Homo sapiens
gccuuugcccacguguccuga

SEQ ID NO: 1368225 - RNA, 14 nt, Homo sapiens
gccuuuuguguuuu

SEQ ID NO: 1368226 - RNA, 18 nt, Homo sapiens
gcgagcaugaacuggccc

SEQ ID NO: 1368227 - RNA, 17 nt, Homo sapiens
gcgcggcgagggcaaag

SEQ ID NO: 1368228 - RNA, 17 nt, Homo sapiens
gcggaaagcccugugcu

SEQ ID NO: 1368229 - RNA, 14 nt, Homo sapiens
gcggagcuuuccac

SEQ ID NO: 1368230 - RNA, 14 nt, Homo sapiens
gcgguugaggagaa

SEQ ID NO: 1368231 - RNA, 18 nt, Homo sapiens
gcgguugaggagaauugc

SEQ ID NO: 1368232 - RNA, 19 nt, Homo sapiens
gcgugaccagcaguacuca

SEQ ID NO: 1368233 - RNA, 20 nt, Homo sapiens
gcgugcuugcaugugcugca

SEQ ID NO: 1368234 - RNA, 19 nt, Homo sapiens
gcuacacagaucacagcuu

SEQ ID NO: 1368235 - RNA, 15 nt, Homo sapiens
gcuaccuacugauaa

SEQ ID NO: 1368236 - RNA, 22 nt, Homo sapiens
gcuagacaguucuuuguuugga

SEQ ID NO: 1368237 - RNA, 22 nt, Homo sapiens
gcucagcuucuccugugugauu

SEQ ID NO: 1368238 - RNA, 19 nt, Homo sapiens
gcucaggacagaugccaca

SEQ ID NO: 1368239 - RNA, 20 nt, Homo sapiens
gcucaggguggucucuucuu

SEQ ID NO: 1368240 - RNA, 16 nt, Homo sapiens
gcuccaaccugcaaag

SEQ ID NO: 1368241 - RNA, 22 nt, Homo sapiens
gcuccacuuucagugaaagcau

SEQ ID NO: 1368242 - RNA, 21 nt, Homo sapiens
gcuccagcugcucugucuucu

SEQ ID NO: 1368243 - RNA, 22 nt, Homo sapiens
gcuccaggaucuuugacugaaa

SEQ ID NO: 1368244 - RNA, 22 nt, Homo sapiens
gcuccaucccaaccaggcaccu

SEQ ID NO: 1368245 - RNA, 21 nt, Homo sapiens
gcuccauggcugccaucucac

SEQ ID NO: 1368246 - RNA, 20 nt, Homo sapiens
gcuccucuccccagcccaga

SEQ ID NO: 1368247 - RNA, 21 nt, Homo sapiens
gcucuuagcagcuuccagauu

SEQ ID NO: 1368248 - RNA, 16 nt, Homo sapiens
gcucuuucucugccag

SEQ ID NO: 1368249 - RNA, 22 nt, Homo sapiens
gcucuuucucugccagugacag

SEQ ID NO: 1368250 - RNA, 15 nt, Homo sapiens
gcugaccuccacagc

SEQ ID NO: 1368251 - RNA, 18 nt, Homo sapiens
gcugacuagaagggccag

SEQ ID NO: 1368252 - RNA, 15 nt, Homo sapiens
gcugagagaaccuca

SEQ ID NO: 1368253 - RNA, 16 nt, Homo sapiens
gcugaggugugcgguu

SEQ ID NO: 1368254 - RNA, 13 nt, Homo sapiens
gcugagugcugaa

SEQ ID NO: 1368255 - RNA, 15 nt, Homo sapiens
gcugccucacuuccu

SEQ ID NO: 1368256 - RNA, 17 nt, Homo sapiens
gcuggagagcacugcca

SEQ ID NO: 1368257 - RNA, 23 nt, Homo sapiens
gcuggagugcaguaaguggcaca

SEQ ID NO: 1368258 - RNA, 17 nt, Homo sapiens
gcuggccccaaaggaaa

SEQ ID NO: 1368259 - RNA, 18 nt, Homo sapiens
gcuggcccugcagguggu

SEQ ID NO: 1368260 - RNA, 21 nt, Homo sapiens
gcuggccuccuaugccucauc

SEQ ID NO: 1368261 - RNA, 21 nt, Homo sapiens
gcugggauguuucugucacau

SEQ ID NO: 1368262 - RNA, 18 nt, Homo sapiens
gcugggcagaaggccaag

SEQ ID NO: 1368263 - RNA, 15 nt, Homo sapiens
gcuggguccagggga

SEQ ID NO: 1368264 - RNA, 17 nt, Homo sapiens
gcugguugagguuucaa

SEQ ID NO: 1368265 - RNA, 13 nt, Homo sapiens
gcugucaucucag

SEQ ID NO: 1368266 - RNA, 16 nt, Homo sapiens
gcuguugaagauuuga

SEQ ID NO: 1368267 - RNA, 22 nt, Homo sapiens
gcuguuuuccucccuucugcua

SEQ ID NO: 1368268 - RNA, 19 nt, Homo sapiens
gcuuagaaugcaucucauc

SEQ ID NO: 1368269 - RNA, 18 nt, Homo sapiens
gcuuaucuuagaagcacu

SEQ ID NO: 1368270 - RNA, 13 nt, Homo sapiens
gcuuaugaauaua

SEQ ID NO: 1368271 - RNA, 23 nt, Homo sapiens
gcuuccccuuuugccaaucucaa

SEQ ID NO: 1368272 - RNA, 22 nt, Homo sapiens
gcuucuccugugugauugacag

SEQ ID NO: 1368273 - RNA, 13 nt, Homo sapiens
gcuuggaaaggac

SEQ ID NO: 1368274 - RNA, 17 nt, Homo sapiens
gcuuggaaaggaccagu

SEQ ID NO: 1368275 - RNA, 17 nt, Homo sapiens
gcuugggaaagguggug

SEQ ID NO: 1368276 - RNA, 14 nt, Homo sapiens
gcuuguguuuuuaa

SEQ ID NO: 1368277 - RNA, 15 nt, Homo sapiens
gcuuucccacuuccc

SEQ ID NO: 1368278 - RNA, 19 nt, Homo sapiens
gcuuugaaaacaugacuca

SEQ ID NO: 1368279 - RNA, 15 nt, Homo sapiens
gcuuugaaaauucag

SEQ ID NO: 1368280 - RNA, 19 nt, Homo sapiens
ggaaaaaauaaaagaucuu

SEQ ID NO: 1368281 - RNA, 16 nt, Homo sapiens
ggaaaagauacccaaa

SEQ ID NO: 1368282 - RNA, 18 nt, Homo sapiens
ggaaaaggcuuacuugcc

SEQ ID NO: 1368283 - RNA, 16 nt, Homo sapiens
ggaaacccagcucaca

SEQ ID NO: 1368284 - RNA, 16 nt, Homo sapiens
agagugacacccaaga

SEQ ID NO: 1368285 - RNA, 22 nt, Homo sapiens
agagugguuaagacuacugaag

SEQ ID NO: 1368286 - RNA, 17 nt, Homo sapiens
agaguguagacuguggc

SEQ ID NO: 1368287 - RNA, 13 nt, Homo sapiens
agauaacuaggaa

SEQ ID NO: 1368288 - RNA, 15 nt, Homo sapiens
agauaucagugucuc

SEQ ID NO: 1368289 - RNA, 19 nt, Homo sapiens
agaucgugccauugcacuc

SEQ ID NO: 1368290 - RNA, 21 nt, Homo sapiens
agaucgugccauugcacucca

SEQ ID NO: 1368291 - RNA, 17 nt, Homo sapiens
agaucucgguuugccaa

SEQ ID NO: 1368292 - RNA, 18 nt, Homo sapiens
agaucuggucccuugcag

SEQ ID NO: 1368293 - RNA, 13 nt, Homo sapiens
agaucuugaauag

SEQ ID NO: 1368294 - RNA, 23 nt, Homo sapiens
agaucuuucaggacucuaccuca

SEQ ID NO: 1368295 - RNA, 21 nt, Homo sapiens
agaucuuuucuugaccuagua

SEQ ID NO: 1368296 - RNA, 19 nt, Homo sapiens
agaugcaaggaccaggacu

SEQ ID NO: 1368297 - RNA, 18 nt, Homo sapiens
agaugccccagagcuguu

SEQ ID NO: 1368298 - RNA, 14 nt, Homo sapiens
agaugcuggcccag

SEQ ID NO: 1368299 - RNA, 22 nt, Homo sapiens
agauggaaaaacugaggcuuag

SEQ ID NO: 1368300 - RNA, 17 nt, Homo sapiens
agaugggagccuuuacc

SEQ ID NO: 1368301 - RNA, 22 nt, Homo sapiens
agauguaauguuuucuuugcaa

SEQ ID NO: 1368302 - RNA, 22 nt, Homo sapiens
agauguauuuguuguagacuua

SEQ ID NO: 1368303 - RNA, 12 nt, Homo sapiens
agauguccucag

SEQ ID NO: 1368304 - RNA, 19 nt, Homo sapiens
agauguccuugaugcucau

SEQ ID NO: 1368305 - RNA, 22 nt, Homo sapiens
agauguccuuguaauauucccu

SEQ ID NO: 1368306 - RNA, 18 nt, Homo sapiens
agauuucucugagaucau

SEQ ID NO: 1368307 - RNA, 13 nt, Homo sapiens
agcaaaacauaaa

SEQ ID NO: 1368308 - RNA, 22 nt, Homo sapiens
agcaaacugaauggcaaugaaa

SEQ ID NO: 1368309 - RNA, 16 nt, Homo sapiens
agcaaauuuucagcau

SEQ ID NO: 1368310 - RNA, 23 nt, Homo sapiens
agcaacuuguguuacaaaaauac

SEQ ID NO: 1368311 - RNA, 18 nt, Homo sapiens
agcaagaucccaucucuu

SEQ ID NO: 1368312 - RNA, 21 nt, Homo sapiens
agcaaggguugggcccagugu

SEQ ID NO: 1368313 - RNA, 14 nt, Homo sapiens
agcaaugguguugu

SEQ ID NO: 1368314 - RNA, 19 nt, Homo sapiens
agcacagcuugaccugagg

SEQ ID NO: 1368315 - RNA, 16 nt, Homo sapiens
agcaccauaacuuugu

SEQ ID NO: 1368316 - RNA, 16 nt, Homo sapiens
agcacuugucucagga

SEQ ID NO: 1368317 - RNA, 22 nt, Homo sapiens
agcagaaaucuagaagacuguc

SEQ ID NO: 1368318 - RNA, 15 nt, Homo sapiens
agcagaaggugugcu

SEQ ID NO: 1368319 - RNA, 22 nt, Homo sapiens
agcagcucaaaggcacagugaa

SEQ ID NO: 1368320 - RNA, 18 nt, Homo sapiens
agcagggauuaaccucug

SEQ ID NO: 1368321 - RNA, 15 nt, Homo sapiens
agcagucgugccugu

SEQ ID NO: 1368322 - RNA, 13 nt, Homo sapiens
agcagugagcacu

SEQ ID NO: 1368323 - RNA, 12 nt, Homo sapiens
agcauacuuugu

SEQ ID NO: 1368324 - RNA, 21 nt, Homo sapiens
agcaucucuggccuguaccca

SEQ ID NO: 1368325 - RNA, 16 nt, Homo sapiens
agccacugacuugcuc

SEQ ID NO: 1368326 - RNA, 21 nt, Homo sapiens
agccacugcauaccaaccugg

SEQ ID NO: 1368327 - RNA, 19 nt, Homo sapiens
agccagccaacccuuucau

SEQ ID NO: 1368328 - RNA, 19 nt, Homo sapiens
agcccaccccucaacaccu

SEQ ID NO: 1368329 - RNA, 17 nt, Homo sapiens
agcccacccugcugcug

SEQ ID NO: 1368330 - RNA, 11 nt, Homo sapiens
agcccagagac

SEQ ID NO: 1368331 - RNA, 14 nt, Homo sapiens
agcccggacugacc

SEQ ID NO: 1368332 - RNA, 15 nt, Homo sapiens
agcccucccuaccua

SEQ ID NO: 1368333 - RNA, 18 nt, Homo sapiens
agcccucccuaccuacca

SEQ ID NO: 1368334 - RNA, 19 nt, Homo sapiens
agcccuccgccauucucaa

SEQ ID NO: 1368335 - RNA, 15 nt, Homo sapiens
agcccugaggugaaa

SEQ ID NO: 1368336 - RNA, 18 nt, Homo sapiens
agcccugcagucacagcu

SEQ ID NO: 1368337 - RNA, 12 nt, Homo sapiens
agcccuguaaca

SEQ ID NO: 1368338 - RNA, 20 nt, Homo sapiens
agccgagauugcaccacugc

SEQ ID NO: 1368339 - RNA, 21 nt, Homo sapiens
agccucaccauacccuguuga

SEQ ID NO: 1368340 - RNA, 14 nt, Homo sapiens
agccucacuccuca

SEQ ID NO: 1368341 - RNA, 19 nt, Homo sapiens
agccuccugcucugugaag

SEQ ID NO: 1368342 - RNA, 16 nt, Homo sapiens
agccucuggcuagagg

SEQ ID NO: 1368343 - RNA, 19 nt, Homo sapiens
agccucuucugucccaagu

SEQ ID NO: 1368344 - RNA, 12 nt, Homo sapiens
agccugccuuuc

SEQ ID NO: 1368345 - RNA, 14 nt, Homo sapiens
agccuggccagaca

SEQ ID NO: 1368346 - RNA, 23 nt, Homo sapiens
agccuguggcaucuuugccuugg

SEQ ID NO: 1368347 - RNA, 15 nt, Homo sapiens
agccuguuacaggaa

SEQ ID NO: 1368348 - RNA, 18 nt, Homo sapiens
agccuucugugcugugag

SEQ ID NO: 1368349 - RNA, 21 nt, Homo sapiens
agcgaucucuccacugugcuu

SEQ ID NO: 1368350 - RNA, 22 nt, Homo sapiens
agcgccuccccaccacugagcc

SEQ ID NO: 1368351 - RNA, 22 nt, Homo sapiens
agcgccuuucccaacucuagcu

SEQ ID NO: 1368352 - RNA, 20 nt, Homo sapiens
agcguuaccgccacacuuga

SEQ ID NO: 1368353 - RNA, 21 nt, Homo sapiens
agcguuaccgccacacuugaa

SEQ ID NO: 1368354 - RNA, 22 nt, Homo sapiens
agcuaaauuuucugaaacugca

SEQ ID NO: 1368355 - RNA, 15 nt, Homo sapiens
agcuaacaaguagca

SEQ ID NO: 1368356 - RNA, 21 nt, Homo sapiens
agcuaacaaguagcacacuga

SEQ ID NO: 1368357 - RNA, 13 nt, Homo sapiens
agcuaacagugaa

SEQ ID NO: 1368358 - RNA, 18 nt, Homo sapiens
agcuaaggaggggaaaaa

SEQ ID NO: 1368359 - RNA, 14 nt, Homo sapiens
agcuccacugccau

SEQ ID NO: 1368360 - RNA, 21 nt, Homo sapiens
agcucuguauggucaggaugu

SEQ ID NO: 1368361 - RNA, 17 nt, Homo sapiens
agcucuucaggccuccc

SEQ ID NO: 1368362 - RNA, 18 nt, Homo sapiens
agcugacauauacugggu

SEQ ID NO: 1368363 - RNA, 18 nt, Homo sapiens
agcugacuguucuuggua

SEQ ID NO: 1368364 - RNA, 19 nt, Homo sapiens
agcugacuuuuaacuacaa

SEQ ID NO: 1368365 - RNA, 20 nt, Homo sapiens
agcugagucucccuaaggca

SEQ ID NO: 1368366 - RNA, 17 nt, Homo sapiens
agcugagugcugaaaua

SEQ ID NO: 1368367 - RNA, 14 nt, Homo sapiens
agcugcuccgugcu

SEQ ID NO: 1368368 - RNA, 16 nt, Homo sapiens
agcugggcagaccccu

SEQ ID NO: 1368369 - RNA, 15 nt, Homo sapiens
aguugauucagcucu

SEQ ID NO: 1368370 - RNA, 21 nt, Homo sapiens
aguugcaaauuuuagcguuaa

SEQ ID NO: 1368371 - RNA, 14 nt, Homo sapiens
aguugcugucaucc

SEQ ID NO: 1368372 - RNA, 16 nt, Homo sapiens
aguugggggcugucca

SEQ ID NO: 1368373 - RNA, 13 nt, Homo sapiens
aguuucacuggcu

SEQ ID NO: 1368374 - RNA, 19 nt, Homo sapiens
aguuugagaccaaccuggg

SEQ ID NO: 1368375 - RNA, 19 nt, Homo sapiens
aguuuuaguuuucucuuag

SEQ ID NO: 1368376 - RNA, 21 nt, Homo sapiens
aguuuuccgagaggaccaucu

SEQ ID NO: 1368377 - RNA, 19 nt, Homo sapiens
aguuuuccuacacuugaga

SEQ ID NO: 1368378 - RNA, 14 nt, Homo sapiens
auaaaaaacauaau

SEQ ID NO: 1368379 - RNA, 22 nt, Homo sapiens
auaaaacguuaguuaaucccuu

SEQ ID NO: 1368380 - RNA, 13 nt, Homo sapiens
auaaagucuugcc

SEQ ID NO: 1368381 - RNA, 14 nt, Homo sapiens
auaacaaagcccuu

SEQ ID NO: 1368382 - RNA, 15 nt, Homo sapiens
auaacaaagcccuua

SEQ ID NO: 1368383 - RNA, 18 nt, Homo sapiens
auaacauuuaaauuccac

SEQ ID NO: 1368384 - RNA, 19 nt, Homo sapiens
auaacauuuaaauuccaca

SEQ ID NO: 1368385 - RNA, 21 nt, Homo sapiens
auaacauuuaaauuccacaga

SEQ ID NO: 1368386 - RNA, 23 nt, Homo sapiens
auaacauuuaaauuccacagauu

SEQ ID NO: 1368387 - RNA, 22 nt, Homo sapiens
auaacuaggaaauccauucaca

SEQ ID NO: 1368388 - RNA, 19 nt, Homo sapiens
auaagguaaaaugccauga

SEQ ID NO: 1368389 - RNA, 18 nt, Homo sapiens
auaauaaaugcccucuuc

SEQ ID NO: 1368390 - RNA, 18 nt, Homo sapiens
auaauccaaauccaucaa

SEQ ID NO: 1368391 - RNA, 11 nt, Homo sapiens
auaaugcucac

SEQ ID NO: 1368392 - RNA, 21 nt, Homo sapiens
auacaccuacugguuaaauaa

SEQ ID NO: 1368393 - RNA, 16 nt, Homo sapiens
auacagaauuacugua

SEQ ID NO: 1368394 - RNA, 18 nt, Homo sapiens
auacaguacaggcagcac

SEQ ID NO: 1368395 - RNA, 13 nt, Homo sapiens
auacauauguuaa

SEQ ID NO: 1368396 - RNA, 13 nt, Homo sapiens
auacccguugaua

SEQ ID NO: 1368397 - RNA, 20 nt, Homo sapiens
auacgcaucagacagaugga

SEQ ID NO: 1368398 - RNA, 21 nt, Homo sapiens
auacugacuccagguguaguu

SEQ ID NO: 1368399 - RNA, 16 nt, Homo sapiens
auacuuaagaauacac

SEQ ID NO: 1368400 - RNA, 15 nt, Homo sapiens
auagacaauuugcac

SEQ ID NO: 1368401 - RNA, 15 nt, Homo sapiens
auagacccgaggaaa

SEQ ID NO: 1368402 - RNA, 15 nt, Homo sapiens
auagagccacguaug

SEQ ID NO: 1368403 - RNA, 15 nt, Homo sapiens
auagagugcauuuga

SEQ ID NO: 1368404 - RNA, 21 nt, Homo sapiens
auagaucguagauguuguaga

SEQ ID NO: 1368405 - RNA, 15 nt, Homo sapiens
auagcaagaucccau

SEQ ID NO: 1368406 - RNA, 15 nt, Homo sapiens
auaggugugugagac

SEQ ID NO: 1368407 - RNA, 15 nt, Homo sapiens
auaguauugugcaua

SEQ ID NO: 1368408 - RNA, 14 nt, Homo sapiens
auagucuuugccag

SEQ ID NO: 1368409 - RNA, 18 nt, Homo sapiens
auagucuuuugccagaga

SEQ ID NO: 1368410 - RNA, 15 nt, Homo sapiens
auaguugcugucauc

SEQ ID NO: 1368411 - RNA, 15 nt, Homo sapiens
auauaaacacuauau

SEQ ID NO: 1368412 - RNA, 14 nt, Homo sapiens
auauaauuuauuga

SEQ ID NO: 1368413 - RNA, 22 nt, Homo sapiens
auauacugcuugucaucugcau

SEQ ID NO: 1368414 - RNA, 19 nt, Homo sapiens
auauacuuaagaauacaca

SEQ ID NO: 1368415 - RNA, 16 nt, Homo sapiens
auauaggaaaacaaua

SEQ ID NO: 1368416 - RNA, 14 nt, Homo sapiens
auauauaacauaua

SEQ ID NO: 1368417 - RNA, 17 nt, Homo sapiens
auauauuccaccaggau

SEQ ID NO: 1368418 - RNA, 13 nt, Homo sapiens
auaucagugacag

SEQ ID NO: 1368419 - RNA, 20 nt, Homo sapiens
auaucaguuuuuacuuucuc

SEQ ID NO: 1368420 - RNA, 17 nt, Homo sapiens
auauccaacaugugcuc

SEQ ID NO: 1368421 - RNA, 22 nt, Homo sapiens
auaucgcuggccagcauuauaa

SEQ ID NO: 1368422 - RNA, 11 nt, Homo sapiens
auaucuuggcc

SEQ ID NO: 1368423 - RNA, 20 nt, Homo sapiens
auaugaaauaaaauuacaca

SEQ ID NO: 1368424 - RNA, 18 nt, Homo sapiens
auaugcuaauauauguau

SEQ ID NO: 1368425 - RNA, 16 nt, Homo sapiens
auauggcagugucuuu

SEQ ID NO: 1368426 - RNA, 23 nt, Homo sapiens
auauguuucucccccuuuccaaa

SEQ ID NO: 1368427 - RNA, 19 nt, Homo sapiens
auauucaguauuguagaua

SEQ ID NO: 1368428 - RNA, 14 nt, Homo sapiens
auauuccaccagga

SEQ ID NO: 1368429 - RNA, 13 nt, Homo sapiens
auauugugcaaac

SEQ ID NO: 1368430 - RNA, 16 nt, Homo sapiens
auauuucaagugccua

SEQ ID NO: 1368431 - RNA, 14 nt, Homo sapiens
auauuuuauuuccu

SEQ ID NO: 1368432 - RNA, 23 nt, Homo sapiens
aucaaccccccgacugugcugcu

SEQ ID NO: 1368433 - RNA, 23 nt, Homo sapiens
aucaagacugcaaacccuuucau

SEQ ID NO: 1368434 - RNA, 14 nt, Homo sapiens
aucaagcuuaguga

SEQ ID NO: 1368435 - RNA, 18 nt, Homo sapiens
aucaaucaagacugcaaa

SEQ ID NO: 1368436 - RNA, 18 nt, Homo sapiens
aucacgagaucaagagau

SEQ ID NO: 1368437 - RNA, 14 nt, Homo sapiens
aucacugugaaaau

SEQ ID NO: 1368438 - RNA, 15 nt, Homo sapiens
aucacuucaggucag

SEQ ID NO: 1368439 - RNA, 18 nt, Homo sapiens
aucagaggaaaagggcaa

SEQ ID NO: 1368440 - RNA, 17 nt, Homo sapiens
aucauugugacgugugu

SEQ ID NO: 1368441 - RNA, 17 nt, Homo sapiens
auccaacaugugcucag

SEQ ID NO: 1368442 - RNA, 16 nt, Homo sapiens
auccaggcagauccag

SEQ ID NO: 1368443 - RNA, 12 nt, Homo sapiens
auccagugacaa

SEQ ID NO: 1368444 - RNA, 19 nt, Homo sapiens
auccauauagaaaucuaga

SEQ ID NO: 1368445 - RNA, 20 nt, Homo sapiens
auccaucugggcuaccccac

SEQ ID NO: 1368446 - RNA, 23 nt, Homo sapiens
aucccuuugucugucaaucacag

SEQ ID NO: 1368447 - RNA, 14 nt, Homo sapiens
auccgcgugugccu

SEQ ID NO: 1368448 - RNA, 16 nt, Homo sapiens
auccgcgugugccugu

SEQ ID NO: 1368449 - RNA, 23 nt, Homo sapiens
auccuaagacuaacaaaggcagc

SEQ ID NO: 1368450 - RNA, 13 nt, Homo sapiens
auccuccaacagc

SEQ ID NO: 1368451 - RNA, 22 nt, Homo sapiens
auccuggguggucugcaggcag

SEQ ID NO: 1368452 - RNA, 20 nt, Homo sapiens
auuaucaaaugaauaaaucc

SEQ ID NO: 1368453 - RNA, 16 nt, Homo sapiens
auuauccuucuacuug

SEQ ID NO: 1368454 - RNA, 14 nt, Homo sapiens
auuaugcuaccuac

SEQ ID NO: 1368455 - RNA, 18 nt, Homo sapiens
auuauuuuuucugugguc

SEQ ID NO: 1368456 - RNA, 17 nt, Homo sapiens
auucacaaaauuuccac

SEQ ID NO: 1368457 - RNA, 23 nt, Homo sapiens
auucaugaagcggucacagauca

SEQ ID NO: 1368458 - RNA, 15 nt, Homo sapiens
auucaugacuaugga

SEQ ID NO: 1368459 - RNA, 13 nt, Homo sapiens
auucaugcacugu

SEQ ID NO: 1368460 - RNA, 17 nt, Homo sapiens
auucauuuucugccuau

SEQ ID NO: 1368461 - RNA, 14 nt, Homo sapiens
auuccacagauuau

SEQ ID NO: 1368462 - RNA, 16 nt, Homo sapiens
auuccccacccugaaa

SEQ ID NO: 1368463 - RNA, 15 nt, Homo sapiens
auucccuugaucuca

SEQ ID NO: 1368464 - RNA, 18 nt, Homo sapiens
auuccuuagauaccuuga

SEQ ID NO: 1368465 - RNA, 17 nt, Homo sapiens
auucgcugugucagcau

SEQ ID NO: 1368466 - RNA, 14 nt, Homo sapiens
auucggagugucug

SEQ ID NO: 1368467 - RNA, 13 nt, Homo sapiens
auucuucuuccaa

SEQ ID NO: 1368468 - RNA, 20 nt, Homo sapiens
auucuuuugaauuguuacau

SEQ ID NO: 1368469 - RNA, 12 nt, Homo sapiens
auugaaaacacu

SEQ ID NO: 1368470 - RNA, 17 nt, Homo sapiens
auugacaaaaaccagca

SEQ ID NO: 1368471 - RNA, 18 nt, Homo sapiens
auugacucuguggcuuug

SEQ ID NO: 1368472 - RNA, 15 nt, Homo sapiens
auugccaucauucua

SEQ ID NO: 1368473 - RNA, 15 nt, Homo sapiens
auugcuuugccaaaa

SEQ ID NO: 1368474 - RNA, 15 nt, Homo sapiens
auuguacaguuuaaa

SEQ ID NO: 1368475 - RNA, 15 nt, Homo sapiens
auuguacuaaagcca

SEQ ID NO: 1368476 - RNA, 13 nt, Homo sapiens
auuguuucauuca

SEQ ID NO: 1368477 - RNA, 21 nt, Homo sapiens
auuuaaaauggaaagcugugu

SEQ ID NO: 1368478 - RNA, 23 nt, Homo sapiens
auuuaaauuacaauuuuaucugu

SEQ ID NO: 1368479 - RNA, 17 nt, Homo sapiens
auuuaaauuccacagau

SEQ ID NO: 1368480 - RNA, 22 nt, Homo sapiens
auuuaaccccacacagcacuuc

SEQ ID NO: 1368481 - RNA, 17 nt, Homo sapiens
auuuaaguucaagagaa

SEQ ID NO: 1368482 - RNA, 13 nt, Homo sapiens
auuuaaucugcug

SEQ ID NO: 1368483 - RNA, 18 nt, Homo sapiens
auuuagaccccauacaag

SEQ ID NO: 1368484 - RNA, 19 nt, Homo sapiens
auuuaggagaagccaggaa

SEQ ID NO: 1368485 - RNA, 20 nt, Homo sapiens
auuuaguuuuuaacaaucua

SEQ ID NO: 1368486 - RNA, 22 nt, Homo sapiens
auuuauacuuugcaauccaaau

SEQ ID NO: 1368487 - RNA, 20 nt, Homo sapiens
auuuauuuacaacucaaaaa

SEQ ID NO: 1368488 - RNA, 21 nt, Homo sapiens
cuuauuuuaauuccacuuuaa

SEQ ID NO: 1368489 - RNA, 20 nt, Homo sapiens
cuucaaaaacgcacugcaag

SEQ ID NO: 1368490 - RNA, 18 nt, Homo sapiens
cuucaaagcaagcuggua

SEQ ID NO: 1368491 - RNA, 13 nt, Homo sapiens
cuucaagugccaa

SEQ ID NO: 1368492 - RNA, 15 nt, Homo sapiens
cuucaagugccaaac

SEQ ID NO: 1368493 - RNA, 17 nt, Homo sapiens
cuucacucaaucucuga

SEQ ID NO: 1368494 - RNA, 19 nt, Homo sapiens
cuucacucuucaaaugccu

SEQ ID NO: 1368495 - RNA, 14 nt, Homo sapiens
cuucagugcugcuc

SEQ ID NO: 1368496 - RNA, 20 nt, Homo sapiens
cuucauaauuucuucacuca

SEQ ID NO: 1368497 - RNA, 20 nt, Homo sapiens
cuucauucuccuuguuguug

SEQ ID NO: 1368498 - RNA, 21 nt, Homo sapiens
cuuccaacucaaacucuuaaa

SEQ ID NO: 1368499 - RNA, 16 nt, Homo sapiens
cuuccacuucaggguu

SEQ ID NO: 1368500 - RNA, 14 nt, Homo sapiens
cuuccagaaaacaa

SEQ ID NO: 1368501 - RNA, 18 nt, Homo sapiens
cuuccagauugacgacaa

SEQ ID NO: 1368502 - RNA, 12 nt, Homo sapiens
cuuccagugcag

SEQ ID NO: 1368503 - RNA, 23 nt, Homo sapiens
cuuccaucucagcacucuguggg

SEQ ID NO: 1368504 - RNA, 17 nt, Homo sapiens
cuuccccaaugcuccau

SEQ ID NO: 1368505 - RNA, 23 nt, Homo sapiens
cuuccguggucagagugccacug

SEQ ID NO: 1368506 - RNA, 12 nt, Homo sapiens
cuuccuagguca

SEQ ID NO: 1368507 - RNA, 14 nt, Homo sapiens
cuuccucugugcca

SEQ ID NO: 1368508 - RNA, 17 nt, Homo sapiens
cuuccugaguggugcca

SEQ ID NO: 1368509 - RNA, 23 nt, Homo sapiens
cuuccugguugagcuucugcuaa

SEQ ID NO: 1368510 - RNA, 19 nt, Homo sapiens
cuuccuugaagaacugcag

SEQ ID NO: 1368511 - RNA, 22 nt, Homo sapiens
cuucuaggauagcuaacuguaa

SEQ ID NO: 1368512 - RNA, 23 nt, Homo sapiens
cuucucuucccugcgccugugau

SEQ ID NO: 1368513 - RNA, 10 nt, Homo sapiens
cuucugccau

SEQ ID NO: 1368514 - RNA, 11 nt, Homo sapiens
cuucuugccuc

SEQ ID NO: 1368515 - RNA, 13 nt, Homo sapiens
cuucuugcucccc

SEQ ID NO: 1368516 - RNA, 12 nt, Homo sapiens
cuucuuugccca

SEQ ID NO: 1368517 - RNA, 20 nt, Homo sapiens
cuucuuuuuuuuugagaugg

SEQ ID NO: 1368518 - RNA, 13 nt, Homo sapiens
cuugaacauuccc

SEQ ID NO: 1368519 - RNA, 18 nt, Homo sapiens
cuugaagacaauggcuua

SEQ ID NO: 1368520 - RNA, 17 nt, Homo sapiens
cuugaauguaguauuca

SEQ ID NO: 1368521 - RNA, 19 nt, Homo sapiens
cuugaauuucuccgaaugu

SEQ ID NO: 1368522 - RNA, 15 nt, Homo sapiens
cuugacagagucugu

SEQ ID NO: 1368523 - RNA, 13 nt, Homo sapiens
cuugacugcauua

SEQ ID NO: 1368524 - RNA, 22 nt, Homo sapiens
cuugagaggguggaauauccaa

SEQ ID NO: 1368525 - RNA, 13 nt, Homo sapiens
cuugagauuuugu

SEQ ID NO: 1368526 - RNA, 21 nt, Homo sapiens
cuugauggaagugggccaguc

SEQ ID NO: 1368527 - RNA, 16 nt, Homo sapiens
cuugcagaguacauga

SEQ ID NO: 1368528 - RNA, 12 nt, Homo sapiens
cuugccagagau

SEQ ID NO: 1368529 - RNA, 11 nt, Homo sapiens
cuugccucuuc

SEQ ID NO: 1368530 - RNA, 20 nt, Homo sapiens
cuugcugggugguucucugg

SEQ ID NO: 1368531 - RNA, 14 nt, Homo sapiens
cuuggaaaggacca

SEQ ID NO: 1368532 - RNA, 13 nt, Homo sapiens
cuuggacuaguga

SEQ ID NO: 1368533 - RNA, 21 nt, Homo sapiens
cuuggcaccagacacccagga

SEQ ID NO: 1368534 - RNA, 22 nt, Homo sapiens
cuuggcugcaggaaucuuuaaa

SEQ ID NO: 1368535 - RNA, 21 nt, Homo sapiens
cuugggaaaggugguguuucu

SEQ ID NO: 1368536 - RNA, 18 nt, Homo sapiens
cuugggguuuaaauaucc

SEQ ID NO: 1368537 - RNA, 14 nt, Homo sapiens
cuuguaaaagccua

SEQ ID NO: 1368538 - RNA, 14 nt, Homo sapiens
cuuguaaagacugu

SEQ ID NO: 1368539 - RNA, 15 nt, Homo sapiens
cuuguaaagacugua

SEQ ID NO: 1368540 - RNA, 16 nt, Homo sapiens
cuuguaaagacuguag

SEQ ID NO: 1368541 - RNA, 21 nt, Homo sapiens
cuuguaguuccauguacugua

SEQ ID NO: 1368542 - RNA, 19 nt, Homo sapiens
cuugucaagccugugcaaa

SEQ ID NO: 1368543 - RNA, 20 nt, Homo sapiens
cuugucucaggacucugaaa

SEQ ID NO: 1368544 - RNA, 19 nt, Homo sapiens
cuugugagcaagguggugu

SEQ ID NO: 1368545 - RNA, 20 nt, Homo sapiens
cuugugugauguuuuacaca

SEQ ID NO: 1368546 - RNA, 18 nt, Homo sapiens
cuuuaaaauguaaagcca

SEQ ID NO: 1368547 - RNA, 21 nt, Homo sapiens
cuuuaaagcaggauuucucaa

SEQ ID NO: 1368548 - RNA, 20 nt, Homo sapiens
cuuuaagccugcauucuuaa

SEQ ID NO: 1368549 - RNA, 17 nt, Homo sapiens
cuuuagaaacucaaaaa

SEQ ID NO: 1368550 - RNA, 20 nt, Homo sapiens
cuuucaagcuucuugccagu

SEQ ID NO: 1368551 - RNA, 12 nt, Homo sapiens
cuuucaccucag

SEQ ID NO: 1368552 - RNA, 14 nt, Homo sapiens
cuuucaggacucua

SEQ ID NO: 1368553 - RNA, 24 nt, Homo sapiens
cuuucaggccacauggcuaaagaa

SEQ ID NO: 1368554 - RNA, 17 nt, Homo sapiens
cuuucauaaagucuugc

SEQ ID NO: 1368555 - RNA, 16 nt, Homo sapiens
cuuucaucuuugugga

SEQ ID NO: 1368556 - RNA, 13 nt, Homo sapiens
cuuucccuugugu

SEQ ID NO: 1368557 - RNA, 13 nt, Homo sapiens
cuuuccucagugu

SEQ ID NO: 1368558 - RNA, 23 nt, Homo sapiens
cuuucuggaaguuucuggugcca

SEQ ID NO: 1368559 - RNA, 11 nt, Homo sapiens
cuuucuucccu

SEQ ID NO: 1368560 - RNA, 21 nt, Homo sapiens
cuuugacugaagccgugccug

SEQ ID NO: 1368561 - RNA, 20 nt, Homo sapiens
cuuugagcugagugcugaaa

SEQ ID NO: 1368562 - RNA, 17 nt, Homo sapiens
cuuugcagugcacuuug

SEQ ID NO: 1368563 - RNA, 20 nt, Homo sapiens
cuuuggaaauggcuguauca

SEQ ID NO: 1368564 - RNA, 13 nt, Homo sapiens
cuuuggacacuca

SEQ ID NO: 1368565 - RNA, 14 nt, Homo sapiens
cuuuggcuuugcaa

SEQ ID NO: 1368566 - RNA, 19 nt, Homo sapiens
cuuugggccagacaugcca

SEQ ID NO: 1368567 - RNA, 16 nt, Homo sapiens
cuuuguauauuacaua

SEQ ID NO: 1368568 - RNA, 15 nt, Homo sapiens
cuuugucacagggug

SEQ ID NO: 1368569 - RNA, 15 nt, Homo sapiens
cuuugugguagcuua

SEQ ID NO: 1368570 - RNA, 21 nt, Homo sapiens
cuuuguuuguugucagcugaa

SEQ ID NO: 1368571 - RNA, 19 nt, Homo sapiens
cuuuuaaaaugcaauguaa

SEQ ID NO: 1368572 - RNA, 13 nt, Homo sapiens
cuuuuaacuacaa

SEQ ID NO: 1368573 - RNA, 18 nt, Homo sapiens
cuuuuaagcagugaguua

SEQ ID NO: 1368574 - RNA, 21 nt, Homo sapiens
cuuuuaggacccuucccuuga

SEQ ID NO: 1368575 - RNA, 17 nt, Homo sapiens
cuuuuccauccuaguga

SEQ ID NO: 1368576 - RNA, 17 nt, Homo sapiens
cuuuugugcaaagccaa

SEQ ID NO: 1368577 - RNA, 18 nt, Homo sapiens
cuuuuuaaccugcaaaau

SEQ ID NO: 1368578 - RNA, 13 nt, Homo sapiens
cuuuuuucucuga

SEQ ID NO: 1368579 - RNA, 16 nt, Homo sapiens
gaaaaaaaaauggaag

SEQ ID NO: 1368580 - RNA, 17 nt, Homo sapiens
gaaaaaaaaauggaagc

SEQ ID NO: 1368581 - RNA, 16 nt, Homo sapiens
gaaaaaaagaugguau

SEQ ID NO: 1368582 - RNA, 17 nt, Homo sapiens
gaaaaauaucuuggccu

SEQ ID NO: 1368583 - RNA, 14 nt, Homo sapiens
gaaaaauuuguaua

SEQ ID NO: 1368584 - RNA, 18 nt, Homo sapiens
gaaaacguuuaaauuacu

SEQ ID NO: 1368585 - RNA, 17 nt, Homo sapiens
gaaaagacaaacaguag

SEQ ID NO: 1368586 - RNA, 15 nt, Homo sapiens
gaaaaggcugguaca

SEQ ID NO: 1368587 - RNA, 16 nt, Homo sapiens
gaaaagggcaaaaaga

SEQ ID NO: 1368588 - RNA, 19 nt, Homo sapiens
gaaaauaacaaagcccuua

SEQ ID NO: 1368589 - RNA, 12 nt, Homo sapiens
gaaaaucuuaca

SEQ ID NO: 1368590 - RNA, 21 nt, Homo sapiens
gaaaaugcuguauuagucaca

SEQ ID NO: 1368591 - RNA, 15 nt, Homo sapiens
gaaaauuaacacugc

SEQ ID NO: 1368592 - RNA, 17 nt, Homo sapiens
gaaacacaaacugaagu

SEQ ID NO: 1368593 - RNA, 14 nt, Homo sapiens
gaaacgcuucuuuu

SEQ ID NO: 1368594 - RNA, 14 nt, Homo sapiens
gaaacucacacucc

SEQ ID NO: 1368595 - RNA, 21 nt, Homo sapiens
gaaacucuucaggcaccugaa

SEQ ID NO: 1368596 - RNA, 17 nt, Homo sapiens
gaaacugccauugugau

SEQ ID NO: 1368597 - RNA, 21 nt, Homo sapiens
gaaacugccauugugaucauu

SEQ ID NO: 1368598 - RNA, 17 nt, Homo sapiens
gaaacugcgaggccagu

SEQ ID NO: 1368599 - RNA, 18 nt, Homo sapiens
gaaacuggaugaggucau

SEQ ID NO: 1368600 - RNA, 19 nt, Homo sapiens
gaaacuggaugaggucaua

SEQ ID NO: 1368601 - RNA, 18 nt, Homo sapiens
gaaagacagagcugggau

SEQ ID NO: 1368602 - RNA, 20 nt, Homo sapiens
gaaagauuugugaacuggaa

SEQ ID NO: 1368603 - RNA, 21 nt, Homo sapiens
gaaagcaacuuuacugagaca

SEQ ID NO: 1368604 - RNA, 19 nt, Homo sapiens
gaaagcucacuguagcuuu

SEQ ID NO: 1368605 - RNA, 16 nt, Homo sapiens
cugggccgcugccacg

SEQ ID NO: 1368606 - RNA, 15 nt, Homo sapiens
cuggggcaggucacu

SEQ ID NO: 1368607 - RNA, 18 nt, Homo sapiens
cuggggcaggucacuuua

SEQ ID NO: 1368608 - RNA, 16 nt, Homo sapiens
cuggggggacccagug

SEQ ID NO: 1368609 - RNA, 21 nt, Homo sapiens
cuggggggacccagugcagaa

SEQ ID NO: 1368610 - RNA, 19 nt, Homo sapiens
cugguccagggcuagugac

SEQ ID NO: 1368611 - RNA, 21 nt, Homo sapiens
cugguuuuuaaguacucacua

SEQ ID NO: 1368612 - RNA, 21 nt, Homo sapiens
cuguaagaaaccuacugccca

SEQ ID NO: 1368613 - RNA, 18 nt, Homo sapiens
cuguaagaguucacaugg

SEQ ID NO: 1368614 - RNA, 17 nt, Homo sapiens
cuguaaucccagcacuu

SEQ ID NO: 1368615 - RNA, 23 nt, Homo sapiens
cuguagggugcugcgcagcaucc

SEQ ID NO: 1368616 - RNA, 14 nt, Homo sapiens
cuguauuagucaca

SEQ ID NO: 1368617 - RNA, 18 nt, Homo sapiens
cuguauucccaguuacuu

SEQ ID NO: 1368618 - RNA, 19 nt, Homo sapiens
cugucaaucacagucucag

SEQ ID NO: 1368619 - RNA, 23 nt, Homo sapiens
cugucacaucagcuccacuuuca

SEQ ID NO: 1368620 - RNA, 19 nt, Homo sapiens
cuguccucagccuugccag

SEQ ID NO: 1368621 - RNA, 22 nt, Homo sapiens
cuguccucagccuugccagaga

SEQ ID NO: 1368622 - RNA, 17 nt, Homo sapiens
cugucucaccauguaca

SEQ ID NO: 1368623 - RNA, 17 nt, Homo sapiens
cugucucauccaaaaag

SEQ ID NO: 1368624 - RNA, 15 nt, Homo sapiens
cugucuugucuucaa

SEQ ID NO: 1368625 - RNA, 21 nt, Homo sapiens
cugugccucgcauccuaugcu

SEQ ID NO: 1368626 - RNA, 15 nt, Homo sapiens
cugugcuauggugcu

SEQ ID NO: 1368627 - RNA, 21 nt, Homo sapiens
cuguggacguggguugcacug

SEQ ID NO: 1368628 - RNA, 19 nt, Homo sapiens
cuguggagcuccacugcca

SEQ ID NO: 1368629 - RNA, 23 nt, Homo sapiens
cugugguaguccucccaagcugu

SEQ ID NO: 1368630 - RNA, 16 nt, Homo sapiens
cugugugauugacagc

SEQ ID NO: 1368631 - RNA, 14 nt, Homo sapiens
cuguuccccagaga

SEQ ID NO: 1368632 - RNA, 15 nt, Homo sapiens
cuguuccccagagaa

SEQ ID NO: 1368633 - RNA, 13 nt, Homo sapiens
cuguugacauauu

SEQ ID NO: 1368634 - RNA, 14 nt, Homo sapiens
cuguugagguguga

SEQ ID NO: 1368635 - RNA, 14 nt, Homo sapiens
cuuaaacacuugca

SEQ ID NO: 1368636 - RNA, 15 nt, Homo sapiens
cuuaaaucuuuucaa

SEQ ID NO: 1368637 - RNA, 15 nt, Homo sapiens
cuuaagaauacacag

SEQ ID NO: 1368638 - RNA, 21 nt, Homo sapiens
cuuaagauuccauuuuggaaa

SEQ ID NO: 1368639 - RNA, 23 nt, Homo sapiens
cuuaagugcaugcauugagcugc

SEQ ID NO: 1368640 - RNA, 20 nt, Homo sapiens
cuuaauaaaagaacaugcuu

SEQ ID NO: 1368641 - RNA, 22 nt, Homo sapiens
cuuaauacaucuacaaccauug

SEQ ID NO: 1368642 - RNA, 14 nt, Homo sapiens
cuuaaugcucugau

SEQ ID NO: 1368643 - RNA, 18 nt, Homo sapiens
cuuaauucuccaagcgga

SEQ ID NO: 1368644 - RNA, 23 nt, Homo sapiens
cuuacauguuuguuucuguagaa

SEQ ID NO: 1368645 - RNA, 15 nt, Homo sapiens
cuuagagaggacaau

SEQ ID NO: 1368646 - RNA, 15 nt, Homo sapiens
cuuagauacuaauaa

SEQ ID NO: 1368647 - RNA, 21 nt, Homo sapiens
cuuagugagcagugagcacug

SEQ ID NO: 1368648 - RNA, 19 nt, Homo sapiens
cuuauaccagguuaccuca

SEQ ID NO: 1368649 - RNA, 20 nt, Homo sapiens
cuuauauuuaaaacuugccu

SEQ ID NO: 1368650 - RNA, 22 nt, Homo sapiens
cuuaucaacauuugggggauaa

SEQ ID NO: 1368651 - RNA, 15 nt, Homo sapiens
cuuaucccaagagaa

SEQ ID NO: 1368652 - RNA, 12 nt, Homo sapiens
cuuaucuugcac

SEQ ID NO: 1368653 - RNA, 21 nt, Homo sapiens
gaaaggaccaguaugcuugga

SEQ ID NO: 1368654 - RNA, 19 nt, Homo sapiens
gaaauaccacaagccugag

SEQ ID NO: 1368655 - RNA, 20 nt, Homo sapiens
gaaaucaacuugcuuaucaa

SEQ ID NO: 1368656 - RNA, 17 nt, Homo sapiens
gaaaucuagaagacugu

SEQ ID NO: 1368657 - RNA, 17 nt, Homo sapiens
gaaauggcuguaucauu

SEQ ID NO: 1368658 - RNA, 20 nt, Homo sapiens
gaaauuaacucagacacaaa

SEQ ID NO: 1368659 - RNA, 14 nt, Homo sapiens
gaaauuuacuacag

SEQ ID NO: 1368660 - RNA, 13 nt, Homo sapiens
gaacacagaucau

SEQ ID NO: 1368661 - RNA, 23 nt, Homo sapiens
gaacacuaacuaugcauggugcc

SEQ ID NO: 1368662 - RNA, 20 nt, Homo sapiens
gaacagguguuuuuccacaa

SEQ ID NO: 1368663 - RNA, 18 nt, Homo sapiens
gaacaucucgaauacaau

SEQ ID NO: 1368664 - RNA, 12 nt, Homo sapiens
gaaccauaucaa

SEQ ID NO: 1368665 - RNA, 22 nt, Homo sapiens
gaacccuuucgcuggcuuucca

SEQ ID NO: 1368666 - RNA, 16 nt, Homo sapiens
gaaccuggaccccagc

SEQ ID NO: 1368667 - RNA, 19 nt, Homo sapiens
gaacuaaauuuaagcuuaa

SEQ ID NO: 1368668 - RNA, 13 nt, Homo sapiens
gaacucagaucca

SEQ ID NO: 1368669 - RNA, 19 nt, Homo sapiens
gaacucuucacucuucaaa

SEQ ID NO: 1368670 - RNA, 12 nt, Homo sapiens
gaacugcaguga

SEQ ID NO: 1368671 - RNA, 17 nt, Homo sapiens
gaagaaggggacaaugg

SEQ ID NO: 1368672 - RNA, 23 nt, Homo sapiens
gaagaagguaggagaaagggcgg

SEQ ID NO: 1368673 - RNA, 19 nt, Homo sapiens
gaagacuauauuguacaca

SEQ ID NO: 1368674 - RNA, 20 nt, Homo sapiens
gaagcaugaauaacauuuaa

SEQ ID NO: 1368675 - RNA, 18 nt, Homo sapiens
gaagcggucacagaucac

SEQ ID NO: 1368676 - RNA, 13 nt, Homo sapiens
gaagcugcuccgu

SEQ ID NO: 1368677 - RNA, 21 nt, Homo sapiens
gaagcuuuggugagaaccugg

SEQ ID NO: 1368678 - RNA, 19 nt, Homo sapiens
gaaggaaaagauacccaaa

SEQ ID NO: 1368679 - RNA, 14 nt, Homo sapiens
gaaggagagcaaga

SEQ ID NO: 1368680 - RNA, 23 nt, Homo sapiens
gaaggaggcuggcuuguccccuc

SEQ ID NO: 1368681 - RNA, 13 nt, Homo sapiens
gaaggaucaucug

SEQ ID NO: 1368682 - RNA, 17 nt, Homo sapiens
gaagggccacgugcuuu

SEQ ID NO: 1368683 - RNA, 14 nt, Homo sapiens
gaagguacugucau

SEQ ID NO: 1368684 - RNA, 20 nt, Homo sapiens
gaagguauuagcaaagcaaa

SEQ ID NO: 1368685 - RNA, 19 nt, Homo sapiens
gaaguaagcaaagacuuuc

SEQ ID NO: 1368686 - RNA, 21 nt, Homo sapiens
gaaguaagcaaagacuuuccu

SEQ ID NO: 1368687 - RNA, 13 nt, Homo sapiens
gaaguaucugucu

SEQ ID NO: 1368688 - RNA, 15 nt, Homo sapiens
gaagucaugcguuua

SEQ ID NO: 1368689 - RNA, 21 nt, Homo sapiens
gaagugagaacccagcugucc

SEQ ID NO: 1368690 - RNA, 17 nt, Homo sapiens
gaagugcagcagguuaa

SEQ ID NO: 1368691 - RNA, 18 nt, Homo sapiens
gaaguggagaggguguca

SEQ ID NO: 1368692 - RNA, 18 nt, Homo sapiens
gaaguguaagaaacacac

SEQ ID NO: 1368693 - RNA, 16 nt, Homo sapiens
gaagugugugaucugu

SEQ ID NO: 1368694 - RNA, 17 nt, Homo sapiens
gaaguuucuggugccau

SEQ ID NO: 1368695 - RNA, 19 nt, Homo sapiens
gaaguuucuggugccauuu

SEQ ID NO: 1368696 - RNA, 19 nt, Homo sapiens
gaauaaauuaaaauuacac

SEQ ID NO: 1368697 - RNA, 14 nt, Homo sapiens
gaauaacauuuaaa

SEQ ID NO: 1368698 - RNA, 19 nt, Homo sapiens
gaauaacauuuaaauucca

SEQ ID NO: 1368699 - RNA, 14 nt, Homo sapiens
gaauaauccagaaa

SEQ ID NO: 1368700 - RNA, 23 nt, Homo sapiens
gaauacucauucgucuacucuga

SEQ ID NO: 1368701 - RNA, 20 nt, Homo sapiens
gaaucagauuuuaacagcuc

SEQ ID NO: 1368702 - RNA, 15 nt, Homo sapiens
gaaucggcuuugcag

SEQ ID NO: 1368703 - RNA, 18 nt, Homo sapiens
gaaucggcuuugcagugc

SEQ ID NO: 1368704 - RNA, 19 nt, Homo sapiens
gaaucuuaagguguagcca

SEQ ID NO: 1368705 - RNA, 23 nt, Homo sapiens
gaaucuuuaaaagaugcuuuuaa

SEQ ID NO: 1368706 - RNA, 14 nt, Homo sapiens
gaaugaacacuccc

SEQ ID NO: 1368707 - RNA, 20 nt, Homo sapiens
gaaugccgguuaaauuccau

SEQ ID NO: 1368708 - RNA, 24 nt, Homo sapiens
gaaugucaagguucccucccacuc

SEQ ID NO: 1368709 - RNA, 13 nt, Homo sapiens
gaauuacuguaac

SEQ ID NO: 1368710 - RNA, 24 nt, Homo sapiens
gaauugcggcgagacaagcaugga

SEQ ID NO: 1368711 - RNA, 21 nt, Homo sapiens
gaauuuuuacuuagauacuaa

SEQ ID NO: 1368712 - RNA, 16 nt, Homo sapiens
gacaagccuaacuuca

SEQ ID NO: 1368713 - RNA, 14 nt, Homo sapiens
gacaauacuggggu

SEQ ID NO: 1368714 - RNA, 18 nt, Homo sapiens
gacaaucacuacaaguca

SEQ ID NO: 1368715 - RNA, 20 nt, Homo sapiens
gacaauggcuuacuccagga

SEQ ID NO: 1368716 - RNA, 22 nt, Homo sapiens
gacacacuggagaaaaggcagu

SEQ ID NO: 1368717 - RNA, 19 nt, Homo sapiens
gacacaggcccucccuguu

SEQ ID NO: 1368718 - RNA, 16 nt, Homo sapiens
gauugggcggggcuuc

SEQ ID NO: 1368719 - RNA, 20 nt, Homo sapiens
gauuucuuuguucucaugca

SEQ ID NO: 1368720 - RNA, 18 nt, Homo sapiens
gauuugugaacuggaaga

SEQ ID NO: 1368721 - RNA, 20 nt, Homo sapiens
gauuuuacauguggcccaac

SEQ ID NO: 1368722 - RNA, 15 nt, Homo sapiens
gauuuugucuaccau

SEQ ID NO: 1368723 - RNA, 14 nt, Homo sapiens
gcaaaaaauacuuu

SEQ ID NO: 1368724 - RNA, 14 nt, Homo sapiens
gcaaaaaauucuuu

SEQ ID NO: 1368725 - RNA, 18 nt, Homo sapiens
gcaaaaggauauucacuu

SEQ ID NO: 1368726 - RNA, 12 nt, Homo sapiens
gcaaaagguuua

SEQ ID NO: 1368727 - RNA, 15 nt, Homo sapiens
gcaaaauaaagccau

SEQ ID NO: 1368728 - RNA, 18 nt, Homo sapiens
gcaaaaucuguucuaaca

SEQ ID NO: 1368729 - RNA, 15 nt, Homo sapiens
gcaaacaaaauggac

SEQ ID NO: 1368730 - RNA, 18 nt, Homo sapiens
gcaaagcaaaaggcugag

SEQ ID NO: 1368731 - RNA, 16 nt, Homo sapiens
gcaaauuuucuuccau

SEQ ID NO: 1368732 - RNA, 21 nt, Homo sapiens
gcaagcaagaaacacugggcu

SEQ ID NO: 1368733 - RNA, 19 nt, Homo sapiens
gcaauaaccucaaagugac

SEQ ID NO: 1368734 - RNA, 20 nt, Homo sapiens
gcaauaaccucaaagugacu

SEQ ID NO: 1368735 - RNA, 22 nt, Homo sapiens
gcaauucuaacuuuuuugcuau

SEQ ID NO: 1368736 - RNA, 13 nt, Homo sapiens
gcacacucagugg

SEQ ID NO: 1368737 - RNA, 14 nt, Homo sapiens
gcaccacccuaguc

SEQ ID NO: 1368738 - RNA, 21 nt, Homo sapiens
gcacccacccaagacaaguga

SEQ ID NO: 1368739 - RNA, 13 nt, Homo sapiens
gcaccccaugcca

SEQ ID NO: 1368740 - RNA, 11 nt, Homo sapiens
gcaccuggcau

SEQ ID NO: 1368741 - RNA, 15 nt, Homo sapiens
gcacgcuaccaaauc

SEQ ID NO: 1368742 - RNA, 14 nt, Homo sapiens
gcacggcucugggg

SEQ ID NO: 1368743 - RNA, 22 nt, Homo sapiens
gcacguggccucuugagcagug

SEQ ID NO: 1368744 - RNA, 18 nt, Homo sapiens
gcacucuguauauuugau

SEQ ID NO: 1368745 - RNA, 13 nt, Homo sapiens
gcacugaugcugc

SEQ ID NO: 1368746 - RNA, 16 nt, Homo sapiens
gcagaacuaccaggug

SEQ ID NO: 1368747 - RNA, 13 nt, Homo sapiens
gcagaacuuucac

SEQ ID NO: 1368748 - RNA, 23 nt, Homo sapiens
gcagcaaggaggaagaggacuca

SEQ ID NO: 1368749 - RNA, 14 nt, Homo sapiens
gcagcaggugcuuu

SEQ ID NO: 1368750 - RNA, 16 nt, Homo sapiens
gcagcaucucuggccu

SEQ ID NO: 1368751 - RNA, 23 nt, Homo sapiens
gcagcccaugcccaccugcccau

SEQ ID NO: 1368752 - RNA, 20 nt, Homo sapiens
gcagccuccugcucugugaa

SEQ ID NO: 1368753 - RNA, 17 nt, Homo sapiens
gcagcuggagaucuuaa

SEQ ID NO: 1368754 - RNA, 15 nt, Homo sapiens
gcaggaagcucagac

SEQ ID NO: 1368755 - RNA, 18 nt, Homo sapiens
gcaggacuaaaugucuag

SEQ ID NO: 1368756 - RNA, 14 nt, Homo sapiens
gcagggcugacucu

SEQ ID NO: 1368757 - RNA, 15 nt, Homo sapiens
gcagguaaccccaga

SEQ ID NO: 1368758 - RNA, 19 nt, Homo sapiens
gcagguaaccccagauuca

SEQ ID NO: 1368759 - RNA, 15 nt, Homo sapiens
gcagguauggaaggg

SEQ ID NO: 1368760 - RNA, 13 nt, Homo sapiens
gcagguuugcaau

SEQ ID NO: 1368761 - RNA, 23 nt, Homo sapiens
gcagucaucuugaccaagcagga

SEQ ID NO: 1368762 - RNA, 14 nt, Homo sapiens
gcagugagcacuga

SEQ ID NO: 1368763 - RNA, 18 nt, Homo sapiens
gcagugcccaucuuccag

SEQ ID NO: 1368764 - RNA, 18 nt, Homo sapiens
gcaguucuuguggaagac

SEQ ID NO: 1368765 - RNA, 16 nt, Homo sapiens
gcauaggucucuuugc

SEQ ID NO: 1368766 - RNA, 18 nt, Homo sapiens
gcaucacagaaugugaua

SEQ ID NO: 1368767 - RNA, 17 nt, Homo sapiens
gcauccauguaaucuau

SEQ ID NO: 1368768 - RNA, 19 nt, Homo sapiens
gcaucccugagacagggag

SEQ ID NO: 1368769 - RNA, 15 nt, Homo sapiens
gcaucugaccagcag

SEQ ID NO: 1368770 - RNA, 23 nt, Homo sapiens
gcauggggcggguccuagcuguu

SEQ ID NO: 1368771 - RNA, 22 nt, Homo sapiens
ggcuguugacgcaccugugguu

SEQ ID NO: 1368772 - RNA, 13 nt, Homo sapiens
ggcuuagugccac

SEQ ID NO: 1368773 - RNA, 19 nt, Homo sapiens
ggcuuaugaauauauuuaa

SEQ ID NO: 1368774 - RNA, 13 nt, Homo sapiens
ggcuugcugccaa

SEQ ID NO: 1368775 - RNA, 16 nt, Homo sapiens
ggcuuuucccuugcuu

SEQ ID NO: 1368776 - RNA, 16 nt, Homo sapiens
gggaaaaguccuuggc

SEQ ID NO: 1368777 - RNA, 14 nt, Homo sapiens
gggacaagggauuu

SEQ ID NO: 1368778 - RNA, 17 nt, Homo sapiens
gggacacuuacccaagg

SEQ ID NO: 1368779 - RNA, 20 nt, Homo sapiens
gggacagagcagaacuuuca

SEQ ID NO: 1368780 - RNA, 22 nt, Homo sapiens
gggaccaacugggcccaagaca

SEQ ID NO: 1368781 - RNA, 20 nt, Homo sapiens
gggacugcuaccucugagaa

SEQ ID NO: 1368782 - RNA, 19 nt, Homo sapiens
gggagaagcuccucucccc

SEQ ID NO: 1368783 - RNA, 18 nt, Homo sapiens
gggagauggaucaaucaa

SEQ ID NO: 1368784 - RNA, 22 nt, Homo sapiens
gggagcagccugguguccugcc

SEQ ID NO: 1368785 - RNA, 16 nt, Homo sapiens
gggagcaugcuucccu

SEQ ID NO: 1368786 - RNA, 20 nt, Homo sapiens
gggaggcagagguugcagug

SEQ ID NO: 1368787 - RNA, 21 nt, Homo sapiens
gggaggccccagggggucuca

SEQ ID NO: 1368788 - RNA, 17 nt, Homo sapiens
gggauguuucugucaca

SEQ ID NO: 1368789 - RNA, 15 nt, Homo sapiens
gggauucaggcugcu

SEQ ID NO: 1368790 - RNA, 23 nt, Homo sapiens
gggauuuuuggcuacacacaaac

SEQ ID NO: 1368791 - RNA, 12 nt, Homo sapiens
gggccagagcca

SEQ ID NO: 1368792 - RNA, 21 nt, Homo sapiens
gggccagagccagggggguga

SEQ ID NO: 1368793 - RNA, 19 nt, Homo sapiens
gggccauggcucagggugg

SEQ ID NO: 1368794 - RNA, 18 nt, Homo sapiens
gggcuaccccacccaagu

SEQ ID NO: 1368795 - RNA, 12 nt, Homo sapiens
gggcucagcaaa

SEQ ID NO: 1368796 - RNA, 23 nt, Homo sapiens
gggcucaggaggggaaguccagc

SEQ ID NO: 1368797 - RNA, 17 nt, Homo sapiens
ggggacaagggauuuga

SEQ ID NO: 1368798 - RNA, 14 nt, Homo sapiens
ggggcggugcaggg

SEQ ID NO: 1368799 - RNA, 11 nt, Homo sapiens
ggggucuugca

SEQ ID NO: 1368800 - RNA, 19 nt, Homo sapiens
ggguaagaagaaagcaaaa

SEQ ID NO: 1368801 - RNA, 13 nt, Homo sapiens
ggguccacuuccc

SEQ ID NO: 1368802 - RNA, 19 nt, Homo sapiens
gggugggaguagugcuuuc

SEQ ID NO: 1368803 - RNA, 15 nt, Homo sapiens
ggguuugacauuuca

SEQ ID NO: 1368804 - RNA, 17 nt, Homo sapiens
gguaaaaacugcagugu

SEQ ID NO: 1368805 - RNA, 20 nt, Homo sapiens
gguaauaucaucuugaaaag

SEQ ID NO: 1368806 - RNA, 17 nt, Homo sapiens
gguaauugcugaggugu

SEQ ID NO: 1368807 - RNA, 19 nt, Homo sapiens
gguagagacuuugacucuc

SEQ ID NO: 1368808 - RNA, 20 nt, Homo sapiens
gguaugucugugccauuucu

SEQ ID NO: 1368809 - RNA, 17 nt, Homo sapiens
ggucaagaacacaguga

SEQ ID NO: 1368810 - RNA, 15 nt, Homo sapiens
ggucagagugccacu

SEQ ID NO: 1368811 - RNA, 12 nt, Homo sapiens
ggucaugcccuc

SEQ ID NO: 1368812 - RNA, 12 nt, Homo sapiens
ggucuccaggga

SEQ ID NO: 1368813 - RNA, 23 nt, Homo sapiens
ggucugcucuuucucugccagug

SEQ ID NO: 1368814 - RNA, 23 nt, Homo sapiens
ggugaaggaugcggcaggugcuc

SEQ ID NO: 1368815 - RNA, 16 nt, Homo sapiens
ggugaccucacuuuag

SEQ ID NO: 1368816 - RNA, 17 nt, Homo sapiens
ggugcacagccacuccc

SEQ ID NO: 1368817 - RNA, 17 nt, Homo sapiens
ggugcaugaagguuucu

SEQ ID NO: 1368818 - RNA, 15 nt, Homo sapiens
ggugcugcagcaccg

SEQ ID NO: 1368819 - RNA, 14 nt, Homo sapiens
gguggaguggugcu

SEQ ID NO: 1368820 - RNA, 22 nt, Homo sapiens
ggugucugcgucgucaccaaau

SEQ ID NO: 1368821 - RNA, 13 nt, Homo sapiens
gguguugacaugu

SEQ ID NO: 1368822 - RNA, 16 nt, Homo sapiens
gguuaacuuggucaga

SEQ ID NO: 1368823 - RNA, 16 nt, Homo sapiens
gguuaagacagggugg

SEQ ID NO: 1368824 - RNA, 14 nt, Homo sapiens
gguucaacuuauua

SEQ ID NO: 1368825 - RNA, 22 nt, Homo sapiens
gguuccagggucccucugugua

SEQ ID NO: 1368826 - RNA, 19 nt, Homo sapiens
gguucucagguguugccaa

SEQ ID NO: 1368827 - RNA, 21 nt, Homo sapiens
gguucucauaacucugugauc

SEQ ID NO: 1368828 - RNA, 17 nt, Homo sapiens
gguucucuccaccaggu

SEQ ID NO: 1368829 - RNA, 19 nt, Homo sapiens
gguugcacuggccacccaa

SEQ ID NO: 1368830 - RNA, 17 nt, Homo sapiens
gguuuaucagcaaaaaa

SEQ ID NO: 1368831 - RNA, 15 nt, Homo sapiens
gguuuuacugcagcu

SEQ ID NO: 1368832 - RNA, 21 nt, Homo sapiens
gguuuuauaaggcugauguca

SEQ ID NO: 1368833 - RNA, 18 nt, Homo sapiens
guaaaaaaaccaccaaaa

SEQ ID NO: 1368834 - RNA, 20 nt, Homo sapiens
guaaaaacugcagugucuuu

SEQ ID NO: 1368835 - RNA, 23 nt, Homo sapiens
guaaaaugcuguguccacggggu

SEQ ID NO: 1368836 - RNA, 12 nt, Homo sapiens
guaaagacugua

SEQ ID NO: 1368837 - RNA, 23 nt, Homo sapiens
guaaaguuuccgugcguggcacu

SEQ ID NO: 1368838 - RNA, 22 nt, Homo sapiens
guaacaggcuugaaucaaagaa

SEQ ID NO: 1368839 - RNA, 13 nt, Homo sapiens
guaacauauuuau

SEQ ID NO: 1368840 - RNA, 12 nt, Homo sapiens
guaacauuuuau

SEQ ID NO: 1368841 - RNA, 12 nt, Homo sapiens
guaacucagugu

SEQ ID NO: 1368842 - RNA, 18 nt, Homo sapiens
guaagaguucacauggaa

SEQ ID NO: 1368843 - RNA, 21 nt, Homo sapiens
guaaggacggacucacuucuc

SEQ ID NO: 1368844 - RNA, 13 nt, Homo sapiens
guaaggagcacca

SEQ ID NO: 1368845 - RNA, 14 nt, Homo sapiens
guacagacauauuu

SEQ ID NO: 1368846 - RNA, 18 nt, Homo sapiens
guacaggcagcacagaga

SEQ ID NO: 1368847 - RNA, 18 nt, Homo sapiens
guacaguagauuuuccaa

SEQ ID NO: 1368848 - RNA, 18 nt, Homo sapiens
guaccagaugcagcucaa

SEQ ID NO: 1368849 - RNA, 18 nt, Homo sapiens
guacuauauuugugaaua

SEQ ID NO: 1368850 - RNA, 12 nt, Homo sapiens
guacuucuugaa

SEQ ID NO: 1368851 - RNA, 12 nt, Homo sapiens
guagacugccau

SEQ ID NO: 1368852 - RNA, 23 nt, Homo sapiens
guagauauuggacaaagaaccuu

SEQ ID NO: 1368853 - RNA, 12 nt, Homo sapiens
guagcacacuga

SEQ ID NO: 1368854 - RNA, 14 nt, Homo sapiens
guagcacacugagu

SEQ ID NO: 1368855 - RNA, 20 nt, Homo sapiens
guagcugccccuggcucuga

SEQ ID NO: 1368856 - RNA, 16 nt, Homo sapiens
guaggcuucuaccugc

SEQ ID NO: 1368857 - RNA, 17 nt, Homo sapiens
guaggguuugacauuuc

SEQ ID NO: 1368858 - RNA, 15 nt, Homo sapiens
guauaaucccaccca

SEQ ID NO: 1368859 - RNA, 17 nt, Homo sapiens
guauacagaccagguga

SEQ ID NO: 1368860 - RNA, 22 nt, Homo sapiens
guauaccuaucacuuacauuuu

SEQ ID NO: 1368861 - RNA, 23 nt, Homo sapiens
guauauuugauugaauaaugcca

SEQ ID NO: 1368862 - RNA, 14 nt, Homo sapiens
guauccucuugcca

SEQ ID NO: 1368863 - RNA, 15 nt, Homo sapiens
guaugacugcacaug

SEQ ID NO: 1368864 - RNA, 19 nt, Homo sapiens
guaugauccuaaugaaugc

SEQ ID NO: 1368865 - RNA, 23 nt, Homo sapiens
gucaagaagaaaaagguuugcau

SEQ ID NO: 1368866 - RNA, 13 nt, Homo sapiens
gucagaaguugau

SEQ ID NO: 1368867 - RNA, 15 nt, Homo sapiens
gucagagccacucua

SEQ ID NO: 1368868 - RNA, 23 nt, Homo sapiens
gucaguugcaaauuuuagcguua

SEQ ID NO: 1368869 - RNA, 14 nt, Homo sapiens
gucauagacuccuu

SEQ ID NO: 1368870 - RNA, 21 nt, Homo sapiens
gucauagacuccuuugcuaau

SEQ ID NO: 1368871 - RNA, 20 nt, Homo sapiens
gucaucugcaugucuacuca

SEQ ID NO: 1368872 - RNA, 11 nt, Homo sapiens
gucaugcccuc

SEQ ID NO: 1368873 - RNA, 18 nt, Homo sapiens
gucaugcguuuaaucaca

SEQ ID NO: 1368874 - RNA, 17 nt, Homo sapiens
gucauguggcuaccugu

SEQ ID NO: 1368875 - RNA, 17 nt, Homo sapiens
guccagaucuacacagc

SEQ ID NO: 1368876 - RNA, 23 nt, Homo sapiens
guccagccgccauugccaccagg

SEQ ID NO: 1368877 - RNA, 18 nt, Homo sapiens
gucccacgccucccugag

SEQ ID NO: 1368878 - RNA, 14 nt, Homo sapiens
gucccagccaguga

SEQ ID NO: 1368879 - RNA, 14 nt, Homo sapiens
guccuaccuauuau

SEQ ID NO: 1368880 - RNA, 14 nt, Homo sapiens
guccucccaagcug

SEQ ID NO: 1368881 - RNA, 23 nt, Homo sapiens
guccugggguauaaaacuuuccu

SEQ ID NO: 1368882 - RNA, 18 nt, Homo sapiens
guccuguuuuugucaugu

SEQ ID NO: 1368883 - RNA, 20 nt, Homo sapiens
gucuaaacuuuagaauuaau

SEQ ID NO: 1368884 - RNA, 19 nt, Homo sapiens
gucuaauagucuuugccag

SEQ ID NO: 1368885 - RNA, 18 nt, Homo sapiens
gucuacucagcauuugau

SEQ ID NO: 1368886 - RNA, 18 nt, Homo sapiens
gucucuacccaguagaug

SEQ ID NO: 1368887 - RNA, 22 nt, Homo sapiens
gucucuacccaguagaugccac

SEQ ID NO: 1368888 - RNA, 12 nt, Homo sapiens
uuugaacuuaaa

SEQ ID NO: 1368889 - RNA, 17 nt, Homo sapiens
uuugaccacccaccuga

SEQ ID NO: 1368890 - RNA, 15 nt, Homo sapiens
uuugagcacaacuuu

SEQ ID NO: 1368891 - RNA, 18 nt, Homo sapiens
uuugagcugagugcugaa

SEQ ID NO: 1368892 - RNA, 17 nt, Homo sapiens
uuugcagggcgugagac

SEQ ID NO: 1368893 - RNA, 14 nt, Homo sapiens
uuugcauguuugua

SEQ ID NO: 1368894 - RNA, 17 nt, Homo sapiens
uuugccaaaauucauuu

SEQ ID NO: 1368895 - RNA, 19 nt, Homo sapiens
uuugcuaaaccuauuucac

SEQ ID NO: 1368896 - RNA, 15 nt, Homo sapiens
uuugcuuucugcuca

SEQ ID NO: 1368897 - RNA, 22 nt, Homo sapiens
uuuggaaaucacacgucuggcu

SEQ ID NO: 1368898 - RNA, 14 nt, Homo sapiens
uuuggcuuugcaaa

SEQ ID NO: 1368899 - RNA, 20 nt, Homo sapiens
uuugggaacugcaauaaccu

SEQ ID NO: 1368900 - RNA, 13 nt, Homo sapiens
uuuguaaauuccc

SEQ ID NO: 1368901 - RNA, 17 nt, Homo sapiens
uuugugugcgucacugu

SEQ ID NO: 1368902 - RNA, 21 nt, Homo sapiens
uuuuaaaaaaaucccauuuaa

SEQ ID NO: 1368903 - RNA, 12 nt, Homo sapiens
uuuuaauuccac

SEQ ID NO: 1368904 - RNA, 17 nt, Homo sapiens
uuuuacauguggcccaa

SEQ ID NO: 1368905 - RNA, 23 nt, Homo sapiens
uuuuagguagaaaaacauauucu

SEQ ID NO: 1368906 - RNA, 14 nt, Homo sapiens
uuuucagaugugaa

SEQ ID NO: 1368907 - RNA, 16 nt, Homo sapiens
uuuucuaaacuuuaau

SEQ ID NO: 1368908 - RNA, 17 nt, Homo sapiens
uuuucuuauugcgcugc

SEQ ID NO: 1368909 - RNA, 18 nt, Homo sapiens
uuuuuaaaaaacugcuga

SEQ ID NO: 1368910 - RNA, 13 nt, Homo sapiens
uuuuuauaauauc

SEQ ID NO: 1368911 - RNA, 18 nt, Homo sapiens
uuuuuccaauuagcuccu

SEQ ID NO: 1368912 - RNA, 21 nt, Homo sapiens
uuuuuggcuacacacaaacca

SEQ ID NO: 1368913 - RNA, 21 nt, Homo sapiens
ggaggccagccagugaccuga

SEQ ID NO: 1368914 - RNA, 23 nt, Homo sapiens
ggaggcccaucccccaccugcca

SEQ ID NO: 1368915 - RNA, 14 nt, Homo sapiens
ggagggcaguuuuc

SEQ ID NO: 1368916 - RNA, 23 nt, Homo sapiens
ggauacgcaucagacagauggaa

SEQ ID NO: 1368917 - RNA, 16 nt, Homo sapiens
ggauagagacuggaac

SEQ ID NO: 1368918 - RNA, 13 nt, Homo sapiens
ggauauuuacuau

SEQ ID NO: 1368919 - RNA, 16 nt, Homo sapiens
ggaugcggccauucaa

SEQ ID NO: 1368920 - RNA, 17 nt, Homo sapiens
ggauuaaccucugcacu

SEQ ID NO: 1368921 - RNA, 13 nt, Homo sapiens
ggauugggguccc

SEQ ID NO: 1368922 - RNA, 15 nt, Homo sapiens
ggcaaaaagaccaag

SEQ ID NO: 1368923 - RNA, 17 nt, Homo sapiens
ggcaaagccuucauugc

SEQ ID NO: 1368924 - RNA, 12 nt, Homo sapiens
ggcaccagacac

SEQ ID NO: 1368925 - RNA, 18 nt, Homo sapiens
ggcaccagacacccagga

SEQ ID NO: 1368926 - RNA, 16 nt, Homo sapiens
ggcaccuaauccaggc

SEQ ID NO: 1368927 - RNA, 20 nt, Homo sapiens
ggcaggagaaucgcuugaac

SEQ ID NO: 1368928 - RNA, 20 nt, Homo sapiens
ggcaggagaauugcuugaac

SEQ ID NO: 1368929 - RNA, 14 nt, Homo sapiens
ggcagguccagcuc

SEQ ID NO: 1368930 - RNA, 20 nt, Homo sapiens
ggcaguacuccucccugggg

SEQ ID NO: 1368931 - RNA, 22 nt, Homo sapiens
ggcauaggucucuuugcuuucu

SEQ ID NO: 1368932 - RNA, 14 nt, Homo sapiens
ggcaucauugugac

SEQ ID NO: 1368933 - RNA, 19 nt, Homo sapiens
ggccaauaaauaugauguu

SEQ ID NO: 1368934 - RNA, 20 nt, Homo sapiens
ggccaauaaauaugauguua

SEQ ID NO: 1368935 - RNA, 13 nt, Homo sapiens
ggccaccacugca

SEQ ID NO: 1368936 - RNA, 19 nt, Homo sapiens
ggccacggugccuccagau

SEQ ID NO: 1368937 - RNA, 18 nt, Homo sapiens
ggccauggcucagggugg

SEQ ID NO: 1368938 - RNA, 22 nt, Homo sapiens
ggccauuuggccggcucuggug

SEQ ID NO: 1368939 - RNA, 13 nt, Homo sapiens
ggcccagugcaug

SEQ ID NO: 1368940 - RNA, 13 nt, Homo sapiens
ggcccccaucucc

SEQ ID NO: 1368941 - RNA, 23 nt, Homo sapiens
ggcccguccggcaguucugggug

SEQ ID NO: 1368942 - RNA, 23 nt, Homo sapiens
ggcccuccucucccauccuugau

SEQ ID NO: 1368943 - RNA, 14 nt, Homo sapiens
ggcccugcaggguc

SEQ ID NO: 1368944 - RNA, 13 nt, Homo sapiens
ggccucacucugg

SEQ ID NO: 1368945 - RNA, 10 nt, Homo sapiens
ggccucagaa

SEQ ID NO: 1368946 - RNA, 20 nt, Homo sapiens
ggccuccccagccaggcugc

SEQ ID NO: 1368947 - RNA, 15 nt, Homo sapiens
ggccuccugugacug

SEQ ID NO: 1368948 - RNA, 20 nt, Homo sapiens
ggccugccuggcaggugugc

SEQ ID NO: 1368949 - RNA, 23 nt, Homo sapiens
ggccuguuugccgucugugacau

SEQ ID NO: 1368950 - RNA, 14 nt, Homo sapiens
ggccuugcuugccc

SEQ ID NO: 1368951 - RNA, 14 nt, Homo sapiens
ggcggaucaucuaa

SEQ ID NO: 1368952 - RNA, 21 nt, Homo sapiens
ggcgguccuacugcugugagc

SEQ ID NO: 1368953 - RNA, 19 nt, Homo sapiens
ggcuacagauugggcgggg

SEQ ID NO: 1368954 - RNA, 13 nt, Homo sapiens
ggcuagacaguuc

SEQ ID NO: 1368955 - RNA, 15 nt, Homo sapiens
ggcucacaccuguaa

SEQ ID NO: 1368956 - RNA, 21 nt, Homo sapiens
ggcucauacaggucacccuga

SEQ ID NO: 1368957 - RNA, 13 nt, Homo sapiens
ggcuccuaccugg

SEQ ID NO: 1368958 - RNA, 15 nt, Homo sapiens
ggcuccuaccugggg

SEQ ID NO: 1368959 - RNA, 13 nt, Homo sapiens
ggcuccuguggua

SEQ ID NO: 1368960 - RNA, 19 nt, Homo sapiens
ggcucucuugugcauugua

SEQ ID NO: 1368961 - RNA, 15 nt, Homo sapiens
ggcugaccaugcuca

SEQ ID NO: 1368962 - RNA, 17 nt, Homo sapiens
ggcugaugguguggccu

SEQ ID NO: 1368963 - RNA, 20 nt, Homo sapiens
ggcuggagugcaguggcgca

SEQ ID NO: 1368964 - RNA, 18 nt, Homo sapiens
ggcugggaagaagcugca

SEQ ID NO: 1368965 - RNA, 19 nt, Homo sapiens
ggcugggagacagagucag

SEQ ID NO: 1368966 - RNA, 11 nt, Homo sapiens
ggcugggcuag

SEQ ID NO: 1368967 - RNA, 10 nt, Homo sapiens
ggcuguccag

SEQ ID NO: 1368968 - RNA, 20 nt, Homo sapiens
ggcuguguugguguggccca

SEQ ID NO: 1368969 - RNA, 16 nt, Homo sapiens
ugcuauaguauuugau

SEQ ID NO: 1368970 - RNA, 23 nt, Homo sapiens
ugcucagguacuuguaaauuauu

SEQ ID NO: 1368971 - RNA, 14 nt, Homo sapiens
ugcucauaugcaug

SEQ ID NO: 1368972 - RNA, 17 nt, Homo sapiens
ugcuccaggaucuuuga

SEQ ID NO: 1368973 - RNA, 21 nt, Homo sapiens
ugcuccauggcugccaucuca

SEQ ID NO: 1368974 - RNA, 18 nt, Homo sapiens
ugcucccgucugucuguc

SEQ ID NO: 1368975 - RNA, 21 nt, Homo sapiens
ugcucugucuucuuugcccac

SEQ ID NO: 1368976 - RNA, 13 nt, Homo sapiens
ugcugaacagugg

SEQ ID NO: 1368977 - RNA, 16 nt, Homo sapiens
ugcugcauugauccag

SEQ ID NO: 1368978 - RNA, 21 nt, Homo sapiens
ugcuggggagacaaaucucag

SEQ ID NO: 1368979 - RNA, 13 nt, Homo sapiens
ugcuggugcacag

SEQ ID NO: 1368980 - RNA, 22 nt, Homo sapiens
ugcugugaggcuguccuguaca

SEQ ID NO: 1368981 - RNA, 14 nt, Homo sapiens
ugcuguguguccca

SEQ ID NO: 1368982 - RNA, 14 nt, Homo sapiens
ugcuguugaagauu

SEQ ID NO: 1368983 - RNA, 15 nt, Homo sapiens
ugcuucagugcugcu

SEQ ID NO: 1368984 - RNA, 14 nt, Homo sapiens
ugcuuccaacucau

SEQ ID NO: 1368985 - RNA, 18 nt, Homo sapiens
ugcuuccucccaacaagc

SEQ ID NO: 1368986 - RNA, 23 nt, Homo sapiens
ugcuuccucccaacaagcagcug

SEQ ID NO: 1368987 - RNA, 16 nt, Homo sapiens
ugcuucgcagaugucc

SEQ ID NO: 1368988 - RNA, 18 nt, Homo sapiens
ugcuuggagcugagcaaa

SEQ ID NO: 1368989 - RNA, 21 nt, Homo sapiens
ugcuuucagaagugcccuucc

SEQ ID NO: 1368990 - RNA, 20 nt, Homo sapiens
ugcuuugaaaacaugacuca

SEQ ID NO: 1368991 - RNA, 13 nt, Homo sapiens
ugcuuugccaaaa

SEQ ID NO: 1368992 - RNA, 15 nt, Homo sapiens
ugcuuugccaaaaua

SEQ ID NO: 1368993 - RNA, 16 nt, Homo sapiens
ugcuuuggaaaucaca

SEQ ID NO: 1368994 - RNA, 14 nt, Homo sapiens
uggaaaauaaauca

SEQ ID NO: 1368995 - RNA, 13 nt, Homo sapiens
uggaaaaugauua

SEQ ID NO: 1368996 - RNA, 19 nt, Homo sapiens
uggaaaaugcuucuuggcu

SEQ ID NO: 1368997 - RNA, 21 nt, Homo sapiens
uggaacacuagacaagccaga

SEQ ID NO: 1368998 - RNA, 20 nt, Homo sapiens
uggaagaaagcaacaaagau

SEQ ID NO: 1368999 - RNA, 16 nt, Homo sapiens
uggacaaacagccuca

SEQ ID NO: 1369000 - RNA, 14 nt, Homo sapiens
uggacugguuuuca

SEQ ID NO: 1369001 - RNA, 13 nt, Homo sapiens
uggagaagcuccc

SEQ ID NO: 1369002 - RNA, 22 nt, Homo sapiens
uggagacuuccucuguucucag

SEQ ID NO: 1369003 - RNA, 16 nt, Homo sapiens
uggagagacagcuaca

SEQ ID NO: 1369004 - RNA, 22 nt, Homo sapiens
uggagauaccagagacucugaa

SEQ ID NO: 1369005 - RNA, 21 nt, Homo sapiens
uggagccuccaauugcagugg

SEQ ID NO: 1369006 - RNA, 16 nt, Homo sapiens
uggagcucagguccca

SEQ ID NO: 1369007 - RNA, 23 nt, Homo sapiens
uggaggacagugggaacuggagg

SEQ ID NO: 1369008 - RNA, 20 nt, Homo sapiens
uggaggcucucuugugcauu

SEQ ID NO: 1369009 - RNA, 17 nt, Homo sapiens
uggaguacccagccuau

SEQ ID NO: 1369010 - RNA, 14 nt, Homo sapiens
uggagugcagugac

SEQ ID NO: 1369011 - RNA, 19 nt, Homo sapiens
uggaguguuauguauuucc

SEQ ID NO: 1369012 - RNA, 11 nt, Homo sapiens
uggaugccuug

SEQ ID NO: 1369013 - RNA, 13 nt, Homo sapiens
uggaugcggccau

SEQ ID NO: 1369014 - RNA, 20 nt, Homo sapiens
uggauuccucgaaacugcca

SEQ ID NO: 1369015 - RNA, 23 nt, Homo sapiens
uggcaacagaucuggaaccucag

SEQ ID NO: 1369016 - RNA, 16 nt, Homo sapiens
uggcacccaugcaccu

SEQ ID NO: 1369017 - RNA, 18 nt, Homo sapiens
uggcagcauugacucugu

SEQ ID NO: 1369018 - RNA, 17 nt, Homo sapiens
uggcaugagaaauacaa

SEQ ID NO: 1369019 - RNA, 18 nt, Homo sapiens
uggccaaggagcugcuau

SEQ ID NO: 1369020 - RNA, 14 nt, Homo sapiens
uggccacugagcug

SEQ ID NO: 1369021 - RNA, 16 nt, Homo sapiens
uggccagaggugucac

SEQ ID NO: 1369022 - RNA, 17 nt, Homo sapiens
uggccagaggugucacc

SEQ ID NO: 1369023 - RNA, 18 nt, Homo sapiens
uggccaguccacccugcc

SEQ ID NO: 1369024 - RNA, 13 nt, Homo sapiens
uggccaguucauu

SEQ ID NO: 1369025 - RNA, 22 nt, Homo sapiens
uggccuccccugccaccaggcc

SEQ ID NO: 1369026 - RNA, 23 nt, Homo sapiens
uggccuggggcaggucacuuuac

SEQ ID NO: 1369027 - RNA, 20 nt, Homo sapiens
uggcgaaaggagugacuuug

SEQ ID NO: 1369028 - RNA, 19 nt, Homo sapiens
uggcgcuuagagaggacaa

SEQ ID NO: 1369029 - RNA, 14 nt, Homo sapiens
uguugcuuauacug

SEQ ID NO: 1369030 - RNA, 12 nt, Homo sapiens
uguuggugacaa

SEQ ID NO: 1369031 - RNA, 16 nt, Homo sapiens
uguuuauucuauaguu

SEQ ID NO: 1369032 - RNA, 18 nt, Homo sapiens
uguuucacaauaccucau

SEQ ID NO: 1369033 - RNA, 23 nt, Homo sapiens
uguuucucccccuuuccaaaaac

SEQ ID NO: 1369034 - RNA, 19 nt, Homo sapiens
uguuuguuuggcuguccag

SEQ ID NO: 1369035 - RNA, 18 nt, Homo sapiens
uguuuuaaucuccucuga

SEQ ID NO: 1369036 - RNA, 20 nt, Homo sapiens
uguuuugccauguuggccag

SEQ ID NO: 1369037 - RNA, 12 nt, Homo sapiens
uuaaaaagucaa

SEQ ID NO: 1369038 - RNA, 21 nt, Homo sapiens
uuaaaaauuguuaauuuuucc

SEQ ID NO: 1369039 - RNA, 13 nt, Homo sapiens
uuaaaaugccaau

SEQ ID NO: 1369040 - RNA, 13 nt, Homo sapiens
uuaaaauucucaa

SEQ ID NO: 1369041 - RNA, 21 nt, Homo sapiens
uuaaacccuauugguaaagaa

SEQ ID NO: 1369042 - RNA, 15 nt, Homo sapiens
uuaaagaauaugacu

SEQ ID NO: 1369043 - RNA, 19 nt, Homo sapiens
uuaaagcugaaaacugcaa

SEQ ID NO: 1369044 - RNA, 17 nt, Homo sapiens
uuaaaggaauaaggugu

SEQ ID NO: 1369045 - RNA, 22 nt, Homo sapiens
uuaaauaaaaauuacuguguua

SEQ ID NO: 1369046 - RNA, 15 nt, Homo sapiens
uuaaauaaauggaau

SEQ ID NO: 1369047 - RNA, 24 nt, Homo sapiens
uuaaaucagccguguaaccaugga

SEQ ID NO: 1369048 - RNA, 13 nt, Homo sapiens
uuaaauguauuau

SEQ ID NO: 1369049 - RNA, 20 nt, Homo sapiens
uuaaauuccacagauuauca

SEQ ID NO: 1369050 - RNA, 21 nt, Homo sapiens
uuaacugccuuacagacagaa

SEQ ID NO: 1369051 - RNA, 20 nt, Homo sapiens
uuaacugugaaauaccacaa

SEQ ID NO: 1369052 - RNA, 18 nt, Homo sapiens
uuaacuuuuaagguugaa

SEQ ID NO: 1369053 - RNA, 18 nt, Homo sapiens
uuaagaccuggcagcucu

SEQ ID NO: 1369054 - RNA, 20 nt, Homo sapiens
uuaagagaauguuucuuaaa

SEQ ID NO: 1369055 - RNA, 22 nt, Homo sapiens
uuaaguggggugggaaggggag

SEQ ID NO: 1369056 - RNA, 19 nt, Homo sapiens
uuaaguugauggugaugaa

SEQ ID NO: 1369057 - RNA, 20 nt, Homo sapiens
uuaaguugauggugaugaaa

SEQ ID NO: 1369058 - RNA, 21 nt, Homo sapiens
uuaauaaaagaacaugcuuga

SEQ ID NO: 1369059 - RNA, 12 nt, Homo sapiens
uuaauacaccuu

SEQ ID NO: 1369060 - RNA, 16 nt, Homo sapiens
uuaauauugugcaaac

SEQ ID NO: 1369061 - RNA, 19 nt, Homo sapiens
uuaaucuccucugaaaugu

SEQ ID NO: 1369062 - RNA, 15 nt, Homo sapiens
uuaauuccacuuuaa

SEQ ID NO: 1369063 - RNA, 17 nt, Homo sapiens
uuaauuuuuugguacaa

SEQ ID NO: 1369064 - RNA, 11 nt, Homo sapiens
uuacagaauuu

SEQ ID NO: 1369065 - RNA, 19 nt, Homo sapiens
uuacaguuuaucuauggca

SEQ ID NO: 1369066 - RNA, 16 nt, Homo sapiens
uuacauguaauuugau

SEQ ID NO: 1369067 - RNA, 20 nt, Homo sapiens
uuaccaucacugaguuuucc

SEQ ID NO: 1369068 - RNA, 14 nt, Homo sapiens
uuacuaucauguca

SEQ ID NO: 1369069 - RNA, 15 nt, Homo sapiens
uuacuaucaugucaa

SEQ ID NO: 1369070 - RNA, 17 nt, Homo sapiens
uuacuaucaugucaaac

SEQ ID NO: 1369071 - RNA, 22 nt, Homo sapiens
uuacugguauuaauaaacacau

SEQ ID NO: 1369072 - RNA, 10 nt, Homo sapiens
uuacuguaac

SEQ ID NO: 1369073 - RNA, 15 nt, Homo sapiens
uuacuuaaaggaaua

SEQ ID NO: 1369074 - RNA, 19 nt, Homo sapiens
uuagaauuaaaaaagcaua

SEQ ID NO: 1369075 - RNA, 20 nt, Homo sapiens
uuagaccaagcuuguccaac

SEQ ID NO: 1369076 - RNA, 18 nt, Homo sapiens
uuagagauuauaacaaau

SEQ ID NO: 1369077 - RNA, 13 nt, Homo sapiens
uuagauacuaaua

SEQ ID NO: 1369078 - RNA, 15 nt, Homo sapiens
uuagcauuuugcuaa

SEQ ID NO: 1369079 - RNA, 15 nt, Homo sapiens
uuagcccaaaaccaa

SEQ ID NO: 1369080 - RNA, 9 nt, Homo sapiens
uuagcucau

SEQ ID NO: 1369081 - RNA, 18 nt, Homo sapiens
uuaggaagguacugucau

SEQ ID NO: 1369082 - RNA, 17 nt, Homo sapiens
uuaggacuuuuugucaa

SEQ ID NO: 1369083 - RNA, 23 nt, Homo sapiens
uuaggauuuucacauucuuggcu

SEQ ID NO: 1369084 - RNA, 22 nt, Homo sapiens
uuagggaagaaaaagcaagugu

SEQ ID NO: 1369085 - RNA, 16 nt, Homo sapiens
uuagguuaaaguuaau

SEQ ID NO: 1369086 - RNA, 19 nt, Homo sapiens
ugaagucccagauacuugg

SEQ ID NO: 1369087 - RNA, 20 nt, Homo sapiens
ugaauaauacaguaucucag

SEQ ID NO: 1369088 - RNA, 14 nt, Homo sapiens
ugaauacaggcaua

SEQ ID NO: 1369089 - RNA, 12 nt, Homo sapiens
ugaaucacagua

SEQ ID NO: 1369090 - RNA, 14 nt, Homo sapiens
ugaaucacaguaua

SEQ ID NO: 1369091 - RNA, 22 nt, Homo sapiens
ugaaucacugcaccucuuuguc

SEQ ID NO: 1369092 - RNA, 15 nt, Homo sapiens
ugaaugcggcccaac

SEQ ID NO: 1369093 - RNA, 19 nt, Homo sapiens
ugaauuguuacaucaugcu

SEQ ID NO: 1369094 - RNA, 19 nt, Homo sapiens
ugaauuucuccgaauguca

SEQ ID NO: 1369095 - RNA, 21 nt, Homo sapiens
ugaauuuggucuguauagucu

SEQ ID NO: 1369096 - RNA, 12 nt, Homo sapiens
ugacaaaccauc

SEQ ID NO: 1369097 - RNA, 18 nt, Homo sapiens
ugacaaaggccugugaag

SEQ ID NO: 1369098 - RNA, 13 nt, Homo sapiens
ugacaaccaaaag

SEQ ID NO: 1369099 - RNA, 21 nt, Homo sapiens
ugacaaccgagaagguuuauc

SEQ ID NO: 1369100 - RNA, 20 nt, Homo sapiens
ugacaaugguguuauuugaa

SEQ ID NO: 1369101 - RNA, 23 nt, Homo sapiens
ugacacagacauccucuaugcca

SEQ ID NO: 1369102 - RNA, 19 nt, Homo sapiens
ugacagcuuugcugcugaa

SEQ ID NO: 1369103 - RNA, 13 nt, Homo sapiens
ugacauauuuaau

SEQ ID NO: 1369104 - RNA, 20 nt, Homo sapiens
ugaccaggggcccuaccugg

SEQ ID NO: 1369105 - RNA, 23 nt, Homo sapiens
ugaccucacuuuaggcagcugua

SEQ ID NO: 1369106 - RNA, 13 nt, Homo sapiens
ugaccuccacagc

SEQ ID NO: 1369107 - RNA, 22 nt, Homo sapiens
ugacgacaagugcugaacagug

SEQ ID NO: 1369108 - RNA, 16 nt, Homo sapiens
ugacucacuuauccca

SEQ ID NO: 1369109 - RNA, 20 nt, Homo sapiens
ugacucuccagaaagcucau

SEQ ID NO: 1369110 - RNA, 19 nt, Homo sapiens
ugacuugacagaacacugu

SEQ ID NO: 1369111 - RNA, 16 nt, Homo sapiens
ugacuugugucccaug

SEQ ID NO: 1369112 - RNA, 17 nt, Homo sapiens
ugacuugugucccauga

SEQ ID NO: 1369113 - RNA, 12 nt, Homo sapiens
ugacuuuaguga

SEQ ID NO: 1369114 - RNA, 12 nt, Homo sapiens
ugagaagauuca

SEQ ID NO: 1369115 - RNA, 14 nt, Homo sapiens
ugagaagccaugua

SEQ ID NO: 1369116 - RNA, 17 nt, Homo sapiens
ugagaaggcucuugcca

SEQ ID NO: 1369117 - RNA, 16 nt, Homo sapiens
ugagacucagugcaga

SEQ ID NO: 1369118 - RNA, 13 nt, Homo sapiens
ugagacuugccag

SEQ ID NO: 1369119 - RNA, 18 nt, Homo sapiens
ugagauauauucaguauu

SEQ ID NO: 1369120 - RNA, 18 nt, Homo sapiens
ugagauuaagaaugccag

SEQ ID NO: 1369121 - RNA, 18 nt, Homo sapiens
ugagauugggcauggggu

SEQ ID NO: 1369122 - RNA, 23 nt, Homo sapiens
ugagcaaguaacacuaacuuuga

SEQ ID NO: 1369123 - RNA, 15 nt, Homo sapiens
ugagcgaaaacagga

SEQ ID NO: 1369124 - RNA, 14 nt, Homo sapiens
ugagcugagugcug

SEQ ID NO: 1369125 - RNA, 18 nt, Homo sapiens
ugagcugccuccagccug

SEQ ID NO: 1369126 - RNA, 13 nt, Homo sapiens
ugagcuucuuuag

SEQ ID NO: 1369127 - RNA, 21 nt, Homo sapiens
ugagcuuggaaaggaccagua

SEQ ID NO: 1369128 - RNA, 17 nt, Homo sapiens
ugaggcaagagaauuac

SEQ ID NO: 1369129 - RNA, 20 nt, Homo sapiens
ugagggggaauuccuggaac

SEQ ID NO: 1369130 - RNA, 17 nt, Homo sapiens
ugaguagcucuccugac

SEQ ID NO: 1369131 - RNA, 13 nt, Homo sapiens
ugaguggugccaa

SEQ ID NO: 1369132 - RNA, 19 nt, Homo sapiens
ugaguuacuaucaugucaa

SEQ ID NO: 1369133 - RNA, 17 nt, Homo sapiens
ugaguuugaacacagau

SEQ ID NO: 1369134 - RNA, 15 nt, Homo sapiens
ugauaaagcacagcu

SEQ ID NO: 1369135 - RNA, 13 nt, Homo sapiens
ugauaaugcucac

SEQ ID NO: 1369136 - RNA, 13 nt, Homo sapiens
ugauacuuacuca

SEQ ID NO: 1369137 - RNA, 15 nt, Homo sapiens
ugauagggaacuggg

SEQ ID NO: 1369138 - RNA, 17 nt, Homo sapiens
ugauauauuccaccagg

SEQ ID NO: 1369139 - RNA, 17 nt, Homo sapiens
ugauccuccaacagcug

SEQ ID NO: 1369140 - RNA, 22 nt, Homo sapiens
ugaugacuguuuguuagucagu

SEQ ID NO: 1369141 - RNA, 20 nt, Homo sapiens
ugaugcaagcaagaaacacu

SEQ ID NO: 1369142 - RNA, 16 nt, Homo sapiens
ugauggaagaugcagu

SEQ ID NO: 1369143 - RNA, 17 nt, Homo sapiens
ugaugucguuugaauca

SEQ ID NO: 1369144 - RNA, 19 nt, Homo sapiens
ugauguguuuacauuuacu

SEQ ID NO: 1369145 - RNA, 13 nt, Homo sapiens
ugauucacagugu

SEQ ID NO: 1369146 - RNA, 22 nt, Homo sapiens
ugauucaggggucugaugacac

SEQ ID NO: 1369147 - RNA, 11 nt, Homo sapiens
caaauucuccu

SEQ ID NO: 1369148 - RNA, 16 nt, Homo sapiens
caacaaagauugagaa

SEQ ID NO: 1369149 - RNA, 21 nt, Homo sapiens
caacaaugugaggggucccua

SEQ ID NO: 1369150 - RNA, 18 nt, Homo sapiens
caacaguuacauaauuca

SEQ ID NO: 1369151 - RNA, 18 nt, Homo sapiens
caacaugugcucagggaa

SEQ ID NO: 1369152 - RNA, 19 nt, Homo sapiens
caaccaauggaaugugaug

SEQ ID NO: 1369153 - RNA, 17 nt, Homo sapiens
caacuacgcugauuuga

SEQ ID NO: 1369154 - RNA, 17 nt, Homo sapiens
caacuagaaacagcucc

SEQ ID NO: 1369155 - RNA, 13 nt, Homo sapiens
caacucaucuuag

SEQ ID NO: 1369156 - RNA, 16 nt, Homo sapiens
caacucguauagcaug

SEQ ID NO: 1369157 - RNA, 18 nt, Homo sapiens
caacuguccacgcgugcc

SEQ ID NO: 1369158 - RNA, 20 nt, Homo sapiens
caacuuauuaacaauuaggc

SEQ ID NO: 1369159 - RNA, 19 nt, Homo sapiens
caacuuccuaaauauuaug

SEQ ID NO: 1369160 - RNA, 17 nt, Homo sapiens
caacuugggaacuagac

SEQ ID NO: 1369161 - RNA, 20 nt, Homo sapiens
caacuugggaacuagacucc

SEQ ID NO: 1369162 - RNA, 16 nt, Homo sapiens
caacuuguauuuccaa

SEQ ID NO: 1369163 - RNA, 14 nt, Homo sapiens
caagaaagcucacu

SEQ ID NO: 1369164 - RNA, 12 nt, Homo sapiens
caagaaugccag

SEQ ID NO: 1369165 - RNA, 12 nt, Homo sapiens
caagacagaugg

SEQ ID NO: 1369166 - RNA, 12 nt, Homo sapiens
caagacagaugu

SEQ ID NO: 1369167 - RNA, 11 nt, Homo sapiens
caagacauuuc

SEQ ID NO: 1369168 - RNA, 22 nt, Homo sapiens
caagacauuucucuaacuccug

SEQ ID NO: 1369169 - RNA, 12 nt, Homo sapiens
caagacugagcc

SEQ ID NO: 1369170 - RNA, 15 nt, Homo sapiens
caagcaggaagcuca

SEQ ID NO: 1369171 - RNA, 23 nt, Homo sapiens
caagcauggaaaaucagugacau

SEQ ID NO: 1369172 - RNA, 17 nt, Homo sapiens
caagcccugcagucaca

SEQ ID NO: 1369173 - RNA, 17 nt, Homo sapiens
caagcccuguugacaca

SEQ ID NO: 1369174 - RNA, 16 nt, Homo sapiens
caagccugugcaaaaa

SEQ ID NO: 1369175 - RNA, 21 nt, Homo sapiens
caagcugccgaaccaaaagaa

SEQ ID NO: 1369176 - RNA, 16 nt, Homo sapiens
caagcugguauuuuca

SEQ ID NO: 1369177 - RNA, 14 nt, Homo sapiens
caaggcugcaguga

SEQ ID NO: 1369178 - RNA, 14 nt, Homo sapiens
caagggucuucagg

SEQ ID NO: 1369179 - RNA, 15 nt, Homo sapiens
caaggucuguaauug

SEQ ID NO: 1369180 - RNA, 17 nt, Homo sapiens
caagucuguuuacugca

SEQ ID NO: 1369181 - RNA, 18 nt, Homo sapiens
caagugauccucaggcag

SEQ ID NO: 1369182 - RNA, 22 nt, Homo sapiens
caagugauguguuuacauuuac

SEQ ID NO: 1369183 - RNA, 22 nt, Homo sapiens
agcuggcagcagaguguggccu

SEQ ID NO: 1369184 - RNA, 17 nt, Homo sapiens
agcuggguguguuggca

SEQ ID NO: 1369185 - RNA, 20 nt, Homo sapiens
agcuggugguaucugaguug

SEQ ID NO: 1369186 - RNA, 12 nt, Homo sapiens
agcugucuugga

SEQ ID NO: 1369187 - RNA, 13 nt, Homo sapiens
agcugugugagaa

SEQ ID NO: 1369188 - RNA, 18 nt, Homo sapiens
agcuguguuuggaaaauu

SEQ ID NO: 1369189 - RNA, 19 nt, Homo sapiens
agcuguuaauuugaguacu

SEQ ID NO: 1369190 - RNA, 13 nt, Homo sapiens
agcuguucagcug

SEQ ID NO: 1369191 - RNA, 17 nt, Homo sapiens
agcuguuccuguucagu

SEQ ID NO: 1369192 - RNA, 14 nt, Homo sapiens
agcuuagaaugcau

SEQ ID NO: 1369193 - RNA, 15 nt, Homo sapiens
agcuuccucuggcca

SEQ ID NO: 1369194 - RNA, 21 nt, Homo sapiens
agcuugcaggguuucucgcca

SEQ ID NO: 1369195 - RNA, 16 nt, Homo sapiens
agcuuugaaaauucag

SEQ ID NO: 1369196 - RNA, 21 nt, Homo sapiens
agcuuugagcuuaagaauuuu

SEQ ID NO: 1369197 - RNA, 13 nt, Homo sapiens
aggaaaacaauaa

SEQ ID NO: 1369198 - RNA, 21 nt, Homo sapiens
aggaaaaccucaagcaguaau

SEQ ID NO: 1369199 - RNA, 17 nt, Homo sapiens
aggaaaaggcugguaca

SEQ ID NO: 1369200 - RNA, 17 nt, Homo sapiens
aggaaacucacacuccc

SEQ ID NO: 1369201 - RNA, 18 nt, Homo sapiens
aggaaauucagcccacca

SEQ ID NO: 1369202 - RNA, 22 nt, Homo sapiens
aggaacccuucuccauacccac

SEQ ID NO: 1369203 - RNA, 23 nt, Homo sapiens
aggaagcccuaagacgucccuuu

SEQ ID NO: 1369204 - RNA, 14 nt, Homo sapiens
aggaagcuccaguu

SEQ ID NO: 1369205 - RNA, 14 nt, Homo sapiens
aggaaggggugcug

SEQ ID NO: 1369206 - RNA, 23 nt, Homo sapiens
aggaaguuucuaguuuguguaac

SEQ ID NO: 1369207 - RNA, 17 nt, Homo sapiens
aggaaucccggcuccag

SEQ ID NO: 1369208 - RNA, 14 nt, Homo sapiens
aggaccaagcaucu

SEQ ID NO: 1369209 - RNA, 13 nt, Homo sapiens
aggacccagcucg

SEQ ID NO: 1369210 - RNA, 16 nt, Homo sapiens
aggacggacucacuuc

SEQ ID NO: 1369211 - RNA, 15 nt, Homo sapiens
aggacguggugacuu

SEQ ID NO: 1369212 - RNA, 20 nt, Homo sapiens
aggagagcuagcagcaggga

SEQ ID NO: 1369213 - RNA, 18 nt, Homo sapiens
aggagaggggcacagggu

SEQ ID NO: 1369214 - RNA, 17 nt, Homo sapiens
aggagauaauuguuuca

SEQ ID NO: 1369215 - RNA, 23 nt, Homo sapiens
aggagcaaucuaagcuguguuac

SEQ ID NO: 1369216 - RNA, 20 nt, Homo sapiens
aggaggcucccgaggggaag

SEQ ID NO: 1369217 - RNA, 22 nt, Homo sapiens
aggaggggccgcugccacccac

SEQ ID NO: 1369218 - RNA, 21 nt, Homo sapiens
aggauauccucccuccagaua

SEQ ID NO: 1369219 - RNA, 13 nt, Homo sapiens
aggaugacaguga

SEQ ID NO: 1369220 - RNA, 14 nt, Homo sapiens
aggaugcagcacug

SEQ ID NO: 1369221 - RNA, 15 nt, Homo sapiens
aggaugcagcacugc

SEQ ID NO: 1369222 - RNA, 16 nt, Homo sapiens
aggaugguucugugac

SEQ ID NO: 1369223 - RNA, 13 nt, Homo sapiens
aggcaacugcauu

SEQ ID NO: 1369224 - RNA, 12 nt, Homo sapiens
aggcagcacaga

SEQ ID NO: 1369225 - RNA, 16 nt, Homo sapiens
aggcagccugccuuua

SEQ ID NO: 1369226 - RNA, 19 nt, Homo sapiens
aggcaguaugccaaggguc

SEQ ID NO: 1369227 - RNA, 16 nt, Homo sapiens
aggcauaggucucuuu

SEQ ID NO: 1369228 - RNA, 15 nt, Homo sapiens
aggcaugggugcaag

SEQ ID NO: 1369229 - RNA, 16 nt, Homo sapiens
aggcauuaacacaaag

SEQ ID NO: 1369230 - RNA, 13 nt, Homo sapiens
aggcccacucugu

SEQ ID NO: 1369231 - RNA, 17 nt, Homo sapiens
aggcccccacuugccuc

SEQ ID NO: 1369232 - RNA, 14 nt, Homo sapiens
aggcccccaucucc

SEQ ID NO: 1369233 - RNA, 16 nt, Homo sapiens
aggccgagaagcaaga

SEQ ID NO: 1369234 - RNA, 20 nt, Homo sapiens
aggccuccugugacuggcag

SEQ ID NO: 1369235 - RNA, 14 nt, Homo sapiens
aggccuggacuuuc

SEQ ID NO: 1369236 - RNA, 15 nt, Homo sapiens
aggccuuggcuugau

SEQ ID NO: 1369237 - RNA, 14 nt, Homo sapiens
aggcggugcuugau

SEQ ID NO: 1369238 - RNA, 16 nt, Homo sapiens
aggcucucuugugcau

SEQ ID NO: 1369239 - RNA, 21 nt, Homo sapiens
aggcugaggcaagagaauuac

SEQ ID NO: 1369240 - RNA, 16 nt, Homo sapiens
aggcuggagugcagua

SEQ ID NO: 1369241 - RNA, 17 nt, Homo sapiens
aggcuggagugcaguga

SEQ ID NO: 1369242 - RNA, 14 nt, Homo sapiens
aggcugguggcaag

SEQ ID NO: 1369243 - RNA, 16 nt, Homo sapiens
aggcuguccuguacau

SEQ ID NO: 1369244 - RNA, 20 nt, Homo sapiens
agggaagaaaaagcaagugu

SEQ ID NO: 1369245 - RNA, 19 nt, Homo sapiens
agggaagcuggccgagggu

SEQ ID NO: 1369246 - RNA, 17 nt, Homo sapiens
agggaauaauccagaaa

SEQ ID NO: 1369247 - RNA, 20 nt, Homo sapiens
agggaauggcacagcccaaa

SEQ ID NO: 1369248 - RNA, 14 nt, Homo sapiens
agggacacuuaccc

SEQ ID NO: 1369249 - RNA, 16 nt, Homo sapiens
agggacagaugaaugc

SEQ ID NO: 1369250 - RNA, 14 nt, Homo sapiens
agggagguggcaag

SEQ ID NO: 1369251 - RNA, 17 nt, Homo sapiens
agggcaaaaagaccaag

SEQ ID NO: 1369252 - RNA, 20 nt, Homo sapiens
agggccguugcccccagacu

SEQ ID NO: 1369253 - RNA, 16 nt, Homo sapiens
agggcugucuucguau

SEQ ID NO: 1369254 - RNA, 15 nt, Homo sapiens
aggggacaagggauu

SEQ ID NO: 1369255 - RNA, 13 nt, Homo sapiens
aggggcacagggu

SEQ ID NO: 1369256 - RNA, 15 nt, Homo sapiens
aggggcccuaccugg

SEQ ID NO: 1369257 - RNA, 23 nt, Homo sapiens
aggggcuucagguccaggcugug

SEQ ID NO: 1369258 - RNA, 17 nt, Homo sapiens
agggggaauuccuggaa

SEQ ID NO: 1369259 - RNA, 15 nt, Homo sapiens
agggguuucagaauu

SEQ ID NO: 1369260 - RNA, 16 nt, Homo sapiens
agggucccucugugua

SEQ ID NO: 1369261 - RNA, 20 nt, Homo sapiens
ccagaguggccuggccagga

SEQ ID NO: 1369262 - RNA, 23 nt, Homo sapiens
ccagauugacgacaagugcugaa

SEQ ID NO: 1369263 - RNA, 16 nt, Homo sapiens
ccagcacuuugggagg

SEQ ID NO: 1369264 - RNA, 14 nt, Homo sapiens
ccagcaguacucag

SEQ ID NO: 1369265 - RNA, 20 nt, Homo sapiens
ccagccuuggugggggagcc

SEQ ID NO: 1369266 - RNA, 23 nt, Homo sapiens
ccagcgaucucuccacugugcuu

SEQ ID NO: 1369267 - RNA, 20 nt, Homo sapiens
ccagcuccaaccugcaaaga

SEQ ID NO: 1369268 - RNA, 21 nt, Homo sapiens
ccagcuccaaccugcaaagau

SEQ ID NO: 1369269 - RNA, 13 nt, Homo sapiens
ccagcugcacuga

SEQ ID NO: 1369270 - RNA, 14 nt, Homo sapiens
ccagcugugugaga

SEQ ID NO: 1369271 - RNA, 17 nt, Homo sapiens
ccaggaagccgugcccu

SEQ ID NO: 1369272 - RNA, 21 nt, Homo sapiens
ccaggacuauauuugggccug

SEQ ID NO: 1369273 - RNA, 22 nt, Homo sapiens
ccaggagaaguugaggggagca

SEQ ID NO: 1369274 - RNA, 23 nt, Homo sapiens
ccaggagcugggcagaaggccaa

SEQ ID NO: 1369275 - RNA, 22 nt, Homo sapiens
ccaggauauccucccuccagau

SEQ ID NO: 1369276 - RNA, 18 nt, Homo sapiens
ccaggcaacuugggaacu

SEQ ID NO: 1369277 - RNA, 21 nt, Homo sapiens
ccaggccaccuccccagcauu

SEQ ID NO: 1369278 - RNA, 15 nt, Homo sapiens
ccaggccccaggaag

SEQ ID NO: 1369279 - RNA, 16 nt, Homo sapiens
ccaggcugcucagggc

SEQ ID NO: 1369280 - RNA, 18 nt, Homo sapiens
ccaggcuggagugcagua

SEQ ID NO: 1369281 - RNA, 16 nt, Homo sapiens
ccagggacacauuucu

SEQ ID NO: 1369282 - RNA, 10 nt, Homo sapiens
ccaggggaug

SEQ ID NO: 1369283 - RNA, 13 nt, Homo sapiens
ccaggucagggag

SEQ ID NO: 1369284 - RNA, 16 nt, Homo sapiens
ccagguuaccucacuu

SEQ ID NO: 1369285 - RNA, 17 nt, Homo sapiens
ccagugacaaccaaaag

SEQ ID NO: 1369286 - RNA, 21 nt, Homo sapiens
ccauaauugcuuugccaaaau

SEQ ID NO: 1369287 - RNA, 15 nt, Homo sapiens
ccaucauuguaacau

SEQ ID NO: 1369288 - RNA, 13 nt, Homo sapiens
ccauccaguggag

SEQ ID NO: 1369289 - RNA, 14 nt, Homo sapiens
ccaucuagucacaa

SEQ ID NO: 1369290 - RNA, 10 nt, Homo sapiens
ccaucucagg

SEQ ID NO: 1369291 - RNA, 19 nt, Homo sapiens
ccaucucuacaaaaagcau

SEQ ID NO: 1369292 - RNA, 17 nt, Homo sapiens
ccaugaaaaugcaacaa

SEQ ID NO: 1369293 - RNA, 17 nt, Homo sapiens
ccaugauggcaacagau

SEQ ID NO: 1369294 - RNA, 22 nt, Homo sapiens
ccaugauggcaacagaucugga

SEQ ID NO: 1369295 - RNA, 21 nt, Homo sapiens
ccauggacagaagaaggcagc

SEQ ID NO: 1369296 - RNA, 12 nt, Homo sapiens
ccauuacugcau

SEQ ID NO: 1369297 - RNA, 16 nt, Homo sapiens
ccauuacugcauaaaa

SEQ ID NO: 1369298 - RNA, 16 nt, Homo sapiens
ccauugaaacaugcca

SEQ ID NO: 1369299 - RNA, 23 nt, Homo sapiens
ccauuuucuuauugcgcugcuac

SEQ ID NO: 1369300 - RNA, 21 nt, Homo sapiens
cccaaaccggcaggugcgauu

SEQ ID NO: 1369301 - RNA, 17 nt, Homo sapiens
cccaaagccaagaaaga

SEQ ID NO: 1369302 - RNA, 19 nt, Homo sapiens
cccaacacuuccagcauuu

SEQ ID NO: 1369303 - RNA, 16 nt, Homo sapiens
cccaagccugcaguca

SEQ ID NO: 1369304 - RNA, 17 nt, Homo sapiens
cccacccccuucucugc

SEQ ID NO: 1369305 - RNA, 13 nt, Homo sapiens
cccaccuuugcca

SEQ ID NO: 1369306 - RNA, 21 nt, Homo sapiens
cccacgacugcccggcagggu

SEQ ID NO: 1369307 - RNA, 18 nt, Homo sapiens
cccacuguaucuaggcaa

SEQ ID NO: 1369308 - RNA, 19 nt, Homo sapiens
cccagagacauacuugaag

SEQ ID NO: 1369309 - RNA, 21 nt, Homo sapiens
cccagagggaguagaauacgc

SEQ ID NO: 1369310 - RNA, 21 nt, Homo sapiens
cccagauagcuggcugggugg

SEQ ID NO: 1369311 - RNA, 17 nt, Homo sapiens
cccagauucuucagcuu

SEQ ID NO: 1369312 - RNA, 18 nt, Homo sapiens
cccagcagguuaccugga

SEQ ID NO: 1369313 - RNA, 23 nt, Homo sapiens
cccagcccagggcuccugcacuu

SEQ ID NO: 1369314 - RNA, 13 nt, Homo sapiens
cccagcuacuuga

SEQ ID NO: 1369315 - RNA, 23 nt, Homo sapiens
cccaggacccugaaggggccaug

SEQ ID NO: 1369316 - RNA, 15 nt, Homo sapiens
cccaggcacugcaaa

SEQ ID NO: 1369317 - RNA, 21 nt, Homo sapiens
cccaggcuggagagcacugcc

SEQ ID NO: 1369318 - RNA, 19 nt, Homo sapiens
cccaggcuggagugcagug

SEQ ID NO: 1369319 - RNA, 19 nt, Homo sapiens
cccagggcuccugcacuua

SEQ ID NO: 1369320 - RNA, 18 nt, Homo sapiens
cccaggggacaagggauu

SEQ ID NO: 1369321 - RNA, 22 nt, Homo sapiens
cccaggugguuauggagagggu

SEQ ID NO: 1369322 - RNA, 14 nt, Homo sapiens
cccaguguguuucu

SEQ ID NO: 1369323 - RNA, 16 nt, Homo sapiens
cccaguuagcucucaa

SEQ ID NO: 1369324 - RNA, 12 nt, Homo sapiens
cccauccagcua

SEQ ID NO: 1369325 - RNA, 13 nt, Homo sapiens
cccaucucuacaa

SEQ ID NO: 1369326 - RNA, 17 nt, Homo sapiens
cccaugcacugugaagg

SEQ ID NO: 1369327 - RNA, 14 nt, Homo sapiens
cccauuccugaaga

SEQ ID NO: 1369328 - RNA, 20 nt, Homo sapiens
ccccaacaaaccauccagug

SEQ ID NO: 1369329 - RNA, 20 nt, Homo sapiens
ccccaacuacccccagcugu

SEQ ID NO: 1369330 - RNA, 18 nt, Homo sapiens
ccccaccacugagccauc

SEQ ID NO: 1369331 - RNA, 15 nt, Homo sapiens
ccccaugcacuguga

SEQ ID NO: 1369332 - RNA, 16 nt, Homo sapiens
cccccacugaccagaa

SEQ ID NO: 1369333 - RNA, 14 nt, Homo sapiens
cccccagcuaagaa

SEQ ID NO: 1369334 - RNA, 21 nt, Homo sapiens
cccccgugaggaugucacuca

SEQ ID NO: 1369335 - RNA, 20 nt, Homo sapiens
ccccgugaggaugucacuca

SEQ ID NO: 1369336 - RNA, 15 nt, Homo sapiens
ccccuuagcaauaag

SEQ ID NO: 1369337 - RNA, 23 nt, Homo sapiens
cccggugggacccccguggggca

SEQ ID NO: 1369338 - RNA, 19 nt, Homo sapiens
cccguugauaacucagugg

SEQ ID NO: 1369339 - RNA, 23 nt, Homo sapiens
cccuacccuccugcugagcugcc

SEQ ID NO: 1369340 - RNA, 23 nt, Homo sapiens
cccucaacaccucugcacaagcu

SEQ ID NO: 1369341 - RNA, 21 nt, Homo sapiens
cccucaccuuggcaccagaca

SEQ ID NO: 1369342 - RNA, 18 nt, Homo sapiens
cccucauucuacugaaaa

SEQ ID NO: 1369343 - RNA, 18 nt, Homo sapiens
cccuccacagcuguguga

SEQ ID NO: 1369344 - RNA, 14 nt, Homo sapiens
cccuccacuccuca

SEQ ID NO: 1369345 - RNA, 16 nt, Homo sapiens
cccugagacaaaugga

SEQ ID NO: 1369346 - RNA, 18 nt, Homo sapiens
cccugagacaaauggagg

SEQ ID NO: 1369347 - RNA, 15 nt, Homo sapiens
cccugcccuggucca

SEQ ID NO: 1369348 - RNA, 23 nt, Homo sapiens
cccugccuuuaaaaacaaacaga

SEQ ID NO: 1369349 - RNA, 23 nt, Homo sapiens
cccugcugacacagacauccucu

SEQ ID NO: 1369350 - RNA, 16 nt, Homo sapiens
cccuggccuaggcagu

SEQ ID NO: 1369351 - RNA, 18 nt, Homo sapiens
cccuggguguccccgcug

SEQ ID NO: 1369352 - RNA, 18 nt, Homo sapiens
cccuguaacaggcuugaa

SEQ ID NO: 1369353 - RNA, 17 nt, Homo sapiens
cccugucuaaaaauuca

SEQ ID NO: 1369354 - RNA, 12 nt, Homo sapiens
cccugugcucca

SEQ ID NO: 1369355 - RNA, 22 nt, Homo sapiens
cccuuacucuugcugagucaga

SEQ ID NO: 1369356 - RNA, 20 nt, Homo sapiens
cccuucccucaccuuggcac

SEQ ID NO: 1369357 - RNA, 15 nt, Homo sapiens
cccuugaaaacugcu

SEQ ID NO: 1369358 - RNA, 22 nt, Homo sapiens
cccuuucauaaagucuugccuu

SEQ ID NO: 1369359 - RNA, 16 nt, Homo sapiens
cccuuuccccagugac

SEQ ID NO: 1369360 - RNA, 21 nt, Homo sapiens
ccgccauugccaccaggagaa

SEQ ID NO: 1369361 - RNA, 16 nt, Homo sapiens
ccgcugcgggcccacg

SEQ ID NO: 1369362 - RNA, 13 nt, Homo sapiens
ccggacugaccaa

SEQ ID NO: 1369363 - RNA, 23 nt, Homo sapiens
ccgggaggcagagguugcagugu

SEQ ID NO: 1369364 - RNA, 18 nt, Homo sapiens
ccgggucacacaaaggca

SEQ ID NO: 1369365 - RNA, 10 nt, Homo sapiens
ccgugaugcu

SEQ ID NO: 1369366 - RNA, 17 nt, Homo sapiens
ccguggcugauggugug

SEQ ID NO: 1369367 - RNA, 21 nt, Homo sapiens
ccuaagaucucgguuugccaa

SEQ ID NO: 1369368 - RNA, 22 nt, Homo sapiens
ccuaagcccuccgccauucuca

SEQ ID NO: 1369369 - RNA, 18 nt, Homo sapiens
ccuaagugcaacugcaag

SEQ ID NO: 1369370 - RNA, 19 nt, Homo sapiens
ccuaauccaggcagaucca

SEQ ID NO: 1369371 - RNA, 11 nt, Homo sapiens
ccuacagugaa

SEQ ID NO: 1369372 - RNA, 15 nt, Homo sapiens
ccuaccaagauauac

SEQ ID NO: 1369373 - RNA, 19 nt, Homo sapiens
ccuacuguagcaaccugaa

SEQ ID NO: 1369374 - RNA, 11 nt, Homo sapiens
ccuacuucuca

SEQ ID NO: 1369375 - RNA, 12 nt, Homo sapiens
ccuagacuguua

SEQ ID NO: 1369376 - RNA, 15 nt, Homo sapiens
ccuaggcauuugcug

SEQ ID NO: 1369377 - RNA, 14 nt, Homo sapiens
cguggguugcacug

SEQ ID NO: 1369378 - RNA, 14 nt, Homo sapiens
cgugugaggacuga

SEQ ID NO: 1369379 - RNA, 12 nt, Homo sapiens
cguuuaaucaca

SEQ ID NO: 1369380 - RNA, 21 nt, Homo sapiens
cguuucccagagucaucugau

SEQ ID NO: 1369381 - RNA, 15 nt, Homo sapiens
cuaaaaagagacugu

SEQ ID NO: 1369382 - RNA, 21 nt, Homo sapiens
cuaaaaagagacugugccaug

SEQ ID NO: 1369383 - RNA, 21 nt, Homo sapiens
cuaaacuucauacaauguaag

SEQ ID NO: 1369384 - RNA, 19 nt, Homo sapiens
cuaaagguuguauugcaua

SEQ ID NO: 1369385 - RNA, 18 nt, Homo sapiens
cuaaaguaucugagauua

SEQ ID NO: 1369386 - RNA, 17 nt, Homo sapiens
cuaaauaagaaaauaac

SEQ ID NO: 1369387 - RNA, 16 nt, Homo sapiens
cuaacauguaauugca

SEQ ID NO: 1369388 - RNA, 21 nt, Homo sapiens
cuaacuaugcauggugcccca

SEQ ID NO: 1369389 - RNA, 15 nt, Homo sapiens
cuaacuccugccauu

SEQ ID NO: 1369390 - RNA, 21 nt, Homo sapiens
cuaacuuuuuugcuauccagc

SEQ ID NO: 1369391 - RNA, 19 nt, Homo sapiens
cuaagacuaacaaaggcag

SEQ ID NO: 1369392 - RNA, 12 nt, Homo sapiens
cuaagacuacua

SEQ ID NO: 1369393 - RNA, 20 nt, Homo sapiens
cuaagaucucgguuugccaa

SEQ ID NO: 1369394 - RNA, 17 nt, Homo sapiens
cuaagcccccacuacaa

SEQ ID NO: 1369395 - RNA, 18 nt, Homo sapiens
cuaagcccccacuacaag

SEQ ID NO: 1369396 - RNA, 19 nt, Homo sapiens
cuaauacagacuaugucac

SEQ ID NO: 1369397 - RNA, 16 nt, Homo sapiens
cuaauaucaaaugcag

SEQ ID NO: 1369398 - RNA, 12 nt, Homo sapiens
cuaauggaauau

SEQ ID NO: 1369399 - RNA, 16 nt, Homo sapiens
cuacaagucagcucca

SEQ ID NO: 1369400 - RNA, 13 nt, Homo sapiens
cuacacagaggac

SEQ ID NO: 1369401 - RNA, 23 nt, Homo sapiens
cuacacagaggacccaggggaaa

SEQ ID NO: 1369402 - RNA, 18 nt, Homo sapiens
cuacacagaucacagcuu

SEQ ID NO: 1369403 - RNA, 16 nt, Homo sapiens
cuaccaagauauaccu

SEQ ID NO: 1369404 - RNA, 19 nt, Homo sapiens
cuaccaggcacgucugcag

SEQ ID NO: 1369405 - RNA, 21 nt, Homo sapiens
cuaccagggggucagagggau

SEQ ID NO: 1369406 - RNA, 14 nt, Homo sapiens
cuaccuaccaagau

SEQ ID NO: 1369407 - RNA, 23 nt, Homo sapiens
cuaccucugagaagacacaaggu

SEQ ID NO: 1369408 - RNA, 12 nt, Homo sapiens
cuaccuguaacu

SEQ ID NO: 1369409 - RNA, 16 nt, Homo sapiens
cuacuuuaucaauuaa

SEQ ID NO: 1369410 - RNA, 15 nt, Homo sapiens
cuacuuuguggcaau

SEQ ID NO: 1369411 - RNA, 18 nt, Homo sapiens
cuagaagggucacuuuaa

SEQ ID NO: 1369412 - RNA, 14 nt, Homo sapiens
cuagaaguggcaga

SEQ ID NO: 1369413 - RNA, 15 nt, Homo sapiens
cuagagcacugccac

SEQ ID NO: 1369414 - RNA, 14 nt, Homo sapiens
cuagaguccucacu

SEQ ID NO: 1369415 - RNA, 15 nt, Homo sapiens
cuagauggcuccucu

SEQ ID NO: 1369416 - RNA, 18 nt, Homo sapiens
cuagcacuugucucagga

SEQ ID NO: 1369417 - RNA, 23 nt, Homo sapiens
cuagcagaaaucuagaagacugu

SEQ ID NO: 1369418 - RNA, 20 nt, Homo sapiens
cuagccuuaagacauuugaa

SEQ ID NO: 1369419 - RNA, 21 nt, Homo sapiens
cuaggaaacucacacuccccu

SEQ ID NO: 1369420 - RNA, 16 nt, Homo sapiens
cuaggaaauccauuca

SEQ ID NO: 1369421 - RNA, 19 nt, Homo sapiens
cuaggcgauuuugucuacc

SEQ ID NO: 1369422 - RNA, 19 nt, Homo sapiens
cuagggauucaggcugcuu

SEQ ID NO: 1369423 - RNA, 21 nt, Homo sapiens
cuaggugagaacccuugcacu

SEQ ID NO: 1369424 - RNA, 22 nt, Homo sapiens
cuaggugagaacccuugcacua

SEQ ID NO: 1369425 - RNA, 19 nt, Homo sapiens
cuagucacaaagacuccuu

SEQ ID NO: 1369426 - RNA, 18 nt, Homo sapiens
cuaguguucuguuuguua

SEQ ID NO: 1369427 - RNA, 20 nt, Homo sapiens
cuauaaauagaugcugugua

SEQ ID NO: 1369428 - RNA, 18 nt, Homo sapiens
cuauagaauaaagccucu

SEQ ID NO: 1369429 - RNA, 16 nt, Homo sapiens
cuauauggcagugucu

SEQ ID NO: 1369430 - RNA, 13 nt, Homo sapiens
cuaucuauagaga

SEQ ID NO: 1369431 - RNA, 20 nt, Homo sapiens
cuaugaaauaucaugcucca

SEQ ID NO: 1369432 - RNA, 20 nt, Homo sapiens
cuaugaguuggacuucaguc

SEQ ID NO: 1369433 - RNA, 20 nt, Homo sapiens
cuauggcacccaugcaccuu

SEQ ID NO: 1369434 - RNA, 14 nt, Homo sapiens
cuauggugcucugu

SEQ ID NO: 1369435 - RNA, 19 nt, Homo sapiens
cuaugugccuuucacuuua

SEQ ID NO: 1369436 - RNA, 13 nt, Homo sapiens
cuauuauccuucu

SEQ ID NO: 1369437 - RNA, 15 nt, Homo sapiens
cuauuugaacaagug

SEQ ID NO: 1369438 - RNA, 23 nt, Homo sapiens
cuauuuuuauuuguuugugcauu

SEQ ID NO: 1369439 - RNA, 18 nt, Homo sapiens
cucaaagugacuauucag

SEQ ID NO: 1369440 - RNA, 19 nt, Homo sapiens
cucaagcccugcagucaca

SEQ ID NO: 1369441 - RNA, 22 nt, Homo sapiens
cucaauaaaaguuuccuuucaa

SEQ ID NO: 1369442 - RNA, 12 nt, Homo sapiens
cucaaucucuga

SEQ ID NO: 1369443 - RNA, 13 nt, Homo sapiens
cucacaccuguaa

SEQ ID NO: 1369444 - RNA, 20 nt, Homo sapiens
cucacaccuguaaucccagc

SEQ ID NO: 1369445 - RNA, 20 nt, Homo sapiens
cucacacuguaagaguucac

SEQ ID NO: 1369446 - RNA, 12 nt, Homo sapiens
cucacccaugca

SEQ ID NO: 1369447 - RNA, 12 nt, Homo sapiens
cucacgccugua

SEQ ID NO: 1369448 - RNA, 18 nt, Homo sapiens
cucacuggagacucacuu

SEQ ID NO: 1369449 - RNA, 21 nt, Homo sapiens
cucagaaaugucauguggcua

SEQ ID NO: 1369450 - RNA, 23 nt, Homo sapiens
cucagaaaugucauguggcuacc

SEQ ID NO: 1369451 - RNA, 14 nt, Homo sapiens
cucagaacugcaau

SEQ ID NO: 1369452 - RNA, 18 nt, Homo sapiens
cucagaagucaguugcaa

SEQ ID NO: 1369453 - RNA, 13 nt, Homo sapiens
cucagcaaaagau

SEQ ID NO: 1369454 - RNA, 13 nt, Homo sapiens
cucagcacucugc

SEQ ID NO: 1369455 - RNA, 22 nt, Homo sapiens
cucaggacacuaauacaccagg

SEQ ID NO: 1369456 - RNA, 15 nt, Homo sapiens
cucagguguugccaa

SEQ ID NO: 1369457 - RNA, 18 nt, Homo sapiens
cucaguauccaugcucuu

SEQ ID NO: 1369458 - RNA, 10 nt, Homo sapiens
cucagugcag

SEQ ID NO: 1369459 - RNA, 16 nt, Homo sapiens
cucauccccacaaucu

SEQ ID NO: 1369460 - RNA, 22 nt, Homo sapiens
cucaucuuagguuggcaaaaag

SEQ ID NO: 1369461 - RNA, 18 nt, Homo sapiens
cucauuuacaacugaaac

SEQ ID NO: 1369462 - RNA, 16 nt, Homo sapiens
cuccaaaccugaaguu

SEQ ID NO: 1369463 - RNA, 13 nt, Homo sapiens
cuccaaacugaag

SEQ ID NO: 1369464 - RNA, 13 nt, Homo sapiens
cuccaggugcaga

SEQ ID NO: 1369465 - RNA, 19 nt, Homo sapiens
cuccauacccacaaucuga

SEQ ID NO: 1369466 - RNA, 18 nt, Homo sapiens
cuccaucccaaccaggca

SEQ ID NO: 1369467 - RNA, 19 nt, Homo sapiens
cuccauggcugccaucuca

SEQ ID NO: 1369468 - RNA, 20 nt, Homo sapiens
cuccauuguucagaugcuuc

SEQ ID NO: 1369469 - RNA, 14 nt, Homo sapiens
cucccacaaaggag

SEQ ID NO: 1369470 - RNA, 23 nt, Homo sapiens
cucccacaccgucagguacuccu

SEQ ID NO: 1369471 - RNA, 19 nt, Homo sapiens
cucccagaacacacuccau

SEQ ID NO: 1369472 - RNA, 22 nt, Homo sapiens
cucccaggcuggagagcacugc

SEQ ID NO: 1369473 - RNA, 14 nt, Homo sapiens
cucccagugacaac

SEQ ID NO: 1369474 - RNA, 22 nt, Homo sapiens
cucccauaauugcuuugccaaa

SEQ ID NO: 1369475 - RNA, 23 nt, Homo sapiens
cucccauaauugcuuugccaaaa

SEQ ID NO: 1369476 - RNA, 16 nt, Homo sapiens
cuccccacacuaaccu

SEQ ID NO: 1369477 - RNA, 18 nt, Homo sapiens
cuccccagccaggcugcc

SEQ ID NO: 1369478 - RNA, 13 nt, Homo sapiens
cucccuaccaccu

SEQ ID NO: 1369479 - RNA, 21 nt, Homo sapiens
cucccuaccuaccaagauaua

SEQ ID NO: 1369480 - RNA, 15 nt, Homo sapiens
cucccuccagauaua

SEQ ID NO: 1369481 - RNA, 21 nt, Homo sapiens
cucccugaagccuuugcauuu

SEQ ID NO: 1369482 - RNA, 20 nt, Homo sapiens
cucccugcaucugaccagca

SEQ ID NO: 1369483 - RNA, 18 nt, Homo sapiens
cucccuggccuaggcagu

SEQ ID NO: 1369484 - RNA, 19 nt, Homo sapiens
cuccgaaugucaagguucc

SEQ ID NO: 1369485 - RNA, 11 nt, Homo sapiens
cuccuaccugg

SEQ ID NO: 1369486 - RNA, 12 nt, Homo sapiens
cuccuacuguag

SEQ ID NO: 1369487 - RNA, 11 nt, Homo sapiens
cuccugccauu

SEQ ID NO: 1369488 - RNA, 19 nt, Homo sapiens
cuccuuccaacaggagcug

SEQ ID NO: 1369489 - RNA, 12 nt, Homo sapiens
cuccuugcugca

SEQ ID NO: 1369490 - RNA, 13 nt, Homo sapiens
cucuacaaaaagc

SEQ ID NO: 1369491 - RNA, 14 nt, Homo sapiens
cucuacauguaacu

SEQ ID NO: 1369492 - RNA, 12 nt, Homo sapiens
cucuacccagua

SEQ ID NO: 1369493 - RNA, 14 nt, Homo sapiens
cucuacucuaggga

SEQ ID NO: 1369494 - RNA, 22 nt, Homo sapiens
cuggguaagaagaaagcaaaag

SEQ ID NO: 1369495 - RNA, 20 nt, Homo sapiens
cuggguccaccccaugucac

SEQ ID NO: 1369496 - RNA, 16 nt, Homo sapiens
cuggguguggggacac

SEQ ID NO: 1369497 - RNA, 15 nt, Homo sapiens
cuggucccuugcagc

SEQ ID NO: 1369498 - RNA, 19 nt, Homo sapiens
cuggugcuucgugugcucc

SEQ ID NO: 1369499 - RNA, 21 nt, Homo sapiens
cuguaauccuagcacuuuggg

SEQ ID NO: 1369500 - RNA, 22 nt, Homo sapiens
cuguacuguuacugggcccuga

SEQ ID NO: 1369501 - RNA, 13 nt, Homo sapiens
cuguagacugcca

SEQ ID NO: 1369502 - RNA, 21 nt, Homo sapiens
cuguauucccaguuacuuggg

SEQ ID NO: 1369503 - RNA, 16 nt, Homo sapiens
cugucaggauucaguu

SEQ ID NO: 1369504 - RNA, 20 nt, Homo sapiens
cuguccucagccuugccaga

SEQ ID NO: 1369505 - RNA, 20 nt, Homo sapiens
cuguccugaccugucucacc

SEQ ID NO: 1369506 - RNA, 14 nt, Homo sapiens
cugucggugggacc

SEQ ID NO: 1369507 - RNA, 20 nt, Homo sapiens
cugucuguuuccucuguaua

SEQ ID NO: 1369508 - RNA, 22 nt, Homo sapiens
cugucuucguauucccauuaga

SEQ ID NO: 1369509 - RNA, 16 nt, Homo sapiens
cugugaaaauugacca

SEQ ID NO: 1369510 - RNA, 13 nt, Homo sapiens
cugugaaauacca

SEQ ID NO: 1369511 - RNA, 13 nt, Homo sapiens
cugugaucuugcu

SEQ ID NO: 1369512 - RNA, 19 nt, Homo sapiens
cugugccauuucucaggga

SEQ ID NO: 1369513 - RNA, 22 nt, Homo sapiens
cugugccccuugacaacuggca

SEQ ID NO: 1369514 - RNA, 13 nt, Homo sapiens
cugugcugugagu

SEQ ID NO: 1369515 - RNA, 18 nt, Homo sapiens
cuguggaugauaaaacac

SEQ ID NO: 1369516 - RNA, 17 nt, Homo sapiens
cuguggcuagugacaaa

SEQ ID NO: 1369517 - RNA, 15 nt, Homo sapiens
cuguggcucacguga

SEQ ID NO: 1369518 - RNA, 15 nt, Homo sapiens
cugugugaaggugaa

SEQ ID NO: 1369519 - RNA, 17 nt, Homo sapiens
cuguguguacuaauaca

SEQ ID NO: 1369520 - RNA, 21 nt, Homo sapiens
cuguguuauucuuugcgugua

SEQ ID NO: 1369521 - RNA, 16 nt, Homo sapiens
cuguuacuuuggcaau

SEQ ID NO: 1369522 - RNA, 19 nt, Homo sapiens
cuguuauuauauuugacau

SEQ ID NO: 1369523 - RNA, 16 nt, Homo sapiens
cuguucuaacauguaa

SEQ ID NO: 1369524 - RNA, 14 nt, Homo sapiens
cuguugacauauuu

SEQ ID NO: 1369525 - RNA, 15 nt, Homo sapiens
cuguugcauauacca

SEQ ID NO: 1369526 - RNA, 18 nt, Homo sapiens
cuuaagaauacacaggau

SEQ ID NO: 1369527 - RNA, 21 nt, Homo sapiens
cuuaagagacacuccaaaccu

SEQ ID NO: 1369528 - RNA, 23 nt, Homo sapiens
cuuaauaaaagaacaugcuugaa

SEQ ID NO: 1369529 - RNA, 14 nt, Homo sapiens
cuuacaaacaugug

SEQ ID NO: 1369530 - RNA, 18 nt, Homo sapiens
cuuacaaacaugugguua

SEQ ID NO: 1369531 - RNA, 20 nt, Homo sapiens
cuuacauuugaaaucuauga

SEQ ID NO: 1369532 - RNA, 22 nt, Homo sapiens
cuuagagaggacaauacugggg

SEQ ID NO: 1369533 - RNA, 15 nt, Homo sapiens
cuuagggaagaaaaa

SEQ ID NO: 1369534 - RNA, 12 nt, Homo sapiens
cuuagugacaaa

SEQ ID NO: 1369535 - RNA, 20 nt, Homo sapiens
cuuaugguaccagaugcagc

SEQ ID NO: 1369536 - RNA, 17 nt, Homo sapiens
cuucaaagcaaagcucu

SEQ ID NO: 1369537 - RNA, 23 nt, Homo sapiens
cuucacagaugugugauucacag

SEQ ID NO: 1369538 - RNA, 23 nt, Homo sapiens
cuucagucuugaugcaguuucau

SEQ ID NO: 1369539 - RNA, 13 nt, Homo sapiens
cuucagugcugcu

SEQ ID NO: 1369540 - RNA, 14 nt, Homo sapiens
cuucaguuaauucu

SEQ ID NO: 1369541 - RNA, 14 nt, Homo sapiens
cuucauacuccuuu

SEQ ID NO: 1369542 - RNA, 16 nt, Homo sapiens
cuucaugcccuucuga

SEQ ID NO: 1369543 - RNA, 13 nt, Homo sapiens
cuucauugccuua

SEQ ID NO: 1369544 - RNA, 20 nt, Homo sapiens
cuuccaaacauuaaugcaau

SEQ ID NO: 1369545 - RNA, 18 nt, Homo sapiens
cuuccaacguggcccaga

SEQ ID NO: 1369546 - RNA, 20 nt, Homo sapiens
cuuccaacguggcccagaga

SEQ ID NO: 1369547 - RNA, 17 nt, Homo sapiens
cuuccacuucaggguuc

SEQ ID NO: 1369548 - RNA, 17 nt, Homo sapiens
cuuccagaaaacaaaac

SEQ ID NO: 1369549 - RNA, 18 nt, Homo sapiens
cuuccaucuagucacaaa

SEQ ID NO: 1369550 - RNA, 19 nt, Homo sapiens
cuucccgaaccccaaggag

SEQ ID NO: 1369551 - RNA, 13 nt, Homo sapiens
cuucccuaccuca

SEQ ID NO: 1369552 - RNA, 21 nt, Homo sapiens
cuuccguggucagagugccac

SEQ ID NO: 1369553 - RNA, 21 nt, Homo sapiens
cuuccucccaacaagcagcug

SEQ ID NO: 1369554 - RNA, 19 nt, Homo sapiens
cuuccugaguggugccaaa

SEQ ID NO: 1369555 - RNA, 20 nt, Homo sapiens
cuuccugaguggugccaaac

SEQ ID NO: 1369556 - RNA, 13 nt, Homo sapiens
cuuccuggccccu

SEQ ID NO: 1369557 - RNA, 14 nt, Homo sapiens
cuucggacaacuca

SEQ ID NO: 1369558 - RNA, 21 nt, Homo sapiens
cuucgggaagaaggggacaau

SEQ ID NO: 1369559 - RNA, 22 nt, Homo sapiens
cuucuaauugcuguguguccca

SEQ ID NO: 1369560 - RNA, 17 nt, Homo sapiens
cuucucaccugggccua

SEQ ID NO: 1369561 - RNA, 21 nt, Homo sapiens
cuucugagccugccuuucucc

SEQ ID NO: 1369562 - RNA, 16 nt, Homo sapiens
cuucugcccuugccaa

SEQ ID NO: 1369563 - RNA, 12 nt, Homo sapiens
cuucugcuacug

SEQ ID NO: 1369564 - RNA, 21 nt, Homo sapiens
cuucuggacugguuuucacau

SEQ ID NO: 1369565 - RNA, 15 nt, Homo sapiens
cuucugggucuccag

SEQ ID NO: 1369566 - RNA, 18 nt, Homo sapiens
cuucuugaaaucaaucaa

SEQ ID NO: 1369567 - RNA, 20 nt, Homo sapiens
cuucuugccucugugcugug

SEQ ID NO: 1369568 - RNA, 14 nt, Homo sapiens
cuugaaaacugcug

SEQ ID NO: 1369569 - RNA, 15 nt, Homo sapiens
cuugaaaucaagggc

SEQ ID NO: 1369570 - RNA, 14 nt, Homo sapiens
cuugaaucaaagaa

SEQ ID NO: 1369571 - RNA, 23 nt, Homo sapiens
cuugaccaagcaggaagcucaga

SEQ ID NO: 1369572 - RNA, 16 nt, Homo sapiens
cuugauaaagggccaa

SEQ ID NO: 1369573 - RNA, 22 nt, Homo sapiens
cuugcaaauaccuccucccuaa

SEQ ID NO: 1369574 - RNA, 20 nt, Homo sapiens
cuugcaccccaaagcuuucc

SEQ ID NO: 1369575 - RNA, 18 nt, Homo sapiens
cuugcaggguuucucgcc

SEQ ID NO: 1369576 - RNA, 16 nt, Homo sapiens
cuugcaugugcugcag

SEQ ID NO: 1369577 - RNA, 19 nt, Homo sapiens
cuugccaguugggggaaaa

SEQ ID NO: 1369578 - RNA, 15 nt, Homo sapiens
cuugccuaggcgauu

SEQ ID NO: 1369579 - RNA, 18 nt, Homo sapiens
cuugccugcagggccaug

SEQ ID NO: 1369580 - RNA, 18 nt, Homo sapiens
cuugccuugcugaacucc

SEQ ID NO: 1369581 - RNA, 19 nt, Homo sapiens
cuuggaggccagccaguga

SEQ ID NO: 1369582 - RNA, 21 nt, Homo sapiens
cuuggaggccagccagugacc

SEQ ID NO: 1369583 - RNA, 15 nt, Homo sapiens
cuuggcuugauggaa

SEQ ID NO: 1369584 - RNA, 17 nt, Homo sapiens
cuuggggcccagugcau

SEQ ID NO: 1369585 - RNA, 23 nt, Homo sapiens
cuugguaaaaacugcagugucuu

SEQ ID NO: 1369586 - RNA, 15 nt, Homo sapiens
cuugguaauuguacu

SEQ ID NO: 1369587 - RNA, 23 nt, Homo sapiens
cuugguaauuguacuaaagccaa

SEQ ID NO: 1369588 - RNA, 15 nt, Homo sapiens
cuugguucucuccac

SEQ ID NO: 1369589 - RNA, 17 nt, Homo sapiens
cuuguaaaugugguaaa

SEQ ID NO: 1369590 - RNA, 15 nt, Homo sapiens
cuuguauguuuagag

SEQ ID NO: 1369591 - RNA, 14 nt, Homo sapiens
cuuguauuuccaaa

SEQ ID NO: 1369592 - RNA, 22 nt, Homo sapiens
cuugucuggcagcaggaugcuc

SEQ ID NO: 1369593 - RNA, 18 nt, Homo sapiens
cuuguuaaagagcacugg

SEQ ID NO: 1369594 - RNA, 18 nt, Homo sapiens
cuuguuaauuuuauucaa

SEQ ID NO: 1369595 - RNA, 16 nt, Homo sapiens
cuuguuucugcaucuu

SEQ ID NO: 1369596 - RNA, 19 nt, Homo sapiens
cuuuaaaauguaaagccau

SEQ ID NO: 1369597 - RNA, 22 nt, Homo sapiens
cuuuaacauuuuacugugcugu

SEQ ID NO: 1369598 - RNA, 14 nt, Homo sapiens
cuuuaagccugcau

SEQ ID NO: 1369599 - RNA, 18 nt, Homo sapiens
cuuuagaaagcugacauu

SEQ ID NO: 1369600 - RNA, 21 nt, Homo sapiens
cuuuagaaagcugacauugcc

SEQ ID NO: 1369601 - RNA, 20 nt, Homo sapiens
cuuuaguugauuuaaacucu

SEQ ID NO: 1369602 - RNA, 17 nt, Homo sapiens
cuuuaucaccucauucu

SEQ ID NO: 1369603 - RNA, 15 nt, Homo sapiens
cuuucaucagaggaa

SEQ ID NO: 1369604 - RNA, 15 nt, Homo sapiens
cuuucccaucuuaaa

SEQ ID NO: 1369605 - RNA, 22 nt, Homo sapiens
cuuuccccagugacaccucagc

SEQ ID NO: 1369606 - RNA, 16 nt, Homo sapiens
cuuuccucgccugaca

SEQ ID NO: 1369607 - RNA, 15 nt, Homo sapiens
cuuuccugcaacuca

SEQ ID NO: 1369608 - RNA, 18 nt, Homo sapiens
cuuucugcuaucaaagag

SEQ ID NO: 1369609 - RNA, 19 nt, Homo sapiens
cuuucugcuaucaaagagg

SEQ ID NO: 1369610 - RNA, 19 nt, Homo sapiens
gacagagcagaacuuucac

SEQ ID NO: 1369611 - RNA, 13 nt, Homo sapiens
gacaggauguguu

SEQ ID NO: 1369612 - RNA, 20 nt, Homo sapiens
gacaggccgggcaguguccc

SEQ ID NO: 1369613 - RNA, 14 nt, Homo sapiens
gacagggcuucucc

SEQ ID NO: 1369614 - RNA, 22 nt, Homo sapiens
gacaguagugaaaucuugugau

SEQ ID NO: 1369615 - RNA, 16 nt, Homo sapiens
gacaguugcagcccuu

SEQ ID NO: 1369616 - RNA, 22 nt, Homo sapiens
gacauagaaaguucauggaacu

SEQ ID NO: 1369617 - RNA, 19 nt, Homo sapiens
gacauggagaccgugacca

SEQ ID NO: 1369618 - RNA, 15 nt, Homo sapiens
gacauguggggccag

SEQ ID NO: 1369619 - RNA, 16 nt, Homo sapiens
gacauuccugcaggga

SEQ ID NO: 1369620 - RNA, 19 nt, Homo sapiens
gacauuggcaccuaaucca

SEQ ID NO: 1369621 - RNA, 14 nt, Homo sapiens
gaccaaaacaaaca

SEQ ID NO: 1369622 - RNA, 15 nt, Homo sapiens
gaccaacugggccca

SEQ ID NO: 1369623 - RNA, 22 nt, Homo sapiens
gaccaagcaggaagcucagacu

SEQ ID NO: 1369624 - RNA, 17 nt, Homo sapiens
gaccaagcuuguccaac

SEQ ID NO: 1369625 - RNA, 12 nt, Homo sapiens
gaccaagugaug

SEQ ID NO: 1369626 - RNA, 21 nt, Homo sapiens
gaccaguaugcuuggacugaa

SEQ ID NO: 1369627 - RNA, 15 nt, Homo sapiens
gacccaccacuggaa

SEQ ID NO: 1369628 - RNA, 20 nt, Homo sapiens
gacccccguggggcagggag

SEQ ID NO: 1369629 - RNA, 18 nt, Homo sapiens
gaccccucgcaacugucc

SEQ ID NO: 1369630 - RNA, 13 nt, Homo sapiens
gaccccucuaccu

SEQ ID NO: 1369631 - RNA, 17 nt, Homo sapiens
gacccuguaaaauggag

SEQ ID NO: 1369632 - RNA, 16 nt, Homo sapiens
gaccuaguauaucagu

SEQ ID NO: 1369633 - RNA, 18 nt, Homo sapiens
gaccuaguauaucaguga

SEQ ID NO: 1369634 - RNA, 15 nt, Homo sapiens
gaccuccacuugcuu

SEQ ID NO: 1369635 - RNA, 14 nt, Homo sapiens
gaccugauccugga

SEQ ID NO: 1369636 - RNA, 18 nt, Homo sapiens
gaccuuaugagaaacugc

SEQ ID NO: 1369637 - RNA, 19 nt, Homo sapiens
gaccuuguagagaacacgc

SEQ ID NO: 1369638 - RNA, 18 nt, Homo sapiens
gacggugcccaagccaga

SEQ ID NO: 1369639 - RNA, 14 nt, Homo sapiens
gacuaacaaaggca

SEQ ID NO: 1369640 - RNA, 20 nt, Homo sapiens
gacuauggauaaacuaaaca

SEQ ID NO: 1369641 - RNA, 19 nt, Homo sapiens
gacucaaaccaacucagug

SEQ ID NO: 1369642 - RNA, 18 nt, Homo sapiens
gacucaugguguguuaca

SEQ ID NO: 1369643 - RNA, 16 nt, Homo sapiens
gacucgguuucuccaa

SEQ ID NO: 1369644 - RNA, 16 nt, Homo sapiens
gacucuaggugcccuu

SEQ ID NO: 1369645 - RNA, 23 nt, Homo sapiens
gacucuccagaaagcucaucuca

SEQ ID NO: 1369646 - RNA, 17 nt, Homo sapiens
gacucuuuaugcuugca

SEQ ID NO: 1369647 - RNA, 19 nt, Homo sapiens
gacucuuuaugcuugcaaa

SEQ ID NO: 1369648 - RNA, 13 nt, Homo sapiens
gacugccugaaca

SEQ ID NO: 1369649 - RNA, 14 nt, Homo sapiens
gacugcugagucaa

SEQ ID NO: 1369650 - RNA, 19 nt, Homo sapiens
gacuggggcgucaccucca

SEQ ID NO: 1369651 - RNA, 13 nt, Homo sapiens
gacuggugcugca

SEQ ID NO: 1369652 - RNA, 15 nt, Homo sapiens
gacuucuugaaauca

SEQ ID NO: 1369653 - RNA, 23 nt, Homo sapiens
gacuucuugguacccagucaccu

SEQ ID NO: 1369654 - RNA, 18 nt, Homo sapiens
gacuugacagaacacugu

SEQ ID NO: 1369655 - RNA, 17 nt, Homo sapiens
gacuuuuuccuugggcu

SEQ ID NO: 1369656 - RNA, 23 nt, Homo sapiens
gagaaaaaauauuuuccugccag

SEQ ID NO: 1369657 - RNA, 16 nt, Homo sapiens
gagaaacagccugugu

SEQ ID NO: 1369658 - RNA, 20 nt, Homo sapiens
gagaaagggcggugaacucu

SEQ ID NO: 1369659 - RNA, 16 nt, Homo sapiens
gagaacccuugcacua

SEQ ID NO: 1369660 - RNA, 22 nt, Homo sapiens
gagaagcaccagcaauucucuu

SEQ ID NO: 1369661 - RNA, 23 nt, Homo sapiens
gagaagguauuagcaaagcaaaa

SEQ ID NO: 1369662 - RNA, 19 nt, Homo sapiens
gagaauaauucuugcaaua

SEQ ID NO: 1369663 - RNA, 13 nt, Homo sapiens
gagacaaauggag

SEQ ID NO: 1369664 - RNA, 12 nt, Homo sapiens
gagacaagcaug

SEQ ID NO: 1369665 - RNA, 14 nt, Homo sapiens
gagacauacuugaa

SEQ ID NO: 1369666 - RNA, 18 nt, Homo sapiens
gagacgguuuccagggag

SEQ ID NO: 1369667 - RNA, 15 nt, Homo sapiens
gagacucagugcaga

SEQ ID NO: 1369668 - RNA, 20 nt, Homo sapiens
gagacuuugacucuccagaa

SEQ ID NO: 1369669 - RNA, 18 nt, Homo sapiens
gagauaauucuagcuuug

SEQ ID NO: 1369670 - RNA, 20 nt, Homo sapiens
gagaucgugccauugcacuc

SEQ ID NO: 1369671 - RNA, 17 nt, Homo sapiens
gagaucuuaagauucca

SEQ ID NO: 1369672 - RNA, 23 nt, Homo sapiens
gagcacaauuucccuucauacuc

SEQ ID NO: 1369673 - RNA, 15 nt, Homo sapiens
gagcagugagcacug

SEQ ID NO: 1369674 - RNA, 23 nt, Homo sapiens
gagccaauugauuucaacagaau

SEQ ID NO: 1369675 - RNA, 16 nt, Homo sapiens
gagccacguauguuuu

SEQ ID NO: 1369676 - RNA, 18 nt, Homo sapiens
gagccagggcugucuucg

SEQ ID NO: 1369677 - RNA, 21 nt, Homo sapiens
gagccccaggggacaagggau

SEQ ID NO: 1369678 - RNA, 22 nt, Homo sapiens
gagcccucuaugguguggcaaa

SEQ ID NO: 1369679 - RNA, 14 nt, Homo sapiens
gagcccuuaugaca

SEQ ID NO: 1369680 - RNA, 20 nt, Homo sapiens
gagccgagaucgugccauug

SEQ ID NO: 1369681 - RNA, 15 nt, Homo sapiens
gagccugcagggaag

SEQ ID NO: 1369682 - RNA, 16 nt, Homo sapiens
gagccugcugcauggg

SEQ ID NO: 1369683 - RNA, 16 nt, Homo sapiens
gagccuggcaagaaug

SEQ ID NO: 1369684 - RNA, 18 nt, Homo sapiens
gagccuucaagugccaaa

SEQ ID NO: 1369685 - RNA, 14 nt, Homo sapiens
gagcgagacuuggu

SEQ ID NO: 1369686 - RNA, 23 nt, Homo sapiens
gagcgagggcauaaauacagcua

SEQ ID NO: 1369687 - RNA, 21 nt, Homo sapiens
gagcucaggucccaggccagc

SEQ ID NO: 1369688 - RNA, 15 nt, Homo sapiens
gagcuccacugccau

SEQ ID NO: 1369689 - RNA, 16 nt, Homo sapiens
gagcugggauguuucu

SEQ ID NO: 1369690 - RNA, 21 nt, Homo sapiens
gagcugggcagaaggccaaga

SEQ ID NO: 1369691 - RNA, 19 nt, Homo sapiens
gaggcaagugugggccacu

SEQ ID NO: 1369692 - RNA, 20 nt, Homo sapiens
gaggcagagcuugcagugag

SEQ ID NO: 1369693 - RNA, 20 nt, Homo sapiens
gaggcagaggcugcauugag

SEQ ID NO: 1369694 - RNA, 20 nt, Homo sapiens
gaggcaggagaaucgcuuga

SEQ ID NO: 1369695 - RNA, 22 nt, Homo sapiens
gaggcauucacuagaggugaaa

SEQ ID NO: 1369696 - RNA, 14 nt, Homo sapiens
gaggccaugugcau

SEQ ID NO: 1369697 - RNA, 15 nt, Homo sapiens
gaggcccccaucucc

SEQ ID NO: 1369698 - RNA, 15 nt, Homo sapiens
gaggccucgacccac

SEQ ID NO: 1369699 - RNA, 17 nt, Homo sapiens
gaggccuggacuuuccu

SEQ ID NO: 1369700 - RNA, 22 nt, Homo sapiens
gaggccuggacuuuccugcaac

SEQ ID NO: 1369701 - RNA, 16 nt, Homo sapiens
gaggcugaggcaagag

SEQ ID NO: 1369702 - RNA, 19 nt, Homo sapiens
gaggcuggguucauuugug

SEQ ID NO: 1369703 - RNA, 16 nt, Homo sapiens
gagggcagaucacuuc

SEQ ID NO: 1369704 - RNA, 20 nt, Homo sapiens
gagggcagcuggagaucuua

SEQ ID NO: 1369705 - RNA, 12 nt, Homo sapiens
gagggcugguug

SEQ ID NO: 1369706 - RNA, 17 nt, Homo sapiens
gagguaaauaaguaaaa

SEQ ID NO: 1369707 - RNA, 16 nt, Homo sapiens
gagguugggcuuccau

SEQ ID NO: 1369708 - RNA, 14 nt, Homo sapiens
gaguccacuuuguu

SEQ ID NO: 1369709 - RNA, 15 nt, Homo sapiens
gaguccucacuccca

SEQ ID NO: 1369710 - RNA, 21 nt, Homo sapiens
gagucucccuaaggcaugugu

SEQ ID NO: 1369711 - RNA, 15 nt, Homo sapiens
gagucugaacagcug

SEQ ID NO: 1369712 - RNA, 11 nt, Homo sapiens
gagugcaguga

SEQ ID NO: 1369713 - RNA, 21 nt, Homo sapiens
gagugcuuccgcugcggugau

SEQ ID NO: 1369714 - RNA, 11 nt, Homo sapiens
gaguggugcca

SEQ ID NO: 1369715 - RNA, 21 nt, Homo sapiens
gaguuugggaacugcaauaac

SEQ ID NO: 1369716 - RNA, 18 nt, Homo sapiens
gauaacuaggaaauccau

SEQ ID NO: 1369717 - RNA, 13 nt, Homo sapiens
gauaacucagugg

SEQ ID NO: 1369718 - RNA, 12 nt, Homo sapiens
gauaacuuugac

SEQ ID NO: 1369719 - RNA, 13 nt, Homo sapiens
gauaauacuucca

SEQ ID NO: 1369720 - RNA, 19 nt, Homo sapiens
gauaauuguuucauucauc

SEQ ID NO: 1369721 - RNA, 17 nt, Homo sapiens
gauacauacaccagcau

SEQ ID NO: 1369722 - RNA, 13 nt, Homo sapiens
gauacauacagaa

SEQ ID NO: 1369723 - RNA, 19 nt, Homo sapiens
gauacccaaaggucaagaa

SEQ ID NO: 1369724 - RNA, 17 nt, Homo sapiens
gauacugcgacuuucug

SEQ ID NO: 1369725 - RNA, 19 nt, Homo sapiens
gauacugcgacuuucugcc

SEQ ID NO: 1369726 - RNA, 19 nt, Homo sapiens
aagugagacuccgucacaa

SEQ ID NO: 1369727 - RNA, 20 nt, Homo sapiens
aagugauccucccaccucag

SEQ ID NO: 1369728 - RNA, 22 nt, Homo sapiens
aagugauuuuuuuccacaagau

SEQ ID NO: 1369729 - RNA, 16 nt, Homo sapiens
aagugcaaauuugaua

SEQ ID NO: 1369730 - RNA, 11 nt, Homo sapiens
aagugccccug

SEQ ID NO: 1369731 - RNA, 20 nt, Homo sapiens
aagugcugcgauuacaggca

SEQ ID NO: 1369732 - RNA, 21 nt, Homo sapiens
aagugcugggauuacaggugu

SEQ ID NO: 1369733 - RNA, 16 nt, Homo sapiens
aagugcuuucuucucc

SEQ ID NO: 1369734 - RNA, 14 nt, Homo sapiens
aaguggcaaaaaua

SEQ ID NO: 1369735 - RNA, 21 nt, Homo sapiens
aaguggugagaacuacucagg

SEQ ID NO: 1369736 - RNA, 22 nt, Homo sapiens
aaguguaagaaacacacugagg

SEQ ID NO: 1369737 - RNA, 19 nt, Homo sapiens
aaguguauuauaacagugu

SEQ ID NO: 1369738 - RNA, 11 nt, Homo sapiens
aagugugagua

SEQ ID NO: 1369739 - RNA, 15 nt, Homo sapiens
aagugugugaucugu

SEQ ID NO: 1369740 - RNA, 13 nt, Homo sapiens
aagugugugcaug

SEQ ID NO: 1369741 - RNA, 15 nt, Homo sapiens
aaguuaacuuccaau

SEQ ID NO: 1369742 - RNA, 22 nt, Homo sapiens
aaguuacauugcuggucuugua

SEQ ID NO: 1369743 - RNA, 22 nt, Homo sapiens
aaguuagggaauggcacagccc

SEQ ID NO: 1369744 - RNA, 17 nt, Homo sapiens
aaguugcucugaaguca

SEQ ID NO: 1369745 - RNA, 19 nt, Homo sapiens
aaguuuccccaccagugaa

SEQ ID NO: 1369746 - RNA, 23 nt, Homo sapiens
aaguuuucagaaccucuucccca

SEQ ID NO: 1369747 - RNA, 19 nt, Homo sapiens
aaguuuugacaucaaugau

SEQ ID NO: 1369748 - RNA, 16 nt, Homo sapiens
aauaaaaaucauucua

SEQ ID NO: 1369749 - RNA, 21 nt, Homo sapiens
aauaaaacaucuuuccagucc

SEQ ID NO: 1369750 - RNA, 18 nt, Homo sapiens
aauaaaauuuaggaccaa

SEQ ID NO: 1369751 - RNA, 17 nt, Homo sapiens
aauaaacaacauugucu

SEQ ID NO: 1369752 - RNA, 17 nt, Homo sapiens
aauaaacuagacucuga

SEQ ID NO: 1369753 - RNA, 20 nt, Homo sapiens
aauaaagaugcccacugagg

SEQ ID NO: 1369754 - RNA, 15 nt, Homo sapiens
aauaaaguguuuuca

SEQ ID NO: 1369755 - RNA, 16 nt, Homo sapiens
aauaaauaaaugcaau

SEQ ID NO: 1369756 - RNA, 13 nt, Homo sapiens
aauaaauaagaau

SEQ ID NO: 1369757 - RNA, 14 nt, Homo sapiens
aauaacaaucacaa

SEQ ID NO: 1369758 - RNA, 13 nt, Homo sapiens
aauaagagaagcu

SEQ ID NO: 1369759 - RNA, 23 nt, Homo sapiens
aauaagcaggcgugaccugccag

SEQ ID NO: 1369760 - RNA, 15 nt, Homo sapiens
aauaaguacugugua

SEQ ID NO: 1369761 - RNA, 14 nt, Homo sapiens
aauaauaaacagug

SEQ ID NO: 1369762 - RNA, 14 nt, Homo sapiens
aauaauaccuaagc

SEQ ID NO: 1369763 - RNA, 21 nt, Homo sapiens
aauaaugaguuagaacuauua

SEQ ID NO: 1369764 - RNA, 18 nt, Homo sapiens
aauacaauaaguuaacua

SEQ ID NO: 1369765 - RNA, 14 nt, Homo sapiens
aauacacacaagua

SEQ ID NO: 1369766 - RNA, 17 nt, Homo sapiens
aauacaguaucucaggg

SEQ ID NO: 1369767 - RNA, 20 nt, Homo sapiens
aauaccucaaccuaugguau

SEQ ID NO: 1369768 - RNA, 18 nt, Homo sapiens
aauacugauggugcauuu

SEQ ID NO: 1369769 - RNA, 14 nt, Homo sapiens
aauagaagggcaaa

SEQ ID NO: 1369770 - RNA, 23 nt, Homo sapiens
aauagaucaaaguccagcaggca

SEQ ID NO: 1369771 - RNA, 20 nt, Homo sapiens
aauagcaaccuuuuuaucuc

SEQ ID NO: 1369772 - RNA, 13 nt, Homo sapiens
aauagccaaucau

SEQ ID NO: 1369773 - RNA, 13 nt, Homo sapiens
aauagccacugca

SEQ ID NO: 1369774 - RNA, 13 nt, Homo sapiens
aauagccauaaag

SEQ ID NO: 1369775 - RNA, 15 nt, Homo sapiens
aauagccucccugua

SEQ ID NO: 1369776 - RNA, 17 nt, Homo sapiens
aauaggagagagaucau

SEQ ID NO: 1369777 - RNA, 19 nt, Homo sapiens
aauaggugugaacagggaa

SEQ ID NO: 1369778 - RNA, 22 nt, Homo sapiens
aauaguacagacagaaggugcu

SEQ ID NO: 1369779 - RNA, 12 nt, Homo sapiens
aauaguauuuau

SEQ ID NO: 1369780 - RNA, 14 nt, Homo sapiens
aauagugauuucca

SEQ ID NO: 1369781 - RNA, 14 nt, Homo sapiens
aauauaaagcaucu

SEQ ID NO: 1369782 - RNA, 14 nt, Homo sapiens
aauauaacugccuu

SEQ ID NO: 1369783 - RNA, 18 nt, Homo sapiens
aauauacauucaaacuua

SEQ ID NO: 1369784 - RNA, 17 nt, Homo sapiens
aauauaccuucagagac

SEQ ID NO: 1369785 - RNA, 15 nt, Homo sapiens
aauauagcucaggua

SEQ ID NO: 1369786 - RNA, 13 nt, Homo sapiens
aauauaggggcaa

SEQ ID NO: 1369787 - RNA, 19 nt, Homo sapiens
aauauauauguugauuucu

SEQ ID NO: 1369788 - RNA, 13 nt, Homo sapiens
aauauaucaguaa

SEQ ID NO: 1369789 - RNA, 14 nt, Homo sapiens
aauaucacaucacu

SEQ ID NO: 1369790 - RNA, 15 nt, Homo sapiens
aauaucaguuacuca

SEQ ID NO: 1369791 - RNA, 19 nt, Homo sapiens
aauaugauaauaaaggcau

SEQ ID NO: 1369792 - RNA, 19 nt, Homo sapiens
aauaugcaccaaaucaucu

SEQ ID NO: 1369793 - RNA, 16 nt, Homo sapiens
aauaugggcacuuuaa

SEQ ID NO: 1369794 - RNA, 15 nt, Homo sapiens
aauauuuauaagcua

SEQ ID NO: 1369795 - RNA, 19 nt, Homo sapiens
aauauuuauuguauuuuag

SEQ ID NO: 1369796 - RNA, 20 nt, Homo sapiens
aauauuuccuuaaacugugu

SEQ ID NO: 1369797 - RNA, 14 nt, Homo sapiens
aauauuuguagaag

SEQ ID NO: 1369798 - RNA, 18 nt, Homo sapiens
aauauuuuaagacuauaa

SEQ ID NO: 1369799 - RNA, 15 nt, Homo sapiens
aauauuuuaccacug

SEQ ID NO: 1369800 - RNA, 15 nt, Homo sapiens
aauauuuuccaugaa

SEQ ID NO: 1369801 - RNA, 23 nt, Homo sapiens
aauauuuuccaugaaaaugcaac

SEQ ID NO: 1369802 - RNA, 20 nt, Homo sapiens
aaucaaaacccaacaugacu

SEQ ID NO: 1369803 - RNA, 13 nt, Homo sapiens
aaucaaauagcau

SEQ ID NO: 1369804 - RNA, 12 nt, Homo sapiens
aaucaacucuaa

SEQ ID NO: 1369805 - RNA, 21 nt, Homo sapiens
aaucaaggugauugugauuau

SEQ ID NO: 1369806 - RNA, 14 nt, Homo sapiens
aaucaaguuuccaa

SEQ ID NO: 1369807 - RNA, 20 nt, Homo sapiens
aaucagacuucacacugcaa

SEQ ID NO: 1369808 - RNA, 18 nt, Homo sapiens
aaucagagagcucacuaa

SEQ ID NO: 1369809 - RNA, 14 nt, Homo sapiens
aaucagaucauuuc

SEQ ID NO: 1369810 - RNA, 18 nt, Homo sapiens
aaucagguccucagagaa

SEQ ID NO: 1369811 - RNA, 19 nt, Homo sapiens
aaucauaaaacuugaugug

SEQ ID NO: 1369812 - RNA, 16 nt, Homo sapiens
aaucauacuuagcaaa

SEQ ID NO: 1369813 - RNA, 21 nt, Homo sapiens
aaucaucucucaucacuuuuc

SEQ ID NO: 1369814 - RNA, 23 nt, Homo sapiens
aaucauugauugucagcuacuaa

SEQ ID NO: 1369815 - RNA, 21 nt, Homo sapiens
aaucauugcuuaugacaugau

SEQ ID NO: 1369816 - RNA, 14 nt, Homo sapiens
aauccacucuccau

SEQ ID NO: 1369817 - RNA, 19 nt, Homo sapiens
aauccagagagcagugugg

SEQ ID NO: 1369818 - RNA, 21 nt, Homo sapiens
aauccaggcgugguggcacac

SEQ ID NO: 1369819 - RNA, 16 nt, Homo sapiens
aaucccagcuacucaa

SEQ ID NO: 1369820 - RNA, 17 nt, Homo sapiens
aauccuaaauaauguua

SEQ ID NO: 1369821 - RNA, 14 nt, Homo sapiens
aauccuguacaauu

SEQ ID NO: 1369822 - RNA, 16 nt, Homo sapiens
aauccuguccucagcu

SEQ ID NO: 1369823 - RNA, 14 nt, Homo sapiens
aauccuucuaaucu

SEQ ID NO: 1369824 - RNA, 19 nt, Homo sapiens
aauccuuuacuguuaguca

SEQ ID NO: 1369825 - RNA, 18 nt, Homo sapiens
aaucgcuccaccuugcag

SEQ ID NO: 1369826 - RNA, 16 nt, Homo sapiens
aaucucggcucacugc

SEQ ID NO: 1369827 - RNA, 18 nt, Homo sapiens
aaucucggcucacugcaa

SEQ ID NO: 1369828 - RNA, 16 nt, Homo sapiens
aaucucuaguugucac

SEQ ID NO: 1369829 - RNA, 17 nt, Homo sapiens
aaucucucagcuuuuaa

SEQ ID NO: 1369830 - RNA, 14 nt, Homo sapiens
aaucucuugcacuc

SEQ ID NO: 1369831 - RNA, 16 nt, Homo sapiens
aaucucuugcacucaa

SEQ ID NO: 1369832 - RNA, 20 nt, Homo sapiens
aaucugaucguucuuucuag

SEQ ID NO: 1369833 - RNA, 23 nt, Homo sapiens
aaucugccugauaggacccauau

SEQ ID NO: 1369834 - RNA, 21 nt, Homo sapiens
aaucuuacaaaagauugucau

SEQ ID NO: 1369835 - RNA, 18 nt, Homo sapiens
aaucuucagggcacugcu

SEQ ID NO: 1369836 - RNA, 21 nt, Homo sapiens
aaucuucagggcacugcugcu

SEQ ID NO: 1369837 - RNA, 13 nt, Homo sapiens
aaucuugcaacug

SEQ ID NO: 1369838 - RNA, 22 nt, Homo sapiens
aaucuuguuuccaaaaaccaug

SEQ ID NO: 1369839 - RNA, 12 nt, Homo sapiens
aauuuguacaua

SEQ ID NO: 1369840 - RNA, 19 nt, Homo sapiens
aauuuguucagucuuucau

SEQ ID NO: 1369841 - RNA, 19 nt, Homo sapiens
aauuuuaaauuauaacuua

SEQ ID NO: 1369842 - RNA, 21 nt, Homo sapiens
aauuuuauguuuaguugcaca

SEQ ID NO: 1369843 - RNA, 21 nt, Homo sapiens
aauuuuguugcaucauguuga

SEQ ID NO: 1369844 - RNA, 20 nt, Homo sapiens
acaaaaaaaccucuaugcaa

SEQ ID NO: 1369845 - RNA, 18 nt, Homo sapiens
acaaaaaacaacaaauaa

SEQ ID NO: 1369846 - RNA, 14 nt, Homo sapiens
acaaaaaauuagcu

SEQ ID NO: 1369847 - RNA, 16 nt, Homo sapiens
acaaaaagcuucccca

SEQ ID NO: 1369848 - RNA, 11 nt, Homo sapiens
acaaaacagaa

SEQ ID NO: 1369849 - RNA, 17 nt, Homo sapiens
acaaacauguaagcaua

SEQ ID NO: 1369850 - RNA, 14 nt, Homo sapiens
acaaacaugugguu

SEQ ID NO: 1369851 - RNA, 17 nt, Homo sapiens
acaaagagcccaauuac

SEQ ID NO: 1369852 - RNA, 24 nt, Homo sapiens
acaaaggagagcuagcagcaggga

SEQ ID NO: 1369853 - RNA, 14 nt, Homo sapiens
acaaaguaagccau

SEQ ID NO: 1369854 - RNA, 12 nt, Homo sapiens
acaaauaugcaa

SEQ ID NO: 1369855 - RNA, 15 nt, Homo sapiens
acaaaugcaauuuca

SEQ ID NO: 1369856 - RNA, 13 nt, Homo sapiens
acaaauugcuuga

SEQ ID NO: 1369857 - RNA, 17 nt, Homo sapiens
acaaauugcuugaaaga

SEQ ID NO: 1369858 - RNA, 23 nt, Homo sapiens
acaaauuggagcagggacagauc

SEQ ID NO: 1369859 - RNA, 18 nt, Homo sapiens
acaaauugggccaaagaa

SEQ ID NO: 1369860 - RNA, 13 nt, Homo sapiens
acaacaaagagaa

SEQ ID NO: 1369861 - RNA, 22 nt, Homo sapiens
acaacagcaaaacuccaucuca

SEQ ID NO: 1369862 - RNA, 17 nt, Homo sapiens
acaacauguauaauauu

SEQ ID NO: 1369863 - RNA, 16 nt, Homo sapiens
acaaccaaaaaauucu

SEQ ID NO: 1369864 - RNA, 21 nt, Homo sapiens
acaaccaugagaccacuguua

SEQ ID NO: 1369865 - RNA, 15 nt, Homo sapiens
acaaccugugaucaa

SEQ ID NO: 1369866 - RNA, 12 nt, Homo sapiens
acaacugugguc

SEQ ID NO: 1369867 - RNA, 16 nt, Homo sapiens
acaacuuccacuccaa

SEQ ID NO: 1369868 - RNA, 21 nt, Homo sapiens
acaacuuccacuccaagugag

SEQ ID NO: 1369869 - RNA, 19 nt, Homo sapiens
acaacuucuaauugccaug

SEQ ID NO: 1369870 - RNA, 18 nt, Homo sapiens
acaacuugaauaauacac

SEQ ID NO: 1369871 - RNA, 16 nt, Homo sapiens
acaagauaagcuucca

SEQ ID NO: 1369872 - RNA, 10 nt, Homo sapiens
acaagcaaaa

SEQ ID NO: 1369873 - RNA, 22 nt, Homo sapiens
acaaguauucauuuuuucuacc

SEQ ID NO: 1369874 - RNA, 11 nt, Homo sapiens
acaaguccagc

SEQ ID NO: 1369875 - RNA, 14 nt, Homo sapiens
acaagugagacaaa

SEQ ID NO: 1369876 - RNA, 18 nt, Homo sapiens
acaauagugauugauaga

SEQ ID NO: 1369877 - RNA, 13 nt, Homo sapiens
acaauaucuucau

SEQ ID NO: 1369878 - RNA, 20 nt, Homo sapiens
acaauauggucccaaaugac

SEQ ID NO: 1369879 - RNA, 16 nt, Homo sapiens
acaauauucaaucaaa

SEQ ID NO: 1369880 - RNA, 16 nt, Homo sapiens
acaauccaucucucaa

SEQ ID NO: 1369881 - RNA, 13 nt, Homo sapiens
acaaugugaaaag

SEQ ID NO: 1369882 - RNA, 18 nt, Homo sapiens
acaauuagucaaaccacu

SEQ ID NO: 1369883 - RNA, 23 nt, Homo sapiens
acaauuagucaaaccacuguuau

SEQ ID NO: 1369884 - RNA, 13 nt, Homo sapiens
acaauuuaccagc

SEQ ID NO: 1369885 - RNA, 22 nt, Homo sapiens
acacaaaacguuaagugaugaa

SEQ ID NO: 1369886 - RNA, 20 nt, Homo sapiens
acacaaacgggcucagcaaa

SEQ ID NO: 1369887 - RNA, 12 nt, Homo sapiens
acacaaggucau

SEQ ID NO: 1369888 - RNA, 11 nt, Homo sapiens
acacacacagg

SEQ ID NO: 1369889 - RNA, 15 nt, Homo sapiens
acacaccaucuuucc

SEQ ID NO: 1369890 - RNA, 18 nt, Homo sapiens
acacacugaggcagggaa

SEQ ID NO: 1369891 - RNA, 15 nt, Homo sapiens
acacagacugcgauu

SEQ ID NO: 1369892 - RNA, 15 nt, Homo sapiens
acacagaucacagcu

SEQ ID NO: 1369893 - RNA, 15 nt, Homo sapiens
acacagcgagacucc

SEQ ID NO: 1369894 - RNA, 17 nt, Homo sapiens
acacagcugcagagaca

SEQ ID NO: 1369895 - RNA, 20 nt, Homo sapiens
acacaggauggucucugcca

SEQ ID NO: 1369896 - RNA, 14 nt, Homo sapiens
acacaggcaaaauc

SEQ ID NO: 1369897 - RNA, 13 nt, Homo sapiens
acacaucuuccac

SEQ ID NO: 1369898 - RNA, 15 nt, Homo sapiens
acacaugagaucuag

SEQ ID NO: 1369899 - RNA, 13 nt, Homo sapiens
acaccacacauac

SEQ ID NO: 1369900 - RNA, 13 nt, Homo sapiens
acaccaggcugug

SEQ ID NO: 1369901 - RNA, 16 nt, Homo sapiens
acaccagguagaacac

SEQ ID NO: 1369902 - RNA, 19 nt, Homo sapiens
acaccauuuuccugccuca

SEQ ID NO: 1369903 - RNA, 13 nt, Homo sapiens
acacccacagugg

SEQ ID NO: 1369904 - RNA, 17 nt, Homo sapiens
acacccgacuccucaaa

SEQ ID NO: 1369905 - RNA, 16 nt, Homo sapiens
acaccuagaucagaac

SEQ ID NO: 1369906 - RNA, 16 nt, Homo sapiens
acaccucaguucccuu

SEQ ID NO: 1369907 - RNA, 22 nt, Homo sapiens
acaccuguacuggagagcaaca

SEQ ID NO: 1369908 - RNA, 18 nt, Homo sapiens
acaccuguagucccagcu

SEQ ID NO: 1369909 - RNA, 21 nt, Homo sapiens
acacggaugacuuaacugcau

SEQ ID NO: 1369910 - RNA, 15 nt, Homo sapiens
acacggggcaguggc

SEQ ID NO: 1369911 - RNA, 14 nt, Homo sapiens
acacuaacauauaa

SEQ ID NO: 1369912 - RNA, 15 nt, Homo sapiens
acacuaacauauaau

SEQ ID NO: 1369913 - RNA, 20 nt, Homo sapiens
acacuaaccuggguucccuu

SEQ ID NO: 1369914 - RNA, 20 nt, Homo sapiens
acacuaugaagauguuucaa

SEQ ID NO: 1369915 - RNA, 16 nt, Homo sapiens
acacucaaaagcuggg

SEQ ID NO: 1369916 - RNA, 20 nt, Homo sapiens
acacucacuccacaacccaa

SEQ ID NO: 1369917 - RNA, 22 nt, Homo sapiens
acacucuucugaauugacugua

SEQ ID NO: 1369918 - RNA, 14 nt, Homo sapiens
acacugaagcucuu

SEQ ID NO: 1369919 - RNA, 19 nt, Homo sapiens
acacugcuaggugggccag

SEQ ID NO: 1369920 - RNA, 12 nt, Homo sapiens
acacugcugcuc

SEQ ID NO: 1369921 - RNA, 18 nt, Homo sapiens
acacugcugcuccagugc

SEQ ID NO: 1369922 - RNA, 22 nt, Homo sapiens
acacugggcugcagagacugga

SEQ ID NO: 1369923 - RNA, 20 nt, Homo sapiens
acacuguauauaaacauauc

SEQ ID NO: 1369924 - RNA, 22 nt, Homo sapiens
acacuguauauaaacauaucaa

SEQ ID NO: 1369925 - RNA, 15 nt, Homo sapiens
acacuuacacuuuau

SEQ ID NO: 1369926 - RNA, 16 nt, Homo sapiens
acacuuaugggccaag

SEQ ID NO: 1369927 - RNA, 20 nt, Homo sapiens
acacuuaugggccaagccca

SEQ ID NO: 1369928 - RNA, 17 nt, Homo sapiens
acacuuauugcuuugaa

SEQ ID NO: 1369929 - RNA, 19 nt, Homo sapiens
acacuucugugagaccccc

SEQ ID NO: 1369930 - RNA, 23 nt, Homo sapiens
acacuugugugugggcugugagu

SEQ ID NO: 1369931 - RNA, 18 nt, Homo sapiens
acagaaagacugagcuca

SEQ ID NO: 1369932 - RNA, 19 nt, Homo sapiens
acagaaagacugagcucaa

SEQ ID NO: 1369933 - RNA, 18 nt, Homo sapiens
acagaagccucacugcaa

SEQ ID NO: 1369934 - RNA, 13 nt, Homo sapiens
acagaaggggugg

SEQ ID NO: 1369935 - RNA, 17 nt, Homo sapiens
acagaaguccauggagu

SEQ ID NO: 1369936 - RNA, 15 nt, Homo sapiens
acagacuggagacaa

SEQ ID NO: 1369937 - RNA, 20 nt, Homo sapiens
acagagcgagacuccgucuc

SEQ ID NO: 1369938 - RNA, 22 nt, Homo sapiens
acagagggaaacacagcagcuu

SEQ ID NO: 1369939 - RNA, 20 nt, Homo sapiens
acagagugagacucugucuc

SEQ ID NO: 1369940 - RNA, 21 nt, Homo sapiens
acagaguggucuuucuggaga

SEQ ID NO: 1369941 - RNA, 22 nt, Homo sapiens
acagaugacaaugggagccuca

SEQ ID NO: 1369942 - RNA, 19 nt, Homo sapiens
acagaugcaaugugcuacu

SEQ ID NO: 1369943 - RNA, 16 nt, Homo sapiens
acagauguagcaacau

SEQ ID NO: 1369944 - RNA, 22 nt, Homo sapiens
acagauguucacccaaccacau

SEQ ID NO: 1369945 - RNA, 18 nt, Homo sapiens
acagcaaaacuccaucuc

SEQ ID NO: 1369946 - RNA, 14 nt, Homo sapiens
acagcaaaagaaga

SEQ ID NO: 1369947 - RNA, 17 nt, Homo sapiens
acagcagcaguuacaaa

SEQ ID NO: 1369948 - RNA, 17 nt, Homo sapiens
acagcagccccugcaca

SEQ ID NO: 1369949 - RNA, 19 nt, Homo sapiens
acagcaggagggacaauga

SEQ ID NO: 1369950 - RNA, 17 nt, Homo sapiens
acagcaggcgccucggg

SEQ ID NO: 1369951 - RNA, 22 nt, Homo sapiens
acagcauggagucacagccacu

SEQ ID NO: 1369952 - RNA, 19 nt, Homo sapiens
accaugagaccacuguuau

SEQ ID NO: 1369953 - RNA, 24 nt, Homo sapiens
accaugauuaaccacuucagcuga

SEQ ID NO: 1369954 - RNA, 9 nt, Homo sapiens
accaugcug

SEQ ID NO: 1369955 - RNA, 23 nt, Homo sapiens
accauguacauaauucuugcuau

SEQ ID NO: 1369956 - RNA, 16 nt, Homo sapiens
accauguacauagcuu

SEQ ID NO: 1369957 - RNA, 13 nt, Homo sapiens
accauguacauga

SEQ ID NO: 1369958 - RNA, 20 nt, Homo sapiens
accauguacaugaagaagcu

SEQ ID NO: 1369959 - RNA, 23 nt, Homo sapiens
accauuuguaauaaaguauauaa

SEQ ID NO: 1369960 - RNA, 21 nt, Homo sapiens
acccaaccacaucccacucac

SEQ ID NO: 1369961 - RNA, 20 nt, Homo sapiens
acccacaaauaaaugacaag

SEQ ID NO: 1369962 - RNA, 23 nt, Homo sapiens
acccaccaguugaauuucaucau

SEQ ID NO: 1369963 - RNA, 16 nt, Homo sapiens
acccaccaucaugucu

SEQ ID NO: 1369964 - RNA, 14 nt, Homo sapiens
acccaccaugucug

SEQ ID NO: 1369965 - RNA, 15 nt, Homo sapiens
acccaccucagccuc

SEQ ID NO: 1369966 - RNA, 22 nt, Homo sapiens
acccacuuaccuugcaucucac

SEQ ID NO: 1369967 - RNA, 14 nt, Homo sapiens
acccacuuccugau

SEQ ID NO: 1369968 - RNA, 21 nt, Homo sapiens
acccacuucuaaauagcaauu

SEQ ID NO: 1369969 - RNA, 19 nt, Homo sapiens
acccagaaaucauuuuacc

SEQ ID NO: 1369970 - RNA, 15 nt, Homo sapiens
acccagauuuccuaa

SEQ ID NO: 1369971 - RNA, 20 nt, Homo sapiens
acccaggacuuccauuugcu

SEQ ID NO: 1369972 - RNA, 21 nt, Homo sapiens
acccagucagaguugugcaca

SEQ ID NO: 1369973 - RNA, 22 nt, Homo sapiens
acccagucagaguugugcacau

SEQ ID NO: 1369974 - RNA, 23 nt, Homo sapiens
acccagucagaguugugcacaug

SEQ ID NO: 1369975 - RNA, 14 nt, Homo sapiens
acccaucuaccccu

SEQ ID NO: 1369976 - RNA, 12 nt, Homo sapiens
acccaucugcac

SEQ ID NO: 1369977 - RNA, 14 nt, Homo sapiens
acccaugucuacac

SEQ ID NO: 1369978 - RNA, 18 nt, Homo sapiens
accccaaggagggagaug

SEQ ID NO: 1369979 - RNA, 22 nt, Homo sapiens
accccagugcuuguuccucuca

SEQ ID NO: 1369980 - RNA, 11 nt, Homo sapiens
accccaucucu

SEQ ID NO: 1369981 - RNA, 19 nt, Homo sapiens
accccccugggcugagaga

SEQ ID NO: 1369982 - RNA, 18 nt, Homo sapiens
accccgggcaagacuuuu

SEQ ID NO: 1369983 - RNA, 15 nt, Homo sapiens
accccucaccuugca

SEQ ID NO: 1369984 - RNA, 14 nt, Homo sapiens
accccuuugcccuu

SEQ ID NO: 1369985 - RNA, 21 nt, Homo sapiens
acccgggaggcagagguugca

SEQ ID NO: 1369986 - RNA, 15 nt, Homo sapiens
acccuaauguggcag

SEQ ID NO: 1369987 - RNA, 23 nt, Homo sapiens
acccuaauguggcagcugucuca

SEQ ID NO: 1369988 - RNA, 20 nt, Homo sapiens
acccuacuucuuuugcucuu

SEQ ID NO: 1369989 - RNA, 22 nt, Homo sapiens
acccuccuggggcucucagugu

SEQ ID NO: 1369990 - RNA, 14 nt, Homo sapiens
acccuccuggugcu

SEQ ID NO: 1369991 - RNA, 13 nt, Homo sapiens
acccugcagagau

SEQ ID NO: 1369992 - RNA, 16 nt, Homo sapiens
acccugcugaccuccc

SEQ ID NO: 1369993 - RNA, 13 nt, Homo sapiens
acccuguccaaac

SEQ ID NO: 1369994 - RNA, 14 nt, Homo sapiens
acccuucuuuccau

SEQ ID NO: 1369995 - RNA, 23 nt, Homo sapiens
acccuugcgcuuuugcuggucac

SEQ ID NO: 1369996 - RNA, 19 nt, Homo sapiens
accgaaaggccaaauuccc

SEQ ID NO: 1369997 - RNA, 13 nt, Homo sapiens
accgagcaauuuu

SEQ ID NO: 1369998 - RNA, 16 nt, Homo sapiens
accgaguggcugucau

SEQ ID NO: 1369999 - RNA, 14 nt, Homo sapiens
accgauaugcacuu

SEQ ID NO: 1370000 - RNA, 21 nt, Homo sapiens
accgauugccuuuauuuugcu

SEQ ID NO: 1370001 - RNA, 17 nt, Homo sapiens
accgccaaagaaugccu

SEQ ID NO: 1370002 - RNA, 17 nt, Homo sapiens
accgcugccagcacaga

SEQ ID NO: 1370003 - RNA, 21 nt, Homo sapiens
accgggcuggccugugccuau

SEQ ID NO: 1370004 - RNA, 15 nt, Homo sapiens
accgugaccaggaac

SEQ ID NO: 1370005 - RNA, 17 nt, Homo sapiens
accuaagucucugugaa

SEQ ID NO: 1370006 - RNA, 21 nt, Homo sapiens
accuaauguuuaugagccaga

SEQ ID NO: 1370007 - RNA, 23 nt, Homo sapiens
accuacauuuuaaugcaccugaa

SEQ ID NO: 1370008 - RNA, 15 nt, Homo sapiens
accuaccacaguguc

SEQ ID NO: 1370009 - RNA, 22 nt, Homo sapiens
accuacugauaaccacuccuaa

SEQ ID NO: 1370010 - RNA, 20 nt, Homo sapiens
accuagcaaagcuccugccu

SEQ ID NO: 1370011 - RNA, 16 nt, Homo sapiens
accuauucacugcuua

SEQ ID NO: 1370012 - RNA, 19 nt, Homo sapiens
accucaccaagcugcugug

SEQ ID NO: 1370013 - RNA, 21 nt, Homo sapiens
accucaccccacuguggcuga

SEQ ID NO: 1370014 - RNA, 12 nt, Homo sapiens
accucacuguga

SEQ ID NO: 1370015 - RNA, 22 nt, Homo sapiens
accucagugucauuuaugaaaa

SEQ ID NO: 1370016 - RNA, 22 nt, Homo sapiens
accucaguuuuaucauuuucaa

SEQ ID NO: 1370017 - RNA, 18 nt, Homo sapiens
accucauuccugggacua

SEQ ID NO: 1370018 - RNA, 17 nt, Homo sapiens
accucccauccuaauca

SEQ ID NO: 1370019 - RNA, 15 nt, Homo sapiens
accuccccaacagca

SEQ ID NO: 1370020 - RNA, 14 nt, Homo sapiens
accucuaacaacaa

SEQ ID NO: 1370021 - RNA, 19 nt, Homo sapiens
accucuaacaacaaauuaa

SEQ ID NO: 1370022 - RNA, 13 nt, Homo sapiens
accucuaugcaau

SEQ ID NO: 1370023 - RNA, 17 nt, Homo sapiens
accucugccugaaguca

SEQ ID NO: 1370024 - RNA, 19 nt, Homo sapiens
accucugggucaucucuca

SEQ ID NO: 1370025 - RNA, 20 nt, Homo sapiens
accucuucugggaacuuccu

SEQ ID NO: 1370026 - RNA, 19 nt, Homo sapiens
accugacguacucugguua

SEQ ID NO: 1370027 - RNA, 14 nt, Homo sapiens
accugagcugccau

SEQ ID NO: 1370028 - RNA, 17 nt, Homo sapiens
accugagucccaaagcu

SEQ ID NO: 1370029 - RNA, 13 nt, Homo sapiens
accugcaggccaa

SEQ ID NO: 1370030 - RNA, 18 nt, Homo sapiens
accugcugagggaccagc

SEQ ID NO: 1370031 - RNA, 19 nt, Homo sapiens
accugcuuuacuuugccca

SEQ ID NO: 1370032 - RNA, 20 nt, Homo sapiens
accugcuuuacuuugcccag

SEQ ID NO: 1370033 - RNA, 18 nt, Homo sapiens
accuggcccuuagaaaua

SEQ ID NO: 1370034 - RNA, 22 nt, Homo sapiens
accugggcugaggcauccuucc

SEQ ID NO: 1370035 - RNA, 14 nt, Homo sapiens
accuguaaaacuuu

SEQ ID NO: 1370036 - RNA, 16 nt, Homo sapiens
accugucccaccucaa

SEQ ID NO: 1370037 - RNA, 14 nt, Homo sapiens
accuguccuugcac

SEQ ID NO: 1370038 - RNA, 16 nt, Homo sapiens
accuguccuugcacac

SEQ ID NO: 1370039 - RNA, 15 nt, Homo sapiens
accuuaaacuuucaa

SEQ ID NO: 1370040 - RNA, 23 nt, Homo sapiens
accuuacauuugaaaucuaugaa

SEQ ID NO: 1370041 - RNA, 16 nt, Homo sapiens
accuuaucugugcgug

SEQ ID NO: 1370042 - RNA, 20 nt, Homo sapiens
accuuaucuuaaagcacuua

SEQ ID NO: 1370043 - RNA, 12 nt, Homo sapiens
accuucaaagcu

SEQ ID NO: 1370044 - RNA, 15 nt, Homo sapiens
accuucaauuccugg

SEQ ID NO: 1370045 - RNA, 19 nt, Homo sapiens
accuugaagaaccucucac

SEQ ID NO: 1370046 - RNA, 22 nt, Homo sapiens
accuugacuugauuagugccuu

SEQ ID NO: 1370047 - RNA, 22 nt, Homo sapiens
acgaaagcugggcaacaugccu

SEQ ID NO: 1370048 - RNA, 15 nt, Homo sapiens
acgaacccaccugcu

SEQ ID NO: 1370049 - RNA, 16 nt, Homo sapiens
acgaagcuuaguauaa

SEQ ID NO: 1370050 - RNA, 15 nt, Homo sapiens
acgaaggccucugaa

SEQ ID NO: 1370051 - RNA, 17 nt, Homo sapiens
acgacaacgaugaugcu

SEQ ID NO: 1370052 - RNA, 13 nt, Homo sapiens
acgacuucagggc

SEQ ID NO: 1370053 - RNA, 17 nt, Homo sapiens
acgcacacugucugccc

SEQ ID NO: 1370054 - RNA, 16 nt, Homo sapiens
acgcacugguaugugu

SEQ ID NO: 1370055 - RNA, 20 nt, Homo sapiens
acgcccaugugugagugugu

SEQ ID NO: 1370056 - RNA, 15 nt, Homo sapiens
acgccuaugauccca

SEQ ID NO: 1370057 - RNA, 17 nt, Homo sapiens
acgccuguaaucccaga

SEQ ID NO: 1370058 - RNA, 19 nt, Homo sapiens
acgccuguaguccuagcca

SEQ ID NO: 1370059 - RNA, 12 nt, Homo sapiens
acgcgugcacac

SEQ ID NO: 1370060 - RNA, 20 nt, Homo sapiens
acgcgugcacacaccagagc

SEQ ID NO: 1370061 - RNA, 16 nt, Homo sapiens
acgcugguagagaugg

SEQ ID NO: 1370062 - RNA, 20 nt, Homo sapiens
acggaauaaugaguuagaac

SEQ ID NO: 1370063 - RNA, 16 nt, Homo sapiens
acggcgcccccagugu

SEQ ID NO: 1370064 - RNA, 14 nt, Homo sapiens
acggcucacugcag

SEQ ID NO: 1370065 - RNA, 22 nt, Homo sapiens
acugguauguguggaugaugcu

SEQ ID NO: 1370066 - RNA, 19 nt, Homo sapiens
acugguucauucuacguau

SEQ ID NO: 1370067 - RNA, 17 nt, Homo sapiens
acugguuguugccaaac

SEQ ID NO: 1370068 - RNA, 21 nt, Homo sapiens
acuguagacucuggaaguaua

SEQ ID NO: 1370069 - RNA, 22 nt, Homo sapiens
acuguauguuuacuucucacca

SEQ ID NO: 1370070 - RNA, 21 nt, Homo sapiens
acugucuugaagacaauggcu

SEQ ID NO: 1370071 - RNA, 22 nt, Homo sapiens
acugucuugaagacaauggcuu

SEQ ID NO: 1370072 - RNA, 21 nt, Homo sapiens
acugucuuucagauacauggu

SEQ ID NO: 1370073 - RNA, 15 nt, Homo sapiens
acugugccuuugagu

SEQ ID NO: 1370074 - RNA, 21 nt, Homo sapiens
acugugucagggaacauauuu

SEQ ID NO: 1370075 - RNA, 21 nt, Homo sapiens
acugugucccucucucuggaa

SEQ ID NO: 1370076 - RNA, 16 nt, Homo sapiens
acuguguggacuguga

SEQ ID NO: 1370077 - RNA, 19 nt, Homo sapiens
acuguguggacugugaugc

SEQ ID NO: 1370078 - RNA, 16 nt, Homo sapiens
acuguuacugugucag

SEQ ID NO: 1370079 - RNA, 20 nt, Homo sapiens
acuguuagucauuugcugag

SEQ ID NO: 1370080 - RNA, 13 nt, Homo sapiens
acuguugcccagg

SEQ ID NO: 1370081 - RNA, 19 nt, Homo sapiens
acuguuuauuugcacuaug

SEQ ID NO: 1370082 - RNA, 17 nt, Homo sapiens
acuguuuuucagggagg

SEQ ID NO: 1370083 - RNA, 14 nt, Homo sapiens
acuuaaaacuguaa

SEQ ID NO: 1370084 - RNA, 21 nt, Homo sapiens
acuuaaauaauaaacagugga

SEQ ID NO: 1370085 - RNA, 19 nt, Homo sapiens
acuuacacaucuuccacag

SEQ ID NO: 1370086 - RNA, 18 nt, Homo sapiens
acuuaccuagauuuacag

SEQ ID NO: 1370087 - RNA, 22 nt, Homo sapiens
acuuagaaauugcauuuccuga

SEQ ID NO: 1370088 - RNA, 23 nt, Homo sapiens
acuuagaaauugcauuuccugac

SEQ ID NO: 1370089 - RNA, 16 nt, Homo sapiens
acuuagguguggggga

SEQ ID NO: 1370090 - RNA, 13 nt, Homo sapiens
acuucaagcuuuu

SEQ ID NO: 1370091 - RNA, 14 nt, Homo sapiens
acuucacacacagg

SEQ ID NO: 1370092 - RNA, 20 nt, Homo sapiens
acuucagagacuaucugauu

SEQ ID NO: 1370093 - RNA, 18 nt, Homo sapiens
acuucagagcacacuuau

SEQ ID NO: 1370094 - RNA, 20 nt, Homo sapiens
acuucagcucacacaugaga

SEQ ID NO: 1370095 - RNA, 13 nt, Homo sapiens
acuuccaccagcc

SEQ ID NO: 1370096 - RNA, 18 nt, Homo sapiens
acuuccaccagccugcac

SEQ ID NO: 1370097 - RNA, 16 nt, Homo sapiens
acuuccacugccaucc

SEQ ID NO: 1370098 - RNA, 23 nt, Homo sapiens
acuuccagugcaacacugaagcu

SEQ ID NO: 1370099 - RNA, 16 nt, Homo sapiens
acuucccuacauggag

SEQ ID NO: 1370100 - RNA, 17 nt, Homo sapiens
acuuccuccccauguga

SEQ ID NO: 1370101 - RNA, 14 nt, Homo sapiens
acuuccugcacuga

SEQ ID NO: 1370102 - RNA, 23 nt, Homo sapiens
acuucuaacuagaaaucugccaa

SEQ ID NO: 1370103 - RNA, 11 nt, Homo sapiens
acuucucacca

SEQ ID NO: 1370104 - RNA, 21 nt, Homo sapiens
acuucuuacuucccuaaugaa

SEQ ID NO: 1370105 - RNA, 11 nt, Homo sapiens
acuucuuccau

SEQ ID NO: 1370106 - RNA, 16 nt, Homo sapiens
acuugagaauuacccu

SEQ ID NO: 1370107 - RNA, 17 nt, Homo sapiens
acuugauguguuaucuc

SEQ ID NO: 1370108 - RNA, 14 nt, Homo sapiens
acuuggaacacaau

SEQ ID NO: 1370109 - RNA, 17 nt, Homo sapiens
acuuggaacacaaugac

SEQ ID NO: 1370110 - RNA, 20 nt, Homo sapiens
acuuggagccccagugccaa

SEQ ID NO: 1370111 - RNA, 20 nt, Homo sapiens
acuugggccacugugaagag

SEQ ID NO: 1370112 - RNA, 16 nt, Homo sapiens
acuuguggacacagcu

SEQ ID NO: 1370113 - RNA, 18 nt, Homo sapiens
acuuguggacacagcucu

SEQ ID NO: 1370114 - RNA, 20 nt, Homo sapiens
acuuucauugccagugucuu

SEQ ID NO: 1370115 - RNA, 18 nt, Homo sapiens
acuuucuuaucacuuaua

SEQ ID NO: 1370116 - RNA, 16 nt, Homo sapiens
acuuugaagaugucau

SEQ ID NO: 1370117 - RNA, 15 nt, Homo sapiens
acuuugcacagcucu

SEQ ID NO: 1370118 - RNA, 14 nt, Homo sapiens
acuuuguguucacc

SEQ ID NO: 1370119 - RNA, 15 nt, Homo sapiens
acuuuuaaguacuua

SEQ ID NO: 1370120 - RNA, 22 nt, Homo sapiens
acuuuuaaguugcugaugaacu

SEQ ID NO: 1370121 - RNA, 21 nt, Homo sapiens
acuuuucuuaaaaaguuauaa

SEQ ID NO: 1370122 - RNA, 23 nt, Homo sapiens
acuuuugguaucuacuucuacau

SEQ ID NO: 1370123 - RNA, 17 nt, Homo sapiens
acuuuuuaaaacacaac

SEQ ID NO: 1370124 - RNA, 21 nt, Homo sapiens
acuuuuuaaaauaauaacaau

SEQ ID NO: 1370125 - RNA, 12 nt, Homo sapiens
agaaaaaagaga

SEQ ID NO: 1370126 - RNA, 20 nt, Homo sapiens
agaaaaaauaacacacauau

SEQ ID NO: 1370127 - RNA, 19 nt, Homo sapiens
agaaaaaggagcuuaccuc

SEQ ID NO: 1370128 - RNA, 12 nt, Homo sapiens
agaaaagauuau

SEQ ID NO: 1370129 - RNA, 15 nt, Homo sapiens
agaaaauacaauaaa

SEQ ID NO: 1370130 - RNA, 20 nt, Homo sapiens
agaaacacuaaagcauucaa

SEQ ID NO: 1370131 - RNA, 12 nt, Homo sapiens
agaaacaucuca

SEQ ID NO: 1370132 - RNA, 12 nt, Homo sapiens
agaaacccaagu

SEQ ID NO: 1370133 - RNA, 20 nt, Homo sapiens
agaaaccuuauuguaccucu

SEQ ID NO: 1370134 - RNA, 21 nt, Homo sapiens
agaaaccuuauuguaccucuc

SEQ ID NO: 1370135 - RNA, 12 nt, Homo sapiens
agaaacugacac

SEQ ID NO: 1370136 - RNA, 17 nt, Homo sapiens
agaaacuguagucucag

SEQ ID NO: 1370137 - RNA, 17 nt, Homo sapiens
agaaacuucggggcugc

SEQ ID NO: 1370138 - RNA, 21 nt, Homo sapiens
agaaagcauccuaaauauauc

SEQ ID NO: 1370139 - RNA, 22 nt, Homo sapiens
agaaagccagucuuaacauuuc

SEQ ID NO: 1370140 - RNA, 17 nt, Homo sapiens
agaaagcucaucucagc

SEQ ID NO: 1370141 - RNA, 22 nt, Homo sapiens
agaaaggagaacuauccaaaac

SEQ ID NO: 1370142 - RNA, 18 nt, Homo sapiens
agaaaggagagucuugca

SEQ ID NO: 1370143 - RNA, 12 nt, Homo sapiens
agaaaggcauga

SEQ ID NO: 1370144 - RNA, 21 nt, Homo sapiens
agaaaggggcaggagcucaga

SEQ ID NO: 1370145 - RNA, 14 nt, Homo sapiens
agaaaguacuucuc

SEQ ID NO: 1370146 - RNA, 12 nt, Homo sapiens
agaaaguucuca

SEQ ID NO: 1370147 - RNA, 22 nt, Homo sapiens
agaaaguuuccccaccagugaa

SEQ ID NO: 1370148 - RNA, 23 nt, Homo sapiens
agaaauaaauguaccugauguac

SEQ ID NO: 1370149 - RNA, 14 nt, Homo sapiens
agaaauaacaaauu

SEQ ID NO: 1370150 - RNA, 14 nt, Homo sapiens
agaaauaauaugca

SEQ ID NO: 1370151 - RNA, 23 nt, Homo sapiens
agaaauacaauucuacauuguca

SEQ ID NO: 1370152 - RNA, 18 nt, Homo sapiens
agaaaugaugauguggaa

SEQ ID NO: 1370153 - RNA, 16 nt, Homo sapiens
agaaauuccaauauaa

SEQ ID NO: 1370154 - RNA, 12 nt, Homo sapiens
agaacaaaaaca

SEQ ID NO: 1370155 - RNA, 15 nt, Homo sapiens
agaacaacuacugug

SEQ ID NO: 1370156 - RNA, 14 nt, Homo sapiens
agaaccaaaagaga

SEQ ID NO: 1370157 - RNA, 18 nt, Homo sapiens
agaacccuuggagccaau

SEQ ID NO: 1370158 - RNA, 11 nt, Homo sapiens
agaaccucagg

SEQ ID NO: 1370159 - RNA, 12 nt, Homo sapiens
agaaccucaggc

SEQ ID NO: 1370160 - RNA, 23 nt, Homo sapiens
agaacuucugaaaccucuggguc

SEQ ID NO: 1370161 - RNA, 14 nt, Homo sapiens
agaacuugaccccc

SEQ ID NO: 1370162 - RNA, 17 nt, Homo sapiens
agaagaacauccaagga

SEQ ID NO: 1370163 - RNA, 19 nt, Homo sapiens
agaagacacugaugggcaa

SEQ ID NO: 1370164 - RNA, 14 nt, Homo sapiens
agaagagacuggga

SEQ ID NO: 1370165 - RNA, 16 nt, Homo sapiens
agaagcaagaaacuuc

SEQ ID NO: 1370166 - RNA, 12 nt, Homo sapiens
agaagccaagga

SEQ ID NO: 1370167 - RNA, 23 nt, Homo sapiens
agaagcuaaauccuuuacuguua

SEQ ID NO: 1370168 - RNA, 22 nt, Homo sapiens
agaagcucucgauggacaauga

SEQ ID NO: 1370169 - RNA, 20 nt, Homo sapiens
agaaggauguacauuuccaa

SEQ ID NO: 1370170 - RNA, 13 nt, Homo sapiens
agaagggggccau

SEQ ID NO: 1370171 - RNA, 22 nt, Homo sapiens
agaagggggucucuucuuccag

SEQ ID NO: 1370172 - RNA, 14 nt, Homo sapiens
agaagguugcucua

SEQ ID NO: 1370173 - RNA, 16 nt, Homo sapiens
agaagguugugaugaa

SEQ ID NO: 1370174 - RNA, 19 nt, Homo sapiens
agaagguugugaugaagaa

SEQ ID NO: 1370175 - RNA, 13 nt, Homo sapiens
agaagugcuuucu

SEQ ID NO: 1370176 - RNA, 17 nt, Homo sapiens
agaaguugagagagcaa

SEQ ID NO: 1370177 - RNA, 14 nt, Homo sapiens
agaauagcuuugaa

SEQ ID NO: 1370178 - RNA, 17 nt, Homo sapiens
cauguuuuucuucuccc

SEQ ID NO: 1370179 - RNA, 15 nt, Homo sapiens
cauuaaacuuaccug

SEQ ID NO: 1370180 - RNA, 20 nt, Homo sapiens
cauuaaauauaauaugcaca

SEQ ID NO: 1370181 - RNA, 21 nt, Homo sapiens
cauuaacaguuuuccaugaaa

SEQ ID NO: 1370182 - RNA, 16 nt, Homo sapiens
cauuaauauuugcuga

SEQ ID NO: 1370183 - RNA, 13 nt, Homo sapiens
cauuaaugcaaug

SEQ ID NO: 1370184 - RNA, 23 nt, Homo sapiens
cauuacagagaggagaaacacau

SEQ ID NO: 1370185 - RNA, 17 nt, Homo sapiens
cauuaccauggagacaa

SEQ ID NO: 1370186 - RNA, 19 nt, Homo sapiens
cauuagaccaagcuugucc

SEQ ID NO: 1370187 - RNA, 15 nt, Homo sapiens
cauuauauugcaaug

SEQ ID NO: 1370188 - RNA, 13 nt, Homo sapiens
cauuaucuaugau

SEQ ID NO: 1370189 - RNA, 17 nt, Homo sapiens
cauuauuaaauguuucu

SEQ ID NO: 1370190 - RNA, 14 nt, Homo sapiens
cauucaacagauca

SEQ ID NO: 1370191 - RNA, 15 nt, Homo sapiens
cauucacagugcaag

SEQ ID NO: 1370192 - RNA, 12 nt, Homo sapiens
cauucacuuguu

SEQ ID NO: 1370193 - RNA, 19 nt, Homo sapiens
cauucaguuaaaaauccag

SEQ ID NO: 1370194 - RNA, 19 nt, Homo sapiens
cauucauaacagaacaaga

SEQ ID NO: 1370195 - RNA, 21 nt, Homo sapiens
cauucaugacugaacugaaaa

SEQ ID NO: 1370196 - RNA, 14 nt, Homo sapiens
cauuccaccuuccc

SEQ ID NO: 1370197 - RNA, 22 nt, Homo sapiens
cauuccaggaccagaagcauuu

SEQ ID NO: 1370198 - RNA, 21 nt, Homo sapiens
cauucccugagucaccaggaa

SEQ ID NO: 1370199 - RNA, 12 nt, Homo sapiens
cauuccuaacac

SEQ ID NO: 1370200 - RNA, 20 nt, Homo sapiens
cauuccugaaagaaacaguu

SEQ ID NO: 1370201 - RNA, 21 nt, Homo sapiens
cauuccugaaagaaacaguua

SEQ ID NO: 1370202 - RNA, 16 nt, Homo sapiens
cauucugaccauuuca

SEQ ID NO: 1370203 - RNA, 17 nt, Homo sapiens
cauucugccugcccagg

SEQ ID NO: 1370204 - RNA, 16 nt, Homo sapiens
cauucugcucuuugau

SEQ ID NO: 1370205 - RNA, 21 nt, Homo sapiens
cauucugcucuuugauucaaa

SEQ ID NO: 1370206 - RNA, 12 nt, Homo sapiens
cauucuuuuaua

SEQ ID NO: 1370207 - RNA, 20 nt, Homo sapiens
cauugaccaagaacugcaug

SEQ ID NO: 1370208 - RNA, 18 nt, Homo sapiens
cauugacugauggugaaa

SEQ ID NO: 1370209 - RNA, 20 nt, Homo sapiens
cauugaugacccucugaccc

SEQ ID NO: 1370210 - RNA, 16 nt, Homo sapiens
cauugauggggaagga

SEQ ID NO: 1370211 - RNA, 15 nt, Homo sapiens
cauugcuuaugacau

SEQ ID NO: 1370212 - RNA, 15 nt, Homo sapiens
cauugcuuuccacug

SEQ ID NO: 1370213 - RNA, 22 nt, Homo sapiens
cauugucuucugaccucuauaa

SEQ ID NO: 1370214 - RNA, 21 nt, Homo sapiens
cauuguuuuguguaacauauu

SEQ ID NO: 1370215 - RNA, 12 nt, Homo sapiens
cauuuaggaacu

SEQ ID NO: 1370216 - RNA, 13 nt, Homo sapiens
cauuuaucauaua

SEQ ID NO: 1370217 - RNA, 20 nt, Homo sapiens
cauuuauuauuucaauguga

SEQ ID NO: 1370218 - RNA, 21 nt, Homo sapiens
cauuucaaauacaucuuugau

SEQ ID NO: 1370219 - RNA, 23 nt, Homo sapiens
cauuucagagaggccuuuuggaa

SEQ ID NO: 1370220 - RNA, 19 nt, Homo sapiens
cauuuccugacagaaggac

SEQ ID NO: 1370221 - RNA, 23 nt, Homo sapiens
cauuucucaaaugcacaucucau

SEQ ID NO: 1370222 - RNA, 13 nt, Homo sapiens
cauuugcaccuac

SEQ ID NO: 1370223 - RNA, 15 nt, Homo sapiens
cauuugcaccuaccu

SEQ ID NO: 1370224 - RNA, 14 nt, Homo sapiens
cauuugcuuugucc

SEQ ID NO: 1370225 - RNA, 22 nt, Homo sapiens
cauuugucaacaaagucaccca

SEQ ID NO: 1370226 - RNA, 12 nt, Homo sapiens
cauuugucacag

SEQ ID NO: 1370227 - RNA, 16 nt, Homo sapiens
cauuugugugugugca

SEQ ID NO: 1370228 - RNA, 18 nt, Homo sapiens
cauuugugugugugcaag

SEQ ID NO: 1370229 - RNA, 23 nt, Homo sapiens
cauuugugugugugcaagugugu

SEQ ID NO: 1370230 - RNA, 15 nt, Homo sapiens
cauuuguuauucuua

SEQ ID NO: 1370231 - RNA, 15 nt, Homo sapiens
cauuuuaagaguuac

SEQ ID NO: 1370232 - RNA, 14 nt, Homo sapiens
cauuuucugccuau

SEQ ID NO: 1370233 - RNA, 18 nt, Homo sapiens
cauuuugcccuuccauag

SEQ ID NO: 1370234 - RNA, 19 nt, Homo sapiens
cauuuuuuaaaacaagaaa

SEQ ID NO: 1370235 - RNA, 15 nt, Homo sapiens
ccaaaaaaaguucag

SEQ ID NO: 1370236 - RNA, 13 nt, Homo sapiens
ccaaaacauuccg

SEQ ID NO: 1370237 - RNA, 18 nt, Homo sapiens
ccaaaaccacagcccugu

SEQ ID NO: 1370238 - RNA, 15 nt, Homo sapiens
ccaaaacuaauuucc

SEQ ID NO: 1370239 - RNA, 18 nt, Homo sapiens
ccaaaaucggaucugggg

SEQ ID NO: 1370240 - RNA, 18 nt, Homo sapiens
ccaaacacauacaggaag

SEQ ID NO: 1370241 - RNA, 18 nt, Homo sapiens
ccaaagaaacauugccuu

SEQ ID NO: 1370242 - RNA, 22 nt, Homo sapiens
ccaaagacuacauauugucacu

SEQ ID NO: 1370243 - RNA, 21 nt, Homo sapiens
ccaaaggaagcuuucucugcu

SEQ ID NO: 1370244 - RNA, 23 nt, Homo sapiens
ccaaaggauagugcgauguuuca

SEQ ID NO: 1370245 - RNA, 21 nt, Homo sapiens
ccaaagggugaagcuauuuau

SEQ ID NO: 1370246 - RNA, 20 nt, Homo sapiens
ccaaaguaucaggacgagaa

SEQ ID NO: 1370247 - RNA, 20 nt, Homo sapiens
ccaaagugguuucagcaaua

SEQ ID NO: 1370248 - RNA, 15 nt, Homo sapiens
ccaaauaaauauauu

SEQ ID NO: 1370249 - RNA, 18 nt, Homo sapiens
ccaaauaccauguacaua

SEQ ID NO: 1370250 - RNA, 15 nt, Homo sapiens
ccaaauggacauaag

SEQ ID NO: 1370251 - RNA, 12 nt, Homo sapiens
ccaaauuaucaa

SEQ ID NO: 1370252 - RNA, 15 nt, Homo sapiens
ccaacagcacccucu

SEQ ID NO: 1370253 - RNA, 21 nt, Homo sapiens
ccaacagcacccucuccagau

SEQ ID NO: 1370254 - RNA, 11 nt, Homo sapiens
ccaacaugacu

SEQ ID NO: 1370255 - RNA, 16 nt, Homo sapiens
ccaacgaaaagcacau

SEQ ID NO: 1370256 - RNA, 15 nt, Homo sapiens
ccaacgacaaagcca

SEQ ID NO: 1370257 - RNA, 20 nt, Homo sapiens
ccaacguggggcagcacaga

SEQ ID NO: 1370258 - RNA, 19 nt, Homo sapiens
ccaacuucauuugaugcua

SEQ ID NO: 1370259 - RNA, 16 nt, Homo sapiens
ccaagacacagaucac

SEQ ID NO: 1370260 - RNA, 22 nt, Homo sapiens
ccaagaccugacucaggcauca

SEQ ID NO: 1370261 - RNA, 20 nt, Homo sapiens
ccaagacucugaaaucucag

SEQ ID NO: 1370262 - RNA, 18 nt, Homo sapiens
ccaagaggagacuuuaau

SEQ ID NO: 1370263 - RNA, 18 nt, Homo sapiens
ccaagagggcugcaaaag

SEQ ID NO: 1370264 - RNA, 21 nt, Homo sapiens
ccaagauaucagcccaaaagu

SEQ ID NO: 1370265 - RNA, 16 nt, Homo sapiens
ccaagcaggaagcuca

SEQ ID NO: 1370266 - RNA, 23 nt, Homo sapiens
ccaagcuggagugcaguggugcg

SEQ ID NO: 1370267 - RNA, 19 nt, Homo sapiens
ccaaggaggaaaaacagac

SEQ ID NO: 1370268 - RNA, 17 nt, Homo sapiens
ccaagugagaaggagau

SEQ ID NO: 1370269 - RNA, 19 nt, Homo sapiens
ccaaguuuauauacaauua

SEQ ID NO: 1370270 - RNA, 22 nt, Homo sapiens
ccaauaaagccuucaaacuccc

SEQ ID NO: 1370271 - RNA, 12 nt, Homo sapiens
ccaauaccuccu

SEQ ID NO: 1370272 - RNA, 19 nt, Homo sapiens
ccaauauuucucagacauc

SEQ ID NO: 1370273 - RNA, 16 nt, Homo sapiens
ccaauauuuguagaag

SEQ ID NO: 1370274 - RNA, 14 nt, Homo sapiens
ccaaucauuuuaau

SEQ ID NO: 1370275 - RNA, 22 nt, Homo sapiens
ccaaugaggucugaaauggagg

SEQ ID NO: 1370276 - RNA, 13 nt, Homo sapiens
ccaaugaugguca

SEQ ID NO: 1370277 - RNA, 23 nt, Homo sapiens
ccaaugcauugcuaaaauauuau

SEQ ID NO: 1370278 - RNA, 17 nt, Homo sapiens
ccaauggcaacaucuug

SEQ ID NO: 1370279 - RNA, 20 nt, Homo sapiens
ccaauggcaacaucuugcaa

SEQ ID NO: 1370280 - RNA, 20 nt, Homo sapiens
ccaauguuuaaaaaaguuua

SEQ ID NO: 1370281 - RNA, 20 nt, Homo sapiens
ccaauucuuugaauuuccca

SEQ ID NO: 1370282 - RNA, 13 nt, Homo sapiens
ccaauuugcacuu

SEQ ID NO: 1370283 - RNA, 16 nt, Homo sapiens
ccaauuugcacuuuca

SEQ ID NO: 1370284 - RNA, 23 nt, Homo sapiens
ccaauuuucuggaauacaugaaa

SEQ ID NO: 1370285 - RNA, 13 nt, Homo sapiens
ccacaaccaaaaa

SEQ ID NO: 1370286 - RNA, 16 nt, Homo sapiens
ccacaaccgaccagau

SEQ ID NO: 1370287 - RNA, 20 nt, Homo sapiens
ccacaauucacuagaccaga

SEQ ID NO: 1370288 - RNA, 14 nt, Homo sapiens
ccacacacagagga

SEQ ID NO: 1370289 - RNA, 22 nt, Homo sapiens
ccacaccggccaagaugcuuuu

SEQ ID NO: 1370290 - RNA, 18 nt, Homo sapiens
ccacacuguacucugcac

SEQ ID NO: 1370291 - RNA, 21 nt, Homo sapiens
cccaaaucugccuauugcagc

SEQ ID NO: 1370292 - RNA, 17 nt, Homo sapiens
cccaaauggcagggaua

SEQ ID NO: 1370293 - RNA, 20 nt, Homo sapiens
cccaagagugguuaugccuc

SEQ ID NO: 1370294 - RNA, 18 nt, Homo sapiens
cccaaguuauugggaugu

SEQ ID NO: 1370295 - RNA, 22 nt, Homo sapiens
cccaauggcaacaucuugcaaa

SEQ ID NO: 1370296 - RNA, 20 nt, Homo sapiens
cccacaagugccacugcccg

SEQ ID NO: 1370297 - RNA, 22 nt, Homo sapiens
cccacacccuggaggauuucau

SEQ ID NO: 1370298 - RNA, 15 nt, Homo sapiens
cccacagcacuaauu

SEQ ID NO: 1370299 - RNA, 13 nt, Homo sapiens
cccacagguauga

SEQ ID NO: 1370300 - RNA, 22 nt, Homo sapiens
cccaccagcuaaggacauuucc

SEQ ID NO: 1370301 - RNA, 17 nt, Homo sapiens
cccacccaacaagccau

SEQ ID NO: 1370302 - RNA, 19 nt, Homo sapiens
cccacccucuggagaaggu

SEQ ID NO: 1370303 - RNA, 17 nt, Homo sapiens
cccaccuccugcaauaa

SEQ ID NO: 1370304 - RNA, 22 nt, Homo sapiens
cccaccuucuucagccaccucu

SEQ ID NO: 1370305 - RNA, 21 nt, Homo sapiens
cccacgacugcccggcagggu

SEQ ID NO: 1370306 - RNA, 16 nt, Homo sapiens
cccacuugacacuauu

SEQ ID NO: 1370307 - RNA, 16 nt, Homo sapiens
cccagaacuggacuca

SEQ ID NO: 1370308 - RNA, 14 nt, Homo sapiens
cccagaagguugug

SEQ ID NO: 1370309 - RNA, 14 nt, Homo sapiens
cccagagaagccaa

SEQ ID NO: 1370310 - RNA, 22 nt, Homo sapiens
cccagagugcugggauuacaau

SEQ ID NO: 1370311 - RNA, 13 nt, Homo sapiens
cccagcuacucag

SEQ ID NO: 1370312 - RNA, 12 nt, Homo sapiens
cccagcuacucg

SEQ ID NO: 1370313 - RNA, 23 nt, Homo sapiens
cccaggcaucugcuuuacucugg

SEQ ID NO: 1370314 - RNA, 16 nt, Homo sapiens
cccaggccuccagcuc

SEQ ID NO: 1370315 - RNA, 19 nt, Homo sapiens
cccaggcuggagugcagug

SEQ ID NO: 1370316 - RNA, 19 nt, Homo sapiens
cccaggcuggcgugcagug

SEQ ID NO: 1370317 - RNA, 15 nt, Homo sapiens
cccagggacuuccuc

SEQ ID NO: 1370318 - RNA, 20 nt, Homo sapiens
cccagggccuuaaaagccau

SEQ ID NO: 1370319 - RNA, 19 nt, Homo sapiens
cccaguaagccacugccac

SEQ ID NO: 1370320 - RNA, 17 nt, Homo sapiens
cccaguaccuccaagca

SEQ ID NO: 1370321 - RNA, 22 nt, Homo sapiens
cccagucagaguugugcacaug

SEQ ID NO: 1370322 - RNA, 19 nt, Homo sapiens
cccagucuggaaugcagug

SEQ ID NO: 1370323 - RNA, 14 nt, Homo sapiens
cccaguguguuucu

SEQ ID NO: 1370324 - RNA, 14 nt, Homo sapiens
cccauaucugugaa

SEQ ID NO: 1370325 - RNA, 23 nt, Homo sapiens
cccauaucugugaaaugcuggca

SEQ ID NO: 1370326 - RNA, 13 nt, Homo sapiens
cccaucucuacaa

SEQ ID NO: 1370327 - RNA, 23 nt, Homo sapiens
cccaucuuguuucacacuaguca

SEQ ID NO: 1370328 - RNA, 13 nt, Homo sapiens
cccaugaagccac

SEQ ID NO: 1370329 - RNA, 12 nt, Homo sapiens
cccaugagauuc

SEQ ID NO: 1370330 - RNA, 14 nt, Homo sapiens
cccaugcccagcug

SEQ ID NO: 1370331 - RNA, 14 nt, Homo sapiens
cccaugugugagug

SEQ ID NO: 1370332 - RNA, 16 nt, Homo sapiens
cccauugauguacuuu

SEQ ID NO: 1370333 - RNA, 14 nt, Homo sapiens
cccauugucuuuac

SEQ ID NO: 1370334 - RNA, 18 nt, Homo sapiens
cccauuucuuaaucagug

SEQ ID NO: 1370335 - RNA, 11 nt, Homo sapiens
ccccaaagugg

SEQ ID NO: 1370336 - RNA, 11 nt, Homo sapiens
ccccaacagca

SEQ ID NO: 1370337 - RNA, 23 nt, Homo sapiens
ccccaacagcacccucuccagau

SEQ ID NO: 1370338 - RNA, 12 nt, Homo sapiens
ccccaccaguga

SEQ ID NO: 1370339 - RNA, 23 nt, Homo sapiens
ccccagacgcacgugggucuuca

SEQ ID NO: 1370340 - RNA, 10 nt, Homo sapiens
ccccagagac

SEQ ID NO: 1370341 - RNA, 18 nt, Homo sapiens
ccccagagcuggaccuga

SEQ ID NO: 1370342 - RNA, 16 nt, Homo sapiens
ccccaggccccaggaa

SEQ ID NO: 1370343 - RNA, 16 nt, Homo sapiens
ccccaggguccuguag

SEQ ID NO: 1370344 - RNA, 23 nt, Homo sapiens
ccccauggguuuugcuuaggcac

SEQ ID NO: 1370345 - RNA, 15 nt, Homo sapiens
ccccaugugccugca

SEQ ID NO: 1370346 - RNA, 11 nt, Homo sapiens
cccccaacagc

SEQ ID NO: 1370347 - RNA, 23 nt, Homo sapiens
cccccgugaggaugucacucaga

SEQ ID NO: 1370348 - RNA, 21 nt, Homo sapiens
cccccugacauuaucuuggau

SEQ ID NO: 1370349 - RNA, 12 nt, Homo sapiens
cccccuugaggg

SEQ ID NO: 1370350 - RNA, 19 nt, Homo sapiens
ccccgcauuccaggcuccu

SEQ ID NO: 1370351 - RNA, 20 nt, Homo sapiens
ccccgugaggaugucacuca

SEQ ID NO: 1370352 - RNA, 16 nt, Homo sapiens
ccccucagauuccacc

SEQ ID NO: 1370353 - RNA, 14 nt, Homo sapiens
ccccuggcucugac

SEQ ID NO: 1370354 - RNA, 16 nt, Homo sapiens
ccccugggacugcugc

SEQ ID NO: 1370355 - RNA, 18 nt, Homo sapiens
cccgagguggcugccugg

SEQ ID NO: 1370356 - RNA, 15 nt, Homo sapiens
cccgcauuccaggcu

SEQ ID NO: 1370357 - RNA, 22 nt, Homo sapiens
cccgccacccucccacugccaa

SEQ ID NO: 1370358 - RNA, 14 nt, Homo sapiens
cccgggaagccacc

SEQ ID NO: 1370359 - RNA, 22 nt, Homo sapiens
cccgucauguuccucaaaagca

SEQ ID NO: 1370360 - RNA, 23 nt, Homo sapiens
cccuaucucgaacauggaacuca

SEQ ID NO: 1370361 - RNA, 12 nt, Homo sapiens
cccuaugcugcc

SEQ ID NO: 1370362 - RNA, 13 nt, Homo sapiens
cccuauuagcucu

SEQ ID NO: 1370363 - RNA, 21 nt, Homo sapiens
cccuauugcugcuugaggcaa

SEQ ID NO: 1370364 - RNA, 19 nt, Homo sapiens
cccuauugguaaagaaugg

SEQ ID NO: 1370365 - RNA, 17 nt, Homo sapiens
cccucaaagcuuccauu

SEQ ID NO: 1370366 - RNA, 18 nt, Homo sapiens
cccucaaagcuuccauuc

SEQ ID NO: 1370367 - RNA, 12 nt, Homo sapiens
cccucacaggag

SEQ ID NO: 1370368 - RNA, 15 nt, Homo sapiens
cccucacuguugaau

SEQ ID NO: 1370369 - RNA, 13 nt, Homo sapiens
cccucggugggcc

SEQ ID NO: 1370370 - RNA, 17 nt, Homo sapiens
cccugaaaacccagaga

SEQ ID NO: 1370371 - RNA, 16 nt, Homo sapiens
cccugagacaaaugga

SEQ ID NO: 1370372 - RNA, 16 nt, Homo sapiens
cccugagucaccagga

SEQ ID NO: 1370373 - RNA, 19 nt, Homo sapiens
cccugauuguguauauuca

SEQ ID NO: 1370374 - RNA, 14 nt, Homo sapiens
cccugcacaaagcc

SEQ ID NO: 1370375 - RNA, 18 nt, Homo sapiens
cccugcagagaugcggug

SEQ ID NO: 1370376 - RNA, 18 nt, Homo sapiens
cccugcagggccaagcac

SEQ ID NO: 1370377 - RNA, 13 nt, Homo sapiens
cccugcccggcug

SEQ ID NO: 1370378 - RNA, 23 nt, Homo sapiens
cccugccuuuaaaaacaaacaga

SEQ ID NO: 1370379 - RNA, 14 nt, Homo sapiens
cccugcugaccucc

SEQ ID NO: 1370380 - RNA, 22 nt, Homo sapiens
cccugcugaccucccagugacc

SEQ ID NO: 1370381 - RNA, 20 nt, Homo sapiens
cccuggaucuaccagcauaa

SEQ ID NO: 1370382 - RNA, 22 nt, Homo sapiens
cccuggcucugaccgaaacagc

SEQ ID NO: 1370383 - RNA, 21 nt, Homo sapiens
cccuggggccuguacaaaagg

SEQ ID NO: 1370384 - RNA, 22 nt, Homo sapiens
cccuguccaaacugccuaagcc

SEQ ID NO: 1370385 - RNA, 22 nt, Homo sapiens
cccuuacuuagcaugcacaaag

SEQ ID NO: 1370386 - RNA, 15 nt, Homo sapiens
cccuucagcauccuc

SEQ ID NO: 1370387 - RNA, 21 nt, Homo sapiens
cccuuccaugucgccucugca

SEQ ID NO: 1370388 - RNA, 14 nt, Homo sapiens
cccuucucuguauu

SEQ ID NO: 1370389 - RNA, 16 nt, Homo sapiens
cccuucuuuucugacu

SEQ ID NO: 1370390 - RNA, 20 nt, Homo sapiens
cccuuucuguaccauuuauu

SEQ ID NO: 1370391 - RNA, 15 nt, Homo sapiens
ccgaagaaggguccu

SEQ ID NO: 1370392 - RNA, 22 nt, Homo sapiens
ccgaauugucuuuggugcuuuu

SEQ ID NO: 1370393 - RNA, 20 nt, Homo sapiens
ccgagucucuucuccacugg

SEQ ID NO: 1370394 - RNA, 21 nt, Homo sapiens
ccgccauugccaccaggagaa

SEQ ID NO: 1370395 - RNA, 18 nt, Homo sapiens
ccggaugcuucuccauga

SEQ ID NO: 1370396 - RNA, 12 nt, Homo sapiens
ccggcucugcac

SEQ ID NO: 1370397 - RNA, 23 nt, Homo sapiens
ccgggaggcagagguugcagugu

SEQ ID NO: 1370398 - RNA, 17 nt, Homo sapiens
ccgggcaauccagacag

SEQ ID NO: 1370399 - RNA, 19 nt, Homo sapiens
ccgggcuggccugugccua

SEQ ID NO: 1370400 - RNA, 15 nt, Homo sapiens
ccgguggaaggccuu

SEQ ID NO: 1370401 - RNA, 16 nt, Homo sapiens
ccgguugcuucuggga

SEQ ID NO: 1370402 - RNA, 12 nt, Homo sapiens
ccgucucaagga

SEQ ID NO: 1370403 - RNA, 11 nt, Homo sapiens
ccgugccuuca

SEQ ID NO: 1370404 - RNA, 18 nt, Homo sapiens
ccguggcuaagagugucc

SEQ ID NO: 1370405 - RNA, 12 nt, Homo sapiens
ccgugggccaug

SEQ ID NO: 1370406 - RNA, 13 nt, Homo sapiens
ccguucuugacau

SEQ ID NO: 1370407 - RNA, 17 nt, Homo sapiens
ccuaagacuuauguauu

SEQ ID NO: 1370408 - RNA, 22 nt, Homo sapiens
ccuaagcccuccgccauucuca

SEQ ID NO: 1370409 - RNA, 17 nt, Homo sapiens
ccuaaggcacccacaaa

SEQ ID NO: 1370410 - RNA, 19 nt, Homo sapiens
ccuaaggcacccacaaaua

SEQ ID NO: 1370411 - RNA, 18 nt, Homo sapiens
ccuaaugagaagucaaca

SEQ ID NO: 1370412 - RNA, 15 nt, Homo sapiens
ccuaauguggcagcu

SEQ ID NO: 1370413 - RNA, 16 nt, Homo sapiens
ccuacaccucuugaaa

SEQ ID NO: 1370414 - RNA, 18 nt, Homo sapiens
ccuacaccucuugaaaau

SEQ ID NO: 1370415 - RNA, 16 nt, Homo sapiens
ccuacaguggcuguca

SEQ ID NO: 1370416 - RNA, 19 nt, Homo sapiens
ccuacauacgucuuucaca

SEQ ID NO: 1370417 - RNA, 16 nt, Homo sapiens
ccuaccaaccucugaa

SEQ ID NO: 1370418 - RNA, 14 nt, Homo sapiens
ccuaccacaguguc

SEQ ID NO: 1370419 - RNA, 15 nt, Homo sapiens
ccuacuaacauauaa

SEQ ID NO: 1370420 - RNA, 11 nt, Homo sapiens
ccuacugcugg

SEQ ID NO: 1370421 - RNA, 16 nt, Homo sapiens
ccuacuucuuuugcuc

SEQ ID NO: 1370422 - RNA, 20 nt, Homo sapiens
ccuagacugacccugaucag

SEQ ID NO: 1370423 - RNA, 12 nt, Homo sapiens
ccuagacuguua

SEQ ID NO: 1370424 - RNA, 18 nt, Homo sapiens
ccuagagcuagauguguc

SEQ ID NO: 1370425 - RNA, 23 nt, Homo sapiens
ccuagcaaggcaugauguuaacc

SEQ ID NO: 1370426 - RNA, 15 nt, Homo sapiens
ccuagccgaccucag

SEQ ID NO: 1370427 - RNA, 17 nt, Homo sapiens
ccuagcugugugcaguc

SEQ ID NO: 1370428 - RNA, 21 nt, Homo sapiens
ccuaggaauucccagcccaaa

SEQ ID NO: 1370429 - RNA, 17 nt, Homo sapiens
ccuaggaguauccucau

SEQ ID NO: 1370430 - RNA, 17 nt, Homo sapiens
ccuauaaaacaggucaa

SEQ ID NO: 1370431 - RNA, 19 nt, Homo sapiens
ccuauauguaguauaaaga

SEQ ID NO: 1370432 - RNA, 23 nt, Homo sapiens
ccuaucagaaguuucucagcucc

SEQ ID NO: 1370433 - RNA, 12 nt, Homo sapiens
ccuaugauccca

SEQ ID NO: 1370434 - RNA, 18 nt, Homo sapiens
ccucaaaaugacagccau

SEQ ID NO: 1370435 - RNA, 21 nt, Homo sapiens
ccucaaacuuccagucaggua

SEQ ID NO: 1370436 - RNA, 16 nt, Homo sapiens
ccucaaccugugauga

SEQ ID NO: 1370437 - RNA, 11 nt, Homo sapiens
ccucacaucuu

SEQ ID NO: 1370438 - RNA, 19 nt, Homo sapiens
ccucaccauuuuuguucua

SEQ ID NO: 1370439 - RNA, 12 nt, Homo sapiens
ccucagauuccg

SEQ ID NO: 1370440 - RNA, 22 nt, Homo sapiens
ccucagccucccaaagugcugg

SEQ ID NO: 1370441 - RNA, 12 nt, Homo sapiens
ccucaggugcua

SEQ ID NO: 1370442 - RNA, 21 nt, Homo sapiens
ccucagugaaagcagucaucu

SEQ ID NO: 1370443 - RNA, 14 nt, Homo sapiens
ccucaguuccugca

SEQ ID NO: 1370444 - RNA, 13 nt, Homo sapiens
ccucauuagcauu

SEQ ID NO: 1370445 - RNA, 20 nt, Homo sapiens
ccucauuagcauuuugcuaa

SEQ ID NO: 1370446 - RNA, 13 nt, Homo sapiens
ccucauuccugaa

SEQ ID NO: 1370447 - RNA, 14 nt, Homo sapiens
ccucauuugcaagg

SEQ ID NO: 1370448 - RNA, 13 nt, Homo sapiens
ccuccaaaagccc

SEQ ID NO: 1370449 - RNA, 20 nt, Homo sapiens
ccuccaaaagcccugaguuu

SEQ ID NO: 1370450 - RNA, 13 nt, Homo sapiens
ccuccaaaugcca

SEQ ID NO: 1370451 - RNA, 16 nt, Homo sapiens
ccuccaaaugccaacu

SEQ ID NO: 1370452 - RNA, 16 nt, Homo sapiens
ccuccaccccccagaa

SEQ ID NO: 1370453 - RNA, 16 nt, Homo sapiens
ccuccauacucaggac

SEQ ID NO: 1370454 - RNA, 15 nt, Homo sapiens
ccuccauucugacca

SEQ ID NO: 1370455 - RNA, 17 nt, Homo sapiens
ccuccauucugaccauu

SEQ ID NO: 1370456 - RNA, 12 nt, Homo sapiens
ccuccauuugca

SEQ ID NO: 1370457 - RNA, 21 nt, Homo sapiens
ccucccaaagugcugggauua

SEQ ID NO: 1370458 - RNA, 13 nt, Homo sapiens
ccuccccauguga

SEQ ID NO: 1370459 - RNA, 10 nt, Homo sapiens
ccucccugaa

SEQ ID NO: 1370460 - RNA, 18 nt, Homo sapiens
ccucccuggcucccauga

SEQ ID NO: 1370461 - RNA, 17 nt, Homo sapiens
ccuccuaaaguagacuu

SEQ ID NO: 1370462 - RNA, 18 nt, Homo sapiens
ccucgggacaucaaaaac

SEQ ID NO: 1370463 - RNA, 16 nt, Homo sapiens
ccucuaaaacaguccu

SEQ ID NO: 1370464 - RNA, 12 nt, Homo sapiens
ccucucccaguu

SEQ ID NO: 1370465 - RNA, 11 nt, Homo sapiens
ccucucuccau

SEQ ID NO: 1370466 - RNA, 19 nt, Homo sapiens
ccucucucuucugcuccac

SEQ ID NO: 1370467 - RNA, 16 nt, Homo sapiens
ccucucuuauagaaua

SEQ ID NO: 1370468 - RNA, 12 nt, Homo sapiens
ccucugccucaa

SEQ ID NO: 1370469 - RNA, 15 nt, Homo sapiens
ccucugccugcauuc

SEQ ID NO: 1370470 - RNA, 20 nt, Homo sapiens
ccucuggaauaaaacauaca

SEQ ID NO: 1370471 - RNA, 21 nt, Homo sapiens
ccucuggcuggcuaacuggaa

SEQ ID NO: 1370472 - RNA, 17 nt, Homo sapiens
ccucuuagaaaaaccac

SEQ ID NO: 1370473 - RNA, 22 nt, Homo sapiens
ccucuuccccagaaaggagacu

SEQ ID NO: 1370474 - RNA, 24 nt, Homo sapiens
ccucuuccccagaaaggagacuag

SEQ ID NO: 1370475 - RNA, 21 nt, Homo sapiens
ccucuucucuacucuagggaa

SEQ ID NO: 1370476 - RNA, 20 nt, Homo sapiens
ccucuuuuucuagucuucau

SEQ ID NO: 1370477 - RNA, 13 nt, Homo sapiens
ccugaaaaaucua

SEQ ID NO: 1370478 - RNA, 18 nt, Homo sapiens
ccugaaagccacagacaa

SEQ ID NO: 1370479 - RNA, 13 nt, Homo sapiens
ccugaagucacac

SEQ ID NO: 1370480 - RNA, 20 nt, Homo sapiens
ccugaagucacacagugagu

SEQ ID NO: 1370481 - RNA, 18 nt, Homo sapiens
ccugaaguuggagugagu

SEQ ID NO: 1370482 - RNA, 18 nt, Homo sapiens
ccugacccagagccuagg

SEQ ID NO: 1370483 - RNA, 19 nt, Homo sapiens
ccugaccugucaccgugag

SEQ ID NO: 1370484 - RNA, 15 nt, Homo sapiens
ccugagacaaaugga

SEQ ID NO: 1370485 - RNA, 13 nt, Homo sapiens
ccugagagugggu

SEQ ID NO: 1370486 - RNA, 15 nt, Homo sapiens
ccugagccacaaaaa

SEQ ID NO: 1370487 - RNA, 20 nt, Homo sapiens
ccugagcucgguggacccag

SEQ ID NO: 1370488 - RNA, 20 nt, Homo sapiens
ccugaggcuggacuccagau

SEQ ID NO: 1370489 - RNA, 19 nt, Homo sapiens
ccugaucgccaaccuuucc

SEQ ID NO: 1370490 - RNA, 12 nt, Homo sapiens
ccugauguuaaa

SEQ ID NO: 1370491 - RNA, 19 nt, Homo sapiens
ccugauuuuacacacauua

SEQ ID NO: 1370492 - RNA, 17 nt, Homo sapiens
ccugcaccccugcaguu

SEQ ID NO: 1370493 - RNA, 21 nt, Homo sapiens
ccugcaguuauuaacacuaac

SEQ ID NO: 1370494 - RNA, 18 nt, Homo sapiens
ccugccaggcacacugag

SEQ ID NO: 1370495 - RNA, 12 nt, Homo sapiens
ccugccaggcag

SEQ ID NO: 1370496 - RNA, 15 nt, Homo sapiens
ccugcccaccuguca

SEQ ID NO: 1370497 - RNA, 16 nt, Homo sapiens
ccugcccagugcacac

SEQ ID NO: 1370498 - RNA, 22 nt, Homo sapiens
ccugccccaaacaaauaugcaa

SEQ ID NO: 1370499 - RNA, 14 nt, Homo sapiens
ccugcccuagcucc

SEQ ID NO: 1370500 - RNA, 16 nt, Homo sapiens
ccugcccuagcuccac

SEQ ID NO: 1370501 - RNA, 15 nt, Homo sapiens
ccugccuagcacuca

SEQ ID NO: 1370502 - RNA, 13 nt, Homo sapiens
ccugcguggcuga

SEQ ID NO: 1370503 - RNA, 14 nt, Homo sapiens
ccugcuauuuccca

SEQ ID NO: 1370504 - RNA, 18 nt, Homo sapiens
ccugcucuccucuugcca

SEQ ID NO: 1370505 - RNA, 18 nt, Homo sapiens
ccugcuuuacuuugccca

SEQ ID NO: 1370506 - RNA, 22 nt, Homo sapiens
ccuggaaauaucaguuacucag

SEQ ID NO: 1370507 - RNA, 20 nt, Homo sapiens
ccuggaaggcagccaggcug

SEQ ID NO: 1370508 - RNA, 12 nt, Homo sapiens
ccuggaccucag

SEQ ID NO: 1370509 - RNA, 19 nt, Homo sapiens
ccuggagcccauccagucu

SEQ ID NO: 1370510 - RNA, 20 nt, Homo sapiens
ccuggaggccgggugcucag

SEQ ID NO: 1370511 - RNA, 23 nt, Homo sapiens
ccuggaucaguccuuugaucagu

SEQ ID NO: 1370512 - RNA, 20 nt, Homo sapiens
ccuggcacuggaugcagaaa

SEQ ID NO: 1370513 - RNA, 21 nt, Homo sapiens
ccuggccaucucugaacuuca

SEQ ID NO: 1370514 - RNA, 21 nt, Homo sapiens
ccuggcuccaacacugcugcu

SEQ ID NO: 1370515 - RNA, 14 nt, Homo sapiens
ccuggcuuugccca

SEQ ID NO: 1370516 - RNA, 21 nt, Homo sapiens
ccugggaggaaauuugaaugg

SEQ ID NO: 1370517 - RNA, 19 nt, Homo sapiens
ccugggcaucagaccuuaa

SEQ ID NO: 1370518 - RNA, 12 nt, Homo sapiens
cgugugugcaag

SEQ ID NO: 1370519 - RNA, 18 nt, Homo sapiens
cguuaagaauuguuaaag

SEQ ID NO: 1370520 - RNA, 21 nt, Homo sapiens
cguucccggguagccacugga

SEQ ID NO: 1370521 - RNA, 19 nt, Homo sapiens
cguuggccuaacacugggc

SEQ ID NO: 1370522 - RNA, 23 nt, Homo sapiens
cguuuccugagaagugucuaaaa

SEQ ID NO: 1370523 - RNA, 13 nt, Homo sapiens
cguuuuaugauuu

SEQ ID NO: 1370524 - RNA, 14 nt, Homo sapiens
cguuuuuuucauuc

SEQ ID NO: 1370525 - RNA, 14 nt, Homo sapiens
cuaaaaaacagagg

SEQ ID NO: 1370526 - RNA, 22 nt, Homo sapiens
cuaaaaaacagaggccauggca

SEQ ID NO: 1370527 - RNA, 15 nt, Homo sapiens
cuaaaaaugcaacuu

SEQ ID NO: 1370528 - RNA, 17 nt, Homo sapiens
cuaaaacuuaacauuca

SEQ ID NO: 1370529 - RNA, 14 nt, Homo sapiens
cuaaaacuucaucu

SEQ ID NO: 1370530 - RNA, 18 nt, Homo sapiens
cuaaagagagaugaacca

SEQ ID NO: 1370531 - RNA, 17 nt, Homo sapiens
cuaaagccaaaggucua

SEQ ID NO: 1370532 - RNA, 16 nt, Homo sapiens
cuaaagguuguauugc

SEQ ID NO: 1370533 - RNA, 19 nt, Homo sapiens
cuaaaguuagaaaguugau

SEQ ID NO: 1370534 - RNA, 20 nt, Homo sapiens
cuaaauaauguuaucugugu

SEQ ID NO: 1370535 - RNA, 21 nt, Homo sapiens
cuaaaugaaaaucgugacaac

SEQ ID NO: 1370536 - RNA, 16 nt, Homo sapiens
cuaaauuacaaaugca

SEQ ID NO: 1370537 - RNA, 15 nt, Homo sapiens
cuaaauuauagugua

SEQ ID NO: 1370538 - RNA, 14 nt, Homo sapiens
cuaacaacaaauua

SEQ ID NO: 1370539 - RNA, 22 nt, Homo sapiens
cuaacaauggaagauuugccca

SEQ ID NO: 1370540 - RNA, 16 nt, Homo sapiens
cuaacagugugauuca

SEQ ID NO: 1370541 - RNA, 13 nt, Homo sapiens
cuaacuagcuugg

SEQ ID NO: 1370542 - RNA, 13 nt, Homo sapiens
cuaacuccaguga

SEQ ID NO: 1370543 - RNA, 23 nt, Homo sapiens
cuaacuuuccuucauucaaccca

SEQ ID NO: 1370544 - RNA, 16 nt, Homo sapiens
cuaagagucucuauua

SEQ ID NO: 1370545 - RNA, 14 nt, Homo sapiens
cuaagauggcuuuu

SEQ ID NO: 1370546 - RNA, 17 nt, Homo sapiens
cuaagcacgggccauau

SEQ ID NO: 1370547 - RNA, 20 nt, Homo sapiens
cuaagcugccgguucuuaaa

SEQ ID NO: 1370548 - RNA, 23 nt, Homo sapiens
cuaagggcaggcccaaauuauca

SEQ ID NO: 1370549 - RNA, 22 nt, Homo sapiens
cuaaggucauuaccacaggcca

SEQ ID NO: 1370550 - RNA, 19 nt, Homo sapiens
cuaaucauccaaugcucaa

SEQ ID NO: 1370551 - RNA, 17 nt, Homo sapiens
cuaauuagagcagauga

SEQ ID NO: 1370552 - RNA, 22 nt, Homo sapiens
cuaauuucugaaaugugcagcu

SEQ ID NO: 1370553 - RNA, 16 nt, Homo sapiens
cuacaaacacaagcaa

SEQ ID NO: 1370554 - RNA, 23 nt, Homo sapiens
cuacaaacucccacuugucaugu

SEQ ID NO: 1370555 - RNA, 21 nt, Homo sapiens
cuacaauauuaacauaagaaa

SEQ ID NO: 1370556 - RNA, 16 nt, Homo sapiens
cuacagagagaaaaau

SEQ ID NO: 1370557 - RNA, 20 nt, Homo sapiens
cuacagaugucccauuuuca

SEQ ID NO: 1370558 - RNA, 19 nt, Homo sapiens
cuacauggaguauauguca

SEQ ID NO: 1370559 - RNA, 15 nt, Homo sapiens
cuacauuuuaaugca

SEQ ID NO: 1370560 - RNA, 13 nt, Homo sapiens
cuaccaacuggaa

SEQ ID NO: 1370561 - RNA, 19 nt, Homo sapiens
cuaccaacuggaagcacag

SEQ ID NO: 1370562 - RNA, 14 nt, Homo sapiens
cuacccugcugacc

SEQ ID NO: 1370563 - RNA, 18 nt, Homo sapiens
cuacccugcugaccuccc

SEQ ID NO: 1370564 - RNA, 15 nt, Homo sapiens
cuacguaucugcuac

SEQ ID NO: 1370565 - RNA, 19 nt, Homo sapiens
cuacgugacuguggcacac

SEQ ID NO: 1370566 - RNA, 19 nt, Homo sapiens
cuacucaggaggcugaggc

SEQ ID NO: 1370567 - RNA, 14 nt, Homo sapiens
cuacugagccuuca

SEQ ID NO: 1370568 - RNA, 16 nt, Homo sapiens
cuacugaggugcuaug

SEQ ID NO: 1370569 - RNA, 13 nt, Homo sapiens
cuacuguguuccu

SEQ ID NO: 1370570 - RNA, 15 nt, Homo sapiens
cuacuuaaugagaua

SEQ ID NO: 1370571 - RNA, 19 nt, Homo sapiens
cuacuuccugugacuucag

SEQ ID NO: 1370572 - RNA, 19 nt, Homo sapiens
cuagaacucuccaucuuau

SEQ ID NO: 1370573 - RNA, 23 nt, Homo sapiens
cuagacugacccugaucagucua

SEQ ID NO: 1370574 - RNA, 17 nt, Homo sapiens
cuagagaaaagucuacc

SEQ ID NO: 1370575 - RNA, 23 nt, Homo sapiens
cuagagauauggcagcgaaagga

SEQ ID NO: 1370576 - RNA, 18 nt, Homo sapiens
cuagagcacacuguagca

SEQ ID NO: 1370577 - RNA, 17 nt, Homo sapiens
cuagaguccucacuccc

SEQ ID NO: 1370578 - RNA, 13 nt, Homo sapiens
cuagaugagccca

SEQ ID NO: 1370579 - RNA, 15 nt, Homo sapiens
cuagaugagcccagc

SEQ ID NO: 1370580 - RNA, 15 nt, Homo sapiens
cuagauuuaugaaua

SEQ ID NO: 1370581 - RNA, 16 nt, Homo sapiens
cuagcacuuggagcca

SEQ ID NO: 1370582 - RNA, 14 nt, Homo sapiens
cuagcagaaaucua

SEQ ID NO: 1370583 - RNA, 12 nt, Homo sapiens
cuagcaucucau

SEQ ID NO: 1370584 - RNA, 17 nt, Homo sapiens
cuagcaucucaugagug

SEQ ID NO: 1370585 - RNA, 22 nt, Homo sapiens
cuagcaucucaugagugccaag

SEQ ID NO: 1370586 - RNA, 14 nt, Homo sapiens
cuagccggagugac

SEQ ID NO: 1370587 - RNA, 13 nt, Homo sapiens
cuaggagcacugu

SEQ ID NO: 1370588 - RNA, 19 nt, Homo sapiens
cuaggagcugggaggaaaa

SEQ ID NO: 1370589 - RNA, 18 nt, Homo sapiens
cuaggccacaccaucucc

SEQ ID NO: 1370590 - RNA, 18 nt, Homo sapiens
cuagggacuuucuaagaa

SEQ ID NO: 1370591 - RNA, 19 nt, Homo sapiens
cuagggauucaggcugcuu

SEQ ID NO: 1370592 - RNA, 14 nt, Homo sapiens
cuagguaacaguuu

SEQ ID NO: 1370593 - RNA, 13 nt, Homo sapiens
cuaggugcccuug

SEQ ID NO: 1370594 - RNA, 23 nt, Homo sapiens
cuagguucuaaaaauugugauca

SEQ ID NO: 1370595 - RNA, 16 nt, Homo sapiens
cuaguagucauuucau

SEQ ID NO: 1370596 - RNA, 16 nt, Homo sapiens
cuaguccuuuacuaau

SEQ ID NO: 1370597 - RNA, 15 nt, Homo sapiens
cuagucugcuagcca

SEQ ID NO: 1370598 - RNA, 16 nt, Homo sapiens
cuagugacaagcuccu

SEQ ID NO: 1370599 - RNA, 20 nt, Homo sapiens
cuaguucagacacuuuggaa

SEQ ID NO: 1370600 - RNA, 15 nt, Homo sapiens
cuaguuugaccucau

SEQ ID NO: 1370601 - RNA, 20 nt, Homo sapiens
cuaguuuugucaaacuguag

SEQ ID NO: 1370602 - RNA, 16 nt, Homo sapiens
cuauaaaaaaaugcau

SEQ ID NO: 1370603 - RNA, 20 nt, Homo sapiens
cuauaacuauguugauaaaa

SEQ ID NO: 1370604 - RNA, 12 nt, Homo sapiens
cuauagucccag

SEQ ID NO: 1370605 - RNA, 18 nt, Homo sapiens
cuauauacuauaugauuc

SEQ ID NO: 1370606 - RNA, 17 nt, Homo sapiens
cuauauucucaguguag

SEQ ID NO: 1370607 - RNA, 18 nt, Homo sapiens
cuauauuuagauuguuaa

SEQ ID NO: 1370608 - RNA, 19 nt, Homo sapiens
cuaucaccucuuaugcaca

SEQ ID NO: 1370609 - RNA, 13 nt, Homo sapiens
cuaucaguucccu

SEQ ID NO: 1370610 - RNA, 15 nt, Homo sapiens
cuaucauucugcucu

SEQ ID NO: 1370611 - RNA, 18 nt, Homo sapiens
cuaucccaucccauccca

SEQ ID NO: 1370612 - RNA, 20 nt, Homo sapiens
cuaucugauuuccuaauguc

SEQ ID NO: 1370613 - RNA, 22 nt, Homo sapiens
cuaucuucauaucuaucagagu

SEQ ID NO: 1370614 - RNA, 20 nt, Homo sapiens
cuaucuuggcucacugcaaa

SEQ ID NO: 1370615 - RNA, 19 nt, Homo sapiens
cuaugaaugauacccugaa

SEQ ID NO: 1370616 - RNA, 17 nt, Homo sapiens
cuaugaauuuucaagua

SEQ ID NO: 1370617 - RNA, 14 nt, Homo sapiens
cuauggaagcauau

SEQ ID NO: 1370618 - RNA, 20 nt, Homo sapiens
cuauggcacccaugcaccuu

SEQ ID NO: 1370619 - RNA, 18 nt, Homo sapiens
cuauggcucuacuuucag

SEQ ID NO: 1370620 - RNA, 11 nt, Homo sapiens
cuaugggacuc

SEQ ID NO: 1370621 - RNA, 20 nt, Homo sapiens
cuaugucacccaaugcauau

SEQ ID NO: 1370622 - RNA, 13 nt, Homo sapiens
cuaugugcaugca

SEQ ID NO: 1370623 - RNA, 13 nt, Homo sapiens
cuauguucuuagu

SEQ ID NO: 1370624 - RNA, 14 nt, Homo sapiens
cuauguugcccagg

SEQ ID NO: 1370625 - RNA, 16 nt, Homo sapiens
cuauuacaccaaauaa

SEQ ID NO: 1370626 - RNA, 15 nt, Homo sapiens
cuauucaguuuucag

SEQ ID NO: 1370627 - RNA, 16 nt, Homo sapiens
cuauucauugacugau

SEQ ID NO: 1370628 - RNA, 22 nt, Homo sapiens
cuauuccauggcuaacuggcga

SEQ ID NO: 1370629 - RNA, 14 nt, Homo sapiens
cuauugccugagag

SEQ ID NO: 1370630 - RNA, 15 nt, Homo sapiens
cuauuucuaucccaa

SEQ ID NO: 1370631 - RNA, 23 nt, Homo sapiens
uaaaagaaccgagcaauuuucug

SEQ ID NO: 1370632 - RNA, 23 nt, Homo sapiens
uaaaagaugcauuaucuaugaua

SEQ ID NO: 1370633 - RNA, 23 nt, Homo sapiens
uaaaaguucauaacagugccauu

SEQ ID NO: 1370634 - RNA, 17 nt, Homo sapiens
uaaaauaaaugcaauug

SEQ ID NO: 1370635 - RNA, 16 nt, Homo sapiens
uaaaauaauaacaauc

SEQ ID NO: 1370636 - RNA, 14 nt, Homo sapiens
uaaaauagccacuu

SEQ ID NO: 1370637 - RNA, 14 nt, Homo sapiens
uaaaauaguagcau

SEQ ID NO: 1370638 - RNA, 19 nt, Homo sapiens
uaaaauauuccugcauuug

SEQ ID NO: 1370639 - RNA, 19 nt, Homo sapiens
uaaaaugaaauuacuacaa

SEQ ID NO: 1370640 - RNA, 18 nt, Homo sapiens
uaaacaaauguaugauua

SEQ ID NO: 1370641 - RNA, 16 nt, Homo sapiens
uaaacaacuaccuccu

SEQ ID NO: 1370642 - RNA, 20 nt, Homo sapiens
uaaacaagaguuuucuuccu

SEQ ID NO: 1370643 - RNA, 13 nt, Homo sapiens
uaaacacugaugg

SEQ ID NO: 1370644 - RNA, 17 nt, Homo sapiens
uaaacaguggaauauaa

SEQ ID NO: 1370645 - RNA, 19 nt, Homo sapiens
uaaacauuuuuaaguauuu

SEQ ID NO: 1370646 - RNA, 20 nt, Homo sapiens
uaaaccauaugaacauauau

SEQ ID NO: 1370647 - RNA, 22 nt, Homo sapiens
uaaaccuuuuuggacacacaaa

SEQ ID NO: 1370648 - RNA, 20 nt, Homo sapiens
uaaacuauuuugaagaucuu

SEQ ID NO: 1370649 - RNA, 13 nt, Homo sapiens
uaaacucugcuca

SEQ ID NO: 1370650 - RNA, 19 nt, Homo sapiens
uaaacuugucaggguauaa

SEQ ID NO: 1370651 - RNA, 21 nt, Homo sapiens
uaaacuuuagaauuaauuuau

SEQ ID NO: 1370652 - RNA, 18 nt, Homo sapiens
uaaagagaaacuuugugc

SEQ ID NO: 1370653 - RNA, 15 nt, Homo sapiens
uaaagagaacucugg

SEQ ID NO: 1370654 - RNA, 20 nt, Homo sapiens
uaaagagagaauguagauau

SEQ ID NO: 1370655 - RNA, 18 nt, Homo sapiens
uaaagagagaugaaccac

SEQ ID NO: 1370656 - RNA, 17 nt, Homo sapiens
uaaagcauucaauuuau

SEQ ID NO: 1370657 - RNA, 22 nt, Homo sapiens
uaaagccuuggauguauauguc

SEQ ID NO: 1370658 - RNA, 16 nt, Homo sapiens
uaaagcugaaaacugc

SEQ ID NO: 1370659 - RNA, 17 nt, Homo sapiens
uaaaggcuaaaagggaa

SEQ ID NO: 1370660 - RNA, 24 nt, Homo sapiens
uaaagguaaaacaugcuggugaac

SEQ ID NO: 1370661 - RNA, 21 nt, Homo sapiens
uaaauaaauguaucuuauuca

SEQ ID NO: 1370662 - RNA, 12 nt, Homo sapiens
uaaauacuguuu

SEQ ID NO: 1370663 - RNA, 19 nt, Homo sapiens
uaaauagaccucucaauuu

SEQ ID NO: 1370664 - RNA, 21 nt, Homo sapiens
uaaauagaguauaugcacuuu

SEQ ID NO: 1370665 - RNA, 19 nt, Homo sapiens
uaaaucaaugucacuuaaa

SEQ ID NO: 1370666 - RNA, 23 nt, Homo sapiens
uaaaucauuaagacaacugaguu

SEQ ID NO: 1370667 - RNA, 23 nt, Homo sapiens
uaaaucccauucauaacuuucau

SEQ ID NO: 1370668 - RNA, 20 nt, Homo sapiens
uaaaucuguuauuuugcuau

SEQ ID NO: 1370669 - RNA, 18 nt, Homo sapiens
uaaaugaaguaacuuguc

SEQ ID NO: 1370670 - RNA, 11 nt, Homo sapiens
uaaaugcccug

SEQ ID NO: 1370671 - RNA, 21 nt, Homo sapiens
uaaaugcugucaacuaugaua

SEQ ID NO: 1370672 - RNA, 16 nt, Homo sapiens
uaaauggguagagaaa

SEQ ID NO: 1370673 - RNA, 15 nt, Homo sapiens
uaaauguaagaauca

SEQ ID NO: 1370674 - RNA, 14 nt, Homo sapiens
uaaauguaauaagu

SEQ ID NO: 1370675 - RNA, 11 nt, Homo sapiens
uaaaugugcag

SEQ ID NO: 1370676 - RNA, 23 nt, Homo sapiens
uaaauuaugcuuucuauuuugag

SEQ ID NO: 1370677 - RNA, 16 nt, Homo sapiens
uaaauuauggcauuuu

SEQ ID NO: 1370678 - RNA, 20 nt, Homo sapiens
uaaauucuauaggaacauau

SEQ ID NO: 1370679 - RNA, 16 nt, Homo sapiens
uaaauuguacuguuga

SEQ ID NO: 1370680 - RNA, 17 nt, Homo sapiens
uaaauuugguucuaggc

SEQ ID NO: 1370681 - RNA, 14 nt, Homo sapiens
uaaauuuguguucu

SEQ ID NO: 1370682 - RNA, 16 nt, Homo sapiens
uaacaaaagcaauugu

SEQ ID NO: 1370683 - RNA, 20 nt, Homo sapiens
uaacaaccaaagacuacaua

SEQ ID NO: 1370684 - RNA, 11 nt, Homo sapiens
uaacaaugaag

SEQ ID NO: 1370685 - RNA, 15 nt, Homo sapiens
uaacacacauaaagg

SEQ ID NO: 1370686 - RNA, 19 nt, Homo sapiens
uaacaccaugauuaaccac

SEQ ID NO: 1370687 - RNA, 22 nt, Homo sapiens
uaacagauuugcauaugucuau

SEQ ID NO: 1370688 - RNA, 18 nt, Homo sapiens
uaacagcugucuauguau

SEQ ID NO: 1370689 - RNA, 17 nt, Homo sapiens
uaacaggagugccacuu

SEQ ID NO: 1370690 - RNA, 18 nt, Homo sapiens
uaacaggauauuuaauga

SEQ ID NO: 1370691 - RNA, 16 nt, Homo sapiens
uaaccccauucuuugc

SEQ ID NO: 1370692 - RNA, 15 nt, Homo sapiens
uaaccccuggcaacc

SEQ ID NO: 1370693 - RNA, 22 nt, Homo sapiens
uaaccgucaauaggcaaagggg

SEQ ID NO: 1370694 - RNA, 19 nt, Homo sapiens
uaaccuccuuuacccucau

SEQ ID NO: 1370695 - RNA, 13 nt, Homo sapiens
uaacggcacugug

SEQ ID NO: 1370696 - RNA, 17 nt, Homo sapiens
uaacucaauauuuucca

SEQ ID NO: 1370697 - RNA, 18 nt, Homo sapiens
uaacucaccucucaaggu

SEQ ID NO: 1370698 - RNA, 23 nt, Homo sapiens
uaacucagaaacaucaguuacuc

SEQ ID NO: 1370699 - RNA, 14 nt, Homo sapiens
uaacugcauugaga

SEQ ID NO: 1370700 - RNA, 21 nt, Homo sapiens
uaacugcauugagaacugcau

SEQ ID NO: 1370701 - RNA, 14 nt, Homo sapiens
uaagaaccugaaua

SEQ ID NO: 1370702 - RNA, 22 nt, Homo sapiens
uaagacaacaaagagaagcaga

SEQ ID NO: 1370703 - RNA, 17 nt, Homo sapiens
uaagacauaaauuacuu

SEQ ID NO: 1370704 - RNA, 16 nt, Homo sapiens
uaagacgaaugauuua

SEQ ID NO: 1370705 - RNA, 18 nt, Homo sapiens
uaagagaagcuacuuugu

SEQ ID NO: 1370706 - RNA, 13 nt, Homo sapiens
uaagagagccuug

SEQ ID NO: 1370707 - RNA, 19 nt, Homo sapiens
uaagagugccguaacaacu

SEQ ID NO: 1370708 - RNA, 22 nt, Homo sapiens
uaagagugccguaacaacugug

SEQ ID NO: 1370709 - RNA, 24 nt, Homo sapiens
uaagaguggaaccaacacuaacau

SEQ ID NO: 1370710 - RNA, 15 nt, Homo sapiens
uaagauaauguugcu

SEQ ID NO: 1370711 - RNA, 17 nt, Homo sapiens
uaagauguucacugugg

SEQ ID NO: 1370712 - RNA, 14 nt, Homo sapiens
uaagauucauccau

SEQ ID NO: 1370713 - RNA, 12 nt, Homo sapiens
uaagauuuaccc

SEQ ID NO: 1370714 - RNA, 13 nt, Homo sapiens
uaagcaacaucua

SEQ ID NO: 1370715 - RNA, 16 nt, Homo sapiens
uaagcuaggaaugaaa

SEQ ID NO: 1370716 - RNA, 21 nt, Homo sapiens
uaagcuaucuucaaaugucua

SEQ ID NO: 1370717 - RNA, 20 nt, Homo sapiens
uaagcucuacugaggugcua

SEQ ID NO: 1370718 - RNA, 20 nt, Homo sapiens
uaagcugggauaaucacauu

SEQ ID NO: 1370719 - RNA, 16 nt, Homo sapiens
uaagcuguaaccgaua

SEQ ID NO: 1370720 - RNA, 22 nt, Homo sapiens
uaagcuguaaccgauaugcacu

SEQ ID NO: 1370721 - RNA, 14 nt, Homo sapiens
uaaggaaagcaaua

SEQ ID NO: 1370722 - RNA, 19 nt, Homo sapiens
uaaggaacauguacuguua

SEQ ID NO: 1370723 - RNA, 14 nt, Homo sapiens
uaaggacauuuccc

SEQ ID NO: 1370724 - RNA, 22 nt, Homo sapiens
uaaggacgggaccauuuuuaca

SEQ ID NO: 1370725 - RNA, 19 nt, Homo sapiens
uaaggcugaggaaaggcca

SEQ ID NO: 1370726 - RNA, 20 nt, Homo sapiens
uaagggggugcagcagugag

SEQ ID NO: 1370727 - RNA, 20 nt, Homo sapiens
uaaggguuaguuuacaauca

SEQ ID NO: 1370728 - RNA, 21 nt, Homo sapiens
uaagguauauaaauuuuccca

SEQ ID NO: 1370729 - RNA, 13 nt, Homo sapiens
uaaggugagggaa

SEQ ID NO: 1370730 - RNA, 14 nt, Homo sapiens
uaaguaaacuaaug

SEQ ID NO: 1370731 - RNA, 15 nt, Homo sapiens
uaaguaaugaugucg

SEQ ID NO: 1370732 - RNA, 23 nt, Homo sapiens
uaaguacuauguaucaaugagua

SEQ ID NO: 1370733 - RNA, 14 nt, Homo sapiens
uaaguuuaucuuuc

SEQ ID NO: 1370734 - RNA, 13 nt, Homo sapiens
uaaguuucacuga

SEQ ID NO: 1370735 - RNA, 15 nt, Homo sapiens
uaauaaaccuccuuc

SEQ ID NO: 1370736 - RNA, 21 nt, Homo sapiens
uaauaagcaaagggagcacug

SEQ ID NO: 1370737 - RNA, 15 nt, Homo sapiens
uaauaagcuaaagag

SEQ ID NO: 1370738 - RNA, 14 nt, Homo sapiens
uaauaaguacugug

SEQ ID NO: 1370739 - RNA, 16 nt, Homo sapiens
uaauaaguuucacuga

SEQ ID NO: 1370740 - RNA, 18 nt, Homo sapiens
uaauaaguuucacugacu

SEQ ID NO: 1370741 - RNA, 18 nt, Homo sapiens
uaauacagacuaugucac

SEQ ID NO: 1370742 - RNA, 13 nt, Homo sapiens
uaauauacuaugc

SEQ ID NO: 1370743 - RNA, 22 nt, Homo sapiens
uaaucagggaggucauuuuggu

SEQ ID NO: 1370744 - RNA, 14 nt, Homo sapiens
ucaaaacucaguau

SEQ ID NO: 1370745 - RNA, 17 nt, Homo sapiens
ucaaaacucaguaucau

SEQ ID NO: 1370746 - RNA, 15 nt, Homo sapiens
ucaaaagcacuuugu

SEQ ID NO: 1370747 - RNA, 22 nt, Homo sapiens
ucaaaagcacuuugugcugugu

SEQ ID NO: 1370748 - RNA, 12 nt, Homo sapiens
ucaaaaggugcc

SEQ ID NO: 1370749 - RNA, 22 nt, Homo sapiens
ucaaaauaaaaaugagguacuc

SEQ ID NO: 1370750 - RNA, 18 nt, Homo sapiens
ucaaaauauacauucaaa

SEQ ID NO: 1370751 - RNA, 18 nt, Homo sapiens
ucaaaauuucagcauuau

SEQ ID NO: 1370752 - RNA, 17 nt, Homo sapiens
ucaaacuagugcaugaa

SEQ ID NO: 1370753 - RNA, 19 nt, Homo sapiens
ucaaacucuugaccucagg

SEQ ID NO: 1370754 - RNA, 21 nt, Homo sapiens
ucaaacugcaugauucaugcc

SEQ ID NO: 1370755 - RNA, 22 nt, Homo sapiens
ucaaacuugugagguguuugca

SEQ ID NO: 1370756 - RNA, 15 nt, Homo sapiens
ucaaagcacacguca

SEQ ID NO: 1370757 - RNA, 20 nt, Homo sapiens
ucaaaggaaaauaguaaugu

SEQ ID NO: 1370758 - RNA, 16 nt, Homo sapiens
ucaaaguaaaacuugc

SEQ ID NO: 1370759 - RNA, 13 nt, Homo sapiens
ucaaaguggcaaa

SEQ ID NO: 1370760 - RNA, 14 nt, Homo sapiens
ucaacaaagucacc

SEQ ID NO: 1370761 - RNA, 12 nt, Homo sapiens
ucaacacuuaag

SEQ ID NO: 1370762 - RNA, 12 nt, Homo sapiens
ucaacagaauug

SEQ ID NO: 1370763 - RNA, 19 nt, Homo sapiens
ucaacaucuuuuacauucu

SEQ ID NO: 1370764 - RNA, 16 nt, Homo sapiens
ucaaccuccccggcuc

SEQ ID NO: 1370765 - RNA, 21 nt, Homo sapiens
ucaaccuccugggcuaaguga

SEQ ID NO: 1370766 - RNA, 14 nt, Homo sapiens
ucaaccucuguauu

SEQ ID NO: 1370767 - RNA, 13 nt, Homo sapiens
ucaacuaugauau

SEQ ID NO: 1370768 - RNA, 18 nt, Homo sapiens
ucaacugucuccuaccuc

SEQ ID NO: 1370769 - RNA, 20 nt, Homo sapiens
ucaacuguugauugcaggaa

SEQ ID NO: 1370770 - RNA, 14 nt, Homo sapiens
ucaagaaagccagu

SEQ ID NO: 1370771 - RNA, 21 nt, Homo sapiens
ucaagcccugcagucacagcu

SEQ ID NO: 1370772 - RNA, 16 nt, Homo sapiens
ucaaggcugcagugag

SEQ ID NO: 1370773 - RNA, 13 nt, Homo sapiens
ucaaggugggccu

SEQ ID NO: 1370774 - RNA, 19 nt, Homo sapiens
ucaaguccuacaagcuaaa

SEQ ID NO: 1370775 - RNA, 12 nt, Homo sapiens
ucaauacuaugg

SEQ ID NO: 1370776 - RNA, 15 nt, Homo sapiens
ucaauccucuaagcu

SEQ ID NO: 1370777 - RNA, 18 nt, Homo sapiens
ucaaucucugauucuguc

SEQ ID NO: 1370778 - RNA, 21 nt, Homo sapiens
ucaaucuuaucauauuucaaa

SEQ ID NO: 1370779 - RNA, 14 nt, Homo sapiens
ucaaugguaugcaa

SEQ ID NO: 1370780 - RNA, 17 nt, Homo sapiens
ucaauucagugcuguac

SEQ ID NO: 1370781 - RNA, 20 nt, Homo sapiens
ucaauuccaccugcaaucaa

SEQ ID NO: 1370782 - RNA, 19 nt, Homo sapiens
ucaauuuguucagucuuuc

SEQ ID NO: 1370783 - RNA, 21 nt, Homo sapiens
ucaauuuucacaucaaagaca

SEQ ID NO: 1370784 - RNA, 16 nt, Homo sapiens
ucacaaaugauauuaa

SEQ ID NO: 1370785 - RNA, 20 nt, Homo sapiens
ucacaacauuuacuuaacag

SEQ ID NO: 1370786 - RNA, 17 nt, Homo sapiens
ucacaaccucucugauc

SEQ ID NO: 1370787 - RNA, 19 nt, Homo sapiens
ucacaaccucucugaucuu

SEQ ID NO: 1370788 - RNA, 13 nt, Homo sapiens
ucacaagcugccu

SEQ ID NO: 1370789 - RNA, 18 nt, Homo sapiens
ucacaaggcauucaagug

SEQ ID NO: 1370790 - RNA, 18 nt, Homo sapiens
ucacaauacucaaaagag

SEQ ID NO: 1370791 - RNA, 18 nt, Homo sapiens
ucacacaauacaauaagu

SEQ ID NO: 1370792 - RNA, 12 nt, Homo sapiens
ucacacugcuga

SEQ ID NO: 1370793 - RNA, 22 nt, Homo sapiens
ucacacuguauauaaacauauc

SEQ ID NO: 1370794 - RNA, 22 nt, Homo sapiens
ucacacuuuucuuauaaugcaa

SEQ ID NO: 1370795 - RNA, 14 nt, Homo sapiens
ucacagccucugaa

SEQ ID NO: 1370796 - RNA, 21 nt, Homo sapiens
ucacaggcagguccaggguuu

SEQ ID NO: 1370797 - RNA, 19 nt, Homo sapiens
ucacagguagacaguauau

SEQ ID NO: 1370798 - RNA, 20 nt, Homo sapiens
ucacaguguggggaagccca

SEQ ID NO: 1370799 - RNA, 14 nt, Homo sapiens
ucacaguuacguga

SEQ ID NO: 1370800 - RNA, 15 nt, Homo sapiens
ucacaguuccucgcc

SEQ ID NO: 1370801 - RNA, 20 nt, Homo sapiens
ucacaucaugcuguuuuauc

SEQ ID NO: 1370802 - RNA, 17 nt, Homo sapiens
ucacauuaucaucugaa

SEQ ID NO: 1370803 - RNA, 19 nt, Homo sapiens
ucacauuuauucugcucac

SEQ ID NO: 1370804 - RNA, 18 nt, Homo sapiens
ucaccaaaucagcugcua

SEQ ID NO: 1370805 - RNA, 16 nt, Homo sapiens
ucaccaggucagggag

SEQ ID NO: 1370806 - RNA, 14 nt, Homo sapiens
ucacccaaugcaua

SEQ ID NO: 1370807 - RNA, 19 nt, Homo sapiens
ucacccggcccccaugcaa

SEQ ID NO: 1370808 - RNA, 16 nt, Homo sapiens
ucaccgacaacaugcu

SEQ ID NO: 1370809 - RNA, 19 nt, Homo sapiens
ucaccuaagucucugugaa

SEQ ID NO: 1370810 - RNA, 20 nt, Homo sapiens
ucaccuaagucucugugaau

SEQ ID NO: 1370811 - RNA, 17 nt, Homo sapiens
ucaccugaggucaggag

SEQ ID NO: 1370812 - RNA, 18 nt, Homo sapiens
ucaccuguaaaacuuuau

SEQ ID NO: 1370813 - RNA, 20 nt, Homo sapiens
ucacgaggucaggaguucaa

SEQ ID NO: 1370814 - RNA, 14 nt, Homo sapiens
ucacgccacugcac

SEQ ID NO: 1370815 - RNA, 20 nt, Homo sapiens
ucacgucgucuucuguauac

SEQ ID NO: 1370816 - RNA, 23 nt, Homo sapiens
ucacuaaagcaguagaaauaaua

SEQ ID NO: 1370817 - RNA, 18 nt, Homo sapiens
ucacucaaucucugauuc

SEQ ID NO: 1370818 - RNA, 17 nt, Homo sapiens
ucacucaccaucuggaa

SEQ ID NO: 1370819 - RNA, 12 nt, Homo sapiens
ucacucuguugc

SEQ ID NO: 1370820 - RNA, 16 nt, Homo sapiens
ucacugaaguucuccu

SEQ ID NO: 1370821 - RNA, 13 nt, Homo sapiens
ucacugacacaca

SEQ ID NO: 1370822 - RNA, 19 nt, Homo sapiens
ucacugcuuguuaugcauc

SEQ ID NO: 1370823 - RNA, 16 nt, Homo sapiens
ucacuguuucucugcu

SEQ ID NO: 1370824 - RNA, 13 nt, Homo sapiens
ucacuucaguugc

SEQ ID NO: 1370825 - RNA, 13 nt, Homo sapiens
ucacuuccuacaa

SEQ ID NO: 1370826 - RNA, 13 nt, Homo sapiens
ucacuuguacaaa

SEQ ID NO: 1370827 - RNA, 16 nt, Homo sapiens
ucacuuuaaagcccuu

SEQ ID NO: 1370828 - RNA, 20 nt, Homo sapiens
ucacuuuacaaauucaagcc

SEQ ID NO: 1370829 - RNA, 14 nt, Homo sapiens
ucagaaauguacaa

SEQ ID NO: 1370830 - RNA, 21 nt, Homo sapiens
ucagaaaugucuggagaauaa

SEQ ID NO: 1370831 - RNA, 19 nt, Homo sapiens
ucagaaccucuuccccaga

SEQ ID NO: 1370832 - RNA, 15 nt, Homo sapiens
ucagaagacacugca

SEQ ID NO: 1370833 - RNA, 22 nt, Homo sapiens
ucagaaucauugaaguauuuuc

SEQ ID NO: 1370834 - RNA, 14 nt, Homo sapiens
ucagaauguguuau

SEQ ID NO: 1370835 - RNA, 13 nt, Homo sapiens
ucagacacuuugg

SEQ ID NO: 1370836 - RNA, 16 nt, Homo sapiens
ucagacuccugugcaa

SEQ ID NO: 1370837 - RNA, 14 nt, Homo sapiens
ucagagagcucacu

SEQ ID NO: 1370838 - RNA, 23 nt, Homo sapiens
ucagagugggguggggagcaugu

SEQ ID NO: 1370839 - RNA, 14 nt, Homo sapiens
ucagaguugugcac

SEQ ID NO: 1370840 - RNA, 18 nt, Homo sapiens
ucagauaaacaacaaaua

SEQ ID NO: 1370841 - RNA, 21 nt, Homo sapiens
ucagauaaugcccagacauuu

SEQ ID NO: 1370842 - RNA, 20 nt, Homo sapiens
ucagauauuuuuucagaaau

SEQ ID NO: 1370843 - RNA, 21 nt, Homo sapiens
ucagauauuuuuucagaaaua

SEQ ID NO: 1370844 - RNA, 14 nt, Homo sapiens
ucagaugaagucuu

SEQ ID NO: 1370845 - RNA, 20 nt, Homo sapiens
ucagaugauucuaugucuca

SEQ ID NO: 1370846 - RNA, 14 nt, Homo sapiens
ucagauuccaccua

SEQ ID NO: 1370847 - RNA, 11 nt, Homo sapiens
ucagcaaaaaa

SEQ ID NO: 1370848 - RNA, 20 nt, Homo sapiens
ucagcaaaaaaguacuuaaa

SEQ ID NO: 1370849 - RNA, 19 nt, Homo sapiens
ucagcaaaagaugcuucuc

SEQ ID NO: 1370850 - RNA, 19 nt, Homo sapiens
ucagcaauacagacuacuu

SEQ ID NO: 1370851 - RNA, 17 nt, Homo sapiens
ucagcaauacuaaggga

SEQ ID NO: 1370852 - RNA, 15 nt, Homo sapiens
ucagcagagaacugg

SEQ ID NO: 1370853 - RNA, 15 nt, Homo sapiens
ucagcagcccuccuc

SEQ ID NO: 1370854 - RNA, 20 nt, Homo sapiens
ucagcaguucagcuccuucc

SEQ ID NO: 1370855 - RNA, 20 nt, Homo sapiens
ucagcaugaaggaugccaua

SEQ ID NO: 1370856 - RNA, 18 nt, Homo sapiens
ucagccccuucauggaag

SEQ ID NO: 1370857 - RNA, 17 nt, Homo sapiens
ucggcuccuggacucau

SEQ ID NO: 1370858 - RNA, 21 nt, Homo sapiens
ucgggaaggugucuggacauu

SEQ ID NO: 1370859 - RNA, 11 nt, Homo sapiens
ucgggacauca

SEQ ID NO: 1370860 - RNA, 10 nt, Homo sapiens
ucguagccaa

SEQ ID NO: 1370861 - RNA, 19 nt, Homo sapiens
ucgucggggggacagcucc

SEQ ID NO: 1370862 - RNA, 13 nt, Homo sapiens
ucgugcacucugc

SEQ ID NO: 1370863 - RNA, 17 nt, Homo sapiens
ucguuuuuuucauucca

SEQ ID NO: 1370864 - RNA, 14 nt, Homo sapiens
ucuaaaauccugcu

SEQ ID NO: 1370865 - RNA, 20 nt, Homo sapiens
ucuaaaaugaguuaccuaca

SEQ ID NO: 1370866 - RNA, 12 nt, Homo sapiens
ucuaaaugaagu

SEQ ID NO: 1370867 - RNA, 17 nt, Homo sapiens
ucuaaaugaagugcaaa

SEQ ID NO: 1370868 - RNA, 23 nt, Homo sapiens
ucuaaaugaagugcaaauuugau

SEQ ID NO: 1370869 - RNA, 21 nt, Homo sapiens
ucuaacaucuagcuggcuucc

SEQ ID NO: 1370870 - RNA, 23 nt, Homo sapiens
ucuaacucugauguaaaugaagu

SEQ ID NO: 1370871 - RNA, 19 nt, Homo sapiens
ucuaacuuuugugugaaau

SEQ ID NO: 1370872 - RNA, 18 nt, Homo sapiens
ucuaaggaauaugagcuu

SEQ ID NO: 1370873 - RNA, 22 nt, Homo sapiens
ucuaaggaauaugagcuuuaug

SEQ ID NO: 1370874 - RNA, 20 nt, Homo sapiens
ucuaauaaaaaacaccuucu

SEQ ID NO: 1370875 - RNA, 14 nt, Homo sapiens
ucuaauggcuuuau

SEQ ID NO: 1370876 - RNA, 22 nt, Homo sapiens
ucuaauugaauuuucaagcauc

SEQ ID NO: 1370877 - RNA, 19 nt, Homo sapiens
ucuacaaacucccacuugu

SEQ ID NO: 1370878 - RNA, 16 nt, Homo sapiens
ucuacauccaauguau

SEQ ID NO: 1370879 - RNA, 17 nt, Homo sapiens
uugccuggagugugaac

SEQ ID NO: 1370880 - RNA, 15 nt, Homo sapiens
uugcuaaaauauuau

SEQ ID NO: 1370881 - RNA, 22 nt, Homo sapiens
uugcuccuggcuggggccuguu

SEQ ID NO: 1370882 - RNA, 13 nt, Homo sapiens
uugcucuuuggua

SEQ ID NO: 1370883 - RNA, 17 nt, Homo sapiens
uugcucuuuucaaugug

SEQ ID NO: 1370884 - RNA, 21 nt, Homo sapiens
uugcugcaucuccccucagau

SEQ ID NO: 1370885 - RNA, 14 nt, Homo sapiens
uugcuggacuguca

SEQ ID NO: 1370886 - RNA, 16 nt, Homo sapiens
uugcuggcaaagacag

SEQ ID NO: 1370887 - RNA, 17 nt, Homo sapiens
uugcuggucacugccau

SEQ ID NO: 1370888 - RNA, 20 nt, Homo sapiens
uugcuucuguaguacuccuu

SEQ ID NO: 1370889 - RNA, 19 nt, Homo sapiens
uugcuugcacaaaccaauu

SEQ ID NO: 1370890 - RNA, 12 nt, Homo sapiens
uugcuuuccacu

SEQ ID NO: 1370891 - RNA, 16 nt, Homo sapiens
uugcuuuuuuuccaau

SEQ ID NO: 1370892 - RNA, 17 nt, Homo sapiens
uuggaaaauaaaucaau

SEQ ID NO: 1370893 - RNA, 23 nt, Homo sapiens
uuggaaagcaucaccucaggcca

SEQ ID NO: 1370894 - RNA, 14 nt, Homo sapiens
uuggaaaguacucc

SEQ ID NO: 1370895 - RNA, 23 nt, Homo sapiens
uuggacaaucaugaaauaugcau

SEQ ID NO: 1370896 - RNA, 16 nt, Homo sapiens
uuggaccauccuauuu

SEQ ID NO: 1370897 - RNA, 17 nt, Homo sapiens
uuggacugauaaucucu

SEQ ID NO: 1370898 - RNA, 12 nt, Homo sapiens
uuggagggauaa

SEQ ID NO: 1370899 - RNA, 17 nt, Homo sapiens
uuggagggugucccaaa

SEQ ID NO: 1370900 - RNA, 18 nt, Homo sapiens
uuggagugcgggugggcu

SEQ ID NO: 1370901 - RNA, 21 nt, Homo sapiens
uuggauaaaauaaaugcaauu

SEQ ID NO: 1370902 - RNA, 15 nt, Homo sapiens
uuggcacugagauau

SEQ ID NO: 1370903 - RNA, 15 nt, Homo sapiens
uuggcaugccuucca

SEQ ID NO: 1370904 - RNA, 13 nt, Homo sapiens
uuggccaaaaaga

SEQ ID NO: 1370905 - RNA, 22 nt, Homo sapiens
uuggccucagaauucacaaaau

SEQ ID NO: 1370906 - RNA, 14 nt, Homo sapiens
uuggcgggccaagg

SEQ ID NO: 1370907 - RNA, 22 nt, Homo sapiens
uuggcugugcccucagauuccg

SEQ ID NO: 1370908 - RNA, 10 nt, Homo sapiens
uuggggacuc

SEQ ID NO: 1370909 - RNA, 13 nt, Homo sapiens
uugggucuuugaa

SEQ ID NO: 1370910 - RNA, 16 nt, Homo sapiens
uuggguugcaaucugg

SEQ ID NO: 1370911 - RNA, 16 nt, Homo sapiens
uugguaagcuuccagg

SEQ ID NO: 1370912 - RNA, 18 nt, Homo sapiens
uuggugaauuugaaucuc

SEQ ID NO: 1370913 - RNA, 20 nt, Homo sapiens
uuguaaauacacauagcaug

SEQ ID NO: 1370914 - RNA, 13 nt, Homo sapiens
uuguaacuccacc

SEQ ID NO: 1370915 - RNA, 22 nt, Homo sapiens
uuguaagaaaccaaucaagaua

SEQ ID NO: 1370916 - RNA, 23 nt, Homo sapiens
uuguaaguggucgcuuacuuuga

SEQ ID NO: 1370917 - RNA, 20 nt, Homo sapiens
uuguacagacguaugcuuau

SEQ ID NO: 1370918 - RNA, 22 nt, Homo sapiens
uuguagagauggggucucacag

SEQ ID NO: 1370919 - RNA, 21 nt, Homo sapiens
uuguagagccagggucucacu

SEQ ID NO: 1370920 - RNA, 13 nt, Homo sapiens
uugucuacacucu

SEQ ID NO: 1370921 - RNA, 17 nt, Homo sapiens
uugucuuacuguugcau

SEQ ID NO: 1370922 - RNA, 14 nt, Homo sapiens
uugucuuguucacc

SEQ ID NO: 1370923 - RNA, 13 nt, Homo sapiens
uugugagaaacau

SEQ ID NO: 1370924 - RNA, 14 nt, Homo sapiens
uuguuaaucaauca

SEQ ID NO: 1370925 - RNA, 18 nt, Homo sapiens
uuguucagggcugugauc

SEQ ID NO: 1370926 - RNA, 17 nt, Homo sapiens
uuguucuuggccaaaga

SEQ ID NO: 1370927 - RNA, 20 nt, Homo sapiens
uuguucuuuggaaauacaca

SEQ ID NO: 1370928 - RNA, 16 nt, Homo sapiens
uuguugacacggccau

SEQ ID NO: 1370929 - RNA, 17 nt, Homo sapiens
uuguuggccaaagccaa

SEQ ID NO: 1370930 - RNA, 19 nt, Homo sapiens
uuguuguuuauaaagggag

SEQ ID NO: 1370931 - RNA, 21 nt, Homo sapiens
uuguuucuuccaagacuccag

SEQ ID NO: 1370932 - RNA, 21 nt, Homo sapiens
uuguuuuaugcucagggucaa

SEQ ID NO: 1370933 - RNA, 18 nt, Homo sapiens
uuguuuuguguaacauau

SEQ ID NO: 1370934 - RNA, 19 nt, Homo sapiens
uuguuuuguguaacauauu

SEQ ID NO: 1370935 - RNA, 15 nt, Homo sapiens
uuuaaaaaaaauccu

SEQ ID NO: 1370936 - RNA, 13 nt, Homo sapiens
uuuaaaaagcaaa

SEQ ID NO: 1370937 - RNA, 12 nt, Homo sapiens
uuuaaacaguga

SEQ ID NO: 1370938 - RNA, 15 nt, Homo sapiens
uuuaaagagaaugua

SEQ ID NO: 1370939 - RNA, 15 nt, Homo sapiens
uuuaaaguucugugu

SEQ ID NO: 1370940 - RNA, 14 nt, Homo sapiens
uuuaaauagaccuc

SEQ ID NO: 1370941 - RNA, 21 nt, Homo sapiens
uuuaaauggcuuuaugcuagu

SEQ ID NO: 1370942 - RNA, 14 nt, Homo sapiens
uuuaaauuagauaa

SEQ ID NO: 1370943 - RNA, 19 nt, Homo sapiens
uuuaacauaaauuguacug

SEQ ID NO: 1370944 - RNA, 11 nt, Homo sapiens
uuuaaccaaga

SEQ ID NO: 1370945 - RNA, 16 nt, Homo sapiens
uuuaagauaccuugau

SEQ ID NO: 1370946 - RNA, 19 nt, Homo sapiens
uuuaaggcaggacagagaa

SEQ ID NO: 1370947 - RNA, 19 nt, Homo sapiens
uuuaagguuuuuacuguga

SEQ ID NO: 1370948 - RNA, 16 nt, Homo sapiens
uuuaauuugauaguau

SEQ ID NO: 1370949 - RNA, 18 nt, Homo sapiens
uuuacagugcuauuuacu

SEQ ID NO: 1370950 - RNA, 14 nt, Homo sapiens
uuuacauccaugaa

SEQ ID NO: 1370951 - RNA, 14 nt, Homo sapiens
uuuacccucaggca

SEQ ID NO: 1370952 - RNA, 20 nt, Homo sapiens
uuuacuaauccaacccauga

SEQ ID NO: 1370953 - RNA, 15 nt, Homo sapiens
uuuacuccaugaagg

SEQ ID NO: 1370954 - RNA, 23 nt, Homo sapiens
uuuagaaaagaaagcaaacuuaa

SEQ ID NO: 1370955 - RNA, 22 nt, Homo sapiens
uuuagagugaaauauaugcuau

SEQ ID NO: 1370956 - RNA, 20 nt, Homo sapiens
uuuagaugguuacacuguua

SEQ ID NO: 1370957 - RNA, 19 nt, Homo sapiens
uuuagauuaaacaaacaaa

SEQ ID NO: 1370958 - RNA, 14 nt, Homo sapiens
uuuagcacaaaaaa

SEQ ID NO: 1370959 - RNA, 14 nt, Homo sapiens
uuuagcuaccucac

SEQ ID NO: 1370960 - RNA, 22 nt, Homo sapiens
uuuagcuaccucacuaugcugc

SEQ ID NO: 1370961 - RNA, 23 nt, Homo sapiens
uuuagcuaccucacuaugcugcu

SEQ ID NO: 1370962 - RNA, 16 nt, Homo sapiens
uuuauaagagugccgu

SEQ ID NO: 1370963 - RNA, 16 nt, Homo sapiens
uuuaucauuaccauua

SEQ ID NO: 1370964 - RNA, 22 nt, Homo sapiens
uuuuuaucuccccuucacaugc

SEQ ID NO: 1370965 - RNA, 21 nt, Homo sapiens
uuuuugacauuuacuguggau

SEQ ID NO: 1370966 - RNA, 14 nt, Homo sapiens
uuuuuuacacaaau

SEQ ID NO: 1370967 - RNA, 22 nt, Homo sapiens
ggguguuuauccuaucucucca

SEQ ID NO: 1370968 - RNA, 16 nt, Homo sapiens
ggguuacaaacugcaa

SEQ ID NO: 1370969 - RNA, 19 nt, Homo sapiens
gguaauaaguacuguguac

SEQ ID NO: 1370970 - RNA, 15 nt, Homo sapiens
gguaaugugaauaaa

SEQ ID NO: 1370971 - RNA, 14 nt, Homo sapiens
gguacacagacuau

SEQ ID NO: 1370972 - RNA, 19 nt, Homo sapiens
gguagagacuuugacucuc

SEQ ID NO: 1370973 - RNA, 19 nt, Homo sapiens
gguaguacuccugcaaaau

SEQ ID NO: 1370974 - RNA, 14 nt, Homo sapiens
gguaucaccacugg

SEQ ID NO: 1370975 - RNA, 16 nt, Homo sapiens
gguauccugcccagug

SEQ ID NO: 1370976 - RNA, 23 nt, Homo sapiens
ggucaggaaggaugagcauuuag

SEQ ID NO: 1370977 - RNA, 19 nt, Homo sapiens
ggucagguguucaagacca

SEQ ID NO: 1370978 - RNA, 21 nt, Homo sapiens
ggucaucucucacacauucca

SEQ ID NO: 1370979 - RNA, 15 nt, Homo sapiens
ggucuagaaaagcau

SEQ ID NO: 1370980 - RNA, 24 nt, Homo sapiens
ggucuaggaacauacuucagcuca

SEQ ID NO: 1370981 - RNA, 22 nt, Homo sapiens
ggugaaacuaacagauaagcaa

SEQ ID NO: 1370982 - RNA, 18 nt, Homo sapiens
cucuauuuccuaucauuu

SEQ ID NO: 1370983 - RNA, 15 nt, Homo sapiens
cucuccgaccagaca

SEQ ID NO: 1370984 - RNA, 16 nt, Homo sapiens
cucuccuuuggccauu

SEQ ID NO: 1370985 - RNA, 12 nt, Homo sapiens
cucucucacuga

SEQ ID NO: 1370986 - RNA, 16 nt, Homo sapiens
cucucuccaucagagg

SEQ ID NO: 1370987 - RNA, 21 nt, Homo sapiens
cucucuggcuaaggacaggca

SEQ ID NO: 1370988 - RNA, 23 nt, Homo sapiens
cucucugggccucaguuuuccca

SEQ ID NO: 1370989 - RNA, 14 nt, Homo sapiens
cucucuuuacauuu

SEQ ID NO: 1370990 - RNA, 13 nt, Homo sapiens
cucugaaaaccaa

SEQ ID NO: 1370991 - RNA, 19 nt, Homo sapiens
cucugaagucacaucacag

SEQ ID NO: 1370992 - RNA, 23 nt, Homo sapiens
cucugaagucacaucacaggaca

SEQ ID NO: 1370993 - RNA, 21 nt, Homo sapiens
cucugaggacacuaaccacgc

SEQ ID NO: 1370994 - RNA, 15 nt, Homo sapiens
cucugcccugcccua

SEQ ID NO: 1370995 - RNA, 22 nt, Homo sapiens
cucugccugaagucacacagug

SEQ ID NO: 1370996 - RNA, 21 nt, Homo sapiens
cucugcugcagcggccacacu

SEQ ID NO: 1370997 - RNA, 14 nt, Homo sapiens
cucuggaguucauc

SEQ ID NO: 1370998 - RNA, 22 nt, Homo sapiens
cucuggcaucucuuucugcaaa

SEQ ID NO: 1370999 - RNA, 16 nt, Homo sapiens
cucugggccaagucaa

SEQ ID NO: 1371000 - RNA, 21 nt, Homo sapiens
cucugggccaagucaaagaca

SEQ ID NO: 1371001 - RNA, 13 nt, Homo sapiens
cucugucucaaaa

SEQ ID NO: 1371002 - RNA, 14 nt, Homo sapiens
cucugucucaaaaa

SEQ ID NO: 1371003 - RNA, 21 nt, Homo sapiens
cucugugaacgauuuagaaag

SEQ ID NO: 1371004 - RNA, 18 nt, Homo sapiens
cucuguuuucaugcuauu

SEQ ID NO: 1371005 - RNA, 17 nt, Homo sapiens
cucuuacuuauuaucuu

SEQ ID NO: 1371006 - RNA, 16 nt, Homo sapiens
cucuuagaaaaaccac

SEQ ID NO: 1371007 - RNA, 17 nt, Homo sapiens
cucuuauccaacaucaa

SEQ ID NO: 1371008 - RNA, 15 nt, Homo sapiens
cucuucaacugacca

SEQ ID NO: 1371009 - RNA, 19 nt, Homo sapiens
cucuucagaaaacccuuuu

SEQ ID NO: 1371010 - RNA, 17 nt, Homo sapiens
cucuucauuuucccauu

SEQ ID NO: 1371011 - RNA, 14 nt, Homo sapiens
cucuuccuauccca

SEQ ID NO: 1371012 - RNA, 16 nt, Homo sapiens
cucuuccuaucccauc

SEQ ID NO: 1371013 - RNA, 20 nt, Homo sapiens
cucuucugggaacuuccuca

SEQ ID NO: 1371014 - RNA, 16 nt, Homo sapiens
cucuugaagacacuga

SEQ ID NO: 1371015 - RNA, 13 nt, Homo sapiens
cucuugcagagaa

SEQ ID NO: 1371016 - RNA, 21 nt, Homo sapiens
cucuuguauaugaugaucugg

SEQ ID NO: 1371017 - RNA, 17 nt, Homo sapiens
cucuuuugaauccaugc

SEQ ID NO: 1371018 - RNA, 15 nt, Homo sapiens
cucuuuuucuagucu

SEQ ID NO: 1371019 - RNA, 23 nt, Homo sapiens
cugaaaaaugguaauuguugcua

SEQ ID NO: 1371020 - RNA, 24 nt, Homo sapiens
cugaaaccucugggucaucucuca

SEQ ID NO: 1371021 - RNA, 20 nt, Homo sapiens
cugaacaguguuggcuuuca

SEQ ID NO: 1371022 - RNA, 16 nt, Homo sapiens
cugaacaucacagcuu

SEQ ID NO: 1371023 - RNA, 20 nt, Homo sapiens
cugaagaacaguaacugcca

SEQ ID NO: 1371024 - RNA, 22 nt, Homo sapiens
cugaagaacaguaacugccauc

SEQ ID NO: 1371025 - RNA, 22 nt, Homo sapiens
cugaagagcuauuauauaaaaa

SEQ ID NO: 1371026 - RNA, 16 nt, Homo sapiens
cugaagauacaugucu

SEQ ID NO: 1371027 - RNA, 21 nt, Homo sapiens
cugaagcuuauuaaugcuaag

SEQ ID NO: 1371028 - RNA, 20 nt, Homo sapiens
cugaagggcaucaugcaucu

SEQ ID NO: 1371029 - RNA, 15 nt, Homo sapiens
cugaagggguucuca

SEQ ID NO: 1371030 - RNA, 22 nt, Homo sapiens
cugaaguuucauuuaugauaca

SEQ ID NO: 1371031 - RNA, 20 nt, Homo sapiens
cugaauacauucugcuuuca

SEQ ID NO: 1371032 - RNA, 18 nt, Homo sapiens
cugaaugauuuccaaaga

SEQ ID NO: 1371033 - RNA, 20 nt, Homo sapiens
cugaauguauugaacuugga

SEQ ID NO: 1371034 - RNA, 19 nt, Homo sapiens
cugaauguuagauaguuac

SEQ ID NO: 1371035 - RNA, 20 nt, Homo sapiens
cugaauguuagauaguuacu

SEQ ID NO: 1371036 - RNA, 20 nt, Homo sapiens
cugaauuuggccugcacuaa

SEQ ID NO: 1371037 - RNA, 15 nt, Homo sapiens
cugaccaagagagaa

SEQ ID NO: 1371038 - RNA, 14 nt, Homo sapiens
cugaccuacauacg

SEQ ID NO: 1371039 - RNA, 16 nt, Homo sapiens
cugaccucccagugac

SEQ ID NO: 1371040 - RNA, 20 nt, Homo sapiens
cugaccuggaaagaaaaagc

SEQ ID NO: 1371041 - RNA, 23 nt, Homo sapiens
cugacucaacauguuacugacca

SEQ ID NO: 1371042 - RNA, 20 nt, Homo sapiens
cugacugcaccuucugugcc

SEQ ID NO: 1371043 - RNA, 17 nt, Homo sapiens
cugagaaauguucagaa

SEQ ID NO: 1371044 - RNA, 19 nt, Homo sapiens
cugagaagucaaacauuuc

SEQ ID NO: 1371045 - RNA, 16 nt, Homo sapiens
cugagagacccaagga

SEQ ID NO: 1371046 - RNA, 20 nt, Homo sapiens
cugagagcauguuuuaucau

SEQ ID NO: 1371047 - RNA, 16 nt, Homo sapiens
cugagcaaagcauuga

SEQ ID NO: 1371048 - RNA, 18 nt, Homo sapiens
cugagccuacagaugaac

SEQ ID NO: 1371049 - RNA, 13 nt, Homo sapiens
cugagcucacuga

SEQ ID NO: 1371050 - RNA, 20 nt, Homo sapiens
cugagcugccuguaacuuga

SEQ ID NO: 1371051 - RNA, 13 nt, Homo sapiens
cugaggaccagcc

SEQ ID NO: 1371052 - RNA, 22 nt, Homo sapiens
cugaggcaagagaauuacuuga

SEQ ID NO: 1371053 - RNA, 22 nt, Homo sapiens
cugaggcaagagaauugcuuga

SEQ ID NO: 1371054 - RNA, 22 nt, Homo sapiens
cugaggcaggagaauugcuuga

SEQ ID NO: 1371055 - RNA, 15 nt, Homo sapiens
cugagucugcagaug

SEQ ID NO: 1371056 - RNA, 18 nt, Homo sapiens
cugagugagcugaagagu

SEQ ID NO: 1371057 - RNA, 20 nt, Homo sapiens
cugauauagaucacauaaca

SEQ ID NO: 1371058 - RNA, 22 nt, Homo sapiens
cugaucucagggaagcccagcu

SEQ ID NO: 1371059 - RNA, 16 nt, Homo sapiens
cugaugacacugagaa

SEQ ID NO: 1371060 - RNA, 12 nt, Homo sapiens
cugauggugcau

SEQ ID NO: 1371061 - RNA, 13 nt, Homo sapiens
cugauguggcaac

SEQ ID NO: 1371062 - RNA, 19 nt, Homo sapiens
cugauuagaaaugaccaau

SEQ ID NO: 1371063 - RNA, 17 nt, Homo sapiens
cugcaaaucugccugau

SEQ ID NO: 1371064 - RNA, 14 nt, Homo sapiens
cugcaagcacugca

SEQ ID NO: 1371065 - RNA, 21 nt, Homo sapiens
cugcacguggcuucugaugaa

SEQ ID NO: 1371066 - RNA, 23 nt, Homo sapiens
cugcacuuaaauaucaaucauuu

SEQ ID NO: 1371067 - RNA, 14 nt, Homo sapiens
cugcacuugcagac

SEQ ID NO: 1371068 - RNA, 16 nt, Homo sapiens
cugcaguuccaaaaga

SEQ ID NO: 1371069 - RNA, 18 nt, Homo sapiens
cugcaucuccccucagau

SEQ ID NO: 1371070 - RNA, 23 nt, Homo sapiens
cugcaucuccccucagauuccac

SEQ ID NO: 1371071 - RNA, 20 nt, Homo sapiens
cugcauugagaacugcauau

SEQ ID NO: 1371072 - RNA, 23 nt, Homo sapiens
cugcauuuucuggguucugggug

SEQ ID NO: 1371073 - RNA, 16 nt, Homo sapiens
cugccacccuggggag

SEQ ID NO: 1371074 - RNA, 11 nt, Homo sapiens
cugccagagaa

SEQ ID NO: 1371075 - RNA, 13 nt, Homo sapiens
cugccagggagcu

SEQ ID NO: 1371076 - RNA, 19 nt, Homo sapiens
cugccauauucuguuggcc

SEQ ID NO: 1371077 - RNA, 20 nt, Homo sapiens
cugcccaaacauaaagagaa

SEQ ID NO: 1371078 - RNA, 18 nt, Homo sapiens
cugcccaaagcagcacuu

SEQ ID NO: 1371079 - RNA, 18 nt, Homo sapiens
cugccccaugaagccaca

SEQ ID NO: 1371080 - RNA, 22 nt, Homo sapiens
cugccccucaugccaaccccgc

SEQ ID NO: 1371081 - RNA, 16 nt, Homo sapiens
cugcccuagagcacac

SEQ ID NO: 1371082 - RNA, 19 nt, Homo sapiens
cugccucugucucacugaa

SEQ ID NO: 1371083 - RNA, 20 nt, Homo sapiens
cugccuuccacaauucacua

SEQ ID NO: 1371084 - RNA, 20 nt, Homo sapiens
cugcggcacccuugcgcuuu

SEQ ID NO: 1371085 - RNA, 18 nt, Homo sapiens
ggaaaguaaauauuucag

SEQ ID NO: 1371086 - RNA, 23 nt, Homo sapiens
ggaaaguaaauauuucaggcaua

SEQ ID NO: 1371087 - RNA, 18 nt, Homo sapiens
ggaaauagugauuuccac

SEQ ID NO: 1371088 - RNA, 18 nt, Homo sapiens
ggaacacugcacucuuaa

SEQ ID NO: 1371089 - RNA, 15 nt, Homo sapiens
ggaacaugcguguga

SEQ ID NO: 1371090 - RNA, 23 nt, Homo sapiens
ggaacauguacuguuacuguguc

SEQ ID NO: 1371091 - RNA, 23 nt, Homo sapiens
ggaaccgcaggaagcugcuccgu

SEQ ID NO: 1371092 - RNA, 18 nt, Homo sapiens
ggaacuaagaaagcccuu

SEQ ID NO: 1371093 - RNA, 14 nt, Homo sapiens
ggaacucucuccac

SEQ ID NO: 1371094 - RNA, 19 nt, Homo sapiens
ggaacucuggaguucauca

SEQ ID NO: 1371095 - RNA, 10 nt, Homo sapiens
ggaacuuccu

SEQ ID NO: 1371096 - RNA, 18 nt, Homo sapiens
ggaagagcugcaacggaa

SEQ ID NO: 1371097 - RNA, 14 nt, Homo sapiens
ggaagagugcaaaa

SEQ ID NO: 1371098 - RNA, 18 nt, Homo sapiens
ggaagcugugagagcagu

SEQ ID NO: 1371099 - RNA, 17 nt, Homo sapiens
ggaaggacauccauguu

SEQ ID NO: 1371100 - RNA, 19 nt, Homo sapiens
ucagucugggugggacuua

SEQ ID NO: 1371101 - RNA, 20 nt, Homo sapiens
ucagucuuuuccaugaacuu

SEQ ID NO: 1371102 - RNA, 15 nt, Homo sapiens
ucagugaacugugag

SEQ ID NO: 1371103 - RNA, 20 nt, Homo sapiens
ucagugaagaugccagugaa

SEQ ID NO: 1371104 - RNA, 22 nt, Homo sapiens
ucagugacagaguucacuauaa

SEQ ID NO: 1371105 - RNA, 15 nt, Homo sapiens
ucaguguacauggaa

SEQ ID NO: 1371106 - RNA, 13 nt, Homo sapiens
ucaguuacucuga

SEQ ID NO: 1371107 - RNA, 20 nt, Homo sapiens
ucaguucccuuggccucaga

SEQ ID NO: 1371108 - RNA, 15 nt, Homo sapiens
ucaguuggugcugcu

SEQ ID NO: 1371109 - RNA, 22 nt, Homo sapiens
ucaguuugcuagcagaaaucua

SEQ ID NO: 1371110 - RNA, 18 nt, Homo sapiens
ucauaauuucuucacuca

SEQ ID NO: 1371111 - RNA, 19 nt, Homo sapiens
ucauaauuucuucacucaa

SEQ ID NO: 1371112 - RNA, 14 nt, Homo sapiens
ucauacuacauaca

SEQ ID NO: 1371113 - RNA, 13 nt, Homo sapiens
ucauagcauuaac

SEQ ID NO: 1371114 - RNA, 17 nt, Homo sapiens
ucauauaaucuuacaau

SEQ ID NO: 1371115 - RNA, 22 nt, Homo sapiens
ucauauauauacauacaugcau

SEQ ID NO: 1371116 - RNA, 16 nt, Homo sapiens
ucauaugauugugcac

SEQ ID NO: 1371117 - RNA, 18 nt, Homo sapiens
ucauaugauugugcacau

SEQ ID NO: 1371118 - RNA, 12 nt, Homo sapiens
ucauaugcagaa

SEQ ID NO: 1371119 - RNA, 22 nt, Homo sapiens
ucauaugguugacaguaugcau

SEQ ID NO: 1371120 - RNA, 12 nt, Homo sapiens
ucauauuccugc

SEQ ID NO: 1371121 - RNA, 21 nt, Homo sapiens
ucaucagccuguguaggcagu

SEQ ID NO: 1371122 - RNA, 23 nt, Homo sapiens
ucaucagcuaucguuaguguauu

SEQ ID NO: 1371123 - RNA, 21 nt, Homo sapiens
ucaucauaaaauaaaguauau

SEQ ID NO: 1371124 - RNA, 18 nt, Homo sapiens
ucauccaaugcucaagaa

SEQ ID NO: 1371125 - RNA, 20 nt, Homo sapiens
ucaucucaggccucccucaa

SEQ ID NO: 1371126 - RNA, 16 nt, Homo sapiens
ucaucugaaaaucugg

SEQ ID NO: 1371127 - RNA, 23 nt, Homo sapiens
ucaucuuagugccugagaguauu

SEQ ID NO: 1371128 - RNA, 10 nt, Homo sapiens
ucaucuuccc

SEQ ID NO: 1371129 - RNA, 16 nt, Homo sapiens
ucaugaaagcaucuga

SEQ ID NO: 1371130 - RNA, 23 nt, Homo sapiens
ucaugaagaaccuugacggcauu

SEQ ID NO: 1371131 - RNA, 17 nt, Homo sapiens
ucaugagugcaacugug

SEQ ID NO: 1371132 - RNA, 20 nt, Homo sapiens
ucaugauguauuguugcuuu

SEQ ID NO: 1371133 - RNA, 17 nt, Homo sapiens
ucaugcguguguguugu

SEQ ID NO: 1371134 - RNA, 17 nt, Homo sapiens
ucauggcagcuaagcca

SEQ ID NO: 1371135 - RNA, 21 nt, Homo sapiens
ucauggguuauguguaugugc

SEQ ID NO: 1371136 - RNA, 22 nt, Homo sapiens
ucauguauauguguucauuaaa

SEQ ID NO: 1371137 - RNA, 14 nt, Homo sapiens
ucauguuaugauaa

SEQ ID NO: 1371138 - RNA, 14 nt, Homo sapiens
ucauguuccucaaa

SEQ ID NO: 1371139 - RNA, 15 nt, Homo sapiens
ucauguuccucaaaa

SEQ ID NO: 1371140 - RNA, 15 nt, Homo sapiens
ucauuauuugcagag

SEQ ID NO: 1371141 - RNA, 12 nt, Homo sapiens
ucauucaaguca

SEQ ID NO: 1371142 - RNA, 20 nt, Homo sapiens
ucauucagggauagcacuga

SEQ ID NO: 1371143 - RNA, 19 nt, Homo sapiens
ucauucauuuaacagagcu

SEQ ID NO: 1371144 - RNA, 15 nt, Homo sapiens
ucauuccuaacacag

SEQ ID NO: 1371145 - RNA, 20 nt, Homo sapiens
ucauuccuaacacagcaugu

SEQ ID NO: 1371146 - RNA, 17 nt, Homo sapiens
ucauuccugccugucuc

SEQ ID NO: 1371147 - RNA, 20 nt, Homo sapiens
ucauucuacugaacagucca

SEQ ID NO: 1371148 - RNA, 22 nt, Homo sapiens
ucauuguaaacaaacuguguaa

SEQ ID NO: 1371149 - RNA, 18 nt, Homo sapiens
ucauuguuuggcauugaa

SEQ ID NO: 1371150 - RNA, 17 nt, Homo sapiens
ucauuucagauaaacaa

SEQ ID NO: 1371151 - RNA, 12 nt, Homo sapiens
ucauuucuagca

SEQ ID NO: 1371152 - RNA, 21 nt, Homo sapiens
ucauuuguaccucgaguuuua

SEQ ID NO: 1371153 - RNA, 17 nt, Homo sapiens
ucauuuucugcauuuaa

SEQ ID NO: 1371154 - RNA, 21 nt, Homo sapiens
uccaaaacuaauuuccucuga

SEQ ID NO: 1371155 - RNA, 12 nt, Homo sapiens
uccaaagcuuuc

SEQ ID NO: 1371156 - RNA, 17 nt, Homo sapiens
uccaaaggaaucuccag

SEQ ID NO: 1371157 - RNA, 19 nt, Homo sapiens
uccaaccccccaccugcca

SEQ ID NO: 1371158 - RNA, 16 nt, Homo sapiens
uccaaccuaaccccuu

SEQ ID NO: 1371159 - RNA, 16 nt, Homo sapiens
uccaacguggcccaga

SEQ ID NO: 1371160 - RNA, 20 nt, Homo sapiens
uccaacguggggcagcacag

SEQ ID NO: 1371161 - RNA, 23 nt, Homo sapiens
uccaacuaacguacauucaacag

SEQ ID NO: 1371162 - RNA, 21 nt, Homo sapiens
uccaacugcugccccaaagga

SEQ ID NO: 1371163 - RNA, 23 nt, Homo sapiens
uccaagccugaccacgcuuucua

SEQ ID NO: 1371164 - RNA, 19 nt, Homo sapiens
uccaagguguaacucuaau

SEQ ID NO: 1371165 - RNA, 16 nt, Homo sapiens
uccaaugcauugcuaa

SEQ ID NO: 1371166 - RNA, 16 nt, Homo sapiens
uccaauuugcacuuuc

SEQ ID NO: 1371167 - RNA, 19 nt, Homo sapiens
uccaauuuggaaucuucuc

SEQ ID NO: 1371168 - RNA, 19 nt, Homo sapiens
uccaauuuuguugcaucau

SEQ ID NO: 1371169 - RNA, 15 nt, Homo sapiens
uccacacagccaaua

SEQ ID NO: 1371170 - RNA, 16 nt, Homo sapiens
uccacacccucuccca

SEQ ID NO: 1371171 - RNA, 14 nt, Homo sapiens
uccacacgccaagc

SEQ ID NO: 1371172 - RNA, 15 nt, Homo sapiens
uccacagugacucca

SEQ ID NO: 1371173 - RNA, 12 nt, Homo sapiens
uccaccaagaaa

SEQ ID NO: 1371174 - RNA, 17 nt, Homo sapiens
uccaccccacucacaga

SEQ ID NO: 1371175 - RNA, 13 nt, Homo sapiens
uccacccuuggcc

SEQ ID NO: 1371176 - RNA, 18 nt, Homo sapiens
uccaccuggaagcccucu

SEQ ID NO: 1371177 - RNA, 13 nt, Homo sapiens
uccacggacucaa

SEQ ID NO: 1371178 - RNA, 15 nt, Homo sapiens
uccacguacugcagc

SEQ ID NO: 1371179 - RNA, 13 nt, Homo sapiens
uccacuacugcua

SEQ ID NO: 1371180 - RNA, 14 nt, Homo sapiens
uccacuacugcuac

SEQ ID NO: 1371181 - RNA, 15 nt, Homo sapiens
uccacugucaagaaa

SEQ ID NO: 1371182 - RNA, 14 nt, Homo sapiens
uccacugugccaug

SEQ ID NO: 1371183 - RNA, 16 nt, Homo sapiens
uccacuuauaaaggaa

SEQ ID NO: 1371184 - RNA, 23 nt, Homo sapiens
uccacuucuuguuccccacugac

SEQ ID NO: 1371185 - RNA, 13 nt, Homo sapiens
uccacuucuuuca

SEQ ID NO: 1371186 - RNA, 16 nt, Homo sapiens
uccagaagaacaaaga

SEQ ID NO: 1371187 - RNA, 17 nt, Homo sapiens
uccagagagcagugugg

SEQ ID NO: 1371188 - RNA, 17 nt, Homo sapiens
uccagagggaauugcag

SEQ ID NO: 1371189 - RNA, 17 nt, Homo sapiens
uccagaugagaguacac

SEQ ID NO: 1371190 - RNA, 19 nt, Homo sapiens
uccagcccucucacugugu

SEQ ID NO: 1371191 - RNA, 20 nt, Homo sapiens
uccagccugggcaacagagc

SEQ ID NO: 1371192 - RNA, 19 nt, Homo sapiens
uccagcugcucugucuucu

SEQ ID NO: 1371193 - RNA, 23 nt, Homo sapiens
uccagcugcucugucuucuuugc

SEQ ID NO: 1371194 - RNA, 23 nt, Homo sapiens
uccagcuggaagggucaacaucu

SEQ ID NO: 1371195 - RNA, 16 nt, Homo sapiens
uccaggcgaugugcaa

SEQ ID NO: 1371196 - RNA, 19 nt, Homo sapiens
uccaggcgaugugcaagug

SEQ ID NO: 1371197 - RNA, 14 nt, Homo sapiens
uccagggaugccau

SEQ ID NO: 1371198 - RNA, 16 nt, Homo sapiens
uccagggccagaugag

SEQ ID NO: 1371199 - RNA, 23 nt, Homo sapiens
uccagucucuucugcuggcagaa

SEQ ID NO: 1371200 - RNA, 21 nt, Homo sapiens
uccauagggccuccuuagauc

SEQ ID NO: 1371201 - RNA, 17 nt, Homo sapiens
uccauaucuaaccagug

SEQ ID NO: 1371202 - RNA, 20 nt, Homo sapiens
uccaucagaggacaccugua

SEQ ID NO: 1371203 - RNA, 13 nt, Homo sapiens
uccaucccaggcu

SEQ ID NO: 1371204 - RNA, 15 nt, Homo sapiens
uccauccuaccacaa

SEQ ID NO: 1371205 - RNA, 18 nt, Homo sapiens
uccaugaaaaugaaccau

SEQ ID NO: 1371206 - RNA, 14 nt, Homo sapiens
uccaugaauguauc

SEQ ID NO: 1371207 - RNA, 16 nt, Homo sapiens
uccaugagacacaucu

SEQ ID NO: 1371208 - RNA, 13 nt, Homo sapiens
uccauguacugua

SEQ ID NO: 1371209 - RNA, 22 nt, Homo sapiens
uccaugucgccucugcauucag

SEQ ID NO: 1371210 - RNA, 16 nt, Homo sapiens
uccaugugugugcaag

SEQ ID NO: 1371211 - RNA, 19 nt, Homo sapiens
uccauugguuuaccuguga

SEQ ID NO: 1371212 - RNA, 18 nt, Homo sapiens
uccauuugugugugugca

SEQ ID NO: 1371213 - RNA, 20 nt, Homo sapiens
uccauuugugugugugcaag

SEQ ID NO: 1371214 - RNA, 10 nt, Homo sapiens
ucccaaagag

SEQ ID NO: 1371215 - RNA, 23 nt, Homo sapiens
ucccaaauugaaucacugcucac

SEQ ID NO: 1371216 - RNA, 21 nt, Homo sapiens
ucccaacugcaagucacaaag

SEQ ID NO: 1371217 - RNA, 22 nt, Homo sapiens
ucccaacugcaagucacaaagg

SEQ ID NO: 1371218 - RNA, 17 nt, Homo sapiens
ucccaauucauccucac

SEQ ID NO: 1371219 - RNA, 18 nt, Homo sapiens
ucccacacccuguuuuac

SEQ ID NO: 1371220 - RNA, 16 nt, Homo sapiens
ucccacaggcccuucc

SEQ ID NO: 1371221 - RNA, 23 nt, Homo sapiens
ucccaccuccauuugcaauugac

SEQ ID NO: 1371222 - RNA, 15 nt, Homo sapiens
ucccacucaagccaa

SEQ ID NO: 1371223 - RNA, 15 nt, Homo sapiens
ucccacucaguccau

SEQ ID NO: 1371224 - RNA, 18 nt, Homo sapiens
ucccagaacacacuccau

SEQ ID NO: 1371225 - RNA, 13 nt, Homo sapiens
ucccagcacuuug

SEQ ID NO: 1371226 - RNA, 23 nt, Homo sapiens
ucccagcacuuugggaggccaag

SEQ ID NO: 1371227 - RNA, 17 nt, Homo sapiens
ucccagcuacucgggag

SEQ ID NO: 1371228 - RNA, 15 nt, Homo sapiens
ucccaggaacugggc

SEQ ID NO: 1371229 - RNA, 14 nt, Homo sapiens
ucccaggaguacac

SEQ ID NO: 1371230 - RNA, 17 nt, Homo sapiens
ucccaggaguacacccc

SEQ ID NO: 1371231 - RNA, 23 nt, Homo sapiens
ucccaggaguacaccccaacagc

SEQ ID NO: 1371232 - RNA, 22 nt, Homo sapiens
ucccagugaccccugaccucac

SEQ ID NO: 1371233 - RNA, 16 nt, Homo sapiens
auugaaugaugugaua

SEQ ID NO: 1371234 - RNA, 19 nt, Homo sapiens
auugaccaagaacugcaug

SEQ ID NO: 1371235 - RNA, 16 nt, Homo sapiens
auugacugauggugaa

SEQ ID NO: 1371236 - RNA, 17 nt, Homo sapiens
auugacugucacuguuc

SEQ ID NO: 1371237 - RNA, 15 nt, Homo sapiens
auugagaacugcaua

SEQ ID NO: 1371238 - RNA, 14 nt, Homo sapiens
auugagagugauuc

SEQ ID NO: 1371239 - RNA, 18 nt, Homo sapiens
auugauagaguguuauca

SEQ ID NO: 1371240 - RNA, 18 nt, Homo sapiens
auugauauugaaugaugu

SEQ ID NO: 1371241 - RNA, 20 nt, Homo sapiens
auugaucauuuuuauaacca

SEQ ID NO: 1371242 - RNA, 11 nt, Homo sapiens
auugauuucaa

SEQ ID NO: 1371243 - RNA, 18 nt, Homo sapiens
auugauuucaacagaauc

SEQ ID NO: 1371244 - RNA, 20 nt, Homo sapiens
auugccaccaggagaaccac

SEQ ID NO: 1371245 - RNA, 17 nt, Homo sapiens
auugcuaugaaugauac

SEQ ID NO: 1371246 - RNA, 17 nt, Homo sapiens
auuggaccauccuauuu

SEQ ID NO: 1371247 - RNA, 19 nt, Homo sapiens
auuggagaguaaaaacuga

SEQ ID NO: 1371248 - RNA, 20 nt, Homo sapiens
auuggauaaaauaaaugcaa

SEQ ID NO: 1371249 - RNA, 11 nt, Homo sapiens
auuggcaaaga

SEQ ID NO: 1371250 - RNA, 15 nt, Homo sapiens
auugggggacguggg

SEQ ID NO: 1371251 - RNA, 19 nt, Homo sapiens
auuguaaacauuaguucua

SEQ ID NO: 1371252 - RNA, 15 nt, Homo sapiens
auuguacaaccugug

SEQ ID NO: 1371253 - RNA, 17 nt, Homo sapiens
auuguacaaccugugau

SEQ ID NO: 1371254 - RNA, 14 nt, Homo sapiens
auuguaccaugaaa

SEQ ID NO: 1371255 - RNA, 21 nt, Homo sapiens
auuguacuguugaauuuggcu

SEQ ID NO: 1371256 - RNA, 16 nt, Homo sapiens
auugugaaguacauau

SEQ ID NO: 1371257 - RNA, 12 nt, Homo sapiens
auuguggcugca

SEQ ID NO: 1371258 - RNA, 12 nt, Homo sapiens
auuguguucucu

SEQ ID NO: 1371259 - RNA, 16 nt, Homo sapiens
auuuaaaaugagaucg

SEQ ID NO: 1371260 - RNA, 13 nt, Homo sapiens
auuuaaacuucua

SEQ ID NO: 1371261 - RNA, 13 nt, Homo sapiens
auuuaacagagcu

SEQ ID NO: 1371262 - RNA, 22 nt, Homo sapiens
auuuaaggaagaaucuucugcc

SEQ ID NO: 1371263 - RNA, 16 nt, Homo sapiens
auuuaauaacauaaca

SEQ ID NO: 1371264 - RNA, 13 nt, Homo sapiens
auuuacauugccu

SEQ ID NO: 1371265 - RNA, 11 nt, Homo sapiens
auuuacuuaac

SEQ ID NO: 1371266 - RNA, 19 nt, Homo sapiens
auuuauaacagcauucuug

SEQ ID NO: 1371267 - RNA, 15 nt, Homo sapiens
auuuauaacucauca

SEQ ID NO: 1371268 - RNA, 14 nt, Homo sapiens
auuuaucugugcaa

SEQ ID NO: 1371269 - RNA, 19 nt, Homo sapiens
auuuaucugugcaaauccu

SEQ ID NO: 1371270 - RNA, 23 nt, Homo sapiens
auuuaucugugcaaauccuugau

SEQ ID NO: 1371271 - RNA, 22 nt, Homo sapiens
auuuaugucucagaccacuauu

SEQ ID NO: 1371272 - RNA, 14 nt, Homo sapiens
auuuauuaccucug

SEQ ID NO: 1371273 - RNA, 17 nt, Homo sapiens
auuuauuaccucugaua

SEQ ID NO: 1371274 - RNA, 14 nt, Homo sapiens
auuuauugagcacc

SEQ ID NO: 1371275 - RNA, 20 nt, Homo sapiens
auuuauugccuggaguguga

SEQ ID NO: 1371276 - RNA, 16 nt, Homo sapiens
auuuauuuacaacuca

SEQ ID NO: 1371277 - RNA, 20 nt, Homo sapiens
auuucaagaauguuauucaa

SEQ ID NO: 1371278 - RNA, 13 nt, Homo sapiens
auuucagcauuau

SEQ ID NO: 1371279 - RNA, 23 nt, Homo sapiens
auuucagguuuuguaaagaugcc

SEQ ID NO: 1371280 - RNA, 12 nt, Homo sapiens
auuucaucucuu

SEQ ID NO: 1371281 - RNA, 15 nt, Homo sapiens
auuuccggccaacag

SEQ ID NO: 1371282 - RNA, 22 nt, Homo sapiens
auuuccucauuuuuauaauguc

SEQ ID NO: 1371283 - RNA, 23 nt, Homo sapiens
auuuccuuaaacuguguggacug

SEQ ID NO: 1371284 - RNA, 19 nt, Homo sapiens
auuucuggaaaacugccuu

SEQ ID NO: 1371285 - RNA, 16 nt, Homo sapiens
auuucuuauagucaau

SEQ ID NO: 1371286 - RNA, 14 nt, Homo sapiens
auuucuucacucaa

SEQ ID NO: 1371287 - RNA, 16 nt, Homo sapiens
auuucuuguugcucaa

SEQ ID NO: 1371288 - RNA, 11 nt, Homo sapiens
auuucuuugcc

SEQ ID NO: 1371289 - RNA, 19 nt, Homo sapiens
auuugaagacaaaaauacu

SEQ ID NO: 1371290 - RNA, 18 nt, Homo sapiens
auuugaauuucaguaaac

SEQ ID NO: 1371291 - RNA, 15 nt, Homo sapiens
auuugauaguauugu

SEQ ID NO: 1371292 - RNA, 23 nt, Homo sapiens
auuugcaaggugaacacuuccuu

SEQ ID NO: 1371293 - RNA, 14 nt, Homo sapiens
auuugcagagacag

SEQ ID NO: 1371294 - RNA, 15 nt, Homo sapiens
auuugcauauguaug

SEQ ID NO: 1371295 - RNA, 16 nt, Homo sapiens
auuugcugaauacaga

SEQ ID NO: 1371296 - RNA, 17 nt, Homo sapiens
auuuguauuguuagcca

SEQ ID NO: 1371297 - RNA, 18 nt, Homo sapiens
auuugucgauauuuccau

SEQ ID NO: 1371298 - RNA, 16 nt, Homo sapiens
auuuguuugcaauuuu

SEQ ID NO: 1371299 - RNA, 20 nt, Homo sapiens
auuuguuuucuucuguaugu

SEQ ID NO: 1371300 - RNA, 18 nt, Homo sapiens
auuuuaaugaagugcaau

SEQ ID NO: 1371301 - RNA, 15 nt, Homo sapiens
auuuuacauuuaucu

SEQ ID NO: 1371302 - RNA, 12 nt, Homo sapiens
auuuuauggcaa

SEQ ID NO: 1371303 - RNA, 13 nt, Homo sapiens
auuuuauuauaau

SEQ ID NO: 1371304 - RNA, 20 nt, Homo sapiens
auuuuauuuuuuucuaccuu

SEQ ID NO: 1371305 - RNA, 12 nt, Homo sapiens
auuuucaguaua

SEQ ID NO: 1371306 - RNA, 14 nt, Homo sapiens
auuuucaguauaau

SEQ ID NO: 1371307 - RNA, 18 nt, Homo sapiens
auuuuccccuagcuuucc

SEQ ID NO: 1371308 - RNA, 15 nt, Homo sapiens
auuuucugcauuuaa

SEQ ID NO: 1371309 - RNA, 19 nt, Homo sapiens
auuuucuggaauacaugaa

SEQ ID NO: 1371310 - RNA, 19 nt, Homo sapiens
auuuucuugaauggcaugc

SEQ ID NO: 1371311 - RNA, 12 nt, Homo sapiens
auuuucuugaug

SEQ ID NO: 1371312 - RNA, 18 nt, Homo sapiens
auuuugccauaaagucaa

SEQ ID NO: 1371313 - RNA, 18 nt, Homo sapiens
auuuugcuccccagugaa

SEQ ID NO: 1371314 - RNA, 23 nt, Homo sapiens
auuuugguggguuuugaacauaa

SEQ ID NO: 1371315 - RNA, 19 nt, Homo sapiens
auuuuguaacgaagacaca

SEQ ID NO: 1371316 - RNA, 23 nt, Homo sapiens
auuuuucacuucaaaacaguauu

SEQ ID NO: 1371317 - RNA, 16 nt, Homo sapiens
auuuuucucuaacuca

SEQ ID NO: 1371318 - RNA, 20 nt, Homo sapiens
auuuuuguuucuuccaaagc

SEQ ID NO: 1371319 - RNA, 17 nt, Homo sapiens
caaaaaacaacugacca

SEQ ID NO: 1371320 - RNA, 24 nt, Homo sapiens
caaaaaacauuguuuuguguaaca

SEQ ID NO: 1371321 - RNA, 15 nt, Homo sapiens
caaaaacuacacaua

SEQ ID NO: 1371322 - RNA, 21 nt, Homo sapiens
caaaaauauaccuucagagac

SEQ ID NO: 1371323 - RNA, 17 nt, Homo sapiens
caaaacagaaaaugaag

SEQ ID NO: 1371324 - RNA, 17 nt, Homo sapiens
caaaacauuuuacuuua

SEQ ID NO: 1371325 - RNA, 18 nt, Homo sapiens
caaaaccacuagaacucu

SEQ ID NO: 1371326 - RNA, 17 nt, Homo sapiens
caaaaccugauguuaaa

SEQ ID NO: 1371327 - RNA, 12 nt, Homo sapiens
caaaagauguau

SEQ ID NO: 1371328 - RNA, 18 nt, Homo sapiens
caaaagcaauuguauuac

SEQ ID NO: 1371329 - RNA, 18 nt, Homo sapiens
caaaaguuucuuacucaa

SEQ ID NO: 1371330 - RNA, 17 nt, Homo sapiens
caaaauaaagugacaga

SEQ ID NO: 1371331 - RNA, 23 nt, Homo sapiens
caaaaugguaaccucuacuauga

SEQ ID NO: 1371332 - RNA, 16 nt, Homo sapiens
caaaauuucagcauua

SEQ ID NO: 1371333 - RNA, 15 nt, Homo sapiens
caaaauuuccaguac

SEQ ID NO: 1371334 - RNA, 22 nt, Homo sapiens
caaaauuuugcuccccagugaa

SEQ ID NO: 1371335 - RNA, 20 nt, Homo sapiens
caaacaaagccagaagcuga

SEQ ID NO: 1371336 - RNA, 20 nt, Homo sapiens
caaacaaccccccaucacaa

SEQ ID NO: 1371337 - RNA, 18 nt, Homo sapiens
caaacaauuaacugagca

SEQ ID NO: 1371338 - RNA, 12 nt, Homo sapiens
caaacacccaug

SEQ ID NO: 1371339 - RNA, 15 nt, Homo sapiens
caaacacccaugccc

SEQ ID NO: 1371340 - RNA, 14 nt, Homo sapiens
caaaccacuguuau

SEQ ID NO: 1371341 - RNA, 18 nt, Homo sapiens
caaacuaagcuaugugaa

SEQ ID NO: 1371342 - RNA, 14 nt, Homo sapiens
caaacuaccuucca

SEQ ID NO: 1371343 - RNA, 15 nt, Homo sapiens
caaacucucccuuca

SEQ ID NO: 1371344 - RNA, 22 nt, Homo sapiens
agaaaagaugugcagauaucac

SEQ ID NO: 1371345 - RNA, 19 nt, Homo sapiens
agaaaagauuauauauuau

SEQ ID NO: 1371346 - RNA, 21 nt, Homo sapiens
agaaaaguagguuuacauuca

SEQ ID NO: 1371347 - RNA, 18 nt, Homo sapiens
agaaaagugggccagugu

SEQ ID NO: 1371348 - RNA, 15 nt, Homo sapiens
agaaaauaaaauuaa

SEQ ID NO: 1371349 - RNA, 17 nt, Homo sapiens
agaaaauuguacaaccu

SEQ ID NO: 1371350 - RNA, 21 nt, Homo sapiens
agaaacaacuucuacuucugc

SEQ ID NO: 1371351 - RNA, 13 nt, Homo sapiens
agaaacaucucaa

SEQ ID NO: 1371352 - RNA, 22 nt, Homo sapiens
agaaaccuacagaauacuagcc

SEQ ID NO: 1371353 - RNA, 13 nt, Homo sapiens
agaaacucaccau

SEQ ID NO: 1371354 - RNA, 16 nt, Homo sapiens
agaaacugacacaugc

SEQ ID NO: 1371355 - RNA, 19 nt, Homo sapiens
agaaacuguagucucagga

SEQ ID NO: 1371356 - RNA, 23 nt, Homo sapiens
agaaacuucugcuuuaauggcuu

SEQ ID NO: 1371357 - RNA, 18 nt, Homo sapiens
agaaacuugugaagugga

SEQ ID NO: 1371358 - RNA, 21 nt, Homo sapiens
agaaagcaaaugugaccugug

SEQ ID NO: 1371359 - RNA, 23 nt, Homo sapiens
agaaagcaaaugugaccuguguc

SEQ ID NO: 1371360 - RNA, 14 nt, Homo sapiens
agaaaguacuucuu

SEQ ID NO: 1371361 - RNA, 18 nt, Homo sapiens
agaaagugaagcaaauca

SEQ ID NO: 1371362 - RNA, 19 nt, Homo sapiens
agaaauaaagcaucucauu

SEQ ID NO: 1371363 - RNA, 15 nt, Homo sapiens
agaaauaauaugcau

SEQ ID NO: 1371364 - RNA, 17 nt, Homo sapiens
agaaauagacaguauau

SEQ ID NO: 1371365 - RNA, 13 nt, Homo sapiens
agaaaucuagaag

SEQ ID NO: 1371366 - RNA, 18 nt, Homo sapiens
agaaaucuagaagacugu

SEQ ID NO: 1371367 - RNA, 14 nt, Homo sapiens
agaaaugacuuuga

SEQ ID NO: 1371368 - RNA, 14 nt, Homo sapiens
agaaauuagcugug

SEQ ID NO: 1371369 - RNA, 18 nt, Homo sapiens
agaaauuaugucagcuua

SEQ ID NO: 1371370 - RNA, 16 nt, Homo sapiens
agaaauuuaaaagaca

SEQ ID NO: 1371371 - RNA, 12 nt, Homo sapiens
agaacacauucu

SEQ ID NO: 1371372 - RNA, 19 nt, Homo sapiens
agaacagcauuggucccag

SEQ ID NO: 1371373 - RNA, 13 nt, Homo sapiens
agaacaguuugua

SEQ ID NO: 1371374 - RNA, 22 nt, Homo sapiens
agaacucuccaucuuauuuuca

SEQ ID NO: 1371375 - RNA, 13 nt, Homo sapiens
agaacugagcucc

SEQ ID NO: 1371376 - RNA, 23 nt, Homo sapiens
agaacuggaaagacauagccaac

SEQ ID NO: 1371377 - RNA, 18 nt, Homo sapiens
agaagacaacauuucuca

SEQ ID NO: 1371378 - RNA, 19 nt, Homo sapiens
agaagacaacauuucucaa

SEQ ID NO: 1371379 - RNA, 23 nt, Homo sapiens
agaagacugucagcuuccaaaca

SEQ ID NO: 1371380 - RNA, 11 nt, Homo sapiens
agaagaugaau

SEQ ID NO: 1371381 - RNA, 18 nt, Homo sapiens
agaagauuuuaugcugcu

SEQ ID NO: 1371382 - RNA, 20 nt, Homo sapiens
agaagcacccaggacuucca

SEQ ID NO: 1371383 - RNA, 23 nt, Homo sapiens
agaagccucacugcaagcacugc

SEQ ID NO: 1371384 - RNA, 19 nt, Homo sapiens
agaaggacauuuuacugca

SEQ ID NO: 1371385 - RNA, 13 nt, Homo sapiens
agaaggcaaaaag

SEQ ID NO: 1371386 - RNA, 10 nt, Homo sapiens
agaagggaug

SEQ ID NO: 1371387 - RNA, 22 nt, Homo sapiens
agaaggguaccuugaacacugg

SEQ ID NO: 1371388 - RNA, 14 nt, Homo sapiens
agaagguccuuaau

SEQ ID NO: 1371389 - RNA, 15 nt, Homo sapiens
agaagguugugauga

SEQ ID NO: 1371390 - RNA, 17 nt, Homo sapiens
agaagguuuacucugug

SEQ ID NO: 1371391 - RNA, 13 nt, Homo sapiens
agaaguaggcaug

SEQ ID NO: 1371392 - RNA, 18 nt, Homo sapiens
agaaguugacaggcagug

SEQ ID NO: 1371393 - RNA, 14 nt, Homo sapiens
agaauaaauacugu

SEQ ID NO: 1371394 - RNA, 19 nt, Homo sapiens
agaauauuuauuaccucug

SEQ ID NO: 1371395 - RNA, 22 nt, Homo sapiens
agaaucaauccagcgguucuca

SEQ ID NO: 1371396 - RNA, 17 nt, Homo sapiens
agaaucagaucauuuca

SEQ ID NO: 1371397 - RNA, 20 nt, Homo sapiens
agaaucagugcaaagauuug

SEQ ID NO: 1371398 - RNA, 18 nt, Homo sapiens
agaaucauuaauacaaag

SEQ ID NO: 1371399 - RNA, 16 nt, Homo sapiens
agaauccccuccaucu

SEQ ID NO: 1371400 - RNA, 14 nt, Homo sapiens
agaaucugcagcua

SEQ ID NO: 1371401 - RNA, 18 nt, Homo sapiens
agaaucuguguagacgaa

SEQ ID NO: 1371402 - RNA, 18 nt, Homo sapiens
agaaugaauaauaauuau

SEQ ID NO: 1371403 - RNA, 19 nt, Homo sapiens
agaaugaugcacauuucau

SEQ ID NO: 1371404 - RNA, 13 nt, Homo sapiens
agaaugucagaaa

SEQ ID NO: 1371405 - RNA, 23 nt, Homo sapiens
agaauuccuuuucuaacucuccc

SEQ ID NO: 1371406 - RNA, 15 nt, Homo sapiens
agaauucuuacaugu

SEQ ID NO: 1371407 - RNA, 23 nt, Homo sapiens
agaauugcaauuuuaacacacau

SEQ ID NO: 1371408 - RNA, 19 nt, Homo sapiens
agaauugcuugaacccagg

SEQ ID NO: 1371409 - RNA, 21 nt, Homo sapiens
agaauuuauucaauuccucug

SEQ ID NO: 1371410 - RNA, 14 nt, Homo sapiens
agacaaaugcugcg

SEQ ID NO: 1371411 - RNA, 15 nt, Homo sapiens
agacaacauuucuca

SEQ ID NO: 1371412 - RNA, 19 nt, Homo sapiens
agacaaggccgucaggacc

SEQ ID NO: 1371413 - RNA, 17 nt, Homo sapiens
agacaagugacuguauc

SEQ ID NO: 1371414 - RNA, 19 nt, Homo sapiens
agacacaaacaaacaagcu

SEQ ID NO: 1371415 - RNA, 17 nt, Homo sapiens
agacaccuugacagggc

SEQ ID NO: 1371416 - RNA, 21 nt, Homo sapiens
agacagaaccccuacaugaaa

SEQ ID NO: 1371417 - RNA, 18 nt, Homo sapiens
agacagacuugagaacuu

SEQ ID NO: 1371418 - RNA, 20 nt, Homo sapiens
agacagaguuuucacucuua

SEQ ID NO: 1371419 - RNA, 16 nt, Homo sapiens
agacauaaauuacuuu

SEQ ID NO: 1371420 - RNA, 16 nt, Homo sapiens
agacaugaaugcacac

SEQ ID NO: 1371421 - RNA, 18 nt, Homo sapiens
agacauggcuugccacag

SEQ ID NO: 1371422 - RNA, 12 nt, Homo sapiens
agaccaaaauaa

SEQ ID NO: 1371423 - RNA, 15 nt, Homo sapiens
agaccacuguuauca

SEQ ID NO: 1371424 - RNA, 19 nt, Homo sapiens
agaccagggugguugggac

SEQ ID NO: 1371425 - RNA, 13 nt, Homo sapiens
agaccaguccaug

SEQ ID NO: 1371426 - RNA, 16 nt, Homo sapiens
agaccauaauguuaca

SEQ ID NO: 1371427 - RNA, 15 nt, Homo sapiens
agaccauagugacca

SEQ ID NO: 1371428 - RNA, 15 nt, Homo sapiens
agaccgugugugaaa

SEQ ID NO: 1371429 - RNA, 16 nt, Homo sapiens
agaccucugugcacuu

SEQ ID NO: 1371430 - RNA, 21 nt, Homo sapiens
agaccuggcacuggaugcaga

SEQ ID NO: 1371431 - RNA, 19 nt, Homo sapiens
agaccuguaaucauauaau

SEQ ID NO: 1371432 - RNA, 20 nt, Homo sapiens
agacgcagacaugugcacuu

SEQ ID NO: 1371433 - RNA, 22 nt, Homo sapiens
agacuacauauugucacugaca

SEQ ID NO: 1371434 - RNA, 13 nt, Homo sapiens
agacuagugccgu

SEQ ID NO: 1371435 - RNA, 14 nt, Homo sapiens
agacuagugccgua

SEQ ID NO: 1371436 - RNA, 15 nt, Homo sapiens
agacuaucaguuccc

SEQ ID NO: 1371437 - RNA, 23 nt, Homo sapiens
agacuauuaauaaauaagacugu

SEQ ID NO: 1371438 - RNA, 18 nt, Homo sapiens
agacuauucccuucuaac

SEQ ID NO: 1371439 - RNA, 21 nt, Homo sapiens
agacucagggccccagcacua

SEQ ID NO: 1371440 - RNA, 17 nt, Homo sapiens
agacucaguuugucaga

SEQ ID NO: 1371441 - RNA, 17 nt, Homo sapiens
agacucccaagcuggac

SEQ ID NO: 1371442 - RNA, 20 nt, Homo sapiens
agacucuacagaggccaugg

SEQ ID NO: 1371443 - RNA, 13 nt, Homo sapiens
agacucugucuca

SEQ ID NO: 1371444 - RNA, 19 nt, Homo sapiens
agacugcugcugaauuuau

SEQ ID NO: 1371445 - RNA, 20 nt, Homo sapiens
agacugggucucgcuuuguu

SEQ ID NO: 1371446 - RNA, 22 nt, Homo sapiens
agacuguggcugcuagcacuug

SEQ ID NO: 1371447 - RNA, 23 nt, Homo sapiens
agacuugaaauacuacuuaccau

SEQ ID NO: 1371448 - RNA, 14 nt, Homo sapiens
agacuugguuucaa

SEQ ID NO: 1371449 - RNA, 16 nt, Homo sapiens
agacuuucaagggaau

SEQ ID NO: 1371450 - RNA, 12 nt, Homo sapiens
agacuuugacuc

SEQ ID NO: 1371451 - RNA, 20 nt, Homo sapiens
agacuuugacucuccagaaa

SEQ ID NO: 1371452 - RNA, 20 nt, Homo sapiens
agagaaccucacgcaccucc

SEQ ID NO: 1371453 - RNA, 18 nt, Homo sapiens
agagacaggacuagcugg

SEQ ID NO: 1371454 - RNA, 17 nt, Homo sapiens
agcacacuuaugggcca

SEQ ID NO: 1371455 - RNA, 20 nt, Homo sapiens
agcacagcagccccugcaca

SEQ ID NO: 1371456 - RNA, 17 nt, Homo sapiens
auugaaaucaagcuuau

SEQ ID NO: 1371457 - RNA, 12 nt, Homo sapiens
auugaaguaaug

SEQ ID NO: 1371458 - RNA, 16 nt, Homo sapiens
auugaauauaacuuuu

SEQ ID NO: 1371459 - RNA, 20 nt, Homo sapiens
aaaggcauuucaaagucuca

SEQ ID NO: 1371460 - RNA, 17 nt, Homo sapiens
aaaggcuaugauugucu

SEQ ID NO: 1371461 - RNA, 15 nt, Homo sapiens
aaaggcucagucuca

SEQ ID NO: 1371462 - RNA, 16 nt, Homo sapiens
aaagggauaguccaaa

SEQ ID NO: 1371463 - RNA, 18 nt, Homo sapiens
aaagggcccagagagggu

SEQ ID NO: 1371464 - RNA, 14 nt, Homo sapiens
aaagggcuuucuca

SEQ ID NO: 1371465 - RNA, 23 nt, Homo sapiens
aaagguauuaaauugauguugcu

SEQ ID NO: 1371466 - RNA, 19 nt, Homo sapiens
aaaggugaaaaaagcuuuu

SEQ ID NO: 1371467 - RNA, 16 nt, Homo sapiens
aaaggugaccaaugau

SEQ ID NO: 1371468 - RNA, 16 nt, Homo sapiens
aaagguggugccaauu

SEQ ID NO: 1371469 - RNA, 23 nt, Homo sapiens
aaagguuauuuucuccugauaua

SEQ ID NO: 1371470 - RNA, 22 nt, Homo sapiens
aaagguugacaauaaaugugcu

SEQ ID NO: 1371471 - RNA, 13 nt, Homo sapiens
aaaguaagccaug

SEQ ID NO: 1371472 - RNA, 14 nt, Homo sapiens
aaaguagacuucau

SEQ ID NO: 1371473 - RNA, 11 nt, Homo sapiens
aaaguauucca

SEQ ID NO: 1371474 - RNA, 21 nt, Homo sapiens
aaagugacucacuuaucccaa

SEQ ID NO: 1371475 - RNA, 23 nt, Homo sapiens
aaagugacucacuuaucccaaga

SEQ ID NO: 1371476 - RNA, 15 nt, Homo sapiens
aaaguguaacauaug

SEQ ID NO: 1371477 - RNA, 19 nt, Homo sapiens
aaaguguauuauaacagug

SEQ ID NO: 1371478 - RNA, 21 nt, Homo sapiens
aaaguuuccccaccagugaau

SEQ ID NO: 1371479 - RNA, 15 nt, Homo sapiens
aaauaaaaaccaaga

SEQ ID NO: 1371480 - RNA, 17 nt, Homo sapiens
aaauaacagacugucug

SEQ ID NO: 1371481 - RNA, 20 nt, Homo sapiens
aaauaaccccaaaaugaaga

SEQ ID NO: 1371482 - RNA, 17 nt, Homo sapiens
aaauaaggaacaugaaa

SEQ ID NO: 1371483 - RNA, 19 nt, Homo sapiens
aaauaaguggaaaccgugu

SEQ ID NO: 1371484 - RNA, 19 nt, Homo sapiens
aaauaauaaacaguggaau

SEQ ID NO: 1371485 - RNA, 14 nt, Homo sapiens
aaauaauaacaauc

SEQ ID NO: 1371486 - RNA, 16 nt, Homo sapiens
aaauaauuuuucacuu

SEQ ID NO: 1371487 - RNA, 20 nt, Homo sapiens
aaauaauuuuucacuucaaa

SEQ ID NO: 1371488 - RNA, 11 nt, Homo sapiens
aaauacaauaa

SEQ ID NO: 1371489 - RNA, 22 nt, Homo sapiens
aaauacacagugcugaccagac

SEQ ID NO: 1371490 - RNA, 23 nt, Homo sapiens
aaauacacagugcugaccagaca

SEQ ID NO: 1371491 - RNA, 14 nt, Homo sapiens
aaauacacauagca

SEQ ID NO: 1371492 - RNA, 14 nt, Homo sapiens
aaauacucuaauuc

SEQ ID NO: 1371493 - RNA, 15 nt, Homo sapiens
aaauacuucuugaag

SEQ ID NO: 1371494 - RNA, 19 nt, Homo sapiens
aaauacuucuugaagccga

SEQ ID NO: 1371495 - RNA, 17 nt, Homo sapiens
aaauagaaccacuauga

SEQ ID NO: 1371496 - RNA, 19 nt, Homo sapiens
aaauagcuauauccaugua

SEQ ID NO: 1371497 - RNA, 15 nt, Homo sapiens
aaauauaauaugcac

SEQ ID NO: 1371498 - RNA, 18 nt, Homo sapiens
aaauauaaucuaauacac

SEQ ID NO: 1371499 - RNA, 14 nt, Homo sapiens
aaauauacauucaa

SEQ ID NO: 1371500 - RNA, 17 nt, Homo sapiens
aaauaucacaucacuua

SEQ ID NO: 1371501 - RNA, 22 nt, Homo sapiens
aaauaugcaccaaaucaucucu

SEQ ID NO: 1371502 - RNA, 22 nt, Homo sapiens
aaauaugcucagccacccugug

SEQ ID NO: 1371503 - RNA, 20 nt, Homo sapiens
aaauauuauugguguuuacc

SEQ ID NO: 1371504 - RNA, 22 nt, Homo sapiens
aaauauuauugguguuuaccca

SEQ ID NO: 1371505 - RNA, 20 nt, Homo sapiens
aaauauuuccuuaaacugug

SEQ ID NO: 1371506 - RNA, 18 nt, Homo sapiens
aaauauuugacaggcuua

SEQ ID NO: 1371507 - RNA, 18 nt, Homo sapiens
aaauauuugcuaugaagc

SEQ ID NO: 1371508 - RNA, 22 nt, Homo sapiens
aaauauuuuggcauuguacuaa

SEQ ID NO: 1371509 - RNA, 16 nt, Homo sapiens
aaaucaaauauauguc

SEQ ID NO: 1371510 - RNA, 17 nt, Homo sapiens
aaaucaaguauuggcaa

SEQ ID NO: 1371511 - RNA, 21 nt, Homo sapiens
aaaucaaguuggcuucuaauc

SEQ ID NO: 1371512 - RNA, 12 nt, Homo sapiens
aaaucagccuaa

SEQ ID NO: 1371513 - RNA, 17 nt, Homo sapiens
aaaucagcugcuacuac

SEQ ID NO: 1371514 - RNA, 15 nt, Homo sapiens
aaaucauuaagacaa

SEQ ID NO: 1371515 - RNA, 21 nt, Homo sapiens
aaauccacagaacuagccuua

SEQ ID NO: 1371516 - RNA, 21 nt, Homo sapiens
aaauccuguugaaaagccaug

SEQ ID NO: 1371517 - RNA, 15 nt, Homo sapiens
aaauccuucuaaucu

SEQ ID NO: 1371518 - RNA, 16 nt, Homo sapiens
aaaucuaaguguuuca

SEQ ID NO: 1371519 - RNA, 12 nt, Homo sapiens
aaaucuaugaaa

SEQ ID NO: 1371520 - RNA, 18 nt, Homo sapiens
aaaucuaugaaauaucau

SEQ ID NO: 1371521 - RNA, 21 nt, Homo sapiens
aaaucucagcaaugauuacuc

SEQ ID NO: 1371522 - RNA, 22 nt, Homo sapiens
aaaucugccugauaggacccau

SEQ ID NO: 1371523 - RNA, 21 nt, Homo sapiens
aaaucuuuuuuguucaaagau

SEQ ID NO: 1371524 - RNA, 20 nt, Homo sapiens
aaaugaaccacauagacuuu

SEQ ID NO: 1371525 - RNA, 19 nt, Homo sapiens
aaaugacaagugagacaaa

SEQ ID NO: 1371526 - RNA, 20 nt, Homo sapiens
aaaugagaagucucacugau

SEQ ID NO: 1371527 - RNA, 15 nt, Homo sapiens
aaaugcaaauucuca

SEQ ID NO: 1371528 - RNA, 17 nt, Homo sapiens
aaaugcaacaacaugua

SEQ ID NO: 1371529 - RNA, 23 nt, Homo sapiens
aaaugcccagcuuaaaggggcua

SEQ ID NO: 1371530 - RNA, 16 nt, Homo sapiens
aaauggaggaauauga

SEQ ID NO: 1371531 - RNA, 15 nt, Homo sapiens
aaauggaggccuguc

SEQ ID NO: 1371532 - RNA, 20 nt, Homo sapiens
aaauggaggccuguccugac

SEQ ID NO: 1371533 - RNA, 21 nt, Homo sapiens
aaauggcagggauacccagug

SEQ ID NO: 1371534 - RNA, 17 nt, Homo sapiens
aaaugggaaaaccagac

SEQ ID NO: 1371535 - RNA, 23 nt, Homo sapiens
aaauggggauauguuaacuauug

SEQ ID NO: 1371536 - RNA, 18 nt, Homo sapiens
aaauguaauaaguaucac

SEQ ID NO: 1371537 - RNA, 20 nt, Homo sapiens
aaauguaauacuccuaagac

SEQ ID NO: 1371538 - RNA, 19 nt, Homo sapiens
aaaugucuaagguaguaac

SEQ ID NO: 1371539 - RNA, 19 nt, Homo sapiens
aaaugugcagcucccauuu

SEQ ID NO: 1371540 - RNA, 23 nt, Homo sapiens
aaauguggagaaacuguagucuc

SEQ ID NO: 1371541 - RNA, 17 nt, Homo sapiens
aaauguuacuucucuca

SEQ ID NO: 1371542 - RNA, 19 nt, Homo sapiens
aaauguucagaagguugcu

SEQ ID NO: 1371543 - RNA, 12 nt, Homo sapiens
aaauguuucuca

SEQ ID NO: 1371544 - RNA, 14 nt, Homo sapiens
aaauuaaaagcuau

SEQ ID NO: 1371545 - RNA, 13 nt, Homo sapiens
aaauuaaagcuga

SEQ ID NO: 1371546 - RNA, 18 nt, Homo sapiens
aaauuaaauugcagaugg

SEQ ID NO: 1371547 - RNA, 14 nt, Homo sapiens
aaauuauaucucag

SEQ ID NO: 1371548 - RNA, 20 nt, Homo sapiens
aaauucauggugcacugagc

SEQ ID NO: 1371549 - RNA, 23 nt, Homo sapiens
aaauuccuuagcuuagaccucag

SEQ ID NO: 1371550 - RNA, 17 nt, Homo sapiens
aaauuccuugauucaca

SEQ ID NO: 1371551 - RNA, 23 nt, Homo sapiens
aaauuccuuggcaugccuuccag

SEQ ID NO: 1371552 - RNA, 20 nt, Homo sapiens
aaauucuauaggaacauaug

SEQ ID NO: 1371553 - RNA, 24 nt, Homo sapiens
aaauucucagucaguaauugccaa

SEQ ID NO: 1371554 - RNA, 20 nt, Homo sapiens
aaauugcaugcugcuuuaau

SEQ ID NO: 1371555 - RNA, 15 nt, Homo sapiens
aaauugccuaaagag

SEQ ID NO: 1371556 - RNA, 20 nt, Homo sapiens
aaauuguaagugaaguaaaa

SEQ ID NO: 1371557 - RNA, 15 nt, Homo sapiens
aaauuguacaaccug

SEQ ID NO: 1371558 - RNA, 18 nt, Homo sapiens
aaauuuaauauagcuauu

SEQ ID NO: 1371559 - RNA, 23 nt, Homo sapiens
aaauuuccaguaccuuugucaca

SEQ ID NO: 1371560 - RNA, 16 nt, Homo sapiens
aaauuugaauuucagu

SEQ ID NO: 1371561 - RNA, 20 nt, Homo sapiens
aaauuuuuuaaaaagcaaaa

SEQ ID NO: 1371562 - RNA, 21 nt, Homo sapiens
aacaaaaaaaccucuaugcaa

SEQ ID NO: 1371563 - RNA, 21 nt, Homo sapiens
aacaaauuagguuuuguacaa

SEQ ID NO: 1371564 - RNA, 22 nt, Homo sapiens
aacaaauuagguuuuguacaau

SEQ ID NO: 1371565 - RNA, 19 nt, Homo sapiens
aacaaccuggucacaggac

SEQ ID NO: 1371566 - RNA, 14 nt, Homo sapiens
aacaagaauuggaa

SEQ ID NO: 1371567 - RNA, 12 nt, Homo sapiens
aacaagaucugc

SEQ ID NO: 1371568 - RNA, 16 nt, Homo sapiens
aacaauggaagauuug

SEQ ID NO: 1371569 - RNA, 22 nt, Homo sapiens
aacaauggaagauuugcccauu

SEQ ID NO: 1371570 - RNA, 16 nt, Homo sapiens
aacaauuaacugagca

SEQ ID NO: 1371571 - RNA, 13 nt, Homo sapiens
agagaggaagagc

SEQ ID NO: 1371572 - RNA, 17 nt, Homo sapiens
agagaggguggugaccu

SEQ ID NO: 1371573 - RNA, 22 nt, Homo sapiens
agagcaacaauccaucucucaa

SEQ ID NO: 1371574 - RNA, 19 nt, Homo sapiens
agagcaagacucugucuca

SEQ ID NO: 1371575 - RNA, 13 nt, Homo sapiens
agagcaagcuuuu

SEQ ID NO: 1371576 - RNA, 16 nt, Homo sapiens
agagccagggcugaug

SEQ ID NO: 1371577 - RNA, 16 nt, Homo sapiens
agagccccacccucag

SEQ ID NO: 1371578 - RNA, 15 nt, Homo sapiens
agagccucacaguua

SEQ ID NO: 1371579 - RNA, 17 nt, Homo sapiens
agagcugagugagcuga

SEQ ID NO: 1371580 - RNA, 23 nt, Homo sapiens
agagcugggauguuucugucaca

SEQ ID NO: 1371581 - RNA, 22 nt, Homo sapiens
agagcuuugcuucucucucuaa

SEQ ID NO: 1371582 - RNA, 15 nt, Homo sapiens
agagcuuuuugcaug

SEQ ID NO: 1371583 - RNA, 15 nt, Homo sapiens
agaggaagagugcaa

SEQ ID NO: 1371584 - RNA, 21 nt, Homo sapiens
agaggacaccuguacuggaga

SEQ ID NO: 1371585 - RNA, 15 nt, Homo sapiens
agaggagaaggaggg

SEQ ID NO: 1371586 - RNA, 22 nt, Homo sapiens
agaggcaaugauuguuaauuua

SEQ ID NO: 1371587 - RNA, 19 nt, Homo sapiens
agaggcagggucucacucu

SEQ ID NO: 1371588 - RNA, 14 nt, Homo sapiens
agaggccauggcag

SEQ ID NO: 1371589 - RNA, 22 nt, Homo sapiens
agaggcuauuauuuucacugua

SEQ ID NO: 1371590 - RNA, 23 nt, Homo sapiens
agaggcugaggugagaggaucag

SEQ ID NO: 1371591 - RNA, 18 nt, Homo sapiens
agagggaaggucucagga

SEQ ID NO: 1371592 - RNA, 14 nt, Homo sapiens
agaggggggcugcc

SEQ ID NO: 1371593 - RNA, 22 nt, Homo sapiens
agagggguggaguuuuaacugu

SEQ ID NO: 1371594 - RNA, 13 nt, Homo sapiens
agaggguacuuua

SEQ ID NO: 1371595 - RNA, 14 nt, Homo sapiens
agagguagcacuac

SEQ ID NO: 1371596 - RNA, 13 nt, Homo sapiens
agaguacacccca

SEQ ID NO: 1371597 - RNA, 21 nt, Homo sapiens
agaguacaccccaacagcacc

SEQ ID NO: 1371598 - RNA, 16 nt, Homo sapiens
agaguagagggcacug

SEQ ID NO: 1371599 - RNA, 19 nt, Homo sapiens
agaguagagggcacugggu

SEQ ID NO: 1371600 - RNA, 22 nt, Homo sapiens
agaguauccacuguuuauucaa

SEQ ID NO: 1371601 - RNA, 21 nt, Homo sapiens
agaguccuauuugcacuguag

SEQ ID NO: 1371602 - RNA, 14 nt, Homo sapiens
agagugcaaaacau

SEQ ID NO: 1371603 - RNA, 18 nt, Homo sapiens
agagugccccaccugcca

SEQ ID NO: 1371604 - RNA, 21 nt, Homo sapiens
agagugccguaacaacugugg

SEQ ID NO: 1371605 - RNA, 23 nt, Homo sapiens
agagugccguaacaacugugguc

SEQ ID NO: 1371606 - RNA, 22 nt, Homo sapiens
agagugguuaagacuacugaag

SEQ ID NO: 1371607 - RNA, 19 nt, Homo sapiens
agaguguuaucagucauaa

SEQ ID NO: 1371608 - RNA, 21 nt, Homo sapiens
agaguuggcuggucaacuuga

SEQ ID NO: 1371609 - RNA, 14 nt, Homo sapiens
agaguugugcacau

SEQ ID NO: 1371610 - RNA, 13 nt, Homo sapiens
agauaaagaccuu

SEQ ID NO: 1371611 - RNA, 13 nt, Homo sapiens
agauaacucuccu

SEQ ID NO: 1371612 - RNA, 14 nt, Homo sapiens
agauaauaugagaa

SEQ ID NO: 1371613 - RNA, 15 nt, Homo sapiens
agauaaucucucagc

SEQ ID NO: 1371614 - RNA, 14 nt, Homo sapiens
agauacuagcuauc

SEQ ID NO: 1371615 - RNA, 19 nt, Homo sapiens
agauacuuugucagcaaua

SEQ ID NO: 1371616 - RNA, 14 nt, Homo sapiens
agauagaaccugga

SEQ ID NO: 1371617 - RNA, 16 nt, Homo sapiens
agauagaagaacugca

SEQ ID NO: 1371618 - RNA, 20 nt, Homo sapiens
agauaguagcauacauuuau

SEQ ID NO: 1371619 - RNA, 13 nt, Homo sapiens
agauauaugcucu

SEQ ID NO: 1371620 - RNA, 19 nt, Homo sapiens
agauauugugaaguacaua

SEQ ID NO: 1371621 - RNA, 20 nt, Homo sapiens
agauauuguuuggaucaaaa

SEQ ID NO: 1371622 - RNA, 15 nt, Homo sapiens
agaucacaauacuca

SEQ ID NO: 1371623 - RNA, 22 nt, Homo sapiens
agaucaccaguguguggcuuuc

SEQ ID NO: 1371624 - RNA, 15 nt, Homo sapiens
agaucacgccacugc

SEQ ID NO: 1371625 - RNA, 14 nt, Homo sapiens
agaucauggcccac

SEQ ID NO: 1371626 - RNA, 18 nt, Homo sapiens
agaucccagcucacguca

SEQ ID NO: 1371627 - RNA, 21 nt, Homo sapiens
agaucccagcucacgucacac

SEQ ID NO: 1371628 - RNA, 15 nt, Homo sapiens
agauccuaccccuga

SEQ ID NO: 1371629 - RNA, 15 nt, Homo sapiens
agauccugguuggug

SEQ ID NO: 1371630 - RNA, 16 nt, Homo sapiens
agaucgcaguuugccu

SEQ ID NO: 1371631 - RNA, 19 nt, Homo sapiens
agaucuaacaagauagcca

SEQ ID NO: 1371632 - RNA, 22 nt, Homo sapiens
agaucuaauauugacugccucu

SEQ ID NO: 1371633 - RNA, 16 nt, Homo sapiens
agaucuauguacugua

SEQ ID NO: 1371634 - RNA, 17 nt, Homo sapiens
agaucuauguacuguaa

SEQ ID NO: 1371635 - RNA, 18 nt, Homo sapiens
agaucuggucccuugcag

SEQ ID NO: 1371636 - RNA, 23 nt, Homo sapiens
agaucuuucaggacucuaccuca

SEQ ID NO: 1371637 - RNA, 14 nt, Homo sapiens
agaugaagucuugu

SEQ ID NO: 1371638 - RNA, 15 nt, Homo sapiens
agaugacauggugaa

SEQ ID NO: 1371639 - RNA, 14 nt, Homo sapiens
agaugacuucccaa

SEQ ID NO: 1371640 - RNA, 10 nt, Homo sapiens
agaugcauua

SEQ ID NO: 1371641 - RNA, 19 nt, Homo sapiens
agaugcauuaucuaugaua

SEQ ID NO: 1371642 - RNA, 20 nt, Homo sapiens
agaugccuucuccagacaaa

SEQ ID NO: 1371643 - RNA, 20 nt, Homo sapiens
agaugcugacuguacuccuc

SEQ ID NO: 1371644 - RNA, 20 nt, Homo sapiens
agaugcugcaaauaaauuca

SEQ ID NO: 1371645 - RNA, 19 nt, Homo sapiens
agauggauagucuguccaa

SEQ ID NO: 1371646 - RNA, 16 nt, Homo sapiens
agauggcugugccucu

SEQ ID NO: 1371647 - RNA, 22 nt, Homo sapiens
agauguaagaaauguucuugca

SEQ ID NO: 1371648 - RNA, 17 nt, Homo sapiens
agauguauauauuuccu

SEQ ID NO: 1371649 - RNA, 16 nt, Homo sapiens
agaugucccauuuuca

SEQ ID NO: 1371650 - RNA, 13 nt, Homo sapiens
agauguggggaaa

SEQ ID NO: 1371651 - RNA, 14 nt, Homo sapiens
agaugugucuuacc

SEQ ID NO: 1371652 - RNA, 16 nt, Homo sapiens
agaugugucuuaccag

SEQ ID NO: 1371653 - RNA, 16 nt, Homo sapiens
agauguguuaggaaug

SEQ ID NO: 1371654 - RNA, 17 nt, Homo sapiens
agauguuauacaaccau

SEQ ID NO: 1371655 - RNA, 18 nt, Homo sapiens
agauguucacccaaccac

SEQ ID NO: 1371656 - RNA, 17 nt, Homo sapiens
agauguuuaugauguaa

SEQ ID NO: 1371657 - RNA, 19 nt, Homo sapiens
agauguuuuggggacucau

SEQ ID NO: 1371658 - RNA, 17 nt, Homo sapiens
agauuaaacugagugaa

SEQ ID NO: 1371659 - RNA, 19 nt, Homo sapiens
agauuauauugagacaaaa

SEQ ID NO: 1371660 - RNA, 17 nt, Homo sapiens
agauucaaacucaauga

SEQ ID NO: 1371661 - RNA, 22 nt, Homo sapiens
agauucaaacucaaugaugcua

SEQ ID NO: 1371662 - RNA, 11 nt, Homo sapiens
agauucaccug

SEQ ID NO: 1371663 - RNA, 16 nt, Homo sapiens
agauuccgcaccaaua

SEQ ID NO: 1371664 - RNA, 22 nt, Homo sapiens
agauucuaauggcuuuauugca

SEQ ID NO: 1371665 - RNA, 20 nt, Homo sapiens
agauugcaccauugcgcucu

SEQ ID NO: 1371666 - RNA, 22 nt, Homo sapiens
agauugugccacuucacuccag

SEQ ID NO: 1371667 - RNA, 18 nt, Homo sapiens
agauuuccaaaagacuug

SEQ ID NO: 1371668 - RNA, 16 nt, Homo sapiens
agauuuuaugcugcug

SEQ ID NO: 1371669 - RNA, 18 nt, Homo sapiens
agcaaaaaaguacuuaaa

SEQ ID NO: 1371670 - RNA, 22 nt, Homo sapiens
agcaaaaccaaauauuccagag

SEQ ID NO: 1371671 - RNA, 13 nt, Homo sapiens
agcaaaccugccc

SEQ ID NO: 1371672 - RNA, 21 nt, Homo sapiens
agcaaagugaagacacuggcu

SEQ ID NO: 1371673 - RNA, 22 nt, Homo sapiens
agcaaaucuacuucaacacuuc

SEQ ID NO: 1371674 - RNA, 13 nt, Homo sapiens
agcaaauguuaca

SEQ ID NO: 1371675 - RNA, 17 nt, Homo sapiens
agcaacaaaaauuacuc

SEQ ID NO: 1371676 - RNA, 16 nt, Homo sapiens
agcaacacaauguuau

SEQ ID NO: 1371677 - RNA, 19 nt, Homo sapiens
agcaagaucccaucucuuu

SEQ ID NO: 1371678 - RNA, 21 nt, Homo sapiens
agcaagugaauuuuucucuaa

SEQ ID NO: 1371679 - RNA, 22 nt, Homo sapiens
agcaauauaucugaagagcuau

SEQ ID NO: 1371680 - RNA, 14 nt, Homo sapiens
agcaaugauuacuc

SEQ ID NO: 1371681 - RNA, 20 nt, Homo sapiens
agcaauuguauuacuuccuc

SEQ ID NO: 1371682 - RNA, 13 nt, Homo sapiens
aaaaaaccaucca

SEQ ID NO: 1371683 - RNA, 15 nt, Homo sapiens
aaaaaauacaguauu

SEQ ID NO: 1371684 - RNA, 12 nt, Homo sapiens
aaaaacaauuau

SEQ ID NO: 1371685 - RNA, 17 nt, Homo sapiens
aaaaaccccaaacuguu

SEQ ID NO: 1371686 - RNA, 23 nt, Homo sapiens
aaaaaccucuaugcaaucugagu

SEQ ID NO: 1371687 - RNA, 17 nt, Homo sapiens
aaaaaccugcaguuuug

SEQ ID NO: 1371688 - RNA, 15 nt, Homo sapiens
aaaaagaaucugcau

SEQ ID NO: 1371689 - RNA, 19 nt, Homo sapiens
aaaaagaccuaugagcaca

SEQ ID NO: 1371690 - RNA, 15 nt, Homo sapiens
aaaaaggucuuuaaa

SEQ ID NO: 1371691 - RNA, 23 nt, Homo sapiens
aaaaaguccuugauuuagcacua

SEQ ID NO: 1371692 - RNA, 16 nt, Homo sapiens
aaaaaguuaaacauug

SEQ ID NO: 1371693 - RNA, 16 nt, Homo sapiens
aaaaauaaaaaagauc

SEQ ID NO: 1371694 - RNA, 19 nt, Homo sapiens
aaaaauaaaaaagaucucc

SEQ ID NO: 1371695 - RNA, 17 nt, Homo sapiens
aaaaaucauaguacucu

SEQ ID NO: 1371696 - RNA, 13 nt, Homo sapiens
aaaaaugagcucg

SEQ ID NO: 1371697 - RNA, 17 nt, Homo sapiens
aaaaaugaugggacaau

SEQ ID NO: 1371698 - RNA, 23 nt, Homo sapiens
aaaaauggauacuggugcaguca

SEQ ID NO: 1371699 - RNA, 13 nt, Homo sapiens
aaaacaagccaug

SEQ ID NO: 1371700 - RNA, 17 nt, Homo sapiens
aaaacacaaaaguuucu

SEQ ID NO: 1371701 - RNA, 11 nt, Homo sapiens
aaaacaucacu

SEQ ID NO: 1371702 - RNA, 13 nt, Homo sapiens
aaaacaucacuga

SEQ ID NO: 1371703 - RNA, 21 nt, Homo sapiens
aaaacauuguuuuguguaaca

SEQ ID NO: 1371704 - RNA, 20 nt, Homo sapiens
aaaaccaaauuuguauuuaa

SEQ ID NO: 1371705 - RNA, 23 nt, Homo sapiens
aaaaccaccaccaucaccagaca

SEQ ID NO: 1371706 - RNA, 17 nt, Homo sapiens
aaaaccacuagaacucu

SEQ ID NO: 1371707 - RNA, 13 nt, Homo sapiens
aaaaccacuguac

SEQ ID NO: 1371708 - RNA, 17 nt, Homo sapiens
aaaaccagcgugugacu

SEQ ID NO: 1371709 - RNA, 19 nt, Homo sapiens
aaaacccacaaaaguacaa

SEQ ID NO: 1371710 - RNA, 23 nt, Homo sapiens
aaaaccccaucucuacaaaaagc

SEQ ID NO: 1371711 - RNA, 18 nt, Homo sapiens
aaaaccugugugccauuu

SEQ ID NO: 1371712 - RNA, 13 nt, Homo sapiens
aaaaccuucccca

SEQ ID NO: 1371713 - RNA, 20 nt, Homo sapiens
aaaacuagaauuucauuuau

SEQ ID NO: 1371714 - RNA, 14 nt, Homo sapiens
aaaacuccaucuca

SEQ ID NO: 1371715 - RNA, 11 nt, Homo sapiens
aaaacucuccu

SEQ ID NO: 1371716 - RNA, 17 nt, Homo sapiens
aaagccuucauugccuu

SEQ ID NO: 1371717 - RNA, 18 nt, Homo sapiens
aaagcugauuacugucaa

SEQ ID NO: 1371718 - RNA, 13 nt, Homo sapiens
aaagcugcugaca

SEQ ID NO: 1371719 - RNA, 16 nt, Homo sapiens
aaagcuggcaauauua

SEQ ID NO: 1371720 - RNA, 13 nt, Homo sapiens
aaagcuuccccaa

SEQ ID NO: 1371721 - RNA, 14 nt, Homo sapiens
aaagcuuuccccca

SEQ ID NO: 1371722 - RNA, 21 nt, Homo sapiens
aaaggacaccuuuuaacucac

SEQ ID NO: 1371723 - RNA, 17 nt, Homo sapiens
aaaggagaacuauccaa

SEQ ID NO: 1371724 - RNA, 18 nt, Homo sapiens
aaaggagaacuauccaaa

SEQ ID NO: 1371725 - RNA, 16 nt, Homo sapiens
aaaggcuaaaagggaa

SEQ ID NO: 1371726 - RNA, 21 nt, Homo sapiens
aaaggcuagguacacagcucu

SEQ ID NO: 1371727 - RNA, 18 nt, Homo sapiens
aaagggauaguccaaaga

SEQ ID NO: 1371728 - RNA, 15 nt, Homo sapiens
aaagguggacuggaa

SEQ ID NO: 1371729 - RNA, 17 nt, Homo sapiens
aaaguauuccaccuuaa

SEQ ID NO: 1371730 - RNA, 16 nt, Homo sapiens
aaagucaaaaggugcc

SEQ ID NO: 1371731 - RNA, 14 nt, Homo sapiens
aaagucaaucuuau

SEQ ID NO: 1371732 - RNA, 23 nt, Homo sapiens
aaagucuuugaagugacuucaca

SEQ ID NO: 1371733 - RNA, 19 nt, Homo sapiens
aaagugagacuccgucaca

SEQ ID NO: 1371734 - RNA, 12 nt, Homo sapiens
aaagugcugcug

SEQ ID NO: 1371735 - RNA, 15 nt, Homo sapiens
aaaguuaaccuaccu

SEQ ID NO: 1371736 - RNA, 14 nt, Homo sapiens
aaaguuucagagaa

SEQ ID NO: 1371737 - RNA, 23 nt, Homo sapiens
aaaguuuuaugagaaaugccagu

SEQ ID NO: 1371738 - RNA, 23 nt, Homo sapiens
aaauaaaaaucauucuacugaac

SEQ ID NO: 1371739 - RNA, 13 nt, Homo sapiens
aaauaaaaauucc

SEQ ID NO: 1371740 - RNA, 19 nt, Homo sapiens
aaauaaacacauagauuca

SEQ ID NO: 1371741 - RNA, 16 nt, Homo sapiens
aaauaaauagcuauau

SEQ ID NO: 1371742 - RNA, 15 nt, Homo sapiens
aaauaacaaauuaaa

SEQ ID NO: 1371743 - RNA, 14 nt, Homo sapiens
aaauaagucacuua

SEQ ID NO: 1371744 - RNA, 16 nt, Homo sapiens
aaauaauaaaucuggu

SEQ ID NO: 1371745 - RNA, 13 nt, Homo sapiens
aaauacuugccug

SEQ ID NO: 1371746 - RNA, 19 nt, Homo sapiens
aaauauacacacagcagua

SEQ ID NO: 1371747 - RNA, 16 nt, Homo sapiens
aaauauaguucacaau

SEQ ID NO: 1371748 - RNA, 14 nt, Homo sapiens
aaauauauaugugu

SEQ ID NO: 1371749 - RNA, 11 nt, Homo sapiens
aaauauguaac

SEQ ID NO: 1371750 - RNA, 21 nt, Homo sapiens
aaauauguccauaucuaacca

SEQ ID NO: 1371751 - RNA, 23 nt, Homo sapiens
aaauauuaugcaaauucccagau

SEQ ID NO: 1371752 - RNA, 19 nt, Homo sapiens
aaauauuguugaacacuug

SEQ ID NO: 1371753 - RNA, 23 nt, Homo sapiens
aaauauuuaugagaaaguucuca

SEQ ID NO: 1371754 - RNA, 15 nt, Homo sapiens
aaauauuucccucac

SEQ ID NO: 1371755 - RNA, 15 nt, Homo sapiens
aaaucaauaaauucc

SEQ ID NO: 1371756 - RNA, 13 nt, Homo sapiens
aaaucacucucag

SEQ ID NO: 1371757 - RNA, 20 nt, Homo sapiens
aaaucaucucucaucacuuu

SEQ ID NO: 1371758 - RNA, 10 nt, Homo sapiens
aaauccacua

SEQ ID NO: 1371759 - RNA, 18 nt, Homo sapiens
aaauccgggucaagugaa

SEQ ID NO: 1371760 - RNA, 17 nt, Homo sapiens
aaauccugagcaaacaa

SEQ ID NO: 1371761 - RNA, 23 nt, Homo sapiens
aaaucggaucuggggcucuggga

SEQ ID NO: 1371762 - RNA, 16 nt, Homo sapiens
aaaucuagaagacugu

SEQ ID NO: 1371763 - RNA, 22 nt, Homo sapiens
aaaucuguucaaggaaucauug

SEQ ID NO: 1371764 - RNA, 15 nt, Homo sapiens
aaaugaaagcaugug

SEQ ID NO: 1371765 - RNA, 14 nt, Homo sapiens
aaaugagaacauga

SEQ ID NO: 1371766 - RNA, 11 nt, Homo sapiens
aaaugcaacuu

SEQ ID NO: 1371767 - RNA, 14 nt, Homo sapiens
aaaugcagugaauu

SEQ ID NO: 1371768 - RNA, 18 nt, Homo sapiens
aaaugcauccauuccuca

SEQ ID NO: 1371769 - RNA, 21 nt, Homo sapiens
aaaugcccaucuaugucccuu

SEQ ID NO: 1371770 - RNA, 22 nt, Homo sapiens
aaccuccccggcucaagugauc

SEQ ID NO: 1371771 - RNA, 20 nt, Homo sapiens
aaccugggagguggagguug

SEQ ID NO: 1371772 - RNA, 20 nt, Homo sapiens
aaccuggguaacuagggaag

SEQ ID NO: 1371773 - RNA, 17 nt, Homo sapiens
aaccuggugcuggauau

SEQ ID NO: 1371774 - RNA, 23 nt, Homo sapiens
aaccuguaaagcaggugcccagg

SEQ ID NO: 1371775 - RNA, 17 nt, Homo sapiens
aaccugugaucaagcaa

SEQ ID NO: 1371776 - RNA, 12 nt, Homo sapiens
aaccugugauga

SEQ ID NO: 1371777 - RNA, 14 nt, Homo sapiens
aaccugugugccau

SEQ ID NO: 1371778 - RNA, 17 nt, Homo sapiens
aaccuuaaacuuucaau

SEQ ID NO: 1371779 - RNA, 18 nt, Homo sapiens
aacgaacuuuccauggga

SEQ ID NO: 1371780 - RNA, 12 nt, Homo sapiens
aacgcacaaaac

SEQ ID NO: 1371781 - RNA, 18 nt, Homo sapiens
aacggcccaccaaggaca

SEQ ID NO: 1371782 - RNA, 14 nt, Homo sapiens
aacguaaauacaca

SEQ ID NO: 1371783 - RNA, 21 nt, Homo sapiens
aacguggggcagcacagagag

SEQ ID NO: 1371784 - RNA, 22 nt, Homo sapiens
aacuaaagccaaggguauccaa

SEQ ID NO: 1371785 - RNA, 21 nt, Homo sapiens
aacuaaaguuagaaaguugau

SEQ ID NO: 1371786 - RNA, 16 nt, Homo sapiens
aacuaacaaccaaaga

SEQ ID NO: 1371787 - RNA, 17 nt, Homo sapiens
aacuaacaaccaaagac

SEQ ID NO: 1371788 - RNA, 19 nt, Homo sapiens
aacuaagcuaugugaaaua

SEQ ID NO: 1371789 - RNA, 22 nt, Homo sapiens
aacuaauaaaagcauaaaugca

SEQ ID NO: 1371790 - RNA, 15 nt, Homo sapiens
aacuacaaacacaag

SEQ ID NO: 1371791 - RNA, 16 nt, Homo sapiens
aacuacaaacacaagc

SEQ ID NO: 1371792 - RNA, 17 nt, Homo sapiens
aacuaccuccucagucu

SEQ ID NO: 1371793 - RNA, 17 nt, Homo sapiens
aacuagaauuuauucaa

SEQ ID NO: 1371794 - RNA, 18 nt, Homo sapiens
aacuagaauuucauuuau

SEQ ID NO: 1371795 - RNA, 18 nt, Homo sapiens
aacuagcuuggaaacugg

SEQ ID NO: 1371796 - RNA, 18 nt, Homo sapiens
aacuagguuuuaauaauu

SEQ ID NO: 1371797 - RNA, 14 nt, Homo sapiens
aacuauauucucag

SEQ ID NO: 1371798 - RNA, 17 nt, Homo sapiens
aacuauuguauaauggg

SEQ ID NO: 1371799 - RNA, 20 nt, Homo sapiens
aacucaauauuuuccaugaa

SEQ ID NO: 1371800 - RNA, 16 nt, Homo sapiens
aacucagaaacaucag

SEQ ID NO: 1371801 - RNA, 16 nt, Homo sapiens
aacucaggacuccagc

SEQ ID NO: 1371802 - RNA, 17 nt, Homo sapiens
aacucauuccugccugu

SEQ ID NO: 1371803 - RNA, 23 nt, Homo sapiens
aacuccuuguuucagaugauucu

SEQ ID NO: 1371804 - RNA, 20 nt, Homo sapiens
aacucuacccuggcacuaua

SEQ ID NO: 1371805 - RNA, 19 nt, Homo sapiens
aacucuccuacacuuccau

SEQ ID NO: 1371806 - RNA, 13 nt, Homo sapiens
aacucuccuccau

SEQ ID NO: 1371807 - RNA, 13 nt, Homo sapiens
aacucugauguaa

SEQ ID NO: 1371808 - RNA, 16 nt, Homo sapiens
aacucugccagccaca

SEQ ID NO: 1371809 - RNA, 17 nt, Homo sapiens
aacucugggcugccaug

SEQ ID NO: 1371810 - RNA, 17 nt, Homo sapiens
aacugaaaacaagccau

SEQ ID NO: 1371811 - RNA, 20 nt, Homo sapiens
aacugaccagccuccaugcu

SEQ ID NO: 1371812 - RNA, 15 nt, Homo sapiens
aacugcauggaccua

SEQ ID NO: 1371813 - RNA, 21 nt, Homo sapiens
aacugcauggaccuaacauuc

SEQ ID NO: 1371814 - RNA, 16 nt, Homo sapiens
aacugcugaugcucau

SEQ ID NO: 1371815 - RNA, 16 nt, Homo sapiens
aacuggaugaggucau

SEQ ID NO: 1371816 - RNA, 14 nt, Homo sapiens
aacuggcaucugac

SEQ ID NO: 1371817 - RNA, 16 nt, Homo sapiens
aacugggcaugguagu

SEQ ID NO: 1371818 - RNA, 16 nt, Homo sapiens
aacuguagucucagga

SEQ ID NO: 1371819 - RNA, 14 nt, Homo sapiens
aacuguaugaaugu

SEQ ID NO: 1371820 - RNA, 22 nt, Homo sapiens
aacuguguaacugcccaaagca

SEQ ID NO: 1371821 - RNA, 18 nt, Homo sapiens
aacuguguauguacauau

SEQ ID NO: 1371822 - RNA, 17 nt, Homo sapiens
aacuuaaaaaaaugaca

SEQ ID NO: 1371823 - RNA, 16 nt, Homo sapiens
aacuuaauaguauuua

SEQ ID NO: 1371824 - RNA, 16 nt, Homo sapiens
aacuuaggcaugcaca

SEQ ID NO: 1371825 - RNA, 14 nt, Homo sapiens
aacuucagacugaa

SEQ ID NO: 1371826 - RNA, 13 nt, Homo sapiens
aacuucauuugau

SEQ ID NO: 1371827 - RNA, 12 nt, Homo sapiens
aacuuccaguca

SEQ ID NO: 1371828 - RNA, 21 nt, Homo sapiens
aacuuccagugcaacacugaa

SEQ ID NO: 1371829 - RNA, 21 nt, Homo sapiens
aacuucuccccauuuccccca

SEQ ID NO: 1371830 - RNA, 18 nt, Homo sapiens
cuggcucccagggccaug

SEQ ID NO: 1371831 - RNA, 20 nt, Homo sapiens
cuggcucccagggccaugaa

SEQ ID NO: 1371832 - RNA, 13 nt, Homo sapiens
cuggcugggcaug

SEQ ID NO: 1371833 - RNA, 18 nt, Homo sapiens
cuggcuggggccuguuga

SEQ ID NO: 1371834 - RNA, 20 nt, Homo sapiens
cuggcuucacagauguguga

SEQ ID NO: 1371835 - RNA, 15 nt, Homo sapiens
cuggcuucagccucc

SEQ ID NO: 1371836 - RNA, 23 nt, Homo sapiens
cuggcuuugcccaaccucagcaa

SEQ ID NO: 1371837 - RNA, 16 nt, Homo sapiens
cugggaacuuccucag

SEQ ID NO: 1371838 - RNA, 15 nt, Homo sapiens
cugggagaaccucag

SEQ ID NO: 1371839 - RNA, 16 nt, Homo sapiens
cugggagaaccucagg

SEQ ID NO: 1371840 - RNA, 21 nt, Homo sapiens
cugggauguuuugagggucuu

SEQ ID NO: 1371841 - RNA, 18 nt, Homo sapiens
cugggauuacagguguga

SEQ ID NO: 1371842 - RNA, 14 nt, Homo sapiens
cugggcaacacagc

SEQ ID NO: 1371843 - RNA, 19 nt, Homo sapiens
cugggcaacacagcgagac

SEQ ID NO: 1371844 - RNA, 14 nt, Homo sapiens
cugggcagcauagc

SEQ ID NO: 1371845 - RNA, 20 nt, Homo sapiens
cugggccaaguuccucuagu

SEQ ID NO: 1371846 - RNA, 22 nt, Homo sapiens
cugggccaaguuccucuagugc

SEQ ID NO: 1371847 - RNA, 13 nt, Homo sapiens
cugggcccagaag

SEQ ID NO: 1371848 - RNA, 14 nt, Homo sapiens
cugggccuucucac

SEQ ID NO: 1371849 - RNA, 12 nt, Homo sapiens
cugggcucucca

SEQ ID NO: 1371850 - RNA, 17 nt, Homo sapiens
cuggggaacuagaggga

SEQ ID NO: 1371851 - RNA, 19 nt, Homo sapiens
cuggggaagcugugaaaga

SEQ ID NO: 1371852 - RNA, 12 nt, Homo sapiens
cugggggccaug

SEQ ID NO: 1371853 - RNA, 14 nt, Homo sapiens
cugggggccaugag

SEQ ID NO: 1371854 - RNA, 20 nt, Homo sapiens
cugggugaguggggagacac

SEQ ID NO: 1371855 - RNA, 20 nt, Homo sapiens
cuggguucccuuuccuucca

SEQ ID NO: 1371856 - RNA, 15 nt, Homo sapiens
cugguaggaauagca

SEQ ID NO: 1371857 - RNA, 15 nt, Homo sapiens
cugguauguguggau

SEQ ID NO: 1371858 - RNA, 14 nt, Homo sapiens
cuggucuucaauua

SEQ ID NO: 1371859 - RNA, 22 nt, Homo sapiens
cuggugaggagcacagcucagg

SEQ ID NO: 1371860 - RNA, 18 nt, Homo sapiens
cuggugcagucauuauga

SEQ ID NO: 1371861 - RNA, 17 nt, Homo sapiens
cugguuagguagaggga

SEQ ID NO: 1371862 - RNA, 18 nt, Homo sapiens
cugguuccggcucugcac

SEQ ID NO: 1371863 - RNA, 21 nt, Homo sapiens
cugguugguguugcagaaggu

SEQ ID NO: 1371864 - RNA, 15 nt, Homo sapiens
cuguaacaugcaauu

SEQ ID NO: 1371865 - RNA, 16 nt, Homo sapiens
cuguaaggcauuuuca

SEQ ID NO: 1371866 - RNA, 23 nt, Homo sapiens
cuguaaucccagcacuuugggag

SEQ ID NO: 1371867 - RNA, 21 nt, Homo sapiens
cuguaaucccagcuacuuggg

SEQ ID NO: 1371868 - RNA, 18 nt, Homo sapiens
cuguagacuagugccgua

SEQ ID NO: 1371869 - RNA, 18 nt, Homo sapiens
cuguagguucaugcccaa

SEQ ID NO: 1371870 - RNA, 19 nt, Homo sapiens
cuguagucccagcuacucg

SEQ ID NO: 1371871 - RNA, 18 nt, Homo sapiens
cuguaucggagacaguga

SEQ ID NO: 1371872 - RNA, 13 nt, Homo sapiens
cuguaucugugua

SEQ ID NO: 1371873 - RNA, 19 nt, Homo sapiens
cuguaucuuguuuuuccac

SEQ ID NO: 1371874 - RNA, 17 nt, Homo sapiens
cuguaugccaagugaaa

SEQ ID NO: 1371875 - RNA, 16 nt, Homo sapiens
cuguauuacauaaaua

SEQ ID NO: 1371876 - RNA, 17 nt, Homo sapiens
cuguauuagucacagag

SEQ ID NO: 1371877 - RNA, 21 nt, Homo sapiens
cuguauucccaguuacuuggg

SEQ ID NO: 1371878 - RNA, 18 nt, Homo sapiens
cugucagcuuccaaacau

SEQ ID NO: 1371879 - RNA, 15 nt, Homo sapiens
cugucaucagccugu

SEQ ID NO: 1371880 - RNA, 12 nt, Homo sapiens
cuguccaaagac

SEQ ID NO: 1371881 - RNA, 12 nt, Homo sapiens
cuguccagagag

SEQ ID NO: 1371882 - RNA, 15 nt, Homo sapiens
cuguccccacacuga

SEQ ID NO: 1371883 - RNA, 16 nt, Homo sapiens
cuguccccacacugac

SEQ ID NO: 1371884 - RNA, 23 nt, Homo sapiens
cugucccccugagaucagagucc

SEQ ID NO: 1371885 - RNA, 20 nt, Homo sapiens
cuguccugaccugucucacc

SEQ ID NO: 1371886 - RNA, 20 nt, Homo sapiens
cugucgcaugagaacauuaa

SEQ ID NO: 1371887 - RNA, 22 nt, Homo sapiens
cugucgcaugagaacauuaaca

SEQ ID NO: 1371888 - RNA, 14 nt, Homo sapiens
cugucgcccagucu

SEQ ID NO: 1371889 - RNA, 14 nt, Homo sapiens
cugucgcccagugc

SEQ ID NO: 1371890 - RNA, 20 nt, Homo sapiens
cugucucaaaccuccaaaag

SEQ ID NO: 1371891 - RNA, 20 nt, Homo sapiens
cugucuuccaaggagaccaa

SEQ ID NO: 1371892 - RNA, 14 nt, Homo sapiens
cugucuucucaggc

SEQ ID NO: 1371893 - RNA, 14 nt, Homo sapiens
cugucuuucacuga

SEQ ID NO: 1371894 - RNA, 21 nt, Homo sapiens
cugugaaaugcuggcauuugc

SEQ ID NO: 1371895 - RNA, 15 nt, Homo sapiens
cugugagcagggauu

SEQ ID NO: 1371896 - RNA, 14 nt, Homo sapiens
cugugaucaagcaa

SEQ ID NO: 1371897 - RNA, 19 nt, Homo sapiens
cugugaucaagcaauaaua

SEQ ID NO: 1371898 - RNA, 21 nt, Homo sapiens
cugugauucccuccugcuacu

SEQ ID NO: 1371899 - RNA, 12 nt, Homo sapiens
cugugcaaguca

SEQ ID NO: 1371900 - RNA, 14 nt, Homo sapiens
cugugcccucagau

SEQ ID NO: 1371901 - RNA, 16 nt, Homo sapiens
cugugccuaucaccuc

SEQ ID NO: 1371902 - RNA, 16 nt, Homo sapiens
cuguggcaucuuugcc

SEQ ID NO: 1371903 - RNA, 15 nt, Homo sapiens
cuguggcucacguga

SEQ ID NO: 1371904 - RNA, 13 nt, Homo sapiens
cugugguggagaa

SEQ ID NO: 1371905 - RNA, 21 nt, Homo sapiens
cuguguacagaauucugcuac

SEQ ID NO: 1371906 - RNA, 22 nt, Homo sapiens
cuguguacagaauucugcuacc

SEQ ID NO: 1371907 - RNA, 20 nt, Homo sapiens
cugugucagggaacauauuu

SEQ ID NO: 1371908 - RNA, 14 nt, Homo sapiens
cuguguccaacucc

SEQ ID NO: 1371909 - RNA, 13 nt, Homo sapiens
cugugugacauca

SEQ ID NO: 1371910 - RNA, 22 nt, Homo sapiens
cugugugcaagugugugcacau

SEQ ID NO: 1371911 - RNA, 12 nt, Homo sapiens
cugugugccauu

SEQ ID NO: 1371912 - RNA, 19 nt, Homo sapiens
cugugugggacuguacaca

SEQ ID NO: 1371913 - RNA, 16 nt, Homo sapiens
cuguguuccuggcaau

SEQ ID NO: 1371914 - RNA, 17 nt, Homo sapiens
cuguguuccuggcaaua

SEQ ID NO: 1371915 - RNA, 20 nt, Homo sapiens
cuguguuuuuccuccauaaa

SEQ ID NO: 1371916 - RNA, 17 nt, Homo sapiens
cuguucagcugguugag

SEQ ID NO: 1371917 - RNA, 19 nt, Homo sapiens
cuguucauuguaagcacuu

SEQ ID NO: 1371918 - RNA, 18 nt, Homo sapiens
cuguuccuucacauccug

SEQ ID NO: 1371919 - RNA, 13 nt, Homo sapiens
cuguugaagcucu

SEQ ID NO: 1371920 - RNA, 23 nt, Homo sapiens
cuguugagaugggggacugagag

SEQ ID NO: 1371921 - RNA, 20 nt, Homo sapiens
cuccaggaugaguuacuuga

SEQ ID NO: 1371922 - RNA, 21 nt, Homo sapiens
cuccaggaugaguuacuugaa

SEQ ID NO: 1371923 - RNA, 22 nt, Homo sapiens
cuccaggaugaguuacuugaaa

SEQ ID NO: 1371924 - RNA, 22 nt, Homo sapiens
cuccaucuuauuuucauguaua

SEQ ID NO: 1371925 - RNA, 19 nt, Homo sapiens
cuccaugcugagaacaaaa

SEQ ID NO: 1371926 - RNA, 15 nt, Homo sapiens
cuccauuguuuugcc

SEQ ID NO: 1371927 - RNA, 20 nt, Homo sapiens
cucccaggcuggagugcagu

SEQ ID NO: 1371928 - RNA, 13 nt, Homo sapiens
cucccagggccau

SEQ ID NO: 1371929 - RNA, 15 nt, Homo sapiens
cucccagggccauga

SEQ ID NO: 1371930 - RNA, 22 nt, Homo sapiens
cucccagggccuuaaaagccau

SEQ ID NO: 1371931 - RNA, 12 nt, Homo sapiens
cuccccaacagc

SEQ ID NO: 1371932 - RNA, 16 nt, Homo sapiens
cuccccacacuaaccu

SEQ ID NO: 1371933 - RNA, 21 nt, Homo sapiens
cuccccagccuuugaucaggu

SEQ ID NO: 1371934 - RNA, 17 nt, Homo sapiens
cuccccucagauuccac

SEQ ID NO: 1371935 - RNA, 17 nt, Homo sapiens
cuccccugcccuggucc

SEQ ID NO: 1371936 - RNA, 16 nt, Homo sapiens
cucccgggaagccacc

SEQ ID NO: 1371937 - RNA, 14 nt, Homo sapiens
cucccggggccccu

SEQ ID NO: 1371938 - RNA, 19 nt, Homo sapiens
cucccugaaguaagcaaag

SEQ ID NO: 1371939 - RNA, 14 nt, Homo sapiens
cucccuguccuccu

SEQ ID NO: 1371940 - RNA, 19 nt, Homo sapiens
cuccguggcaucaccuuag

SEQ ID NO: 1371941 - RNA, 16 nt, Homo sapiens
cuccuaccucugcucu

SEQ ID NO: 1371942 - RNA, 12 nt, Homo sapiens
cuccucaaaagc

SEQ ID NO: 1371943 - RNA, 21 nt, Homo sapiens
cuccucccaggaacugggcca

SEQ ID NO: 1371944 - RNA, 19 nt, Homo sapiens
cuccuccuugucuuggcag

SEQ ID NO: 1371945 - RNA, 22 nt, Homo sapiens
cuccucuguccaggcacugcug

SEQ ID NO: 1371946 - RNA, 19 nt, Homo sapiens
cuccugaggaucagaaagu

SEQ ID NO: 1371947 - RNA, 20 nt, Homo sapiens
cuccugaguaguugggauua

SEQ ID NO: 1371948 - RNA, 16 nt, Homo sapiens
cuccuggcccacugca

SEQ ID NO: 1371949 - RNA, 14 nt, Homo sapiens
cuccugugcaacuu

SEQ ID NO: 1371950 - RNA, 16 nt, Homo sapiens
cuccuuagagacauca

SEQ ID NO: 1371951 - RNA, 15 nt, Homo sapiens
cuccuuccaccacaa

SEQ ID NO: 1371952 - RNA, 21 nt, Homo sapiens
cuccuugcccuagaugagccc

SEQ ID NO: 1371953 - RNA, 19 nt, Homo sapiens
cuccuugggaggccccacu

SEQ ID NO: 1371954 - RNA, 22 nt, Homo sapiens
cuccuugggaggccccacuggg

SEQ ID NO: 1371955 - RNA, 16 nt, Homo sapiens
cucgagcaguccugcc

SEQ ID NO: 1371956 - RNA, 20 nt, Homo sapiens
cucgggcgagucacugccuc

SEQ ID NO: 1371957 - RNA, 19 nt, Homo sapiens
cucuaaaaugaguuaccua

SEQ ID NO: 1371958 - RNA, 13 nt, Homo sapiens
cucuaacugaugu

SEQ ID NO: 1371959 - RNA, 13 nt, Homo sapiens
cucuacaaaaagc

SEQ ID NO: 1371960 - RNA, 14 nt, Homo sapiens
cucuacacugugaa

SEQ ID NO: 1371961 - RNA, 22 nt, Homo sapiens
cucuacccucuuagaaaaacca

SEQ ID NO: 1371962 - RNA, 20 nt, Homo sapiens
cucuacuaaaaauacaaaaa

SEQ ID NO: 1371963 - RNA, 16 nt, Homo sapiens
cucuacuuaaugagau

SEQ ID NO: 1371964 - RNA, 20 nt, Homo sapiens
cucuaugaaaauuauaucuc

SEQ ID NO: 1371965 - RNA, 20 nt, Homo sapiens
cucuauggguaucaaacagc

SEQ ID NO: 1371966 - RNA, 15 nt, Homo sapiens
cucuauuuagcauga

SEQ ID NO: 1371967 - RNA, 21 nt, Homo sapiens
cucuauuuguaauugaacuua

SEQ ID NO: 1371968 - RNA, 17 nt, Homo sapiens
cucucaauuucuggaaa

SEQ ID NO: 1371969 - RNA, 14 nt, Homo sapiens
cucucaccuccuaa

SEQ ID NO: 1371970 - RNA, 16 nt, Homo sapiens
cucucaccuccuaaag

SEQ ID NO: 1371971 - RNA, 17 nt, Homo sapiens
cucuccaacaucuucaa

SEQ ID NO: 1371972 - RNA, 18 nt, Homo sapiens
cucucccaggacccauca

SEQ ID NO: 1371973 - RNA, 17 nt, Homo sapiens
cucuccccagcaaguga

SEQ ID NO: 1371974 - RNA, 14 nt, Homo sapiens
cucuccucuugcca

SEQ ID NO: 1371975 - RNA, 22 nt, Homo sapiens
cucuccugauuauuuaucacau

SEQ ID NO: 1371976 - RNA, 15 nt, Homo sapiens
cucucuccacccuau

SEQ ID NO: 1371977 - RNA, 10 nt, Homo sapiens
cucucuccag

SEQ ID NO: 1371978 - RNA, 14 nt, Homo sapiens
cucucuccugucca

SEQ ID NO: 1371979 - RNA, 22 nt, Homo sapiens
cucugaagaguggguuucacaa

SEQ ID NO: 1371980 - RNA, 11 nt, Homo sapiens
cucugaaguca

SEQ ID NO: 1371981 - RNA, 12 nt, Homo sapiens
cucugaagucac

SEQ ID NO: 1371982 - RNA, 13 nt, Homo sapiens
cucugacucccaa

SEQ ID NO: 1371983 - RNA, 21 nt, Homo sapiens
cucugagcagugcuugaauga

SEQ ID NO: 1371984 - RNA, 23 nt, Homo sapiens
cucugaguaucuccucgcaagcu

SEQ ID NO: 1371985 - RNA, 19 nt, Homo sapiens
cucugagucccagagccaa

SEQ ID NO: 1371986 - RNA, 13 nt, Homo sapiens
cucugcacaagcu

SEQ ID NO: 1371987 - RNA, 20 nt, Homo sapiens
cucugcccaaacauaaagag

SEQ ID NO: 1371988 - RNA, 20 nt, Homo sapiens
cucugcccugcccuagcucc

SEQ ID NO: 1371989 - RNA, 17 nt, Homo sapiens
cucugccuccucuucaa

SEQ ID NO: 1371990 - RNA, 14 nt, Homo sapiens
cucugccugaaguc

SEQ ID NO: 1371991 - RNA, 14 nt, Homo sapiens
cucugcugaaggaa

SEQ ID NO: 1371992 - RNA, 12 nt, Homo sapiens
cucugcuugcau

SEQ ID NO: 1371993 - RNA, 19 nt, Homo sapiens
cucugcuugcauccccaac

SEQ ID NO: 1371994 - RNA, 16 nt, Homo sapiens
cucuggugacaccagc

SEQ ID NO: 1371995 - RNA, 22 nt, Homo sapiens
cucuuaagcuuccgccgucuca

SEQ ID NO: 1371996 - RNA, 16 nt, Homo sapiens
cucuuaggcaaucaca

SEQ ID NO: 1371997 - RNA, 18 nt, Homo sapiens
cucuuauagaaaguucaa

SEQ ID NO: 1371998 - RNA, 13 nt, Homo sapiens
cucuuaugcacac

SEQ ID NO: 1371999 - RNA, 14 nt, Homo sapiens
cucuuaugccauuu

SEQ ID NO: 1372000 - RNA, 23 nt, Homo sapiens
cucuucuccaccucccacaaagg

SEQ ID NO: 1372001 - RNA, 14 nt, Homo sapiens
cucuucuccacugg

SEQ ID NO: 1372002 - RNA, 17 nt, Homo sapiens
cucuucugggaacuucc

SEQ ID NO: 1372003 - RNA, 13 nt, Homo sapiens
cucuugaggccag

SEQ ID NO: 1372004 - RNA, 18 nt, Homo sapiens
cucuuguauaugaugauc

SEQ ID NO: 1372005 - RNA, 13 nt, Homo sapiens
cucuuguuauuau

SEQ ID NO: 1372006 - RNA, 15 nt, Homo sapiens
cugaaaacaagccau

SEQ ID NO: 1372007 - RNA, 16 nt, Homo sapiens
cugaaaacaagccaug

SEQ ID NO: 1372008 - RNA, 11 nt, Homo sapiens
cugaaaaccaa

SEQ ID NO: 1372009 - RNA, 22 nt, Homo sapiens
cugaaaagaucugaagguccca

SEQ ID NO: 1372010 - RNA, 19 nt, Homo sapiens
cugaaaagaugguaucaua

SEQ ID NO: 1372011 - RNA, 20 nt, Homo sapiens
cugaaaagaugguaucauau

SEQ ID NO: 1372012 - RNA, 16 nt, Homo sapiens
cugaaauauacacaca

SEQ ID NO: 1372013 - RNA, 21 nt, Homo sapiens
cugaaauauacacacagcagu

SEQ ID NO: 1372014 - RNA, 23 nt, Homo sapiens
cugaaauuuuaaugaagugcaau

SEQ ID NO: 1372015 - RNA, 23 nt, Homo sapiens
cugaaauuuuaauugaacuaaca

SEQ ID NO: 1372016 - RNA, 15 nt, Homo sapiens
cugaaccuuccaucu

SEQ ID NO: 1372017 - RNA, 16 nt, Homo sapiens
ccugcugccccagcug

SEQ ID NO: 1372018 - RNA, 17 nt, Homo sapiens
ccugcuugcaaauccac

SEQ ID NO: 1372019 - RNA, 20 nt, Homo sapiens
ccuggaaucaagaugucaga

SEQ ID NO: 1372020 - RNA, 17 nt, Homo sapiens
ccuggagccuccacugc

SEQ ID NO: 1372021 - RNA, 23 nt, Homo sapiens
ccuggaguacuuugaagauguca

SEQ ID NO: 1372022 - RNA, 15 nt, Homo sapiens
ccuggaugaaguuau

SEQ ID NO: 1372023 - RNA, 12 nt, Homo sapiens
ccuggcaagaau

SEQ ID NO: 1372024 - RNA, 20 nt, Homo sapiens
ccuggcagaacugagcuccu

SEQ ID NO: 1372025 - RNA, 14 nt, Homo sapiens
ccuggcauggcacc

SEQ ID NO: 1372026 - RNA, 17 nt, Homo sapiens
ccuggcccuggggccug

SEQ ID NO: 1372027 - RNA, 19 nt, Homo sapiens
ccugggagaaccucaggcu

SEQ ID NO: 1372028 - RNA, 18 nt, Homo sapiens
ccugggaggaaauuugaa

SEQ ID NO: 1372029 - RNA, 16 nt, Homo sapiens
ccugggcccuuccuau

SEQ ID NO: 1372030 - RNA, 14 nt, Homo sapiens
ccuggggugcccuc

SEQ ID NO: 1372031 - RNA, 17 nt, Homo sapiens
ccuggguaacuagggaa

SEQ ID NO: 1372032 - RNA, 22 nt, Homo sapiens
ccuggugggccuccucugucca

SEQ ID NO: 1372033 - RNA, 21 nt, Homo sapiens
ccugguuaaauuugaauuuca

SEQ ID NO: 1372034 - RNA, 15 nt, Homo sapiens
ccugguuugaagaaa

SEQ ID NO: 1372035 - RNA, 20 nt, Homo sapiens
ccuguaaucccagcuacucg

SEQ ID NO: 1372036 - RNA, 20 nt, Homo sapiens
ccuguaccccagcacuugug

SEQ ID NO: 1372037 - RNA, 22 nt, Homo sapiens
ccuguacuggagagcaacacag

SEQ ID NO: 1372038 - RNA, 15 nt, Homo sapiens
ccuguagucccagcu

SEQ ID NO: 1372039 - RNA, 17 nt, Homo sapiens
ccugucaaacaaagcca

SEQ ID NO: 1372040 - RNA, 17 nt, Homo sapiens
ccugucaauacuaugga

SEQ ID NO: 1372041 - RNA, 19 nt, Homo sapiens
ccuguccugaaagccacag

SEQ ID NO: 1372042 - RNA, 20 nt, Homo sapiens
ccugucuuccaaggagacca

SEQ ID NO: 1372043 - RNA, 14 nt, Homo sapiens
ccugugaccagcac

SEQ ID NO: 1372044 - RNA, 18 nt, Homo sapiens
ccugugcaacuuucccaa

SEQ ID NO: 1372045 - RNA, 19 nt, Homo sapiens
ccugugguuacagugcaga

SEQ ID NO: 1372046 - RNA, 22 nt, Homo sapiens
ccuguguaaaacuauauucuca

SEQ ID NO: 1372047 - RNA, 16 nt, Homo sapiens
ccuguuacacaugaca

SEQ ID NO: 1372048 - RNA, 22 nt, Homo sapiens
ccuguucugggugcagcugaga

SEQ ID NO: 1372049 - RNA, 12 nt, Homo sapiens
ccuguugcccuu

SEQ ID NO: 1372050 - RNA, 16 nt, Homo sapiens
ccuuaaacuccuguga

SEQ ID NO: 1372051 - RNA, 14 nt, Homo sapiens
ccuuaaacuuucaa

SEQ ID NO: 1372052 - RNA, 16 nt, Homo sapiens
ccuuauucuacauuuc

SEQ ID NO: 1372053 - RNA, 14 nt, Homo sapiens
ccuuauuguaccuc

SEQ ID NO: 1372054 - RNA, 16 nt, Homo sapiens
ccuuauuguaccucuc

SEQ ID NO: 1372055 - RNA, 21 nt, Homo sapiens
ccuuauuucucaucacaucau

SEQ ID NO: 1372056 - RNA, 15 nt, Homo sapiens
ccuucaaacuuccag

SEQ ID NO: 1372057 - RNA, 18 nt, Homo sapiens
ccuucacuucugaccaca

SEQ ID NO: 1372058 - RNA, 21 nt, Homo sapiens
ccuuccagcacccugcaaaau

SEQ ID NO: 1372059 - RNA, 20 nt, Homo sapiens
ccuuccccagccucuucuag

SEQ ID NO: 1372060 - RNA, 17 nt, Homo sapiens
ccuucguuaacugugua

SEQ ID NO: 1372061 - RNA, 13 nt, Homo sapiens
ccuucuaaucugc

SEQ ID NO: 1372062 - RNA, 13 nt, Homo sapiens
ccuucuacugcuu

SEQ ID NO: 1372063 - RNA, 12 nt, Homo sapiens
ccuucuccaaau

SEQ ID NO: 1372064 - RNA, 15 nt, Homo sapiens
ccuucuccaugcuga

SEQ ID NO: 1372065 - RNA, 16 nt, Homo sapiens
ccuucucccacacugc

SEQ ID NO: 1372066 - RNA, 20 nt, Homo sapiens
ccuucucugcuccaccacau

SEQ ID NO: 1372067 - RNA, 19 nt, Homo sapiens
ccuucuuuccauuucucuc

SEQ ID NO: 1372068 - RNA, 17 nt, Homo sapiens
ccuugaccagcagaucc

SEQ ID NO: 1372069 - RNA, 18 nt, Homo sapiens
ccuugagcuccccaaaaa

SEQ ID NO: 1372070 - RNA, 14 nt, Homo sapiens
ccuugaugcucaua

SEQ ID NO: 1372071 - RNA, 15 nt, Homo sapiens
ccuugccagacaugu

SEQ ID NO: 1372072 - RNA, 13 nt, Homo sapiens
ccuugcccagaga

SEQ ID NO: 1372073 - RNA, 17 nt, Homo sapiens
ccuuggcaugccuucca

SEQ ID NO: 1372074 - RNA, 21 nt, Homo sapiens
ccuuggcuaguaaaagccauc

SEQ ID NO: 1372075 - RNA, 15 nt, Homo sapiens
ccuuggcucaauccu

SEQ ID NO: 1372076 - RNA, 18 nt, Homo sapiens
ccuuuagagccagcccau

SEQ ID NO: 1372077 - RNA, 20 nt, Homo sapiens
ccuuuaggaagguauguguc

SEQ ID NO: 1372078 - RNA, 19 nt, Homo sapiens
ccuuuauuccuucauuuca

SEQ ID NO: 1372079 - RNA, 22 nt, Homo sapiens
ccuuuccaaaugcccagcuuaa

SEQ ID NO: 1372080 - RNA, 17 nt, Homo sapiens
ccuuucucuaaaacugc

SEQ ID NO: 1372081 - RNA, 14 nt, Homo sapiens
ccuuucuggcuuug

SEQ ID NO: 1372082 - RNA, 15 nt, Homo sapiens
ccuuucuuacauuag

SEQ ID NO: 1372083 - RNA, 22 nt, Homo sapiens
ccuuucuuucuaacuccaguga

SEQ ID NO: 1372084 - RNA, 16 nt, Homo sapiens
ccuuugaaaugaauau

SEQ ID NO: 1372085 - RNA, 18 nt, Homo sapiens
ccuuuguguauucaucuu

SEQ ID NO: 1372086 - RNA, 13 nt, Homo sapiens
ccuuuuacauacu

SEQ ID NO: 1372087 - RNA, 17 nt, Homo sapiens
ccuuuuacauacugcug

SEQ ID NO: 1372088 - RNA, 17 nt, Homo sapiens
ccuuuuauuucuuaaac

SEQ ID NO: 1372089 - RNA, 20 nt, Homo sapiens
ccuuuugacagcugugcugu

SEQ ID NO: 1372090 - RNA, 15 nt, Homo sapiens
ccuuuuuguuauuag

SEQ ID NO: 1372091 - RNA, 16 nt, Homo sapiens
ccuuuuuuguuauuau

SEQ ID NO: 1372092 - RNA, 16 nt, Homo sapiens
cgaaacuggaaguuau

SEQ ID NO: 1372093 - RNA, 20 nt, Homo sapiens
cgagacuugguuucaaaaaa

SEQ ID NO: 1372094 - RNA, 14 nt, Homo sapiens
cgagaucaagagau

SEQ ID NO: 1372095 - RNA, 19 nt, Homo sapiens
cgagaucacgccacugcac

SEQ ID NO: 1372096 - RNA, 22 nt, Homo sapiens
cgagcuaugaucgcgccacuac

SEQ ID NO: 1372097 - RNA, 14 nt, Homo sapiens
cgaggaaacucaga

SEQ ID NO: 1372098 - RNA, 16 nt, Homo sapiens
cgagggauguggagca

SEQ ID NO: 1372099 - RNA, 15 nt, Homo sapiens
cgagucacacucaag

SEQ ID NO: 1372100 - RNA, 17 nt, Homo sapiens
cgaguuguuggcugcuc

SEQ ID NO: 1372101 - RNA, 16 nt, Homo sapiens
cgaguuuuaaacuggu

SEQ ID NO: 1372102 - RNA, 18 nt, Homo sapiens
cgaucauggcucacugca

SEQ ID NO: 1372103 - RNA, 18 nt, Homo sapiens
cgaucuggguucacugca

SEQ ID NO: 1372104 - RNA, 18 nt, Homo sapiens
cgauuaauaacaggcaaa

SEQ ID NO: 1372105 - RNA, 17 nt, Homo sapiens
cgcacaaggcugaccaa

SEQ ID NO: 1372106 - RNA, 21 nt, Homo sapiens
cgcacaaggcugaccaagaga

SEQ ID NO: 1372107 - RNA, 18 nt, Homo sapiens
cgcagauguccuugaugc

SEQ ID NO: 1372108 - RNA, 22 nt, Homo sapiens
cgcagcuguaaggcacgcugga

SEQ ID NO: 1372109 - RNA, 16 nt, Homo sapiens
cgcaucaggccuggca

SEQ ID NO: 1372110 - RNA, 20 nt, Homo sapiens
cgcaucccagacuugcugaa

SEQ ID NO: 1372111 - RNA, 20 nt, Homo sapiens
cgcaugcccucaaucccagc

SEQ ID NO: 1372112 - RNA, 13 nt, Homo sapiens
cgcauucccugag

SEQ ID NO: 1372113 - RNA, 20 nt, Homo sapiens
cgccaccccuccuuccuuga

SEQ ID NO: 1372114 - RNA, 14 nt, Homo sapiens
cgccuuacuggcaa

SEQ ID NO: 1372115 - RNA, 18 nt, Homo sapiens
cagcgagacuccgucuca

SEQ ID NO: 1372116 - RNA, 16 nt, Homo sapiens
cagcgagcccuggugg

SEQ ID NO: 1372117 - RNA, 21 nt, Homo sapiens
cagcuaccucuucuauggacu

SEQ ID NO: 1372118 - RNA, 24 nt, Homo sapiens
cagcuacuccggaggcugaggcag

SEQ ID NO: 1372119 - RNA, 23 nt, Homo sapiens
cagcuauuuucaacauaacugaa

SEQ ID NO: 1372120 - RNA, 11 nt, Homo sapiens
cagcucaaagg

SEQ ID NO: 1372121 - RNA, 18 nt, Homo sapiens
cagcucagcagugacugu

SEQ ID NO: 1372122 - RNA, 18 nt, Homo sapiens
cagcucaggaacuagacu

SEQ ID NO: 1372123 - RNA, 15 nt, Homo sapiens
cagcuccagggccag

SEQ ID NO: 1372124 - RNA, 18 nt, Homo sapiens
cagcucuccccuucucug

SEQ ID NO: 1372125 - RNA, 20 nt, Homo sapiens
cagcucugaggacugcacca

SEQ ID NO: 1372126 - RNA, 11 nt, Homo sapiens
cagcucugcaa

SEQ ID NO: 1372127 - RNA, 18 nt, Homo sapiens
cagcucuguguugccaug

SEQ ID NO: 1372128 - RNA, 22 nt, Homo sapiens
cagcugaacaguguuggcuuuc

SEQ ID NO: 1372129 - RNA, 19 nt, Homo sapiens
cagcugaagaacaucucga

SEQ ID NO: 1372130 - RNA, 14 nt, Homo sapiens
cagcugcaccugcc

SEQ ID NO: 1372131 - RNA, 16 nt, Homo sapiens
cagcugcaucuacuca

SEQ ID NO: 1372132 - RNA, 14 nt, Homo sapiens
cagcugccagagaa

SEQ ID NO: 1372133 - RNA, 14 nt, Homo sapiens
cagcuggcacuguc

SEQ ID NO: 1372134 - RNA, 16 nt, Homo sapiens
cagcugggaucugacu

SEQ ID NO: 1372135 - RNA, 19 nt, Homo sapiens
cagcugggaucugacugca

SEQ ID NO: 1372136 - RNA, 13 nt, Homo sapiens
cagcugugcugua

SEQ ID NO: 1372137 - RNA, 17 nt, Homo sapiens
cagcugugcuguaacac

SEQ ID NO: 1372138 - RNA, 19 nt, Homo sapiens
cagcuuguaaauagcucag

SEQ ID NO: 1372139 - RNA, 19 nt, Homo sapiens
cagcuuugcuaccaaagca

SEQ ID NO: 1372140 - RNA, 23 nt, Homo sapiens
cagcuuuuaguacccaccugagc

SEQ ID NO: 1372141 - RNA, 20 nt, Homo sapiens
ccgagcugggggccaugagc

SEQ ID NO: 1372142 - RNA, 23 nt, Homo sapiens
ccgagcugggggccaugagcucc

SEQ ID NO: 1372143 - RNA, 22 nt, Homo sapiens
ccgagcuuugaaaauucagugg

SEQ ID NO: 1372144 - RNA, 19 nt, Homo sapiens
ccgcaccaauaaagccuuc

SEQ ID NO: 1372145 - RNA, 19 nt, Homo sapiens
ccgcaugcagcagcuugcu

SEQ ID NO: 1372146 - RNA, 18 nt, Homo sapiens
ccgcauuuggauuggaug

SEQ ID NO: 1372147 - RNA, 21 nt, Homo sapiens
ccgcugcauccgugagcagug

SEQ ID NO: 1372148 - RNA, 16 nt, Homo sapiens
ccggacagagcacguu

SEQ ID NO: 1372149 - RNA, 13 nt, Homo sapiens
ccggccauucucc

SEQ ID NO: 1372150 - RNA, 12 nt, Homo sapiens
ccggcugcgugg

SEQ ID NO: 1372151 - RNA, 22 nt, Homo sapiens
ccgggaagccacccucccagcu

SEQ ID NO: 1372152 - RNA, 14 nt, Homo sapiens
ccgggcaagacuuu

SEQ ID NO: 1372153 - RNA, 20 nt, Homo sapiens
ccgggcugggagcucugcag

SEQ ID NO: 1372154 - RNA, 12 nt, Homo sapiens
ccguacauucaa

SEQ ID NO: 1372155 - RNA, 16 nt, Homo sapiens
ccgucuguacuaaaaa

SEQ ID NO: 1372156 - RNA, 19 nt, Homo sapiens
ccgugaggaugucacucag

SEQ ID NO: 1372157 - RNA, 21 nt, Homo sapiens
ccgugagugaaccaucauuau

SEQ ID NO: 1372158 - RNA, 14 nt, Homo sapiens
ccuaaaaacacaga

SEQ ID NO: 1372159 - RNA, 17 nt, Homo sapiens
ccuaaaaguucauaaca

SEQ ID NO: 1372160 - RNA, 16 nt, Homo sapiens
ccuaagacgucccuuu

SEQ ID NO: 1372161 - RNA, 23 nt, Homo sapiens
ccuaagccaugggagacacugau

SEQ ID NO: 1372162 - RNA, 18 nt, Homo sapiens
ccuaaugaaugcauaaaa

SEQ ID NO: 1372163 - RNA, 19 nt, Homo sapiens
ccuacagaauacuagccag

SEQ ID NO: 1372164 - RNA, 23 nt, Homo sapiens
ccuacaguugaaaaacagcugag

SEQ ID NO: 1372165 - RNA, 16 nt, Homo sapiens
ccuacuacaugcaagg

SEQ ID NO: 1372166 - RNA, 15 nt, Homo sapiens
ccuacugaaugcucu

SEQ ID NO: 1372167 - RNA, 19 nt, Homo sapiens
ccuacuuccugcacugacc

SEQ ID NO: 1372168 - RNA, 13 nt, Homo sapiens
ccuagaggugcuc

SEQ ID NO: 1372169 - RNA, 16 nt, Homo sapiens
ccuagauucuacauau

SEQ ID NO: 1372170 - RNA, 19 nt, Homo sapiens
ccuagcaccuggcuaguuu

SEQ ID NO: 1372171 - RNA, 20 nt, Homo sapiens
ccuagcacuuugggaggcca

SEQ ID NO: 1372172 - RNA, 19 nt, Homo sapiens
ccuagccucgcucuuggca

SEQ ID NO: 1372173 - RNA, 21 nt, Homo sapiens
ccuagccuuagaagucacaca

SEQ ID NO: 1372174 - RNA, 17 nt, Homo sapiens
ccuagcuccacacccuc

SEQ ID NO: 1372175 - RNA, 20 nt, Homo sapiens
ccuaggauuucaugauuuca

SEQ ID NO: 1372176 - RNA, 20 nt, Homo sapiens
ccuagucuuuuaaacaguuu

SEQ ID NO: 1372177 - RNA, 15 nt, Homo sapiens
ccuaguucuucaucc

SEQ ID NO: 1372178 - RNA, 23 nt, Homo sapiens
ccuaguuugugagaaacaucuca

SEQ ID NO: 1372179 - RNA, 18 nt, Homo sapiens
ccuauagccaccccaaga

SEQ ID NO: 1372180 - RNA, 11 nt, Homo sapiens
ccuaucaccuc

SEQ ID NO: 1372181 - RNA, 15 nt, Homo sapiens
ccuaucccaucccau

SEQ ID NO: 1372182 - RNA, 14 nt, Homo sapiens
ccucaaaaugacag

SEQ ID NO: 1372183 - RNA, 17 nt, Homo sapiens
ccucaaagcacacguca

SEQ ID NO: 1372184 - RNA, 19 nt, Homo sapiens
ccucaaagcuuccauucca

SEQ ID NO: 1372185 - RNA, 17 nt, Homo sapiens
ccucaaaugcaguauuu

SEQ ID NO: 1372186 - RNA, 23 nt, Homo sapiens
ccucaaauuuaaaggcuaccuua

SEQ ID NO: 1372187 - RNA, 16 nt, Homo sapiens
ccucaauucauauuua

SEQ ID NO: 1372188 - RNA, 23 nt, Homo sapiens
ccucacagagugcauugugaggg

SEQ ID NO: 1372189 - RNA, 21 nt, Homo sapiens
ccucacaggagcuuacuggca

SEQ ID NO: 1372190 - RNA, 15 nt, Homo sapiens
ccucaccccacugug

SEQ ID NO: 1372191 - RNA, 14 nt, Homo sapiens
ccucacucagucca

SEQ ID NO: 1372192 - RNA, 18 nt, Homo sapiens
ccucacugaaaauuacag

SEQ ID NO: 1372193 - RNA, 17 nt, Homo sapiens
ccucagaauugaucauu

SEQ ID NO: 1372194 - RNA, 21 nt, Homo sapiens
ccucagauuccgcaccaauaa

SEQ ID NO: 1372195 - RNA, 20 nt, Homo sapiens
ccucagcugccucacuuccu

SEQ ID NO: 1372196 - RNA, 14 nt, Homo sapiens
ccucaggcaggugg

SEQ ID NO: 1372197 - RNA, 19 nt, Homo sapiens
ccucaggccaggugcagug

SEQ ID NO: 1372198 - RNA, 16 nt, Homo sapiens
ccucaggugcuaggga

SEQ ID NO: 1372199 - RNA, 20 nt, Homo sapiens
ccucaguuuuaucauuuuca

SEQ ID NO: 1372200 - RNA, 20 nt, Homo sapiens
ccucauuaccuugugcuaau

SEQ ID NO: 1372201 - RNA, 17 nt, Homo sapiens
ccucauuuaucccucaa

SEQ ID NO: 1372202 - RNA, 19 nt, Homo sapiens
ccucauuugggguagcuag

SEQ ID NO: 1372203 - RNA, 14 nt, Homo sapiens
ccuccaaaagcccu

SEQ ID NO: 1372204 - RNA, 19 nt, Homo sapiens
ccuccacugccucuggaau

SEQ ID NO: 1372205 - RNA, 11 nt, Homo sapiens
ccuccauuccu

SEQ ID NO: 1372206 - RNA, 12 nt, Homo sapiens
ccuccauucuga

SEQ ID NO: 1372207 - RNA, 22 nt, Homo sapiens
ccuccauuugcaauugaccucu

SEQ ID NO: 1372208 - RNA, 20 nt, Homo sapiens
ccucccaaaguguugggauu

SEQ ID NO: 1372209 - RNA, 20 nt, Homo sapiens
ccucccuucuacugcuucua

SEQ ID NO: 1372210 - RNA, 13 nt, Homo sapiens
ccuccguccagcc

SEQ ID NO: 1372211 - RNA, 23 nt, Homo sapiens
ccuccuccagccgccaugcuccu

SEQ ID NO: 1372212 - RNA, 18 nt, Homo sapiens
ccuccuuacauaugcaaa

SEQ ID NO: 1372213 - RNA, 21 nt, Homo sapiens
ccuccuuacauaugcaaaaau

SEQ ID NO: 1372214 - RNA, 14 nt, Homo sapiens
ccuccuucgggaca

SEQ ID NO: 1372215 - RNA, 15 nt, Homo sapiens
ccucgcccuccacaa

SEQ ID NO: 1372216 - RNA, 16 nt, Homo sapiens
ccucgcccuccacaaa

SEQ ID NO: 1372217 - RNA, 13 nt, Homo sapiens
ccucgggacauca

SEQ ID NO: 1372218 - RNA, 21 nt, Homo sapiens
ccucgggcgagucacugccuc

SEQ ID NO: 1372219 - RNA, 21 nt, Homo sapiens
ccucgugguggaaacuuuucu

SEQ ID NO: 1372220 - RNA, 17 nt, Homo sapiens
ccucuaacaacaaauua

SEQ ID NO: 1372221 - RNA, 18 nt, Homo sapiens
ccucuacuuaaugagaua

SEQ ID NO: 1372222 - RNA, 20 nt, Homo sapiens
ccucuccaggaaugccuccu

SEQ ID NO: 1372223 - RNA, 17 nt, Homo sapiens
ccucuccuuugugacuu

SEQ ID NO: 1372224 - RNA, 16 nt, Homo sapiens
ccucucucccuggacc

SEQ ID NO: 1372225 - RNA, 14 nt, Homo sapiens
ccucugaaaaccaa

SEQ ID NO: 1372226 - RNA, 19 nt, Homo sapiens
ccucugacccuagcucuuu

SEQ ID NO: 1372227 - RNA, 22 nt, Homo sapiens
ccucugcuggccgggcacagcu

SEQ ID NO: 1372228 - RNA, 21 nt, Homo sapiens
ccucugggccaagucaaagac

SEQ ID NO: 1372229 - RNA, 20 nt, Homo sapiens
ccucugucauaugcagaauu

SEQ ID NO: 1372230 - RNA, 14 nt, Homo sapiens
ccucuguccaggca

SEQ ID NO: 1372231 - RNA, 13 nt, Homo sapiens
ccucuuccacuuu

SEQ ID NO: 1372232 - RNA, 14 nt, Homo sapiens
ccucuuccccagaa

SEQ ID NO: 1372233 - RNA, 21 nt, Homo sapiens
ccucuuccgugacgucacugg

SEQ ID NO: 1372234 - RNA, 16 nt, Homo sapiens
ccucuuguugcugagu

SEQ ID NO: 1372235 - RNA, 13 nt, Homo sapiens
ccucuuucccucc

SEQ ID NO: 1372236 - RNA, 17 nt, Homo sapiens
auuucucaaaugcacau

SEQ ID NO: 1372237 - RNA, 20 nt, Homo sapiens
auuucucccagcucuagaca

SEQ ID NO: 1372238 - RNA, 14 nt, Homo sapiens
auuucucucuccag

SEQ ID NO: 1372239 - RNA, 22 nt, Homo sapiens
auuucucucuccagucuuccac

SEQ ID NO: 1372240 - RNA, 18 nt, Homo sapiens
auuucuggaaaacugccu

SEQ ID NO: 1372241 - RNA, 17 nt, Homo sapiens
auuucuucucaaagggu

SEQ ID NO: 1372242 - RNA, 19 nt, Homo sapiens
auuugaacucuucaaucuc

SEQ ID NO: 1372243 - RNA, 19 nt, Homo sapiens
auuugaagcaucacauaaa

SEQ ID NO: 1372244 - RNA, 18 nt, Homo sapiens
auuuggaaaauaaaucaa

SEQ ID NO: 1372245 - RNA, 21 nt, Homo sapiens
auuuguaauuccuuacuguaa

SEQ ID NO: 1372246 - RNA, 17 nt, Homo sapiens
auuuguaauugaacuua

SEQ ID NO: 1372247 - RNA, 13 nt, Homo sapiens
auuugucaacaaa

SEQ ID NO: 1372248 - RNA, 21 nt, Homo sapiens
auuuguccuuggggacaucuc

SEQ ID NO: 1372249 - RNA, 17 nt, Homo sapiens
auuugugugugugcaag

SEQ ID NO: 1372250 - RNA, 18 nt, Homo sapiens
auuuuaacaacacacaau

SEQ ID NO: 1372251 - RNA, 19 nt, Homo sapiens
auuuuaaugaagugcaaua

SEQ ID NO: 1372252 - RNA, 18 nt, Homo sapiens
auuuuacauguggcccaa

SEQ ID NO: 1372253 - RNA, 14 nt, Homo sapiens
auuuuauacauuaa

SEQ ID NO: 1372254 - RNA, 23 nt, Homo sapiens
auuuuauguaaaauuuugccuaa

SEQ ID NO: 1372255 - RNA, 19 nt, Homo sapiens
auuuuauguuuaguugcac

SEQ ID NO: 1372256 - RNA, 22 nt, Homo sapiens
auuuuauuaucaccaugcaaug

SEQ ID NO: 1372257 - RNA, 18 nt, Homo sapiens
auuuuauucccuuucaca

SEQ ID NO: 1372258 - RNA, 19 nt, Homo sapiens
auuuucaagaaacugagga

SEQ ID NO: 1372259 - RNA, 14 nt, Homo sapiens
auuuucaaguaauu

SEQ ID NO: 1372260 - RNA, 16 nt, Homo sapiens
auuuucaauucaaaaa

SEQ ID NO: 1372261 - RNA, 17 nt, Homo sapiens
auuuucacacaauacaa

SEQ ID NO: 1372262 - RNA, 14 nt, Homo sapiens
agcuauauccaugu

SEQ ID NO: 1372263 - RNA, 20 nt, Homo sapiens
agcuaucucucagugaacug

SEQ ID NO: 1372264 - RNA, 20 nt, Homo sapiens
agcuaugaucgcgccacuac

SEQ ID NO: 1372265 - RNA, 20 nt, Homo sapiens
agcuauuuaucuguaguaaa

SEQ ID NO: 1372266 - RNA, 21 nt, Homo sapiens
agcucaagucuucccugauca

SEQ ID NO: 1372267 - RNA, 12 nt, Homo sapiens
agcucacgucac

SEQ ID NO: 1372268 - RNA, 16 nt, Homo sapiens
agcucacgucacacuu

SEQ ID NO: 1372269 - RNA, 15 nt, Homo sapiens
agcucagcccacccc

SEQ ID NO: 1372270 - RNA, 15 nt, Homo sapiens
agcucaggcacacuu

SEQ ID NO: 1372271 - RNA, 16 nt, Homo sapiens
agcucaggcacacuuc

SEQ ID NO: 1372272 - RNA, 22 nt, Homo sapiens
agcucaggugucccugcacuug

SEQ ID NO: 1372273 - RNA, 13 nt, Homo sapiens
agcucaucucagc

SEQ ID NO: 1372274 - RNA, 22 nt, Homo sapiens
agcuccacacccucucccagga

SEQ ID NO: 1372275 - RNA, 14 nt, Homo sapiens
agcuccaguggaag

SEQ ID NO: 1372276 - RNA, 13 nt, Homo sapiens
agcuccugccucu

SEQ ID NO: 1372277 - RNA, 21 nt, Homo sapiens
agcucugcuugccgaaacugg

SEQ ID NO: 1372278 - RNA, 14 nt, Homo sapiens
agcucuguuuucau

SEQ ID NO: 1372279 - RNA, 21 nt, Homo sapiens
agcucuucuccauccuaccac

SEQ ID NO: 1372280 - RNA, 18 nt, Homo sapiens
agcucuugaagacacuga

SEQ ID NO: 1372281 - RNA, 13 nt, Homo sapiens
agcugagcaggga

SEQ ID NO: 1372282 - RNA, 18 nt, Homo sapiens
agcugauuuuaacaauaa

SEQ ID NO: 1372283 - RNA, 13 nt, Homo sapiens
agcugcacccuca

SEQ ID NO: 1372284 - RNA, 15 nt, Homo sapiens
agcugccaccaucac

SEQ ID NO: 1372285 - RNA, 16 nt, Homo sapiens
agcugcuggcuugcag

SEQ ID NO: 1372286 - RNA, 22 nt, Homo sapiens
agcuggaagggucaacaucuuu

SEQ ID NO: 1372287 - RNA, 23 nt, Homo sapiens
agcuggaagggucaacaucuuuu

SEQ ID NO: 1372288 - RNA, 18 nt, Homo sapiens
agcuggaauuuuuuauuc

SEQ ID NO: 1372289 - RNA, 15 nt, Homo sapiens
agcuggagugcagug

SEQ ID NO: 1372290 - RNA, 21 nt, Homo sapiens
agcuggcaauauuacaauccu

SEQ ID NO: 1372291 - RNA, 22 nt, Homo sapiens
agcuggcagcagaguguggccu

SEQ ID NO: 1372292 - RNA, 22 nt, Homo sapiens
agcugggauaaucacauuauca

SEQ ID NO: 1372293 - RNA, 23 nt, Homo sapiens
agcugggauaaucacauuaucau

SEQ ID NO: 1372294 - RNA, 22 nt, Homo sapiens
agcuggguuggaaaacaguauu

SEQ ID NO: 1372295 - RNA, 19 nt, Homo sapiens
agcuggugccccacugaau

SEQ ID NO: 1372296 - RNA, 20 nt, Homo sapiens
agcuggugguaucugaguug

SEQ ID NO: 1372297 - RNA, 13 nt, Homo sapiens
augggaugaaugg

SEQ ID NO: 1372298 - RNA, 23 nt, Homo sapiens
augggcacugccgagaacagcau

SEQ ID NO: 1372299 - RNA, 21 nt, Homo sapiens
auggguagcuucugaccucag

SEQ ID NO: 1372300 - RNA, 18 nt, Homo sapiens
augguaaaaccccaucuc

SEQ ID NO: 1372301 - RNA, 19 nt, Homo sapiens
augguuccauucucucucc

SEQ ID NO: 1372302 - RNA, 14 nt, Homo sapiens
augguuuuacucau

SEQ ID NO: 1372303 - RNA, 17 nt, Homo sapiens
auguaaacagugccugc

SEQ ID NO: 1372304 - RNA, 20 nt, Homo sapiens
auguaaacauaauucuugua

SEQ ID NO: 1372305 - RNA, 13 nt, Homo sapiens
auguaaauacugu

SEQ ID NO: 1372306 - RNA, 14 nt, Homo sapiens
auguaacuggaauc

SEQ ID NO: 1372307 - RNA, 17 nt, Homo sapiens
auguaagcauaacuuau

SEQ ID NO: 1372308 - RNA, 17 nt, Homo sapiens
auguaauaaugugaauc

SEQ ID NO: 1372309 - RNA, 16 nt, Homo sapiens
auguaaugcauaggaa

SEQ ID NO: 1372310 - RNA, 22 nt, Homo sapiens
auguacaauauuuuaagcauua

SEQ ID NO: 1372311 - RNA, 16 nt, Homo sapiens
auguacauagcuugau

SEQ ID NO: 1372312 - RNA, 20 nt, Homo sapiens
auguaccucuuuuagucauu

SEQ ID NO: 1372313 - RNA, 17 nt, Homo sapiens
auguaccugaugcuaug

SEQ ID NO: 1372314 - RNA, 16 nt, Homo sapiens
auguagcaaaacgcau

SEQ ID NO: 1372315 - RNA, 16 nt, Homo sapiens
auguagcaaucagauu

SEQ ID NO: 1372316 - RNA, 12 nt, Homo sapiens
auguagucucau

SEQ ID NO: 1372317 - RNA, 19 nt, Homo sapiens
auguauuuaaccagucuuc

SEQ ID NO: 1372318 - RNA, 16 nt, Homo sapiens
augucaacagagcaag

SEQ ID NO: 1372319 - RNA, 20 nt, Homo sapiens
augucaacagagcaaggaga

SEQ ID NO: 1372320 - RNA, 14 nt, Homo sapiens
augucaagccauaa

SEQ ID NO: 1372321 - RNA, 17 nt, Homo sapiens
augucaccaauuaacca

SEQ ID NO: 1372322 - RNA, 13 nt, Homo sapiens
augucaccaccuu

SEQ ID NO: 1372323 - RNA, 19 nt, Homo sapiens
augucagaguagaagauuu

SEQ ID NO: 1372324 - RNA, 15 nt, Homo sapiens
augucccaacuugua

SEQ ID NO: 1372325 - RNA, 19 nt, Homo sapiens
augucguuugaaucacagu

SEQ ID NO: 1372326 - RNA, 22 nt, Homo sapiens
augucuccucucccauucgcaa

SEQ ID NO: 1372327 - RNA, 17 nt, Homo sapiens
augucuggagaauaauu

SEQ ID NO: 1372328 - RNA, 18 nt, Homo sapiens
augucuguagcuccucaa

SEQ ID NO: 1372329 - RNA, 20 nt, Homo sapiens
augucuuuccuuuugcucuu

SEQ ID NO: 1372330 - RNA, 15 nt, Homo sapiens
augugaaaguuacaa

SEQ ID NO: 1372331 - RNA, 17 nt, Homo sapiens
augugaccugugucacu

SEQ ID NO: 1372332 - RNA, 12 nt, Homo sapiens
augugagugugu

SEQ ID NO: 1372333 - RNA, 19 nt, Homo sapiens
augugcagguuuugaaaau

SEQ ID NO: 1372334 - RNA, 16 nt, Homo sapiens
augugcucaugcauug

SEQ ID NO: 1372335 - RNA, 12 nt, Homo sapiens
augugucagcca

SEQ ID NO: 1372336 - RNA, 13 nt, Homo sapiens
augugucuuacca

SEQ ID NO: 1372337 - RNA, 18 nt, Homo sapiens
augugugagugugugcaa

SEQ ID NO: 1372338 - RNA, 14 nt, Homo sapiens
auguguggacucaa

SEQ ID NO: 1372339 - RNA, 16 nt, Homo sapiens
augugugugcaagugu

SEQ ID NO: 1372340 - RNA, 19 nt, Homo sapiens
auguguuauuugucacaaa

SEQ ID NO: 1372341 - RNA, 21 nt, Homo sapiens
auguguucauuaaagcaugaa

SEQ ID NO: 1372342 - RNA, 14 nt, Homo sapiens
auguuacugaccag

SEQ ID NO: 1372343 - RNA, 16 nt, Homo sapiens
auguuacugaccagca

SEQ ID NO: 1372344 - RNA, 14 nt, Homo sapiens
auguucaacuggag

SEQ ID NO: 1372345 - RNA, 23 nt, Homo sapiens
auguucacccaaccacaucccac

SEQ ID NO: 1372346 - RNA, 16 nt, Homo sapiens
auguucacuguggcau

SEQ ID NO: 1372347 - RNA, 15 nt, Homo sapiens
auguucuagucugcu

SEQ ID NO: 1372348 - RNA, 15 nt, Homo sapiens
auguucugacauuaa

SEQ ID NO: 1372349 - RNA, 20 nt, Homo sapiens
auguucugggacacaguuca

SEQ ID NO: 1372350 - RNA, 17 nt, Homo sapiens
auguugaaagaucaaaa

SEQ ID NO: 1372351 - RNA, 20 nt, Homo sapiens
auguugcccaguguguuucu

SEQ ID NO: 1372352 - RNA, 15 nt, Homo sapiens
auguuucgcugauau

SEQ ID NO: 1372353 - RNA, 23 nt, Homo sapiens
auguuucgugaaguauacuguau

SEQ ID NO: 1372354 - RNA, 22 nt, Homo sapiens
auguuucugucacaucagcucc

SEQ ID NO: 1372355 - RNA, 17 nt, Homo sapiens
auguuugcuauugacaa

SEQ ID NO: 1372356 - RNA, 13 nt, Homo sapiens
auguuugucagau

SEQ ID NO: 1372357 - RNA, 17 nt, Homo sapiens
auguuuguggccucaga

SEQ ID NO: 1372358 - RNA, 17 nt, Homo sapiens
auguuuuagccagugau

SEQ ID NO: 1372359 - RNA, 18 nt, Homo sapiens
auguuuuccuucuacuua

SEQ ID NO: 1372360 - RNA, 13 nt, Homo sapiens
auguuuuguaaga

SEQ ID NO: 1372361 - RNA, 18 nt, Homo sapiens
auuaaagguggugccaau

SEQ ID NO: 1372362 - RNA, 18 nt, Homo sapiens
auuaagaaagacuaucua

SEQ ID NO: 1372363 - RNA, 23 nt, Homo sapiens
auuaagcaucacaaaugauauua

SEQ ID NO: 1372364 - RNA, 17 nt, Homo sapiens
auuaaguccuacuuuac

SEQ ID NO: 1372365 - RNA, 19 nt, Homo sapiens
auuaauuccaacuguacuu

SEQ ID NO: 1372366 - RNA, 19 nt, Homo sapiens
auuacauauuugcauaugu

SEQ ID NO: 1372367 - RNA, 18 nt, Homo sapiens
auuacauggggucuagaa

SEQ ID NO: 1372368 - RNA, 20 nt, Homo sapiens
auuaccacugaagauagaag

SEQ ID NO: 1372369 - RNA, 19 nt, Homo sapiens
auuacccuucuuuccauuu

SEQ ID NO: 1372370 - RNA, 22 nt, Homo sapiens
auuacuaaauuacaaaugcaau

SEQ ID NO: 1372371 - RNA, 13 nt, Homo sapiens
auuagaccaagcu

SEQ ID NO: 1372372 - RNA, 16 nt, Homo sapiens
auuaggacuggcuuug

SEQ ID NO: 1372373 - RNA, 17 nt, Homo sapiens
auuauaauauacuauau

SEQ ID NO: 1372374 - RNA, 22 nt, Homo sapiens
auuauaccgcuaucauuccaaa

SEQ ID NO: 1372375 - RNA, 18 nt, Homo sapiens
auuauaggccaaacuggc

SEQ ID NO: 1372376 - RNA, 18 nt, Homo sapiens
auuaucuaugauaugcua

SEQ ID NO: 1372377 - RNA, 15 nt, Homo sapiens
auuaucuucaggaca

SEQ ID NO: 1372378 - RNA, 13 nt, Homo sapiens
auuaugaagucau

SEQ ID NO: 1372379 - RNA, 13 nt, Homo sapiens
auuaugacaccuu

SEQ ID NO: 1372380 - RNA, 18 nt, Homo sapiens
auuaugccauagcaagau

SEQ ID NO: 1372381 - RNA, 22 nt, Homo sapiens
agcauguguauuuccagugcaa

SEQ ID NO: 1372382 - RNA, 14 nt, Homo sapiens
agcauuacaguggg

SEQ ID NO: 1372383 - RNA, 20 nt, Homo sapiens
agcauucuugucacaauaaa

SEQ ID NO: 1372384 - RNA, 14 nt, Homo sapiens
agcauugcuuucug

SEQ ID NO: 1372385 - RNA, 23 nt, Homo sapiens
agcauuuuccagcccuauagcca

SEQ ID NO: 1372386 - RNA, 20 nt, Homo sapiens
agcauuuugcuaaaugugaa

SEQ ID NO: 1372387 - RNA, 14 nt, Homo sapiens
agccaaacucugcc

SEQ ID NO: 1372388 - RNA, 13 nt, Homo sapiens
agccaaauguaau

SEQ ID NO: 1372389 - RNA, 15 nt, Homo sapiens
agccaaccccugugg

SEQ ID NO: 1372390 - RNA, 22 nt, Homo sapiens
agccaauagaguugggacaauu

SEQ ID NO: 1372391 - RNA, 15 nt, Homo sapiens
agccacagacaauau

SEQ ID NO: 1372392 - RNA, 12 nt, Homo sapiens
agccacaguaua

SEQ ID NO: 1372393 - RNA, 23 nt, Homo sapiens
agccacccucccagcucugagga

SEQ ID NO: 1372394 - RNA, 17 nt, Homo sapiens
agccaccugucccaccu

SEQ ID NO: 1372395 - RNA, 21 nt, Homo sapiens
agccacugcauaccaaccugg

SEQ ID NO: 1372396 - RNA, 14 nt, Homo sapiens
agccagaagcugag

SEQ ID NO: 1372397 - RNA, 18 nt, Homo sapiens
agccagggcugucuucgu

SEQ ID NO: 1372398 - RNA, 15 nt, Homo sapiens
agccagguucugacu

SEQ ID NO: 1372399 - RNA, 22 nt, Homo sapiens
agccaucuaaaguaaaaaggga

SEQ ID NO: 1372400 - RNA, 19 nt, Homo sapiens
agccaugggagacacugau

SEQ ID NO: 1372401 - RNA, 17 nt, Homo sapiens
agcccaauguaaugcau

SEQ ID NO: 1372402 - RNA, 18 nt, Homo sapiens
agcccauccagucuccca

SEQ ID NO: 1372403 - RNA, 20 nt, Homo sapiens
agcccauuucuccauacgca

SEQ ID NO: 1372404 - RNA, 20 nt, Homo sapiens
agccccagugccaagcacag

SEQ ID NO: 1372405 - RNA, 21 nt, Homo sapiens
agccccugggacugcugcuuc

SEQ ID NO: 1372406 - RNA, 19 nt, Homo sapiens
agcccuccgccauucucaa

SEQ ID NO: 1372407 - RNA, 15 nt, Homo sapiens
agcccucucacugug

SEQ ID NO: 1372408 - RNA, 22 nt, Homo sapiens
agcccugaguuucaaguauccu

SEQ ID NO: 1372409 - RNA, 18 nt, Homo sapiens
agcccugauugcgcaaaa

SEQ ID NO: 1372410 - RNA, 21 nt, Homo sapiens
agcccugggccccaccaccua

SEQ ID NO: 1372411 - RNA, 18 nt, Homo sapiens
agcccuuaggaagaauuu

SEQ ID NO: 1372412 - RNA, 13 nt, Homo sapiens
agccgaccucagc

SEQ ID NO: 1372413 - RNA, 22 nt, Homo sapiens
agccgccaggaccgccaaagaa

SEQ ID NO: 1372414 - RNA, 15 nt, Homo sapiens
agccgccauugccac

SEQ ID NO: 1372415 - RNA, 16 nt, Homo sapiens
agccgcugcacaucac

SEQ ID NO: 1372416 - RNA, 20 nt, Homo sapiens
agccuagaaacuaacacagc

SEQ ID NO: 1372417 - RNA, 17 nt, Homo sapiens
agccuagccgaccucag

SEQ ID NO: 1372418 - RNA, 21 nt, Homo sapiens
agccuaggggucagggaccaa

SEQ ID NO: 1372419 - RNA, 16 nt, Homo sapiens
agccuaggugacagag

SEQ ID NO: 1372420 - RNA, 22 nt, Homo sapiens
agccuauaccccuuacuuagca

SEQ ID NO: 1372421 - RNA, 16 nt, Homo sapiens
agccucaagaugaagg

SEQ ID NO: 1372422 - RNA, 22 nt, Homo sapiens
agccucacugcaagcacugcau

SEQ ID NO: 1372423 - RNA, 17 nt, Homo sapiens
agccucccucugaccug

SEQ ID NO: 1372424 - RNA, 19 nt, Homo sapiens
agccucucuuccuauccca

SEQ ID NO: 1372425 - RNA, 23 nt, Homo sapiens
agccucugagccccugggacugc

SEQ ID NO: 1372426 - RNA, 17 nt, Homo sapiens
agccugagcagagacau

SEQ ID NO: 1372427 - RNA, 13 nt, Homo sapiens
agccugagccaca

SEQ ID NO: 1372428 - RNA, 14 nt, Homo sapiens
agccugcagucauc

SEQ ID NO: 1372429 - RNA, 17 nt, Homo sapiens
agccugcuccagcuguu

SEQ ID NO: 1372430 - RNA, 21 nt, Homo sapiens
agccugcucccccacccccuc

SEQ ID NO: 1372431 - RNA, 16 nt, Homo sapiens
agccuggccaacaugg

SEQ ID NO: 1372432 - RNA, 15 nt, Homo sapiens
agccugggcaaugug

SEQ ID NO: 1372433 - RNA, 21 nt, Homo sapiens
agccugggcagcauagcaaga

SEQ ID NO: 1372434 - RNA, 16 nt, Homo sapiens
agccuggugcugcugc

SEQ ID NO: 1372435 - RNA, 19 nt, Homo sapiens
agccuuagaagucacacag

SEQ ID NO: 1372436 - RNA, 19 nt, Homo sapiens
agccuugguacuaggcagu

SEQ ID NO: 1372437 - RNA, 13 nt, Homo sapiens
agccuuuccauaa

SEQ ID NO: 1372438 - RNA, 14 nt, Homo sapiens
agccuuugccuccc

SEQ ID NO: 1372439 - RNA, 15 nt, Homo sapiens
agcgauuaauaacag

SEQ ID NO: 1372440 - RNA, 23 nt, Homo sapiens
agcggccacacuguacucugcac

SEQ ID NO: 1372441 - RNA, 23 nt, Homo sapiens
agcggcuggcagcccaccccuca

SEQ ID NO: 1372442 - RNA, 17 nt, Homo sapiens
agcguagcuaagugaaa

SEQ ID NO: 1372443 - RNA, 16 nt, Homo sapiens
agcgugagccacugca

SEQ ID NO: 1372444 - RNA, 24 nt, Homo sapiens
agcgugcauaaguuaacuuccaau

SEQ ID NO: 1372445 - RNA, 16 nt, Homo sapiens
agcuaacuuauuuucc

SEQ ID NO: 1372446 - RNA, 12 nt, Homo sapiens
agcuaagugaaa

SEQ ID NO: 1372447 - RNA, 17 nt, Homo sapiens
agcuaauaaaauaucau

SEQ ID NO: 1372448 - RNA, 14 nt, Homo sapiens
agcuacaauaucuu

SEQ ID NO: 1372449 - RNA, 19 nt, Homo sapiens
agcuacacagaucacagcu

SEQ ID NO: 1372450 - RNA, 14 nt, Homo sapiens
agcuaccagguguu

SEQ ID NO: 1372451 - RNA, 21 nt, Homo sapiens
agcuaccucacuaugcugcuu

SEQ ID NO: 1372452 - RNA, 16 nt, Homo sapiens
agcuacuaaugauguu

SEQ ID NO: 1372453 - RNA, 16 nt, Homo sapiens
agcuagaugugucuua

SEQ ID NO: 1372454 - RNA, 13 nt, Homo sapiens
agcuagcugagua

SEQ ID NO: 1372455 - RNA, 18 nt, Homo sapiens
agcuaggccuggccagau

SEQ ID NO: 1372456 - RNA, 22 nt, Homo sapiens
agcuaggccuggccagaugcac

SEQ ID NO: 1372457 - RNA, 15 nt, Homo sapiens
agaagaagugaccaa

SEQ ID NO: 1372458 - RNA, 18 nt, Homo sapiens
agaagaagugaccaagga

SEQ ID NO: 1372459 - RNA, 15 nt, Homo sapiens
agaagacaacauuaa

SEQ ID NO: 1372460 - RNA, 13 nt, Homo sapiens
agaagacacugca

SEQ ID NO: 1372461 - RNA, 19 nt, Homo sapiens
agaagacuauauuguacac

SEQ ID NO: 1372462 - RNA, 22 nt, Homo sapiens
agaagauaugugaagaaaaaug

SEQ ID NO: 1372463 - RNA, 22 nt, Homo sapiens
agaagaucacugaagaaacuuc

SEQ ID NO: 1372464 - RNA, 19 nt, Homo sapiens
agaagauuuuaugcugcug

SEQ ID NO: 1372465 - RNA, 21 nt, Homo sapiens
agaagcagaagggcagaagau

SEQ ID NO: 1372466 - RNA, 18 nt, Homo sapiens
agaagcuuaagugggcag

SEQ ID NO: 1372467 - RNA, 14 nt, Homo sapiens
agaaggaagacuuu

SEQ ID NO: 1372468 - RNA, 13 nt, Homo sapiens
agaaggagggaga

SEQ ID NO: 1372469 - RNA, 22 nt, Homo sapiens
agaaggcaugaaauugucuagc

SEQ ID NO: 1372470 - RNA, 18 nt, Homo sapiens
agaagggcaaauauuuau

SEQ ID NO: 1372471 - RNA, 19 nt, Homo sapiens
agaaggggaagcacucgug

SEQ ID NO: 1372472 - RNA, 22 nt, Homo sapiens
agaagucaugaagcccaaguga

SEQ ID NO: 1372473 - RNA, 22 nt, Homo sapiens
agaaguccauggaguuaucuaa

SEQ ID NO: 1372474 - RNA, 22 nt, Homo sapiens
agaaguucuggcugaacacugg

SEQ ID NO: 1372475 - RNA, 19 nt, Homo sapiens
agaauauacaaauagcaaa

SEQ ID NO: 1372476 - RNA, 20 nt, Homo sapiens
agaauauacuaaauuaacuu

SEQ ID NO: 1372477 - RNA, 18 nt, Homo sapiens
agaaucauugaaguauuu

SEQ ID NO: 1372478 - RNA, 19 nt, Homo sapiens
agaaucauugaaguauuuu

SEQ ID NO: 1372479 - RNA, 21 nt, Homo sapiens
agaaucccuaagccuagcugg

SEQ ID NO: 1372480 - RNA, 18 nt, Homo sapiens
agaauccuacaacuucca

SEQ ID NO: 1372481 - RNA, 21 nt, Homo sapiens
agaaucugcagcuaacuuauu

SEQ ID NO: 1372482 - RNA, 19 nt, Homo sapiens
agaaucugcauuuagcaca

SEQ ID NO: 1372483 - RNA, 19 nt, Homo sapiens
agaaucuucuguuccacau

SEQ ID NO: 1372484 - RNA, 22 nt, Homo sapiens
agaaugaaagacugaaucuucc

SEQ ID NO: 1372485 - RNA, 14 nt, Homo sapiens
agaaugagacugaa

SEQ ID NO: 1372486 - RNA, 14 nt, Homo sapiens
agaaugaugcacau

SEQ ID NO: 1372487 - RNA, 17 nt, Homo sapiens
agaauggaaaacagacu

SEQ ID NO: 1372488 - RNA, 18 nt, Homo sapiens
agaauggcuuuggucucu

SEQ ID NO: 1372489 - RNA, 19 nt, Homo sapiens
agaauggcuuuggucucuu

SEQ ID NO: 1372490 - RNA, 22 nt, Homo sapiens
agaauggcuuuggucucuugcu

SEQ ID NO: 1372491 - RNA, 15 nt, Homo sapiens
agaaugugacaggca

SEQ ID NO: 1372492 - RNA, 17 nt, Homo sapiens
agaaugugauauuugaa

SEQ ID NO: 1372493 - RNA, 15 nt, Homo sapiens
agaaugugcucaugc

SEQ ID NO: 1372494 - RNA, 21 nt, Homo sapiens
agaauuauaauuaguuccuca

SEQ ID NO: 1372495 - RNA, 13 nt, Homo sapiens
agacaacauuucu

SEQ ID NO: 1372496 - RNA, 21 nt, Homo sapiens
agacaauggcuuacuccagga

SEQ ID NO: 1372497 - RNA, 22 nt, Homo sapiens
agacaaugugaaaagaaaaaug

SEQ ID NO: 1372498 - RNA, 17 nt, Homo sapiens
agacacaggcccggcuc

SEQ ID NO: 1372499 - RNA, 17 nt, Homo sapiens
agacacaucuccuccau

SEQ ID NO: 1372500 - RNA, 22 nt, Homo sapiens
agacacaucuccuccauacuca

SEQ ID NO: 1372501 - RNA, 11 nt, Homo sapiens
agacaccucag

SEQ ID NO: 1372502 - RNA, 15 nt, Homo sapiens
agacacuauuuaucu

SEQ ID NO: 1372503 - RNA, 14 nt, Homo sapiens
agacagaagccuca

SEQ ID NO: 1372504 - RNA, 22 nt, Homo sapiens
agacagaguuuucacucuuauu

SEQ ID NO: 1372505 - RNA, 20 nt, Homo sapiens
agacagcaggcauaaggcac

SEQ ID NO: 1372506 - RNA, 14 nt, Homo sapiens
agacagcugucuug

SEQ ID NO: 1372507 - RNA, 14 nt, Homo sapiens
agacagcuucucau

SEQ ID NO: 1372508 - RNA, 20 nt, Homo sapiens
agacaggaugguuacucuug

SEQ ID NO: 1372509 - RNA, 16 nt, Homo sapiens
agacaguauauaacua

SEQ ID NO: 1372510 - RNA, 18 nt, Homo sapiens
agacauaaauuacuuuuu

SEQ ID NO: 1372511 - RNA, 18 nt, Homo sapiens
agacauaaccacugcuuc

SEQ ID NO: 1372512 - RNA, 17 nt, Homo sapiens
agacauacuccuuccau

SEQ ID NO: 1372513 - RNA, 19 nt, Homo sapiens
agacauacuccuuccauca

SEQ ID NO: 1372514 - RNA, 21 nt, Homo sapiens
agacauaguugugcaugccug

SEQ ID NO: 1372515 - RNA, 18 nt, Homo sapiens
agacaugagcauggcuga

SEQ ID NO: 1372516 - RNA, 16 nt, Homo sapiens
agacauguaucacugu

SEQ ID NO: 1372517 - RNA, 22 nt, Homo sapiens
agaccaaggcgggagcaucucu

SEQ ID NO: 1372518 - RNA, 17 nt, Homo sapiens
agaccaaguccuggcua

SEQ ID NO: 1372519 - RNA, 14 nt, Homo sapiens
agaccagaagugga

SEQ ID NO: 1372520 - RNA, 23 nt, Homo sapiens
agaccaggcuggccagcauggug

SEQ ID NO: 1372521 - RNA, 15 nt, Homo sapiens
agaccauaauguuac

SEQ ID NO: 1372522 - RNA, 17 nt, Homo sapiens
agacccccacaccucag

SEQ ID NO: 1372523 - RNA, 16 nt, Homo sapiens
agaccuaggauuucau

SEQ ID NO: 1372524 - RNA, 22 nt, Homo sapiens
agaccucuagacugguucauuc

SEQ ID NO: 1372525 - RNA, 15 nt, Homo sapiens
agaccugagaaccuu

SEQ ID NO: 1372526 - RNA, 21 nt, Homo sapiens
agaccugcugagggaccagcc

SEQ ID NO: 1372527 - RNA, 15 nt, Homo sapiens
agaccuggcacugga

SEQ ID NO: 1372528 - RNA, 14 nt, Homo sapiens
agaccugugcuagu

SEQ ID NO: 1372529 - RNA, 17 nt, Homo sapiens
acaugcagcccaugccc

SEQ ID NO: 1372530 - RNA, 18 nt, Homo sapiens
acaugcauacacucucaa

SEQ ID NO: 1372531 - RNA, 18 nt, Homo sapiens
acaugcauacauacacau

SEQ ID NO: 1372532 - RNA, 15 nt, Homo sapiens
acaugcgaccgugac

SEQ ID NO: 1372533 - RNA, 15 nt, Homo sapiens
acauggaugccaacc

SEQ ID NO: 1372534 - RNA, 21 nt, Homo sapiens
acauggcuaaagaagguuuca

SEQ ID NO: 1372535 - RNA, 19 nt, Homo sapiens
acauguaagcauaacuuau

SEQ ID NO: 1372536 - RNA, 16 nt, Homo sapiens
acaugugcacaugcac

SEQ ID NO: 1372537 - RNA, 23 nt, Homo sapiens
acauguggugggacagggaccca

SEQ ID NO: 1372538 - RNA, 23 nt, Homo sapiens
acaugugugcgugugcgugcaug

SEQ ID NO: 1372539 - RNA, 13 nt, Homo sapiens
acauuaguucuau

SEQ ID NO: 1372540 - RNA, 14 nt, Homo sapiens
acauuaucaucuga

SEQ ID NO: 1372541 - RNA, 22 nt, Homo sapiens
acauuaucaucugaaaaucugg

SEQ ID NO: 1372542 - RNA, 14 nt, Homo sapiens
acauuaucuuggau

SEQ ID NO: 1372543 - RNA, 14 nt, Homo sapiens
acauucauguucua

SEQ ID NO: 1372544 - RNA, 22 nt, Homo sapiens
acauucauguucuagucugcuu

SEQ ID NO: 1372545 - RNA, 20 nt, Homo sapiens
acauucugcaagcacaucug

SEQ ID NO: 1372546 - RNA, 23 nt, Homo sapiens
acauucugcaagcacaucugcau

SEQ ID NO: 1372547 - RNA, 21 nt, Homo sapiens
acauucuuguuuuaagugccu

SEQ ID NO: 1372548 - RNA, 23 nt, Homo sapiens
acauucuuguuuuaagugccuuu

SEQ ID NO: 1372549 - RNA, 20 nt, Homo sapiens
acauuguuugucugucuuca

SEQ ID NO: 1372550 - RNA, 22 nt, Homo sapiens
acauuguuuuguguaacauauu

SEQ ID NO: 1372551 - RNA, 22 nt, Homo sapiens
acauuuaucuguacauacuuuu

SEQ ID NO: 1372552 - RNA, 18 nt, Homo sapiens
acauuuauucugcucaca

SEQ ID NO: 1372553 - RNA, 13 nt, Homo sapiens
accaaaaagggau

SEQ ID NO: 1372554 - RNA, 19 nt, Homo sapiens
accaaaaugacaaugauga

SEQ ID NO: 1372555 - RNA, 21 nt, Homo sapiens
accaaaaugacaaugaugaug

SEQ ID NO: 1372556 - RNA, 19 nt, Homo sapiens
accaaauacuuuaauguau

SEQ ID NO: 1372557 - RNA, 20 nt, Homo sapiens
accaaauacuuuaauguaua

SEQ ID NO: 1372558 - RNA, 14 nt, Homo sapiens
accaaaucaucucu

SEQ ID NO: 1372559 - RNA, 16 nt, Homo sapiens
accaaauuauugucca

SEQ ID NO: 1372560 - RNA, 16 nt, Homo sapiens
accaacaagggcagug

SEQ ID NO: 1372561 - RNA, 15 nt, Homo sapiens
accaacccucagagc

SEQ ID NO: 1372562 - RNA, 12 nt, Homo sapiens
accaacuggaag

SEQ ID NO: 1372563 - RNA, 15 nt, Homo sapiens
accaagacucugaaa

SEQ ID NO: 1372564 - RNA, 17 nt, Homo sapiens
accaagagccaauggag

SEQ ID NO: 1372565 - RNA, 15 nt, Homo sapiens
accaagcuuguccaa

SEQ ID NO: 1372566 - RNA, 21 nt, Homo sapiens
accaaggaccccucaccuugc

SEQ ID NO: 1372567 - RNA, 17 nt, Homo sapiens
accaaggagaugaagca

SEQ ID NO: 1372568 - RNA, 23 nt, Homo sapiens
accaaggaggaguuuaaacugaa

SEQ ID NO: 1372569 - RNA, 15 nt, Homo sapiens
accaaguggcuccca

SEQ ID NO: 1372570 - RNA, 23 nt, Homo sapiens
accaaguuauaaaucaaugucac

SEQ ID NO: 1372571 - RNA, 14 nt, Homo sapiens
accaauaaagccuu

SEQ ID NO: 1372572 - RNA, 13 nt, Homo sapiens
accaauguucucu

SEQ ID NO: 1372573 - RNA, 16 nt, Homo sapiens
accacaaaacuuuucu

SEQ ID NO: 1372574 - RNA, 13 nt, Homo sapiens
uuuaccaggguag

SEQ ID NO: 1372575 - RNA, 18 nt, Homo sapiens
uuuaccccucuaccaagc

SEQ ID NO: 1372576 - RNA, 16 nt, Homo sapiens
uuuacuguccaaagac

SEQ ID NO: 1372577 - RNA, 14 nt, Homo sapiens
uuuagaaacuaaga

SEQ ID NO: 1372578 - RNA, 13 nt, Homo sapiens
uuuagaacagaaa

SEQ ID NO: 1372579 - RNA, 13 nt, Homo sapiens
uuuagauuguuaa

SEQ ID NO: 1372580 - RNA, 16 nt, Homo sapiens
uuuagcagaggagcca

SEQ ID NO: 1372581 - RNA, 19 nt, Homo sapiens
uuuaggaccaauaccuccu

SEQ ID NO: 1372582 - RNA, 16 nt, Homo sapiens
uuuauaaaacuuugaa

SEQ ID NO: 1372583 - RNA, 13 nt, Homo sapiens
uuuauauagcuug

SEQ ID NO: 1372584 - RNA, 19 nt, Homo sapiens
uuuaucacacuucugugag

SEQ ID NO: 1372585 - RNA, 20 nt, Homo sapiens
uuuaucauauauauacauac

SEQ ID NO: 1372586 - RNA, 13 nt, Homo sapiens
uuuaucugugcaa

SEQ ID NO: 1372587 - RNA, 14 nt, Homo sapiens
uuuaucugugcaaa

SEQ ID NO: 1372588 - RNA, 21 nt, Homo sapiens
uuuauuacaguuuaucuaugg

SEQ ID NO: 1372589 - RNA, 13 nt, Homo sapiens
uuuauuaccucug

SEQ ID NO: 1372590 - RNA, 17 nt, Homo sapiens
uuuauuauuuucaccug

SEQ ID NO: 1372591 - RNA, 11 nt, Homo sapiens
uuuauucuugu

SEQ ID NO: 1372592 - RNA, 13 nt, Homo sapiens
uuuauugcacaaa

SEQ ID NO: 1372593 - RNA, 14 nt, Homo sapiens
uuuauugcaugaga

SEQ ID NO: 1372594 - RNA, 16 nt, Homo sapiens
uuucaaauugagagaa

SEQ ID NO: 1372595 - RNA, 13 nt, Homo sapiens
uuucaauucaaaa

SEQ ID NO: 1372596 - RNA, 11 nt, Homo sapiens
uuucaccacau

SEQ ID NO: 1372597 - RNA, 14 nt, Homo sapiens
uuucacccacagaa

SEQ ID NO: 1372598 - RNA, 12 nt, Homo sapiens
uuucagcuaaag

SEQ ID NO: 1372599 - RNA, 16 nt, Homo sapiens
uuucaggccacauggc

SEQ ID NO: 1372600 - RNA, 14 nt, Homo sapiens
uuucaugugugauu

SEQ ID NO: 1372601 - RNA, 22 nt, Homo sapiens
uuucauuccuaacacagcaugu

SEQ ID NO: 1372602 - RNA, 12 nt, Homo sapiens
uuucauugcugg

SEQ ID NO: 1372603 - RNA, 17 nt, Homo sapiens
uuuccaauuuuguugca

SEQ ID NO: 1372604 - RNA, 17 nt, Homo sapiens
uuuccacauuugucaca

SEQ ID NO: 1372605 - RNA, 18 nt, Homo sapiens
uuuccacuacugcuacca

SEQ ID NO: 1372606 - RNA, 17 nt, Homo sapiens
uuuccauuuaguaacag

SEQ ID NO: 1372607 - RNA, 17 nt, Homo sapiens
uuuccccaccagugaau

SEQ ID NO: 1372608 - RNA, 18 nt, Homo sapiens
uuuccuaaaugcagugaa

SEQ ID NO: 1372609 - RNA, 15 nt, Homo sapiens
uuuccuccaggcaaa

SEQ ID NO: 1372610 - RNA, 15 nt, Homo sapiens
uuuccugcggcauca

SEQ ID NO: 1372611 - RNA, 16 nt, Homo sapiens
uuuccuuaaacugugu

SEQ ID NO: 1372612 - RNA, 18 nt, Homo sapiens
uuuccuucauucaaccca

SEQ ID NO: 1372613 - RNA, 15 nt, Homo sapiens
uuuccuuuuaugaga

SEQ ID NO: 1372614 - RNA, 22 nt, Homo sapiens
uuucuauaauguugucauuuca

SEQ ID NO: 1372615 - RNA, 14 nt, Homo sapiens
uuucucaaaugcac

SEQ ID NO: 1372616 - RNA, 15 nt, Homo sapiens
uuucuccuuagucuu

SEQ ID NO: 1372617 - RNA, 16 nt, Homo sapiens
uuucucuaaaacugcc

SEQ ID NO: 1372618 - RNA, 15 nt, Homo sapiens
uuucucuagcuugau

SEQ ID NO: 1372619 - RNA, 15 nt, Homo sapiens
uuucucuguauagua

SEQ ID NO: 1372620 - RNA, 16 nt, Homo sapiens
auuuauuuauggagga

SEQ ID NO: 1372621 - RNA, 13 nt, Homo sapiens
auuuauuuaugua

SEQ ID NO: 1372622 - RNA, 23 nt, Homo sapiens
auuucaaaacucauuuccuaugu

SEQ ID NO: 1372623 - RNA, 13 nt, Homo sapiens
auuucaagaccuc

SEQ ID NO: 1372624 - RNA, 18 nt, Homo sapiens
auuucagauaaacaacaa

SEQ ID NO: 1372625 - RNA, 15 nt, Homo sapiens
auuucagugcugcug

SEQ ID NO: 1372626 - RNA, 22 nt, Homo sapiens
auuuccuacgggcuguguucca

SEQ ID NO: 1372627 - RNA, 21 nt, Homo sapiens
auuuccuaggcugacuaagaa

SEQ ID NO: 1372628 - RNA, 19 nt, Homo sapiens
auuucuauuuuuguagaag

SEQ ID NO: 1372629 - RNA, 21 nt, Homo sapiens
auuucugggucuuucugacau

SEQ ID NO: 1372630 - RNA, 13 nt, Homo sapiens
auuucuucacuca

SEQ ID NO: 1372631 - RNA, 19 nt, Homo sapiens
auuucuucacucaaucucu

SEQ ID NO: 1372632 - RNA, 17 nt, Homo sapiens
auuugaaggucuugauu

SEQ ID NO: 1372633 - RNA, 15 nt, Homo sapiens
auuugagacauucca

SEQ ID NO: 1372634 - RNA, 19 nt, Homo sapiens
auuugaggucaaguaagaa

SEQ ID NO: 1372635 - RNA, 15 nt, Homo sapiens
auuuggaaucuucuc

SEQ ID NO: 1372636 - RNA, 15 nt, Homo sapiens
auuuggccugcacua

SEQ ID NO: 1372637 - RNA, 22 nt, Homo sapiens
auuugucacaaauaaacauaau

SEQ ID NO: 1372638 - RNA, 23 nt, Homo sapiens
auuugucacaaauaaacauaaua

SEQ ID NO: 1372639 - RNA, 22 nt, Homo sapiens
auuuguccuuggggacaucuca

SEQ ID NO: 1372640 - RNA, 22 nt, Homo sapiens
auuugucgauauuuccaucauu

SEQ ID NO: 1372641 - RNA, 20 nt, Homo sapiens
auuuguucguauuuagaaug

SEQ ID NO: 1372642 - RNA, 22 nt, Homo sapiens
auuuuaacacacauaaaggaua

SEQ ID NO: 1372643 - RNA, 13 nt, Homo sapiens
auuuuaagugcuu

SEQ ID NO: 1372644 - RNA, 17 nt, Homo sapiens
auuuuaaugaagugcaa

SEQ ID NO: 1372645 - RNA, 16 nt, Homo sapiens
auuuuacugucuuaau

SEQ ID NO: 1372646 - RNA, 21 nt, Homo sapiens
auuuuaguaagagauuccuga

SEQ ID NO: 1372647 - RNA, 14 nt, Homo sapiens
auuuuaugcugcug

SEQ ID NO: 1372648 - RNA, 14 nt, Homo sapiens
auuuuauucaaggu

SEQ ID NO: 1372649 - RNA, 23 nt, Homo sapiens
auuuuauuuuuuucucucugaca

SEQ ID NO: 1372650 - RNA, 19 nt, Homo sapiens
auuuucaacauaacugaag

SEQ ID NO: 1372651 - RNA, 22 nt, Homo sapiens
auuuuccccccacucuccccac

SEQ ID NO: 1372652 - RNA, 16 nt, Homo sapiens
auuuuccuccaggcaa

SEQ ID NO: 1372653 - RNA, 12 nt, Homo sapiens
auuuugauucag

SEQ ID NO: 1372654 - RNA, 17 nt, Homo sapiens
auuuugcauaguaccaa

SEQ ID NO: 1372655 - RNA, 20 nt, Homo sapiens
auuuugccauaaagucaaau

SEQ ID NO: 1372656 - RNA, 14 nt, Homo sapiens
auuuugccuaauac

SEQ ID NO: 1372657 - RNA, 19 nt, Homo sapiens
auuuugcuaaaugugaaug

SEQ ID NO: 1372658 - RNA, 11 nt, Homo sapiens
cacaagcaaaa

SEQ ID NO: 1372659 - RNA, 12 nt, Homo sapiens
cacaagcaaaac

SEQ ID NO: 1372660 - RNA, 21 nt, Homo sapiens
cacaaggcugaccaagagaga

SEQ ID NO: 1372661 - RNA, 17 nt, Homo sapiens
cacaaggugcaaaucaa

SEQ ID NO: 1372662 - RNA, 19 nt, Homo sapiens
cacaauaugggcacuuuaa

SEQ ID NO: 1372663 - RNA, 15 nt, Homo sapiens
cacaaugcagugccu

SEQ ID NO: 1372664 - RNA, 20 nt, Homo sapiens
cacaauggugcucauuucau

SEQ ID NO: 1372665 - RNA, 15 nt, Homo sapiens
cacacaaggugcaaa

SEQ ID NO: 1372666 - RNA, 15 nt, Homo sapiens
cacacaccuguaguc

SEQ ID NO: 1372667 - RNA, 23 nt, Homo sapiens
cacacauacacacacacaagcuu

SEQ ID NO: 1372668 - RNA, 20 nt, Homo sapiens
cacacaucaguaauguauuc

SEQ ID NO: 1372669 - RNA, 15 nt, Homo sapiens
cacaccaucuuucca

SEQ ID NO: 1372670 - RNA, 19 nt, Homo sapiens
cacaccuacaccucuugaa

SEQ ID NO: 1372671 - RNA, 13 nt, Homo sapiens
cacaccuacccuc

SEQ ID NO: 1372672 - RNA, 21 nt, Homo sapiens
cacaccucccacccccuguau

SEQ ID NO: 1372673 - RNA, 19 nt, Homo sapiens
cacaccucuccuuugugac

SEQ ID NO: 1372674 - RNA, 15 nt, Homo sapiens
cacacucacuggcau

SEQ ID NO: 1372675 - RNA, 15 nt, Homo sapiens
cacacuguacucugc

SEQ ID NO: 1372676 - RNA, 16 nt, Homo sapiens
cacacuguacucugca

SEQ ID NO: 1372677 - RNA, 21 nt, Homo sapiens
cacacuguagcauuacagugg

SEQ ID NO: 1372678 - RNA, 14 nt, Homo sapiens
cacacuguauauaa

SEQ ID NO: 1372679 - RNA, 19 nt, Homo sapiens
cacacuguucugaaaguga

SEQ ID NO: 1372680 - RNA, 16 nt, Homo sapiens
cacagacugcgauuug

SEQ ID NO: 1372681 - RNA, 24 nt, Homo sapiens
cacagacuggagacaaugcagaug

SEQ ID NO: 1372682 - RNA, 16 nt, Homo sapiens
cacagaugugugauuc

SEQ ID NO: 1372683 - RNA, 16 nt, Homo sapiens
cacagauguucaccca

SEQ ID NO: 1372684 - RNA, 21 nt, Homo sapiens
cacagcagccccugcacaaag

SEQ ID NO: 1372685 - RNA, 19 nt, Homo sapiens
cacagcaguagcaguagau

SEQ ID NO: 1372686 - RNA, 15 nt, Homo sapiens
cacagccaucaaggg

SEQ ID NO: 1372687 - RNA, 16 nt, Homo sapiens
cacagcucaggaacua

SEQ ID NO: 1372688 - RNA, 21 nt, Homo sapiens
cacagcugcagagacagagag

SEQ ID NO: 1372689 - RNA, 22 nt, Homo sapiens
cacagucucuuuaaucuucagu

SEQ ID NO: 1372690 - RNA, 11 nt, Homo sapiens
cacagugcaag

SEQ ID NO: 1372691 - RNA, 15 nt, Homo sapiens
cacaguuucuuccau

SEQ ID NO: 1372692 - RNA, 22 nt, Homo sapiens
cacauccaaccccccaccugcc

SEQ ID NO: 1372693 - RNA, 18 nt, Homo sapiens
cacauccacacagccaau

SEQ ID NO: 1372694 - RNA, 23 nt, Homo sapiens
cacaucccuggaaggacauccau

SEQ ID NO: 1372695 - RNA, 13 nt, Homo sapiens
cacaucugcauuu

SEQ ID NO: 1372696 - RNA, 14 nt, Homo sapiens
cacaugcacgugug

SEQ ID NO: 1372697 - RNA, 14 nt, Homo sapiens
cacaugugcacaug

SEQ ID NO: 1372698 - RNA, 16 nt, Homo sapiens
cacaugugcacaugca

SEQ ID NO: 1372699 - RNA, 15 nt, Homo sapiens
cacauugugccuuuu

SEQ ID NO: 1372700 - RNA, 13 nt, Homo sapiens
caccaaagccacc

SEQ ID NO: 1372701 - RNA, 14 nt, Homo sapiens
caccacagagccuc

SEQ ID NO: 1372702 - RNA, 21 nt, Homo sapiens
caccaggagacagacagagaa

SEQ ID NO: 1372703 - RNA, 14 nt, Homo sapiens
caccaugcccagcu

SEQ ID NO: 1372704 - RNA, 16 nt, Homo sapiens
cacccaugcccagcug

SEQ ID NO: 1372705 - RNA, 17 nt, Homo sapiens
cacccaugcccagcugu

SEQ ID NO: 1372706 - RNA, 12 nt, Homo sapiens
caccccaacagc

SEQ ID NO: 1372707 - RNA, 14 nt, Homo sapiens
cacccccgugucca

SEQ ID NO: 1372708 - RNA, 17 nt, Homo sapiens
caccccuccuuccuuga

SEQ ID NO: 1372709 - RNA, 16 nt, Homo sapiens
cacccgacuccucaaa

SEQ ID NO: 1372710 - RNA, 17 nt, Homo sapiens
cacccgacuccucaaaa

SEQ ID NO: 1372711 - RNA, 14 nt, Homo sapiens
cacccucuggagaa

SEQ ID NO: 1372712 - RNA, 16 nt, Homo sapiens
cacccuggaggauuuc

SEQ ID NO: 1372713 - RNA, 22 nt, Homo sapiens
caccggccaagaugcuuuucaa

SEQ ID NO: 1372714 - RNA, 19 nt, Homo sapiens
caccuacgcgagucuuacu

SEQ ID NO: 1372715 - RNA, 19 nt, Homo sapiens
caccuagagcuagaugugu

SEQ ID NO: 1372716 - RNA, 21 nt, Homo sapiens
caccuagagcuagaugugucu

SEQ ID NO: 1372717 - RNA, 13 nt, Homo sapiens
caccucugcacaa

SEQ ID NO: 1372718 - RNA, 19 nt, Homo sapiens
caccucugcacaagcugca

SEQ ID NO: 1372719 - RNA, 15 nt, Homo sapiens
caccucuuaugcaca

SEQ ID NO: 1372720 - RNA, 17 nt, Homo sapiens
caccugagcuuuggaca

SEQ ID NO: 1372721 - RNA, 21 nt, Homo sapiens
caccugguuccggcucugcac

SEQ ID NO: 1372722 - RNA, 18 nt, Homo sapiens
caccuguaaaacuuuauu

SEQ ID NO: 1372723 - RNA, 22 nt, Homo sapiens
caccuguagucccagcuacuca

SEQ ID NO: 1372724 - RNA, 16 nt, Homo sapiens
cacgaacccaccugcu

SEQ ID NO: 1372725 - RNA, 17 nt, Homo sapiens
cacgaagcuuaguauaa

SEQ ID NO: 1372726 - RNA, 19 nt, Homo sapiens
cacgacugcccggcagggu

SEQ ID NO: 1372727 - RNA, 16 nt, Homo sapiens
cacgagaucaagagau

SEQ ID NO: 1372728 - RNA, 19 nt, Homo sapiens
cacgaggucaggaguucaa

SEQ ID NO: 1372729 - RNA, 18 nt, Homo sapiens
cacgagugggaaggacuu

SEQ ID NO: 1372730 - RNA, 16 nt, Homo sapiens
cacgccuguaauccca

SEQ ID NO: 1372731 - RNA, 17 nt, Homo sapiens
cacgcuggagugcagug

SEQ ID NO: 1372732 - RNA, 18 nt, Homo sapiens
cacguaaaucuguucaag

SEQ ID NO: 1372733 - RNA, 14 nt, Homo sapiens
cacgucauguuucu

SEQ ID NO: 1372734 - RNA, 13 nt, Homo sapiens
cacgucugcuaac

SEQ ID NO: 1372735 - RNA, 15 nt, Homo sapiens
cacgugcucucugga

SEQ ID NO: 1372736 - RNA, 16 nt, Homo sapiens
cacuaaggugugcucu

SEQ ID NO: 1372737 - RNA, 15 nt, Homo sapiens
cacuacgugacugug

SEQ ID NO: 1372738 - RNA, 20 nt, Homo sapiens
cacuauaauguaagcucuac

SEQ ID NO: 1372739 - RNA, 21 nt, Homo sapiens
cacuauagccuaggugacaga

SEQ ID NO: 1372740 - RNA, 19 nt, Homo sapiens
cacuaugaagauguuucaa

SEQ ID NO: 1372741 - RNA, 19 nt, Homo sapiens
cacuauuuaucugugcaaa

SEQ ID NO: 1372742 - RNA, 20 nt, Homo sapiens
cacucaaugguuaacuaauu

SEQ ID NO: 1372743 - RNA, 21 nt, Homo sapiens
cacucacacggacacucaaaa

SEQ ID NO: 1372744 - RNA, 22 nt, Homo sapiens
cacucacagagacacagggcau

SEQ ID NO: 1372745 - RNA, 14 nt, Homo sapiens
cacucacuacaggg

SEQ ID NO: 1372746 - RNA, 21 nt, Homo sapiens
cacucacuccacaacccaaga

SEQ ID NO: 1372747 - RNA, 16 nt, Homo sapiens
cacucccuggcucuca

SEQ ID NO: 1372748 - RNA, 19 nt, Homo sapiens
cacucuacccuauacaacu

SEQ ID NO: 1372749 - RNA, 16 nt, Homo sapiens
cacucucaaagcaaau

SEQ ID NO: 1372750 - RNA, 16 nt, Homo sapiens
cacucucagugcuucu

SEQ ID NO: 1372751 - RNA, 10 nt, Homo sapiens
cacugagaua

SEQ ID NO: 1372752 - RNA, 13 nt, Homo sapiens
cacugcaagcacu

SEQ ID NO: 1372753 - RNA, 15 nt, Homo sapiens
cacugcaagcacugc

SEQ ID NO: 1372754 - RNA, 21 nt, Homo sapiens
cacugcaccgggccacagaga

SEQ ID NO: 1372755 - RNA, 13 nt, Homo sapiens
cacugcacuccag

SEQ ID NO: 1372756 - RNA, 16 nt, Homo sapiens
cacugcacucuagccg

SEQ ID NO: 1372757 - RNA, 14 nt, Homo sapiens
cacugcccuucuca

SEQ ID NO: 1372758 - RNA, 16 nt, Homo sapiens
cacugcuuaugcaguc

SEQ ID NO: 1372759 - RNA, 15 nt, Homo sapiens
cacuggagaucacca

SEQ ID NO: 1372760 - RNA, 18 nt, Homo sapiens
cacuggcaucuuugcuau

SEQ ID NO: 1372761 - RNA, 21 nt, Homo sapiens
cacugggcugcagagacugga

SEQ ID NO: 1372762 - RNA, 22 nt, Homo sapiens
cacugggcuucuagaaccaggc

SEQ ID NO: 1372763 - RNA, 14 nt, Homo sapiens
cacuguauaccccg

SEQ ID NO: 1372764 - RNA, 19 nt, Homo sapiens
cacuguauaccccgugaag

SEQ ID NO: 1372765 - RNA, 14 nt, Homo sapiens
cacuguuucucuca

SEQ ID NO: 1372766 - RNA, 20 nt, Homo sapiens
cacuuaaaaaauguccauga

SEQ ID NO: 1372767 - RNA, 14 nt, Homo sapiens
cacuuccaccagcc

SEQ ID NO: 1372768 - RNA, 21 nt, Homo sapiens
cacuucccacuauugcuugca

SEQ ID NO: 1372769 - RNA, 17 nt, Homo sapiens
cacuucccuacauggag

SEQ ID NO: 1372770 - RNA, 20 nt, Homo sapiens
cacuugccccuguuaccuaa

SEQ ID NO: 1372771 - RNA, 21 nt, Homo sapiens
cacuugccccuguuaccuaau

SEQ ID NO: 1372772 - RNA, 19 nt, Homo sapiens
cuauugacaagucauuuua

SEQ ID NO: 1372773 - RNA, 23 nt, Homo sapiens
cuauugacaucagcaucaccuag

SEQ ID NO: 1372774 - RNA, 17 nt, Homo sapiens
cuauugccugagagcac

SEQ ID NO: 1372775 - RNA, 12 nt, Homo sapiens
cuauugcugcuc

SEQ ID NO: 1372776 - RNA, 21 nt, Homo sapiens
cuauuuucaacauaacugaag

SEQ ID NO: 1372777 - RNA, 13 nt, Homo sapiens
cuauuuucauucu

SEQ ID NO: 1372778 - RNA, 22 nt, Homo sapiens
cuauuuuuauuuguuugugcau

SEQ ID NO: 1372779 - RNA, 18 nt, Homo sapiens
cuauuuuuuguaaugugu

SEQ ID NO: 1372780 - RNA, 16 nt, Homo sapiens
cucaaaaggaaaccaa

SEQ ID NO: 1372781 - RNA, 17 nt, Homo sapiens
cucaaaaugacagccau

SEQ ID NO: 1372782 - RNA, 15 nt, Homo sapiens
cucaaacacagagag

SEQ ID NO: 1372783 - RNA, 19 nt, Homo sapiens
cucaaaccuccaaaagccc

SEQ ID NO: 1372784 - RNA, 22 nt, Homo sapiens
cucaaacucuugaccucaggug

SEQ ID NO: 1372785 - RNA, 11 nt, Homo sapiens
cucaaacugcc

SEQ ID NO: 1372786 - RNA, 16 nt, Homo sapiens
cucaaacuuccaguca

SEQ ID NO: 1372787 - RNA, 12 nt, Homo sapiens
cucaaagcacac

SEQ ID NO: 1372788 - RNA, 14 nt, Homo sapiens
cucaaagcuuccau

SEQ ID NO: 1372789 - RNA, 18 nt, Homo sapiens
cucaaagcuuccauucca

SEQ ID NO: 1372790 - RNA, 13 nt, Homo sapiens
cucaaaggcacag

SEQ ID NO: 1372791 - RNA, 23 nt, Homo sapiens
cucaacauguuacugaccagcaa

SEQ ID NO: 1372792 - RNA, 14 nt, Homo sapiens
cucaaccuauggua

SEQ ID NO: 1372793 - RNA, 16 nt, Homo sapiens
cucaagaugaaggcaa

SEQ ID NO: 1372794 - RNA, 23 nt, Homo sapiens
cucaagcagucuacccaccucag

SEQ ID NO: 1372795 - RNA, 16 nt, Homo sapiens
cucaagcccugcaguc

SEQ ID NO: 1372796 - RNA, 17 nt, Homo sapiens
cucaaggaauuugcauu

SEQ ID NO: 1372797 - RNA, 17 nt, Homo sapiens
cucaagucuucccugau

SEQ ID NO: 1372798 - RNA, 18 nt, Homo sapiens
cucaagugucucagucca

SEQ ID NO: 1372799 - RNA, 17 nt, Homo sapiens
cucaauaaagugcuuua

SEQ ID NO: 1372800 - RNA, 15 nt, Homo sapiens
cucaauauuccugaa

SEQ ID NO: 1372801 - RNA, 12 nt, Homo sapiens
cucaaucucuga

SEQ ID NO: 1372802 - RNA, 16 nt, Homo sapiens
cucacacaugagaucu

SEQ ID NO: 1372803 - RNA, 21 nt, Homo sapiens
cucacagagugcauugugagg

SEQ ID NO: 1372804 - RNA, 15 nt, Homo sapiens
cucacauaucuguca

SEQ ID NO: 1372805 - RNA, 17 nt, Homo sapiens
cucacauaucugucauu

SEQ ID NO: 1372806 - RNA, 19 nt, Homo sapiens
cucaccccugcccugggau

SEQ ID NO: 1372807 - RNA, 18 nt, Homo sapiens
cucacccuguaccacaaa

SEQ ID NO: 1372808 - RNA, 13 nt, Homo sapiens
cucaccuccuaaa

SEQ ID NO: 1372809 - RNA, 14 nt, Homo sapiens
cucacgccuguaau

SEQ ID NO: 1372810 - RNA, 14 nt, Homo sapiens
cucacuaugcugcu

SEQ ID NO: 1372811 - RNA, 17 nt, Homo sapiens
cucacucaaguucaagg

SEQ ID NO: 1372812 - RNA, 14 nt, Homo sapiens
cucacuggcaucuu

SEQ ID NO: 1372813 - RNA, 14 nt, Homo sapiens
cucacuuaucccaa

SEQ ID NO: 1372814 - RNA, 20 nt, Homo sapiens
cucacuugaaugugucacua

SEQ ID NO: 1372815 - RNA, 17 nt, Homo sapiens
cucacuuuuauugauaa

SEQ ID NO: 1372816 - RNA, 19 nt, Homo sapiens
cucagaaucgcuccaccuu

SEQ ID NO: 1372817 - RNA, 23 nt, Homo sapiens
cucagauuccaccuagagcuaga

SEQ ID NO: 1372818 - RNA, 13 nt, Homo sapiens
cucagcaaaagau

SEQ ID NO: 1372819 - RNA, 19 nt, Homo sapiens
cucagccaaccuuacuuac

SEQ ID NO: 1372820 - RNA, 15 nt, Homo sapiens
cucagccacccugug

SEQ ID NO: 1372821 - RNA, 23 nt, Homo sapiens
cucagcccugggccccaccaccu

SEQ ID NO: 1372822 - RNA, 21 nt, Homo sapiens
cucagccguucuugacaucaa

SEQ ID NO: 1372823 - RNA, 22 nt, Homo sapiens
cucagccguucuugacaucaag

SEQ ID NO: 1372824 - RNA, 18 nt, Homo sapiens
cucagccucccaaagugc

SEQ ID NO: 1372825 - RNA, 14 nt, Homo sapiens
cucagcuucuuaau

SEQ ID NO: 1372826 - RNA, 15 nt, Homo sapiens
cucaggagaagggau

SEQ ID NO: 1372827 - RNA, 16 nt, Homo sapiens
cucaggagaagggaua

SEQ ID NO: 1372828 - RNA, 19 nt, Homo sapiens
cucagggcugacacgucca

SEQ ID NO: 1372829 - RNA, 20 nt, Homo sapiens
cucaguggacuuuccacccc

SEQ ID NO: 1372830 - RNA, 17 nt, Homo sapiens
cucaguuggugcugcuu

SEQ ID NO: 1372831 - RNA, 20 nt, Homo sapiens
cucaguuggugcugcuuucu

SEQ ID NO: 1372832 - RNA, 21 nt, Homo sapiens
cucaguuggugcugcuuucuu

SEQ ID NO: 1372833 - RNA, 14 nt, Homo sapiens
cucauacacagaaa

SEQ ID NO: 1372834 - RNA, 14 nt, Homo sapiens
cucauagcauuaac

SEQ ID NO: 1372835 - RNA, 20 nt, Homo sapiens
cucauauauaucuaucuuau

SEQ ID NO: 1372836 - RNA, 14 nt, Homo sapiens
cucaucauuuccau

SEQ ID NO: 1372837 - RNA, 22 nt, Homo sapiens
cucaucuuagguuggcaaaaag

SEQ ID NO: 1372838 - RNA, 19 nt, Homo sapiens
cucaugagugccaagcaaa

SEQ ID NO: 1372839 - RNA, 14 nt, Homo sapiens
cucaugauauguca

SEQ ID NO: 1372840 - RNA, 21 nt, Homo sapiens
cucauggcagcuaagccacau

SEQ ID NO: 1372841 - RNA, 19 nt, Homo sapiens
cucauucagggauagcacu

SEQ ID NO: 1372842 - RNA, 15 nt, Homo sapiens
cucauugaugucaaa

SEQ ID NO: 1372843 - RNA, 12 nt, Homo sapiens
cucauugcuuca

SEQ ID NO: 1372844 - RNA, 15 nt, Homo sapiens
cucauugcuucacaa

SEQ ID NO: 1372845 - RNA, 22 nt, Homo sapiens
cucauuguuuauuaacaaauua

SEQ ID NO: 1372846 - RNA, 16 nt, Homo sapiens
cucauuuaucccucaa

SEQ ID NO: 1372847 - RNA, 12 nt, Homo sapiens
cuccacugccuc

SEQ ID NO: 1372848 - RNA, 16 nt, Homo sapiens
cuccacugccuucgau

SEQ ID NO: 1372849 - RNA, 18 nt, Homo sapiens
cuccagagggaauugcag

SEQ ID NO: 1372850 - RNA, 16 nt, Homo sapiens
cuccagcucaccagcc

SEQ ID NO: 1372851 - RNA, 17 nt, Homo sapiens
cuccaggaugaguuacu

SEQ ID NO: 1372852 - RNA, 13 nt, Homo sapiens
cuccaggcaaaau

SEQ ID NO: 1372853 - RNA, 13 nt, Homo sapiens
cuccagucuucca

SEQ ID NO: 1372854 - RNA, 14 nt, Homo sapiens
cuccagucuuccac

SEQ ID NO: 1372855 - RNA, 19 nt, Homo sapiens
cuccauccaauucuuugaa

SEQ ID NO: 1372856 - RNA, 14 nt, Homo sapiens
cuaaaaugaguuac

SEQ ID NO: 1372857 - RNA, 16 nt, Homo sapiens
cuaaaaugaguuaccu

SEQ ID NO: 1372858 - RNA, 17 nt, Homo sapiens
cuaaacaacuaccuccu

SEQ ID NO: 1372859 - RNA, 22 nt, Homo sapiens
cuaaacuguuuauuugcacuau

SEQ ID NO: 1372860 - RNA, 21 nt, Homo sapiens
cuaaagacccuaaaucugagg

SEQ ID NO: 1372861 - RNA, 18 nt, Homo sapiens
cuaaaguaaaaagggaau

SEQ ID NO: 1372862 - RNA, 16 nt, Homo sapiens
cuaaaguaucuguauu

SEQ ID NO: 1372863 - RNA, 14 nt, Homo sapiens
cuaaauaggagaua

SEQ ID NO: 1372864 - RNA, 18 nt, Homo sapiens
cuaaaucugccuuuucau

SEQ ID NO: 1372865 - RNA, 18 nt, Homo sapiens
cuaacauuauauugcaau

SEQ ID NO: 1372866 - RNA, 16 nt, Homo sapiens
cuaaccugaacugaug

SEQ ID NO: 1372867 - RNA, 17 nt, Homo sapiens
cuaacgacuucagggca

SEQ ID NO: 1372868 - RNA, 14 nt, Homo sapiens
cuaacucugaugua

SEQ ID NO: 1372869 - RNA, 14 nt, Homo sapiens
cuaacucuggugcu

SEQ ID NO: 1372870 - RNA, 15 nt, Homo sapiens
cuaacuuuccuucau

SEQ ID NO: 1372871 - RNA, 18 nt, Homo sapiens
cuaacuuuccuucauuca

SEQ ID NO: 1372872 - RNA, 21 nt, Homo sapiens
cuaacuuuuuugcuauccagc

SEQ ID NO: 1372873 - RNA, 19 nt, Homo sapiens
cuaagaaauaugcacaaua

SEQ ID NO: 1372874 - RNA, 21 nt, Homo sapiens
cuaagaagcagauaauggugu

SEQ ID NO: 1372875 - RNA, 21 nt, Homo sapiens
cuaagagaaugugcucaugca

SEQ ID NO: 1372876 - RNA, 20 nt, Homo sapiens
cuaagccacauggcugggau

SEQ ID NO: 1372877 - RNA, 11 nt, Homo sapiens
cuaagccuuuc

SEQ ID NO: 1372878 - RNA, 17 nt, Homo sapiens
cuaagccuuuccauaag

SEQ ID NO: 1372879 - RNA, 20 nt, Homo sapiens
cuaagcucaaggcgugagga

SEQ ID NO: 1372880 - RNA, 22 nt, Homo sapiens
cuaagcuggugccccacugaau

SEQ ID NO: 1372881 - RNA, 13 nt, Homo sapiens
cuaagcuguaacc

SEQ ID NO: 1372882 - RNA, 21 nt, Homo sapiens
cuaagguaguaacuuuccaua

SEQ ID NO: 1372883 - RNA, 16 nt, Homo sapiens
cuaaguuaccuuucua

SEQ ID NO: 1372884 - RNA, 14 nt, Homo sapiens
cuaauaaaauauca

SEQ ID NO: 1372885 - RNA, 16 nt, Homo sapiens
cuaauaaaauaucauu

SEQ ID NO: 1372886 - RNA, 17 nt, Homo sapiens
cuaauaaacauccuuca

SEQ ID NO: 1372887 - RNA, 13 nt, Homo sapiens
cuaauacauuaaa

SEQ ID NO: 1372888 - RNA, 17 nt, Homo sapiens
cuaaucagcauucucac

SEQ ID NO: 1372889 - RNA, 18 nt, Homo sapiens
cuaaucauccaaugcuca

SEQ ID NO: 1372890 - RNA, 21 nt, Homo sapiens
cuaaucuucuuaugcaauuuc

SEQ ID NO: 1372891 - RNA, 19 nt, Homo sapiens
cuaauggaaaaugauuuua

SEQ ID NO: 1372892 - RNA, 12 nt, Homo sapiens
cuaaugggacac

SEQ ID NO: 1372893 - RNA, 14 nt, Homo sapiens
cuacaaaggccaug

SEQ ID NO: 1372894 - RNA, 20 nt, Homo sapiens
cuacaaugcugcgucuccca

SEQ ID NO: 1372895 - RNA, 18 nt, Homo sapiens
cuacacagaucacagcuu

SEQ ID NO: 1372896 - RNA, 23 nt, Homo sapiens
cuacagggcgagacucugucuca

SEQ ID NO: 1372897 - RNA, 16 nt, Homo sapiens
cuacaguggcugucac

SEQ ID NO: 1372898 - RNA, 21 nt, Homo sapiens
cuacauauucuuuaaauuuca

SEQ ID NO: 1372899 - RNA, 17 nt, Homo sapiens
cuacauccaauguauga

SEQ ID NO: 1372900 - RNA, 16 nt, Homo sapiens
cuaccaaccucugaag

SEQ ID NO: 1372901 - RNA, 14 nt, Homo sapiens
cuaccaacuggaag

SEQ ID NO: 1372902 - RNA, 15 nt, Homo sapiens
cuaccaagcugugac

SEQ ID NO: 1372903 - RNA, 15 nt, Homo sapiens
cuaccacagugucug

SEQ ID NO: 1372904 - RNA, 21 nt, Homo sapiens
cuaccagguguucuacacuca

SEQ ID NO: 1372905 - RNA, 11 nt, Homo sapiens
cuaccaucucc

SEQ ID NO: 1372906 - RNA, 23 nt, Homo sapiens
cuaccgagucucuucuccacugg

SEQ ID NO: 1372907 - RNA, 16 nt, Homo sapiens
cuaccucaaacuucca

SEQ ID NO: 1372908 - RNA, 12 nt, Homo sapiens
cuaccucaaggg

SEQ ID NO: 1372909 - RNA, 18 nt, Homo sapiens
cuaccugagucccaaagc

SEQ ID NO: 1372910 - RNA, 20 nt, Homo sapiens
cuaccuugaaagaagaaaag

SEQ ID NO: 1372911 - RNA, 18 nt, Homo sapiens
cuaccuuuugcuguggca

SEQ ID NO: 1372912 - RNA, 23 nt, Homo sapiens
cuacucaggaggcugaggcagaa

SEQ ID NO: 1372913 - RNA, 21 nt, Homo sapiens
cuacugaacaguccaucuucu

SEQ ID NO: 1372914 - RNA, 22 nt, Homo sapiens
cuacugugucagggaacauauu

SEQ ID NO: 1372915 - RNA, 14 nt, Homo sapiens
cuagaacucuccau

SEQ ID NO: 1372916 - RNA, 13 nt, Homo sapiens
cuagaagacuguc

SEQ ID NO: 1372917 - RNA, 19 nt, Homo sapiens
cuagagaaggacccggagg

SEQ ID NO: 1372918 - RNA, 14 nt, Homo sapiens
cuagagaugacuga

SEQ ID NO: 1372919 - RNA, 17 nt, Homo sapiens
cuagagcuagauguguc

SEQ ID NO: 1372920 - RNA, 18 nt, Homo sapiens
cuagagcuagaugugucu

SEQ ID NO: 1372921 - RNA, 22 nt, Homo sapiens
cuagagcuagaugugucuuacc

SEQ ID NO: 1372922 - RNA, 14 nt, Homo sapiens
cuagaguccucacu

SEQ ID NO: 1372923 - RNA, 15 nt, Homo sapiens
cuagaugugucuuac

SEQ ID NO: 1372924 - RNA, 17 nt, Homo sapiens
cuagaugugucuuacca

SEQ ID NO: 1372925 - RNA, 20 nt, Homo sapiens
cuagcacuuugggaggccaa

SEQ ID NO: 1372926 - RNA, 23 nt, Homo sapiens
cuagcagaaaucuagaagacugu

SEQ ID NO: 1372927 - RNA, 21 nt, Homo sapiens
cuagcaucucaugagugccaa

SEQ ID NO: 1372928 - RNA, 17 nt, Homo sapiens
cuagcugaguaugcuga

SEQ ID NO: 1372929 - RNA, 17 nt, Homo sapiens
cuagcugcaagugacau

SEQ ID NO: 1372930 - RNA, 13 nt, Homo sapiens
cuaggagaccaag

SEQ ID NO: 1372931 - RNA, 17 nt, Homo sapiens
cuaggcauuugcugaau

SEQ ID NO: 1372932 - RNA, 22 nt, Homo sapiens
cuaggcugggugcccacagccc

SEQ ID NO: 1372933 - RNA, 21 nt, Homo sapiens
cuagggcccaggaucaaguca

SEQ ID NO: 1372934 - RNA, 15 nt, Homo sapiens
cuagguaggggccca

SEQ ID NO: 1372935 - RNA, 16 nt, Homo sapiens
cuagguucgaauccag

SEQ ID NO: 1372936 - RNA, 20 nt, Homo sapiens
cuagguucuaaaaauuguga

SEQ ID NO: 1372937 - RNA, 16 nt, Homo sapiens
cuagucugcuuuggua

SEQ ID NO: 1372938 - RNA, 20 nt, Homo sapiens
cuagucugugugggacugua

SEQ ID NO: 1372939 - RNA, 14 nt, Homo sapiens
cuccaucucugucu

SEQ ID NO: 1372940 - RNA, 16 nt, Homo sapiens
cuccauguuugaugua

SEQ ID NO: 1372941 - RNA, 23 nt, Homo sapiens
cuccauuccuggagcccgaggca

SEQ ID NO: 1372942 - RNA, 19 nt, Homo sapiens
cucccaaagugcugggauu

SEQ ID NO: 1372943 - RNA, 14 nt, Homo sapiens
cucccacaaaggag

SEQ ID NO: 1372944 - RNA, 16 nt, Homo sapiens
cucccagggccaugaa

SEQ ID NO: 1372945 - RNA, 22 nt, Homo sapiens
cucccaguccaaauguccucca

SEQ ID NO: 1372946 - RNA, 22 nt, Homo sapiens
cucccagugaccccugaccuca

SEQ ID NO: 1372947 - RNA, 12 nt, Homo sapiens
cuccccagugaa

SEQ ID NO: 1372948 - RNA, 14 nt, Homo sapiens
cuccccccacugca

SEQ ID NO: 1372949 - RNA, 17 nt, Homo sapiens
cucccccugccagugcc

SEQ ID NO: 1372950 - RNA, 12 nt, Homo sapiens
cuccccuaucca

SEQ ID NO: 1372951 - RNA, 23 nt, Homo sapiens
cuccccuauguaaaacuuagcaa

SEQ ID NO: 1372952 - RNA, 15 nt, Homo sapiens
cuccccuucacaugc

SEQ ID NO: 1372953 - RNA, 13 nt, Homo sapiens
cuccccuuugccu

SEQ ID NO: 1372954 - RNA, 19 nt, Homo sapiens
cuccccuuuuucuuccuca

SEQ ID NO: 1372955 - RNA, 16 nt, Homo sapiens
cucccuaggagaccaa

SEQ ID NO: 1372956 - RNA, 16 nt, Homo sapiens
cucccucaaagcacac

SEQ ID NO: 1372957 - RNA, 17 nt, Homo sapiens
cucccugaaguaagcaa

SEQ ID NO: 1372958 - RNA, 17 nt, Homo sapiens
cucccuucucuaccuca

SEQ ID NO: 1372959 - RNA, 20 nt, Homo sapiens
cuccgucuaagucaugagcu

SEQ ID NO: 1372960 - RNA, 14 nt, Homo sapiens
cuccucacugaaaa

SEQ ID NO: 1372961 - RNA, 17 nt, Homo sapiens
cuccucccugauguaca

SEQ ID NO: 1372962 - RNA, 13 nt, Homo sapiens
cuccucgcaagcu

SEQ ID NO: 1372963 - RNA, 18 nt, Homo sapiens
cuccugugucuugcaaug

SEQ ID NO: 1372964 - RNA, 14 nt, Homo sapiens
cuccuuccaccaca

SEQ ID NO: 1372965 - RNA, 18 nt, Homo sapiens
cuccuuccuugaccagca

SEQ ID NO: 1372966 - RNA, 19 nt, Homo sapiens
cuccuuguaaagacuguag

SEQ ID NO: 1372967 - RNA, 18 nt, Homo sapiens
cuccuuucccaacacuuc

SEQ ID NO: 1372968 - RNA, 22 nt, Homo sapiens
cucgaacccacacugcaacagg

SEQ ID NO: 1372969 - RNA, 15 nt, Homo sapiens
ucccaauagcacuuu

SEQ ID NO: 1372970 - RNA, 12 nt, Homo sapiens
ucccaauucauc

SEQ ID NO: 1372971 - RNA, 20 nt, Homo sapiens
ucccaccacagcagguguca

SEQ ID NO: 1372972 - RNA, 23 nt, Homo sapiens
ucccaccgguugcuucugggaag

SEQ ID NO: 1372973 - RNA, 16 nt, Homo sapiens
ucccaccucaaauggg

SEQ ID NO: 1372974 - RNA, 13 nt, Homo sapiens
ucccacucaagcc

SEQ ID NO: 1372975 - RNA, 12 nt, Homo sapiens
ucccacugccaa

SEQ ID NO: 1372976 - RNA, 22 nt, Homo sapiens
ucccacuuggaggccuuucauc

SEQ ID NO: 1372977 - RNA, 15 nt, Homo sapiens
ucccacuugucaugu

SEQ ID NO: 1372978 - RNA, 22 nt, Homo sapiens
ucccagcacuuugggaggccaa

SEQ ID NO: 1372979 - RNA, 11 nt, Homo sapiens
ucccagcauug

SEQ ID NO: 1372980 - RNA, 13 nt, Homo sapiens
ucccagcuacuca

SEQ ID NO: 1372981 - RNA, 15 nt, Homo sapiens
ucccagcuacuuggg

SEQ ID NO: 1372982 - RNA, 17 nt, Homo sapiens
ucccagcucacgucaca

SEQ ID NO: 1372983 - RNA, 21 nt, Homo sapiens
ucccagcugaaauacugaggg

SEQ ID NO: 1372984 - RNA, 19 nt, Homo sapiens
ucccaggcuggagugcagu

SEQ ID NO: 1372985 - RNA, 16 nt, Homo sapiens
ucccaucccagcugaa

SEQ ID NO: 1372986 - RNA, 17 nt, Homo sapiens
ucccauucgcaauaagu

SEQ ID NO: 1372987 - RNA, 15 nt, Homo sapiens
ucccauucuugcaug

SEQ ID NO: 1372988 - RNA, 19 nt, Homo sapiens
uccccaacgaaaagcacau

SEQ ID NO: 1372989 - RNA, 21 nt, Homo sapiens
ucuacaaacucccacuuguca

SEQ ID NO: 1372990 - RNA, 14 nt, Homo sapiens
ucuacaaaggccau

SEQ ID NO: 1372991 - RNA, 17 nt, Homo sapiens
ucuacacuguauuacau

SEQ ID NO: 1372992 - RNA, 14 nt, Homo sapiens
ucuacagaggccau

SEQ ID NO: 1372993 - RNA, 21 nt, Homo sapiens
ucuacaguuaggguugaguua

SEQ ID NO: 1372994 - RNA, 21 nt, Homo sapiens
ucuacauuucaccuacuuugu

SEQ ID NO: 1372995 - RNA, 13 nt, Homo sapiens
ucuaccaacugga

SEQ ID NO: 1372996 - RNA, 12 nt, Homo sapiens
ucuaccacccac

SEQ ID NO: 1372997 - RNA, 17 nt, Homo sapiens
ucuaccccugcuaagga

SEQ ID NO: 1372998 - RNA, 19 nt, Homo sapiens
ucuacccugcugaccuccc

SEQ ID NO: 1372999 - RNA, 15 nt, Homo sapiens
ucuacccuggcacua

SEQ ID NO: 1373000 - RNA, 18 nt, Homo sapiens
ucuaccugagucccaaag

SEQ ID NO: 1373001 - RNA, 22 nt, Homo sapiens
ucuacgcaaaaaauaacuacag

SEQ ID NO: 1373002 - RNA, 19 nt, Homo sapiens
ucuacuaaaaauacaaaaa

SEQ ID NO: 1373003 - RNA, 15 nt, Homo sapiens
ucuacugaggugcua

SEQ ID NO: 1373004 - RNA, 16 nt, Homo sapiens
ucuacugaggugcuau

SEQ ID NO: 1373005 - RNA, 13 nt, Homo sapiens
ucuacugcuucua

SEQ ID NO: 1373006 - RNA, 23 nt, Homo sapiens
ucuacuuacacaucuuccacagg

SEQ ID NO: 1373007 - RNA, 16 nt, Homo sapiens
ucuacuucugcccuug

SEQ ID NO: 1373008 - RNA, 15 nt, Homo sapiens
ucuagaagacuguca

SEQ ID NO: 1373009 - RNA, 20 nt, Homo sapiens
ucuaguugaggaguuuccua

SEQ ID NO: 1373010 - RNA, 17 nt, Homo sapiens
ucuauaauugccacuga

SEQ ID NO: 1373011 - RNA, 20 nt, Homo sapiens
ucuaucccaaacuaagcuau

SEQ ID NO: 1373012 - RNA, 23 nt, Homo sapiens
ucuaucucucuuuacauuuuggu

SEQ ID NO: 1373013 - RNA, 19 nt, Homo sapiens
ucuaugaaauaucaugcuc

SEQ ID NO: 1373014 - RNA, 23 nt, Homo sapiens
ucuaugaccucgcccuccacaaa

SEQ ID NO: 1373015 - RNA, 16 nt, Homo sapiens
ucuauggcacccaugc

SEQ ID NO: 1373016 - RNA, 15 nt, Homo sapiens
ucuaugucucaugau

SEQ ID NO: 1373017 - RNA, 20 nt, Homo sapiens
ucuauuuugagaucauugca

SEQ ID NO: 1373018 - RNA, 17 nt, Homo sapiens
ucucaaaccuccaaaag

SEQ ID NO: 1373019 - RNA, 22 nt, Homo sapiens
ucucaaacgguacacagacuau

SEQ ID NO: 1373020 - RNA, 23 nt, Homo sapiens
ucucaaaggguacuuccacugau

SEQ ID NO: 1373021 - RNA, 22 nt, Homo sapiens
ucucaagccgcaucccagacuu

SEQ ID NO: 1373022 - RNA, 18 nt, Homo sapiens
ucucacaguguugcccag

SEQ ID NO: 1373023 - RNA, 18 nt, Homo sapiens
ucucacuauguugcccag

SEQ ID NO: 1373024 - RNA, 18 nt, Homo sapiens
ucucacuguugcccaggc

SEQ ID NO: 1373025 - RNA, 14 nt, Homo sapiens
ucucacuugucuca

SEQ ID NO: 1373026 - RNA, 18 nt, Homo sapiens
ucucacuuuuauugauaa

SEQ ID NO: 1373027 - RNA, 14 nt, Homo sapiens
ucucagaagguauu

SEQ ID NO: 1373028 - RNA, 22 nt, Homo sapiens
ucucagagugguucugagauua

SEQ ID NO: 1373029 - RNA, 13 nt, Homo sapiens
ucucagcacuugg

SEQ ID NO: 1373030 - RNA, 17 nt, Homo sapiens
ucucagggaagcccagc

SEQ ID NO: 1373031 - RNA, 23 nt, Homo sapiens
ucucaguccaccugagcugccau

SEQ ID NO: 1373032 - RNA, 21 nt, Homo sapiens
ucucagugcuucuuacuauua

SEQ ID NO: 1373033 - RNA, 17 nt, Homo sapiens
ucucauacucaccucac

SEQ ID NO: 1373034 - RNA, 15 nt, Homo sapiens
ucucaugagugccaa

SEQ ID NO: 1373035 - RNA, 21 nt, Homo sapiens
ucucaugagugccaagcaaaa

SEQ ID NO: 1373036 - RNA, 18 nt, Homo sapiens
ucucauuuaaaaugagau

SEQ ID NO: 1373037 - RNA, 19 nt, Homo sapiens
ucucauuuaaaaugagauc

SEQ ID NO: 1373038 - RNA, 21 nt, Homo sapiens
ucucauuuuuaucccauugag

SEQ ID NO: 1373039 - RNA, 17 nt, Homo sapiens
ucuccaaaugagaucua

SEQ ID NO: 1373040 - RNA, 21 nt, Homo sapiens
ucuccaaccagauugucagcu

SEQ ID NO: 1373041 - RNA, 20 nt, Homo sapiens
ucuccagaaagcucaucuca

SEQ ID NO: 1373042 - RNA, 20 nt, Homo sapiens
ucuccagagggaauugcaga

SEQ ID NO: 1373043 - RNA, 19 nt, Homo sapiens
ucuccagggacauguggaa

SEQ ID NO: 1373044 - RNA, 18 nt, Homo sapiens
ucuccaucucugucucaa

SEQ ID NO: 1373045 - RNA, 18 nt, Homo sapiens
ucucccaggacccaucac

SEQ ID NO: 1373046 - RNA, 13 nt, Homo sapiens
ucuccccaugugc

SEQ ID NO: 1373047 - RNA, 16 nt, Homo sapiens
ucucccccuaguuugu

SEQ ID NO: 1373048 - RNA, 17 nt, Homo sapiens
ucucccgggaagccacc

SEQ ID NO: 1373049 - RNA, 16 nt, Homo sapiens
ucucccuggcccucag

SEQ ID NO: 1373050 - RNA, 23 nt, Homo sapiens
ucucccuguuggucgguggguug

SEQ ID NO: 1373051 - RNA, 23 nt, Homo sapiens
ucuccucucucuguaauaaacuc

SEQ ID NO: 1373052 - RNA, 18 nt, Homo sapiens
ucuccugaagaggaacug

SEQ ID NO: 1373053 - RNA, 19 nt, Homo sapiens
ucuccugaggaucagaaag

SEQ ID NO: 1373054 - RNA, 21 nt, Homo sapiens
ucuccugaggaucagaaagua

SEQ ID NO: 1373055 - RNA, 13 nt, Homo sapiens
ucuccugcaugca

SEQ ID NO: 1373056 - RNA, 20 nt, Homo sapiens
ucucgaacuccuggacucaa

SEQ ID NO: 1373057 - RNA, 13 nt, Homo sapiens
ucucgauggacaa

SEQ ID NO: 1373058 - RNA, 15 nt, Homo sapiens
ucucuaaaauagcca

SEQ ID NO: 1373059 - RNA, 23 nt, Homo sapiens
ucucuaugccagcucagucccau

SEQ ID NO: 1373060 - RNA, 17 nt, Homo sapiens
ucucuauuaccacugaa

SEQ ID NO: 1373061 - RNA, 21 nt, Homo sapiens
ucucucagugaacugugaggg

SEQ ID NO: 1373062 - RNA, 13 nt, Homo sapiens
ucucucuucucca

SEQ ID NO: 1373063 - RNA, 16 nt, Homo sapiens
ucucugcaucacccac

SEQ ID NO: 1373064 - RNA, 14 nt, Homo sapiens
ucucugcuauggaa

SEQ ID NO: 1373065 - RNA, 21 nt, Homo sapiens
ucucuuaaaccacagcacuau

SEQ ID NO: 1373066 - RNA, 16 nt, Homo sapiens
ucucuuauagaauauu

SEQ ID NO: 1373067 - RNA, 21 nt, Homo sapiens
ucucuuuaaauggcuuuaugc

SEQ ID NO: 1373068 - RNA, 19 nt, Homo sapiens
ucugaaaauuaacacugcu

SEQ ID NO: 1373069 - RNA, 13 nt, Homo sapiens
ucugaaacuaaug

SEQ ID NO: 1373070 - RNA, 17 nt, Homo sapiens
ucugaaacuaaugaaag

SEQ ID NO: 1373071 - RNA, 21 nt, Homo sapiens
ucugaagcagaugcaaagagg

SEQ ID NO: 1373072 - RNA, 13 nt, Homo sapiens
ucugaagucacau

SEQ ID NO: 1373073 - RNA, 15 nt, Homo sapiens
ucugaagucacugca

SEQ ID NO: 1373074 - RNA, 13 nt, Homo sapiens
ucugaauuccaag

SEQ ID NO: 1373075 - RNA, 13 nt, Homo sapiens
ucugaccaaaaca

SEQ ID NO: 1373076 - RNA, 13 nt, Homo sapiens
ucugaccauuuca

SEQ ID NO: 1373077 - RNA, 18 nt, Homo sapiens
ucugaccauuucaggggu

SEQ ID NO: 1373078 - RNA, 13 nt, Homo sapiens
ucugagauacuaa

SEQ ID NO: 1373079 - RNA, 12 nt, Homo sapiens
ucugagccaaag

SEQ ID NO: 1373080 - RNA, 21 nt, Homo sapiens
ucugagcucuggcuuugccuu

SEQ ID NO: 1373081 - RNA, 21 nt, Homo sapiens
ucugaggcuucuggggcuuca

SEQ ID NO: 1373082 - RNA, 15 nt, Homo sapiens
uucuaaugugugaau

SEQ ID NO: 1373083 - RNA, 11 nt, Homo sapiens
uucuaggcauc

SEQ ID NO: 1373084 - RNA, 17 nt, Homo sapiens
uucuagguaggggccca

SEQ ID NO: 1373085 - RNA, 24 nt, Homo sapiens
uucuaguuuugucaaacuguagaa

SEQ ID NO: 1373086 - RNA, 17 nt, Homo sapiens
uucuauaggaacauaug

SEQ ID NO: 1373087 - RNA, 23 nt, Homo sapiens
uucucaaaugcacaucucauggc

SEQ ID NO: 1373088 - RNA, 21 nt, Homo sapiens
uucucacagugggagccaggg

SEQ ID NO: 1373089 - RNA, 14 nt, Homo sapiens
uucucaucacauca

SEQ ID NO: 1373090 - RNA, 16 nt, Homo sapiens
uucuccaugcugagaa

SEQ ID NO: 1373091 - RNA, 22 nt, Homo sapiens
uuggccaaacaucagaccuguc

SEQ ID NO: 1373092 - RNA, 17 nt, Homo sapiens
uuggcuaguugaaucua

SEQ ID NO: 1373093 - RNA, 14 nt, Homo sapiens
uuggcuucagggga

SEQ ID NO: 1373094 - RNA, 13 nt, Homo sapiens
uuggcuuugccag

SEQ ID NO: 1373095 - RNA, 16 nt, Homo sapiens
uugggauauucugaaa

SEQ ID NO: 1373096 - RNA, 21 nt, Homo sapiens
uugggauauucugaaacuuga

SEQ ID NO: 1373097 - RNA, 23 nt, Homo sapiens
uugggauugucuuacuguugcau

SEQ ID NO: 1373098 - RNA, 16 nt, Homo sapiens
uugggcuggugucacc

SEQ ID NO: 1373099 - RNA, 14 nt, Homo sapiens
uugguaugugacau

SEQ ID NO: 1373100 - RNA, 14 nt, Homo sapiens
uugguccuaagucc

SEQ ID NO: 1373101 - RNA, 14 nt, Homo sapiens
uuggugcuuuucac

SEQ ID NO: 1373102 - RNA, 17 nt, Homo sapiens
uuggugcuuuucacuug

SEQ ID NO: 1373103 - RNA, 14 nt, Homo sapiens
uugguuuaaaagac

SEQ ID NO: 1373104 - RNA, 20 nt, Homo sapiens
uuguaaaauauuuaugagaa

SEQ ID NO: 1373105 - RNA, 22 nt, Homo sapiens
uuguaagugagagagacaagaa

SEQ ID NO: 1373106 - RNA, 16 nt, Homo sapiens
uuguauauuauggaag

SEQ ID NO: 1373107 - RNA, 18 nt, Homo sapiens
uuguaugauccuaaugaa

SEQ ID NO: 1373108 - RNA, 15 nt, Homo sapiens
uugucaaaaggaagu

SEQ ID NO: 1373109 - RNA, 17 nt, Homo sapiens
uugucccacucaagcca

SEQ ID NO: 1373110 - RNA, 18 nt, Homo sapiens
uugucccuaugcauauca

SEQ ID NO: 1373111 - RNA, 16 nt, Homo sapiens
uugucuuuacuccaug

SEQ ID NO: 1373112 - RNA, 15 nt, Homo sapiens
uugugagccaccacg

SEQ ID NO: 1373113 - RNA, 14 nt, Homo sapiens
uugugaucaugaga

SEQ ID NO: 1373114 - RNA, 17 nt, Homo sapiens
uuguggucugagccaaa

SEQ ID NO: 1373115 - RNA, 21 nt, Homo sapiens
uuguggucugagccaaagaga

SEQ ID NO: 1373116 - RNA, 22 nt, Homo sapiens
uuguguguguguguugauccca

SEQ ID NO: 1373117 - RNA, 23 nt, Homo sapiens
uuguguuuuuuuuuuaaauagac

SEQ ID NO: 1373118 - RNA, 17 nt, Homo sapiens
uuguuaagauaugaugu

SEQ ID NO: 1373119 - RNA, 18 nt, Homo sapiens
uuguuaccuuuaugguuu

SEQ ID NO: 1373120 - RNA, 19 nt, Homo sapiens
uuguuaugcaucauuucag

SEQ ID NO: 1373121 - RNA, 18 nt, Homo sapiens
uuguuauucuguaguuuc

SEQ ID NO: 1373122 - RNA, 21 nt, Homo sapiens
uuguucguauuuagaauggga

SEQ ID NO: 1373123 - RNA, 12 nt, Homo sapiens
uuguugaacacu

SEQ ID NO: 1373124 - RNA, 14 nt, Homo sapiens
uuguugcagccaaa

SEQ ID NO: 1373125 - RNA, 15 nt, Homo sapiens
uuguuguucuuucag

SEQ ID NO: 1373126 - RNA, 13 nt, Homo sapiens
uuguuuuuugcca

SEQ ID NO: 1373127 - RNA, 14 nt, Homo sapiens
uuguuuuuugccau

SEQ ID NO: 1373128 - RNA, 23 nt, Homo sapiens
uuuaaaaaaaaaaaaaaagccaa

SEQ ID NO: 1373129 - RNA, 23 nt, Homo sapiens
uuuaaaaaaauacaguauucugu

SEQ ID NO: 1373130 - RNA, 20 nt, Homo sapiens
uuuaaaaccugugugccauu

SEQ ID NO: 1373131 - RNA, 21 nt, Homo sapiens
uuuaaacacggggcuugcaac

SEQ ID NO: 1373132 - RNA, 14 nt, Homo sapiens
uuuaaacauaggaa

SEQ ID NO: 1373133 - RNA, 12 nt, Homo sapiens
uuuaaacaucag

SEQ ID NO: 1373134 - RNA, 22 nt, Homo sapiens
uuuaaacugaaugaacaaccuc

SEQ ID NO: 1373135 - RNA, 19 nt, Homo sapiens
uuuaaauggagacuggaaa

SEQ ID NO: 1373136 - RNA, 13 nt, Homo sapiens
uuuaacaauaacu

SEQ ID NO: 1373137 - RNA, 14 nt, Homo sapiens
uuuaacggcacugu

SEQ ID NO: 1373138 - RNA, 17 nt, Homo sapiens
uuuaacuuaacauucug

SEQ ID NO: 1373139 - RNA, 12 nt, Homo sapiens
uuuaaggauaaa

SEQ ID NO: 1373140 - RNA, 22 nt, Homo sapiens
uuuaauacaggguagauaaccu

SEQ ID NO: 1373141 - RNA, 14 nt, Homo sapiens
uuuaaucacauucg

SEQ ID NO: 1373142 - RNA, 16 nt, Homo sapiens
uuuaaucccacuugcc

SEQ ID NO: 1373143 - RNA, 16 nt, Homo sapiens
uuuaaugaagugcaau

SEQ ID NO: 1373144 - RNA, 12 nt, Homo sapiens
uuuacaccaguu

SEQ ID NO: 1373145 - RNA, 13 nt, Homo sapiens
uuuacauaugcuu

SEQ ID NO: 1373146 - RNA, 17 nt, Homo sapiens
uuuacauuauuaagaaa

SEQ ID NO: 1373147 - RNA, 11 nt, Homo sapiens
uuuacauucau

SEQ ID NO: 1373148 - RNA, 15 nt, Homo sapiens
uuuacauucaucuca

SEQ ID NO: 1373149 - RNA, 15 nt, Homo sapiens
uuuacauuuaucugu

SEQ ID NO: 1373150 - RNA, 17 nt, Homo sapiens
uuuagauuuuaaucaaa

SEQ ID NO: 1373151 - RNA, 20 nt, Homo sapiens
uuuagcaauuuauacaauau

SEQ ID NO: 1373152 - RNA, 12 nt, Homo sapiens
uuuagcacaaaa

SEQ ID NO: 1373153 - RNA, 17 nt, Homo sapiens
uuuagcagaaucaaaau

SEQ ID NO: 1373154 - RNA, 18 nt, Homo sapiens
uuuagcagaggagccaug

SEQ ID NO: 1373155 - RNA, 13 nt, Homo sapiens
uuuaggaugcuuu

SEQ ID NO: 1373156 - RNA, 23 nt, Homo sapiens
uuuauacucaggcagaucucagc

SEQ ID NO: 1373157 - RNA, 15 nt, Homo sapiens
uuuauacuguuuacu

SEQ ID NO: 1373158 - RNA, 18 nt, Homo sapiens
uuuauauuuuuauagaca

SEQ ID NO: 1373159 - RNA, 18 nt, Homo sapiens
uuuaucacacaaagcaga

SEQ ID NO: 1373160 - RNA, 21 nt, Homo sapiens
uuuaucuauggcacccaugca

SEQ ID NO: 1373161 - RNA, 20 nt, Homo sapiens
uuuaugagaaaugccagugu

SEQ ID NO: 1373162 - RNA, 22 nt, Homo sapiens
uuuaugagacccauuccuauuu

SEQ ID NO: 1373163 - RNA, 13 nt, Homo sapiens
uuuaugaguacuu

SEQ ID NO: 1373164 - RNA, 14 nt, Homo sapiens
uuuauucaacaacu

SEQ ID NO: 1373165 - RNA, 17 nt, Homo sapiens
uuuauucuugaagugaa

SEQ ID NO: 1373166 - RNA, 14 nt, Homo sapiens
uuuauuuacuucgu

SEQ ID NO: 1373167 - RNA, 19 nt, Homo sapiens
uuuauuuuuguagagccag

SEQ ID NO: 1373168 - RNA, 23 nt, Homo sapiens
uuucaagaccuucuccccauucu

SEQ ID NO: 1373169 - RNA, 19 nt, Homo sapiens
uuucaaguguaacuuauua

SEQ ID NO: 1373170 - RNA, 20 nt, Homo sapiens
uuucaauaucuuuauugcau

SEQ ID NO: 1373171 - RNA, 23 nt, Homo sapiens
uuucaaucaaaacucaguaucau

SEQ ID NO: 1373172 - RNA, 18 nt, Homo sapiens
uuucacacuuccaccagc

SEQ ID NO: 1373173 - RNA, 14 nt, Homo sapiens
uuucacauaugugu

SEQ ID NO: 1373174 - RNA, 17 nt, Homo sapiens
uuucaccacaugugcac

SEQ ID NO: 1373175 - RNA, 18 nt, Homo sapiens
uuucacuuguguuuuaaa

SEQ ID NO: 1373176 - RNA, 17 nt, Homo sapiens
uuucagaaaauucccau

SEQ ID NO: 1373177 - RNA, 17 nt, Homo sapiens
uuucagauaaacaacaa

SEQ ID NO: 1373178 - RNA, 19 nt, Homo sapiens
uuucagaugauucuauguc

SEQ ID NO: 1373179 - RNA, 19 nt, Homo sapiens
uuucagugaaagcaucacu

SEQ ID NO: 1373180 - RNA, 23 nt, Homo sapiens
uuucaguggcuaccuacauacaa

SEQ ID NO: 1373181 - RNA, 18 nt, Homo sapiens
uuucauaaccuagccuua

SEQ ID NO: 1373182 - RNA, 16 nt, Homo sapiens
uuucauaucacacugu

SEQ ID NO: 1373183 - RNA, 17 nt, Homo sapiens
uuucaucauaacauaaa

SEQ ID NO: 1373184 - RNA, 20 nt, Homo sapiens
uuucaugcuauuucacucua

SEQ ID NO: 1373185 - RNA, 20 nt, Homo sapiens
uuucauggguuauguguaug

SEQ ID NO: 1373186 - RNA, 12 nt, Homo sapiens
uuucauucacuu

SEQ ID NO: 1373187 - RNA, 15 nt, Homo sapiens
uuuccaaauucacaa

SEQ ID NO: 1373188 - RNA, 15 nt, Homo sapiens
uuuccagauauucaa

SEQ ID NO: 1373189 - RNA, 21 nt, Homo sapiens
uuuccagcgggacucuucuca

SEQ ID NO: 1373190 - RNA, 22 nt, Homo sapiens
uuuccagucauaccaacuuuag

SEQ ID NO: 1373191 - RNA, 17 nt, Homo sapiens
uuucccuguuucuucca

SEQ ID NO: 1373192 - RNA, 13 nt, Homo sapiens
uuuccuaucauuu

SEQ ID NO: 1373193 - RNA, 19 nt, Homo sapiens
uuuccuguagucccauuga

SEQ ID NO: 1373194 - RNA, 12 nt, Homo sapiens
uuuccuguucag

SEQ ID NO: 1373195 - RNA, 22 nt, Homo sapiens
uuuccuguucagcauucuuagc

SEQ ID NO: 1373196 - RNA, 20 nt, Homo sapiens
gcccaggauggcuuugaaug

SEQ ID NO: 1373197 - RNA, 15 nt, Homo sapiens
gcccaggcaggccac

SEQ ID NO: 1373198 - RNA, 17 nt, Homo sapiens
gcccaggcaggucuuga

SEQ ID NO: 1373199 - RNA, 20 nt, Homo sapiens
gcccaggcuggaguggagug

SEQ ID NO: 1373200 - RNA, 20 nt, Homo sapiens
gcccagggccacucugccuc

SEQ ID NO: 1373201 - RNA, 15 nt, Homo sapiens
gcccaguguguuucu

SEQ ID NO: 1373202 - RNA, 21 nt, Homo sapiens
gcccaguguuguuuguaaaua

SEQ ID NO: 1373203 - RNA, 19 nt, Homo sapiens
gcccaguguuugugcaagg

SEQ ID NO: 1373204 - RNA, 18 nt, Homo sapiens
gcccaguuggguggaugc

SEQ ID NO: 1373205 - RNA, 18 nt, Homo sapiens
gcccauaucugugaaaug

SEQ ID NO: 1373206 - RNA, 14 nt, Homo sapiens
gcccauccagucuc

SEQ ID NO: 1373207 - RNA, 16 nt, Homo sapiens
gcccauuucuccauac

SEQ ID NO: 1373208 - RNA, 15 nt, Homo sapiens
gccccaugaagccac

SEQ ID NO: 1373209 - RNA, 18 nt, Homo sapiens
gccccauggggcaucucu

SEQ ID NO: 1373210 - RNA, 15 nt, Homo sapiens
gcccccaugcaaggu

SEQ ID NO: 1373211 - RNA, 21 nt, Homo sapiens
gcccccgagcugggggccaug

SEQ ID NO: 1373212 - RNA, 17 nt, Homo sapiens
gcccccgcucaugggcc

SEQ ID NO: 1373213 - RNA, 13 nt, Homo sapiens
gcccccugcaucu

SEQ ID NO: 1373214 - RNA, 20 nt, Homo sapiens
gcccccuucucccacacugc

SEQ ID NO: 1373215 - RNA, 19 nt, Homo sapiens
gccccucaccaacccagag

SEQ ID NO: 1373216 - RNA, 15 nt, Homo sapiens
gccccuguuaccuaa

SEQ ID NO: 1373217 - RNA, 17 nt, Homo sapiens
gccccuucauggaagaa

SEQ ID NO: 1373218 - RNA, 22 nt, Homo sapiens
gcccuaggcuccgucaguauca

SEQ ID NO: 1373219 - RNA, 22 nt, Homo sapiens
gcccucgggcgagucacugccu

SEQ ID NO: 1373220 - RNA, 22 nt, Homo sapiens
gcccucuaugguguggcaaagc

SEQ ID NO: 1373221 - RNA, 16 nt, Homo sapiens
guucugucucauauga

SEQ ID NO: 1373222 - RNA, 14 nt, Homo sapiens
guucuuacugcuug

SEQ ID NO: 1373223 - RNA, 20 nt, Homo sapiens
guucuuucagaaagcuuuga

SEQ ID NO: 1373224 - RNA, 15 nt, Homo sapiens
guugaaagaucaaaa

SEQ ID NO: 1373225 - RNA, 19 nt, Homo sapiens
guugagaguugcuggugua

SEQ ID NO: 1373226 - RNA, 19 nt, Homo sapiens
guugaggccaggaguuuaa

SEQ ID NO: 1373227 - RNA, 20 nt, Homo sapiens
guugauaaauuccacuggac

SEQ ID NO: 1373228 - RNA, 15 nt, Homo sapiens
guugaucccaagaca

SEQ ID NO: 1373229 - RNA, 13 nt, Homo sapiens
guugcaucauguu

SEQ ID NO: 1373230 - RNA, 14 nt, Homo sapiens
guugcugcaucucc

SEQ ID NO: 1373231 - RNA, 16 nt, Homo sapiens
guugcuuuuuuuccaa

SEQ ID NO: 1373232 - RNA, 14 nt, Homo sapiens
guuguaaagaguug

SEQ ID NO: 1373233 - RNA, 14 nt, Homo sapiens
guuguauugcauau

SEQ ID NO: 1373234 - RNA, 23 nt, Homo sapiens
guuguucuuuucccccaaagugg

SEQ ID NO: 1373235 - RNA, 11 nt, Homo sapiens
guuguugccaa

SEQ ID NO: 1373236 - RNA, 23 nt, Homo sapiens
guuuacacugucaaacaucugga

SEQ ID NO: 1373237 - RNA, 18 nt, Homo sapiens
guuuagccaaaggauaag

SEQ ID NO: 1373238 - RNA, 14 nt, Homo sapiens
guuuaguugcacaa

SEQ ID NO: 1373239 - RNA, 23 nt, Homo sapiens
guuucaaaaaaucugaccaaaac

SEQ ID NO: 1373240 - RNA, 21 nt, Homo sapiens
guuucauaggagacacaucca

SEQ ID NO: 1373241 - RNA, 19 nt, Homo sapiens
guuucuaaaguguuggcaa

SEQ ID NO: 1373242 - RNA, 22 nt, Homo sapiens
guuucucuugaagaacugacua

SEQ ID NO: 1373243 - RNA, 23 nt, Homo sapiens
guuucugaaaagaugguaucaua

SEQ ID NO: 1373244 - RNA, 14 nt, Homo sapiens
guuucuggaauuga

SEQ ID NO: 1373245 - RNA, 16 nt, Homo sapiens
guuucuuccacagugc

SEQ ID NO: 1373246 - RNA, 14 nt, Homo sapiens
guuugaccaucacc

SEQ ID NO: 1373247 - RNA, 13 nt, Homo sapiens
guuugagaccagc

SEQ ID NO: 1373248 - RNA, 18 nt, Homo sapiens
guuugagcuuagugaaau

SEQ ID NO: 1373249 - RNA, 17 nt, Homo sapiens
guuugcuuauuguucca

SEQ ID NO: 1373250 - RNA, 20 nt, Homo sapiens
guuuguggccucagaauuga

SEQ ID NO: 1373251 - RNA, 14 nt, Homo sapiens
guuuuacugcagcu

SEQ ID NO: 1373252 - RNA, 11 nt, Homo sapiens
guuuucagugu

SEQ ID NO: 1373253 - RNA, 14 nt, Homo sapiens
guuuucaguguaca

SEQ ID NO: 1373254 - RNA, 19 nt, Homo sapiens
guuuuguggaggagcucag

SEQ ID NO: 1373255 - RNA, 17 nt, Homo sapiens
guuuuguguaacauauu

SEQ ID NO: 1373256 - RNA, 15 nt, Homo sapiens
guuuuuaagcuguuu

SEQ ID NO: 1373257 - RNA, 20 nt, Homo sapiens
guuuuuagauuaaacaaaca

SEQ ID NO: 1373258 - RNA, 18 nt, Homo sapiens
guuuuucauucacuuuaa

SEQ ID NO: 1373259 - RNA, 13 nt, Homo sapiens
guuuuuccuccau

SEQ ID NO: 1373260 - RNA, 17 nt, Homo sapiens
guuuuuguuuuuugcca

SEQ ID NO: 1373261 - RNA, 12 nt, Homo sapiens
guuuuuugccau

SEQ ID NO: 1373262 - RNA, 17 nt, Homo sapiens
uaaaaaaaaucaaguau

SEQ ID NO: 1373263 - RNA, 19 nt, Homo sapiens
uaaaaaccaagaagauguc

SEQ ID NO: 1373264 - RNA, 13 nt, Homo sapiens
gaggaaacuuuga

SEQ ID NO: 1373265 - RNA, 14 nt, Homo sapiens
gaggaaacuuugau

SEQ ID NO: 1373266 - RNA, 16 nt, Homo sapiens
gaggaaaggccagcug

SEQ ID NO: 1373267 - RNA, 18 nt, Homo sapiens
gaggaagugauaguuucu

SEQ ID NO: 1373268 - RNA, 13 nt, Homo sapiens
gaggaaugcuccc

SEQ ID NO: 1373269 - RNA, 17 nt, Homo sapiens
gaggacuuuucuuugug

SEQ ID NO: 1373270 - RNA, 22 nt, Homo sapiens
gaggagggaugcugccugaguc

SEQ ID NO: 1373271 - RNA, 20 nt, Homo sapiens
gaggcaggagaauggcguga

SEQ ID NO: 1373272 - RNA, 20 nt, Homo sapiens
gaggcaggaggauugcuuga

SEQ ID NO: 1373273 - RNA, 15 nt, Homo sapiens
gaggccucgacccac

SEQ ID NO: 1373274 - RNA, 22 nt, Homo sapiens
gaggcucuaaccacacagccua

SEQ ID NO: 1373275 - RNA, 21 nt, Homo sapiens
gaggcugagccuacagaugaa

SEQ ID NO: 1373276 - RNA, 20 nt, Homo sapiens
gaggcugucuucucaggcuc

SEQ ID NO: 1373277 - RNA, 13 nt, Homo sapiens
gagggaagccuga

SEQ ID NO: 1373278 - RNA, 16 nt, Homo sapiens
gagggcagaucacuuc

SEQ ID NO: 1373279 - RNA, 17 nt, Homo sapiens
gagggcccacuucaggg

SEQ ID NO: 1373280 - RNA, 23 nt, Homo sapiens
gagggguugaugccagacaucac

SEQ ID NO: 1373281 - RNA, 15 nt, Homo sapiens
gagggucuucuuaca

SEQ ID NO: 1373282 - RNA, 23 nt, Homo sapiens
gaggguuguucuccuagacugac

SEQ ID NO: 1373283 - RNA, 13 nt, Homo sapiens
gagguacacucuu

SEQ ID NO: 1373284 - RNA, 13 nt, Homo sapiens
gagguacucuccu

SEQ ID NO: 1373285 - RNA, 20 nt, Homo sapiens
gagguaggagaauugcuuga

SEQ ID NO: 1373286 - RNA, 20 nt, Homo sapiens
gaggucaaggcugcagugag

SEQ ID NO: 1373287 - RNA, 18 nt, Homo sapiens
gagguggagguugcagug

SEQ ID NO: 1373288 - RNA, 19 nt, Homo sapiens
gagguggagguugcaguga

SEQ ID NO: 1373289 - RNA, 12 nt, Homo sapiens
gagguggcugcc

SEQ ID NO: 1373290 - RNA, 20 nt, Homo sapiens
gagguggggcuggaugucuc

SEQ ID NO: 1373291 - RNA, 21 nt, Homo sapiens
gagguguuuaacggcacugug

SEQ ID NO: 1373292 - RNA, 21 nt, Homo sapiens
gaguacuuugaagaugucauc

SEQ ID NO: 1373293 - RNA, 18 nt, Homo sapiens
gagucaaaacacuuguaa

SEQ ID NO: 1373294 - RNA, 12 nt, Homo sapiens
gagucacugccu

SEQ ID NO: 1373295 - RNA, 20 nt, Homo sapiens
gacgcaacuuaagcugggau

SEQ ID NO: 1373296 - RNA, 23 nt, Homo sapiens
gacgggcaaaauaaagugacaga

SEQ ID NO: 1373297 - RNA, 20 nt, Homo sapiens
gacgugcacgcacacugucu

SEQ ID NO: 1373298 - RNA, 13 nt, Homo sapiens
gacuacagacauu

SEQ ID NO: 1373299 - RNA, 17 nt, Homo sapiens
gacuacaggcacccacc

SEQ ID NO: 1373300 - RNA, 21 nt, Homo sapiens
gacuauugacaucagcaucac

SEQ ID NO: 1373301 - RNA, 17 nt, Homo sapiens
gacucaaguuucuucaa

SEQ ID NO: 1373302 - RNA, 21 nt, Homo sapiens
gacucaaguuucuucaaucug

SEQ ID NO: 1373303 - RNA, 18 nt, Homo sapiens
gacucacuggcagcccca

SEQ ID NO: 1373304 - RNA, 18 nt, Homo sapiens
gacucaggaugcccaggg

SEQ ID NO: 1373305 - RNA, 22 nt, Homo sapiens
gacucaguuuucuugcagauca

SEQ ID NO: 1373306 - RNA, 16 nt, Homo sapiens
gacucauugcuucaca

SEQ ID NO: 1373307 - RNA, 17 nt, Homo sapiens
gacuccagaucugcacc

SEQ ID NO: 1373308 - RNA, 16 nt, Homo sapiens
gacuccgucucaaaaa

SEQ ID NO: 1373309 - RNA, 17 nt, Homo sapiens
gacucuacagaggccau

SEQ ID NO: 1373310 - RNA, 22 nt, Homo sapiens
gacucuauuaaaaucuucaaua

SEQ ID NO: 1373311 - RNA, 19 nt, Homo sapiens
gacucuccagaaagcucau

SEQ ID NO: 1373312 - RNA, 23 nt, Homo sapiens
gacucuccagaaagcucaucuca

SEQ ID NO: 1373313 - RNA, 20 nt, Homo sapiens
gacucuucucauccuuccuc

SEQ ID NO: 1373314 - RNA, 21 nt, Homo sapiens
gacugacccugaucagucuaa

SEQ ID NO: 1373315 - RNA, 22 nt, Homo sapiens
gacugcacguggcuucugauga

SEQ ID NO: 1373316 - RNA, 17 nt, Homo sapiens
gacugcauggagucuuc

SEQ ID NO: 1373317 - RNA, 18 nt, Homo sapiens
gacugccaugcuagacaa

SEQ ID NO: 1373318 - RNA, 13 nt, Homo sapiens
gacugcugcugaa

SEQ ID NO: 1373319 - RNA, 17 nt, Homo sapiens
gacuggauucgugacaa

SEQ ID NO: 1373320 - RNA, 23 nt, Homo sapiens
gacuguggccaugguccccaaga

SEQ ID NO: 1373321 - RNA, 18 nt, Homo sapiens
gacuuaacugguucauau

SEQ ID NO: 1373322 - RNA, 19 nt, Homo sapiens
gacuuccauuugcuuuguc

SEQ ID NO: 1373323 - RNA, 22 nt, Homo sapiens
ugcccagagaugggacugggag

SEQ ID NO: 1373324 - RNA, 20 nt, Homo sapiens
ugcccaggcuggcgugcagu

SEQ ID NO: 1373325 - RNA, 19 nt, Homo sapiens
ugcccaguguuugugcaag

SEQ ID NO: 1373326 - RNA, 14 nt, Homo sapiens
ugccccacugaauu

SEQ ID NO: 1373327 - RNA, 18 nt, Homo sapiens
ugccccagaaaaauaacu

SEQ ID NO: 1373328 - RNA, 17 nt, Homo sapiens
ugccccaugccugucca

SEQ ID NO: 1373329 - RNA, 13 nt, Homo sapiens
ugcccccaacagc

SEQ ID NO: 1373330 - RNA, 18 nt, Homo sapiens
ugcccccuucucccacac

SEQ ID NO: 1373331 - RNA, 16 nt, Homo sapiens
ugccccuggcucugac

SEQ ID NO: 1373332 - RNA, 19 nt, Homo sapiens
ugcccucgggcgagucacu

SEQ ID NO: 1373333 - RNA, 14 nt, Homo sapiens
ugcccugcuugcaa

SEQ ID NO: 1373334 - RNA, 21 nt, Homo sapiens
ugcccuuggaggccagccagu

SEQ ID NO: 1373335 - RNA, 23 nt, Homo sapiens
ugccggcucuggcucuccccaau

SEQ ID NO: 1373336 - RNA, 17 nt, Homo sapiens
ugccguaacaacugugg

SEQ ID NO: 1373337 - RNA, 23 nt, Homo sapiens
ugccuagcacucacaugcuggac

SEQ ID NO: 1373338 - RNA, 13 nt, Homo sapiens
ugccuagggccug

SEQ ID NO: 1373339 - RNA, 18 nt, Homo sapiens
ugccuaucuucuuucaca

SEQ ID NO: 1373340 - RNA, 18 nt, Homo sapiens
ugccucgaacuggcugca

SEQ ID NO: 1373341 - RNA, 15 nt, Homo sapiens
ugccugaaccuucca

SEQ ID NO: 1373342 - RNA, 23 nt, Homo sapiens
ugccugccccaaacaaauaugca

SEQ ID NO: 1373343 - RNA, 22 nt, Homo sapiens
ugccugcggaguugugcacgua

SEQ ID NO: 1373344 - RNA, 19 nt, Homo sapiens
ugccuggaguccuugaccg

SEQ ID NO: 1373345 - RNA, 16 nt, Homo sapiens
ugccuguaaucccagc

SEQ ID NO: 1373346 - RNA, 20 nt, Homo sapiens
ugccuguucccauucuugca

SEQ ID NO: 1373347 - RNA, 18 nt, Homo sapiens
ugccuuccagcacccugc

SEQ ID NO: 1373348 - RNA, 18 nt, Homo sapiens
ugccuucuccagacaaac

SEQ ID NO: 1373349 - RNA, 20 nt, Homo sapiens
ugccuuuucaucuaauguga

SEQ ID NO: 1373350 - RNA, 17 nt, Homo sapiens
ugccuuuuuaaugaaca

SEQ ID NO: 1373351 - RNA, 17 nt, Homo sapiens
ugcgaccgugaccagga

SEQ ID NO: 1373352 - RNA, 16 nt, Homo sapiens
ugcgagugugugcaug

SEQ ID NO: 1373353 - RNA, 19 nt, Homo sapiens
ugcgcacaaggcugaccaa

SEQ ID NO: 1373354 - RNA, 15 nt, Homo sapiens
ugcgccauugcacuc

SEQ ID NO: 1373355 - RNA, 16 nt, Homo sapiens
ugcgucucauacucac

SEQ ID NO: 1373356 - RNA, 13 nt, Homo sapiens
ugcgugcaugugc

SEQ ID NO: 1373357 - RNA, 14 nt, Homo sapiens
ugcgugugugcaag

SEQ ID NO: 1373358 - RNA, 20 nt, Homo sapiens
ugcuaaaggaaaaaaccauc

SEQ ID NO: 1373359 - RNA, 16 nt, Homo sapiens
ugcuaaauaaacaaca

SEQ ID NO: 1373360 - RNA, 13 nt, Homo sapiens
ugcuaaaugugaa

SEQ ID NO: 1373361 - RNA, 22 nt, Homo sapiens
ugcuaacuagcuuggaaacugg

SEQ ID NO: 1373362 - RNA, 15 nt, Homo sapiens
ugcuaaucuucaggg

SEQ ID NO: 1373363 - RNA, 20 nt, Homo sapiens
ugcuaaucuucuuaugcaau

SEQ ID NO: 1373364 - RNA, 16 nt, Homo sapiens
ugcuaccucacugggg

SEQ ID NO: 1373365 - RNA, 20 nt, Homo sapiens
ugcuagacaagcuuguccau

SEQ ID NO: 1373366 - RNA, 14 nt, Homo sapiens
ugcuauaucaguuu

SEQ ID NO: 1373367 - RNA, 16 nt, Homo sapiens
ugcuauugacaaguca

SEQ ID NO: 1373368 - RNA, 15 nt, Homo sapiens
ugcuauuucacucua

SEQ ID NO: 1373369 - RNA, 19 nt, Homo sapiens
ugcucacauaucugucauu

SEQ ID NO: 1373370 - RNA, 17 nt, Homo sapiens
ugcucagcaugauucuu

SEQ ID NO: 1373371 - RNA, 12 nt, Homo sapiens
ugcucaggauaa

SEQ ID NO: 1373372 - RNA, 18 nt, Homo sapiens
ugcucaguuggugcugcu

SEQ ID NO: 1373373 - RNA, 17 nt, Homo sapiens
ugcucauaacuguguca

SEQ ID NO: 1373374 - RNA, 16 nt, Homo sapiens
ugcucaugguccccau

SEQ ID NO: 1373375 - RNA, 13 nt, Homo sapiens
ucuugcagaucaa

SEQ ID NO: 1373376 - RNA, 21 nt, Homo sapiens
ucuugcuauggggagaaaaga

SEQ ID NO: 1373377 - RNA, 15 nt, Homo sapiens
ucuuggagaauauca

SEQ ID NO: 1373378 - RNA, 20 nt, Homo sapiens
ucuuggccaaagaccaaauu

SEQ ID NO: 1373379 - RNA, 19 nt, Homo sapiens
ucuugggucccccacguga

SEQ ID NO: 1373380 - RNA, 15 nt, Homo sapiens
ucuugguacuacuag

SEQ ID NO: 1373381 - RNA, 19 nt, Homo sapiens
ucuugugagggacugagau

SEQ ID NO: 1373382 - RNA, 15 nt, Homo sapiens
ucuuguugcugcauc

SEQ ID NO: 1373383 - RNA, 17 nt, Homo sapiens
ucuuguugcugcaucuc

SEQ ID NO: 1373384 - RNA, 18 nt, Homo sapiens
ucuuguugcugcaucucc

SEQ ID NO: 1373385 - RNA, 20 nt, Homo sapiens
ucuuuaaaaguauccagaga

SEQ ID NO: 1373386 - RNA, 19 nt, Homo sapiens
ucuuuaagaguauguugcu

SEQ ID NO: 1373387 - RNA, 14 nt, Homo sapiens
ucuuuacuccauga

SEQ ID NO: 1373388 - RNA, 19 nt, Homo sapiens
ucuuuaggagacuaaugga

SEQ ID NO: 1373389 - RNA, 13 nt, Homo sapiens
ucuuuauaauucu

SEQ ID NO: 1373390 - RNA, 15 nt, Homo sapiens
ucuuucacacuucca

SEQ ID NO: 1373391 - RNA, 23 nt, Homo sapiens
ucuuucacacuuccaccagccug

SEQ ID NO: 1373392 - RNA, 19 nt, Homo sapiens
ucuuucagaaagcuuugaa

SEQ ID NO: 1373393 - RNA, 20 nt, Homo sapiens
ucuuucaggacucuaccuca

SEQ ID NO: 1373394 - RNA, 18 nt, Homo sapiens
ucuuuccuggcuacucca

SEQ ID NO: 1373395 - RNA, 22 nt, Homo sapiens
ucuuucuaacuccagugaagua

SEQ ID NO: 1373396 - RNA, 16 nt, Homo sapiens
ucuuuuacauucugca

SEQ ID NO: 1373397 - RNA, 14 nt, Homo sapiens
ucuuuuccaugaac

SEQ ID NO: 1373398 - RNA, 17 nt, Homo sapiens
ucuuuucgccguggcug

SEQ ID NO: 1373399 - RNA, 13 nt, Homo sapiens
ucuuuugccauga

SEQ ID NO: 1373400 - RNA, 11 nt, Homo sapiens
ucuuuugcucu

SEQ ID NO: 1373401 - RNA, 19 nt, Homo sapiens
ucuuuuggggaagcuuucu

SEQ ID NO: 1373402 - RNA, 21 nt, Homo sapiens
ugaaaaaugguaauuguugcu

SEQ ID NO: 1373403 - RNA, 16 nt, Homo sapiens
ugaaaaauuacagcuu

SEQ ID NO: 1373404 - RNA, 14 nt, Homo sapiens
ugaaaacaagccau

SEQ ID NO: 1373405 - RNA, 12 nt, Homo sapiens
ugaaaacagcua

SEQ ID NO: 1373406 - RNA, 22 nt, Homo sapiens
ugaaaacucacagaacuaugua

SEQ ID NO: 1373407 - RNA, 17 nt, Homo sapiens
ugaaaagacucaguguu

SEQ ID NO: 1373408 - RNA, 22 nt, Homo sapiens
ugaaaauacaacuuaaauaaua

SEQ ID NO: 1373409 - RNA, 22 nt, Homo sapiens
ugaaaauguauguguaaguauu

SEQ ID NO: 1373410 - RNA, 21 nt, Homo sapiens
ugaaacaagcaacagauggau

SEQ ID NO: 1373411 - RNA, 14 nt, Homo sapiens
ugaaacacaccagg

SEQ ID NO: 1373412 - RNA, 14 nt, Homo sapiens
ugaaacagcugcca

SEQ ID NO: 1373413 - RNA, 11 nt, Homo sapiens
ugaaagaucuu

SEQ ID NO: 1373414 - RNA, 15 nt, Homo sapiens
ugaaagccacagaca

SEQ ID NO: 1373415 - RNA, 16 nt, Homo sapiens
ugaaagccacagacaa

SEQ ID NO: 1373416 - RNA, 15 nt, Homo sapiens
ugaaaucucagaauu

SEQ ID NO: 1373417 - RNA, 15 nt, Homo sapiens
ugaaaugaaaacaug

SEQ ID NO: 1373418 - RNA, 11 nt, Homo sapiens
ugaaaugcuag

SEQ ID NO: 1373419 - RNA, 15 nt, Homo sapiens
ugaaaugcuggcauu

SEQ ID NO: 1373420 - RNA, 18 nt, Homo sapiens
ugaaaugcuggcauuugc

SEQ ID NO: 1373421 - RNA, 20 nt, Homo sapiens
ugaacaaaaaaaugcucaca

SEQ ID NO: 1373422 - RNA, 15 nt, Homo sapiens
ugaacaaaugacauc

SEQ ID NO: 1373423 - RNA, 13 nt, Homo sapiens
ugaacacuggggg

SEQ ID NO: 1373424 - RNA, 19 nt, Homo sapiens
ugaaccuuccaucucgcca

SEQ ID NO: 1373425 - RNA, 17 nt, Homo sapiens
ugaacggugagcauugu

SEQ ID NO: 1373426 - RNA, 19 nt, Homo sapiens
ugaacuaauuucugugucu

SEQ ID NO: 1373427 - RNA, 18 nt, Homo sapiens
ugaacucuucaaucucuu

SEQ ID NO: 1373428 - RNA, 24 nt, Homo sapiens
ugaacuuggaaagaaaugcccauc

SEQ ID NO: 1373429 - RNA, 19 nt, Homo sapiens
ugaagaaaaaauacauuuu

SEQ ID NO: 1373430 - RNA, 17 nt, Homo sapiens
ugaagaaacuucugcuu

SEQ ID NO: 1373431 - RNA, 18 nt, Homo sapiens
ugaagaacaguaacugcc

SEQ ID NO: 1373432 - RNA, 15 nt, Homo sapiens
ugaagacacugaaau

SEQ ID NO: 1373433 - RNA, 16 nt, Homo sapiens
ugauaaugcagacuuc

SEQ ID NO: 1373434 - RNA, 23 nt, Homo sapiens
ugauacagugaagauacaggaca

SEQ ID NO: 1373435 - RNA, 14 nt, Homo sapiens
ugauacauauguga

SEQ ID NO: 1373436 - RNA, 14 nt, Homo sapiens
ugauacccugaauu

SEQ ID NO: 1373437 - RNA, 14 nt, Homo sapiens
ugauagauccagau

SEQ ID NO: 1373438 - RNA, 17 nt, Homo sapiens
ugauagauccagaugag

SEQ ID NO: 1373439 - RNA, 13 nt, Homo sapiens
ugauagucaauau

SEQ ID NO: 1373440 - RNA, 19 nt, Homo sapiens
ugauauagaucacauaaca

SEQ ID NO: 1373441 - RNA, 17 nt, Homo sapiens
ugauauuuuuacuugca

SEQ ID NO: 1373442 - RNA, 16 nt, Homo sapiens
ugaucaagcaauaaua

SEQ ID NO: 1373443 - RNA, 19 nt, Homo sapiens
ugaucacggcucacugcag

SEQ ID NO: 1373444 - RNA, 21 nt, Homo sapiens
ugauccacagaaauacaugaa

SEQ ID NO: 1373445 - RNA, 17 nt, Homo sapiens
ugauccguuccauugca

SEQ ID NO: 1373446 - RNA, 18 nt, Homo sapiens
ugauccuaaugaaugcau

SEQ ID NO: 1373447 - RNA, 19 nt, Homo sapiens
ugauccuaggcauuugcug

SEQ ID NO: 1373448 - RNA, 21 nt, Homo sapiens
ugaucgcgccacuacacucca

SEQ ID NO: 1373449 - RNA, 15 nt, Homo sapiens
ugaucgcuuucuaca

SEQ ID NO: 1373450 - RNA, 19 nt, Homo sapiens
ugaucucggcucauguagc

SEQ ID NO: 1373451 - RNA, 12 nt, Homo sapiens
ugaucugggaac

SEQ ID NO: 1373452 - RNA, 19 nt, Homo sapiens
ugaugacagacacuucuaa

SEQ ID NO: 1373453 - RNA, 17 nt, Homo sapiens
ugaugauuaauucaccu

SEQ ID NO: 1373454 - RNA, 15 nt, Homo sapiens
ugaugcacauuucau

SEQ ID NO: 1373455 - RNA, 16 nt, Homo sapiens
ugaugcuaccaugccu

SEQ ID NO: 1373456 - RNA, 14 nt, Homo sapiens
ugaugcugugcuau

SEQ ID NO: 1373457 - RNA, 17 nt, Homo sapiens
ugauggagucagguuug

SEQ ID NO: 1373458 - RNA, 15 nt, Homo sapiens
ugauggcaccacugc

SEQ ID NO: 1373459 - RNA, 21 nt, Homo sapiens
ugauggcaccacugcacucca

SEQ ID NO: 1373460 - RNA, 19 nt, Homo sapiens
ugauguauuguugcuuuuu

SEQ ID NO: 1373461 - RNA, 15 nt, Homo sapiens
ugaugucuuuguuaa

SEQ ID NO: 1373462 - RNA, 18 nt, Homo sapiens
ugauguggcaacugcuga

SEQ ID NO: 1373463 - RNA, 15 nt, Homo sapiens
ugauuauagugacaa

SEQ ID NO: 1373464 - RNA, 13 nt, Homo sapiens
ugauucacaauga

SEQ ID NO: 1373465 - RNA, 21 nt, Homo sapiens
ugauucacaaugaaaugcucu

SEQ ID NO: 1373466 - RNA, 17 nt, Homo sapiens
ugauucauuuucugccu

SEQ ID NO: 1373467 - RNA, 12 nt, Homo sapiens
ugauucuauguc

SEQ ID NO: 1373468 - RNA, 17 nt, Homo sapiens
ugauucucagcacuugg

SEQ ID NO: 1373469 - RNA, 22 nt, Homo sapiens
ugauucuccugccucagccucc

SEQ ID NO: 1373470 - RNA, 14 nt, Homo sapiens
ugauucugaaucaa

SEQ ID NO: 1373471 - RNA, 18 nt, Homo sapiens
ugauuggccccacugacg

SEQ ID NO: 1373472 - RNA, 23 nt, Homo sapiens
ugauuguuauuggguaucaccac

SEQ ID NO: 1373473 - RNA, 18 nt, Homo sapiens
ugauuuaauaacauaaca

SEQ ID NO: 1373474 - RNA, 14 nt, Homo sapiens
ugauuucauuucaa

SEQ ID NO: 1373475 - RNA, 21 nt, Homo sapiens
ugauuucccuucuucugucau

SEQ ID NO: 1373476 - RNA, 12 nt, Homo sapiens
ugauuucuugcu

SEQ ID NO: 1373477 - RNA, 13 nt, Homo sapiens
ugauuuuacuuag

SEQ ID NO: 1373478 - RNA, 22 nt, Homo sapiens
ugauuuuuauccaaucuuguuu

SEQ ID NO: 1373479 - RNA, 14 nt, Homo sapiens
ugauuuuuuuccac

SEQ ID NO: 1373480 - RNA, 16 nt, Homo sapiens
ugcaaagauuugcuuu

SEQ ID NO: 1373481 - RNA, 19 nt, Homo sapiens
ugcaaagauuugcuuuaau

SEQ ID NO: 1373482 - RNA, 21 nt, Homo sapiens
ugcaaauccuugauacugcuc

SEQ ID NO: 1373483 - RNA, 20 nt, Homo sapiens
ugcaaauucccagauuugaa

SEQ ID NO: 1373484 - RNA, 13 nt, Homo sapiens
ugcaacaacaugu

SEQ ID NO: 1373485 - RNA, 14 nt, Homo sapiens
ugcaacaacaugua

SEQ ID NO: 1373486 - RNA, 20 nt, Homo sapiens
ugcaagaaggauaccaaaua

SEQ ID NO: 1373487 - RNA, 14 nt, Homo sapiens
gaaaaacauuauuu

SEQ ID NO: 1373488 - RNA, 15 nt, Homo sapiens
gaaaaacuuccauga

SEQ ID NO: 1373489 - RNA, 20 nt, Homo sapiens
gaaaaagaccuaugagcaca

SEQ ID NO: 1373490 - RNA, 19 nt, Homo sapiens
gaaaaaguuaaacauugaa

SEQ ID NO: 1373491 - RNA, 15 nt, Homo sapiens
gaaaaauugccuuca

SEQ ID NO: 1373492 - RNA, 19 nt, Homo sapiens
gaaaacacuaguaccuuca

SEQ ID NO: 1373493 - RNA, 15 nt, Homo sapiens
gaaaacugcaacuug

SEQ ID NO: 1373494 - RNA, 23 nt, Homo sapiens
gaaaacugccuuuuaucugccca

SEQ ID NO: 1373495 - RNA, 19 nt, Homo sapiens
gaaaagaccaguccaugag

SEQ ID NO: 1373496 - RNA, 16 nt, Homo sapiens
gaaaagggcuuucuca

SEQ ID NO: 1373497 - RNA, 16 nt, Homo sapiens
gaaaaggguguugcua

SEQ ID NO: 1373498 - RNA, 18 nt, Homo sapiens
gaaaauaaaauuaagaau

SEQ ID NO: 1373499 - RNA, 20 nt, Homo sapiens
gaaaauaguuuggauuacuu

SEQ ID NO: 1373500 - RNA, 20 nt, Homo sapiens
gaaaauauguaacuggaauc

SEQ ID NO: 1373501 - RNA, 23 nt, Homo sapiens
gaaaaugaaccauucacagugca

SEQ ID NO: 1373502 - RNA, 21 nt, Homo sapiens
gaaaaugcuguauuagucaca

SEQ ID NO: 1373503 - RNA, 14 nt, Homo sapiens
gaaaauguccuccc

SEQ ID NO: 1373504 - RNA, 15 nt, Homo sapiens
gaaaauguccucccu

SEQ ID NO: 1373505 - RNA, 15 nt, Homo sapiens
gaaaauuaacacugc

SEQ ID NO: 1373506 - RNA, 22 nt, Homo sapiens
gaaaauuguacaaccugugauc

SEQ ID NO: 1373507 - RNA, 20 nt, Homo sapiens
gaaacaaauaagaccauaaa

SEQ ID NO: 1373508 - RNA, 14 nt, Homo sapiens
gaaacagcugccac

SEQ ID NO: 1373509 - RNA, 16 nt, Homo sapiens
gaaacauuaugccuua

SEQ ID NO: 1373510 - RNA, 17 nt, Homo sapiens
gaaaccaggaacucugg

SEQ ID NO: 1373511 - RNA, 20 nt, Homo sapiens
gaaacccguguaucugggau

SEQ ID NO: 1373512 - RNA, 20 nt, Homo sapiens
gaaaccuuauuguaccucuc

SEQ ID NO: 1373513 - RNA, 18 nt, Homo sapiens
gaaggccaccugcagguc

SEQ ID NO: 1373514 - RNA, 18 nt, Homo sapiens
gaaggccgagaagcaaga

SEQ ID NO: 1373515 - RNA, 15 nt, Homo sapiens
gaagggacauauuca

SEQ ID NO: 1373516 - RNA, 22 nt, Homo sapiens
gaaggguucaccaggucaggga

SEQ ID NO: 1373517 - RNA, 15 nt, Homo sapiens
gaagguaaaacaaau

SEQ ID NO: 1373518 - RNA, 19 nt, Homo sapiens
gaaguaagcaaagacuuuc

SEQ ID NO: 1373519 - RNA, 22 nt, Homo sapiens
gaaguagaauuuguccaauaac

SEQ ID NO: 1373520 - RNA, 14 nt, Homo sapiens
gaaguaugagggaa

SEQ ID NO: 1373521 - RNA, 18 nt, Homo sapiens
gaaguguaagaaacacac

SEQ ID NO: 1373522 - RNA, 16 nt, Homo sapiens
gaagugugugaucugu

SEQ ID NO: 1373523 - RNA, 18 nt, Homo sapiens
gaaguuuauacaguacag

SEQ ID NO: 1373524 - RNA, 17 nt, Homo sapiens
gaaguuugaccaucacc

SEQ ID NO: 1373525 - RNA, 14 nt, Homo sapiens
gaaguuuguguucu

SEQ ID NO: 1373526 - RNA, 20 nt, Homo sapiens
gaaguuuugacaucaaugau

SEQ ID NO: 1373527 - RNA, 16 nt, Homo sapiens
gaauaaacaggaaaau

SEQ ID NO: 1373528 - RNA, 19 nt, Homo sapiens
gaauaaacuagacucugaa

SEQ ID NO: 1373529 - RNA, 22 nt, Homo sapiens
gaauaacauggugugcuucuua

SEQ ID NO: 1373530 - RNA, 12 nt, Homo sapiens
gaauaaggccuu

SEQ ID NO: 1373531 - RNA, 16 nt, Homo sapiens
gaauagcaugucacua

SEQ ID NO: 1373532 - RNA, 15 nt, Homo sapiens
gaauaguaaguggug

SEQ ID NO: 1373533 - RNA, 17 nt, Homo sapiens
gaauauaaacacuauau

SEQ ID NO: 1373534 - RNA, 19 nt, Homo sapiens
gaauauaaauuuguguucu

SEQ ID NO: 1373535 - RNA, 19 nt, Homo sapiens
gaauauacuaaauuaacuu

SEQ ID NO: 1373536 - RNA, 20 nt, Homo sapiens
gaauauauuauaaucuucca

SEQ ID NO: 1373537 - RNA, 14 nt, Homo sapiens
gaauaugaacggug

SEQ ID NO: 1373538 - RNA, 18 nt, Homo sapiens
gaauauuuauuaccucug

SEQ ID NO: 1373539 - RNA, 20 nt, Homo sapiens
gaaucaacagggcagcagau

SEQ ID NO: 1373540 - RNA, 20 nt, Homo sapiens
gaaucaaggugauugugauu

SEQ ID NO: 1373541 - RNA, 22 nt, Homo sapiens
ccaugugugagugugugcaagu

SEQ ID NO: 1373542 - RNA, 23 nt, Homo sapiens
ccaugugugugcaagugugugca

SEQ ID NO: 1373543 - RNA, 16 nt, Homo sapiens
ccauguuuaagauuua

SEQ ID NO: 1373544 - RNA, 16 nt, Homo sapiens
ccauuaaaguucucaa

SEQ ID NO: 1373545 - RNA, 21 nt, Homo sapiens
ccauuagcauuugucaacaaa

SEQ ID NO: 1373546 - RNA, 13 nt, Homo sapiens
ccauugagacuau

SEQ ID NO: 1373547 - RNA, 14 nt, Homo sapiens
ccauuguuuugccu

SEQ ID NO: 1373548 - RNA, 22 nt, Homo sapiens
ccauuuacacuuuugagacuuu

SEQ ID NO: 1373549 - RNA, 21 nt, Homo sapiens
ccauuuauaauguuaguagaa

SEQ ID NO: 1373550 - RNA, 22 nt, Homo sapiens
ccauuuauaauguuaguagaaa

SEQ ID NO: 1373551 - RNA, 18 nt, Homo sapiens
ccauuucagcuguuucac

SEQ ID NO: 1373552 - RNA, 17 nt, Homo sapiens
ccauuucugagaucaaa

SEQ ID NO: 1373553 - RNA, 13 nt, Homo sapiens
ccauuuguaauaa

SEQ ID NO: 1373554 - RNA, 18 nt, Homo sapiens
ccauuugugugugugcaa

SEQ ID NO: 1373555 - RNA, 19 nt, Homo sapiens
ccauuuuggaaguuuucag

SEQ ID NO: 1373556 - RNA, 18 nt, Homo sapiens
cccaaauucuuucagugg

SEQ ID NO: 1373557 - RNA, 23 nt, Homo sapiens
cccaacagcacuuagguuuuccu

SEQ ID NO: 1373558 - RNA, 14 nt, Homo sapiens
cccaauagcacuuu

SEQ ID NO: 1373559 - RNA, 18 nt, Homo sapiens
cccacagccgcagcugua

SEQ ID NO: 1373560 - RNA, 15 nt, Homo sapiens
cauguuggcccagac

SEQ ID NO: 1373561 - RNA, 21 nt, Homo sapiens
cauguuguacauuagaccucu

SEQ ID NO: 1373562 - RNA, 12 nt, Homo sapiens
cauguuuuuacc

SEQ ID NO: 1373563 - RNA, 12 nt, Homo sapiens
cauuaucuauga

SEQ ID NO: 1373564 - RNA, 13 nt, Homo sapiens
cauuaucuugcag

SEQ ID NO: 1373565 - RNA, 22 nt, Homo sapiens
cauucaauguuuaugcaaggaa

SEQ ID NO: 1373566 - RNA, 17 nt, Homo sapiens
cauucauguucuagucu

SEQ ID NO: 1373567 - RNA, 17 nt, Homo sapiens
cauucauuuaacagagc

SEQ ID NO: 1373568 - RNA, 16 nt, Homo sapiens
cauuccaauuugcacu

SEQ ID NO: 1373569 - RNA, 21 nt, Homo sapiens
cauuccugggacuaugcugua

SEQ ID NO: 1373570 - RNA, 15 nt, Homo sapiens
cauucgaguguuuca

SEQ ID NO: 1373571 - RNA, 14 nt, Homo sapiens
cauucuacugaaca

SEQ ID NO: 1373572 - RNA, 13 nt, Homo sapiens
cauucuagguagg

SEQ ID NO: 1373573 - RNA, 15 nt, Homo sapiens
cauucucuuguuauu

SEQ ID NO: 1373574 - RNA, 14 nt, Homo sapiens
cauucugaccauuu

SEQ ID NO: 1373575 - RNA, 23 nt, Homo sapiens
cauucuuguuuuaagugccuuua

SEQ ID NO: 1373576 - RNA, 23 nt, Homo sapiens
cauugagaacugcauauguuucg

SEQ ID NO: 1373577 - RNA, 22 nt, Homo sapiens
cauugcaagcuucuuuuaguug

SEQ ID NO: 1373578 - RNA, 16 nt, Homo sapiens
cauugccagugucuuu

SEQ ID NO: 1373579 - RNA, 17 nt, Homo sapiens
cauugcuucacuaccca

SEQ ID NO: 1373580 - RNA, 15 nt, Homo sapiens
cauugugaggguuaa

SEQ ID NO: 1373581 - RNA, 19 nt, Homo sapiens
cauuguucagaugcuucuu

SEQ ID NO: 1373582 - RNA, 19 nt, Homo sapiens
cauuguuuauuguauacug

SEQ ID NO: 1373583 - RNA, 21 nt, Homo sapiens
cauuuaaauuagauaacaaaa

SEQ ID NO: 1373584 - RNA, 13 nt, Homo sapiens
cauuuacacuuuu

SEQ ID NO: 1373585 - RNA, 23 nt, Homo sapiens
cauuuacuuaacagaacagucac

SEQ ID NO: 1373586 - RNA, 12 nt, Homo sapiens
cauuuagcacaa

SEQ ID NO: 1373587 - RNA, 14 nt, Homo sapiens
cauuuaucccucaa

SEQ ID NO: 1373588 - RNA, 24 nt, Homo sapiens
cauuuaucuguacauacuuuuuca

SEQ ID NO: 1373589 - RNA, 13 nt, Homo sapiens
cauuucaaaggga

SEQ ID NO: 1373590 - RNA, 15 nt, Homo sapiens
cauuucgccccucau

SEQ ID NO: 1373591 - RNA, 15 nt, Homo sapiens
cauuucuaacucuga

SEQ ID NO: 1373592 - RNA, 23 nt, Homo sapiens
cauuugaaaucuaugaaauauca

SEQ ID NO: 1373593 - RNA, 20 nt, Homo sapiens
cauuugaguugcccaucuug

SEQ ID NO: 1373594 - RNA, 19 nt, Homo sapiens
cauuugcgaaugguuccau

SEQ ID NO: 1373595 - RNA, 16 nt, Homo sapiens
cauuugugugcucaug

SEQ ID NO: 1373596 - RNA, 19 nt, Homo sapiens
cauuugugugugugcaagu

SEQ ID NO: 1373597 - RNA, 21 nt, Homo sapiens
cauuuguuggaaugaauuaaa

SEQ ID NO: 1373598 - RNA, 22 nt, Homo sapiens
cauuuuacccuuggcucaaucc

SEQ ID NO: 1373599 - RNA, 14 nt, Homo sapiens
cauuuucagacugc

SEQ ID NO: 1373600 - RNA, 18 nt, Homo sapiens
cauuuucugaaacuaaug

SEQ ID NO: 1373601 - RNA, 17 nt, Homo sapiens
cauuuucugccacccaa

SEQ ID NO: 1373602 - RNA, 13 nt, Homo sapiens
cauuuugcaaaau

SEQ ID NO: 1373603 - RNA, 14 nt, Homo sapiens
cauuuugcaaaauu

SEQ ID NO: 1373604 - RNA, 22 nt, Homo sapiens
cauuuuggaaguuuucaggacu

SEQ ID NO: 1373605 - RNA, 19 nt, Homo sapiens
cauuuuuauacagugauaa

SEQ ID NO: 1373606 - RNA, 21 nt, Homo sapiens
cauuuuuuuucagcagacuau

SEQ ID NO: 1373607 - RNA, 13 nt, Homo sapiens
ccaaaaaccucac

SEQ ID NO: 1373608 - RNA, 18 nt, Homo sapiens
ccaaaacaaacaaacaga

SEQ ID NO: 1373609 - RNA, 18 nt, Homo sapiens
ccaaacucauaacagucu

SEQ ID NO: 1373610 - RNA, 14 nt, Homo sapiens
ccaaacucugccag

SEQ ID NO: 1373611 - RNA, 17 nt, Homo sapiens
ccaaacuugacaguaaa

SEQ ID NO: 1373612 - RNA, 15 nt, Homo sapiens
ccaaagacauguuua

SEQ ID NO: 1373613 - RNA, 17 nt, Homo sapiens
ccaaagagaaugccauu

SEQ ID NO: 1373614 - RNA, 14 nt, Homo sapiens
ccaaagcagcacuu

SEQ ID NO: 1373615 - RNA, 15 nt, Homo sapiens
ccaaaggaagcuuuc

SEQ ID NO: 1373616 - RNA, 17 nt, Homo sapiens
ccaaagggccccuuucu

SEQ ID NO: 1373617 - RNA, 20 nt, Homo sapiens
ccaaaguaaauguccugcua

SEQ ID NO: 1373618 - RNA, 15 nt, Homo sapiens
ccaaagugcugcgau

SEQ ID NO: 1373619 - RNA, 17 nt, Homo sapiens
ccaaagugcugggauua

SEQ ID NO: 1373620 - RNA, 14 nt, Homo sapiens
ccaaauaccaugua

SEQ ID NO: 1373621 - RNA, 15 nt, Homo sapiens
ccaaaucagcugcua

SEQ ID NO: 1373622 - RNA, 12 nt, Homo sapiens
ccaaaugagauc

SEQ ID NO: 1373623 - RNA, 16 nt, Homo sapiens
ccaaauggcagggaua

SEQ ID NO: 1373624 - RNA, 20 nt, Homo sapiens
ccaaauuacguguacuacaa

SEQ ID NO: 1373625 - RNA, 17 nt, Homo sapiens
ccaacacaaggugggca

SEQ ID NO: 1373626 - RNA, 11 nt, Homo sapiens
ccaacacuuca

SEQ ID NO: 1373627 - RNA, 21 nt, Homo sapiens
ccaacagaagcuuccauucca

SEQ ID NO: 1373628 - RNA, 14 nt, Homo sapiens
ccaacagcacccuc

SEQ ID NO: 1373629 - RNA, 16 nt, Homo sapiens
ccaacagcacccucuc

SEQ ID NO: 1373630 - RNA, 19 nt, Homo sapiens
ccaacccaaaccuggagau

SEQ ID NO: 1373631 - RNA, 17 nt, Homo sapiens
ccaaccccccaccugcc

SEQ ID NO: 1373632 - RNA, 12 nt, Homo sapiens
ccaacuccagua

SEQ ID NO: 1373633 - RNA, 21 nt, Homo sapiens
ccaacugcaagucacaaagga

SEQ ID NO: 1373634 - RNA, 21 nt, Homo sapiens
ccaacuucauuugaugcuaaa

SEQ ID NO: 1373635 - RNA, 17 nt, Homo sapiens
ccaagaauucuccaaaa

SEQ ID NO: 1373636 - RNA, 17 nt, Homo sapiens
ccaagacuugguguccu

SEQ ID NO: 1373637 - RNA, 18 nt, Homo sapiens
ccaagcacagugccugca

SEQ ID NO: 1373638 - RNA, 19 nt, Homo sapiens
ccaagcaggaagcucagac

SEQ ID NO: 1373639 - RNA, 19 nt, Homo sapiens
ccaagcaguuucuuucaaa

SEQ ID NO: 1373640 - RNA, 13 nt, Homo sapiens
ccaaggagaccaa

SEQ ID NO: 1373641 - RNA, 18 nt, Homo sapiens
ccaaggauggaccacaca

SEQ ID NO: 1373642 - RNA, 20 nt, Homo sapiens
ccaaggcuauauuucuggga

SEQ ID NO: 1373643 - RNA, 16 nt, Homo sapiens
ccaaggcucugagcaa

SEQ ID NO: 1373644 - RNA, 15 nt, Homo sapiens
ccaaggggcagucug

SEQ ID NO: 1373645 - RNA, 23 nt, Homo sapiens
ccaaguccaggucgggcucagcu

SEQ ID NO: 1373646 - RNA, 16 nt, Homo sapiens
ccaagugccagucuug

SEQ ID NO: 1373647 - RNA, 17 nt, Homo sapiens
ccaagugugugugcgug

SEQ ID NO: 1373648 - RNA, 13 nt, Homo sapiens
ccaauagcacuuu

SEQ ID NO: 1373649 - RNA, 12 nt, Homo sapiens
ccaauagcuuua

SEQ ID NO: 1373650 - RNA, 19 nt, Homo sapiens
cauaauucuugcuaugaaa

SEQ ID NO: 1373651 - RNA, 22 nt, Homo sapiens
cauaauuuguacauauguaaaa

SEQ ID NO: 1373652 - RNA, 18 nt, Homo sapiens
cauacaauuccaaacaca

SEQ ID NO: 1373653 - RNA, 12 nt, Homo sapiens
cauacaggccau

SEQ ID NO: 1373654 - RNA, 15 nt, Homo sapiens
cauacauacacauau

SEQ ID NO: 1373655 - RNA, 15 nt, Homo sapiens
cauacccuguuacca

SEQ ID NO: 1373656 - RNA, 16 nt, Homo sapiens
cauacuacacauucaa

SEQ ID NO: 1373657 - RNA, 19 nt, Homo sapiens
cauagaaauuacacccaaa

SEQ ID NO: 1373658 - RNA, 13 nt, Homo sapiens
cauagagaucuau

SEQ ID NO: 1373659 - RNA, 15 nt, Homo sapiens
cauagaggugaggga

SEQ ID NO: 1373660 - RNA, 23 nt, Homo sapiens
cauagaggugagggaagccugaa

SEQ ID NO: 1373661 - RNA, 22 nt, Homo sapiens
cauagcgcugcucuuaugccau

SEQ ID NO: 1373662 - RNA, 15 nt, Homo sapiens
cauagcuuccaugag

SEQ ID NO: 1373663 - RNA, 18 nt, Homo sapiens
cauagcuugauaaagggc

SEQ ID NO: 1373664 - RNA, 23 nt, Homo sapiens
cauaggaaaucuuguccagagac

SEQ ID NO: 1373665 - RNA, 19 nt, Homo sapiens
cauaggaaguauggcauga

SEQ ID NO: 1373666 - RNA, 21 nt, Homo sapiens
cauaguaugguggcuggguug

SEQ ID NO: 1373667 - RNA, 18 nt, Homo sapiens
cauaguugugcaugccug

SEQ ID NO: 1373668 - RNA, 16 nt, Homo sapiens
cauauauauacauaca

SEQ ID NO: 1373669 - RNA, 16 nt, Homo sapiens
cauauaucuauuacac

SEQ ID NO: 1373670 - RNA, 18 nt, Homo sapiens
cauauccaacaugugcuc

SEQ ID NO: 1373671 - RNA, 14 nt, Homo sapiens
cauaugaacauaua

SEQ ID NO: 1373672 - RNA, 14 nt, Homo sapiens
cauaugaauaacau

SEQ ID NO: 1373673 - RNA, 16 nt, Homo sapiens
cauaugauugugcaca

SEQ ID NO: 1373674 - RNA, 21 nt, Homo sapiens
cauaugauugugcacauacuu

SEQ ID NO: 1373675 - RNA, 14 nt, Homo sapiens
cauauguaugacuc

SEQ ID NO: 1373676 - RNA, 15 nt, Homo sapiens
cauauucccacagca

SEQ ID NO: 1373677 - RNA, 21 nt, Homo sapiens
cauauuggacugauaaucucu

SEQ ID NO: 1373678 - RNA, 13 nt, Homo sapiens
cauauuuacuucu

SEQ ID NO: 1373679 - RNA, 17 nt, Homo sapiens
cauauuucaaaugauuu

SEQ ID NO: 1373680 - RNA, 21 nt, Homo sapiens
caucaagaugagagaacugga

SEQ ID NO: 1373681 - RNA, 13 nt, Homo sapiens
caucaaguugcac

SEQ ID NO: 1373682 - RNA, 16 nt, Homo sapiens
caucacaggacacggg

SEQ ID NO: 1373683 - RNA, 18 nt, Homo sapiens
caucacuccucugucaua

SEQ ID NO: 1373684 - RNA, 14 nt, Homo sapiens
caucacugaaaugc

SEQ ID NO: 1373685 - RNA, 17 nt, Homo sapiens
caucacuucccuacaug

SEQ ID NO: 1373686 - RNA, 14 nt, Homo sapiens
caucaguguuaaaa

SEQ ID NO: 1373687 - RNA, 15 nt, Homo sapiens
caucauguugaauaa

SEQ ID NO: 1373688 - RNA, 17 nt, Homo sapiens
caucauuucaggaguua

SEQ ID NO: 1373689 - RNA, 13 nt, Homo sapiens
cauccaacugaga

SEQ ID NO: 1373690 - RNA, 18 nt, Homo sapiens
cauccaaggagaaacaga

SEQ ID NO: 1373691 - RNA, 22 nt, Homo sapiens
cauccaauucuuugaauuuccc

SEQ ID NO: 1373692 - RNA, 17 nt, Homo sapiens
cauccaguucaugagaa

SEQ ID NO: 1373693 - RNA, 19 nt, Homo sapiens
caucccagacuugcugaau

SEQ ID NO: 1373694 - RNA, 18 nt, Homo sapiens
caucccaucccaucccau

SEQ ID NO: 1373695 - RNA, 19 nt, Homo sapiens
caucccgugcaaaacaugc

SEQ ID NO: 1373696 - RNA, 17 nt, Homo sapiens
cauccuccacaauagca

SEQ ID NO: 1373697 - RNA, 17 nt, Homo sapiens
cauccuucaagaacucu

SEQ ID NO: 1373698 - RNA, 24 nt, Homo sapiens
cauccuuggaaauuggaagagcac

SEQ ID NO: 1373699 - RNA, 16 nt, Homo sapiens
caucuaaaguaaaaag

SEQ ID NO: 1373700 - RNA, 23 nt, Homo sapiens
caucuaagaaguuuuguucuguc

SEQ ID NO: 1373701 - RNA, 21 nt, Homo sapiens
caucuacccugcugaccuccc

SEQ ID NO: 1373702 - RNA, 19 nt, Homo sapiens
caucuaccugagucccaaa

SEQ ID NO: 1373703 - RNA, 21 nt, Homo sapiens
caucucaauaaagugcuuuaa

SEQ ID NO: 1373704 - RNA, 19 nt, Homo sapiens
caucucaggccucccucaa

SEQ ID NO: 1373705 - RNA, 13 nt, Homo sapiens
caucucagugcag

SEQ ID NO: 1373706 - RNA, 19 nt, Homo sapiens
caucuccccucagauucca

SEQ ID NO: 1373707 - RNA, 13 nt, Homo sapiens
caucucuacuaaa

SEQ ID NO: 1373708 - RNA, 23 nt, Homo sapiens
caucucucccuccccugccauuu

SEQ ID NO: 1373709 - RNA, 16 nt, Homo sapiens
caucucuuucugcaaa

SEQ ID NO: 1373710 - RNA, 15 nt, Homo sapiens
caucugcuacugugu

SEQ ID NO: 1373711 - RNA, 21 nt, Homo sapiens
caucugcuuuacucuggacca

SEQ ID NO: 1373712 - RNA, 23 nt, Homo sapiens
caucugggcaaaacccacagaag

SEQ ID NO: 1373713 - RNA, 14 nt, Homo sapiens
caucuuccaacuca

SEQ ID NO: 1373714 - RNA, 18 nt, Homo sapiens
caucuuccuggaagcaga

SEQ ID NO: 1373715 - RNA, 17 nt, Homo sapiens
caucuugcaaaacuaca

SEQ ID NO: 1373716 - RNA, 23 nt, Homo sapiens
caucuugcucugcugacagacac

SEQ ID NO: 1373717 - RNA, 17 nt, Homo sapiens
caucuuggucacauaca

SEQ ID NO: 1373718 - RNA, 23 nt, Homo sapiens
caucuuggucagauuugaacucu

SEQ ID NO: 1373719 - RNA, 12 nt, Homo sapiens
caucuuuccauc

SEQ ID NO: 1373720 - RNA, 21 nt, Homo sapiens
caugaaaaauugcuaugacua

SEQ ID NO: 1373721 - RNA, 23 nt, Homo sapiens
caugaacaucuuuaggagacuaa

SEQ ID NO: 1373722 - RNA, 16 nt, Homo sapiens
caugaagggucccuga

SEQ ID NO: 1373723 - RNA, 13 nt, Homo sapiens
caugaauaugauu

SEQ ID NO: 1373724 - RNA, 13 nt, Homo sapiens
caugaauguauca

SEQ ID NO: 1373725 - RNA, 18 nt, Homo sapiens
caugagugauucuugaca

SEQ ID NO: 1373726 - RNA, 19 nt, Homo sapiens
caugauggagcgcaccugc

SEQ ID NO: 1373727 - RNA, 20 nt, Homo sapiens
caugauggagcgcaccugcc

SEQ ID NO: 1373728 - RNA, 23 nt, Homo sapiens
caugauggcaccacugcacucca

SEQ ID NO: 1373729 - RNA, 14 nt, Homo sapiens
caugauucuuuaau

SEQ ID NO: 1373730 - RNA, 16 nt, Homo sapiens
caugcaaggcacugua

SEQ ID NO: 1373731 - RNA, 22 nt, Homo sapiens
caugcagaaagggagcagagaa

SEQ ID NO: 1373732 - RNA, 15 nt, Homo sapiens
caugcauacauacac

SEQ ID NO: 1373733 - RNA, 21 nt, Homo sapiens
caugcauuuugcagcagugag

SEQ ID NO: 1373734 - RNA, 16 nt, Homo sapiens
caugcccucaauccca

SEQ ID NO: 1373735 - RNA, 17 nt, Homo sapiens
caugccuguagucccag

SEQ ID NO: 1373736 - RNA, 18 nt, Homo sapiens
caugcucaguuggugcug

SEQ ID NO: 1373737 - RNA, 20 nt, Homo sapiens
caugcugaacaucacagcuu

SEQ ID NO: 1373738 - RNA, 19 nt, Homo sapiens
auaguacuggcaugguacg

SEQ ID NO: 1373739 - RNA, 22 nt, Homo sapiens
auaguauugugcauagagccac

SEQ ID NO: 1373740 - RNA, 13 nt, Homo sapiens
auaguccaaagac

SEQ ID NO: 1373741 - RNA, 14 nt, Homo sapiens
auaguccgucucug

SEQ ID NO: 1373742 - RNA, 17 nt, Homo sapiens
auagucuauauuuuaac

SEQ ID NO: 1373743 - RNA, 23 nt, Homo sapiens
auagugauugauagaguguuauc

SEQ ID NO: 1373744 - RNA, 16 nt, Homo sapiens
auaguggagagaacug

SEQ ID NO: 1373745 - RNA, 12 nt, Homo sapiens
auaguguugcuu

SEQ ID NO: 1373746 - RNA, 15 nt, Homo sapiens
auauaaacacuauau

SEQ ID NO: 1373747 - RNA, 13 nt, Homo sapiens
auauaaacauauc

SEQ ID NO: 1373748 - RNA, 16 nt, Homo sapiens
auauaaaggcagggaa

SEQ ID NO: 1373749 - RNA, 16 nt, Homo sapiens
auauaaauuuguguuc

SEQ ID NO: 1373750 - RNA, 13 nt, Homo sapiens
auauaacugccuu

SEQ ID NO: 1373751 - RNA, 14 nt, Homo sapiens
auauaagagcaaga

SEQ ID NO: 1373752 - RNA, 18 nt, Homo sapiens
auauaaggaaagcaauaa

SEQ ID NO: 1373753 - RNA, 16 nt, Homo sapiens
auauaaugcaaaccau

SEQ ID NO: 1373754 - RNA, 12 nt, Homo sapiens
auauaccaagcu

SEQ ID NO: 1373755 - RNA, 14 nt, Homo sapiens
auauaccuuacuga

SEQ ID NO: 1373756 - RNA, 17 nt, Homo sapiens
auauagccaaaaauguc

SEQ ID NO: 1373757 - RNA, 19 nt, Homo sapiens
auauagcuugaaacauaga

SEQ ID NO: 1373758 - RNA, 17 nt, Homo sapiens
auauaggggcaauguca

SEQ ID NO: 1373759 - RNA, 14 nt, Homo sapiens
auauauauacauac

SEQ ID NO: 1373760 - RNA, 20 nt, Homo sapiens
auauauguguuuuucacauu

SEQ ID NO: 1373761 - RNA, 21 nt, Homo sapiens
auauauucucuuugguguaca

SEQ ID NO: 1373762 - RNA, 14 nt, Homo sapiens
auauauuuuuuaga

SEQ ID NO: 1373763 - RNA, 17 nt, Homo sapiens
auaucaaaagcaaauaa

SEQ ID NO: 1373764 - RNA, 16 nt, Homo sapiens
auaucaaaauugcaau

SEQ ID NO: 1373765 - RNA, 17 nt, Homo sapiens
auaucuaucagaguauc

SEQ ID NO: 1373766 - RNA, 19 nt, Homo sapiens
auaucuaucagaguaucca

SEQ ID NO: 1373767 - RNA, 19 nt, Homo sapiens
auaucuucauacaaugaca

SEQ ID NO: 1373768 - RNA, 15 nt, Homo sapiens
auaugaaacauuuaa

SEQ ID NO: 1373769 - RNA, 16 nt, Homo sapiens
auaugauauguaaaca

SEQ ID NO: 1373770 - RNA, 20 nt, Homo sapiens
auaugaugaucuggauccac

SEQ ID NO: 1373771 - RNA, 11 nt, Homo sapiens
auaugcacaaa

SEQ ID NO: 1373772 - RNA, 13 nt, Homo sapiens
auaugcacuugaa

SEQ ID NO: 1373773 - RNA, 18 nt, Homo sapiens
auaugcuaauauauguau

SEQ ID NO: 1373774 - RNA, 16 nt, Homo sapiens
auauggcagugucuuu

SEQ ID NO: 1373775 - RNA, 18 nt, Homo sapiens
auauguaaggaagucaga

SEQ ID NO: 1373776 - RNA, 14 nt, Homo sapiens
auauguaccaugua

SEQ ID NO: 1373777 - RNA, 20 nt, Homo sapiens
auaugucucaggucccugca

SEQ ID NO: 1373778 - RNA, 22 nt, Homo sapiens
auauguugaugaaaaauagcaa

SEQ ID NO: 1373779 - RNA, 23 nt, Homo sapiens
auauguugaugaaaaauagcaac

SEQ ID NO: 1373780 - RNA, 21 nt, Homo sapiens
auauguuuuaagaggcagggu

SEQ ID NO: 1373781 - RNA, 15 nt, Homo sapiens
auauuaugucuucau

SEQ ID NO: 1373782 - RNA, 13 nt, Homo sapiens
auauucauuugga

SEQ ID NO: 1373783 - RNA, 13 nt, Homo sapiens
auauuccugcauu

SEQ ID NO: 1373784 - RNA, 18 nt, Homo sapiens
auauuccugcauuuguga

SEQ ID NO: 1373785 - RNA, 21 nt, Homo sapiens
auauucucaguguagggcaga

SEQ ID NO: 1373786 - RNA, 18 nt, Homo sapiens
auauucugguuacugugg

SEQ ID NO: 1373787 - RNA, 15 nt, Homo sapiens
auauuggacugauaa

SEQ ID NO: 1373788 - RNA, 12 nt, Homo sapiens
auauuguugccg

SEQ ID NO: 1373789 - RNA, 16 nt, Homo sapiens
auauuguuuucagugu

SEQ ID NO: 1373790 - RNA, 19 nt, Homo sapiens
auauuuauagcaauccaug

SEQ ID NO: 1373791 - RNA, 21 nt, Homo sapiens
auauuuaugagaaaguucuca

SEQ ID NO: 1373792 - RNA, 17 nt, Homo sapiens
auauuugcuaugaagcg

SEQ ID NO: 1373793 - RNA, 19 nt, Homo sapiens
auauuuuaaccugcauaaa

SEQ ID NO: 1373794 - RNA, 16 nt, Homo sapiens
auauuuugcauaguac

SEQ ID NO: 1373795 - RNA, 19 nt, Homo sapiens
aucaaaacccaacaugacu

SEQ ID NO: 1373796 - RNA, 18 nt, Homo sapiens
aucaaacacaaugccuca

SEQ ID NO: 1373797 - RNA, 14 nt, Homo sapiens
aucaaguccuacaa

SEQ ID NO: 1373798 - RNA, 12 nt, Homo sapiens
aucaauguuucu

SEQ ID NO: 1373799 - RNA, 19 nt, Homo sapiens
aucacaacauuuacuuaac

SEQ ID NO: 1373800 - RNA, 23 nt, Homo sapiens
aucacaaggcauucaaguguaca

SEQ ID NO: 1373801 - RNA, 13 nt, Homo sapiens
aucacauagugaa

SEQ ID NO: 1373802 - RNA, 10 nt, Homo sapiens
aucaccacug

SEQ ID NO: 1373803 - RNA, 13 nt, Homo sapiens
aucaccagagguc

SEQ ID NO: 1373804 - RNA, 22 nt, Homo sapiens
aucaccucuuaugcacaccucc

SEQ ID NO: 1373805 - RNA, 18 nt, Homo sapiens
aucaccuuaggcagggaa

SEQ ID NO: 1373806 - RNA, 21 nt, Homo sapiens
aucaccuugauaaugggauga

SEQ ID NO: 1373807 - RNA, 23 nt, Homo sapiens
aucacggcucacugcagccucaa

SEQ ID NO: 1373808 - RNA, 15 nt, Homo sapiens
aucacuucaggucag

SEQ ID NO: 1373809 - RNA, 18 nt, Homo sapiens
aucacuucccuacaugga

SEQ ID NO: 1373810 - RNA, 17 nt, Homo sapiens
aucagccugcuccagcu

SEQ ID NO: 1373811 - RNA, 20 nt, Homo sapiens
aucaggccuggcacgguggc

SEQ ID NO: 1373812 - RNA, 16 nt, Homo sapiens
aucagucauaacuaaa

SEQ ID NO: 1373813 - RNA, 17 nt, Homo sapiens
aucagugaagaugccag

SEQ ID NO: 1373814 - RNA, 21 nt, Homo sapiens
aucauauccuaugacccagca

SEQ ID NO: 1373815 - RNA, 15 nt, Homo sapiens
aucaucaacccuaaa

SEQ ID NO: 1373816 - RNA, 12 nt, Homo sapiens
aucaucucucau

SEQ ID NO: 1373817 - RNA, 15 nt, Homo sapiens
aucaugcuguuuuau

SEQ ID NO: 1373818 - RNA, 17 nt, Homo sapiens
aucauggcucacugcag

SEQ ID NO: 1373819 - RNA, 18 nt, Homo sapiens
aucaugucuccucuccca

SEQ ID NO: 1373820 - RNA, 17 nt, Homo sapiens
aucauuguuuauuguau

SEQ ID NO: 1373821 - RNA, 16 nt, Homo sapiens
aucauuuuauuaucac

SEQ ID NO: 1373822 - RNA, 16 nt, Homo sapiens
auccaagaaucaguga

SEQ ID NO: 1373823 - RNA, 18 nt, Homo sapiens
auccaagaaucagugaag

SEQ ID NO: 1373824 - RNA, 21 nt, Homo sapiens
auccaauucuuugaauuuccc

SEQ ID NO: 1373825 - RNA, 18 nt, Homo sapiens
auccacauugccagugac

SEQ ID NO: 1373826 - RNA, 16 nt, Homo sapiens
auccacccaccucagc

SEQ ID NO: 1373827 - RNA, 15 nt, Homo sapiens
auccacugugccaug

SEQ ID NO: 1373828 - RNA, 18 nt, Homo sapiens
auccagagagcagugugg

SEQ ID NO: 1373829 - RNA, 16 nt, Homo sapiens
auccaggcacccaaac

SEQ ID NO: 1373830 - RNA, 22 nt, Homo sapiens
auccaucaaguugcacacucac

SEQ ID NO: 1373831 - RNA, 23 nt, Homo sapiens
auccauuccucagggacagagac

SEQ ID NO: 1373832 - RNA, 16 nt, Homo sapiens
auccauuuaugucuca

SEQ ID NO: 1373833 - RNA, 20 nt, Homo sapiens
aucccacuugccccuguuac

SEQ ID NO: 1373834 - RNA, 17 nt, Homo sapiens
aucccaucccaucccau

SEQ ID NO: 1373835 - RNA, 18 nt, Homo sapiens
aucccaucccaucccauc

SEQ ID NO: 1373836 - RNA, 15 nt, Homo sapiens
aucccccuuucucua

SEQ ID NO: 1373837 - RNA, 19 nt, Homo sapiens
auccccuccguggcaucac

SEQ ID NO: 1373838 - RNA, 18 nt, Homo sapiens
aucccucgggugugcuau

SEQ ID NO: 1373839 - RNA, 18 nt, Homo sapiens
aucccucugucaggguca

SEQ ID NO: 1373840 - RNA, 12 nt, Homo sapiens
aucccuguucau

SEQ ID NO: 1373841 - RNA, 16 nt, Homo sapiens
aucccuuaccucggug

SEQ ID NO: 1373842 - RNA, 19 nt, Homo sapiens
auccgaaguaugagggaaa

SEQ ID NO: 1373843 - RNA, 17 nt, Homo sapiens
auccgggucaagugaag

SEQ ID NO: 1373844 - RNA, 13 nt, Homo sapiens
auccguacauuca

SEQ ID NO: 1373845 - RNA, 14 nt, Homo sapiens
auccuaaucaucca

SEQ ID NO: 1373846 - RNA, 12 nt, Homo sapiens
auccuaccacaa

SEQ ID NO: 1373847 - RNA, 12 nt, Homo sapiens
auccuaccccac

SEQ ID NO: 1373848 - RNA, 20 nt, Homo sapiens
auccucaauucaucaauaug

SEQ ID NO: 1373849 - RNA, 16 nt, Homo sapiens
auccugagcaaacaaa

SEQ ID NO: 1373850 - RNA, 14 nt, Homo sapiens
auccugcccagugu

SEQ ID NO: 1373851 - RNA, 21 nt, Homo sapiens
auccugguugguguugcagaa

SEQ ID NO: 1373852 - RNA, 12 nt, Homo sapiens
aguugugcacau

SEQ ID NO: 1373853 - RNA, 17 nt, Homo sapiens
aguuuccucaggcugcu

SEQ ID NO: 1373854 - RNA, 18 nt, Homo sapiens
aguuucuaucauucugcu

SEQ ID NO: 1373855 - RNA, 21 nt, Homo sapiens
aguuucucagcucccaaggcu

SEQ ID NO: 1373856 - RNA, 12 nt, Homo sapiens
aguuucuuccau

SEQ ID NO: 1373857 - RNA, 23 nt, Homo sapiens
aguuugaguuacuaucaugucaa

SEQ ID NO: 1373858 - RNA, 13 nt, Homo sapiens
aguuugauuucau

SEQ ID NO: 1373859 - RNA, 11 nt, Homo sapiens
aguuugcaguu

SEQ ID NO: 1373860 - RNA, 22 nt, Homo sapiens
aguuuguacagacguaugcuua

SEQ ID NO: 1373861 - RNA, 17 nt, Homo sapiens
aguuugucagacuuuaa

SEQ ID NO: 1373862 - RNA, 19 nt, Homo sapiens
aguuugugagaaacaucuc

SEQ ID NO: 1373863 - RNA, 17 nt, Homo sapiens
aguuuuugauagcuuua

SEQ ID NO: 1373864 - RNA, 12 nt, Homo sapiens
auaaaaacccaa

SEQ ID NO: 1373865 - RNA, 21 nt, Homo sapiens
auaaaaaucauucuacugaac

SEQ ID NO: 1373866 - RNA, 21 nt, Homo sapiens
auaaaacaucuuuccaguccu

SEQ ID NO: 1373867 - RNA, 17 nt, Homo sapiens
auaaaaccccaucucua

SEQ ID NO: 1373868 - RNA, 18 nt, Homo sapiens
auaaaagaaaugcacaau

SEQ ID NO: 1373869 - RNA, 21 nt, Homo sapiens
auaaaauuaaagcugaaaacu

SEQ ID NO: 1373870 - RNA, 15 nt, Homo sapiens
auaaaauuaugccau

SEQ ID NO: 1373871 - RNA, 16 nt, Homo sapiens
auaaacaacauugucu

SEQ ID NO: 1373872 - RNA, 16 nt, Homo sapiens
auaaacauaucaaugu

SEQ ID NO: 1373873 - RNA, 15 nt, Homo sapiens
auaaacauccuucaa

SEQ ID NO: 1373874 - RNA, 22 nt, Homo sapiens
auaaaccccaccuuuauuccuu

SEQ ID NO: 1373875 - RNA, 19 nt, Homo sapiens
auaaacuuuuagaaacuua

SEQ ID NO: 1373876 - RNA, 15 nt, Homo sapiens
auaaagagaacucug

SEQ ID NO: 1373877 - RNA, 16 nt, Homo sapiens
auaaagauacgaguuu

SEQ ID NO: 1373878 - RNA, 15 nt, Homo sapiens
auaaaggcauuucaa

SEQ ID NO: 1373879 - RNA, 19 nt, Homo sapiens
auaaaugacaagugagaca

SEQ ID NO: 1373880 - RNA, 20 nt, Homo sapiens
auaaaugaggaaacuccaaa

SEQ ID NO: 1373881 - RNA, 15 nt, Homo sapiens
auaaaugccccaaag

SEQ ID NO: 1373882 - RNA, 14 nt, Homo sapiens
auaaaugugaacuu

SEQ ID NO: 1373883 - RNA, 14 nt, Homo sapiens
auaaauuauggcau

SEQ ID NO: 1373884 - RNA, 17 nt, Homo sapiens
auaaauucagauauauu

SEQ ID NO: 1373885 - RNA, 14 nt, Homo sapiens
auaaauucuacucu

SEQ ID NO: 1373886 - RNA, 22 nt, Homo sapiens
auaaauucuauaggaacauaug

SEQ ID NO: 1373887 - RNA, 20 nt, Homo sapiens
auaacaaauuaaaagcuaua

SEQ ID NO: 1373888 - RNA, 21 nt, Homo sapiens
auaacauggugugcuucuuaa

SEQ ID NO: 1373889 - RNA, 17 nt, Homo sapiens
auaaccacugcuuccau

SEQ ID NO: 1373890 - RNA, 14 nt, Homo sapiens
auaaccuagccuua

SEQ ID NO: 1373891 - RNA, 15 nt, Homo sapiens
auaacuauguugaua

SEQ ID NO: 1373892 - RNA, 22 nt, Homo sapiens
auaacuauugauauaauuucca

SEQ ID NO: 1373893 - RNA, 22 nt, Homo sapiens
auaacuccuuguuucagaugau

SEQ ID NO: 1373894 - RNA, 23 nt, Homo sapiens
auaacucuacccuggcacuauaa

SEQ ID NO: 1373895 - RNA, 16 nt, Homo sapiens
auaacuuuaacuuuua

SEQ ID NO: 1373896 - RNA, 18 nt, Homo sapiens
auaagagugccguaacaa

SEQ ID NO: 1373897 - RNA, 16 nt, Homo sapiens
auaagauacaucacag

SEQ ID NO: 1373898 - RNA, 18 nt, Homo sapiens
auaagcuacugaugagaa

SEQ ID NO: 1373899 - RNA, 21 nt, Homo sapiens
auaagggaggaauauagaaug

SEQ ID NO: 1373900 - RNA, 13 nt, Homo sapiens
auaaguacauuau

SEQ ID NO: 1373901 - RNA, 18 nt, Homo sapiens
auaaguaucacacuguau

SEQ ID NO: 1373902 - RNA, 12 nt, Homo sapiens
auaaguccuugc

SEQ ID NO: 1373903 - RNA, 15 nt, Homo sapiens
auaagugcaugacau

SEQ ID NO: 1373904 - RNA, 14 nt, Homo sapiens
auaaguuucacuga

SEQ ID NO: 1373905 - RNA, 16 nt, Homo sapiens
auaauaaacaguggaa

SEQ ID NO: 1373906 - RNA, 16 nt, Homo sapiens
auaauaagcuaaagag

SEQ ID NO: 1373907 - RNA, 16 nt, Homo sapiens
auaauacaguaucuca

SEQ ID NO: 1373908 - RNA, 20 nt, Homo sapiens
auaauaugcacacagugcuu

SEQ ID NO: 1373909 - RNA, 20 nt, Homo sapiens
auaaucacauuaucaucuga

SEQ ID NO: 1373910 - RNA, 21 nt, Homo sapiens
auaaucacauuaucaucugaa

SEQ ID NO: 1373911 - RNA, 15 nt, Homo sapiens
auaaucgaaguaauu

SEQ ID NO: 1373912 - RNA, 22 nt, Homo sapiens
auaaucucuuuaaauggcuuua

SEQ ID NO: 1373913 - RNA, 21 nt, Homo sapiens
auaaucuuuggguaacuucaa

SEQ ID NO: 1373914 - RNA, 18 nt, Homo sapiens
auaaugguugacuggguu

SEQ ID NO: 1373915 - RNA, 17 nt, Homo sapiens
auaaugucccuucacaa

SEQ ID NO: 1373916 - RNA, 17 nt, Homo sapiens
auaauguuacauuauua

SEQ ID NO: 1373917 - RNA, 22 nt, Homo sapiens
auaauguuaucuguguagcaag

SEQ ID NO: 1373918 - RNA, 11 nt, Homo sapiens
auaauugccac

SEQ ID NO: 1373919 - RNA, 21 nt, Homo sapiens
auaauuuguauacccuguccu

SEQ ID NO: 1373920 - RNA, 16 nt, Homo sapiens
auaauuuuucacuuca

SEQ ID NO: 1373921 - RNA, 20 nt, Homo sapiens
auacaaauugauagucaaua

SEQ ID NO: 1373922 - RNA, 16 nt, Homo sapiens
auacaagaaagcaaug

SEQ ID NO: 1373923 - RNA, 19 nt, Homo sapiens
auacaagaaagcaaugcca

SEQ ID NO: 1373924 - RNA, 19 nt, Homo sapiens
auacaauuagucaaaccac

SEQ ID NO: 1373925 - RNA, 23 nt, Homo sapiens
auacacccccaccuccugcaaua

SEQ ID NO: 1373926 - RNA, 15 nt, Homo sapiens
auacacuaugaagau

SEQ ID NO: 1373927 - RNA, 22 nt, Homo sapiens
auacacugaaguuaacagagac

SEQ ID NO: 1373928 - RNA, 15 nt, Homo sapiens
auacacuuacacuuu

SEQ ID NO: 1373929 - RNA, 16 nt, Homo sapiens
auacaggacauucuca

SEQ ID NO: 1373930 - RNA, 17 nt, Homo sapiens
auacaggacauucucau

SEQ ID NO: 1373931 - RNA, 22 nt, Homo sapiens
auacaggagucugucucugcua

SEQ ID NO: 1373932 - RNA, 22 nt, Homo sapiens
auacaguauucuguaccauagc

SEQ ID NO: 1373933 - RNA, 14 nt, Homo sapiens
auacauacaugcau

SEQ ID NO: 1373934 - RNA, 20 nt, Homo sapiens
auacaugcauacacucucaa

SEQ ID NO: 1373935 - RNA, 18 nt, Homo sapiens
auacauggguagcuucug

SEQ ID NO: 1373936 - RNA, 24 nt, Homo sapiens
auacauggguagcuucugaccuca

SEQ ID NO: 1373937 - RNA, 14 nt, Homo sapiens
auacccagugaugu

SEQ ID NO: 1373938 - RNA, 17 nt, Homo sapiens
auacccugaauuuggcc

SEQ ID NO: 1373939 - RNA, 23 nt, Homo sapiens
auaccgcugcauaguauuccauu

SEQ ID NO: 1373940 - RNA, 21 nt, Homo sapiens
auaccucaacccccauuucua

SEQ ID NO: 1373941 - RNA, 21 nt, Homo sapiens
auaccuuacugagagcauguu

SEQ ID NO: 1373942 - RNA, 13 nt, Homo sapiens
auacgcaucagac

SEQ ID NO: 1373943 - RNA, 21 nt, Homo sapiens
auacgccuguaguccuagcca

SEQ ID NO: 1373944 - RNA, 13 nt, Homo sapiens
auacucaccucac

SEQ ID NO: 1373945 - RNA, 19 nt, Homo sapiens
auacugcucaucauuccuu

SEQ ID NO: 1373946 - RNA, 21 nt, Homo sapiens
auacugcucaucauuccuuga

SEQ ID NO: 1373947 - RNA, 17 nt, Homo sapiens
auacuggcaaagcagaa

SEQ ID NO: 1373948 - RNA, 22 nt, Homo sapiens
auacuuuuugcauauguaagga

SEQ ID NO: 1373949 - RNA, 12 nt, Homo sapiens
auagaaagccaa

SEQ ID NO: 1373950 - RNA, 16 nt, Homo sapiens
auagaagaacugcaaa

SEQ ID NO: 1373951 - RNA, 20 nt, Homo sapiens
auagaaugagugaaucaccu

SEQ ID NO: 1373952 - RNA, 21 nt, Homo sapiens
auagagguucuuuauugcuca

SEQ ID NO: 1373953 - RNA, 15 nt, Homo sapiens
auagaguauaugcac

SEQ ID NO: 1373954 - RNA, 12 nt, Homo sapiens
auagaucagcca

SEQ ID NO: 1373955 - RNA, 14 nt, Homo sapiens
auagcaacaugcuu

SEQ ID NO: 1373956 - RNA, 12 nt, Homo sapiens
auagcaagugaa

SEQ ID NO: 1373957 - RNA, 14 nt, Homo sapiens
auagcaauuucgcc

SEQ ID NO: 1373958 - RNA, 23 nt, Homo sapiens
auagccaacugcuguucauguua

SEQ ID NO: 1373959 - RNA, 18 nt, Homo sapiens
auagccacuuaccuucaa

SEQ ID NO: 1373960 - RNA, 16 nt, Homo sapiens
auaggagagagaucau

SEQ ID NO: 1373961 - RNA, 14 nt, Homo sapiens
auaggagugagcca

SEQ ID NO: 1373962 - RNA, 12 nt, Homo sapiens
auaggugcuuau

SEQ ID NO: 1373963 - RNA, 17 nt, Homo sapiens
auaguacagacagaagg

SEQ ID NO: 1373964 - RNA, 13 nt, Homo sapiens
auaguacuggcau

SEQ ID NO: 1373965 - RNA, 21 nt, Homo sapiens
aguaaguaccacucaggccaa

SEQ ID NO: 1373966 - RNA, 21 nt, Homo sapiens
aguaaucuuuggcuguaaggc

SEQ ID NO: 1373967 - RNA, 17 nt, Homo sapiens
aguaauuucuucucaaa

SEQ ID NO: 1373968 - RNA, 14 nt, Homo sapiens
aguacagacagaag

SEQ ID NO: 1373969 - RNA, 11 nt, Homo sapiens
aguaccugcug

SEQ ID NO: 1373970 - RNA, 17 nt, Homo sapiens
aguacuggcaugguacg

SEQ ID NO: 1373971 - RNA, 15 nt, Homo sapiens
aguacuuuaccuccu

SEQ ID NO: 1373972 - RNA, 14 nt, Homo sapiens
aguagaggcauuua

SEQ ID NO: 1373973 - RNA, 15 nt, Homo sapiens
aguagaggcauuuag

SEQ ID NO: 1373974 - RNA, 17 nt, Homo sapiens
aguagagggcacugggu

SEQ ID NO: 1373975 - RNA, 18 nt, Homo sapiens
aguagagggcacuggguc

SEQ ID NO: 1373976 - RNA, 21 nt, Homo sapiens
aguagauuuuaaaaguuauua

SEQ ID NO: 1373977 - RNA, 13 nt, Homo sapiens
aguagguuuacau

SEQ ID NO: 1373978 - RNA, 14 nt, Homo sapiens
aguaguaucaauga

SEQ ID NO: 1373979 - RNA, 22 nt, Homo sapiens
aguauaaauaaaaugagcaaaa

SEQ ID NO: 1373980 - RNA, 21 nt, Homo sapiens
aguauauuuauagucacaaga

SEQ ID NO: 1373981 - RNA, 19 nt, Homo sapiens
aguaucugggaacugugcc

SEQ ID NO: 1373982 - RNA, 20 nt, Homo sapiens
aguauguauguguaccuaag

SEQ ID NO: 1373983 - RNA, 12 nt, Homo sapiens
aguauugugcau

SEQ ID NO: 1373984 - RNA, 14 nt, Homo sapiens
aguauuuucccaau

SEQ ID NO: 1373985 - RNA, 22 nt, Homo sapiens
agucaaaacagagaugugauaa

SEQ ID NO: 1373986 - RNA, 21 nt, Homo sapiens
agucaaauuuguaaaucuuau

SEQ ID NO: 1373987 - RNA, 12 nt, Homo sapiens
agucacaaagga

SEQ ID NO: 1373988 - RNA, 20 nt, Homo sapiens
agucacagagauaauucuag

SEQ ID NO: 1373989 - RNA, 16 nt, Homo sapiens
agucacagcuacacag

SEQ ID NO: 1373990 - RNA, 21 nt, Homo sapiens
agucacaguuagguagcuuua

SEQ ID NO: 1373991 - RNA, 13 nt, Homo sapiens
agucagcucuucu

SEQ ID NO: 1373992 - RNA, 22 nt, Homo sapiens
agucaguuucuaucauucugcu

SEQ ID NO: 1373993 - RNA, 14 nt, Homo sapiens
agucaugaacacau

SEQ ID NO: 1373994 - RNA, 20 nt, Homo sapiens
agucaugagcugagcaggga

SEQ ID NO: 1373995 - RNA, 20 nt, Homo sapiens
agucaugcguuuaaucacau

SEQ ID NO: 1373996 - RNA, 19 nt, Homo sapiens
agucauuaugagaggcaau

SEQ ID NO: 1373997 - RNA, 18 nt, Homo sapiens
aguccaccugagcugcca

SEQ ID NO: 1373998 - RNA, 15 nt, Homo sapiens
aaaucaaugucacuu

SEQ ID NO: 1373999 - RNA, 16 nt, Homo sapiens
aaaucacucucagugc

SEQ ID NO: 1374000 - RNA, 23 nt, Homo sapiens
aaauccacuagcaccgaccccac

SEQ ID NO: 1374001 - RNA, 15 nt, Homo sapiens
aaaucccccuuucuc

SEQ ID NO: 1374002 - RNA, 14 nt, Homo sapiens
aaauccuucuaauc

SEQ ID NO: 1374003 - RNA, 21 nt, Homo sapiens
aaaucgugacaacacuugugu

SEQ ID NO: 1374004 - RNA, 12 nt, Homo sapiens
aaaucuagaaga

SEQ ID NO: 1374005 - RNA, 23 nt, Homo sapiens
aaaucucacuuuucuccaugagu

SEQ ID NO: 1374006 - RNA, 16 nt, Homo sapiens
aaaucucagcaaugau

SEQ ID NO: 1374007 - RNA, 22 nt, Homo sapiens
aaaucugaggaaucaacagggc

SEQ ID NO: 1374008 - RNA, 16 nt, Homo sapiens
aaaucuguaagcucuu

SEQ ID NO: 1374009 - RNA, 17 nt, Homo sapiens
aaaugacagauguugaa

SEQ ID NO: 1374010 - RNA, 14 nt, Homo sapiens
aaaugagcaaaagu

SEQ ID NO: 1374011 - RNA, 17 nt, Homo sapiens
aaaugauguugaauauu

SEQ ID NO: 1374012 - RNA, 22 nt, Homo sapiens
aaaugcuguauuagucacagag

SEQ ID NO: 1374013 - RNA, 20 nt, Homo sapiens
aaaugcuuauguuagaaaua

SEQ ID NO: 1374014 - RNA, 18 nt, Homo sapiens
aaaugggaaaaccagacu

SEQ ID NO: 1374015 - RNA, 23 nt, Homo sapiens
aaaugggaauuuauaacccagug

SEQ ID NO: 1374016 - RNA, 17 nt, Homo sapiens
aaaugguagcauacuuu

SEQ ID NO: 1374017 - RNA, 15 nt, Homo sapiens
aaauguaaagacaaa

SEQ ID NO: 1374018 - RNA, 17 nt, Homo sapiens
aaauguagguaugaaua

SEQ ID NO: 1374019 - RNA, 16 nt, Homo sapiens
aaauguauaccuguaa

SEQ ID NO: 1374020 - RNA, 13 nt, Homo sapiens
aaauguccaugau

SEQ ID NO: 1374021 - RNA, 19 nt, Homo sapiens
aaaugucuggucuguccac

SEQ ID NO: 1374022 - RNA, 19 nt, Homo sapiens
aaaugugguuacacacuuu

SEQ ID NO: 1374023 - RNA, 21 nt, Homo sapiens
aaauguuagugaucaccacuu

SEQ ID NO: 1374024 - RNA, 22 nt, Homo sapiens
aaauguuauuuuuuaauuauua

SEQ ID NO: 1374025 - RNA, 19 nt, Homo sapiens
aaauuaacugggcauggua

SEQ ID NO: 1374026 - RNA, 17 nt, Homo sapiens
aaauuagcugugugaaa

SEQ ID NO: 1374027 - RNA, 16 nt, Homo sapiens
aaauuauaucucagua

SEQ ID NO: 1374028 - RNA, 14 nt, Homo sapiens
aaauuaugccauag

SEQ ID NO: 1374029 - RNA, 15 nt, Homo sapiens
aaauucaagccuuag

SEQ ID NO: 1374030 - RNA, 17 nt, Homo sapiens
aaauuccuuuucccgaa

SEQ ID NO: 1374031 - RNA, 15 nt, Homo sapiens
aaauucgcaaacuuu

SEQ ID NO: 1374032 - RNA, 15 nt, Homo sapiens
aaauucuacaacuuu

SEQ ID NO: 1374033 - RNA, 21 nt, Homo sapiens
aaauucuauaggaacauauga

SEQ ID NO: 1374034 - RNA, 21 nt, Homo sapiens
aaauucuguuuuucuaggccu

SEQ ID NO: 1374035 - RNA, 19 nt, Homo sapiens
aaauugaaaggcauucucu

SEQ ID NO: 1374036 - RNA, 17 nt, Homo sapiens
aaauugaacuucaggga

SEQ ID NO: 1374037 - RNA, 15 nt, Homo sapiens
aaauuggauacugcu

SEQ ID NO: 1374038 - RNA, 14 nt, Homo sapiens
aaauuguacuguug

SEQ ID NO: 1374039 - RNA, 13 nt, Homo sapiens
aaauuuaagcauu

SEQ ID NO: 1374040 - RNA, 19 nt, Homo sapiens
aaauuuccagugagcuuau

SEQ ID NO: 1374041 - RNA, 14 nt, Homo sapiens
aaauuuuacaauag

SEQ ID NO: 1374042 - RNA, 17 nt, Homo sapiens
aacaaaagugcuuugga

SEQ ID NO: 1374043 - RNA, 12 nt, Homo sapiens
aacaaagccaga

SEQ ID NO: 1374044 - RNA, 16 nt, Homo sapiens
aacaaagucacccacu

SEQ ID NO: 1374045 - RNA, 14 nt, Homo sapiens
aacaaauaauuugu

SEQ ID NO: 1374046 - RNA, 12 nt, Homo sapiens
aacaaauaugca

SEQ ID NO: 1374047 - RNA, 13 nt, Homo sapiens
aacaaauaugcaa

SEQ ID NO: 1374048 - RNA, 21 nt, Homo sapiens
aacaaccguuggaaacauaac

SEQ ID NO: 1374049 - RNA, 22 nt, Homo sapiens
aacaaccucggcuccuggacuc

SEQ ID NO: 1374050 - RNA, 22 nt, Homo sapiens
aacaaccuggucacaggacucu

SEQ ID NO: 1374051 - RNA, 17 nt, Homo sapiens
aacaacuguggucaauc

SEQ ID NO: 1374052 - RNA, 19 nt, Homo sapiens
aacaacuguggucaauccg

SEQ ID NO: 1374053 - RNA, 13 nt, Homo sapiens
aacaagccuaaaa

SEQ ID NO: 1374054 - RNA, 13 nt, Homo sapiens
aacaaucacaaag

SEQ ID NO: 1374055 - RNA, 23 nt, Homo sapiens
aacaauuuuaggaggaccagagc

SEQ ID NO: 1374056 - RNA, 20 nt, Homo sapiens
aacacaaacgggcucagcaa

SEQ ID NO: 1374057 - RNA, 14 nt, Homo sapiens
aacacaagcaaaac

SEQ ID NO: 1374058 - RNA, 14 nt, Homo sapiens
aacacaauaugaau

SEQ ID NO: 1374059 - RNA, 15 nt, Homo sapiens
aacacaauguuauuc

SEQ ID NO: 1374060 - RNA, 18 nt, Homo sapiens
aacacaauuguaaguaau

SEQ ID NO: 1374061 - RNA, 13 nt, Homo sapiens
aacacacacuguu

SEQ ID NO: 1374062 - RNA, 21 nt, Homo sapiens
aacacacccaucaucugacau

SEQ ID NO: 1374063 - RNA, 14 nt, Homo sapiens
aacacacugaggca

SEQ ID NO: 1374064 - RNA, 14 nt, Homo sapiens
aacacauacaggaa

SEQ ID NO: 1374065 - RNA, 20 nt, Homo sapiens
aacacccgacuccucaaaag

SEQ ID NO: 1374066 - RNA, 23 nt, Homo sapiens
aacacgcagauccuuugucuaca

SEQ ID NO: 1374067 - RNA, 21 nt, Homo sapiens
aacacggggcuugcaacuuag

SEQ ID NO: 1374068 - RNA, 19 nt, Homo sapiens
aacacguuuuuucacuauu

SEQ ID NO: 1374069 - RNA, 23 nt, Homo sapiens
aacacucacauuuauucugcuca

SEQ ID NO: 1374070 - RNA, 18 nt, Homo sapiens
aacacucugaauuccaag

SEQ ID NO: 1374071 - RNA, 21 nt, Homo sapiens
aacacugcugcuccagugcag

SEQ ID NO: 1374072 - RNA, 12 nt, Homo sapiens
aacacugggcug

SEQ ID NO: 1374073 - RNA, 17 nt, Homo sapiens
aacagaaauuaaucuua

SEQ ID NO: 1374074 - RNA, 21 nt, Homo sapiens
aacagcaaaacuccaucucaa

SEQ ID NO: 1374075 - RNA, 22 nt, Homo sapiens
aacagcacccucuccagaugag

SEQ ID NO: 1374076 - RNA, 22 nt, Homo sapiens
aacagcgggagaccugugcuag

SEQ ID NO: 1374077 - RNA, 23 nt, Homo sapiens
aacagcugaggucucuugaggga

SEQ ID NO: 1374078 - RNA, 20 nt, Homo sapiens
aacagcuguggcucacguga

SEQ ID NO: 1374079 - RNA, 16 nt, Homo sapiens
aacaguaacugccauc

SEQ ID NO: 1374080 - RNA, 13 nt, Homo sapiens
aacaguucacuug

SEQ ID NO: 1374081 - RNA, 22 nt, Homo sapiens
aacauaacaaaaucacuuccau

SEQ ID NO: 1374082 - RNA, 19 nt, Homo sapiens
aacauaagguacuagcagu

SEQ ID NO: 1374083 - RNA, 19 nt, Homo sapiens
aacauacaggagucugucu

SEQ ID NO: 1374084 - RNA, 16 nt, Homo sapiens
aacauacuucagcuca

SEQ ID NO: 1374085 - RNA, 16 nt, Homo sapiens
aacauauuuaaggaac

SEQ ID NO: 1374086 - RNA, 24 nt, Homo sapiens
aacauauuuauauauguaucuaaa

SEQ ID NO: 1374087 - RNA, 20 nt, Homo sapiens
aacaucacugaaaugcuagc

SEQ ID NO: 1374088 - RNA, 23 nt, Homo sapiens
aacaucagcaaaaaaguacuuaa

SEQ ID NO: 1374089 - RNA, 20 nt, Homo sapiens
aacaucgucuaaacuuuaga

SEQ ID NO: 1374090 - RNA, 17 nt, Homo sapiens
aacaucuuuuacauucu

SEQ ID NO: 1374091 - RNA, 22 nt, Homo sapiens
aacaucuuuuuuuuuuuugaca

SEQ ID NO: 1374092 - RNA, 14 nt, Homo sapiens
aacaugcuaccuga

SEQ ID NO: 1374093 - RNA, 22 nt, Homo sapiens
aacauggugaaaccucaucucu

SEQ ID NO: 1374094 - RNA, 20 nt, Homo sapiens
aacauguacuguuacugugu

SEQ ID NO: 1374095 - RNA, 21 nt, Homo sapiens
aacaugugguuaaugccaugg

SEQ ID NO: 1374096 - RNA, 14 nt, Homo sapiens
aacauuaguucuau

SEQ ID NO: 1374097 - RNA, 20 nt, Homo sapiens
aacauuauuuggauaucaaa

SEQ ID NO: 1374098 - RNA, 19 nt, Homo sapiens
aaccaaauauuccagagac

SEQ ID NO: 1374099 - RNA, 11 nt, Homo sapiens
aaccacuguac

SEQ ID NO: 1374100 - RNA, 23 nt, Homo sapiens
aaccacuguuauuaacagaugua

SEQ ID NO: 1374101 - RNA, 14 nt, Homo sapiens
aaccacuucagcug

SEQ ID NO: 1374102 - RNA, 22 nt, Homo sapiens
aaccacuucagcugacuuuucu

SEQ ID NO: 1374103 - RNA, 17 nt, Homo sapiens
aaccaggauauugacau

SEQ ID NO: 1374104 - RNA, 13 nt, Homo sapiens
aaccagucugaag

SEQ ID NO: 1374105 - RNA, 18 nt, Homo sapiens
aaccaguuaugugaauga

SEQ ID NO: 1374106 - RNA, 17 nt, Homo sapiens
aaccaucaaaguggcaa

SEQ ID NO: 1374107 - RNA, 15 nt, Homo sapiens
aaccaucccugaugu

SEQ ID NO: 1374108 - RNA, 14 nt, Homo sapiens
aaccaugguaugaa

SEQ ID NO: 1374109 - RNA, 19 nt, Homo sapiens
aaccauucacagugcaaga

SEQ ID NO: 1374110 - RNA, 21 nt, Homo sapiens
agauggagguucucucggagu

SEQ ID NO: 1374111 - RNA, 21 nt, Homo sapiens
agauggagucuggcucugucu

SEQ ID NO: 1374112 - RNA, 18 nt, Homo sapiens
agauggauagucugucca

SEQ ID NO: 1374113 - RNA, 22 nt, Homo sapiens
agauggcugugccucugccugu

SEQ ID NO: 1374114 - RNA, 12 nt, Homo sapiens
agaugggacugg

SEQ ID NO: 1374115 - RNA, 22 nt, Homo sapiens
agaugggcaaauuaaggcauaa

SEQ ID NO: 1374116 - RNA, 19 nt, Homo sapiens
agauguccuugaugcucau

SEQ ID NO: 1374117 - RNA, 15 nt, Homo sapiens
agaugugucuuacca

SEQ ID NO: 1374118 - RNA, 20 nt, Homo sapiens
agauguucacccaaccacau

SEQ ID NO: 1374119 - RNA, 19 nt, Homo sapiens
agauuauuuacugacauau

SEQ ID NO: 1374120 - RNA, 12 nt, Homo sapiens
agauuccaccua

SEQ ID NO: 1374121 - RNA, 13 nt, Homo sapiens
agauucuaccaca

SEQ ID NO: 1374122 - RNA, 14 nt, Homo sapiens
agauucuaccacac

SEQ ID NO: 1374123 - RNA, 13 nt, Homo sapiens
agauugauacuuu

SEQ ID NO: 1374124 - RNA, 16 nt, Homo sapiens
agauuguuaaaauaac

SEQ ID NO: 1374125 - RNA, 15 nt, Homo sapiens
agauuuccuaacucu

SEQ ID NO: 1374126 - RNA, 20 nt, Homo sapiens
agcaaaaccacugagcuucu

SEQ ID NO: 1374127 - RNA, 17 nt, Homo sapiens
agcaaaacgcauggagu

SEQ ID NO: 1374128 - RNA, 18 nt, Homo sapiens
agcaaaacuccaucucaa

SEQ ID NO: 1374129 - RNA, 15 nt, Homo sapiens
agcaaacacauuaag

SEQ ID NO: 1374130 - RNA, 12 nt, Homo sapiens
agcaaagacuuu

SEQ ID NO: 1374131 - RNA, 17 nt, Homo sapiens
agcaaagcuccugccuc

SEQ ID NO: 1374132 - RNA, 13 nt, Homo sapiens
agcaaaugugacc

SEQ ID NO: 1374133 - RNA, 18 nt, Homo sapiens
agcaaauguuaugcauaa

SEQ ID NO: 1374134 - RNA, 19 nt, Homo sapiens
agcaacaugcuucaugaaa

SEQ ID NO: 1374135 - RNA, 17 nt, Homo sapiens
agcaaccagagcacugu

SEQ ID NO: 1374136 - RNA, 19 nt, Homo sapiens
agcaaccagagcacuguau

SEQ ID NO: 1374137 - RNA, 21 nt, Homo sapiens
agcaaccuguaagacugauaa

SEQ ID NO: 1374138 - RNA, 18 nt, Homo sapiens
agcaagacucugucucaa

SEQ ID NO: 1374139 - RNA, 18 nt, Homo sapiens
agcaaguuacagugaugc

SEQ ID NO: 1374140 - RNA, 18 nt, Homo sapiens
agcaauacagacuacuuc

SEQ ID NO: 1374141 - RNA, 16 nt, Homo sapiens
agcaauacuaagggaa

SEQ ID NO: 1374142 - RNA, 12 nt, Homo sapiens
agcacacgucau

SEQ ID NO: 1374143 - RNA, 22 nt, Homo sapiens
agcacagaaaacuagaauuuca

SEQ ID NO: 1374144 - RNA, 15 nt, Homo sapiens
agcacagugccugca

SEQ ID NO: 1374145 - RNA, 23 nt, Homo sapiens
agcacaugaaaaccauuaccuga

SEQ ID NO: 1374146 - RNA, 14 nt, Homo sapiens
agcaccaggggaug

SEQ ID NO: 1374147 - RNA, 16 nt, Homo sapiens
agcaccauaacuuugu

SEQ ID NO: 1374148 - RNA, 14 nt, Homo sapiens
agcaccccaugcca

SEQ ID NO: 1374149 - RNA, 16 nt, Homo sapiens
agcacccugcaaaaug

SEQ ID NO: 1374150 - RNA, 19 nt, Homo sapiens
agcacuaaggugugcucug

SEQ ID NO: 1374151 - RNA, 21 nt, Homo sapiens
agcacuaauucaacauauacc

SEQ ID NO: 1374152 - RNA, 23 nt, Homo sapiens
agcacuaauucaacauauaccuu

SEQ ID NO: 1374153 - RNA, 19 nt, Homo sapiens
agcacuuucauugccagug

SEQ ID NO: 1374154 - RNA, 18 nt, Homo sapiens
agcagaagcucucgaugg

SEQ ID NO: 1374155 - RNA, 15 nt, Homo sapiens
agcagagaacuggaa

SEQ ID NO: 1374156 - RNA, 19 nt, Homo sapiens
agcagcuaucucucaguga

SEQ ID NO: 1374157 - RNA, 17 nt, Homo sapiens
agcaggagggacaauga

SEQ ID NO: 1374158 - RNA, 23 nt, Homo sapiens
agcaggcgccucgggucccagau

SEQ ID NO: 1374159 - RNA, 13 nt, Homo sapiens
agcaguaagcuau

SEQ ID NO: 1374160 - RNA, 17 nt, Homo sapiens
agcagugccuuccauaa

SEQ ID NO: 1374161 - RNA, 17 nt, Homo sapiens
agcagugucuuccauaa

SEQ ID NO: 1374162 - RNA, 23 nt, Homo sapiens
agcaguuacaaaaaccuucccca

SEQ ID NO: 1374163 - RNA, 13 nt, Homo sapiens
agcauaacuuauu

SEQ ID NO: 1374164 - RNA, 12 nt, Homo sapiens
agcauaauguga

SEQ ID NO: 1374165 - RNA, 13 nt, Homo sapiens
agcauaaugugag

SEQ ID NO: 1374166 - RNA, 13 nt, Homo sapiens
agcauacuuuaua

SEQ ID NO: 1374167 - RNA, 17 nt, Homo sapiens
agcauauuguuauuaua

SEQ ID NO: 1374168 - RNA, 16 nt, Homo sapiens
agcaucaccucaggcc

SEQ ID NO: 1374169 - RNA, 17 nt, Homo sapiens
agcaucaccucaggcca

SEQ ID NO: 1374170 - RNA, 13 nt, Homo sapiens
agcauccaugugu

SEQ ID NO: 1374171 - RNA, 16 nt, Homo sapiens
agcauccugucuggca

SEQ ID NO: 1374172 - RNA, 12 nt, Homo sapiens
agcaucuaagaa

SEQ ID NO: 1374173 - RNA, 18 nt, Homo sapiens
agcaugcauucauaacag

SEQ ID NO: 1374174 - RNA, 23 nt, Homo sapiens
agcaugcucaguuggugcugcuu

SEQ ID NO: 1374175 - RNA, 21 nt, Homo sapiens
agcaugcugugauugugccua

SEQ ID NO: 1374176 - RNA, 15 nt, Homo sapiens
agcauuacagugggu

SEQ ID NO: 1374177 - RNA, 18 nt, Homo sapiens
agcauuaugauguggguc

SEQ ID NO: 1374178 - RNA, 18 nt, Homo sapiens
agcauucuugucacaaua

SEQ ID NO: 1374179 - RNA, 19 nt, Homo sapiens
agcauucuugucacaauaa

SEQ ID NO: 1374180 - RNA, 17 nt, Homo sapiens
agcauugggcugggcuc

SEQ ID NO: 1374181 - RNA, 21 nt, Homo sapiens
agccaaacucugccagccaca

SEQ ID NO: 1374182 - RNA, 18 nt, Homo sapiens
agccaaagagaaugccau

SEQ ID NO: 1374183 - RNA, 19 nt, Homo sapiens
agccaaagagaaugccauu

SEQ ID NO: 1374184 - RNA, 23 nt, Homo sapiens
agccaacuuuugcauguuuugua

SEQ ID NO: 1374185 - RNA, 18 nt, Homo sapiens
agccaaguuuauauacaa

SEQ ID NO: 1374186 - RNA, 15 nt, Homo sapiens
agccaaucacaagca

SEQ ID NO: 1374187 - RNA, 12 nt, Homo sapiens
agccacacugaa

SEQ ID NO: 1374188 - RNA, 22 nt, Homo sapiens
agccaccaugcccagcucagag

SEQ ID NO: 1374189 - RNA, 23 nt, Homo sapiens
agccaccaugcccagcucagagg

SEQ ID NO: 1374190 - RNA, 21 nt, Homo sapiens
agccacccaggggaaugaucu

SEQ ID NO: 1374191 - RNA, 19 nt, Homo sapiens
agccagcagccagcucuca

SEQ ID NO: 1374192 - RNA, 22 nt, Homo sapiens
agccauaguggagagaacugaa

SEQ ID NO: 1374193 - RNA, 23 nt, Homo sapiens
agccauaguggagagaacugaau

SEQ ID NO: 1374194 - RNA, 16 nt, Homo sapiens
agcccaccuuggcuca

SEQ ID NO: 1374195 - RNA, 22 nt, Homo sapiens
agcccacguucucucugccugu

SEQ ID NO: 1374196 - RNA, 17 nt, Homo sapiens
agcccaggaggacugcc

SEQ ID NO: 1374197 - RNA, 16 nt, Homo sapiens
agcccauccagucucc

SEQ ID NO: 1374198 - RNA, 14 nt, Homo sapiens
agcccauggcuuua

SEQ ID NO: 1374199 - RNA, 21 nt, Homo sapiens
agccccaacccaaaccuggag

SEQ ID NO: 1374200 - RNA, 15 nt, Homo sapiens
agccccagugccaag

SEQ ID NO: 1374201 - RNA, 18 nt, Homo sapiens
agcccucaggucagggug

SEQ ID NO: 1374202 - RNA, 20 nt, Homo sapiens
agcccuccgccauucucaag

SEQ ID NO: 1374203 - RNA, 16 nt, Homo sapiens
agcccucucacugugu

SEQ ID NO: 1374204 - RNA, 12 nt, Homo sapiens
agccgaccucag

SEQ ID NO: 1374205 - RNA, 14 nt, Homo sapiens
agccgagauugcac

SEQ ID NO: 1374206 - RNA, 13 nt, Homo sapiens
agccgugaugccu

SEQ ID NO: 1374207 - RNA, 23 nt, Homo sapiens
agccuacuagggaccuggggaag

SEQ ID NO: 1374208 - RNA, 18 nt, Homo sapiens
agccuaggugacagagug

SEQ ID NO: 1374209 - RNA, 15 nt, Homo sapiens
agccuauggcaucuu

SEQ ID NO: 1374210 - RNA, 20 nt, Homo sapiens
agccucaaccuccccggcuc

SEQ ID NO: 1374211 - RNA, 20 nt, Homo sapiens
agccucauugaugucaaaaa

SEQ ID NO: 1374212 - RNA, 12 nt, Homo sapiens
agccuccacugc

SEQ ID NO: 1374213 - RNA, 18 nt, Homo sapiens
agccucccuguaacucca

SEQ ID NO: 1374214 - RNA, 21 nt, Homo sapiens
agccucucuuccuaucccauc

SEQ ID NO: 1374215 - RNA, 14 nt, Homo sapiens
agccucugaauaug

SEQ ID NO: 1374216 - RNA, 14 nt, Homo sapiens
agccucugcugcca

SEQ ID NO: 1374217 - RNA, 13 nt, Homo sapiens
agccucuggcuag

SEQ ID NO: 1374218 - RNA, 16 nt, Homo sapiens
agccucuggcuagagg

SEQ ID NO: 1374219 - RNA, 20 nt, Homo sapiens
agccugcguggcugaccccc

SEQ ID NO: 1374220 - RNA, 14 nt, Homo sapiens
agccugcugcaugg

SEQ ID NO: 1374221 - RNA, 14 nt, Homo sapiens
agccuggacccugu

SEQ ID NO: 1374222 - RNA, 18 nt, Homo sapiens
agccugggcagcauagca

SEQ ID NO: 1374223 - RNA, 23 nt, Homo sapiens
auacuacauacaagcauaagcaa

SEQ ID NO: 1374224 - RNA, 22 nt, Homo sapiens
auacucaggacuccucuccgca

SEQ ID NO: 1374225 - RNA, 16 nt, Homo sapiens
auacuccaaccauaug

SEQ ID NO: 1374226 - RNA, 15 nt, Homo sapiens
auacucuaauucuaa

SEQ ID NO: 1374227 - RNA, 19 nt, Homo sapiens
auacugacacuuugccaga

SEQ ID NO: 1374228 - RNA, 18 nt, Homo sapiens
auacugagugugccucau

SEQ ID NO: 1374229 - RNA, 23 nt, Homo sapiens
auacuguuuuacuguccaaagac

SEQ ID NO: 1374230 - RNA, 14 nt, Homo sapiens
auagaaaguucaaa

SEQ ID NO: 1374231 - RNA, 20 nt, Homo sapiens
auagaacucugggcugccau

SEQ ID NO: 1374232 - RNA, 15 nt, Homo sapiens
auagacccgaggaaa

SEQ ID NO: 1374233 - RNA, 20 nt, Homo sapiens
auagacugccaugcuagaca

SEQ ID NO: 1374234 - RNA, 15 nt, Homo sapiens
auagagccacguaug

SEQ ID NO: 1374235 - RNA, 21 nt, Homo sapiens
auagaggcaagaaagagauac

SEQ ID NO: 1374236 - RNA, 15 nt, Homo sapiens
auagauauguagaua

SEQ ID NO: 1374237 - RNA, 18 nt, Homo sapiens
auagcaguugaaacaaga

SEQ ID NO: 1374238 - RNA, 15 nt, Homo sapiens
auagcauguaauggu

SEQ ID NO: 1374239 - RNA, 19 nt, Homo sapiens
auagcauuggggacauggg

SEQ ID NO: 1374240 - RNA, 15 nt, Homo sapiens
auagccaaucaucua

SEQ ID NO: 1374241 - RNA, 12 nt, Homo sapiens
auagccacuuac

SEQ ID NO: 1374242 - RNA, 21 nt, Homo sapiens
auagcgcugcucuuaugccau

SEQ ID NO: 1374243 - RNA, 15 nt, Homo sapiens
auaggccugggugcu

SEQ ID NO: 1374244 - RNA, 20 nt, Homo sapiens
auaguacucuuuguagcaaa

SEQ ID NO: 1374245 - RNA, 14 nt, Homo sapiens
auagucacaagagc

SEQ ID NO: 1374246 - RNA, 23 nt, Homo sapiens
auagucaccuuuuaaauccuguu

SEQ ID NO: 1374247 - RNA, 18 nt, Homo sapiens
auagucccagcuacccag

SEQ ID NO: 1374248 - RNA, 17 nt, Homo sapiens
auagucccagcuacuca

SEQ ID NO: 1374249 - RNA, 13 nt, Homo sapiens
auagucuguccaa

SEQ ID NO: 1374250 - RNA, 19 nt, Homo sapiens
auagugaaaccccaucucu

SEQ ID NO: 1374251 - RNA, 17 nt, Homo sapiens
auaguggggucagggcu

SEQ ID NO: 1374252 - RNA, 21 nt, Homo sapiens
auaguguagaaaagaacugga

SEQ ID NO: 1374253 - RNA, 14 nt, Homo sapiens
auaguugugcaugc

SEQ ID NO: 1374254 - RNA, 19 nt, Homo sapiens
auauaaauuuguguucuca

SEQ ID NO: 1374255 - RNA, 19 nt, Homo sapiens
auauacacacacaaagaga

SEQ ID NO: 1374256 - RNA, 21 nt, Homo sapiens
auauacuauuuucauucucuu

SEQ ID NO: 1374257 - RNA, 16 nt, Homo sapiens
auauagcaagauccca

SEQ ID NO: 1374258 - RNA, 18 nt, Homo sapiens
auauagcuugaaacauag

SEQ ID NO: 1374259 - RNA, 16 nt, Homo sapiens
auauauggggggccaa

SEQ ID NO: 1374260 - RNA, 16 nt, Homo sapiens
auauauuuauaacuca

SEQ ID NO: 1374261 - RNA, 22 nt, Homo sapiens
auauauuuauuuaagcuuaugu

SEQ ID NO: 1374262 - RNA, 19 nt, Homo sapiens
auaucagcccaaaagucaa

SEQ ID NO: 1374263 - RNA, 18 nt, Homo sapiens
auaucaguccucuuucaa

SEQ ID NO: 1374264 - RNA, 20 nt, Homo sapiens
auaucaguuuuuacuuucuc

SEQ ID NO: 1374265 - RNA, 13 nt, Homo sapiens
auaucaugcucca

SEQ ID NO: 1374266 - RNA, 14 nt, Homo sapiens
auaucaugcuccau

SEQ ID NO: 1374267 - RNA, 14 nt, Homo sapiens
auaucgaucucuua

SEQ ID NO: 1374268 - RNA, 12 nt, Homo sapiens
auaucugggcug

SEQ ID NO: 1374269 - RNA, 13 nt, Homo sapiens
auaugaacauaua

SEQ ID NO: 1374270 - RNA, 16 nt, Homo sapiens
auaugauugugcacau

SEQ ID NO: 1374271 - RNA, 21 nt, Homo sapiens
auaugcacaauagcaguugaa

SEQ ID NO: 1374272 - RNA, 20 nt, Homo sapiens
auaugcaccaaaucaucucu

SEQ ID NO: 1374273 - RNA, 16 nt, Homo sapiens
auaugcucugauuuau

SEQ ID NO: 1374274 - RNA, 16 nt, Homo sapiens
auauguccauaucuaa

SEQ ID NO: 1374275 - RNA, 20 nt, Homo sapiens
auaugugaagaaaaauguau

SEQ ID NO: 1374276 - RNA, 17 nt, Homo sapiens
auauuacaauccuugac

SEQ ID NO: 1374277 - RNA, 19 nt, Homo sapiens
auauuaguauguaugugua

SEQ ID NO: 1374278 - RNA, 12 nt, Homo sapiens
auauucauuuca

SEQ ID NO: 1374279 - RNA, 18 nt, Homo sapiens
auauucauuucaaaggga

SEQ ID NO: 1374280 - RNA, 22 nt, Homo sapiens
auauuccauauauuagcauuua

SEQ ID NO: 1374281 - RNA, 21 nt, Homo sapiens
auauuccugcauuugugaaau

SEQ ID NO: 1374282 - RNA, 17 nt, Homo sapiens
auauucugcaacacugu

SEQ ID NO: 1374283 - RNA, 22 nt, Homo sapiens
auauuuaaauguaaagacaaaa

SEQ ID NO: 1374284 - RNA, 14 nt, Homo sapiens
auauuucaggcaua

SEQ ID NO: 1374285 - RNA, 18 nt, Homo sapiens
auauuucaggcauacuga

SEQ ID NO: 1374286 - RNA, 18 nt, Homo sapiens
auauuugaagcaucacau

SEQ ID NO: 1374287 - RNA, 13 nt, Homo sapiens
auauuuuauacau

SEQ ID NO: 1374288 - RNA, 18 nt, Homo sapiens
auauuuuguaacuauuac

SEQ ID NO: 1374289 - RNA, 22 nt, Homo sapiens
auauuuuuaauaaaaguugcaa

SEQ ID NO: 1374290 - RNA, 22 nt, Homo sapiens
aucaaaauuucagcauuauuga

SEQ ID NO: 1374291 - RNA, 17 nt, Homo sapiens
aucaaacuagugcauga

SEQ ID NO: 1374292 - RNA, 23 nt, Homo sapiens
aucaaaucugcuuuuuaaagaau

SEQ ID NO: 1374293 - RNA, 14 nt, Homo sapiens
aucaacucuaauag

SEQ ID NO: 1374294 - RNA, 20 nt, Homo sapiens
aucaaguauuuuugacauuu

SEQ ID NO: 1374295 - RNA, 14 nt, Homo sapiens
aucaaguugcacac

SEQ ID NO: 1374296 - RNA, 15 nt, Homo sapiens
aucaaugucacuuaa

SEQ ID NO: 1374297 - RNA, 20 nt, Homo sapiens
aucaauguuuguccuguaua

SEQ ID NO: 1374298 - RNA, 14 nt, Homo sapiens
aucaauuaccacac

SEQ ID NO: 1374299 - RNA, 22 nt, Homo sapiens
aucacaaaggaaagauuugcca

SEQ ID NO: 1374300 - RNA, 23 nt, Homo sapiens
aucacacgucuggcuucacagau

SEQ ID NO: 1374301 - RNA, 16 nt, Homo sapiens
aucacagccucugaaa

SEQ ID NO: 1374302 - RNA, 14 nt, Homo sapiens
aucacaucaugcug

SEQ ID NO: 1374303 - RNA, 18 nt, Homo sapiens
aucacauuaucaucugaa

SEQ ID NO: 1374304 - RNA, 19 nt, Homo sapiens
aucacauucgaguguuuca

SEQ ID NO: 1374305 - RNA, 22 nt, Homo sapiens
aucaccuagaaacuuguuagaa

SEQ ID NO: 1374306 - RNA, 21 nt, Homo sapiens
aucaccuccccuccuugccuc

SEQ ID NO: 1374307 - RNA, 18 nt, Homo sapiens
aucacgagaucaagagau

SEQ ID NO: 1374308 - RNA, 22 nt, Homo sapiens
aucacggcucacugcagccuca

SEQ ID NO: 1374309 - RNA, 15 nt, Homo sapiens
aucacuccucuguca

SEQ ID NO: 1374310 - RNA, 13 nt, Homo sapiens
aucagacuaguga

SEQ ID NO: 1374311 - RNA, 20 nt, Homo sapiens
aucagcaaaaaaguacuuaa

SEQ ID NO: 1374312 - RNA, 21 nt, Homo sapiens
aucagcaaaaaaguacuuaaa

SEQ ID NO: 1374313 - RNA, 18 nt, Homo sapiens
aucagcagagaacuggaa

SEQ ID NO: 1374314 - RNA, 15 nt, Homo sapiens
aucagccacauucua

SEQ ID NO: 1374315 - RNA, 21 nt, Homo sapiens
aucagccugggcaaugugaua

SEQ ID NO: 1374316 - RNA, 16 nt, Homo sapiens
aucagcuuaggggcug

SEQ ID NO: 1374317 - RNA, 21 nt, Homo sapiens
aucaggcuauguauggaauac

SEQ ID NO: 1374318 - RNA, 17 nt, Homo sapiens
aucagggaggucauuuu

SEQ ID NO: 1374319 - RNA, 23 nt, Homo sapiens
aucagugacagaguucacuauaa

SEQ ID NO: 1374320 - RNA, 14 nt, Homo sapiens
aucaguuacucuga

SEQ ID NO: 1374321 - RNA, 16 nt, Homo sapiens
aucaguugaggccagg

SEQ ID NO: 1374322 - RNA, 16 nt, Homo sapiens
aucauaaaacuugaug

SEQ ID NO: 1374323 - RNA, 15 nt, Homo sapiens
aucauauauauacau

SEQ ID NO: 1374324 - RNA, 22 nt, Homo sapiens
aucauaugguugacaguaugca

SEQ ID NO: 1374325 - RNA, 19 nt, Homo sapiens
aucauccacugugccaugu

SEQ ID NO: 1374326 - RNA, 12 nt, Homo sapiens
aucaugagauaa

SEQ ID NO: 1374327 - RNA, 19 nt, Homo sapiens
aucaugcaaaugcuguauu

SEQ ID NO: 1374328 - RNA, 20 nt, Homo sapiens
aucaugccccuguacuccag

SEQ ID NO: 1374329 - RNA, 16 nt, Homo sapiens
aucaugcugucuuuac

SEQ ID NO: 1374330 - RNA, 14 nt, Homo sapiens
aucauggcucacug

SEQ ID NO: 1374331 - RNA, 16 nt, Homo sapiens
aucaugggcuggacau

SEQ ID NO: 1374332 - RNA, 21 nt, Homo sapiens
aucauguugaauaaugcuguu

SEQ ID NO: 1374333 - RNA, 15 nt, Homo sapiens
aucauuaugaaguca

SEQ ID NO: 1374334 - RNA, 13 nt, Homo sapiens
aucauuccuugag

SEQ ID NO: 1374335 - RNA, 22 nt, Homo sapiens
aucauuuuauuaucaccaugca

SEQ ID NO: 1374336 - RNA, 14 nt, Homo sapiens
auguaucucaggaa

SEQ ID NO: 1374337 - RNA, 22 nt, Homo sapiens
auguauuuuccugcauaaucau

SEQ ID NO: 1374338 - RNA, 21 nt, Homo sapiens
augucaauaaaaccacuguac

SEQ ID NO: 1374339 - RNA, 18 nt, Homo sapiens
augucacaaccucucuga

SEQ ID NO: 1374340 - RNA, 11 nt, Homo sapiens
augucagaaaa

SEQ ID NO: 1374341 - RNA, 19 nt, Homo sapiens
auguccucuuguugcugag

SEQ ID NO: 1374342 - RNA, 17 nt, Homo sapiens
augucguuugaaucaca

SEQ ID NO: 1374343 - RNA, 22 nt, Homo sapiens
augucuccaucucugucucaaa

SEQ ID NO: 1374344 - RNA, 21 nt, Homo sapiens
augucucccagggccuuaaaa

SEQ ID NO: 1374345 - RNA, 22 nt, Homo sapiens
augucuguagcuccucaacuca

SEQ ID NO: 1374346 - RNA, 20 nt, Homo sapiens
augucuucucguuaaggaga

SEQ ID NO: 1374347 - RNA, 22 nt, Homo sapiens
augucuuuguuaagacugcuga

SEQ ID NO: 1374348 - RNA, 17 nt, Homo sapiens
augugaaaguuacaaau

SEQ ID NO: 1374349 - RNA, 22 nt, Homo sapiens
augugaauaaauucuauaggaa

SEQ ID NO: 1374350 - RNA, 16 nt, Homo sapiens
augugaaucaugguuu

SEQ ID NO: 1374351 - RNA, 13 nt, Homo sapiens
augugauacaaau

SEQ ID NO: 1374352 - RNA, 13 nt, Homo sapiens
augugcaaaaauu

SEQ ID NO: 1374353 - RNA, 17 nt, Homo sapiens
augugcaaguguaugca

SEQ ID NO: 1374354 - RNA, 14 nt, Homo sapiens
augugcacaugcac

SEQ ID NO: 1374355 - RNA, 13 nt, Homo sapiens
augugccauuuau

SEQ ID NO: 1374356 - RNA, 19 nt, Homo sapiens
augugccauuuaugugagu

SEQ ID NO: 1374357 - RNA, 15 nt, Homo sapiens
augugcccccagacg

SEQ ID NO: 1374358 - RNA, 23 nt, Homo sapiens
augugccuguagucccaggcuga

SEQ ID NO: 1374359 - RNA, 21 nt, Homo sapiens
augugcucagggaauaaucca

SEQ ID NO: 1374360 - RNA, 12 nt, Homo sapiens
auguggcagcug

SEQ ID NO: 1374361 - RNA, 16 nt, Homo sapiens
auguggcccaacacaa

SEQ ID NO: 1374362 - RNA, 24 nt, Homo sapiens
augugguuaaugccauggacagaa

SEQ ID NO: 1374363 - RNA, 17 nt, Homo sapiens
auguguaugugccauuu

SEQ ID NO: 1374364 - RNA, 17 nt, Homo sapiens
augugucuuaccagauc

SEQ ID NO: 1374365 - RNA, 12 nt, Homo sapiens
augugugauuca

SEQ ID NO: 1374366 - RNA, 13 nt, Homo sapiens
augugugauucac

SEQ ID NO: 1374367 - RNA, 16 nt, Homo sapiens
augugugauucacagu

SEQ ID NO: 1374368 - RNA, 17 nt, Homo sapiens
augugugugcaagugug

SEQ ID NO: 1374369 - RNA, 17 nt, Homo sapiens
auguuacacuaagggug

SEQ ID NO: 1374370 - RNA, 21 nt, Homo sapiens
auguuacucaugacuccuuuc

SEQ ID NO: 1374371 - RNA, 18 nt, Homo sapiens
auguuagaaauaagacaa

SEQ ID NO: 1374372 - RNA, 19 nt, Homo sapiens
auguuaggaaaauuucaca

SEQ ID NO: 1374373 - RNA, 23 nt, Homo sapiens
auguuaggaaaauuucacauuaa

SEQ ID NO: 1374374 - RNA, 13 nt, Homo sapiens
auguuauuaccua

SEQ ID NO: 1374375 - RNA, 19 nt, Homo sapiens
auguucagaauguacggaa

SEQ ID NO: 1374376 - RNA, 14 nt, Homo sapiens
auguuccucaaaag

SEQ ID NO: 1374377 - RNA, 17 nt, Homo sapiens
auguucucugaggacac

SEQ ID NO: 1374378 - RNA, 12 nt, Homo sapiens
auguugaugaaa

SEQ ID NO: 1374379 - RNA, 14 nt, Homo sapiens
auguugcccagugu

SEQ ID NO: 1374380 - RNA, 16 nt, Homo sapiens
auguugcccagugugu

SEQ ID NO: 1374381 - RNA, 20 nt, Homo sapiens
auguugcuuucuuaucccag

SEQ ID NO: 1374382 - RNA, 23 nt, Homo sapiens
auguugcuuucuuaucccaguga

SEQ ID NO: 1374383 - RNA, 18 nt, Homo sapiens
auguuguaauucaugcca

SEQ ID NO: 1374384 - RNA, 12 nt, Homo sapiens
auguuuacuucu

SEQ ID NO: 1374385 - RNA, 23 nt, Homo sapiens
auguuuaugauaauaaaggcacc

SEQ ID NO: 1374386 - RNA, 13 nt, Homo sapiens
auguuucaaaaaa

SEQ ID NO: 1374387 - RNA, 19 nt, Homo sapiens
auguuucgcugauauaugu

SEQ ID NO: 1374388 - RNA, 12 nt, Homo sapiens
auguuugcacac

SEQ ID NO: 1374389 - RNA, 18 nt, Homo sapiens
auguuugcacacuugugu

SEQ ID NO: 1374390 - RNA, 22 nt, Homo sapiens
auguuugcuauugacaagucau

SEQ ID NO: 1374391 - RNA, 16 nt, Homo sapiens
auuaacagcugauaca

SEQ ID NO: 1374392 - RNA, 21 nt, Homo sapiens
auuaacuuuuuaaaacacaac

SEQ ID NO: 1374393 - RNA, 14 nt, Homo sapiens
auuaagcaucacaa

SEQ ID NO: 1374394 - RNA, 16 nt, Homo sapiens
auuaaguaaacuaaug

SEQ ID NO: 1374395 - RNA, 16 nt, Homo sapiens
auuaauuaauauucau

SEQ ID NO: 1374396 - RNA, 23 nt, Homo sapiens
auuacaggugugaaccaccacac

SEQ ID NO: 1374397 - RNA, 21 nt, Homo sapiens
auuacccccucauuguuuauu

SEQ ID NO: 1374398 - RNA, 17 nt, Homo sapiens
auuacccuucuuuccau

SEQ ID NO: 1374399 - RNA, 14 nt, Homo sapiens
auuacuucugcuac

SEQ ID NO: 1374400 - RNA, 17 nt, Homo sapiens
auuagccaaguguggua

SEQ ID NO: 1374401 - RNA, 18 nt, Homo sapiens
auuagccgggcauggugg

SEQ ID NO: 1374402 - RNA, 19 nt, Homo sapiens
auuagccuaugugcaugca

SEQ ID NO: 1374403 - RNA, 14 nt, Homo sapiens
auuaguaacauuca

SEQ ID NO: 1374404 - RNA, 15 nt, Homo sapiens
auuagucaaaccacu

SEQ ID NO: 1374405 - RNA, 12 nt, Homo sapiens
auuauaacuuaa

SEQ ID NO: 1374406 - RNA, 14 nt, Homo sapiens
auuauagugacaau

SEQ ID NO: 1374407 - RNA, 18 nt, Homo sapiens
auuauagugacaaugaag

SEQ ID NO: 1374408 - RNA, 17 nt, Homo sapiens
auuauauugagacaaaa

SEQ ID NO: 1374409 - RNA, 14 nt, Homo sapiens
auuaucaauguucu

SEQ ID NO: 1374410 - RNA, 14 nt, Homo sapiens
auuaucuucaggac

SEQ ID NO: 1374411 - RNA, 16 nt, Homo sapiens
auuaugagaggcaaug

SEQ ID NO: 1374412 - RNA, 22 nt, Homo sapiens
auuaugcaucugcuacuguguc

SEQ ID NO: 1374413 - RNA, 16 nt, Homo sapiens
auuauuuaaacaucag

SEQ ID NO: 1374414 - RNA, 14 nt, Homo sapiens
auuauuuaucacau

SEQ ID NO: 1374415 - RNA, 13 nt, Homo sapiens
auuauuuuuacag

SEQ ID NO: 1374416 - RNA, 16 nt, Homo sapiens
auucaaaaauguacaa

SEQ ID NO: 1374417 - RNA, 17 nt, Homo sapiens
auucaaagagacauaua

SEQ ID NO: 1374418 - RNA, 20 nt, Homo sapiens
auucaacaacuacuacuuga

SEQ ID NO: 1374419 - RNA, 15 nt, Homo sapiens
auucaagucagcucu

SEQ ID NO: 1374420 - RNA, 17 nt, Homo sapiens
auucacaaaauuuccac

SEQ ID NO: 1374421 - RNA, 15 nt, Homo sapiens
auucacagugcaaga

SEQ ID NO: 1374422 - RNA, 20 nt, Homo sapiens
auucacgugcagcagcaaca

SEQ ID NO: 1374423 - RNA, 15 nt, Homo sapiens
auucacuagaccaga

SEQ ID NO: 1374424 - RNA, 20 nt, Homo sapiens
auucagaaaagaugugcaga

SEQ ID NO: 1374425 - RNA, 14 nt, Homo sapiens
auucagcucugcaa

SEQ ID NO: 1374426 - RNA, 21 nt, Homo sapiens
auucaguugguaagcuuccag

SEQ ID NO: 1374427 - RNA, 17 nt, Homo sapiens
auucauauuuacuucuu

SEQ ID NO: 1374428 - RNA, 14 nt, Homo sapiens
auucauguggaaua

SEQ ID NO: 1374429 - RNA, 16 nt, Homo sapiens
auucauuucaaaggga

SEQ ID NO: 1374430 - RNA, 17 nt, Homo sapiens
auucauuuucugccuau

SEQ ID NO: 1374431 - RNA, 17 nt, Homo sapiens
auuccaauuugcacuuu

SEQ ID NO: 1374432 - RNA, 15 nt, Homo sapiens
auuccaccuagagcu

SEQ ID NO: 1374433 - RNA, 13 nt, Homo sapiens
auuccacuggacu

SEQ ID NO: 1374434 - RNA, 17 nt, Homo sapiens
auuccaggcgaugugca

SEQ ID NO: 1374435 - RNA, 16 nt, Homo sapiens
auucccacagcacuaa

SEQ ID NO: 1374436 - RNA, 22 nt, Homo sapiens
auucccagauuugaagacaaaa

SEQ ID NO: 1374437 - RNA, 22 nt, Homo sapiens
auuccccuuggggaagacgaag

SEQ ID NO: 1374438 - RNA, 23 nt, Homo sapiens
auucccuccucccuucuacugcu

SEQ ID NO: 1374439 - RNA, 16 nt, Homo sapiens
auucccuccugcuacu

SEQ ID NO: 1374440 - RNA, 21 nt, Homo sapiens
auuccuaagacugcugcugaa

SEQ ID NO: 1374441 - RNA, 14 nt, Homo sapiens
auuccuagaaacug

SEQ ID NO: 1374442 - RNA, 20 nt, Homo sapiens
auuccuuagcuuagaccuca

SEQ ID NO: 1374443 - RNA, 23 nt, Homo sapiens
auuccuuggcaugccuuccagca

SEQ ID NO: 1374444 - RNA, 18 nt, Homo sapiens
auucuaacuuuuuugcua

SEQ ID NO: 1374445 - RNA, 22 nt, Homo sapiens
auucuaaggaauaugagcuuua

SEQ ID NO: 1374446 - RNA, 15 nt, Homo sapiens
auucuaaucuaacaa

SEQ ID NO: 1374447 - RNA, 18 nt, Homo sapiens
auucuacugaacacuuca

SEQ ID NO: 1374448 - RNA, 14 nt, Homo sapiens
auucuacugaacag

SEQ ID NO: 1374449 - RNA, 23 nt, Homo sapiens
cacagccgcagccucccucugac

SEQ ID NO: 1374450 - RNA, 17 nt, Homo sapiens
cacagcucuguguugcc

SEQ ID NO: 1374451 - RNA, 16 nt, Homo sapiens
cacagcugaacuuguu

SEQ ID NO: 1374452 - RNA, 20 nt, Homo sapiens
cacagcugaacuuguugaga

SEQ ID NO: 1374453 - RNA, 14 nt, Homo sapiens
cacagcugugguga

SEQ ID NO: 1374454 - RNA, 23 nt, Homo sapiens
cacagcuucugcagcagacuguc

SEQ ID NO: 1374455 - RNA, 20 nt, Homo sapiens
cacaggauggucucugccau

SEQ ID NO: 1374456 - RNA, 23 nt, Homo sapiens
cacaguauuacuucugcuacaua

SEQ ID NO: 1374457 - RNA, 18 nt, Homo sapiens
cacaguuagguagcuuua

SEQ ID NO: 1374458 - RNA, 17 nt, Homo sapiens
cacauacuacacauuca

SEQ ID NO: 1374459 - RNA, 15 nt, Homo sapiens
cacauagauucaccu

SEQ ID NO: 1374460 - RNA, 21 nt, Homo sapiens
cacaugaaaaccauuaccuga

SEQ ID NO: 1374461 - RNA, 11 nt, Homo sapiens
cacaugcuuuu

SEQ ID NO: 1374462 - RNA, 17 nt, Homo sapiens
cacaugcuuuucuuccu

SEQ ID NO: 1374463 - RNA, 14 nt, Homo sapiens
cacauggcugggau

SEQ ID NO: 1374464 - RNA, 22 nt, Homo sapiens
cacaugggaguuuagugugaua

SEQ ID NO: 1374465 - RNA, 14 nt, Homo sapiens
cacaugugugcgug

SEQ ID NO: 1374466 - RNA, 16 nt, Homo sapiens
cacauucaauaagcau

SEQ ID NO: 1374467 - RNA, 17 nt, Homo sapiens
cacauucgaguguuuca

SEQ ID NO: 1374468 - RNA, 15 nt, Homo sapiens
cacauugccagugac

SEQ ID NO: 1374469 - RNA, 15 nt, Homo sapiens
caccaaaucaucucu

SEQ ID NO: 1374470 - RNA, 20 nt, Homo sapiens
caccaaaucaucucucauca

SEQ ID NO: 1374471 - RNA, 22 nt, Homo sapiens
caccaaaucaucucucaucacu

SEQ ID NO: 1374472 - RNA, 19 nt, Homo sapiens
caccaacuauagaauguau

SEQ ID NO: 1374473 - RNA, 22 nt, Homo sapiens
caccaagcugcuguggccauca

SEQ ID NO: 1374474 - RNA, 21 nt, Homo sapiens
caccaauauuucucagacauc

SEQ ID NO: 1374475 - RNA, 18 nt, Homo sapiens
caccaauccccgccacag

SEQ ID NO: 1374476 - RNA, 14 nt, Homo sapiens
caccacaugugcac

SEQ ID NO: 1374477 - RNA, 15 nt, Homo sapiens
caccacaugugcaca

SEQ ID NO: 1374478 - RNA, 18 nt, Homo sapiens
caccacggccucacccag

SEQ ID NO: 1374479 - RNA, 19 nt, Homo sapiens
caccacggccucacccagg

SEQ ID NO: 1374480 - RNA, 13 nt, Homo sapiens
caccagcagccug

SEQ ID NO: 1374481 - RNA, 13 nt, Homo sapiens
caccaguguccuc

SEQ ID NO: 1374482 - RNA, 18 nt, Homo sapiens
caccaucaccagacaggu

SEQ ID NO: 1374483 - RNA, 23 nt, Homo sapiens
caccaucagucaaugaauaacag

SEQ ID NO: 1374484 - RNA, 17 nt, Homo sapiens
caccauucgucaucacu

SEQ ID NO: 1374485 - RNA, 16 nt, Homo sapiens
caccauugcugcuccu

SEQ ID NO: 1374486 - RNA, 18 nt, Homo sapiens
caccauuuuccugccuca

SEQ ID NO: 1374487 - RNA, 14 nt, Homo sapiens
cacccaaaagucaa

SEQ ID NO: 1374488 - RNA, 23 nt, Homo sapiens
cacccaaaagucaaaaggugccu

SEQ ID NO: 1374489 - RNA, 16 nt, Homo sapiens
cacccacucuguccug

SEQ ID NO: 1374490 - RNA, 12 nt, Homo sapiens
caccccacugug

SEQ ID NO: 1374491 - RNA, 24 nt, Homo sapiens
caccccagugcacccacucugcuu

SEQ ID NO: 1374492 - RNA, 15 nt, Homo sapiens
caccccuaaagagau

SEQ ID NO: 1374493 - RNA, 17 nt, Homo sapiens
cacccucccacugccaa

SEQ ID NO: 1374494 - RNA, 14 nt, Homo sapiens
cacccucuccagau

SEQ ID NO: 1374495 - RNA, 20 nt, Homo sapiens
cacccuguagguucuugaua

SEQ ID NO: 1374496 - RNA, 21 nt, Homo sapiens
cacccuguccaaacugccuaa

SEQ ID NO: 1374497 - RNA, 12 nt, Homo sapiens
caccuagccucg

SEQ ID NO: 1374498 - RNA, 21 nt, Homo sapiens
caccuccccagccuuugauca

SEQ ID NO: 1374499 - RNA, 15 nt, Homo sapiens
caccuccuacgucaa

SEQ ID NO: 1374500 - RNA, 14 nt, Homo sapiens
caccuccugcaaua

SEQ ID NO: 1374501 - RNA, 16 nt, Homo sapiens
caccugaaugugucug

SEQ ID NO: 1374502 - RNA, 17 nt, Homo sapiens
caccugagcuuuggacg

SEQ ID NO: 1374503 - RNA, 22 nt, Homo sapiens
caccugagcuuuggacgcacac

SEQ ID NO: 1374504 - RNA, 23 nt, Homo sapiens
caccugguuccggaauccugucc

SEQ ID NO: 1374505 - RNA, 19 nt, Homo sapiens
caccuguacuggagagcaa

SEQ ID NO: 1374506 - RNA, 21 nt, Homo sapiens
caccugucaaacaaagccaga

SEQ ID NO: 1374507 - RNA, 19 nt, Homo sapiens
caccuucagaggcugaggu

SEQ ID NO: 1374508 - RNA, 16 nt, Homo sapiens
caccuugcccuuuacg

SEQ ID NO: 1374509 - RNA, 20 nt, Homo sapiens
cacgagagagggcuuucuca

SEQ ID NO: 1374510 - RNA, 23 nt, Homo sapiens
cacgagcaaagugaagacacugg

SEQ ID NO: 1374511 - RNA, 21 nt, Homo sapiens
cacggacucaaguuucuucaa

SEQ ID NO: 1374512 - RNA, 17 nt, Homo sapiens
cacggauccauguagca

SEQ ID NO: 1374513 - RNA, 16 nt, Homo sapiens
cacgguggcucaggcc

SEQ ID NO: 1374514 - RNA, 22 nt, Homo sapiens
cacguaguagggucaggccacg

SEQ ID NO: 1374515 - RNA, 16 nt, Homo sapiens
cacuaaagcauucaau

SEQ ID NO: 1374516 - RNA, 22 nt, Homo sapiens
cacuaacauuauauugcaauga

SEQ ID NO: 1374517 - RNA, 16 nt, Homo sapiens
cacuaaccacgcugga

SEQ ID NO: 1374518 - RNA, 17 nt, Homo sapiens
cacuaaggugugcucug

SEQ ID NO: 1374519 - RNA, 18 nt, Homo sapiens
cacuaauggggcggugag

SEQ ID NO: 1374520 - RNA, 14 nt, Homo sapiens
cacuaauucugcau

SEQ ID NO: 1374521 - RNA, 22 nt, Homo sapiens
cacuaauuugauguuuacaggu

SEQ ID NO: 1374522 - RNA, 21 nt, Homo sapiens
cacucacauuuauucugcuca

SEQ ID NO: 1374523 - RNA, 14 nt, Homo sapiens
cacucccaguccaa

SEQ ID NO: 1374524 - RNA, 19 nt, Homo sapiens
cacucccuucuccuugaua

SEQ ID NO: 1374525 - RNA, 17 nt, Homo sapiens
cacucuauuaaaucuug

SEQ ID NO: 1374526 - RNA, 20 nt, Homo sapiens
cacucuuauagaaaguucaa

SEQ ID NO: 1374527 - RNA, 22 nt, Homo sapiens
cacucuuauugcccacgcugga

SEQ ID NO: 1374528 - RNA, 22 nt, Homo sapiens
cacugaaaauuacaguauggua

SEQ ID NO: 1374529 - RNA, 13 nt, Homo sapiens
cacugaaaugcua

SEQ ID NO: 1374530 - RNA, 17 nt, Homo sapiens
cacugaggaccagccau

SEQ ID NO: 1374531 - RNA, 13 nt, Homo sapiens
cacugauguauga

SEQ ID NO: 1374532 - RNA, 12 nt, Homo sapiens
cacugcaagcac

SEQ ID NO: 1374533 - RNA, 14 nt, Homo sapiens
cacugcauaccaac

SEQ ID NO: 1374534 - RNA, 12 nt, Homo sapiens
cacugccaaaga

SEQ ID NO: 1374535 - RNA, 20 nt, Homo sapiens
cacuggacugacgacuugag

SEQ ID NO: 1374536 - RNA, 14 nt, Homo sapiens
cacuggaugcagaa

SEQ ID NO: 1374537 - RNA, 19 nt, Homo sapiens
cacuguauauaaacauauc

SEQ ID NO: 1374538 - RNA, 16 nt, Homo sapiens
cacugucucugcugca

SEQ ID NO: 1374539 - RNA, 23 nt, Homo sapiens
cacugugaagagaaccauaucaa

SEQ ID NO: 1374540 - RNA, 19 nt, Homo sapiens
cacugugccaugugccagg

SEQ ID NO: 1374541 - RNA, 20 nt, Homo sapiens
cacuguggcauugucuguaa

SEQ ID NO: 1374542 - RNA, 14 nt, Homo sapiens
cacuguugcccagg

SEQ ID NO: 1374543 - RNA, 13 nt, Homo sapiens
cacuguuugccca

SEQ ID NO: 1374544 - RNA, 16 nt, Homo sapiens
cacuucaaaacaguau

SEQ ID NO: 1374545 - RNA, 20 nt, Homo sapiens
cacuuccugcugcgaaagac

SEQ ID NO: 1374546 - RNA, 17 nt, Homo sapiens
cacuuccuuaccuagug

SEQ ID NO: 1374547 - RNA, 19 nt, Homo sapiens
cacuucuaaaugaagugca

SEQ ID NO: 1374548 - RNA, 16 nt, Homo sapiens
cacuugaagaugcugc

SEQ ID NO: 1374549 - RNA, 18 nt, Homo sapiens
cacuugcacgcccaugug

SEQ ID NO: 1374550 - RNA, 19 nt, Homo sapiens
cacuugcacgcccaugugu

SEQ ID NO: 1374551 - RNA, 14 nt, Homo sapiens
cacuuggaacacaa

SEQ ID NO: 1374552 - RNA, 22 nt, Homo sapiens
cacuugggauugucuuacuguu

SEQ ID NO: 1374553 - RNA, 19 nt, Homo sapiens
cacuuugggaggcugaggc

SEQ ID NO: 1374554 - RNA, 16 nt, Homo sapiens
cagaaaaacucuggga

SEQ ID NO: 1374555 - RNA, 16 nt, Homo sapiens
cagaaaauucccauga

SEQ ID NO: 1374556 - RNA, 14 nt, Homo sapiens
cagaaagcuuugaa

SEQ ID NO: 1374557 - RNA, 19 nt, Homo sapiens
cagaaaggagaacuaucca

SEQ ID NO: 1374558 - RNA, 15 nt, Homo sapiens
cagaaauacaugaaa

SEQ ID NO: 1374559 - RNA, 19 nt, Homo sapiens
cagaaaucaaaaagggaau

SEQ ID NO: 1374560 - RNA, 21 nt, Homo sapiens
cagaaaucuagaagacuguca

SEQ ID NO: 1374561 - RNA, 23 nt, Homo sapiens
cugcagaggggaaaccaguguag

SEQ ID NO: 1374562 - RNA, 20 nt, Homo sapiens
cugcagaguaggcagcugcc

SEQ ID NO: 1374563 - RNA, 21 nt, Homo sapiens
cugcagccccgcgccuccuuc

SEQ ID NO: 1374564 - RNA, 15 nt, Homo sapiens
cugcagccucaggau

SEQ ID NO: 1374565 - RNA, 15 nt, Homo sapiens
cugcaggcagggcug

SEQ ID NO: 1374566 - RNA, 13 nt, Homo sapiens
cugcaggccaaga

SEQ ID NO: 1374567 - RNA, 14 nt, Homo sapiens
cugcauaaucauau

SEQ ID NO: 1374568 - RNA, 21 nt, Homo sapiens
cugcauaccaaccugggcaau

SEQ ID NO: 1374569 - RNA, 22 nt, Homo sapiens
cugcaucuccccucagauucca

SEQ ID NO: 1374570 - RNA, 19 nt, Homo sapiens
cugcauggaccuaacauuc

SEQ ID NO: 1374571 - RNA, 15 nt, Homo sapiens
cugcauguuacauaa

SEQ ID NO: 1374572 - RNA, 21 nt, Homo sapiens
cugcauugccugcggucaagg

SEQ ID NO: 1374573 - RNA, 15 nt, Homo sapiens
cugcauuuuacugua

SEQ ID NO: 1374574 - RNA, 16 nt, Homo sapiens
cugcauuuuacuguac

SEQ ID NO: 1374575 - RNA, 20 nt, Homo sapiens
cugccaacacgcccggcuaa

SEQ ID NO: 1374576 - RNA, 16 nt, Homo sapiens
cugccaugaacuggag

SEQ ID NO: 1374577 - RNA, 15 nt, Homo sapiens
cugccaugccagcuu

SEQ ID NO: 1374578 - RNA, 18 nt, Homo sapiens
cugccauuucugagauca

SEQ ID NO: 1374579 - RNA, 15 nt, Homo sapiens
cugcccagugcacac

SEQ ID NO: 1374580 - RNA, 20 nt, Homo sapiens
cugccccaaacaaauaugca

SEQ ID NO: 1374581 - RNA, 21 nt, Homo sapiens
cugccccuggcucugaccgaa

SEQ ID NO: 1374582 - RNA, 18 nt, Homo sapiens
cugcccugguccagggaa

SEQ ID NO: 1374583 - RNA, 18 nt, Homo sapiens
cugccuaaguggcugcug

SEQ ID NO: 1374584 - RNA, 17 nt, Homo sapiens
cugccucagccucccaa

SEQ ID NO: 1374585 - RNA, 18 nt, Homo sapiens
cugccuccccaacccugc

SEQ ID NO: 1374586 - RNA, 19 nt, Homo sapiens
cugccuccccaacccugcc

SEQ ID NO: 1374587 - RNA, 15 nt, Homo sapiens
cugccucugacacac

SEQ ID NO: 1374588 - RNA, 20 nt, Homo sapiens
cugccucuggaauugcucaa

SEQ ID NO: 1374589 - RNA, 16 nt, Homo sapiens
cugccugaagucacac

SEQ ID NO: 1374590 - RNA, 19 nt, Homo sapiens
cugccuggaguacuuugaa

SEQ ID NO: 1374591 - RNA, 17 nt, Homo sapiens
cugccuggaguccuuga

SEQ ID NO: 1374592 - RNA, 18 nt, Homo sapiens
cugccuugaagccacuga

SEQ ID NO: 1374593 - RNA, 18 nt, Homo sapiens
cugccuugauuagacucc

SEQ ID NO: 1374594 - RNA, 17 nt, Homo sapiens
cugcuaccucacugggg

SEQ ID NO: 1374595 - RNA, 16 nt, Homo sapiens
cugcucacacugcuga

SEQ ID NO: 1374596 - RNA, 14 nt, Homo sapiens
cugcucagggcugg

SEQ ID NO: 1374597 - RNA, 12 nt, Homo sapiens
cugcuccagcug

SEQ ID NO: 1374598 - RNA, 14 nt, Homo sapiens
cugcucccacagaa

SEQ ID NO: 1374599 - RNA, 18 nt, Homo sapiens
cugcucggccgucuucac

SEQ ID NO: 1374600 - RNA, 14 nt, Homo sapiens
cugcugacaguguu

SEQ ID NO: 1374601 - RNA, 16 nt, Homo sapiens
cugcugcuccagugca

SEQ ID NO: 1374602 - RNA, 19 nt, Homo sapiens
cugcuguucauguuacuca

SEQ ID NO: 1374603 - RNA, 20 nt, Homo sapiens
cugcuucuaccaacuggaag

SEQ ID NO: 1374604 - RNA, 23 nt, Homo sapiens
cugcuucugcaccuuaucuuaaa

SEQ ID NO: 1374605 - RNA, 16 nt, Homo sapiens
cugcuuugucaaaagg

SEQ ID NO: 1374606 - RNA, 22 nt, Homo sapiens
cuggaagcacagaaaacuagaa

SEQ ID NO: 1374607 - RNA, 18 nt, Homo sapiens
cuggaaggcacacgccug

SEQ ID NO: 1374608 - RNA, 22 nt, Homo sapiens
cuggaaucacauucuuagcaca

SEQ ID NO: 1374609 - RNA, 20 nt, Homo sapiens
cuggaauguaaucaauguuu

SEQ ID NO: 1374610 - RNA, 13 nt, Homo sapiens
cuggaauugauau

SEQ ID NO: 1374611 - RNA, 17 nt, Homo sapiens
cuggaauugauauugaa

SEQ ID NO: 1374612 - RNA, 23 nt, Homo sapiens
cuggaauugauauugaaugaugu

SEQ ID NO: 1374613 - RNA, 15 nt, Homo sapiens
cuggaccacugggca

SEQ ID NO: 1374614 - RNA, 20 nt, Homo sapiens
cuggaccugagcuauucuca

SEQ ID NO: 1374615 - RNA, 13 nt, Homo sapiens
cuggacucaggau

SEQ ID NO: 1374616 - RNA, 17 nt, Homo sapiens
cuggacucauugcuuca

SEQ ID NO: 1374617 - RNA, 17 nt, Homo sapiens
cuggagacucguggacu

SEQ ID NO: 1374618 - RNA, 17 nt, Homo sapiens
cuggagccuccacugcc

SEQ ID NO: 1374619 - RNA, 19 nt, Homo sapiens
cuggagccuccacugccuc

SEQ ID NO: 1374620 - RNA, 20 nt, Homo sapiens
cuggagccuccacugccucu

SEQ ID NO: 1374621 - RNA, 17 nt, Homo sapiens
cuggaggaguuccuuga

SEQ ID NO: 1374622 - RNA, 21 nt, Homo sapiens
cuggaggcagaaucccggcug

SEQ ID NO: 1374623 - RNA, 22 nt, Homo sapiens
cuggaguacuuugaagauguca

SEQ ID NO: 1374624 - RNA, 20 nt, Homo sapiens
cuggaguggaguggcgugau

SEQ ID NO: 1374625 - RNA, 12 nt, Homo sapiens
cuggaugaaguu

SEQ ID NO: 1374626 - RNA, 14 nt, Homo sapiens
cuggaugucuccau

SEQ ID NO: 1374627 - RNA, 21 nt, Homo sapiens
cuggcaaugaaaaauucucag

SEQ ID NO: 1374628 - RNA, 17 nt, Homo sapiens
cuggcacuauaauguaa

SEQ ID NO: 1374629 - RNA, 21 nt, Homo sapiens
cuggcagaaagcaaaugugac

SEQ ID NO: 1374630 - RNA, 20 nt, Homo sapiens
cuggcagcaucuucacuucu

SEQ ID NO: 1374631 - RNA, 19 nt, Homo sapiens
cuggcagccgugccuucag

SEQ ID NO: 1374632 - RNA, 19 nt, Homo sapiens
cuggcaguggaacuaagaa

SEQ ID NO: 1374633 - RNA, 17 nt, Homo sapiens
cuggcauggcaccuguc

SEQ ID NO: 1374634 - RNA, 17 nt, Homo sapiens
cuggccagcugacuccc

SEQ ID NO: 1374635 - RNA, 20 nt, Homo sapiens
cuggcgugcaguggugcgau

SEQ ID NO: 1374636 - RNA, 19 nt, Homo sapiens
cuggcuacuccauguuggc

SEQ ID NO: 1374637 - RNA, 22 nt, Homo sapiens
cuggcuagaguccucacuccca

SEQ ID NO: 1374638 - RNA, 14 nt, Homo sapiens
cuggcucagccuca

SEQ ID NO: 1374639 - RNA, 21 nt, Homo sapiens
cuggcucccagggccaugaac

SEQ ID NO: 1374640 - RNA, 14 nt, Homo sapiens
cugggaacucccaa

SEQ ID NO: 1374641 - RNA, 21 nt, Homo sapiens
cugggaacucccaagaacagc

SEQ ID NO: 1374642 - RNA, 18 nt, Homo sapiens
cugggacacuuaacagau

SEQ ID NO: 1374643 - RNA, 21 nt, Homo sapiens
cugggauauuuccauauggca

SEQ ID NO: 1374644 - RNA, 20 nt, Homo sapiens
cugggauccgggaucaaagu

SEQ ID NO: 1374645 - RNA, 21 nt, Homo sapiens
cugggauccuaagggcucacc

SEQ ID NO: 1374646 - RNA, 20 nt, Homo sapiens
cugggauuacaggugugaac

SEQ ID NO: 1374647 - RNA, 15 nt, Homo sapiens
cugggcaauauagca

SEQ ID NO: 1374648 - RNA, 18 nt, Homo sapiens
cugggcagcauacugaga

SEQ ID NO: 1374649 - RNA, 13 nt, Homo sapiens
cugggccaagcca

SEQ ID NO: 1374650 - RNA, 19 nt, Homo sapiens
cugggccaagucaaagaca

SEQ ID NO: 1374651 - RNA, 16 nt, Homo sapiens
cugggcccaagacaga

SEQ ID NO: 1374652 - RNA, 23 nt, Homo sapiens
cugggcccagggcccuagguuug

SEQ ID NO: 1374653 - RNA, 16 nt, Homo sapiens
cugggccccaccaccu

SEQ ID NO: 1374654 - RNA, 15 nt, Homo sapiens
cugggccuucucacc

SEQ ID NO: 1374655 - RNA, 18 nt, Homo sapiens
cugggcucccuugugcgu

SEQ ID NO: 1374656 - RNA, 13 nt, Homo sapiens
cugggcugaggca

SEQ ID NO: 1374657 - RNA, 19 nt, Homo sapiens
cugggcugcagagacugga

SEQ ID NO: 1374658 - RNA, 14 nt, Homo sapiens
cuggggcaauggga

SEQ ID NO: 1374659 - RNA, 16 nt, Homo sapiens
cuggggcucucagugu

SEQ ID NO: 1374660 - RNA, 20 nt, Homo sapiens
cuggggcugaucucagggaa

SEQ ID NO: 1374661 - RNA, 20 nt, Homo sapiens
cuggguccaccccaugucac

SEQ ID NO: 1374662 - RNA, 22 nt, Homo sapiens
cugggucuuucugacaucagca

SEQ ID NO: 1374663 - RNA, 17 nt, Homo sapiens
cuggguuucucuguaua

SEQ ID NO: 1374664 - RNA, 20 nt, Homo sapiens
cugguaauuuaagauuccag

SEQ ID NO: 1374665 - RNA, 15 nt, Homo sapiens
cugguauauacauau

SEQ ID NO: 1374666 - RNA, 16 nt, Homo sapiens
cugguauguguggaug

SEQ ID NO: 1374667 - RNA, 19 nt, Homo sapiens
cuggucaacuugagcaugu

SEQ ID NO: 1374668 - RNA, 15 nt, Homo sapiens
cuggucaaguuguaa

SEQ ID NO: 1374669 - RNA, 12 nt, Homo sapiens
cugguccaugau

SEQ ID NO: 1374670 - RNA, 16 nt, Homo sapiens
cuggucccacucaguc

SEQ ID NO: 1374671 - RNA, 23 nt, Homo sapiens
cuggucucaaacuccugggcuca

SEQ ID NO: 1374672 - RNA, 13 nt, Homo sapiens
cuggucuugugga

SEQ ID NO: 1374673 - RNA, 14 nt, Homo sapiens
cuucagguggaaaa

SEQ ID NO: 1374674 - RNA, 17 nt, Homo sapiens
cuucagucuuuuccaug

SEQ ID NO: 1374675 - RNA, 15 nt, Homo sapiens
cuucaugcaaugaca

SEQ ID NO: 1374676 - RNA, 15 nt, Homo sapiens
cuucauggacuucca

SEQ ID NO: 1374677 - RNA, 24 nt, Homo sapiens
cuucauuugaugcuaaauaggaga

SEQ ID NO: 1374678 - RNA, 20 nt, Homo sapiens
cuuccaaacauuaaugcaau

SEQ ID NO: 1374679 - RNA, 16 nt, Homo sapiens
cuuccaacguggccca

SEQ ID NO: 1374680 - RNA, 20 nt, Homo sapiens
cuuccaacguggcccagaga

SEQ ID NO: 1374681 - RNA, 21 nt, Homo sapiens
cuuccaacucaaacucuuaaa

SEQ ID NO: 1374682 - RNA, 17 nt, Homo sapiens
cuuccacaccuagcauc

SEQ ID NO: 1374683 - RNA, 15 nt, Homo sapiens
cuuccacuccaagug

SEQ ID NO: 1374684 - RNA, 21 nt, Homo sapiens
cuuccauaauuaugacaguua

SEQ ID NO: 1374685 - RNA, 22 nt, Homo sapiens
cuuccauaauuaugacaguuau

SEQ ID NO: 1374686 - RNA, 21 nt, Homo sapiens
cuuccauuugugugugugcaa

SEQ ID NO: 1374687 - RNA, 20 nt, Homo sapiens
cuucccaggaguacacccca

SEQ ID NO: 1374688 - RNA, 14 nt, Homo sapiens
cuucccuaaugaag

SEQ ID NO: 1374689 - RNA, 19 nt, Homo sapiens
cuucccucaaagcuuccau

SEQ ID NO: 1374690 - RNA, 16 nt, Homo sapiens
cuucccucacaccgcg

SEQ ID NO: 1374691 - RNA, 13 nt, Homo sapiens
cuucccugaucaa

SEQ ID NO: 1374692 - RNA, 21 nt, Homo sapiens
cuucccuggcuuguaacucca

SEQ ID NO: 1374693 - RNA, 16 nt, Homo sapiens
cuucccuguccuguag

SEQ ID NO: 1374694 - RNA, 16 nt, Homo sapiens
cuuccuccccauguga

SEQ ID NO: 1374695 - RNA, 18 nt, Homo sapiens
cuuccuggaguacaaaca

SEQ ID NO: 1374696 - RNA, 19 nt, Homo sapiens
cuuccuggaguacaaacac

SEQ ID NO: 1374697 - RNA, 17 nt, Homo sapiens
cuuccuggcuucuuacu

SEQ ID NO: 1374698 - RNA, 23 nt, Homo sapiens
cuuccuuaccgugggcacugaag

SEQ ID NO: 1374699 - RNA, 17 nt, Homo sapiens
cuuccuucuagggagca

SEQ ID NO: 1374700 - RNA, 18 nt, Homo sapiens
cuucuaaaugaagugcaa

SEQ ID NO: 1374701 - RNA, 17 nt, Homo sapiens
cuucuaaucaaagcuuu

SEQ ID NO: 1374702 - RNA, 16 nt, Homo sapiens
cuucuccaaaugagau

SEQ ID NO: 1374703 - RNA, 17 nt, Homo sapiens
cuucuccaaaugagauc

SEQ ID NO: 1374704 - RNA, 14 nt, Homo sapiens
cuucuccacuggau

SEQ ID NO: 1374705 - RNA, 13 nt, Homo sapiens
cuucucugcucca

SEQ ID NO: 1374706 - RNA, 22 nt, Homo sapiens
cuucucuuuaacucaggacucc

SEQ ID NO: 1374707 - RNA, 13 nt, Homo sapiens
cuucugaccucua

SEQ ID NO: 1374708 - RNA, 19 nt, Homo sapiens
cuucugaggcgcugcuuug

SEQ ID NO: 1374709 - RNA, 17 nt, Homo sapiens
cuucuguaguacuccuu

SEQ ID NO: 1374710 - RNA, 18 nt, Homo sapiens
cuucugucaucuaccuuu

SEQ ID NO: 1374711 - RNA, 19 nt, Homo sapiens
cuucugugcccagcucagu

SEQ ID NO: 1374712 - RNA, 14 nt, Homo sapiens
cuucugugccucag

SEQ ID NO: 1374713 - RNA, 18 nt, Homo sapiens
cuucuucuuagcaccaca

SEQ ID NO: 1374714 - RNA, 14 nt, Homo sapiens
cuucuugugaucuu

SEQ ID NO: 1374715 - RNA, 13 nt, Homo sapiens
cuucuuguucccc

SEQ ID NO: 1374716 - RNA, 20 nt, Homo sapiens
cuucuuuauacaaugaccac

SEQ ID NO: 1374717 - RNA, 20 nt, Homo sapiens
cuucuuuuaguuguaucucu

SEQ ID NO: 1374718 - RNA, 21 nt, Homo sapiens
cuucuuuugaacaaaugacau

SEQ ID NO: 1374719 - RNA, 18 nt, Homo sapiens
cuugaaacaagcaacaga

SEQ ID NO: 1374720 - RNA, 19 nt, Homo sapiens
cuugaaagaaaauaugcau

SEQ ID NO: 1374721 - RNA, 22 nt, Homo sapiens
cuugaaagaaaauaugcaucua

SEQ ID NO: 1374722 - RNA, 21 nt, Homo sapiens
cuugaacacaguauuuuccca

SEQ ID NO: 1374723 - RNA, 14 nt, Homo sapiens
cuugaacacagucu

SEQ ID NO: 1374724 - RNA, 17 nt, Homo sapiens
cuugaaccacaguucua

SEQ ID NO: 1374725 - RNA, 19 nt, Homo sapiens
cuugaacccaggaggcaga

SEQ ID NO: 1374726 - RNA, 16 nt, Homo sapiens
cuugaagacacugaaa

SEQ ID NO: 1374727 - RNA, 15 nt, Homo sapiens
cuugaaugugucacu

SEQ ID NO: 1374728 - RNA, 20 nt, Homo sapiens
cuugaguuuagugaucugaa

SEQ ID NO: 1374729 - RNA, 18 nt, Homo sapiens
cuugauaaagggccaaua

SEQ ID NO: 1374730 - RNA, 17 nt, Homo sapiens
cuugauccacagaaaua

SEQ ID NO: 1374731 - RNA, 13 nt, Homo sapiens
cuugaucuguaua

SEQ ID NO: 1374732 - RNA, 12 nt, Homo sapiens
cuugaugguuua

SEQ ID NO: 1374733 - RNA, 15 nt, Homo sapiens
cuugcaaaacuacaa

SEQ ID NO: 1374734 - RNA, 13 nt, Homo sapiens
cuugcacaaacca

SEQ ID NO: 1374735 - RNA, 17 nt, Homo sapiens
cuugcacgcccaugugu

SEQ ID NO: 1374736 - RNA, 17 nt, Homo sapiens
cuugcaguuaaggguua

SEQ ID NO: 1374737 - RNA, 18 nt, Homo sapiens
cuugcaguuaaggguuag

SEQ ID NO: 1374738 - RNA, 14 nt, Homo sapiens
cuugccacugcacu

SEQ ID NO: 1374739 - RNA, 22 nt, Homo sapiens
cuugccaucuauaggggccaaa

SEQ ID NO: 1374740 - RNA, 18 nt, Homo sapiens
cuugccccuguuaccuaa

SEQ ID NO: 1374741 - RNA, 15 nt, Homo sapiens
cuugccgaaacugga

SEQ ID NO: 1374742 - RNA, 17 nt, Homo sapiens
cuugccgaaacuggaag

SEQ ID NO: 1374743 - RNA, 23 nt, Homo sapiens
cuugccgaaacuggaaguuauuu

SEQ ID NO: 1374744 - RNA, 14 nt, Homo sapiens
cuugccugcaggca

SEQ ID NO: 1374745 - RNA, 23 nt, Homo sapiens
cuugccugugacauuuugccacu

SEQ ID NO: 1374746 - RNA, 18 nt, Homo sapiens
cuugcugccaaaagccuu

SEQ ID NO: 1374747 - RNA, 12 nt, Homo sapiens
cuugcugugagc

SEQ ID NO: 1374748 - RNA, 16 nt, Homo sapiens
cuugcuuauucacuga

SEQ ID NO: 1374749 - RNA, 23 nt, Homo sapiens
cuuggaaagcaucaccucaggcc

SEQ ID NO: 1374750 - RNA, 23 nt, Homo sapiens
cuuggaagagaaugucugaucua

SEQ ID NO: 1374751 - RNA, 23 nt, Homo sapiens
cuuggaauccuggggaacauaga

SEQ ID NO: 1374752 - RNA, 23 nt, Homo sapiens
cuuggacugaagggguucucaca

SEQ ID NO: 1374753 - RNA, 21 nt, Homo sapiens
cuuggaggccagccagugacc

SEQ ID NO: 1374754 - RNA, 23 nt, Homo sapiens
cuuggaggcugucuucucaggcu

SEQ ID NO: 1374755 - RNA, 20 nt, Homo sapiens
cuuggccagaagggggccau

SEQ ID NO: 1374756 - RNA, 21 nt, Homo sapiens
cuuggccagaagggggccaug

SEQ ID NO: 1374757 - RNA, 15 nt, Homo sapiens
cuuggcucacugcaa

SEQ ID NO: 1374758 - RNA, 15 nt, Homo sapiens
cuuggcugugcccuc

SEQ ID NO: 1374759 - RNA, 15 nt, Homo sapiens
cuugggauugucuua

SEQ ID NO: 1374760 - RNA, 18 nt, Homo sapiens
cuugguucaguaccacau

SEQ ID NO: 1374761 - RNA, 23 nt, Homo sapiens
cuuguaacaagaaaacauaagag

SEQ ID NO: 1374762 - RNA, 16 nt, Homo sapiens
cuuguauagcaguuuc

SEQ ID NO: 1374763 - RNA, 17 nt, Homo sapiens
cuugucaugugacaggu

SEQ ID NO: 1374764 - RNA, 19 nt, Homo sapiens
cuugugacuagugcugaag

SEQ ID NO: 1374765 - RNA, 16 nt, Homo sapiens
cuuguguccacuguga

SEQ ID NO: 1374766 - RNA, 18 nt, Homo sapiens
cuugugugugggcuguga

SEQ ID NO: 1374767 - RNA, 19 nt, Homo sapiens
cuugugugugggcugugag

SEQ ID NO: 1374768 - RNA, 21 nt, Homo sapiens
cuugugugugggcugugagug

SEQ ID NO: 1374769 - RNA, 23 nt, Homo sapiens
cuuguuagaaaugcaaauucuca

SEQ ID NO: 1374770 - RNA, 16 nt, Homo sapiens
cuuguuaugcaucauu

SEQ ID NO: 1374771 - RNA, 23 nt, Homo sapiens
cuuguuccccacugacagccucc

SEQ ID NO: 1374772 - RNA, 22 nt, Homo sapiens
cuuguugacacggccaugacca

SEQ ID NO: 1374773 - RNA, 20 nt, Homo sapiens
cuuguugagauccccguguu

SEQ ID NO: 1374774 - RNA, 12 nt, Homo sapiens
cuuguugcugca

SEQ ID NO: 1374775 - RNA, 16 nt, Homo sapiens
cuuguugcugcaucuc

SEQ ID NO: 1374776 - RNA, 23 nt, Homo sapiens
cuuguuucacacuagucacauuc

SEQ ID NO: 1374777 - RNA, 23 nt, Homo sapiens
cuuguuuuuccacuacugcuacc

SEQ ID NO: 1374778 - RNA, 20 nt, Homo sapiens
cuuuaaaaaaaauccuucua

SEQ ID NO: 1374779 - RNA, 15 nt, Homo sapiens
cuuuaaaauauuguu

SEQ ID NO: 1374780 - RNA, 19 nt, Homo sapiens
cuuuaaagucagguccaau

SEQ ID NO: 1374781 - RNA, 11 nt, Homo sapiens
cuuuaauuuca

SEQ ID NO: 1374782 - RNA, 22 nt, Homo sapiens
cuuuacaaaaagacacuugaua

SEQ ID NO: 1374783 - RNA, 13 nt, Homo sapiens
cuuuacaaagcug

SEQ ID NO: 1374784 - RNA, 18 nt, Homo sapiens
cuuuacuguuagucauuu

SEQ ID NO: 1374785 - RNA, 20 nt, Homo sapiens
gacaaccccagccaaucaca

SEQ ID NO: 1374786 - RNA, 16 nt, Homo sapiens
gacaaccgaugcucca

SEQ ID NO: 1374787 - RNA, 16 nt, Homo sapiens
gacaacgaugaugcuu

SEQ ID NO: 1374788 - RNA, 21 nt, Homo sapiens
gacaagugacuguaucugugu

SEQ ID NO: 1374789 - RNA, 20 nt, Homo sapiens
gacaaugaagaugaugcuau

SEQ ID NO: 1374790 - RNA, 20 nt, Homo sapiens
gacaauggcuuacuccagga

SEQ ID NO: 1374791 - RNA, 21 nt, Homo sapiens
gacaauuccuagauaaaaaga

SEQ ID NO: 1374792 - RNA, 20 nt, Homo sapiens
gacaauuugcugccaaacac

SEQ ID NO: 1374793 - RNA, 19 nt, Homo sapiens
gacacacacguuauaauca

SEQ ID NO: 1374794 - RNA, 12 nt, Homo sapiens
gacacacuuguc

SEQ ID NO: 1374795 - RNA, 21 nt, Homo sapiens
gacacagcucuucuccaggcu

SEQ ID NO: 1374796 - RNA, 15 nt, Homo sapiens
gacaccaccaaggcu

SEQ ID NO: 1374797 - RNA, 21 nt, Homo sapiens
gacacuauuuaucugugcaaa

SEQ ID NO: 1374798 - RNA, 15 nt, Homo sapiens
gacacuguuugccca

SEQ ID NO: 1374799 - RNA, 21 nt, Homo sapiens
gacagagccccacccucagau

SEQ ID NO: 1374800 - RNA, 22 nt, Homo sapiens
gacagagucucaaucuguuacc

SEQ ID NO: 1374801 - RNA, 19 nt, Homo sapiens
gacagagugagacucuguc

SEQ ID NO: 1374802 - RNA, 23 nt, Homo sapiens
gacagauuccaggcgaugugcaa

SEQ ID NO: 1374803 - RNA, 19 nt, Homo sapiens
gacagcaucuaagaaguuu

SEQ ID NO: 1374804 - RNA, 22 nt, Homo sapiens
gacagccacggccaggccagag

SEQ ID NO: 1374805 - RNA, 21 nt, Homo sapiens
gacagcucccucugccugaac

SEQ ID NO: 1374806 - RNA, 13 nt, Homo sapiens
gacagcuucucau

SEQ ID NO: 1374807 - RNA, 23 nt, Homo sapiens
gacaggcccaagagaugaagagu

SEQ ID NO: 1374808 - RNA, 22 nt, Homo sapiens
gacaguauauaacuaacaacca

SEQ ID NO: 1374809 - RNA, 21 nt, Homo sapiens
gacagugccugggaauguauu

SEQ ID NO: 1374810 - RNA, 22 nt, Homo sapiens
gacauauacuaagauguucacu

SEQ ID NO: 1374811 - RNA, 13 nt, Homo sapiens
gacauauaucuau

SEQ ID NO: 1374812 - RNA, 17 nt, Homo sapiens
gacauauaucuauuaca

SEQ ID NO: 1374813 - RNA, 17 nt, Homo sapiens
gacaucaagcacagaag

SEQ ID NO: 1374814 - RNA, 18 nt, Homo sapiens
gacaucagcaucaccuag

SEQ ID NO: 1374815 - RNA, 18 nt, Homo sapiens
gacaucgguucauauuaa

SEQ ID NO: 1374816 - RNA, 24 nt, Homo sapiens
gacaucgguucauauuaagacaua

SEQ ID NO: 1374817 - RNA, 24 nt, Homo sapiens
gacaugaucgcuuucuacacugua

SEQ ID NO: 1374818 - RNA, 23 nt, Homo sapiens
gacauguucccuucuccuuccaa

SEQ ID NO: 1374819 - RNA, 23 nt, Homo sapiens
gacauuaacaguuuuccaugaaa

SEQ ID NO: 1374820 - RNA, 11 nt, Homo sapiens
gacauuccaau

SEQ ID NO: 1374821 - RNA, 16 nt, Homo sapiens
gacauucucaucacca

SEQ ID NO: 1374822 - RNA, 23 nt, Homo sapiens
gacauucucaucaccacagggau

SEQ ID NO: 1374823 - RNA, 14 nt, Homo sapiens
gaccaauaccuccu

SEQ ID NO: 1374824 - RNA, 17 nt, Homo sapiens
gaccagaagcauuucac

SEQ ID NO: 1374825 - RNA, 15 nt, Homo sapiens
gaccagccuggccaa

SEQ ID NO: 1374826 - RNA, 14 nt, Homo sapiens
gaccagccugggca

SEQ ID NO: 1374827 - RNA, 15 nt, Homo sapiens
gaccauuagcauuug

SEQ ID NO: 1374828 - RNA, 23 nt, Homo sapiens
gacccacggagcccuuaugacau

SEQ ID NO: 1374829 - RNA, 15 nt, Homo sapiens
gaccccugaccucac

SEQ ID NO: 1374830 - RNA, 18 nt, Homo sapiens
gaccccuguucccaugcu

SEQ ID NO: 1374831 - RNA, 19 nt, Homo sapiens
gacccggagcuaacacugg

SEQ ID NO: 1374832 - RNA, 17 nt, Homo sapiens
gacccucguggccuucc

SEQ ID NO: 1374833 - RNA, 21 nt, Homo sapiens
gaccuccugagcgaugacuca

SEQ ID NO: 1374834 - RNA, 14 nt, Homo sapiens
gaccugagaaccuu

SEQ ID NO: 1374835 - RNA, 12 nt, Homo sapiens
gaccugagcucc

SEQ ID NO: 1374836 - RNA, 14 nt, Homo sapiens
gaccugcaggccaa

SEQ ID NO: 1374837 - RNA, 17 nt, Homo sapiens
gaccuucaacuuccaaa

SEQ ID NO: 1374838 - RNA, 15 nt, Homo sapiens
gacgguucaccagcc

SEQ ID NO: 1374839 - RNA, 20 nt, Homo sapiens
gacuaaccucuaacaacaaa

SEQ ID NO: 1374840 - RNA, 12 nt, Homo sapiens
gacuacaggugu

SEQ ID NO: 1374841 - RNA, 15 nt, Homo sapiens
gacuaggagcacugu

SEQ ID NO: 1374842 - RNA, 19 nt, Homo sapiens
gacuagggcuuauccaugc

SEQ ID NO: 1374843 - RNA, 20 nt, Homo sapiens
gacuauggcucuacuuucag

SEQ ID NO: 1374844 - RNA, 22 nt, Homo sapiens
gacuaugucacccaaugcauau

SEQ ID NO: 1374845 - RNA, 16 nt, Homo sapiens
gacucaagugucucag

SEQ ID NO: 1374846 - RNA, 15 nt, Homo sapiens
gacucaauaaaauca

SEQ ID NO: 1374847 - RNA, 17 nt, Homo sapiens
gacucaauaaaaucaug

SEQ ID NO: 1374848 - RNA, 17 nt, Homo sapiens
gacucaaugcacugaca

SEQ ID NO: 1374849 - RNA, 15 nt, Homo sapiens
gacucaucauuucca

SEQ ID NO: 1374850 - RNA, 15 nt, Homo sapiens
gacuccucaaaagca

SEQ ID NO: 1374851 - RNA, 22 nt, Homo sapiens
gacuccuuagagacaucaaaau

SEQ ID NO: 1374852 - RNA, 17 nt, Homo sapiens
gacucuuggcacagcau

SEQ ID NO: 1374853 - RNA, 13 nt, Homo sapiens
gacugacauuuag

SEQ ID NO: 1374854 - RNA, 12 nt, Homo sapiens
gacugagcucaa

SEQ ID NO: 1374855 - RNA, 13 nt, Homo sapiens
gacugauggugaa

SEQ ID NO: 1374856 - RNA, 21 nt, Homo sapiens
gacugcaccuucugugccuca

SEQ ID NO: 1374857 - RNA, 17 nt, Homo sapiens
gacugccaugcuagaca

SEQ ID NO: 1374858 - RNA, 19 nt, Homo sapiens
gacuggaccccgcccagca

SEQ ID NO: 1374859 - RNA, 18 nt, Homo sapiens
gacugguuguugccaaac

SEQ ID NO: 1374860 - RNA, 15 nt, Homo sapiens
gacuguauuuuccaa

SEQ ID NO: 1374861 - RNA, 19 nt, Homo sapiens
gacugucaguaggcuggaa

SEQ ID NO: 1374862 - RNA, 20 nt, Homo sapiens
gacugucaguaggcuggaag

SEQ ID NO: 1374863 - RNA, 14 nt, Homo sapiens
gacugucuuucaga

SEQ ID NO: 1374864 - RNA, 17 nt, Homo sapiens
gacuguggcacacgccu

SEQ ID NO: 1374865 - RNA, 20 nt, Homo sapiens
gacuguggcugcuagcacuu

SEQ ID NO: 1374866 - RNA, 22 nt, Homo sapiens
gacuuaaaauauuccugcauuu

SEQ ID NO: 1374867 - RNA, 16 nt, Homo sapiens
gacuugagcuuggcag

SEQ ID NO: 1374868 - RNA, 17 nt, Homo sapiens
gacuugauuagugccuu

SEQ ID NO: 1374869 - RNA, 20 nt, Homo sapiens
gacuuguuuuaugcucaggg

SEQ ID NO: 1374870 - RNA, 18 nt, Homo sapiens
gagaaacacuaaagcauu

SEQ ID NO: 1374871 - RNA, 23 nt, Homo sapiens
gagaaacagagacaggcccaaga

SEQ ID NO: 1374872 - RNA, 19 nt, Homo sapiens
gagaaacuguagucucagg

SEQ ID NO: 1374873 - RNA, 20 nt, Homo sapiens
gagaaaggggauguauccau

SEQ ID NO: 1374874 - RNA, 17 nt, Homo sapiens
gagaaaugccagugugc

SEQ ID NO: 1374875 - RNA, 12 nt, Homo sapiens
gagaacagugau

SEQ ID NO: 1374876 - RNA, 13 nt, Homo sapiens
gagaacuacucag

SEQ ID NO: 1374877 - RNA, 12 nt, Homo sapiens
gagaacugauga

SEQ ID NO: 1374878 - RNA, 19 nt, Homo sapiens
gagaacugcauauguuucg

SEQ ID NO: 1374879 - RNA, 23 nt, Homo sapiens
gagaagaauuuucagaccccagc

SEQ ID NO: 1374880 - RNA, 20 nt, Homo sapiens
gagaagcauauagaggcaag

SEQ ID NO: 1374881 - RNA, 13 nt, Homo sapiens
gagaagccaaaag

SEQ ID NO: 1374882 - RNA, 16 nt, Homo sapiens
gagaaggaaagugauu

SEQ ID NO: 1374883 - RNA, 18 nt, Homo sapiens
gagaagucaaacauuuca

SEQ ID NO: 1374884 - RNA, 20 nt, Homo sapiens
gagaagucuuagacuugaaa

SEQ ID NO: 1374885 - RNA, 17 nt, Homo sapiens
gagaaucacuugcacuc

SEQ ID NO: 1374886 - RNA, 13 nt, Homo sapiens
gagaaugccauuc

SEQ ID NO: 1374887 - RNA, 14 nt, Homo sapiens
gagacacaucuccu

SEQ ID NO: 1374888 - RNA, 22 nt, Homo sapiens
gagacacuauuuaucugugcaa

SEQ ID NO: 1374889 - RNA, 20 nt, Homo sapiens
gagacagacagagaaggcag

SEQ ID NO: 1374890 - RNA, 19 nt, Homo sapiens
gagacagauauacugggag

SEQ ID NO: 1374891 - RNA, 23 nt, Homo sapiens
gagacccccacaccucaguuccc

SEQ ID NO: 1374892 - RNA, 19 nt, Homo sapiens
gagacuccgucucaaaaaa

SEQ ID NO: 1374893 - RNA, 16 nt, Homo sapiens
gagacuccgucucaag

SEQ ID NO: 1374894 - RNA, 17 nt, Homo sapiens
gagacuccgucucaagg

SEQ ID NO: 1374895 - RNA, 13 nt, Homo sapiens
gagacucugucuc

SEQ ID NO: 1374896 - RNA, 15 nt, Homo sapiens
gagacugcugaguca

SEQ ID NO: 1374897 - RNA, 16 nt, Homo sapiens
gcaauauaaccaaugu

SEQ ID NO: 1374898 - RNA, 21 nt, Homo sapiens
gcaauauaucugaagagcuau

SEQ ID NO: 1374899 - RNA, 13 nt, Homo sapiens
gcaaucacauagu

SEQ ID NO: 1374900 - RNA, 12 nt, Homo sapiens
gcaaugucacaa

SEQ ID NO: 1374901 - RNA, 23 nt, Homo sapiens
gcaaugugcccccagacgcacgu

SEQ ID NO: 1374902 - RNA, 17 nt, Homo sapiens
gcaauugcucaugcaua

SEQ ID NO: 1374903 - RNA, 17 nt, Homo sapiens
gcaauuuugcauuugaa

SEQ ID NO: 1374904 - RNA, 19 nt, Homo sapiens
gcacaaaguguauucacgu

SEQ ID NO: 1374905 - RNA, 18 nt, Homo sapiens
gcacaaggcugaccaaga

SEQ ID NO: 1374906 - RNA, 23 nt, Homo sapiens
gcacacacaccacacauacacac

SEQ ID NO: 1374907 - RNA, 21 nt, Homo sapiens
gcacacuagccucuccaggaa

SEQ ID NO: 1374908 - RNA, 14 nt, Homo sapiens
gcacacugucugcc

SEQ ID NO: 1374909 - RNA, 15 nt, Homo sapiens
gcacaugugugcgug

SEQ ID NO: 1374910 - RNA, 21 nt, Homo sapiens
gcacauuuccccagaccugag

SEQ ID NO: 1374911 - RNA, 14 nt, Homo sapiens
gcaccacccuaguc

SEQ ID NO: 1374912 - RNA, 15 nt, Homo sapiens
gcaccauugcgcucu

SEQ ID NO: 1374913 - RNA, 13 nt, Homo sapiens
gcaccccaugcca

SEQ ID NO: 1374914 - RNA, 17 nt, Homo sapiens
gcaccccccaagcuguu

SEQ ID NO: 1374915 - RNA, 14 nt, Homo sapiens
gcacccucuccaga

SEQ ID NO: 1374916 - RNA, 17 nt, Homo sapiens
gcaccuguacucaggag

SEQ ID NO: 1374917 - RNA, 14 nt, Homo sapiens
gcacgcccaugugu

SEQ ID NO: 1374918 - RNA, 15 nt, Homo sapiens
gcacgcccaugugug

SEQ ID NO: 1374919 - RNA, 19 nt, Homo sapiens
gcacgggcccgugacaucc

SEQ ID NO: 1374920 - RNA, 18 nt, Homo sapiens
gcacgguggcucaggccu

SEQ ID NO: 1374921 - RNA, 22 nt, Homo sapiens
gcacguggcuucugaugaaucu

SEQ ID NO: 1374922 - RNA, 17 nt, Homo sapiens
gcacugaggaccagcca

SEQ ID NO: 1374923 - RNA, 16 nt, Homo sapiens
gcagaaaauugccuaa

SEQ ID NO: 1374924 - RNA, 20 nt, Homo sapiens
gcagaaaauuguacaaccug

SEQ ID NO: 1374925 - RNA, 13 nt, Homo sapiens
gcagaauaaucuu

SEQ ID NO: 1374926 - RNA, 22 nt, Homo sapiens
gcagaaucccggcugucaaggg

SEQ ID NO: 1374927 - RNA, 18 nt, Homo sapiens
gcagaauugagagugauu

SEQ ID NO: 1374928 - RNA, 23 nt, Homo sapiens
gcagaauugagagugauuccuuu

SEQ ID NO: 1374929 - RNA, 16 nt, Homo sapiens
gcagacuggugagcag

SEQ ID NO: 1374930 - RNA, 21 nt, Homo sapiens
gcagagaacuggaaagacaua

SEQ ID NO: 1374931 - RNA, 16 nt, Homo sapiens
gcagagaggcugaaua

SEQ ID NO: 1374932 - RNA, 23 nt, Homo sapiens
gcagaguacuggcugauggagua

SEQ ID NO: 1374933 - RNA, 17 nt, Homo sapiens
gcagaucugugccccau

SEQ ID NO: 1374934 - RNA, 18 nt, Homo sapiens
gcagccaaacccaugagg

SEQ ID NO: 1374935 - RNA, 19 nt, Homo sapiens
gcagccacaaccaaaaaau

SEQ ID NO: 1374936 - RNA, 21 nt, Homo sapiens
gcagccaccaggucaucuccu

SEQ ID NO: 1374937 - RNA, 14 nt, Homo sapiens
gcagcuaagccaca

SEQ ID NO: 1374938 - RNA, 18 nt, Homo sapiens
gcagcucaggcacacuuc

SEQ ID NO: 1374939 - RNA, 12 nt, Homo sapiens
gcaggaccucag

SEQ ID NO: 1374940 - RNA, 17 nt, Homo sapiens
gcaggagaaucgcuuga

SEQ ID NO: 1374941 - RNA, 13 nt, Homo sapiens
gcaggauucuucc

SEQ ID NO: 1374942 - RNA, 24 nt, Homo sapiens
gcaggauuucuucacaccucuccu

SEQ ID NO: 1374943 - RNA, 18 nt, Homo sapiens
gcagggauuagguguuca

SEQ ID NO: 1374944 - RNA, 13 nt, Homo sapiens
gcagggcaugacu

SEQ ID NO: 1374945 - RNA, 14 nt, Homo sapiens
gcagggcugacucu

SEQ ID NO: 1374946 - RNA, 23 nt, Homo sapiens
gcagucaucuugaccaagcagga

SEQ ID NO: 1374947 - RNA, 22 nt, Homo sapiens
gcagucauuaugagaggcaaug

SEQ ID NO: 1374948 - RNA, 19 nt, Homo sapiens
gcagucugcuucugcaccu

SEQ ID NO: 1374949 - RNA, 21 nt, Homo sapiens
gcagugagcuguguucuugcc

SEQ ID NO: 1374950 - RNA, 16 nt, Homo sapiens
gcaguggaacuaagaa

SEQ ID NO: 1374951 - RNA, 19 nt, Homo sapiens
gcaguucagcuccuuccac

SEQ ID NO: 1374952 - RNA, 12 nt, Homo sapiens
gcauaagcaaaa

SEQ ID NO: 1374953 - RNA, 16 nt, Homo sapiens
gcauaaguuucuggga

SEQ ID NO: 1374954 - RNA, 15 nt, Homo sapiens
gcauacagagacaga

SEQ ID NO: 1374955 - RNA, 20 nt, Homo sapiens
gcauaguucccauguuaaau

SEQ ID NO: 1374956 - RNA, 15 nt, Homo sapiens
gcauauauacauaua

SEQ ID NO: 1374957 - RNA, 15 nt, Homo sapiens
gcaucaaugcugagu

SEQ ID NO: 1374958 - RNA, 21 nt, Homo sapiens
gcaucaccuuaggcagggaag

SEQ ID NO: 1374959 - RNA, 22 nt, Homo sapiens
gcaucauuauuugcagagacag

SEQ ID NO: 1374960 - RNA, 14 nt, Homo sapiens
gcauccaacugaga

SEQ ID NO: 1374961 - RNA, 15 nt, Homo sapiens
gcaucucagugcagg

SEQ ID NO: 1374962 - RNA, 17 nt, Homo sapiens
gcaucuccccucagauu

SEQ ID NO: 1374963 - RNA, 12 nt, Homo sapiens
gcaucugacaca

SEQ ID NO: 1374964 - RNA, 20 nt, Homo sapiens
gcaucuuccccaacgaaaag

SEQ ID NO: 1374965 - RNA, 15 nt, Homo sapiens
gcaugaauagauucu

SEQ ID NO: 1374966 - RNA, 14 nt, Homo sapiens
gcaugaccugugac

SEQ ID NO: 1374967 - RNA, 23 nt, Homo sapiens
gcaugaccugugaccagcacugu

SEQ ID NO: 1374968 - RNA, 19 nt, Homo sapiens
gcaugcucaguuggugcug

SEQ ID NO: 1374969 - RNA, 22 nt, Homo sapiens
gcauggcguagagggugcugcc

SEQ ID NO: 1374970 - RNA, 18 nt, Homo sapiens
gcaugucucaauaguaaa

SEQ ID NO: 1374971 - RNA, 21 nt, Homo sapiens
gcaugugcugugaccauuuau

SEQ ID NO: 1374972 - RNA, 20 nt, Homo sapiens
gcauguuggcccagaccuca

SEQ ID NO: 1374973 - RNA, 21 nt, Homo sapiens
gcauuguugagguggucugaa

SEQ ID NO: 1374974 - RNA, 23 nt, Homo sapiens
gcauuuaaccgucaauaggcaaa

SEQ ID NO: 1374975 - RNA, 22 nt, Homo sapiens
gcauuuauggucaacacuuaag

SEQ ID NO: 1374976 - RNA, 19 nt, Homo sapiens
gcauuugucaacaaaguca

SEQ ID NO: 1374977 - RNA, 17 nt, Homo sapiens
gccaaacacccaugccc

SEQ ID NO: 1374978 - RNA, 20 nt, Homo sapiens
gccaaacccaugaggcaaug

SEQ ID NO: 1374979 - RNA, 22 nt, Homo sapiens
gccaaagaccaaauuccuuggc

SEQ ID NO: 1374980 - RNA, 23 nt, Homo sapiens
gccaaagagaaugccauucucuu

SEQ ID NO: 1374981 - RNA, 15 nt, Homo sapiens
gccaaccccaaagaa

SEQ ID NO: 1374982 - RNA, 18 nt, Homo sapiens
gccaagaaguugcucuga

SEQ ID NO: 1374983 - RNA, 16 nt, Homo sapiens
gccaagagaauauccg

SEQ ID NO: 1374984 - RNA, 22 nt, Homo sapiens
gccaagauugcgccauugcacu

SEQ ID NO: 1374985 - RNA, 21 nt, Homo sapiens
gccaaggagggcagaucacuu

SEQ ID NO: 1374986 - RNA, 18 nt, Homo sapiens
gccaauggagacugucuc

SEQ ID NO: 1374987 - RNA, 11 nt, Homo sapiens
gccacaaccaa

SEQ ID NO: 1374988 - RNA, 17 nt, Homo sapiens
gccacauggcugggauu

SEQ ID NO: 1374989 - RNA, 13 nt, Homo sapiens
gccaccccagaaa

SEQ ID NO: 1374990 - RNA, 15 nt, Homo sapiens
gccaccccuccuucc

SEQ ID NO: 1374991 - RNA, 19 nt, Homo sapiens
gccacccucccacugccaa

SEQ ID NO: 1374992 - RNA, 23 nt, Homo sapiens
gccaccugcaggucacugaaacu

SEQ ID NO: 1374993 - RNA, 14 nt, Homo sapiens
gccaccugcugcug

SEQ ID NO: 1374994 - RNA, 16 nt, Homo sapiens
gccaccugcugcugcu

SEQ ID NO: 1374995 - RNA, 14 nt, Homo sapiens
gccacgugggcaaa

SEQ ID NO: 1374996 - RNA, 23 nt, Homo sapiens
gccacugccacacgucugacccu

SEQ ID NO: 1374997 - RNA, 11 nt, Homo sapiens
gccaggagcuc

SEQ ID NO: 1374998 - RNA, 14 nt, Homo sapiens
gccaggcuccuucc

SEQ ID NO: 1374999 - RNA, 13 nt, Homo sapiens
gccaggugcugcu

SEQ ID NO: 1375000 - RNA, 11 nt, Homo sapiens
gccaguauuuu

SEQ ID NO: 1375001 - RNA, 14 nt, Homo sapiens
gccagugucuuucu

SEQ ID NO: 1375002 - RNA, 18 nt, Homo sapiens
gccagugucuuucuuugg

SEQ ID NO: 1375003 - RNA, 13 nt, Homo sapiens
gccauaugaauaa

SEQ ID NO: 1375004 - RNA, 20 nt, Homo sapiens
gccaucggugaaacuaacag

SEQ ID NO: 1375005 - RNA, 15 nt, Homo sapiens
gccauguggucauac

SEQ ID NO: 1375006 - RNA, 17 nt, Homo sapiens
gccauguuauuuauagu

SEQ ID NO: 1375007 - RNA, 13 nt, Homo sapiens
gcccaaacauaaa

SEQ ID NO: 1375008 - RNA, 16 nt, Homo sapiens
gcccaaauucuuucag

SEQ ID NO: 1375009 - RNA, 14 nt, Homo sapiens
gcccaagaauagau

SEQ ID NO: 1375010 - RNA, 16 nt, Homo sapiens
ggaagcugucccucac

SEQ ID NO: 1375011 - RNA, 22 nt, Homo sapiens
ggaaggagaggagaggggcaca

SEQ ID NO: 1375012 - RNA, 19 nt, Homo sapiens
ggaaggucuccccaugugc

SEQ ID NO: 1375013 - RNA, 13 nt, Homo sapiens
ggaaguauacuuu

SEQ ID NO: 1375014 - RNA, 16 nt, Homo sapiens
ggaaguuaaagggcau

SEQ ID NO: 1375015 - RNA, 22 nt, Homo sapiens
ggaauaaauugcuccuugacau

SEQ ID NO: 1375016 - RNA, 14 nt, Homo sapiens
ggaauaauccagaa

SEQ ID NO: 1375017 - RNA, 21 nt, Homo sapiens
ggaauccuggggaacauagaa

SEQ ID NO: 1375018 - RNA, 21 nt, Homo sapiens
ggaauggaaagcggaguuccu

SEQ ID NO: 1375019 - RNA, 15 nt, Homo sapiens
ggacaacauccuuaa

SEQ ID NO: 1375020 - RNA, 17 nt, Homo sapiens
ggacaaggcuagaucau

SEQ ID NO: 1375021 - RNA, 21 nt, Homo sapiens
ggacagaccuucaacuuccaa

SEQ ID NO: 1375022 - RNA, 13 nt, Homo sapiens
ggacagcauauaa

SEQ ID NO: 1375023 - RNA, 22 nt, Homo sapiens
ggacaucuaguaggugcuugac

SEQ ID NO: 1375024 - RNA, 18 nt, Homo sapiens
ggacauuccaauuugcac

SEQ ID NO: 1375025 - RNA, 18 nt, Homo sapiens
ggacauugcggacagcca

SEQ ID NO: 1375026 - RNA, 19 nt, Homo sapiens
ggacuaaguguaccagaga

SEQ ID NO: 1375027 - RNA, 20 nt, Homo sapiens
ggacuaaguguaccagagaa

SEQ ID NO: 1375028 - RNA, 13 nt, Homo sapiens
ggacuacaggcac

SEQ ID NO: 1375029 - RNA, 14 nt, Homo sapiens
ggacucaaacugcc

SEQ ID NO: 1375030 - RNA, 22 nt, Homo sapiens
ggacucaaugcacugacauugu

SEQ ID NO: 1375031 - RNA, 23 nt, Homo sapiens
ggacucaaugcacugacauuguu

SEQ ID NO: 1375032 - RNA, 15 nt, Homo sapiens
ggacuccagaucugc

SEQ ID NO: 1375033 - RNA, 11 nt, Homo sapiens
ggacugagaug

SEQ ID NO: 1375034 - RNA, 15 nt, Homo sapiens
ggacuuccauuugcu

SEQ ID NO: 1375035 - RNA, 15 nt, Homo sapiens
ggacuuggaagcucc

SEQ ID NO: 1375036 - RNA, 14 nt, Homo sapiens
ggagaacuagagaa

SEQ ID NO: 1375037 - RNA, 19 nt, Homo sapiens
ggagaauaauucuuugauu

SEQ ID NO: 1375038 - RNA, 16 nt, Homo sapiens
ggagaauugcuugaac

SEQ ID NO: 1375039 - RNA, 12 nt, Homo sapiens
ggagacacugau

SEQ ID NO: 1375040 - RNA, 15 nt, Homo sapiens
ggagaccuggcacug

SEQ ID NO: 1375041 - RNA, 21 nt, Homo sapiens
ggagacuagauuuaugaauac

SEQ ID NO: 1375042 - RNA, 21 nt, Homo sapiens
ggagacucaccucugccucaa

SEQ ID NO: 1375043 - RNA, 13 nt, Homo sapiens
ggagacugcugag

SEQ ID NO: 1375044 - RNA, 13 nt, Homo sapiens
ggagagaacugaa

SEQ ID NO: 1375045 - RNA, 14 nt, Homo sapiens
ggagagaacugaau

SEQ ID NO: 1375046 - RNA, 17 nt, Homo sapiens
ggagagcaacacaggau

SEQ ID NO: 1375047 - RNA, 20 nt, Homo sapiens
ggagagcuggggaagcuucu

SEQ ID NO: 1375048 - RNA, 14 nt, Homo sapiens
ggagaugggaugcu

SEQ ID NO: 1375049 - RNA, 16 nt, Homo sapiens
ggagccaccuguccca

SEQ ID NO: 1375050 - RNA, 15 nt, Homo sapiens
ggagcuaacacuggc

SEQ ID NO: 1375051 - RNA, 21 nt, Homo sapiens
ggagcuagcugaguaugcuga

SEQ ID NO: 1375052 - RNA, 13 nt, Homo sapiens
ggaggaagugaua

SEQ ID NO: 1375053 - RNA, 19 nt, Homo sapiens
ggaggaagugauaguuucu

SEQ ID NO: 1375054 - RNA, 15 nt, Homo sapiens
ggaggaccagagcua

SEQ ID NO: 1375055 - RNA, 12 nt, Homo sapiens
ggaggauguucu

SEQ ID NO: 1375056 - RNA, 13 nt, Homo sapiens
ggaggcugcagug

SEQ ID NO: 1375057 - RNA, 14 nt, Homo sapiens
ggaggcugcaguga

SEQ ID NO: 1375058 - RNA, 16 nt, Homo sapiens
ggaguaggacauacca

SEQ ID NO: 1375059 - RNA, 13 nt, Homo sapiens
ggaguagugucac

SEQ ID NO: 1375060 - RNA, 16 nt, Homo sapiens
ggagucccuuuggcaa

SEQ ID NO: 1375061 - RNA, 21 nt, Homo sapiens
ggagugcccccaacagcaccc

SEQ ID NO: 1375062 - RNA, 13 nt, Homo sapiens
ggaguuacuggau

SEQ ID NO: 1375063 - RNA, 15 nt, Homo sapiens
ggaguuagaggccag

SEQ ID NO: 1375064 - RNA, 16 nt, Homo sapiens
ggaguucagauguuuu

SEQ ID NO: 1375065 - RNA, 15 nt, Homo sapiens
ggaguucagcugcuu

SEQ ID NO: 1375066 - RNA, 19 nt, Homo sapiens
ggaguuuaaacugaaugaa

SEQ ID NO: 1375067 - RNA, 16 nt, Homo sapiens
ggauaacacauuugau

SEQ ID NO: 1375068 - RNA, 20 nt, Homo sapiens
ggauaaugcuguugccucau

SEQ ID NO: 1375069 - RNA, 20 nt, Homo sapiens
ggauaguccaaagacuuaac

SEQ ID NO: 1375070 - RNA, 14 nt, Homo sapiens
ggauagucugucca

SEQ ID NO: 1375071 - RNA, 17 nt, Homo sapiens
ggauaucaaaagcaaau

SEQ ID NO: 1375072 - RNA, 21 nt, Homo sapiens
ggauauuuccauauggcaaua

SEQ ID NO: 1375073 - RNA, 14 nt, Homo sapiens
ggaucugacugcac

SEQ ID NO: 1375074 - RNA, 12 nt, Homo sapiens
ggaugaauggaa

SEQ ID NO: 1375075 - RNA, 12 nt, Homo sapiens
ggaugaugccuc

SEQ ID NO: 1375076 - RNA, 20 nt, Homo sapiens
ggaugggggagggagggcaa

SEQ ID NO: 1375077 - RNA, 15 nt, Homo sapiens
ggauggucucugcca

SEQ ID NO: 1375078 - RNA, 22 nt, Homo sapiens
ggaugucuccaucucugucuca

SEQ ID NO: 1375079 - RNA, 21 nt, Homo sapiens
ggauguuuuuucccuguuuaa

SEQ ID NO: 1375080 - RNA, 16 nt, Homo sapiens
ggauuaccaguagaug

SEQ ID NO: 1375081 - RNA, 16 nt, Homo sapiens
ggauugcuaugaauga

SEQ ID NO: 1375082 - RNA, 17 nt, Homo sapiens
ggauugcuaugaaugau

SEQ ID NO: 1375083 - RNA, 18 nt, Homo sapiens
ggauuggccaaacaucag

SEQ ID NO: 1375084 - RNA, 15 nt, Homo sapiens
ggauuuggguuggaa

SEQ ID NO: 1375085 - RNA, 20 nt, Homo sapiens
ggcaaaaccacuagaacucu

SEQ ID NO: 1375086 - RNA, 17 nt, Homo sapiens
ggcaaaauaaagugaca

SEQ ID NO: 1375087 - RNA, 18 nt, Homo sapiens
ggcaacagagcaagaucc

SEQ ID NO: 1375088 - RNA, 17 nt, Homo sapiens
ggcaacaucuugcaaaa

SEQ ID NO: 1375089 - RNA, 17 nt, Homo sapiens
ggcaaccagaccauugu

SEQ ID NO: 1375090 - RNA, 20 nt, Homo sapiens
ggcaacugcugaugcucaug

SEQ ID NO: 1375091 - RNA, 18 nt, Homo sapiens
ggcaagagccacaguaua

SEQ ID NO: 1375092 - RNA, 16 nt, Homo sapiens
ggcaauaguguguucu

SEQ ID NO: 1375093 - RNA, 15 nt, Homo sapiens
ggcacaacaucaagc

SEQ ID NO: 1375094 - RNA, 21 nt, Homo sapiens
ggcacaauaugggcacuuuaa

SEQ ID NO: 1375095 - RNA, 20 nt, Homo sapiens
ggcacagcauggagucacag

SEQ ID NO: 1375096 - RNA, 21 nt, Homo sapiens
ggcaccuccuacgucaaacau

SEQ ID NO: 1375097 - RNA, 14 nt, Homo sapiens
ggcacgguggcuca

SEQ ID NO: 1375098 - RNA, 18 nt, Homo sapiens
ggcacucagaagacacug

SEQ ID NO: 1375099 - RNA, 19 nt, Homo sapiens
ggcacucagaagacacuga

SEQ ID NO: 1375100 - RNA, 22 nt, Homo sapiens
ggcagacacuguuugcccagug

SEQ ID NO: 1375101 - RNA, 20 nt, Homo sapiens
ggcagagaggacuguugaca

SEQ ID NO: 1375102 - RNA, 18 nt, Homo sapiens
ggcagcauagcaagacac

SEQ ID NO: 1375103 - RNA, 16 nt, Homo sapiens
ggcagccacaacugca

SEQ ID NO: 1375104 - RNA, 20 nt, Homo sapiens
ggcaggagaaucgcuugaac

SEQ ID NO: 1375105 - RNA, 23 nt, Homo sapiens
ggcagugaugcuggaugcuccuu

SEQ ID NO: 1375106 - RNA, 21 nt, Homo sapiens
ggcaucuccugugcaugggug

SEQ ID NO: 1375107 - RNA, 22 nt, Homo sapiens
ggcaucuuugccuugggcugcu

SEQ ID NO: 1375108 - RNA, 18 nt, Homo sapiens
ggcaugacuuugucccau

SEQ ID NO: 1375109 - RNA, 16 nt, Homo sapiens
ggcauggagccagugc

SEQ ID NO: 1375110 - RNA, 18 nt, Homo sapiens
ggccaagcaccuagccuc

SEQ ID NO: 1375111 - RNA, 20 nt, Homo sapiens
ggccaauaaauaugauguua

SEQ ID NO: 1375112 - RNA, 19 nt, Homo sapiens
ggccaaugggagagcucuu

SEQ ID NO: 1375113 - RNA, 15 nt, Homo sapiens
ggccacaccaucucc

SEQ ID NO: 1375114 - RNA, 19 nt, Homo sapiens
ggccagagggagugacaga

SEQ ID NO: 1375115 - RNA, 17 nt, Homo sapiens
ggccagaugcacauccc

SEQ ID NO: 1375116 - RNA, 17 nt, Homo sapiens
ggccaggcuggucucaa

SEQ ID NO: 1375117 - RNA, 23 nt, Homo sapiens
ggccaguauuuuuauuucuuuaa

SEQ ID NO: 1375118 - RNA, 11 nt, Homo sapiens
ggccaguguga

SEQ ID NO: 1375119 - RNA, 13 nt, Homo sapiens
ggccauggcaauu

SEQ ID NO: 1375120 - RNA, 19 nt, Homo sapiens
ggcccaccaaggacagcua

SEQ ID NO: 1375121 - RNA, 17 nt, Homo sapiens
ggcccacuucaccguac

SEQ ID NO: 1375122 - RNA, 11 nt, Homo sapiens
ggcccagaccu

SEQ ID NO: 1375123 - RNA, 13 nt, Homo sapiens
uccuugugguuuu

SEQ ID NO: 1375124 - RNA, 20 nt, Homo sapiens
uccuuuaaauccuuccauga

SEQ ID NO: 1375125 - RNA, 14 nt, Homo sapiens
uccuuucaccacau

SEQ ID NO: 1375126 - RNA, 23 nt, Homo sapiens
uccuuuguuuuuuuuuccugucc

SEQ ID NO: 1375127 - RNA, 15 nt, Homo sapiens
uccuuuuguguacag

SEQ ID NO: 1375128 - RNA, 17 nt, Homo sapiens
ucgaaauacaagccauu

SEQ ID NO: 1375129 - RNA, 17 nt, Homo sapiens
ucgaacauggaacucau

SEQ ID NO: 1375130 - RNA, 21 nt, Homo sapiens
ucgagccacaaccgaccagau

SEQ ID NO: 1375131 - RNA, 12 nt, Homo sapiens
ucgaguguuuca

SEQ ID NO: 1375132 - RNA, 17 nt, Homo sapiens
ucgaguuuuaaacuggu

SEQ ID NO: 1375133 - RNA, 18 nt, Homo sapiens
ucgaugagaaauugaacu

SEQ ID NO: 1375134 - RNA, 16 nt, Homo sapiens
ucgcaucucagugcag

SEQ ID NO: 1375135 - RNA, 19 nt, Homo sapiens
ucgccuuuugacagcugug

SEQ ID NO: 1375136 - RNA, 23 nt, Homo sapiens
ucgcuaccuuuugcuguggcaaa

SEQ ID NO: 1375137 - RNA, 18 nt, Homo sapiens
ucgcucccgggacucacu

SEQ ID NO: 1375138 - RNA, 18 nt, Homo sapiens
ucggagacagugaucucc

SEQ ID NO: 1375139 - RNA, 14 nt, Homo sapiens
ucggccgucuucac

SEQ ID NO: 1375140 - RNA, 16 nt, Homo sapiens
ucggcuggccagcuga

SEQ ID NO: 1375141 - RNA, 18 nt, Homo sapiens
ucgggcgagucacugccu

SEQ ID NO: 1375142 - RNA, 22 nt, Homo sapiens
ucggggaacuccuggaaauauc

SEQ ID NO: 1375143 - RNA, 14 nt, Homo sapiens
ucguagccaucucu

SEQ ID NO: 1375144 - RNA, 17 nt, Homo sapiens
ucguauaagcauggaga

SEQ ID NO: 1375145 - RNA, 15 nt, Homo sapiens
ucgucuaaacuuuag

SEQ ID NO: 1375146 - RNA, 13 nt, Homo sapiens
ucgugacaacaug

SEQ ID NO: 1375147 - RNA, 16 nt, Homo sapiens
ucuaaaaauccauaaa

SEQ ID NO: 1375148 - RNA, 12 nt, Homo sapiens
ucuaaaacugcc

SEQ ID NO: 1375149 - RNA, 17 nt, Homo sapiens
ucuaaaccauaugaaca

SEQ ID NO: 1375150 - RNA, 19 nt, Homo sapiens
ucuaaacuuuagaauuaau

SEQ ID NO: 1375151 - RNA, 18 nt, Homo sapiens
ucuaacucagaaacauca

SEQ ID NO: 1375152 - RNA, 20 nt, Homo sapiens
ucuaagccuucugguuuuau

SEQ ID NO: 1375153 - RNA, 17 nt, Homo sapiens
ucuaagccuuuccauaa

SEQ ID NO: 1375154 - RNA, 19 nt, Homo sapiens
ucuaaggaauaugagcuuu

SEQ ID NO: 1375155 - RNA, 19 nt, Homo sapiens
ucuaagguaguaacuuucc

SEQ ID NO: 1375156 - RNA, 17 nt, Homo sapiens
ucuaauagcgaggcucu

SEQ ID NO: 1375157 - RNA, 22 nt, Homo sapiens
ucuaaucuuuuaauguauuugu

SEQ ID NO: 1375158 - RNA, 14 nt, Homo sapiens
ucuaauuucugaaa

SEQ ID NO: 1375159 - RNA, 22 nt, Homo sapiens
ucuaccaacuggaagcacagaa

SEQ ID NO: 1375160 - RNA, 15 nt, Homo sapiens
ucuacccuauacaac

SEQ ID NO: 1375161 - RNA, 22 nt, Homo sapiens
ucuaccugaccaacaguuccuu

SEQ ID NO: 1375162 - RNA, 14 nt, Homo sapiens
ucuacgccagggga

SEQ ID NO: 1375163 - RNA, 15 nt, Homo sapiens
ucuacuaaaaauaca

SEQ ID NO: 1375164 - RNA, 10 nt, Homo sapiens
ucuacugcuu

SEQ ID NO: 1375165 - RNA, 13 nt, Homo sapiens
ucuagaacuugac

SEQ ID NO: 1375166 - RNA, 16 nt, Homo sapiens
ucuagacaaaaaccau

SEQ ID NO: 1375167 - RNA, 22 nt, Homo sapiens
ucuagacacugccacacagggu

SEQ ID NO: 1375168 - RNA, 15 nt, Homo sapiens
ucuaggaacauacuu

SEQ ID NO: 1375169 - RNA, 16 nt, Homo sapiens
ucuagggaaaaaccag

SEQ ID NO: 1375170 - RNA, 14 nt, Homo sapiens
ucuauaacuccuug

SEQ ID NO: 1375171 - RNA, 16 nt, Homo sapiens
ucuauaggaacauaug

SEQ ID NO: 1375172 - RNA, 13 nt, Homo sapiens
ucuaucuuauaua

SEQ ID NO: 1375173 - RNA, 18 nt, Homo sapiens
ucuauggcacccaugcac

SEQ ID NO: 1375174 - RNA, 20 nt, Homo sapiens
ucuauggcacccaugcaccu

SEQ ID NO: 1375175 - RNA, 23 nt, Homo sapiens
ucuaugggacucaaugcacugac

SEQ ID NO: 1375176 - RNA, 14 nt, Homo sapiens
ucuauguggcugua

SEQ ID NO: 1375177 - RNA, 22 nt, Homo sapiens
ucuauugcuggcaaagacagaa

SEQ ID NO: 1375178 - RNA, 14 nt, Homo sapiens
ucucaaaugcacau

SEQ ID NO: 1375179 - RNA, 14 nt, Homo sapiens
ucucaacaaaugga

SEQ ID NO: 1375180 - RNA, 15 nt, Homo sapiens
ucucacacauuccag

SEQ ID NO: 1375181 - RNA, 16 nt, Homo sapiens
ucucacuguugcccag

SEQ ID NO: 1375182 - RNA, 18 nt, Homo sapiens
ucucacuugugcaguguu

SEQ ID NO: 1375183 - RNA, 20 nt, Homo sapiens
ucucacuuuucuccaugagu

SEQ ID NO: 1375184 - RNA, 20 nt, Homo sapiens
ucucagaccugcgcacucca

SEQ ID NO: 1375185 - RNA, 12 nt, Homo sapiens
ucucagcacuug

SEQ ID NO: 1375186 - RNA, 21 nt, Homo sapiens
ucucagggaagcccagcucca

SEQ ID NO: 1375187 - RNA, 20 nt, Homo sapiens
ucucagucaguaauugccaa

SEQ ID NO: 1375188 - RNA, 13 nt, Homo sapiens
ucucagugcugua

SEQ ID NO: 1375189 - RNA, 22 nt, Homo sapiens
ucucauaugauugugcacauac

SEQ ID NO: 1375190 - RNA, 14 nt, Homo sapiens
ucucaucacuuuuc

SEQ ID NO: 1375191 - RNA, 12 nt, Homo sapiens
ucucauccugca

SEQ ID NO: 1375192 - RNA, 15 nt, Homo sapiens
ucuccaaauacugau

SEQ ID NO: 1375193 - RNA, 17 nt, Homo sapiens
ucuccagacccaccaca

SEQ ID NO: 1375194 - RNA, 16 nt, Homo sapiens
ucuccagugcaccugu

SEQ ID NO: 1375195 - RNA, 22 nt, Homo sapiens
ucuccaucagaggacaccugua

SEQ ID NO: 1375196 - RNA, 22 nt, Homo sapiens
ucuccauguuugauguaucuga

SEQ ID NO: 1375197 - RNA, 21 nt, Homo sapiens
ucucccaggccaggcuccuuc

SEQ ID NO: 1375198 - RNA, 16 nt, Homo sapiens
ucuccuguccaaccua

SEQ ID NO: 1375199 - RNA, 13 nt, Homo sapiens
ucuccuugcccua

SEQ ID NO: 1375200 - RNA, 13 nt, Homo sapiens
ucuccuuuggcca

SEQ ID NO: 1375201 - RNA, 17 nt, Homo sapiens
ucucgauggacaaugaa

SEQ ID NO: 1375202 - RNA, 12 nt, Homo sapiens
ucucgcuuuguu

SEQ ID NO: 1375203 - RNA, 13 nt, Homo sapiens
ucucuaaaacugc

SEQ ID NO: 1375204 - RNA, 16 nt, Homo sapiens
ucucuaacucagaaac

SEQ ID NO: 1375205 - RNA, 15 nt, Homo sapiens
ucucuacgcaaaaaa

SEQ ID NO: 1375206 - RNA, 18 nt, Homo sapiens
ucucuacugaaaguacaa

SEQ ID NO: 1375207 - RNA, 18 nt, Homo sapiens
ucucucagugaacuguga

SEQ ID NO: 1375208 - RNA, 12 nt, Homo sapiens
ucucuccacuga

SEQ ID NO: 1375209 - RNA, 15 nt, Homo sapiens
ucucuccagucuucc

SEQ ID NO: 1375210 - RNA, 20 nt, Homo sapiens
ucucuccucagacugcucaa

SEQ ID NO: 1375211 - RNA, 11 nt, Homo sapiens
ucucucuccag

SEQ ID NO: 1375212 - RNA, 16 nt, Homo sapiens
ucucucucucuacaaa

SEQ ID NO: 1375213 - RNA, 15 nt, Homo sapiens
ucucugagcuccagu

SEQ ID NO: 1375214 - RNA, 13 nt, Homo sapiens
ucucugccaugaa

SEQ ID NO: 1375215 - RNA, 13 nt, Homo sapiens
ucucugccuguga

SEQ ID NO: 1375216 - RNA, 18 nt, Homo sapiens
ucucugcuccaccacauc

SEQ ID NO: 1375217 - RNA, 13 nt, Homo sapiens
ucucugcuugcau

SEQ ID NO: 1375218 - RNA, 21 nt, Homo sapiens
ucucugcuuuggaaaucacac

SEQ ID NO: 1375219 - RNA, 15 nt, Homo sapiens
ucucugucucaaauu

SEQ ID NO: 1375220 - RNA, 12 nt, Homo sapiens
ucucugugaauu

SEQ ID NO: 1375221 - RNA, 17 nt, Homo sapiens
ucucugugggccccacc

SEQ ID NO: 1375222 - RNA, 18 nt, Homo sapiens
ucucuucagaaaacccuu

SEQ ID NO: 1375223 - RNA, 16 nt, Homo sapiens
ucucuuuaacucagga

SEQ ID NO: 1375224 - RNA, 23 nt, Homo sapiens
ucucuuuaacucaggacuccagc

SEQ ID NO: 1375225 - RNA, 12 nt, Homo sapiens
ucugaaaaccaa

SEQ ID NO: 1375226 - RNA, 18 nt, Homo sapiens
ucugaaaauuaacacugc

SEQ ID NO: 1375227 - RNA, 16 nt, Homo sapiens
ucugaaaugaccucaa

SEQ ID NO: 1375228 - RNA, 19 nt, Homo sapiens
ucugaagauacaugucuuu

SEQ ID NO: 1375229 - RNA, 19 nt, Homo sapiens
ucugaaggucccaccucca

SEQ ID NO: 1375230 - RNA, 23 nt, Homo sapiens
ucugaagucacaucacaggacac

SEQ ID NO: 1375231 - RNA, 13 nt, Homo sapiens
ucugaauugacug

SEQ ID NO: 1375232 - RNA, 13 nt, Homo sapiens
ucugacacacagc

SEQ ID NO: 1375233 - RNA, 14 nt, Homo sapiens
ucugacacacagcu

SEQ ID NO: 1375234 - RNA, 15 nt, Homo sapiens
ucugacucccaaaga

SEQ ID NO: 1375235 - RNA, 22 nt, Homo sapiens
ucugacucccaaagagcugccu

SEQ ID NO: 1375236 - RNA, 20 nt, Homo sapiens
ucugacucuuggcacagcau

SEQ ID NO: 1375237 - RNA, 19 nt, Homo sapiens
ugcauauguaaggaaguca

SEQ ID NO: 1375238 - RNA, 15 nt, Homo sapiens
ugcauauucuuaugu

SEQ ID NO: 1375239 - RNA, 16 nt, Homo sapiens
ugcaucuccccucaga

SEQ ID NO: 1375240 - RNA, 21 nt, Homo sapiens
ugcaucuccccucagauucca

SEQ ID NO: 1375241 - RNA, 17 nt, Homo sapiens
ugcaucugcuacugugu

SEQ ID NO: 1375242 - RNA, 16 nt, Homo sapiens
ugcaugugugugcuca

SEQ ID NO: 1375243 - RNA, 17 nt, Homo sapiens
ugcaugugugugcucag

SEQ ID NO: 1375244 - RNA, 16 nt, Homo sapiens
ugcauuuuugugaaau

SEQ ID NO: 1375245 - RNA, 18 nt, Homo sapiens
ugccaaagggaaauauca

SEQ ID NO: 1375246 - RNA, 22 nt, Homo sapiens
ugccaaaugaauaagacaacaa

SEQ ID NO: 1375247 - RNA, 20 nt, Homo sapiens
ugccaaccggucacccagga

SEQ ID NO: 1375248 - RNA, 16 nt, Homo sapiens
ugccaaguaaauagca

SEQ ID NO: 1375249 - RNA, 18 nt, Homo sapiens
ugccacacgucugacccu

SEQ ID NO: 1375250 - RNA, 15 nt, Homo sapiens
ugccaccugcugcug

SEQ ID NO: 1375251 - RNA, 14 nt, Homo sapiens
ugccacugccucuu

SEQ ID NO: 1375252 - RNA, 12 nt, Homo sapiens
ugccacuggaac

SEQ ID NO: 1375253 - RNA, 12 nt, Homo sapiens
ugccagacaugu

SEQ ID NO: 1375254 - RNA, 17 nt, Homo sapiens
ugccagaugcaauacaa

SEQ ID NO: 1375255 - RNA, 16 nt, Homo sapiens
ugccagcuuaucucag

SEQ ID NO: 1375256 - RNA, 23 nt, Homo sapiens
ugccaucaagaugagagaacugg

SEQ ID NO: 1375257 - RNA, 19 nt, Homo sapiens
ugccaucuauaggggccaa

SEQ ID NO: 1375258 - RNA, 19 nt, Homo sapiens
ugccaucuuggacuuguca

SEQ ID NO: 1375259 - RNA, 18 nt, Homo sapiens
ugccaugacaacuucuaa

SEQ ID NO: 1375260 - RNA, 23 nt, Homo sapiens
ugccaugccagcuuaucucaggg

SEQ ID NO: 1375261 - RNA, 23 nt, Homo sapiens
ugccauggaggcacacagcugca

SEQ ID NO: 1375262 - RNA, 20 nt, Homo sapiens
ugccaugggggcaacagcca

SEQ ID NO: 1375263 - RNA, 13 nt, Homo sapiens
ugccaugugaaga

SEQ ID NO: 1375264 - RNA, 17 nt, Homo sapiens
ugcccaaccucagcaac

SEQ ID NO: 1375265 - RNA, 13 nt, Homo sapiens
ugcccaccagauc

SEQ ID NO: 1375266 - RNA, 18 nt, Homo sapiens
ugcccaccugucaaacaa

SEQ ID NO: 1375267 - RNA, 20 nt, Homo sapiens
ugcccacgcuggagugcagu

SEQ ID NO: 1375268 - RNA, 16 nt, Homo sapiens
ugcccacuauggucau

SEQ ID NO: 1375269 - RNA, 21 nt, Homo sapiens
ugcccagaauucccagcuguc

SEQ ID NO: 1375270 - RNA, 20 nt, Homo sapiens
ugcccaggcuggaguggagu

SEQ ID NO: 1375271 - RNA, 17 nt, Homo sapiens
ugcccaggcuggucuca

SEQ ID NO: 1375272 - RNA, 12 nt, Homo sapiens
ugcccagugugu

SEQ ID NO: 1375273 - RNA, 16 nt, Homo sapiens
ugcccaguguguuucu

SEQ ID NO: 1375274 - RNA, 22 nt, Homo sapiens
ugcccaguguuguuuguaaaua

SEQ ID NO: 1375275 - RNA, 16 nt, Homo sapiens
ugcccauuuacacuuu

SEQ ID NO: 1375276 - RNA, 14 nt, Homo sapiens
ugcccccaacagca

SEQ ID NO: 1375277 - RNA, 15 nt, Homo sapiens
ugccccgucaccauc

SEQ ID NO: 1375278 - RNA, 14 nt, Homo sapiens
ugccccucccugcc

SEQ ID NO: 1375279 - RNA, 20 nt, Homo sapiens
ugccccugagacaaauggag

SEQ ID NO: 1375280 - RNA, 13 nt, Homo sapiens
ugcccuccacugc

SEQ ID NO: 1375281 - RNA, 17 nt, Homo sapiens
ugcccugcccaugggag

SEQ ID NO: 1375282 - RNA, 19 nt, Homo sapiens
ugcccugggauguccacag

SEQ ID NO: 1375283 - RNA, 16 nt, Homo sapiens
ugcccugguccaggga

SEQ ID NO: 1375284 - RNA, 14 nt, Homo sapiens
ugccucacuucuuc

SEQ ID NO: 1375285 - RNA, 22 nt, Homo sapiens
ugccucagccuccugaguaguu

SEQ ID NO: 1375286 - RNA, 21 nt, Homo sapiens
ugccucauuaccuugugcuaa

SEQ ID NO: 1375287 - RNA, 23 nt, Homo sapiens
ugccucauuaucuugcagcugua

SEQ ID NO: 1375288 - RNA, 18 nt, Homo sapiens
ugccuccaccccccagaa

SEQ ID NO: 1375289 - RNA, 16 nt, Homo sapiens
ugccugaaccuuccau

SEQ ID NO: 1375290 - RNA, 15 nt, Homo sapiens
ugccugaagucacac

SEQ ID NO: 1375291 - RNA, 18 nt, Homo sapiens
ugccugcaggcaugaguc

SEQ ID NO: 1375292 - RNA, 19 nt, Homo sapiens
ugccugcaggcaugaguca

SEQ ID NO: 1375293 - RNA, 20 nt, Homo sapiens
ugccuggaagagcagcccua

SEQ ID NO: 1375294 - RNA, 20 nt, Homo sapiens
ugccuggccaggcagaucug

SEQ ID NO: 1375295 - RNA, 16 nt, Homo sapiens
ugccugguggcagcug

SEQ ID NO: 1375296 - RNA, 22 nt, Homo sapiens
ugccugugcacggccagcugca

SEQ ID NO: 1375297 - RNA, 14 nt, Homo sapiens
ugccuuaacuggag

SEQ ID NO: 1375298 - RNA, 15 nt, Homo sapiens
ugccuugaagccacu

SEQ ID NO: 1375299 - RNA, 15 nt, Homo sapiens
ugcgaaagacccaca

SEQ ID NO: 1375300 - RNA, 22 nt, Homo sapiens
ugcgaaugguagucuaaccaaa

SEQ ID NO: 1375301 - RNA, 17 nt, Homo sapiens
ugcgaucuggguucacu

SEQ ID NO: 1375302 - RNA, 20 nt, Homo sapiens
ugcggaaugaaccacaucuu

SEQ ID NO: 1375303 - RNA, 13 nt, Homo sapiens
ugcggcaucagau

SEQ ID NO: 1375304 - RNA, 12 nt, Homo sapiens
ugcggugcauac

SEQ ID NO: 1375305 - RNA, 23 nt, Homo sapiens
ugcggugcauacacccccaccuc

SEQ ID NO: 1375306 - RNA, 11 nt, Homo sapiens
ugcgucacugu

SEQ ID NO: 1375307 - RNA, 23 nt, Homo sapiens
ugcuaaacgcacacaguaucuag

SEQ ID NO: 1375308 - RNA, 23 nt, Homo sapiens
ugcuaauauauguauaugcaaua

SEQ ID NO: 1375309 - RNA, 24 nt, Homo sapiens
ugcuacugauuguuucauugcgaa

SEQ ID NO: 1375310 - RNA, 16 nt, Homo sapiens
ugcuaucgccaucaca

SEQ ID NO: 1375311 - RNA, 22 nt, Homo sapiens
ugcuaucuuggcucacugcaaa

SEQ ID NO: 1375312 - RNA, 19 nt, Homo sapiens
ugcuaugaagcguugaugg

SEQ ID NO: 1375313 - RNA, 14 nt, Homo sapiens
ugcuauggggacau

SEQ ID NO: 1375314 - RNA, 19 nt, Homo sapiens
ugcucaaggcaaccagagg

SEQ ID NO: 1375315 - RNA, 22 nt, Homo sapiens
ugcucagggaauaauccagaaa

SEQ ID NO: 1375316 - RNA, 21 nt, Homo sapiens
ugcucaguagucagacuggau

SEQ ID NO: 1375317 - RNA, 15 nt, Homo sapiens
ugcucauguaugugc

SEQ ID NO: 1375318 - RNA, 17 nt, Homo sapiens
ugcucauguaugugcga

SEQ ID NO: 1375319 - RNA, 21 nt, Homo sapiens
ugcuccauacucuaacaucua

SEQ ID NO: 1375320 - RNA, 18 nt, Homo sapiens
ugcugaacaucacagcuu

SEQ ID NO: 1375321 - RNA, 22 nt, Homo sapiens
ugcugaggagaguggaacagaa

SEQ ID NO: 1375322 - RNA, 22 nt, Homo sapiens
ugcugcaccccaaguccagguc

SEQ ID NO: 1375323 - RNA, 21 nt, Homo sapiens
ugcugcagcggccacacugua

SEQ ID NO: 1375324 - RNA, 21 nt, Homo sapiens
ugcugccaaacacccaugccc

SEQ ID NO: 1375325 - RNA, 21 nt, Homo sapiens
ugcugcuauuuuacugucuua

SEQ ID NO: 1375326 - RNA, 15 nt, Homo sapiens
ugcugcugccuuuag

SEQ ID NO: 1375327 - RNA, 14 nt, Homo sapiens
ugcugcuuagcuug

SEQ ID NO: 1375328 - RNA, 22 nt, Homo sapiens
ugcuggaaguagaauuugucca

SEQ ID NO: 1375329 - RNA, 20 nt, Homo sapiens
ugcuggcaguggaacuaaga

SEQ ID NO: 1375330 - RNA, 15 nt, Homo sapiens
ugcuggcauuugcac

SEQ ID NO: 1375331 - RNA, 19 nt, Homo sapiens
ugcuggcccauaaacaccc

SEQ ID NO: 1375332 - RNA, 19 nt, Homo sapiens
ugcuggccgggcacagcug

SEQ ID NO: 1375333 - RNA, 19 nt, Homo sapiens
ugcugggggccgcccugua

SEQ ID NO: 1375334 - RNA, 23 nt, Homo sapiens
ugcuggucuucaauuaccaagaa

SEQ ID NO: 1375335 - RNA, 14 nt, Homo sapiens
ugcuggugaaccag

SEQ ID NO: 1375336 - RNA, 18 nt, Homo sapiens
ugcuuaaacuacaaacac

SEQ ID NO: 1375337 - RNA, 19 nt, Homo sapiens
ugcuucaaacuaacacauu

SEQ ID NO: 1375338 - RNA, 17 nt, Homo sapiens
ugcuucaugaaaauccu

SEQ ID NO: 1375339 - RNA, 16 nt, Homo sapiens
ugcuucgcagaugucc

SEQ ID NO: 1375340 - RNA, 23 nt, Homo sapiens
ugcuucuuugaaacuuguaugaa

SEQ ID NO: 1375341 - RNA, 22 nt, Homo sapiens
ugcuugccucaguaaaaugaac

SEQ ID NO: 1375342 - RNA, 14 nt, Homo sapiens
ugcuuggguguaac

SEQ ID NO: 1375343 - RNA, 15 nt, Homo sapiens
ugcuuguaacaagaa

SEQ ID NO: 1375344 - RNA, 12 nt, Homo sapiens
ugcuuguucccu

SEQ ID NO: 1375345 - RNA, 20 nt, Homo sapiens
ugcuuuacuuugcccaggga

SEQ ID NO: 1375346 - RNA, 19 nt, Homo sapiens
ugcuuucuuguugcugcau

SEQ ID NO: 1375347 - RNA, 16 nt, Homo sapiens
ugcuuuggaaaucaca

SEQ ID NO: 1375348 - RNA, 17 nt, Homo sapiens
ugcuuuguaugcacuuu

SEQ ID NO: 1375349 - RNA, 19 nt, Homo sapiens
ugugaacaagugaacacau

SEQ ID NO: 1375350 - RNA, 14 nt, Homo sapiens
ugugaaugaucucu

SEQ ID NO: 1375351 - RNA, 23 nt, Homo sapiens
ugugaaugaugauccuaggcauu

SEQ ID NO: 1375352 - RNA, 18 nt, Homo sapiens
ugugaccaggaaggaagu

SEQ ID NO: 1375353 - RNA, 17 nt, Homo sapiens
ugugacccuacuuccug

SEQ ID NO: 1375354 - RNA, 16 nt, Homo sapiens
ugugagaaacaucuca

SEQ ID NO: 1375355 - RNA, 14 nt, Homo sapiens
ugugagcagggauu

SEQ ID NO: 1375356 - RNA, 19 nt, Homo sapiens
ugugaguaagagcuggugu

SEQ ID NO: 1375357 - RNA, 17 nt, Homo sapiens
ugugaguguaaguguga

SEQ ID NO: 1375358 - RNA, 22 nt, Homo sapiens
ugugcaagugugugcaugugug

SEQ ID NO: 1375359 - RNA, 17 nt, Homo sapiens
ugugcacacauuaggca

SEQ ID NO: 1375360 - RNA, 14 nt, Homo sapiens
ugugcacaugugug

SEQ ID NO: 1375361 - RNA, 16 nt, Homo sapiens
ugugcacgagugggaa

SEQ ID NO: 1375362 - RNA, 21 nt, Homo sapiens
ugugcaguggcccccacagaa

SEQ ID NO: 1375363 - RNA, 13 nt, Homo sapiens
ugugcccagagau

SEQ ID NO: 1375364 - RNA, 16 nt, Homo sapiens
ugugccccaugccugu

SEQ ID NO: 1375365 - RNA, 17 nt, Homo sapiens
ugugcgugaaacacacc

SEQ ID NO: 1375366 - RNA, 19 nt, Homo sapiens
ugugcguguguccaugugu

SEQ ID NO: 1375367 - RNA, 16 nt, Homo sapiens
ugugcgugugugcaag

SEQ ID NO: 1375368 - RNA, 13 nt, Homo sapiens
uguggacacagcu

SEQ ID NO: 1375369 - RNA, 18 nt, Homo sapiens
uguggaggagcucaggac

SEQ ID NO: 1375370 - RNA, 19 nt, Homo sapiens
uguggcccagggaagccaa

SEQ ID NO: 1375371 - RNA, 16 nt, Homo sapiens
uguggccccaacacaa

SEQ ID NO: 1375372 - RNA, 15 nt, Homo sapiens
ugugggcuccauuca

SEQ ID NO: 1375373 - RNA, 23 nt, Homo sapiens
ugugggcucccuuccucccaaaa

SEQ ID NO: 1375374 - RNA, 20 nt, Homo sapiens
ugugguaguuaauaaaacac

SEQ ID NO: 1375375 - RNA, 21 nt, Homo sapiens
uguguaauaaaguguuuucag

SEQ ID NO: 1375376 - RNA, 17 nt, Homo sapiens
uguguccaugugugugc

SEQ ID NO: 1375377 - RNA, 18 nt, Homo sapiens
ugugucgcuuaugucuau

SEQ ID NO: 1375378 - RNA, 19 nt, Homo sapiens
ugugucgcuuaugucuaua

SEQ ID NO: 1375379 - RNA, 19 nt, Homo sapiens
ugugugaaauucucuuucc

SEQ ID NO: 1375380 - RNA, 17 nt, Homo sapiens
ugugugagugugugcaa

SEQ ID NO: 1375381 - RNA, 18 nt, Homo sapiens
ugugugaucugugggcac

SEQ ID NO: 1375382 - RNA, 23 nt, Homo sapiens
ugugugcaagugugugcaugugu

SEQ ID NO: 1375383 - RNA, 16 nt, Homo sapiens
ugugugguuuagugua

SEQ ID NO: 1375384 - RNA, 14 nt, Homo sapiens
uguguguaccugug

SEQ ID NO: 1375385 - RNA, 18 nt, Homo sapiens
uguguguauguuugcaca

SEQ ID NO: 1375386 - RNA, 16 nt, Homo sapiens
ugugugugcguguguc

SEQ ID NO: 1375387 - RNA, 15 nt, Homo sapiens
uguguuggcacaugc

SEQ ID NO: 1375388 - RNA, 14 nt, Homo sapiens
uguguuuccuucag

SEQ ID NO: 1375389 - RNA, 22 nt, Homo sapiens
uguguuuuaaaauaaggauuuu

SEQ ID NO: 1375390 - RNA, 14 nt, Homo sapiens
uguuaacuauugua

SEQ ID NO: 1375391 - RNA, 20 nt, Homo sapiens
uguuaucuguguagcaagcu

SEQ ID NO: 1375392 - RNA, 18 nt, Homo sapiens
uguuauggaaacuguugc

SEQ ID NO: 1375393 - RNA, 21 nt, Homo sapiens
uguuauuggguaucaccacug

SEQ ID NO: 1375394 - RNA, 16 nt, Homo sapiens
uguuauuuauaguguu

SEQ ID NO: 1375395 - RNA, 17 nt, Homo sapiens
uguucagcuccagcuca

SEQ ID NO: 1375396 - RNA, 15 nt, Homo sapiens
uguucagggcuguga

SEQ ID NO: 1375397 - RNA, 16 nt, Homo sapiens
uguucagggcugugau

SEQ ID NO: 1375398 - RNA, 15 nt, Homo sapiens
uguucccaaauuuuc

SEQ ID NO: 1375399 - RNA, 22 nt, Homo sapiens
uguucuaaagguggugaggcaa

SEQ ID NO: 1375400 - RNA, 16 nt, Homo sapiens
uguucucugaggacac

SEQ ID NO: 1375401 - RNA, 16 nt, Homo sapiens
uguucugggacacagu

SEQ ID NO: 1375402 - RNA, 17 nt, Homo sapiens
uguugaaaauguucaga

SEQ ID NO: 1375403 - RNA, 15 nt, Homo sapiens
uguugaacacuugaa

SEQ ID NO: 1375404 - RNA, 15 nt, Homo sapiens
uguugacacggccau

SEQ ID NO: 1375405 - RNA, 13 nt, Homo sapiens
uguugacaugugc

SEQ ID NO: 1375406 - RNA, 20 nt, Homo sapiens
uguugauaaauuccacugga

SEQ ID NO: 1375407 - RNA, 15 nt, Homo sapiens
uguugauuucuugua

SEQ ID NO: 1375408 - RNA, 15 nt, Homo sapiens
uguuggccaguguga

SEQ ID NO: 1375409 - RNA, 14 nt, Homo sapiens
uguuuacacuguca

SEQ ID NO: 1375410 - RNA, 18 nt, Homo sapiens
uguuuagcccaaaaccaa

SEQ ID NO: 1375411 - RNA, 12 nt, Homo sapiens
uguuuaguugca

SEQ ID NO: 1375412 - RNA, 15 nt, Homo sapiens
uguuuauacagcuca

SEQ ID NO: 1375413 - RNA, 14 nt, Homo sapiens
uguuuauuacuuau

SEQ ID NO: 1375414 - RNA, 17 nt, Homo sapiens
uguuuauuuacaaggga

SEQ ID NO: 1375415 - RNA, 13 nt, Homo sapiens
uguuuccaaaaac

SEQ ID NO: 1375416 - RNA, 18 nt, Homo sapiens
uguuuccugugcaaguca

SEQ ID NO: 1375417 - RNA, 14 nt, Homo sapiens
uguuugcccagugu

SEQ ID NO: 1375418 - RNA, 21 nt, Homo sapiens
uguuuggguauauucauuuca

SEQ ID NO: 1375419 - RNA, 17 nt, Homo sapiens
uguuugucagauaugau

SEQ ID NO: 1375420 - RNA, 14 nt, Homo sapiens
uguuuucucuugag

SEQ ID NO: 1375421 - RNA, 20 nt, Homo sapiens
uguuuucuugccaaugaggu

SEQ ID NO: 1375422 - RNA, 16 nt, Homo sapiens
uguuuugagcuuaaaa

SEQ ID NO: 1375423 - RNA, 19 nt, Homo sapiens
uguuuuuuuuuuccacuua

SEQ ID NO: 1375424 - RNA, 21 nt, Homo sapiens
uuaaaaaaaaaaaaaacauug

SEQ ID NO: 1375425 - RNA, 15 nt, Homo sapiens
uuaaaaucauaaaua

SEQ ID NO: 1375426 - RNA, 17 nt, Homo sapiens
uuaaacaaauguaugau

SEQ ID NO: 1375427 - RNA, 19 nt, Homo sapiens
uuaaacauaggaaagaaga

SEQ ID NO: 1375428 - RNA, 18 nt, Homo sapiens
uuaaacauugaaguaaug

SEQ ID NO: 1375429 - RNA, 22 nt, Homo sapiens
uuaaaguucucaaugcaaccau

SEQ ID NO: 1375430 - RNA, 12 nt, Homo sapiens
uuaaauaguaaa

SEQ ID NO: 1375431 - RNA, 16 nt, Homo sapiens
uuaaaucacacaugcu

SEQ ID NO: 1375432 - RNA, 15 nt, Homo sapiens
uuaaauguuucucaa

SEQ ID NO: 1375433 - RNA, 18 nt, Homo sapiens
uuaaauuauacuggagaa

SEQ ID NO: 1375434 - RNA, 16 nt, Homo sapiens
uuaaauuuuuccuuag

SEQ ID NO: 1375435 - RNA, 23 nt, Homo sapiens
uuaacaaauuauguuacaucugu

SEQ ID NO: 1375436 - RNA, 13 nt, Homo sapiens
uuaacacacauaa

SEQ ID NO: 1375437 - RNA, 21 nt, Homo sapiens
uuaacagaugcaaugugcuac

SEQ ID NO: 1375438 - RNA, 15 nt, Homo sapiens
uuaacggcacugugg

SEQ ID NO: 1375439 - RNA, 23 nt, Homo sapiens
uuaacuauuuuauuuucuaaugu

SEQ ID NO: 1375440 - RNA, 15 nt, Homo sapiens
uuaacugauguuacu

SEQ ID NO: 1375441 - RNA, 23 nt, Homo sapiens
uuaacuuguaaaugaaaaaauuc

SEQ ID NO: 1375442 - RNA, 22 nt, Homo sapiens
uuaagaacuagggagggggaaa

SEQ ID NO: 1375443 - RNA, 14 nt, Homo sapiens
uuaagacuacugaa

SEQ ID NO: 1375444 - RNA, 20 nt, Homo sapiens
uuaagaggcagggucucacu

SEQ ID NO: 1375445 - RNA, 21 nt, Homo sapiens
uuaagcuaggauguugcucag

SEQ ID NO: 1375446 - RNA, 23 nt, Homo sapiens
uuaagcugggauaaucacauuau

SEQ ID NO: 1375447 - RNA, 20 nt, Homo sapiens
uuaaguuauugauguuuuaa

SEQ ID NO: 1375448 - RNA, 16 nt, Homo sapiens
uuaaguugauggugau

SEQ ID NO: 1375449 - RNA, 17 nt, Homo sapiens
uuaaguugauggugaug

SEQ ID NO: 1375450 - RNA, 15 nt, Homo sapiens
uuaaguuuaucuuuc

SEQ ID NO: 1375451 - RNA, 23 nt, Homo sapiens
uuaauaaucagcaagaauuugau

SEQ ID NO: 1375452 - RNA, 15 nt, Homo sapiens
uuaaucccacuugcc

SEQ ID NO: 1375453 - RNA, 16 nt, Homo sapiens
uuaaugaagugcaaua

SEQ ID NO: 1375454 - RNA, 15 nt, Homo sapiens
uuaaugacagagcca

SEQ ID NO: 1375455 - RNA, 21 nt, Homo sapiens
uuaauguauuuguuugcaauu

SEQ ID NO: 1375456 - RNA, 17 nt, Homo sapiens
uuaaugucuggugcuuu

SEQ ID NO: 1375457 - RNA, 18 nt, Homo sapiens
uuaauuagggguugcuaa

SEQ ID NO: 1375458 - RNA, 16 nt, Homo sapiens
uuaauuguuaagauau

SEQ ID NO: 1375459 - RNA, 15 nt, Homo sapiens
uuaauuuugauucag

SEQ ID NO: 1375460 - RNA, 12 nt, Homo sapiens
uuacaaacugca

SEQ ID NO: 1375461 - RNA, 15 nt, Homo sapiens
uuacaacagugagaa

SEQ ID NO: 1375462 - RNA, 13 nt, Homo sapiens
uuuaagcaucaaa

SEQ ID NO: 1375463 - RNA, 14 nt, Homo sapiens
uuuaagcuaccaau

SEQ ID NO: 1375464 - RNA, 12 nt, Homo sapiens
uuuaaggcuaaa

SEQ ID NO: 1375465 - RNA, 16 nt, Homo sapiens
uuuaauaacauaacaa

SEQ ID NO: 1375466 - RNA, 15 nt, Homo sapiens
uuuaauacaggguag

SEQ ID NO: 1375467 - RNA, 16 nt, Homo sapiens
uuuaauagaauauaau

SEQ ID NO: 1375468 - RNA, 16 nt, Homo sapiens
uuuaauuauaccgcua

SEQ ID NO: 1375469 - RNA, 16 nt, Homo sapiens
uuuacaaaagauguau

SEQ ID NO: 1375470 - RNA, 21 nt, Homo sapiens
uuuacaaagcuggcaauauua

SEQ ID NO: 1375471 - RNA, 12 nt, Homo sapiens
uuuacaaaguau

SEQ ID NO: 1375472 - RNA, 23 nt, Homo sapiens
uuuacaauaaaacuuugcugcca

SEQ ID NO: 1375473 - RNA, 17 nt, Homo sapiens
uuuacacugucaaacau

SEQ ID NO: 1375474 - RNA, 13 nt, Homo sapiens
uuuacagcugccu

SEQ ID NO: 1375475 - RNA, 16 nt, Homo sapiens
uuuaccauuuguaaua

SEQ ID NO: 1375476 - RNA, 16 nt, Homo sapiens
uuuacuagaaaggcau

SEQ ID NO: 1375477 - RNA, 18 nt, Homo sapiens
uuuagauuaaacaaacaa

SEQ ID NO: 1375478 - RNA, 19 nt, Homo sapiens
uuuagcguagcuaagugaa

SEQ ID NO: 1375479 - RNA, 23 nt, Homo sapiens
uuuaguaagagauuccugagcca

SEQ ID NO: 1375480 - RNA, 23 nt, Homo sapiens
uuuauaaagggagauaacaaucu

SEQ ID NO: 1375481 - RNA, 23 nt, Homo sapiens
uuuauagagcagaacccuagucu

SEQ ID NO: 1375482 - RNA, 14 nt, Homo sapiens
uuuauaguguugcu

SEQ ID NO: 1375483 - RNA, 19 nt, Homo sapiens
uuuaucaaguguauuugaa

SEQ ID NO: 1375484 - RNA, 18 nt, Homo sapiens
uuuaucuauggcacccau

SEQ ID NO: 1375485 - RNA, 18 nt, Homo sapiens
uuuaucuguuuuguacuu

SEQ ID NO: 1375486 - RNA, 14 nt, Homo sapiens
uuuaugacaggaug

SEQ ID NO: 1375487 - RNA, 13 nt, Homo sapiens
uuuauggccucag

SEQ ID NO: 1375488 - RNA, 18 nt, Homo sapiens
uuuaugugcucuccaaau

SEQ ID NO: 1375489 - RNA, 16 nt, Homo sapiens
uuuauuaccucugaua

SEQ ID NO: 1375490 - RNA, 19 nt, Homo sapiens
uuuauuauauuuuucccua

SEQ ID NO: 1375491 - RNA, 18 nt, Homo sapiens
uuuauuuaagcaucaaau

SEQ ID NO: 1375492 - RNA, 19 nt, Homo sapiens
uuuauuuuauagagcagaa

SEQ ID NO: 1375493 - RNA, 16 nt, Homo sapiens
uuucaaaaaaucugac

SEQ ID NO: 1375494 - RNA, 23 nt, Homo sapiens
uuucaaagaaggaauucuaggca

SEQ ID NO: 1375495 - RNA, 14 nt, Homo sapiens
uuucaaagucucac

SEQ ID NO: 1375496 - RNA, 21 nt, Homo sapiens
uuucaccuguuuuuaagcugu

SEQ ID NO: 1375497 - RNA, 14 nt, Homo sapiens
uuucaccuucauau

SEQ ID NO: 1375498 - RNA, 21 nt, Homo sapiens
uuucaggccacauggcuaaag

SEQ ID NO: 1375499 - RNA, 15 nt, Homo sapiens
uuucauugauaugaa

SEQ ID NO: 1375500 - RNA, 15 nt, Homo sapiens
uuuccacuacugcua

SEQ ID NO: 1375501 - RNA, 22 nt, Homo sapiens
uuuccaguccuuggucaguuug

SEQ ID NO: 1375502 - RNA, 14 nt, Homo sapiens
uuuccauagucaca

SEQ ID NO: 1375503 - RNA, 22 nt, Homo sapiens
uuuccaugcacccucauacaca

SEQ ID NO: 1375504 - RNA, 18 nt, Homo sapiens
uuucccuguuucuuccac

SEQ ID NO: 1375505 - RNA, 22 nt, Homo sapiens
uuuccgcccucaaaaugacagc

SEQ ID NO: 1375506 - RNA, 13 nt, Homo sapiens
uuuccguuuccag

SEQ ID NO: 1375507 - RNA, 18 nt, Homo sapiens
uuuccugaucacuaugca

SEQ ID NO: 1375508 - RNA, 20 nt, Homo sapiens
uuuccuucauucaacccacc

SEQ ID NO: 1375509 - RNA, 16 nt, Homo sapiens
uuucgugcacucugcu

SEQ ID NO: 1375510 - RNA, 17 nt, Homo sapiens
uuucgugcacucugcua

SEQ ID NO: 1375511 - RNA, 18 nt, Homo sapiens
uuucuaacuccagugaag

SEQ ID NO: 1375512 - RNA, 17 nt, Homo sapiens
uuucuaacucugaugua

SEQ ID NO: 1375513 - RNA, 12 nt, Homo sapiens
uuucuacccagc

SEQ ID NO: 1375514 - RNA, 13 nt, Homo sapiens
uuucuagagccug

SEQ ID NO: 1375515 - RNA, 12 nt, Homo sapiens
uuucuaucauuc

SEQ ID NO: 1375516 - RNA, 14 nt, Homo sapiens
uuucuaugugacaa

SEQ ID NO: 1375517 - RNA, 13 nt, Homo sapiens
uuucucaauaagc

SEQ ID NO: 1375518 - RNA, 14 nt, Homo sapiens
uuucugaacacaau

SEQ ID NO: 1375519 - RNA, 18 nt, Homo sapiens
uuucuggaaaacugccuu

SEQ ID NO: 1375520 - RNA, 17 nt, Homo sapiens
uuucuguugccacaacc

SEQ ID NO: 1375521 - RNA, 17 nt, Homo sapiens
uuucuuaaucaguguag

SEQ ID NO: 1375522 - RNA, 14 nt, Homo sapiens
uuucuuacauuagc

SEQ ID NO: 1375523 - RNA, 13 nt, Homo sapiens
uuucuucucucca

SEQ ID NO: 1375524 - RNA, 18 nt, Homo sapiens
uuucuuucuaacuccagu

SEQ ID NO: 1375525 - RNA, 17 nt, Homo sapiens
uuucuuuuuuauacuca

SEQ ID NO: 1375526 - RNA, 18 nt, Homo sapiens
uuucuuuuuuauacucaa

SEQ ID NO: 1375527 - RNA, 18 nt, Homo sapiens
uuugaaaaacaaacagaa

SEQ ID NO: 1375528 - RNA, 24 nt, Homo sapiens
uuugaaauaauaaaucugguagaa

SEQ ID NO: 1375529 - RNA, 20 nt, Homo sapiens
uuugaaauagucugugugaa

SEQ ID NO: 1375530 - RNA, 12 nt, Homo sapiens
uuugaaccaaaa

SEQ ID NO: 1375531 - RNA, 19 nt, Homo sapiens
uuugaacccuugcuugcaa

SEQ ID NO: 1375532 - RNA, 23 nt, Homo sapiens
uuugaauuucaguaaacaaugaa

SEQ ID NO: 1375533 - RNA, 18 nt, Homo sapiens
uuugacagagucucaauc

SEQ ID NO: 1375534 - RNA, 14 nt, Homo sapiens
uuugacauuuacug

SEQ ID NO: 1375535 - RNA, 23 nt, Homo sapiens
uuugacuagaaaauuuaaaacau

SEQ ID NO: 1375536 - RNA, 11 nt, Homo sapiens
uuugagccaug

SEQ ID NO: 1375537 - RNA, 14 nt, Homo sapiens
uuugaugaaaucag

SEQ ID NO: 1375538 - RNA, 14 nt, Homo sapiens
uuugcaaugucaca

SEQ ID NO: 1375539 - RNA, 18 nt, Homo sapiens
uuugccagugggaacucc

SEQ ID NO: 1375540 - RNA, 19 nt, Homo sapiens
uuugcuaaaugugaaugau

SEQ ID NO: 1375541 - RNA, 18 nt, Homo sapiens
uuugcuccaccccacuca

SEQ ID NO: 1375542 - RNA, 14 nt, Homo sapiens
uuugcugccaaaca

SEQ ID NO: 1375543 - RNA, 15 nt, Homo sapiens
uuuggauuacuuaaa

SEQ ID NO: 1375544 - RNA, 22 nt, Homo sapiens
uuuggcauuccccacuugagaa

SEQ ID NO: 1375545 - RNA, 17 nt, Homo sapiens
uuuggguuuugggucuu

SEQ ID NO: 1375546 - RNA, 12 nt, Homo sapiens
uuugguacuaau

SEQ ID NO: 1375547 - RNA, 22 nt, Homo sapiens
uuuguaaugggaacugccucuu

SEQ ID NO: 1375548 - RNA, 14 nt, Homo sapiens
uuugucaacaaagu

SEQ ID NO: 1375549 - RNA, 21 nt, Homo sapiens
uuugucauauaagauucauau

SEQ ID NO: 1375550 - RNA, 20 nt, Homo sapiens
uuuguccuuggggacaucuc

SEQ ID NO: 1375551 - RNA, 17 nt, Homo sapiens
uuugugugcgucacugu

SEQ ID NO: 1375552 - RNA, 21 nt, Homo sapiens
uuuguguucuguuuguuaaaa

SEQ ID NO: 1375553 - RNA, 15 nt, Homo sapiens
uuuguuggagccacu

SEQ ID NO: 1375554 - RNA, 21 nt, Homo sapiens
uuuuaaaaaaaucccauuuaa

SEQ ID NO: 1375555 - RNA, 17 nt, Homo sapiens
uuuuaacacacauaaag

SEQ ID NO: 1375556 - RNA, 14 nt, Homo sapiens
uuuuaagacuauaa

SEQ ID NO: 1375557 - RNA, 22 nt, Homo sapiens
uuuuaauuuaaucuuccaugga

SEQ ID NO: 1375558 - RNA, 13 nt, Homo sapiens
uuuuagacagagu

SEQ ID NO: 1375559 - RNA, 11 nt, Homo sapiens
uuuuagcucau

SEQ ID NO: 1375560 - RNA, 14 nt, Homo sapiens
uuuuagcuuuacaa

SEQ ID NO: 1375561 - RNA, 19 nt, Homo sapiens
uuuuaguugcucaaagagc

SEQ ID NO: 1375562 - RNA, 20 nt, Homo sapiens
uuuuauaaugucccuucaca

SEQ ID NO: 1375563 - RNA, 22 nt, Homo sapiens
uuuuccacaagauucccagaga

SEQ ID NO: 1375564 - RNA, 12 nt, Homo sapiens
uuuuccuauaau

SEQ ID NO: 1375565 - RNA, 15 nt, Homo sapiens
uuuuccuccaggcaa

SEQ ID NO: 1375566 - RNA, 22 nt, Homo sapiens
uuuucugcuaaaaaguccuuga

SEQ ID NO: 1375567 - RNA, 19 nt, Homo sapiens
uuuucuggaauacaugaaa

SEQ ID NO: 1375568 - RNA, 22 nt, Homo sapiens
uuuucuuacuagaccuguaacu

SEQ ID NO: 1375569 - RNA, 15 nt, Homo sapiens
uuuugccacuggaac

SEQ ID NO: 1375570 - RNA, 12 nt, Homo sapiens
uuuugguaucua

SEQ ID NO: 1375571 - RNA, 13 nt, Homo sapiens
uuuuguguacugu

SEQ ID NO: 1375572 - RNA, 16 nt, Homo sapiens
uuuuuaaaaaaguaag

SEQ ID NO: 1375573 - RNA, 14 nt, Homo sapiens
uuuuuaaguguucu

SEQ ID NO: 1375574 - RNA, 15 nt, Homo sapiens
uuuuuacauccauga

SEQ ID NO: 1375575 - RNA, 18 nt, Homo sapiens
uuuuuagcucaucggcua

SEQ ID NO: 1375576 - RNA, 16 nt, Homo sapiens
aucccaucccauccca

SEQ ID NO: 1375577 - RNA, 14 nt, Homo sapiens
aucccuacaaaaaa

SEQ ID NO: 1375578 - RNA, 12 nt, Homo sapiens
aucccuaccccc

SEQ ID NO: 1375579 - RNA, 16 nt, Homo sapiens
aucccuaugcugccua

SEQ ID NO: 1375580 - RNA, 13 nt, Homo sapiens
auccgaaguauga

SEQ ID NO: 1375581 - RNA, 19 nt, Homo sapiens
auccuagagaaaacuugaa

SEQ ID NO: 1375582 - RNA, 15 nt, Homo sapiens
auccuaggcauuugc

SEQ ID NO: 1375583 - RNA, 20 nt, Homo sapiens
auccucacugggugggguga

SEQ ID NO: 1375584 - RNA, 14 nt, Homo sapiens
auccuccugccuca

SEQ ID NO: 1375585 - RNA, 15 nt, Homo sapiens
auccugagcaaacaa

SEQ ID NO: 1375586 - RNA, 21 nt, Homo sapiens
auccugagcaaacaaaaccac

SEQ ID NO: 1375587 - RNA, 22 nt, Homo sapiens
auccugagcaaacaaaaccacc

SEQ ID NO: 1375588 - RNA, 23 nt, Homo sapiens
auccugagcaaacaaaaccaccu

SEQ ID NO: 1375589 - RNA, 17 nt, Homo sapiens
auccuggggaacauaga

SEQ ID NO: 1375590 - RNA, 14 nt, Homo sapiens
auccuuccacggac

SEQ ID NO: 1375591 - RNA, 17 nt, Homo sapiens
auccuuccucauuugca

SEQ ID NO: 1375592 - RNA, 13 nt, Homo sapiens
auccuuuacuguu

SEQ ID NO: 1375593 - RNA, 15 nt, Homo sapiens
aucgcugucaucuca

SEQ ID NO: 1375594 - RNA, 22 nt, Homo sapiens
aucuaaaccauaugaacauaua

SEQ ID NO: 1375595 - RNA, 14 nt, Homo sapiens
aucuaauacacuuu

SEQ ID NO: 1375596 - RNA, 16 nt, Homo sapiens
aucuaaugugaaguag

SEQ ID NO: 1375597 - RNA, 22 nt, Homo sapiens
aucuacuucaacacuucaugua

SEQ ID NO: 1375598 - RNA, 17 nt, Homo sapiens
aucuagaagacugucag

SEQ ID NO: 1375599 - RNA, 22 nt, Homo sapiens
aucuagcuggcuucccugucua

SEQ ID NO: 1375600 - RNA, 12 nt, Homo sapiens
aucuauuuuccu

SEQ ID NO: 1375601 - RNA, 19 nt, Homo sapiens
aucucaauaaagugcuuua

SEQ ID NO: 1375602 - RNA, 16 nt, Homo sapiens
aucucaccccauccca

SEQ ID NO: 1375603 - RNA, 21 nt, Homo sapiens
aucucacuuuucuccaugagu

SEQ ID NO: 1375604 - RNA, 16 nt, Homo sapiens
aucucagcaaugauua

SEQ ID NO: 1375605 - RNA, 19 nt, Homo sapiens
aucucagcuggaucuccau

SEQ ID NO: 1375606 - RNA, 19 nt, Homo sapiens
aucucaggccaccugcccc

SEQ ID NO: 1375607 - RNA, 18 nt, Homo sapiens
aucucaggccucccucaa

SEQ ID NO: 1375608 - RNA, 17 nt, Homo sapiens
aucuccauauguuacac

SEQ ID NO: 1375609 - RNA, 15 nt, Homo sapiens
aucuccauucucuca

SEQ ID NO: 1375610 - RNA, 16 nt, Homo sapiens
aucuccccucagauuc

SEQ ID NO: 1375611 - RNA, 17 nt, Homo sapiens
aucuccccucagauucc

SEQ ID NO: 1375612 - RNA, 18 nt, Homo sapiens
aucuccccucagauucca

SEQ ID NO: 1375613 - RNA, 19 nt, Homo sapiens
aucucuacugaaaguacaa

SEQ ID NO: 1375614 - RNA, 16 nt, Homo sapiens
aucucucuagugaugg

SEQ ID NO: 1375615 - RNA, 19 nt, Homo sapiens
aucucuugcacucaaagcu

SEQ ID NO: 1375616 - RNA, 21 nt, Homo sapiens
aucucuuuugaauccaugcuu

SEQ ID NO: 1375617 - RNA, 19 nt, Homo sapiens
aucugaacagaaauaccaa

SEQ ID NO: 1375618 - RNA, 18 nt, Homo sapiens
aucugaagauacaugucu

SEQ ID NO: 1375619 - RNA, 21 nt, Homo sapiens
aucugacacaaaaaaaguuga

SEQ ID NO: 1375620 - RNA, 14 nt, Homo sapiens
aucugacauaguua

SEQ ID NO: 1375621 - RNA, 13 nt, Homo sapiens
aucugaccaaaac

SEQ ID NO: 1375622 - RNA, 16 nt, Homo sapiens
aucugagcuaacuuau

SEQ ID NO: 1375623 - RNA, 20 nt, Homo sapiens
aucugauuuccuaaugucag

SEQ ID NO: 1375624 - RNA, 17 nt, Homo sapiens
aucugcauuuagcacaa

SEQ ID NO: 1375625 - RNA, 16 nt, Homo sapiens
aucuggucccuugcag

SEQ ID NO: 1375626 - RNA, 14 nt, Homo sapiens
aucuuaaagcacuu

SEQ ID NO: 1375627 - RNA, 15 nt, Homo sapiens
aucuuaaagcacuua

SEQ ID NO: 1375628 - RNA, 17 nt, Homo sapiens
aucuuaaagcacuuaca

SEQ ID NO: 1375629 - RNA, 16 nt, Homo sapiens
aucuuagcugccaagu

SEQ ID NO: 1375630 - RNA, 14 nt, Homo sapiens
aucuuagugccuga

SEQ ID NO: 1375631 - RNA, 18 nt, Homo sapiens
aucuucaggacacucacu

SEQ ID NO: 1375632 - RNA, 21 nt, Homo sapiens
aucuucagggcacugcugcug

SEQ ID NO: 1375633 - RNA, 19 nt, Homo sapiens
aucuucauacaaugacaag

SEQ ID NO: 1375634 - RNA, 18 nt, Homo sapiens
aucuuccaaggguacuaa

SEQ ID NO: 1375635 - RNA, 23 nt, Homo sapiens
aucuuccccaacgaaaagcacau

SEQ ID NO: 1375636 - RNA, 23 nt, Homo sapiens
aucuuccuuuguugcacaaauag

SEQ ID NO: 1375637 - RNA, 21 nt, Homo sapiens
aucuucuguuccacauccaca

SEQ ID NO: 1375638 - RNA, 22 nt, Homo sapiens
aucuucuuuauaauucuacuuu

SEQ ID NO: 1375639 - RNA, 17 nt, Homo sapiens
aucuugcucuaucucac

SEQ ID NO: 1375640 - RNA, 17 nt, Homo sapiens
aucuugcucugcugaca

SEQ ID NO: 1375641 - RNA, 14 nt, Homo sapiens
aucuuggacugaca

SEQ ID NO: 1375642 - RNA, 15 nt, Homo sapiens
aucuuguuuuuccac

SEQ ID NO: 1375643 - RNA, 22 nt, Homo sapiens
aucuuguuuuuccacuacugcu

SEQ ID NO: 1375644 - RNA, 17 nt, Homo sapiens
aucuuuccuuccucuca

SEQ ID NO: 1375645 - RNA, 12 nt, Homo sapiens
aucuuugcagac

SEQ ID NO: 1375646 - RNA, 19 nt, Homo sapiens
aucuuuucuacagcaaauu

SEQ ID NO: 1375647 - RNA, 20 nt, Homo sapiens
augaaaaauaagucacuuau

SEQ ID NO: 1375648 - RNA, 16 nt, Homo sapiens
augaaacauuuuguca

SEQ ID NO: 1375649 - RNA, 20 nt, Homo sapiens
augaaaccccguuucuacua

SEQ ID NO: 1375650 - RNA, 22 nt, Homo sapiens
augaaagcacuccucccugaug

SEQ ID NO: 1375651 - RNA, 13 nt, Homo sapiens
augaaauaugcau

SEQ ID NO: 1375652 - RNA, 15 nt, Homo sapiens
augaaaugcucuccu

SEQ ID NO: 1375653 - RNA, 13 nt, Homo sapiens
augaaccacauua

SEQ ID NO: 1375654 - RNA, 15 nt, Homo sapiens
augaagaugaugcua

SEQ ID NO: 1375655 - RNA, 12 nt, Homo sapiens
augaagugcaau

SEQ ID NO: 1375656 - RNA, 18 nt, Homo sapiens
augaauauuuuguaacua

SEQ ID NO: 1375657 - RNA, 15 nt, Homo sapiens
augaauccuacauac

SEQ ID NO: 1375658 - RNA, 19 nt, Homo sapiens
augaauuuuuuucaucuuc

SEQ ID NO: 1375659 - RNA, 16 nt, Homo sapiens
augacaaaggcacuga

SEQ ID NO: 1375660 - RNA, 21 nt, Homo sapiens
augacaacccugugguuucca

SEQ ID NO: 1375661 - RNA, 11 nt, Homo sapiens
augacagugaa

SEQ ID NO: 1375662 - RNA, 13 nt, Homo sapiens
augacaucacuug

SEQ ID NO: 1375663 - RNA, 13 nt, Homo sapiens
augaccuggaaau

SEQ ID NO: 1375664 - RNA, 15 nt, Homo sapiens
augacugcauuuuac

SEQ ID NO: 1375665 - RNA, 14 nt, Homo sapiens
augagaaaugccag

SEQ ID NO: 1375666 - RNA, 17 nt, Homo sapiens
augagaaggaauuugag

SEQ ID NO: 1375667 - RNA, 20 nt, Homo sapiens
augagaaucagaucauuuca

SEQ ID NO: 1375668 - RNA, 16 nt, Homo sapiens
augagaccacuguuau

SEQ ID NO: 1375669 - RNA, 15 nt, Homo sapiens
augagagaacuggag

SEQ ID NO: 1375670 - RNA, 20 nt, Homo sapiens
augagaguagagggcacugg

SEQ ID NO: 1375671 - RNA, 12 nt, Homo sapiens
augagcauuuag

SEQ ID NO: 1375672 - RNA, 13 nt, Homo sapiens
augagcuccagac

SEQ ID NO: 1375673 - RNA, 13 nt, Homo sapiens
augagggaaaaug

SEQ ID NO: 1375674 - RNA, 20 nt, Homo sapiens
augagguacucuccuggaaa

SEQ ID NO: 1375675 - RNA, 20 nt, Homo sapiens
augaucacggcucacugcag

SEQ ID NO: 1375676 - RNA, 18 nt, Homo sapiens
augauccuaaugaaugca

SEQ ID NO: 1375677 - RNA, 22 nt, Homo sapiens
augauccuaggcauuugcugaa

SEQ ID NO: 1375678 - RNA, 13 nt, Homo sapiens
augaucucccugc

SEQ ID NO: 1375679 - RNA, 20 nt, Homo sapiens
augaucuuugcagacaggca

SEQ ID NO: 1375680 - RNA, 19 nt, Homo sapiens
augaugagaguuucuguua

SEQ ID NO: 1375681 - RNA, 16 nt, Homo sapiens
augaugauaaugauga

SEQ ID NO: 1375682 - RNA, 12 nt, Homo sapiens
augaugaucugg

SEQ ID NO: 1375683 - RNA, 18 nt, Homo sapiens
augaugcuauuaauacug

SEQ ID NO: 1375684 - RNA, 17 nt, Homo sapiens
augauguaggggccaag

SEQ ID NO: 1375685 - RNA, 19 nt, Homo sapiens
augaugucguuugaaucac

SEQ ID NO: 1375686 - RNA, 14 nt, Homo sapiens
augauucuaugucu

SEQ ID NO: 1375687 - RNA, 18 nt, Homo sapiens
augauugcuuaucaguag

SEQ ID NO: 1375688 - RNA, 14 nt, Homo sapiens
augugauacaaauu

SEQ ID NO: 1375689 - RNA, 14 nt, Homo sapiens
augugcucagggaa

SEQ ID NO: 1375690 - RNA, 13 nt, Homo sapiens
augugcucaugca

SEQ ID NO: 1375691 - RNA, 17 nt, Homo sapiens
caggaguuugaauccau

SEQ ID NO: 1375692 - RNA, 19 nt, Homo sapiens
caggaugaguuacuugaaa

SEQ ID NO: 1375693 - RNA, 15 nt, Homo sapiens
caggauggcacuguu

SEQ ID NO: 1375694 - RNA, 13 nt, Homo sapiens
cauacucaccuca

SEQ ID NO: 1375695 - RNA, 16 nt, Homo sapiens
cauacuucuucauuca

SEQ ID NO: 1375696 - RNA, 18 nt, Homo sapiens
cauagacuuuaugcaaua

SEQ ID NO: 1375697 - RNA, 23 nt, Homo sapiens
cauagagaucuauguacuguaau

SEQ ID NO: 1375698 - RNA, 16 nt, Homo sapiens
cauagauucaccugua

SEQ ID NO: 1375699 - RNA, 17 nt, Homo sapiens
cauagcaagauugcuua

SEQ ID NO: 1375700 - RNA, 14 nt, Homo sapiens
cauaggcagcacua

SEQ ID NO: 1375701 - RNA, 15 nt, Homo sapiens
cauagggccuccuua

SEQ ID NO: 1375702 - RNA, 22 nt, Homo sapiens
cauagugaccaacauagugaaa

SEQ ID NO: 1375703 - RNA, 18 nt, Homo sapiens
cauaguggagagaacuga

SEQ ID NO: 1375704 - RNA, 15 nt, Homo sapiens
cauauaaucuuacaa

SEQ ID NO: 1375705 - RNA, 16 nt, Homo sapiens
cauauaccagcaauau

SEQ ID NO: 1375706 - RNA, 13 nt, Homo sapiens
cauauauauguca

SEQ ID NO: 1375707 - RNA, 22 nt, Homo sapiens
cauauauuagcauuuaguccaa

SEQ ID NO: 1375708 - RNA, 14 nt, Homo sapiens
cauauccaacaugu

SEQ ID NO: 1375709 - RNA, 15 nt, Homo sapiens
cauauccugagccau

SEQ ID NO: 1375710 - RNA, 15 nt, Homo sapiens
cauaugauugugcac

SEQ ID NO: 1375711 - RNA, 20 nt, Homo sapiens
cauaugugaauauggacuca

SEQ ID NO: 1375712 - RNA, 16 nt, Homo sapiens
cauauucuguuggcca

SEQ ID NO: 1375713 - RNA, 19 nt, Homo sapiens
cauauucuuuaaauuucau

SEQ ID NO: 1375714 - RNA, 18 nt, Homo sapiens
cauauuggaauguacaug

SEQ ID NO: 1375715 - RNA, 20 nt, Homo sapiens
cauauuggaauguacauguc

SEQ ID NO: 1375716 - RNA, 22 nt, Homo sapiens
cauauuggaauguacaugucaa

SEQ ID NO: 1375717 - RNA, 20 nt, Homo sapiens
caucaaacacaaugccucau

SEQ ID NO: 1375718 - RNA, 15 nt, Homo sapiens
caucaaguugcacac

SEQ ID NO: 1375719 - RNA, 11 nt, Homo sapiens
caucaaugaug

SEQ ID NO: 1375720 - RNA, 22 nt, Homo sapiens
caucaccuugauaaugggauga

SEQ ID NO: 1375721 - RNA, 23 nt, Homo sapiens
caucacgcggccgagacauggcu

SEQ ID NO: 1375722 - RNA, 18 nt, Homo sapiens
caucagacuccugugcaa

SEQ ID NO: 1375723 - RNA, 21 nt, Homo sapiens
caucagacuccugugcaacuu

SEQ ID NO: 1375724 - RNA, 14 nt, Homo sapiens
caucagcaaaaaag

SEQ ID NO: 1375725 - RNA, 19 nt, Homo sapiens
caucagcagagaacuggaa

SEQ ID NO: 1375726 - RNA, 15 nt, Homo sapiens
caucagucaaugaau

SEQ ID NO: 1375727 - RNA, 16 nt, Homo sapiens
caucagucaaugaaua

SEQ ID NO: 1375728 - RNA, 17 nt, Homo sapiens
cauccaaugcucaagaa

SEQ ID NO: 1375729 - RNA, 16 nt, Homo sapiens
cauccaauucuuugaa

SEQ ID NO: 1375730 - RNA, 16 nt, Homo sapiens
cauccagguucagcuu

SEQ ID NO: 1375731 - RNA, 11 nt, Homo sapiens
cauccaugaaa

SEQ ID NO: 1375732 - RNA, 21 nt, Homo sapiens
cauccauuuauuuggcaucug

SEQ ID NO: 1375733 - RNA, 13 nt, Homo sapiens
caucccaucccau

SEQ ID NO: 1375734 - RNA, 22 nt, Homo sapiens
cauccugaaaaggguguugcua

SEQ ID NO: 1375735 - RNA, 21 nt, Homo sapiens
caucuauugccugagagcaca

SEQ ID NO: 1375736 - RNA, 14 nt, Homo sapiens
caucucagugcagg

SEQ ID NO: 1375737 - RNA, 15 nt, Homo sapiens
caucucagugcagga

SEQ ID NO: 1375738 - RNA, 16 nt, Homo sapiens
caucucauuccaacuu

SEQ ID NO: 1375739 - RNA, 20 nt, Homo sapiens
caucuccccucagauuccac

SEQ ID NO: 1375740 - RNA, 13 nt, Homo sapiens
caucucuacaaaa

SEQ ID NO: 1375741 - RNA, 12 nt, Homo sapiens
caucucuacuaa

SEQ ID NO: 1375742 - RNA, 12 nt, Homo sapiens
caucucuuugau

SEQ ID NO: 1375743 - RNA, 22 nt, Homo sapiens
caucugccuccccuucacuccc

SEQ ID NO: 1375744 - RNA, 13 nt, Homo sapiens
caucugcuuuacu

SEQ ID NO: 1375745 - RNA, 18 nt, Homo sapiens
caucugcuuuacucugga

SEQ ID NO: 1375746 - RNA, 12 nt, Homo sapiens
caucuguacuca

SEQ ID NO: 1375747 - RNA, 23 nt, Homo sapiens
caucuguagauacuagcuaucua

SEQ ID NO: 1375748 - RNA, 17 nt, Homo sapiens
caucuuaguauuugcau

SEQ ID NO: 1375749 - RNA, 19 nt, Homo sapiens
caucuucaaagcuugaaga

SEQ ID NO: 1375750 - RNA, 15 nt, Homo sapiens
caucuucuccaucug

SEQ ID NO: 1375751 - RNA, 14 nt, Homo sapiens
caucuuggucacau

SEQ ID NO: 1375752 - RNA, 19 nt, Homo sapiens
caucuuggucacauacaau

SEQ ID NO: 1375753 - RNA, 20 nt, Homo sapiens
caucuuugauacuuguucaa

SEQ ID NO: 1375754 - RNA, 23 nt, Homo sapiens
caucuuuguggcgggagugcuca

SEQ ID NO: 1375755 - RNA, 18 nt, Homo sapiens
caucuuuuacauucugca

SEQ ID NO: 1375756 - RNA, 14 nt, Homo sapiens
caugaaaacagaaa

SEQ ID NO: 1375757 - RNA, 20 nt, Homo sapiens
caugaaagcaucugagcuaa

SEQ ID NO: 1375758 - RNA, 14 nt, Homo sapiens
caugaaauaugcau

SEQ ID NO: 1375759 - RNA, 22 nt, Homo sapiens
caugaacaucuuuaggagacua

SEQ ID NO: 1375760 - RNA, 15 nt, Homo sapiens
caugaaccaagugga

SEQ ID NO: 1375761 - RNA, 12 nt, Homo sapiens
caugaacuggag

SEQ ID NO: 1375762 - RNA, 21 nt, Homo sapiens
caugaagcccaagugaaauca

SEQ ID NO: 1375763 - RNA, 17 nt, Homo sapiens
caugaaggcagagccau

SEQ ID NO: 1375764 - RNA, 13 nt, Homo sapiens
caugaaugcacac

SEQ ID NO: 1375765 - RNA, 17 nt, Homo sapiens
caugaauguaucaggaa

SEQ ID NO: 1375766 - RNA, 20 nt, Homo sapiens
caugacauauuuuugcuuua

SEQ ID NO: 1375767 - RNA, 15 nt, Homo sapiens
caugaccacuuuccc

SEQ ID NO: 1375768 - RNA, 18 nt, Homo sapiens
caugaccugugaccagca

SEQ ID NO: 1375769 - RNA, 21 nt, Homo sapiens
caugagagaauuguaucauuu

SEQ ID NO: 1375770 - RNA, 19 nt, Homo sapiens
caugagaucuaggugagga

SEQ ID NO: 1375771 - RNA, 19 nt, Homo sapiens
caugagauucauucaguua

SEQ ID NO: 1375772 - RNA, 20 nt, Homo sapiens
caugaucuugugacauauua

SEQ ID NO: 1375773 - RNA, 19 nt, Homo sapiens
caugauggagucagguuug

SEQ ID NO: 1375774 - RNA, 19 nt, Homo sapiens
caugcaaggggaaaaucuc

SEQ ID NO: 1375775 - RNA, 14 nt, Homo sapiens
caugcaaggugccc

SEQ ID NO: 1375776 - RNA, 13 nt, Homo sapiens
caugcaaugacau

SEQ ID NO: 1375777 - RNA, 18 nt, Homo sapiens
caugcacccucauacaca

SEQ ID NO: 1375778 - RNA, 16 nt, Homo sapiens
caugcauguuugguua

SEQ ID NO: 1375779 - RNA, 11 nt, Homo sapiens
caugcauuuga

SEQ ID NO: 1375780 - RNA, 23 nt, Homo sapiens
caugcccuggauccaucaggcca

SEQ ID NO: 1375781 - RNA, 18 nt, Homo sapiens
caugccgggcgcaguggc

SEQ ID NO: 1375782 - RNA, 17 nt, Homo sapiens
caugcguuuaaucacau

SEQ ID NO: 1375783 - RNA, 22 nt, Homo sapiens
caugcuccuggcccacugcauc

SEQ ID NO: 1375784 - RNA, 23 nt, Homo sapiens
cauggaacucauuccugccuguc

SEQ ID NO: 1375785 - RNA, 15 nt, Homo sapiens
cauggagaaacccug

SEQ ID NO: 1375786 - RNA, 13 nt, Homo sapiens
cauggagccagug

SEQ ID NO: 1375787 - RNA, 15 nt, Homo sapiens
cauggauaacacauu

SEQ ID NO: 1375788 - RNA, 12 nt, Homo sapiens
cauggaugccaa

SEQ ID NO: 1375789 - RNA, 20 nt, Homo sapiens
cauggcaccugucgcccagu

SEQ ID NO: 1375790 - RNA, 19 nt, Homo sapiens
caugggagacacugaugua

SEQ ID NO: 1375791 - RNA, 17 nt, Homo sapiens
caugguccccauggcau

SEQ ID NO: 1375792 - RNA, 16 nt, Homo sapiens
cauguacauagcuuga

SEQ ID NO: 1375793 - RNA, 12 nt, Homo sapiens
cauguacaugaa

SEQ ID NO: 1375794 - RNA, 18 nt, Homo sapiens
cauguacuguuacugugu

SEQ ID NO: 1375795 - RNA, 14 nt, Homo sapiens
cauguaugugcgaa

SEQ ID NO: 1375796 - RNA, 17 nt, Homo sapiens
caugucucaauaguaaa

SEQ ID NO: 1375797 - RNA, 22 nt, Homo sapiens
cauguggaaaaaaaaaagaugu

SEQ ID NO: 1375798 - RNA, 16 nt, Homo sapiens
cauguggaagcacuuu

SEQ ID NO: 1375799 - RNA, 18 nt, Homo sapiens
caugugugagugugugca

SEQ ID NO: 1375800 - RNA, 17 nt, Homo sapiens
caugugugcgagugugu

SEQ ID NO: 1375801 - RNA, 22 nt, Homo sapiens
caugugugcgagugugugcaug

SEQ ID NO: 1375802 - RNA, 17 nt, Homo sapiens
caugugugcgugugcgu

SEQ ID NO: 1375803 - RNA, 17 nt, Homo sapiens
ccagaaagcucaucuca

SEQ ID NO: 1375804 - RNA, 18 nt, Homo sapiens
ccagaaauccaguuauuu

SEQ ID NO: 1375805 - RNA, 15 nt, Homo sapiens
ccagaacacacucca

SEQ ID NO: 1375806 - RNA, 18 nt, Homo sapiens
ccagaacuggacucagga

SEQ ID NO: 1375807 - RNA, 15 nt, Homo sapiens
ccagaagaagcuuaa

SEQ ID NO: 1375808 - RNA, 14 nt, Homo sapiens
ccagaagagguaua

SEQ ID NO: 1375809 - RNA, 17 nt, Homo sapiens
ccagaagggggccauga

SEQ ID NO: 1375810 - RNA, 13 nt, Homo sapiens
ccagaauagcuuu

SEQ ID NO: 1375811 - RNA, 23 nt, Homo sapiens
ccagacagcaacggggaggccaa

SEQ ID NO: 1375812 - RNA, 13 nt, Homo sapiens
ccagacagcuccc

SEQ ID NO: 1375813 - RNA, 22 nt, Homo sapiens
ccagacagcucccucugccuga

SEQ ID NO: 1375814 - RNA, 14 nt, Homo sapiens
ccagagcaaaauaa

SEQ ID NO: 1375815 - RNA, 22 nt, Homo sapiens
ccagagcuggaccugagcuauu

SEQ ID NO: 1375816 - RNA, 22 nt, Homo sapiens
ccagaugccuucuccagacaaa

SEQ ID NO: 1375817 - RNA, 13 nt, Homo sapiens
ccagcaauuccau

SEQ ID NO: 1375818 - RNA, 16 nt, Homo sapiens
ccagcaccaccagguc

SEQ ID NO: 1375819 - RNA, 15 nt, Homo sapiens
ccagcacccugcaaa

SEQ ID NO: 1375820 - RNA, 12 nt, Homo sapiens
ccagcacuuugg

SEQ ID NO: 1375821 - RNA, 17 nt, Homo sapiens
ccagcagaucccagcuc

SEQ ID NO: 1375822 - RNA, 20 nt, Homo sapiens
ccagccaagagggcugcaaa

SEQ ID NO: 1375823 - RNA, 17 nt, Homo sapiens
ccagcccauggcuuuag

SEQ ID NO: 1375824 - RNA, 15 nt, Homo sapiens
ccagccuggccaaca

SEQ ID NO: 1375825 - RNA, 20 nt, Homo sapiens
ccagccugggcagccaggcu

SEQ ID NO: 1375826 - RNA, 23 nt, Homo sapiens
ccagccugugguuacagugcaga

SEQ ID NO: 1375827 - RNA, 18 nt, Homo sapiens
ccagcgagggagaggucg

SEQ ID NO: 1375828 - RNA, 18 nt, Homo sapiens
ccagcgugugacuacucc

SEQ ID NO: 1375829 - RNA, 17 nt, Homo sapiens
ccagcuaaggacauuuc

SEQ ID NO: 1375830 - RNA, 18 nt, Homo sapiens
ccagcucacgucacacuu

SEQ ID NO: 1375831 - RNA, 21 nt, Homo sapiens
ccagcucagucccaucagaga

SEQ ID NO: 1375832 - RNA, 23 nt, Homo sapiens
ccagcugugguuuucuuuugcca

SEQ ID NO: 1375833 - RNA, 23 nt, Homo sapiens
ccaggagacagacagagaaggca

SEQ ID NO: 1375834 - RNA, 13 nt, Homo sapiens
ccaggagacaguu

SEQ ID NO: 1375835 - RNA, 23 nt, Homo sapiens
ccaggagcugggcagaaggccaa

SEQ ID NO: 1375836 - RNA, 22 nt, Homo sapiens
ccaggaguucgaggcugcaguc

SEQ ID NO: 1375837 - RNA, 18 nt, Homo sapiens
ccaggaguuugagaccag

SEQ ID NO: 1375838 - RNA, 19 nt, Homo sapiens
ccaggaugaguuacuugaa

SEQ ID NO: 1375839 - RNA, 16 nt, Homo sapiens
ccaggauggcacuguu

SEQ ID NO: 1375840 - RNA, 18 nt, Homo sapiens
ccaggcaacuugggaacu

SEQ ID NO: 1375841 - RNA, 14 nt, Homo sapiens
ccaggccuccagcu

SEQ ID NO: 1375842 - RNA, 13 nt, Homo sapiens
ccaggcugccuga

SEQ ID NO: 1375843 - RNA, 14 nt, Homo sapiens
ccaggcugccugag

SEQ ID NO: 1375844 - RNA, 16 nt, Homo sapiens
ccaggcugcucagggc

SEQ ID NO: 1375845 - RNA, 17 nt, Homo sapiens
ccaggcuggagugcagu

SEQ ID NO: 1375846 - RNA, 23 nt, Homo sapiens
ccaggcuggcagauuuccaaaag

SEQ ID NO: 1375847 - RNA, 16 nt, Homo sapiens
ccagggacacauuucu

SEQ ID NO: 1375848 - RNA, 22 nt, Homo sapiens
ccaggggaaugaucucugauga

SEQ ID NO: 1375849 - RNA, 13 nt, Homo sapiens
ccaggucagggag

SEQ ID NO: 1375850 - RNA, 21 nt, Homo sapiens
ccaggucucccgggaagccac

SEQ ID NO: 1375851 - RNA, 12 nt, Homo sapiens
ccaggugcacag

SEQ ID NO: 1375852 - RNA, 14 nt, Homo sapiens
ccagguguucuaca

SEQ ID NO: 1375853 - RNA, 12 nt, Homo sapiens
ccagugggcaug

SEQ ID NO: 1375854 - RNA, 20 nt, Homo sapiens
ccaguguguuucugaucuga

SEQ ID NO: 1375855 - RNA, 18 nt, Homo sapiens
ccaguguuguuuguaaau

SEQ ID NO: 1375856 - RNA, 21 nt, Homo sapiens
ccauaaaggggagggacucau

SEQ ID NO: 1375857 - RNA, 20 nt, Homo sapiens
ccauagcaagauugcuuaaa

SEQ ID NO: 1375858 - RNA, 16 nt, Homo sapiens
ccauagcuuccaugag

SEQ ID NO: 1375859 - RNA, 22 nt, Homo sapiens
ccauaggaggccaacccaaaau

SEQ ID NO: 1375860 - RNA, 19 nt, Homo sapiens
ccauauucccacagcacua

SEQ ID NO: 1375861 - RNA, 22 nt, Homo sapiens
ccaucacgcggccgagacaugg

SEQ ID NO: 1375862 - RNA, 14 nt, Homo sapiens
ccaucccaucccau

SEQ ID NO: 1375863 - RNA, 16 nt, Homo sapiens
ccaucuaccccuggau

SEQ ID NO: 1375864 - RNA, 14 nt, Homo sapiens
ccaucucuacuaaa

SEQ ID NO: 1375865 - RNA, 14 nt, Homo sapiens
ccaucuuuccaucc

SEQ ID NO: 1375866 - RNA, 20 nt, Homo sapiens
ccaugaacacguuuuuucac

SEQ ID NO: 1375867 - RNA, 13 nt, Homo sapiens
ccaugaagccaca

SEQ ID NO: 1375868 - RNA, 14 nt, Homo sapiens
ccaugaagccacag

SEQ ID NO: 1375869 - RNA, 17 nt, Homo sapiens
ccaugaggcaaugucag

SEQ ID NO: 1375870 - RNA, 20 nt, Homo sapiens
ccaugaggcaaugucaggaa

SEQ ID NO: 1375871 - RNA, 21 nt, Homo sapiens
ccaugccucuccaacaucuuc

SEQ ID NO: 1375872 - RNA, 16 nt, Homo sapiens
ccaugcuagacaagcu

SEQ ID NO: 1375873 - RNA, 23 nt, Homo sapiens
ccauggcaugggggccucagggc

SEQ ID NO: 1375874 - RNA, 17 nt, Homo sapiens
ccauggcuaaggcacca

SEQ ID NO: 1375875 - RNA, 21 nt, Homo sapiens
ccaugggggcagggcaugacu

SEQ ID NO: 1375876 - RNA, 13 nt, Homo sapiens
ccaugguuuuacu

SEQ ID NO: 1375877 - RNA, 20 nt, Homo sapiens
ccauguaagcaccccuucau

SEQ ID NO: 1375878 - RNA, 16 nt, Homo sapiens
ccauguacaugaagaa

SEQ ID NO: 1375879 - RNA, 19 nt, Homo sapiens
ccaugucgccucugcauuc

SEQ ID NO: 1375880 - RNA, 21 nt, Homo sapiens
ccaugucuuuggacaaccaug

SEQ ID NO: 1375881 - RNA, 16 nt, Homo sapiens
ccaugugugagugugu

SEQ ID NO: 1375882 - RNA, 14 nt, Homo sapiens
ccaugugugugcaa

SEQ ID NO: 1375883 - RNA, 15 nt, Homo sapiens
ccaugugugugcaag

SEQ ID NO: 1375884 - RNA, 16 nt, Homo sapiens
ccaugugugugcaagu

SEQ ID NO: 1375885 - RNA, 15 nt, Homo sapiens
ccauuaaaguucuca

SEQ ID NO: 1375886 - RNA, 13 nt, Homo sapiens
ccauuaccugacu

SEQ ID NO: 1375887 - RNA, 15 nt, Homo sapiens
ccauuagaccaagcu

SEQ ID NO: 1375888 - RNA, 23 nt, Homo sapiens
ccauuccccagccucucuuccua

SEQ ID NO: 1375889 - RNA, 12 nt, Homo sapiens
ccauuuacacuu

SEQ ID NO: 1375890 - RNA, 16 nt, Homo sapiens
ccauuuacacuuuuga

SEQ ID NO: 1375891 - RNA, 14 nt, Homo sapiens
ccauuuugcaaaau

SEQ ID NO: 1375892 - RNA, 23 nt, Homo sapiens
ccauuuuuuucauuguguucucu

SEQ ID NO: 1375893 - RNA, 18 nt, Homo sapiens
cccaacacaaggugggca

SEQ ID NO: 1375894 - RNA, 22 nt, Homo sapiens
cccaacagcacccucuccagau

SEQ ID NO: 1375895 - RNA, 13 nt, Homo sapiens
cccaacaugacug

SEQ ID NO: 1375896 - RNA, 14 nt, Homo sapiens
cccaacgaaaagca

SEQ ID NO: 1375897 - RNA, 16 nt, Homo sapiens
cccaagccugcaguca

SEQ ID NO: 1375898 - RNA, 19 nt, Homo sapiens
cccaagcuggagugcagug

SEQ ID NO: 1375899 - RNA, 18 nt, Homo sapiens
cccaagugaaaucaaagg

SEQ ID NO: 1375900 - RNA, 17 nt, Homo sapiens
cccaauauuuaccagac

SEQ ID NO: 1375901 - RNA, 16 nt, Homo sapiens
cccacaaaaguacaau

SEQ ID NO: 1375902 - RNA, 22 nt, Homo sapiens
cccacacugaccuguguucccu

SEQ ID NO: 1375903 - RNA, 17 nt, Homo sapiens
cccacccccuucucugc

SEQ ID NO: 1375904 - RNA, 21 nt, Homo sapiens
cccacccuccuuucaccacau

SEQ ID NO: 1375905 - RNA, 21 nt, Homo sapiens
cccacugccaaagaacuugga

SEQ ID NO: 1375906 - RNA, 16 nt, Homo sapiens
cccacugcucugguua

SEQ ID NO: 1375907 - RNA, 17 nt, Homo sapiens
cccacuguggcugauuu

SEQ ID NO: 1375908 - RNA, 20 nt, Homo sapiens
cccacuguggcugauuugga

SEQ ID NO: 1375909 - RNA, 12 nt, Homo sapiens
cccacuucaggg

SEQ ID NO: 1375910 - RNA, 23 nt, Homo sapiens
cccacuuuucucucuauuuguau

SEQ ID NO: 1375911 - RNA, 11 nt, Homo sapiens
cuguguuaaaa

SEQ ID NO: 1375912 - RNA, 17 nt, Homo sapiens
cuguuagcauaauguga

SEQ ID NO: 1375913 - RNA, 12 nt, Homo sapiens
cuguucaaggaa

SEQ ID NO: 1375914 - RNA, 14 nt, Homo sapiens
cuguuccuucacau

SEQ ID NO: 1375915 - RNA, 20 nt, Homo sapiens
cuguugaaaagccauguuua

SEQ ID NO: 1375916 - RNA, 19 nt, Homo sapiens
cuguuggccagugugacaa

SEQ ID NO: 1375917 - RNA, 23 nt, Homo sapiens
cuguuuacaaaagcccaauguaa

SEQ ID NO: 1375918 - RNA, 19 nt, Homo sapiens
cuguuuccauagggugaca

SEQ ID NO: 1375919 - RNA, 17 nt, Homo sapiens
cuguuuuaugugcacac

SEQ ID NO: 1375920 - RNA, 12 nt, Homo sapiens
cuuaaaagccau

SEQ ID NO: 1375921 - RNA, 14 nt, Homo sapiens
gaaaagucuacccc

SEQ ID NO: 1375922 - RNA, 20 nt, Homo sapiens
gaaaaguuuccccauuauuu

SEQ ID NO: 1375923 - RNA, 14 nt, Homo sapiens
gaaaauagaacaac

SEQ ID NO: 1375924 - RNA, 16 nt, Homo sapiens
gaaaauauggguugca

SEQ ID NO: 1375925 - RNA, 18 nt, Homo sapiens
gaaaaucucagcaaugau

SEQ ID NO: 1375926 - RNA, 23 nt, Homo sapiens
gaaaaugauugcuuaucaguagu

SEQ ID NO: 1375927 - RNA, 13 nt, Homo sapiens
gaaaaugauuuua

SEQ ID NO: 1375928 - RNA, 11 nt, Homo sapiens
gaaaaugucag

SEQ ID NO: 1375929 - RNA, 14 nt, Homo sapiens
gaaaauuauaucuc

SEQ ID NO: 1375930 - RNA, 22 nt, Homo sapiens
gaaaauuggacauuaagcauca

SEQ ID NO: 1375931 - RNA, 19 nt, Homo sapiens
gaaacaagcaacagaugga

SEQ ID NO: 1375932 - RNA, 15 nt, Homo sapiens
cuugaccucagugaa

SEQ ID NO: 1375933 - RNA, 23 nt, Homo sapiens
cuugacuauuggaggaccaaaaa

SEQ ID NO: 1375934 - RNA, 15 nt, Homo sapiens
cuugagccaguaauu

SEQ ID NO: 1375935 - RNA, 20 nt, Homo sapiens
cuugagggugcuuguucccu

SEQ ID NO: 1375936 - RNA, 14 nt, Homo sapiens
cuugaguguguuac

SEQ ID NO: 1375937 - RNA, 22 nt, Homo sapiens
cuugauaaugggaugaauggaa

SEQ ID NO: 1375938 - RNA, 15 nt, Homo sapiens
cuugauucacaauga

SEQ ID NO: 1375939 - RNA, 16 nt, Homo sapiens
cuugauucacaaugaa

SEQ ID NO: 1375940 - RNA, 18 nt, Homo sapiens
cuugauucagaaccauuu

SEQ ID NO: 1375941 - RNA, 20 nt, Homo sapiens
cuugcagcuguaaacauauu

SEQ ID NO: 1375942 - RNA, 16 nt, Homo sapiens
gaaugcagugguauga

SEQ ID NO: 1375943 - RNA, 16 nt, Homo sapiens
gaauggguuugcuaga

SEQ ID NO: 1375944 - RNA, 15 nt, Homo sapiens
gaauguaaugguggc

SEQ ID NO: 1375945 - RNA, 19 nt, Homo sapiens
gaauguguuauuugucaca

SEQ ID NO: 1375946 - RNA, 14 nt, Homo sapiens
gaauuaaccuggug

SEQ ID NO: 1375947 - RNA, 14 nt, Homo sapiens
gaauuaugcaucug

SEQ ID NO: 1375948 - RNA, 23 nt, Homo sapiens
gaauuaugcaucugcuacugugu

SEQ ID NO: 1375949 - RNA, 13 nt, Homo sapiens
gaauucuugaguu

SEQ ID NO: 1375950 - RNA, 22 nt, Homo sapiens
gaauugauauugaaugauguga

SEQ ID NO: 1375951 - RNA, 19 nt, Homo sapiens
gaauugucuuuggugcuuu

SEQ ID NO: 1375952 - RNA, 20 nt, Homo sapiens
gaauuguuuuuugcucuuuu

SEQ ID NO: 1375953 - RNA, 18 nt, Homo sapiens
gaauuuauaacccaguga

SEQ ID NO: 1375954 - RNA, 18 nt, Homo sapiens
gaauuucaguaaacaaug

SEQ ID NO: 1375955 - RNA, 17 nt, Homo sapiens
gaauuuggccugcacua

SEQ ID NO: 1375956 - RNA, 18 nt, Homo sapiens
gaauuuggguaugaacag

SEQ ID NO: 1375957 - RNA, 14 nt, Homo sapiens
gaauuugguaaauu

SEQ ID NO: 1375958 - RNA, 19 nt, Homo sapiens
gaauuuuuuuuaacauucc

SEQ ID NO: 1375959 - RNA, 18 nt, Homo sapiens
gacaaaauccaugaacaa

SEQ ID NO: 1375960 - RNA, 21 nt, Homo sapiens
gacaaagccaaacucugccag

SEQ ID NO: 1375961 - RNA, 16 nt, Homo sapiens
gacaaauaauaagcaa

SEQ ID NO: 1375962 - RNA, 19 nt, Homo sapiens
gacaacacguuacuagcag

SEQ ID NO: 1375963 - RNA, 17 nt, Homo sapiens
gacaaccccagccaauc

SEQ ID NO: 1375964 - RNA, 19 nt, Homo sapiens
gacaaugaagaugaugcua

SEQ ID NO: 1375965 - RNA, 15 nt, Homo sapiens
gacacacacagcuuc

SEQ ID NO: 1375966 - RNA, 16 nt, Homo sapiens
gacacaggcccggcuc

SEQ ID NO: 1375967 - RNA, 13 nt, Homo sapiens
gacaccaccaagg

SEQ ID NO: 1375968 - RNA, 15 nt, Homo sapiens
gacacggccaugacc

SEQ ID NO: 1375969 - RNA, 17 nt, Homo sapiens
gacacguccaccccagu

SEQ ID NO: 1375970 - RNA, 21 nt, Homo sapiens
gacacucacacggacacucaa

SEQ ID NO: 1375971 - RNA, 15 nt, Homo sapiens
gacacugcaaaggcg

SEQ ID NO: 1375972 - RNA, 22 nt, Homo sapiens
gacacuucuaaaugaagugcaa

SEQ ID NO: 1375973 - RNA, 19 nt, Homo sapiens
gacacuuuggaaguuugug

SEQ ID NO: 1375974 - RNA, 17 nt, Homo sapiens
gacagacagagaaggca

SEQ ID NO: 1375975 - RNA, 15 nt, Homo sapiens
gacagagcaagugag

SEQ ID NO: 1375976 - RNA, 19 nt, Homo sapiens
gacagcauauaaauguaau

SEQ ID NO: 1375977 - RNA, 20 nt, Homo sapiens
gacagcauauaaauguaaua

SEQ ID NO: 1375978 - RNA, 13 nt, Homo sapiens
gacagccuggcac

SEQ ID NO: 1375979 - RNA, 16 nt, Homo sapiens
gacaggaauacuuaac

SEQ ID NO: 1375980 - RNA, 21 nt, Homo sapiens
gacaggacagcauggugcaug

SEQ ID NO: 1375981 - RNA, 23 nt, Homo sapiens
gacaggcacagaugaaugggagu

SEQ ID NO: 1375982 - RNA, 15 nt, Homo sapiens
gacaguauauaacua

SEQ ID NO: 1375983 - RNA, 16 nt, Homo sapiens
gacagugaacauucug

SEQ ID NO: 1375984 - RNA, 17 nt, Homo sapiens
gacaguguuuucuggga

SEQ ID NO: 1375985 - RNA, 21 nt, Homo sapiens
gacauaaaugaggaaacucca

SEQ ID NO: 1375986 - RNA, 16 nt, Homo sapiens
gacaugggauggggga

SEQ ID NO: 1375987 - RNA, 21 nt, Homo sapiens
gacauuaacaguuuuccauga

SEQ ID NO: 1375988 - RNA, 23 nt, Homo sapiens
gacauugauacagugaagauaca

SEQ ID NO: 1375989 - RNA, 15 nt, Homo sapiens
gaccaacugggccca

SEQ ID NO: 1375990 - RNA, 22 nt, Homo sapiens
gaccaagcaggaagcucagacu

SEQ ID NO: 1375991 - RNA, 17 nt, Homo sapiens
gaccaagcuuguccaac

SEQ ID NO: 1375992 - RNA, 23 nt, Homo sapiens
gaccacacuuccuguccagagag

SEQ ID NO: 1375993 - RNA, 17 nt, Homo sapiens
gaccacugggcaaugau

SEQ ID NO: 1375994 - RNA, 24 nt, Homo sapiens
gaccacugggcaaugauggcaauu

SEQ ID NO: 1375995 - RNA, 22 nt, Homo sapiens
gaccacuuuccccgugggccau

SEQ ID NO: 1375996 - RNA, 14 nt, Homo sapiens
gaccagaaguggac

SEQ ID NO: 1375997 - RNA, 22 nt, Homo sapiens
gaccagagcucuggagccaccu

SEQ ID NO: 1375998 - RNA, 17 nt, Homo sapiens
gaccaguuguugauaac

SEQ ID NO: 1375999 - RNA, 15 nt, Homo sapiens
gaccauaaagggaaa

SEQ ID NO: 1376000 - RNA, 16 nt, Homo sapiens
gaccauccuauuuaac

SEQ ID NO: 1376001 - RNA, 22 nt, Homo sapiens
gaccauuuuuacauccaugaaa

SEQ ID NO: 1376002 - RNA, 18 nt, Homo sapiens
gacccagggaugacaugu

SEQ ID NO: 1376003 - RNA, 23 nt, Homo sapiens
gacccagucagaguugugcacau

SEQ ID NO: 1376004 - RNA, 20 nt, Homo sapiens
gacccaucacgccugugcag

SEQ ID NO: 1376005 - RNA, 18 nt, Homo sapiens
gaccccugucucccaaaa

SEQ ID NO: 1376006 - RNA, 18 nt, Homo sapiens
gacccuaaaucugaggaa

SEQ ID NO: 1376007 - RNA, 21 nt, Homo sapiens
gacccuacuucuuuugcucuu

SEQ ID NO: 1376008 - RNA, 14 nt, Homo sapiens
gacccuauugcugc

SEQ ID NO: 1376009 - RNA, 20 nt, Homo sapiens
gacccucugacccuagcucu

SEQ ID NO: 1376010 - RNA, 15 nt, Homo sapiens
gacccuucccuugag

SEQ ID NO: 1376011 - RNA, 15 nt, Homo sapiens
gaccgugugugaaau

SEQ ID NO: 1376012 - RNA, 15 nt, Homo sapiens
gaccuaacauucgau

SEQ ID NO: 1376013 - RNA, 17 nt, Homo sapiens
gaccuaugagcacauag

SEQ ID NO: 1376014 - RNA, 16 nt, Homo sapiens
gaccucauuccuggga

SEQ ID NO: 1376015 - RNA, 21 nt, Homo sapiens
gaccucuauauuugcucuuuu

SEQ ID NO: 1376016 - RNA, 18 nt, Homo sapiens
gaccucugccugaaguca

SEQ ID NO: 1376017 - RNA, 20 nt, Homo sapiens
gaccugccaggcacacugag

SEQ ID NO: 1376018 - RNA, 12 nt, Homo sapiens
gaccuggcacug

SEQ ID NO: 1376019 - RNA, 22 nt, Homo sapiens
gaccugugaccagcacugucuc

SEQ ID NO: 1376020 - RNA, 12 nt, Homo sapiens
gaccuguguucc

SEQ ID NO: 1376021 - RNA, 19 nt, Homo sapiens
gaccuuaucugugcgugaa

SEQ ID NO: 1376022 - RNA, 22 nt, Homo sapiens
gaccuucuaggaagcuccaguu

SEQ ID NO: 1376023 - RNA, 22 nt, Homo sapiens
gacgggcaaaauaaagugacag

SEQ ID NO: 1376024 - RNA, 21 nt, Homo sapiens
gacguuggccuaacacugggc

SEQ ID NO: 1376025 - RNA, 18 nt, Homo sapiens
gacuaaccucuaacaaca

SEQ ID NO: 1376026 - RNA, 16 nt, Homo sapiens
gacuaauggaaauauu

SEQ ID NO: 1376027 - RNA, 17 nt, Homo sapiens
gacuagaggcuugcaua

SEQ ID NO: 1376028 - RNA, 13 nt, Homo sapiens
gacuagugcugaa

SEQ ID NO: 1376029 - RNA, 14 nt, Homo sapiens
gacuaucaguuccc

SEQ ID NO: 1376030 - RNA, 18 nt, Homo sapiens
gacuauguuucuauucua

SEQ ID NO: 1376031 - RNA, 18 nt, Homo sapiens
gacuauuugcuuauuuaa

SEQ ID NO: 1376032 - RNA, 13 nt, Homo sapiens
gacucaaacugcc

SEQ ID NO: 1376033 - RNA, 19 nt, Homo sapiens
gacucagggccccagcacu

SEQ ID NO: 1376034 - RNA, 21 nt, Homo sapiens
gacucagggccccagcacuaa

SEQ ID NO: 1376035 - RNA, 14 nt, Homo sapiens
gacuccagaucugc

SEQ ID NO: 1376036 - RNA, 16 nt, Homo sapiens
gacuccgucucaagga

SEQ ID NO: 1376037 - RNA, 13 nt, Homo sapiens
gacuccucaaaag

SEQ ID NO: 1376038 - RNA, 17 nt, Homo sapiens
gacuccugugcaacuuu

SEQ ID NO: 1376039 - RNA, 22 nt, Homo sapiens
gacugagagacaggacuagcug

SEQ ID NO: 1376040 - RNA, 16 nt, Homo sapiens
gacugagcagacuggu

SEQ ID NO: 1376041 - RNA, 15 nt, Homo sapiens
gacugagcucaaggu

SEQ ID NO: 1376042 - RNA, 17 nt, Homo sapiens
gagucagcagaacuggg

SEQ ID NO: 1376043 - RNA, 15 nt, Homo sapiens
gaguccucacuccca

SEQ ID NO: 1376044 - RNA, 16 nt, Homo sapiens
gaguccuccuguccag

SEQ ID NO: 1376045 - RNA, 20 nt, Homo sapiens
gaguccucguagccaucucu

SEQ ID NO: 1376046 - RNA, 17 nt, Homo sapiens
gagucucacuguugccc

SEQ ID NO: 1376047 - RNA, 14 nt, Homo sapiens
gagucugaagcaga

SEQ ID NO: 1376048 - RNA, 17 nt, Homo sapiens
gagugaaacauugaacu

SEQ ID NO: 1376049 - RNA, 18 nt, Homo sapiens
gagugauucuugcugcua

SEQ ID NO: 1376050 - RNA, 19 nt, Homo sapiens
gagugcauugugaggguua

SEQ ID NO: 1376051 - RNA, 23 nt, Homo sapiens
gagugcccagaacuggacucagg

SEQ ID NO: 1376052 - RNA, 21 nt, Homo sapiens
gagugccguaacaacuguggu

SEQ ID NO: 1376053 - RNA, 19 nt, Homo sapiens
gaguggaacagaaggggug

SEQ ID NO: 1376054 - RNA, 16 nt, Homo sapiens
gaguggguuucacaag

SEQ ID NO: 1376055 - RNA, 11 nt, Homo sapiens
gaguuaccuac

SEQ ID NO: 1376056 - RNA, 17 nt, Homo sapiens
gaguuacuuccuaucaa

SEQ ID NO: 1376057 - RNA, 18 nt, Homo sapiens
gaguugggacaauugcuu

SEQ ID NO: 1376058 - RNA, 17 nt, Homo sapiens
gaguugucaagucucug

SEQ ID NO: 1376059 - RNA, 16 nt, Homo sapiens
gauaaagaugcaagga

SEQ ID NO: 1376060 - RNA, 23 nt, Homo sapiens
gauaacacaaguaaaacuguggu

SEQ ID NO: 1376061 - RNA, 22 nt, Homo sapiens
gauaaggacgggaccauuuuua

SEQ ID NO: 1376062 - RNA, 15 nt, Homo sapiens
gauaaguguccccua

SEQ ID NO: 1376063 - RNA, 19 nt, Homo sapiens
gauacacuaugaagauguu

SEQ ID NO: 1376064 - RNA, 21 nt, Homo sapiens
gauacagaugacaaugggagc

SEQ ID NO: 1376065 - RNA, 20 nt, Homo sapiens
gauacaugguugugaccuga

SEQ ID NO: 1376066 - RNA, 21 nt, Homo sapiens
gauacccauagcuuccaugag

SEQ ID NO: 1376067 - RNA, 21 nt, Homo sapiens
gauaccucaacccccauuucu

SEQ ID NO: 1376068 - RNA, 19 nt, Homo sapiens
gauacuccaaccauaugga

SEQ ID NO: 1376069 - RNA, 22 nt, Homo sapiens
gauacugcucaucauuccuuga

SEQ ID NO: 1376070 - RNA, 14 nt, Homo sapiens
gauacugcugccaa

SEQ ID NO: 1376071 - RNA, 20 nt, Homo sapiens
gauagauauaugcucugcau

SEQ ID NO: 1376072 - RNA, 14 nt, Homo sapiens
gauaguccaaagac

SEQ ID NO: 1376073 - RNA, 15 nt, Homo sapiens
gauaguccaaagacu

SEQ ID NO: 1376074 - RNA, 12 nt, Homo sapiens
gauagucugucc

SEQ ID NO: 1376075 - RNA, 18 nt, Homo sapiens
gauauagaucacauaaca

SEQ ID NO: 1376076 - RNA, 21 nt, Homo sapiens
gauauaggucagugaggccca

SEQ ID NO: 1376077 - RNA, 17 nt, Homo sapiens
gauaucaaaagcaaaua

SEQ ID NO: 1376078 - RNA, 19 nt, Homo sapiens
gauaugaugucccuaugga

SEQ ID NO: 1376079 - RNA, 14 nt, Homo sapiens
gauaugcacuugaa

SEQ ID NO: 1376080 - RNA, 17 nt, Homo sapiens
gauauguucaacuggag

SEQ ID NO: 1376081 - RNA, 12 nt, Homo sapiens
gaucacauaaca

SEQ ID NO: 1376082 - RNA, 17 nt, Homo sapiens
gaucacgccacugcacu

SEQ ID NO: 1376083 - RNA, 14 nt, Homo sapiens
gaucaugcauuguu

SEQ ID NO: 1376084 - RNA, 14 nt, Homo sapiens
gauccaagcugguc

SEQ ID NO: 1376085 - RNA, 18 nt, Homo sapiens
gaucccaagacaaugaaa

SEQ ID NO: 1376086 - RNA, 20 nt, Homo sapiens
gauccccaaaacaggccagg

SEQ ID NO: 1376087 - RNA, 19 nt, Homo sapiens
gaucuaagccuuuccauaa

SEQ ID NO: 1376088 - RNA, 20 nt, Homo sapiens
gaucuaauauugacugccuc

SEQ ID NO: 1376089 - RNA, 23 nt, Homo sapiens
gaucucggcucauguagccucaa

SEQ ID NO: 1376090 - RNA, 17 nt, Homo sapiens
gaucugggaacucccaa

SEQ ID NO: 1376091 - RNA, 17 nt, Homo sapiens
gaucuggucccuugcag

SEQ ID NO: 1376092 - RNA, 21 nt, Homo sapiens
gaucuguuuuuaaaaaucaua

SEQ ID NO: 1376093 - RNA, 12 nt, Homo sapiens
gaugaagcuucc

SEQ ID NO: 1376094 - RNA, 17 nt, Homo sapiens
gaugaaguuaucuggcu

SEQ ID NO: 1376095 - RNA, 19 nt, Homo sapiens
gaugacaaugggagccuca

SEQ ID NO: 1376096 - RNA, 13 nt, Homo sapiens
gaugagaguacac

SEQ ID NO: 1376097 - RNA, 15 nt, Homo sapiens
gaugcaaugugcuac

SEQ ID NO: 1376098 - RNA, 18 nt, Homo sapiens
gaugcagaaaauugccua

SEQ ID NO: 1376099 - RNA, 16 nt, Homo sapiens
gaugcagagucagcag

SEQ ID NO: 1376100 - RNA, 16 nt, Homo sapiens
gaugccuucuccagac

SEQ ID NO: 1376101 - RNA, 13 nt, Homo sapiens
gaugcugucuucg

SEQ ID NO: 1376102 - RNA, 19 nt, Homo sapiens
gauggaaacaaaguggaag

SEQ ID NO: 1376103 - RNA, 19 nt, Homo sapiens
gauggaggggugguccuga

SEQ ID NO: 1376104 - RNA, 15 nt, Homo sapiens
gauggauaagcuugu

SEQ ID NO: 1376105 - RNA, 21 nt, Homo sapiens
gauggauaucccuaccuugaa

SEQ ID NO: 1376106 - RNA, 21 nt, Homo sapiens
gauggcugacuuugcucuuuc

SEQ ID NO: 1376107 - RNA, 15 nt, Homo sapiens
gaugggggaugcuuc

SEQ ID NO: 1376108 - RNA, 13 nt, Homo sapiens
gauguaagagcuu

SEQ ID NO: 1376109 - RNA, 17 nt, Homo sapiens
gaugugcagauaucaca

SEQ ID NO: 1376110 - RNA, 15 nt, Homo sapiens
gaugugucuuaccag

SEQ ID NO: 1376111 - RNA, 16 nt, Homo sapiens
gaugugucuuaccaga

SEQ ID NO: 1376112 - RNA, 19 nt, Homo sapiens
gauguguuaggaaugucaa

SEQ ID NO: 1376113 - RNA, 18 nt, Homo sapiens
gauguuaggcugggccca

SEQ ID NO: 1376114 - RNA, 20 nt, Homo sapiens
gauguucugacccugcuuca

SEQ ID NO: 1376115 - RNA, 18 nt, Homo sapiens
gauguugcuggacuguca

SEQ ID NO: 1376116 - RNA, 19 nt, Homo sapiens
gauguuucuggaauugaua

SEQ ID NO: 1376117 - RNA, 20 nt, Homo sapiens
gauuaaacaaacaaacaauu

SEQ ID NO: 1376118 - RNA, 22 nt, Homo sapiens
gauuacaagcgugagccacugc

SEQ ID NO: 1376119 - RNA, 21 nt, Homo sapiens
gauuaccuaguagucauuuca

SEQ ID NO: 1376120 - RNA, 17 nt, Homo sapiens
gauuauagugacaauga

SEQ ID NO: 1376121 - RNA, 18 nt, Homo sapiens
gauuaucaauuaccacac

SEQ ID NO: 1376122 - RNA, 15 nt, Homo sapiens
gauuauuuaucacau

SEQ ID NO: 1376123 - RNA, 21 nt, Homo sapiens
gauucauauuuacuucuuaua

SEQ ID NO: 1376124 - RNA, 14 nt, Homo sapiens
gauucaugccaauu

SEQ ID NO: 1376125 - RNA, 13 nt, Homo sapiens
gauucccagagac

SEQ ID NO: 1376126 - RNA, 18 nt, Homo sapiens
gauuccuuuucuuguuua

SEQ ID NO: 1376127 - RNA, 15 nt, Homo sapiens
gauucucaugccuca

SEQ ID NO: 1376128 - RNA, 15 nt, Homo sapiens
gauucuucucuuaau

SEQ ID NO: 1376129 - RNA, 18 nt, Homo sapiens
gauucuugacauucacuu

SEQ ID NO: 1376130 - RNA, 14 nt, Homo sapiens
gauucuuuguuaca

SEQ ID NO: 1376131 - RNA, 16 nt, Homo sapiens
gauugcuuaucaguag

SEQ ID NO: 1376132 - RNA, 18 nt, Homo sapiens
gauuggcaggaguuggaa

SEQ ID NO: 1376133 - RNA, 18 nt, Homo sapiens
gauugucuuacuguugca

SEQ ID NO: 1376134 - RNA, 13 nt, Homo sapiens
gauuucaggauac

SEQ ID NO: 1376135 - RNA, 15 nt, Homo sapiens
gauuucaugauuuca

SEQ ID NO: 1376136 - RNA, 17 nt, Homo sapiens
gauuugggcucuuggaa

SEQ ID NO: 1376137 - RNA, 15 nt, Homo sapiens
gauuuuaacaauaac

SEQ ID NO: 1376138 - RNA, 18 nt, Homo sapiens
gauuuuacaaaagaugua

SEQ ID NO: 1376139 - RNA, 20 nt, Homo sapiens
gauuuugaaauuuuuauuaa

SEQ ID NO: 1376140 - RNA, 17 nt, Homo sapiens
gauuuuuagcuuuacaa

SEQ ID NO: 1376141 - RNA, 19 nt, Homo sapiens
guauuugaaaacucacaga

SEQ ID NO: 1376142 - RNA, 22 nt, Homo sapiens
guauuuuccaacuuguucaaau

SEQ ID NO: 1376143 - RNA, 16 nt, Homo sapiens
guauuuuuaguagaga

SEQ ID NO: 1376144 - RNA, 19 nt, Homo sapiens
gucaaaaggaagucucuag

SEQ ID NO: 1376145 - RNA, 12 nt, Homo sapiens
gucaaagcagua

SEQ ID NO: 1376146 - RNA, 17 nt, Homo sapiens
gucaaagugaugaauau

SEQ ID NO: 1376147 - RNA, 22 nt, Homo sapiens
gucaacccaauaguuguugauu

SEQ ID NO: 1376148 - RNA, 15 nt, Homo sapiens
gucaacuccuuucuc

SEQ ID NO: 1376149 - RNA, 14 nt, Homo sapiens
gucaaggccagcaa

SEQ ID NO: 1376150 - RNA, 17 nt, Homo sapiens
gucaagugaaggagcug

SEQ ID NO: 1376151 - RNA, 19 nt, Homo sapiens
gucaauaaaaccacuguac

SEQ ID NO: 1376152 - RNA, 17 nt, Homo sapiens
gucaauaggcaaagggg

SEQ ID NO: 1376153 - RNA, 14 nt, Homo sapiens
gucacaaaggaaug

SEQ ID NO: 1376154 - RNA, 14 nt, Homo sapiens
gucacaauccuaac

SEQ ID NO: 1376155 - RNA, 21 nt, Homo sapiens
gucacaauccuaacacauuau

SEQ ID NO: 1376156 - RNA, 13 nt, Homo sapiens
gucacagccacuu

SEQ ID NO: 1376157 - RNA, 18 nt, Homo sapiens
gucacagccacuugggau

SEQ ID NO: 1376158 - RNA, 22 nt, Homo sapiens
gugccucugggacuggacaauu

SEQ ID NO: 1376159 - RNA, 16 nt, Homo sapiens
gugcgcaauugcucau

SEQ ID NO: 1376160 - RNA, 16 nt, Homo sapiens
gugcgugcaugugcac

SEQ ID NO: 1376161 - RNA, 17 nt, Homo sapiens
gugcgugugcgugcaug

SEQ ID NO: 1376162 - RNA, 21 nt, Homo sapiens
gugcuaugaauuuucaaguaa

SEQ ID NO: 1376163 - RNA, 22 nt, Homo sapiens
gugcucauucauuuaacagagc

SEQ ID NO: 1376164 - RNA, 13 nt, Homo sapiens
gugcugugacucg

SEQ ID NO: 1376165 - RNA, 18 nt, Homo sapiens
gugcuguggccugggcaa

SEQ ID NO: 1376166 - RNA, 15 nt, Homo sapiens
gugcuucagccugag

SEQ ID NO: 1376167 - RNA, 21 nt, Homo sapiens
gugcuuuccguggcacugcau

SEQ ID NO: 1376168 - RNA, 17 nt, Homo sapiens
guggaacgaacuuucca

SEQ ID NO: 1376169 - RNA, 22 nt, Homo sapiens
guggaacgaacuuuccauggga

SEQ ID NO: 1376170 - RNA, 18 nt, Homo sapiens
guggaagaagaaaacacu

SEQ ID NO: 1376171 - RNA, 22 nt, Homo sapiens
guggaaguuaaagggcauuucc

SEQ ID NO: 1376172 - RNA, 23 nt, Homo sapiens
guggaauauaaggaaagcaauaa

SEQ ID NO: 1376173 - RNA, 21 nt, Homo sapiens
guggagaaauuccuugauuca

SEQ ID NO: 1376174 - RNA, 23 nt, Homo sapiens
guggaucaccugaggucaggagu

SEQ ID NO: 1376175 - RNA, 22 nt, Homo sapiens
uagccugccucuucucuacucu

SEQ ID NO: 1376176 - RNA, 20 nt, Homo sapiens
uagcgcugcucuuaugccau

SEQ ID NO: 1376177 - RNA, 13 nt, Homo sapiens
uagcggucaauuu

SEQ ID NO: 1376178 - RNA, 21 nt, Homo sapiens
uagcuaccucacuaugcugcu

SEQ ID NO: 1376179 - RNA, 22 nt, Homo sapiens
uagcuaccucacuaugcugcuu

SEQ ID NO: 1376180 - RNA, 15 nt, Homo sapiens
uagcuauauccaugu

SEQ ID NO: 1376181 - RNA, 15 nt, Homo sapiens
uagcugucugcucag

SEQ ID NO: 1376182 - RNA, 15 nt, Homo sapiens
uagcuuagaccucag

SEQ ID NO: 1376183 - RNA, 16 nt, Homo sapiens
uagcuuagaccucagc

SEQ ID NO: 1376184 - RNA, 19 nt, Homo sapiens
uagcuugcaccuugucaca

SEQ ID NO: 1376185 - RNA, 10 nt, Homo sapiens
uaggaaaauu

SEQ ID NO: 1376186 - RNA, 14 nt, Homo sapiens
uaggaaaauuucac

SEQ ID NO: 1376187 - RNA, 16 nt, Homo sapiens
uaggaagaccaagaca

SEQ ID NO: 1376188 - RNA, 20 nt, Homo sapiens
uaggaaguauggcaugaaca

SEQ ID NO: 1376189 - RNA, 16 nt, Homo sapiens
uaggaauaaauaaaaa

SEQ ID NO: 1376190 - RNA, 13 nt, Homo sapiens
uaggacagcauau

SEQ ID NO: 1376191 - RNA, 19 nt, Homo sapiens
uaggagaaaccagcuuuua

SEQ ID NO: 1376192 - RNA, 15 nt, Homo sapiens
uagggaugugugaga

SEQ ID NO: 1376193 - RNA, 13 nt, Homo sapiens
uaggggcaaaaau

SEQ ID NO: 1376194 - RNA, 12 nt, Homo sapiens
uagguagcuuua

SEQ ID NO: 1376195 - RNA, 20 nt, Homo sapiens
uagguaggggcccacuucac

SEQ ID NO: 1376196 - RNA, 20 nt, Homo sapiens
uaggugacagagugagacuc

SEQ ID NO: 1376197 - RNA, 14 nt, Homo sapiens
uagguuuuguacaa

SEQ ID NO: 1376198 - RNA, 19 nt, Homo sapiens
uaguaacuuuccauagggc

SEQ ID NO: 1376199 - RNA, 21 nt, Homo sapiens
uaguaagaaaacaucacugaa

SEQ ID NO: 1376200 - RNA, 15 nt, Homo sapiens
uaguacccaccugag

SEQ ID NO: 1376201 - RNA, 23 nt, Homo sapiens
uaguacuugggagaccuguaauc

SEQ ID NO: 1376202 - RNA, 17 nt, Homo sapiens
uaguauauuaaaaaugg

SEQ ID NO: 1376203 - RNA, 20 nt, Homo sapiens
uagucaaggaggaaagggau

SEQ ID NO: 1376204 - RNA, 22 nt, Homo sapiens
uagucacagagauaauucuagc

SEQ ID NO: 1376205 - RNA, 20 nt, Homo sapiens
uagugcauuaguggggagga

SEQ ID NO: 1376206 - RNA, 16 nt, Homo sapiens
uagugcuaguggauuu

SEQ ID NO: 1376207 - RNA, 17 nt, Homo sapiens
uagugcugaagcuuauu

SEQ ID NO: 1376208 - RNA, 14 nt, Homo sapiens
uaguggugacugug

SEQ ID NO: 1376209 - RNA, 14 nt, Homo sapiens
uagugguuacccag

SEQ ID NO: 1376210 - RNA, 14 nt, Homo sapiens
uagugucacugcuu

SEQ ID NO: 1376211 - RNA, 12 nt, Homo sapiens
uagugucacuua

SEQ ID NO: 1376212 - RNA, 15 nt, Homo sapiens
uaguuacuauaugcc

SEQ ID NO: 1376213 - RNA, 15 nt, Homo sapiens
uaguucauccaaucc

SEQ ID NO: 1376214 - RNA, 13 nt, Homo sapiens
uaguuccugauga

SEQ ID NO: 1376215 - RNA, 19 nt, Homo sapiens
uaguucuauuucuauccca

SEQ ID NO: 1376216 - RNA, 15 nt, Homo sapiens
uaguucuucauccca

SEQ ID NO: 1376217 - RNA, 21 nt, Homo sapiens
uaguugaucuacaaaggccau

SEQ ID NO: 1376218 - RNA, 23 nt, Homo sapiens
uaguugaucuacaaaggccaugg

SEQ ID NO: 1376219 - RNA, 19 nt, Homo sapiens
uaguuuaggagaaaccagc

SEQ ID NO: 1376220 - RNA, 22 nt, Homo sapiens
uaguuuguaugccaagugagaa

SEQ ID NO: 1376221 - RNA, 16 nt, Homo sapiens
uaguuuuaguugcaga

SEQ ID NO: 1376222 - RNA, 23 nt, Homo sapiens
uaguuuugauccuaaaucugccu

SEQ ID NO: 1376223 - RNA, 22 nt, Homo sapiens
uauaaagcaucuaaacuuuaau

SEQ ID NO: 1376224 - RNA, 19 nt, Homo sapiens
uauaaaggccagcgccaga

SEQ ID NO: 1376225 - RNA, 16 nt, Homo sapiens
uauaaaucaaugucac

SEQ ID NO: 1376226 - RNA, 23 nt, Homo sapiens
uauaaauuuucccaaaacugaua

SEQ ID NO: 1376227 - RNA, 19 nt, Homo sapiens
uauaacccagugaguucag

SEQ ID NO: 1376228 - RNA, 22 nt, Homo sapiens
uauaacuuuugguaucuacuuc

SEQ ID NO: 1376229 - RNA, 14 nt, Homo sapiens
uauaagaauuacua

SEQ ID NO: 1376230 - RNA, 17 nt, Homo sapiens
uauaagaauuacuaaau

SEQ ID NO: 1376231 - RNA, 22 nt, Homo sapiens
uauaaucuuccauacuucuuca

SEQ ID NO: 1376232 - RNA, 17 nt, Homo sapiens
uauaauguaagcucuac

SEQ ID NO: 1376233 - RNA, 20 nt, Homo sapiens
uauaauuuccauagugugag

SEQ ID NO: 1376234 - RNA, 14 nt, Homo sapiens
uauacagcucagcu

SEQ ID NO: 1376235 - RNA, 18 nt, Homo sapiens
uauacaguuuaccgaaaa

SEQ ID NO: 1376236 - RNA, 15 nt, Homo sapiens
uauacauuaacuuca

SEQ ID NO: 1376237 - RNA, 20 nt, Homo sapiens
uauacccguuucacaugcuu

SEQ ID NO: 1376238 - RNA, 16 nt, Homo sapiens
uauagauauguagaua

SEQ ID NO: 1376239 - RNA, 16 nt, Homo sapiens
uauagccaccccaaga

SEQ ID NO: 1376240 - RNA, 14 nt, Homo sapiens
uauagucacaagag

SEQ ID NO: 1376241 - RNA, 16 nt, Homo sapiens
uauaguuuauugacaa

SEQ ID NO: 1376242 - RNA, 16 nt, Homo sapiens
uauauaacaacaaacu

SEQ ID NO: 1376243 - RNA, 16 nt, Homo sapiens
uauauaugugugugua

SEQ ID NO: 1376244 - RNA, 19 nt, Homo sapiens
uauauauuuauaacucauc

SEQ ID NO: 1376245 - RNA, 12 nt, Homo sapiens
uauauccaugua

SEQ ID NO: 1376246 - RNA, 12 nt, Homo sapiens
uauaucuauuac

SEQ ID NO: 1376247 - RNA, 15 nt, Homo sapiens
uauauggggggccaa

SEQ ID NO: 1376248 - RNA, 16 nt, Homo sapiens
uauauguauaugcaau

SEQ ID NO: 1376249 - RNA, 13 nt, Homo sapiens
uauauguaugugu

SEQ ID NO: 1376250 - RNA, 13 nt, Homo sapiens
uauauuauggaag

SEQ ID NO: 1376251 - RNA, 19 nt, Homo sapiens
uauauuguuuucaguguac

SEQ ID NO: 1376252 - RNA, 14 nt, Homo sapiens
uaucaaaauugcaa

SEQ ID NO: 1376253 - RNA, 19 nt, Homo sapiens
uaucaaacuagugcaugaa

SEQ ID NO: 1376254 - RNA, 20 nt, Homo sapiens
uaucaaugaguaacaggaaa

SEQ ID NO: 1376255 - RNA, 21 nt, Homo sapiens
uaucaauguuuguccuguaua

SEQ ID NO: 1376256 - RNA, 15 nt, Homo sapiens
uaucaauuaccacac

SEQ ID NO: 1376257 - RNA, 14 nt, Homo sapiens
uaucacacaaagca

SEQ ID NO: 1376258 - RNA, 14 nt, Homo sapiens
uaucacgauauuau

SEQ ID NO: 1376259 - RNA, 15 nt, Homo sapiens
uaucagaauucucag

SEQ ID NO: 1376260 - RNA, 19 nt, Homo sapiens
uaucaguaguaucaaugau

SEQ ID NO: 1376261 - RNA, 21 nt, Homo sapiens
uaucaguugagcuucauauac

SEQ ID NO: 1376262 - RNA, 14 nt, Homo sapiens
uaucauucagcaac

SEQ ID NO: 1376263 - RNA, 19 nt, Homo sapiens
uaucauuuucugcauuuaa

SEQ ID NO: 1376264 - RNA, 17 nt, Homo sapiens
uauccacuuaccuagau

SEQ ID NO: 1376265 - RNA, 11 nt, Homo sapiens
uauccaugccu

SEQ ID NO: 1376266 - RNA, 18 nt, Homo sapiens
uaucccaaacuaagcuau

SEQ ID NO: 1376267 - RNA, 14 nt, Homo sapiens
uaucccuaugcugc

SEQ ID NO: 1376268 - RNA, 20 nt, Homo sapiens
uauccucugaccuacauacg

SEQ ID NO: 1376269 - RNA, 14 nt, Homo sapiens
uaucuaaaccauau

SEQ ID NO: 1376270 - RNA, 23 nt, Homo sapiens
uaucuaauauguaacaagccacc

SEQ ID NO: 1376271 - RNA, 15 nt, Homo sapiens
uaucuacuucuacau

SEQ ID NO: 1376272 - RNA, 13 nt, Homo sapiens
uaucuaucuuaua

SEQ ID NO: 1376273 - RNA, 21 nt, Homo sapiens
uaucuauggcacccaugcacc

SEQ ID NO: 1376274 - RNA, 16 nt, Homo sapiens
uaucucacagcacacu

SEQ ID NO: 1376275 - RNA, 11 nt, Homo sapiens
uaucugugaaa

SEQ ID NO: 1376276 - RNA, 21 nt, Homo sapiens
uaucuguguagacuauuugcu

SEQ ID NO: 1376277 - RNA, 17 nt, Homo sapiens
uaucuguguuugcugag

SEQ ID NO: 1376278 - RNA, 15 nt, Homo sapiens
uaucuuaaagcacuu

SEQ ID NO: 1376279 - RNA, 16 nt, Homo sapiens
uaucuuacaaagugua

SEQ ID NO: 1376280 - RNA, 16 nt, Homo sapiens
uaucuugcagcuguaa

SEQ ID NO: 1376281 - RNA, 23 nt, Homo sapiens
uaucuugcagcuguaaacauauu

SEQ ID NO: 1376282 - RNA, 20 nt, Homo sapiens
uaugaaaacagcuaucucac

SEQ ID NO: 1376283 - RNA, 19 nt, Homo sapiens
uaugaaaauacaacuuaaa

SEQ ID NO: 1376284 - RNA, 22 nt, Homo sapiens
uaugaauauuuauaacagcauu

SEQ ID NO: 1376285 - RNA, 16 nt, Homo sapiens
uaugaauuaagcugua

SEQ ID NO: 1376286 - RNA, 23 nt, Homo sapiens
uaugaggaugcagagucagcaga

SEQ ID NO: 1376287 - RNA, 18 nt, Homo sapiens
uaugaugucccuauggaa

SEQ ID NO: 1376288 - RNA, 17 nt, Homo sapiens
uacauauauaugucagg

SEQ ID NO: 1376289 - RNA, 14 nt, Homo sapiens
uacauaugcuuuaa

SEQ ID NO: 1376290 - RNA, 15 nt, Homo sapiens
uacauaugugaauau

SEQ ID NO: 1376291 - RNA, 14 nt, Homo sapiens
uacaucugucaugg

SEQ ID NO: 1376292 - RNA, 19 nt, Homo sapiens
uacaugcaaggcacuguac

SEQ ID NO: 1376293 - RNA, 18 nt, Homo sapiens
uacaugcauacacucuca

SEQ ID NO: 1376294 - RNA, 17 nt, Homo sapiens
uacaugggguuuucaau

SEQ ID NO: 1376295 - RNA, 19 nt, Homo sapiens
uacauuaaagcagucacuu

SEQ ID NO: 1376296 - RNA, 16 nt, Homo sapiens
uacauucaacagauca

SEQ ID NO: 1376297 - RNA, 20 nt, Homo sapiens
uacauuuaaacuugucaggg

SEQ ID NO: 1376298 - RNA, 17 nt, Homo sapiens
uacauuucaccuacuuu

SEQ ID NO: 1376299 - RNA, 13 nt, Homo sapiens
uacauuuccaaau

SEQ ID NO: 1376300 - RNA, 16 nt, Homo sapiens
uaccaaaauuauuuca

SEQ ID NO: 1376301 - RNA, 15 nt, Homo sapiens
uaccaaauaccaugu

SEQ ID NO: 1376302 - RNA, 17 nt, Homo sapiens
uaccaaccugaagacac

SEQ ID NO: 1376303 - RNA, 15 nt, Homo sapiens
uaccaagcugugacc

SEQ ID NO: 1376304 - RNA, 18 nt, Homo sapiens
uaccacagugucuguauc

SEQ ID NO: 1376305 - RNA, 12 nt, Homo sapiens
uaccagaaccac

SEQ ID NO: 1376306 - RNA, 20 nt, Homo sapiens
uaccagacgguucaccagcc

SEQ ID NO: 1376307 - RNA, 12 nt, Homo sapiens
uaccaugcugaa

SEQ ID NO: 1376308 - RNA, 13 nt, Homo sapiens
uaccauguggcaa

SEQ ID NO: 1376309 - RNA, 22 nt, Homo sapiens
uaccauuuguaauaaaguauau

SEQ ID NO: 1376310 - RNA, 21 nt, Homo sapiens
uacccaccugagcuuuggaca

SEQ ID NO: 1376311 - RNA, 20 nt, Homo sapiens
uacccaggcuggagugcagu

SEQ ID NO: 1376312 - RNA, 13 nt, Homo sapiens
uaccggcaauuuc

SEQ ID NO: 1376313 - RNA, 17 nt, Homo sapiens
uaccuaccacagugucu

SEQ ID NO: 1376314 - RNA, 14 nt, Homo sapiens
uaccucacuggggu

SEQ ID NO: 1376315 - RNA, 18 nt, Homo sapiens
uaccugaccaacaguucc

SEQ ID NO: 1376316 - RNA, 13 nt, Homo sapiens
uaccugggcauuc

SEQ ID NO: 1376317 - RNA, 21 nt, Homo sapiens
uaccugggcauucuuguuuca

SEQ ID NO: 1376318 - RNA, 22 nt, Homo sapiens
uaccuucaauaaaguaucuaca

SEQ ID NO: 1376319 - RNA, 13 nt, Homo sapiens
uaccuugugcuaa

SEQ ID NO: 1376320 - RNA, 15 nt, Homo sapiens
uacgccagaacugcu

SEQ ID NO: 1376321 - RNA, 20 nt, Homo sapiens
uacgcuccaucgcugucauc

SEQ ID NO: 1376322 - RNA, 23 nt, Homo sapiens
uacggguguaaacacugauggua

SEQ ID NO: 1376323 - RNA, 13 nt, Homo sapiens
uacguaucugcuc

SEQ ID NO: 1376324 - RNA, 15 nt, Homo sapiens
uacgucaaagcagua

SEQ ID NO: 1376325 - RNA, 17 nt, Homo sapiens
uacuaaauuacaaaugc

SEQ ID NO: 1376326 - RNA, 21 nt, Homo sapiens
uacuaaauuacaaaugcaauu

SEQ ID NO: 1376327 - RNA, 23 nt, Homo sapiens
uacuaagauguucacuguggcau

SEQ ID NO: 1376328 - RNA, 15 nt, Homo sapiens
uacuacacccagcua

SEQ ID NO: 1376329 - RNA, 17 nt, Homo sapiens
uacuagcagucacuuga

SEQ ID NO: 1376330 - RNA, 14 nt, Homo sapiens
uacuaucaugucaa

SEQ ID NO: 1376331 - RNA, 12 nt, Homo sapiens
uacucaaaagag

SEQ ID NO: 1376332 - RNA, 13 nt, Homo sapiens
uacucaucaucaa

SEQ ID NO: 1376333 - RNA, 16 nt, Homo sapiens
uacuccuuccaucaaa

SEQ ID NO: 1376334 - RNA, 12 nt, Homo sapiens
uacucugaaauu

SEQ ID NO: 1376335 - RNA, 18 nt, Homo sapiens
uacucuguuccuucacau

SEQ ID NO: 1376336 - RNA, 12 nt, Homo sapiens
uacugacauaua

SEQ ID NO: 1376337 - RNA, 14 nt, Homo sapiens
uacugagagcaugu

SEQ ID NO: 1376338 - RNA, 22 nt, Homo sapiens
uacugaggugcuauguucuuag

SEQ ID NO: 1376339 - RNA, 14 nt, Homo sapiens
uacugaguaugugg

SEQ ID NO: 1376340 - RNA, 17 nt, Homo sapiens
uacugcuaccacaacua

SEQ ID NO: 1376341 - RNA, 22 nt, Homo sapiens
uacugcuggcaguggaacuaag

SEQ ID NO: 1376342 - RNA, 18 nt, Homo sapiens
uacuggucuuguggaauu

SEQ ID NO: 1376343 - RNA, 12 nt, Homo sapiens
uacugugucagg

SEQ ID NO: 1376344 - RNA, 21 nt, Homo sapiens
uacugugucaggaaacauauu

SEQ ID NO: 1376345 - RNA, 17 nt, Homo sapiens
uacuuagcagcuaucuc

SEQ ID NO: 1376346 - RNA, 18 nt, Homo sapiens
uacuuagcaugcacaaag

SEQ ID NO: 1376347 - RNA, 21 nt, Homo sapiens
uacuucagcucacacaugaga

SEQ ID NO: 1376348 - RNA, 17 nt, Homo sapiens
uacuucauggacuucca

SEQ ID NO: 1376349 - RNA, 19 nt, Homo sapiens
uacuucuacauccaaugua

SEQ ID NO: 1376350 - RNA, 18 nt, Homo sapiens
uacuucuuauacauuuga

SEQ ID NO: 1376351 - RNA, 14 nt, Homo sapiens
uacuuguggacaca

SEQ ID NO: 1376352 - RNA, 24 nt, Homo sapiens
uacuuugggacgcccacguggcag

SEQ ID NO: 1376353 - RNA, 22 nt, Homo sapiens
uacuuuuuucuuauuuaacuua

SEQ ID NO: 1376354 - RNA, 21 nt, Homo sapiens
uagaaacuuguuagaaaugca

SEQ ID NO: 1376355 - RNA, 15 nt, Homo sapiens
uagaaagaagaugaa

SEQ ID NO: 1376356 - RNA, 15 nt, Homo sapiens
uagaaauauagccaa

SEQ ID NO: 1376357 - RNA, 13 nt, Homo sapiens
uagaaauuuuaca

SEQ ID NO: 1376358 - RNA, 13 nt, Homo sapiens
uagaaccaggcaa

SEQ ID NO: 1376359 - RNA, 23 nt, Homo sapiens
uagaagagacguuuaaaagccau

SEQ ID NO: 1376360 - RNA, 19 nt, Homo sapiens
uagaagauuuuaugcugcu

SEQ ID NO: 1376361 - RNA, 12 nt, Homo sapiens
uagaagggcaaa

SEQ ID NO: 1376362 - RNA, 12 nt, Homo sapiens
uagaagucacac

SEQ ID NO: 1376363 - RNA, 16 nt, Homo sapiens
uagaagucacacagua

SEQ ID NO: 1376364 - RNA, 23 nt, Homo sapiens
uagaaguguuaacuuagcuugaa

SEQ ID NO: 1376365 - RNA, 21 nt, Homo sapiens
uagaaguugacaggcagugcc

SEQ ID NO: 1376366 - RNA, 17 nt, Homo sapiens
uagaauauuuauuaccu

SEQ ID NO: 1376367 - RNA, 23 nt, Homo sapiens
uagaauauuuauuaccucugaua

SEQ ID NO: 1376368 - RNA, 16 nt, Homo sapiens
uagacagagucucacu

SEQ ID NO: 1376369 - RNA, 12 nt, Homo sapiens
uagaccauuaau

SEQ ID NO: 1376370 - RNA, 22 nt, Homo sapiens
uagacugacccugaucagucua

SEQ ID NO: 1376371 - RNA, 12 nt, Homo sapiens
uagacugccugg

SEQ ID NO: 1376372 - RNA, 16 nt, Homo sapiens
uagacuuuaugcaaua

SEQ ID NO: 1376373 - RNA, 19 nt, Homo sapiens
uagacuuucuuaucacuua

SEQ ID NO: 1376374 - RNA, 21 nt, Homo sapiens
uagagacaggguuuugccaug

SEQ ID NO: 1376375 - RNA, 15 nt, Homo sapiens
uagagacuguagauu

SEQ ID NO: 1376376 - RNA, 22 nt, Homo sapiens
uagagauggggaaagaauuccu

SEQ ID NO: 1376377 - RNA, 22 nt, Homo sapiens
uagagauggggucucacagugu

SEQ ID NO: 1376378 - RNA, 19 nt, Homo sapiens
uagagcagccacaaccaaa

SEQ ID NO: 1376379 - RNA, 15 nt, Homo sapiens
uagagcuagaugugu

SEQ ID NO: 1376380 - RNA, 16 nt, Homo sapiens
uagagcuagauguguc

SEQ ID NO: 1376381 - RNA, 20 nt, Homo sapiens
uagagcuagaugugucuuac

SEQ ID NO: 1376382 - RNA, 22 nt, Homo sapiens
uagagcuagaugugucuuacca

SEQ ID NO: 1376383 - RNA, 20 nt, Homo sapiens
uagaggugcucauucauuua

SEQ ID NO: 1376384 - RNA, 15 nt, Homo sapiens
uagaguucagacuuu

SEQ ID NO: 1376385 - RNA, 15 nt, Homo sapiens
uaugauugugcacau

SEQ ID NO: 1376386 - RNA, 19 nt, Homo sapiens
uaugauugugcacauacuu

SEQ ID NO: 1376387 - RNA, 18 nt, Homo sapiens
uaugccauagcaagauug

SEQ ID NO: 1376388 - RNA, 14 nt, Homo sapiens
uaugccuucacuuu

SEQ ID NO: 1376389 - RNA, 14 nt, Homo sapiens
uaugcuacuacaaa

SEQ ID NO: 1376390 - RNA, 21 nt, Homo sapiens
uauggacucaguuuucuugca

SEQ ID NO: 1376391 - RNA, 20 nt, Homo sapiens
uauggaguaccauguggcaa

SEQ ID NO: 1376392 - RNA, 23 nt, Homo sapiens
uauggauucagaauauacuaaau

SEQ ID NO: 1376393 - RNA, 19 nt, Homo sapiens
uauggcagugucuuuccac

SEQ ID NO: 1376394 - RNA, 20 nt, Homo sapiens
uaugggggcacugaggacca

SEQ ID NO: 1376395 - RNA, 16 nt, Homo sapiens
uauggguugcauuugg

SEQ ID NO: 1376396 - RNA, 21 nt, Homo sapiens
uauguacauaggcagcacuag

SEQ ID NO: 1376397 - RNA, 12 nt, Homo sapiens
uauguagauaac

SEQ ID NO: 1376398 - RNA, 16 nt, Homo sapiens
uauguagaugugcauu

SEQ ID NO: 1376399 - RNA, 13 nt, Homo sapiens
uauguauggaaua

SEQ ID NO: 1376400 - RNA, 14 nt, Homo sapiens
uauguauguaaaaa

SEQ ID NO: 1376401 - RNA, 19 nt, Homo sapiens
uaugucacccaaugcauau

SEQ ID NO: 1376402 - RNA, 20 nt, Homo sapiens
uaugucaggcaaagugcugc

SEQ ID NO: 1376403 - RNA, 15 nt, Homo sapiens
uaugucucagaccac

SEQ ID NO: 1376404 - RNA, 14 nt, Homo sapiens
uaugucucaugaug

SEQ ID NO: 1376405 - RNA, 23 nt, Homo sapiens
uaugugagagaaagugugagcaa

SEQ ID NO: 1376406 - RNA, 15 nt, Homo sapiens
uaugugcgugugugc

SEQ ID NO: 1376407 - RNA, 13 nt, Homo sapiens
uauguguaaguau

SEQ ID NO: 1376408 - RNA, 15 nt, Homo sapiens
uauguguaugugcca

SEQ ID NO: 1376409 - RNA, 17 nt, Homo sapiens
uauguuuacuucucacc

SEQ ID NO: 1376410 - RNA, 16 nt, Homo sapiens
uauuaaaucuugcaac

SEQ ID NO: 1376411 - RNA, 20 nt, Homo sapiens
uauuaaggaagacaauguga

SEQ ID NO: 1376412 - RNA, 12 nt, Homo sapiens
uauuaccacuga

SEQ ID NO: 1376413 - RNA, 20 nt, Homo sapiens
uauuacccuucuuuccauuu

SEQ ID NO: 1376414 - RNA, 22 nt, Homo sapiens
uauuacuuauuuuugacagugu

SEQ ID NO: 1376415 - RNA, 16 nt, Homo sapiens
uauuauaaaaguacua

SEQ ID NO: 1376416 - RNA, 17 nt, Homo sapiens
uauuauucuucauaaca

SEQ ID NO: 1376417 - RNA, 18 nt, Homo sapiens
uauucaguaauaacucua

SEQ ID NO: 1376418 - RNA, 17 nt, Homo sapiens
uauucccacagcacuaa

SEQ ID NO: 1376419 - RNA, 19 nt, Homo sapiens
uauucccuucuaaccugaa

SEQ ID NO: 1376420 - RNA, 23 nt, Homo sapiens
uauucuaguuuugucaaacugua

SEQ ID NO: 1376421 - RNA, 19 nt, Homo sapiens
uauucucacuccaccaccc

SEQ ID NO: 1376422 - RNA, 22 nt, Homo sapiens
uauucuguuggccagugugaca

SEQ ID NO: 1376423 - RNA, 15 nt, Homo sapiens
uauucuucauaacaa

SEQ ID NO: 1376424 - RNA, 20 nt, Homo sapiens
uauugaaugaugugauacaa

SEQ ID NO: 1376425 - RNA, 18 nt, Homo sapiens
uauugacaauaauuucag

SEQ ID NO: 1376426 - RNA, 18 nt, Homo sapiens
uauuggaggaccaaaaaa

SEQ ID NO: 1376427 - RNA, 21 nt, Homo sapiens
uauuguugcuuuuuuuccaau

SEQ ID NO: 1376428 - RNA, 19 nt, Homo sapiens
uauuuaacuggcuucagcc

SEQ ID NO: 1376429 - RNA, 13 nt, Homo sapiens
uauuuaccagacc

SEQ ID NO: 1376430 - RNA, 15 nt, Homo sapiens
uauuuaucacauagc

SEQ ID NO: 1376431 - RNA, 23 nt, Homo sapiens
uauuuauugcuguguaacacugu

SEQ ID NO: 1376432 - RNA, 17 nt, Homo sapiens
uauuuauuuuauggcaa

SEQ ID NO: 1376433 - RNA, 20 nt, Homo sapiens
uauuucaaaauauacauuca

SEQ ID NO: 1376434 - RNA, 12 nt, Homo sapiens
uauuucaggcau

SEQ ID NO: 1376435 - RNA, 16 nt, Homo sapiens
uauuucugaaucgaga

SEQ ID NO: 1376436 - RNA, 20 nt, Homo sapiens
uauuugcacuaugagccuau

SEQ ID NO: 1376437 - RNA, 12 nt, Homo sapiens
uauuugucacaa

SEQ ID NO: 1376438 - RNA, 17 nt, Homo sapiens
uauuuguuugcaauuuu

SEQ ID NO: 1376439 - RNA, 15 nt, Homo sapiens
uauuuuaaccugcau

SEQ ID NO: 1376440 - RNA, 22 nt, Homo sapiens
uauuuuaagcauuacucuugua

SEQ ID NO: 1376441 - RNA, 22 nt, Homo sapiens
uauuuuaaucuaauucuaagga

SEQ ID NO: 1376442 - RNA, 23 nt, Homo sapiens
uauuuuauauaauaaaguauucc

SEQ ID NO: 1376443 - RNA, 12 nt, Homo sapiens
uauuuuauucaa

SEQ ID NO: 1376444 - RNA, 20 nt, Homo sapiens
uauuuuauucccuuucacaa

SEQ ID NO: 1376445 - RNA, 14 nt, Homo sapiens
uauuuuccaugaaa

SEQ ID NO: 1376446 - RNA, 22 nt, Homo sapiens
uauuuugcauaguaccaaucau

SEQ ID NO: 1376447 - RNA, 22 nt, Homo sapiens
uauuuugccagugggaacuccu

SEQ ID NO: 1376448 - RNA, 21 nt, Homo sapiens
ucaaaaacugucaaagaauca

SEQ ID NO: 1376449 - RNA, 18 nt, Homo sapiens
ucaaaaagggaaugcauu

SEQ ID NO: 1376450 - RNA, 13 nt, Homo sapiens
ucaaaaauacuca

SEQ ID NO: 1376451 - RNA, 21 nt, Homo sapiens
ucaaaacccaacaugacuguu

SEQ ID NO: 1376452 - RNA, 16 nt, Homo sapiens
ucaaaaggaaaccaag

SEQ ID NO: 1376453 - RNA, 22 nt, Homo sapiens
ucaaaagguuaauaaaguaauu

SEQ ID NO: 1376454 - RNA, 11 nt, Homo sapiens
ucaaacaaagc

SEQ ID NO: 1376455 - RNA, 15 nt, Homo sapiens
ucaaacaaagccaga

SEQ ID NO: 1376456 - RNA, 22 nt, Homo sapiens
ucaaacgugaaaaugcuguauu

SEQ ID NO: 1376457 - RNA, 13 nt, Homo sapiens
ucaaagacauucu

SEQ ID NO: 1376458 - RNA, 22 nt, Homo sapiens
ucaaagcaggaauugguggcag

SEQ ID NO: 1376459 - RNA, 16 nt, Homo sapiens
ucaaaggguacuucca

SEQ ID NO: 1376460 - RNA, 15 nt, Homo sapiens
ucaaaguaaaacuug

SEQ ID NO: 1376461 - RNA, 18 nt, Homo sapiens
ucaaaguaaaacuugcug

SEQ ID NO: 1376462 - RNA, 15 nt, Homo sapiens
ucaaaguggcaaaaa

SEQ ID NO: 1376463 - RNA, 19 nt, Homo sapiens
ucaaaguuaaccuaccugu

SEQ ID NO: 1376464 - RNA, 14 nt, Homo sapiens
ucaaauaacuaaaa

SEQ ID NO: 1376465 - RNA, 18 nt, Homo sapiens
ucaaaugggcugcugcuu

SEQ ID NO: 1376466 - RNA, 20 nt, Homo sapiens
ucaacaucuuuuacauucug

SEQ ID NO: 1376467 - RNA, 15 nt, Homo sapiens
ucaaccaauguagaa

SEQ ID NO: 1376468 - RNA, 19 nt, Homo sapiens
ucaacuucagagacuaucu

SEQ ID NO: 1376469 - RNA, 15 nt, Homo sapiens
ucaagaaacugagga

SEQ ID NO: 1376470 - RNA, 13 nt, Homo sapiens
ucaagaaagccag

SEQ ID NO: 1376471 - RNA, 22 nt, Homo sapiens
ucaagaaagccagucuuaacau

SEQ ID NO: 1376472 - RNA, 19 nt, Homo sapiens
ucaagagaagcacaugaaa

SEQ ID NO: 1376473 - RNA, 19 nt, Homo sapiens
ucaagauuaaacugaguga

SEQ ID NO: 1376474 - RNA, 17 nt, Homo sapiens
ucaagcaauccuccuga

SEQ ID NO: 1376475 - RNA, 22 nt, Homo sapiens
ucaagcuaauaaaauaucauuc

SEQ ID NO: 1376476 - RNA, 22 nt, Homo sapiens
ucaaggaccaacaagggcagug

SEQ ID NO: 1376477 - RNA, 18 nt, Homo sapiens
ucaagggguguucaguua

SEQ ID NO: 1376478 - RNA, 20 nt, Homo sapiens
ucaaguaguguaucacagua

SEQ ID NO: 1376479 - RNA, 15 nt, Homo sapiens
ucuguucuuccauca

SEQ ID NO: 1376480 - RNA, 20 nt, Homo sapiens
ucuguuggccagugugacaa

SEQ ID NO: 1376481 - RNA, 18 nt, Homo sapiens
ucuguuuuuaaaaaucau

SEQ ID NO: 1376482 - RNA, 21 nt, Homo sapiens
ucuuaacuucuccccauuucc

SEQ ID NO: 1376483 - RNA, 22 nt, Homo sapiens
ucuuaagcuuccgccgucucaa

SEQ ID NO: 1376484 - RNA, 22 nt, Homo sapiens
ucuuaaguuguggagagugcaa

SEQ ID NO: 1376485 - RNA, 23 nt, Homo sapiens
ucuuaccagaucuaauauugacu

SEQ ID NO: 1376486 - RNA, 12 nt, Homo sapiens
ucuuacuguugc

SEQ ID NO: 1376487 - RNA, 16 nt, Homo sapiens
ucuuagaaaaaccacc

SEQ ID NO: 1376488 - RNA, 18 nt, Homo sapiens
ucuuagagagaagaucac

SEQ ID NO: 1376489 - RNA, 20 nt, Homo sapiens
ucuuagcacaccuacaccuc

SEQ ID NO: 1376490 - RNA, 13 nt, Homo sapiens
ucuuagugucacu

SEQ ID NO: 1376491 - RNA, 15 nt, Homo sapiens
ucuuagugucacuua

SEQ ID NO: 1376492 - RNA, 16 nt, Homo sapiens
ucuuaucccagugauc

SEQ ID NO: 1376493 - RNA, 18 nt, Homo sapiens
ucuuaucccagugaucac

SEQ ID NO: 1376494 - RNA, 12 nt, Homo sapiens
ucuuaugccauu

SEQ ID NO: 1376495 - RNA, 13 nt, Homo sapiens
ucuucaagcagau

SEQ ID NO: 1376496 - RNA, 15 nt, Homo sapiens
ucuucacaccuaccc

SEQ ID NO: 1376497 - RNA, 22 nt, Homo sapiens
ucuucagagauaggccuguggg

SEQ ID NO: 1376498 - RNA, 16 nt, Homo sapiens
ucuucagcauuuucca

SEQ ID NO: 1376499 - RNA, 21 nt, Homo sapiens
ucuucauaauuucuucacuca

SEQ ID NO: 1376500 - RNA, 15 nt, Homo sapiens
ucuuccacagugccu

SEQ ID NO: 1376501 - RNA, 13 nt, Homo sapiens
ucuuccuauccca

SEQ ID NO: 1376502 - RNA, 19 nt, Homo sapiens
ucuuccuaucccaucccau

SEQ ID NO: 1376503 - RNA, 22 nt, Homo sapiens
ucuucuaagaauuuuaucuguu

SEQ ID NO: 1376504 - RNA, 13 nt, Homo sapiens
ucuucuaagcaaa

SEQ ID NO: 1376505 - RNA, 16 nt, Homo sapiens
ucuucucccaauucau

SEQ ID NO: 1376506 - RNA, 18 nt, Homo sapiens
ucuucugaauugacugua

SEQ ID NO: 1376507 - RNA, 24 nt, Homo sapiens
ucuucuuugcccacaaugcuuugc

SEQ ID NO: 1376508 - RNA, 15 nt, Homo sapiens
ucuugacauucacuu

SEQ ID NO: 1376509 - RNA, 19 nt, Homo sapiens
ucuugccccccaccccagc

SEQ ID NO: 1376510 - RNA, 17 nt, Homo sapiens
ucuuguaagagcuauac

SEQ ID NO: 1376511 - RNA, 17 nt, Homo sapiens
ucuugucauugccagcu

SEQ ID NO: 1376512 - RNA, 20 nt, Homo sapiens
ucuuguguuggcuguggcag

SEQ ID NO: 1376513 - RNA, 19 nt, Homo sapiens
ucuuguguuuuugucuuau

SEQ ID NO: 1376514 - RNA, 14 nt, Homo sapiens
ucuuguugcucaaa

SEQ ID NO: 1376515 - RNA, 17 nt, Homo sapiens
ucuuuccauuaugauuc

SEQ ID NO: 1376516 - RNA, 14 nt, Homo sapiens
ucuuucccagacuu

SEQ ID NO: 1376517 - RNA, 16 nt, Homo sapiens
ucuuuccuuccucuca

SEQ ID NO: 1376518 - RNA, 20 nt, Homo sapiens
ucuuugaacccuugcuugca

SEQ ID NO: 1376519 - RNA, 20 nt, Homo sapiens
ucuuugauucaaagcacugu

SEQ ID NO: 1376520 - RNA, 17 nt, Homo sapiens
ucuuugcccacaaugcu

SEQ ID NO: 1376521 - RNA, 19 nt, Homo sapiens
ucuuuguaaugucaccacc

SEQ ID NO: 1376522 - RNA, 21 nt, Homo sapiens
ucuuuguaaugucaccaccuu

SEQ ID NO: 1376523 - RNA, 21 nt, Homo sapiens
ucuuuuagucauuuugcuuca

SEQ ID NO: 1376524 - RNA, 14 nt, Homo sapiens
ucuuuucaaugugu

SEQ ID NO: 1376525 - RNA, 21 nt, Homo sapiens
ucuuuucuggaauguaaucaa

SEQ ID NO: 1376526 - RNA, 18 nt, Homo sapiens
ucuuuugaacaaaugaca

SEQ ID NO: 1376527 - RNA, 18 nt, Homo sapiens
ucuuuugguugccuuaaa

SEQ ID NO: 1376528 - RNA, 23 nt, Homo sapiens
ugaaaaaguauaaauaaaaugag

SEQ ID NO: 1376529 - RNA, 22 nt, Homo sapiens
ugaaaaaugguaauuguugcua

SEQ ID NO: 1376530 - RNA, 22 nt, Homo sapiens
ugaaaaauucucagucaguaau

SEQ ID NO: 1376531 - RNA, 20 nt, Homo sapiens
ugaaaaugcuguauuaguca

SEQ ID NO: 1376532 - RNA, 21 nt, Homo sapiens
ugaaaaugucagaaaccaguu

SEQ ID NO: 1376533 - RNA, 12 nt, Homo sapiens
ugaaaauguuca

SEQ ID NO: 1376534 - RNA, 19 nt, Homo sapiens
ugaaaauguuuuucugcca

SEQ ID NO: 1376535 - RNA, 20 nt, Homo sapiens
ugaaacaggagagaaagggg

SEQ ID NO: 1376536 - RNA, 20 nt, Homo sapiens
ugaaaccccaucucuacuga

SEQ ID NO: 1376537 - RNA, 14 nt, Homo sapiens
ugaaacuaacagau

SEQ ID NO: 1376538 - RNA, 23 nt, Homo sapiens
ugaaacuuguuuauuauguacaa

SEQ ID NO: 1376539 - RNA, 23 nt, Homo sapiens
ugaaagaaccaaaagagaucaca

SEQ ID NO: 1376540 - RNA, 22 nt, Homo sapiens
ugaaagcacuccucccugaugu

SEQ ID NO: 1376541 - RNA, 19 nt, Homo sapiens
ugaaauaauguacaucugg

SEQ ID NO: 1376542 - RNA, 20 nt, Homo sapiens
ugaaauacgccagaacugcu

SEQ ID NO: 1376543 - RNA, 17 nt, Homo sapiens
ugaaauauacacacagc

SEQ ID NO: 1376544 - RNA, 22 nt, Homo sapiens
ugaaauaugauaauaaaggcau

SEQ ID NO: 1376545 - RNA, 13 nt, Homo sapiens
ugaaaucuaugaa

SEQ ID NO: 1376546 - RNA, 19 nt, Homo sapiens
ugaaauggugaaaugcaga

SEQ ID NO: 1376547 - RNA, 24 nt, Homo sapiens
ugaacacaucagcuagcaaaagaa

SEQ ID NO: 1376548 - RNA, 21 nt, Homo sapiens
ugaacacuugaagccaucuaa

SEQ ID NO: 1376549 - RNA, 22 nt, Homo sapiens
ugaacacuugaagccaucuaaa

SEQ ID NO: 1376550 - RNA, 21 nt, Homo sapiens
ugaacaucuuuaggagacuaa

SEQ ID NO: 1376551 - RNA, 17 nt, Homo sapiens
ugaaccaaaacauuccg

SEQ ID NO: 1376552 - RNA, 21 nt, Homo sapiens
ugaacuccuggccucaaguga

SEQ ID NO: 1376553 - RNA, 18 nt, Homo sapiens
ugaacuccugggcucaag

SEQ ID NO: 1376554 - RNA, 22 nt, Homo sapiens
ugaacucuuucuggccugccuu

SEQ ID NO: 1376555 - RNA, 20 nt, Homo sapiens
ugaacugaaaacaagccaug

SEQ ID NO: 1376556 - RNA, 22 nt, Homo sapiens
ugaagaacaguaacugccauca

SEQ ID NO: 1376557 - RNA, 12 nt, Homo sapiens
ugaagaacugac

SEQ ID NO: 1376558 - RNA, 19 nt, Homo sapiens
ugaagaagagaaugugaca

SEQ ID NO: 1376559 - RNA, 22 nt, Homo sapiens
ugaagaccuggacuauugaaug

SEQ ID NO: 1376560 - RNA, 23 nt, Homo sapiens
ugaagagagagcugagugagcug

SEQ ID NO: 1376561 - RNA, 21 nt, Homo sapiens
ugaagagauccuucuguaaag

SEQ ID NO: 1376562 - RNA, 18 nt, Homo sapiens
ugaagagggagaagggau

SEQ ID NO: 1376563 - RNA, 15 nt, Homo sapiens
ugaagagugaggaua

SEQ ID NO: 1376564 - RNA, 20 nt, Homo sapiens
ugaagauaucuugaaaugaa

SEQ ID NO: 1376565 - RNA, 16 nt, Homo sapiens
ugaagcaaacacauua

SEQ ID NO: 1376566 - RNA, 23 nt, Homo sapiens
ugaagcaaaucagaaacuuguga

SEQ ID NO: 1376567 - RNA, 20 nt, Homo sapiens
ugaagcccuaacucagccaa

SEQ ID NO: 1376568 - RNA, 16 nt, Homo sapiens
ugaauuuuuaugauau

SEQ ID NO: 1376569 - RNA, 13 nt, Homo sapiens
ugacacacagcuc

SEQ ID NO: 1376570 - RNA, 14 nt, Homo sapiens
ugacaccagccuuu

SEQ ID NO: 1376571 - RNA, 19 nt, Homo sapiens
ugacaccauuuuccugccu

SEQ ID NO: 1376572 - RNA, 19 nt, Homo sapiens
ugacaccuauuuuagacaa

SEQ ID NO: 1376573 - RNA, 20 nt, Homo sapiens
ugacacggccaugaccacuu

SEQ ID NO: 1376574 - RNA, 17 nt, Homo sapiens
ugacacuuuucaugugu

SEQ ID NO: 1376575 - RNA, 16 nt, Homo sapiens
ugacagacacaggccc

SEQ ID NO: 1376576 - RNA, 15 nt, Homo sapiens
ugacagaguaagacu

SEQ ID NO: 1376577 - RNA, 13 nt, Homo sapiens
ugacagagugccu

SEQ ID NO: 1376578 - RNA, 19 nt, Homo sapiens
ugacagaguucacuauaaa

SEQ ID NO: 1376579 - RNA, 22 nt, Homo sapiens
ugacagcugaccuuugucaucu

SEQ ID NO: 1376580 - RNA, 18 nt, Homo sapiens
ugacaguaaaucacacaa

SEQ ID NO: 1376581 - RNA, 14 nt, Homo sapiens
ugacaugugcuuug

SEQ ID NO: 1376582 - RNA, 14 nt, Homo sapiens
ugaccaacaguucc

SEQ ID NO: 1376583 - RNA, 19 nt, Homo sapiens
ugaccagaaaucaaaaagg

SEQ ID NO: 1376584 - RNA, 22 nt, Homo sapiens
ugaccaggcauccuccacaaua

SEQ ID NO: 1376585 - RNA, 17 nt, Homo sapiens
ugaccaguugcacuugg

SEQ ID NO: 1376586 - RNA, 15 nt, Homo sapiens
ugaccucccagugac

SEQ ID NO: 1376587 - RNA, 18 nt, Homo sapiens
ugaccugaggaagcguga

SEQ ID NO: 1376588 - RNA, 21 nt, Homo sapiens
ugaccugucaccgugagcagc

SEQ ID NO: 1376589 - RNA, 14 nt, Homo sapiens
ugaccugugaccag

SEQ ID NO: 1376590 - RNA, 17 nt, Homo sapiens
ugacgguguccaugccu

SEQ ID NO: 1376591 - RNA, 20 nt, Homo sapiens
ugacgguguccaugccuucc

SEQ ID NO: 1376592 - RNA, 22 nt, Homo sapiens
ugacguuggccuaacacugggc

SEQ ID NO: 1376593 - RNA, 19 nt, Homo sapiens
ugacuauggcuaccaaaaa

SEQ ID NO: 1376594 - RNA, 20 nt, Homo sapiens
ugacucuccagaaagcucau

SEQ ID NO: 1376595 - RNA, 14 nt, Homo sapiens
ugacucuuggcaca

SEQ ID NO: 1376596 - RNA, 16 nt, Homo sapiens
ugacugauggugaaau

SEQ ID NO: 1376597 - RNA, 21 nt, Homo sapiens
ugagaacagaucuccaaagcu

SEQ ID NO: 1376598 - RNA, 22 nt, Homo sapiens
ugagaacagaucuccaaagcuu

SEQ ID NO: 1376599 - RNA, 22 nt, Homo sapiens
ugagaacauuaacaaaagcaau

SEQ ID NO: 1376600 - RNA, 18 nt, Homo sapiens
ugagaacuacucagggaa

SEQ ID NO: 1376601 - RNA, 15 nt, Homo sapiens
ugagaacuugacaag

SEQ ID NO: 1376602 - RNA, 19 nt, Homo sapiens
ugagaagucaaacauuuca

SEQ ID NO: 1376603 - RNA, 12 nt, Homo sapiens
ugagacauucca

SEQ ID NO: 1376604 - RNA, 17 nt, Homo sapiens
ugagaccacuguuauca

SEQ ID NO: 1376605 - RNA, 22 nt, Homo sapiens
ugagaccagccugggcagcaua

SEQ ID NO: 1376606 - RNA, 19 nt, Homo sapiens
ugagagacaggacuagcug

SEQ ID NO: 1376607 - RNA, 11 nt, Homo sapiens
ugagaguacac

SEQ ID NO: 1376608 - RNA, 16 nt, Homo sapiens
ugagaucauugcaaac

SEQ ID NO: 1376609 - RNA, 15 nt, Homo sapiens
ugagauccuuuaaau

SEQ ID NO: 1376610 - RNA, 23 nt, Homo sapiens
ugagaucgugccguuacucucca

SEQ ID NO: 1376611 - RNA, 15 nt, Homo sapiens
ugagcagagacauga

SEQ ID NO: 1376612 - RNA, 21 nt, Homo sapiens
ugagcauuguggcugucagca

SEQ ID NO: 1376613 - RNA, 12 nt, Homo sapiens
ugagcuaacuua

SEQ ID NO: 1376614 - RNA, 16 nt, Homo sapiens
ugagcuccccaaaaac

SEQ ID NO: 1376615 - RNA, 21 nt, Homo sapiens
ugagcuggcgggauugaagga

SEQ ID NO: 1376616 - RNA, 21 nt, Homo sapiens
ugagcuuaagaauuuugagca

SEQ ID NO: 1376617 - RNA, 19 nt, Homo sapiens
ugagcuuagugaaauuacu

SEQ ID NO: 1376618 - RNA, 23 nt, Homo sapiens
ugagcuuggccagaagggggcca

SEQ ID NO: 1376619 - RNA, 23 nt, Homo sapiens
ugaggaccacuccuguacacuga

SEQ ID NO: 1376620 - RNA, 16 nt, Homo sapiens
ugaggaugcagaguca

SEQ ID NO: 1376621 - RNA, 13 nt, Homo sapiens
ugaggauuucaag

SEQ ID NO: 1376622 - RNA, 20 nt, Homo sapiens
ugaggcaaccacaggcagca

SEQ ID NO: 1376623 - RNA, 17 nt, Homo sapiens
ugaggcaagagaauuac

SEQ ID NO: 1376624 - RNA, 18 nt, Homo sapiens
ugaggcaagagaauuacu

SEQ ID NO: 1376625 - RNA, 20 nt, Homo sapiens
ugaggcauccuuccucacac

SEQ ID NO: 1376626 - RNA, 17 nt, Homo sapiens
ugaggcggauggcugug

SEQ ID NO: 1376627 - RNA, 16 nt, Homo sapiens
ugaggcuggacuccag

SEQ ID NO: 1376628 - RNA, 16 nt, Homo sapiens
ugagggaaaaugagua

SEQ ID NO: 1376629 - RNA, 15 nt, Homo sapiens
ugaggguuaaugaaa

SEQ ID NO: 1376630 - RNA, 13 nt, Homo sapiens
ugaguaucuccuc

SEQ ID NO: 1376631 - RNA, 20 nt, Homo sapiens
ugagucaccaagcccaguua

SEQ ID NO: 1376632 - RNA, 18 nt, Homo sapiens
ugagucccuuccaggcca

SEQ ID NO: 1376633 - RNA, 17 nt, Homo sapiens
ugagugaaucaccugug

SEQ ID NO: 1376634 - RNA, 14 nt, Homo sapiens
ugagugacuagacg

SEQ ID NO: 1376635 - RNA, 15 nt, Homo sapiens
ugagugugugcaagu

SEQ ID NO: 1376636 - RNA, 19 nt, Homo sapiens
ugaguuacuaucaugucaa

SEQ ID NO: 1376637 - RNA, 22 nt, Homo sapiens
ugaguuacuuccuaucaagcca

SEQ ID NO: 1376638 - RNA, 21 nt, Homo sapiens
ugaguuuuugauagcuuuauu

SEQ ID NO: 1376639 - RNA, 19 nt, Homo sapiens
ugauacaagaaagcaaugc

SEQ ID NO: 1376640 - RNA, 14 nt, Homo sapiens
ugauacagagggau

SEQ ID NO: 1376641 - RNA, 16 nt, Homo sapiens
ugauagaguguuauca

SEQ ID NO: 1376642 - RNA, 11 nt, Homo sapiens
ugauagcuuua

SEQ ID NO: 1376643 - RNA, 20 nt, Homo sapiens
ugauauguugguagauucua

SEQ ID NO: 1376644 - RNA, 16 nt, Homo sapiens
ugauauuccauaguau

SEQ ID NO: 1376645 - RNA, 17 nt, Homo sapiens
ugauauugcauaugcau

SEQ ID NO: 1376646 - RNA, 23 nt, Homo sapiens
ugaucauuuuccccccacucucc

SEQ ID NO: 1376647 - RNA, 20 nt, Homo sapiens
ugauccuaaugaaugcauaa

SEQ ID NO: 1376648 - RNA, 17 nt, Homo sapiens
ugaucuugauugugggu

SEQ ID NO: 1376649 - RNA, 18 nt, Homo sapiens
ugaugaaauguaaauacu

SEQ ID NO: 1376650 - RNA, 15 nt, Homo sapiens
ugaugacccucugac

SEQ ID NO: 1376651 - RNA, 15 nt, Homo sapiens
ugaugacgacgacaa

SEQ ID NO: 1376652 - RNA, 20 nt, Homo sapiens
ugaugcaagcaagaaacacu

SEQ ID NO: 1376653 - RNA, 23 nt, Homo sapiens
ugaugcucccuccccugcccugg

SEQ ID NO: 1376654 - RNA, 19 nt, Homo sapiens
ugauggauaucccuaccuu

SEQ ID NO: 1376655 - RNA, 15 nt, Homo sapiens
ugauguuccacaaaa

SEQ ID NO: 1376656 - RNA, 11 nt, Homo sapiens
ugauguugcug

SEQ ID NO: 1376657 - RNA, 20 nt, Homo sapiens
ugauuaaagguggugccaau

SEQ ID NO: 1376658 - RNA, 14 nt, Homo sapiens
ugcacaaugucuug

SEQ ID NO: 1376659 - RNA, 17 nt, Homo sapiens
ugcacaaugucuuggua

SEQ ID NO: 1376660 - RNA, 16 nt, Homo sapiens
ugcaccugccagccug

SEQ ID NO: 1376661 - RNA, 15 nt, Homo sapiens
ugcacgcccaugugu

SEQ ID NO: 1376662 - RNA, 23 nt, Homo sapiens
ugcacuacucccucaaagcacac

SEQ ID NO: 1376663 - RNA, 14 nt, Homo sapiens
ugcacuccagccug

SEQ ID NO: 1376664 - RNA, 18 nt, Homo sapiens
ugcagaaaauugccuaaa

SEQ ID NO: 1376665 - RNA, 21 nt, Homo sapiens
ugcagaaagaccgugugugaa

SEQ ID NO: 1376666 - RNA, 18 nt, Homo sapiens
ugcagaauccaaaguaaa

SEQ ID NO: 1376667 - RNA, 19 nt, Homo sapiens
ugcagaauugagagugauu

SEQ ID NO: 1376668 - RNA, 14 nt, Homo sapiens
ugcagacaggccau

SEQ ID NO: 1376669 - RNA, 16 nt, Homo sapiens
ugcagagugcccagaa

SEQ ID NO: 1376670 - RNA, 14 nt, Homo sapiens
ugcagcccaugccc

SEQ ID NO: 1376671 - RNA, 16 nt, Homo sapiens
ugcagccucaaccucc

SEQ ID NO: 1376672 - RNA, 14 nt, Homo sapiens
ugcaggaaaacuga

SEQ ID NO: 1376673 - RNA, 16 nt, Homo sapiens
ugcaggaccucaggug

SEQ ID NO: 1376674 - RNA, 21 nt, Homo sapiens
ugcagggggugugucugcuca

SEQ ID NO: 1376675 - RNA, 15 nt, Homo sapiens
ugcagucacagcuac

SEQ ID NO: 1376676 - RNA, 19 nt, Homo sapiens
ugcagucaucuugaccaag

SEQ ID NO: 1376677 - RNA, 20 nt, Homo sapiens
ugcaguggcccccacagaaa

SEQ ID NO: 1376678 - RNA, 18 nt, Homo sapiens
ugcauaaaaaggucuuua

SEQ ID NO: 1376679 - RNA, 18 nt, Homo sapiens
ugcauaagugcaugacau

SEQ ID NO: 1376680 - RNA, 14 nt, Homo sapiens
ugcauaauaagcua

SEQ ID NO: 1376681 - RNA, 14 nt, Homo sapiens
ugcauaggaaguau

SEQ ID NO: 1376682 - RNA, 21 nt, Homo sapiens
ugcauauccaacaugugcuca

SEQ ID NO: 1376683 - RNA, 16 nt, Homo sapiens
ugcaucauguugaaua

SEQ ID NO: 1376684 - RNA, 18 nt, Homo sapiens
ugcauccguaguucccug

SEQ ID NO: 1376685 - RNA, 23 nt, Homo sapiens
ugcaucuccccucagauuccacc

SEQ ID NO: 1376686 - RNA, 21 nt, Homo sapiens
ugcaucugcuacugugucagg

SEQ ID NO: 1376687 - RNA, 14 nt, Homo sapiens
ugcaugcagaaagg

SEQ ID NO: 1376688 - RNA, 16 nt, Homo sapiens
ugcaugcagcaucuaa

SEQ ID NO: 1376689 - RNA, 23 nt, Homo sapiens
ugcaugccuggcacaacaucaag

SEQ ID NO: 1376690 - RNA, 14 nt, Homo sapiens
ugcauguaucuucu

SEQ ID NO: 1376691 - RNA, 21 nt, Homo sapiens
ugcauguuacauaagauaaau

SEQ ID NO: 1376692 - RNA, 12 nt, Homo sapiens
ugcauuaucuau

SEQ ID NO: 1376693 - RNA, 17 nt, Homo sapiens
ugcauuaucuaugauau

SEQ ID NO: 1376694 - RNA, 18 nt, Homo sapiens
ugcauugcuaaaauauua

SEQ ID NO: 1376695 - RNA, 16 nt, Homo sapiens
ugcauugugaggguua

SEQ ID NO: 1376696 - RNA, 21 nt, Homo sapiens
ugcauuuucccagauacuucc

SEQ ID NO: 1376697 - RNA, 17 nt, Homo sapiens
ugcauuuuuaaauacaa

SEQ ID NO: 1376698 - RNA, 14 nt, Homo sapiens
ugccaaagaacuug

SEQ ID NO: 1376699 - RNA, 17 nt, Homo sapiens
ugccaagcacagugccu

SEQ ID NO: 1376700 - RNA, 17 nt, Homo sapiens
ugccaccuccuggaagg

SEQ ID NO: 1376701 - RNA, 14 nt, Homo sapiens
ugccagacaucacc

SEQ ID NO: 1376702 - RNA, 16 nt, Homo sapiens
ugccaggcacacugag

SEQ ID NO: 1376703 - RNA, 11 nt, Homo sapiens
ugccagugaaa

SEQ ID NO: 1376704 - RNA, 13 nt, Homo sapiens
ugccagugacaug

SEQ ID NO: 1376705 - RNA, 14 nt, Homo sapiens
ugccauagcaagau

SEQ ID NO: 1376706 - RNA, 16 nt, Homo sapiens
ugccaugaacuggagg

SEQ ID NO: 1376707 - RNA, 19 nt, Homo sapiens
ugccauguggucauacucu

SEQ ID NO: 1376708 - RNA, 21 nt, Homo sapiens
ugcccaaccugcucuccucuu

SEQ ID NO: 1376709 - RNA, 22 nt, Homo sapiens
ugcccaauuagggccuagccuu

SEQ ID NO: 1376710 - RNA, 19 nt, Homo sapiens
ugcccacgcuggagugcag

SEQ ID NO: 1376711 - RNA, 14 nt, Homo sapiens
ugcccagacauuuu

SEQ ID NO: 1376712 - RNA, 18 nt, Homo sapiens
ugcccagggccacucugc

SEQ ID NO: 1376713 - RNA, 15 nt, Homo sapiens
ugcccagggcucagc

SEQ ID NO: 1376714 - RNA, 20 nt, Homo sapiens
ugcccagggcucagccuggu

SEQ ID NO: 1376715 - RNA, 12 nt, Homo sapiens
ugccccaccugc

SEQ ID NO: 1376716 - RNA, 14 nt, Homo sapiens
ugccccaccuuuau

SEQ ID NO: 1376717 - RNA, 17 nt, Homo sapiens
ugccccccuugccagac

SEQ ID NO: 1376718 - RNA, 19 nt, Homo sapiens
ugccccgugcagacuggag

SEQ ID NO: 1376719 - RNA, 22 nt, Homo sapiens
ugccccucccagaacacacucc

SEQ ID NO: 1376720 - RNA, 14 nt, Homo sapiens
ugccccucucucca

SEQ ID NO: 1376721 - RNA, 12 nt, Homo sapiens
ugccccugagac

SEQ ID NO: 1376722 - RNA, 18 nt, Homo sapiens
ugcccggcaggguccuag

SEQ ID NO: 1376723 - RNA, 22 nt, Homo sapiens
ugcccggggcagcugccagaga

SEQ ID NO: 1376724 - RNA, 15 nt, Homo sapiens
ugcccucagauuccg

SEQ ID NO: 1376725 - RNA, 17 nt, Homo sapiens
ugcccuggauccaucag

SEQ ID NO: 1376726 - RNA, 20 nt, Homo sapiens
ugcccuucagcauccucagu

SEQ ID NO: 1376727 - RNA, 22 nt, Homo sapiens
ugcccuuggccugaagucccag

SEQ ID NO: 1376728 - RNA, 15 nt, Homo sapiens
ugccgaaacuggaag

SEQ ID NO: 1376729 - RNA, 12 nt, Homo sapiens
ugccgcauuugg

SEQ ID NO: 1376730 - RNA, 21 nt, Homo sapiens
ugccguaacaacuguggucaa

SEQ ID NO: 1376731 - RNA, 21 nt, Homo sapiens
ugccuaagaagaugacuuccc

SEQ ID NO: 1376732 - RNA, 13 nt, Homo sapiens
ugccuaaguauuc

SEQ ID NO: 1376733 - RNA, 22 nt, Homo sapiens
ugccuacgaauagccacugcau

SEQ ID NO: 1376734 - RNA, 15 nt, Homo sapiens
ugccuagaggugcuc

SEQ ID NO: 1376735 - RNA, 16 nt, Homo sapiens
ugccucacuuccuaca

SEQ ID NO: 1376736 - RNA, 22 nt, Homo sapiens
ugccucauuaccuugugcuaau

SEQ ID NO: 1376737 - RNA, 17 nt, Homo sapiens
ugccuccaccccccaga

SEQ ID NO: 1376738 - RNA, 20 nt, Homo sapiens
ugccuccaccccccagaacc

SEQ ID NO: 1376739 - RNA, 22 nt, Homo sapiens
ugccuccauucugaccauuuca

SEQ ID NO: 1376740 - RNA, 23 nt, Homo sapiens
ugccuccucccugggcagaaagu

SEQ ID NO: 1376741 - RNA, 17 nt, Homo sapiens
ugccucucgguggccag

SEQ ID NO: 1376742 - RNA, 17 nt, Homo sapiens
ugccucugccucugaca

SEQ ID NO: 1376743 - RNA, 14 nt, Homo sapiens
ugccucugucucac

SEQ ID NO: 1376744 - RNA, 20 nt, Homo sapiens
ugccuggagcuccugggaag

SEQ ID NO: 1376745 - RNA, 16 nt, Homo sapiens
ugccuuccacaauuca

SEQ ID NO: 1376746 - RNA, 16 nt, Homo sapiens
ugccuuggcuucaggg

SEQ ID NO: 1376747 - RNA, 18 nt, Homo sapiens
ugcggccuuuggcuucac

SEQ ID NO: 1376748 - RNA, 19 nt, Homo sapiens
ugugugcacaugugugcgu

SEQ ID NO: 1376749 - RNA, 16 nt, Homo sapiens
ugugugcacguacaca

SEQ ID NO: 1376750 - RNA, 14 nt, Homo sapiens
uguguggacuguga

SEQ ID NO: 1376751 - RNA, 18 nt, Homo sapiens
ugugugggacuguacaca

SEQ ID NO: 1376752 - RNA, 13 nt, Homo sapiens
uguguguagccaa

SEQ ID NO: 1376753 - RNA, 13 nt, Homo sapiens
ugugugugugcaa

SEQ ID NO: 1376754 - RNA, 14 nt, Homo sapiens
uguguuaucucuua

SEQ ID NO: 1376755 - RNA, 10 nt, Homo sapiens
uguguuccaa

SEQ ID NO: 1376756 - RNA, 20 nt, Homo sapiens
uguguuccaacaaccauuuu

SEQ ID NO: 1376757 - RNA, 20 nt, Homo sapiens
uguguugccaugugugcuga

SEQ ID NO: 1376758 - RNA, 13 nt, Homo sapiens
uguguuugcugag

SEQ ID NO: 1376759 - RNA, 18 nt, Homo sapiens
uguguuuugcuaaaggaa

SEQ ID NO: 1376760 - RNA, 18 nt, Homo sapiens
uguuaacauggacaugau

SEQ ID NO: 1376761 - RNA, 21 nt, Homo sapiens
uguuaacauggacaugaucuu

SEQ ID NO: 1376762 - RNA, 19 nt, Homo sapiens
uguuacagguuacaugaga

SEQ ID NO: 1376763 - RNA, 20 nt, Homo sapiens
uguuacagguuacaugagag

SEQ ID NO: 1376764 - RNA, 16 nt, Homo sapiens
uguuacugaucaugca

SEQ ID NO: 1376765 - RNA, 15 nt, Homo sapiens
uguuacugucuucag

SEQ ID NO: 1376766 - RNA, 23 nt, Homo sapiens
uguuagaaaugcaaauucucaag

SEQ ID NO: 1376767 - RNA, 20 nt, Homo sapiens
uguuaucagucauaacuaaa

SEQ ID NO: 1376768 - RNA, 17 nt, Homo sapiens
uguuauucaauggaauc

SEQ ID NO: 1376769 - RNA, 17 nt, Homo sapiens
uguucagggcugugauc

SEQ ID NO: 1376770 - RNA, 18 nt, Homo sapiens
uguucauguuacucauga

SEQ ID NO: 1376771 - RNA, 19 nt, Homo sapiens
uguuccacauccacacagc

SEQ ID NO: 1376772 - RNA, 13 nt, Homo sapiens
uguucugggacac

SEQ ID NO: 1376773 - RNA, 21 nt, Homo sapiens
uguugagccaggccugggucu

SEQ ID NO: 1376774 - RNA, 15 nt, Homo sapiens
uuagcauuuugcuaa

SEQ ID NO: 1376775 - RNA, 22 nt, Homo sapiens
uuagcuaccucacuaugcugcu

SEQ ID NO: 1376776 - RNA, 9 nt, Homo sapiens
uuagcucau

SEQ ID NO: 1376777 - RNA, 22 nt, Homo sapiens
uuagcugugcgcaauugcucau

SEQ ID NO: 1376778 - RNA, 14 nt, Homo sapiens
uuaggagaaaccag

SEQ ID NO: 1376779 - RNA, 14 nt, Homo sapiens
uuagguuuuguaca

SEQ ID NO: 1376780 - RNA, 16 nt, Homo sapiens
uuagguuuuguacaau

SEQ ID NO: 1376781 - RNA, 22 nt, Homo sapiens
uuaguucuauuucuaucccaaa

SEQ ID NO: 1376782 - RNA, 16 nt, Homo sapiens
uuaguuuuauauugcu

SEQ ID NO: 1376783 - RNA, 13 nt, Homo sapiens
uuauaaaaucaaa

SEQ ID NO: 1376784 - RNA, 23 nt, Homo sapiens
uuauaaagggagauaacaaucug

SEQ ID NO: 1376785 - RNA, 17 nt, Homo sapiens
uuauaaccaacuuuucu

SEQ ID NO: 1376786 - RNA, 14 nt, Homo sapiens
uuauaauauacuau

SEQ ID NO: 1376787 - RNA, 15 nt, Homo sapiens
uuauacagugauaaa

SEQ ID NO: 1376788 - RNA, 18 nt, Homo sapiens
uuauacauuaacuucagc

SEQ ID NO: 1376789 - RNA, 21 nt, Homo sapiens
uuauagaauauuuauuaccuc

SEQ ID NO: 1376790 - RNA, 23 nt, Homo sapiens
uuauagagaugagggcucccuau

SEQ ID NO: 1376791 - RNA, 17 nt, Homo sapiens
uuauagugacaaugaag

SEQ ID NO: 1376792 - RNA, 16 nt, Homo sapiens
uuauauaauuacauau

SEQ ID NO: 1376793 - RNA, 24 nt, Homo sapiens
uuauauauguaucuaaaccauaug

SEQ ID NO: 1376794 - RNA, 14 nt, Homo sapiens
uuaucaccaugcaa

SEQ ID NO: 1376795 - RNA, 20 nt, Homo sapiens
uuaucauauauauacauaca

SEQ ID NO: 1376796 - RNA, 20 nt, Homo sapiens
uuauccaaucuuguuuccaa

SEQ ID NO: 1376797 - RNA, 12 nt, Homo sapiens
uuauccaugccu

SEQ ID NO: 1376798 - RNA, 22 nt, Homo sapiens
uuaucccacggaaaaugccaau

SEQ ID NO: 1376799 - RNA, 18 nt, Homo sapiens
uuaucugagucaacuccu

SEQ ID NO: 1376800 - RNA, 20 nt, Homo sapiens
aggcauccuuccucacacca

SEQ ID NO: 1376801 - RNA, 15 nt, Homo sapiens
aggcaucugcuuuac

SEQ ID NO: 1376802 - RNA, 20 nt, Homo sapiens
aggcaugagccaccgcgccu

SEQ ID NO: 1376803 - RNA, 11 nt, Homo sapiens
aggcauucucu

SEQ ID NO: 1376804 - RNA, 21 nt, Homo sapiens
aggccaagaggcuguucccac

SEQ ID NO: 1376805 - RNA, 16 nt, Homo sapiens
aggccacaccaucucc

SEQ ID NO: 1376806 - RNA, 20 nt, Homo sapiens
aggccacuugaugaccccca

SEQ ID NO: 1376807 - RNA, 15 nt, Homo sapiens
aggccagaugcacau

SEQ ID NO: 1376808 - RNA, 19 nt, Homo sapiens
aggccagcuggcagcagag

SEQ ID NO: 1376809 - RNA, 20 nt, Homo sapiens
aggccaggugcaguggcuca

SEQ ID NO: 1376810 - RNA, 21 nt, Homo sapiens
aggccauggcagaauaaucuu

SEQ ID NO: 1376811 - RNA, 16 nt, Homo sapiens
aggcccuugggcaccu

SEQ ID NO: 1376812 - RNA, 13 nt, Homo sapiens
aggccucccucaa

SEQ ID NO: 1376813 - RNA, 18 nt, Homo sapiens
aggccuggccagaugcac

SEQ ID NO: 1376814 - RNA, 19 nt, Homo sapiens
aggcgauccaccugucuca

SEQ ID NO: 1376815 - RNA, 22 nt, Homo sapiens
aggcgauccaccugucucagcc

SEQ ID NO: 1376816 - RNA, 13 nt, Homo sapiens
aggcgaugugcaa

SEQ ID NO: 1376817 - RNA, 17 nt, Homo sapiens
aggcgaugugcaagugu

SEQ ID NO: 1376818 - RNA, 17 nt, Homo sapiens
aggcgggagcaucucuu

SEQ ID NO: 1376819 - RNA, 20 nt, Homo sapiens
aggcggguggaucacuugag

SEQ ID NO: 1376820 - RNA, 18 nt, Homo sapiens
aggcuauacuugucuugu

SEQ ID NO: 1376821 - RNA, 23 nt, Homo sapiens
aggcucugcccugcccuagcucc

SEQ ID NO: 1376822 - RNA, 14 nt, Homo sapiens
aggcucugucucaa

SEQ ID NO: 1376823 - RNA, 12 nt, Homo sapiens
aggcucuucucc

SEQ ID NO: 1376824 - RNA, 15 nt, Homo sapiens
aggcugaaagacagg

SEQ ID NO: 1376825 - RNA, 18 nt, Homo sapiens
aggcugagagcaguggcu

SEQ ID NO: 1376826 - RNA, 17 nt, Homo sapiens
aggcugaggcaagagaa

SEQ ID NO: 1376827 - RNA, 20 nt, Homo sapiens
aggcugcagcgagcuaugau

SEQ ID NO: 1376828 - RNA, 15 nt, Homo sapiens
aggcuggcuuguccc

SEQ ID NO: 1376829 - RNA, 14 nt, Homo sapiens
aggcugucuucuca

SEQ ID NO: 1376830 - RNA, 15 nt, Homo sapiens
aggcugucuucucag

SEQ ID NO: 1376831 - RNA, 23 nt, Homo sapiens
aggcuucaauuuauugcacaaaa

SEQ ID NO: 1376832 - RNA, 15 nt, Homo sapiens
aggcuucuggggcuu

SEQ ID NO: 1376833 - RNA, 13 nt, Homo sapiens
agggaaaaaccag

SEQ ID NO: 1376834 - RNA, 21 nt, Homo sapiens
agggaaaauguuuuguaagaa

SEQ ID NO: 1376835 - RNA, 12 nt, Homo sapiens
agggaacauauu

SEQ ID NO: 1376836 - RNA, 18 nt, Homo sapiens
agggaacgggguccuuca

SEQ ID NO: 1376837 - RNA, 19 nt, Homo sapiens
agggaagcuggccgagggu

SEQ ID NO: 1376838 - RNA, 17 nt, Homo sapiens
agggaauucucuuggcu

SEQ ID NO: 1376839 - RNA, 19 nt, Homo sapiens
agggaauugaggucugcuc

SEQ ID NO: 1376840 - RNA, 21 nt, Homo sapiens
agggacagaucauagauuucu

SEQ ID NO: 1376841 - RNA, 15 nt, Homo sapiens
agggacauguggaaa

SEQ ID NO: 1376842 - RNA, 15 nt, Homo sapiens
agggagaggccauga

SEQ ID NO: 1376843 - RNA, 15 nt, Homo sapiens
agggauuuucagccc

SEQ ID NO: 1376844 - RNA, 19 nt, Homo sapiens
agggauuuucagcccucag

SEQ ID NO: 1376845 - RNA, 18 nt, Homo sapiens
agggcaagagccacagua

SEQ ID NO: 1376846 - RNA, 15 nt, Homo sapiens
agggcacugcugcug

SEQ ID NO: 1376847 - RNA, 18 nt, Homo sapiens
agggcacugcugcugccu

SEQ ID NO: 1376848 - RNA, 23 nt, Homo sapiens
agggcagggcaucuccugugcau

SEQ ID NO: 1376849 - RNA, 18 nt, Homo sapiens
agggcauccaacugagaa

SEQ ID NO: 1376850 - RNA, 18 nt, Homo sapiens
agggccuuaaaagccauc

SEQ ID NO: 1376851 - RNA, 19 nt, Homo sapiens
agggcuuggacucaagcaa

SEQ ID NO: 1376852 - RNA, 21 nt, Homo sapiens
aggggcaggagcucagaugaa

SEQ ID NO: 1376853 - RNA, 22 nt, Homo sapiens
aggggcccaaauucuuucagug

SEQ ID NO: 1376854 - RNA, 14 nt, Homo sapiens
aggggcuggcacug

SEQ ID NO: 1376855 - RNA, 18 nt, Homo sapiens
agggggugugucugcuca

SEQ ID NO: 1376856 - RNA, 20 nt, Homo sapiens
aggggguuacaaacugcaau

SEQ ID NO: 1376857 - RNA, 14 nt, Homo sapiens
aggguaaauucucu

SEQ ID NO: 1376858 - RNA, 21 nt, Homo sapiens
aggguaccuugaacacugggg

SEQ ID NO: 1376859 - RNA, 13 nt, Homo sapiens
aggguacuuccac

SEQ ID NO: 1376860 - RNA, 23 nt, Homo sapiens
aggguagucugguuucuagacuu

SEQ ID NO: 1376861 - RNA, 14 nt, Homo sapiens
agggucucuucagg

SEQ ID NO: 1376862 - RNA, 13 nt, Homo sapiens
aggguuacuaugc

SEQ ID NO: 1376863 - RNA, 21 nt, Homo sapiens
aggguucaccaggucagggag

SEQ ID NO: 1376864 - RNA, 22 nt, Homo sapiens
aggguucaccaggucagggaga

SEQ ID NO: 1376865 - RNA, 13 nt, Homo sapiens
agguacagagaag

SEQ ID NO: 1376866 - RNA, 20 nt, Homo sapiens
agguagcugccccuggcucu

SEQ ID NO: 1376867 - RNA, 18 nt, Homo sapiens
agguagcuuuagggcaau

SEQ ID NO: 1376868 - RNA, 17 nt, Homo sapiens
agguagggguugggaau

SEQ ID NO: 1376869 - RNA, 22 nt, Homo sapiens
agguauucguaaggaugggaag

SEQ ID NO: 1376870 - RNA, 18 nt, Homo sapiens
aggucacauugugccuuu

SEQ ID NO: 1376871 - RNA, 17 nt, Homo sapiens
aggucacugaaacuuca

SEQ ID NO: 1376872 - RNA, 22 nt, Homo sapiens
aggucagagccugcaguuauua

SEQ ID NO: 1376873 - RNA, 15 nt, Homo sapiens
aggucaggaguucga

SEQ ID NO: 1376874 - RNA, 18 nt, Homo sapiens
aggucccaccuccauuug

SEQ ID NO: 1376875 - RNA, 13 nt, Homo sapiens
agguccucuacuu

SEQ ID NO: 1376876 - RNA, 23 nt, Homo sapiens
agguccucuacuuaaugagauag

SEQ ID NO: 1376877 - RNA, 20 nt, Homo sapiens
aggugauccacccaccucag

SEQ ID NO: 1376878 - RNA, 18 nt, Homo sapiens
aggugccccucucuccau

SEQ ID NO: 1376879 - RNA, 15 nt, Homo sapiens
aggugcuucuucacu

SEQ ID NO: 1376880 - RNA, 20 nt, Homo sapiens
aggugggaggaucucuugag

SEQ ID NO: 1376881 - RNA, 14 nt, Homo sapiens
agguggggcagcuu

SEQ ID NO: 1376882 - RNA, 15 nt, Homo sapiens
agguggugaggcaau

SEQ ID NO: 1376883 - RNA, 13 nt, Homo sapiens
agguggugccaau

SEQ ID NO: 1376884 - RNA, 16 nt, Homo sapiens
agguguucaagaccag

SEQ ID NO: 1376885 - RNA, 15 nt, Homo sapiens
agguguuuaguugca

SEQ ID NO: 1376886 - RNA, 15 nt, Homo sapiens
agguuauacuccucc

SEQ ID NO: 1376887 - RNA, 17 nt, Homo sapiens
agguugcagugagccaa

SEQ ID NO: 1376888 - RNA, 21 nt, Homo sapiens
agguugucugaagucacugca

SEQ ID NO: 1376889 - RNA, 17 nt, Homo sapiens
agguugugggcauugau

SEQ ID NO: 1376890 - RNA, 23 nt, Homo sapiens
agguuuaagcgauucucaugccu

SEQ ID NO: 1376891 - RNA, 15 nt, Homo sapiens
agguuuacauuguca

SEQ ID NO: 1376892 - RNA, 13 nt, Homo sapiens
agguuuccuucag

SEQ ID NO: 1376893 - RNA, 15 nt, Homo sapiens
agguuuuuacuguga

SEQ ID NO: 1376894 - RNA, 16 nt, Homo sapiens
agguuuuuggucugac

SEQ ID NO: 1376895 - RNA, 23 nt, Homo sapiens
aguaaaacaaaaauucacaagcu

SEQ ID NO: 1376896 - RNA, 13 nt, Homo sapiens
aguaaacaaugaa

SEQ ID NO: 1376897 - RNA, 17 nt, Homo sapiens
aguaacauucauguucu

SEQ ID NO: 1376898 - RNA, 18 nt, Homo sapiens
aguaagagcuggugucug

SEQ ID NO: 1376899 - RNA, 13 nt, Homo sapiens
aguaaguacgugu

SEQ ID NO: 1376900 - RNA, 14 nt, Homo sapiens
aguaaguggugaga

SEQ ID NO: 1376901 - RNA, 16 nt, Homo sapiens
aguaaguggugagaac

SEQ ID NO: 1376902 - RNA, 21 nt, Homo sapiens
aguaaugaauuuuuaugauau

SEQ ID NO: 1376903 - RNA, 23 nt, Homo sapiens
aguaauguugacuguauuuucca

SEQ ID NO: 1376904 - RNA, 15 nt, Homo sapiens
aguaccacucaggcc

SEQ ID NO: 1376905 - RNA, 21 nt, Homo sapiens
aguacguguuauuuuuuucaa

SEQ ID NO: 1376906 - RNA, 14 nt, Homo sapiens
aguagaauccuaaa

SEQ ID NO: 1376907 - RNA, 14 nt, Homo sapiens
aguagagacagggu

SEQ ID NO: 1376908 - RNA, 12 nt, Homo sapiens
aguagcaauuuc

SEQ ID NO: 1376909 - RNA, 16 nt, Homo sapiens
aguagcauacauuuau

SEQ ID NO: 1376910 - RNA, 22 nt, Homo sapiens
aguauacuuuuugcauauguaa

SEQ ID NO: 1376911 - RNA, 16 nt, Homo sapiens
aguaucacacuguaua

SEQ ID NO: 1376912 - RNA, 22 nt, Homo sapiens
agcucugcuugccgaaacugga

SEQ ID NO: 1376913 - RNA, 23 nt, Homo sapiens
agcucugcuugccgaaacuggaa

SEQ ID NO: 1376914 - RNA, 21 nt, Homo sapiens
agcucuggugacaccagccuu

SEQ ID NO: 1376915 - RNA, 15 nt, Homo sapiens
agcucuguuuuacaa

SEQ ID NO: 1376916 - RNA, 17 nt, Homo sapiens
agcucuucaggccuccc

SEQ ID NO: 1376917 - RNA, 23 nt, Homo sapiens
agcucuucuccauccuaccacaa

SEQ ID NO: 1376918 - RNA, 23 nt, Homo sapiens
agcugaacaguguuggcuuucau

SEQ ID NO: 1376919 - RNA, 15 nt, Homo sapiens
agcugaauacauucu

SEQ ID NO: 1376920 - RNA, 15 nt, Homo sapiens
agcugagauuccugg

SEQ ID NO: 1376921 - RNA, 22 nt, Homo sapiens
agcugagauugugccacuucac

SEQ ID NO: 1376922 - RNA, 14 nt, Homo sapiens
agcugaguguagug

SEQ ID NO: 1376923 - RNA, 13 nt, Homo sapiens
agcugcaccugcc

SEQ ID NO: 1376924 - RNA, 22 nt, Homo sapiens
agcugccaagccccauccugcc

SEQ ID NO: 1376925 - RNA, 18 nt, Homo sapiens
agcugccauccagggaug

SEQ ID NO: 1376926 - RNA, 16 nt, Homo sapiens
agcugccucacuuccu

SEQ ID NO: 1376927 - RNA, 18 nt, Homo sapiens
agcugcgccugcgcugca

SEQ ID NO: 1376928 - RNA, 14 nt, Homo sapiens
agcugcuccgugcu

SEQ ID NO: 1376929 - RNA, 18 nt, Homo sapiens
agcuggaccaguggugcc

SEQ ID NO: 1376930 - RNA, 16 nt, Homo sapiens
agcuggaccugagcua

SEQ ID NO: 1376931 - RNA, 23 nt, Homo sapiens
agcuggauuuccuaggcugacua

SEQ ID NO: 1376932 - RNA, 20 nt, Homo sapiens
agcugggggccaugagcucc

SEQ ID NO: 1376933 - RNA, 16 nt, Homo sapiens
agcuggugguaucuga

SEQ ID NO: 1376934 - RNA, 19 nt, Homo sapiens
agcugguugggaagacaug

SEQ ID NO: 1376935 - RNA, 21 nt, Homo sapiens
agcuguaaccgauaugcacuu

SEQ ID NO: 1376936 - RNA, 21 nt, Homo sapiens
agcuguaagauaauguugcuu

SEQ ID NO: 1376937 - RNA, 17 nt, Homo sapiens
agcugucaggcugauua

SEQ ID NO: 1376938 - RNA, 19 nt, Homo sapiens
agcuguggccagcuuguua

SEQ ID NO: 1376939 - RNA, 13 nt, Homo sapiens
agcuuaagaauuu

SEQ ID NO: 1376940 - RNA, 20 nt, Homo sapiens
agcuuacuggcaaacaugaa

SEQ ID NO: 1376941 - RNA, 13 nt, Homo sapiens
agcuuagaccuca

SEQ ID NO: 1376942 - RNA, 22 nt, Homo sapiens
agcuuaggggcugcugaccucc

SEQ ID NO: 1376943 - RNA, 14 nt, Homo sapiens
agcuucaaacugca

SEQ ID NO: 1376944 - RNA, 13 nt, Homo sapiens
agcuuccauucca

SEQ ID NO: 1376945 - RNA, 14 nt, Homo sapiens
agcuucucugugaa

SEQ ID NO: 1376946 - RNA, 21 nt, Homo sapiens
agcuucuuaaaugagaaggaa

SEQ ID NO: 1376947 - RNA, 23 nt, Homo sapiens
agcuugcucuucagugggagaaa

SEQ ID NO: 1376948 - RNA, 22 nt, Homo sapiens
agcuuggaaacuggaugagguc

SEQ ID NO: 1376949 - RNA, 19 nt, Homo sapiens
agcuuggcuguagaaggag

SEQ ID NO: 1376950 - RNA, 18 nt, Homo sapiens
agcuuuacaaauauguca

SEQ ID NO: 1376951 - RNA, 19 nt, Homo sapiens
agcuuucugcuaucaaaga

SEQ ID NO: 1376952 - RNA, 16 nt, Homo sapiens
agcuuugaaaauucag

SEQ ID NO: 1376953 - RNA, 21 nt, Homo sapiens
agcuuugagcuuaagaauuuu

SEQ ID NO: 1376954 - RNA, 20 nt, Homo sapiens
agcuuuggacacacacagcu

SEQ ID NO: 1376955 - RNA, 20 nt, Homo sapiens
agcuuuggacgcacacagcu

SEQ ID NO: 1376956 - RNA, 13 nt, Homo sapiens
aggaaaaaaccau

SEQ ID NO: 1376957 - RNA, 18 nt, Homo sapiens
aggaaaauuggacauuaa

SEQ ID NO: 1376958 - RNA, 18 nt, Homo sapiens
aggaaagggauaguccaa

SEQ ID NO: 1376959 - RNA, 23 nt, Homo sapiens
aggaaagggauaguccaaagacu

SEQ ID NO: 1376960 - RNA, 12 nt, Homo sapiens
aggaaagugauu

SEQ ID NO: 1376961 - RNA, 13 nt, Homo sapiens
aggaaagugauuu

SEQ ID NO: 1376962 - RNA, 18 nt, Homo sapiens
aggaaauauauaugugug

SEQ ID NO: 1376963 - RNA, 20 nt, Homo sapiens
aggaacacucugaauuccaa

SEQ ID NO: 1376964 - RNA, 12 nt, Homo sapiens
aggaacacugca

SEQ ID NO: 1376965 - RNA, 13 nt, Homo sapiens
aggaacacugcac

SEQ ID NO: 1376966 - RNA, 14 nt, Homo sapiens
aggaacagucuugu

SEQ ID NO: 1376967 - RNA, 16 nt, Homo sapiens
aggaaccccaggagau

SEQ ID NO: 1376968 - RNA, 20 nt, Homo sapiens
aggaaccuccuccacaccag

SEQ ID NO: 1376969 - RNA, 22 nt, Homo sapiens
aggaagaccaagacacagauca

SEQ ID NO: 1376970 - RNA, 15 nt, Homo sapiens
aggaagagugcaaaa

SEQ ID NO: 1376971 - RNA, 15 nt, Homo sapiens
aggaagaucaggcca

SEQ ID NO: 1376972 - RNA, 18 nt, Homo sapiens
aggaagcaccccaugcca

SEQ ID NO: 1376973 - RNA, 23 nt, Homo sapiens
aggaagcccuaagacgucccuuu

SEQ ID NO: 1376974 - RNA, 14 nt, Homo sapiens
aggaagccgugccc

SEQ ID NO: 1376975 - RNA, 20 nt, Homo sapiens
aggaagcucagacugguuga

SEQ ID NO: 1376976 - RNA, 21 nt, Homo sapiens
aggaagguaugugucagccau

SEQ ID NO: 1376977 - RNA, 15 nt, Homo sapiens
aggaauagcauguca

SEQ ID NO: 1376978 - RNA, 20 nt, Homo sapiens
aggaauauagaaugaaagac

SEQ ID NO: 1376979 - RNA, 17 nt, Homo sapiens
aggaauccacauugcca

SEQ ID NO: 1376980 - RNA, 22 nt, Homo sapiens
aggaauccacauugccagugac

SEQ ID NO: 1376981 - RNA, 22 nt, Homo sapiens
aggaauggaggcucuaauugaa

SEQ ID NO: 1376982 - RNA, 17 nt, Homo sapiens
aggaauuugcauuuagu

SEQ ID NO: 1376983 - RNA, 22 nt, Homo sapiens
aggacaccuuuuaacucaccuc

SEQ ID NO: 1376984 - RNA, 21 nt, Homo sapiens
aggacacuagaagauuuugaa

SEQ ID NO: 1376985 - RNA, 19 nt, Homo sapiens
aggacagcuacacgcugac

SEQ ID NO: 1376986 - RNA, 14 nt, Homo sapiens
aggacaucagucug

SEQ ID NO: 1376987 - RNA, 14 nt, Homo sapiens
aggaccaaggagau

SEQ ID NO: 1376988 - RNA, 13 nt, Homo sapiens
aggaccacuccug

SEQ ID NO: 1376989 - RNA, 14 nt, Homo sapiens
aggacccuucccuu

SEQ ID NO: 1376990 - RNA, 15 nt, Homo sapiens
aggaccuagggaugu

SEQ ID NO: 1376991 - RNA, 16 nt, Homo sapiens
aggacuuuauagauca

SEQ ID NO: 1376992 - RNA, 17 nt, Homo sapiens
aggagaaacacaucuuc

SEQ ID NO: 1376993 - RNA, 21 nt, Homo sapiens
aggagaaggacauuuuacugc

SEQ ID NO: 1376994 - RNA, 14 nt, Homo sapiens
aggagacacaucca

SEQ ID NO: 1376995 - RNA, 20 nt, Homo sapiens
aggagaccuggcacuggaug

SEQ ID NO: 1376996 - RNA, 23 nt, Homo sapiens
aggagacuuuacauggaugccaa

SEQ ID NO: 1376997 - RNA, 20 nt, Homo sapiens
aggagagcuagcagcaggga

SEQ ID NO: 1376998 - RNA, 15 nt, Homo sapiens
aggagagggaaaaug

SEQ ID NO: 1376999 - RNA, 20 nt, Homo sapiens
aggagauggaaguugcagug

SEQ ID NO: 1377000 - RNA, 17 nt, Homo sapiens
aggagcaugagugccgu

SEQ ID NO: 1377001 - RNA, 12 nt, Homo sapiens
aggagcucagau

SEQ ID NO: 1377002 - RNA, 21 nt, Homo sapiens
aggagcugcuggcuugcagug

SEQ ID NO: 1377003 - RNA, 17 nt, Homo sapiens
aggaggcuggcagguau

SEQ ID NO: 1377004 - RNA, 16 nt, Homo sapiens
aggagggcagcagggu

SEQ ID NO: 1377005 - RNA, 21 nt, Homo sapiens
aggagggucaggaaggaugag

SEQ ID NO: 1377006 - RNA, 21 nt, Homo sapiens
aggaguacaccccaacagcac

SEQ ID NO: 1377007 - RNA, 13 nt, Homo sapiens
aggaguuccuuga

SEQ ID NO: 1377008 - RNA, 23 nt, Homo sapiens
aggauauugacauugauacagug

SEQ ID NO: 1377009 - RNA, 17 nt, Homo sapiens
aggaucagaaaguaauu

SEQ ID NO: 1377010 - RNA, 23 nt, Homo sapiens
aggaucuuucacccacagaaaga

SEQ ID NO: 1377011 - RNA, 14 nt, Homo sapiens
aggaugggcacugc

SEQ ID NO: 1377012 - RNA, 15 nt, Homo sapiens
aggauuagacaguca

SEQ ID NO: 1377013 - RNA, 13 nt, Homo sapiens
aggcaaaaagaca

SEQ ID NO: 1377014 - RNA, 13 nt, Homo sapiens
aggcaaagacagg

SEQ ID NO: 1377015 - RNA, 19 nt, Homo sapiens
aggcaaagugcugcuggaa

SEQ ID NO: 1377016 - RNA, 15 nt, Homo sapiens
aggcaaccagaggaa

SEQ ID NO: 1377017 - RNA, 15 nt, Homo sapiens
aggcaauggccuaaa

SEQ ID NO: 1377018 - RNA, 16 nt, Homo sapiens
aggcagagaaucauac

SEQ ID NO: 1377019 - RNA, 18 nt, Homo sapiens
aggcagagguugcagugu

SEQ ID NO: 1377020 - RNA, 18 nt, Homo sapiens
aggcagaugccucuagaa

SEQ ID NO: 1377021 - RNA, 14 nt, Homo sapiens
aggcagcaaacaga

SEQ ID NO: 1377022 - RNA, 17 nt, Homo sapiens
aggcaguuggccagaga

SEQ ID NO: 1377023 - RNA, 13 nt, Homo sapiens
aguauccacuuug

SEQ ID NO: 1377024 - RNA, 18 nt, Homo sapiens
aguauggcaugaacaucu

SEQ ID NO: 1377025 - RNA, 21 nt, Homo sapiens
aguaugugaguguguccaagu

SEQ ID NO: 1377026 - RNA, 12 nt, Homo sapiens
aguauuccauuu

SEQ ID NO: 1377027 - RNA, 17 nt, Homo sapiens
aguauucuguaccauag

SEQ ID NO: 1377028 - RNA, 20 nt, Homo sapiens
aguauugacuuguauaccuu

SEQ ID NO: 1377029 - RNA, 17 nt, Homo sapiens
aguauuucagaugcuuu

SEQ ID NO: 1377030 - RNA, 21 nt, Homo sapiens
aguauuuuccuccaggcaaaa

SEQ ID NO: 1377031 - RNA, 15 nt, Homo sapiens
agucaaaacacuugu

SEQ ID NO: 1377032 - RNA, 16 nt, Homo sapiens
agucaaaacacuugua

SEQ ID NO: 1377033 - RNA, 13 nt, Homo sapiens
agucaaagacauu

SEQ ID NO: 1377034 - RNA, 15 nt, Homo sapiens
agucaaauuuguaaa

SEQ ID NO: 1377035 - RNA, 17 nt, Homo sapiens
agucaaccaauguagaa

SEQ ID NO: 1377036 - RNA, 23 nt, Homo sapiens
agucacugcacagugcaucucag

SEQ ID NO: 1377037 - RNA, 17 nt, Homo sapiens
agucagaguugugcaca

SEQ ID NO: 1377038 - RNA, 23 nt, Homo sapiens
agucaggccuuaauuuucaguau

SEQ ID NO: 1377039 - RNA, 16 nt, Homo sapiens
agucaugaacacauca

SEQ ID NO: 1377040 - RNA, 20 nt, Homo sapiens
agucaugaacacaucagcua

SEQ ID NO: 1377041 - RNA, 17 nt, Homo sapiens
agucauggcaccaaagc

SEQ ID NO: 1377042 - RNA, 19 nt, Homo sapiens
agucauuugcugagcaugu

SEQ ID NO: 1377043 - RNA, 21 nt, Homo sapiens
agucauuugcugagcauguac

SEQ ID NO: 1377044 - RNA, 18 nt, Homo sapiens
agucccaccuuggcugca

SEQ ID NO: 1377045 - RNA, 16 nt, Homo sapiens
agucccauugauguac

SEQ ID NO: 1377046 - RNA, 20 nt, Homo sapiens
agucccuaaaaacacagaca

SEQ ID NO: 1377047 - RNA, 21 nt, Homo sapiens
agucccuaaaaacacagacau

SEQ ID NO: 1377048 - RNA, 12 nt, Homo sapiens
agucccugugaa

SEQ ID NO: 1377049 - RNA, 17 nt, Homo sapiens
aguccuacaagcuaaaa

SEQ ID NO: 1377050 - RNA, 17 nt, Homo sapiens
aguccuagccacucagg

SEQ ID NO: 1377051 - RNA, 19 nt, Homo sapiens
aguccucguagccaucucu

SEQ ID NO: 1377052 - RNA, 16 nt, Homo sapiens
aguccuucaaacuucc

SEQ ID NO: 1377053 - RNA, 19 nt, Homo sapiens
agucuaccccugcuaagga

SEQ ID NO: 1377054 - RNA, 20 nt, Homo sapiens
agucucaaucuguuacccag

SEQ ID NO: 1377055 - RNA, 14 nt, Homo sapiens
agucucaggaccua

SEQ ID NO: 1377056 - RNA, 16 nt, Homo sapiens
agucuccccuauguaa

SEQ ID NO: 1377057 - RNA, 17 nt, Homo sapiens
agucucuucuaagcaaa

SEQ ID NO: 1377058 - RNA, 21 nt, Homo sapiens
agucugauuaaagguggugcc

SEQ ID NO: 1377059 - RNA, 14 nt, Homo sapiens
agucugcuucugca

SEQ ID NO: 1377060 - RNA, 18 nt, Homo sapiens
agucugcuuugguacuaa

SEQ ID NO: 1377061 - RNA, 13 nt, Homo sapiens
agucuggcucugu

SEQ ID NO: 1377062 - RNA, 15 nt, Homo sapiens
agucugucucugcua

SEQ ID NO: 1377063 - RNA, 14 nt, Homo sapiens
agucuucaagcaga

SEQ ID NO: 1377064 - RNA, 22 nt, Homo sapiens
agucuucauaauuucuucacuc

SEQ ID NO: 1377065 - RNA, 20 nt, Homo sapiens
agucuucucauagcauuaac

SEQ ID NO: 1377066 - RNA, 18 nt, Homo sapiens
agugaaaccccaucucua

SEQ ID NO: 1377067 - RNA, 18 nt, Homo sapiens
agugaaaucugugcaaua

SEQ ID NO: 1377068 - RNA, 20 nt, Homo sapiens
agugaagaugccagugaaac

SEQ ID NO: 1377069 - RNA, 12 nt, Homo sapiens
agugaaguaauc

SEQ ID NO: 1377070 - RNA, 18 nt, Homo sapiens
agugaauaaccacuuaaa

SEQ ID NO: 1377071 - RNA, 14 nt, Homo sapiens
agugaauuguguag

SEQ ID NO: 1377072 - RNA, 20 nt, Homo sapiens
agugaccccugaccucacug

SEQ ID NO: 1377073 - RNA, 21 nt, Homo sapiens
agugaccgaaagguuauguua

SEQ ID NO: 1377074 - RNA, 16 nt, Homo sapiens
agugaccggcugcuuu

SEQ ID NO: 1377075 - RNA, 15 nt, Homo sapiens
agugagcugauauca

SEQ ID NO: 1377076 - RNA, 16 nt, Homo sapiens
agugaguauaacucua

SEQ ID NO: 1377077 - RNA, 16 nt, Homo sapiens
agugauaugcauuucc

SEQ ID NO: 1377078 - RNA, 20 nt, Homo sapiens
agugauccuccugccucagc

SEQ ID NO: 1377079 - RNA, 20 nt, Homo sapiens
agugaucuuucccaagagaa

SEQ ID NO: 1377080 - RNA, 19 nt, Homo sapiens
agugauucugaaucaaggu

SEQ ID NO: 1377081 - RNA, 17 nt, Homo sapiens
agugauucuugcugcua

SEQ ID NO: 1377082 - RNA, 17 nt, Homo sapiens
agugauugauagagugu

SEQ ID NO: 1377083 - RNA, 22 nt, Homo sapiens
agugauugauagaguguuauca

SEQ ID NO: 1377084 - RNA, 12 nt, Homo sapiens
agugauuuccac

SEQ ID NO: 1377085 - RNA, 21 nt, Homo sapiens
agugcacuaauucugcaucug

SEQ ID NO: 1377086 - RNA, 18 nt, Homo sapiens
agugcaggagagacagug

SEQ ID NO: 1377087 - RNA, 21 nt, Homo sapiens
agugcaggcuggcaccgccuu

SEQ ID NO: 1377088 - RNA, 16 nt, Homo sapiens
agugcaguggugcgau

SEQ ID NO: 1377089 - RNA, 16 nt, Homo sapiens
agugcccccaacagca

SEQ ID NO: 1377090 - RNA, 14 nt, Homo sapiens
agugccuuaccucc

SEQ ID NO: 1377091 - RNA, 20 nt, Homo sapiens
agugccuucugcccucccug

SEQ ID NO: 1377092 - RNA, 21 nt, Homo sapiens
agugcugggauuacaggugug

SEQ ID NO: 1377093 - RNA, 22 nt, Homo sapiens
agugcuuguuccucucaucucc

SEQ ID NO: 1377094 - RNA, 16 nt, Homo sapiens
aguggauugcauuucu

SEQ ID NO: 1377095 - RNA, 16 nt, Homo sapiens
aguggcccccacagaa

SEQ ID NO: 1377096 - RNA, 20 nt, Homo sapiens
aguggcguaaucucggcuca

SEQ ID NO: 1377097 - RNA, 20 nt, Homo sapiens
agugggugccccccuugcca

SEQ ID NO: 1377098 - RNA, 13 nt, Homo sapiens
agugguuucagca

SEQ ID NO: 1377099 - RNA, 16 nt, Homo sapiens
aguguagccuugcccg

SEQ ID NO: 1377100 - RNA, 21 nt, Homo sapiens
aguguaugcacgugugcacac

SEQ ID NO: 1377101 - RNA, 21 nt, Homo sapiens
aguguauuuuauguguggccc

SEQ ID NO: 1377102 - RNA, 18 nt, Homo sapiens
agugucacugcuuguuau

SEQ ID NO: 1377103 - RNA, 21 nt, Homo sapiens
agugucacuuaccuagauuua

SEQ ID NO: 1377104 - RNA, 14 nt, Homo sapiens
agugugaucccaag

SEQ ID NO: 1377105 - RNA, 12 nt, Homo sapiens
agugugauucac

SEQ ID NO: 1377106 - RNA, 12 nt, Homo sapiens
aguguggcccag

SEQ ID NO: 1377107 - RNA, 13 nt, Homo sapiens
agugugugcaagu

SEQ ID NO: 1377108 - RNA, 13 nt, Homo sapiens
agugugugugcgu

SEQ ID NO: 1377109 - RNA, 17 nt, Homo sapiens
aguguuaucagucauaa

SEQ ID NO: 1377110 - RNA, 22 nt, Homo sapiens
aguguuaucagucauaacuaaa

SEQ ID NO: 1377111 - RNA, 12 nt, Homo sapiens
aguguugcuugg

SEQ ID NO: 1377112 - RNA, 23 nt, Homo sapiens
aguuaaagugaauaaccacuuaa

SEQ ID NO: 1377113 - RNA, 19 nt, Homo sapiens
aguuacuauccuggcuuug

SEQ ID NO: 1377114 - RNA, 13 nt, Homo sapiens
aguuacucauuca

SEQ ID NO: 1377115 - RNA, 14 nt, Homo sapiens
aguuagguuuaaca

SEQ ID NO: 1377116 - RNA, 16 nt, Homo sapiens
aguuaucuggcuucaa

SEQ ID NO: 1377117 - RNA, 21 nt, Homo sapiens
aguucaccuauuucaaaaauu

SEQ ID NO: 1377118 - RNA, 13 nt, Homo sapiens
aguucagacuuuu

SEQ ID NO: 1377119 - RNA, 14 nt, Homo sapiens
aguucagcuccuuc

SEQ ID NO: 1377120 - RNA, 18 nt, Homo sapiens
aguucauauguaccaugu

SEQ ID NO: 1377121 - RNA, 13 nt, Homo sapiens
aguucccuuggcc

SEQ ID NO: 1377122 - RNA, 15 nt, Homo sapiens
aguuccgacugccau

SEQ ID NO: 1377123 - RNA, 15 nt, Homo sapiens
aguugaggcauuugg

SEQ ID NO: 1377124 - RNA, 20 nt, Homo sapiens
aguugaucuacaaaggccau

SEQ ID NO: 1377125 - RNA, 15 nt, Homo sapiens
aguugauucagcucu

SEQ ID NO: 1377126 - RNA, 19 nt, Homo sapiens
aguugcugcauuccuaaac

SEQ ID NO: 1377127 - RNA, 18 nt, Homo sapiens
aguuggaagugugugauc

SEQ ID NO: 1377128 - RNA, 14 nt, Homo sapiens
aguuggacagcaaa

SEQ ID NO: 1377129 - RNA, 12 nt, Homo sapiens
aguuggugcugc

SEQ ID NO: 1377130 - RNA, 14 nt, Homo sapiens
aguuggugcugcuu

SEQ ID NO: 1377131 - RNA, 18 nt, Homo sapiens
aguuuaauaacuaccuaa

SEQ ID NO: 1377132 - RNA, 16 nt, Homo sapiens
aguuuacaaucagcca

SEQ ID NO: 1377133 - RNA, 19 nt, Homo sapiens
aguuuauacccguuucaca

SEQ ID NO: 1377134 - RNA, 17 nt, Homo sapiens
aguuuauauacaauuau

SEQ ID NO: 1377135 - RNA, 13 nt, Homo sapiens
aguuuaucuuuca

SEQ ID NO: 1377136 - RNA, 21 nt, Homo sapiens
auagccaccccaagagugguu

SEQ ID NO: 1377137 - RNA, 23 nt, Homo sapiens
auagccaccccagaaauggugaa

SEQ ID NO: 1377138 - RNA, 21 nt, Homo sapiens
augcaaauucccagauuugaa

SEQ ID NO: 1377139 - RNA, 14 nt, Homo sapiens
augcaaauucucaa

SEQ ID NO: 1377140 - RNA, 15 nt, Homo sapiens
augcaacaacaugua

SEQ ID NO: 1377141 - RNA, 21 nt, Homo sapiens
augcaagcaagaaacacuggg

SEQ ID NO: 1377142 - RNA, 22 nt, Homo sapiens
augcaaggaaggaaagaaagaa

SEQ ID NO: 1377143 - RNA, 14 nt, Homo sapiens
augcaaugugcuac

SEQ ID NO: 1377144 - RNA, 21 nt, Homo sapiens
augcaauuucauuuaaacuuc

SEQ ID NO: 1377145 - RNA, 20 nt, Homo sapiens
augcaccaaaucaucucuca

SEQ ID NO: 1377146 - RNA, 19 nt, Homo sapiens
augcacuugaaaugauggu

SEQ ID NO: 1377147 - RNA, 15 nt, Homo sapiens
augcauaaaauguua

SEQ ID NO: 1377148 - RNA, 12 nt, Homo sapiens
augcauacacuc

SEQ ID NO: 1377149 - RNA, 20 nt, Homo sapiens
augcauaggaaguauggcau

SEQ ID NO: 1377150 - RNA, 15 nt, Homo sapiens
augcauugcuaaaau

SEQ ID NO: 1377151 - RNA, 21 nt, Homo sapiens
augccaaccccgcccuaggcc

SEQ ID NO: 1377152 - RNA, 21 nt, Homo sapiens
augccaaccggucacccagga

SEQ ID NO: 1377153 - RNA, 23 nt, Homo sapiens
augccacagaguaugaaggaaga

SEQ ID NO: 1377154 - RNA, 17 nt, Homo sapiens
augccacccuguuuuca

SEQ ID NO: 1377155 - RNA, 17 nt, Homo sapiens
augccaccuccuggaag

SEQ ID NO: 1377156 - RNA, 17 nt, Homo sapiens
augccagcuuaucucag

SEQ ID NO: 1377157 - RNA, 19 nt, Homo sapiens
augccagggacugacaaaa

SEQ ID NO: 1377158 - RNA, 22 nt, Homo sapiens
augccagugaaacuucaagcaa

SEQ ID NO: 1377159 - RNA, 23 nt, Homo sapiens
augccagugaaacuucaagcaaa

SEQ ID NO: 1377160 - RNA, 12 nt, Homo sapiens
augccagugugc

SEQ ID NO: 1377161 - RNA, 16 nt, Homo sapiens
augccaucuguguccu

SEQ ID NO: 1377162 - RNA, 23 nt, Homo sapiens
augccauguggucauacucucag

SEQ ID NO: 1377163 - RNA, 14 nt, Homo sapiens
augcccacugagga

SEQ ID NO: 1377164 - RNA, 21 nt, Homo sapiens
augccccauggggcaucucuu

SEQ ID NO: 1377165 - RNA, 17 nt, Homo sapiens
augccuucacuuuacaa

SEQ ID NO: 1377166 - RNA, 14 nt, Homo sapiens
augcuaacaguuca

SEQ ID NO: 1377167 - RNA, 20 nt, Homo sapiens
augcuacugcugccuaguua

SEQ ID NO: 1377168 - RNA, 20 nt, Homo sapiens
augcuaguagcagugagcaa

SEQ ID NO: 1377169 - RNA, 22 nt, Homo sapiens
augcuaguuugaccucauuugu

SEQ ID NO: 1377170 - RNA, 16 nt, Homo sapiens
augcuauuucacucua

SEQ ID NO: 1377171 - RNA, 18 nt, Homo sapiens
augcucaguuggugcugc

SEQ ID NO: 1377172 - RNA, 16 nt, Homo sapiens
augcucuuuacuucau

SEQ ID NO: 1377173 - RNA, 14 nt, Homo sapiens
augcugccuaggcu

SEQ ID NO: 1377174 - RNA, 23 nt, Homo sapiens
augcuggcauuugcaccuaccuc

SEQ ID NO: 1377175 - RNA, 16 nt, Homo sapiens
augcuggcuguuggcu

SEQ ID NO: 1377176 - RNA, 19 nt, Homo sapiens
augcugugauugugccuac

SEQ ID NO: 1377177 - RNA, 15 nt, Homo sapiens
augcuguugccucau

SEQ ID NO: 1377178 - RNA, 16 nt, Homo sapiens
augcuucugacuucau

SEQ ID NO: 1377179 - RNA, 22 nt, Homo sapiens
augcuucugacuucauagauuu

SEQ ID NO: 1377180 - RNA, 14 nt, Homo sapiens
auggaauuacaugu

SEQ ID NO: 1377181 - RNA, 15 nt, Homo sapiens
auggaauuacaugua

SEQ ID NO: 1377182 - RNA, 15 nt, Homo sapiens
auggacauaagacag

SEQ ID NO: 1377183 - RNA, 20 nt, Homo sapiens
auggacuuccacugccaucc

SEQ ID NO: 1377184 - RNA, 17 nt, Homo sapiens
auggagcaugaauggua

SEQ ID NO: 1377185 - RNA, 16 nt, Homo sapiens
auggaggcacacagcu

SEQ ID NO: 1377186 - RNA, 16 nt, Homo sapiens
auggaguauaugucaa

SEQ ID NO: 1377187 - RNA, 16 nt, Homo sapiens
auggauagucugucca

SEQ ID NO: 1377188 - RNA, 17 nt, Homo sapiens
auggauaucccuaccuu

SEQ ID NO: 1377189 - RNA, 16 nt, Homo sapiens
auggauccccagugaa

SEQ ID NO: 1377190 - RNA, 14 nt, Homo sapiens
auggauuuccagcc

SEQ ID NO: 1377191 - RNA, 22 nt, Homo sapiens
auggcacagcccaaagaaggaa

SEQ ID NO: 1377192 - RNA, 22 nt, Homo sapiens
auggcaccacugcacuccagcc

SEQ ID NO: 1377193 - RNA, 12 nt, Homo sapiens
auggcauauaau

SEQ ID NO: 1377194 - RNA, 21 nt, Homo sapiens
auggcaugggggccucagggc

SEQ ID NO: 1377195 - RNA, 19 nt, Homo sapiens
auggccccugccuucccag

SEQ ID NO: 1377196 - RNA, 16 nt, Homo sapiens
auggccuuugcuuaug

SEQ ID NO: 1377197 - RNA, 16 nt, Homo sapiens
auggcuaccaaaaaga

SEQ ID NO: 1377198 - RNA, 17 nt, Homo sapiens
auggcugugccucugcc

SEQ ID NO: 1377199 - RNA, 19 nt, Homo sapiens
auggcuuuagcuaccucac

SEQ ID NO: 1377200 - RNA, 16 nt, Homo sapiens
augggacucaaugcac

SEQ ID NO: 1377201 - RNA, 15 nt, Homo sapiens
augggagacacugau

SEQ ID NO: 1377202 - RNA, 13 nt, Homo sapiens
augggagccucau

SEQ ID NO: 1377203 - RNA, 14 nt, Homo sapiens
auggggacauucca

SEQ ID NO: 1377204 - RNA, 17 nt, Homo sapiens
auggggccacagccaga

SEQ ID NO: 1377205 - RNA, 14 nt, Homo sapiens
augggggaugcuuc

SEQ ID NO: 1377206 - RNA, 13 nt, Homo sapiens
augggggccucag

SEQ ID NO: 1377207 - RNA, 18 nt, Homo sapiens
auggggugggguagggcu

SEQ ID NO: 1377208 - RNA, 21 nt, Homo sapiens
auggguuucuccagagggaau

SEQ ID NO: 1377209 - RNA, 21 nt, Homo sapiens
augguacuaguguuuuuuaga

SEQ ID NO: 1377210 - RNA, 20 nt, Homo sapiens
augguagugggugccuguaa

SEQ ID NO: 1377211 - RNA, 20 nt, Homo sapiens
augguauggaacucucucca

SEQ ID NO: 1377212 - RNA, 20 nt, Homo sapiens
auggucaacacuuaaggguu

SEQ ID NO: 1377213 - RNA, 14 nt, Homo sapiens
auggucccaaauga

SEQ ID NO: 1377214 - RNA, 21 nt, Homo sapiens
augguccuggggcucugugca

SEQ ID NO: 1377215 - RNA, 21 nt, Homo sapiens
auggugaaaccucaucucuac

SEQ ID NO: 1377216 - RNA, 14 nt, Homo sapiens
auggugauaaggga

SEQ ID NO: 1377217 - RNA, 19 nt, Homo sapiens
auggugcacugagcugcaa

SEQ ID NO: 1377218 - RNA, 17 nt, Homo sapiens
auggugggcacagaagu

SEQ ID NO: 1377219 - RNA, 14 nt, Homo sapiens
augguuuuguggau

SEQ ID NO: 1377220 - RNA, 13 nt, Homo sapiens
auguaacugcauu

SEQ ID NO: 1377221 - RNA, 17 nt, Homo sapiens
auguaagagcuuuacaa

SEQ ID NO: 1377222 - RNA, 21 nt, Homo sapiens
auguaauugaauaaaguugaa

SEQ ID NO: 1377223 - RNA, 19 nt, Homo sapiens
auguacaucuggccuugaa

SEQ ID NO: 1377224 - RNA, 21 nt, Homo sapiens
auguacaugaagaagcuaaau

SEQ ID NO: 1377225 - RNA, 22 nt, Homo sapiens
auguaggggccaagcagugccc

SEQ ID NO: 1377226 - RNA, 18 nt, Homo sapiens
auguaggguaaggugccu

SEQ ID NO: 1377227 - RNA, 15 nt, Homo sapiens
auguauaugcaauau

SEQ ID NO: 1377228 - RNA, 14 nt, Homo sapiens
auguauaugucauc

SEQ ID NO: 1377229 - RNA, 18 nt, Homo sapiens
auguaucaaugaguaaca

SEQ ID NO: 1377230 - RNA, 14 nt, Homo sapiens
auguauguauuuau

SEQ ID NO: 1377231 - RNA, 17 nt, Homo sapiens
auguauguguaccuaag

SEQ ID NO: 1377232 - RNA, 14 nt, Homo sapiens
auguauguuuacac

SEQ ID NO: 1377233 - RNA, 21 nt, Homo sapiens
auguauguuuacacugucaaa

SEQ ID NO: 1377234 - RNA, 20 nt, Homo sapiens
auguauuuguuugcaauuuu

SEQ ID NO: 1377235 - RNA, 14 nt, Homo sapiens
augucacucagaug

SEQ ID NO: 1377236 - RNA, 14 nt, Homo sapiens
augucagacuggcu

SEQ ID NO: 1377237 - RNA, 12 nt, Homo sapiens
augucagcuuau

SEQ ID NO: 1377238 - RNA, 22 nt, Homo sapiens
auguccaugauggaauauuccc

SEQ ID NO: 1377239 - RNA, 15 nt, Homo sapiens
auguccccaccaauc

SEQ ID NO: 1377240 - RNA, 22 nt, Homo sapiens
augucccuauggaagcauauug

SEQ ID NO: 1377241 - RNA, 15 nt, Homo sapiens
augucucagaccacu

SEQ ID NO: 1377242 - RNA, 17 nt, Homo sapiens
augucucagaccacuau

SEQ ID NO: 1377243 - RNA, 14 nt, Homo sapiens
augucuccaucucu

SEQ ID NO: 1377244 - RNA, 21 nt, Homo sapiens
augucucucagaauucuucag

SEQ ID NO: 1377245 - RNA, 20 nt, Homo sapiens
augucucuuuaaugucacag

SEQ ID NO: 1377246 - RNA, 20 nt, Homo sapiens
augucuuaaucaugagauaa

SEQ ID NO: 1377247 - RNA, 23 nt, Homo sapiens
augugaagagggagaagcaugaa

SEQ ID NO: 1377248 - RNA, 19 nt, Homo sapiens
cagagauaauucuagcuuu

SEQ ID NO: 1377249 - RNA, 15 nt, Homo sapiens
cagagcacuguauac

SEQ ID NO: 1377250 - RNA, 20 nt, Homo sapiens
cagagcagagaggcugaaua

SEQ ID NO: 1377251 - RNA, 17 nt, Homo sapiens
caggauggucucugcca

SEQ ID NO: 1377252 - RNA, 14 nt, Homo sapiens
caggcaaacuugca

SEQ ID NO: 1377253 - RNA, 15 nt, Homo sapiens
caggcaacgcacaaa

SEQ ID NO: 1377254 - RNA, 18 nt, Homo sapiens
caggcaacgcacaaaaca

SEQ ID NO: 1377255 - RNA, 16 nt, Homo sapiens
caggcaagcaccuccu

SEQ ID NO: 1377256 - RNA, 13 nt, Homo sapiens
caggcacacugag

SEQ ID NO: 1377257 - RNA, 23 nt, Homo sapiens
caggcacgaacccaccugcugag

SEQ ID NO: 1377258 - RNA, 18 nt, Homo sapiens
caggcagagaaucauacu

SEQ ID NO: 1377259 - RNA, 14 nt, Homo sapiens
caggcagcauuuag

SEQ ID NO: 1377260 - RNA, 22 nt, Homo sapiens
caggcaucugcuuuacucugga

SEQ ID NO: 1377261 - RNA, 17 nt, Homo sapiens
caggccauacuuuacaa

SEQ ID NO: 1377262 - RNA, 14 nt, Homo sapiens
caggcccaagagau

SEQ ID NO: 1377263 - RNA, 23 nt, Homo sapiens
caggcucugcccugcccuagcuc

SEQ ID NO: 1377264 - RNA, 13 nt, Homo sapiens
caggcuggucuca

SEQ ID NO: 1377265 - RNA, 15 nt, Homo sapiens
cagggaagcccagcu

SEQ ID NO: 1377266 - RNA, 19 nt, Homo sapiens
cagggaagcugucccucac

SEQ ID NO: 1377267 - RNA, 16 nt, Homo sapiens
cagggacauguggaaa

SEQ ID NO: 1377268 - RNA, 11 nt, Homo sapiens
cagggacccac

SEQ ID NO: 1377269 - RNA, 14 nt, Homo sapiens
cagggaggugaccc

SEQ ID NO: 1377270 - RNA, 17 nt, Homo sapiens
cagggauacccagugau

SEQ ID NO: 1377271 - RNA, 23 nt, Homo sapiens
cagggauuuguccuuggggacau

SEQ ID NO: 1377272 - RNA, 18 nt, Homo sapiens
cagggcagcagaucugua

SEQ ID NO: 1377273 - RNA, 18 nt, Homo sapiens
cagggcauuuugguccaa

SEQ ID NO: 1377274 - RNA, 20 nt, Homo sapiens
cagggcccugagcucggugg

SEQ ID NO: 1377275 - RNA, 14 nt, Homo sapiens
cagggccucaaagu

SEQ ID NO: 1377276 - RNA, 15 nt, Homo sapiens
cagggccuccagccc

SEQ ID NO: 1377277 - RNA, 18 nt, Homo sapiens
cagggcucagccuggugg

SEQ ID NO: 1377278 - RNA, 22 nt, Homo sapiens
cagggcucagccuggugggccu

SEQ ID NO: 1377279 - RNA, 12 nt, Homo sapiens
cagggcugugau

SEQ ID NO: 1377280 - RNA, 15 nt, Homo sapiens
cagggcuguguguac

SEQ ID NO: 1377281 - RNA, 15 nt, Homo sapiens
caggggaccacaccu

SEQ ID NO: 1377282 - RNA, 20 nt, Homo sapiens
cagggggugugucugcucag

SEQ ID NO: 1377283 - RNA, 18 nt, Homo sapiens
caggggucgucaccaccu

SEQ ID NO: 1377284 - RNA, 17 nt, Homo sapiens
cagguacagagaaggaa

SEQ ID NO: 1377285 - RNA, 23 nt, Homo sapiens
cagguaccccagcucugcuugcc

SEQ ID NO: 1377286 - RNA, 20 nt, Homo sapiens
cagguagaacacaaggucau

SEQ ID NO: 1377287 - RNA, 21 nt, Homo sapiens
cagguagaacacaaggucauu

SEQ ID NO: 1377288 - RNA, 14 nt, Homo sapiens
caggucaacuucag

SEQ ID NO: 1377289 - RNA, 16 nt, Homo sapiens
cagguccaauuuguaa

SEQ ID NO: 1377290 - RNA, 19 nt, Homo sapiens
cagguccucuacuuaauga

SEQ ID NO: 1377291 - RNA, 21 nt, Homo sapiens
caggugauccacccaccucag

SEQ ID NO: 1377292 - RNA, 19 nt, Homo sapiens
caggugccccucucuccau

SEQ ID NO: 1377293 - RNA, 14 nt, Homo sapiens
caggugcugccauc

SEQ ID NO: 1377294 - RNA, 15 nt, Homo sapiens
caggugcugccaucc

SEQ ID NO: 1377295 - RNA, 22 nt, Homo sapiens
caggugcugcucagcagaggau

SEQ ID NO: 1377296 - RNA, 20 nt, Homo sapiens
cagguggacacacaaggugc

SEQ ID NO: 1377297 - RNA, 16 nt, Homo sapiens
cagguuauacuccucc

SEQ ID NO: 1377298 - RNA, 22 nt, Homo sapiens
cagguucaugccaccauggcca

SEQ ID NO: 1377299 - RNA, 20 nt, Homo sapiens
cagguucugguuagcucagc

SEQ ID NO: 1377300 - RNA, 15 nt, Homo sapiens
cagguuggugggggc

SEQ ID NO: 1377301 - RNA, 23 nt, Homo sapiens
caguaaaaaacaacuucuuugua

SEQ ID NO: 1377302 - RNA, 10 nt, Homo sapiens
caguaacuga

SEQ ID NO: 1377303 - RNA, 12 nt, Homo sapiens
caguaacugaca

SEQ ID NO: 1377304 - RNA, 16 nt, Homo sapiens
caguagcuguggugag

SEQ ID NO: 1377305 - RNA, 16 nt, Homo sapiens
caguagucagacugga

SEQ ID NO: 1377306 - RNA, 13 nt, Homo sapiens
caguauauaacua

SEQ ID NO: 1377307 - RNA, 12 nt, Homo sapiens
caguaugcuugg

SEQ ID NO: 1377308 - RNA, 22 nt, Homo sapiens
caguauuuucccaauagcacuu

SEQ ID NO: 1377309 - RNA, 18 nt, Homo sapiens
cagucagaguugugcaca

SEQ ID NO: 1377310 - RNA, 19 nt, Homo sapiens
cagucagaguugugcacau

SEQ ID NO: 1377311 - RNA, 14 nt, Homo sapiens
cagucaucuugacc

SEQ ID NO: 1377312 - RNA, 11 nt, Homo sapiens
caguccagcuu

SEQ ID NO: 1377313 - RNA, 16 nt, Homo sapiens
caguccauagcagaga

SEQ ID NO: 1377314 - RNA, 14 nt, Homo sapiens
caguccucuuucaa

SEQ ID NO: 1377315 - RNA, 19 nt, Homo sapiens
caguccugccucagccucc

SEQ ID NO: 1377316 - RNA, 22 nt, Homo sapiens
cagucucggguggcuagucaga

SEQ ID NO: 1377317 - RNA, 11 nt, Homo sapiens
cagucuuccac

SEQ ID NO: 1377318 - RNA, 17 nt, Homo sapiens
cagugaaagcagucauc

SEQ ID NO: 1377319 - RNA, 14 nt, Homo sapiens
cagugaaagccaga

SEQ ID NO: 1377320 - RNA, 20 nt, Homo sapiens
cagugagcuguguucuugcc

SEQ ID NO: 1377321 - RNA, 19 nt, Homo sapiens
cagugaguucagccuuuaa

SEQ ID NO: 1377322 - RNA, 21 nt, Homo sapiens
cagugcaacacugaagcucuu

SEQ ID NO: 1377323 - RNA, 17 nt, Homo sapiens
cagugcacccacucugc

SEQ ID NO: 1377324 - RNA, 16 nt, Homo sapiens
cagugcccucauuuua

SEQ ID NO: 1377325 - RNA, 22 nt, Homo sapiens
cagugcccuggggcugaucuca

SEQ ID NO: 1377326 - RNA, 15 nt, Homo sapiens
cagugcuguacuuga

SEQ ID NO: 1377327 - RNA, 22 nt, Homo sapiens
cagugcuguacuugaugacaga

SEQ ID NO: 1377328 - RNA, 21 nt, Homo sapiens
cagugggugccccccuugcca

SEQ ID NO: 1377329 - RNA, 14 nt, Homo sapiens
caguguacauggaa

SEQ ID NO: 1377330 - RNA, 21 nt, Homo sapiens
caguguauguacuaagcagua

SEQ ID NO: 1377331 - RNA, 12 nt, Homo sapiens
cagugucauuua

SEQ ID NO: 1377332 - RNA, 16 nt, Homo sapiens
cagugucuuccauaau

SEQ ID NO: 1377333 - RNA, 17 nt, Homo sapiens
cagugucuuuccaccuu

SEQ ID NO: 1377334 - RNA, 20 nt, Homo sapiens
caguguguuucugaucugau

SEQ ID NO: 1377335 - RNA, 20 nt, Homo sapiens
caguguuauuaaugacaaag

SEQ ID NO: 1377336 - RNA, 22 nt, Homo sapiens
caguuaaggggagcaacagagg

SEQ ID NO: 1377337 - RNA, 14 nt, Homo sapiens
caguucagcuccuu

SEQ ID NO: 1377338 - RNA, 21 nt, Homo sapiens
caguucaggagucccaaggaa

SEQ ID NO: 1377339 - RNA, 13 nt, Homo sapiens
caguuccaaaaga

SEQ ID NO: 1377340 - RNA, 14 nt, Homo sapiens
caguugcuuugcag

SEQ ID NO: 1377341 - RNA, 13 nt, Homo sapiens
caguuggugcugc

SEQ ID NO: 1377342 - RNA, 19 nt, Homo sapiens
caguuuaccgaaaaucaua

SEQ ID NO: 1377343 - RNA, 15 nt, Homo sapiens
caguuucccuaucuc

SEQ ID NO: 1377344 - RNA, 17 nt, Homo sapiens
cauaaacugugugcaga

SEQ ID NO: 1377345 - RNA, 15 nt, Homo sapiens
cauaaauuguacugu

SEQ ID NO: 1377346 - RNA, 22 nt, Homo sapiens
cauaacagucuuacugcaggca

SEQ ID NO: 1377347 - RNA, 15 nt, Homo sapiens
cauaagaaaagauua

SEQ ID NO: 1377348 - RNA, 15 nt, Homo sapiens
cauaagcuacugaug

SEQ ID NO: 1377349 - RNA, 17 nt, Homo sapiens
cauaaguagagacugaa

SEQ ID NO: 1377350 - RNA, 18 nt, Homo sapiens
cauaagugcaugacauau

SEQ ID NO: 1377351 - RNA, 18 nt, Homo sapiens
cauaaguuaacuuccaau

SEQ ID NO: 1377352 - RNA, 21 nt, Homo sapiens
cauaauaaaaggaguucagau

SEQ ID NO: 1377353 - RNA, 17 nt, Homo sapiens
cauaauaagcuaaagag

SEQ ID NO: 1377354 - RNA, 18 nt, Homo sapiens
cauaauguuacauuauua

SEQ ID NO: 1377355 - RNA, 21 nt, Homo sapiens
cauaauguuacauuauuauca

SEQ ID NO: 1377356 - RNA, 22 nt, Homo sapiens
cauaauuccauaugcuguuuca

SEQ ID NO: 1377357 - RNA, 16 nt, Homo sapiens
cauaauuguucuuagu

SEQ ID NO: 1377358 - RNA, 13 nt, Homo sapiens
cauacaauuccaa

SEQ ID NO: 1377359 - RNA, 19 nt, Homo sapiens
cauacacauauauacacac

SEQ ID NO: 1377360 - RNA, 14 nt, Homo sapiens
caugugugugcaag

SEQ ID NO: 1377361 - RNA, 15 nt, Homo sapiens
cauuaaacaugacau

SEQ ID NO: 1377362 - RNA, 14 nt, Homo sapiens
cauuaauacaaaga

SEQ ID NO: 1377363 - RNA, 20 nt, Homo sapiens
cauuaccagacgguucacca

SEQ ID NO: 1377364 - RNA, 16 nt, Homo sapiens
cauuaccuugugcuaa

SEQ ID NO: 1377365 - RNA, 15 nt, Homo sapiens
aucccagcacuuugg

SEQ ID NO: 1377366 - RNA, 12 nt, Homo sapiens
aucccaucccau

SEQ ID NO: 1377367 - RNA, 15 nt, Homo sapiens
cugcugccccaaagg

SEQ ID NO: 1377368 - RNA, 18 nt, Homo sapiens
cugcugcuccagugcagg

SEQ ID NO: 1377369 - RNA, 16 nt, Homo sapiens
cugcuucaaauauuuc

SEQ ID NO: 1377370 - RNA, 20 nt, Homo sapiens
cugcuuccaauuuucuggaa

SEQ ID NO: 1377371 - RNA, 19 nt, Homo sapiens
cugcuucuaccaacuggaa

SEQ ID NO: 1377372 - RNA, 17 nt, Homo sapiens
cugcuucuuuucacuuc

SEQ ID NO: 1377373 - RNA, 22 nt, Homo sapiens
cugcuucuuuucacuucagagc

SEQ ID NO: 1377374 - RNA, 14 nt, Homo sapiens
cugcuuucuuguug

SEQ ID NO: 1377375 - RNA, 20 nt, Homo sapiens
cugcuuucuuguugcugcau

SEQ ID NO: 1377376 - RNA, 16 nt, Homo sapiens
cuggaaagacauagcc

SEQ ID NO: 1377377 - RNA, 20 nt, Homo sapiens
cuggaaaggaggaaggagcc

SEQ ID NO: 1377378 - RNA, 15 nt, Homo sapiens
cuggaauuauuuuag

SEQ ID NO: 1377379 - RNA, 13 nt, Homo sapiens
cuggaauugcuca

SEQ ID NO: 1377380 - RNA, 12 nt, Homo sapiens
cuggacucagga

SEQ ID NO: 1377381 - RNA, 11 nt, Homo sapiens
cuggacuguca

SEQ ID NO: 1377382 - RNA, 16 nt, Homo sapiens
cuggagauggggagaa

SEQ ID NO: 1377383 - RNA, 20 nt, Homo sapiens
cuggagucaaaacacuugua

SEQ ID NO: 1377384 - RNA, 20 nt, Homo sapiens
cuggagugcaguggugcuau

SEQ ID NO: 1377385 - RNA, 21 nt, Homo sapiens
cuggaucuaccagcauaaaua

SEQ ID NO: 1377386 - RNA, 13 nt, Homo sapiens
cuggaugucucca

SEQ ID NO: 1377387 - RNA, 15 nt, Homo sapiens
cuggauucgugacaa

SEQ ID NO: 1377388 - RNA, 15 nt, Homo sapiens
cuggcaagaaugugu

SEQ ID NO: 1377389 - RNA, 22 nt, Homo sapiens
cuggcagaaagcaaaugugacc

SEQ ID NO: 1377390 - RNA, 19 nt, Homo sapiens
cuggccagaugcaccagcc

SEQ ID NO: 1377391 - RNA, 23 nt, Homo sapiens
cuggccaguuggaaccacggaga

SEQ ID NO: 1377392 - RNA, 22 nt, Homo sapiens
cuggcccaagugguuugugcua

SEQ ID NO: 1377393 - RNA, 14 nt, Homo sapiens
cuggcccagccaaa

SEQ ID NO: 1377394 - RNA, 16 nt, Homo sapiens
cuggccucagacucau

SEQ ID NO: 1377395 - RNA, 13 nt, Homo sapiens
cuggcgugcagug

SEQ ID NO: 1377396 - RNA, 14 nt, Homo sapiens
cuggcucucagaag

SEQ ID NO: 1377397 - RNA, 23 nt, Homo sapiens
cuggcugcaaaggguaucaggug

SEQ ID NO: 1377398 - RNA, 13 nt, Homo sapiens
cuggcugcaguga

SEQ ID NO: 1377399 - RNA, 18 nt, Homo sapiens
cugggauuacaagcguga

SEQ ID NO: 1377400 - RNA, 22 nt, Homo sapiens
cugggauuacaauugugagcca

SEQ ID NO: 1377401 - RNA, 15 nt, Homo sapiens
cugggauuacaggug

SEQ ID NO: 1377402 - RNA, 15 nt, Homo sapiens
cugggcaacacagcg

SEQ ID NO: 1377403 - RNA, 16 nt, Homo sapiens
cugggcagaaggccaa

SEQ ID NO: 1377404 - RNA, 22 nt, Homo sapiens
cugggcagcauagcaagacaca

SEQ ID NO: 1377405 - RNA, 16 nt, Homo sapiens
cugggccaagucaaag

SEQ ID NO: 1377406 - RNA, 15 nt, Homo sapiens
cugggccccaccacc

SEQ ID NO: 1377407 - RNA, 23 nt, Homo sapiens
cugggcucgccacaucccaugag

SEQ ID NO: 1377408 - RNA, 22 nt, Homo sapiens
cugggcugcuacccagaaauca

SEQ ID NO: 1377409 - RNA, 12 nt, Homo sapiens
cugggcuuugau

SEQ ID NO: 1377410 - RNA, 14 nt, Homo sapiens
cuggggcucugugc

SEQ ID NO: 1377411 - RNA, 22 nt, Homo sapiens
cugggggaggggacauugaaca

SEQ ID NO: 1377412 - RNA, 20 nt, Homo sapiens
cugggggccugaccuccccc

SEQ ID NO: 1377413 - RNA, 21 nt, Homo sapiens
cugggucucgcuuuguugccc

SEQ ID NO: 1377414 - RNA, 23 nt, Homo sapiens
cugggucucgcuuuguugcccag

SEQ ID NO: 1377415 - RNA, 15 nt, Homo sapiens
cuggucccuugcagc

SEQ ID NO: 1377416 - RNA, 13 nt, Homo sapiens
cugguccuuccag

SEQ ID NO: 1377417 - RNA, 15 nt, Homo sapiens
cuggucucaaacucc

SEQ ID NO: 1377418 - RNA, 15 nt, Homo sapiens
cuggugacaccagcc

SEQ ID NO: 1377419 - RNA, 16 nt, Homo sapiens
cuggugacccagucag

SEQ ID NO: 1377420 - RNA, 19 nt, Homo sapiens
cugguggcccgacagccug

SEQ ID NO: 1377421 - RNA, 23 nt, Homo sapiens
cuggugggcuagccaauagaguu

SEQ ID NO: 1377422 - RNA, 12 nt, Homo sapiens
cuguaauagugu

SEQ ID NO: 1377423 - RNA, 21 nt, Homo sapiens
cuguaauccuagcacuuuggg

SEQ ID NO: 1377424 - RNA, 15 nt, Homo sapiens
cuguaaugacaaaua

SEQ ID NO: 1377425 - RNA, 23 nt, Homo sapiens
cuguacaaaguagaagucuuaga

SEQ ID NO: 1377426 - RNA, 14 nt, Homo sapiens
cuguacaauugcau

SEQ ID NO: 1377427 - RNA, 14 nt, Homo sapiens
cuguacacacuuua

SEQ ID NO: 1377428 - RNA, 22 nt, Homo sapiens
cuguacuccagccugggugaca

SEQ ID NO: 1377429 - RNA, 23 nt, Homo sapiens
cuguagaaaugaugauguggaag

SEQ ID NO: 1377430 - RNA, 22 nt, Homo sapiens
cuguagaaugauuucaugcuau

SEQ ID NO: 1377431 - RNA, 18 nt, Homo sapiens
cuguagcauuacaguggg

SEQ ID NO: 1377432 - RNA, 14 nt, Homo sapiens
cuguagucccagcu

SEQ ID NO: 1377433 - RNA, 21 nt, Homo sapiens
cuguagucccagcuacucggg

SEQ ID NO: 1377434 - RNA, 16 nt, Homo sapiens
cuguauauacaauaac

SEQ ID NO: 1377435 - RNA, 12 nt, Homo sapiens
cuguauuccuag

SEQ ID NO: 1377436 - RNA, 17 nt, Homo sapiens
cuguauuucaagaccuc

SEQ ID NO: 1377437 - RNA, 12 nt, Homo sapiens
cugucaaacaaa

SEQ ID NO: 1377438 - RNA, 18 nt, Homo sapiens
cugucaaacaaagccaga

SEQ ID NO: 1377439 - RNA, 19 nt, Homo sapiens
cugucaaagaaucaaucca

SEQ ID NO: 1377440 - RNA, 19 nt, Homo sapiens
cugucaaguuaacaaggaa

SEQ ID NO: 1377441 - RNA, 15 nt, Homo sapiens
cugucagucugcuua

SEQ ID NO: 1377442 - RNA, 18 nt, Homo sapiens
cugucaucagccugugua

SEQ ID NO: 1377443 - RNA, 13 nt, Homo sapiens
cuguccaaaugga

SEQ ID NO: 1377444 - RNA, 14 nt, Homo sapiens
cuguccuugcacac

SEQ ID NO: 1377445 - RNA, 17 nt, Homo sapiens
cuguccuugcacacucc

SEQ ID NO: 1377446 - RNA, 17 nt, Homo sapiens
cugucucaccauguaca

SEQ ID NO: 1377447 - RNA, 13 nt, Homo sapiens
cugucucugcuau

SEQ ID NO: 1377448 - RNA, 21 nt, Homo sapiens
cugucuggaggggagcucugu

SEQ ID NO: 1377449 - RNA, 14 nt, Homo sapiens
cugucuuugcugag

SEQ ID NO: 1377450 - RNA, 22 nt, Homo sapiens
cugugaaaugcuggcauuugca

SEQ ID NO: 1377451 - RNA, 18 nt, Homo sapiens
cugugaccaggaaggaag

SEQ ID NO: 1377452 - RNA, 22 nt, Homo sapiens
cugugacucgagucacacucaa

SEQ ID NO: 1377453 - RNA, 11 nt, Homo sapiens
cugugcaauaa

SEQ ID NO: 1377454 - RNA, 21 nt, Homo sapiens
cugugcacggccagcugcauc

SEQ ID NO: 1377455 - RNA, 23 nt, Homo sapiens
cugugcugugacucgagucacac

SEQ ID NO: 1377456 - RNA, 18 nt, Homo sapiens
cuguggaugauaaaacac

SEQ ID NO: 1377457 - RNA, 15 nt, Homo sapiens
cuguggcugcuagca

SEQ ID NO: 1377458 - RNA, 18 nt, Homo sapiens
cugugguuacagugcaga

SEQ ID NO: 1377459 - RNA, 21 nt, Homo sapiens
cuguguaaaacuauauucuca

SEQ ID NO: 1377460 - RNA, 19 nt, Homo sapiens
cuguguacacaugggaguu

SEQ ID NO: 1377461 - RNA, 20 nt, Homo sapiens
cugugucaggaaacauauuu

SEQ ID NO: 1377462 - RNA, 19 nt, Homo sapiens
cuguguccuugcaccugca

SEQ ID NO: 1377463 - RNA, 15 nt, Homo sapiens
cugugugaaggugaa

SEQ ID NO: 1377464 - RNA, 23 nt, Homo sapiens
cugugugaccucaggccagugug

SEQ ID NO: 1377465 - RNA, 23 nt, Homo sapiens
cugugugcaagugugugcacaug

SEQ ID NO: 1377466 - RNA, 15 nt, Homo sapiens
cuguguggacuguga

SEQ ID NO: 1377467 - RNA, 21 nt, Homo sapiens
cuguguggacugugaugccac

SEQ ID NO: 1377468 - RNA, 22 nt, Homo sapiens
cuguguggacugugaugccaca

SEQ ID NO: 1377469 - RNA, 19 nt, Homo sapiens
cuguguguuuuaguuucau

SEQ ID NO: 1377470 - RNA, 13 nt, Homo sapiens
cuuaaacuuucaa

SEQ ID NO: 1377471 - RNA, 14 nt, Homo sapiens
cuuaacauucugua

SEQ ID NO: 1377472 - RNA, 22 nt, Homo sapiens
cuuaacauuucuaacucugaug

SEQ ID NO: 1377473 - RNA, 13 nt, Homo sapiens
cuuaaccccagua

SEQ ID NO: 1377474 - RNA, 18 nt, Homo sapiens
cuuaacugcauuuuuaga

SEQ ID NO: 1377475 - RNA, 12 nt, Homo sapiens
cuuaagauuugg

SEQ ID NO: 1377476 - RNA, 14 nt, Homo sapiens
cuuaauauguuaac

SEQ ID NO: 1377477 - RNA, 23 nt, Homo sapiens
cuuaaucaguguagccccaagaa

SEQ ID NO: 1377478 - RNA, 22 nt, Homo sapiens
cuuaauggcucaugaccuggaa

SEQ ID NO: 1377479 - RNA, 18 nt, Homo sapiens
cuuacaaacaugugguua

SEQ ID NO: 1377480 - RNA, 15 nt, Homo sapiens
cuuacacaucuucca

SEQ ID NO: 1377481 - RNA, 16 nt, Homo sapiens
cuuaccuugcaucuca

SEQ ID NO: 1377482 - RNA, 23 nt, Homo sapiens
cuuacugcuugguccuugauuua

SEQ ID NO: 1377483 - RNA, 15 nt, Homo sapiens
cuuacuggcaaacau

SEQ ID NO: 1377484 - RNA, 14 nt, Homo sapiens
cuuacuguaacgga

SEQ ID NO: 1377485 - RNA, 14 nt, Homo sapiens
cuuacuguugcaua

SEQ ID NO: 1377486 - RNA, 21 nt, Homo sapiens
cuuacuucccuaaugaaguua

SEQ ID NO: 1377487 - RNA, 14 nt, Homo sapiens
cuuagaaaaaccac

SEQ ID NO: 1377488 - RNA, 18 nt, Homo sapiens
cuuagaaauugcauuucc

SEQ ID NO: 1377489 - RNA, 14 nt, Homo sapiens
cuuagcaacuuggg

SEQ ID NO: 1377490 - RNA, 22 nt, Homo sapiens
cuuagcagcuaucucucaguga

SEQ ID NO: 1377491 - RNA, 21 nt, Homo sapiens
cuuagcaugaauccuacauac

SEQ ID NO: 1377492 - RNA, 11 nt, Homo sapiens
cuuagcucaca

SEQ ID NO: 1377493 - RNA, 18 nt, Homo sapiens
cuuagugaaauuacuucu

SEQ ID NO: 1377494 - RNA, 15 nt, Homo sapiens
cuuauacauuugaua

SEQ ID NO: 1377495 - RNA, 22 nt, Homo sapiens
cuuaucaguaguaucaaugauu

SEQ ID NO: 1377496 - RNA, 19 nt, Homo sapiens
cuuauccguuagccguggu

SEQ ID NO: 1377497 - RNA, 19 nt, Homo sapiens
cuuauuaauuugacuagaa

SEQ ID NO: 1377498 - RNA, 16 nt, Homo sapiens
cuuauuuaacuuaaca

SEQ ID NO: 1377499 - RNA, 13 nt, Homo sapiens
cuuauuuccucau

SEQ ID NO: 1377500 - RNA, 17 nt, Homo sapiens
cuuauuuuugacagugu

SEQ ID NO: 1377501 - RNA, 21 nt, Homo sapiens
cuucaacugaccagccuccau

SEQ ID NO: 1377502 - RNA, 19 nt, Homo sapiens
cuucaaucucuugcacuca

SEQ ID NO: 1377503 - RNA, 23 nt, Homo sapiens
cuucacagaugugugauucacag

SEQ ID NO: 1377504 - RNA, 14 nt, Homo sapiens
cuucacaguguuuc

SEQ ID NO: 1377505 - RNA, 15 nt, Homo sapiens
cuucacaugcaucaa

SEQ ID NO: 1377506 - RNA, 21 nt, Homo sapiens
cuucacuucaguugcuuugca

SEQ ID NO: 1377507 - RNA, 23 nt, Homo sapiens
cuucagaagacacugcaaaggcg

SEQ ID NO: 1377508 - RNA, 15 nt, Homo sapiens
cuucagacguguaug

SEQ ID NO: 1377509 - RNA, 18 nt, Homo sapiens
cuucagacugaacaugua

SEQ ID NO: 1377510 - RNA, 15 nt, Homo sapiens
cuucagagacuaucu

SEQ ID NO: 1377511 - RNA, 23 nt, Homo sapiens
cuucagagacuaucugauuuccu

SEQ ID NO: 1377512 - RNA, 22 nt, Homo sapiens
cuucagguucuuagugucacuu

SEQ ID NO: 1377513 - RNA, 22 nt, Homo sapiens
cuucagucuugaauuucuaaaa

SEQ ID NO: 1377514 - RNA, 16 nt, Homo sapiens
cuucagugggagaaaa

SEQ ID NO: 1377515 - RNA, 20 nt, Homo sapiens
cuucauaauuucuucacuca

SEQ ID NO: 1377516 - RNA, 19 nt, Homo sapiens
cuucauauaccagcaauau

SEQ ID NO: 1377517 - RNA, 19 nt, Homo sapiens
cuucauccuuagcaacagc

SEQ ID NO: 1377518 - RNA, 21 nt, Homo sapiens
cuucauguaacuucccugaaa

SEQ ID NO: 1377519 - RNA, 18 nt, Homo sapiens
cuucauuugaugcuaaau

SEQ ID NO: 1377520 - RNA, 18 nt, Homo sapiens
cuuccaacguggcccaga

SEQ ID NO: 1377521 - RNA, 13 nt, Homo sapiens
cuuccaacugcug

SEQ ID NO: 1377522 - RNA, 19 nt, Homo sapiens
cuuccaaggguacuaagga

SEQ ID NO: 1377523 - RNA, 21 nt, Homo sapiens
cuuccaauuuacauacucugc

SEQ ID NO: 1377524 - RNA, 19 nt, Homo sapiens
cuuccacaauucacuagac

SEQ ID NO: 1377525 - RNA, 21 nt, Homo sapiens
cuuccacacucaccucuaaaa

SEQ ID NO: 1377526 - RNA, 19 nt, Homo sapiens
cuuccagcacccugcaaaa

SEQ ID NO: 1377527 - RNA, 21 nt, Homo sapiens
cuuccaggggagguucaguga

SEQ ID NO: 1377528 - RNA, 18 nt, Homo sapiens
cuuccagugcaacacuga

SEQ ID NO: 1377529 - RNA, 20 nt, Homo sapiens
cuuccagugcaacacugaag

SEQ ID NO: 1377530 - RNA, 12 nt, Homo sapiens
cuuccaugagaa

SEQ ID NO: 1377531 - RNA, 24 nt, Homo sapiens
cuuccauuaacuuagcauguguug

SEQ ID NO: 1377532 - RNA, 12 nt, Homo sapiens
cuuccauuugcu

SEQ ID NO: 1377533 - RNA, 13 nt, Homo sapiens
cuuccccuugccc

SEQ ID NO: 1377534 - RNA, 19 nt, Homo sapiens
cuucccgaaccccaaggag

SEQ ID NO: 1377535 - RNA, 22 nt, Homo sapiens
cuucccggcgucccuaccuccu

SEQ ID NO: 1377536 - RNA, 15 nt, Homo sapiens
cuucccuacauggag

SEQ ID NO: 1377537 - RNA, 13 nt, Homo sapiens
cuucccuaccuca

SEQ ID NO: 1377538 - RNA, 14 nt, Homo sapiens
cuuccgccgucuca

SEQ ID NO: 1377539 - RNA, 23 nt, Homo sapiens
cuuccggucggcuggccagcuga

SEQ ID NO: 1377540 - RNA, 15 nt, Homo sapiens
cuuccuggaagcaga

SEQ ID NO: 1377541 - RNA, 20 nt, Homo sapiens
cuuccuggcuccaacacugc

SEQ ID NO: 1377542 - RNA, 14 nt, Homo sapiens
cuuccuguccagag

SEQ ID NO: 1377543 - RNA, 16 nt, Homo sapiens
cuuccuguccagagag

SEQ ID NO: 1377544 - RNA, 16 nt, Homo sapiens
cuuccugugacuucag

SEQ ID NO: 1377545 - RNA, 15 nt, Homo sapiens
cuuccuugaccagca

SEQ ID NO: 1377546 - RNA, 13 nt, Homo sapiens
cuucgacugugac

SEQ ID NO: 1377547 - RNA, 14 nt, Homo sapiens
cuucggacaacuca

SEQ ID NO: 1377548 - RNA, 13 nt, Homo sapiens
cuucuagaaccag

SEQ ID NO: 1377549 - RNA, 22 nt, Homo sapiens
cuucuauuccauggcuaacugg

SEQ ID NO: 1377550 - RNA, 23 nt, Homo sapiens
cuucucacucccuucuccuugau

SEQ ID NO: 1377551 - RNA, 15 nt, Homo sapiens
cuucuccccauucug

SEQ ID NO: 1377552 - RNA, 22 nt, Homo sapiens
cuucuccuaggauuccuaagac

SEQ ID NO: 1377553 - RNA, 19 nt, Homo sapiens
cuucucgugacaccaccaa

SEQ ID NO: 1377554 - RNA, 14 nt, Homo sapiens
cuucucuccagugc

SEQ ID NO: 1377555 - RNA, 18 nt, Homo sapiens
cuucucugcccauucccc

SEQ ID NO: 1377556 - RNA, 15 nt, Homo sapiens
cuucucuuuaacuca

SEQ ID NO: 1377557 - RNA, 14 nt, Homo sapiens
cuucugcaaaaaac

SEQ ID NO: 1377558 - RNA, 16 nt, Homo sapiens
cuucugggaacuuccu

SEQ ID NO: 1377559 - RNA, 18 nt, Homo sapiens
cuucugggaacuuccuca

SEQ ID NO: 1377560 - RNA, 16 nt, Homo sapiens
cuucugggaagacaac

SEQ ID NO: 1377561 - RNA, 19 nt, Homo sapiens
cuucuuacaugcauuugag

SEQ ID NO: 1377562 - RNA, 13 nt, Homo sapiens
cuucuuugcccac

SEQ ID NO: 1377563 - RNA, 17 nt, Homo sapiens
cuucuuuuuguucuuca

SEQ ID NO: 1377564 - RNA, 15 nt, Homo sapiens
cuugaaaagacauca

SEQ ID NO: 1377565 - RNA, 21 nt, Homo sapiens
cuugaaaagacaucaagcaca

SEQ ID NO: 1377566 - RNA, 23 nt, Homo sapiens
cuugaaaagacaucaagcacaga

SEQ ID NO: 1377567 - RNA, 23 nt, Homo sapiens
cuugaaagaaaggggcaggagcu

SEQ ID NO: 1377568 - RNA, 20 nt, Homo sapiens
cuugaaagucaugaacacau

SEQ ID NO: 1377569 - RNA, 18 nt, Homo sapiens
cuugaagacaauggcuua

SEQ ID NO: 1377570 - RNA, 15 nt, Homo sapiens
cuugaagggcccaga

SEQ ID NO: 1377571 - RNA, 23 nt, Homo sapiens
cuugaccaagcaggaagcucaga

SEQ ID NO: 1377572 - RNA, 16 nt, Homo sapiens
cuugaccagcagaucc

SEQ ID NO: 1377573 - RNA, 15 nt, Homo sapiens
gaauaaugcuguuuu

SEQ ID NO: 1377574 - RNA, 17 nt, Homo sapiens
gaauacuaaauuauagu

SEQ ID NO: 1377575 - RNA, 19 nt, Homo sapiens
gaauacugaguauguggaa

SEQ ID NO: 1377576 - RNA, 15 nt, Homo sapiens
gaauagaugcugacu

SEQ ID NO: 1377577 - RNA, 21 nt, Homo sapiens
gaauauauuauaaucuuccau

SEQ ID NO: 1377578 - RNA, 19 nt, Homo sapiens
gaauauggugggcacagaa

SEQ ID NO: 1377579 - RNA, 15 nt, Homo sapiens
gaaucacuugcacuc

SEQ ID NO: 1377580 - RNA, 16 nt, Homo sapiens
gaaucacuugcacucc

SEQ ID NO: 1377581 - RNA, 19 nt, Homo sapiens
gaaucccuaagccuagcug

SEQ ID NO: 1377582 - RNA, 14 nt, Homo sapiens
gaaucuugcguuuu

SEQ ID NO: 1377583 - RNA, 16 nt, Homo sapiens
gaaugaugugauacaa

SEQ ID NO: 1377584 - RNA, 22 nt, Homo sapiens
gaaugcaaaguagcaauuucca

SEQ ID NO: 1377585 - RNA, 17 nt, Homo sapiens
gacugcaccauugcugc

SEQ ID NO: 1377586 - RNA, 14 nt, Homo sapiens
gacugcugagucaa

SEQ ID NO: 1377587 - RNA, 23 nt, Homo sapiens
gacugcugcuucuuaaccccagu

SEQ ID NO: 1377588 - RNA, 13 nt, Homo sapiens
gacuggcuuuguc

SEQ ID NO: 1377589 - RNA, 21 nt, Homo sapiens
gacugguggccccugccuugg

SEQ ID NO: 1377590 - RNA, 17 nt, Homo sapiens
gacuguacacacuuuau

SEQ ID NO: 1377591 - RNA, 20 nt, Homo sapiens
gacuucaaaaacugucaaag

SEQ ID NO: 1377592 - RNA, 17 nt, Homo sapiens
gacuucauuuuuccuaa

SEQ ID NO: 1377593 - RNA, 16 nt, Homo sapiens
gacuuccccgcauucc

SEQ ID NO: 1377594 - RNA, 16 nt, Homo sapiens
gacuugaaauacuacu

SEQ ID NO: 1377595 - RNA, 18 nt, Homo sapiens
gacuugacagaacacugu

SEQ ID NO: 1377596 - RNA, 22 nt, Homo sapiens
gacuugcugaaucggaaucucu

SEQ ID NO: 1377597 - RNA, 20 nt, Homo sapiens
gagguagcacuacaaacaca

SEQ ID NO: 1377598 - RNA, 16 nt, Homo sapiens
gaggucucuugaggga

SEQ ID NO: 1377599 - RNA, 18 nt, Homo sapiens
gaggucuuuugacaugug

SEQ ID NO: 1377600 - RNA, 17 nt, Homo sapiens
gaggugagggaagccug

SEQ ID NO: 1377601 - RNA, 17 nt, Homo sapiens
gagguggcugccuggag

SEQ ID NO: 1377602 - RNA, 15 nt, Homo sapiens
gagguuauaggucac

SEQ ID NO: 1377603 - RNA, 14 nt, Homo sapiens
gagguugcagggag

SEQ ID NO: 1377604 - RNA, 20 nt, Homo sapiens
gagguugucuguggccagaa

SEQ ID NO: 1377605 - RNA, 15 nt, Homo sapiens
gaguacaaacacagg

SEQ ID NO: 1377606 - RNA, 22 nt, Homo sapiens
gaguacuuugaagaugucaucc

SEQ ID NO: 1377607 - RNA, 18 nt, Homo sapiens
gaguagccccaacccaaa

SEQ ID NO: 1377608 - RNA, 18 nt, Homo sapiens
gagucaacuccuuucuca

SEQ ID NO: 1377609 - RNA, 13 nt, Homo sapiens
gagucacugccuc

SEQ ID NO: 1377610 - RNA, 23 nt, Homo sapiens
uagauaaaagaaccgagcaauuu

SEQ ID NO: 1377611 - RNA, 16 nt, Homo sapiens
uagauaaacucagaaa

SEQ ID NO: 1377612 - RNA, 23 nt, Homo sapiens
uagauaaccuguacuucaaguua

SEQ ID NO: 1377613 - RNA, 15 nt, Homo sapiens
uagauauaugcucug

SEQ ID NO: 1377614 - RNA, 14 nt, Homo sapiens
uagaugugucuuac

SEQ ID NO: 1377615 - RNA, 17 nt, Homo sapiens
uagaugugucuuaccag

SEQ ID NO: 1377616 - RNA, 14 nt, Homo sapiens
uagauuuuggcaaa

SEQ ID NO: 1377617 - RNA, 14 nt, Homo sapiens
uagcaaaauugagg

SEQ ID NO: 1377618 - RNA, 16 nt, Homo sapiens
uagcaauugacuguca

SEQ ID NO: 1377619 - RNA, 17 nt, Homo sapiens
uagcacuauuuacauac

SEQ ID NO: 1377620 - RNA, 14 nt, Homo sapiens
uagcagacaguguu

SEQ ID NO: 1377621 - RNA, 20 nt, Homo sapiens
uagcagaggagccauguccu

SEQ ID NO: 1377622 - RNA, 18 nt, Homo sapiens
uagcagggaaacagcuaa

SEQ ID NO: 1377623 - RNA, 18 nt, Homo sapiens
uagcauuugucaacaaag

SEQ ID NO: 1377624 - RNA, 18 nt, Homo sapiens
uagccaucucucuacucc

SEQ ID NO: 1377625 - RNA, 14 nt, Homo sapiens
uagccgaccucagc

SEQ ID NO: 1377626 - RNA, 16 nt, Homo sapiens
uagccucuccaggaau

SEQ ID NO: 1377627 - RNA, 22 nt, Homo sapiens
gccacgugggcaaacaggcagu

SEQ ID NO: 1377628 - RNA, 22 nt, Homo sapiens
gccagaaagcauaaaauucuua

SEQ ID NO: 1377629 - RNA, 16 nt, Homo sapiens
gccagaagggggccau

SEQ ID NO: 1377630 - RNA, 18 nt, Homo sapiens
gccagagcaaagggccag

SEQ ID NO: 1377631 - RNA, 19 nt, Homo sapiens
gccagaguggccuggccag

SEQ ID NO: 1377632 - RNA, 16 nt, Homo sapiens
gccagcucagucccau

SEQ ID NO: 1377633 - RNA, 19 nt, Homo sapiens
gccagcuuaucucaggggu

SEQ ID NO: 1377634 - RNA, 21 nt, Homo sapiens
gccaggacaugcagcccagaa

SEQ ID NO: 1377635 - RNA, 15 nt, Homo sapiens
gccaggugcacagac

SEQ ID NO: 1377636 - RNA, 13 nt, Homo sapiens
gccaggugcagug

SEQ ID NO: 1377637 - RNA, 19 nt, Homo sapiens
gccaguccugccuggccag

SEQ ID NO: 1377638 - RNA, 14 nt, Homo sapiens
gccaucucugaacu

SEQ ID NO: 1377639 - RNA, 16 nt, Homo sapiens
gccauggcuccccuuu

SEQ ID NO: 1377640 - RNA, 20 nt, Homo sapiens
gccauucucaagcccugcag

SEQ ID NO: 1377641 - RNA, 22 nt, Homo sapiens
gccauuuuggguuuugggucuu

SEQ ID NO: 1377642 - RNA, 15 nt, Homo sapiens
ucugcuacuguguca

SEQ ID NO: 1377643 - RNA, 21 nt, Homo sapiens
ucugcuggcagaaagcaaaug

SEQ ID NO: 1377644 - RNA, 20 nt, Homo sapiens
ucugcuugccgaaacuggaa

SEQ ID NO: 1377645 - RNA, 16 nt, Homo sapiens
ucugcuuugacugagc

SEQ ID NO: 1377646 - RNA, 16 nt, Homo sapiens
ucuggaucuccugacc

SEQ ID NO: 1377647 - RNA, 17 nt, Homo sapiens
ucuggccugaacugagg

SEQ ID NO: 1377648 - RNA, 20 nt, Homo sapiens
ucugggaacucccaagaaca

SEQ ID NO: 1377649 - RNA, 23 nt, Homo sapiens
ucugggauauuuccauauggcaa

SEQ ID NO: 1377650 - RNA, 17 nt, Homo sapiens
ucugggccaaguuccuc

SEQ ID NO: 1377651 - RNA, 20 nt, Homo sapiens
ucugggcuuggggcuuccua

SEQ ID NO: 1377652 - RNA, 20 nt, Homo sapiens
ucuggggauacuggcaaagc

SEQ ID NO: 1377653 - RNA, 18 nt, Homo sapiens
ucugggucaucucucaca

SEQ ID NO: 1377654 - RNA, 23 nt, Homo sapiens
ucugggucuuucugacaucagca

SEQ ID NO: 1377655 - RNA, 16 nt, Homo sapiens
ucuggugacaccagcc

SEQ ID NO: 1377656 - RNA, 18 nt, Homo sapiens
ucugguggucucugcuug

SEQ ID NO: 1377657 - RNA, 22 nt, Homo sapiens
ucuguauuccuagaaacugaca

SEQ ID NO: 1377658 - RNA, 15 nt, Homo sapiens
ucugucaaugucuug

SEQ ID NO: 1377659 - RNA, 15 nt, Homo sapiens
ucugucauaugcaga

SEQ ID NO: 1377660 - RNA, 17 nt, Homo sapiens
ucuguccuacucugugu

SEQ ID NO: 1377661 - RNA, 22 nt, Homo sapiens
ucugugcaaauccuugauacug

SEQ ID NO: 1377662 - RNA, 19 nt, Homo sapiens
ucugugggccccacccacu

SEQ ID NO: 1377663 - RNA, 20 nt, Homo sapiens
ucuguguuuuugaaauauua

SEQ ID NO: 1377664 - RNA, 15 nt, Homo sapiens
ugaagcuaauaauuc

SEQ ID NO: 1377665 - RNA, 15 nt, Homo sapiens
ugaagggguucucac

SEQ ID NO: 1377666 - RNA, 23 nt, Homo sapiens
ugaaggguucaccaggucaggga

SEQ ID NO: 1377667 - RNA, 14 nt, Homo sapiens
ugaaguaagcaaag

SEQ ID NO: 1377668 - RNA, 23 nt, Homo sapiens
ugaaguaaugaauuuuuaugaua

SEQ ID NO: 1377669 - RNA, 14 nt, Homo sapiens
ugaaguacauauua

SEQ ID NO: 1377670 - RNA, 16 nt, Homo sapiens
ugaagucacacaguga

SEQ ID NO: 1377671 - RNA, 19 nt, Homo sapiens
ugaagucccagauacuugg

SEQ ID NO: 1377672 - RNA, 22 nt, Homo sapiens
ugaagugcaaauuugauacaua

SEQ ID NO: 1377673 - RNA, 20 nt, Homo sapiens
ugaaguuaagaaccugaaua

SEQ ID NO: 1377674 - RNA, 15 nt, Homo sapiens
ugaaguuuaaacucu

SEQ ID NO: 1377675 - RNA, 15 nt, Homo sapiens
ugaaguuuacaauca

SEQ ID NO: 1377676 - RNA, 18 nt, Homo sapiens
ugaauaaugcuguuuuau

SEQ ID NO: 1377677 - RNA, 17 nt, Homo sapiens
ugaauauaaacacuaua

SEQ ID NO: 1377678 - RNA, 20 nt, Homo sapiens
ugaauaugaacggugagcau

SEQ ID NO: 1377679 - RNA, 20 nt, Homo sapiens
ugaauauuuauauuucacua

SEQ ID NO: 1377680 - RNA, 17 nt, Homo sapiens
ugaaucuaaaagcuuuu

SEQ ID NO: 1377681 - RNA, 21 nt, Homo sapiens
ugaauggacucaaacugccuu

SEQ ID NO: 1377682 - RNA, 22 nt, Homo sapiens
ugaauggagcagaaauucaccu

SEQ ID NO: 1377683 - RNA, 15 nt, Homo sapiens
ugaauggccugccuu

SEQ ID NO: 1377684 - RNA, 14 nt, Homo sapiens
ugaauuucaguaaa

SEQ ID NO: 1377685 - RNA, 16 nt, Homo sapiens
ugaauuucccacauac

SEQ ID NO: 1377686 - RNA, 13 nt, Homo sapiens
ugauuaaugcuaa

SEQ ID NO: 1377687 - RNA, 14 nt, Homo sapiens
ugauuaaugcuaaa

SEQ ID NO: 1377688 - RNA, 15 nt, Homo sapiens
ugauuacuaugcucu

SEQ ID NO: 1377689 - RNA, 20 nt, Homo sapiens
ugauuaguaaagaaaugaca

SEQ ID NO: 1377690 - RNA, 13 nt, Homo sapiens
ugauucacagugu

SEQ ID NO: 1377691 - RNA, 15 nt, Homo sapiens
ugauucacaguguga

SEQ ID NO: 1377692 - RNA, 15 nt, Homo sapiens
ugauucuaugucuca

SEQ ID NO: 1377693 - RNA, 14 nt, Homo sapiens
ugauuuaaaucagc

SEQ ID NO: 1377694 - RNA, 21 nt, Homo sapiens
ugauuuaucugagucaacucc

SEQ ID NO: 1377695 - RNA, 13 nt, Homo sapiens
ugauuucaagacc

SEQ ID NO: 1377696 - RNA, 14 nt, Homo sapiens
ugauuugcuaucaa

SEQ ID NO: 1377697 - RNA, 14 nt, Homo sapiens
ugauuuuacaauug

SEQ ID NO: 1377698 - RNA, 13 nt, Homo sapiens
ugcaaaauuucca

SEQ ID NO: 1377699 - RNA, 21 nt, Homo sapiens
ugcaaaggcgcagugcuucuc

SEQ ID NO: 1377700 - RNA, 21 nt, Homo sapiens
ugcaacuuagcucacaccuga

SEQ ID NO: 1377701 - RNA, 15 nt, Homo sapiens
ugcaagagugacagu

SEQ ID NO: 1377702 - RNA, 16 nt, Homo sapiens
ugcaagugacaucucu

SEQ ID NO: 1377703 - RNA, 16 nt, Homo sapiens
ugcaagugugugcaug

SEQ ID NO: 1377704 - RNA, 21 nt, Homo sapiens
ugcaagugugugcaugugugc

SEQ ID NO: 1377705 - RNA, 14 nt, Homo sapiens
ugcaauauguauua

SEQ ID NO: 1377706 - RNA, 22 nt, Homo sapiens
ugcaaugucacaaccucucuga

SEQ ID NO: 1377707 - RNA, 20 nt, Homo sapiens
ugcaauuuuaacacacauaa

SEQ ID NO: 1377708 - RNA, 21 nt, Homo sapiens
ugcacaaauugggccaaagaa

SEQ ID NO: 1377709 - RNA, 16 nt, Homo sapiens
ugcggucccuucuuac

SEQ ID NO: 1377710 - RNA, 14 nt, Homo sapiens
ugcgugcaugugca

SEQ ID NO: 1377711 - RNA, 17 nt, Homo sapiens
ugcgugugcgugcaugu

SEQ ID NO: 1377712 - RNA, 15 nt, Homo sapiens
ugcgugugugcaagu

SEQ ID NO: 1377713 - RNA, 23 nt, Homo sapiens
ugcguguuuccugugcaagucag

SEQ ID NO: 1377714 - RNA, 13 nt, Homo sapiens
ugcguuacuaauu

SEQ ID NO: 1377715 - RNA, 22 nt, Homo sapiens
ugcuaaaggaaaaaaccaucca

SEQ ID NO: 1377716 - RNA, 22 nt, Homo sapiens
ugcuaaauggucgcccaggaga

SEQ ID NO: 1377717 - RNA, 23 nt, Homo sapiens
ugcuaaauggucgcccaggagac

SEQ ID NO: 1377718 - RNA, 22 nt, Homo sapiens
ugcuaauccucuuuuucuaguc

SEQ ID NO: 1377719 - RNA, 20 nt, Homo sapiens
ugcuacaaauacucuuagga

SEQ ID NO: 1377720 - RNA, 23 nt, Homo sapiens
ugcuacaugacgacaaagcugcu

SEQ ID NO: 1377721 - RNA, 14 nt, Homo sapiens
ugcuacuuccugcc

SEQ ID NO: 1377722 - RNA, 17 nt, Homo sapiens
ugcuauaacuauguuga

SEQ ID NO: 1377723 - RNA, 21 nt, Homo sapiens
ugcuauaacuauguugauaaa

SEQ ID NO: 1377724 - RNA, 16 nt, Homo sapiens
ugcuaugaaugauacc

SEQ ID NO: 1377725 - RNA, 20 nt, Homo sapiens
ugcuauggaaugauugugga

SEQ ID NO: 1377726 - RNA, 13 nt, Homo sapiens
ugcuauggggaca

SEQ ID NO: 1377727 - RNA, 19 nt, Homo sapiens
ugcuauggggacauuccaa

SEQ ID NO: 1377728 - RNA, 12 nt, Homo sapiens
ugcuauuugccu

SEQ ID NO: 1377729 - RNA, 19 nt, Homo sapiens
ugcucaguuggugcugcuu

SEQ ID NO: 1377730 - RNA, 21 nt, Homo sapiens
ugcucauucauuuaacagagc

SEQ ID NO: 1377731 - RNA, 14 nt, Homo sapiens
ugcuccagugcagg

SEQ ID NO: 1377732 - RNA, 14 nt, Homo sapiens
ugcucccacagaac

SEQ ID NO: 1377733 - RNA, 20 nt, Homo sapiens
ugcuccguaugccaagagga

SEQ ID NO: 1377734 - RNA, 22 nt, Homo sapiens
ugcuccgucuaagucaugagcu

SEQ ID NO: 1377735 - RNA, 17 nt, Homo sapiens
ugcuccuuagcugccaa

SEQ ID NO: 1377736 - RNA, 12 nt, Homo sapiens
ugcuccuuccaa

SEQ ID NO: 1377737 - RNA, 18 nt, Homo sapiens
ugcucugcuggucuucaa

SEQ ID NO: 1377738 - RNA, 19 nt, Homo sapiens
ugcucugcuggucuucaau

SEQ ID NO: 1377739 - RNA, 23 nt, Homo sapiens
ugcucuuuaugaaugaaaaaaca

SEQ ID NO: 1377740 - RNA, 15 nt, Homo sapiens
ugcucuuucuugacu

SEQ ID NO: 1377741 - RNA, 21 nt, Homo sapiens
ugcucuuugauucaaagcacu

SEQ ID NO: 1377742 - RNA, 19 nt, Homo sapiens
ugcugaccucccagugacc

SEQ ID NO: 1377743 - RNA, 15 nt, Homo sapiens
ugcugauguggcaac

SEQ ID NO: 1377744 - RNA, 21 nt, Homo sapiens
ugcugcaucuccccucagauu

SEQ ID NO: 1377745 - RNA, 17 nt, Homo sapiens
ugcugccaaacacccau

SEQ ID NO: 1377746 - RNA, 17 nt, Homo sapiens
ugcugcuccagugcagg

SEQ ID NO: 1377747 - RNA, 14 nt, Homo sapiens
ugcugcuguuuaca

SEQ ID NO: 1377748 - RNA, 14 nt, Homo sapiens
ugcuggagacacuc

SEQ ID NO: 1377749 - RNA, 22 nt, Homo sapiens
ugcuggcagaaagcaaauguga

SEQ ID NO: 1377750 - RNA, 19 nt, Homo sapiens
ugcuggcucccagggccau

SEQ ID NO: 1377751 - RNA, 14 nt, Homo sapiens
ugcugggaugacca

SEQ ID NO: 1377752 - RNA, 16 nt, Homo sapiens
ugcuggucacugccau

SEQ ID NO: 1377753 - RNA, 16 nt, Homo sapiens
ugcuguacuugaugac

SEQ ID NO: 1377754 - RNA, 21 nt, Homo sapiens
ugcuuaggcacucauggguaa

SEQ ID NO: 1377755 - RNA, 14 nt, Homo sapiens
ugcuucaaacuaac

SEQ ID NO: 1377756 - RNA, 16 nt, Homo sapiens
ugcuuccugacaauca

SEQ ID NO: 1377757 - RNA, 19 nt, Homo sapiens
ugcuucuaccaacuggaag

SEQ ID NO: 1377758 - RNA, 14 nt, Homo sapiens
ugcuugaaugaagu

SEQ ID NO: 1377759 - RNA, 16 nt, Homo sapiens
ugcuugagcucaggag

SEQ ID NO: 1377760 - RNA, 17 nt, Homo sapiens
ugcuugcacaaaccaau

SEQ ID NO: 1377761 - RNA, 18 nt, Homo sapiens
ugcuugccgaaacuggaa

SEQ ID NO: 1377762 - RNA, 17 nt, Homo sapiens
ugcuuuaaaaaaauaca

SEQ ID NO: 1377763 - RNA, 19 nt, Homo sapiens
ugcuuucuuaucccaguga

SEQ ID NO: 1377764 - RNA, 14 nt, Homo sapiens
ugcuuuuaaaugca

SEQ ID NO: 1377765 - RNA, 19 nt, Homo sapiens
ugcuuuucccuaagccaag

SEQ ID NO: 1377766 - RNA, 21 nt, Homo sapiens
ugcuuuuuaaagaaugcucuu

SEQ ID NO: 1377767 - RNA, 14 nt, Homo sapiens
ugcuuuuuuuccaa

SEQ ID NO: 1377768 - RNA, 14 nt, Homo sapiens
uggaaacaggacca

SEQ ID NO: 1377769 - RNA, 17 nt, Homo sapiens
uggaaagaaaaagcaau

SEQ ID NO: 1377770 - RNA, 19 nt, Homo sapiens
uggaaauagugauuuccac

SEQ ID NO: 1377771 - RNA, 14 nt, Homo sapiens
uggaacaagcacag

SEQ ID NO: 1377772 - RNA, 16 nt, Homo sapiens
uggaacaagcacagau

SEQ ID NO: 1377773 - RNA, 23 nt, Homo sapiens
uggaacacaaugacuaaagacau

SEQ ID NO: 1377774 - RNA, 23 nt, Homo sapiens
uggaaccaacacuaacauauaau

SEQ ID NO: 1377775 - RNA, 16 nt, Homo sapiens
uggaagagcacaagag

SEQ ID NO: 1377776 - RNA, 17 nt, Homo sapiens
uggaagcucugaaguca

SEQ ID NO: 1377777 - RNA, 18 nt, Homo sapiens
uggaaggccuucuuucua

SEQ ID NO: 1377778 - RNA, 20 nt, Homo sapiens
uggaaucauauaguauguaa

SEQ ID NO: 1377779 - RNA, 19 nt, Homo sapiens
uggaaucuucucuuugaca

SEQ ID NO: 1377780 - RNA, 16 nt, Homo sapiens
uggaaugccauuugca

SEQ ID NO: 1377781 - RNA, 22 nt, Homo sapiens
uggaauuuugugcccccaugua

SEQ ID NO: 1377782 - RNA, 16 nt, Homo sapiens
uggaauuuuucauuga

SEQ ID NO: 1377783 - RNA, 15 nt, Homo sapiens
uggacacacacagcu

SEQ ID NO: 1377784 - RNA, 15 nt, Homo sapiens
uggaccuaacauucg

SEQ ID NO: 1377785 - RNA, 14 nt, Homo sapiens
uggaccugagcuau

SEQ ID NO: 1377786 - RNA, 15 nt, Homo sapiens
uggacgcacacagcu

SEQ ID NO: 1377787 - RNA, 16 nt, Homo sapiens
uggacucaguuuucuu

SEQ ID NO: 1377788 - RNA, 17 nt, Homo sapiens
uggacuccagaucugca

SEQ ID NO: 1377789 - RNA, 18 nt, Homo sapiens
uggacucuacacugugaa

SEQ ID NO: 1377790 - RNA, 16 nt, Homo sapiens
uggacugauaaucucu

SEQ ID NO: 1377791 - RNA, 21 nt, Homo sapiens
uggacuuuucguuaacauuga

SEQ ID NO: 1377792 - RNA, 17 nt, Homo sapiens
uggagaaacuguagucu

SEQ ID NO: 1377793 - RNA, 19 nt, Homo sapiens
uggagaaacuguagucuca

SEQ ID NO: 1377794 - RNA, 15 nt, Homo sapiens
uggagagaacugaau

SEQ ID NO: 1377795 - RNA, 18 nt, Homo sapiens
uggagcagccaacaagca

SEQ ID NO: 1377796 - RNA, 18 nt, Homo sapiens
uggagcagggacagauca

SEQ ID NO: 1377797 - RNA, 19 nt, Homo sapiens
uggagcagggacagaucau

SEQ ID NO: 1377798 - RNA, 23 nt, Homo sapiens
uggagccaccugucccaccucaa

SEQ ID NO: 1377799 - RNA, 23 nt, Homo sapiens
uggagcccaggaguuugaggcug

SEQ ID NO: 1377800 - RNA, 19 nt, Homo sapiens
uggagcccauccagucucc

SEQ ID NO: 1377801 - RNA, 17 nt, Homo sapiens
uggagccccacugcccu

SEQ ID NO: 1377802 - RNA, 18 nt, Homo sapiens
uggagccccaucagcucc

SEQ ID NO: 1377803 - RNA, 23 nt, Homo sapiens
uggaggccuguccugaccugucu

SEQ ID NO: 1377804 - RNA, 19 nt, Homo sapiens
uggaggcugcagugagcug

SEQ ID NO: 1377805 - RNA, 20 nt, Homo sapiens
uggaguagccauucuuuauu

SEQ ID NO: 1377806 - RNA, 15 nt, Homo sapiens
uggaguccagucucu

SEQ ID NO: 1377807 - RNA, 15 nt, Homo sapiens
uggauagucugucca

SEQ ID NO: 1377808 - RNA, 21 nt, Homo sapiens
uggauaucccuaccuugaaag

SEQ ID NO: 1377809 - RNA, 16 nt, Homo sapiens
uggaucaucuauugcu

SEQ ID NO: 1377810 - RNA, 22 nt, Homo sapiens
uggaucuaccagcauaaauauc

SEQ ID NO: 1377811 - RNA, 19 nt, Homo sapiens
uggaugcagaaacaguuca

SEQ ID NO: 1377812 - RNA, 17 nt, Homo sapiens
uggaugccaaccgguca

SEQ ID NO: 1377813 - RNA, 22 nt, Homo sapiens
uggauguucugacccugcuuca

SEQ ID NO: 1377814 - RNA, 23 nt, Homo sapiens
uggauuuggguuggaagugaggg

SEQ ID NO: 1377815 - RNA, 22 nt, Homo sapiens
uggauuuuacauguggcccaac

SEQ ID NO: 1377816 - RNA, 11 nt, Homo sapiens
uggcaaagaca

SEQ ID NO: 1377817 - RNA, 19 nt, Homo sapiens
uggcaacggaagaaugaga

SEQ ID NO: 1377818 - RNA, 20 nt, Homo sapiens
uggcaauauaaggggaugag

SEQ ID NO: 1377819 - RNA, 19 nt, Homo sapiens
uggcacacaccuguagucc

SEQ ID NO: 1377820 - RNA, 13 nt, Homo sapiens
uggcacugcauac

SEQ ID NO: 1377821 - RNA, 14 nt, Homo sapiens
uguugcugcaucuc

SEQ ID NO: 1377822 - RNA, 20 nt, Homo sapiens
uguuggccaaagccaaagcu

SEQ ID NO: 1377823 - RNA, 13 nt, Homo sapiens
uguuuaaaaaagu

SEQ ID NO: 1377824 - RNA, 23 nt, Homo sapiens
uguuuauucaacaacuacuacuu

SEQ ID NO: 1377825 - RNA, 19 nt, Homo sapiens
uguuuauuugcacuaugag

SEQ ID NO: 1377826 - RNA, 17 nt, Homo sapiens
uguuuccaaaaaccaug

SEQ ID NO: 1377827 - RNA, 16 nt, Homo sapiens
uguuuccugugcaagu

SEQ ID NO: 1377828 - RNA, 18 nt, Homo sapiens
uguuucugaucugaugca

SEQ ID NO: 1377829 - RNA, 22 nt, Homo sapiens
uguuucuggaauugauauugaa

SEQ ID NO: 1377830 - RNA, 19 nt, Homo sapiens
uguuuguaaauaagagauu

SEQ ID NO: 1377831 - RNA, 12 nt, Homo sapiens
uguuugugauug

SEQ ID NO: 1377832 - RNA, 17 nt, Homo sapiens
uguuuugcccaccagau

SEQ ID NO: 1377833 - RNA, 13 nt, Homo sapiens
uguuuuuaagcug

SEQ ID NO: 1377834 - RNA, 12 nt, Homo sapiens
uguuuuuugcca

SEQ ID NO: 1377835 - RNA, 18 nt, Homo sapiens
uuaaaaaaauacaguauu

SEQ ID NO: 1377836 - RNA, 15 nt, Homo sapiens
uuaaaaauaugugua

SEQ ID NO: 1377837 - RNA, 22 nt, Homo sapiens
uuaaaacaacacucacauuuau

SEQ ID NO: 1377838 - RNA, 17 nt, Homo sapiens
uuaaaagacacacuugu

SEQ ID NO: 1377839 - RNA, 14 nt, Homo sapiens
uuaaaaugagaucg

SEQ ID NO: 1377840 - RNA, 20 nt, Homo sapiens
uuaaacacggggcuugcaac

SEQ ID NO: 1377841 - RNA, 21 nt, Homo sapiens
uuaaacacggggcuugcaacu

SEQ ID NO: 1377842 - RNA, 22 nt, Homo sapiens
uuaaacaguaaaacaaaaauuc

SEQ ID NO: 1377843 - RNA, 20 nt, Homo sapiens
uuaaacuacaaacacaagca

SEQ ID NO: 1377844 - RNA, 20 nt, Homo sapiens
uuaaacuguguggacuguga

SEQ ID NO: 1377845 - RNA, 18 nt, Homo sapiens
uuaaacuuaccugggcau

SEQ ID NO: 1377846 - RNA, 15 nt, Homo sapiens
uuaaaguuacuuugu

SEQ ID NO: 1377847 - RNA, 13 nt, Homo sapiens
uuaaaguucucaa

SEQ ID NO: 1377848 - RNA, 17 nt, Homo sapiens
uuaaauaaaucauaaaa

SEQ ID NO: 1377849 - RNA, 15 nt, Homo sapiens
uuaaaucuugcaacu

SEQ ID NO: 1377850 - RNA, 19 nt, Homo sapiens
uuaaauugcagaugguuaa

SEQ ID NO: 1377851 - RNA, 13 nt, Homo sapiens
uuaacauaagaaa

SEQ ID NO: 1377852 - RNA, 18 nt, Homo sapiens
uuaaccagucugaaguuu

SEQ ID NO: 1377853 - RNA, 18 nt, Homo sapiens
uuaaccugcauaaaaagg

SEQ ID NO: 1377854 - RNA, 17 nt, Homo sapiens
uuaacucaggacuccag

SEQ ID NO: 1377855 - RNA, 21 nt, Homo sapiens
uuaacugguauauacauauau

SEQ ID NO: 1377856 - RNA, 15 nt, Homo sapiens
uuaacuucagccagc

SEQ ID NO: 1377857 - RNA, 18 nt, Homo sapiens
uuaacuuccaauuuacau

SEQ ID NO: 1377858 - RNA, 20 nt, Homo sapiens
uuaagaauguucuuauguug

SEQ ID NO: 1377859 - RNA, 22 nt, Homo sapiens
uuaagaguuagguuuaacauaa

SEQ ID NO: 1377860 - RNA, 23 nt, Homo sapiens
uuaagaguuagguuuaacauaaa

SEQ ID NO: 1377861 - RNA, 18 nt, Homo sapiens
uuaagauaguuuugccag

SEQ ID NO: 1377862 - RNA, 12 nt, Homo sapiens
uuaagcauuguu

SEQ ID NO: 1377863 - RNA, 22 nt, Homo sapiens
uuaagcgauucucaugccucag

SEQ ID NO: 1377864 - RNA, 22 nt, Homo sapiens
uuaagcugggauaaucacauua

SEQ ID NO: 1377865 - RNA, 22 nt, Homo sapiens
uuaaguauguuauuuucuguug

SEQ ID NO: 1377866 - RNA, 23 nt, Homo sapiens
uuaaguguaacuggcaguuuucc

SEQ ID NO: 1377867 - RNA, 13 nt, Homo sapiens
uuaauaaagaagu

SEQ ID NO: 1377868 - RNA, 18 nt, Homo sapiens
uuaauaaagacgauuugu

SEQ ID NO: 1377869 - RNA, 16 nt, Homo sapiens
uuaauaaauucagaua

SEQ ID NO: 1377870 - RNA, 20 nt, Homo sapiens
uuaauacagggcauuuuggu

SEQ ID NO: 1377871 - RNA, 20 nt, Homo sapiens
uuaauaggguaaauucucua

SEQ ID NO: 1377872 - RNA, 14 nt, Homo sapiens
uuaaucaugagaua

SEQ ID NO: 1377873 - RNA, 20 nt, Homo sapiens
uuaaugaacaugugaaguua

SEQ ID NO: 1377874 - RNA, 15 nt, Homo sapiens
uuaaugaagugcaau

SEQ ID NO: 1377875 - RNA, 13 nt, Homo sapiens
uuacaaacugcaa

SEQ ID NO: 1377876 - RNA, 21 nt, Homo sapiens
uuacagagaggagaaacacau

SEQ ID NO: 1377877 - RNA, 24 nt, Homo sapiens
uuacagcugccugcaguacuuuac

SEQ ID NO: 1377878 - RNA, 18 nt, Homo sapiens
uuacagggagcugggaca

SEQ ID NO: 1377879 - RNA, 16 nt, Homo sapiens
uuacagugcagacagg

SEQ ID NO: 1377880 - RNA, 12 nt, Homo sapiens
uuacaguguaug

SEQ ID NO: 1377881 - RNA, 14 nt, Homo sapiens
uuacauccuugugg

SEQ ID NO: 1377882 - RNA, 13 nt, Homo sapiens
uuacaucuuucac

SEQ ID NO: 1377883 - RNA, 22 nt, Homo sapiens
uuacauuauuaaauguuucuca

SEQ ID NO: 1377884 - RNA, 21 nt, Homo sapiens
uuaccagacgguucaccagcc

SEQ ID NO: 1377885 - RNA, 19 nt, Homo sapiens
uuaccuaguagucauuuca

SEQ ID NO: 1377886 - RNA, 22 nt, Homo sapiens
uuaccugggcauucuuguuuca

SEQ ID NO: 1377887 - RNA, 22 nt, Homo sapiens
uuacuaaauuacaaaugcaauu

SEQ ID NO: 1377888 - RNA, 15 nt, Homo sapiens
uuacuaucaugucaa

SEQ ID NO: 1377889 - RNA, 17 nt, Homo sapiens
uuacuaucaugucaaac

SEQ ID NO: 1377890 - RNA, 11 nt, Homo sapiens
uuacucaaagu

SEQ ID NO: 1377891 - RNA, 21 nt, Homo sapiens
uuacucaugugcagguuuuga

SEQ ID NO: 1377892 - RNA, 11 nt, Homo sapiens
uuacucugaag

SEQ ID NO: 1377893 - RNA, 21 nt, Homo sapiens
uuacugaaagaaaaagaccua

SEQ ID NO: 1377894 - RNA, 16 nt, Homo sapiens
uuacuucccuaaugaa

SEQ ID NO: 1377895 - RNA, 16 nt, Homo sapiens
uuacuuuguguucacc

SEQ ID NO: 1377896 - RNA, 14 nt, Homo sapiens
uuacuuuuucauuc

SEQ ID NO: 1377897 - RNA, 21 nt, Homo sapiens
uuagaaacuaagagaaugaua

SEQ ID NO: 1377898 - RNA, 20 nt, Homo sapiens
uuagaaacuuaucuuacaaa

SEQ ID NO: 1377899 - RNA, 16 nt, Homo sapiens
uuagaagucacacagu

SEQ ID NO: 1377900 - RNA, 21 nt, Homo sapiens
uuagaaugggaucacgaggaa

SEQ ID NO: 1377901 - RNA, 17 nt, Homo sapiens
uuagacagagucucacu

SEQ ID NO: 1377902 - RNA, 22 nt, Homo sapiens
uuagacaugacugaugacauau

SEQ ID NO: 1377903 - RNA, 22 nt, Homo sapiens
uuagagaggugaggaucuggua

SEQ ID NO: 1377904 - RNA, 20 nt, Homo sapiens
uuagauuguuaaaauaacua

SEQ ID NO: 1377905 - RNA, 18 nt, Homo sapiens
uuagcacuauuuacauac

SEQ ID NO: 1377906 - RNA, 13 nt, Homo sapiens
uuagcaugcacaa

SEQ ID NO: 1377907 - RNA, 13 nt, Homo sapiens
uuaucugugcaaa

SEQ ID NO: 1377908 - RNA, 20 nt, Homo sapiens
uuaucugugcgugaaacaca

SEQ ID NO: 1377909 - RNA, 11 nt, Homo sapiens
uuaugaaucuc

SEQ ID NO: 1377910 - RNA, 18 nt, Homo sapiens
uuaugagaaaguucucau

SEQ ID NO: 1377911 - RNA, 20 nt, Homo sapiens
uuaugagaaaugccagugug

SEQ ID NO: 1377912 - RNA, 21 nt, Homo sapiens
uuaugcagucggaagcuccag

SEQ ID NO: 1377913 - RNA, 16 nt, Homo sapiens
uuaugcauaaagucag

SEQ ID NO: 1377914 - RNA, 17 nt, Homo sapiens
uuaugcuaccuacugau

SEQ ID NO: 1377915 - RNA, 11 nt, Homo sapiens
uuaugcugcug

SEQ ID NO: 1377916 - RNA, 19 nt, Homo sapiens
uuauggcauuuuucuggga

SEQ ID NO: 1377917 - RNA, 14 nt, Homo sapiens
uuauguuagcauug

SEQ ID NO: 1377918 - RNA, 17 nt, Homo sapiens
uuauuaauuucuucaca

SEQ ID NO: 1377919 - RNA, 19 nt, Homo sapiens
uuauuacauggggucuaga

SEQ ID NO: 1377920 - RNA, 18 nt, Homo sapiens
uuauucaagaaaaguaag

SEQ ID NO: 1377921 - RNA, 22 nt, Homo sapiens
uuauucagaaaagaugugcaga

SEQ ID NO: 1377922 - RNA, 22 nt, Homo sapiens
uuauugcaugagaagccauaca

SEQ ID NO: 1377923 - RNA, 18 nt, Homo sapiens
uuauugguguuuacccag

SEQ ID NO: 1377924 - RNA, 23 nt, Homo sapiens
uuauuguuuauuuaucagugaca

SEQ ID NO: 1377925 - RNA, 20 nt, Homo sapiens
uuauuuacugacauauaucu

SEQ ID NO: 1377926 - RNA, 19 nt, Homo sapiens
uuauuuagggaacugcuug

SEQ ID NO: 1377927 - RNA, 17 nt, Homo sapiens
uuauuuaucaaguguau

SEQ ID NO: 1377928 - RNA, 14 nt, Homo sapiens
uuauuuauguaugu

SEQ ID NO: 1377929 - RNA, 13 nt, Homo sapiens
uuauuuccacuua

SEQ ID NO: 1377930 - RNA, 21 nt, Homo sapiens
uuauuugcacuaugagccuau

SEQ ID NO: 1377931 - RNA, 18 nt, Homo sapiens
uucaaaagguuauauacc

SEQ ID NO: 1377932 - RNA, 17 nt, Homo sapiens
uucaaacugcaugauuc

SEQ ID NO: 1377933 - RNA, 18 nt, Homo sapiens
uucaaacugcaugauuca

SEQ ID NO: 1377934 - RNA, 22 nt, Homo sapiens
uucaaagagacauauacuaaga

SEQ ID NO: 1377935 - RNA, 12 nt, Homo sapiens
uucaaaugggcu

SEQ ID NO: 1377936 - RNA, 20 nt, Homo sapiens
uucaacaacuacuacuugau

SEQ ID NO: 1377937 - RNA, 22 nt, Homo sapiens
uucaagggcugcuucaaacuca

SEQ ID NO: 1377938 - RNA, 19 nt, Homo sapiens
uucaagguuauaugucuua

SEQ ID NO: 1377939 - RNA, 13 nt, Homo sapiens
uucaaguguacag

SEQ ID NO: 1377940 - RNA, 16 nt, Homo sapiens
uucaaguuaaagugaa

SEQ ID NO: 1377941 - RNA, 22 nt, Homo sapiens
uucaaguuaaagugaauaacca

SEQ ID NO: 1377942 - RNA, 12 nt, Homo sapiens
uucaaugugacu

SEQ ID NO: 1377943 - RNA, 15 nt, Homo sapiens
uucaauuaccaagaa

SEQ ID NO: 1377944 - RNA, 15 nt, Homo sapiens
uucacaaugaaaugc

SEQ ID NO: 1377945 - RNA, 11 nt, Homo sapiens
uucacacugca

SEQ ID NO: 1377946 - RNA, 18 nt, Homo sapiens
uucacacuuccaccagcc

SEQ ID NO: 1377947 - RNA, 19 nt, Homo sapiens
uucacacuuccaccagccu

SEQ ID NO: 1377948 - RNA, 17 nt, Homo sapiens
uucacagaugugugauu

SEQ ID NO: 1377949 - RNA, 13 nt, Homo sapiens
uucacagugcaag

SEQ ID NO: 1377950 - RNA, 12 nt, Homo sapiens
uucacagugugu

SEQ ID NO: 1377951 - RNA, 15 nt, Homo sapiens
uucaccagauuugcu

SEQ ID NO: 1377952 - RNA, 11 nt, Homo sapiens
uucaccuguaa

SEQ ID NO: 1377953 - RNA, 13 nt, Homo sapiens
uucaccuugggau

SEQ ID NO: 1377954 - RNA, 17 nt, Homo sapiens
uucacggggucauacua

SEQ ID NO: 1377955 - RNA, 14 nt, Homo sapiens
uucacucaaucucu

SEQ ID NO: 1377956 - RNA, 20 nt, Homo sapiens
uucacuccagccugggugac

SEQ ID NO: 1377957 - RNA, 18 nt, Homo sapiens
uucacuguagaaugauuu

SEQ ID NO: 1377958 - RNA, 20 nt, Homo sapiens
uucacuguagaaugauuuca

SEQ ID NO: 1377959 - RNA, 23 nt, Homo sapiens
uucacuuguguuuuaaaauaagg

SEQ ID NO: 1377960 - RNA, 12 nt, Homo sapiens
uucacuuuacaa

SEQ ID NO: 1377961 - RNA, 13 nt, Homo sapiens
uucacuuuacaaa

SEQ ID NO: 1377962 - RNA, 14 nt, Homo sapiens
uucacuuuacaaau

SEQ ID NO: 1377963 - RNA, 13 nt, Homo sapiens
uucagaaagaagu

SEQ ID NO: 1377964 - RNA, 19 nt, Homo sapiens
uucagaugcuucugggaga

SEQ ID NO: 1377965 - RNA, 14 nt, Homo sapiens
uucagcccucagaa

SEQ ID NO: 1377966 - RNA, 18 nt, Homo sapiens
uucagcucacacaugaga

SEQ ID NO: 1377967 - RNA, 20 nt, Homo sapiens
uucagcuccagcucaccagc

SEQ ID NO: 1377968 - RNA, 15 nt, Homo sapiens
uucagcuccuuccac

SEQ ID NO: 1377969 - RNA, 15 nt, Homo sapiens
uucagcugguugagg

SEQ ID NO: 1377970 - RNA, 18 nt, Homo sapiens
uucagguacuaaauaccu

SEQ ID NO: 1377971 - RNA, 19 nt, Homo sapiens
uucagguuuguaugaugua

SEQ ID NO: 1377972 - RNA, 15 nt, Homo sapiens
uucagugcugcugaa

SEQ ID NO: 1377973 - RNA, 17 nt, Homo sapiens
uucagugcuguacuuga

SEQ ID NO: 1377974 - RNA, 18 nt, Homo sapiens
uucauauauuuguaugau

SEQ ID NO: 1377975 - RNA, 22 nt, Homo sapiens
uucaucagacuccugugcaacu

SEQ ID NO: 1377976 - RNA, 14 nt, Homo sapiens
uucaucuaauguga

SEQ ID NO: 1377977 - RNA, 19 nt, Homo sapiens
uucaucuacccugcugacc

SEQ ID NO: 1377978 - RNA, 11 nt, Homo sapiens
uucaucucuug

SEQ ID NO: 1377979 - RNA, 19 nt, Homo sapiens
uucaugaauugcgccucag

SEQ ID NO: 1377980 - RNA, 22 nt, Homo sapiens
uucauggugcacugagcugcaa

SEQ ID NO: 1377981 - RNA, 17 nt, Homo sapiens
uucauuagccaaauuga

SEQ ID NO: 1377982 - RNA, 13 nt, Homo sapiens
uucauugaugacc

SEQ ID NO: 1377983 - RNA, 16 nt, Homo sapiens
uucauugccagugucu

SEQ ID NO: 1377984 - RNA, 19 nt, Homo sapiens
uucauuucagauaaacaac

SEQ ID NO: 1377985 - RNA, 17 nt, Homo sapiens
uucauuugugugcucau

SEQ ID NO: 1377986 - RNA, 19 nt, Homo sapiens
uuccaaacacauacaggaa

SEQ ID NO: 1377987 - RNA, 19 nt, Homo sapiens
uuccaaggguacuaaggaa

SEQ ID NO: 1377988 - RNA, 13 nt, Homo sapiens
uuccaaugcauug

SEQ ID NO: 1377989 - RNA, 20 nt, Homo sapiens
uuccaauuuacauacucugc

SEQ ID NO: 1377990 - RNA, 18 nt, Homo sapiens
uuccaccuagagcuagau

SEQ ID NO: 1377991 - RNA, 14 nt, Homo sapiens
uuccacuacugcua

SEQ ID NO: 1377992 - RNA, 13 nt, Homo sapiens
uuccagauauuca

SEQ ID NO: 1377993 - RNA, 20 nt, Homo sapiens
uuccaggaccagaagcauuu

SEQ ID NO: 1377994 - RNA, 19 nt, Homo sapiens
uuccaggcgaugugcaagu

SEQ ID NO: 1377995 - RNA, 15 nt, Homo sapiens
aaauaaauacauucu

SEQ ID NO: 1377996 - RNA, 15 nt, Homo sapiens
aaauaaauagcuaua

SEQ ID NO: 1377997 - RNA, 13 nt, Homo sapiens
aaauaaaugacaa

SEQ ID NO: 1377998 - RNA, 22 nt, Homo sapiens
aaauaaauuauuauuuaaacau

SEQ ID NO: 1377999 - RNA, 12 nt, Homo sapiens
aaauaauaugca

SEQ ID NO: 1378000 - RNA, 16 nt, Homo sapiens
aaauaaugcacuuccu

SEQ ID NO: 1378001 - RNA, 16 nt, Homo sapiens
aaauaauugauuucaa

SEQ ID NO: 1378002 - RNA, 20 nt, Homo sapiens
aaauacaguauucuguacca

SEQ ID NO: 1378003 - RNA, 14 nt, Homo sapiens
aaauaccauguaca

SEQ ID NO: 1378004 - RNA, 15 nt, Homo sapiens
aaauacucuaauucu

SEQ ID NO: 1378005 - RNA, 14 nt, Homo sapiens
aaauagaccucuca

SEQ ID NO: 1378006 - RNA, 16 nt, Homo sapiens
aaauaguuuggauuac

SEQ ID NO: 1378007 - RNA, 21 nt, Homo sapiens
aaauaguuuggauuacuuaaa

SEQ ID NO: 1378008 - RNA, 17 nt, Homo sapiens
aaauauaauaugcacac

SEQ ID NO: 1378009 - RNA, 13 nt, Homo sapiens
aaauauacauuca

SEQ ID NO: 1378010 - RNA, 13 nt, Homo sapiens
aaauauagccaaa

SEQ ID NO: 1378011 - RNA, 14 nt, Homo sapiens
aaauauauuucaga

SEQ ID NO: 1378012 - RNA, 20 nt, Homo sapiens
aaauauuaugcaaauuccca

SEQ ID NO: 1378013 - RNA, 16 nt, Homo sapiens
aaauauuauugguguu

SEQ ID NO: 1378014 - RNA, 19 nt, Homo sapiens
aaauauuuacauaugaaau

SEQ ID NO: 1378015 - RNA, 16 nt, Homo sapiens
aaauauuuuaaaggua

SEQ ID NO: 1378016 - RNA, 16 nt, Homo sapiens
aaaucaaugucacuua

SEQ ID NO: 1378017 - RNA, 23 nt, Homo sapiens
aaaucacacaugcuuuucuuccu

SEQ ID NO: 1378018 - RNA, 20 nt, Homo sapiens
aaaucagcugcuacuacucc

SEQ ID NO: 1378019 - RNA, 21 nt, Homo sapiens
aaaucauauccuaugacccag

SEQ ID NO: 1378020 - RNA, 13 nt, Homo sapiens
aaaucaucucuca

SEQ ID NO: 1378021 - RNA, 19 nt, Homo sapiens
aaauccuaccaaccucuga

SEQ ID NO: 1378022 - RNA, 15 nt, Homo sapiens
aaauccuuccaugaa

SEQ ID NO: 1378023 - RNA, 11 nt, Homo sapiens
aaauccuugau

SEQ ID NO: 1378024 - RNA, 12 nt, Homo sapiens
aaauccuugaua

SEQ ID NO: 1378025 - RNA, 17 nt, Homo sapiens
aaaucuagaagacuguc

SEQ ID NO: 1378026 - RNA, 22 nt, Homo sapiens
aaaucucacuuuucuccaugag

SEQ ID NO: 1378027 - RNA, 22 nt, Homo sapiens
aaaucuuaaaagcccuaaguga

SEQ ID NO: 1378028 - RNA, 14 nt, Homo sapiens
aaaucuugcaacug

SEQ ID NO: 1378029 - RNA, 16 nt, Homo sapiens
aaaugaaccauucaca

SEQ ID NO: 1378030 - RNA, 14 nt, Homo sapiens
aaaugaauuucucu

SEQ ID NO: 1378031 - RNA, 20 nt, Homo sapiens
aaaugaauuucucuacagau

SEQ ID NO: 1378032 - RNA, 15 nt, Homo sapiens
aaaugagaacaugaa

SEQ ID NO: 1378033 - RNA, 20 nt, Homo sapiens
aaaugcauauccugagccau

SEQ ID NO: 1378034 - RNA, 12 nt, Homo sapiens
aaaugccagugu

SEQ ID NO: 1378035 - RNA, 14 nt, Homo sapiens
aaaugccagugugc

SEQ ID NO: 1378036 - RNA, 12 nt, Homo sapiens
aaaugcuuaugu

SEQ ID NO: 1378037 - RNA, 21 nt, Homo sapiens
aaauggugguuguuucuucca

SEQ ID NO: 1378038 - RNA, 17 nt, Homo sapiens
aaaugucuaagguagua

SEQ ID NO: 1378039 - RNA, 10 nt, Homo sapiens
aaaugucucc

SEQ ID NO: 1378040 - RNA, 18 nt, Homo sapiens
aaaugugaccugugucac

SEQ ID NO: 1378041 - RNA, 18 nt, Homo sapiens
aaauguggcccccagugg

SEQ ID NO: 1378042 - RNA, 19 nt, Homo sapiens
aaauuacagcuucacccug

SEQ ID NO: 1378043 - RNA, 15 nt, Homo sapiens
aaauuagcugggcau

SEQ ID NO: 1378044 - RNA, 15 nt, Homo sapiens
aaauuauuuaucaag

SEQ ID NO: 1378045 - RNA, 17 nt, Homo sapiens
aaauucaaccacuguaa

SEQ ID NO: 1378046 - RNA, 17 nt, Homo sapiens
aaauucacaaguugugu

SEQ ID NO: 1378047 - RNA, 23 nt, Homo sapiens
aaauucauacauaguacauacaa

SEQ ID NO: 1378048 - RNA, 23 nt, Homo sapiens
aaauucgcugcaaccuguugaua

SEQ ID NO: 1378049 - RNA, 12 nt, Homo sapiens
aaauucuuucag

SEQ ID NO: 1378050 - RNA, 22 nt, Homo sapiens
aaauuggacauuaagcaucaca

SEQ ID NO: 1378051 - RNA, 13 nt, Homo sapiens
aaauuuauugcuu

SEQ ID NO: 1378052 - RNA, 22 nt, Homo sapiens
aaauuugaaccaaaacauuccg

SEQ ID NO: 1378053 - RNA, 20 nt, Homo sapiens
aaauuuguaaaucuuauucu

SEQ ID NO: 1378054 - RNA, 10 nt, Homo sapiens
aaauuuugcc

SEQ ID NO: 1378055 - RNA, 20 nt, Homo sapiens
aaauuuuuccuuagcauugu

SEQ ID NO: 1378056 - RNA, 16 nt, Homo sapiens
aaauuuuuguuuauaa

SEQ ID NO: 1378057 - RNA, 17 nt, Homo sapiens
aaauuuuuuaaaaagca

SEQ ID NO: 1378058 - RNA, 15 nt, Homo sapiens
aacaaacaaacaauu

SEQ ID NO: 1378059 - RNA, 13 nt, Homo sapiens
aacaaacugugua

SEQ ID NO: 1378060 - RNA, 13 nt, Homo sapiens
aacaaagaagaca

SEQ ID NO: 1378061 - RNA, 18 nt, Homo sapiens
aacaaauuagguuuugua

SEQ ID NO: 1378062 - RNA, 20 nt, Homo sapiens
aacaacaaagccaacaguca

SEQ ID NO: 1378063 - RNA, 14 nt, Homo sapiens
aacaacaaauaauu

SEQ ID NO: 1378064 - RNA, 15 nt, Homo sapiens
aacaaccuggucaca

SEQ ID NO: 1378065 - RNA, 12 nt, Homo sapiens
aacaacuguggu

SEQ ID NO: 1378066 - RNA, 15 nt, Homo sapiens
aacaacuucuuugua

SEQ ID NO: 1378067 - RNA, 19 nt, Homo sapiens
aacaacuuucucuuguaaa

SEQ ID NO: 1378068 - RNA, 15 nt, Homo sapiens
aacacaaugccucau

SEQ ID NO: 1378069 - RNA, 23 nt, Homo sapiens
aacacaaugccucaucuucccug

SEQ ID NO: 1378070 - RNA, 17 nt, Homo sapiens
aacacaauucuucuucc

SEQ ID NO: 1378071 - RNA, 21 nt, Homo sapiens
aacacagcauguguauuucca

SEQ ID NO: 1378072 - RNA, 18 nt, Homo sapiens
aacaccagggacacauuu

SEQ ID NO: 1378073 - RNA, 20 nt, Homo sapiens
aacacggggcuugcaacuua

SEQ ID NO: 1378074 - RNA, 15 nt, Homo sapiens
aacacugaagcucuu

SEQ ID NO: 1378075 - RNA, 18 nt, Homo sapiens
aacacugacuccugugga

SEQ ID NO: 1378076 - RNA, 14 nt, Homo sapiens
aacacugcacucuu

SEQ ID NO: 1378077 - RNA, 13 nt, Homo sapiens
aacacugcugcuc

SEQ ID NO: 1378078 - RNA, 16 nt, Homo sapiens
aacacuugaagccauc

SEQ ID NO: 1378079 - RNA, 14 nt, Homo sapiens
aacagaagcuucca

SEQ ID NO: 1378080 - RNA, 15 nt, Homo sapiens
aacagacaacagaag

SEQ ID NO: 1378081 - RNA, 18 nt, Homo sapiens
aacagagacuucuagaca

SEQ ID NO: 1378082 - RNA, 15 nt, Homo sapiens
aacagauaagcaaga

SEQ ID NO: 1378083 - RNA, 13 nt, Homo sapiens
aacagauaauccc

SEQ ID NO: 1378084 - RNA, 21 nt, Homo sapiens
aacagauggauagucugucca

SEQ ID NO: 1378085 - RNA, 15 nt, Homo sapiens
aacagcacccucucc

SEQ ID NO: 1378086 - RNA, 13 nt, Homo sapiens
aacagcagaacuu

SEQ ID NO: 1378087 - RNA, 20 nt, Homo sapiens
aacagcgcuggguccacccc

SEQ ID NO: 1378088 - RNA, 21 nt, Homo sapiens
aacagcgggagaccugugcua

SEQ ID NO: 1378089 - RNA, 12 nt, Homo sapiens
aacagugccauu

SEQ ID NO: 1378090 - RNA, 14 nt, Homo sapiens
aacagugugauuca

SEQ ID NO: 1378091 - RNA, 19 nt, Homo sapiens
aacauaaagagaacucugg

SEQ ID NO: 1378092 - RNA, 13 nt, Homo sapiens
aacauaaagccuu

SEQ ID NO: 1378093 - RNA, 18 nt, Homo sapiens
aacauaaagguuauuuuc

SEQ ID NO: 1378094 - RNA, 16 nt, Homo sapiens
aacauagagaucuaug

SEQ ID NO: 1378095 - RNA, 19 nt, Homo sapiens
aacauauuuauauauguau

SEQ ID NO: 1378096 - RNA, 21 nt, Homo sapiens
aacaucacugaaaugcuagcu

SEQ ID NO: 1378097 - RNA, 20 nt, Homo sapiens
aacaucccugccagcucuuc

SEQ ID NO: 1378098 - RNA, 13 nt, Homo sapiens
aacaucgucuaaa

SEQ ID NO: 1378099 - RNA, 17 nt, Homo sapiens
aacaugaagccaggugu

SEQ ID NO: 1378100 - RNA, 22 nt, Homo sapiens
aacaugguaaaaccccaucucu

SEQ ID NO: 1378101 - RNA, 23 nt, Homo sapiens
aacauggugaaaccucaucucua

SEQ ID NO: 1378102 - RNA, 23 nt, Homo sapiens
aacauguaauaaaaaguauaugu

SEQ ID NO: 1378103 - RNA, 19 nt, Homo sapiens
aacauguaauuaaguacua

SEQ ID NO: 1378104 - RNA, 14 nt, Homo sapiens
aacaugugcucagg

SEQ ID NO: 1378105 - RNA, 21 nt, Homo sapiens
aacauguuagaagcaaugaau

SEQ ID NO: 1378106 - RNA, 22 nt, Homo sapiens
aacauguuuugugcagcacagu

SEQ ID NO: 1378107 - RNA, 14 nt, Homo sapiens
aacauuacucugaa

SEQ ID NO: 1378108 - RNA, 16 nt, Homo sapiens
aacauuauauugcaau

SEQ ID NO: 1378109 - RNA, 20 nt, Homo sapiens
aacucauuccugccugucuc

SEQ ID NO: 1378110 - RNA, 12 nt, Homo sapiens
aacuccagugaa

SEQ ID NO: 1378111 - RNA, 12 nt, Homo sapiens
aacucucuccac

SEQ ID NO: 1378112 - RNA, 23 nt, Homo sapiens
aacucugagcagugcuugaauga

SEQ ID NO: 1378113 - RNA, 14 nt, Homo sapiens
aacucuugaccuca

SEQ ID NO: 1378114 - RNA, 20 nt, Homo sapiens
aacucuuucuggccugccuu

SEQ ID NO: 1378115 - RNA, 22 nt, Homo sapiens
aacucuuucuggccugccuucg

SEQ ID NO: 1378116 - RNA, 18 nt, Homo sapiens
aacugaaaacaagccaug

SEQ ID NO: 1378117 - RNA, 18 nt, Homo sapiens
aacugaaugaacaaccuc

SEQ ID NO: 1378118 - RNA, 21 nt, Homo sapiens
aacugauuuuuagcuuuacaa

SEQ ID NO: 1378119 - RNA, 14 nt, Homo sapiens
aacugcauugagaa

SEQ ID NO: 1378120 - RNA, 17 nt, Homo sapiens
aacugcccaaggcaugu

SEQ ID NO: 1378121 - RNA, 19 nt, Homo sapiens
aacuggaggaguuccuuga

SEQ ID NO: 1378122 - RNA, 17 nt, Homo sapiens
aacuggcaguuuuccau

SEQ ID NO: 1378123 - RNA, 11 nt, Homo sapiens
aacuggcugca

SEQ ID NO: 1378124 - RNA, 19 nt, Homo sapiens
aacugggccuguugcccuu

SEQ ID NO: 1378125 - RNA, 19 nt, Homo sapiens
aacuggguacuuguggaca

SEQ ID NO: 1378126 - RNA, 17 nt, Homo sapiens
aacugucaaagaaucaa

SEQ ID NO: 1378127 - RNA, 22 nt, Homo sapiens
aacugucaaagaaucaauccag

SEQ ID NO: 1378128 - RNA, 17 nt, Homo sapiens
aacuguguauguacaua

SEQ ID NO: 1378129 - RNA, 20 nt, Homo sapiens
aacuguugauugcaggaaua

SEQ ID NO: 1378130 - RNA, 18 nt, Homo sapiens
aacuguugccagagaugg

SEQ ID NO: 1378131 - RNA, 15 nt, Homo sapiens
aacuucagccagcua

SEQ ID NO: 1378132 - RNA, 20 nt, Homo sapiens
aacuuccagugcaacacuga

SEQ ID NO: 1378133 - RNA, 16 nt, Homo sapiens
aacuucuccccauuuc

SEQ ID NO: 1378134 - RNA, 20 nt, Homo sapiens
aacuucugcuuuaauggcuu

SEQ ID NO: 1378135 - RNA, 17 nt, Homo sapiens
aacuugagcauguuacu

SEQ ID NO: 1378136 - RNA, 22 nt, Homo sapiens
aacuugcagaauugagagugau

SEQ ID NO: 1378137 - RNA, 22 nt, Homo sapiens
aacuuggaaauagugauuucca

SEQ ID NO: 1378138 - RNA, 23 nt, Homo sapiens
aacuuugacaaccaugagaccac

SEQ ID NO: 1378139 - RNA, 20 nt, Homo sapiens
aacuuuguuuagcccaaaac

SEQ ID NO: 1378140 - RNA, 18 nt, Homo sapiens
aacuuuugguaucuacuu

SEQ ID NO: 1378141 - RNA, 15 nt, Homo sapiens
aagaaaaaaaccaua

SEQ ID NO: 1378142 - RNA, 19 nt, Homo sapiens
aagaaaagugggccagugu

SEQ ID NO: 1378143 - RNA, 18 nt, Homo sapiens
aagaaaauaugcaucuaa

SEQ ID NO: 1378144 - RNA, 14 nt, Homo sapiens
aagaaacauugccu

SEQ ID NO: 1378145 - RNA, 19 nt, Homo sapiens
aagaaacuucggggcugca

SEQ ID NO: 1378146 - RNA, 18 nt, Homo sapiens
aagaaaggccagcaaauu

SEQ ID NO: 1378147 - RNA, 17 nt, Homo sapiens
aagaaaguguuggcuaa

SEQ ID NO: 1378148 - RNA, 19 nt, Homo sapiens
aagaaauuaugucagcuua

SEQ ID NO: 1378149 - RNA, 17 nt, Homo sapiens
aagaacaguaacugcca

SEQ ID NO: 1378150 - RNA, 16 nt, Homo sapiens
aagaaccgagcaauuu

SEQ ID NO: 1378151 - RNA, 16 nt, Homo sapiens
aagaagaagugaccaa

SEQ ID NO: 1378152 - RNA, 18 nt, Homo sapiens
aagaagagacucuuugca

SEQ ID NO: 1378153 - RNA, 20 nt, Homo sapiens
aagaagcagucaauuuucac

SEQ ID NO: 1378154 - RNA, 15 nt, Homo sapiens
aagaagccacagacc

SEQ ID NO: 1378155 - RNA, 21 nt, Homo sapiens
aagaaggaauucuaggcaucc

SEQ ID NO: 1378156 - RNA, 14 nt, Homo sapiens
aagaaguuaaauga

SEQ ID NO: 1378157 - RNA, 14 nt, Homo sapiens
aagaauguucucaa

SEQ ID NO: 1378158 - RNA, 16 nt, Homo sapiens
aagaauuaugcaucug

SEQ ID NO: 1378159 - RNA, 17 nt, Homo sapiens
aagaauugaacccagga

SEQ ID NO: 1378160 - RNA, 23 nt, Homo sapiens
aagaauuuuuauauccacuaaaa

SEQ ID NO: 1378161 - RNA, 22 nt, Homo sapiens
aagaauuuuuuuuaacauucca

SEQ ID NO: 1378162 - RNA, 15 nt, Homo sapiens
aaguaaauauuucag

SEQ ID NO: 1378163 - RNA, 15 nt, Homo sapiens
aaguaaggcaugguu

SEQ ID NO: 1378164 - RNA, 15 nt, Homo sapiens
aaguaaguaccacuc

SEQ ID NO: 1378165 - RNA, 18 nt, Homo sapiens
aaguaaguaccacucagg

SEQ ID NO: 1378166 - RNA, 17 nt, Homo sapiens
aaguaaguuugauuuca

SEQ ID NO: 1378167 - RNA, 16 nt, Homo sapiens
aaguaauuucuucuca

SEQ ID NO: 1378168 - RNA, 16 nt, Homo sapiens
aaguagaauccuaaau

SEQ ID NO: 1378169 - RNA, 22 nt, Homo sapiens
aaguagcuuuccacauuuguca

SEQ ID NO: 1378170 - RNA, 18 nt, Homo sapiens
aaguagguuuacauucau

SEQ ID NO: 1378171 - RNA, 16 nt, Homo sapiens
aaguaucacacuguau

SEQ ID NO: 1378172 - RNA, 18 nt, Homo sapiens
aaguauuauuuauuugaa

SEQ ID NO: 1378173 - RNA, 20 nt, Homo sapiens
aaguauucugccuuugcaga

SEQ ID NO: 1378174 - RNA, 14 nt, Homo sapiens
aagucaaagacauu

SEQ ID NO: 1378175 - RNA, 22 nt, Homo sapiens
aagucaggacaucagucugauu

SEQ ID NO: 1378176 - RNA, 16 nt, Homo sapiens
aagucaugaacacauc

SEQ ID NO: 1378177 - RNA, 17 nt, Homo sapiens
aagucaugaacacauca

SEQ ID NO: 1378178 - RNA, 20 nt, Homo sapiens
aagucaugaagcccaaguga

SEQ ID NO: 1378179 - RNA, 18 nt, Homo sapiens
aagucauuuuaacuuuau

SEQ ID NO: 1378180 - RNA, 14 nt, Homo sapiens
aagucccagcauug

SEQ ID NO: 1378181 - RNA, 19 nt, Homo sapiens
aagucuugugacuagugcu

SEQ ID NO: 1378182 - RNA, 15 nt, Homo sapiens
aagugaaaucugugc

SEQ ID NO: 1378183 - RNA, 19 nt, Homo sapiens
aagugagacccugucucaa

SEQ ID NO: 1378184 - RNA, 14 nt, Homo sapiens
aaguggccaugcca

SEQ ID NO: 1378185 - RNA, 14 nt, Homo sapiens
aagugguuucagca

SEQ ID NO: 1378186 - RNA, 16 nt, Homo sapiens
aagugguuucagcaau

SEQ ID NO: 1378187 - RNA, 21 nt, Homo sapiens
aagugucugugugcaagugug

SEQ ID NO: 1378188 - RNA, 14 nt, Homo sapiens
aaguuauugauguu

SEQ ID NO: 1378189 - RNA, 16 nt, Homo sapiens
aaguuauugauguuuu

SEQ ID NO: 1378190 - RNA, 22 nt, Homo sapiens
aaguucccuacuuccugugacu

SEQ ID NO: 1378191 - RNA, 15 nt, Homo sapiens
aaguuccucuagugc

SEQ ID NO: 1378192 - RNA, 22 nt, Homo sapiens
aaguucgaagcuccgugaguga

SEQ ID NO: 1378193 - RNA, 19 nt, Homo sapiens
aaguugacaggcagugcca

SEQ ID NO: 1378194 - RNA, 17 nt, Homo sapiens
aaguugcugaugaacuc

SEQ ID NO: 1378195 - RNA, 14 nt, Homo sapiens
aaguuggcuucuaa

SEQ ID NO: 1378196 - RNA, 19 nt, Homo sapiens
aaguuuacaaucaaaggaa

SEQ ID NO: 1378197 - RNA, 17 nt, Homo sapiens
aaguuuagugcccucau

SEQ ID NO: 1378198 - RNA, 20 nt, Homo sapiens
aaguuuagugcccucaucca

SEQ ID NO: 1378199 - RNA, 14 nt, Homo sapiens
aaguuuaucuuuca

SEQ ID NO: 1378200 - RNA, 23 nt, Homo sapiens
aaguuuuaugagaaaugccagug

SEQ ID NO: 1378201 - RNA, 13 nt, Homo sapiens
aaguuuucaggac

SEQ ID NO: 1378202 - RNA, 24 nt, Homo sapiens
aauaaaacccaacagauacuggaa

SEQ ID NO: 1378203 - RNA, 15 nt, Homo sapiens
aauaaagaccugaga

SEQ ID NO: 1378204 - RNA, 14 nt, Homo sapiens
aauaaagcaucuca

SEQ ID NO: 1378205 - RNA, 15 nt, Homo sapiens
aauaaagcaucucau

SEQ ID NO: 1378206 - RNA, 14 nt, Homo sapiens
aauaaagcuugcaa

SEQ ID NO: 1378207 - RNA, 15 nt, Homo sapiens
aauaaaggcauuuca

SEQ ID NO: 1378208 - RNA, 16 nt, Homo sapiens
aauaaauguacauuaa

SEQ ID NO: 1378209 - RNA, 15 nt, Homo sapiens
aauaaauguauucaa

SEQ ID NO: 1378210 - RNA, 15 nt, Homo sapiens
aauaaauucauacau

SEQ ID NO: 1378211 - RNA, 14 nt, Homo sapiens
aauaaauugcuccu

SEQ ID NO: 1378212 - RNA, 15 nt, Homo sapiens
aauaacagccucauu

SEQ ID NO: 1378213 - RNA, 12 nt, Homo sapiens
aauaacauaaca

SEQ ID NO: 1378214 - RNA, 17 nt, Homo sapiens
aauaacauaacaaauaa

SEQ ID NO: 1378215 - RNA, 13 nt, Homo sapiens
aauaacauguaau

SEQ ID NO: 1378216 - RNA, 14 nt, Homo sapiens
aauaaccacuuaaa

SEQ ID NO: 1378217 - RNA, 20 nt, Homo sapiens
aauaagagcguuugcccaaa

SEQ ID NO: 1378218 - RNA, 16 nt, Homo sapiens
aauaagcagaagccau

SEQ ID NO: 1378219 - RNA, 17 nt, Homo sapiens
aauaauaacaaucacaa

SEQ ID NO: 1378220 - RNA, 20 nt, Homo sapiens
aauaauaagaggugcuacug

SEQ ID NO: 1378221 - RNA, 20 nt, Homo sapiens
aauaauacaguaucucaggg

SEQ ID NO: 1378222 - RNA, 22 nt, Homo sapiens
aauaaugaguuagaacuauuaa

SEQ ID NO: 1378223 - RNA, 20 nt, Homo sapiens
aauaauguuguaauucaugc

SEQ ID NO: 1378224 - RNA, 16 nt, Homo sapiens
aauacacaacacacac

SEQ ID NO: 1378225 - RNA, 17 nt, Homo sapiens
aauacagggcaugcauu

SEQ ID NO: 1378226 - RNA, 21 nt, Homo sapiens
aauacaugaaaugucuggucu

SEQ ID NO: 1378227 - RNA, 12 nt, Homo sapiens
aauaccauguac

SEQ ID NO: 1378228 - RNA, 14 nt, Homo sapiens
aauacuccuaagac

SEQ ID NO: 1378229 - RNA, 17 nt, Homo sapiens
aauacuugccugugaca

SEQ ID NO: 1378230 - RNA, 20 nt, Homo sapiens
aauagaaccacuaugaagcu

SEQ ID NO: 1378231 - RNA, 19 nt, Homo sapiens
aauagaaggauguacauuu

SEQ ID NO: 1378232 - RNA, 22 nt, Homo sapiens
aauagaaggauguacauuucca

SEQ ID NO: 1378233 - RNA, 21 nt, Homo sapiens
aauagcacuuucauugccagu

SEQ ID NO: 1378234 - RNA, 18 nt, Homo sapiens
aauagccugcgcuguuuu

SEQ ID NO: 1378235 - RNA, 18 nt, Homo sapiens
aauagcuauauccaugua

SEQ ID NO: 1378236 - RNA, 21 nt, Homo sapiens
aauagcugggacuacaggugu

SEQ ID NO: 1378237 - RNA, 14 nt, Homo sapiens
aauaguauuuauga

SEQ ID NO: 1378238 - RNA, 21 nt, Homo sapiens
aauaguuguuauucuguaguu

SEQ ID NO: 1378239 - RNA, 19 nt, Homo sapiens
aauaguuuugauccuaaau

SEQ ID NO: 1378240 - RNA, 16 nt, Homo sapiens
aauauaacugccuuaa

SEQ ID NO: 1378241 - RNA, 12 nt, Homo sapiens
aauauaaugcaa

SEQ ID NO: 1378242 - RNA, 16 nt, Homo sapiens
aauauagaaugaaaga

SEQ ID NO: 1378243 - RNA, 17 nt, Homo sapiens
aauaucaagcagugaaa

SEQ ID NO: 1378244 - RNA, 15 nt, Homo sapiens
aauaucaugcuccau

SEQ ID NO: 1378245 - RNA, 14 nt, Homo sapiens
aauaucugcuguau

SEQ ID NO: 1378246 - RNA, 19 nt, Homo sapiens
aauaucuugaaacauagag

SEQ ID NO: 1378247 - RNA, 20 nt, Homo sapiens
aauaugacggaagaacauag

SEQ ID NO: 1378248 - RNA, 19 nt, Homo sapiens
aauaugcacaauagcaguu

SEQ ID NO: 1378249 - RNA, 21 nt, Homo sapiens
aauaugggcacuuuaaaugaa

SEQ ID NO: 1378250 - RNA, 15 nt, Homo sapiens
aauauuacaauccuu

SEQ ID NO: 1378251 - RNA, 22 nt, Homo sapiens
aauauuccagagacugggacua

SEQ ID NO: 1378252 - RNA, 20 nt, Homo sapiens
aauauuuauuauuuucaccu

SEQ ID NO: 1378253 - RNA, 18 nt, Homo sapiens
aauauuugacaggcuuau

SEQ ID NO: 1378254 - RNA, 20 nt, Homo sapiens
aauauuuuguaacuauuaca

SEQ ID NO: 1378255 - RNA, 19 nt, Homo sapiens
aauauuuuguuuugugcag

SEQ ID NO: 1378256 - RNA, 22 nt, Homo sapiens
aaucaaaggaaaauaguaaugu

SEQ ID NO: 1378257 - RNA, 20 nt, Homo sapiens
aaucaaggugauugugauua

SEQ ID NO: 1378258 - RNA, 18 nt, Homo sapiens
aaucaaguuggcuucuaa

SEQ ID NO: 1378259 - RNA, 15 nt, Homo sapiens
aaucaaucacgugua

SEQ ID NO: 1378260 - RNA, 23 nt, Homo sapiens
aaucacacaugcuuuucuuccua

SEQ ID NO: 1378261 - RNA, 23 nt, Homo sapiens
aaucacugcucacacugcugaug

SEQ ID NO: 1378262 - RNA, 20 nt, Homo sapiens
aaucagagagcucacuaaaa

SEQ ID NO: 1378263 - RNA, 15 nt, Homo sapiens
aaucagaucauuuca

SEQ ID NO: 1378264 - RNA, 14 nt, Homo sapiens
aaucagcauucuca

SEQ ID NO: 1378265 - RNA, 20 nt, Homo sapiens
aaucagcugcuacuacuccu

SEQ ID NO: 1378266 - RNA, 18 nt, Homo sapiens
aaucauauaaucuuacaa

SEQ ID NO: 1378267 - RNA, 18 nt, Homo sapiens
aaucauaugguugacagu

SEQ ID NO: 1378268 - RNA, 13 nt, Homo sapiens
aaucaugagauaa

SEQ ID NO: 1378269 - RNA, 22 nt, Homo sapiens
aaucaugagauccuuuaaaucc

SEQ ID NO: 1378270 - RNA, 19 nt, Homo sapiens
aaucauggcuaagcuuaaa

SEQ ID NO: 1378271 - RNA, 16 nt, Homo sapiens
aauccagacccggcug

SEQ ID NO: 1378272 - RNA, 15 nt, Homo sapiens
aaucccagcuacuug

SEQ ID NO: 1378273 - RNA, 22 nt, Homo sapiens
aaucccgauucacccuguccaa

SEQ ID NO: 1378274 - RNA, 14 nt, Homo sapiens
aaucccggcuguca

SEQ ID NO: 1378275 - RNA, 20 nt, Homo sapiens
acagagagggggccaccucc

SEQ ID NO: 1378276 - RNA, 21 nt, Homo sapiens
acagagcgagacuccgucuca

SEQ ID NO: 1378277 - RNA, 20 nt, Homo sapiens
acagagcgagagucugucuc

SEQ ID NO: 1378278 - RNA, 20 nt, Homo sapiens
acagaguaagacucugucuc

SEQ ID NO: 1378279 - RNA, 13 nt, Homo sapiens
acagaugccccag

SEQ ID NO: 1378280 - RNA, 20 nt, Homo sapiens
acagauguagcaacaugaga

SEQ ID NO: 1378281 - RNA, 21 nt, Homo sapiens
acagauuccaggcgaugugca

SEQ ID NO: 1378282 - RNA, 15 nt, Homo sapiens
acagauugcugcuuc

SEQ ID NO: 1378283 - RNA, 14 nt, Homo sapiens
acagcaaaacucca

SEQ ID NO: 1378284 - RNA, 19 nt, Homo sapiens
acagcaaaacuccaucuca

SEQ ID NO: 1378285 - RNA, 16 nt, Homo sapiens
acagcacccucuccag

SEQ ID NO: 1378286 - RNA, 15 nt, Homo sapiens
acagcacuaauucaa

SEQ ID NO: 1378287 - RNA, 16 nt, Homo sapiens
acagcagccucugaag

SEQ ID NO: 1378288 - RNA, 12 nt, Homo sapiens
acagcaguagca

SEQ ID NO: 1378289 - RNA, 18 nt, Homo sapiens
acagccacacugugggac

SEQ ID NO: 1378290 - RNA, 14 nt, Homo sapiens
acagccacuuggga

SEQ ID NO: 1378291 - RNA, 15 nt, Homo sapiens
acagccaucaaggga

SEQ ID NO: 1378292 - RNA, 23 nt, Homo sapiens
acagccucccacccccaucucuc

SEQ ID NO: 1378293 - RNA, 19 nt, Homo sapiens
acagcgagacuccgucuca

SEQ ID NO: 1378294 - RNA, 20 nt, Homo sapiens
acagcgagacuccgucucaa

SEQ ID NO: 1378295 - RNA, 18 nt, Homo sapiens
acagcuacacagaucaca

SEQ ID NO: 1378296 - RNA, 15 nt, Homo sapiens
acagcuacacgcuga

SEQ ID NO: 1378297 - RNA, 20 nt, Homo sapiens
acagcucuagacacugccac

SEQ ID NO: 1378298 - RNA, 13 nt, Homo sapiens
acagcucucaccu

SEQ ID NO: 1378299 - RNA, 17 nt, Homo sapiens
acagcucuugaggaugu

SEQ ID NO: 1378300 - RNA, 21 nt, Homo sapiens
acagcugccugugugggacug

SEQ ID NO: 1378301 - RNA, 15 nt, Homo sapiens
acagcuguaauaaca

SEQ ID NO: 1378302 - RNA, 15 nt, Homo sapiens
acagcuucaugccuu

SEQ ID NO: 1378303 - RNA, 14 nt, Homo sapiens
acagcuucuaguga

SEQ ID NO: 1378304 - RNA, 18 nt, Homo sapiens
acaggaaaaaaacuuuua

SEQ ID NO: 1378305 - RNA, 23 nt, Homo sapiens
acaggaagguagaaauaucugaa

SEQ ID NO: 1378306 - RNA, 18 nt, Homo sapiens
acaggaauacuuaacuca

SEQ ID NO: 1378307 - RNA, 15 nt, Homo sapiens
acaggacauucucau

SEQ ID NO: 1378308 - RNA, 15 nt, Homo sapiens
acaggacuagcugga

SEQ ID NO: 1378309 - RNA, 20 nt, Homo sapiens
acaggagucugucucugcua

SEQ ID NO: 1378310 - RNA, 21 nt, Homo sapiens
acaggaugaaaguucccccau

SEQ ID NO: 1378311 - RNA, 17 nt, Homo sapiens
acaggcaccugccaaca

SEQ ID NO: 1378312 - RNA, 18 nt, Homo sapiens
acaggccauacuuuacaa

SEQ ID NO: 1378313 - RNA, 19 nt, Homo sapiens
acaggcccggcuccaggcu

SEQ ID NO: 1378314 - RNA, 16 nt, Homo sapiens
acaggcccuuccucuc

SEQ ID NO: 1378315 - RNA, 21 nt, Homo sapiens
acaggcccuuccucuccacug

SEQ ID NO: 1378316 - RNA, 14 nt, Homo sapiens
acagggcauucaaa

SEQ ID NO: 1378317 - RNA, 17 nt, Homo sapiens
acaggggcuggugggca

SEQ ID NO: 1378318 - RNA, 20 nt, Homo sapiens
acaggggcuggugggcacca

SEQ ID NO: 1378319 - RNA, 20 nt, Homo sapiens
acagguagacaguauauaac

SEQ ID NO: 1378320 - RNA, 19 nt, Homo sapiens
acagguguuuauacagcuc

SEQ ID NO: 1378321 - RNA, 12 nt, Homo sapiens
acaguaaaucac

SEQ ID NO: 1378322 - RNA, 15 nt, Homo sapiens
acaguaaccuuucaa

SEQ ID NO: 1378323 - RNA, 17 nt, Homo sapiens
acaguaacugccaucaa

SEQ ID NO: 1378324 - RNA, 20 nt, Homo sapiens
acaguaacuugguuauacau

SEQ ID NO: 1378325 - RNA, 19 nt, Homo sapiens
acaguacaggcagcacaga

SEQ ID NO: 1378326 - RNA, 21 nt, Homo sapiens
acaguacaggcagcacagaga

SEQ ID NO: 1378327 - RNA, 14 nt, Homo sapiens
acaguaucucaggg

SEQ ID NO: 1378328 - RNA, 22 nt, Homo sapiens
acaguaugguaacuuugcaaau

SEQ ID NO: 1378329 - RNA, 16 nt, Homo sapiens
acaguauuuucccaau

SEQ ID NO: 1378330 - RNA, 16 nt, Homo sapiens
acagugagaaaccaua

SEQ ID NO: 1378331 - RNA, 22 nt, Homo sapiens
acagugaucuccauauguuaca

SEQ ID NO: 1378332 - RNA, 12 nt, Homo sapiens
acagugaugcug

SEQ ID NO: 1378333 - RNA, 13 nt, Homo sapiens
acagugcagacag

SEQ ID NO: 1378334 - RNA, 15 nt, Homo sapiens
acagugccuaauaau

SEQ ID NO: 1378335 - RNA, 15 nt, Homo sapiens
acagugccugggaau

SEQ ID NO: 1378336 - RNA, 15 nt, Homo sapiens
acagugggagccagg

SEQ ID NO: 1378337 - RNA, 19 nt, Homo sapiens
acaguguauguacuaagca

SEQ ID NO: 1378338 - RNA, 17 nt, Homo sapiens
acaguuagguagcuuua

SEQ ID NO: 1378339 - RNA, 22 nt, Homo sapiens
acaguucaauucucauuuguca

SEQ ID NO: 1378340 - RNA, 23 nt, Homo sapiens
acaguucaauucucauuugucac

SEQ ID NO: 1378341 - RNA, 20 nt, Homo sapiens
acaguuccuucagcuuccau

SEQ ID NO: 1378342 - RNA, 14 nt, Homo sapiens
acauaaaagacaca

SEQ ID NO: 1378343 - RNA, 21 nt, Homo sapiens
acauaaauuacuuuuucauuc

SEQ ID NO: 1378344 - RNA, 12 nt, Homo sapiens
acauaagacaga

SEQ ID NO: 1378345 - RNA, 20 nt, Homo sapiens
acauacaagcauaagcaaaa

SEQ ID NO: 1378346 - RNA, 12 nt, Homo sapiens
acauacacacau

SEQ ID NO: 1378347 - RNA, 18 nt, Homo sapiens
acauagaugucccuuucu

SEQ ID NO: 1378348 - RNA, 12 nt, Homo sapiens
acauagugagac

SEQ ID NO: 1378349 - RNA, 13 nt, Homo sapiens
acauaucugucau

SEQ ID NO: 1378350 - RNA, 17 nt, Homo sapiens
acauauuaggaaaauau

SEQ ID NO: 1378351 - RNA, 12 nt, Homo sapiens
acauauuugcau

SEQ ID NO: 1378352 - RNA, 12 nt, Homo sapiens
acaucaagcaca

SEQ ID NO: 1378353 - RNA, 16 nt, Homo sapiens
acaucaguuacucuga

SEQ ID NO: 1378354 - RNA, 18 nt, Homo sapiens
acaucaguuacucugaag

SEQ ID NO: 1378355 - RNA, 22 nt, Homo sapiens
acauccaaccccccaccugcca

SEQ ID NO: 1378356 - RNA, 18 nt, Homo sapiens
acauccacacagccaaua

SEQ ID NO: 1378357 - RNA, 14 nt, Homo sapiens
acauccaugaaaau

SEQ ID NO: 1378358 - RNA, 18 nt, Homo sapiens
acaucuaguaggugcuug

SEQ ID NO: 1378359 - RNA, 23 nt, Homo sapiens
acaucucauccaucaaguugcac

SEQ ID NO: 1378360 - RNA, 18 nt, Homo sapiens
acaucuggaaaauaaaag

SEQ ID NO: 1378361 - RNA, 17 nt, Homo sapiens
acaucuuuccaguccuu

SEQ ID NO: 1378362 - RNA, 22 nt, Homo sapiens
acaucuuuccaguccuugguca

SEQ ID NO: 1378363 - RNA, 14 nt, Homo sapiens
acaugaaaacagaa

SEQ ID NO: 1378364 - RNA, 19 nt, Homo sapiens
acaugagaaacgcuuaugu

SEQ ID NO: 1378365 - RNA, 20 nt, Homo sapiens
acaugauaccucugaucaag

SEQ ID NO: 1378366 - RNA, 15 nt, Homo sapiens
acaugauccugaguu

SEQ ID NO: 1378367 - RNA, 20 nt, Homo sapiens
acaugcaaagauccccaaaa

SEQ ID NO: 1378368 - RNA, 23 nt, Homo sapiens
acaugcagcccagaauagcuuug

SEQ ID NO: 1378369 - RNA, 20 nt, Homo sapiens
acaugcgaccgugaccagga

SEQ ID NO: 1378370 - RNA, 18 nt, Homo sapiens
acaugcugaacaucacag

SEQ ID NO: 1378371 - RNA, 20 nt, Homo sapiens
acauggccagugugauccca

SEQ ID NO: 1378372 - RNA, 16 nt, Homo sapiens
acauggcuugccacag

SEQ ID NO: 1378373 - RNA, 19 nt, Homo sapiens
acauguacuguuacugugu

SEQ ID NO: 1378374 - RNA, 10 nt, Homo sapiens
acaugugcuu

SEQ ID NO: 1378375 - RNA, 14 nt, Homo sapiens
acauguggcccaac

SEQ ID NO: 1378376 - RNA, 22 nt, Homo sapiens
acaugugugcgugugcgugcau

SEQ ID NO: 1378377 - RNA, 18 nt, Homo sapiens
acauguuacugaccagca

SEQ ID NO: 1378378 - RNA, 14 nt, Homo sapiens
acauuaaacacaaa

SEQ ID NO: 1378379 - RNA, 18 nt, Homo sapiens
acauuaacaaaagcaauu

SEQ ID NO: 1378380 - RNA, 15 nt, Homo sapiens
acauuauauugcaau

SEQ ID NO: 1378381 - RNA, 22 nt, Homo sapiens
acauuaucgggagcagugucuu

SEQ ID NO: 1378382 - RNA, 14 nt, Homo sapiens
acauuaugccuuaa

SEQ ID NO: 1378383 - RNA, 20 nt, Homo sapiens
acauuccaaugcauugcuaa

SEQ ID NO: 1378384 - RNA, 15 nt, Homo sapiens
acauuccaauuugca

SEQ ID NO: 1378385 - RNA, 16 nt, Homo sapiens
acauuccaauuugcac

SEQ ID NO: 1378386 - RNA, 16 nt, Homo sapiens
acauucgaguguuuca

SEQ ID NO: 1378387 - RNA, 22 nt, Homo sapiens
acauucucaucaccacagggau

SEQ ID NO: 1378388 - RNA, 22 nt, Homo sapiens
aauccuguccucagcuucuuaa

SEQ ID NO: 1378389 - RNA, 19 nt, Homo sapiens
aauccuguugaaaagccau

SEQ ID NO: 1378390 - RNA, 15 nt, Homo sapiens
aauccuuuacuguua

SEQ ID NO: 1378391 - RNA, 18 nt, Homo sapiens
aaucucaccccaucccac

SEQ ID NO: 1378392 - RNA, 15 nt, Homo sapiens
aaucuccucacugaa

SEQ ID NO: 1378393 - RNA, 12 nt, Homo sapiens
aaucucuaguug

SEQ ID NO: 1378394 - RNA, 20 nt, Homo sapiens
aaucugaagauacaugucuu

SEQ ID NO: 1378395 - RNA, 14 nt, Homo sapiens
aaucugaccaaaac

SEQ ID NO: 1378396 - RNA, 22 nt, Homo sapiens
aaucuuagcugccaaguaaaua

SEQ ID NO: 1378397 - RNA, 16 nt, Homo sapiens
aaucuucuuaugcaau

SEQ ID NO: 1378398 - RNA, 19 nt, Homo sapiens
aaucuuuggguaacuucaa

SEQ ID NO: 1378399 - RNA, 20 nt, Homo sapiens
aaucuuuggguaacuucaaa

SEQ ID NO: 1378400 - RNA, 17 nt, Homo sapiens
aaugaaaaggacuuuau

SEQ ID NO: 1378401 - RNA, 22 nt, Homo sapiens
aaugaaccauucacagugcaag

SEQ ID NO: 1378402 - RNA, 21 nt, Homo sapiens
aaugaaguaacuugucuuaaa

SEQ ID NO: 1378403 - RNA, 15 nt, Homo sapiens
aaugaauggacucaa

SEQ ID NO: 1378404 - RNA, 14 nt, Homo sapiens
aaugaauguuuaca

SEQ ID NO: 1378405 - RNA, 14 nt, Homo sapiens
aaugacaucuucaa

SEQ ID NO: 1378406 - RNA, 19 nt, Homo sapiens
aaugacuaaaaaacaaaga

SEQ ID NO: 1378407 - RNA, 14 nt, Homo sapiens
aaugacugacugca

SEQ ID NO: 1378408 - RNA, 23 nt, Homo sapiens
aaugagacccucguggccuuccc

SEQ ID NO: 1378409 - RNA, 12 nt, Homo sapiens
aaugaugaugac

SEQ ID NO: 1378410 - RNA, 16 nt, Homo sapiens
aaugaugcacauuuca

SEQ ID NO: 1378411 - RNA, 21 nt, Homo sapiens
aaugaugucguuugaaucaca

SEQ ID NO: 1378412 - RNA, 14 nt, Homo sapiens
aaugaugugauaca

SEQ ID NO: 1378413 - RNA, 13 nt, Homo sapiens
aaugauguugaau

SEQ ID NO: 1378414 - RNA, 18 nt, Homo sapiens
aaugauuuacucaauauc

SEQ ID NO: 1378415 - RNA, 23 nt, Homo sapiens
aaugauuucaugcuaucucugug

SEQ ID NO: 1378416 - RNA, 18 nt, Homo sapiens
aaugauuuuacuuagcaa

SEQ ID NO: 1378417 - RNA, 11 nt, Homo sapiens
aaugcaacuuc

SEQ ID NO: 1378418 - RNA, 16 nt, Homo sapiens
aaugcagagucaauga

SEQ ID NO: 1378419 - RNA, 23 nt, Homo sapiens
aaugcauauccaacaugugcuca

SEQ ID NO: 1378420 - RNA, 21 nt, Homo sapiens
aaugcauuauaggaucauuug

SEQ ID NO: 1378421 - RNA, 17 nt, Homo sapiens
aaugccaaucucuucua

SEQ ID NO: 1378422 - RNA, 13 nt, Homo sapiens
aaugccagugugc

SEQ ID NO: 1378423 - RNA, 22 nt, Homo sapiens
aaugccuuacuuuguaugauau

SEQ ID NO: 1378424 - RNA, 14 nt, Homo sapiens
aaugcuaagggcag

SEQ ID NO: 1378425 - RNA, 17 nt, Homo sapiens
aaugcuaauuaggcaaa

SEQ ID NO: 1378426 - RNA, 21 nt, Homo sapiens
aaugcuagcugcaagugacau

SEQ ID NO: 1378427 - RNA, 15 nt, Homo sapiens
aaugcucaagaaaca

SEQ ID NO: 1378428 - RNA, 23 nt, Homo sapiens
aaugcucaagaaacaacuucuac

SEQ ID NO: 1378429 - RNA, 16 nt, Homo sapiens
aaugcuggcauuugca

SEQ ID NO: 1378430 - RNA, 18 nt, Homo sapiens
aaugcugugguugauauu

SEQ ID NO: 1378431 - RNA, 17 nt, Homo sapiens
aaugcuucugacuucau

SEQ ID NO: 1378432 - RNA, 20 nt, Homo sapiens
aauggacauaagacagacag

SEQ ID NO: 1378433 - RNA, 17 nt, Homo sapiens
aauggcaacaucuugca

SEQ ID NO: 1378434 - RNA, 21 nt, Homo sapiens
aauggcagggauacccaguga

SEQ ID NO: 1378435 - RNA, 23 nt, Homo sapiens
aauggcuuuacaaagcuggcaau

SEQ ID NO: 1378436 - RNA, 19 nt, Homo sapiens
aaugggaauuuauaaccca

SEQ ID NO: 1378437 - RNA, 16 nt, Homo sapiens
aaugguaauuguugcu

SEQ ID NO: 1378438 - RNA, 22 nt, Homo sapiens
aaugguauggaacucucuccac

SEQ ID NO: 1378439 - RNA, 21 nt, Homo sapiens
aauggugguuguuucuuccaa

SEQ ID NO: 1378440 - RNA, 15 nt, Homo sapiens
aaugguuccauucuc

SEQ ID NO: 1378441 - RNA, 16 nt, Homo sapiens
aaugguuccauucucu

SEQ ID NO: 1378442 - RNA, 22 nt, Homo sapiens
acauucuuguuuuaagugccuu

SEQ ID NO: 1378443 - RNA, 17 nt, Homo sapiens
acauuucuaacucugau

SEQ ID NO: 1378444 - RNA, 22 nt, Homo sapiens
acauuugaaaucuaugaaauau

SEQ ID NO: 1378445 - RNA, 13 nt, Homo sapiens
acauuuucccaau

SEQ ID NO: 1378446 - RNA, 18 nt, Homo sapiens
accaaaggauagugcgau

SEQ ID NO: 1378447 - RNA, 11 nt, Homo sapiens
accaaaucauc

SEQ ID NO: 1378448 - RNA, 17 nt, Homo sapiens
accaaaucaucucucau

SEQ ID NO: 1378449 - RNA, 11 nt, Homo sapiens
accaaccuggg

SEQ ID NO: 1378450 - RNA, 20 nt, Homo sapiens
accaaccuuuucccaaccau

SEQ ID NO: 1378451 - RNA, 18 nt, Homo sapiens
accaacugggcccaagac

SEQ ID NO: 1378452 - RNA, 18 nt, Homo sapiens
accaagcaggaagcucag

SEQ ID NO: 1378453 - RNA, 14 nt, Homo sapiens
accaagcugugacc

SEQ ID NO: 1378454 - RNA, 15 nt, Homo sapiens
accaauaaagccuuc

SEQ ID NO: 1378455 - RNA, 13 nt, Homo sapiens
accaauaccuccu

SEQ ID NO: 1378456 - RNA, 12 nt, Homo sapiens
accaauauuugu

SEQ ID NO: 1378457 - RNA, 16 nt, Homo sapiens
accacaccucccugaa

SEQ ID NO: 1378458 - RNA, 18 nt, Homo sapiens
accacagagccucgggac

SEQ ID NO: 1378459 - RNA, 13 nt, Homo sapiens
accacagcugcag

SEQ ID NO: 1378460 - RNA, 18 nt, Homo sapiens
accacaggcagcauuuag

SEQ ID NO: 1378461 - RNA, 15 nt, Homo sapiens
accacagugucugua

SEQ ID NO: 1378462 - RNA, 15 nt, Homo sapiens
accacauccugaaaa

SEQ ID NO: 1378463 - RNA, 20 nt, Homo sapiens
accacauccugaaaagggug

SEQ ID NO: 1378464 - RNA, 15 nt, Homo sapiens
accacaugugcacau

SEQ ID NO: 1378465 - RNA, 14 nt, Homo sapiens
accacccaccaguu

SEQ ID NO: 1378466 - RNA, 23 nt, Homo sapiens
accaccugguuccggcucugcac

SEQ ID NO: 1378467 - RNA, 18 nt, Homo sapiens
accacuacaugcagccca

SEQ ID NO: 1378468 - RNA, 21 nt, Homo sapiens
accacuacaugcagcccaugc

SEQ ID NO: 1378469 - RNA, 18 nt, Homo sapiens
accacuagaacucuccau

SEQ ID NO: 1378470 - RNA, 23 nt, Homo sapiens
accacucaggccaacaagccaac

SEQ ID NO: 1378471 - RNA, 14 nt, Homo sapiens
accacuucagcuga

SEQ ID NO: 1378472 - RNA, 17 nt, Homo sapiens
accagaagcauuucacc

SEQ ID NO: 1378473 - RNA, 15 nt, Homo sapiens
accagaagccaaaga

SEQ ID NO: 1378474 - RNA, 13 nt, Homo sapiens
accagaaguggac

SEQ ID NO: 1378475 - RNA, 17 nt, Homo sapiens
accagaggaaacuugca

SEQ ID NO: 1378476 - RNA, 13 nt, Homo sapiens
accagcacugucu

SEQ ID NO: 1378477 - RNA, 22 nt, Homo sapiens
accagccugcacuacucccuca

SEQ ID NO: 1378478 - RNA, 23 nt, Homo sapiens
accagccugcacuacucccucaa

SEQ ID NO: 1378479 - RNA, 11 nt, Homo sapiens
accagggacac

SEQ ID NO: 1378480 - RNA, 23 nt, Homo sapiens
accaggucucccgggaagccacc

SEQ ID NO: 1378481 - RNA, 12 nt, Homo sapiens
accagugaauga

SEQ ID NO: 1378482 - RNA, 22 nt, Homo sapiens
accaguguccuccccucaagga

SEQ ID NO: 1378483 - RNA, 21 nt, Homo sapiens
accaguguuauuaaugacaaa

SEQ ID NO: 1378484 - RNA, 16 nt, Homo sapiens
accauaacaacuucau

SEQ ID NO: 1378485 - RNA, 11 nt, Homo sapiens
accauaaugua

SEQ ID NO: 1378486 - RNA, 14 nt, Homo sapiens
accauaauguuaca

SEQ ID NO: 1378487 - RNA, 21 nt, Homo sapiens
accaugagaccacuguuauca

SEQ ID NO: 1378488 - RNA, 20 nt, Homo sapiens
accaugauuaaccacuucag

SEQ ID NO: 1378489 - RNA, 12 nt, Homo sapiens
accaugcaaugc

SEQ ID NO: 1378490 - RNA, 13 nt, Homo sapiens
accauguacauaa

SEQ ID NO: 1378491 - RNA, 16 nt, Homo sapiens
agcauccucaguuccu

SEQ ID NO: 1378492 - RNA, 22 nt, Homo sapiens
agcaucugagcuaacuuauauu

SEQ ID NO: 1378493 - RNA, 13 nt, Homo sapiens
agcaugcacaaag

SEQ ID NO: 1378494 - RNA, 16 nt, Homo sapiens
agcauucaauuuauuc

SEQ ID NO: 1378495 - RNA, 18 nt, Homo sapiens
agcauuuagcacauacua

SEQ ID NO: 1378496 - RNA, 15 nt, Homo sapiens
agccaaacucugcca

SEQ ID NO: 1378497 - RNA, 23 nt, Homo sapiens
agccaaaggauaaguguccccua

SEQ ID NO: 1378498 - RNA, 16 nt, Homo sapiens
agccaaccccugugga

SEQ ID NO: 1378499 - RNA, 14 nt, Homo sapiens
agccaacuuuugca

SEQ ID NO: 1378500 - RNA, 19 nt, Homo sapiens
agccaagauugcgccauug

SEQ ID NO: 1378501 - RNA, 17 nt, Homo sapiens
agccaagucagcuuugc

SEQ ID NO: 1378502 - RNA, 15 nt, Homo sapiens
agccaaguuaagaau

SEQ ID NO: 1378503 - RNA, 16 nt, Homo sapiens
agccacaaccaaaaaa

SEQ ID NO: 1378504 - RNA, 16 nt, Homo sapiens
agccacgugcucucug

SEQ ID NO: 1378505 - RNA, 15 nt, Homo sapiens
agccagcagccagcu

SEQ ID NO: 1378506 - RNA, 15 nt, Homo sapiens
agccagcugcagcug

SEQ ID NO: 1378507 - RNA, 16 nt, Homo sapiens
agccaggcugccaagg

SEQ ID NO: 1378508 - RNA, 19 nt, Homo sapiens
agccagucuuaacauuucu

SEQ ID NO: 1378509 - RNA, 23 nt, Homo sapiens
agccaucaccuugauaaugggau

SEQ ID NO: 1378510 - RNA, 21 nt, Homo sapiens
agccauguccugcugcuucug

SEQ ID NO: 1378511 - RNA, 17 nt, Homo sapiens
agccauguuuaagauuu

SEQ ID NO: 1378512 - RNA, 13 nt, Homo sapiens
agcccaccccuca

SEQ ID NO: 1378513 - RNA, 14 nt, Homo sapiens
agcccagccauuac

SEQ ID NO: 1378514 - RNA, 23 nt, Homo sapiens
agcccauggcuuuagcuaccuca

SEQ ID NO: 1378515 - RNA, 17 nt, Homo sapiens
agcccauuccucugcca

SEQ ID NO: 1378516 - RNA, 13 nt, Homo sapiens
agccccaucagcu

SEQ ID NO: 1378517 - RNA, 22 nt, Homo sapiens
agccccauucugccugcccagg

SEQ ID NO: 1378518 - RNA, 21 nt, Homo sapiens
agcccgaggcaccaguguccu

SEQ ID NO: 1378519 - RNA, 18 nt, Homo sapiens
agcccgcaugcagcagcu

SEQ ID NO: 1378520 - RNA, 20 nt, Homo sapiens
agcccuaggcuuccacguac

SEQ ID NO: 1378521 - RNA, 17 nt, Homo sapiens
agcccucaggucagggu

SEQ ID NO: 1378522 - RNA, 15 nt, Homo sapiens
agcccugaggugaaa

SEQ ID NO: 1378523 - RNA, 19 nt, Homo sapiens
agcccugcagucacagcua

SEQ ID NO: 1378524 - RNA, 22 nt, Homo sapiens
agcccuguucugggugcagcug

SEQ ID NO: 1378525 - RNA, 18 nt, Homo sapiens
agcccuugaagauaucuu

SEQ ID NO: 1378526 - RNA, 13 nt, Homo sapiens
agccgcagcugua

SEQ ID NO: 1378527 - RNA, 23 nt, Homo sapiens
agccuacaaugcugcgucuccca

SEQ ID NO: 1378528 - RNA, 19 nt, Homo sapiens
agccuagaagagcuucuga

SEQ ID NO: 1378529 - RNA, 16 nt, Homo sapiens
agccucaaaugcagua

SEQ ID NO: 1378530 - RNA, 15 nt, Homo sapiens
agccuccacugccuc

SEQ ID NO: 1378531 - RNA, 16 nt, Homo sapiens
agccuccagguuuccu

SEQ ID NO: 1378532 - RNA, 19 nt, Homo sapiens
agccuccuuucuggcuuug

SEQ ID NO: 1378533 - RNA, 19 nt, Homo sapiens
agucuugucauugccagcu

SEQ ID NO: 1378534 - RNA, 23 nt, Homo sapiens
agucuuguuguuuucccaaagag

SEQ ID NO: 1378535 - RNA, 22 nt, Homo sapiens
agucuuuguaaguaaacugccc

SEQ ID NO: 1378536 - RNA, 15 nt, Homo sapiens
agugaaaaacaucca

SEQ ID NO: 1378537 - RNA, 19 nt, Homo sapiens
agugaaacauugaacucau

SEQ ID NO: 1378538 - RNA, 20 nt, Homo sapiens
agugaaagcaucacuuggga

SEQ ID NO: 1378539 - RNA, 16 nt, Homo sapiens
agugaaauauaugcua

SEQ ID NO: 1378540 - RNA, 13 nt, Homo sapiens
agugaaaucugug

SEQ ID NO: 1378541 - RNA, 12 nt, Homo sapiens
agugaaauuacu

SEQ ID NO: 1378542 - RNA, 16 nt, Homo sapiens
agugaagacacuggcu

SEQ ID NO: 1378543 - RNA, 16 nt, Homo sapiens
agugaagaugccagug

SEQ ID NO: 1378544 - RNA, 15 nt, Homo sapiens
agugacauguuuaca

SEQ ID NO: 1378545 - RNA, 18 nt, Homo sapiens
agugacuguaucugugua

SEQ ID NO: 1378546 - RNA, 17 nt, Homo sapiens
agugacuucacagagac

SEQ ID NO: 1378547 - RNA, 19 nt, Homo sapiens
agugagaaaccauauuucc

SEQ ID NO: 1378548 - RNA, 22 nt, Homo sapiens
agugagacaaaaagcacuagua

SEQ ID NO: 1378549 - RNA, 18 nt, Homo sapiens
agugagacuccgucacaa

SEQ ID NO: 1378550 - RNA, 11 nt, Homo sapiens
agugagcaaac

SEQ ID NO: 1378551 - RNA, 19 nt, Homo sapiens
agugagcuguguucuugcc

SEQ ID NO: 1378552 - RNA, 21 nt, Homo sapiens
agugaggcugcacccacccag

SEQ ID NO: 1378553 - RNA, 13 nt, Homo sapiens
agugagucucuuc

SEQ ID NO: 1378554 - RNA, 14 nt, Homo sapiens
agugauaugcauuu

SEQ ID NO: 1378555 - RNA, 15 nt, Homo sapiens
agugaucaccugcca

SEQ ID NO: 1378556 - RNA, 14 nt, Homo sapiens
agugauggucagag

SEQ ID NO: 1378557 - RNA, 12 nt, Homo sapiens
agugaugucagg

SEQ ID NO: 1378558 - RNA, 12 nt, Homo sapiens
agugauucuugc

SEQ ID NO: 1378559 - RNA, 17 nt, Homo sapiens
agugcaaauuugauaca

SEQ ID NO: 1378560 - RNA, 18 nt, Homo sapiens
agugcacuaauucugcau

SEQ ID NO: 1378561 - RNA, 22 nt, Homo sapiens
agugcagcaaccagagcacugu

SEQ ID NO: 1378562 - RNA, 23 nt, Homo sapiens
agugcaucugggaagauuucuac

SEQ ID NO: 1378563 - RNA, 13 nt, Homo sapiens
agugccaagcaca

SEQ ID NO: 1378564 - RNA, 21 nt, Homo sapiens
agugccguaacaacugugguc

SEQ ID NO: 1378565 - RNA, 14 nt, Homo sapiens
agugccugggaaug

SEQ ID NO: 1378566 - RNA, 18 nt, Homo sapiens
agugcggacaaguuuuaa

SEQ ID NO: 1378567 - RNA, 19 nt, Homo sapiens
agugcgguggugugaucuc

SEQ ID NO: 1378568 - RNA, 17 nt, Homo sapiens
agugcugggauuacaau

SEQ ID NO: 1378569 - RNA, 21 nt, Homo sapiens
agugcuugauugcguggaauu

SEQ ID NO: 1378570 - RNA, 15 nt, Homo sapiens
agugcuuucuucucc

SEQ ID NO: 1378571 - RNA, 20 nt, Homo sapiens
aguggaagaagaaaacacua

SEQ ID NO: 1378572 - RNA, 14 nt, Homo sapiens
aguggauuuuacau

SEQ ID NO: 1378573 - RNA, 23 nt, Homo sapiens
aguggcauggcuccagucugcug

SEQ ID NO: 1378574 - RNA, 23 nt, Homo sapiens
auaaaggcauuucaaagucucac

SEQ ID NO: 1378575 - RNA, 23 nt, Homo sapiens
auaaaguuucuguugauaaucau

SEQ ID NO: 1378576 - RNA, 18 nt, Homo sapiens
auaaaguuuuaugagaaa

SEQ ID NO: 1378577 - RNA, 15 nt, Homo sapiens
auaaauaaaacauuu

SEQ ID NO: 1378578 - RNA, 15 nt, Homo sapiens
auaaauaacagugca

SEQ ID NO: 1378579 - RNA, 19 nt, Homo sapiens
auaaaucaaugucacuuaa

SEQ ID NO: 1378580 - RNA, 19 nt, Homo sapiens
auaaaucagccuaaauguc

SEQ ID NO: 1378581 - RNA, 17 nt, Homo sapiens
auaaaucauuaagacaa

SEQ ID NO: 1378582 - RNA, 19 nt, Homo sapiens
auaacagcuaccaugacaa

SEQ ID NO: 1378583 - RNA, 17 nt, Homo sapiens
auaacauaacaaauaac

SEQ ID NO: 1378584 - RNA, 20 nt, Homo sapiens
auaaccaacccuucccugaa

SEQ ID NO: 1378585 - RNA, 14 nt, Homo sapiens
auaaccacuccuaa

SEQ ID NO: 1378586 - RNA, 14 nt, Homo sapiens
auaacuuuuuccaa

SEQ ID NO: 1378587 - RNA, 17 nt, Homo sapiens
auaagaggugcuacuga

SEQ ID NO: 1378588 - RNA, 13 nt, Homo sapiens
auaagccagcugc

SEQ ID NO: 1378589 - RNA, 19 nt, Homo sapiens
auaaguaucacacuguaua

SEQ ID NO: 1378590 - RNA, 17 nt, Homo sapiens
auaauacaguaucucag

SEQ ID NO: 1378591 - RNA, 15 nt, Homo sapiens
auaauauacuaugca

SEQ ID NO: 1378592 - RNA, 18 nt, Homo sapiens
auaaucugaggaagggag

SEQ ID NO: 1378593 - RNA, 20 nt, Homo sapiens
auaaucuuuggguaacuuca

SEQ ID NO: 1378594 - RNA, 20 nt, Homo sapiens
auaaugucauuaaacaugac

SEQ ID NO: 1378595 - RNA, 21 nt, Homo sapiens
auaaugucauuaaacaugaca

SEQ ID NO: 1378596 - RNA, 16 nt, Homo sapiens
auaaugucccuucaca

SEQ ID NO: 1378597 - RNA, 16 nt, Homo sapiens
auaauguuacauuauu

SEQ ID NO: 1378598 - RNA, 15 nt, Homo sapiens
auaauuaguuccuca

SEQ ID NO: 1378599 - RNA, 16 nt, Homo sapiens
auaauucuacuuugag

SEQ ID NO: 1378600 - RNA, 16 nt, Homo sapiens
auaauugccacugaga

SEQ ID NO: 1378601 - RNA, 23 nt, Homo sapiens
auacaaaaauuccuuuucccgaa

SEQ ID NO: 1378602 - RNA, 19 nt, Homo sapiens
auacaauuauuuuuacagu

SEQ ID NO: 1378603 - RNA, 22 nt, Homo sapiens
auacaauuauuuuuacaguucu

SEQ ID NO: 1378604 - RNA, 15 nt, Homo sapiens
auacacagugcugac

SEQ ID NO: 1378605 - RNA, 14 nt, Homo sapiens
auacacucucaaag

SEQ ID NO: 1378606 - RNA, 18 nt, Homo sapiens
auacaguacaggcagcac

SEQ ID NO: 1378607 - RNA, 16 nt, Homo sapiens
auacaguaucucaggg

SEQ ID NO: 1378608 - RNA, 15 nt, Homo sapiens
auacauacacauaua

SEQ ID NO: 1378609 - RNA, 16 nt, Homo sapiens
auacauucugcuuuca

SEQ ID NO: 1378610 - RNA, 21 nt, Homo sapiens
auaccccuuacuuagcaugca

SEQ ID NO: 1378611 - RNA, 19 nt, Homo sapiens
auaccuucuuaaguuuuca

SEQ ID NO: 1378612 - RNA, 20 nt, Homo sapiens
auacgcaucagacagaugga

SEQ ID NO: 1378613 - RNA, 20 nt, Homo sapiens
auacguuugaaauaguugau

SEQ ID NO: 1378614 - RNA, 14 nt, Homo sapiens
auacuacacauuca

SEQ ID NO: 1378615 - RNA, 22 nt, Homo sapiens
augauccuaaugaaugcauaaa

SEQ ID NO: 1378616 - RNA, 22 nt, Homo sapiens
augaucgcgccacuacacucca

SEQ ID NO: 1378617 - RNA, 22 nt, Homo sapiens
augaucgcuuucuacacuguau

SEQ ID NO: 1378618 - RNA, 17 nt, Homo sapiens
augaucuggauccacca

SEQ ID NO: 1378619 - RNA, 19 nt, Homo sapiens
augaugagcuccucuuccu

SEQ ID NO: 1378620 - RNA, 18 nt, Homo sapiens
augaugcuaccaugccuc

SEQ ID NO: 1378621 - RNA, 19 nt, Homo sapiens
augauggcaccacugcacu

SEQ ID NO: 1378622 - RNA, 16 nt, Homo sapiens
augauguauuguugcu

SEQ ID NO: 1378623 - RNA, 17 nt, Homo sapiens
augauguauuguugcuu

SEQ ID NO: 1378624 - RNA, 18 nt, Homo sapiens
augaugugggucaaggaa

SEQ ID NO: 1378625 - RNA, 12 nt, Homo sapiens
augauuaguaaa

SEQ ID NO: 1378626 - RNA, 14 nt, Homo sapiens
augauugugcacau

SEQ ID NO: 1378627 - RNA, 21 nt, Homo sapiens
augauuuacucaauaucugaa

SEQ ID NO: 1378628 - RNA, 13 nt, Homo sapiens
augauuuacucau

SEQ ID NO: 1378629 - RNA, 21 nt, Homo sapiens
augcaaggggaaaaucucagc

SEQ ID NO: 1378630 - RNA, 22 nt, Homo sapiens
augcaaggggaaaaucucagca

SEQ ID NO: 1378631 - RNA, 14 nt, Homo sapiens
augcaaugccucug

SEQ ID NO: 1378632 - RNA, 17 nt, Homo sapiens
augcacaaaguguauuc

SEQ ID NO: 1378633 - RNA, 13 nt, Homo sapiens
augcacaucucau

SEQ ID NO: 1378634 - RNA, 16 nt, Homo sapiens
augcagaggaauauua

SEQ ID NO: 1378635 - RNA, 15 nt, Homo sapiens
augcagugcuuccaa

SEQ ID NO: 1378636 - RNA, 18 nt, Homo sapiens
augcagugguaugaucac

SEQ ID NO: 1378637 - RNA, 15 nt, Homo sapiens
augcauacacucuca

SEQ ID NO: 1378638 - RNA, 22 nt, Homo sapiens
augcaucaaguuauugacaaac

SEQ ID NO: 1378639 - RNA, 20 nt, Homo sapiens
augcaucugcuacuguguca

SEQ ID NO: 1378640 - RNA, 23 nt, Homo sapiens
augcauuauuuauugcuguguaa

SEQ ID NO: 1378641 - RNA, 21 nt, Homo sapiens
augccaaucucuucuaaaaaa

SEQ ID NO: 1378642 - RNA, 22 nt, Homo sapiens
augccagcucagucccaucaga

SEQ ID NO: 1378643 - RNA, 19 nt, Homo sapiens
augccagcuuaucucaggg

SEQ ID NO: 1378644 - RNA, 23 nt, Homo sapiens
augccauagcaagauugcuuaaa

SEQ ID NO: 1378645 - RNA, 13 nt, Homo sapiens
augcccagcugua

SEQ ID NO: 1378646 - RNA, 20 nt, Homo sapiens
augccccauggggcaucucu

SEQ ID NO: 1378647 - RNA, 19 nt, Homo sapiens
augccuucacuuuacaaau

SEQ ID NO: 1378648 - RNA, 22 nt, Homo sapiens
augccuuccagcacccugcaaa

SEQ ID NO: 1378649 - RNA, 17 nt, Homo sapiens
augcgaaugguagucua

SEQ ID NO: 1378650 - RNA, 15 nt, Homo sapiens
augcguuuaaucaca

SEQ ID NO: 1378651 - RNA, 21 nt, Homo sapiens
augcuacaagacgggcaaaau

SEQ ID NO: 1378652 - RNA, 18 nt, Homo sapiens
augcuauaacuauguuga

SEQ ID NO: 1378653 - RNA, 12 nt, Homo sapiens
augcucaagaaa

SEQ ID NO: 1378654 - RNA, 14 nt, Homo sapiens
augcucagggucaa

SEQ ID NO: 1378655 - RNA, 19 nt, Homo sapiens
augcucaguuggugcugcu

SEQ ID NO: 1378656 - RNA, 23 nt, Homo sapiens
augcucaguuggugcugcuuucu

SEQ ID NO: 1378657 - RNA, 23 nt, Homo sapiens
augcucccuccccugcccugguc

SEQ ID NO: 1378658 - RNA, 13 nt, Homo sapiens
augcuccuuccaa

SEQ ID NO: 1378659 - RNA, 16 nt, Homo sapiens
augcugaacaucacag

SEQ ID NO: 1378660 - RNA, 12 nt, Homo sapiens
augcugcuuuaa

SEQ ID NO: 1378661 - RNA, 20 nt, Homo sapiens
augcuggacggcauuccugc

SEQ ID NO: 1378662 - RNA, 20 nt, Homo sapiens
augcugucuucguacuggga

SEQ ID NO: 1378663 - RNA, 15 nt, Homo sapiens
augcuuccugacaau

SEQ ID NO: 1378664 - RNA, 23 nt, Homo sapiens
augcuuguauuuuacuuuuccau

SEQ ID NO: 1378665 - RNA, 21 nt, Homo sapiens
auggaaauauuaugcaaauuc

SEQ ID NO: 1378666 - RNA, 20 nt, Homo sapiens
auggaauauuccccuaucuc

SEQ ID NO: 1378667 - RNA, 16 nt, Homo sapiens
auggaccagaagccaa

SEQ ID NO: 1378668 - RNA, 15 nt, Homo sapiens
auggacucaguuuuc

SEQ ID NO: 1378669 - RNA, 15 nt, Homo sapiens
auggagacuggaaaa

SEQ ID NO: 1378670 - RNA, 13 nt, Homo sapiens
auggagacuugag

SEQ ID NO: 1378671 - RNA, 14 nt, Homo sapiens
auggaggcacacag

SEQ ID NO: 1378672 - RNA, 19 nt, Homo sapiens
auggagguucucucggagu

SEQ ID NO: 1378673 - RNA, 21 nt, Homo sapiens
auggagugggugucucugcau

SEQ ID NO: 1378674 - RNA, 17 nt, Homo sapiens
auggauaagcuugucua

SEQ ID NO: 1378675 - RNA, 16 nt, Homo sapiens
auggcacccaugcacc

SEQ ID NO: 1378676 - RNA, 22 nt, Homo sapiens
auggcaugggggccucagggca

SEQ ID NO: 1378677 - RNA, 16 nt, Homo sapiens
auggcucuacuuucag

SEQ ID NO: 1378678 - RNA, 18 nt, Homo sapiens
auggcuugccacagcucu

SEQ ID NO: 1378679 - RNA, 15 nt, Homo sapiens
augggaaacuuccaa

SEQ ID NO: 1378680 - RNA, 16 nt, Homo sapiens
augggaugcuugccua

SEQ ID NO: 1378681 - RNA, 18 nt, Homo sapiens
auggggagaaaagacaug

SEQ ID NO: 1378682 - RNA, 21 nt, Homo sapiens
auggggugcaccuguccaaua

SEQ ID NO: 1378683 - RNA, 16 nt, Homo sapiens
augguaaaaguuacuu

SEQ ID NO: 1378684 - RNA, 19 nt, Homo sapiens
augguaaccucuacuauga

SEQ ID NO: 1378685 - RNA, 18 nt, Homo sapiens
augguagcauacuuuaua

SEQ ID NO: 1378686 - RNA, 20 nt, Homo sapiens
augguccuggggcucugugc

SEQ ID NO: 1378687 - RNA, 21 nt, Homo sapiens
auggugaaaccccgucuguac

SEQ ID NO: 1378688 - RNA, 14 nt, Homo sapiens
auggugaaaugcag

SEQ ID NO: 1378689 - RNA, 20 nt, Homo sapiens
auggugcaaauccuacugaa

SEQ ID NO: 1378690 - RNA, 20 nt, Homo sapiens
augguggcgcgcaccuguaa

SEQ ID NO: 1378691 - RNA, 15 nt, Homo sapiens
augguuaaauaucac

SEQ ID NO: 1378692 - RNA, 13 nt, Homo sapiens
augguuucuccag

SEQ ID NO: 1378693 - RNA, 21 nt, Homo sapiens
augguuugcaaggaagccaca

SEQ ID NO: 1378694 - RNA, 23 nt, Homo sapiens
augguuuuccugaaauccucaau

SEQ ID NO: 1378695 - RNA, 13 nt, Homo sapiens
auguaacuucccu

SEQ ID NO: 1378696 - RNA, 16 nt, Homo sapiens
auguaagagcuuuaca

SEQ ID NO: 1378697 - RNA, 23 nt, Homo sapiens
auguaaugcauaggaaguauggc

SEQ ID NO: 1378698 - RNA, 12 nt, Homo sapiens
auguacaaauag

SEQ ID NO: 1378699 - RNA, 18 nt, Homo sapiens
auguacaugaagaagcua

SEQ ID NO: 1378700 - RNA, 22 nt, Homo sapiens
auguacccuaaggucauuacca

SEQ ID NO: 1378701 - RNA, 15 nt, Homo sapiens
auguaccugauguac

SEQ ID NO: 1378702 - RNA, 17 nt, Homo sapiens
auguacuguuacugugu

SEQ ID NO: 1378703 - RNA, 21 nt, Homo sapiens
auguagcaaaacgcauggagu

SEQ ID NO: 1378704 - RNA, 17 nt, Homo sapiens
auguagcaacaugagaa

SEQ ID NO: 1378705 - RNA, 20 nt, Homo sapiens
auguaucccaacuccuauaa

SEQ ID NO: 1378706 - RNA, 12 nt, Homo sapiens
auguaucucagg

SEQ ID NO: 1378707 - RNA, 16 nt, Homo sapiens
auguauguguaccuaa

SEQ ID NO: 1378708 - RNA, 18 nt, Homo sapiens
augucaacagagcaagga

SEQ ID NO: 1378709 - RNA, 17 nt, Homo sapiens
augucagaaaccaguua

SEQ ID NO: 1378710 - RNA, 21 nt, Homo sapiens
augucaggcaaagugcugcug

SEQ ID NO: 1378711 - RNA, 19 nt, Homo sapiens
augucaucccauugucuuc

SEQ ID NO: 1378712 - RNA, 12 nt, Homo sapiens
auguccacagau

SEQ ID NO: 1378713 - RNA, 13 nt, Homo sapiens
auguccauaucua

SEQ ID NO: 1378714 - RNA, 23 nt, Homo sapiens
augucccuugcugugagcaagaa

SEQ ID NO: 1378715 - RNA, 21 nt, Homo sapiens
augucccuuucuuggccaguu

SEQ ID NO: 1378716 - RNA, 21 nt, Homo sapiens
augucguuugaaucacaguau

SEQ ID NO: 1378717 - RNA, 22 nt, Homo sapiens
augucuaaaauccugcuuaaaa

SEQ ID NO: 1378718 - RNA, 14 nt, Homo sapiens
augucuagcuuuca

SEQ ID NO: 1378719 - RNA, 16 nt, Homo sapiens
augucuauaacuccuu

SEQ ID NO: 1378720 - RNA, 19 nt, Homo sapiens
augucucuuuaaugucaca

SEQ ID NO: 1378721 - RNA, 20 nt, Homo sapiens
augucugaucuaaaugugga

SEQ ID NO: 1378722 - RNA, 17 nt, Homo sapiens
augucugcagcccucag

SEQ ID NO: 1378723 - RNA, 14 nt, Homo sapiens
augucuggucuguc

SEQ ID NO: 1378724 - RNA, 23 nt, Homo sapiens
augucugugggcaggaagugaag

SEQ ID NO: 1378725 - RNA, 16 nt, Homo sapiens
augucuguuaacuuaa

SEQ ID NO: 1378726 - RNA, 17 nt, Homo sapiens
augucuugguacuugcu

SEQ ID NO: 1378727 - RNA, 22 nt, Homo sapiens
augugauaaaaccccaucucua

SEQ ID NO: 1378728 - RNA, 18 nt, Homo sapiens
augugauuccaucuugcc

SEQ ID NO: 1378729 - RNA, 13 nt, Homo sapiens
augugcagauauc

SEQ ID NO: 1378730 - RNA, 17 nt, Homo sapiens
augugcagauaucacag

SEQ ID NO: 1378731 - RNA, 21 nt, Homo sapiens
augugcccaguuaaucuugcu

SEQ ID NO: 1378732 - RNA, 12 nt, Homo sapiens
auguggcccaac

SEQ ID NO: 1378733 - RNA, 19 nt, Homo sapiens
augugggucaaggaauuaa

SEQ ID NO: 1378734 - RNA, 18 nt, Homo sapiens
auguggucauacucucag

SEQ ID NO: 1378735 - RNA, 16 nt, Homo sapiens
auguguaugugccauu

SEQ ID NO: 1378736 - RNA, 20 nt, Homo sapiens
augugugagaauaaacuaga

SEQ ID NO: 1378737 - RNA, 15 nt, Homo sapiens
augugugaggagcug

SEQ ID NO: 1378738 - RNA, 16 nt, Homo sapiens
augugugcgagugugu

SEQ ID NO: 1378739 - RNA, 12 nt, Homo sapiens
augugugugcaa

SEQ ID NO: 1378740 - RNA, 13 nt, Homo sapiens
augugugugcuca

SEQ ID NO: 1378741 - RNA, 22 nt, Homo sapiens
auguguguguaugcuacuacaa

SEQ ID NO: 1378742 - RNA, 16 nt, Homo sapiens
auguguuuuuuuacau

SEQ ID NO: 1378743 - RNA, 23 nt, Homo sapiens
auguuaaaauagacuaaccucua

SEQ ID NO: 1378744 - RNA, 16 nt, Homo sapiens
auguuaaccucagugu

SEQ ID NO: 1378745 - RNA, 13 nt, Homo sapiens
auguuacugacca

SEQ ID NO: 1378746 - RNA, 19 nt, Homo sapiens
auguuagggugcucuggaa

SEQ ID NO: 1378747 - RNA, 22 nt, Homo sapiens
auguucacccaaccacauccca

SEQ ID NO: 1378748 - RNA, 15 nt, Homo sapiens
auguucacuguggca

SEQ ID NO: 1378749 - RNA, 17 nt, Homo sapiens
auguuccgagaagaaca

SEQ ID NO: 1378750 - RNA, 16 nt, Homo sapiens
auguucugggacacag

SEQ ID NO: 1378751 - RNA, 15 nt, Homo sapiens
auguugaugaaaaau

SEQ ID NO: 1378752 - RNA, 20 nt, Homo sapiens
auguugaugaaaaauagcaa

SEQ ID NO: 1378753 - RNA, 22 nt, Homo sapiens
auguugauuucuuguaacaucc

SEQ ID NO: 1378754 - RNA, 14 nt, Homo sapiens
auguugcccaggca

SEQ ID NO: 1378755 - RNA, 12 nt, Homo sapiens
auguugccuguc

SEQ ID NO: 1378756 - RNA, 20 nt, Homo sapiens
auguuguuaugggcaggaug

SEQ ID NO: 1378757 - RNA, 13 nt, Homo sapiens
auguuuacacugu

SEQ ID NO: 1378758 - RNA, 13 nt, Homo sapiens
auguuuugcccac

SEQ ID NO: 1378759 - RNA, 14 nt, Homo sapiens
auuaaagacagagg

SEQ ID NO: 1378760 - RNA, 14 nt, Homo sapiens
auuaacagauguag

SEQ ID NO: 1378761 - RNA, 24 nt, Homo sapiens
auuaacagauguagcaacaugaga

SEQ ID NO: 1378762 - RNA, 19 nt, Homo sapiens
auuaacaguuuuccaugaa

SEQ ID NO: 1378763 - RNA, 16 nt, Homo sapiens
auuaaccacuucagcu

SEQ ID NO: 1378764 - RNA, 17 nt, Homo sapiens
auuaagacaacugaguu

SEQ ID NO: 1378765 - RNA, 15 nt, Homo sapiens
auuaagcaucacaaa

SEQ ID NO: 1378766 - RNA, 14 nt, Homo sapiens
auuaaguaaacuaa

SEQ ID NO: 1378767 - RNA, 20 nt, Homo sapiens
auuaauauggggaugcagca

SEQ ID NO: 1378768 - RNA, 16 nt, Homo sapiens
auuaauccacacauca

SEQ ID NO: 1378769 - RNA, 23 nt, Homo sapiens
auuacaagcgugagccacugcac

SEQ ID NO: 1378770 - RNA, 15 nt, Homo sapiens
auuacaauccuugac

SEQ ID NO: 1378771 - RNA, 14 nt, Homo sapiens
auuacaucuuucac

SEQ ID NO: 1378772 - RNA, 22 nt, Homo sapiens
auuaccgucauuggccugugaa

SEQ ID NO: 1378773 - RNA, 19 nt, Homo sapiens
auuaccuaguagucauuuc

SEQ ID NO: 1378774 - RNA, 17 nt, Homo sapiens
auuaccucugauaccuc

SEQ ID NO: 1378775 - RNA, 12 nt, Homo sapiens
auuacucugaaa

SEQ ID NO: 1378776 - RNA, 13 nt, Homo sapiens
auuagacagucaa

SEQ ID NO: 1378777 - RNA, 16 nt, Homo sapiens
auuagaccaagcuugu

SEQ ID NO: 1378778 - RNA, 18 nt, Homo sapiens
auuagaggucuccaaaau

SEQ ID NO: 1378779 - RNA, 13 nt, Homo sapiens
auuagaugaacuc

SEQ ID NO: 1378780 - RNA, 16 nt, Homo sapiens
auuagaugaacucaac

SEQ ID NO: 1378781 - RNA, 22 nt, Homo sapiens
auuagcaaguuacagugaugcu

SEQ ID NO: 1378782 - RNA, 23 nt, Homo sapiens
auuagccaagugugguagagugu

SEQ ID NO: 1378783 - RNA, 19 nt, Homo sapiens
auuagcugaguguagugac

SEQ ID NO: 1378784 - RNA, 15 nt, Homo sapiens
auuaggaaguguaac

SEQ ID NO: 1378785 - RNA, 19 nt, Homo sapiens
auuagguguucaggccagu

SEQ ID NO: 1378786 - RNA, 20 nt, Homo sapiens
auuagucaaaccacuguuau

SEQ ID NO: 1378787 - RNA, 15 nt, Homo sapiens
auuauaaaggccagc

SEQ ID NO: 1378788 - RNA, 15 nt, Homo sapiens
auuauaccgcuauca

SEQ ID NO: 1378789 - RNA, 17 nt, Homo sapiens
auuauagaaguuuagau

SEQ ID NO: 1378790 - RNA, 20 nt, Homo sapiens
auuaucacuuuaaagcccuu

SEQ ID NO: 1378791 - RNA, 13 nt, Homo sapiens
auuaucaucugaa

SEQ ID NO: 1378792 - RNA, 13 nt, Homo sapiens
auuaucaugcaaa

SEQ ID NO: 1378793 - RNA, 17 nt, Homo sapiens
auuaucgggaacagugu

SEQ ID NO: 1378794 - RNA, 18 nt, Homo sapiens
auuaucgggaacaguguu

SEQ ID NO: 1378795 - RNA, 17 nt, Homo sapiens
auuaucgggagcagugu

SEQ ID NO: 1378796 - RNA, 14 nt, Homo sapiens
auuaugacaguuau

SEQ ID NO: 1378797 - RNA, 15 nt, Homo sapiens
auuaugagacuguac

SEQ ID NO: 1378798 - RNA, 16 nt, Homo sapiens
auuaugcaucugcuac

SEQ ID NO: 1378799 - RNA, 18 nt, Homo sapiens
auuaugcaucugcuacug

SEQ ID NO: 1378800 - RNA, 12 nt, Homo sapiens
cccugauuucuu

SEQ ID NO: 1378801 - RNA, 11 nt, Homo sapiens
cccugcauguu

SEQ ID NO: 1378802 - RNA, 15 nt, Homo sapiens
cccugccagcucuuc

SEQ ID NO: 1378803 - RNA, 19 nt, Homo sapiens
cccugcuaaggaguucuca

SEQ ID NO: 1378804 - RNA, 19 nt, Homo sapiens
cccuggaccucagagguga

SEQ ID NO: 1378805 - RNA, 20 nt, Homo sapiens
cccuggagcccauccagucu

SEQ ID NO: 1378806 - RNA, 19 nt, Homo sapiens
cccugggccccaccaccua

SEQ ID NO: 1378807 - RNA, 18 nt, Homo sapiens
cccuggggccuguacaaa

SEQ ID NO: 1378808 - RNA, 20 nt, Homo sapiens
cccugggggcugugauauua

SEQ ID NO: 1378809 - RNA, 15 nt, Homo sapiens
cccuguccuuucuca

SEQ ID NO: 1378810 - RNA, 17 nt, Homo sapiens
cccugucuaaaaauuca

SEQ ID NO: 1378811 - RNA, 14 nt, Homo sapiens
cccugucucaaaaa

SEQ ID NO: 1378812 - RNA, 16 nt, Homo sapiens
cccuguuucucuugaa

SEQ ID NO: 1378813 - RNA, 17 nt, Homo sapiens
cccuuagccucccugaa

SEQ ID NO: 1378814 - RNA, 16 nt, Homo sapiens
cccuuauuuucaagaa

SEQ ID NO: 1378815 - RNA, 15 nt, Homo sapiens
cccuucuccuuccaa

SEQ ID NO: 1378816 - RNA, 12 nt, Homo sapiens
cccuucucugua

SEQ ID NO: 1378817 - RNA, 13 nt, Homo sapiens
cccuucucuguau

SEQ ID NO: 1378818 - RNA, 19 nt, Homo sapiens
cccuuuccuacucucagga

SEQ ID NO: 1378819 - RNA, 20 nt, Homo sapiens
cccuuugcuucauucaaguc

SEQ ID NO: 1378820 - RNA, 18 nt, Homo sapiens
ccgaacuuuaauuucagg

SEQ ID NO: 1378821 - RNA, 18 nt, Homo sapiens
ccgacugccaucuuggac

SEQ ID NO: 1378822 - RNA, 15 nt, Homo sapiens
ccgagucucuucucc

SEQ ID NO: 1378823 - RNA, 23 nt, Homo sapiens
ccgcauuccaggcuccucccucc

SEQ ID NO: 1378824 - RNA, 21 nt, Homo sapiens
ccgccacccucccacugccaa

SEQ ID NO: 1378825 - RNA, 19 nt, Homo sapiens
ccggagugacagaguaaga

SEQ ID NO: 1378826 - RNA, 22 nt, Homo sapiens
ccgggaagcggagguugcaggg

SEQ ID NO: 1378827 - RNA, 20 nt, Homo sapiens
ccgggugcucagggcugaca

SEQ ID NO: 1378828 - RNA, 17 nt, Homo sapiens
ccgguugcuucugggaa

SEQ ID NO: 1378829 - RNA, 12 nt, Homo sapiens
ccguaacaacug

SEQ ID NO: 1378830 - RNA, 19 nt, Homo sapiens
ccgucaauaggcaaagggg

SEQ ID NO: 1378831 - RNA, 23 nt, Homo sapiens
ccguggcuuugguuuaaaagaca

SEQ ID NO: 1378832 - RNA, 21 nt, Homo sapiens
ccuaaaaggcagaguacaaag

SEQ ID NO: 1378833 - RNA, 22 nt, Homo sapiens
ccuaaaucaaguuggcuucuaa

SEQ ID NO: 1378834 - RNA, 21 nt, Homo sapiens
ccuaacacugggcugcagaga

SEQ ID NO: 1378835 - RNA, 19 nt, Homo sapiens
ccuaacaggauuagacagu

SEQ ID NO: 1378836 - RNA, 21 nt, Homo sapiens
ccuaacauucgaucucauuca

SEQ ID NO: 1378837 - RNA, 15 nt, Homo sapiens
ccuaaccucauuccc

SEQ ID NO: 1378838 - RNA, 17 nt, Homo sapiens
ccuaagucucugugaau

SEQ ID NO: 1378839 - RNA, 12 nt, Homo sapiens
ccuaaugaaguu

SEQ ID NO: 1378840 - RNA, 18 nt, Homo sapiens
ccuacagaauacuagcca

SEQ ID NO: 1378841 - RNA, 15 nt, Homo sapiens
ccuaccacagugucu

SEQ ID NO: 1378842 - RNA, 21 nt, Homo sapiens
ccuacccccuaagagccauuu

SEQ ID NO: 1378843 - RNA, 22 nt, Homo sapiens
ccuagagaaaacuugaauucau

SEQ ID NO: 1378844 - RNA, 15 nt, Homo sapiens
ccuagagcacacugu

SEQ ID NO: 1378845 - RNA, 15 nt, Homo sapiens
ccuagagcuagaugu

SEQ ID NO: 1378846 - RNA, 17 nt, Homo sapiens
ccuagagcuagaugugu

SEQ ID NO: 1378847 - RNA, 22 nt, Homo sapiens
ccuagcaucucaugagugccaa

SEQ ID NO: 1378848 - RNA, 15 nt, Homo sapiens
ccuaggcauuugcug

SEQ ID NO: 1378849 - RNA, 20 nt, Homo sapiens
ccuauagucccagcuacuca

SEQ ID NO: 1378850 - RNA, 16 nt, Homo sapiens
ccuauauuguuuucag

SEQ ID NO: 1378851 - RNA, 19 nt, Homo sapiens
ccuauauuguuuucagugu

SEQ ID NO: 1378852 - RNA, 17 nt, Homo sapiens
ccuaucucuccaaccag

SEQ ID NO: 1378853 - RNA, 16 nt, Homo sapiens
ccucaaaugcaguauu

SEQ ID NO: 1378854 - RNA, 18 nt, Homo sapiens
ccucaaccuccugggcua

SEQ ID NO: 1378855 - RNA, 12 nt, Homo sapiens
ccucaaggacaa

SEQ ID NO: 1378856 - RNA, 23 nt, Homo sapiens
ccucaaggguuauagacugccau

SEQ ID NO: 1378857 - RNA, 15 nt, Homo sapiens
ccucaauucaucaau

SEQ ID NO: 1378858 - RNA, 14 nt, Homo sapiens
ccucacaucuuuca

SEQ ID NO: 1378859 - RNA, 17 nt, Homo sapiens
ccucacaucuuucacac

SEQ ID NO: 1378860 - RNA, 21 nt, Homo sapiens
ccucacaucuuucacacuucc

SEQ ID NO: 1378861 - RNA, 18 nt, Homo sapiens
ccucaccaacccagagaa

SEQ ID NO: 1378862 - RNA, 20 nt, Homo sapiens
ccucacccccagcuuugcua

SEQ ID NO: 1378863 - RNA, 15 nt, Homo sapiens
ccucacucuguugcu

SEQ ID NO: 1378864 - RNA, 14 nt, Homo sapiens
ccucacuucuucca

SEQ ID NO: 1378865 - RNA, 16 nt, Homo sapiens
ccucagaugcacauga

SEQ ID NO: 1378866 - RNA, 14 nt, Homo sapiens
ccucagccaugagg

SEQ ID NO: 1378867 - RNA, 23 nt, Homo sapiens
ccucagggacagagacaccugca

SEQ ID NO: 1378868 - RNA, 10 nt, Homo sapiens
ccucagggcu

SEQ ID NO: 1378869 - RNA, 13 nt, Homo sapiens
ccucaggugaucc

SEQ ID NO: 1378870 - RNA, 17 nt, Homo sapiens
ccucaguuuuaucauuu

SEQ ID NO: 1378871 - RNA, 20 nt, Homo sapiens
ccucaugauaugucagggcg

SEQ ID NO: 1378872 - RNA, 19 nt, Homo sapiens
ccucauuagcauuuugcua

SEQ ID NO: 1378873 - RNA, 20 nt, Homo sapiens
ccucauuccccaaccacuuc

SEQ ID NO: 1378874 - RNA, 19 nt, Homo sapiens
ccuccacagcuaccucuuc

SEQ ID NO: 1378875 - RNA, 18 nt, Homo sapiens
ccucccagaacacacucc

SEQ ID NO: 1378876 - RNA, 14 nt, Homo sapiens
ccucccucauucca

SEQ ID NO: 1378877 - RNA, 17 nt, Homo sapiens
ccuccgugauccaucca

SEQ ID NO: 1378878 - RNA, 18 nt, Homo sapiens
ccucgaacccacacugca

SEQ ID NO: 1378879 - RNA, 19 nt, Homo sapiens
ccucgaacccacacugcaa

SEQ ID NO: 1378880 - RNA, 21 nt, Homo sapiens
ccucgaacuccugggcucaag

SEQ ID NO: 1378881 - RNA, 17 nt, Homo sapiens
ccucgggugugcuaugg

SEQ ID NO: 1378882 - RNA, 16 nt, Homo sapiens
ccucuacuuaaugaga

SEQ ID NO: 1378883 - RNA, 21 nt, Homo sapiens
ccucuccagaugagaguacac

SEQ ID NO: 1378884 - RNA, 16 nt, Homo sapiens
ccucuccgcaguuccu

SEQ ID NO: 1378885 - RNA, 13 nt, Homo sapiens
ccucucuccauca

SEQ ID NO: 1378886 - RNA, 13 nt, Homo sapiens
ccucucucuguaa

SEQ ID NO: 1378887 - RNA, 14 nt, Homo sapiens
ccucugcugccaug

SEQ ID NO: 1378888 - RNA, 18 nt, Homo sapiens
ccucugggccaagucaaa

SEQ ID NO: 1378889 - RNA, 24 nt, Homo sapiens
ccucuuugugugcgucacugugaa

SEQ ID NO: 1378890 - RNA, 23 nt, Homo sapiens
ccucuuuucugcaucaucuguag

SEQ ID NO: 1378891 - RNA, 17 nt, Homo sapiens
ccugaaacaacccaaag

SEQ ID NO: 1378892 - RNA, 17 nt, Homo sapiens
ccugaaauuuuaaugaa

SEQ ID NO: 1378893 - RNA, 16 nt, Homo sapiens
ccugaaccuuccaucu

SEQ ID NO: 1378894 - RNA, 22 nt, Homo sapiens
ccugaagguguuuuucauucac

SEQ ID NO: 1378895 - RNA, 21 nt, Homo sapiens
ccugaaguaagcaaagacuuu

SEQ ID NO: 1378896 - RNA, 22 nt, Homo sapiens
ccugaaguaagcaaagacuuuc

SEQ ID NO: 1378897 - RNA, 13 nt, Homo sapiens
ccugaaugaaaua

SEQ ID NO: 1378898 - RNA, 12 nt, Homo sapiens
ccugaccucacu

SEQ ID NO: 1378899 - RNA, 12 nt, Homo sapiens
ccugaccuguca

SEQ ID NO: 1378900 - RNA, 19 nt, Homo sapiens
ccugagcaacagagugaga

SEQ ID NO: 1378901 - RNA, 21 nt, Homo sapiens
ccugaggugaaagggagcuau

SEQ ID NO: 1378902 - RNA, 19 nt, Homo sapiens
ccugaguuucaaguauccu

SEQ ID NO: 1378903 - RNA, 16 nt, Homo sapiens
ccugaugcuaugguca

SEQ ID NO: 1378904 - RNA, 21 nt, Homo sapiens
ccugcaccccugcaguuugag

SEQ ID NO: 1378905 - RNA, 16 nt, Homo sapiens
ccugcaggucacugaa

SEQ ID NO: 1378906 - RNA, 22 nt, Homo sapiens
ccugcaggucacugaaacuuca

SEQ ID NO: 1378907 - RNA, 19 nt, Homo sapiens
ccugcagucaucuugacca

SEQ ID NO: 1378908 - RNA, 16 nt, Homo sapiens
ccugcauucacccaga

SEQ ID NO: 1378909 - RNA, 18 nt, Homo sapiens
ccugccagacggcaccca

SEQ ID NO: 1378910 - RNA, 15 nt, Homo sapiens
ccugccaggcacacu

SEQ ID NO: 1378911 - RNA, 19 nt, Homo sapiens
ccugcccagaucccagaag

SEQ ID NO: 1378912 - RNA, 19 nt, Homo sapiens
ccugcccuugucccacuca

SEQ ID NO: 1378913 - RNA, 14 nt, Homo sapiens
ccuguacuggagag

SEQ ID NO: 1378914 - RNA, 19 nt, Homo sapiens
ccugucaauacuauggagu

SEQ ID NO: 1378915 - RNA, 15 nt, Homo sapiens
ccugucucccaaaaa

SEQ ID NO: 1378916 - RNA, 22 nt, Homo sapiens
ccugucugccagccagcagcca

SEQ ID NO: 1378917 - RNA, 17 nt, Homo sapiens
ccugucuuccugcauuc

SEQ ID NO: 1378918 - RNA, 17 nt, Homo sapiens
ccugugacauuuugcca

SEQ ID NO: 1378919 - RNA, 17 nt, Homo sapiens
ccugugaccagcacugu

SEQ ID NO: 1378920 - RNA, 13 nt, Homo sapiens
ccugugaggugca

SEQ ID NO: 1378921 - RNA, 15 nt, Homo sapiens
ccugugaggugcaga

SEQ ID NO: 1378922 - RNA, 22 nt, Homo sapiens
ccuguucauuguaagcacuuuu

SEQ ID NO: 1378923 - RNA, 18 nt, Homo sapiens
ccuguucugggugcagcu

SEQ ID NO: 1378924 - RNA, 12 nt, Homo sapiens
ccuguugaagcu

SEQ ID NO: 1378925 - RNA, 22 nt, Homo sapiens
ccuuaaaauuuauauguaucca

SEQ ID NO: 1378926 - RNA, 17 nt, Homo sapiens
ccuuaaacuuucaauau

SEQ ID NO: 1378927 - RNA, 17 nt, Homo sapiens
ccuuaagucaaaagaga

SEQ ID NO: 1378928 - RNA, 20 nt, Homo sapiens
ccuuagcagggaaacagcua

SEQ ID NO: 1378929 - RNA, 20 nt, Homo sapiens
ccuuagcugccaagccccau

SEQ ID NO: 1378930 - RNA, 16 nt, Homo sapiens
ccuuaucgaaacucau

SEQ ID NO: 1378931 - RNA, 21 nt, Homo sapiens
ccuuauuguaccucucuuaua

SEQ ID NO: 1378932 - RNA, 13 nt, Homo sapiens
ccuucaaacuucc

SEQ ID NO: 1378933 - RNA, 19 nt, Homo sapiens
ccuucaaguuagcucagga

SEQ ID NO: 1378934 - RNA, 14 nt, Homo sapiens
ccuucacuuuacaa

SEQ ID NO: 1378935 - RNA, 13 nt, Homo sapiens
ccuuccaacugcu

SEQ ID NO: 1378936 - RNA, 15 nt, Homo sapiens
ccuuccacggacuca

SEQ ID NO: 1378937 - RNA, 21 nt, Homo sapiens
ccuuccauagccuaaucccug

SEQ ID NO: 1378938 - RNA, 14 nt, Homo sapiens
ccuuccugucuucc

SEQ ID NO: 1378939 - RNA, 12 nt, Homo sapiens
ccuucgggguga

SEQ ID NO: 1378940 - RNA, 22 nt, Homo sapiens
ccuucuacuuacacaucuucca

SEQ ID NO: 1378941 - RNA, 18 nt, Homo sapiens
ccuucucccacacugcua

SEQ ID NO: 1378942 - RNA, 14 nt, Homo sapiens
ccuucuguggcuca

SEQ ID NO: 1378943 - RNA, 12 nt, Homo sapiens
ccuucuugugau

SEQ ID NO: 1378944 - RNA, 18 nt, Homo sapiens
ccuucuuuuuguucuuca

SEQ ID NO: 1378945 - RNA, 15 nt, Homo sapiens
ccuugaaaagacauc

SEQ ID NO: 1378946 - RNA, 21 nt, Homo sapiens
ccuugaccucagugaaagcag

SEQ ID NO: 1378947 - RNA, 16 nt, Homo sapiens
ccuugaguguguuacc

SEQ ID NO: 1378948 - RNA, 13 nt, Homo sapiens
ccuugcacacucc

SEQ ID NO: 1378949 - RNA, 20 nt, Homo sapiens
ccuuggcaugccuuccagca

SEQ ID NO: 1378950 - RNA, 14 nt, Homo sapiens
ccuuguaauuugaa

SEQ ID NO: 1378951 - RNA, 16 nt, Homo sapiens
ccuugugcguggguga

SEQ ID NO: 1378952 - RNA, 21 nt, Homo sapiens
ccuuuaaaaauaugcaccaaa

SEQ ID NO: 1378953 - RNA, 20 nt, Homo sapiens
ccuuuaaauccuuccaugaa

SEQ ID NO: 1378954 - RNA, 16 nt, Homo sapiens
ccuuuagcacguuuaa

SEQ ID NO: 1378955 - RNA, 16 nt, Homo sapiens
ccuuucaaauuucaca

SEQ ID NO: 1378956 - RNA, 11 nt, Homo sapiens
ccuuuccauaa

SEQ ID NO: 1378957 - RNA, 19 nt, Homo sapiens
ccuuucucuaaaacugccu

SEQ ID NO: 1378958 - RNA, 16 nt, Homo sapiens
ccuuugaucaguauaa

SEQ ID NO: 1378959 - RNA, 15 nt, Homo sapiens
ccuuuuaacucaccu

SEQ ID NO: 1378960 - RNA, 14 nt, Homo sapiens
ccuuuugauauuaa

SEQ ID NO: 1378961 - RNA, 16 nt, Homo sapiens
ccuuuuggcacugaga

SEQ ID NO: 1378962 - RNA, 15 nt, Homo sapiens
cgaagggaucagccc

SEQ ID NO: 1378963 - RNA, 18 nt, Homo sapiens
cgaaugguuccauucucu

SEQ ID NO: 1378964 - RNA, 22 nt, Homo sapiens
cgacaaagccaaacucugccag

SEQ ID NO: 1378965 - RNA, 19 nt, Homo sapiens
cgagaccagccuggccaac

SEQ ID NO: 1378966 - RNA, 17 nt, Homo sapiens
cgagacuccgucucaaa

SEQ ID NO: 1378967 - RNA, 20 nt, Homo sapiens
cgagaggugguuacaccaga

SEQ ID NO: 1378968 - RNA, 19 nt, Homo sapiens
cgagccaaguuaagaaugu

SEQ ID NO: 1378969 - RNA, 17 nt, Homo sapiens
cgcaaaacccacugacc

SEQ ID NO: 1378970 - RNA, 20 nt, Homo sapiens
cgcacaaggcugaccaagag

SEQ ID NO: 1378971 - RNA, 18 nt, Homo sapiens
cgcaccaauaaagccuuc

SEQ ID NO: 1378972 - RNA, 23 nt, Homo sapiens
cgcaucccugaggcuggacucca

SEQ ID NO: 1378973 - RNA, 19 nt, Homo sapiens
cgcaugagaacauuaacaa

SEQ ID NO: 1378974 - RNA, 20 nt, Homo sapiens
cgccacccucccacugccaa

SEQ ID NO: 1378975 - RNA, 19 nt, Homo sapiens
cgcccagcugcaccugcca

SEQ ID NO: 1378976 - RNA, 21 nt, Homo sapiens
cgcccaugugugagugugugc

SEQ ID NO: 1378977 - RNA, 19 nt, Homo sapiens
cgccccucaccaacccaga

SEQ ID NO: 1378978 - RNA, 14 nt, Homo sapiens
cgccugggaucuga

SEQ ID NO: 1378979 - RNA, 11 nt, Homo sapiens
cgcgugcacac

SEQ ID NO: 1378980 - RNA, 22 nt, Homo sapiens
cgcuaaaugaaaaucgugacaa

SEQ ID NO: 1378981 - RNA, 18 nt, Homo sapiens
cgcuacccacuucuaaau

SEQ ID NO: 1378982 - RNA, 12 nt, Homo sapiens
cgcucccgggac

SEQ ID NO: 1378983 - RNA, 15 nt, Homo sapiens
cgcuggagugcagug

SEQ ID NO: 1378984 - RNA, 15 nt, Homo sapiens
cgcuuuguugcccag

SEQ ID NO: 1378985 - RNA, 20 nt, Homo sapiens
cggaaugaaccacaucuugc

SEQ ID NO: 1378986 - RNA, 14 nt, Homo sapiens
cggccacacuguac

SEQ ID NO: 1378987 - RNA, 19 nt, Homo sapiens
cggccacacuguacucugc

SEQ ID NO: 1378988 - RNA, 16 nt, Homo sapiens
cggcccaacgcaaauu

SEQ ID NO: 1378989 - RNA, 21 nt, Homo sapiens
cggccuccucuccuacuuugg

SEQ ID NO: 1378990 - RNA, 21 nt, Homo sapiens
cgggcaaaauaaagugacaga

SEQ ID NO: 1378991 - RNA, 18 nt, Homo sapiens
cgggcugggagcucugca

SEQ ID NO: 1378992 - RNA, 15 nt, Homo sapiens
cggggaagacuugaa

SEQ ID NO: 1378993 - RNA, 21 nt, Homo sapiens
cggggugagcccccagagcug

SEQ ID NO: 1378994 - RNA, 12 nt, Homo sapiens
cgggugugcuau

SEQ ID NO: 1378995 - RNA, 19 nt, Homo sapiens
cggugguucacgccuguaa

SEQ ID NO: 1378996 - RNA, 22 nt, Homo sapiens
cuuggaccgaguagaggcauuu

SEQ ID NO: 1378997 - RNA, 19 nt, Homo sapiens
cuuggacuauuauaauuua

SEQ ID NO: 1378998 - RNA, 19 nt, Homo sapiens
cuuggaggcugucuucuca

SEQ ID NO: 1378999 - RNA, 22 nt, Homo sapiens
cuuggaggcugucuucucaggc

SEQ ID NO: 1379000 - RNA, 13 nt, Homo sapiens
cuuggauguauau

SEQ ID NO: 1379001 - RNA, 22 nt, Homo sapiens
cuuggcuuacugcagccuuugc

SEQ ID NO: 1379002 - RNA, 17 nt, Homo sapiens
cuugggagcaccgccug

SEQ ID NO: 1379003 - RNA, 16 nt, Homo sapiens
cuugguaaucaugaaa

SEQ ID NO: 1379004 - RNA, 18 nt, Homo sapiens
cuuggucacauacaauua

SEQ ID NO: 1379005 - RNA, 23 nt, Homo sapiens
cuuguaaauagcucagguguccc

SEQ ID NO: 1379006 - RNA, 17 nt, Homo sapiens
cuuguaaaugugguaaa

SEQ ID NO: 1379007 - RNA, 21 nt, Homo sapiens
cuuguaacauccaauaggaau

SEQ ID NO: 1379008 - RNA, 18 nt, Homo sapiens
cuuguaauucuaaaugaa

SEQ ID NO: 1379009 - RNA, 23 nt, Homo sapiens
cuugucccacucaagccaagcag

SEQ ID NO: 1379010 - RNA, 17 nt, Homo sapiens
cuugucccugcccagaa

SEQ ID NO: 1379011 - RNA, 12 nt, Homo sapiens
cuugucuuggca

SEQ ID NO: 1379012 - RNA, 17 nt, Homo sapiens
cuugugaaguggaaaug

SEQ ID NO: 1379013 - RNA, 15 nt, Homo sapiens
cuuguguuaugaagc

SEQ ID NO: 1379014 - RNA, 18 nt, Homo sapiens
cuuguguuggcuguggca

SEQ ID NO: 1379015 - RNA, 17 nt, Homo sapiens
cuuguuagaaaugcaaa

SEQ ID NO: 1379016 - RNA, 14 nt, Homo sapiens
cuuguugcugcauc

SEQ ID NO: 1379017 - RNA, 16 nt, Homo sapiens
cuuguuuuaugcucag

SEQ ID NO: 1379018 - RNA, 20 nt, Homo sapiens
cuuuaaaaauaugcaccaaa

SEQ ID NO: 1379019 - RNA, 15 nt, Homo sapiens
cuuuaaauggcuuua

SEQ ID NO: 1379020 - RNA, 22 nt, Homo sapiens
cuuuaauaguuuugauccuaaa

SEQ ID NO: 1379021 - RNA, 16 nt, Homo sapiens
cuuuacauggaugcca

SEQ ID NO: 1379022 - RNA, 15 nt, Homo sapiens
cuuuacguaucugcu

SEQ ID NO: 1379023 - RNA, 22 nt, Homo sapiens
cuuuagagccagcccauggcuu

SEQ ID NO: 1379024 - RNA, 14 nt, Homo sapiens
cuuuagcuaccuca

SEQ ID NO: 1379025 - RNA, 18 nt, Homo sapiens
cuuuaggcagcagcuuuu

SEQ ID NO: 1379026 - RNA, 21 nt, Homo sapiens
cuuuauauuuuuaacuuuaag

SEQ ID NO: 1379027 - RNA, 16 nt, Homo sapiens
cuuucacccacagaaa

SEQ ID NO: 1379028 - RNA, 20 nt, Homo sapiens
cuuucagaaaauucccauga

SEQ ID NO: 1379029 - RNA, 21 nt, Homo sapiens
cuuucagaaagcuuugaauac

SEQ ID NO: 1379030 - RNA, 14 nt, Homo sapiens
cuuucaggacucua

SEQ ID NO: 1379031 - RNA, 23 nt, Homo sapiens
cuuucaucccucgggugugcuau

SEQ ID NO: 1379032 - RNA, 18 nt, Homo sapiens
cuuucccucccuuccucu

SEQ ID NO: 1379033 - RNA, 23 nt, Homo sapiens
cuuucccucccuuccucuuucca

SEQ ID NO: 1379034 - RNA, 18 nt, Homo sapiens
cuuucccuuaaauaacac

SEQ ID NO: 1379035 - RNA, 18 nt, Homo sapiens
cuuuccuguuccagagag

SEQ ID NO: 1379036 - RNA, 14 nt, Homo sapiens
cuuucuacccagcg

SEQ ID NO: 1379037 - RNA, 20 nt, Homo sapiens
cuuucugcaaaggcaccuga

SEQ ID NO: 1379038 - RNA, 22 nt, Homo sapiens
cuuucuuacauuagcaguuugc

SEQ ID NO: 1379039 - RNA, 14 nt, Homo sapiens
cuuucuuaucccag

SEQ ID NO: 1379040 - RNA, 12 nt, Homo sapiens
cuuucuucuccc

SEQ ID NO: 1379041 - RNA, 14 nt, Homo sapiens
cuuucuuguugcug

SEQ ID NO: 1379042 - RNA, 21 nt, Homo sapiens
cuuucuuguugcugcaucucc

SEQ ID NO: 1379043 - RNA, 15 nt, Homo sapiens
cuuugaagaugucau

SEQ ID NO: 1379044 - RNA, 18 nt, Homo sapiens
cuuugaaugcggcccaac

SEQ ID NO: 1379045 - RNA, 17 nt, Homo sapiens
cuuugagacugggucuc

SEQ ID NO: 1379046 - RNA, 18 nt, Homo sapiens
cuuugaugucauauggaa

SEQ ID NO: 1379047 - RNA, 16 nt, Homo sapiens
cuuugauucaaagcac

SEQ ID NO: 1379048 - RNA, 21 nt, Homo sapiens
cuuugcccacaaugcuuugcc

SEQ ID NO: 1379049 - RNA, 23 nt, Homo sapiens
cuuugccccugagacaaauggag

SEQ ID NO: 1379050 - RNA, 22 nt, Homo sapiens
cuuugcuauggggacauuccaa

SEQ ID NO: 1379051 - RNA, 21 nt, Homo sapiens
cuuugcuuuaaguguaacugg

SEQ ID NO: 1379052 - RNA, 20 nt, Homo sapiens
cuuuggcaaaacuuaggcau

SEQ ID NO: 1379053 - RNA, 15 nt, Homo sapiens
cuuuggccauuccaa

SEQ ID NO: 1379054 - RNA, 21 nt, Homo sapiens
cuuugggauugcuaugaauga

SEQ ID NO: 1379055 - RNA, 16 nt, Homo sapiens
cuuuggugcuuuucac

SEQ ID NO: 1379056 - RNA, 17 nt, Homo sapiens
cuuugucccggggcucc

SEQ ID NO: 1379057 - RNA, 20 nt, Homo sapiens
cuuugugugcgucacuguga

SEQ ID NO: 1379058 - RNA, 11 nt, Homo sapiens
cuuuguuaaaa

SEQ ID NO: 1379059 - RNA, 21 nt, Homo sapiens
cuuuguuuguugucagcugaa

SEQ ID NO: 1379060 - RNA, 18 nt, Homo sapiens
cuuuuaaaacacuuccau

SEQ ID NO: 1379061 - RNA, 21 nt, Homo sapiens
cuuuuaaacccuauugguaaa

SEQ ID NO: 1379062 - RNA, 15 nt, Homo sapiens
cuuuuaaaugcauaa

SEQ ID NO: 1379063 - RNA, 15 nt, Homo sapiens
cuuuuaaggcuaaaa

SEQ ID NO: 1379064 - RNA, 13 nt, Homo sapiens
cuuuuaaguugcu

SEQ ID NO: 1379065 - RNA, 14 nt, Homo sapiens
cuuuuacaccaguu

SEQ ID NO: 1379066 - RNA, 21 nt, Homo sapiens
cuuuuaggacccuucccuuga

SEQ ID NO: 1379067 - RNA, 20 nt, Homo sapiens
cuuuuaucugcccagaauuc

SEQ ID NO: 1379068 - RNA, 23 nt, Homo sapiens
cuuuucacugcuggcugccuuag

SEQ ID NO: 1379069 - RNA, 17 nt, Homo sapiens
cuuuucaucuaauguga

SEQ ID NO: 1379070 - RNA, 19 nt, Homo sapiens
cuuuucgcaggauucuucc

SEQ ID NO: 1379071 - RNA, 16 nt, Homo sapiens
cuuuucuaacucuccc

SEQ ID NO: 1379072 - RNA, 15 nt, Homo sapiens
cuuuucuccaugagu

SEQ ID NO: 1379073 - RNA, 21 nt, Homo sapiens
cuuuucucucuauuuguauug

SEQ ID NO: 1379074 - RNA, 21 nt, Homo sapiens
cuuuugagacuuuuuggugga

SEQ ID NO: 1379075 - RNA, 19 nt, Homo sapiens
cuuuugguaucuacuucua

SEQ ID NO: 1379076 - RNA, 15 nt, Homo sapiens
cuuuugguaugugac

SEQ ID NO: 1379077 - RNA, 15 nt, Homo sapiens
cuuuugguugccuua

SEQ ID NO: 1379078 - RNA, 18 nt, Homo sapiens
cuuuuuaaagaaugcucu

SEQ ID NO: 1379079 - RNA, 22 nt, Homo sapiens
cuuuuuaugacaggauguuugc

SEQ ID NO: 1379080 - RNA, 12 nt, Homo sapiens
cuuuuuccagag

SEQ ID NO: 1379081 - RNA, 13 nt, Homo sapiens
gaaaaacuuccau

SEQ ID NO: 1379082 - RNA, 16 nt, Homo sapiens
gaaaaauaagucacuu

SEQ ID NO: 1379083 - RNA, 19 nt, Homo sapiens
gaaaaaucuaaguguuuca

SEQ ID NO: 1379084 - RNA, 13 nt, Homo sapiens
gaaaacuacauuu

SEQ ID NO: 1379085 - RNA, 14 nt, Homo sapiens
gaaaagaacuggaa

SEQ ID NO: 1379086 - RNA, 10 nt, Homo sapiens
gaaaagcagg

SEQ ID NO: 1379087 - RNA, 15 nt, Homo sapiens
gaaaagcugcugaca

SEQ ID NO: 1379088 - RNA, 20 nt, Homo sapiens
gaaaagcugcugacaguguu

SEQ ID NO: 1379089 - RNA, 16 nt, Homo sapiens
gaaaaggaagacuaga

SEQ ID NO: 1379090 - RNA, 15 nt, Homo sapiens
gaaaaguaagcccuu

SEQ ID NO: 1379091 - RNA, 17 nt, Homo sapiens
gaaaaucauauaaucuu

SEQ ID NO: 1379092 - RNA, 14 nt, Homo sapiens
gaaaauccuaccaa

SEQ ID NO: 1379093 - RNA, 22 nt, Homo sapiens
gaaaaugaagaagaaaauagaa

SEQ ID NO: 1379094 - RNA, 22 nt, Homo sapiens
gaaaaugauuuuacuuagcaau

SEQ ID NO: 1379095 - RNA, 14 nt, Homo sapiens
gaaaauguacaaua

SEQ ID NO: 1379096 - RNA, 14 nt, Homo sapiens
gaaaauguuuugua

SEQ ID NO: 1379097 - RNA, 13 nt, Homo sapiens
gaaaauugaauuu

SEQ ID NO: 1379098 - RNA, 17 nt, Homo sapiens
gaaaauuguacaaccug

SEQ ID NO: 1379099 - RNA, 13 nt, Homo sapiens
gaaacaacuucua

SEQ ID NO: 1379100 - RNA, 15 nt, Homo sapiens
gaaacagcgcugggu

SEQ ID NO: 1379101 - RNA, 17 nt, Homo sapiens
gaaaccccaucucuacu

SEQ ID NO: 1379102 - RNA, 19 nt, Homo sapiens
gaaaccccaucucuacuaa

SEQ ID NO: 1379103 - RNA, 17 nt, Homo sapiens
gaaacuguagucucagg

SEQ ID NO: 1379104 - RNA, 20 nt, Homo sapiens
gaaacuugcauacagagaca

SEQ ID NO: 1379105 - RNA, 19 nt, Homo sapiens
gaaacuugugaaguggaaa

SEQ ID NO: 1379106 - RNA, 16 nt, Homo sapiens
gaaagaaaaagcaaua

SEQ ID NO: 1379107 - RNA, 14 nt, Homo sapiens
gaaagaaaugccca

SEQ ID NO: 1379108 - RNA, 18 nt, Homo sapiens
gaaagacagagcugggau

SEQ ID NO: 1379109 - RNA, 19 nt, Homo sapiens
cuuacuuagcaugcacaaa

SEQ ID NO: 1379110 - RNA, 20 nt, Homo sapiens
cuuacuuauuaucuucagga

SEQ ID NO: 1379111 - RNA, 14 nt, Homo sapiens
cuuacuuugaguua

SEQ ID NO: 1379112 - RNA, 19 nt, Homo sapiens
cuuagaauuugggggaaaa

SEQ ID NO: 1379113 - RNA, 16 nt, Homo sapiens
cuuagcagcuaucucu

SEQ ID NO: 1379114 - RNA, 15 nt, Homo sapiens
cuuagcaugcacaaa

SEQ ID NO: 1379115 - RNA, 17 nt, Homo sapiens
cuuagccaagcaguuuc

SEQ ID NO: 1379116 - RNA, 15 nt, Homo sapiens
cuuagccuacagaug

SEQ ID NO: 1379117 - RNA, 17 nt, Homo sapiens
cuuagcuuagaccucag

SEQ ID NO: 1379118 - RNA, 15 nt, Homo sapiens
cuuaggcaugcacag

SEQ ID NO: 1379119 - RNA, 21 nt, Homo sapiens
cuuaggugcuucuucacuuca

SEQ ID NO: 1379120 - RNA, 14 nt, Homo sapiens
cuuaguauuugcau

SEQ ID NO: 1379121 - RNA, 22 nt, Homo sapiens
cuuaguguuuggguauauucau

SEQ ID NO: 1379122 - RNA, 14 nt, Homo sapiens
cuuauacauuugau

SEQ ID NO: 1379123 - RNA, 16 nt, Homo sapiens
cuuauagaaaguucaa

SEQ ID NO: 1379124 - RNA, 17 nt, Homo sapiens
cuuauccaugccuggga

SEQ ID NO: 1379125 - RNA, 15 nt, Homo sapiens
cuuaucccaagagaa

SEQ ID NO: 1379126 - RNA, 17 nt, Homo sapiens
cuuaucuaaucaugaaa

SEQ ID NO: 1379127 - RNA, 18 nt, Homo sapiens
cuuaugggcccagccagc

SEQ ID NO: 1379128 - RNA, 15 nt, Homo sapiens
cuuauguauuuauga

SEQ ID NO: 1379129 - RNA, 21 nt, Homo sapiens
cuuauucacugaaguucuccu

SEQ ID NO: 1379130 - RNA, 14 nt, Homo sapiens
cuuauuguaccucu

SEQ ID NO: 1379131 - RNA, 16 nt, Homo sapiens
cuuauuuaaugaaaga

SEQ ID NO: 1379132 - RNA, 12 nt, Homo sapiens
cuucaaacuucc

SEQ ID NO: 1379133 - RNA, 22 nt, Homo sapiens
cuucaaaugucuaagguaguaa

SEQ ID NO: 1379134 - RNA, 16 nt, Homo sapiens
cuucacaacccaucua

SEQ ID NO: 1379135 - RNA, 17 nt, Homo sapiens
cuucacucaaucucuga

SEQ ID NO: 1379136 - RNA, 20 nt, Homo sapiens
gaacacuugaagccaucuaa

SEQ ID NO: 1379137 - RNA, 13 nt, Homo sapiens
gaacagaaggaug

SEQ ID NO: 1379138 - RNA, 17 nt, Homo sapiens
gaacagaaggaugaaug

SEQ ID NO: 1379139 - RNA, 20 nt, Homo sapiens
gaacagacaacagaagucau

SEQ ID NO: 1379140 - RNA, 17 nt, Homo sapiens
gaacagcgggagaccug

SEQ ID NO: 1379141 - RNA, 13 nt, Homo sapiens
gaacaguguuucc

SEQ ID NO: 1379142 - RNA, 23 nt, Homo sapiens
gaacauaaagccuuggauguaua

SEQ ID NO: 1379143 - RNA, 16 nt, Homo sapiens
gaacauagaacucugg

SEQ ID NO: 1379144 - RNA, 17 nt, Homo sapiens
gaacauagacuagagaa

SEQ ID NO: 1379145 - RNA, 22 nt, Homo sapiens
gaacauuaacaaaagcaauugu

SEQ ID NO: 1379146 - RNA, 19 nt, Homo sapiens
gaaccaauauuuguagaag

SEQ ID NO: 1379147 - RNA, 18 nt, Homo sapiens
gaaccacauagacuuuau

SEQ ID NO: 1379148 - RNA, 16 nt, Homo sapiens
gaaccacgucugcuaa

SEQ ID NO: 1379149 - RNA, 21 nt, Homo sapiens
gaaccacgucugcuaacuugg

SEQ ID NO: 1379150 - RNA, 13 nt, Homo sapiens
gaaccacuaugaa

SEQ ID NO: 1379151 - RNA, 12 nt, Homo sapiens
gaaccauaucaa

SEQ ID NO: 1379152 - RNA, 14 nt, Homo sapiens
gaaccccaggagau

SEQ ID NO: 1379153 - RNA, 22 nt, Homo sapiens
gaacccuuggagccaauggaga

SEQ ID NO: 1379154 - RNA, 21 nt, Homo sapiens
gaaccgagcaauuuucugcua

SEQ ID NO: 1379155 - RNA, 18 nt, Homo sapiens
gaaccugcccugcuccca

SEQ ID NO: 1379156 - RNA, 13 nt, Homo sapiens
gaaccuggagcca

SEQ ID NO: 1379157 - RNA, 23 nt, Homo sapiens
gaacgaguuguuggcugcucccu

SEQ ID NO: 1379158 - RNA, 12 nt, Homo sapiens
gaacugcuuuau

SEQ ID NO: 1379159 - RNA, 16 nt, Homo sapiens
gaacuggacucaggau

SEQ ID NO: 1379160 - RNA, 16 nt, Homo sapiens
gaacuuucaccuucau

SEQ ID NO: 1379161 - RNA, 20 nt, Homo sapiens
gaagaacaguaacugccauc

SEQ ID NO: 1379162 - RNA, 12 nt, Homo sapiens
gaagaacugacu

SEQ ID NO: 1379163 - RNA, 23 nt, Homo sapiens
gaagaagauaugugaagaaaaau

SEQ ID NO: 1379164 - RNA, 12 nt, Homo sapiens
gaagacacugca

SEQ ID NO: 1379165 - RNA, 16 nt, Homo sapiens
gaagaccugcugaggg

SEQ ID NO: 1379166 - RNA, 19 nt, Homo sapiens
gaagacuauauuguacaca

SEQ ID NO: 1379167 - RNA, 17 nt, Homo sapiens
gaagagaaugugacagg

SEQ ID NO: 1379168 - RNA, 21 nt, Homo sapiens
gaagagacguuuaaaagccau

SEQ ID NO: 1379169 - RNA, 18 nt, Homo sapiens
gaagagauccuucuguaa

SEQ ID NO: 1379170 - RNA, 15 nt, Homo sapiens
gaagaguuaaaacag

SEQ ID NO: 1379171 - RNA, 15 nt, Homo sapiens
gaagauaucuugaaa

SEQ ID NO: 1379172 - RNA, 19 nt, Homo sapiens
gaagaucaggccaacccca

SEQ ID NO: 1379173 - RNA, 12 nt, Homo sapiens
gaagauguuugc

SEQ ID NO: 1379174 - RNA, 12 nt, Homo sapiens
gaagcacagcuu

SEQ ID NO: 1379175 - RNA, 12 nt, Homo sapiens
gaagcauuuacu

SEQ ID NO: 1379176 - RNA, 16 nt, Homo sapiens
gaagccucuggcuaga

SEQ ID NO: 1379177 - RNA, 16 nt, Homo sapiens
gaagcucugaagucac

SEQ ID NO: 1379178 - RNA, 14 nt, Homo sapiens
gaaggaaugucuuu

SEQ ID NO: 1379179 - RNA, 13 nt, Homo sapiens
gaaggacauuuua

SEQ ID NO: 1379180 - RNA, 23 nt, Homo sapiens
gaaggaccuccugagcgaugacu

SEQ ID NO: 1379181 - RNA, 21 nt, Homo sapiens
gaaggagaguccccugaaggu

SEQ ID NO: 1379182 - RNA, 22 nt, Homo sapiens
gaaggaggcuuaggacuuucca

SEQ ID NO: 1379183 - RNA, 14 nt, Homo sapiens
gaaggaugcugucu

SEQ ID NO: 1379184 - RNA, 12 nt, Homo sapiens
gaaggccaagag

SEQ ID NO: 1379185 - RNA, 17 nt, Homo sapiens
gaaggccuucuuucuag

SEQ ID NO: 1379186 - RNA, 17 nt, Homo sapiens
gaaggcugcuguuuacu

SEQ ID NO: 1379187 - RNA, 12 nt, Homo sapiens
gaaggcuuucag

SEQ ID NO: 1379188 - RNA, 20 nt, Homo sapiens
gaaggucccaccuccauuug

SEQ ID NO: 1379189 - RNA, 20 nt, Homo sapiens
gaagguucuacgccagggga

SEQ ID NO: 1379190 - RNA, 15 nt, Homo sapiens
gaaguaugagggaaa

SEQ ID NO: 1379191 - RNA, 22 nt, Homo sapiens
gaaguaugagggaaaaugagua

SEQ ID NO: 1379192 - RNA, 20 nt, Homo sapiens
gaaguauuuuccuccaggca

SEQ ID NO: 1379193 - RNA, 14 nt, Homo sapiens
gaagucacacagua

SEQ ID NO: 1379194 - RNA, 19 nt, Homo sapiens
gaagucacacaguauuacu

SEQ ID NO: 1379195 - RNA, 18 nt, Homo sapiens
gaagucuuagacuugaaa

SEQ ID NO: 1379196 - RNA, 21 nt, Homo sapiens
gaagugauugaauauuguuaa

SEQ ID NO: 1379197 - RNA, 10 nt, Homo sapiens
gaagugcaau

SEQ ID NO: 1379198 - RNA, 19 nt, Homo sapiens
gaagugcuuucuucuccca

SEQ ID NO: 1379199 - RNA, 20 nt, Homo sapiens
gaagugcuuucuucucccaa

SEQ ID NO: 1379200 - RNA, 14 nt, Homo sapiens
gaaguuaaagggca

SEQ ID NO: 1379201 - RNA, 21 nt, Homo sapiens
gaaguugacaggcagugccau

SEQ ID NO: 1379202 - RNA, 18 nt, Homo sapiens
gaauaaagccugcuuuuu

SEQ ID NO: 1379203 - RNA, 18 nt, Homo sapiens
gaauaaauaaauguaucu

SEQ ID NO: 1379204 - RNA, 22 nt, Homo sapiens
gaauaaauaugcucagccaccc

SEQ ID NO: 1379205 - RNA, 15 nt, Homo sapiens
gaauaaccacuuaaa

SEQ ID NO: 1379206 - RNA, 18 nt, Homo sapiens
gaauaauacaguaucuca

SEQ ID NO: 1379207 - RNA, 14 nt, Homo sapiens
gaauaauaccuaag

SEQ ID NO: 1379208 - RNA, 13 nt, Homo sapiens
gaauaauccagaa

SEQ ID NO: 1379209 - RNA, 14 nt, Homo sapiens
gaauaauccagaaa

SEQ ID NO: 1379210 - RNA, 14 nt, Homo sapiens
gaauaccaguguua

SEQ ID NO: 1379211 - RNA, 23 nt, Homo sapiens
gaauaccaguguuauuaaugaca

SEQ ID NO: 1379212 - RNA, 14 nt, Homo sapiens
gaauacuuaacuca

SEQ ID NO: 1379213 - RNA, 19 nt, Homo sapiens
gaauagcuuugaauguggc

SEQ ID NO: 1379214 - RNA, 18 nt, Homo sapiens
gaauauaaggaaagcaau

SEQ ID NO: 1379215 - RNA, 16 nt, Homo sapiens
gaauaugauuaguaaa

SEQ ID NO: 1379216 - RNA, 21 nt, Homo sapiens
gaauauuuauuaccucugaua

SEQ ID NO: 1379217 - RNA, 18 nt, Homo sapiens
gaaucagacuucacacug

SEQ ID NO: 1379218 - RNA, 18 nt, Homo sapiens
gaaucauuaauacaaaga

SEQ ID NO: 1379219 - RNA, 19 nt, Homo sapiens
gaaucuacaaaaaacaaca

SEQ ID NO: 1379220 - RNA, 12 nt, Homo sapiens
gaaucucucuuc

SEQ ID NO: 1379221 - RNA, 20 nt, Homo sapiens
gaaucugaauguaauuugug

SEQ ID NO: 1379222 - RNA, 20 nt, Homo sapiens
gaaucugcauuuagcacaaa

SEQ ID NO: 1379223 - RNA, 19 nt, Homo sapiens
gaaucuuugucagcaguuc

SEQ ID NO: 1379224 - RNA, 20 nt, Homo sapiens
gaugucaaaaacuucaauau

SEQ ID NO: 1379225 - RNA, 17 nt, Homo sapiens
gauguccacagaugccu

SEQ ID NO: 1379226 - RNA, 14 nt, Homo sapiens
gaugucccuaugga

SEQ ID NO: 1379227 - RNA, 13 nt, Homo sapiens
gaugugauacaaa

SEQ ID NO: 1379228 - RNA, 16 nt, Homo sapiens
gaugugcaaguguaug

SEQ ID NO: 1379229 - RNA, 15 nt, Homo sapiens
gauguucacuguggc

SEQ ID NO: 1379230 - RNA, 15 nt, Homo sapiens
gauguuucaaaaaau

SEQ ID NO: 1379231 - RNA, 15 nt, Homo sapiens
gauguuucugucaca

SEQ ID NO: 1379232 - RNA, 17 nt, Homo sapiens
gauuaaaaucacucuca

SEQ ID NO: 1379233 - RNA, 19 nt, Homo sapiens
gauuacaggcaugagccac

SEQ ID NO: 1379234 - RNA, 21 nt, Homo sapiens
gauuagaggcaugugccauca

SEQ ID NO: 1379235 - RNA, 20 nt, Homo sapiens
gauuagguguucaggccagu

SEQ ID NO: 1379236 - RNA, 18 nt, Homo sapiens
gauuauagugacaaugaa

SEQ ID NO: 1379237 - RNA, 15 nt, Homo sapiens
gauuauuuuaaucua

SEQ ID NO: 1379238 - RNA, 21 nt, Homo sapiens
gauucacaaugaaaugcucuc

SEQ ID NO: 1379239 - RNA, 14 nt, Homo sapiens
gauucacaguguga

SEQ ID NO: 1379240 - RNA, 17 nt, Homo sapiens
gauucagaauguguuau

SEQ ID NO: 1379241 - RNA, 20 nt, Homo sapiens
gauucgugacaacaugcgac

SEQ ID NO: 1379242 - RNA, 13 nt, Homo sapiens
gauucuugcugcu

SEQ ID NO: 1379243 - RNA, 18 nt, Homo sapiens
gauucuuuccauuaugau

SEQ ID NO: 1379244 - RNA, 19 nt, Homo sapiens
gauugcgccauugcacucc

SEQ ID NO: 1379245 - RNA, 17 nt, Homo sapiens
gauugcuccauacucua

SEQ ID NO: 1379246 - RNA, 18 nt, Homo sapiens
gauugcuuaaaauagcaa

SEQ ID NO: 1379247 - RNA, 15 nt, Homo sapiens
gauuggccccacuga

SEQ ID NO: 1379248 - RNA, 20 nt, Homo sapiens
gauugugccacuucacucca

SEQ ID NO: 1379249 - RNA, 14 nt, Homo sapiens
gauuuacucauuau

SEQ ID NO: 1379250 - RNA, 15 nt, Homo sapiens
gauuuaucacacaaa

SEQ ID NO: 1379251 - RNA, 15 nt, Homo sapiens
gauuucuggggcccc

SEQ ID NO: 1379252 - RNA, 22 nt, Homo sapiens
gauuugucccuaugcauaucag

SEQ ID NO: 1379253 - RNA, 12 nt, Homo sapiens
gauuuuacuuag

SEQ ID NO: 1379254 - RNA, 20 nt, Homo sapiens
gcaaaaaaauuaaauuauuu

SEQ ID NO: 1379255 - RNA, 21 nt, Homo sapiens
gcaaaaaaauuaaauuauuua

SEQ ID NO: 1379256 - RNA, 13 nt, Homo sapiens
gcaaaaccaaaua

SEQ ID NO: 1379257 - RNA, 16 nt, Homo sapiens
gcaaaacuccaucuca

SEQ ID NO: 1379258 - RNA, 19 nt, Homo sapiens
gcaaaagaggauguucacc

SEQ ID NO: 1379259 - RNA, 21 nt, Homo sapiens
gcaaaagugagggcuugucau

SEQ ID NO: 1379260 - RNA, 13 nt, Homo sapiens
gcaaacaggcagu

SEQ ID NO: 1379261 - RNA, 24 nt, Homo sapiens
gcaaacuuucuuaaaacauuauga

SEQ ID NO: 1379262 - RNA, 18 nt, Homo sapiens
gcaaagauuugcuuuaau

SEQ ID NO: 1379263 - RNA, 17 nt, Homo sapiens
gcaaagccuucauugcc

SEQ ID NO: 1379264 - RNA, 16 nt, Homo sapiens
gcaaaggcgucugaau

SEQ ID NO: 1379265 - RNA, 17 nt, Homo sapiens
gcaacaaaaauuacucu

SEQ ID NO: 1379266 - RNA, 17 nt, Homo sapiens
gcaacagacaagugacu

SEQ ID NO: 1379267 - RNA, 14 nt, Homo sapiens
gcaacaguagcaua

SEQ ID NO: 1379268 - RNA, 12 nt, Homo sapiens
gcaacaguuuuu

SEQ ID NO: 1379269 - RNA, 14 nt, Homo sapiens
gcaacaugcuucau

SEQ ID NO: 1379270 - RNA, 16 nt, Homo sapiens
gcaaccagagcacugu

SEQ ID NO: 1379271 - RNA, 18 nt, Homo sapiens
gcaaccagagcacuguau

SEQ ID NO: 1379272 - RNA, 20 nt, Homo sapiens
gcaaccagaggaaacuugca

SEQ ID NO: 1379273 - RNA, 16 nt, Homo sapiens
gcaagagaauuacuug

SEQ ID NO: 1379274 - RNA, 21 nt, Homo sapiens
gcaagcaagaaacacugggcu

SEQ ID NO: 1379275 - RNA, 13 nt, Homo sapiens
gcaaggagaaaaa

SEQ ID NO: 1379276 - RNA, 16 nt, Homo sapiens
gcaaggggaaaaucuc

SEQ ID NO: 1379277 - RNA, 21 nt, Homo sapiens
gcaaguaugugagugugucca

SEQ ID NO: 1379278 - RNA, 16 nt, Homo sapiens
gcaaguguaugcacgu

SEQ ID NO: 1379279 - RNA, 19 nt, Homo sapiens
gcaaguguguaugugcgug

SEQ ID NO: 1379280 - RNA, 15 nt, Homo sapiens
gcaagugugugcaug

SEQ ID NO: 1379281 - RNA, 18 nt, Homo sapiens
gcaauaaaaaucauagua

SEQ ID NO: 1379282 - RNA, 20 nt, Homo sapiens
gcaauaguggaacgaacuuu

SEQ ID NO: 1379283 - RNA, 20 nt, Homo sapiens
gcaaugugcccccagacgca

SEQ ID NO: 1379284 - RNA, 22 nt, Homo sapiens
gcaauucuaacuuuuuugcuau

SEQ ID NO: 1379285 - RNA, 18 nt, Homo sapiens
gcaauuuccggccaacag

SEQ ID NO: 1379286 - RNA, 20 nt, Homo sapiens
gcacaaauugggccaaagaa

SEQ ID NO: 1379287 - RNA, 16 nt, Homo sapiens
gcacaaggcugaccaa

SEQ ID NO: 1379288 - RNA, 19 nt, Homo sapiens
gcacacggagacgugauga

SEQ ID NO: 1379289 - RNA, 17 nt, Homo sapiens
gcacagggucucuacca

SEQ ID NO: 1379290 - RNA, 22 nt, Homo sapiens
gcacaucugcauuuucacccca

SEQ ID NO: 1379291 - RNA, 12 nt, Homo sapiens
gcacaugugugc

SEQ ID NO: 1379292 - RNA, 22 nt, Homo sapiens
gcacauugaaagagaaccaguu

SEQ ID NO: 1379293 - RNA, 14 nt, Homo sapiens
gcaccacggccuca

SEQ ID NO: 1379294 - RNA, 20 nt, Homo sapiens
gcaccacugcacuccagccu

SEQ ID NO: 1379295 - RNA, 21 nt, Homo sapiens
gcaccaggcacgaacccaccu

SEQ ID NO: 1379296 - RNA, 14 nt, Homo sapiens
gcacccacccagca

SEQ ID NO: 1379297 - RNA, 22 nt, Homo sapiens
gcacccaggacuuccauuugcu

SEQ ID NO: 1379298 - RNA, 15 nt, Homo sapiens
gcacccucuccagau

SEQ ID NO: 1379299 - RNA, 18 nt, Homo sapiens
gcaccgggccacagagaa

SEQ ID NO: 1379300 - RNA, 18 nt, Homo sapiens
gcacucaaagcuuguuaa

SEQ ID NO: 1379301 - RNA, 19 nt, Homo sapiens
gcacucagaagacacugau

SEQ ID NO: 1379302 - RNA, 15 nt, Homo sapiens
gcacucauggguaau

SEQ ID NO: 1379303 - RNA, 22 nt, Homo sapiens
gcacugaaggcuuucagggccu

SEQ ID NO: 1379304 - RNA, 21 nt, Homo sapiens
gcacugacauuguuggccaaa

SEQ ID NO: 1379305 - RNA, 19 nt, Homo sapiens
gcacugagcaaagcauuga

SEQ ID NO: 1379306 - RNA, 16 nt, Homo sapiens
gcacugaggaccagcc

SEQ ID NO: 1379307 - RNA, 13 nt, Homo sapiens
gcacugcugcugc

SEQ ID NO: 1379308 - RNA, 16 nt, Homo sapiens
gcacuguuucucucac

SEQ ID NO: 1379309 - RNA, 17 nt, Homo sapiens
gcacuuuaaaugaagcu

SEQ ID NO: 1379310 - RNA, 17 nt, Homo sapiens
gcacuuugggaggccaa

SEQ ID NO: 1379311 - RNA, 20 nt, Homo sapiens
gcacuuugggaggccaagga

SEQ ID NO: 1379312 - RNA, 15 nt, Homo sapiens
guacuuuuuccagac

SEQ ID NO: 1379313 - RNA, 23 nt, Homo sapiens
guagaaaaagcaguaacugacaa

SEQ ID NO: 1379314 - RNA, 16 nt, Homo sapiens
guagaaaagaacugga

SEQ ID NO: 1379315 - RNA, 15 nt, Homo sapiens
guagcaacaugagaa

SEQ ID NO: 1379316 - RNA, 20 nt, Homo sapiens
guagcugccccuggcucuga

SEQ ID NO: 1379317 - RNA, 19 nt, Homo sapiens
guagcugggacuacaggca

SEQ ID NO: 1379318 - RNA, 14 nt, Homo sapiens
guagggaguaccug

SEQ ID NO: 1379319 - RNA, 14 nt, Homo sapiens
guaggggcaaaaau

SEQ ID NO: 1379320 - RNA, 13 nt, Homo sapiens
guagucauuucau

SEQ ID NO: 1379321 - RNA, 17 nt, Homo sapiens
guagucccagcuacuca

SEQ ID NO: 1379322 - RNA, 19 nt, Homo sapiens
guagucccagcuacucagg

SEQ ID NO: 1379323 - RNA, 23 nt, Homo sapiens
guauaaaaugguguuuucaugua

SEQ ID NO: 1379324 - RNA, 21 nt, Homo sapiens
guauaaauauguauuuuguca

SEQ ID NO: 1379325 - RNA, 19 nt, Homo sapiens
guauaacacaauaugaaua

SEQ ID NO: 1379326 - RNA, 15 nt, Homo sapiens
guauaacugaguuaa

SEQ ID NO: 1379327 - RNA, 16 nt, Homo sapiens
guauaaguccuugcaa

SEQ ID NO: 1379328 - RNA, 20 nt, Homo sapiens
guauacuuuuugcauaugua

SEQ ID NO: 1379329 - RNA, 15 nt, Homo sapiens
guauauucauuucaa

SEQ ID NO: 1379330 - RNA, 20 nt, Homo sapiens
guauauucugguuacugugg

SEQ ID NO: 1379331 - RNA, 21 nt, Homo sapiens
guauccucugaccuacauacg

SEQ ID NO: 1379332 - RNA, 14 nt, Homo sapiens
guaugacuaaagag

SEQ ID NO: 1379333 - RNA, 23 nt, Homo sapiens
guaugaggucuaggaacauacuu

SEQ ID NO: 1379334 - RNA, 17 nt, Homo sapiens
guaugaucacggcucac

SEQ ID NO: 1379335 - RNA, 17 nt, Homo sapiens
guaugcacgugugcaca

SEQ ID NO: 1379336 - RNA, 14 nt, Homo sapiens
guaugccaagugaa

SEQ ID NO: 1379337 - RNA, 18 nt, Homo sapiens
guauggcaugaacaucuu

SEQ ID NO: 1379338 - RNA, 17 nt, Homo sapiens
guauguaacuacaggaa

SEQ ID NO: 1379339 - RNA, 13 nt, Homo sapiens
guaugugccauuu

SEQ ID NO: 1379340 - RNA, 15 nt, Homo sapiens
guauguuugggagac

SEQ ID NO: 1379341 - RNA, 21 nt, Homo sapiens
guauguuugggagacugcuga

SEQ ID NO: 1379342 - RNA, 23 nt, Homo sapiens
guauguuugggagacugcugagu

SEQ ID NO: 1379343 - RNA, 20 nt, Homo sapiens
guauucauuuuuucuacccu

SEQ ID NO: 1379344 - RNA, 12 nt, Homo sapiens
guauuccauuuu

SEQ ID NO: 1379345 - RNA, 15 nt, Homo sapiens
guauucuuauuuaau

SEQ ID NO: 1379346 - RNA, 20 nt, Homo sapiens
guauuguauaaguccuugca

SEQ ID NO: 1379347 - RNA, 21 nt, Homo sapiens
guauuuaauuguaaacuguac

SEQ ID NO: 1379348 - RNA, 16 nt, Homo sapiens
guauuuuacuuuucca

SEQ ID NO: 1379349 - RNA, 22 nt, Homo sapiens
gucaaaguaaaacuugcugccu

SEQ ID NO: 1379350 - RNA, 14 nt, Homo sapiens
gucaacuaugauau

SEQ ID NO: 1379351 - RNA, 18 nt, Homo sapiens
gucaauccgaaguaugag

SEQ ID NO: 1379352 - RNA, 12 nt, Homo sapiens
gucaaugaacuu

SEQ ID NO: 1379353 - RNA, 19 nt, Homo sapiens
gucaaugaacuuuccacau

SEQ ID NO: 1379354 - RNA, 22 nt, Homo sapiens
gucacaacaacaacaacaaaaa

SEQ ID NO: 1379355 - RNA, 18 nt, Homo sapiens
gucacauagagugaucuu

SEQ ID NO: 1379356 - RNA, 14 nt, Homo sapiens
gucacaucuuggca

SEQ ID NO: 1379357 - RNA, 16 nt, Homo sapiens
gucagaguugugcaca

SEQ ID NO: 1379358 - RNA, 20 nt, Homo sapiens
gucagauuugaacucuucaa

SEQ ID NO: 1379359 - RNA, 20 nt, Homo sapiens
gucagcaggaagcaacgaag

SEQ ID NO: 1379360 - RNA, 16 nt, Homo sapiens
gucagcaugccucuag

SEQ ID NO: 1379361 - RNA, 16 nt, Homo sapiens
gucaggaaacauauuu

SEQ ID NO: 1379362 - RNA, 16 nt, Homo sapiens
gucagggaacauauuu

SEQ ID NO: 1379363 - RNA, 22 nt, Homo sapiens
gucagucugaugagaacucuga

SEQ ID NO: 1379364 - RNA, 20 nt, Homo sapiens
gucauacuacauacaagcau

SEQ ID NO: 1379365 - RNA, 10 nt, Homo sapiens
gucauagaaa

SEQ ID NO: 1379366 - RNA, 16 nt, Homo sapiens
gucaucagcuauucag

SEQ ID NO: 1379367 - RNA, 21 nt, Homo sapiens
gucaucucucacacauuccag

SEQ ID NO: 1379368 - RNA, 15 nt, Homo sapiens
gucauggcaccaaag

SEQ ID NO: 1379369 - RNA, 19 nt, Homo sapiens
guccauguaauauucccau

SEQ ID NO: 1379370 - RNA, 18 nt, Homo sapiens
guccaugugugugcaagu

SEQ ID NO: 1379371 - RNA, 14 nt, Homo sapiens
gucccagcuacuca

SEQ ID NO: 1379372 - RNA, 13 nt, Homo sapiens
guccccaccaauc

SEQ ID NO: 1379373 - RNA, 20 nt, Homo sapiens
gucccggggcuccacugaac

SEQ ID NO: 1379374 - RNA, 17 nt, Homo sapiens
gucccuaaaaacacaga

SEQ ID NO: 1379375 - RNA, 16 nt, Homo sapiens
gucccucucucuggaa

SEQ ID NO: 1379376 - RNA, 22 nt, Homo sapiens
gucccuguuagcauaaugugag

SEQ ID NO: 1379377 - RNA, 13 nt, Homo sapiens
gucccuuccaggc

SEQ ID NO: 1379378 - RNA, 15 nt, Homo sapiens
guccgaucuuugacu

SEQ ID NO: 1379379 - RNA, 24 nt, Homo sapiens
guccucacaucuuucacacuucca

SEQ ID NO: 1379380 - RNA, 17 nt, Homo sapiens
guccugccucagccucc

SEQ ID NO: 1379381 - RNA, 19 nt, Homo sapiens
guccuggaaucacauucuu

SEQ ID NO: 1379382 - RNA, 23 nt, Homo sapiens
guccuguauaagaauuacuaaau

SEQ ID NO: 1379383 - RNA, 14 nt, Homo sapiens
guccuugaugcuca

SEQ ID NO: 1379384 - RNA, 18 nt, Homo sapiens
guccuuggggacaucuca

SEQ ID NO: 1379385 - RNA, 14 nt, Homo sapiens
gucgcaucucagug

SEQ ID NO: 1379386 - RNA, 16 nt, Homo sapiens
gucuaaaaacaccaaa

SEQ ID NO: 1379387 - RNA, 20 nt, Homo sapiens
gucuaaacuuuagaauuaau

SEQ ID NO: 1379388 - RNA, 13 nt, Homo sapiens
gucuaagucauga

SEQ ID NO: 1379389 - RNA, 19 nt, Homo sapiens
gucuauauuuuaaccugca

SEQ ID NO: 1379390 - RNA, 17 nt, Homo sapiens
gucucagaccacuauuc

SEQ ID NO: 1379391 - RNA, 21 nt, Homo sapiens
gucucauaugauugugcacau

SEQ ID NO: 1379392 - RNA, 18 nt, Homo sapiens
gucuccaucucugucuca

SEQ ID NO: 1379393 - RNA, 17 nt, Homo sapiens
gucuccauuguuuugcc

SEQ ID NO: 1379394 - RNA, 19 nt, Homo sapiens
gucuccucucucuguaaua

SEQ ID NO: 1379395 - RNA, 19 nt, Homo sapiens
gucuccuuugcaggcucau

SEQ ID NO: 1379396 - RNA, 18 nt, Homo sapiens
gucucugcuauggaaugc

SEQ ID NO: 1379397 - RNA, 18 nt, Homo sapiens
gucugaaagcagguuaac

SEQ ID NO: 1379398 - RNA, 22 nt, Homo sapiens
gucugagagauucaugcugauu

SEQ ID NO: 1379399 - RNA, 18 nt, Homo sapiens
gucugaugagaacucuga

SEQ ID NO: 1379400 - RNA, 17 nt, Homo sapiens
gugagaaggagauucaa

SEQ ID NO: 1379401 - RNA, 20 nt, Homo sapiens
gugagaaucaaaacucuccu

SEQ ID NO: 1379402 - RNA, 15 nt, Homo sapiens
gugagcacuaaggug

SEQ ID NO: 1379403 - RNA, 21 nt, Homo sapiens
gugagcacuaaggugugcucu

SEQ ID NO: 1379404 - RNA, 22 nt, Homo sapiens
gugagcagacugcaaaucugcc

SEQ ID NO: 1379405 - RNA, 17 nt, Homo sapiens
gugagcagcggacuuca

SEQ ID NO: 1379406 - RNA, 18 nt, Homo sapiens
gugaggaugucacucaga

SEQ ID NO: 1379407 - RNA, 18 nt, Homo sapiens
gugaguaagagcuggugu

SEQ ID NO: 1379408 - RNA, 15 nt, Homo sapiens
gugagugugugcaag

SEQ ID NO: 1379409 - RNA, 23 nt, Homo sapiens
gugauacaacuucaagugcaugc

SEQ ID NO: 1379410 - RNA, 16 nt, Homo sapiens
gugaucugaacagaaa

SEQ ID NO: 1379411 - RNA, 17 nt, Homo sapiens
gugauucuugcugcuau

SEQ ID NO: 1379412 - RNA, 16 nt, Homo sapiens
gugauuuuacauuuau

SEQ ID NO: 1379413 - RNA, 18 nt, Homo sapiens
gugcaaagauuugcuuua

SEQ ID NO: 1379414 - RNA, 19 nt, Homo sapiens
gugcaaaguucccuacuuc

SEQ ID NO: 1379415 - RNA, 20 nt, Homo sapiens
gugcaagugucugugugcaa

SEQ ID NO: 1379416 - RNA, 15 nt, Homo sapiens
gugcaaguguguaug

SEQ ID NO: 1379417 - RNA, 14 nt, Homo sapiens
gugcacucugcuaa

SEQ ID NO: 1379418 - RNA, 15 nt, Homo sapiens
gugcagcaaccagag

SEQ ID NO: 1379419 - RNA, 23 nt, Homo sapiens
gugcagcaaccagagcacuguau

SEQ ID NO: 1379420 - RNA, 20 nt, Homo sapiens
gugcaguggcccccacagaa

SEQ ID NO: 1379421 - RNA, 18 nt, Homo sapiens
gugcauagagccacguau

SEQ ID NO: 1379422 - RNA, 17 nt, Homo sapiens
gugcaugcagcaucuaa

SEQ ID NO: 1379423 - RNA, 20 nt, Homo sapiens
gugcaugcagcaucuaagua

SEQ ID NO: 1379424 - RNA, 22 nt, Homo sapiens
gugcaugccuggcacaacauca

SEQ ID NO: 1379425 - RNA, 12 nt, Homo sapiens
gugcaugugcac

SEQ ID NO: 1379426 - RNA, 13 nt, Homo sapiens
gugcaugugcacu

SEQ ID NO: 1379427 - RNA, 16 nt, Homo sapiens
gugcaugugcacuugc

SEQ ID NO: 1379428 - RNA, 13 nt, Homo sapiens
gugccaagcacag

SEQ ID NO: 1379429 - RNA, 22 nt, Homo sapiens
gugccaauuuauuuacauuuaa

SEQ ID NO: 1379430 - RNA, 14 nt, Homo sapiens
gugcccacagcccg

SEQ ID NO: 1379431 - RNA, 15 nt, Homo sapiens
gugcccaccaacauc

SEQ ID NO: 1379432 - RNA, 20 nt, Homo sapiens
gugcccccagacgcacgugg

SEQ ID NO: 1379433 - RNA, 13 nt, Homo sapiens
gugcggugcauac

SEQ ID NO: 1379434 - RNA, 19 nt, Homo sapiens
gugcuaaauaaacaacaaa

SEQ ID NO: 1379435 - RNA, 21 nt, Homo sapiens
gugcucauucauuuaacagag

SEQ ID NO: 1379436 - RNA, 18 nt, Homo sapiens
gugcugggauuacaggug

SEQ ID NO: 1379437 - RNA, 19 nt, Homo sapiens
gugcugggauuacaggugu

SEQ ID NO: 1379438 - RNA, 17 nt, Homo sapiens
gugcuguggccugggca

SEQ ID NO: 1379439 - RNA, 18 nt, Homo sapiens
gugcuuaaaaaucauuga

SEQ ID NO: 1379440 - RNA, 14 nt, Homo sapiens
gugcuucuucacuu

SEQ ID NO: 1379441 - RNA, 18 nt, Homo sapiens
guggaaagugaauuugaa

SEQ ID NO: 1379442 - RNA, 15 nt, Homo sapiens
guggaacaagcacag

SEQ ID NO: 1379443 - RNA, 12 nt, Homo sapiens
guggagaacucc

SEQ ID NO: 1379444 - RNA, 22 nt, Homo sapiens
guggagcacaaaagccucucau

SEQ ID NO: 1379445 - RNA, 15 nt, Homo sapiens
guggaugaugcugcc

SEQ ID NO: 1379446 - RNA, 22 nt, Homo sapiens
guggcagaauggggugcaugaa

SEQ ID NO: 1379447 - RNA, 21 nt, Homo sapiens
guggcaucccaguggccucaa

SEQ ID NO: 1379448 - RNA, 17 nt, Homo sapiens
guggccagcacucugaa

SEQ ID NO: 1379449 - RNA, 14 nt, Homo sapiens
guggcccaagacaa

SEQ ID NO: 1379450 - RNA, 18 nt, Homo sapiens
guggcccagggaagccaa

SEQ ID NO: 1379451 - RNA, 15 nt, Homo sapiens
guggccccaacacaa

SEQ ID NO: 1379452 - RNA, 19 nt, Homo sapiens
guggccucugggaggccag

SEQ ID NO: 1379453 - RNA, 18 nt, Homo sapiens
guggcuucccgcucagcc

SEQ ID NO: 1379454 - RNA, 19 nt, Homo sapiens
gugggcagagguucauuuc

SEQ ID NO: 1379455 - RNA, 18 nt, Homo sapiens
gugggcccagggccuagg

SEQ ID NO: 1379456 - RNA, 21 nt, Homo sapiens
guggugagccgagauugcacc

SEQ ID NO: 1379457 - RNA, 21 nt, Homo sapiens
gugguuauuuagggaacugcu

SEQ ID NO: 1379458 - RNA, 17 nt, Homo sapiens
gugguuuuugagccaug

SEQ ID NO: 1379459 - RNA, 14 nt, Homo sapiens
guguaagaaacaca

SEQ ID NO: 1379460 - RNA, 22 nt, Homo sapiens
guguaggcuuuacuuagcuuau

SEQ ID NO: 1379461 - RNA, 18 nt, Homo sapiens
guguauauuuaagguaua

SEQ ID NO: 1379462 - RNA, 13 nt, Homo sapiens
guguaugcacgug

SEQ ID NO: 1379463 - RNA, 22 nt, Homo sapiens
gugucacuacucacagucucuu

SEQ ID NO: 1379464 - RNA, 17 nt, Homo sapiens
gugucaggaaacauauu

SEQ ID NO: 1379465 - RNA, 21 nt, Homo sapiens
gugucucugcaucacccacag

SEQ ID NO: 1379466 - RNA, 16 nt, Homo sapiens
gugugacaucaguggc

SEQ ID NO: 1379467 - RNA, 21 nt, Homo sapiens
gugugcaacagacaagugacu

SEQ ID NO: 1379468 - RNA, 12 nt, Homo sapiens
gugugcaagugu

SEQ ID NO: 1379469 - RNA, 18 nt, Homo sapiens
gugugcaagugugugcau

SEQ ID NO: 1379470 - RNA, 13 nt, Homo sapiens
gugugcgugcaug

SEQ ID NO: 1379471 - RNA, 23 nt, Homo sapiens
guguguaugugcgugugugcaag

SEQ ID NO: 1379472 - RNA, 20 nt, Homo sapiens
guguguccaugugugugcaa

SEQ ID NO: 1379473 - RNA, 15 nt, Homo sapiens
gugugugugcaagug

SEQ ID NO: 1379474 - RNA, 22 nt, Homo sapiens
guguguuaaaugggacuggagu

SEQ ID NO: 1379475 - RNA, 21 nt, Homo sapiens
guguuacgcacacguacuuaa

SEQ ID NO: 1379476 - RNA, 19 nt, Homo sapiens
guguuaggacagcauauaa

SEQ ID NO: 1379477 - RNA, 21 nt, Homo sapiens
guguuauuaaugacaaaggca

SEQ ID NO: 1379478 - RNA, 21 nt, Homo sapiens
guguuauuguauuagguguca

SEQ ID NO: 1379479 - RNA, 19 nt, Homo sapiens
guguuuauccuaucucucc

SEQ ID NO: 1379480 - RNA, 13 nt, Homo sapiens
guguuuccuucag

SEQ ID NO: 1379481 - RNA, 13 nt, Homo sapiens
guguuugcugagg

SEQ ID NO: 1379482 - RNA, 20 nt, Homo sapiens
guguuugguucuggggcccc

SEQ ID NO: 1379483 - RNA, 17 nt, Homo sapiens
guguuuuuaguugcuca

SEQ ID NO: 1379484 - RNA, 18 nt, Homo sapiens
guguuuuucacauuugcg

SEQ ID NO: 1379485 - RNA, 20 nt, Homo sapiens
guuaaaauaaaauuguacau

SEQ ID NO: 1379486 - RNA, 17 nt, Homo sapiens
guuaaacauugaaguaa

SEQ ID NO: 1379487 - RNA, 20 nt, Homo sapiens
guuaaauagaguauaugcac

SEQ ID NO: 1379488 - RNA, 13 nt, Homo sapiens
uacuuacagcaua

SEQ ID NO: 1379489 - RNA, 13 nt, Homo sapiens
uacuuagcagcua

SEQ ID NO: 1379490 - RNA, 17 nt, Homo sapiens
uacuuagcaugcacaaa

SEQ ID NO: 1379491 - RNA, 12 nt, Homo sapiens
uacuucucacca

SEQ ID NO: 1379492 - RNA, 13 nt, Homo sapiens
uacuugagacugu

SEQ ID NO: 1379493 - RNA, 12 nt, Homo sapiens
uacuuuaccucc

SEQ ID NO: 1379494 - RNA, 15 nt, Homo sapiens
uacuuuaccuccuau

SEQ ID NO: 1379495 - RNA, 17 nt, Homo sapiens
uacuuuguauccucuga

SEQ ID NO: 1379496 - RNA, 16 nt, Homo sapiens
uagaaaagaaagcaaa

SEQ ID NO: 1379497 - RNA, 20 nt, Homo sapiens
uagaaacuaagagaaugaua

SEQ ID NO: 1379498 - RNA, 14 nt, Homo sapiens
uagaaauaagacaa

SEQ ID NO: 1379499 - RNA, 22 nt, Homo sapiens
uagaaaucccccuuucucuaau

SEQ ID NO: 1379500 - RNA, 18 nt, Homo sapiens
uagaaaugaccaauauua

SEQ ID NO: 1379501 - RNA, 18 nt, Homo sapiens
uagaaauuggcuggaugu

SEQ ID NO: 1379502 - RNA, 17 nt, Homo sapiens
uagaacguaaccacgga

SEQ ID NO: 1379503 - RNA, 18 nt, Homo sapiens
uagaacucuccaucuuau

SEQ ID NO: 1379504 - RNA, 23 nt, Homo sapiens
uagaacucugggcugccauguga

SEQ ID NO: 1379505 - RNA, 21 nt, Homo sapiens
uagaaggaaacuagcuuacau

SEQ ID NO: 1379506 - RNA, 20 nt, Homo sapiens
uagaauuugggggaaaauuu

SEQ ID NO: 1379507 - RNA, 23 nt, Homo sapiens
uagacccgaggaaacucagaguc

SEQ ID NO: 1379508 - RNA, 16 nt, Homo sapiens
uagaccuccagcuguu

SEQ ID NO: 1379509 - RNA, 23 nt, Homo sapiens
uagacugccaugcuagacaagcu

SEQ ID NO: 1379510 - RNA, 14 nt, Homo sapiens
uagagacuguagau

SEQ ID NO: 1379511 - RNA, 15 nt, Homo sapiens
uagagcuagucuuuc

SEQ ID NO: 1379512 - RNA, 21 nt, Homo sapiens
uagaggacagcaacuggugau

SEQ ID NO: 1379513 - RNA, 22 nt, Homo sapiens
uagaggcaagaaagagauacca

SEQ ID NO: 1379514 - RNA, 13 nt, Homo sapiens
uagaguguuauca

SEQ ID NO: 1379515 - RNA, 18 nt, Homo sapiens
uagaguguuaucagucau

SEQ ID NO: 1379516 - RNA, 14 nt, Homo sapiens
uagaguugggacaa

SEQ ID NO: 1379517 - RNA, 15 nt, Homo sapiens
uagauaaauuucaau

SEQ ID NO: 1379518 - RNA, 15 nt, Homo sapiens
uagaugguuacacug

SEQ ID NO: 1379519 - RNA, 13 nt, Homo sapiens
uagaugugucuua

SEQ ID NO: 1379520 - RNA, 20 nt, Homo sapiens
uagcaacaugcuucaugaaa

SEQ ID NO: 1379521 - RNA, 14 nt, Homo sapiens
uagcacuauuuaca

SEQ ID NO: 1379522 - RNA, 14 nt, Homo sapiens
uagcacucacaugc

SEQ ID NO: 1379523 - RNA, 13 nt, Homo sapiens
uagcagaaaucua

SEQ ID NO: 1379524 - RNA, 22 nt, Homo sapiens
uagcagcagggagggcuucugc

SEQ ID NO: 1379525 - RNA, 17 nt, Homo sapiens
uagcagcuaucucucag

SEQ ID NO: 1379526 - RNA, 23 nt, Homo sapiens
uagcaggaagcugugagagcagu

SEQ ID NO: 1379527 - RNA, 15 nt, Homo sapiens
uagcaucucaugagu

SEQ ID NO: 1379528 - RNA, 16 nt, Homo sapiens
uagcauuaacuaaucu

SEQ ID NO: 1379529 - RNA, 16 nt, Homo sapiens
uagccaggauccacaa

SEQ ID NO: 1379530 - RNA, 14 nt, Homo sapiens
uagcccaaaaccaa

SEQ ID NO: 1379531 - RNA, 20 nt, Homo sapiens
uagccccuuagccaguugua

SEQ ID NO: 1379532 - RNA, 17 nt, Homo sapiens
uagccgaccucagccuu

SEQ ID NO: 1379533 - RNA, 22 nt, Homo sapiens
uagccucgccgucugugaauug

SEQ ID NO: 1379534 - RNA, 17 nt, Homo sapiens
uagccucgcucuuggca

SEQ ID NO: 1379535 - RNA, 15 nt, Homo sapiens
uagcgaggcucuaac

SEQ ID NO: 1379536 - RNA, 21 nt, Homo sapiens
uagcgcugcucuuaugccauu

SEQ ID NO: 1379537 - RNA, 18 nt, Homo sapiens
uagcuaccucacuaugcu

SEQ ID NO: 1379538 - RNA, 17 nt, Homo sapiens
uagcuauauccauguac

SEQ ID NO: 1379539 - RNA, 14 nt, Homo sapiens
uagcucacaccuga

SEQ ID NO: 1379540 - RNA, 17 nt, Homo sapiens
uagcucuggugaccuug

SEQ ID NO: 1379541 - RNA, 17 nt, Homo sapiens
uagcugggacuacaggc

SEQ ID NO: 1379542 - RNA, 17 nt, Homo sapiens
uagcugggacuacaggu

SEQ ID NO: 1379543 - RNA, 20 nt, Homo sapiens
uagcugguuccugcuagaaa

SEQ ID NO: 1379544 - RNA, 14 nt, Homo sapiens
uagcuuagaccuca

SEQ ID NO: 1379545 - RNA, 19 nt, Homo sapiens
uagcuuagaccucagccug

SEQ ID NO: 1379546 - RNA, 15 nt, Homo sapiens
uagcuuggaaacugg

SEQ ID NO: 1379547 - RNA, 22 nt, Homo sapiens
uagcuuuagggcaauauugcca

SEQ ID NO: 1379548 - RNA, 23 nt, Homo sapiens
uagcuuuagggcaauauugccau

SEQ ID NO: 1379549 - RNA, 22 nt, Homo sapiens
uaggaagaauuuuuauauccac

SEQ ID NO: 1379550 - RNA, 18 nt, Homo sapiens
uaggaaugcuaacaguuc

SEQ ID NO: 1379551 - RNA, 15 nt, Homo sapiens
uaggacagcauauaa

SEQ ID NO: 1379552 - RNA, 22 nt, Homo sapiens
uaggacagcauauaaauguaau

SEQ ID NO: 1379553 - RNA, 17 nt, Homo sapiens
uaggaccaauaccuccu

SEQ ID NO: 1379554 - RNA, 20 nt, Homo sapiens
uaggagagagaucaugagaa

SEQ ID NO: 1379555 - RNA, 18 nt, Homo sapiens
uaggagcaugagugccgu

SEQ ID NO: 1379556 - RNA, 15 nt, Homo sapiens
uaggauguugcucag

SEQ ID NO: 1379557 - RNA, 14 nt, Homo sapiens
uaggcauuugcuga

SEQ ID NO: 1379558 - RNA, 22 nt, Homo sapiens
uaggccuggggacggcuuuuac

SEQ ID NO: 1379559 - RNA, 12 nt, Homo sapiens
uaggcucugcac

SEQ ID NO: 1379560 - RNA, 16 nt, Homo sapiens
uaggcugggcccagag

SEQ ID NO: 1379561 - RNA, 14 nt, Homo sapiens
uagggaaaaaccag

SEQ ID NO: 1379562 - RNA, 21 nt, Homo sapiens
uagguaggaaaaugaagaaga

SEQ ID NO: 1379563 - RNA, 15 nt, Homo sapiens
uagguuaacuaugua

SEQ ID NO: 1379564 - RNA, 19 nt, Homo sapiens
uaguaaagugauaauuucu

SEQ ID NO: 1379565 - RNA, 21 nt, Homo sapiens
uaguaauguuuuauacuguuu

SEQ ID NO: 1379566 - RNA, 11 nt, Homo sapiens
uaguacuccuu

SEQ ID NO: 1379567 - RNA, 17 nt, Homo sapiens
uagucauuucauggguu

SEQ ID NO: 1379568 - RNA, 16 nt, Homo sapiens
uaguccaaagacuuaa

SEQ ID NO: 1379569 - RNA, 21 nt, Homo sapiens
uagucccauugauguacuuua

SEQ ID NO: 1379570 - RNA, 22 nt, Homo sapiens
uagucccauugauguacuuuac

SEQ ID NO: 1379571 - RNA, 22 nt, Homo sapiens
uagucucuggcaagaugcuuua

SEQ ID NO: 1379572 - RNA, 18 nt, Homo sapiens
uagucugcuuugguacua

SEQ ID NO: 1379573 - RNA, 19 nt, Homo sapiens
uagugauuuccacagugac

SEQ ID NO: 1379574 - RNA, 23 nt, Homo sapiens
uagugauuuccacagugacucca

SEQ ID NO: 1379575 - RNA, 16 nt, Homo sapiens
uaguggggucagggcu

SEQ ID NO: 1379576 - RNA, 19 nt, Homo sapiens
uagugguguuuuaaagaga

SEQ ID NO: 1379577 - RNA, 18 nt, Homo sapiens
uaguguuaauaucuugaa

SEQ ID NO: 1379578 - RNA, 13 nt, Homo sapiens
uaguuaaaguaau

SEQ ID NO: 1379579 - RNA, 21 nt, Homo sapiens
uaguugucacuuuccucuucc

SEQ ID NO: 1379580 - RNA, 22 nt, Homo sapiens
uaguuuuuaccuaccacagugu

SEQ ID NO: 1379581 - RNA, 13 nt, Homo sapiens
uauaaaaguacua

SEQ ID NO: 1379582 - RNA, 21 nt, Homo sapiens
uauaacuaguccuuuacuaau

SEQ ID NO: 1379583 - RNA, 16 nt, Homo sapiens
uauaacuauguugaua

SEQ ID NO: 1379584 - RNA, 18 nt, Homo sapiens
uauaacuauguugauaaa

SEQ ID NO: 1379585 - RNA, 20 nt, Homo sapiens
uauaagcagauuuaacaauu

SEQ ID NO: 1379586 - RNA, 14 nt, Homo sapiens
uauaaugguugacu

SEQ ID NO: 1379587 - RNA, 14 nt, Homo sapiens
uauacaauauacuu

SEQ ID NO: 1379588 - RNA, 21 nt, Homo sapiens
uauacacuauuugugagcaaa

SEQ ID NO: 1379589 - RNA, 11 nt, Homo sapiens
uauacagcuca

SEQ ID NO: 1379590 - RNA, 12 nt, Homo sapiens
uauacauuugau

SEQ ID NO: 1379591 - RNA, 21 nt, Homo sapiens
uauaccgcuaucauuccaaag

SEQ ID NO: 1379592 - RNA, 15 nt, Homo sapiens
uauacuguacuuaau

SEQ ID NO: 1379593 - RNA, 21 nt, Homo sapiens
uauagaaggguaccuugaaca

SEQ ID NO: 1379594 - RNA, 15 nt, Homo sapiens
uauagacaaauaaua

SEQ ID NO: 1379595 - RNA, 15 nt, Homo sapiens
uauagaucacauaac

SEQ ID NO: 1379596 - RNA, 16 nt, Homo sapiens
uauagaucagccagug

SEQ ID NO: 1379597 - RNA, 21 nt, Homo sapiens
uauagcgauugaaagggcaau

SEQ ID NO: 1379598 - RNA, 13 nt, Homo sapiens
uauauaccaagcu

SEQ ID NO: 1379599 - RNA, 17 nt, Homo sapiens
uauauauuuuguguaua

SEQ ID NO: 1379600 - RNA, 16 nt, Homo sapiens
uauaucaguaucugag

SEQ ID NO: 1379601 - RNA, 13 nt, Homo sapiens
uauaucaguccuc

SEQ ID NO: 1379602 - RNA, 15 nt, Homo sapiens
uauauccauguacug

SEQ ID NO: 1379603 - RNA, 14 nt, Homo sapiens
uauaucgaucucuu

SEQ ID NO: 1379604 - RNA, 16 nt, Homo sapiens
uauaucugaagagcua

SEQ ID NO: 1379605 - RNA, 21 nt, Homo sapiens
uauaugacuucagaaauguua

SEQ ID NO: 1379606 - RNA, 11 nt, Homo sapiens
uauaugcucug

SEQ ID NO: 1379607 - RNA, 14 nt, Homo sapiens
uauauggggggcca

SEQ ID NO: 1379608 - RNA, 18 nt, Homo sapiens
uauauguagaguguuuua

SEQ ID NO: 1379609 - RNA, 17 nt, Homo sapiens
uauaugucaucucagug

SEQ ID NO: 1379610 - RNA, 16 nt, Homo sapiens
uauauguugaaugaca

SEQ ID NO: 1379611 - RNA, 14 nt, Homo sapiens
uauauucaagguua

SEQ ID NO: 1379612 - RNA, 13 nt, Homo sapiens
uaucaaacagcuc

SEQ ID NO: 1379613 - RNA, 14 nt, Homo sapiens
uaucacaucacuua

SEQ ID NO: 1379614 - RNA, 18 nt, Homo sapiens
uaucaccucuuaugcaca

SEQ ID NO: 1379615 - RNA, 18 nt, Homo sapiens
uaucagaguauccacugu

SEQ ID NO: 1379616 - RNA, 15 nt, Homo sapiens
uaucaggguauucca

SEQ ID NO: 1379617 - RNA, 14 nt, Homo sapiens
uaucaggugcugcc

SEQ ID NO: 1379618 - RNA, 14 nt, Homo sapiens
uaucagucauaacu

SEQ ID NO: 1379619 - RNA, 11 nt, Homo sapiens
uaucaguuccc

SEQ ID NO: 1379620 - RNA, 21 nt, Homo sapiens
uaucauggaaauauuaugcaa

SEQ ID NO: 1379621 - RNA, 14 nt, Homo sapiens
uauccaacaugugc

SEQ ID NO: 1379622 - RNA, 22 nt, Homo sapiens
uauccaaucuuguuuccaaaaa

SEQ ID NO: 1379623 - RNA, 18 nt, Homo sapiens
ugugcacacacaccacac

SEQ ID NO: 1379624 - RNA, 13 nt, Homo sapiens
ugugcagauauca

SEQ ID NO: 1379625 - RNA, 14 nt, Homo sapiens
ugugcagauaucac

SEQ ID NO: 1379626 - RNA, 18 nt, Homo sapiens
ugugcagcucccauuugg

SEQ ID NO: 1379627 - RNA, 21 nt, Homo sapiens
ugugcaguguugacaguucau

SEQ ID NO: 1379628 - RNA, 18 nt, Homo sapiens
ugugcaugugugugcuca

SEQ ID NO: 1379629 - RNA, 14 nt, Homo sapiens
ugugccaugugcca

SEQ ID NO: 1379630 - RNA, 23 nt, Homo sapiens
ugugcccccugaaacagcugcca

SEQ ID NO: 1379631 - RNA, 14 nt, Homo sapiens
ugugcccucagauu

SEQ ID NO: 1379632 - RNA, 22 nt, Homo sapiens
ugugccuuaggaaaagcauuug

SEQ ID NO: 1379633 - RNA, 15 nt, Homo sapiens
ugugcgugugugcaa

SEQ ID NO: 1379634 - RNA, 20 nt, Homo sapiens
uguggagcagccaacaagca

SEQ ID NO: 1379635 - RNA, 17 nt, Homo sapiens
uguggaugauaaaacac

SEQ ID NO: 1379636 - RNA, 14 nt, Homo sapiens
uguggcagcugucu

SEQ ID NO: 1379637 - RNA, 18 nt, Homo sapiens
uguggccaucaaccucug

SEQ ID NO: 1379638 - RNA, 14 nt, Homo sapiens
uguggccaucugcu

SEQ ID NO: 1379639 - RNA, 20 nt, Homo sapiens
uguggccuucggacaacuca

SEQ ID NO: 1379640 - RNA, 17 nt, Homo sapiens
uguggcucacgugagag

SEQ ID NO: 1379641 - RNA, 17 nt, Homo sapiens
uguggcucacgugugug

SEQ ID NO: 1379642 - RNA, 13 nt, Homo sapiens
ugugggacugaga

SEQ ID NO: 1379643 - RNA, 16 nt, Homo sapiens
ugugggcaggaaguga

SEQ ID NO: 1379644 - RNA, 14 nt, Homo sapiens
uguggguaccugua

SEQ ID NO: 1379645 - RNA, 21 nt, Homo sapiens
uguggucaauccgaaguauga

SEQ ID NO: 1379646 - RNA, 13 nt, Homo sapiens
ugugguugcucac

SEQ ID NO: 1379647 - RNA, 15 nt, Homo sapiens
uguguaacugcccaa

SEQ ID NO: 1379648 - RNA, 16 nt, Homo sapiens
uguguaccuaagggag

SEQ ID NO: 1379649 - RNA, 20 nt, Homo sapiens
uguguaccugugacuaaaca

SEQ ID NO: 1379650 - RNA, 12 nt, Homo sapiens
ugugucagcaua

SEQ ID NO: 1379651 - RNA, 15 nt, Homo sapiens
ugugucaggaaacau

SEQ ID NO: 1379652 - RNA, 18 nt, Homo sapiens
ugugucaggaaacauauu

SEQ ID NO: 1379653 - RNA, 19 nt, Homo sapiens
ugugucaggaaacauauuu

SEQ ID NO: 1379654 - RNA, 17 nt, Homo sapiens
ugugucagggaacauau

SEQ ID NO: 1379655 - RNA, 19 nt, Homo sapiens
uguguccaugugugugcaa

SEQ ID NO: 1379656 - RNA, 15 nt, Homo sapiens
ugugugaguguacca

SEQ ID NO: 1379657 - RNA, 21 nt, Homo sapiens
ugugugagugugugcaaguau

SEQ ID NO: 1379658 - RNA, 20 nt, Homo sapiens
ugugugcaagugugugcaca

SEQ ID NO: 1379659 - RNA, 21 nt, Homo sapiens
ugugugcacguacacacacau

SEQ ID NO: 1379660 - RNA, 15 nt, Homo sapiens
ugugugcgucacugu

SEQ ID NO: 1379661 - RNA, 14 nt, Homo sapiens
ugugugggcuguga

SEQ ID NO: 1379662 - RNA, 12 nt, Homo sapiens
uguguguagcca

SEQ ID NO: 1379663 - RNA, 19 nt, Homo sapiens
uguguguauguuugcacac

SEQ ID NO: 1379664 - RNA, 15 nt, Homo sapiens
ugugugugcaagugu

SEQ ID NO: 1379665 - RNA, 14 nt, Homo sapiens
ugugugugugcaag

SEQ ID NO: 1379666 - RNA, 19 nt, Homo sapiens
uguguucucuauugcugcu

SEQ ID NO: 1379667 - RNA, 17 nt, Homo sapiens
uguguuggcuguggcag

SEQ ID NO: 1379668 - RNA, 21 nt, Homo sapiens
uguguuuccuucagugcaucu

SEQ ID NO: 1379669 - RNA, 19 nt, Homo sapiens
uguguuuuguuuuguauca

SEQ ID NO: 1379670 - RNA, 14 nt, Homo sapiens
uguguuuuucacau

SEQ ID NO: 1379671 - RNA, 13 nt, Homo sapiens
uguuaaaauaacu

SEQ ID NO: 1379672 - RNA, 13 nt, Homo sapiens
uguuaaguugaug

SEQ ID NO: 1379673 - RNA, 14 nt, Homo sapiens
uguuacacaugaca

SEQ ID NO: 1379674 - RNA, 15 nt, Homo sapiens
uguuaccuccuauaa

SEQ ID NO: 1379675 - RNA, 18 nt, Homo sapiens
uguuacugccuaucagca

SEQ ID NO: 1379676 - RNA, 20 nt, Homo sapiens
uguuagaacacuauuuucag

SEQ ID NO: 1379677 - RNA, 16 nt, Homo sapiens
uguuagcauaauguga

SEQ ID NO: 1379678 - RNA, 14 nt, Homo sapiens
uguuaucagucaua

SEQ ID NO: 1379679 - RNA, 21 nt, Homo sapiens
uguuaugcaucauuucaggag

SEQ ID NO: 1379680 - RNA, 20 nt, Homo sapiens
uguuauuauaaaaguacuag

SEQ ID NO: 1379681 - RNA, 14 nt, Homo sapiens
uguuauuauauaau

SEQ ID NO: 1379682 - RNA, 22 nt, Homo sapiens
uguuauuuucuguugaaguuua

SEQ ID NO: 1379683 - RNA, 22 nt, Homo sapiens
uguucaaagucaaauaacuccu

SEQ ID NO: 1379684 - RNA, 15 nt, Homo sapiens
uguucauguuacuca

SEQ ID NO: 1379685 - RNA, 14 nt, Homo sapiens
uguuccccacugac

SEQ ID NO: 1379686 - RNA, 15 nt, Homo sapiens
uguucccuauuuugc

SEQ ID NO: 1379687 - RNA, 23 nt, Homo sapiens
uguucccuauuuugccaguggga

SEQ ID NO: 1379688 - RNA, 19 nt, Homo sapiens
uguuccuugucacugguag

SEQ ID NO: 1379689 - RNA, 22 nt, Homo sapiens
uguucuaaaaauaaaaguauug

SEQ ID NO: 1379690 - RNA, 19 nt, Homo sapiens
uguucucuauuagacuuua

SEQ ID NO: 1379691 - RNA, 13 nt, Homo sapiens
uguugaacaauag

SEQ ID NO: 1379692 - RNA, 14 nt, Homo sapiens
uguugaaguuuaca

SEQ ID NO: 1379693 - RNA, 14 nt, Homo sapiens
uguugaauaaugcu

SEQ ID NO: 1379694 - RNA, 13 nt, Homo sapiens
uguugacauccaa

SEQ ID NO: 1379695 - RNA, 17 nt, Homo sapiens
uguugacauccaagcuu

SEQ ID NO: 1379696 - RNA, 21 nt, Homo sapiens
uguugcccaggcuggucucaa

SEQ ID NO: 1379697 - RNA, 14 nt, Homo sapiens
uguugcccagguug

SEQ ID NO: 1379698 - RNA, 22 nt, Homo sapiens
uguugcugagucugcagaugag

SEQ ID NO: 1379699 - RNA, 15 nt, Homo sapiens
uguugcugcaucucc

SEQ ID NO: 1379700 - RNA, 23 nt, Homo sapiens
uguugcugcaucuccccucagau

SEQ ID NO: 1379701 - RNA, 21 nt, Homo sapiens
uguugcuggacugucauagaa

SEQ ID NO: 1379702 - RNA, 20 nt, Homo sapiens
uguugggauuauaggaguga

SEQ ID NO: 1379703 - RNA, 19 nt, Homo sapiens
uguuguggucugagccaaa

SEQ ID NO: 1379704 - RNA, 15 nt, Homo sapiens
uguuguuauucagaa

SEQ ID NO: 1379705 - RNA, 18 nt, Homo sapiens
uguuguuuucccaaagag

SEQ ID NO: 1379706 - RNA, 19 nt, Homo sapiens
uguuuaagaaaaaauaaca

SEQ ID NO: 1379707 - RNA, 13 nt, Homo sapiens
uguuuacccagua

SEQ ID NO: 1379708 - RNA, 13 nt, Homo sapiens
uguuuauuacuua

SEQ ID NO: 1379709 - RNA, 17 nt, Homo sapiens
uguuucaggaggcugga

SEQ ID NO: 1379710 - RNA, 14 nt, Homo sapiens
uguuuccacauuca

SEQ ID NO: 1379711 - RNA, 14 nt, Homo sapiens
uguuucccguauug

SEQ ID NO: 1379712 - RNA, 14 nt, Homo sapiens
uguuucugaucuga

SEQ ID NO: 1379713 - RNA, 16 nt, Homo sapiens
uguuugcauguggcca

SEQ ID NO: 1379714 - RNA, 18 nt, Homo sapiens
uguuuggguauccugccc

SEQ ID NO: 1379715 - RNA, 14 nt, Homo sapiens
uguuuuccuauaau

SEQ ID NO: 1379716 - RNA, 15 nt, Homo sapiens
uguuuuguacuuuag

SEQ ID NO: 1379717 - RNA, 23 nt, Homo sapiens
uguuuuuacccugccccugccuu

SEQ ID NO: 1379718 - RNA, 19 nt, Homo sapiens
uuaaaaaauaaaaacugac

SEQ ID NO: 1379719 - RNA, 20 nt, Homo sapiens
uuaaaagccaucaaacacaa

SEQ ID NO: 1379720 - RNA, 16 nt, Homo sapiens
uuaaaauagccauaaa

SEQ ID NO: 1379721 - RNA, 21 nt, Homo sapiens
uuaaacccuauugguaaagaa

SEQ ID NO: 1379722 - RNA, 20 nt, Homo sapiens
uuaaacugaaugaacaaccu

SEQ ID NO: 1379723 - RNA, 12 nt, Homo sapiens
uuaaacuuucaa

SEQ ID NO: 1379724 - RNA, 15 nt, Homo sapiens
uuaaauuucaucuca

SEQ ID NO: 1379725 - RNA, 10 nt, Homo sapiens
uuaacuauug

SEQ ID NO: 1379726 - RNA, 22 nt, Homo sapiens
uuaacuggcuucagccucccca

SEQ ID NO: 1379727 - RNA, 15 nt, Homo sapiens
uuaacuuaacauucu

SEQ ID NO: 1379728 - RNA, 21 nt, Homo sapiens
uuaacuuccaauuuacauacu

SEQ ID NO: 1379729 - RNA, 20 nt, Homo sapiens
uuaacuuugcuuaaacuaca

SEQ ID NO: 1379730 - RNA, 13 nt, Homo sapiens
uuaagaaaauaca

SEQ ID NO: 1379731 - RNA, 16 nt, Homo sapiens
uuaagaaccugaauau

SEQ ID NO: 1379732 - RNA, 17 nt, Homo sapiens
uuaagaaugucgauuaa

SEQ ID NO: 1379733 - RNA, 15 nt, Homo sapiens
uuaagauaugauguc

SEQ ID NO: 1379734 - RNA, 14 nt, Homo sapiens
uuaagcaucacaaa

SEQ ID NO: 1379735 - RNA, 19 nt, Homo sapiens
uuaagcuuccgccgucuca

SEQ ID NO: 1379736 - RNA, 21 nt, Homo sapiens
uuaagcuuccgccgucucaac

SEQ ID NO: 1379737 - RNA, 15 nt, Homo sapiens
uuaaggauugugaua

SEQ ID NO: 1379738 - RNA, 13 nt, Homo sapiens
uuaaggucucucu

SEQ ID NO: 1379739 - RNA, 18 nt, Homo sapiens
uuaaguccuacuuuacau

SEQ ID NO: 1379740 - RNA, 19 nt, Homo sapiens
uuaaguugauggugaugaa

SEQ ID NO: 1379741 - RNA, 20 nt, Homo sapiens
uuaaguugauggugaugaaa

SEQ ID NO: 1379742 - RNA, 13 nt, Homo sapiens
uuaauacaaagaa

SEQ ID NO: 1379743 - RNA, 18 nt, Homo sapiens
uuaauaggaaaaacggaa

SEQ ID NO: 1379744 - RNA, 15 nt, Homo sapiens
uuaaucaugagauaa

SEQ ID NO: 1379745 - RNA, 17 nt, Homo sapiens
uuaaucguacauuuuca

SEQ ID NO: 1379746 - RNA, 16 nt, Homo sapiens
uuaaucuugcuuucuu

SEQ ID NO: 1379747 - RNA, 12 nt, Homo sapiens
uuaaugagauag

SEQ ID NO: 1379748 - RNA, 20 nt, Homo sapiens
uuaauggcucaugaccugga

SEQ ID NO: 1379749 - RNA, 23 nt, Homo sapiens
uuaauggguuuuguguacuguaa

SEQ ID NO: 1379750 - RNA, 17 nt, Homo sapiens
uuacaaaccucaagcca

SEQ ID NO: 1379751 - RNA, 13 nt, Homo sapiens
uuacaauugugag

SEQ ID NO: 1379752 - RNA, 15 nt, Homo sapiens
uuacacaucuuccac

SEQ ID NO: 1379753 - RNA, 21 nt, Homo sapiens
uuacacuugggauugucuuac

SEQ ID NO: 1379754 - RNA, 20 nt, Homo sapiens
uuacagagaggagaaacaca

SEQ ID NO: 1379755 - RNA, 12 nt, Homo sapiens
uuacagugcaga

SEQ ID NO: 1379756 - RNA, 19 nt, Homo sapiens
uuacaguuuaucuauggca

SEQ ID NO: 1379757 - RNA, 14 nt, Homo sapiens
uuacauucaucuca

SEQ ID NO: 1379758 - RNA, 20 nt, Homo sapiens
uuaccagacgguucaccagc

SEQ ID NO: 1379759 - RNA, 21 nt, Homo sapiens
uuacccuucugugcccagcuc

SEQ ID NO: 1379760 - RNA, 16 nt, Homo sapiens
uuaccgugggcacuga

SEQ ID NO: 1379761 - RNA, 14 nt, Homo sapiens
uuaccuaguacaag

SEQ ID NO: 1379762 - RNA, 15 nt, Homo sapiens
uuaccucacagugau

SEQ ID NO: 1379763 - RNA, 20 nt, Homo sapiens
uuacuacaugugggagcuuu

SEQ ID NO: 1379764 - RNA, 14 nt, Homo sapiens
uuacuaucauguca

SEQ ID NO: 1379765 - RNA, 16 nt, Homo sapiens
uuacuaucaugucaaa

SEQ ID NO: 1379766 - RNA, 23 nt, Homo sapiens
uuacucaaggaauuugcauuuag

SEQ ID NO: 1379767 - RNA, 16 nt, Homo sapiens
uuacucaugacuccuu

SEQ ID NO: 1379768 - RNA, 15 nt, Homo sapiens
uuacuguccaaagac

SEQ ID NO: 1379769 - RNA, 12 nt, Homo sapiens
uuacugucuuaa

SEQ ID NO: 1379770 - RNA, 15 nt, Homo sapiens
uuacuuaaaggaaua

SEQ ID NO: 1379771 - RNA, 13 nt, Homo sapiens
uuagaaaaaccac

SEQ ID NO: 1379772 - RNA, 19 nt, Homo sapiens
uuagaaauaaagcaucuca

SEQ ID NO: 1379773 - RNA, 15 nt, Homo sapiens
uuagaaauugcauuu

SEQ ID NO: 1379774 - RNA, 14 nt, Homo sapiens
uuagaagucacaca

SEQ ID NO: 1379775 - RNA, 21 nt, Homo sapiens
uuagaaugaugcacauuucau

SEQ ID NO: 1379776 - RNA, 20 nt, Homo sapiens
uuagaccaagcuuguccaac

SEQ ID NO: 1379777 - RNA, 13 nt, Homo sapiens
uuagacuugaaau

SEQ ID NO: 1379778 - RNA, 22 nt, Homo sapiens
uuagauacagagacuuggggaa

SEQ ID NO: 1379779 - RNA, 22 nt, Homo sapiens
uuagauugaguaagauuuaccc

SEQ ID NO: 1379780 - RNA, 21 nt, Homo sapiens
uuagcaugaauccuacauaca

SEQ ID NO: 1379781 - RNA, 15 nt, Homo sapiens
uuagcaugcacaaag

SEQ ID NO: 1379782 - RNA, 17 nt, Homo sapiens
uuagccagguaauguga

SEQ ID NO: 1379783 - RNA, 20 nt, Homo sapiens
uuagccaucuugaagugaug

SEQ ID NO: 1379784 - RNA, 13 nt, Homo sapiens
uuagcuaccucac

SEQ ID NO: 1379785 - RNA, 15 nt, Homo sapiens
uuagcuguccccuga

SEQ ID NO: 1379786 - RNA, 15 nt, Homo sapiens
uuagcugucugcuca

SEQ ID NO: 1379787 - RNA, 17 nt, Homo sapiens
uuagcuuagaccucagc

SEQ ID NO: 1379788 - RNA, 12 nt, Homo sapiens
uuagcuuuacaa

SEQ ID NO: 1379789 - RNA, 13 nt, Homo sapiens
uuaggacuuucca

SEQ ID NO: 1379790 - RNA, 13 nt, Homo sapiens
uuaguaacauuca

SEQ ID NO: 1379791 - RNA, 14 nt, Homo sapiens
uuaguaacauucau

SEQ ID NO: 1379792 - RNA, 14 nt, Homo sapiens
uuaguauaaguaca

SEQ ID NO: 1379793 - RNA, 20 nt, Homo sapiens
uuaguuuacaaucagccaca

SEQ ID NO: 1379794 - RNA, 15 nt, Homo sapiens
uuauaaaagaugcau

SEQ ID NO: 1379795 - RNA, 17 nt, Homo sapiens
uuauaaaagaugcauua

SEQ ID NO: 1379796 - RNA, 16 nt, Homo sapiens
uuauaaaauuaagcaa

SEQ ID NO: 1379797 - RNA, 15 nt, Homo sapiens
uuauaacccagugag

SEQ ID NO: 1379798 - RNA, 14 nt, Homo sapiens
uuauaagcauguau

SEQ ID NO: 1379799 - RNA, 14 nt, Homo sapiens
uuauacauggguag

SEQ ID NO: 1379800 - RNA, 18 nt, Homo sapiens
uuauagccgaaaugaucu

SEQ ID NO: 1379801 - RNA, 16 nt, Homo sapiens
uuauauauguaucuaa

SEQ ID NO: 1379802 - RNA, 18 nt, Homo sapiens
uuauaugaacauagacua

SEQ ID NO: 1379803 - RNA, 14 nt, Homo sapiens
uuauauuucacuau

SEQ ID NO: 1379804 - RNA, 19 nt, Homo sapiens
uuaucaaucucuaguuguc

SEQ ID NO: 1379805 - RNA, 20 nt, Homo sapiens
uuaucaauguucuaguucug

SEQ ID NO: 1379806 - RNA, 17 nt, Homo sapiens
uuaucaccaugcaaugc

SEQ ID NO: 1379807 - RNA, 17 nt, Homo sapiens
uuaucagaauucucaga

SEQ ID NO: 1379808 - RNA, 14 nt, Homo sapiens
uuaucagucauaac

SEQ ID NO: 1379809 - RNA, 18 nt, Homo sapiens
uuaucccagugaucaccu

SEQ ID NO: 1379810 - RNA, 17 nt, Homo sapiens
uuauccuaucucuccaa

SEQ ID NO: 1379811 - RNA, 18 nt, Homo sapiens
uuaucgggagcagugucu

SEQ ID NO: 1379812 - RNA, 13 nt, Homo sapiens
uuaucuauggcac

SEQ ID NO: 1379813 - RNA, 15 nt, Homo sapiens
uuaucuggcuucaaa

SEQ ID NO: 1379814 - RNA, 23 nt, Homo sapiens
uuaucugugcgugaaacacacca

SEQ ID NO: 1379815 - RNA, 16 nt, Homo sapiens
uuaucuuaaaacuccu

SEQ ID NO: 1379816 - RNA, 22 nt, Homo sapiens
uuaugaagcaagccccacuuau

SEQ ID NO: 1379817 - RNA, 16 nt, Homo sapiens
uuaugacagugaacau

SEQ ID NO: 1379818 - RNA, 23 nt, Homo sapiens
uuaugccauagcaagauugcuua

SEQ ID NO: 1379819 - RNA, 21 nt, Homo sapiens
uuaugccuucacuuuacaaau

SEQ ID NO: 1379820 - RNA, 23 nt, Homo sapiens
uuauggaaggacuacagcagcau

SEQ ID NO: 1379821 - RNA, 16 nt, Homo sapiens
uuauguaauaauguga

SEQ ID NO: 1379822 - RNA, 17 nt, Homo sapiens
uuauguauuuaugaccu

SEQ ID NO: 1379823 - RNA, 14 nt, Homo sapiens
uuaugucuauaacu

SEQ ID NO: 1379824 - RNA, 16 nt, Homo sapiens
uuaugucucagaccac

SEQ ID NO: 1379825 - RNA, 14 nt, Homo sapiens
uuaugucugcugaa

SEQ ID NO: 1379826 - RNA, 20 nt, Homo sapiens
uuaugugagagaaaguguga

SEQ ID NO: 1379827 - RNA, 12 nt, Homo sapiens
aaacaggccagg

SEQ ID NO: 1379828 - RNA, 12 nt, Homo sapiens
aaacaggucaau

SEQ ID NO: 1379829 - RNA, 15 nt, Homo sapiens
aaacaguauugacuu

SEQ ID NO: 1379830 - RNA, 21 nt, Homo sapiens
aaacaguccuucaaacuucca

SEQ ID NO: 1379831 - RNA, 19 nt, Homo sapiens
aaacauaaagagaacucug

SEQ ID NO: 1379832 - RNA, 14 nt, Homo sapiens
aaacaucagcaaaa

SEQ ID NO: 1379833 - RNA, 16 nt, Homo sapiens
aaacauccagauacac

SEQ ID NO: 1379834 - RNA, 17 nt, Homo sapiens
aaacauucaaagagaca

SEQ ID NO: 1379835 - RNA, 21 nt, Homo sapiens
aaacauugaaguaaugaauuu

SEQ ID NO: 1379836 - RNA, 20 nt, Homo sapiens
aaacauuguuuuguguaaca

SEQ ID NO: 1379837 - RNA, 16 nt, Homo sapiens
aaaccaaauauuccag

SEQ ID NO: 1379838 - RNA, 19 nt, Homo sapiens
aaaccaagccguggcuucc

SEQ ID NO: 1379839 - RNA, 16 nt, Homo sapiens
aaaccacuagaacucu

SEQ ID NO: 1379840 - RNA, 22 nt, Homo sapiens
aaaccaucauaguacagguaag

SEQ ID NO: 1379841 - RNA, 22 nt, Homo sapiens
aaacccaguaguggugacugug

SEQ ID NO: 1379842 - RNA, 20 nt, Homo sapiens
aaacccccacccuucugccu

SEQ ID NO: 1379843 - RNA, 20 nt, Homo sapiens
aaaccucugggucaucucuc

SEQ ID NO: 1379844 - RNA, 13 nt, Homo sapiens
aaaccuucaguga

SEQ ID NO: 1379845 - RNA, 19 nt, Homo sapiens
aaacgguacacagacuauu

SEQ ID NO: 1379846 - RNA, 20 nt, Homo sapiens
aaacgugcccucuguuugau

SEQ ID NO: 1379847 - RNA, 24 nt, Homo sapiens
aaacuaacacagccaucaagggaa

SEQ ID NO: 1379848 - RNA, 19 nt, Homo sapiens
aaacuacaaacacaagcaa

SEQ ID NO: 1379849 - RNA, 18 nt, Homo sapiens
aaacuagaauuucauuua

SEQ ID NO: 1379850 - RNA, 19 nt, Homo sapiens
aaacuauuggaaaguacuc

SEQ ID NO: 1379851 - RNA, 13 nt, Homo sapiens
aaacucaaaauau

SEQ ID NO: 1379852 - RNA, 17 nt, Homo sapiens
aaacuccuguuucacuu

SEQ ID NO: 1379853 - RNA, 15 nt, Homo sapiens
aaacucuauggguau

SEQ ID NO: 1379854 - RNA, 19 nt, Homo sapiens
aaacugaggcccuugggca

SEQ ID NO: 1379855 - RNA, 19 nt, Homo sapiens
aaacugauuuuuagcuuua

SEQ ID NO: 1379856 - RNA, 17 nt, Homo sapiens
aaacugccuuccacaau

SEQ ID NO: 1379857 - RNA, 21 nt, Homo sapiens
aaacugccuuggcuucagggg

SEQ ID NO: 1379858 - RNA, 15 nt, Homo sapiens
aaacuuaacauucau

SEQ ID NO: 1379859 - RNA, 13 nt, Homo sapiens
aaacuucaauauc

SEQ ID NO: 1379860 - RNA, 19 nt, Homo sapiens
aaacuuccaagaccugacu

SEQ ID NO: 1379861 - RNA, 21 nt, Homo sapiens
aaacuugcauacagagacaga

SEQ ID NO: 1379862 - RNA, 10 nt, Homo sapiens
aaacuuguau

SEQ ID NO: 1379863 - RNA, 21 nt, Homo sapiens
aaacuuugauaggauguggau

SEQ ID NO: 1379864 - RNA, 14 nt, Homo sapiens
aaagaaguggggac

SEQ ID NO: 1379865 - RNA, 14 nt, Homo sapiens
aaagaauacagaaa

SEQ ID NO: 1379866 - RNA, 22 nt, Homo sapiens
aaagaaucccuguucauuguaa

SEQ ID NO: 1379867 - RNA, 17 nt, Homo sapiens
aaagacacuugauacuu

SEQ ID NO: 1379868 - RNA, 20 nt, Homo sapiens
aaagacauucugacaucuua

SEQ ID NO: 1379869 - RNA, 21 nt, Homo sapiens
aaagaccaaauuccuuggcau

SEQ ID NO: 1379870 - RNA, 20 nt, Homo sapiens
aaagacccuaaaucugagga

SEQ ID NO: 1379871 - RNA, 20 nt, Homo sapiens
aaagacuguacaaaguagaa

SEQ ID NO: 1379872 - RNA, 21 nt, Homo sapiens
aaagacuguagaagaaagagc

SEQ ID NO: 1379873 - RNA, 18 nt, Homo sapiens
aaagacuuaacugguuca

SEQ ID NO: 1379874 - RNA, 14 nt, Homo sapiens
aaagagagcacuga

SEQ ID NO: 1379875 - RNA, 22 nt, Homo sapiens
aaagagccucacaguuacguga

SEQ ID NO: 1379876 - RNA, 22 nt, Homo sapiens
aaagaguccuauuugcacugua

SEQ ID NO: 1379877 - RNA, 16 nt, Homo sapiens
aaagauacgacuuuau

SEQ ID NO: 1379878 - RNA, 15 nt, Homo sapiens
aaagauggaugugcu

SEQ ID NO: 1379879 - RNA, 19 nt, Homo sapiens
aaagcaguggacaccagga

SEQ ID NO: 1379880 - RNA, 16 nt, Homo sapiens
aaagcaucaccucagg

SEQ ID NO: 1379881 - RNA, 18 nt, Homo sapiens
aaagcauucaauuuauuc

SEQ ID NO: 1379882 - RNA, 15 nt, Homo sapiens
aaagccaacagucaa

SEQ ID NO: 1379883 - RNA, 21 nt, Homo sapiens
aaagccaccagacugacaaau

SEQ ID NO: 1379884 - RNA, 17 nt, Homo sapiens
aaagccuagaagagcuu

SEQ ID NO: 1379885 - RNA, 18 nt, Homo sapiens
aaagcucccuguccugaa

SEQ ID NO: 1379886 - RNA, 17 nt, Homo sapiens
aaagcugauuacuguca

SEQ ID NO: 1379887 - RNA, 17 nt, Homo sapiens
aaagcugcugacagugu

SEQ ID NO: 1379888 - RNA, 19 nt, Homo sapiens
aaaggaaagauuugccaau

SEQ ID NO: 1379889 - RNA, 21 nt, Homo sapiens
aaaggagccaauugauuucaa

SEQ ID NO: 1379890 - RNA, 16 nt, Homo sapiens
aaaggagggucaggaa

SEQ ID NO: 1379891 - RNA, 17 nt, Homo sapiens
aaagggagcacuggguu

SEQ ID NO: 1379892 - RNA, 22 nt, Homo sapiens
aaagggagcagagaaggccagg

SEQ ID NO: 1379893 - RNA, 19 nt, Homo sapiens
aaaggggcaggagcucaga

SEQ ID NO: 1379894 - RNA, 16 nt, Homo sapiens
aaaggugaaaaaagcu

SEQ ID NO: 1379895 - RNA, 22 nt, Homo sapiens
aaaggugucuucuuugacuuaa

SEQ ID NO: 1379896 - RNA, 16 nt, Homo sapiens
aaagguuacccuguaa

SEQ ID NO: 1379897 - RNA, 16 nt, Homo sapiens
aaagguugaagcacca

SEQ ID NO: 1379898 - RNA, 17 nt, Homo sapiens
aaaguaauuucuucuca

SEQ ID NO: 1379899 - RNA, 14 nt, Homo sapiens
aaaguacaaaaauu

SEQ ID NO: 1379900 - RNA, 14 nt, Homo sapiens
aaaguagcaauuuc

SEQ ID NO: 1379901 - RNA, 19 nt, Homo sapiens
aaaguagguuuacauucau

SEQ ID NO: 1379902 - RNA, 16 nt, Homo sapiens
aaaguauaacugaguu

SEQ ID NO: 1379903 - RNA, 12 nt, Homo sapiens
aaaguaucuaca

SEQ ID NO: 1379904 - RNA, 17 nt, Homo sapiens
aaagucuaaaaccuuaa

SEQ ID NO: 1379905 - RNA, 15 nt, Homo sapiens
aaagucuugugacua

SEQ ID NO: 1379906 - RNA, 15 nt, Homo sapiens
aaagugacuauucag

SEQ ID NO: 1379907 - RNA, 16 nt, Homo sapiens
aaagugauaugcauuu

SEQ ID NO: 1379908 - RNA, 13 nt, Homo sapiens
aaagugcuuuaaa

SEQ ID NO: 1379909 - RNA, 14 nt, Homo sapiens
aaaguggccaugcc

SEQ ID NO: 1379910 - RNA, 17 nt, Homo sapiens
aaaguguugaccacaga

SEQ ID NO: 1379911 - RNA, 12 nt, Homo sapiens
aaaguuaugaaa

SEQ ID NO: 1379912 - RNA, 23 nt, Homo sapiens
aaaguucccuacuuccugugacu

SEQ ID NO: 1379913 - RNA, 14 nt, Homo sapiens
aaauaaaaacccaa

SEQ ID NO: 1379914 - RNA, 16 nt, Homo sapiens
aaauaaaaauauuaaa

SEQ ID NO: 1379915 - RNA, 22 nt, Homo sapiens
aaauaaaguauauauagaaucu

SEQ ID NO: 1379916 - RNA, 14 nt, Homo sapiens
aaauaacagacugu

SEQ ID NO: 1379917 - RNA, 23 nt, Homo sapiens
aaauaacuaaaagguaugcaauc

SEQ ID NO: 1379918 - RNA, 20 nt, Homo sapiens
aaauaagagaaaaaauuaaa

SEQ ID NO: 1379919 - RNA, 14 nt, Homo sapiens
aaauaagagauuug

SEQ ID NO: 1379920 - RNA, 19 nt, Homo sapiens
aaauaauaacaaucacaaa

SEQ ID NO: 1379921 - RNA, 14 nt, Homo sapiens
aaauacacaacaca

SEQ ID NO: 1379922 - RNA, 17 nt, Homo sapiens
aaauacagauagauaua

SEQ ID NO: 1379923 - RNA, 21 nt, Homo sapiens
aaauaccugucaauacuaugg

SEQ ID NO: 1379924 - RNA, 20 nt, Homo sapiens
aaauacgguaaggauacuuu

SEQ ID NO: 1379925 - RNA, 13 nt, Homo sapiens
aaauacugauggu

SEQ ID NO: 1379926 - RNA, 23 nt, Homo sapiens
aaauagggccucacucuguugcu

SEQ ID NO: 1379927 - RNA, 14 nt, Homo sapiens
aaauaguggccaga

SEQ ID NO: 1379928 - RNA, 16 nt, Homo sapiens
aaauauaagagcaaga

SEQ ID NO: 1379929 - RNA, 14 nt, Homo sapiens
aaauauaauugaca

SEQ ID NO: 1379930 - RNA, 22 nt, Homo sapiens
aaauauaauuguuuuuuaucuu

SEQ ID NO: 1379931 - RNA, 13 nt, Homo sapiens
aaauaugaguuuu

SEQ ID NO: 1379932 - RNA, 18 nt, Homo sapiens
aaauaugcaccaaaucau

SEQ ID NO: 1379933 - RNA, 13 nt, Homo sapiens
aaauauuccugca

SEQ ID NO: 1379934 - RNA, 15 nt, Homo sapiens
aaauauuuaugagaa

SEQ ID NO: 1379935 - RNA, 12 nt, Homo sapiens
aaauauuucagg

SEQ ID NO: 1379936 - RNA, 16 nt, Homo sapiens
aaauauuuccuuaaac

SEQ ID NO: 1379937 - RNA, 12 nt, Homo sapiens
aaauauuugaca

SEQ ID NO: 1379938 - RNA, 12 nt, Homo sapiens
aaaucaaaaagg

SEQ ID NO: 1379939 - RNA, 22 nt, Homo sapiens
aaaucaaaaagggaaugcauua

SEQ ID NO: 1379940 - RNA, 12 nt, Homo sapiens
agccuggugggc

SEQ ID NO: 1379941 - RNA, 21 nt, Homo sapiens
agccugugguuacagugcaga

SEQ ID NO: 1379942 - RNA, 15 nt, Homo sapiens
agccuuauuucucau

SEQ ID NO: 1379943 - RNA, 14 nt, Homo sapiens
agccuucauugccu

SEQ ID NO: 1379944 - RNA, 21 nt, Homo sapiens
agccuuccacacucaccucua

SEQ ID NO: 1379945 - RNA, 15 nt, Homo sapiens
agcgagacuccgucu

SEQ ID NO: 1379946 - RNA, 16 nt, Homo sapiens
agcgagcuaugaucgc

SEQ ID NO: 1379947 - RNA, 18 nt, Homo sapiens
agcgcaucaggccuggca

SEQ ID NO: 1379948 - RNA, 21 nt, Homo sapiens
agcgcugcucuuaugccauuu

SEQ ID NO: 1379949 - RNA, 17 nt, Homo sapiens
agcggaaagcagcucaa

SEQ ID NO: 1379950 - RNA, 15 nt, Homo sapiens
agcgugaaucuguau

SEQ ID NO: 1379951 - RNA, 16 nt, Homo sapiens
agcgugugacuacucc

SEQ ID NO: 1379952 - RNA, 15 nt, Homo sapiens
agcuaaagaggcuga

SEQ ID NO: 1379953 - RNA, 13 nt, Homo sapiens
agcuaagccacau

SEQ ID NO: 1379954 - RNA, 19 nt, Homo sapiens
agcuaagugaaaaggucau

SEQ ID NO: 1379955 - RNA, 14 nt, Homo sapiens
agcuacugacuaug

SEQ ID NO: 1379956 - RNA, 19 nt, Homo sapiens
agcuagaggaaccaacccc

SEQ ID NO: 1379957 - RNA, 19 nt, Homo sapiens
agcuagaugugucuuacca

SEQ ID NO: 1379958 - RNA, 16 nt, Homo sapiens
agcuaucucucaguga

SEQ ID NO: 1379959 - RNA, 19 nt, Homo sapiens
agcucaagucuucccugau

SEQ ID NO: 1379960 - RNA, 17 nt, Homo sapiens
agcucacaccugaccaa

SEQ ID NO: 1379961 - RNA, 12 nt, Homo sapiens
agcucaccagcc

SEQ ID NO: 1379962 - RNA, 15 nt, Homo sapiens
agcucagagugccac

SEQ ID NO: 1379963 - RNA, 18 nt, Homo sapiens
agcucagguagcacuuua

SEQ ID NO: 1379964 - RNA, 12 nt, Homo sapiens
agcucaucucag

SEQ ID NO: 1379965 - RNA, 15 nt, Homo sapiens
agcuccacucugacu

SEQ ID NO: 1379966 - RNA, 18 nt, Homo sapiens
agcuccagggccagauga

SEQ ID NO: 1379967 - RNA, 17 nt, Homo sapiens
agcucccucugccugaa

SEQ ID NO: 1379968 - RNA, 18 nt, Homo sapiens
agcuccgcuuucuaccca

SEQ ID NO: 1379969 - RNA, 13 nt, Homo sapiens
agcuccugggaag

SEQ ID NO: 1379970 - RNA, 15 nt, Homo sapiens
agcucgguggaccca

SEQ ID NO: 1379971 - RNA, 19 nt, Homo sapiens
agcucugcuccucucccca

SEQ ID NO: 1379972 - RNA, 18 nt, Homo sapiens
agcucuggugacaccagc

SEQ ID NO: 1379973 - RNA, 14 nt, Homo sapiens
agcucuggugaccu

SEQ ID NO: 1379974 - RNA, 15 nt, Homo sapiens
agcucuguguugcca

SEQ ID NO: 1379975 - RNA, 21 nt, Homo sapiens
agcucuucaggccucccucuc

SEQ ID NO: 1379976 - RNA, 22 nt, Homo sapiens
agcucuucuccauccuaccaca

SEQ ID NO: 1379977 - RNA, 18 nt, Homo sapiens
agcugagaauagaaggaa

SEQ ID NO: 1379978 - RNA, 15 nt, Homo sapiens
agcugagauggaacc

SEQ ID NO: 1379979 - RNA, 22 nt, Homo sapiens
agcugauuucagugcugcugaa

SEQ ID NO: 1379980 - RNA, 14 nt, Homo sapiens
agcugcaccugcca

SEQ ID NO: 1379981 - RNA, 15 nt, Homo sapiens
agcugcaccugccag

SEQ ID NO: 1379982 - RNA, 14 nt, Homo sapiens
agcugccucacuuc

SEQ ID NO: 1379983 - RNA, 13 nt, Homo sapiens
agcuggauuuccu

SEQ ID NO: 1379984 - RNA, 14 nt, Homo sapiens
agcuggcgucuguc

SEQ ID NO: 1379985 - RNA, 17 nt, Homo sapiens
agcugggacuacaggug

SEQ ID NO: 1379986 - RNA, 17 nt, Homo sapiens
agcugggggccaugagc

SEQ ID NO: 1379987 - RNA, 13 nt, Homo sapiens
agcugggggucaa

SEQ ID NO: 1379988 - RNA, 21 nt, Homo sapiens
agcuggguuggaaaacaguau

SEQ ID NO: 1379989 - RNA, 20 nt, Homo sapiens
agcuggugccccacugaauu

SEQ ID NO: 1379990 - RNA, 17 nt, Homo sapiens
agcuguccccugaccca

SEQ ID NO: 1379991 - RNA, 20 nt, Homo sapiens
agcuguccccugacccagag

SEQ ID NO: 1379992 - RNA, 22 nt, Homo sapiens
agcugucucaaaccuccaaaag

SEQ ID NO: 1379993 - RNA, 12 nt, Homo sapiens
agcugucugcuc

SEQ ID NO: 1379994 - RNA, 14 nt, Homo sapiens
agcugugugcaguc

SEQ ID NO: 1379995 - RNA, 18 nt, Homo sapiens
agcuguuuauggccucag

SEQ ID NO: 1379996 - RNA, 22 nt, Homo sapiens
agcuuauaaaaucaaacagaga

SEQ ID NO: 1379997 - RNA, 15 nt, Homo sapiens
agcuucaugccuuug

SEQ ID NO: 1379998 - RNA, 16 nt, Homo sapiens
agcuuccgccgucuca

SEQ ID NO: 1379999 - RNA, 17 nt, Homo sapiens
agcuuccgccgucucaa

SEQ ID NO: 1380000 - RNA, 17 nt, Homo sapiens
agcuucucuccacugaa

SEQ ID NO: 1380001 - RNA, 21 nt, Homo sapiens
agcuucuuaauauaacugccu

SEQ ID NO: 1380002 - RNA, 22 nt, Homo sapiens
agcuuggauggagacuccauga

SEQ ID NO: 1380003 - RNA, 17 nt, Homo sapiens
agcuuugcuucucucuc

SEQ ID NO: 1380004 - RNA, 13 nt, Homo sapiens
agcuuuuuuacac

SEQ ID NO: 1380005 - RNA, 21 nt, Homo sapiens
aggaaaacugagacucagaca

SEQ ID NO: 1380006 - RNA, 15 nt, Homo sapiens
aggaaaauuucacau

SEQ ID NO: 1380007 - RNA, 21 nt, Homo sapiens
aggaaacuagcuuacaugaga

SEQ ID NO: 1380008 - RNA, 12 nt, Homo sapiens
aggaaacuugca

SEQ ID NO: 1380009 - RNA, 22 nt, Homo sapiens
aggaaagaaagagcaucaggaa

SEQ ID NO: 1380010 - RNA, 16 nt, Homo sapiens
aggaacacugcacucu

SEQ ID NO: 1380011 - RNA, 15 nt, Homo sapiens
aggaacauacuucag

SEQ ID NO: 1380012 - RNA, 15 nt, Homo sapiens
aggaagacaauguga

SEQ ID NO: 1380013 - RNA, 22 nt, Homo sapiens
aggaagaucacuuugcucugau

SEQ ID NO: 1380014 - RNA, 20 nt, Homo sapiens
aggaagccucccacgacugc

SEQ ID NO: 1380015 - RNA, 14 nt, Homo sapiens
aggaagcuccaguu

SEQ ID NO: 1380016 - RNA, 14 nt, Homo sapiens
aggaaggaugagca

SEQ ID NO: 1380017 - RNA, 23 nt, Homo sapiens
aggaaggguaagggaaaggaugg

SEQ ID NO: 1380018 - RNA, 19 nt, Homo sapiens
aggaagggucaaaacauuu

SEQ ID NO: 1380019 - RNA, 15 nt, Homo sapiens
aggaauccacucucc

SEQ ID NO: 1380020 - RNA, 18 nt, Homo sapiens
aggaauggaggcucuaau

SEQ ID NO: 1380021 - RNA, 16 nt, Homo sapiens
aggaauuugcauuuag

SEQ ID NO: 1380022 - RNA, 19 nt, Homo sapiens
aggacaccuguacuggaga

SEQ ID NO: 1380023 - RNA, 16 nt, Homo sapiens
aggacaggcagaaaga

SEQ ID NO: 1380024 - RNA, 18 nt, Homo sapiens
aggacauuuuacugcagu

SEQ ID NO: 1380025 - RNA, 13 nt, Homo sapiens
aggaccagagcua

SEQ ID NO: 1380026 - RNA, 23 nt, Homo sapiens
aggaccucugggcuuugauucca

SEQ ID NO: 1380027 - RNA, 17 nt, Homo sapiens
aggacguugaggacuuu

SEQ ID NO: 1380028 - RNA, 19 nt, Homo sapiens
aggacucccuccucaccuc

SEQ ID NO: 1380029 - RNA, 22 nt, Homo sapiens
aggacucccucuaaguggaaua

SEQ ID NO: 1380030 - RNA, 13 nt, Homo sapiens
aggacuggcuuug

SEQ ID NO: 1380031 - RNA, 18 nt, Homo sapiens
aggacuggcuuuguccca

SEQ ID NO: 1380032 - RNA, 17 nt, Homo sapiens
aggacuguugacaucca

SEQ ID NO: 1380033 - RNA, 19 nt, Homo sapiens
aggacuugugucucugugc

SEQ ID NO: 1380034 - RNA, 13 nt, Homo sapiens
aggagaaggugcc

SEQ ID NO: 1380035 - RNA, 15 nt, Homo sapiens
aggagacucaccucu

SEQ ID NO: 1380036 - RNA, 22 nt, Homo sapiens
aggagaggggcagaacagccgc

SEQ ID NO: 1380037 - RNA, 17 nt, Homo sapiens
aggagagucuugcagug

SEQ ID NO: 1380038 - RNA, 19 nt, Homo sapiens
aggaggcuuggaaagcauc

SEQ ID NO: 1380039 - RNA, 18 nt, Homo sapiens
aggagggcagaucacuuc

SEQ ID NO: 1380040 - RNA, 22 nt, Homo sapiens
aggaggggaggaacacugcacu

SEQ ID NO: 1380041 - RNA, 20 nt, Homo sapiens
aggagguggaggcugcagug

SEQ ID NO: 1380042 - RNA, 20 nt, Homo sapiens
aggaguacaccccaacagca

SEQ ID NO: 1380043 - RNA, 17 nt, Homo sapiens
aggagugccacuucaug

SEQ ID NO: 1380044 - RNA, 14 nt, Homo sapiens
aggaguuacuggau

SEQ ID NO: 1380045 - RNA, 22 nt, Homo sapiens
aggaguucucaucccucuguca

SEQ ID NO: 1380046 - RNA, 22 nt, Homo sapiens
aggaguuguuucugacccacug

SEQ ID NO: 1380047 - RNA, 18 nt, Homo sapiens
aggaguuugagaccaacc

SEQ ID NO: 1380048 - RNA, 17 nt, Homo sapiens
aggauauuuucuuccaa

SEQ ID NO: 1380049 - RNA, 18 nt, Homo sapiens
aggaucacuugagcccag

SEQ ID NO: 1380050 - RNA, 13 nt, Homo sapiens
aggaucagaaagu

SEQ ID NO: 1380051 - RNA, 22 nt, Homo sapiens
aggaucagaaaguaauuucuuc

SEQ ID NO: 1380052 - RNA, 17 nt, Homo sapiens
aggaucuuuugaaccca

SEQ ID NO: 1380053 - RNA, 17 nt, Homo sapiens
aggugucuggacauuca

SEQ ID NO: 1380054 - RNA, 16 nt, Homo sapiens
aggugugaacagggaa

SEQ ID NO: 1380055 - RNA, 16 nt, Homo sapiens
agguugggagccaaau

SEQ ID NO: 1380056 - RNA, 18 nt, Homo sapiens
agguugucugaagucacu

SEQ ID NO: 1380057 - RNA, 17 nt, Homo sapiens
agguuuaggucaagaag

SEQ ID NO: 1380058 - RNA, 22 nt, Homo sapiens
agguuuuuggucugacccacug

SEQ ID NO: 1380059 - RNA, 19 nt, Homo sapiens
aguaaaaacuguucucuau

SEQ ID NO: 1380060 - RNA, 21 nt, Homo sapiens
aguaaaaagcuuacuaaagca

SEQ ID NO: 1380061 - RNA, 15 nt, Homo sapiens
aguaaaacuguggua

SEQ ID NO: 1380062 - RNA, 17 nt, Homo sapiens
aguaaauauuucaggca

SEQ ID NO: 1380063 - RNA, 20 nt, Homo sapiens
aguaaccuuucaaucaaaac

SEQ ID NO: 1380064 - RNA, 19 nt, Homo sapiens
aguaacuugucuuaaauaa

SEQ ID NO: 1380065 - RNA, 10 nt, Homo sapiens
aguaagccac

SEQ ID NO: 1380066 - RNA, 22 nt, Homo sapiens
aguaaguuugauuucauuaaua

SEQ ID NO: 1380067 - RNA, 20 nt, Homo sapiens
aguaaucugaucguucuuuc

SEQ ID NO: 1380068 - RNA, 13 nt, Homo sapiens
aguaaugaugucg

SEQ ID NO: 1380069 - RNA, 16 nt, Homo sapiens
aguaauguuaauucuu

SEQ ID NO: 1380070 - RNA, 17 nt, Homo sapiens
aguaauuauuuucuucc

SEQ ID NO: 1380071 - RNA, 21 nt, Homo sapiens
aguaauuauuuucuuccuuuc

SEQ ID NO: 1380072 - RNA, 16 nt, Homo sapiens
aguaauuucuucucaa

SEQ ID NO: 1380073 - RNA, 18 nt, Homo sapiens
aguacaaacacaggauuu

SEQ ID NO: 1380074 - RNA, 21 nt, Homo sapiens
aguacaccccaacagcacccu

SEQ ID NO: 1380075 - RNA, 17 nt, Homo sapiens
aguacaggcagcacaga

SEQ ID NO: 1380076 - RNA, 17 nt, Homo sapiens
aguacccaccugagcuu

SEQ ID NO: 1380077 - RNA, 21 nt, Homo sapiens
aguacccaccugagcuuugga

SEQ ID NO: 1380078 - RNA, 15 nt, Homo sapiens
aguacuccugcaaaa

SEQ ID NO: 1380079 - RNA, 17 nt, Homo sapiens
aguacuuaaaacuguaa

SEQ ID NO: 1380080 - RNA, 17 nt, Homo sapiens
aguagaauugauuuccc

SEQ ID NO: 1380081 - RNA, 14 nt, Homo sapiens
aguagcugggacua

SEQ ID NO: 1380082 - RNA, 20 nt, Homo sapiens
aguagcugggacuacaggca

SEQ ID NO: 1380083 - RNA, 13 nt, Homo sapiens
aguaggugcuuga

SEQ ID NO: 1380084 - RNA, 16 nt, Homo sapiens
aguagguuuacauuca

SEQ ID NO: 1380085 - RNA, 23 nt, Homo sapiens
aguaguugggauuaccaguagau

SEQ ID NO: 1380086 - RNA, 18 nt, Homo sapiens
aguauaacugaguuaaau

SEQ ID NO: 1380087 - RNA, 15 nt, Homo sapiens
aguauacaagauaag

SEQ ID NO: 1380088 - RNA, 13 nt, Homo sapiens
aguauacaugacu

SEQ ID NO: 1380089 - RNA, 14 nt, Homo sapiens
aguauauauagaau

SEQ ID NO: 1380090 - RNA, 21 nt, Homo sapiens
aguauauucaaccaaauacuu

SEQ ID NO: 1380091 - RNA, 16 nt, Homo sapiens
aguaucugaggcacau

SEQ ID NO: 1380092 - RNA, 14 nt, Homo sapiens
aguauguaugugua

SEQ ID NO: 1380093 - RNA, 21 nt, Homo sapiens
aguauuauaggccaaacuggc

SEQ ID NO: 1380094 - RNA, 15 nt, Homo sapiens
aguauuguggcugca

SEQ ID NO: 1380095 - RNA, 16 nt, Homo sapiens
aguauuugcauauucu

SEQ ID NO: 1380096 - RNA, 17 nt, Homo sapiens
agucaaaaggugccugu

SEQ ID NO: 1380097 - RNA, 14 nt, Homo sapiens
agucaacagugaaa

SEQ ID NO: 1380098 - RNA, 15 nt, Homo sapiens
agucaacagugaaau

SEQ ID NO: 1380099 - RNA, 13 nt, Homo sapiens
agucaccaggaau

SEQ ID NO: 1380100 - RNA, 17 nt, Homo sapiens
agucacucaucucagaa

SEQ ID NO: 1380101 - RNA, 20 nt, Homo sapiens
agucacuuauaauuaugcua

SEQ ID NO: 1380102 - RNA, 16 nt, Homo sapiens
agucaguaauugccaa

SEQ ID NO: 1380103 - RNA, 14 nt, Homo sapiens
agucaucucaacca

SEQ ID NO: 1380104 - RNA, 18 nt, Homo sapiens
agucaucuccaucagcug

SEQ ID NO: 1380105 - RNA, 18 nt, Homo sapiens
agucaucuugaccaagca

SEQ ID NO: 1380106 - RNA, 20 nt, Homo sapiens
agucaugaagcccaagugaa

SEQ ID NO: 1380107 - RNA, 21 nt, Homo sapiens
aguccagccuggcaaggguuc

SEQ ID NO: 1380108 - RNA, 12 nt, Homo sapiens
aguccagucucu

SEQ ID NO: 1380109 - RNA, 16 nt, Homo sapiens
aguccaucuucuuuau

SEQ ID NO: 1380110 - RNA, 18 nt, Homo sapiens
agucccagcuacucagga

SEQ ID NO: 1380111 - RNA, 19 nt, Homo sapiens
aguccuuucuaaguauuuu

SEQ ID NO: 1380112 - RNA, 16 nt, Homo sapiens
agucucacuguugccc

SEQ ID NO: 1380113 - RNA, 22 nt, Homo sapiens
agucucacuuuuauugauaaaa

SEQ ID NO: 1380114 - RNA, 20 nt, Homo sapiens
agucuccauuguuuugccuu

SEQ ID NO: 1380115 - RNA, 20 nt, Homo sapiens
agucucuucuaagcaaaauu

SEQ ID NO: 1380116 - RNA, 19 nt, Homo sapiens
agucugauuaaagguggug

SEQ ID NO: 1380117 - RNA, 17 nt, Homo sapiens
agucugauucccaagcu

SEQ ID NO: 1380118 - RNA, 14 nt, Homo sapiens
agucugcauuacau

SEQ ID NO: 1380119 - RNA, 17 nt, Homo sapiens
agucuugaaacaagcaa

SEQ ID NO: 1380120 - RNA, 21 nt, Homo sapiens
agugaaaagucucccuuucca

SEQ ID NO: 1380121 - RNA, 16 nt, Homo sapiens
agugaaagccagauuc

SEQ ID NO: 1380122 - RNA, 14 nt, Homo sapiens
agugaacauucuga

SEQ ID NO: 1380123 - RNA, 17 nt, Homo sapiens
agugaaggcuguccuua

SEQ ID NO: 1380124 - RNA, 11 nt, Homo sapiens
agugacagagg

SEQ ID NO: 1380125 - RNA, 21 nt, Homo sapiens
agugacaucucuuugauguca

SEQ ID NO: 1380126 - RNA, 22 nt, Homo sapiens
agugaccccugaccucacugug

SEQ ID NO: 1380127 - RNA, 23 nt, Homo sapiens
agugaccccugaccucacuguga

SEQ ID NO: 1380128 - RNA, 13 nt, Homo sapiens
agugagagggcau

SEQ ID NO: 1380129 - RNA, 17 nt, Homo sapiens
agugagcuccuaagcca

SEQ ID NO: 1380130 - RNA, 15 nt, Homo sapiens
agugagggucagaga

SEQ ID NO: 1380131 - RNA, 22 nt, Homo sapiens
agugagggucuucuuacaugca

SEQ ID NO: 1380132 - RNA, 23 nt, Homo sapiens
agugaguauaacucuaacugaug

SEQ ID NO: 1380133 - RNA, 18 nt, Homo sapiens
agugauccuccugccuca

SEQ ID NO: 1380134 - RNA, 13 nt, Homo sapiens
agugauucuugcu

SEQ ID NO: 1380135 - RNA, 19 nt, Homo sapiens
agugauuuuuauccaaucu

SEQ ID NO: 1380136 - RNA, 14 nt, Homo sapiens
agugcaacacugaa

SEQ ID NO: 1380137 - RNA, 17 nt, Homo sapiens
agugcacccacucugcu

SEQ ID NO: 1380138 - RNA, 16 nt, Homo sapiens
agugcagcaaccagag

SEQ ID NO: 1380139 - RNA, 14 nt, Homo sapiens
agugcaucucagcc

SEQ ID NO: 1380140 - RNA, 17 nt, Homo sapiens
agugccaugggggcaac

SEQ ID NO: 1380141 - RNA, 19 nt, Homo sapiens
agugccauugucuuuauau

SEQ ID NO: 1380142 - RNA, 22 nt, Homo sapiens
agugccauugucuuuauaugaa

SEQ ID NO: 1380143 - RNA, 17 nt, Homo sapiens
agugcccaacuguuaua

SEQ ID NO: 1380144 - RNA, 16 nt, Homo sapiens
agugccguaacaacug

SEQ ID NO: 1380145 - RNA, 14 nt, Homo sapiens
agugccuuuaguuu

SEQ ID NO: 1380146 - RNA, 18 nt, Homo sapiens
agugccuuucuucucucc

SEQ ID NO: 1380147 - RNA, 15 nt, Homo sapiens
agugcugaccagaca

SEQ ID NO: 1380148 - RNA, 20 nt, Homo sapiens
agugcugcuggaaguagaau

SEQ ID NO: 1380149 - RNA, 23 nt, Homo sapiens
aguggaggugcugcauugccugc

SEQ ID NO: 1380150 - RNA, 18 nt, Homo sapiens
aguggcaugugcugugac

SEQ ID NO: 1380151 - RNA, 14 nt, Homo sapiens
aguggccaugccac

SEQ ID NO: 1380152 - RNA, 20 nt, Homo sapiens
aguggccaugccacccuguu

SEQ ID NO: 1380153 - RNA, 18 nt, Homo sapiens
aguggcuaccuacauaca

SEQ ID NO: 1380154 - RNA, 20 nt, Homo sapiens
aguggcuaccuacauacaau

SEQ ID NO: 1380155 - RNA, 22 nt, Homo sapiens
agugggcauggagccagugccu

SEQ ID NO: 1380156 - RNA, 13 nt, Homo sapiens
agugggugaauaa

SEQ ID NO: 1380157 - RNA, 17 nt, Homo sapiens
agugggugucucugcau

SEQ ID NO: 1380158 - RNA, 21 nt, Homo sapiens
aguggugcgaucuggguucac

SEQ ID NO: 1380159 - RNA, 16 nt, Homo sapiens
agugguuucagcaaua

SEQ ID NO: 1380160 - RNA, 17 nt, Homo sapiens
aguguaacauaugcaaa

SEQ ID NO: 1380161 - RNA, 20 nt, Homo sapiens
aguguagaaaagaacuggaa

SEQ ID NO: 1380162 - RNA, 15 nt, Homo sapiens
aguguagguaucauu

SEQ ID NO: 1380163 - RNA, 17 nt, Homo sapiens
aguguaugcacgugugc

SEQ ID NO: 1380164 - RNA, 23 nt, Homo sapiens
aguguggccacgugggcaaacag

SEQ ID NO: 1380165 - RNA, 22 nt, Homo sapiens
aguguggcccagggaagccaaa

SEQ ID NO: 1380166 - RNA, 14 nt, Homo sapiens
augacaucuucaaa

SEQ ID NO: 1380167 - RNA, 16 nt, Homo sapiens
augaccacauccugaa

SEQ ID NO: 1380168 - RNA, 15 nt, Homo sapiens
augacuaaagacaua

SEQ ID NO: 1380169 - RNA, 19 nt, Homo sapiens
augacuaaagcagggacaa

SEQ ID NO: 1380170 - RNA, 19 nt, Homo sapiens
augacuucagaaauguuaa

SEQ ID NO: 1380171 - RNA, 13 nt, Homo sapiens
augagaacaugaa

SEQ ID NO: 1380172 - RNA, 16 nt, Homo sapiens
augagaaggaauuuga

SEQ ID NO: 1380173 - RNA, 17 nt, Homo sapiens
augagaccacuguuauc

SEQ ID NO: 1380174 - RNA, 23 nt, Homo sapiens
augagaguuucuguuaaucaugu

SEQ ID NO: 1380175 - RNA, 22 nt, Homo sapiens
augaggaauuucuguucuucca

SEQ ID NO: 1380176 - RNA, 20 nt, Homo sapiens
augaggaggcagaaagcaga

SEQ ID NO: 1380177 - RNA, 22 nt, Homo sapiens
augaggucauagcagugcuuga

SEQ ID NO: 1380178 - RNA, 15 nt, Homo sapiens
augauacacuaugaa

SEQ ID NO: 1380179 - RNA, 15 nt, Homo sapiens
augauacagagggau

SEQ ID NO: 1380180 - RNA, 13 nt, Homo sapiens
augauaugaccag

SEQ ID NO: 1380181 - RNA, 18 nt, Homo sapiens
augauauugcauaugcau

SEQ ID NO: 1380182 - RNA, 17 nt, Homo sapiens
augaucagcuguuuguc

SEQ ID NO: 1380183 - RNA, 20 nt, Homo sapiens
augaucagcuguuugucaua

SEQ ID NO: 1380184 - RNA, 15 nt, Homo sapiens
augaugauguggaag

SEQ ID NO: 1380185 - RNA, 18 nt, Homo sapiens
augaugccucaugauaug

SEQ ID NO: 1380186 - RNA, 17 nt, Homo sapiens
augaugcuaccaugccu

SEQ ID NO: 1380187 - RNA, 22 nt, Homo sapiens
augaugucccuauggaagcaua

SEQ ID NO: 1380188 - RNA, 11 nt, Homo sapiens
augauguuucg

SEQ ID NO: 1380189 - RNA, 21 nt, Homo sapiens
augauucuuuguuacaggcac

SEQ ID NO: 1380190 - RNA, 19 nt, Homo sapiens
augauuucaugcuaucucu

SEQ ID NO: 1380191 - RNA, 16 nt, Homo sapiens
augcaaaguagcaauu

SEQ ID NO: 1380192 - RNA, 16 nt, Homo sapiens
augcaacaacauguau

SEQ ID NO: 1380193 - RNA, 17 nt, Homo sapiens
augcaacaacauguaua

SEQ ID NO: 1380194 - RNA, 11 nt, Homo sapiens
augcaaugccu

SEQ ID NO: 1380195 - RNA, 17 nt, Homo sapiens
augcaaugccucuggaa

SEQ ID NO: 1380196 - RNA, 23 nt, Homo sapiens
augcacgugugcacacacaccac

SEQ ID NO: 1380197 - RNA, 20 nt, Homo sapiens
augcacuuccuuaccuagug

SEQ ID NO: 1380198 - RNA, 13 nt, Homo sapiens
augcagcaucuaa

SEQ ID NO: 1380199 - RNA, 16 nt, Homo sapiens
augcagcaucuaagua

SEQ ID NO: 1380200 - RNA, 15 nt, Homo sapiens
augcagcccaugccc

SEQ ID NO: 1380201 - RNA, 21 nt, Homo sapiens
augcaggcaugcuggcuccca

SEQ ID NO: 1380202 - RNA, 14 nt, Homo sapiens
augcaucauuucag

SEQ ID NO: 1380203 - RNA, 18 nt, Homo sapiens
augcaucugcuacugugu

SEQ ID NO: 1380204 - RNA, 16 nt, Homo sapiens
augcauguacccuaag

SEQ ID NO: 1380205 - RNA, 11 nt, Homo sapiens
augcauuuuaa

SEQ ID NO: 1380206 - RNA, 18 nt, Homo sapiens
augccaaccggucaccca

SEQ ID NO: 1380207 - RNA, 16 nt, Homo sapiens
augccagcuuaucuca

SEQ ID NO: 1380208 - RNA, 18 nt, Homo sapiens
augccagcuuaucucagg

SEQ ID NO: 1380209 - RNA, 15 nt, Homo sapiens
augccauagcaagau

SEQ ID NO: 1380210 - RNA, 17 nt, Homo sapiens
augcccucaaucccagc

SEQ ID NO: 1380211 - RNA, 14 nt, Homo sapiens
augccgcuacaaaa

SEQ ID NO: 1380212 - RNA, 20 nt, Homo sapiens
augccgggcgcaguggcuca

SEQ ID NO: 1380213 - RNA, 22 nt, Homo sapiens
augccucauuaccuugugcuaa

SEQ ID NO: 1380214 - RNA, 17 nt, Homo sapiens
augccugguggcagcug

SEQ ID NO: 1380215 - RNA, 16 nt, Homo sapiens
augcgcacaaggcuga

SEQ ID NO: 1380216 - RNA, 20 nt, Homo sapiens
augcggcccaggauggcuuu

SEQ ID NO: 1380217 - RNA, 19 nt, Homo sapiens
augcguacguuuccugaga

SEQ ID NO: 1380218 - RNA, 14 nt, Homo sapiens
augcuaccaugccu

SEQ ID NO: 1380219 - RNA, 17 nt, Homo sapiens
augcuaguuugaccuca

SEQ ID NO: 1380220 - RNA, 15 nt, Homo sapiens
augcucagguacaga

SEQ ID NO: 1380221 - RNA, 21 nt, Homo sapiens
augcucaguuggugcugcuuu

SEQ ID NO: 1380222 - RNA, 22 nt, Homo sapiens
augcucaguuggugcugcuuuc

SEQ ID NO: 1380223 - RNA, 20 nt, Homo sapiens
augcugaaauccgggucaag

SEQ ID NO: 1380224 - RNA, 14 nt, Homo sapiens
augcugaccugugu

SEQ ID NO: 1380225 - RNA, 15 nt, Homo sapiens
augcugcgucuccca

SEQ ID NO: 1380226 - RNA, 15 nt, Homo sapiens
augcugcuguuuaca

SEQ ID NO: 1380227 - RNA, 21 nt, Homo sapiens
augcuuugccccugagacaaa

SEQ ID NO: 1380228 - RNA, 16 nt, Homo sapiens
auggaaaacagacuca

SEQ ID NO: 1380229 - RNA, 16 nt, Homo sapiens
auggaacucauuccug

SEQ ID NO: 1380230 - RNA, 16 nt, Homo sapiens
auggaacucucuccac

SEQ ID NO: 1380231 - RNA, 18 nt, Homo sapiens
auggacauaagacagaca

SEQ ID NO: 1380232 - RNA, 17 nt, Homo sapiens
auggagacuccaugaga

SEQ ID NO: 1380233 - RNA, 20 nt, Homo sapiens
auggagugggugucucugca

SEQ ID NO: 1380234 - RNA, 15 nt, Homo sapiens
auggcaccaaagcca

SEQ ID NO: 1380235 - RNA, 12 nt, Homo sapiens
auggcagggaua

SEQ ID NO: 1380236 - RNA, 13 nt, Homo sapiens
auggccagccaac

SEQ ID NO: 1380237 - RNA, 18 nt, Homo sapiens
auggccagugugauccca

SEQ ID NO: 1380238 - RNA, 22 nt, Homo sapiens
auggccuggggaagcugugaaa

SEQ ID NO: 1380239 - RNA, 18 nt, Homo sapiens
auggcuggagugauucug

SEQ ID NO: 1380240 - RNA, 12 nt, Homo sapiens
augggaugaaug

SEQ ID NO: 1380241 - RNA, 17 nt, Homo sapiens
augggauucagugcuuc

SEQ ID NO: 1380242 - RNA, 20 nt, Homo sapiens
augggcaaauuaaggcauaa

SEQ ID NO: 1380243 - RNA, 16 nt, Homo sapiens
auggggacauuccaau

SEQ ID NO: 1380244 - RNA, 23 nt, Homo sapiens
auggggauaaaggagaaggcaug

SEQ ID NO: 1380245 - RNA, 15 nt, Homo sapiens
auggggugcaccugu

SEQ ID NO: 1380246 - RNA, 20 nt, Homo sapiens
auggguaucaaacagcucag

SEQ ID NO: 1380247 - RNA, 18 nt, Homo sapiens
auggguccauuuugcccu

SEQ ID NO: 1380248 - RNA, 15 nt, Homo sapiens
auggguugcauuugg

SEQ ID NO: 1380249 - RNA, 16 nt, Homo sapiens
augguaauuguugcua

SEQ ID NO: 1380250 - RNA, 18 nt, Homo sapiens
augguacuauguuagccc

SEQ ID NO: 1380251 - RNA, 21 nt, Homo sapiens
augguauaucaguaucugaga

SEQ ID NO: 1380252 - RNA, 20 nt, Homo sapiens
auggucucugccaugaacug

SEQ ID NO: 1380253 - RNA, 18 nt, Homo sapiens
auggugaaaauauuugac

SEQ ID NO: 1380254 - RNA, 19 nt, Homo sapiens
auggugaaaauauuugaca

SEQ ID NO: 1380255 - RNA, 19 nt, Homo sapiens
auggugaaaccucaucucu

SEQ ID NO: 1380256 - RNA, 20 nt, Homo sapiens
auggugaaaccucaucucua

SEQ ID NO: 1380257 - RNA, 14 nt, Homo sapiens
auggugaugaaaug

SEQ ID NO: 1380258 - RNA, 15 nt, Homo sapiens
auggugcacugagcu

SEQ ID NO: 1380259 - RNA, 17 nt, Homo sapiens
augguggccuggggcuu

SEQ ID NO: 1380260 - RNA, 20 nt, Homo sapiens
auggugguuguuucuuccaa

SEQ ID NO: 1380261 - RNA, 11 nt, Homo sapiens
augguguaacc

SEQ ID NO: 1380262 - RNA, 16 nt, Homo sapiens
augguuacucuuguca

SEQ ID NO: 1380263 - RNA, 15 nt, Homo sapiens
augguuccauucucu

SEQ ID NO: 1380264 - RNA, 19 nt, Homo sapiens
augguuuuacucaugugca

SEQ ID NO: 1380265 - RNA, 14 nt, Homo sapiens
auguaaaacaagaa

SEQ ID NO: 1380266 - RNA, 15 nt, Homo sapiens
auguaaaauuuugcc

SEQ ID NO: 1380267 - RNA, 17 nt, Homo sapiens
auguaaacccucaaggg

SEQ ID NO: 1380268 - RNA, 22 nt, Homo sapiens
auguaaaugaaguaacuugucu

SEQ ID NO: 1380269 - RNA, 14 nt, Homo sapiens
auguaacuacagga

SEQ ID NO: 1380270 - RNA, 18 nt, Homo sapiens
auguaagaaucauuguaa

SEQ ID NO: 1380271 - RNA, 15 nt, Homo sapiens
auguaagcucuacug

SEQ ID NO: 1380272 - RNA, 23 nt, Homo sapiens
auguaauaaguaucacacuguau

SEQ ID NO: 1380273 - RNA, 16 nt, Homo sapiens
auguaauaaugugaau

SEQ ID NO: 1380274 - RNA, 19 nt, Homo sapiens
auguacauaggcagcacua

SEQ ID NO: 1380275 - RNA, 15 nt, Homo sapiens
auguacaugucaaua

SEQ ID NO: 1380276 - RNA, 19 nt, Homo sapiens
auguacuguuacuguguca

SEQ ID NO: 1380277 - RNA, 16 nt, Homo sapiens
auguagaccugugaga

SEQ ID NO: 1380278 - RNA, 13 nt, Homo sapiens
auguagccucaac

SEQ ID NO: 1380279 - RNA, 19 nt, Homo sapiens
caacuaggauacuuucuac

SEQ ID NO: 1380280 - RNA, 13 nt, Homo sapiens
caacucaucuuag

SEQ ID NO: 1380281 - RNA, 12 nt, Homo sapiens
caacuccuggaa

SEQ ID NO: 1380282 - RNA, 17 nt, Homo sapiens
caacugcugaugcucau

SEQ ID NO: 1380283 - RNA, 13 nt, Homo sapiens
caacuguggcuua

SEQ ID NO: 1380284 - RNA, 21 nt, Homo sapiens
caacuucuacuucugcccuug

SEQ ID NO: 1380285 - RNA, 20 nt, Homo sapiens
caacuuguauuaaagacaga

SEQ ID NO: 1380286 - RNA, 17 nt, Homo sapiens
caagaagucaaaguaaa

SEQ ID NO: 1380287 - RNA, 15 nt, Homo sapiens
caagaaucagugcaa

SEQ ID NO: 1380288 - RNA, 22 nt, Homo sapiens
caagacaauucuucuucuucca

SEQ ID NO: 1380289 - RNA, 18 nt, Homo sapiens
caagacacaucccuacaa

SEQ ID NO: 1380290 - RNA, 19 nt, Homo sapiens
caagacucugucucaaaaa

SEQ ID NO: 1380291 - RNA, 23 nt, Homo sapiens
caagagcagcuaaaaccuacuca

SEQ ID NO: 1380292 - RNA, 16 nt, Homo sapiens
caagaggcuguuccca

SEQ ID NO: 1380293 - RNA, 15 nt, Homo sapiens
caagaguuuucuucc

SEQ ID NO: 1380294 - RNA, 21 nt, Homo sapiens
caagaguuuucuuccuuguaa

SEQ ID NO: 1380295 - RNA, 14 nt, Homo sapiens
caagaugcuuuuca

SEQ ID NO: 1380296 - RNA, 15 nt, Homo sapiens
caagcacagaaggag

SEQ ID NO: 1380297 - RNA, 18 nt, Homo sapiens
caagcagccaagcuccuu

SEQ ID NO: 1380298 - RNA, 18 nt, Homo sapiens
caagccaguacgugcuaa

SEQ ID NO: 1380299 - RNA, 16 nt, Homo sapiens
caagccccacuuauuc

SEQ ID NO: 1380300 - RNA, 16 nt, Homo sapiens
caagccugccuaggaa

SEQ ID NO: 1380301 - RNA, 12 nt, Homo sapiens
caagcuauucaa

SEQ ID NO: 1380302 - RNA, 16 nt, Homo sapiens
caagcuccucgugaua

SEQ ID NO: 1380303 - RNA, 20 nt, Homo sapiens
caaggagggcagaucacuuc

SEQ ID NO: 1380304 - RNA, 22 nt, Homo sapiens
caaggcccauaucugugaaaug

SEQ ID NO: 1380305 - RNA, 15 nt, Homo sapiens
caaggccccagagac

SEQ ID NO: 1380306 - RNA, 23 nt, Homo sapiens
caaggcugcgggagaagaaguuu

SEQ ID NO: 1380307 - RNA, 19 nt, Homo sapiens
caaggcugggggaagaagc

SEQ ID NO: 1380308 - RNA, 13 nt, Homo sapiens
caagggagaguga

SEQ ID NO: 1380309 - RNA, 19 nt, Homo sapiens
caagggggacugucuuuca

SEQ ID NO: 1380310 - RNA, 16 nt, Homo sapiens
caaggguuuguugaac

SEQ ID NO: 1380311 - RNA, 14 nt, Homo sapiens
caaggucuuugguu

SEQ ID NO: 1380312 - RNA, 15 nt, Homo sapiens
caaggugaacacuuc

SEQ ID NO: 1380313 - RNA, 23 nt, Homo sapiens
caaguauucauuuuuucuacccu

SEQ ID NO: 1380314 - RNA, 14 nt, Homo sapiens
caaguauuggcaaa

SEQ ID NO: 1380315 - RNA, 17 nt, Homo sapiens
caaguauuggcaaagau

SEQ ID NO: 1380316 - RNA, 18 nt, Homo sapiens
caagucagcucuucucca

SEQ ID NO: 1380317 - RNA, 12 nt, Homo sapiens
caagucaggaca

SEQ ID NO: 1380318 - RNA, 18 nt, Homo sapiens
caagucaugugcauuucc

SEQ ID NO: 1380319 - RNA, 12 nt, Homo sapiens
caagucuucccu

SEQ ID NO: 1380320 - RNA, 16 nt, Homo sapiens
caagugaaaucaaagg

SEQ ID NO: 1380321 - RNA, 16 nt, Homo sapiens
caagugagacaaaaag

SEQ ID NO: 1380322 - RNA, 22 nt, Homo sapiens
caagugagcaaaccugccccau

SEQ ID NO: 1380323 - RNA, 14 nt, Homo sapiens
caagugugugcaca

SEQ ID NO: 1380324 - RNA, 16 nt, Homo sapiens
caagugugugcacaug

SEQ ID NO: 1380325 - RNA, 20 nt, Homo sapiens
caagugugugcacaugugug

SEQ ID NO: 1380326 - RNA, 14 nt, Homo sapiens
caaguugcacacuc

SEQ ID NO: 1380327 - RNA, 17 nt, Homo sapiens
caaguuguguuugauau

SEQ ID NO: 1380328 - RNA, 19 nt, Homo sapiens
caauaaaaguuuucuccaa

SEQ ID NO: 1380329 - RNA, 14 nt, Homo sapiens
caauaaagugcuuu

SEQ ID NO: 1380330 - RNA, 13 nt, Homo sapiens
caauaagcaucaa

SEQ ID NO: 1380331 - RNA, 15 nt, Homo sapiens
caauacucaaaagag

SEQ ID NO: 1380332 - RNA, 18 nt, Homo sapiens
caauacucaaaagagaga

SEQ ID NO: 1380333 - RNA, 21 nt, Homo sapiens
caauagaaggauguacauuuc

SEQ ID NO: 1380334 - RNA, 14 nt, Homo sapiens
caauauacuuguau

SEQ ID NO: 1380335 - RNA, 18 nt, Homo sapiens
caauauagcaagauccca

SEQ ID NO: 1380336 - RNA, 17 nt, Homo sapiens
caauaucuuuauugcau

SEQ ID NO: 1380337 - RNA, 15 nt, Homo sapiens
caauauggucccaaa

SEQ ID NO: 1380338 - RNA, 15 nt, Homo sapiens
caaucagagagcuca

SEQ ID NO: 1380339 - RNA, 17 nt, Homo sapiens
caaucagccacauucua

SEQ ID NO: 1380340 - RNA, 21 nt, Homo sapiens
caaucaggguuuuuagauuaa

SEQ ID NO: 1380341 - RNA, 19 nt, Homo sapiens
caaucaguagccagcaucu

SEQ ID NO: 1380342 - RNA, 17 nt, Homo sapiens
caaucaugaaauaugca

SEQ ID NO: 1380343 - RNA, 18 nt, Homo sapiens
caauccgaaguaugaggg

SEQ ID NO: 1380344 - RNA, 14 nt, Homo sapiens
caaugaaaugcucu

SEQ ID NO: 1380345 - RNA, 16 nt, Homo sapiens
caaugauggcaauuuu

SEQ ID NO: 1380346 - RNA, 16 nt, Homo sapiens
caauggagacugucuc

SEQ ID NO: 1380347 - RNA, 18 nt, Homo sapiens
caauggugcucauuucau

SEQ ID NO: 1380348 - RNA, 15 nt, Homo sapiens
caauguuuaugcaag

SEQ ID NO: 1380349 - RNA, 21 nt, Homo sapiens
caauguuuaugcaaggaagga

SEQ ID NO: 1380350 - RNA, 19 nt, Homo sapiens
caauguuuguccuguauaa

SEQ ID NO: 1380351 - RNA, 18 nt, Homo sapiens
caauuaaguccuacuuua

SEQ ID NO: 1380352 - RNA, 23 nt, Homo sapiens
caauucacuagaccagaagugga

SEQ ID NO: 1380353 - RNA, 15 nt, Homo sapiens
caauuccucugggaa

SEQ ID NO: 1380354 - RNA, 20 nt, Homo sapiens
caauucuaacuuuuuugcua

SEQ ID NO: 1380355 - RNA, 11 nt, Homo sapiens
caauuuaguuc

SEQ ID NO: 1380356 - RNA, 13 nt, Homo sapiens
caauuugccuuuu

SEQ ID NO: 1380357 - RNA, 15 nt, Homo sapiens
caauuuguauaaaau

SEQ ID NO: 1380358 - RNA, 16 nt, Homo sapiens
cacaaaaucuguccaa

SEQ ID NO: 1380359 - RNA, 14 nt, Homo sapiens
cacaaaauugggaa

SEQ ID NO: 1380360 - RNA, 14 nt, Homo sapiens
cacaaauagaguuu

SEQ ID NO: 1380361 - RNA, 20 nt, Homo sapiens
cacaaaugguagcauacuuu

SEQ ID NO: 1380362 - RNA, 18 nt, Homo sapiens
cacaaauuuguaaacuuu

SEQ ID NO: 1380363 - RNA, 12 nt, Homo sapiens
cacaaccaaaaa

SEQ ID NO: 1380364 - RNA, 13 nt, Homo sapiens
cacaacugcaguc

SEQ ID NO: 1380365 - RNA, 19 nt, Homo sapiens
cacaagcagccuacuaaca

SEQ ID NO: 1380366 - RNA, 20 nt, Homo sapiens
cacaaggcugaccaagagag

SEQ ID NO: 1380367 - RNA, 13 nt, Homo sapiens
cacaauaugaaua

SEQ ID NO: 1380368 - RNA, 20 nt, Homo sapiens
cacaauaugggcacuuuaaa

SEQ ID NO: 1380369 - RNA, 22 nt, Homo sapiens
cacacaagcuuuuuuacacaaa

SEQ ID NO: 1380370 - RNA, 20 nt, Homo sapiens
cacacacaaugugucugaga

SEQ ID NO: 1380371 - RNA, 11 nt, Homo sapiens
cacacacagcu

SEQ ID NO: 1380372 - RNA, 13 nt, Homo sapiens
cacacacauacac

SEQ ID NO: 1380373 - RNA, 22 nt, Homo sapiens
cacacacuguucugaaagugac

SEQ ID NO: 1380374 - RNA, 20 nt, Homo sapiens
cacacaguauuacuucugcu

SEQ ID NO: 1380375 - RNA, 20 nt, Homo sapiens
cacacaugcuuuucuuccua

SEQ ID NO: 1380376 - RNA, 22 nt, Homo sapiens
cacacccagcccacuucugcca

SEQ ID NO: 1380377 - RNA, 20 nt, Homo sapiens
cacacccuggaggauuucau

SEQ ID NO: 1380378 - RNA, 17 nt, Homo sapiens
cacaccuagcaucucau

SEQ ID NO: 1380379 - RNA, 16 nt, Homo sapiens
cacacgcgugcacaca

SEQ ID NO: 1380380 - RNA, 21 nt, Homo sapiens
cacacgucuggcuucacagau

SEQ ID NO: 1380381 - RNA, 13 nt, Homo sapiens
cacacucaaggga

SEQ ID NO: 1380382 - RNA, 18 nt, Homo sapiens
cacacucaccucuaaaac

SEQ ID NO: 1380383 - RNA, 22 nt, Homo sapiens
cacacuccccugcacuggaguc

SEQ ID NO: 1380384 - RNA, 13 nt, Homo sapiens
cacacuguuaaaa

SEQ ID NO: 1380385 - RNA, 14 nt, Homo sapiens
cacacuuguccaca

SEQ ID NO: 1380386 - RNA, 20 nt, Homo sapiens
cacagaacacagcaauuccu

SEQ ID NO: 1380387 - RNA, 21 nt, Homo sapiens
cacagaacuauguacuuuaaa

SEQ ID NO: 1380388 - RNA, 12 nt, Homo sapiens
cacagaaguagc

SEQ ID NO: 1380389 - RNA, 20 nt, Homo sapiens
cacagacgccuuacuggcaa

SEQ ID NO: 1380390 - RNA, 13 nt, Homo sapiens
cacagaggcugcc

SEQ ID NO: 1380391 - RNA, 19 nt, Homo sapiens
cacagcaggagggacaaug

SEQ ID NO: 1380392 - RNA, 23 nt, Homo sapiens
cacagccagaaccccgagcccua

SEQ ID NO: 1380393 - RNA, 15 nt, Homo sapiens
cucuauuuaaauucu

SEQ ID NO: 1380394 - RNA, 21 nt, Homo sapiens
cucucaggcaugccuguguga

SEQ ID NO: 1380395 - RNA, 17 nt, Homo sapiens
cucucagugaacuguga

SEQ ID NO: 1380396 - RNA, 18 nt, Homo sapiens
cucucagugaacugugag

SEQ ID NO: 1380397 - RNA, 22 nt, Homo sapiens
cucucagugcuucuuacuauua

SEQ ID NO: 1380398 - RNA, 21 nt, Homo sapiens
cucucaucccccauuaaccag

SEQ ID NO: 1380399 - RNA, 13 nt, Homo sapiens
cucuccacugaaa

SEQ ID NO: 1380400 - RNA, 15 nt, Homo sapiens
cucucuucugcucca

SEQ ID NO: 1380401 - RNA, 12 nt, Homo sapiens
cucucuuuacau

SEQ ID NO: 1380402 - RNA, 12 nt, Homo sapiens
cucugaauucca

SEQ ID NO: 1380403 - RNA, 15 nt, Homo sapiens
cucugacacacagcu

SEQ ID NO: 1380404 - RNA, 16 nt, Homo sapiens
cucugacucccaaaga

SEQ ID NO: 1380405 - RNA, 22 nt, Homo sapiens
cucugcacaagcugcacccuca

SEQ ID NO: 1380406 - RNA, 17 nt, Homo sapiens
cucugcaucacccacag

SEQ ID NO: 1380407 - RNA, 14 nt, Homo sapiens
cucugcauguuaca

SEQ ID NO: 1380408 - RNA, 15 nt, Homo sapiens
cucugcauucuagua

SEQ ID NO: 1380409 - RNA, 19 nt, Homo sapiens
cucugccagccacauccaa

SEQ ID NO: 1380410 - RNA, 17 nt, Homo sapiens
cucugccaugaacugga

SEQ ID NO: 1380411 - RNA, 14 nt, Homo sapiens
cucugcccauuccc

SEQ ID NO: 1380412 - RNA, 14 nt, Homo sapiens
cucugccugcauuc

SEQ ID NO: 1380413 - RNA, 21 nt, Homo sapiens
cucugcuugccgaaacuggaa

SEQ ID NO: 1380414 - RNA, 20 nt, Homo sapiens
cucuggacaggcauguucuc

SEQ ID NO: 1380415 - RNA, 22 nt, Homo sapiens
cucugggccaagucaaagacau

SEQ ID NO: 1380416 - RNA, 17 nt, Homo sapiens
cucugggccuucucacc

SEQ ID NO: 1380417 - RNA, 12 nt, Homo sapiens
cucuguagaaau

SEQ ID NO: 1380418 - RNA, 21 nt, Homo sapiens
cucuguauuccuagaaacuga

SEQ ID NO: 1380419 - RNA, 14 nt, Homo sapiens
cucugucauaugca

SEQ ID NO: 1380420 - RNA, 14 nt, Homo sapiens
cucugugucaggug

SEQ ID NO: 1380421 - RNA, 16 nt, Homo sapiens
cucuucaaucucuugc

SEQ ID NO: 1380422 - RNA, 18 nt, Homo sapiens
cucuucccccucucccag

SEQ ID NO: 1380423 - RNA, 15 nt, Homo sapiens
cucuuccuaucccau

SEQ ID NO: 1380424 - RNA, 20 nt, Homo sapiens
cucuuccuaucccaucccau

SEQ ID NO: 1380425 - RNA, 13 nt, Homo sapiens
cucuugcacucaa

SEQ ID NO: 1380426 - RNA, 20 nt, Homo sapiens
cucuugggcugagacuggau

SEQ ID NO: 1380427 - RNA, 17 nt, Homo sapiens
cucuuguauaugaugau

SEQ ID NO: 1380428 - RNA, 16 nt, Homo sapiens
cucuuguccuagcuug

SEQ ID NO: 1380429 - RNA, 14 nt, Homo sapiens
cucuuguugcugag

SEQ ID NO: 1380430 - RNA, 17 nt, Homo sapiens
cucuuuaaauggcuuua

SEQ ID NO: 1380431 - RNA, 14 nt, Homo sapiens
cucuuuaacaucuu

SEQ ID NO: 1380432 - RNA, 15 nt, Homo sapiens
cucuuuaaucuucag

SEQ ID NO: 1380433 - RNA, 19 nt, Homo sapiens
cucuuucccucccuuccuc

SEQ ID NO: 1380434 - RNA, 13 nt, Homo sapiens
cucuuucuugacu

SEQ ID NO: 1380435 - RNA, 17 nt, Homo sapiens
cucuuuucaaaacauuu

SEQ ID NO: 1380436 - RNA, 19 nt, Homo sapiens
cucuuuugaauccaugcuu

SEQ ID NO: 1380437 - RNA, 21 nt, Homo sapiens
cucuuuuuccaucauaauucu

SEQ ID NO: 1380438 - RNA, 21 nt, Homo sapiens
cugaaaaccucacaugcauac

SEQ ID NO: 1380439 - RNA, 21 nt, Homo sapiens
cugaaaagauguugugucuug

SEQ ID NO: 1380440 - RNA, 13 nt, Homo sapiens
cugaaaaucugga

SEQ ID NO: 1380441 - RNA, 17 nt, Homo sapiens
cugaaaauuaacacugc

SEQ ID NO: 1380442 - RNA, 16 nt, Homo sapiens
cugaaacagcugccac

SEQ ID NO: 1380443 - RNA, 23 nt, Homo sapiens
cugaaaccucugggucaucucuc

SEQ ID NO: 1380444 - RNA, 12 nt, Homo sapiens
cugaaacuucaa

SEQ ID NO: 1380445 - RNA, 16 nt, Homo sapiens
cugaaagaucuuucag

SEQ ID NO: 1380446 - RNA, 13 nt, Homo sapiens
cugaaaguacaaa

SEQ ID NO: 1380447 - RNA, 21 nt, Homo sapiens
cugaaauccgggucaagugaa

SEQ ID NO: 1380448 - RNA, 22 nt, Homo sapiens
cugaacacgaagcuuaguauaa

SEQ ID NO: 1380449 - RNA, 17 nt, Homo sapiens
cugaacauguacacugg

SEQ ID NO: 1380450 - RNA, 18 nt, Homo sapiens
cugaaccaucccugaugu

SEQ ID NO: 1380451 - RNA, 16 nt, Homo sapiens
cugaaccuuccaucuc

SEQ ID NO: 1380452 - RNA, 20 nt, Homo sapiens
cugaacugaaaacaagccau

SEQ ID NO: 1380453 - RNA, 15 nt, Homo sapiens
cugaagaacaguaac

SEQ ID NO: 1380454 - RNA, 15 nt, Homo sapiens
cugaagauaaucuua

SEQ ID NO: 1380455 - RNA, 19 nt, Homo sapiens
cugaagcccuaacucagcc

SEQ ID NO: 1380456 - RNA, 13 nt, Homo sapiens
cugaagcuuuuua

SEQ ID NO: 1380457 - RNA, 11 nt, Homo sapiens
cugaauaugaa

SEQ ID NO: 1380458 - RNA, 15 nt, Homo sapiens
cugaaugguuuucaa

SEQ ID NO: 1380459 - RNA, 13 nt, Homo sapiens
cugacccacagcc

SEQ ID NO: 1380460 - RNA, 13 nt, Homo sapiens
cugacccacugcu

SEQ ID NO: 1380461 - RNA, 17 nt, Homo sapiens
cugacccagagccuagg

SEQ ID NO: 1380462 - RNA, 19 nt, Homo sapiens
cugacccugcuucaaauau

SEQ ID NO: 1380463 - RNA, 17 nt, Homo sapiens
cugaccucacugugacc

SEQ ID NO: 1380464 - RNA, 15 nt, Homo sapiens
cugaccuccacagcu

SEQ ID NO: 1380465 - RNA, 14 nt, Homo sapiens
cugaccuguguucc

SEQ ID NO: 1380466 - RNA, 16 nt, Homo sapiens
cugaccuguguucccu

SEQ ID NO: 1380467 - RNA, 15 nt, Homo sapiens
cugagaaauguucag

SEQ ID NO: 1380468 - RNA, 18 nt, Homo sapiens
cugagagacaggacuagc

SEQ ID NO: 1380469 - RNA, 12 nt, Homo sapiens
cugagagaucug

SEQ ID NO: 1380470 - RNA, 14 nt, Homo sapiens
cugagagaucugcu

SEQ ID NO: 1380471 - RNA, 22 nt, Homo sapiens
cugagcagugcuugaaugaagu

SEQ ID NO: 1380472 - RNA, 16 nt, Homo sapiens
cugagcgaugacucaa

SEQ ID NO: 1380473 - RNA, 22 nt, Homo sapiens
cugagcuuuggacgcacacagc

SEQ ID NO: 1380474 - RNA, 18 nt, Homo sapiens
cugaggcaggaggauugc

SEQ ID NO: 1380475 - RNA, 20 nt, Homo sapiens
cugaggugggaggaucucuu

SEQ ID NO: 1380476 - RNA, 14 nt, Homo sapiens
cugagucccaaagc

SEQ ID NO: 1380477 - RNA, 15 nt, Homo sapiens
cugaguggaugacaa

SEQ ID NO: 1380478 - RNA, 20 nt, Homo sapiens
cugaguggaugacaaaaaga

SEQ ID NO: 1380479 - RNA, 18 nt, Homo sapiens
cugagugggggaucacag

SEQ ID NO: 1380480 - RNA, 17 nt, Homo sapiens
cugauauagaucacaua

SEQ ID NO: 1380481 - RNA, 13 nt, Homo sapiens
cugaucagucuaa

SEQ ID NO: 1380482 - RNA, 14 nt, Homo sapiens
cugaucaugcauug

SEQ ID NO: 1380483 - RNA, 14 nt, Homo sapiens
cugaucgugcuaaa

SEQ ID NO: 1380484 - RNA, 13 nt, Homo sapiens
cugaucucaggga

SEQ ID NO: 1380485 - RNA, 14 nt, Homo sapiens
cugaugaaucuugc

SEQ ID NO: 1380486 - RNA, 21 nt, Homo sapiens
cugaugacacugagaacagau

SEQ ID NO: 1380487 - RNA, 22 nt, Homo sapiens
cugaugaccuaaccuaagcaaa

SEQ ID NO: 1380488 - RNA, 16 nt, Homo sapiens
cugaugagaauacuga

SEQ ID NO: 1380489 - RNA, 13 nt, Homo sapiens
cugaugcaagcaa

SEQ ID NO: 1380490 - RNA, 19 nt, Homo sapiens
cugauguaccugaugcuau

SEQ ID NO: 1380491 - RNA, 18 nt, Homo sapiens
cugauguuaaaauuccau

SEQ ID NO: 1380492 - RNA, 20 nt, Homo sapiens
cugauguuccacaaaacauu

SEQ ID NO: 1380493 - RNA, 15 nt, Homo sapiens
cugauuaaugcuaaa

SEQ ID NO: 1380494 - RNA, 17 nt, Homo sapiens
cugauuaaugcuaaaug

SEQ ID NO: 1380495 - RNA, 22 nt, Homo sapiens
cugauucugucaaugucuugaa

SEQ ID NO: 1380496 - RNA, 17 nt, Homo sapiens
cugauuuccuaauguca

SEQ ID NO: 1380497 - RNA, 17 nt, Homo sapiens
cugauuuuaacaauaac

SEQ ID NO: 1380498 - RNA, 19 nt, Homo sapiens
cugauuuuuagcuuuacaa

SEQ ID NO: 1380499 - RNA, 22 nt, Homo sapiens
cugcaaaggcgucugaaugugu

SEQ ID NO: 1380500 - RNA, 16 nt, Homo sapiens
cugcaagcacaucugc

SEQ ID NO: 1380501 - RNA, 17 nt, Homo sapiens
cugcaagugacaucucu

SEQ ID NO: 1380502 - RNA, 17 nt, Homo sapiens
cugcacagugcaucuca

SEQ ID NO: 1380503 - RNA, 17 nt, Homo sapiens
cugcacccacccaggag

SEQ ID NO: 1380504 - RNA, 20 nt, Homo sapiens
cugcacuaauuugauguuua

SEQ ID NO: 1380505 - RNA, 23 nt, Homo sapiens
cugcacuaauuugauguuuacag

SEQ ID NO: 1380506 - RNA, 20 nt, Homo sapiens
cugcacuggaguccagucuc

SEQ ID NO: 1380507 - RNA, 15 nt, Homo sapiens
cuggugacccaguca

SEQ ID NO: 1380508 - RNA, 17 nt, Homo sapiens
cuggugccccacugaau

SEQ ID NO: 1380509 - RNA, 14 nt, Homo sapiens
cugguggucaggga

SEQ ID NO: 1380510 - RNA, 15 nt, Homo sapiens
cugguuagaaaugca

SEQ ID NO: 1380511 - RNA, 13 nt, Homo sapiens
cugguuagguaga

SEQ ID NO: 1380512 - RNA, 22 nt, Homo sapiens
cugguuguugccaaacagccac

SEQ ID NO: 1380513 - RNA, 15 nt, Homo sapiens
cuguaagauaauguu

SEQ ID NO: 1380514 - RNA, 18 nt, Homo sapiens
cuguaagauaauguugcu

SEQ ID NO: 1380515 - RNA, 19 nt, Homo sapiens
cuguaagauaauguugcuu

SEQ ID NO: 1380516 - RNA, 16 nt, Homo sapiens
cuguaagcucuuugaa

SEQ ID NO: 1380517 - RNA, 17 nt, Homo sapiens
cuguaaucccagaacuu

SEQ ID NO: 1380518 - RNA, 21 nt, Homo sapiens
cuguaaucccagcuacucggg

SEQ ID NO: 1380519 - RNA, 12 nt, Homo sapiens
cuguaaugacaa

SEQ ID NO: 1380520 - RNA, 17 nt, Homo sapiens
cuguacaaaguagaagu

SEQ ID NO: 1380521 - RNA, 17 nt, Homo sapiens
cuguacuaaaaauacaa

SEQ ID NO: 1380522 - RNA, 13 nt, Homo sapiens
cuguacucaggag

SEQ ID NO: 1380523 - RNA, 15 nt, Homo sapiens
cuguacuuuuuccag

SEQ ID NO: 1380524 - RNA, 14 nt, Homo sapiens
cuguagaaaugaug

SEQ ID NO: 1380525 - RNA, 21 nt, Homo sapiens
cuguagaugacauggugaaaa

SEQ ID NO: 1380526 - RNA, 15 nt, Homo sapiens
cuguagguucuugau

SEQ ID NO: 1380527 - RNA, 17 nt, Homo sapiens
cuguaguaaauggcaau

SEQ ID NO: 1380528 - RNA, 14 nt, Homo sapiens
cuguagucucagga

SEQ ID NO: 1380529 - RNA, 15 nt, Homo sapiens
cuguagucucaggac

SEQ ID NO: 1380530 - RNA, 19 nt, Homo sapiens
cuguauauacaauaacaua

SEQ ID NO: 1380531 - RNA, 18 nt, Homo sapiens
cuguaugaaugucugugg

SEQ ID NO: 1380532 - RNA, 13 nt, Homo sapiens
cuguauuacauaa

SEQ ID NO: 1380533 - RNA, 18 nt, Homo sapiens
cuguauucccaguuacuu

SEQ ID NO: 1380534 - RNA, 22 nt, Homo sapiens
cugucaaacaaagccagaagcu

SEQ ID NO: 1380535 - RNA, 18 nt, Homo sapiens
cugucaauaaacagcuuc

SEQ ID NO: 1380536 - RNA, 12 nt, Homo sapiens
cuguccuaggcc

SEQ ID NO: 1380537 - RNA, 13 nt, Homo sapiens
cuguccuuucuca

SEQ ID NO: 1380538 - RNA, 22 nt, Homo sapiens
cuguccuuuuggcacugagaua

SEQ ID NO: 1380539 - RNA, 14 nt, Homo sapiens
cugucucagccucc

SEQ ID NO: 1380540 - RNA, 21 nt, Homo sapiens
cugucucauaugauugugcac

SEQ ID NO: 1380541 - RNA, 14 nt, Homo sapiens
cugucugacaaccu

SEQ ID NO: 1380542 - RNA, 17 nt, Homo sapiens
cugucuucguacuggga

SEQ ID NO: 1380543 - RNA, 22 nt, Homo sapiens
cugucuucguauucccauuaga

SEQ ID NO: 1380544 - RNA, 15 nt, Homo sapiens
cugucuuucacugaa

SEQ ID NO: 1380545 - RNA, 13 nt, Homo sapiens
cugugaccauuua

SEQ ID NO: 1380546 - RNA, 13 nt, Homo sapiens
cugugaguguaag

SEQ ID NO: 1380547 - RNA, 18 nt, Homo sapiens
cugugcaaauccuugaua

SEQ ID NO: 1380548 - RNA, 22 nt, Homo sapiens
cugugcaguggcccccacagaa

SEQ ID NO: 1380549 - RNA, 14 nt, Homo sapiens
cuguggccugggca

SEQ ID NO: 1380550 - RNA, 21 nt, Homo sapiens
cuguggcugcuagcacuugga

SEQ ID NO: 1380551 - RNA, 18 nt, Homo sapiens
cuguguacacgugacaga

SEQ ID NO: 1380552 - RNA, 18 nt, Homo sapiens
cuguguagacuauuugcu

SEQ ID NO: 1380553 - RNA, 15 nt, Homo sapiens
cuguguauucuaguu

SEQ ID NO: 1380554 - RNA, 15 nt, Homo sapiens
cugugucguagccaa

SEQ ID NO: 1380555 - RNA, 20 nt, Homo sapiens
cugugucuugcaauggcagc

SEQ ID NO: 1380556 - RNA, 20 nt, Homo sapiens
cugugucuuuuuucacuaca

SEQ ID NO: 1380557 - RNA, 21 nt, Homo sapiens
cugugugaacuaacaugcaaa

SEQ ID NO: 1380558 - RNA, 13 nt, Homo sapiens
cugugugaugaug

SEQ ID NO: 1380559 - RNA, 16 nt, Homo sapiens
cugugugcaagugugu

SEQ ID NO: 1380560 - RNA, 19 nt, Homo sapiens
cugugugcaagugugugca

SEQ ID NO: 1380561 - RNA, 20 nt, Homo sapiens
cugugugcaagugugugcac

SEQ ID NO: 1380562 - RNA, 23 nt, Homo sapiens
cuguguggacugugaugccacac

SEQ ID NO: 1380563 - RNA, 20 nt, Homo sapiens
cugugugucgcuuaugucua

SEQ ID NO: 1380564 - RNA, 20 nt, Homo sapiens
cuguuaacuuaauaguauuu

SEQ ID NO: 1380565 - RNA, 13 nt, Homo sapiens
cuguuagagucca

SEQ ID NO: 1380566 - RNA, 14 nt, Homo sapiens
cuguuauagagggu

SEQ ID NO: 1380567 - RNA, 18 nt, Homo sapiens
cuguucugucucauauga

SEQ ID NO: 1380568 - RNA, 14 nt, Homo sapiens
cuguugaaaagcca

SEQ ID NO: 1380569 - RNA, 15 nt, Homo sapiens
cuguugaaaagccau

SEQ ID NO: 1380570 - RNA, 18 nt, Homo sapiens
cuguugaauuucccacau

SEQ ID NO: 1380571 - RNA, 18 nt, Homo sapiens
cuguuguaacugcccaag

SEQ ID NO: 1380572 - RNA, 21 nt, Homo sapiens
cuuaaaaagucugcauuacau

SEQ ID NO: 1380573 - RNA, 19 nt, Homo sapiens
cuuaaaacuguaaauuuau

SEQ ID NO: 1380574 - RNA, 11 nt, Homo sapiens
cuuaaaagcca

SEQ ID NO: 1380575 - RNA, 16 nt, Homo sapiens
cuuaaaauagccauaa

SEQ ID NO: 1380576 - RNA, 19 nt, Homo sapiens
cuuaaacuacaaacacaag

SEQ ID NO: 1380577 - RNA, 16 nt, Homo sapiens
cuuaaaggcuguggua

SEQ ID NO: 1380578 - RNA, 23 nt, Homo sapiens
cuuaaauaauaaacaguggaaua

SEQ ID NO: 1380579 - RNA, 14 nt, Homo sapiens
cuuaaauccauccu

SEQ ID NO: 1380580 - RNA, 17 nt, Homo sapiens
cuuaacagaugcaaugu

SEQ ID NO: 1380581 - RNA, 23 nt, Homo sapiens
cuuaacuuggaucauuucuggua

SEQ ID NO: 1380582 - RNA, 20 nt, Homo sapiens
cuuaagcuuccgccgucuca

SEQ ID NO: 1380583 - RNA, 15 nt, Homo sapiens
cuuaaguaucagaaa

SEQ ID NO: 1380584 - RNA, 23 nt, Homo sapiens
cuuaaguuguggagagugcaaca

SEQ ID NO: 1380585 - RNA, 14 nt, Homo sapiens
cuuaauaguauuua

SEQ ID NO: 1380586 - RNA, 15 nt, Homo sapiens
cuuaaucaugagaua

SEQ ID NO: 1380587 - RNA, 15 nt, Homo sapiens
cuuaaucuguuuauu

SEQ ID NO: 1380588 - RNA, 21 nt, Homo sapiens
cuuaaugauccguuccauugc

SEQ ID NO: 1380589 - RNA, 14 nt, Homo sapiens
cuuaauuuucagua

SEQ ID NO: 1380590 - RNA, 17 nt, Homo sapiens
cuuaauuuucaguauaa

SEQ ID NO: 1380591 - RNA, 18 nt, Homo sapiens
cuuacacuuuaugcacaa

SEQ ID NO: 1380592 - RNA, 15 nt, Homo sapiens
cuuacauaugcaaaa

SEQ ID NO: 1380593 - RNA, 21 nt, Homo sapiens
cuuaccagaucuaauauugac

SEQ ID NO: 1380594 - RNA, 16 nt, Homo sapiens
cuuaccucacagugau

SEQ ID NO: 1380595 - RNA, 17 nt, Homo sapiens
cuuagcaugcacaaagu

SEQ ID NO: 1380596 - RNA, 13 nt, Homo sapiens
cuuagcauguccc

SEQ ID NO: 1380597 - RNA, 14 nt, Homo sapiens
cuuaggcaaucaca

SEQ ID NO: 1380598 - RNA, 17 nt, Homo sapiens
cuuaggcaaucacauag

SEQ ID NO: 1380599 - RNA, 14 nt, Homo sapiens
cuuaggcagggaag

SEQ ID NO: 1380600 - RNA, 15 nt, Homo sapiens
cuuagugucacuuac

SEQ ID NO: 1380601 - RNA, 21 nt, Homo sapiens
cuuaguuacucauucagggau

SEQ ID NO: 1380602 - RNA, 16 nt, Homo sapiens
cuuauaaaaaucuuaa

SEQ ID NO: 1380603 - RNA, 18 nt, Homo sapiens
cuuauagaaaguucaaaa

SEQ ID NO: 1380604 - RNA, 17 nt, Homo sapiens
cuuaucugugcgugaaa

SEQ ID NO: 1380605 - RNA, 22 nt, Homo sapiens
cuuaucugugcgugaaacacac

SEQ ID NO: 1380606 - RNA, 17 nt, Homo sapiens
cuuaucuuacaaagugu

SEQ ID NO: 1380607 - RNA, 17 nt, Homo sapiens
cuuauuguuccaagaca

SEQ ID NO: 1380608 - RNA, 21 nt, Homo sapiens
cuucaacugucuccuaccucu

SEQ ID NO: 1380609 - RNA, 22 nt, Homo sapiens
cuucaaggucauuuacuuguac

SEQ ID NO: 1380610 - RNA, 16 nt, Homo sapiens
cuucaaguuagcucag

SEQ ID NO: 1380611 - RNA, 19 nt, Homo sapiens
cuucaaguuagcucaggag

SEQ ID NO: 1380612 - RNA, 21 nt, Homo sapiens
cuucaaucucuugcacucaaa

SEQ ID NO: 1380613 - RNA, 17 nt, Homo sapiens
cuucacccuggagccca

SEQ ID NO: 1380614 - RNA, 16 nt, Homo sapiens
cuucagaagacacugc

SEQ ID NO: 1380615 - RNA, 20 nt, Homo sapiens
cuucagaagacacugcaaag

SEQ ID NO: 1380616 - RNA, 21 nt, Homo sapiens
cuucagccuagccgaccucag

SEQ ID NO: 1380617 - RNA, 23 nt, Homo sapiens
cuucagcucacacaugagaucua

SEQ ID NO: 1380618 - RNA, 21 nt, Homo sapiens
cuucagggcagggcucugaua

SEQ ID NO: 1380619 - RNA, 14 nt, Homo sapiens
cuucagguagaaau

SEQ ID NO: 1380620 - RNA, 21 nt, Homo sapiens
gagacugucucaagagggcac

SEQ ID NO: 1380621 - RNA, 20 nt, Homo sapiens
gagacuuugacucuccagaa

SEQ ID NO: 1380622 - RNA, 13 nt, Homo sapiens
gagagacccaagg

SEQ ID NO: 1380623 - RNA, 20 nt, Homo sapiens
gagagaugaaccacauuaua

SEQ ID NO: 1380624 - RNA, 18 nt, Homo sapiens
gagagauucaugcugauu

SEQ ID NO: 1380625 - RNA, 15 nt, Homo sapiens
gagagccuugguuca

SEQ ID NO: 1380626 - RNA, 11 nt, Homo sapiens
gagagcucacu

SEQ ID NO: 1380627 - RNA, 22 nt, Homo sapiens
gagagcuguucccaaauuuucu

SEQ ID NO: 1380628 - RNA, 23 nt, Homo sapiens
gagagcuuucuguccuuuuggca

SEQ ID NO: 1380629 - RNA, 23 nt, Homo sapiens
gagaggagaaggagggagacaug

SEQ ID NO: 1380630 - RNA, 19 nt, Homo sapiens
gagaguacaccccaacagc

SEQ ID NO: 1380631 - RNA, 17 nt, Homo sapiens
gagagucucacuccccu

SEQ ID NO: 1380632 - RNA, 23 nt, Homo sapiens
gagauacagcucagagugccacg

SEQ ID NO: 1380633 - RNA, 13 nt, Homo sapiens
gagaucaccagug

SEQ ID NO: 1380634 - RNA, 21 nt, Homo sapiens
gagaucacgccacugcacuau

SEQ ID NO: 1380635 - RNA, 20 nt, Homo sapiens
gagauggaaguugcagugag

SEQ ID NO: 1380636 - RNA, 21 nt, Homo sapiens
gagauguaagagcuuuacaaa

SEQ ID NO: 1380637 - RNA, 18 nt, Homo sapiens
gagauguccauagucaaa

SEQ ID NO: 1380638 - RNA, 22 nt, Homo sapiens
gagauuauuuuaaucuaauucu

SEQ ID NO: 1380639 - RNA, 19 nt, Homo sapiens
gagauuccugagccagugu

SEQ ID NO: 1380640 - RNA, 20 nt, Homo sapiens
gagauugcaccauugcgcuc

SEQ ID NO: 1380641 - RNA, 14 nt, Homo sapiens
gagcaaagggccag

SEQ ID NO: 1380642 - RNA, 18 nt, Homo sapiens
gagcaaauguggcuccug

SEQ ID NO: 1380643 - RNA, 11 nt, Homo sapiens
gagcacacugu

SEQ ID NO: 1380644 - RNA, 15 nt, Homo sapiens
gagcacagcucagga

SEQ ID NO: 1380645 - RNA, 16 nt, Homo sapiens
gagcaccgccugugaa

SEQ ID NO: 1380646 - RNA, 21 nt, Homo sapiens
gagcacguuugcagaaggggg

SEQ ID NO: 1380647 - RNA, 21 nt, Homo sapiens
gagcacuggguugacuuucag

SEQ ID NO: 1380648 - RNA, 15 nt, Homo sapiens
gagcagagaaggcca

SEQ ID NO: 1380649 - RNA, 15 nt, Homo sapiens
gagcagccacaacca

SEQ ID NO: 1380650 - RNA, 17 nt, Homo sapiens
gagcaggggcaggguga

SEQ ID NO: 1380651 - RNA, 21 nt, Homo sapiens
gagcaguuugguuucuagcau

SEQ ID NO: 1380652 - RNA, 13 nt, Homo sapiens
gagccaaggguuc

SEQ ID NO: 1380653 - RNA, 16 nt, Homo sapiens
gagccacguauguuuu

SEQ ID NO: 1380654 - RNA, 16 nt, Homo sapiens
gagccacucuguuccu

SEQ ID NO: 1380655 - RNA, 17 nt, Homo sapiens
gagcccauccagucucc

SEQ ID NO: 1380656 - RNA, 18 nt, Homo sapiens
gagcccgaggcaccagug

SEQ ID NO: 1380657 - RNA, 17 nt, Homo sapiens
gagccucgggacaucaa

SEQ ID NO: 1380658 - RNA, 15 nt, Homo sapiens
gagccuggaagacac

SEQ ID NO: 1380659 - RNA, 16 nt, Homo sapiens
gagccuuuggccagaa

SEQ ID NO: 1380660 - RNA, 18 nt, Homo sapiens
gagcgagacuccgucuca

SEQ ID NO: 1380661 - RNA, 14 nt, Homo sapiens
gagcgguaugcucu

SEQ ID NO: 1380662 - RNA, 17 nt, Homo sapiens
gagcgugaaucuguauc

SEQ ID NO: 1380663 - RNA, 20 nt, Homo sapiens
gagcuccccaccaccccagc

SEQ ID NO: 1380664 - RNA, 19 nt, Homo sapiens
gagcucuaagcccauucag

SEQ ID NO: 1380665 - RNA, 20 nt, Homo sapiens
gagcugccauccagggaugc

SEQ ID NO: 1380666 - RNA, 13 nt, Homo sapiens
gagcuggaccuga

SEQ ID NO: 1380667 - RNA, 13 nt, Homo sapiens
gagcugggggcca

SEQ ID NO: 1380668 - RNA, 16 nt, Homo sapiens
gagcuuggcagcugaa

SEQ ID NO: 1380669 - RNA, 13 nt, Homo sapiens
gagcuuggccaga

SEQ ID NO: 1380670 - RNA, 23 nt, Homo sapiens
gagcuuggccagaagggggccau

SEQ ID NO: 1380671 - RNA, 15 nt, Homo sapiens
gagcuuuauguaaua

SEQ ID NO: 1380672 - RNA, 20 nt, Homo sapiens
gagcuuuggacacacacagc

SEQ ID NO: 1380673 - RNA, 15 nt, Homo sapiens
gaggaaacucaccug

SEQ ID NO: 1380674 - RNA, 20 nt, Homo sapiens
gaggaaaggccagcuggcag

SEQ ID NO: 1380675 - RNA, 13 nt, Homo sapiens
gaggaacacugca

SEQ ID NO: 1380676 - RNA, 22 nt, Homo sapiens
gaggacauucuggaaaagcaaa

SEQ ID NO: 1380677 - RNA, 19 nt, Homo sapiens
gaggacuugugucucugug

SEQ ID NO: 1380678 - RNA, 23 nt, Homo sapiens
gaggaggcaauugggauggcgcu

SEQ ID NO: 1380679 - RNA, 13 nt, Homo sapiens
gaggaucacugga

SEQ ID NO: 1380680 - RNA, 13 nt, Homo sapiens
gaggcacacagcu

SEQ ID NO: 1380681 - RNA, 16 nt, Homo sapiens
gaggcaccaguguccu

SEQ ID NO: 1380682 - RNA, 18 nt, Homo sapiens
gaggcagacagcagcuca

SEQ ID NO: 1380683 - RNA, 24 nt, Homo sapiens
gaggcagagguugcagugagcuga

SEQ ID NO: 1380684 - RNA, 20 nt, Homo sapiens
gaggcaggagaaucgcuuga

SEQ ID NO: 1380685 - RNA, 18 nt, Homo sapiens
gaggcaggagaauugcuu

SEQ ID NO: 1380686 - RNA, 20 nt, Homo sapiens
gaggcaggaggaucacuuga

SEQ ID NO: 1380687 - RNA, 15 nt, Homo sapiens
gaggcuccagcaucu

SEQ ID NO: 1380688 - RNA, 12 nt, Homo sapiens
gaggcucuaauu

SEQ ID NO: 1380689 - RNA, 18 nt, Homo sapiens
gaggcugaggcgggugga

SEQ ID NO: 1380690 - RNA, 15 nt, Homo sapiens
gaggcuguucccacc

SEQ ID NO: 1380691 - RNA, 20 nt, Homo sapiens
gaggcuugccccacccaaca

SEQ ID NO: 1380692 - RNA, 15 nt, Homo sapiens
gagggagaagcauga

SEQ ID NO: 1380693 - RNA, 14 nt, Homo sapiens
gagggagugacaga

SEQ ID NO: 1380694 - RNA, 22 nt, Homo sapiens
gagggauaguggggucagggcu

SEQ ID NO: 1380695 - RNA, 15 nt, Homo sapiens
gaggggcaacgaaga

SEQ ID NO: 1380696 - RNA, 18 nt, Homo sapiens
gaggggucaaguuauuaa

SEQ ID NO: 1380697 - RNA, 21 nt, Homo sapiens
gagggugaggggcuggcacug

SEQ ID NO: 1380698 - RNA, 18 nt, Homo sapiens
gagggugggguaaccaaa

SEQ ID NO: 1380699 - RNA, 20 nt, Homo sapiens
gagguggaggcugcagugag

SEQ ID NO: 1380700 - RNA, 21 nt, Homo sapiens
gaguaaguguaagaaaaugau

SEQ ID NO: 1380701 - RNA, 19 nt, Homo sapiens
gaguacaaaguaagccaug

SEQ ID NO: 1380702 - RNA, 15 nt, Homo sapiens
gaguacaccccaaca

SEQ ID NO: 1380703 - RNA, 17 nt, Homo sapiens
gaguacaccccaacagc

SEQ ID NO: 1380704 - RNA, 19 nt, Homo sapiens
gaguacuggcugauggagu

SEQ ID NO: 1380705 - RNA, 19 nt, Homo sapiens
gaguacuuugaagauguca

SEQ ID NO: 1380706 - RNA, 18 nt, Homo sapiens
gaguagagggcacugggu

SEQ ID NO: 1380707 - RNA, 12 nt, Homo sapiens
gaguauaugcac

SEQ ID NO: 1380708 - RNA, 21 nt, Homo sapiens
gaguaucugaggcacauguca

SEQ ID NO: 1380709 - RNA, 21 nt, Homo sapiens
gaguaucugggaacugugccu

SEQ ID NO: 1380710 - RNA, 23 nt, Homo sapiens
gagucacccaugaagacaggaca

SEQ ID NO: 1380711 - RNA, 18 nt, Homo sapiens
gagucccuuccaggccau

SEQ ID NO: 1380712 - RNA, 14 nt, Homo sapiens
gaguccucacuccc

SEQ ID NO: 1380713 - RNA, 20 nt, Homo sapiens
gagucgcaucucagugcagg

SEQ ID NO: 1380714 - RNA, 23 nt, Homo sapiens
gagucugaauagucuucagagau

SEQ ID NO: 1380715 - RNA, 18 nt, Homo sapiens
gagugaaacauugaacuc

SEQ ID NO: 1380716 - RNA, 14 nt, Homo sapiens
gagugcccccaaca

SEQ ID NO: 1380717 - RNA, 17 nt, Homo sapiens
gagugcccccaacagca

SEQ ID NO: 1380718 - RNA, 15 nt, Homo sapiens
gagugggcuaagcac

SEQ ID NO: 1380719 - RNA, 13 nt, Homo sapiens
gagugugugcaag

SEQ ID NO: 1380720 - RNA, 14 nt, Homo sapiens
gagugugugcaugu

SEQ ID NO: 1380721 - RNA, 17 nt, Homo sapiens
gagugugugcaugugug

SEQ ID NO: 1380722 - RNA, 19 nt, Homo sapiens
gaguguuuuaaaacauuca

SEQ ID NO: 1380723 - RNA, 18 nt, Homo sapiens
gaguuguggaaagccucu

SEQ ID NO: 1380724 - RNA, 14 nt, Homo sapiens
gaguuuagugugau

SEQ ID NO: 1380725 - RNA, 21 nt, Homo sapiens
gaguuuagugugauaaaggca

SEQ ID NO: 1380726 - RNA, 15 nt, Homo sapiens
gaguuuaguuuuaua

SEQ ID NO: 1380727 - RNA, 21 nt, Homo sapiens
gaguuugggaacugcaauaac

SEQ ID NO: 1380728 - RNA, 13 nt, Homo sapiens
gauaaagggccaa

SEQ ID NO: 1380729 - RNA, 13 nt, Homo sapiens
gauaauaugagaa

SEQ ID NO: 1380730 - RNA, 15 nt, Homo sapiens
gauaaucagccucuu

SEQ ID NO: 1380731 - RNA, 21 nt, Homo sapiens
gauaaucucuuuaaauggcuu

SEQ ID NO: 1380732 - RNA, 19 nt, Homo sapiens
gauacaggaaaagcugcug

SEQ ID NO: 1380733 - RNA, 12 nt, Homo sapiens
gcuccacucuga

SEQ ID NO: 1380734 - RNA, 11 nt, Homo sapiens
gcuccacugaa

SEQ ID NO: 1380735 - RNA, 19 nt, Homo sapiens
gcuccagaagaacaaagag

SEQ ID NO: 1380736 - RNA, 13 nt, Homo sapiens
gcuccagugcagg

SEQ ID NO: 1380737 - RNA, 21 nt, Homo sapiens
gcuccaucgcugucaucucag

SEQ ID NO: 1380738 - RNA, 14 nt, Homo sapiens
gcucccacagaaca

SEQ ID NO: 1380739 - RNA, 18 nt, Homo sapiens
gcucccuuccucccaaaa

SEQ ID NO: 1380740 - RNA, 21 nt, Homo sapiens
gcuccgugcuuguuugcucac

SEQ ID NO: 1380741 - RNA, 20 nt, Homo sapiens
gcuccuggacucauugcuuc

SEQ ID NO: 1380742 - RNA, 17 nt, Homo sapiens
gcuccuuccugucuucc

SEQ ID NO: 1380743 - RNA, 22 nt, Homo sapiens
gcucuagagaaaagucuacccc

SEQ ID NO: 1380744 - RNA, 17 nt, Homo sapiens
gcucugaccgaaacagc

SEQ ID NO: 1380745 - RNA, 17 nt, Homo sapiens
gcucugaggacugcacc

SEQ ID NO: 1380746 - RNA, 18 nt, Homo sapiens
gcucugaucauccacugu

SEQ ID NO: 1380747 - RNA, 22 nt, Homo sapiens
gcucugcuugccgaaacuggaa

SEQ ID NO: 1380748 - RNA, 23 nt, Homo sapiens
gcucugcuugccgaaacuggaag

SEQ ID NO: 1380749 - RNA, 19 nt, Homo sapiens
gcucuggugacaccagccu

SEQ ID NO: 1380750 - RNA, 19 nt, Homo sapiens
gcucuuaggugcuucuuca

SEQ ID NO: 1380751 - RNA, 12 nt, Homo sapiens
gcucuuguuauu

SEQ ID NO: 1380752 - RNA, 17 nt, Homo sapiens
gcucuuucccuuuauca

SEQ ID NO: 1380753 - RNA, 12 nt, Homo sapiens
gcugaacacugg

SEQ ID NO: 1380754 - RNA, 18 nt, Homo sapiens
gcugacuagaagggccag

SEQ ID NO: 1380755 - RNA, 16 nt, Homo sapiens
gcugagggaccagcca

SEQ ID NO: 1380756 - RNA, 14 nt, Homo sapiens
gcugagucugcaga

SEQ ID NO: 1380757 - RNA, 18 nt, Homo sapiens
gcugaguugguguugaca

SEQ ID NO: 1380758 - RNA, 21 nt, Homo sapiens
gcugcaacggaauuaggaaga

SEQ ID NO: 1380759 - RNA, 21 nt, Homo sapiens
gcugcacaucacaacauuuac

SEQ ID NO: 1380760 - RNA, 15 nt, Homo sapiens
gcugcauaguauucc

SEQ ID NO: 1380761 - RNA, 10 nt, Homo sapiens
gcugcaucuc

SEQ ID NO: 1380762 - RNA, 17 nt, Homo sapiens
gcugccuaggcugaccu

SEQ ID NO: 1380763 - RNA, 18 nt, Homo sapiens
gcugcuacuacuccugua

SEQ ID NO: 1380764 - RNA, 21 nt, Homo sapiens
gcugcuauuuuacugucuuaa

SEQ ID NO: 1380765 - RNA, 14 nt, Homo sapiens
gcuggagugcagug

SEQ ID NO: 1380766 - RNA, 20 nt, Homo sapiens
gcuggagugcggugguguga

SEQ ID NO: 1380767 - RNA, 20 nt, Homo sapiens
gcuggaugucuccaucucug

SEQ ID NO: 1380768 - RNA, 16 nt, Homo sapiens
gcuggcaauauuacaa

SEQ ID NO: 1380769 - RNA, 13 nt, Homo sapiens
gcuggcugcagug

SEQ ID NO: 1380770 - RNA, 14 nt, Homo sapiens
gcuggcugcaguga

SEQ ID NO: 1380771 - RNA, 21 nt, Homo sapiens
gcugggauguuucugucacau

SEQ ID NO: 1380772 - RNA, 15 nt, Homo sapiens
gcugggcucgccaca

SEQ ID NO: 1380773 - RNA, 15 nt, Homo sapiens
gcugggcuucagugg

SEQ ID NO: 1380774 - RNA, 18 nt, Homo sapiens
gcugggcuucaguggcag

SEQ ID NO: 1380775 - RNA, 14 nt, Homo sapiens
gcuggggagggaga

SEQ ID NO: 1380776 - RNA, 16 nt, Homo sapiens
gcuggugccccacuga

SEQ ID NO: 1380777 - RNA, 15 nt, Homo sapiens
gcuggugggcaccaa

SEQ ID NO: 1380778 - RNA, 20 nt, Homo sapiens
gcuguaaccgauaugcacuu

SEQ ID NO: 1380779 - RNA, 20 nt, Homo sapiens
gcugucaguaugacauuuca

SEQ ID NO: 1380780 - RNA, 23 nt, Homo sapiens
gcugugaccauuuauaauguuag

SEQ ID NO: 1380781 - RNA, 17 nt, Homo sapiens
gcuguggccaucaaccu

SEQ ID NO: 1380782 - RNA, 14 nt, Homo sapiens
gcuguuuuauaugu

SEQ ID NO: 1380783 - RNA, 15 nt, Homo sapiens
gcuguuuucuucuau

SEQ ID NO: 1380784 - RNA, 21 nt, Homo sapiens
gcuguuuugauuuguacugaa

SEQ ID NO: 1380785 - RNA, 21 nt, Homo sapiens
gcuuaaacuacaaacacaagc

SEQ ID NO: 1380786 - RNA, 20 nt, Homo sapiens
gcuuaaaggggcuagaguga

SEQ ID NO: 1380787 - RNA, 20 nt, Homo sapiens
gcuuagcuaauauugcaaug

SEQ ID NO: 1380788 - RNA, 18 nt, Homo sapiens
gcuuauaaaaucaaacag

SEQ ID NO: 1380789 - RNA, 21 nt, Homo sapiens
gcuuaucaguaguaucaauga

SEQ ID NO: 1380790 - RNA, 20 nt, Homo sapiens
gcuucaauuuauugcacaaa

SEQ ID NO: 1380791 - RNA, 18 nt, Homo sapiens
gcuucaguggcagcugcu

SEQ ID NO: 1380792 - RNA, 16 nt, Homo sapiens
gcuuccagaaaacccc

SEQ ID NO: 1380793 - RNA, 12 nt, Homo sapiens
gcuuccauucca

SEQ ID NO: 1380794 - RNA, 22 nt, Homo sapiens
gcuuccauuugugugugugcaa

SEQ ID NO: 1380795 - RNA, 23 nt, Homo sapiens
gcuucccggcgucccuaccuccu

SEQ ID NO: 1380796 - RNA, 19 nt, Homo sapiens
gcuucccugucuauugccu

SEQ ID NO: 1380797 - RNA, 12 nt, Homo sapiens
gcuuccuaacug

SEQ ID NO: 1380798 - RNA, 22 nt, Homo sapiens
gcuuccuuagguugaugcugga

SEQ ID NO: 1380799 - RNA, 17 nt, Homo sapiens
gcuucuaccaacuggaa

SEQ ID NO: 1380800 - RNA, 17 nt, Homo sapiens
gcuucuagaaccaggca

SEQ ID NO: 1380801 - RNA, 22 nt, Homo sapiens
gcuucucugagcuccaguggaa

SEQ ID NO: 1380802 - RNA, 13 nt, Homo sapiens
gcuucugaugaau

SEQ ID NO: 1380803 - RNA, 19 nt, Homo sapiens
gcuucugcaccuuaucuua

SEQ ID NO: 1380804 - RNA, 16 nt, Homo sapiens
gcuucuggagcccuug

SEQ ID NO: 1380805 - RNA, 18 nt, Homo sapiens
gcuucuguaguacuccuu

SEQ ID NO: 1380806 - RNA, 19 nt, Homo sapiens
gcuucuguaguacuccuua

SEQ ID NO: 1380807 - RNA, 19 nt, Homo sapiens
gcuucuuaaaauagccaua

SEQ ID NO: 1380808 - RNA, 18 nt, Homo sapiens
gcuugccgaaacuggaag

SEQ ID NO: 1380809 - RNA, 22 nt, Homo sapiens
gcuuggacugaagggguucuca

SEQ ID NO: 1380810 - RNA, 21 nt, Homo sapiens
gcuuggauggagacuccauga

SEQ ID NO: 1380811 - RNA, 13 nt, Homo sapiens
gcuuggcugugcc

SEQ ID NO: 1380812 - RNA, 16 nt, Homo sapiens
gcuuggcugugcccuc

SEQ ID NO: 1380813 - RNA, 18 nt, Homo sapiens
gcuuggcugugcccucag

SEQ ID NO: 1380814 - RNA, 17 nt, Homo sapiens
gcuugugggacuagccu

SEQ ID NO: 1380815 - RNA, 23 nt, Homo sapiens
gcuuuaauuguuaagauaugaug

SEQ ID NO: 1380816 - RNA, 17 nt, Homo sapiens
gcuuuacuuugcccagg

SEQ ID NO: 1380817 - RNA, 15 nt, Homo sapiens
gcuuugaauacuaaa

SEQ ID NO: 1380818 - RNA, 19 nt, Homo sapiens
gcuuugaaugcggcccaac

SEQ ID NO: 1380819 - RNA, 20 nt, Homo sapiens
gcuuuugcuggucacugcca

SEQ ID NO: 1380820 - RNA, 22 nt, Homo sapiens
ggaaaaauggauccccagugaa

SEQ ID NO: 1380821 - RNA, 21 nt, Homo sapiens
ggaaaagagcgcaucaggccu

SEQ ID NO: 1380822 - RNA, 16 nt, Homo sapiens
ggaaaauauccauccu

SEQ ID NO: 1380823 - RNA, 18 nt, Homo sapiens
ggaaaauauguaacugga

SEQ ID NO: 1380824 - RNA, 14 nt, Homo sapiens
ggaaaaucucagca

SEQ ID NO: 1380825 - RNA, 17 nt, Homo sapiens
ggaaaauuucacauuaa

SEQ ID NO: 1380826 - RNA, 22 nt, Homo sapiens
ggaaaauuuuaaaaauacagau

SEQ ID NO: 1380827 - RNA, 20 nt, Homo sapiens
ggaaacuggaugaggucaua

SEQ ID NO: 1380828 - RNA, 20 nt, Homo sapiens
ggaaacuguaugaaugucug

SEQ ID NO: 1380829 - RNA, 16 nt, Homo sapiens
ggaaagaaaugcccau

SEQ ID NO: 1380830 - RNA, 23 nt, Homo sapiens
ggaaagaaccaugcagaggaaua

SEQ ID NO: 1380831 - RNA, 17 nt, Homo sapiens
ggaaagggauaguccaa

SEQ ID NO: 1380832 - RNA, 22 nt, Homo sapiens
ggaaagggugcugcuucccucu

SEQ ID NO: 1380833 - RNA, 17 nt, Homo sapiens
ggaaagugauaugcauu

SEQ ID NO: 1380834 - RNA, 20 nt, Homo sapiens
ggaaagugauuuuuuuccac

SEQ ID NO: 1380835 - RNA, 11 nt, Homo sapiens
ggaaaucacac

SEQ ID NO: 1380836 - RNA, 13 nt, Homo sapiens
ggaacacugcacu

SEQ ID NO: 1380837 - RNA, 18 nt, Homo sapiens
ggaacagaaggaugaaug

SEQ ID NO: 1380838 - RNA, 22 nt, Homo sapiens
ggaacauguacuguuacugugu

SEQ ID NO: 1380839 - RNA, 21 nt, Homo sapiens
ggaacuagagggauacacuga

SEQ ID NO: 1380840 - RNA, 13 nt, Homo sapiens
ggaacucucucca

SEQ ID NO: 1380841 - RNA, 12 nt, Homo sapiens
ggaagaccaaga

SEQ ID NO: 1380842 - RNA, 21 nt, Homo sapiens
ggaagcccagcuccagggcca

SEQ ID NO: 1380843 - RNA, 22 nt, Homo sapiens
ggaagccucccacgacugcccg

SEQ ID NO: 1380844 - RNA, 17 nt, Homo sapiens
ggaagcucugaagucac

SEQ ID NO: 1380845 - RNA, 15 nt, Homo sapiens
ggucuucccuaccuc

SEQ ID NO: 1380846 - RNA, 14 nt, Homo sapiens
ggugaaagugcagu

SEQ ID NO: 1380847 - RNA, 13 nt, Homo sapiens
ggugaggaccacu

SEQ ID NO: 1380848 - RNA, 14 nt, Homo sapiens
ggugaggcaauaaa

SEQ ID NO: 1380849 - RNA, 14 nt, Homo sapiens
ggugauacccaagu

SEQ ID NO: 1380850 - RNA, 17 nt, Homo sapiens
ggugcaugaagguuucu

SEQ ID NO: 1380851 - RNA, 17 nt, Homo sapiens
ggugcguuuggccaaaa

SEQ ID NO: 1380852 - RNA, 17 nt, Homo sapiens
ggugcugcuuucuuguu

SEQ ID NO: 1380853 - RNA, 21 nt, Homo sapiens
ggugcugcuuucuuguugcug

SEQ ID NO: 1380854 - RNA, 23 nt, Homo sapiens
ggugcugcuuucuuguugcugca

SEQ ID NO: 1380855 - RNA, 18 nt, Homo sapiens
gguggaaacuuuucuuaa

SEQ ID NO: 1380856 - RNA, 17 nt, Homo sapiens
gguggaggcugcaguga

SEQ ID NO: 1380857 - RNA, 21 nt, Homo sapiens
gguggaugccugguggcagcu

SEQ ID NO: 1380858 - RNA, 15 nt, Homo sapiens
gguggucugaauguu

SEQ ID NO: 1380859 - RNA, 17 nt, Homo sapiens
gguguaaacacugaugg

SEQ ID NO: 1380860 - RNA, 21 nt, Homo sapiens
gguguccuuucccuccacucc

SEQ ID NO: 1380861 - RNA, 20 nt, Homo sapiens
gguuaucacuuuucuguaac

SEQ ID NO: 1380862 - RNA, 19 nt, Homo sapiens
gguucaccaggucagggag

SEQ ID NO: 1380863 - RNA, 15 nt, Homo sapiens
gguuccggaauccug

SEQ ID NO: 1380864 - RNA, 13 nt, Homo sapiens
gguugcagugagc

SEQ ID NO: 1380865 - RNA, 19 nt, Homo sapiens
gguugggggcagaggccca

SEQ ID NO: 1380866 - RNA, 14 nt, Homo sapiens
gguuuaggucaaga

SEQ ID NO: 1380867 - RNA, 15 nt, Homo sapiens
guaaaaacuguucuc

SEQ ID NO: 1380868 - RNA, 18 nt, Homo sapiens
guaaaauuuaaaucauau

SEQ ID NO: 1380869 - RNA, 20 nt, Homo sapiens
guaaacuguacuagucugug

SEQ ID NO: 1380870 - RNA, 19 nt, Homo sapiens
guaaaggcuauacuugucu

SEQ ID NO: 1380871 - RNA, 15 nt, Homo sapiens
guaaauaaauacauu

SEQ ID NO: 1380872 - RNA, 21 nt, Homo sapiens
guaaauacacauagcauguaa

SEQ ID NO: 1380873 - RNA, 15 nt, Homo sapiens
guaaauuaguauuua

SEQ ID NO: 1380874 - RNA, 15 nt, Homo sapiens
guaaauucaaccacu

SEQ ID NO: 1380875 - RNA, 14 nt, Homo sapiens
guaacaacuguggu

SEQ ID NO: 1380876 - RNA, 19 nt, Homo sapiens
guaacaagaaaacauaaga

SEQ ID NO: 1380877 - RNA, 17 nt, Homo sapiens
guaacauccaauaggaa

SEQ ID NO: 1380878 - RNA, 16 nt, Homo sapiens
guaaccaaauguuggc

SEQ ID NO: 1380879 - RNA, 16 nt, Homo sapiens
guaacucaaagggugg

SEQ ID NO: 1380880 - RNA, 16 nt, Homo sapiens
guaagaaacacacuga

SEQ ID NO: 1380881 - RNA, 16 nt, Homo sapiens
guaagaaucauuguaa

SEQ ID NO: 1380882 - RNA, 15 nt, Homo sapiens
guaagacgaaugauu

SEQ ID NO: 1380883 - RNA, 18 nt, Homo sapiens
guaagcaaagacuuuccu

SEQ ID NO: 1380884 - RNA, 14 nt, Homo sapiens
guaagcucuacuga

SEQ ID NO: 1380885 - RNA, 16 nt, Homo sapiens
guaagugagaacaaau

SEQ ID NO: 1380886 - RNA, 16 nt, Homo sapiens
guaaguugagggccag

SEQ ID NO: 1380887 - RNA, 22 nt, Homo sapiens
guaauaaacucauuucuagcag

SEQ ID NO: 1380888 - RNA, 16 nt, Homo sapiens
guaaucccagcacuuu

SEQ ID NO: 1380889 - RNA, 20 nt, Homo sapiens
guaaucccagcuacuuggga

SEQ ID NO: 1380890 - RNA, 15 nt, Homo sapiens
guaaucucggcucac

SEQ ID NO: 1380891 - RNA, 17 nt, Homo sapiens
guaaucuuuggcuguaa

SEQ ID NO: 1380892 - RNA, 22 nt, Homo sapiens
guaaugauguaggggccaagca

SEQ ID NO: 1380893 - RNA, 19 nt, Homo sapiens
guaauguauucuaucucuc

SEQ ID NO: 1380894 - RNA, 20 nt, Homo sapiens
guaauuaaguacuauguauc

SEQ ID NO: 1380895 - RNA, 16 nt, Homo sapiens
guacaggcaacaauga

SEQ ID NO: 1380896 - RNA, 18 nt, Homo sapiens
guacaggcagcacagaga

SEQ ID NO: 1380897 - RNA, 23 nt, Homo sapiens
guaccaagaagcccaagauauca

SEQ ID NO: 1380898 - RNA, 22 nt, Homo sapiens
guacccaccugagcuuuggaca

SEQ ID NO: 1380899 - RNA, 14 nt, Homo sapiens
guaccucucuuaua

SEQ ID NO: 1380900 - RNA, 14 nt, Homo sapiens
guaccugaugcuau

SEQ ID NO: 1380901 - RNA, 24 nt, Homo sapiens
guacuaagcaguaagcuaucuuca

SEQ ID NO: 1380902 - RNA, 21 nt, Homo sapiens
guacuaauacagacuauguca

SEQ ID NO: 1380903 - RNA, 16 nt, Homo sapiens
guacuauguaucaaug

SEQ ID NO: 1380904 - RNA, 16 nt, Homo sapiens
guacucagcgaaugaa

SEQ ID NO: 1380905 - RNA, 16 nt, Homo sapiens
guacugauggacuuaa

SEQ ID NO: 1380906 - RNA, 15 nt, Homo sapiens
guacuguuacugugu

SEQ ID NO: 1380907 - RNA, 22 nt, Homo sapiens
guacuguugaauuuggcuuuac

SEQ ID NO: 1380908 - RNA, 21 nt, Homo sapiens
guagaccuagggaggaccuua

SEQ ID NO: 1380909 - RNA, 20 nt, Homo sapiens
guagagacaggguuuugcca

SEQ ID NO: 1380910 - RNA, 22 nt, Homo sapiens
guagagacaggguuuugccaug

SEQ ID NO: 1380911 - RNA, 16 nt, Homo sapiens
guagagggcacugggu

SEQ ID NO: 1380912 - RNA, 15 nt, Homo sapiens
guagagucaucucca

SEQ ID NO: 1380913 - RNA, 15 nt, Homo sapiens
guagcauacauuuau

SEQ ID NO: 1380914 - RNA, 16 nt, Homo sapiens
guagcugaaaggggaa

SEQ ID NO: 1380915 - RNA, 13 nt, Homo sapiens
guaggacauacca

SEQ ID NO: 1380916 - RNA, 17 nt, Homo sapiens
guaggggcccacuucac

SEQ ID NO: 1380917 - RNA, 19 nt, Homo sapiens
guagguaauauugcaaggc

SEQ ID NO: 1380918 - RNA, 16 nt, Homo sapiens
guagguggaucaccug

SEQ ID NO: 1380919 - RNA, 15 nt, Homo sapiens
guaggugguuuugaa

SEQ ID NO: 1380920 - RNA, 15 nt, Homo sapiens
guaguaccccaagaa

SEQ ID NO: 1380921 - RNA, 14 nt, Homo sapiens
guaguaucaaugau

SEQ ID NO: 1380922 - RNA, 13 nt, Homo sapiens
guagucucaggac

SEQ ID NO: 1380923 - RNA, 19 nt, Homo sapiens
guagugucacugcuuguua

SEQ ID NO: 1380924 - RNA, 16 nt, Homo sapiens
guauauaaacauauca

SEQ ID NO: 1380925 - RNA, 21 nt, Homo sapiens
guauauaaauuuucccaaaac

SEQ ID NO: 1380926 - RNA, 21 nt, Homo sapiens
guauauaacuaacaaccaaag

SEQ ID NO: 1380927 - RNA, 17 nt, Homo sapiens
guauauauacauaacag

SEQ ID NO: 1380928 - RNA, 15 nt, Homo sapiens
guauaugucaucuca

SEQ ID NO: 1380929 - RNA, 23 nt, Homo sapiens
guauauuucccuguuucuuccac

SEQ ID NO: 1380930 - RNA, 17 nt, Homo sapiens
guauauuugguacugua

SEQ ID NO: 1380931 - RNA, 14 nt, Homo sapiens
guaucacacuguau

SEQ ID NO: 1380932 - RNA, 18 nt, Homo sapiens
guaucccaugagccucag

SEQ ID NO: 1380933 - RNA, 16 nt, Homo sapiens
guauccugcccagugu

SEQ ID NO: 1380934 - RNA, 17 nt, Homo sapiens
guaucuauuuuccucua

SEQ ID NO: 1380935 - RNA, 23 nt, Homo sapiens
guaucugagaccccaaacucucc

SEQ ID NO: 1380936 - RNA, 12 nt, Homo sapiens
guaugccaagug

SEQ ID NO: 1380937 - RNA, 15 nt, Homo sapiens
guauguguaccuaag

SEQ ID NO: 1380938 - RNA, 16 nt, Homo sapiens
guauguuuacacuguc

SEQ ID NO: 1380939 - RNA, 13 nt, Homo sapiens
guauuaaagacag

SEQ ID NO: 1380940 - RNA, 19 nt, Homo sapiens
guauuaggugucauuucca

SEQ ID NO: 1380941 - RNA, 18 nt, Homo sapiens
guauuccuuuuguguaca

SEQ ID NO: 1380942 - RNA, 18 nt, Homo sapiens
guauugacaggaauacuu

SEQ ID NO: 1380943 - RNA, 20 nt, Homo sapiens
guauuguugcuuuuuuucca

SEQ ID NO: 1380944 - RNA, 20 nt, Homo sapiens
guauuuuguuuuugucuuaa

SEQ ID NO: 1380945 - RNA, 14 nt, Homo sapiens
gucaaaaggugccu

SEQ ID NO: 1380946 - RNA, 21 nt, Homo sapiens
gucaacaucuuuuacauucug

SEQ ID NO: 1380947 - RNA, 22 nt, Homo sapiens
gucaacuucagagacuaucuga

SEQ ID NO: 1380948 - RNA, 11 nt, Homo sapiens
gucacacuggu

SEQ ID NO: 1380949 - RNA, 22 nt, Homo sapiens
gucaccaaaucagcugcuacua

SEQ ID NO: 1380950 - RNA, 15 nt, Homo sapiens
gucaccaucucaggc

SEQ ID NO: 1380951 - RNA, 18 nt, Homo sapiens
gucacuuuccucuuccac

SEQ ID NO: 1380952 - RNA, 13 nt, Homo sapiens
gucagacuggaua

SEQ ID NO: 1380953 - RNA, 20 nt, Homo sapiens
gucagaguuccgacugccau

SEQ ID NO: 1380954 - RNA, 23 nt, Homo sapiens
gucaggaacagaaggaugaauga

SEQ ID NO: 1380955 - RNA, 20 nt, Homo sapiens
gucaggacccaccaugucug

SEQ ID NO: 1380956 - RNA, 16 nt, Homo sapiens
gucagguaguugcaau

SEQ ID NO: 1380957 - RNA, 16 nt, Homo sapiens
gucagucaugauggca

SEQ ID NO: 1380958 - RNA, 11 nt, Homo sapiens
ucugacugcug

SEQ ID NO: 1380959 - RNA, 23 nt, Homo sapiens
ucugagccaaagagaaugccauu

SEQ ID NO: 1380960 - RNA, 22 nt, Homo sapiens
ucugagccccugggacugcugc

SEQ ID NO: 1380961 - RNA, 19 nt, Homo sapiens
ucugauauagaauugcaau

SEQ ID NO: 1380962 - RNA, 21 nt, Homo sapiens
ucugcaaaggcaccugaaugu

SEQ ID NO: 1380963 - RNA, 21 nt, Homo sapiens
ucugcagggggugugucugcu

SEQ ID NO: 1380964 - RNA, 23 nt, Homo sapiens
ucugcagggggugugucugcuca

SEQ ID NO: 1380965 - RNA, 16 nt, Homo sapiens
ucugccaggcucuaaa

SEQ ID NO: 1380966 - RNA, 21 nt, Homo sapiens
ucugccaggcucuaaagccaa

SEQ ID NO: 1380967 - RNA, 13 nt, Homo sapiens
ucugcccuugcca

SEQ ID NO: 1380968 - RNA, 21 nt, Homo sapiens
ucugcccuugccaacggagag

SEQ ID NO: 1380969 - RNA, 20 nt, Homo sapiens
ucugccuccccuucacuccc

SEQ ID NO: 1380970 - RNA, 14 nt, Homo sapiens
ucugccucugacac

SEQ ID NO: 1380971 - RNA, 16 nt, Homo sapiens
ucugccugaagucaca

SEQ ID NO: 1380972 - RNA, 22 nt, Homo sapiens
ucugccugauaggacccauauu

SEQ ID NO: 1380973 - RNA, 18 nt, Homo sapiens
ucugcuaccucacugggg

SEQ ID NO: 1380974 - RNA, 18 nt, Homo sapiens
ucugcugacagacacagg

SEQ ID NO: 1380975 - RNA, 15 nt, Homo sapiens
ucugcuggucuucaa

SEQ ID NO: 1380976 - RNA, 15 nt, Homo sapiens
ucugcuuuacucugg

SEQ ID NO: 1380977 - RNA, 23 nt, Homo sapiens
ucugcuuuuuaaagaaugcucuu

SEQ ID NO: 1380978 - RNA, 16 nt, Homo sapiens
ucuggaauacaugaaa

SEQ ID NO: 1380979 - RNA, 11 nt, Homo sapiens
ucuggacaaag

SEQ ID NO: 1380980 - RNA, 20 nt, Homo sapiens
ucuggcaacccuagucugcu

SEQ ID NO: 1380981 - RNA, 22 nt, Homo sapiens
ucuggcaucucuuucugcaaag

SEQ ID NO: 1380982 - RNA, 16 nt, Homo sapiens
ucuggccuuacaccuc

SEQ ID NO: 1380983 - RNA, 14 nt, Homo sapiens
ucuggcgcccauga

SEQ ID NO: 1380984 - RNA, 13 nt, Homo sapiens
ucugggugcagcu

SEQ ID NO: 1380985 - RNA, 17 nt, Homo sapiens
ucuggugcuuucuguca

SEQ ID NO: 1380986 - RNA, 14 nt, Homo sapiens
ucugguuugcagag

SEQ ID NO: 1380987 - RNA, 18 nt, Homo sapiens
ucuguacgucugacaggc

SEQ ID NO: 1380988 - RNA, 16 nt, Homo sapiens
ucugucauaugcagaa

SEQ ID NO: 1380989 - RNA, 18 nt, Homo sapiens
ucuguccguuuacuccaa

SEQ ID NO: 1380990 - RNA, 16 nt, Homo sapiens
ucugucucauaugauu

SEQ ID NO: 1380991 - RNA, 20 nt, Homo sapiens
ucugucuggaggggagcucu

SEQ ID NO: 1380992 - RNA, 13 nt, Homo sapiens
ucugucuggcuga

SEQ ID NO: 1380993 - RNA, 21 nt, Homo sapiens
ucugugagacccccacaccuc

SEQ ID NO: 1380994 - RNA, 21 nt, Homo sapiens
ucuguggaucccuacugcugg

SEQ ID NO: 1380995 - RNA, 21 nt, Homo sapiens
ucuguguagcaagcuauucaa

SEQ ID NO: 1380996 - RNA, 16 nt, Homo sapiens
ucuguuaagugguuuc

SEQ ID NO: 1380997 - RNA, 17 nt, Homo sapiens
ucuguuggccaguguga

SEQ ID NO: 1380998 - RNA, 13 nt, Homo sapiens
ucuguuucuaguu

SEQ ID NO: 1380999 - RNA, 14 nt, Homo sapiens
ucuguuugagauuu

SEQ ID NO: 1381000 - RNA, 13 nt, Homo sapiens
ucuguuuugccug

SEQ ID NO: 1381001 - RNA, 13 nt, Homo sapiens
ucuuaaccccagu

SEQ ID NO: 1381002 - RNA, 16 nt, Homo sapiens
ucuuaacuauucaaug

SEQ ID NO: 1381003 - RNA, 21 nt, Homo sapiens
ucuuaauuaaguaaacuaaug

SEQ ID NO: 1381004 - RNA, 23 nt, Homo sapiens
ucuuaauuaaguaaacuaaugag

SEQ ID NO: 1381005 - RNA, 16 nt, Homo sapiens
ucuuacaugcauuuga

SEQ ID NO: 1381006 - RNA, 22 nt, Homo sapiens
ucuuagagagaagaucacugaa

SEQ ID NO: 1381007 - RNA, 21 nt, Homo sapiens
ucuuagauggugaucugggau

SEQ ID NO: 1381008 - RNA, 21 nt, Homo sapiens
ucuuagauguauauauuuccu

SEQ ID NO: 1381009 - RNA, 14 nt, Homo sapiens
ucuuagcugccaag

SEQ ID NO: 1381010 - RNA, 16 nt, Homo sapiens
ucuuagcugucugcuc

SEQ ID NO: 1381011 - RNA, 17 nt, Homo sapiens
ucuuagcugucugcuca

SEQ ID NO: 1381012 - RNA, 14 nt, Homo sapiens
ucuuaggcaaucac

SEQ ID NO: 1381013 - RNA, 14 nt, Homo sapiens
ucuuaguuugcagu

SEQ ID NO: 1381014 - RNA, 17 nt, Homo sapiens
ucuuauagaaaguucaa

SEQ ID NO: 1381015 - RNA, 19 nt, Homo sapiens
ucuuauucuuuuguaauau

SEQ ID NO: 1381016 - RNA, 16 nt, Homo sapiens
ucuuauuuaacuuaac

SEQ ID NO: 1381017 - RNA, 16 nt, Homo sapiens
ucuuauuuaaugaaag

SEQ ID NO: 1381018 - RNA, 23 nt, Homo sapiens
ucuuauuuaaugaaagacuguac

SEQ ID NO: 1381019 - RNA, 21 nt, Homo sapiens
ucuucaacccccugacauuau

SEQ ID NO: 1381020 - RNA, 19 nt, Homo sapiens
ucuucaacuuuugugcucc

SEQ ID NO: 1381021 - RNA, 18 nt, Homo sapiens
ucuucacucaaucucuga

SEQ ID NO: 1381022 - RNA, 21 nt, Homo sapiens
ucuucacuucuaaaugcauau

SEQ ID NO: 1381023 - RNA, 16 nt, Homo sapiens
ucuucagaagacacug

SEQ ID NO: 1381024 - RNA, 16 nt, Homo sapiens
ucuucaggccucccuc

SEQ ID NO: 1381025 - RNA, 18 nt, Homo sapiens
ucuucagggcacugcugc

SEQ ID NO: 1381026 - RNA, 15 nt, Homo sapiens
ucuucagggggccag

SEQ ID NO: 1381027 - RNA, 18 nt, Homo sapiens
ucuuccaaagcacauuga

SEQ ID NO: 1381028 - RNA, 14 nt, Homo sapiens
ucuuccacagugcc

SEQ ID NO: 1381029 - RNA, 15 nt, Homo sapiens
ucuuccacuuugaua

SEQ ID NO: 1381030 - RNA, 15 nt, Homo sapiens
ucuuccagaaggcaa

SEQ ID NO: 1381031 - RNA, 13 nt, Homo sapiens
ucuucccuaccuc

SEQ ID NO: 1381032 - RNA, 15 nt, Homo sapiens
ucuucccuaccucag

SEQ ID NO: 1381033 - RNA, 23 nt, Homo sapiens
ucuucccuuuuacauacugcugu

SEQ ID NO: 1381034 - RNA, 20 nt, Homo sapiens
ucuucgagccggcaacggca

SEQ ID NO: 1381035 - RNA, 13 nt, Homo sapiens
ucuucucuacucu

SEQ ID NO: 1381036 - RNA, 14 nt, Homo sapiens
ucuucucuacucua

SEQ ID NO: 1381037 - RNA, 18 nt, Homo sapiens
ucuucugauuugucccua

SEQ ID NO: 1381038 - RNA, 20 nt, Homo sapiens
ucuucugggaacuuccucag

SEQ ID NO: 1381039 - RNA, 14 nt, Homo sapiens
ucuucuuacuugau

SEQ ID NO: 1381040 - RNA, 15 nt, Homo sapiens
ucuucuuagcaccac

SEQ ID NO: 1381041 - RNA, 19 nt, Homo sapiens
ucuucuuuuuuugugaugu

SEQ ID NO: 1381042 - RNA, 13 nt, Homo sapiens
ucuugaaagcugu

SEQ ID NO: 1381043 - RNA, 12 nt, Homo sapiens
ucuugacauuca

SEQ ID NO: 1381044 - RNA, 14 nt, Homo sapiens
ucuugccacugcac

SEQ ID NO: 1381045 - RNA, 22 nt, Homo sapiens
ucuugcucuaucucacagcaca

SEQ ID NO: 1381046 - RNA, 19 nt, Homo sapiens
ucuuggguguuuauccuau

SEQ ID NO: 1381047 - RNA, 17 nt, Homo sapiens
ucuuguuccccacugac

SEQ ID NO: 1381048 - RNA, 18 nt, Homo sapiens
ucuuguuguuauucagaa

SEQ ID NO: 1381049 - RNA, 22 nt, Homo sapiens
ucuuguuucaauuccaccugca

SEQ ID NO: 1381050 - RNA, 18 nt, Homo sapiens
ucuuguuuuaagugccuu

SEQ ID NO: 1381051 - RNA, 22 nt, Homo sapiens
ucuuguuuuuuuuuuccacuua

SEQ ID NO: 1381052 - RNA, 14 nt, Homo sapiens
ucuuuaagaugugu

SEQ ID NO: 1381053 - RNA, 18 nt, Homo sapiens
ucuuuauaaucuacuccu

SEQ ID NO: 1381054 - RNA, 18 nt, Homo sapiens
ucuuucaggacucuaccu

SEQ ID NO: 1381055 - RNA, 9 nt, Homo sapiens
ucuuuccau

SEQ ID NO: 1381056 - RNA, 20 nt, Homo sapiens
ucuuucccuuuaucaguuug

SEQ ID NO: 1381057 - RNA, 20 nt, Homo sapiens
ucuuucuaacuccagugaag

SEQ ID NO: 1381058 - RNA, 17 nt, Homo sapiens
ucuuuuaagcccaucaa

SEQ ID NO: 1381059 - RNA, 23 nt, Homo sapiens
ucuuuucugcaucaucuguagau

SEQ ID NO: 1381060 - RNA, 16 nt, Homo sapiens
ucuuuugaacccagga

SEQ ID NO: 1381061 - RNA, 20 nt, Homo sapiens
ucuuuuuaauaaaaaggcac

SEQ ID NO: 1381062 - RNA, 17 nt, Homo sapiens
ugaaaaacagaaagcau

SEQ ID NO: 1381063 - RNA, 19 nt, Homo sapiens
ugaaaaacagaaagcaucc

SEQ ID NO: 1381064 - RNA, 22 nt, Homo sapiens
ugaaaaacagaaagcauccuaa

SEQ ID NO: 1381065 - RNA, 17 nt, Homo sapiens
ugaaaaauaagucacuu

SEQ ID NO: 1381066 - RNA, 13 nt, Homo sapiens
ugaaaaaugccuc

SEQ ID NO: 1381067 - RNA, 16 nt, Homo sapiens
ugaaaagaugguauca

SEQ ID NO: 1381068 - RNA, 17 nt, Homo sapiens
ugaaaagaugguaucau

SEQ ID NO: 1381069 - RNA, 11 nt, Homo sapiens
ugaaaagccau

SEQ ID NO: 1381070 - RNA, 15 nt, Homo sapiens
ugaaaaggguguugc

SEQ ID NO: 1381071 - RNA, 14 nt, Homo sapiens
uggaaaaggaagac

SEQ ID NO: 1381072 - RNA, 14 nt, Homo sapiens
uggaaaauauguaa

SEQ ID NO: 1381073 - RNA, 21 nt, Homo sapiens
uggaaacaaaguggaaggaaa

SEQ ID NO: 1381074 - RNA, 18 nt, Homo sapiens
uggaaacuguugccagag

SEQ ID NO: 1381075 - RNA, 17 nt, Homo sapiens
uggaaagacauagccaa

SEQ ID NO: 1381076 - RNA, 22 nt, Homo sapiens
uggaaaggcucagucucaggag

SEQ ID NO: 1381077 - RNA, 21 nt, Homo sapiens
uggaacagcgggagaccugug

SEQ ID NO: 1381078 - RNA, 14 nt, Homo sapiens
uggaagcacagcuu

SEQ ID NO: 1381079 - RNA, 16 nt, Homo sapiens
uggaagcccuccuucc

SEQ ID NO: 1381080 - RNA, 15 nt, Homo sapiens
uggaagcucugaagu

SEQ ID NO: 1381081 - RNA, 18 nt, Homo sapiens
uggaagcuguguccuugc

SEQ ID NO: 1381082 - RNA, 12 nt, Homo sapiens
uggaagggucaa

SEQ ID NO: 1381083 - RNA, 13 nt, Homo sapiens
uggaauguaauca

SEQ ID NO: 1381084 - RNA, 16 nt, Homo sapiens
uggaauguacucuguu

SEQ ID NO: 1381085 - RNA, 17 nt, Homo sapiens
uggacacgucggacagc

SEQ ID NO: 1381086 - RNA, 19 nt, Homo sapiens
uggacucaguuuucuugca

SEQ ID NO: 1381087 - RNA, 23 nt, Homo sapiens
uggacucauugcuucacaaccca

SEQ ID NO: 1381088 - RNA, 15 nt, Homo sapiens
uggacugucauagaa

SEQ ID NO: 1381089 - RNA, 23 nt, Homo sapiens
uggacugugggacccuccuggug

SEQ ID NO: 1381090 - RNA, 23 nt, Homo sapiens
uggagaaacccuugaaaagacau

SEQ ID NO: 1381091 - RNA, 22 nt, Homo sapiens
uggagauggggagaaaccuaca

SEQ ID NO: 1381092 - RNA, 22 nt, Homo sapiens
uggagccccagugccaagcaca

SEQ ID NO: 1381093 - RNA, 23 nt, Homo sapiens
uggagccccagugccaagcacag

SEQ ID NO: 1381094 - RNA, 15 nt, Homo sapiens
uggaggaaaacugag

SEQ ID NO: 1381095 - RNA, 16 nt, Homo sapiens
uggaggaaaacugaga

SEQ ID NO: 1381096 - RNA, 18 nt, Homo sapiens
uggaggcugucuucucag

SEQ ID NO: 1381097 - RNA, 15 nt, Homo sapiens
uggagggauaagcca

SEQ ID NO: 1381098 - RNA, 18 nt, Homo sapiens
uggaguccgaugauucuc

SEQ ID NO: 1381099 - RNA, 18 nt, Homo sapiens
uggauaucaaaagcaaau

SEQ ID NO: 1381100 - RNA, 19 nt, Homo sapiens
uggauauuagucauagaag

SEQ ID NO: 1381101 - RNA, 19 nt, Homo sapiens
uggaucuccauucucucag

SEQ ID NO: 1381102 - RNA, 22 nt, Homo sapiens
uggaugccaaccggucacccag

SEQ ID NO: 1381103 - RNA, 13 nt, Homo sapiens
uggaugcuccuuc

SEQ ID NO: 1381104 - RNA, 13 nt, Homo sapiens
uggauguucugac

SEQ ID NO: 1381105 - RNA, 17 nt, Homo sapiens
uggauuaguuaacagac

SEQ ID NO: 1381106 - RNA, 15 nt, Homo sapiens
uggauucgugacaac

SEQ ID NO: 1381107 - RNA, 17 nt, Homo sapiens
uggauuugccugugcca

SEQ ID NO: 1381108 - RNA, 21 nt, Homo sapiens
uggauuuuacauguggcccaa

SEQ ID NO: 1381109 - RNA, 18 nt, Homo sapiens
uggcaacaacaaagccaa

SEQ ID NO: 1381110 - RNA, 18 nt, Homo sapiens
uggcaacaucuugcaaaa

SEQ ID NO: 1381111 - RNA, 22 nt, Homo sapiens
uggcaaccugcuuucaagaccc

SEQ ID NO: 1381112 - RNA, 14 nt, Homo sapiens
uggcaacugcugau

SEQ ID NO: 1381113 - RNA, 14 nt, Homo sapiens
uggcagaaagcaaa

SEQ ID NO: 1381114 - RNA, 15 nt, Homo sapiens
uggcagcugucucaa

SEQ ID NO: 1381115 - RNA, 16 nt, Homo sapiens
uggcaucccaguggcc

SEQ ID NO: 1381116 - RNA, 12 nt, Homo sapiens
uggcaugccuuc

SEQ ID NO: 1381117 - RNA, 14 nt, Homo sapiens
uggcaugccuucca

SEQ ID NO: 1381118 - RNA, 17 nt, Homo sapiens
uggcaugccuuccagca

SEQ ID NO: 1381119 - RNA, 20 nt, Homo sapiens
uggcauugucuguaaugaca

SEQ ID NO: 1381120 - RNA, 17 nt, Homo sapiens
uggccagugugauccca

SEQ ID NO: 1381121 - RNA, 22 nt, Homo sapiens
uggcccaagugguuugugcuaa

SEQ ID NO: 1381122 - RNA, 13 nt, Homo sapiens
uggcccacgcacu

SEQ ID NO: 1381123 - RNA, 13 nt, Homo sapiens
uggcccacugcau

SEQ ID NO: 1381124 - RNA, 17 nt, Homo sapiens
uggcccagggaagccaa

SEQ ID NO: 1381125 - RNA, 23 nt, Homo sapiens
uggcccccgagcugggggccaug

SEQ ID NO: 1381126 - RNA, 15 nt, Homo sapiens
uggccccuucacuuc

SEQ ID NO: 1381127 - RNA, 14 nt, Homo sapiens
uggccugcacuggu

SEQ ID NO: 1381128 - RNA, 21 nt, Homo sapiens
uggccuggggaagcugugaaa

SEQ ID NO: 1381129 - RNA, 14 nt, Homo sapiens
uggccuuuaggaag

SEQ ID NO: 1381130 - RNA, 15 nt, Homo sapiens
uggcucccaugacca

SEQ ID NO: 1381131 - RNA, 22 nt, Homo sapiens
uggcuccccuuuuucuuccuca

SEQ ID NO: 1381132 - RNA, 15 nt, Homo sapiens
uggcucuacuuucag

SEQ ID NO: 1381133 - RNA, 16 nt, Homo sapiens
uggcugaggauuucaa

SEQ ID NO: 1381134 - RNA, 17 nt, Homo sapiens
uggcugauggaguaaau

SEQ ID NO: 1381135 - RNA, 20 nt, Homo sapiens
uggcuguagaaggagacaga

SEQ ID NO: 1381136 - RNA, 19 nt, Homo sapiens
uggcugugggcucccuucc

SEQ ID NO: 1381137 - RNA, 23 nt, Homo sapiens
uggcuuacuacaugugggagcuu

SEQ ID NO: 1381138 - RNA, 11 nt, Homo sapiens
uggcuucuuac

SEQ ID NO: 1381139 - RNA, 16 nt, Homo sapiens
uggcuugccacagcuc

SEQ ID NO: 1381140 - RNA, 17 nt, Homo sapiens
uggcuugccacagcucu

SEQ ID NO: 1381141 - RNA, 22 nt, Homo sapiens
uggcuugggacuaaaugcccug

SEQ ID NO: 1381142 - RNA, 16 nt, Homo sapiens
uggcuuucuggcugcu

SEQ ID NO: 1381143 - RNA, 19 nt, Homo sapiens
uggcuuugucccacagcuu

SEQ ID NO: 1381144 - RNA, 22 nt, Homo sapiens
ugggaaaaauucagagaguuag

SEQ ID NO: 1381145 - RNA, 15 nt, Homo sapiens
ugggaaaaccagacu

SEQ ID NO: 1381146 - RNA, 17 nt, Homo sapiens
ugggaacuccuaaauca

SEQ ID NO: 1381147 - RNA, 14 nt, Homo sapiens
ugggacugcugcuu

SEQ ID NO: 1381148 - RNA, 15 nt, Homo sapiens
ugggacugcugcuuc

SEQ ID NO: 1381149 - RNA, 20 nt, Homo sapiens
ugggacuguacacacuuuau

SEQ ID NO: 1381150 - RNA, 18 nt, Homo sapiens
ugggagacugcugaguca

SEQ ID NO: 1381151 - RNA, 19 nt, Homo sapiens
ugggagggguugaugccag

SEQ ID NO: 1381152 - RNA, 14 nt, Homo sapiens
ugggagucaucuca

SEQ ID NO: 1381153 - RNA, 14 nt, Homo sapiens
ugggagugagggau

SEQ ID NO: 1381154 - RNA, 20 nt, Homo sapiens
ugggauccuaagggcucacc

SEQ ID NO: 1381155 - RNA, 18 nt, Homo sapiens
ugggaucugugcccagag

SEQ ID NO: 1381156 - RNA, 18 nt, Homo sapiens
ugggaugaugccucauga

SEQ ID NO: 1381157 - RNA, 16 nt, Homo sapiens
ugggauguccacagau

SEQ ID NO: 1381158 - RNA, 17 nt, Homo sapiens
ugggauuacagguguga

SEQ ID NO: 1381159 - RNA, 19 nt, Homo sapiens
ugggcaacaacagcaaaac

SEQ ID NO: 1381160 - RNA, 12 nt, Homo sapiens
ugggcacaacca

SEQ ID NO: 1381161 - RNA, 15 nt, Homo sapiens
ugggcagcauacuga

SEQ ID NO: 1381162 - RNA, 13 nt, Homo sapiens
ugggcagcuguua

SEQ ID NO: 1381163 - RNA, 21 nt, Homo sapiens
ugggcagcuguuagaguccaa

SEQ ID NO: 1381164 - RNA, 16 nt, Homo sapiens
ugggcaggaccucaga

SEQ ID NO: 1381165 - RNA, 20 nt, Homo sapiens
ugggccccucugacucccaa

SEQ ID NO: 1381166 - RNA, 21 nt, Homo sapiens
ugggccgggcaauccagacag

SEQ ID NO: 1381167 - RNA, 21 nt, Homo sapiens
ugggcucgccacaucccauga

SEQ ID NO: 1381168 - RNA, 19 nt, Homo sapiens
ugggcuggugucaccugaa

SEQ ID NO: 1381169 - RNA, 11 nt, Homo sapiens
ugggcuucuag

SEQ ID NO: 1381170 - RNA, 13 nt, Homo sapiens
ugggcuucuagaa

SEQ ID NO: 1381171 - RNA, 15 nt, Homo sapiens
uggggagaaaagaca

SEQ ID NO: 1381172 - RNA, 16 nt, Homo sapiens
uggggagaaaguacuu

SEQ ID NO: 1381173 - RNA, 17 nt, Homo sapiens
uggggagaucggggcca

SEQ ID NO: 1381174 - RNA, 18 nt, Homo sapiens
uggggagccugagccaca

SEQ ID NO: 1381175 - RNA, 15 nt, Homo sapiens
uggggagucagggac

SEQ ID NO: 1381176 - RNA, 21 nt, Homo sapiens
uggggauacuggcaaagcaga

SEQ ID NO: 1381177 - RNA, 18 nt, Homo sapiens
uggggcugaucucaggga

SEQ ID NO: 1381178 - RNA, 14 nt, Homo sapiens
ugggggaugcuuca

SEQ ID NO: 1381179 - RNA, 16 nt, Homo sapiens
ugggggcugugauauu

SEQ ID NO: 1381180 - RNA, 21 nt, Homo sapiens
ugggguacccacugcucuggu

SEQ ID NO: 1381181 - RNA, 20 nt, Homo sapiens
uggguaagacuaaaucugua

SEQ ID NO: 1381182 - RNA, 22 nt, Homo sapiens
uggguaauaaccaagauggagu

SEQ ID NO: 1381183 - RNA, 22 nt, Homo sapiens
uggguauaaaggcuaaaaggga

SEQ ID NO: 1381184 - RNA, 20 nt, Homo sapiens
uucaucagacuccugugcaa

SEQ ID NO: 1381185 - RNA, 15 nt, Homo sapiens
uucaucccacuccaa

SEQ ID NO: 1381186 - RNA, 18 nt, Homo sapiens
uucaucuauuucugagaa

SEQ ID NO: 1381187 - RNA, 19 nt, Homo sapiens
uucaugauuagcaaguuac

SEQ ID NO: 1381188 - RNA, 18 nt, Homo sapiens
uucauuaauacagggcau

SEQ ID NO: 1381189 - RNA, 21 nt, Homo sapiens
uucauucaggcaacgcacaaa

SEQ ID NO: 1381190 - RNA, 21 nt, Homo sapiens
uucauuccuaacacagcaugu

SEQ ID NO: 1381191 - RNA, 23 nt, Homo sapiens
uucauuccuaacacagcaugugu

SEQ ID NO: 1381192 - RNA, 23 nt, Homo sapiens
uucauuucagauaaacaacaaau

SEQ ID NO: 1381193 - RNA, 23 nt, Homo sapiens
uucauuuggcauuccccacuuga

SEQ ID NO: 1381194 - RNA, 13 nt, Homo sapiens
uuccaaaaaccau

SEQ ID NO: 1381195 - RNA, 15 nt, Homo sapiens
uuccaaacacauaca

SEQ ID NO: 1381196 - RNA, 16 nt, Homo sapiens
uuccaaacacauacag

SEQ ID NO: 1381197 - RNA, 14 nt, Homo sapiens
uuccaaauucacaa

SEQ ID NO: 1381198 - RNA, 16 nt, Homo sapiens
uuccaacguggcccag

SEQ ID NO: 1381199 - RNA, 20 nt, Homo sapiens
uuccaauuuuguugcaucau

SEQ ID NO: 1381200 - RNA, 16 nt, Homo sapiens
uuccacaauucacuag

SEQ ID NO: 1381201 - RNA, 18 nt, Homo sapiens
uuccacaccuagcaucuc

SEQ ID NO: 1381202 - RNA, 19 nt, Homo sapiens
uuccaccagccugcacuac

SEQ ID NO: 1381203 - RNA, 22 nt, Homo sapiens
uuccagaaggcaaaaagacauu

SEQ ID NO: 1381204 - RNA, 21 nt, Homo sapiens
uuccagagucaucuaccugag

SEQ ID NO: 1381205 - RNA, 18 nt, Homo sapiens
uuccaggcgaugugcaag

SEQ ID NO: 1381206 - RNA, 17 nt, Homo sapiens
uuccaguggccuggcuc

SEQ ID NO: 1381207 - RNA, 16 nt, Homo sapiens
uuccauuaugauucuu

SEQ ID NO: 1381208 - RNA, 20 nt, Homo sapiens
uuccauuugugugugugcaa

SEQ ID NO: 1381209 - RNA, 23 nt, Homo sapiens
uuccauuuuuauuucaaaauaua

SEQ ID NO: 1381210 - RNA, 16 nt, Homo sapiens
uucccaaacuugacag

SEQ ID NO: 1381211 - RNA, 19 nt, Homo sapiens
uucccaauaaauacuugcc

SEQ ID NO: 1381212 - RNA, 19 nt, Homo sapiens
uucccaauagcacuuucau

SEQ ID NO: 1381213 - RNA, 22 nt, Homo sapiens
uucccagcuucugccacauaaa

SEQ ID NO: 1381214 - RNA, 15 nt, Homo sapiens
uucccaggaguacac

SEQ ID NO: 1381215 - RNA, 20 nt, Homo sapiens
uucccaucuuccaaggguac

SEQ ID NO: 1381216 - RNA, 15 nt, Homo sapiens
uucccccaguaccuc

SEQ ID NO: 1381217 - RNA, 14 nt, Homo sapiens
uuccccucacuauc

SEQ ID NO: 1381218 - RNA, 19 nt, Homo sapiens
uucccggcgucccuaccuc

SEQ ID NO: 1381219 - RNA, 21 nt, Homo sapiens
uucccggguagccacuggacu

SEQ ID NO: 1381220 - RNA, 22 nt, Homo sapiens
uucccugaauguauugaacuug

SEQ ID NO: 1381221 - RNA, 13 nt, Homo sapiens
uucccugagucac

SEQ ID NO: 1381222 - RNA, 21 nt, Homo sapiens
uucccuucuccuuccaacugc

SEQ ID NO: 1381223 - RNA, 13 nt, Homo sapiens
uuccgcaccaaua

SEQ ID NO: 1381224 - RNA, 21 nt, Homo sapiens
uuccgcaccaauaaagccuuc

SEQ ID NO: 1381225 - RNA, 12 nt, Homo sapiens
uuccguuuccag

SEQ ID NO: 1381226 - RNA, 22 nt, Homo sapiens
uuccuaaggcacccacaaauaa

SEQ ID NO: 1381227 - RNA, 21 nt, Homo sapiens
uuccuagaaacugacacaugc

SEQ ID NO: 1381228 - RNA, 17 nt, Homo sapiens
uuccuaucccaucccau

SEQ ID NO: 1381229 - RNA, 15 nt, Homo sapiens
uuccuauuucuggaa

SEQ ID NO: 1381230 - RNA, 22 nt, Homo sapiens
uuccucuaugaaaauuauaucu

SEQ ID NO: 1381231 - RNA, 15 nt, Homo sapiens
uuccugaaugaaaua

SEQ ID NO: 1381232 - RNA, 11 nt, Homo sapiens
uuccugccacc

SEQ ID NO: 1381233 - RNA, 19 nt, Homo sapiens
uuccugccaccugcugcug

SEQ ID NO: 1381234 - RNA, 21 nt, Homo sapiens
uuccuggagcccgaggcacca

SEQ ID NO: 1381235 - RNA, 15 nt, Homo sapiens
uuccuggcaauagug

SEQ ID NO: 1381236 - RNA, 16 nt, Homo sapiens
uuccuggcuacuccau

SEQ ID NO: 1381237 - RNA, 20 nt, Homo sapiens
uuccuggcuccaacacugcu

SEQ ID NO: 1381238 - RNA, 16 nt, Homo sapiens
uuccuuaaacugugug

SEQ ID NO: 1381239 - RNA, 19 nt, Homo sapiens
uuccuucagacagauucca

SEQ ID NO: 1381240 - RNA, 20 nt, Homo sapiens
uuccuucagugcaucuggga

SEQ ID NO: 1381241 - RNA, 19 nt, Homo sapiens
uuccuucucaucugugauu

SEQ ID NO: 1381242 - RNA, 16 nt, Homo sapiens
uuccuugaccagcaga

SEQ ID NO: 1381243 - RNA, 11 nt, Homo sapiens
uuccuugagaa

SEQ ID NO: 1381244 - RNA, 24 nt, Homo sapiens
uuccuuucccuuuagcacguuuaa

SEQ ID NO: 1381245 - RNA, 21 nt, Homo sapiens
uuccuuuuaaaacacuuccau

SEQ ID NO: 1381246 - RNA, 15 nt, Homo sapiens
uucgaauccagagag

SEQ ID NO: 1381247 - RNA, 17 nt, Homo sapiens
uucguauucccauuaga

SEQ ID NO: 1381248 - RNA, 19 nt, Homo sapiens
uucuaaaaauaaaaguauu

SEQ ID NO: 1381249 - RNA, 17 nt, Homo sapiens
uucuaaaugaagugcaa

SEQ ID NO: 1381250 - RNA, 23 nt, Homo sapiens
uucuaaaugaauguuuacacucu

SEQ ID NO: 1381251 - RNA, 14 nt, Homo sapiens
uucuaaaugcauau

SEQ ID NO: 1381252 - RNA, 16 nt, Homo sapiens
uucuaacuccagugaa

SEQ ID NO: 1381253 - RNA, 21 nt, Homo sapiens
uucuaaguggaaaaaguauua

SEQ ID NO: 1381254 - RNA, 19 nt, Homo sapiens
uucuacacuguauuacaua

SEQ ID NO: 1381255 - RNA, 17 nt, Homo sapiens
uucuacugaacagucca

SEQ ID NO: 1381256 - RNA, 21 nt, Homo sapiens
uucuacuuacacaucuuccac

SEQ ID NO: 1381257 - RNA, 13 nt, Homo sapiens
uucuagcuacaau

SEQ ID NO: 1381258 - RNA, 16 nt, Homo sapiens
uucuaggaagcuccag

SEQ ID NO: 1381259 - RNA, 17 nt, Homo sapiens
uucuaggaagcuccagu

SEQ ID NO: 1381260 - RNA, 18 nt, Homo sapiens
uucuagugauuucugggg

SEQ ID NO: 1381261 - RNA, 17 nt, Homo sapiens
uucuauuucuaucccaa

SEQ ID NO: 1381262 - RNA, 16 nt, Homo sapiens
uucuauuuuuguagaa

SEQ ID NO: 1381263 - RNA, 23 nt, Homo sapiens
uucucaagcccugcagucacagc

SEQ ID NO: 1381264 - RNA, 16 nt, Homo sapiens
uucucacuccaccacc

SEQ ID NO: 1381265 - RNA, 22 nt, Homo sapiens
uucucagaccugcgcacuccau

SEQ ID NO: 1381266 - RNA, 22 nt, Homo sapiens
uucucauccuuccucauuugca

SEQ ID NO: 1381267 - RNA, 11 nt, Homo sapiens
uucuccacugg

SEQ ID NO: 1381268 - RNA, 20 nt, Homo sapiens
uucuccaugcugagaacaaa

SEQ ID NO: 1381269 - RNA, 16 nt, Homo sapiens
uucucuauugcugcuc

SEQ ID NO: 1381270 - RNA, 20 nt, Homo sapiens
uucucucuccagucuuccac

SEQ ID NO: 1381271 - RNA, 14 nt, Homo sapiens
uucucugaaggaca

SEQ ID NO: 1381272 - RNA, 22 nt, Homo sapiens
uucucuugagaggguggaauau

SEQ ID NO: 1381273 - RNA, 16 nt, Homo sapiens
uucugaauugacugua

SEQ ID NO: 1381274 - RNA, 13 nt, Homo sapiens
uucugacaucagc

SEQ ID NO: 1381275 - RNA, 18 nt, Homo sapiens
uucugacaucagcagaga

SEQ ID NO: 1381276 - RNA, 14 nt, Homo sapiens
uucuggaauguaau

SEQ ID NO: 1381277 - RNA, 13 nt, Homo sapiens
uucugggacacag

SEQ ID NO: 1381278 - RNA, 14 nt, Homo sapiens
uucugggugcagcu

SEQ ID NO: 1381279 - RNA, 19 nt, Homo sapiens
uucugggugcagcugagaa

SEQ ID NO: 1381280 - RNA, 13 nt, Homo sapiens
uucugugccucag

SEQ ID NO: 1381281 - RNA, 13 nt, Homo sapiens
uucuguugccaca

SEQ ID NO: 1381282 - RNA, 22 nt, Homo sapiens
uucuuaaccccaguaagccacu

SEQ ID NO: 1381283 - RNA, 17 nt, Homo sapiens
uucuuacaugcauuuga

SEQ ID NO: 1381284 - RNA, 15 nt, Homo sapiens
uucuuagacuuaucu

SEQ ID NO: 1381285 - RNA, 22 nt, Homo sapiens
uucuucaccuaagucucuguga

SEQ ID NO: 1381286 - RNA, 17 nt, Homo sapiens
uucuucaugcaaugaca

SEQ ID NO: 1381287 - RNA, 17 nt, Homo sapiens
uucuucucuuaauuuca

SEQ ID NO: 1381288 - RNA, 15 nt, Homo sapiens
uucuucugucaucua

SEQ ID NO: 1381289 - RNA, 21 nt, Homo sapiens
uucuugaguuuagugaucuga

SEQ ID NO: 1381290 - RNA, 21 nt, Homo sapiens
uucuuggagggcccacuugua

SEQ ID NO: 1381291 - RNA, 13 nt, Homo sapiens
uucuuguugcaaa

SEQ ID NO: 1381292 - RNA, 15 nt, Homo sapiens
uucuuucaaagaagc

SEQ ID NO: 1381293 - RNA, 20 nt, Homo sapiens
uucuuucuagcuaauggaaa

SEQ ID NO: 1381294 - RNA, 13 nt, Homo sapiens
uugaaaaccuggc

SEQ ID NO: 1381295 - RNA, 16 nt, Homo sapiens
uugaaaacucacagaa

SEQ ID NO: 1381296 - RNA, 17 nt, Homo sapiens
uuuuuauacagugauaa

SEQ ID NO: 1381297 - RNA, 19 nt, Homo sapiens
uuuuuuaaauaaaagcagc

SEQ ID NO: 1381298 - RNA, 13 nt, Homo sapiens
uuuuuucaccaau

SEQ ID NO: 1381299 - RNA, 17 nt, Homo sapiens
aaacauaauaaaaggag

SEQ ID NO: 1381300 - RNA, 10 nt, Homo sapiens
aaacaucagc

SEQ ID NO: 1381301 - RNA, 20 nt, Homo sapiens
aaacauuuucacacaauaca

SEQ ID NO: 1381302 - RNA, 23 nt, Homo sapiens
aaacauuuucuugaauggcaugc

SEQ ID NO: 1381303 - RNA, 18 nt, Homo sapiens
aaaccaaccgauugccuu

SEQ ID NO: 1381304 - RNA, 16 nt, Homo sapiens
aaaccaauagcuuuaa

SEQ ID NO: 1381305 - RNA, 17 nt, Homo sapiens
aaaccaggaacucugga

SEQ ID NO: 1381306 - RNA, 17 nt, Homo sapiens
aaacccaauucagucuc

SEQ ID NO: 1381307 - RNA, 13 nt, Homo sapiens
aaacccucaaggg

SEQ ID NO: 1381308 - RNA, 14 nt, Homo sapiens
aaaccucaagccag

SEQ ID NO: 1381309 - RNA, 22 nt, Homo sapiens
aaaccugauguuaaaauuccau

SEQ ID NO: 1381310 - RNA, 22 nt, Homo sapiens
aaaccugcaguuuuguuuguac

SEQ ID NO: 1381311 - RNA, 17 nt, Homo sapiens
aaaccugugugccauuu

SEQ ID NO: 1381312 - RNA, 14 nt, Homo sapiens
aaacgaaagcuggg

SEQ ID NO: 1381313 - RNA, 15 nt, Homo sapiens
aaacguuucaguaau

SEQ ID NO: 1381314 - RNA, 17 nt, Homo sapiens
aaacuaccuuccaguuc

SEQ ID NO: 1381315 - RNA, 14 nt, Homo sapiens
aaacucaguaucau

SEQ ID NO: 1381316 - RNA, 15 nt, Homo sapiens
aaacucauaacaguc

SEQ ID NO: 1381317 - RNA, 13 nt, Homo sapiens
aaacuccaucuca

SEQ ID NO: 1381318 - RNA, 15 nt, Homo sapiens
aaacugaaugaacaa

SEQ ID NO: 1381319 - RNA, 20 nt, Homo sapiens
aaacugaaugaacaaccucg

SEQ ID NO: 1381320 - RNA, 23 nt, Homo sapiens
aaacugcaauagagacuguagau

SEQ ID NO: 1381321 - RNA, 17 nt, Homo sapiens
aaacuguagucucagga

SEQ ID NO: 1381322 - RNA, 22 nt, Homo sapiens
aaacugucaaagaaucaaucca

SEQ ID NO: 1381323 - RNA, 22 nt, Homo sapiens
aaacuguuuauuugcacuauga

SEQ ID NO: 1381324 - RNA, 13 nt, Homo sapiens
aaacuucaagggu

SEQ ID NO: 1381325 - RNA, 13 nt, Homo sapiens
aaacuuccaguca

SEQ ID NO: 1381326 - RNA, 20 nt, Homo sapiens
aaacuucugcuuuaauggcu

SEQ ID NO: 1381327 - RNA, 12 nt, Homo sapiens
aaacuugacagu

SEQ ID NO: 1381328 - RNA, 17 nt, Homo sapiens
aaacuuuggcuuauaaa

SEQ ID NO: 1381329 - RNA, 20 nt, Homo sapiens
aaacuuuucuaauacucuac

SEQ ID NO: 1381330 - RNA, 14 nt, Homo sapiens
aaagaacuuggaaa

SEQ ID NO: 1381331 - RNA, 18 nt, Homo sapiens
aaagaaucgccaugccca

SEQ ID NO: 1381332 - RNA, 16 nt, Homo sapiens
aaagaaugcucuuuac

SEQ ID NO: 1381333 - RNA, 18 nt, Homo sapiens
aaagacaccuacugagug

SEQ ID NO: 1381334 - RNA, 14 nt, Homo sapiens
aaagacauagccaa

SEQ ID NO: 1381335 - RNA, 14 nt, Homo sapiens
aaagaccuaugagc

SEQ ID NO: 1381336 - RNA, 22 nt, Homo sapiens
aaagaccuuuuccaugcacccu

SEQ ID NO: 1381337 - RNA, 18 nt, Homo sapiens
aaagacugagcucaaggu

SEQ ID NO: 1381338 - RNA, 14 nt, Homo sapiens
aaagagaaacuuug

SEQ ID NO: 1381339 - RNA, 23 nt, Homo sapiens
aaagagaaacuuugugcuacaug

SEQ ID NO: 1381340 - RNA, 23 nt, Homo sapiens
aaagagagaucuugauccacaga

SEQ ID NO: 1381341 - RNA, 18 nt, Homo sapiens
aaagagagaugaaccaca

SEQ ID NO: 1381342 - RNA, 19 nt, Homo sapiens
aaagagagucgcaucucag

SEQ ID NO: 1381343 - RNA, 19 nt, Homo sapiens
aaagagguagcacuacaaa

SEQ ID NO: 1381344 - RNA, 18 nt, Homo sapiens
aaagauagcauuggggac

SEQ ID NO: 1381345 - RNA, 15 nt, Homo sapiens
aaagaugcccacuga

SEQ ID NO: 1381346 - RNA, 20 nt, Homo sapiens
aaagaugugcagauaucaca

SEQ ID NO: 1381347 - RNA, 16 nt, Homo sapiens
aaagauguuugucaga

SEQ ID NO: 1381348 - RNA, 16 nt, Homo sapiens
aaagauuugcuuuaau

SEQ ID NO: 1381349 - RNA, 19 nt, Homo sapiens
aaagauuugcuuuaauugu

SEQ ID NO: 1381350 - RNA, 17 nt, Homo sapiens
aaagcaaggaucuuuca

SEQ ID NO: 1381351 - RNA, 15 nt, Homo sapiens
aaagcaccuuagcug

SEQ ID NO: 1381352 - RNA, 15 nt, Homo sapiens
aaagcauccaugugu

SEQ ID NO: 1381353 - RNA, 13 nt, Homo sapiens
aaagcaugucuca

SEQ ID NO: 1381354 - RNA, 20 nt, Homo sapiens
aaagcauguggcauguucau

SEQ ID NO: 1381355 - RNA, 15 nt, Homo sapiens
aaagccaaaggucua

SEQ ID NO: 1381356 - RNA, 15 nt, Homo sapiens
aaagccaucaaacac

SEQ ID NO: 1381357 - RNA, 22 nt, Homo sapiens
aaagccaucaaacacaaugccu

SEQ ID NO: 1381358 - RNA, 12 nt, Homo sapiens
acccuucugccu

SEQ ID NO: 1381359 - RNA, 19 nt, Homo sapiens
acccuuggagccaauggag

SEQ ID NO: 1381360 - RNA, 20 nt, Homo sapiens
accggaggcaaaaggcagug

SEQ ID NO: 1381361 - RNA, 15 nt, Homo sapiens
accgggcugggagcu

SEQ ID NO: 1381362 - RNA, 20 nt, Homo sapiens
accgucaauaggcaaagggg

SEQ ID NO: 1381363 - RNA, 14 nt, Homo sapiens
accgugaccaucuu

SEQ ID NO: 1381364 - RNA, 14 nt, Homo sapiens
accgugggcacuga

SEQ ID NO: 1381365 - RNA, 16 nt, Homo sapiens
accuaaauuugguucu

SEQ ID NO: 1381366 - RNA, 17 nt, Homo sapiens
accuaacgagaaauaga

SEQ ID NO: 1381367 - RNA, 19 nt, Homo sapiens
accuaagucucugugaauu

SEQ ID NO: 1381368 - RNA, 16 nt, Homo sapiens
accuacccccaaaaaa

SEQ ID NO: 1381369 - RNA, 23 nt, Homo sapiens
accuacccccaaaaaacaauuau

SEQ ID NO: 1381370 - RNA, 12 nt, Homo sapiens
accuaguacaag

SEQ ID NO: 1381371 - RNA, 18 nt, Homo sapiens
accuaguggcccuucaca

SEQ ID NO: 1381372 - RNA, 13 nt, Homo sapiens
accuauguuugcu

SEQ ID NO: 1381373 - RNA, 18 nt, Homo sapiens
accucaaacuuccaguca

SEQ ID NO: 1381374 - RNA, 13 nt, Homo sapiens
accucaaccugug

SEQ ID NO: 1381375 - RNA, 16 nt, Homo sapiens
accucacuaugcugcu

SEQ ID NO: 1381376 - RNA, 12 nt, Homo sapiens
accucacugggg

SEQ ID NO: 1381377 - RNA, 19 nt, Homo sapiens
accucagccucccaaagug

SEQ ID NO: 1381378 - RNA, 22 nt, Homo sapiens
accucagugaaagcagucaucu

SEQ ID NO: 1381379 - RNA, 17 nt, Homo sapiens
accucagugucauuuau

SEQ ID NO: 1381380 - RNA, 11 nt, Homo sapiens
accucaucucc

SEQ ID NO: 1381381 - RNA, 15 nt, Homo sapiens
accuccacagcuucc

SEQ ID NO: 1381382 - RNA, 20 nt, Homo sapiens
accuccuccucuggacaaag

SEQ ID NO: 1381383 - RNA, 23 nt, Homo sapiens
accuccugaccugucaccgugag

SEQ ID NO: 1381384 - RNA, 19 nt, Homo sapiens
accucgugauccaccugcc

SEQ ID NO: 1381385 - RNA, 16 nt, Homo sapiens
accucucucacugacu

SEQ ID NO: 1381386 - RNA, 23 nt, Homo sapiens
accucugccugaagucacacagu

SEQ ID NO: 1381387 - RNA, 17 nt, Homo sapiens
accucuggacuggcuag

SEQ ID NO: 1381388 - RNA, 15 nt, Homo sapiens
accugaaacaaccca

SEQ ID NO: 1381389 - RNA, 13 nt, Homo sapiens
accugagaaccuu

SEQ ID NO: 1381390 - RNA, 23 nt, Homo sapiens
accugcaccuccccccacugcag

SEQ ID NO: 1381391 - RNA, 16 nt, Homo sapiens
accugcgggagcugca

SEQ ID NO: 1381392 - RNA, 19 nt, Homo sapiens
accugcucuccucuugcca

SEQ ID NO: 1381393 - RNA, 19 nt, Homo sapiens
accugcugagggaccagcc

SEQ ID NO: 1381394 - RNA, 11 nt, Homo sapiens
accugcugcug

SEQ ID NO: 1381395 - RNA, 22 nt, Homo sapiens
accuguagucccagcuacucag

SEQ ID NO: 1381396 - RNA, 13 nt, Homo sapiens
accuguccuugca

SEQ ID NO: 1381397 - RNA, 22 nt, Homo sapiens
accugugacuaaacaacuaccu

SEQ ID NO: 1381398 - RNA, 19 nt, Homo sapiens
accuguuuuuaagcuguuu

SEQ ID NO: 1381399 - RNA, 23 nt, Homo sapiens
accuuaaacuuucaauaucuuua

SEQ ID NO: 1381400 - RNA, 16 nt, Homo sapiens
accuuaggcagggaag

SEQ ID NO: 1381401 - RNA, 17 nt, Homo sapiens
accuuauuguaccucuc

SEQ ID NO: 1381402 - RNA, 15 nt, Homo sapiens
acugccaugccagcu

SEQ ID NO: 1381403 - RNA, 20 nt, Homo sapiens
acugccaugcuagacaagcu

SEQ ID NO: 1381404 - RNA, 18 nt, Homo sapiens
acugccauggaggcacac

SEQ ID NO: 1381405 - RNA, 23 nt, Homo sapiens
acugcccgagcuggugcauuaca

SEQ ID NO: 1381406 - RNA, 14 nt, Homo sapiens
acugccuaagcccu

SEQ ID NO: 1381407 - RNA, 13 nt, Homo sapiens
acugccucuggaa

SEQ ID NO: 1381408 - RNA, 18 nt, Homo sapiens
acugccuuccacaauuca

SEQ ID NO: 1381409 - RNA, 17 nt, Homo sapiens
acugcucaucauuccuu

SEQ ID NO: 1381410 - RNA, 21 nt, Homo sapiens
acugcugcuucuuaaccccag

SEQ ID NO: 1381411 - RNA, 19 nt, Homo sapiens
acugcuucuaccaacugga

SEQ ID NO: 1381412 - RNA, 13 nt, Homo sapiens
acuggacucagga

SEQ ID NO: 1381413 - RNA, 20 nt, Homo sapiens
acuggacuugagcuuggcag

SEQ ID NO: 1381414 - RNA, 21 nt, Homo sapiens
acuggagcuucucuuuaacuc

SEQ ID NO: 1381415 - RNA, 17 nt, Homo sapiens
acuggaguccagucucu

SEQ ID NO: 1381416 - RNA, 12 nt, Homo sapiens
acuggaucccag

SEQ ID NO: 1381417 - RNA, 22 nt, Homo sapiens
acuggauuggccaaacaucaga

SEQ ID NO: 1381418 - RNA, 19 nt, Homo sapiens
acuggcacagucuuugcau

SEQ ID NO: 1381419 - RNA, 18 nt, Homo sapiens
acuggcaucugacacaaa

SEQ ID NO: 1381420 - RNA, 14 nt, Homo sapiens
acuggcugauggag

SEQ ID NO: 1381421 - RNA, 14 nt, Homo sapiens
acuggcugcaaagg

SEQ ID NO: 1381422 - RNA, 19 nt, Homo sapiens
acugggugaggauaacaca

SEQ ID NO: 1381423 - RNA, 14 nt, Homo sapiens
acuggugagcagac

SEQ ID NO: 1381424 - RNA, 23 nt, Homo sapiens
acugguucauauuggacugauaa

SEQ ID NO: 1381425 - RNA, 13 nt, Homo sapiens
acuguaaagaauu

SEQ ID NO: 1381426 - RNA, 17 nt, Homo sapiens
acuguacacacuuuauu

SEQ ID NO: 1381427 - RNA, 14 nt, Homo sapiens
acuguacucugcac

SEQ ID NO: 1381428 - RNA, 23 nt, Homo sapiens
acuguagaaaugaugauguggaa

SEQ ID NO: 1381429 - RNA, 18 nt, Homo sapiens
acuguauauaaacauauc

SEQ ID NO: 1381430 - RNA, 14 nt, Homo sapiens
acuguauuuuccaa

SEQ ID NO: 1381431 - RNA, 22 nt, Homo sapiens
acugugaagagaaccauaucaa

SEQ ID NO: 1381432 - RNA, 18 nt, Homo sapiens
acugugccaugugccagg

SEQ ID NO: 1381433 - RNA, 21 nt, Homo sapiens
acuguggccuguuaacuggua

SEQ ID NO: 1381434 - RNA, 20 nt, Homo sapiens
acuguggcugcuagcacuug

SEQ ID NO: 1381435 - RNA, 20 nt, Homo sapiens
acugugucaggaaacauauu

SEQ ID NO: 1381436 - RNA, 21 nt, Homo sapiens
acugugucaggaaacauauuu

SEQ ID NO: 1381437 - RNA, 17 nt, Homo sapiens
acuguugcauaacuauu

SEQ ID NO: 1381438 - RNA, 16 nt, Homo sapiens
acuguuugcccagugu

SEQ ID NO: 1381439 - RNA, 20 nt, Homo sapiens
acuuaaaaaauguccaugau

SEQ ID NO: 1381440 - RNA, 15 nt, Homo sapiens
acuuaagacugugua

SEQ ID NO: 1381441 - RNA, 22 nt, Homo sapiens
acuuaagcugggauaaucacau

SEQ ID NO: 1381442 - RNA, 14 nt, Homo sapiens
acuuacacaagacu

SEQ ID NO: 1381443 - RNA, 17 nt, Homo sapiens
acuuacagauaggccuu

SEQ ID NO: 1381444 - RNA, 15 nt, Homo sapiens
acuuagcaugcacaa

SEQ ID NO: 1381445 - RNA, 22 nt, Homo sapiens
acuuauaauuaugcuaccuacu

SEQ ID NO: 1381446 - RNA, 14 nt, Homo sapiens
acuuaucuuacaaa

SEQ ID NO: 1381447 - RNA, 20 nt, Homo sapiens
acuuaugggcccagccagcc

SEQ ID NO: 1381448 - RNA, 20 nt, Homo sapiens
acuuauguauuuaugaccuu

SEQ ID NO: 1381449 - RNA, 19 nt, Homo sapiens
acuucaagagccucuggca

SEQ ID NO: 1381450 - RNA, 13 nt, Homo sapiens
acuucaaggguuu

SEQ ID NO: 1381451 - RNA, 20 nt, Homo sapiens
acuucaaguuaaagugaaua

SEQ ID NO: 1381452 - RNA, 17 nt, Homo sapiens
acuucaguugcuuugca

SEQ ID NO: 1381453 - RNA, 19 nt, Homo sapiens
acuucauuugaugcuaaau

SEQ ID NO: 1381454 - RNA, 11 nt, Homo sapiens
acuucccugaa

SEQ ID NO: 1381455 - RNA, 14 nt, Homo sapiens
acuucuacauccaa

SEQ ID NO: 1381456 - RNA, 21 nt, Homo sapiens
acuucuacauccaauguauga

SEQ ID NO: 1381457 - RNA, 19 nt, Homo sapiens
acuucuagagauaguacau

SEQ ID NO: 1381458 - RNA, 20 nt, Homo sapiens
acuucucucaucugggcaaa

SEQ ID NO: 1381459 - RNA, 18 nt, Homo sapiens
acuucugcuuuaauggcu

SEQ ID NO: 1381460 - RNA, 17 nt, Homo sapiens
acuucuuauacauuuga

SEQ ID NO: 1381461 - RNA, 18 nt, Homo sapiens
acuucuuauacauuugau

SEQ ID NO: 1381462 - RNA, 20 nt, Homo sapiens
acuugaaagcauccaugugu

SEQ ID NO: 1381463 - RNA, 14 nt, Homo sapiens
acuugaagccaucu

SEQ ID NO: 1381464 - RNA, 12 nt, Homo sapiens
acuugagcaugu

SEQ ID NO: 1381465 - RNA, 19 nt, Homo sapiens
acuugauguguuaucucuu

SEQ ID NO: 1381466 - RNA, 17 nt, Homo sapiens
acuugcauacagagaca

SEQ ID NO: 1381467 - RNA, 22 nt, Homo sapiens
acuugucaggguauaaaaugac

SEQ ID NO: 1381468 - RNA, 18 nt, Homo sapiens
acuuguccuuuuguacca

SEQ ID NO: 1381469 - RNA, 14 nt, Homo sapiens
acuuguggacacag

SEQ ID NO: 1381470 - RNA, 16 nt, Homo sapiens
acuuguuccagcucuu

SEQ ID NO: 1381471 - RNA, 17 nt, Homo sapiens
acuuuaauucucuuacu

SEQ ID NO: 1381472 - RNA, 19 nt, Homo sapiens
acuuucauuaaagcauuua

SEQ ID NO: 1381473 - RNA, 16 nt, Homo sapiens
aacagauguagcaaca

SEQ ID NO: 1381474 - RNA, 17 nt, Homo sapiens
aacagcacccucuccag

SEQ ID NO: 1381475 - RNA, 18 nt, Homo sapiens
aacagcagaacuucugaa

SEQ ID NO: 1381476 - RNA, 21 nt, Homo sapiens
aacagcauucuugucacaaua

SEQ ID NO: 1381477 - RNA, 23 nt, Homo sapiens
aacagccaaaacuccacagucaa

SEQ ID NO: 1381478 - RNA, 17 nt, Homo sapiens
aacagcccucaggucag

SEQ ID NO: 1381479 - RNA, 18 nt, Homo sapiens
aacaggaauucugaauua

SEQ ID NO: 1381480 - RNA, 19 nt, Homo sapiens
aacaggauuagacagucaa

SEQ ID NO: 1381481 - RNA, 15 nt, Homo sapiens
aacaguaacugccau

SEQ ID NO: 1381482 - RNA, 18 nt, Homo sapiens
aacaguauugacuuguau

SEQ ID NO: 1381483 - RNA, 13 nt, Homo sapiens
aacagugccauug

SEQ ID NO: 1381484 - RNA, 16 nt, Homo sapiens
aacaguguuggcuuuc

SEQ ID NO: 1381485 - RNA, 17 nt, Homo sapiens
aacaguguuggcuuuca

SEQ ID NO: 1381486 - RNA, 20 nt, Homo sapiens
aacaguuccuucagcuucca

SEQ ID NO: 1381487 - RNA, 15 nt, Homo sapiens
aacaguuuuccauga

SEQ ID NO: 1381488 - RNA, 22 nt, Homo sapiens
aacaguuuuuuaugcuaaucag

SEQ ID NO: 1381489 - RNA, 23 nt, Homo sapiens
aacauaagagagccuugguucau

SEQ ID NO: 1381490 - RNA, 22 nt, Homo sapiens
aacauagugaaaccccaucucu

SEQ ID NO: 1381491 - RNA, 23 nt, Homo sapiens
aacauauuggaauguacauguca

SEQ ID NO: 1381492 - RNA, 19 nt, Homo sapiens
aacaucaguuacucugaag

SEQ ID NO: 1381493 - RNA, 19 nt, Homo sapiens
aacauccuucaagaacucu

SEQ ID NO: 1381494 - RNA, 18 nt, Homo sapiens
aacaucgucuaaacuuua

SEQ ID NO: 1381495 - RNA, 16 nt, Homo sapiens
aacaucuagcuggcuu

SEQ ID NO: 1381496 - RNA, 24 nt, Homo sapiens
aacauggugaaaccucaucucuac

SEQ ID NO: 1381497 - RNA, 19 nt, Homo sapiens
aacauguaagcauaacuua

SEQ ID NO: 1381498 - RNA, 19 nt, Homo sapiens
aacaugugguuaaugccau

SEQ ID NO: 1381499 - RNA, 18 nt, Homo sapiens
aacauuaacaaaagcaau

SEQ ID NO: 1381500 - RNA, 23 nt, Homo sapiens
aacauuaguucuauuucuauccc

SEQ ID NO: 1381501 - RNA, 22 nt, Homo sapiens
aacauuauauugcaaugaagga

SEQ ID NO: 1381502 - RNA, 11 nt, Homo sapiens
aacauucugua

SEQ ID NO: 1381503 - RNA, 22 nt, Homo sapiens
aacauuguuuuguguaacauau

SEQ ID NO: 1381504 - RNA, 17 nt, Homo sapiens
aaccaaagacuacauau

SEQ ID NO: 1381505 - RNA, 19 nt, Homo sapiens
aaccacaggcagcauuuag

SEQ ID NO: 1381506 - RNA, 13 nt, Homo sapiens
aaccacuguacau

SEQ ID NO: 1381507 - RNA, 21 nt, Homo sapiens
aaccacuuaaaaaauguccau

SEQ ID NO: 1381508 - RNA, 18 nt, Homo sapiens
aaccacuucauucuugaa

SEQ ID NO: 1381509 - RNA, 17 nt, Homo sapiens
aaccagagccauggacu

SEQ ID NO: 1381510 - RNA, 16 nt, Homo sapiens
aaccaggaaccuccuc

SEQ ID NO: 1381511 - RNA, 20 nt, Homo sapiens
aaccaggaauccacucucca

SEQ ID NO: 1381512 - RNA, 19 nt, Homo sapiens
aaccaggguuuaucuuuug

SEQ ID NO: 1381513 - RNA, 14 nt, Homo sapiens
aaccauauggauau

SEQ ID NO: 1381514 - RNA, 15 nt, Homo sapiens
aaccaugaaaauggg

SEQ ID NO: 1381515 - RNA, 22 nt, Homo sapiens
aaccaugagaccacuguuauca

SEQ ID NO: 1381516 - RNA, 16 nt, Homo sapiens
aacccauugucuuuac

SEQ ID NO: 1381517 - RNA, 16 nt, Homo sapiens
aaccccaaacuguuga

SEQ ID NO: 1381518 - RNA, 16 nt, Homo sapiens
aaccccaucucuacaa

SEQ ID NO: 1381519 - RNA, 22 nt, Homo sapiens
aacccuggaucaguccuuugau

SEQ ID NO: 1381520 - RNA, 19 nt, Homo sapiens
aaccgcaggaagcugcucc

SEQ ID NO: 1381521 - RNA, 16 nt, Homo sapiens
aaccggucacccagga

SEQ ID NO: 1381522 - RNA, 21 nt, Homo sapiens
aaccuacucacuuagcaugaa

SEQ ID NO: 1381523 - RNA, 20 nt, Homo sapiens
aaccucaggcuuccuuggca

SEQ ID NO: 1381524 - RNA, 20 nt, Homo sapiens
aaccuccccaacagcacuua

SEQ ID NO: 1381525 - RNA, 12 nt, Homo sapiens
cuugccagacau

SEQ ID NO: 1381526 - RNA, 22 nt, Homo sapiens
cuugccccuguuaccuaauuag

SEQ ID NO: 1381527 - RNA, 13 nt, Homo sapiens
cuugcccuuuacg

SEQ ID NO: 1381528 - RNA, 16 nt, Homo sapiens
cuugccgaaacuggaa

SEQ ID NO: 1381529 - RNA, 18 nt, Homo sapiens
cuugcggucccuucuuac

SEQ ID NO: 1381530 - RNA, 17 nt, Homo sapiens
cuugcuccuguguaaaa

SEQ ID NO: 1381531 - RNA, 13 nt, Homo sapiens
cuugcugccugaa

SEQ ID NO: 1381532 - RNA, 22 nt, Homo sapiens
cuugcuuaugacaucacuugua

SEQ ID NO: 1381533 - RNA, 22 nt, Homo sapiens
cuuggaaagcaucaccucaggc

SEQ ID NO: 1381534 - RNA, 21 nt, Homo sapiens
cuuggacuguguuuuuccucc

SEQ ID NO: 1381535 - RNA, 16 nt, Homo sapiens
cuuggagccccagugc

SEQ ID NO: 1381536 - RNA, 19 nt, Homo sapiens
cuuggagccccagugccaa

SEQ ID NO: 1381537 - RNA, 19 nt, Homo sapiens
cuuggaggccagccaguga

SEQ ID NO: 1381538 - RNA, 20 nt, Homo sapiens
cuuggagggauaagccagcu

SEQ ID NO: 1381539 - RNA, 18 nt, Homo sapiens
cuugggagaccuguaauc

SEQ ID NO: 1381540 - RNA, 14 nt, Homo sapiens
cuugggaugaucuu

SEQ ID NO: 1381541 - RNA, 16 nt, Homo sapiens
cuugggaugaugccuc

SEQ ID NO: 1381542 - RNA, 21 nt, Homo sapiens
cuugggaugaugccucaugau

SEQ ID NO: 1381543 - RNA, 20 nt, Homo sapiens
cuugggcaugggggagccuu

SEQ ID NO: 1381544 - RNA, 16 nt, Homo sapiens
cuuggggacaucucau

SEQ ID NO: 1381545 - RNA, 20 nt, Homo sapiens
cuuggggcaggcagugaugc

SEQ ID NO: 1381546 - RNA, 21 nt, Homo sapiens
cuugguucaucaguguuaaaa

SEQ ID NO: 1381547 - RNA, 15 nt, Homo sapiens
cuuguaaagacugua

SEQ ID NO: 1381548 - RNA, 23 nt, Homo sapiens
cuuguaaaugugguaaagaguua

SEQ ID NO: 1381549 - RNA, 13 nt, Homo sapiens
gcauucaaauggg

SEQ ID NO: 1381550 - RNA, 15 nt, Homo sapiens
gcauucaaaugggcu

SEQ ID NO: 1381551 - RNA, 16 nt, Homo sapiens
gcauucagccaggaga

SEQ ID NO: 1381552 - RNA, 16 nt, Homo sapiens
gcauucauaacagaac

SEQ ID NO: 1381553 - RNA, 14 nt, Homo sapiens
gcauuuagcacaaa

SEQ ID NO: 1381554 - RNA, 14 nt, Homo sapiens
gcauuuaggagaua

SEQ ID NO: 1381555 - RNA, 18 nt, Homo sapiens
gccaaagagaaugccauu

SEQ ID NO: 1381556 - RNA, 14 nt, Homo sapiens
gccaaauuuuggcc

SEQ ID NO: 1381557 - RNA, 11 nt, Homo sapiens
gccaacaagca

SEQ ID NO: 1381558 - RNA, 12 nt, Homo sapiens
gccaagugcagg

SEQ ID NO: 1381559 - RNA, 18 nt, Homo sapiens
gccaaucaguagccagca

SEQ ID NO: 1381560 - RNA, 18 nt, Homo sapiens
gccaaucuucaguauuuu

SEQ ID NO: 1381561 - RNA, 19 nt, Homo sapiens
gccaaugccccacuggcag

SEQ ID NO: 1381562 - RNA, 22 nt, Homo sapiens
gccacacugugggacucuucuu

SEQ ID NO: 1381563 - RNA, 11 nt, Homo sapiens
gccacaguaua

SEQ ID NO: 1381564 - RNA, 19 nt, Homo sapiens
gccacccucccagcucuga

SEQ ID NO: 1381565 - RNA, 22 nt, Homo sapiens
gccacccugugggccgggcaau

SEQ ID NO: 1381566 - RNA, 21 nt, Homo sapiens
gccacucaggaggcugaggca

SEQ ID NO: 1381567 - RNA, 16 nt, Homo sapiens
gccacuggaacacuaa

SEQ ID NO: 1381568 - RNA, 14 nt, Homo sapiens
gccagcaucugccu

SEQ ID NO: 1381569 - RNA, 14 nt, Homo sapiens
gccagcugcagcug

SEQ ID NO: 1381570 - RNA, 18 nt, Homo sapiens
gccagcugcaucuacuca

SEQ ID NO: 1381571 - RNA, 18 nt, Homo sapiens
gccaggcaugguggccca

SEQ ID NO: 1381572 - RNA, 23 nt, Homo sapiens
gccaggccagagggagugacaga

SEQ ID NO: 1381573 - RNA, 14 nt, Homo sapiens
gccagggucucacu

SEQ ID NO: 1381574 - RNA, 20 nt, Homo sapiens
gccagucuaguuccugauga

SEQ ID NO: 1381575 - RNA, 22 nt, Homo sapiens
gccauaaaggggagggacucau

SEQ ID NO: 1381576 - RNA, 14 nt, Homo sapiens
gccauaacagacca

SEQ ID NO: 1381577 - RNA, 14 nt, Homo sapiens
gccauacuuuacaa

SEQ ID NO: 1381578 - RNA, 19 nt, Homo sapiens
gccaucagaggccuaguca

SEQ ID NO: 1381579 - RNA, 21 nt, Homo sapiens
gccaucuaaaguaaaaaggga

SEQ ID NO: 1381580 - RNA, 19 nt, Homo sapiens
gccaugaggccucagugga

SEQ ID NO: 1381581 - RNA, 17 nt, Homo sapiens
gccaugauuuuagcaau

SEQ ID NO: 1381582 - RNA, 19 nt, Homo sapiens
gccauggacucuacacugu

SEQ ID NO: 1381583 - RNA, 18 nt, Homo sapiens
gccaugggccuccugugu

SEQ ID NO: 1381584 - RNA, 18 nt, Homo sapiens
gccaugggggcaacagcc

SEQ ID NO: 1381585 - RNA, 20 nt, Homo sapiens
gcgaaaccccaucucuacua

SEQ ID NO: 1381586 - RNA, 16 nt, Homo sapiens
gcgagacuccgucuca

SEQ ID NO: 1381587 - RNA, 15 nt, Homo sapiens
gcgagucacugccuc

SEQ ID NO: 1381588 - RNA, 11 nt, Homo sapiens
gcgaugugcaa

SEQ ID NO: 1381589 - RNA, 14 nt, Homo sapiens
gcgaugugcaagug

SEQ ID NO: 1381590 - RNA, 17 nt, Homo sapiens
gcgauugaaagggcaau

SEQ ID NO: 1381591 - RNA, 21 nt, Homo sapiens
gcgcccaugaugggagggauu

SEQ ID NO: 1381592 - RNA, 17 nt, Homo sapiens
gcgccuccuuccuugcu

SEQ ID NO: 1381593 - RNA, 14 nt, Homo sapiens
gcgcgguggcucac

SEQ ID NO: 1381594 - RNA, 14 nt, Homo sapiens
gcggaguugugcac

SEQ ID NO: 1381595 - RNA, 13 nt, Homo sapiens
gcggcuggcagcc

SEQ ID NO: 1381596 - RNA, 11 nt, Homo sapiens
gcgggggcuug

SEQ ID NO: 1381597 - RNA, 23 nt, Homo sapiens
gcguagagggugcugccccauga

SEQ ID NO: 1381598 - RNA, 15 nt, Homo sapiens
gcgugaaucuguauc

SEQ ID NO: 1381599 - RNA, 12 nt, Homo sapiens
gcgugcaugugc

SEQ ID NO: 1381600 - RNA, 14 nt, Homo sapiens
gcgugugugcaagu

SEQ ID NO: 1381601 - RNA, 12 nt, Homo sapiens
gcguuuuuuaca

SEQ ID NO: 1381602 - RNA, 13 nt, Homo sapiens
gcuaaaagggaaa

SEQ ID NO: 1381603 - RNA, 20 nt, Homo sapiens
gcuaaaauuagaugaacuca

SEQ ID NO: 1381604 - RNA, 21 nt, Homo sapiens
gcuaacuuggagccccagugc

SEQ ID NO: 1381605 - RNA, 21 nt, Homo sapiens
gcuaagauuuagagaugaauu

SEQ ID NO: 1381606 - RNA, 17 nt, Homo sapiens
gcuaaggacauuuccca

SEQ ID NO: 1381607 - RNA, 19 nt, Homo sapiens
gcuaaggaguaguggcccu

SEQ ID NO: 1381608 - RNA, 19 nt, Homo sapiens
gcuaaucuucuuaugcaau

SEQ ID NO: 1381609 - RNA, 23 nt, Homo sapiens
gcuaccagguguucuacacucau

SEQ ID NO: 1381610 - RNA, 14 nt, Homo sapiens
gcuagaguccucac

SEQ ID NO: 1381611 - RNA, 17 nt, Homo sapiens
gcuaggaaugaaauccu

SEQ ID NO: 1381612 - RNA, 20 nt, Homo sapiens
gcuaggguggcccuugcagu

SEQ ID NO: 1381613 - RNA, 15 nt, Homo sapiens
gcuaguaaaagccau

SEQ ID NO: 1381614 - RNA, 15 nt, Homo sapiens
gcuauauccauguac

SEQ ID NO: 1381615 - RNA, 15 nt, Homo sapiens
gcuaucucucaguga

SEQ ID NO: 1381616 - RNA, 19 nt, Homo sapiens
gcuauggaaugccccaugg

SEQ ID NO: 1381617 - RNA, 18 nt, Homo sapiens
gcuauggggacauuccaa

SEQ ID NO: 1381618 - RNA, 11 nt, Homo sapiens
gcuauuugccu

SEQ ID NO: 1381619 - RNA, 15 nt, Homo sapiens
gcucaagcagucuac

SEQ ID NO: 1381620 - RNA, 23 nt, Homo sapiens
gcucaauauuccugaaugaaaua

SEQ ID NO: 1381621 - RNA, 19 nt, Homo sapiens
gcucacaaaccaugcaaau

SEQ ID NO: 1381622 - RNA, 12 nt, Homo sapiens
gcucacgugugu

SEQ ID NO: 1381623 - RNA, 19 nt, Homo sapiens
gcucacuaaaaugcuaauu

SEQ ID NO: 1381624 - RNA, 22 nt, Homo sapiens
gcucacugaaaagacuauugug

SEQ ID NO: 1381625 - RNA, 14 nt, Homo sapiens
gcucagacugguug

SEQ ID NO: 1381626 - RNA, 22 nt, Homo sapiens
gcucagcaaaagaugcuucuca

SEQ ID NO: 1381627 - RNA, 20 nt, Homo sapiens
gcucagcccaccccccucau

SEQ ID NO: 1381628 - RNA, 15 nt, Homo sapiens
gcucagcuucuccaa

SEQ ID NO: 1381629 - RNA, 22 nt, Homo sapiens
gcucaggaggcuuggaaagcau

SEQ ID NO: 1381630 - RNA, 20 nt, Homo sapiens
gcucaggggcguguggcuca

SEQ ID NO: 1381631 - RNA, 21 nt, Homo sapiens
gcucaguagucagacuggaua

SEQ ID NO: 1381632 - RNA, 15 nt, Homo sapiens
gcucagucucaggag

SEQ ID NO: 1381633 - RNA, 17 nt, Homo sapiens
gcucaguuggugcugcu

SEQ ID NO: 1381634 - RNA, 17 nt, Homo sapiens
gcucauagggaagaccu

SEQ ID NO: 1381635 - RNA, 18 nt, Homo sapiens
gcucauauuguucccuau

SEQ ID NO: 1381636 - RNA, 20 nt, Homo sapiens
gcucaugaccuggaaauaaa

SEQ ID NO: 1381637 - RNA, 21 nt, Homo sapiens
gcuccacacccucucccagga

SEQ ID NO: 1381638 - RNA, 22 nt, Homo sapiens
gcuccacuuucagugaaagcau

SEQ ID NO: 1381639 - RNA, 18 nt, Homo sapiens
gcuccagaagaacaaaga

SEQ ID NO: 1381640 - RNA, 21 nt, Homo sapiens
gcuccagcugcucugucuucu

SEQ ID NO: 1381641 - RNA, 23 nt, Homo sapiens
gcuccauacucuaacaucuagcu

SEQ ID NO: 1381642 - RNA, 20 nt, Homo sapiens
gcuccaucgcugucaucuca

SEQ ID NO: 1381643 - RNA, 17 nt, Homo sapiens
gcuccauucaaagugag

SEQ ID NO: 1381644 - RNA, 15 nt, Homo sapiens
gcuccugaggggcau

SEQ ID NO: 1381645 - RNA, 15 nt, Homo sapiens
gcucgagcaguccug

SEQ ID NO: 1381646 - RNA, 20 nt, Homo sapiens
gcucuaucucacagcacacu

SEQ ID NO: 1381647 - RNA, 18 nt, Homo sapiens
gcucuccccuucucugua

SEQ ID NO: 1381648 - RNA, 14 nt, Homo sapiens
gcucuggacaggca

SEQ ID NO: 1381649 - RNA, 17 nt, Homo sapiens
gcucugggauagcugac

SEQ ID NO: 1381650 - RNA, 16 nt, Homo sapiens
gcucugucuucuuugc

SEQ ID NO: 1381651 - RNA, 22 nt, Homo sapiens
gcucuuaggugcuucuucacuu

SEQ ID NO: 1381652 - RNA, 22 nt, Homo sapiens
gcucuucuccauccuaccacaa

SEQ ID NO: 1381653 - RNA, 18 nt, Homo sapiens
gcucuuucccuuuaucag

SEQ ID NO: 1381654 - RNA, 20 nt, Homo sapiens
gcucuuuccuggcuacucca

SEQ ID NO: 1381655 - RNA, 13 nt, Homo sapiens
gcugaccacuuua

SEQ ID NO: 1381656 - RNA, 15 nt, Homo sapiens
gcugaccuccacagc

SEQ ID NO: 1381657 - RNA, 16 nt, Homo sapiens
gcugaccucccaguga

SEQ ID NO: 1381658 - RNA, 16 nt, Homo sapiens
gcugagagaaccucac

SEQ ID NO: 1381659 - RNA, 16 nt, Homo sapiens
gcugagcaccagggga

SEQ ID NO: 1381660 - RNA, 16 nt, Homo sapiens
gcugaggcaagagaau

SEQ ID NO: 1381661 - RNA, 20 nt, Homo sapiens
gcugaggcccccagcugccu

SEQ ID NO: 1381662 - RNA, 23 nt, Homo sapiens
gcugagggugagugggugaauaa

SEQ ID NO: 1381663 - RNA, 16 nt, Homo sapiens
gcugagucugcagaug

SEQ ID NO: 1381664 - RNA, 13 nt, Homo sapiens
gcugaucucaggg

SEQ ID NO: 1381665 - RNA, 17 nt, Homo sapiens
gcugcacccacccagga

SEQ ID NO: 1381666 - RNA, 17 nt, Homo sapiens
gcugcaguuccaaaaga

SEQ ID NO: 1381667 - RNA, 11 nt, Homo sapiens
gcugcaucucc

SEQ ID NO: 1381668 - RNA, 20 nt, Homo sapiens
gcugccaagccccauccugc

SEQ ID NO: 1381669 - RNA, 21 nt, Homo sapiens
gcugccaaguaaauagcaaca

SEQ ID NO: 1381670 - RNA, 15 nt, Homo sapiens
gcugccucacuuccu

SEQ ID NO: 1381671 - RNA, 20 nt, Homo sapiens
gcugcuucaaacucaaacac

SEQ ID NO: 1381672 - RNA, 14 nt, Homo sapiens
gcugcuucugcaaa

SEQ ID NO: 1381673 - RNA, 20 nt, Homo sapiens
gcugcuuuucccuaagccaa

SEQ ID NO: 1381674 - RNA, 19 nt, Homo sapiens
gcuggagugcaguggugcg

SEQ ID NO: 1381675 - RNA, 20 nt, Homo sapiens
gcuggagugcaguggugcua

SEQ ID NO: 1381676 - RNA, 17 nt, Homo sapiens
gcuggauaaaaugaggu

SEQ ID NO: 1381677 - RNA, 19 nt, Homo sapiens
gcuggcaccgccuucucua

SEQ ID NO: 1381678 - RNA, 14 nt, Homo sapiens
gcuggcgugcagug

SEQ ID NO: 1381679 - RNA, 17 nt, Homo sapiens
gcugggaugaccagcau

SEQ ID NO: 1381680 - RNA, 18 nt, Homo sapiens
gcugggcagaaggccaag

SEQ ID NO: 1381681 - RNA, 16 nt, Homo sapiens
gcuguacuugaugaca

SEQ ID NO: 1381682 - RNA, 17 nt, Homo sapiens
gcuguaguaccccaaga

SEQ ID NO: 1381683 - RNA, 16 nt, Homo sapiens
gcuguccuuacccauc

SEQ ID NO: 1381684 - RNA, 20 nt, Homo sapiens
gcugucuauguggcuguauc

SEQ ID NO: 1381685 - RNA, 12 nt, Homo sapiens
gcugucugcuca

SEQ ID NO: 1381686 - RNA, 23 nt, Homo sapiens
gcuguucauguuacucaugacuc

SEQ ID NO: 1381687 - RNA, 13 nt, Homo sapiens
gcuguugccucau

SEQ ID NO: 1381688 - RNA, 18 nt, Homo sapiens
gcuuaaaacaacacucac

SEQ ID NO: 1381689 - RNA, 23 nt, Homo sapiens
gcuuaaacuacaaacacaagcaa

SEQ ID NO: 1381690 - RNA, 22 nt, Homo sapiens
gcuuaauggcucaugaccugga

SEQ ID NO: 1381691 - RNA, 21 nt, Homo sapiens
gcuuaccauuaaaguucucaa

SEQ ID NO: 1381692 - RNA, 22 nt, Homo sapiens
gcuuaccauuaaaguucucaau

SEQ ID NO: 1381693 - RNA, 13 nt, Homo sapiens
gcuuagaccucag

SEQ ID NO: 1381694 - RNA, 18 nt, Homo sapiens
gcuuauccaugccuggga

SEQ ID NO: 1381695 - RNA, 13 nt, Homo sapiens
gcuucaaacuaac

SEQ ID NO: 1381696 - RNA, 21 nt, Homo sapiens
gcuucauucaagucagcucuu

SEQ ID NO: 1381697 - RNA, 16 nt, Homo sapiens
gcuuccgccgucucaa

SEQ ID NO: 1381698 - RNA, 20 nt, Homo sapiens
cuguuguaggguugccagau

SEQ ID NO: 1381699 - RNA, 13 nt, Homo sapiens
cuguuucuauucu

SEQ ID NO: 1381700 - RNA, 18 nt, Homo sapiens
cuguuucucucacugggc

SEQ ID NO: 1381701 - RNA, 13 nt, Homo sapiens
cuguuuguuaaaa

SEQ ID NO: 1381702 - RNA, 19 nt, Homo sapiens
cuguuuuugucuacacucu

SEQ ID NO: 1381703 - RNA, 13 nt, Homo sapiens
cuuaaaagccauc

SEQ ID NO: 1381704 - RNA, 17 nt, Homo sapiens
cuuaaaauauauuucag

SEQ ID NO: 1381705 - RNA, 23 nt, Homo sapiens
cuuaaacuguguggacugugaug

SEQ ID NO: 1381706 - RNA, 13 nt, Homo sapiens
cuuaaagcacuua

SEQ ID NO: 1381707 - RNA, 14 nt, Homo sapiens
cuuaacuauucaau

SEQ ID NO: 1381708 - RNA, 21 nt, Homo sapiens
cuuaagcuuccgccgucucaa

SEQ ID NO: 1381709 - RNA, 19 nt, Homo sapiens
cuuaaugucuuuaaaagua

SEQ ID NO: 1381710 - RNA, 11 nt, Homo sapiens
cuuacaaagug

SEQ ID NO: 1381711 - RNA, 17 nt, Homo sapiens
cuuaccgugggcacuga

SEQ ID NO: 1381712 - RNA, 16 nt, Homo sapiens
cuuacuagaccuguaa

SEQ ID NO: 1381713 - RNA, 14 nt, Homo sapiens
cuuacugcaggcaa

SEQ ID NO: 1381714 - RNA, 20 nt, Homo sapiens
cuuacugcuugguccuugau

SEQ ID NO: 1381715 - RNA, 20 nt, Homo sapiens
cuuacuuagcaugcacaaag

SEQ ID NO: 1381716 - RNA, 15 nt, Homo sapiens
cuuacuuaggugugg

SEQ ID NO: 1381717 - RNA, 14 nt, Homo sapiens
cuuagaaauuguaa

SEQ ID NO: 1381718 - RNA, 13 nt, Homo sapiens
cuuagaccucagc

SEQ ID NO: 1381719 - RNA, 12 nt, Homo sapiens
cuuagcaacagc

SEQ ID NO: 1381720 - RNA, 14 nt, Homo sapiens
cuuagcaacagccg

SEQ ID NO: 1381721 - RNA, 16 nt, Homo sapiens
cuuagcaccacaaaua

SEQ ID NO: 1381722 - RNA, 18 nt, Homo sapiens
cuuagcagcuaucucuca

SEQ ID NO: 1381723 - RNA, 12 nt, Homo sapiens
cugaacugaugg

SEQ ID NO: 1381724 - RNA, 14 nt, Homo sapiens
cugaacuugaauua

SEQ ID NO: 1381725 - RNA, 19 nt, Homo sapiens
cugaaggcugaaagacagg

SEQ ID NO: 1381726 - RNA, 17 nt, Homo sapiens
cugaagggcaucaugca

SEQ ID NO: 1381727 - RNA, 15 nt, Homo sapiens
cugaaggucccaccu

SEQ ID NO: 1381728 - RNA, 16 nt, Homo sapiens
cugaaguaagcaaaga

SEQ ID NO: 1381729 - RNA, 13 nt, Homo sapiens
cugaagucacaca

SEQ ID NO: 1381730 - RNA, 14 nt, Homo sapiens
cugaagucacauca

SEQ ID NO: 1381731 - RNA, 20 nt, Homo sapiens
cugaagucucuucucucuua

SEQ ID NO: 1381732 - RNA, 15 nt, Homo sapiens
cugaaguuucauuua

SEQ ID NO: 1381733 - RNA, 13 nt, Homo sapiens
cugaauacauucu

SEQ ID NO: 1381734 - RNA, 17 nt, Homo sapiens
cugaaucgagaugucca

SEQ ID NO: 1381735 - RNA, 19 nt, Homo sapiens
cugaauuuggccugcacua

SEQ ID NO: 1381736 - RNA, 18 nt, Homo sapiens
cugacagaaggacucagg

SEQ ID NO: 1381737 - RNA, 17 nt, Homo sapiens
cugacauauaucuauua

SEQ ID NO: 1381738 - RNA, 11 nt, Homo sapiens
cugaccaaaac

SEQ ID NO: 1381739 - RNA, 13 nt, Homo sapiens
cugacccuagcuc

SEQ ID NO: 1381740 - RNA, 13 nt, Homo sapiens
cugaccugucuca

SEQ ID NO: 1381741 - RNA, 18 nt, Homo sapiens
cugacgaggcugggccaa

SEQ ID NO: 1381742 - RNA, 20 nt, Homo sapiens
cugacuagaagggccagucc

SEQ ID NO: 1381743 - RNA, 20 nt, Homo sapiens
cucauccuuccucauuugca

SEQ ID NO: 1381744 - RNA, 14 nt, Homo sapiens
cucaugauguauug

SEQ ID NO: 1381745 - RNA, 21 nt, Homo sapiens
cucaugcugcagaggguacuu

SEQ ID NO: 1381746 - RNA, 14 nt, Homo sapiens
cucauguagccuca

SEQ ID NO: 1381747 - RNA, 15 nt, Homo sapiens
cucauguagccucaa

SEQ ID NO: 1381748 - RNA, 21 nt, Homo sapiens
cucauuaucuugcagcuguaa

SEQ ID NO: 1381749 - RNA, 21 nt, Homo sapiens
cucauucagggauagcacuga

SEQ ID NO: 1381750 - RNA, 10 nt, Homo sapiens
cucauuccac

SEQ ID NO: 1381751 - RNA, 16 nt, Homo sapiens
cucauuccaccuuccc

SEQ ID NO: 1381752 - RNA, 19 nt, Homo sapiens
cucauuugucacacacuuu

SEQ ID NO: 1381753 - RNA, 16 nt, Homo sapiens
cuccaccccacucaca

SEQ ID NO: 1381754 - RNA, 19 nt, Homo sapiens
cuccacccuauauguagua

SEQ ID NO: 1381755 - RNA, 17 nt, Homo sapiens
cuccacccuuggacuuu

SEQ ID NO: 1381756 - RNA, 13 nt, Homo sapiens
cuccacuccagau

SEQ ID NO: 1381757 - RNA, 18 nt, Homo sapiens
cuccagaagaacaaagag

SEQ ID NO: 1381758 - RNA, 13 nt, Homo sapiens
cuccagcccauug

SEQ ID NO: 1381759 - RNA, 14 nt, Homo sapiens
cuccaggaaugccu

SEQ ID NO: 1381760 - RNA, 23 nt, Homo sapiens
cuagacguucauuugugugcuca

SEQ ID NO: 1381761 - RNA, 12 nt, Homo sapiens
cuagaggugcuc

SEQ ID NO: 1381762 - RNA, 15 nt, Homo sapiens
cuagauccacacaca

SEQ ID NO: 1381763 - RNA, 21 nt, Homo sapiens
cuagaugagcccagcccuguu

SEQ ID NO: 1381764 - RNA, 14 nt, Homo sapiens
cuagaugugucuua

SEQ ID NO: 1381765 - RNA, 16 nt, Homo sapiens
cuagauuuaugaauac

SEQ ID NO: 1381766 - RNA, 20 nt, Homo sapiens
cuagcaaauguuaugcauaa

SEQ ID NO: 1381767 - RNA, 18 nt, Homo sapiens
cuagcccucucacauuua

SEQ ID NO: 1381768 - RNA, 14 nt, Homo sapiens
cuagccgaccucag

SEQ ID NO: 1381769 - RNA, 15 nt, Homo sapiens
cuagcuggauuuccu

SEQ ID NO: 1381770 - RNA, 21 nt, Homo sapiens
cuagcugggaaggugaccaca

SEQ ID NO: 1381771 - RNA, 20 nt, Homo sapiens
cuaggagcugguguggccaa

SEQ ID NO: 1381772 - RNA, 21 nt, Homo sapiens
cuaggagcugguguggccaag

SEQ ID NO: 1381773 - RNA, 16 nt, Homo sapiens
cuaggaguauccucau

SEQ ID NO: 1381774 - RNA, 18 nt, Homo sapiens
cuaggcuccgucaguauc

SEQ ID NO: 1381775 - RNA, 17 nt, Homo sapiens
cuagggaggaccuuauc

SEQ ID NO: 1381776 - RNA, 19 nt, Homo sapiens
cuagucugcuagccaggau

SEQ ID NO: 1381777 - RNA, 15 nt, Homo sapiens
cuagugcugaagcuu

SEQ ID NO: 1381778 - RNA, 16 nt, Homo sapiens
cuaguugucacuuucc

SEQ ID NO: 1381779 - RNA, 16 nt, Homo sapiens
cuauaacuauguugau

SEQ ID NO: 1381780 - RNA, 13 nt, Homo sapiens
cuauaauaccagc

SEQ ID NO: 1381781 - RNA, 22 nt, Homo sapiens
cuauaauguugucauuucaaga

SEQ ID NO: 1381782 - RNA, 13 nt, Homo sapiens
cuauaauugccac

SEQ ID NO: 1381783 - RNA, 14 nt, Homo sapiens
cuauacuacauuau

SEQ ID NO: 1381784 - RNA, 17 nt, Homo sapiens
cuauaggaacauaugaa

SEQ ID NO: 1381785 - RNA, 21 nt, Homo sapiens
cuauagucccagcuacucaga

SEQ ID NO: 1381786 - RNA, 23 nt, Homo sapiens
cuauauaguuuauugacaauaau

SEQ ID NO: 1381787 - RNA, 16 nt, Homo sapiens
cuauauggcagugucu

SEQ ID NO: 1381788 - RNA, 18 nt, Homo sapiens
cuauauguaguauaaaga

SEQ ID NO: 1381789 - RNA, 17 nt, Homo sapiens
cuauauuguacacaccu

SEQ ID NO: 1381790 - RNA, 19 nt, Homo sapiens
cuauccaaaacuaauuucc

SEQ ID NO: 1381791 - RNA, 11 nt, Homo sapiens
cuauccagcua

SEQ ID NO: 1381792 - RNA, 14 nt, Homo sapiens
cuaucccaucccau

SEQ ID NO: 1381793 - RNA, 18 nt, Homo sapiens
cuaucuucuuucacauau

SEQ ID NO: 1381794 - RNA, 13 nt, Homo sapiens
cuaugaaauauca

SEQ ID NO: 1381795 - RNA, 21 nt, Homo sapiens
cuaugaaauaucaugcuccau

SEQ ID NO: 1381796 - RNA, 16 nt, Homo sapiens
cuaugagcacauagga

SEQ ID NO: 1381797 - RNA, 19 nt, Homo sapiens
cuaugcaacagcucucacc

SEQ ID NO: 1381798 - RNA, 14 nt, Homo sapiens
cuaugcaaucugag

SEQ ID NO: 1381799 - RNA, 15 nt, Homo sapiens
cuauggcaucuuccc

SEQ ID NO: 1381800 - RNA, 13 nt, Homo sapiens
cuauguacuguaa

SEQ ID NO: 1381801 - RNA, 21 nt, Homo sapiens
cuaugugcaugcagcaucuaa

SEQ ID NO: 1381802 - RNA, 15 nt, Homo sapiens
cuauguggcuguauc

SEQ ID NO: 1381803 - RNA, 19 nt, Homo sapiens
cuauguugcccaggcaggu

SEQ ID NO: 1381804 - RNA, 21 nt, Homo sapiens
cuauucccuucuaaccugaac

SEQ ID NO: 1381805 - RNA, 22 nt, Homo sapiens
cuauucucuccucagacugcuc

SEQ ID NO: 1381806 - RNA, 18 nt, Homo sapiens
cuauugcugcucucucac

SEQ ID NO: 1381807 - RNA, 18 nt, Homo sapiens
cuauugcuggcaaagaca

SEQ ID NO: 1381808 - RNA, 16 nt, Homo sapiens
cuauuuccuaucauuu

SEQ ID NO: 1381809 - RNA, 15 nt, Homo sapiens
cuauuuuauucccuu

SEQ ID NO: 1381810 - RNA, 15 nt, Homo sapiens
cuauuuuuguagaag

SEQ ID NO: 1381811 - RNA, 21 nt, Homo sapiens
cuauuuuuguuaagcgugucu

SEQ ID NO: 1381812 - RNA, 23 nt, Homo sapiens
cucaaagcaaauaauuuuucacu

SEQ ID NO: 1381813 - RNA, 18 nt, Homo sapiens
cucaaagugacuauucag

SEQ ID NO: 1381814 - RNA, 17 nt, Homo sapiens
cucaaaugcacaucuca

SEQ ID NO: 1381815 - RNA, 21 nt, Homo sapiens
cucaaaugcacaucucauggc

SEQ ID NO: 1381816 - RNA, 22 nt, Homo sapiens
cucaaccuccugggcuaaguga

SEQ ID NO: 1381817 - RNA, 14 nt, Homo sapiens
cucaagcagucuac

SEQ ID NO: 1381818 - RNA, 17 nt, Homo sapiens
cucaagccaagcagcca

SEQ ID NO: 1381819 - RNA, 22 nt, Homo sapiens
cucaagcccugcagucacagcu

SEQ ID NO: 1381820 - RNA, 22 nt, Homo sapiens
cucaagugauucuccugccuca

SEQ ID NO: 1381821 - RNA, 20 nt, Homo sapiens
cucaaguuucuucaaucuga

SEQ ID NO: 1381822 - RNA, 21 nt, Homo sapiens
cucaauggaagaggccaggac

SEQ ID NO: 1381823 - RNA, 12 nt, Homo sapiens
cucaauucauau

SEQ ID NO: 1381824 - RNA, 13 nt, Homo sapiens
cucaauucaucaa

SEQ ID NO: 1381825 - RNA, 18 nt, Homo sapiens
cucacaaaccaugcaaau

SEQ ID NO: 1381826 - RNA, 13 nt, Homo sapiens
cucacaccuguaa

SEQ ID NO: 1381827 - RNA, 22 nt, Homo sapiens
cucacacggacacucaaaagcu

SEQ ID NO: 1381828 - RNA, 20 nt, Homo sapiens
cucacagagugcauugugag

SEQ ID NO: 1381829 - RNA, 14 nt, Homo sapiens
cucacaguguugcc

SEQ ID NO: 1381830 - RNA, 17 nt, Homo sapiens
cucacauuuauucugcu

SEQ ID NO: 1381831 - RNA, 16 nt, Homo sapiens
cucaccaacccagaga

SEQ ID NO: 1381832 - RNA, 23 nt, Homo sapiens
cucacccccagcuuugcuaccaa

SEQ ID NO: 1381833 - RNA, 16 nt, Homo sapiens
cucacgcaccucccau

SEQ ID NO: 1381834 - RNA, 18 nt, Homo sapiens
cucacgccuaugauccca

SEQ ID NO: 1381835 - RNA, 12 nt, Homo sapiens
cucacgccugua

SEQ ID NO: 1381836 - RNA, 17 nt, Homo sapiens
cucacuaaaaugcuaau

SEQ ID NO: 1381837 - RNA, 15 nt, Homo sapiens
cucacucaccaucug

SEQ ID NO: 1381838 - RNA, 15 nt, Homo sapiens
cucacucccagucca

SEQ ID NO: 1381839 - RNA, 17 nt, Homo sapiens
cucacugaaaauuacag

SEQ ID NO: 1381840 - RNA, 21 nt, Homo sapiens
cucacugggccuccaaccaug

SEQ ID NO: 1381841 - RNA, 14 nt, Homo sapiens
cucacuucuuccau

SEQ ID NO: 1381842 - RNA, 23 nt, Homo sapiens
cucagacagaaccccuacaugaa

SEQ ID NO: 1381843 - RNA, 19 nt, Homo sapiens
cucagaggguuguucuccu

SEQ ID NO: 1381844 - RNA, 16 nt, Homo sapiens
cucagauuccaccuag

SEQ ID NO: 1381845 - RNA, 17 nt, Homo sapiens
cucagccguucuugaca

SEQ ID NO: 1381846 - RNA, 19 nt, Homo sapiens
cucagccucaaaugcagua

SEQ ID NO: 1381847 - RNA, 18 nt, Homo sapiens
cucagccuguuccaugaa

SEQ ID NO: 1381848 - RNA, 16 nt, Homo sapiens
cucaggaccuagggau

SEQ ID NO: 1381849 - RNA, 18 nt, Homo sapiens
cucaggaguuugagacca

SEQ ID NO: 1381850 - RNA, 15 nt, Homo sapiens
cucaggcagaucuca

SEQ ID NO: 1381851 - RNA, 21 nt, Homo sapiens
cucaggcuguuuuugggugca

SEQ ID NO: 1381852 - RNA, 17 nt, Homo sapiens
cucaguuccugcagcag

SEQ ID NO: 1381853 - RNA, 18 nt, Homo sapiens
cucaguuucccuaucucg

SEQ ID NO: 1381854 - RNA, 13 nt, Homo sapiens
cucauacacagaa

SEQ ID NO: 1381855 - RNA, 17 nt, Homo sapiens
cucaucaccacagggau

SEQ ID NO: 1381856 - RNA, 14 nt, Homo sapiens
cucaucauuccuug

SEQ ID NO: 1381857 - RNA, 15 nt, Homo sapiens
cucaucccucuguca

SEQ ID NO: 1381858 - RNA, 15 nt, Homo sapiens
cucauccugcaggca

SEQ ID NO: 1381859 - RNA, 16 nt, Homo sapiens
cacuucuaaaugcaua

SEQ ID NO: 1381860 - RNA, 18 nt, Homo sapiens
cacuucuaaaugcauauc

SEQ ID NO: 1381861 - RNA, 21 nt, Homo sapiens
cacuucuuguuccccacugac

SEQ ID NO: 1381862 - RNA, 21 nt, Homo sapiens
cacuugcagacucuacagagg

SEQ ID NO: 1381863 - RNA, 21 nt, Homo sapiens
cacuugugcaguguugacagu

SEQ ID NO: 1381864 - RNA, 16 nt, Homo sapiens
cacuuugauaccauug

SEQ ID NO: 1381865 - RNA, 20 nt, Homo sapiens
cagaaaaacucugggaaaua

SEQ ID NO: 1381866 - RNA, 17 nt, Homo sapiens
cagaaaagaugugcaga

SEQ ID NO: 1381867 - RNA, 20 nt, Homo sapiens
cagaaaccaguuaugugaau

SEQ ID NO: 1381868 - RNA, 16 nt, Homo sapiens
cagaaagaguucagua

SEQ ID NO: 1381869 - RNA, 17 nt, Homo sapiens
cagaaagcauccuaaau

SEQ ID NO: 1381870 - RNA, 16 nt, Homo sapiens
cagaaagcucaucuca

SEQ ID NO: 1381871 - RNA, 18 nt, Homo sapiens
cagaacacacuccaucag

SEQ ID NO: 1381872 - RNA, 16 nt, Homo sapiens
cagaacacugucuuga

SEQ ID NO: 1381873 - RNA, 14 nt, Homo sapiens
cagaacaguuugua

SEQ ID NO: 1381874 - RNA, 22 nt, Homo sapiens
cagaaccacauuaagucuccau

SEQ ID NO: 1381875 - RNA, 17 nt, Homo sapiens
cagaaccccuacaugaa

SEQ ID NO: 1381876 - RNA, 18 nt, Homo sapiens
cagaaccccuacaugaaa

SEQ ID NO: 1381877 - RNA, 20 nt, Homo sapiens
cagaaccucuuccccagaaa

SEQ ID NO: 1381878 - RNA, 13 nt, Homo sapiens
cagaacuucugaa

SEQ ID NO: 1381879 - RNA, 14 nt, Homo sapiens
cagaagaacaaaga

SEQ ID NO: 1381880 - RNA, 15 nt, Homo sapiens
cagaaggccaagagg

SEQ ID NO: 1381881 - RNA, 12 nt, Homo sapiens
cagaaggggugg

SEQ ID NO: 1381882 - RNA, 14 nt, Homo sapiens
cagaauaauaagag

SEQ ID NO: 1381883 - RNA, 21 nt, Homo sapiens
cagaauaaugaauggacucaa

SEQ ID NO: 1381884 - RNA, 23 nt, Homo sapiens
cagaauagcuuugaauguggccc

SEQ ID NO: 1381885 - RNA, 15 nt, Homo sapiens
cagaaucagaucuga

SEQ ID NO: 1381886 - RNA, 14 nt, Homo sapiens
caggaaaaugccag

SEQ ID NO: 1381887 - RNA, 13 nt, Homo sapiens
caggaaacauauu

SEQ ID NO: 1381888 - RNA, 23 nt, Homo sapiens
caggaaauauauaugugugugua

SEQ ID NO: 1381889 - RNA, 15 nt, Homo sapiens
caggaacagaaggau

SEQ ID NO: 1381890 - RNA, 23 nt, Homo sapiens
caggaaccucagggcugugugua

SEQ ID NO: 1381891 - RNA, 22 nt, Homo sapiens
caggaaccuccuccacaccagc

SEQ ID NO: 1381892 - RNA, 13 nt, Homo sapiens
caggaagcuguga

SEQ ID NO: 1381893 - RNA, 18 nt, Homo sapiens
caggaagucuucagggaa

SEQ ID NO: 1381894 - RNA, 13 nt, Homo sapiens
caggacauucuca

SEQ ID NO: 1381895 - RNA, 17 nt, Homo sapiens
caggacuccagcccauu

SEQ ID NO: 1381896 - RNA, 14 nt, Homo sapiens
caggagacaguuca

SEQ ID NO: 1381897 - RNA, 17 nt, Homo sapiens
caggagaccuggcacug

SEQ ID NO: 1381898 - RNA, 22 nt, Homo sapiens
caggagaccuggcacuggaugc

SEQ ID NO: 1381899 - RNA, 21 nt, Homo sapiens
caggagacuuuacauggaugc

SEQ ID NO: 1381900 - RNA, 22 nt, Homo sapiens
caggagaggggcagaacagccg

SEQ ID NO: 1381901 - RNA, 18 nt, Homo sapiens
caggaggaaggcuuacac

SEQ ID NO: 1381902 - RNA, 16 nt, Homo sapiens
caggagggcccuaccu

SEQ ID NO: 1381903 - RNA, 19 nt, Homo sapiens
caggaguacaccccaacag

SEQ ID NO: 1381904 - RNA, 14 nt, Homo sapiens
caggaguucagggu

SEQ ID NO: 1381905 - RNA, 22 nt, Homo sapiens
caggaucaaaccccgaccaccu

SEQ ID NO: 1381906 - RNA, 14 nt, Homo sapiens
caggaugacuuuac

SEQ ID NO: 1381907 - RNA, 12 nt, Homo sapiens
caggauucuccu

SEQ ID NO: 1381908 - RNA, 14 nt, Homo sapiens
caggcaacgcacaa

SEQ ID NO: 1381909 - RNA, 14 nt, Homo sapiens
caggcaacugaggc

SEQ ID NO: 1381910 - RNA, 12 nt, Homo sapiens
caggcaccugcc

SEQ ID NO: 1381911 - RNA, 13 nt, Homo sapiens
caggcaccugcca

SEQ ID NO: 1381912 - RNA, 19 nt, Homo sapiens
caggcagcuuuuucucucc

SEQ ID NO: 1381913 - RNA, 12 nt, Homo sapiens
caggccagcugu

SEQ ID NO: 1381914 - RNA, 15 nt, Homo sapiens
caggccauacuuuac

SEQ ID NO: 1381915 - RNA, 20 nt, Homo sapiens
caggcccaccuaccuucaaa

SEQ ID NO: 1381916 - RNA, 22 nt, Homo sapiens
caggccgccccagccucugagc

SEQ ID NO: 1381917 - RNA, 21 nt, Homo sapiens
caggccuuaauuuucaguaua

SEQ ID NO: 1381918 - RNA, 14 nt, Homo sapiens
caggcgaugugcaa

SEQ ID NO: 1381919 - RNA, 15 nt, Homo sapiens
caggcgaugugcaag

SEQ ID NO: 1381920 - RNA, 16 nt, Homo sapiens
caggcgaugugcaagu

SEQ ID NO: 1381921 - RNA, 13 nt, Homo sapiens
caggcucuucucc

SEQ ID NO: 1381922 - RNA, 13 nt, Homo sapiens
cagggaagccaaa

SEQ ID NO: 1381923 - RNA, 13 nt, Homo sapiens
cagggaauuucag

SEQ ID NO: 1381924 - RNA, 17 nt, Homo sapiens
cagggaccccugcccuu

SEQ ID NO: 1381925 - RNA, 18 nt, Homo sapiens
cagggagugggcuaagca

SEQ ID NO: 1381926 - RNA, 15 nt, Homo sapiens
cagggauagcacuga

SEQ ID NO: 1381927 - RNA, 16 nt, Homo sapiens
cagggcacugcugcug

SEQ ID NO: 1381928 - RNA, 19 nt, Homo sapiens
cagggcauccaacugagaa

SEQ ID NO: 1381929 - RNA, 20 nt, Homo sapiens
cagggcuggagucaaaacac

SEQ ID NO: 1381930 - RNA, 23 nt, Homo sapiens
cagggcugucuucguauucccau

SEQ ID NO: 1381931 - RNA, 13 nt, Homo sapiens
cagggcugugauc

SEQ ID NO: 1381932 - RNA, 21 nt, Homo sapiens
caggggucgucaccaccucuc

SEQ ID NO: 1381933 - RNA, 14 nt, Homo sapiens
cagggucauagcau

SEQ ID NO: 1381934 - RNA, 20 nt, Homo sapiens
cagggucucacuauguugcc

SEQ ID NO: 1381935 - RNA, 21 nt, Homo sapiens
cagggucucacuauguugccc

SEQ ID NO: 1381936 - RNA, 21 nt, Homo sapiens
cagggucucacucugucgccc

SEQ ID NO: 1381937 - RNA, 20 nt, Homo sapiens
caggguuuugccauguuggc

SEQ ID NO: 1381938 - RNA, 21 nt, Homo sapiens
caggguuuugccauguuggcc

SEQ ID NO: 1381939 - RNA, 13 nt, Homo sapiens
cagguaaggugag

SEQ ID NO: 1381940 - RNA, 17 nt, Homo sapiens
cagguaaggugagggaa

SEQ ID NO: 1381941 - RNA, 21 nt, Homo sapiens
caggucaacuucagagacuau

SEQ ID NO: 1381942 - RNA, 17 nt, Homo sapiens
caggucaauacaguaca

SEQ ID NO: 1381943 - RNA, 20 nt, Homo sapiens
caggucucccgggaagccac

SEQ ID NO: 1381944 - RNA, 13 nt, Homo sapiens
caggugacaguga

SEQ ID NO: 1381945 - RNA, 14 nt, Homo sapiens
caggugacagugag

SEQ ID NO: 1381946 - RNA, 14 nt, Homo sapiens
caggugugagucac

SEQ ID NO: 1381947 - RNA, 14 nt, Homo sapiens
cagguguuuauaca

SEQ ID NO: 1381948 - RNA, 18 nt, Homo sapiens
caguaaaaacuguucucu

SEQ ID NO: 1381949 - RNA, 15 nt, Homo sapiens
caguaaaguguaaca

SEQ ID NO: 1381950 - RNA, 16 nt, Homo sapiens
caguaaaguguaacau

SEQ ID NO: 1381951 - RNA, 15 nt, Homo sapiens
caguaacuugguuau

SEQ ID NO: 1381952 - RNA, 20 nt, Homo sapiens
caguaauguauucuaucucu

SEQ ID NO: 1381953 - RNA, 18 nt, Homo sapiens
caguacaggcagcacaga

SEQ ID NO: 1381954 - RNA, 12 nt, Homo sapiens
caguaguaucaa

SEQ ID NO: 1381955 - RNA, 19 nt, Homo sapiens
caguaguggugacuguggg

SEQ ID NO: 1381956 - RNA, 17 nt, Homo sapiens
caguaugguaacuuugc

SEQ ID NO: 1381957 - RNA, 18 nt, Homo sapiens
cagucaaggaguggcuua

SEQ ID NO: 1381958 - RNA, 19 nt, Homo sapiens
cagucaaggaguggcuuac

SEQ ID NO: 1381959 - RNA, 17 nt, Homo sapiens
cagucagaguugugcac

SEQ ID NO: 1381960 - RNA, 15 nt, Homo sapiens
cagucaucuugacca

SEQ ID NO: 1381961 - RNA, 18 nt, Homo sapiens
cagucucuucuaagcaaa

SEQ ID NO: 1381962 - RNA, 17 nt, Homo sapiens
cagugaagaugccagug

SEQ ID NO: 1381963 - RNA, 14 nt, Homo sapiens
cagugagccaagau

SEQ ID NO: 1381964 - RNA, 20 nt, Homo sapiens
cagugagccaagauugcgcc

SEQ ID NO: 1381965 - RNA, 20 nt, Homo sapiens
cagugagcugauaucaugcc

SEQ ID NO: 1381966 - RNA, 18 nt, Homo sapiens
cagugaggcugcacccac

SEQ ID NO: 1381967 - RNA, 17 nt, Homo sapiens
cagugagucucuucaga

SEQ ID NO: 1381968 - RNA, 17 nt, Homo sapiens
cagugaugcugugcuau

SEQ ID NO: 1381969 - RNA, 14 nt, Homo sapiens
cagugcaacacuga

SEQ ID NO: 1381970 - RNA, 16 nt, Homo sapiens
cagugccauugucuuu

SEQ ID NO: 1381971 - RNA, 21 nt, Homo sapiens
cagugcccagcugggggucaa

SEQ ID NO: 1381972 - RNA, 15 nt, Homo sapiens
cagugccuuccauaa

SEQ ID NO: 1381973 - RNA, 15 nt, Homo sapiens
cagugccuuucuucu

SEQ ID NO: 1381974 - RNA, 14 nt, Homo sapiens
cacacgcgugcaca

SEQ ID NO: 1381975 - RNA, 19 nt, Homo sapiens
cacacgucauguuucuuca

SEQ ID NO: 1381976 - RNA, 14 nt, Homo sapiens
cacacucacuggca

SEQ ID NO: 1381977 - RNA, 23 nt, Homo sapiens
cacacuguauauaaacauaucaa

SEQ ID NO: 1381978 - RNA, 14 nt, Homo sapiens
cacacuuccugucc

SEQ ID NO: 1381979 - RNA, 14 nt, Homo sapiens
cacagaaaacuaga

SEQ ID NO: 1381980 - RNA, 19 nt, Homo sapiens
cacagaaagacugagcuca

SEQ ID NO: 1381981 - RNA, 17 nt, Homo sapiens
cacagaaauacaugaaa

SEQ ID NO: 1381982 - RNA, 16 nt, Homo sapiens
cacagaggugcuguag

SEQ ID NO: 1381983 - RNA, 17 nt, Homo sapiens
cacagaucacagcuuca

SEQ ID NO: 1381984 - RNA, 15 nt, Homo sapiens
cacagcacuaauuca

SEQ ID NO: 1381985 - RNA, 16 nt, Homo sapiens
cacagcacuaauucaa

SEQ ID NO: 1381986 - RNA, 12 nt, Homo sapiens
cacagccaauac

SEQ ID NO: 1381987 - RNA, 20 nt, Homo sapiens
cacagcgagacuccgucuca

SEQ ID NO: 1381988 - RNA, 20 nt, Homo sapiens
cacagcuucauuuccugugu

SEQ ID NO: 1381989 - RNA, 22 nt, Homo sapiens
cacagcuucugcagcagacugu

SEQ ID NO: 1381990 - RNA, 15 nt, Homo sapiens
cacaggcagcauuua

SEQ ID NO: 1381991 - RNA, 16 nt, Homo sapiens
cacaggcagcauuuag

SEQ ID NO: 1381992 - RNA, 20 nt, Homo sapiens
cacagggcauccaacugaga

SEQ ID NO: 1381993 - RNA, 16 nt, Homo sapiens
cacagguagacaguau

SEQ ID NO: 1381994 - RNA, 17 nt, Homo sapiens
cacagguagacaguaua

SEQ ID NO: 1381995 - RNA, 17 nt, Homo sapiens
cacagucugacuucccc

SEQ ID NO: 1381996 - RNA, 13 nt, Homo sapiens
cacagugcaucuc

SEQ ID NO: 1381997 - RNA, 17 nt, Homo sapiens
cacagugcugaccagac

SEQ ID NO: 1381998 - RNA, 23 nt, Homo sapiens
cacagugugaaucuuggugucua

SEQ ID NO: 1381999 - RNA, 12 nt, Homo sapiens
cacaucuuccac

SEQ ID NO: 1382000 - RNA, 14 nt, Homo sapiens
cacaucuugcucug

SEQ ID NO: 1382001 - RNA, 15 nt, Homo sapiens
cacaugcuacaagac

SEQ ID NO: 1382002 - RNA, 20 nt, Homo sapiens
augcuaccaugccucuccaa

SEQ ID NO: 1382003 - RNA, 15 nt, Homo sapiens
augcuaucucugugu

SEQ ID NO: 1382004 - RNA, 17 nt, Homo sapiens
augcuccuuccaacagg

SEQ ID NO: 1382005 - RNA, 19 nt, Homo sapiens
augcucugauuuaucugag

SEQ ID NO: 1382006 - RNA, 16 nt, Homo sapiens
augcucugcauguuac

SEQ ID NO: 1382007 - RNA, 17 nt, Homo sapiens
augcucugcauguuaca

SEQ ID NO: 1382008 - RNA, 13 nt, Homo sapiens
augcugacuguac

SEQ ID NO: 1382009 - RNA, 18 nt, Homo sapiens
augcugcaaauaaauuca

SEQ ID NO: 1382010 - RNA, 19 nt, Homo sapiens
augcugcaguuccaaaaga

SEQ ID NO: 1382011 - RNA, 15 nt, Homo sapiens
augcuggcauuugca

SEQ ID NO: 1382012 - RNA, 20 nt, Homo sapiens
augcuggcucccagggccau

SEQ ID NO: 1382013 - RNA, 19 nt, Homo sapiens
augcuguauuuucuuuuua

SEQ ID NO: 1382014 - RNA, 15 nt, Homo sapiens
augcugugcuaugaa

SEQ ID NO: 1382015 - RNA, 19 nt, Homo sapiens
augcuguuuuauauguaga

SEQ ID NO: 1382016 - RNA, 16 nt, Homo sapiens
augcuugaaugccacg

SEQ ID NO: 1382017 - RNA, 18 nt, Homo sapiens
augcuuguauuuuacuuu

SEQ ID NO: 1382018 - RNA, 12 nt, Homo sapiens
augcuuugcccc

SEQ ID NO: 1382019 - RNA, 17 nt, Homo sapiens
auggaaaagggagauuc

SEQ ID NO: 1382020 - RNA, 13 nt, Homo sapiens
auggaagcauauu

SEQ ID NO: 1382021 - RNA, 23 nt, Homo sapiens
auggaaguugcagugagcugaua

SEQ ID NO: 1382022 - RNA, 20 nt, Homo sapiens
auggaauuuuucauugauau

SEQ ID NO: 1382023 - RNA, 15 nt, Homo sapiens
auggacaagauuacc

SEQ ID NO: 1382024 - RNA, 18 nt, Homo sapiens
auggacaugaucuucuuu

SEQ ID NO: 1382025 - RNA, 14 nt, Homo sapiens
auggauagucuguc

SEQ ID NO: 1382026 - RNA, 17 nt, Homo sapiens
auggcacccaugcaccu

SEQ ID NO: 1382027 - RNA, 20 nt, Homo sapiens
auggccagugugaucccaag

SEQ ID NO: 1382028 - RNA, 18 nt, Homo sapiens
auggcggucagccccuuc

SEQ ID NO: 1382029 - RNA, 15 nt, Homo sapiens
auggcucaugaccug

SEQ ID NO: 1382030 - RNA, 15 nt, Homo sapiens
auggcuuuaugcuag

SEQ ID NO: 1382031 - RNA, 17 nt, Homo sapiens
augggaaccccuucauc

SEQ ID NO: 1382032 - RNA, 17 nt, Homo sapiens
auuuuccuccaggcaaa

SEQ ID NO: 1382033 - RNA, 18 nt, Homo sapiens
auuuuccucuauuuccua

SEQ ID NO: 1382034 - RNA, 17 nt, Homo sapiens
auuuucuaaugugccua

SEQ ID NO: 1382035 - RNA, 19 nt, Homo sapiens
auuuucugaaacuaaugaa

SEQ ID NO: 1382036 - RNA, 15 nt, Homo sapiens
auuuugcagcaguga

SEQ ID NO: 1382037 - RNA, 20 nt, Homo sapiens
auuuugggguacccacugcu

SEQ ID NO: 1382038 - RNA, 15 nt, Homo sapiens
auuuuguaccagugg

SEQ ID NO: 1382039 - RNA, 19 nt, Homo sapiens
auuuuguuuuugucuuaaa

SEQ ID NO: 1382040 - RNA, 21 nt, Homo sapiens
auuuuguuuuugucuuaaaaa

SEQ ID NO: 1382041 - RNA, 15 nt, Homo sapiens
auuuuuauauagcuu

SEQ ID NO: 1382042 - RNA, 19 nt, Homo sapiens
auuuuuguagagccagggu

SEQ ID NO: 1382043 - RNA, 21 nt, Homo sapiens
auuuuuuacagcugccugcag

SEQ ID NO: 1382044 - RNA, 21 nt, Homo sapiens
caaaaaaaguugaaggccuua

SEQ ID NO: 1382045 - RNA, 21 nt, Homo sapiens
caaaaaaaugcucacacucca

SEQ ID NO: 1382046 - RNA, 22 nt, Homo sapiens
caaaaagggauccguacauuca

SEQ ID NO: 1382047 - RNA, 18 nt, Homo sapiens
caaaaauacucacauggc

SEQ ID NO: 1382048 - RNA, 21 nt, Homo sapiens
caaaaaugaaagcaugucuca

SEQ ID NO: 1382049 - RNA, 21 nt, Homo sapiens
caaaacaccagggacacauuu

SEQ ID NO: 1382050 - RNA, 19 nt, Homo sapiens
caaaacauuuuugauuuca

SEQ ID NO: 1382051 - RNA, 13 nt, Homo sapiens
caaaaccaaauau

SEQ ID NO: 1382052 - RNA, 18 nt, Homo sapiens
caaaaccugauguuaaaa

SEQ ID NO: 1382053 - RNA, 22 nt, Homo sapiens
caaaacucuccuacacuuccau

SEQ ID NO: 1382054 - RNA, 20 nt, Homo sapiens
caaaagaagacaacauuucu

SEQ ID NO: 1382055 - RNA, 22 nt, Homo sapiens
caaaagaaguaacaagagugau

SEQ ID NO: 1382056 - RNA, 18 nt, Homo sapiens
caaaagaggauguucacc

SEQ ID NO: 1382057 - RNA, 18 nt, Homo sapiens
caaaauaaugucuuguua

SEQ ID NO: 1382058 - RNA, 23 nt, Homo sapiens
caaaauuuugcuccccagugaag

SEQ ID NO: 1382059 - RNA, 14 nt, Homo sapiens
caaacaaaaccacc

SEQ ID NO: 1382060 - RNA, 14 nt, Homo sapiens
caaacaaauaugca

SEQ ID NO: 1382061 - RNA, 18 nt, Homo sapiens
caaacacaggauuuguaa

SEQ ID NO: 1382062 - RNA, 21 nt, Homo sapiens
caaacacauuaagccuuccac

SEQ ID NO: 1382063 - RNA, 16 nt, Homo sapiens
caaacagccacacugu

SEQ ID NO: 1382064 - RNA, 13 nt, Homo sapiens
caaacagcucagg

SEQ ID NO: 1382065 - RNA, 19 nt, Homo sapiens
caaacgggcugcccugcca

SEQ ID NO: 1382066 - RNA, 17 nt, Homo sapiens
caaacuaagcuauguga

SEQ ID NO: 1382067 - RNA, 23 nt, Homo sapiens
caaacuaccuuccaguuccucau

SEQ ID NO: 1382068 - RNA, 20 nt, Homo sapiens
caaacuguagaaaugaugau

SEQ ID NO: 1382069 - RNA, 19 nt, Homo sapiens
caaacuguguaacugccca

SEQ ID NO: 1382070 - RNA, 14 nt, Homo sapiens
caaacuuccaguca

SEQ ID NO: 1382071 - RNA, 16 nt, Homo sapiens
caaacuuccagugcaa

SEQ ID NO: 1382072 - RNA, 19 nt, Homo sapiens
caaagaagaguuaagaaga

SEQ ID NO: 1382073 - RNA, 13 nt, Homo sapiens
caaagacauucug

SEQ ID NO: 1382074 - RNA, 18 nt, Homo sapiens
caaagagccucacaguua

SEQ ID NO: 1382075 - RNA, 17 nt, Homo sapiens
caaagauccccaaaaca

SEQ ID NO: 1382076 - RNA, 20 nt, Homo sapiens
caaagcauugagcaaagggg

SEQ ID NO: 1382077 - RNA, 10 nt, Homo sapiens
caaagccaaa

SEQ ID NO: 1382078 - RNA, 20 nt, Homo sapiens
caaagcuggcaauauuacaa

SEQ ID NO: 1382079 - RNA, 18 nt, Homo sapiens
caaaggagggucaggaag

SEQ ID NO: 1382080 - RNA, 20 nt, Homo sapiens
caaaggagggucaggaagga

SEQ ID NO: 1382081 - RNA, 23 nt, Homo sapiens
caaaggcacugaggcccagggag

SEQ ID NO: 1382082 - RNA, 14 nt, Homo sapiens
caaaguauuugcug

SEQ ID NO: 1382083 - RNA, 17 nt, Homo sapiens
caaagugcugcgauuac

SEQ ID NO: 1382084 - RNA, 16 nt, Homo sapiens
caaaguguuaaucuua

SEQ ID NO: 1382085 - RNA, 14 nt, Homo sapiens
caaauaauuuguau

SEQ ID NO: 1382086 - RNA, 21 nt, Homo sapiens
caaauaauuuuucacuucaaa

SEQ ID NO: 1382087 - RNA, 19 nt, Homo sapiens
caaauacugauggugcauu

SEQ ID NO: 1382088 - RNA, 17 nt, Homo sapiens
caaauauuuauaagcua

SEQ ID NO: 1382089 - RNA, 15 nt, Homo sapiens
caaaucagcugcuac

SEQ ID NO: 1382090 - RNA, 14 nt, Homo sapiens
caaaucaucucuca

SEQ ID NO: 1382091 - RNA, 20 nt, Homo sapiens
caaaucaucucucaucacuu

SEQ ID NO: 1382092 - RNA, 19 nt, Homo sapiens
caaaucuaagggaaaaagc

SEQ ID NO: 1382093 - RNA, 14 nt, Homo sapiens
caaaugcacaucuc

SEQ ID NO: 1382094 - RNA, 15 nt, Homo sapiens
caaaugcacaucuca

SEQ ID NO: 1382095 - RNA, 18 nt, Homo sapiens
caaaugcacaucucaugg

SEQ ID NO: 1382096 - RNA, 18 nt, Homo sapiens
caaauuagguuuuguaca

SEQ ID NO: 1382097 - RNA, 21 nt, Homo sapiens
caaauucuacugaacacuuca

SEQ ID NO: 1382098 - RNA, 23 nt, Homo sapiens
caaauuggagcagggacagauca

SEQ ID NO: 1382099 - RNA, 17 nt, Homo sapiens
caaauugggccaaagaa

SEQ ID NO: 1382100 - RNA, 17 nt, Homo sapiens
caaauuuucacauaaaa

SEQ ID NO: 1382101 - RNA, 22 nt, Homo sapiens
caacaaaauaaugcacuuccuu

SEQ ID NO: 1382102 - RNA, 23 nt, Homo sapiens
caacaaauuagguuuuguacaau

SEQ ID NO: 1382103 - RNA, 17 nt, Homo sapiens
caacaauccaucucuca

SEQ ID NO: 1382104 - RNA, 21 nt, Homo sapiens
caacaauccaucucucaagua

SEQ ID NO: 1382105 - RNA, 22 nt, Homo sapiens
caacacaggauggucucugcca

SEQ ID NO: 1382106 - RNA, 20 nt, Homo sapiens
caacacaugucuagcuuuca

SEQ ID NO: 1382107 - RNA, 22 nt, Homo sapiens
caacacugcugcuccagugcag

SEQ ID NO: 1382108 - RNA, 17 nt, Homo sapiens
caacacuguacacauaa

SEQ ID NO: 1382109 - RNA, 12 nt, Homo sapiens
caacauaacuga

SEQ ID NO: 1382110 - RNA, 17 nt, Homo sapiens
caacaucaagccuguga

SEQ ID NO: 1382111 - RNA, 13 nt, Homo sapiens
caacaugacuguu

SEQ ID NO: 1382112 - RNA, 21 nt, Homo sapiens
caacaugaugaaaccccaucu

SEQ ID NO: 1382113 - RNA, 16 nt, Homo sapiens
caacaugcgaccguga

SEQ ID NO: 1382114 - RNA, 21 nt, Homo sapiens
caacaugguaaaaccccaucu

SEQ ID NO: 1382115 - RNA, 15 nt, Homo sapiens
caacauuaaacacaa

SEQ ID NO: 1382116 - RNA, 19 nt, Homo sapiens
caaccacaggcagcauuua

SEQ ID NO: 1382117 - RNA, 21 nt, Homo sapiens
caaccacuguaaaaugaaauu

SEQ ID NO: 1382118 - RNA, 18 nt, Homo sapiens
agcugucaggcugauuau

SEQ ID NO: 1382119 - RNA, 19 nt, Homo sapiens
agcugucccucacuguuga

SEQ ID NO: 1382120 - RNA, 18 nt, Homo sapiens
agcugucucaaaccucca

SEQ ID NO: 1382121 - RNA, 12 nt, Homo sapiens
agcuguggcuca

SEQ ID NO: 1382122 - RNA, 23 nt, Homo sapiens
agcugugguuuucuuuugccaug

SEQ ID NO: 1382123 - RNA, 13 nt, Homo sapiens
agcuguucagcug

SEQ ID NO: 1382124 - RNA, 21 nt, Homo sapiens
agcuuaauggcucaugaccug

SEQ ID NO: 1382125 - RNA, 14 nt, Homo sapiens
agcuuacaugagaa

SEQ ID NO: 1382126 - RNA, 22 nt, Homo sapiens
agcuuagccaaugugggagcag

SEQ ID NO: 1382127 - RNA, 14 nt, Homo sapiens
agcuuaucucaggg

SEQ ID NO: 1382128 - RNA, 21 nt, Homo sapiens
agcuucauauaccagcaauau

SEQ ID NO: 1382129 - RNA, 12 nt, Homo sapiens
agcuucaugccu

SEQ ID NO: 1382130 - RNA, 15 nt, Homo sapiens
agcuucucauccugc

SEQ ID NO: 1382131 - RNA, 22 nt, Homo sapiens
agcuucuuaauauaacugccuu

SEQ ID NO: 1382132 - RNA, 15 nt, Homo sapiens
agcuugaaacauaga

SEQ ID NO: 1382133 - RNA, 19 nt, Homo sapiens
agcuugauucucagcacuu

SEQ ID NO: 1382134 - RNA, 13 nt, Homo sapiens
agcuugcagugag

SEQ ID NO: 1382135 - RNA, 17 nt, Homo sapiens
agcuugcucuucagugg

SEQ ID NO: 1382136 - RNA, 17 nt, Homo sapiens
agcuuguaaauagcuca

SEQ ID NO: 1382137 - RNA, 22 nt, Homo sapiens
agcuuuauuuuuuaaguauuua

SEQ ID NO: 1382138 - RNA, 12 nt, Homo sapiens
agcuuucugucc

SEQ ID NO: 1382139 - RNA, 13 nt, Homo sapiens
agcuuugcaggau

SEQ ID NO: 1382140 - RNA, 19 nt, Homo sapiens
agcuuuggacgcacacagc

SEQ ID NO: 1382141 - RNA, 20 nt, Homo sapiens
aggaaaaaccaauagcuuua

SEQ ID NO: 1382142 - RNA, 20 nt, Homo sapiens
aggaaaacugaggcccuugg

SEQ ID NO: 1382143 - RNA, 12 nt, Homo sapiens
aggaaacauauu

SEQ ID NO: 1382144 - RNA, 16 nt, Homo sapiens
aggaaacucaccugcu

SEQ ID NO: 1382145 - RNA, 13 nt, Homo sapiens
aggaaagcaauaa

SEQ ID NO: 1382146 - RNA, 21 nt, Homo sapiens
aggaaagugauuuuuuuccac

SEQ ID NO: 1382147 - RNA, 22 nt, Homo sapiens
aggaacugggccaacucaccug

SEQ ID NO: 1382148 - RNA, 19 nt, Homo sapiens
aggaagagccaggugcugc

SEQ ID NO: 1382149 - RNA, 13 nt, Homo sapiens
aggaagagugcaa

SEQ ID NO: 1382150 - RNA, 19 nt, Homo sapiens
aggaagcugugagagcagu

SEQ ID NO: 1382151 - RNA, 21 nt, Homo sapiens
aggaagguagaaauaucugaa

SEQ ID NO: 1382152 - RNA, 15 nt, Homo sapiens
aggaagucagacuuu

SEQ ID NO: 1382153 - RNA, 14 nt, Homo sapiens
aggaagugacucau

SEQ ID NO: 1382154 - RNA, 12 nt, Homo sapiens
aggaauuucuga

SEQ ID NO: 1382155 - RNA, 21 nt, Homo sapiens
aggacaaccauuccagacugc

SEQ ID NO: 1382156 - RNA, 18 nt, Homo sapiens
aggacagagcugacaaaa

SEQ ID NO: 1382157 - RNA, 17 nt, Homo sapiens
aggacagcauggugcau

SEQ ID NO: 1382158 - RNA, 21 nt, Homo sapiens
aggacagggaggugaccccag

SEQ ID NO: 1382159 - RNA, 22 nt, Homo sapiens
aggacauucuggaaaagcaaaa

SEQ ID NO: 1382160 - RNA, 20 nt, Homo sapiens
aggacauugcggacagccac

SEQ ID NO: 1382161 - RNA, 15 nt, Homo sapiens
aggaccgccaaagaa

SEQ ID NO: 1382162 - RNA, 23 nt, Homo sapiens
aggacuagggcuuauccaugccu

SEQ ID NO: 1382163 - RNA, 23 nt, Homo sapiens
aggacugccccgugcagacugga

SEQ ID NO: 1382164 - RNA, 18 nt, Homo sapiens
aggacuguugacauccaa

SEQ ID NO: 1382165 - RNA, 15 nt, Homo sapiens
aggagaaacacaucu

SEQ ID NO: 1382166 - RNA, 15 nt, Homo sapiens
aggagacccacaggu

SEQ ID NO: 1382167 - RNA, 22 nt, Homo sapiens
aggagaccuggcacuggaugca

SEQ ID NO: 1382168 - RNA, 15 nt, Homo sapiens
aggagacuagauugc

SEQ ID NO: 1382169 - RNA, 14 nt, Homo sapiens
aggagauguaagag

SEQ ID NO: 1382170 - RNA, 22 nt, Homo sapiens
aggaggagaaaucucacuuuuc

SEQ ID NO: 1382171 - RNA, 20 nt, Homo sapiens
aggaggaguuuaaacugaau

SEQ ID NO: 1382172 - RNA, 14 nt, Homo sapiens
aggaggcagaaagc

SEQ ID NO: 1382173 - RNA, 20 nt, Homo sapiens
aggaggcagagguugcagug

SEQ ID NO: 1382174 - RNA, 20 nt, Homo sapiens
aggaggcuuaggacuuucca

SEQ ID NO: 1382175 - RNA, 23 nt, Homo sapiens
aggagggcgugacucacccaagc

SEQ ID NO: 1382176 - RNA, 21 nt, Homo sapiens
aggaggggaggaacacugcac

SEQ ID NO: 1382177 - RNA, 17 nt, Homo sapiens
aggagguuuaggucaag

SEQ ID NO: 1382178 - RNA, 22 nt, Homo sapiens
aggaguacaccccaacagcacc

SEQ ID NO: 1382179 - RNA, 12 nt, Homo sapiens
aggauaacacaa

SEQ ID NO: 1382180 - RNA, 22 nt, Homo sapiens
aggauaccaaauaccauguaca

SEQ ID NO: 1382181 - RNA, 18 nt, Homo sapiens
aggauacuuuacaugguu

SEQ ID NO: 1382182 - RNA, 21 nt, Homo sapiens
aggauauaguuaucaaucucu

SEQ ID NO: 1382183 - RNA, 23 nt, Homo sapiens
aggauauaguuaucaaucucuag

SEQ ID NO: 1382184 - RNA, 19 nt, Homo sapiens
aggaucaguugaggccagg

SEQ ID NO: 1382185 - RNA, 21 nt, Homo sapiens
aggaugaaagugaccauguuu

SEQ ID NO: 1382186 - RNA, 21 nt, Homo sapiens
aggaugagcauuuagggcaag

SEQ ID NO: 1382187 - RNA, 15 nt, Homo sapiens
aggaugcccacuucc

SEQ ID NO: 1382188 - RNA, 18 nt, Homo sapiens
aggauggcaaagagaguc

SEQ ID NO: 1382189 - RNA, 13 nt, Homo sapiens
aggauggcacugu

SEQ ID NO: 1382190 - RNA, 17 nt, Homo sapiens
aggauguucugggacac

SEQ ID NO: 1382191 - RNA, 15 nt, Homo sapiens
aggauuuugauccaa

SEQ ID NO: 1382192 - RNA, 20 nt, Homo sapiens
aggcaaaauugauauacuuu

SEQ ID NO: 1382193 - RNA, 13 nt, Homo sapiens
aggcaacugcauu

SEQ ID NO: 1382194 - RNA, 20 nt, Homo sapiens
aggcacccaaaccccggggc

SEQ ID NO: 1382195 - RNA, 20 nt, Homo sapiens
agaggggaacagacuggaag

SEQ ID NO: 1382196 - RNA, 18 nt, Homo sapiens
agagggggcgaagggauc

SEQ ID NO: 1382197 - RNA, 23 nt, Homo sapiens
agagggguggaguuuuaacugua

SEQ ID NO: 1382198 - RNA, 19 nt, Homo sapiens
agaguacaccccaacagca

SEQ ID NO: 1382199 - RNA, 20 nt, Homo sapiens
agaguacaccccaacagcac

SEQ ID NO: 1382200 - RNA, 20 nt, Homo sapiens
agaguauaugcacuuuccaa

SEQ ID NO: 1382201 - RNA, 16 nt, Homo sapiens
agagugagagggcaug

SEQ ID NO: 1382202 - RNA, 18 nt, Homo sapiens
agagugcccagaacugga

SEQ ID NO: 1382203 - RNA, 22 nt, Homo sapiens
agagugccguaacaacuguggu

SEQ ID NO: 1382204 - RNA, 21 nt, Homo sapiens
agaguggccuggccaggagcu

SEQ ID NO: 1382205 - RNA, 16 nt, Homo sapiens
agaguggguuucacaa

SEQ ID NO: 1382206 - RNA, 16 nt, Homo sapiens
agaguuaaucaacuga

SEQ ID NO: 1382207 - RNA, 12 nt, Homo sapiens
agaguugugcac

SEQ ID NO: 1382208 - RNA, 23 nt, Homo sapiens
agauaaaagaaccgagcaauuuu

SEQ ID NO: 1382209 - RNA, 17 nt, Homo sapiens
agauaaacaacaaauaa

SEQ ID NO: 1382210 - RNA, 20 nt, Homo sapiens
agauaacaaucuguauauaa

SEQ ID NO: 1382211 - RNA, 18 nt, Homo sapiens
agauaaccuguacuucaa

SEQ ID NO: 1382212 - RNA, 13 nt, Homo sapiens
agauaagcaagag

SEQ ID NO: 1382213 - RNA, 22 nt, Homo sapiens
agauaagcuuccaggcugcaua

SEQ ID NO: 1382214 - RNA, 13 nt, Homo sapiens
agauaauguugcu

SEQ ID NO: 1382215 - RNA, 12 nt, Homo sapiens
agauacaugucu

SEQ ID NO: 1382216 - RNA, 13 nt, Homo sapiens
agauaugugaaga

SEQ ID NO: 1382217 - RNA, 12 nt, Homo sapiens
agaucacgccac

SEQ ID NO: 1382218 - RNA, 17 nt, Homo sapiens
agaucacgccacugcac

SEQ ID NO: 1382219 - RNA, 14 nt, Homo sapiens
agaucagccaguga

SEQ ID NO: 1382220 - RNA, 18 nt, Homo sapiens
agaucagccagugaccaa

SEQ ID NO: 1382221 - RNA, 21 nt, Homo sapiens
agaucagccugggcaauguga

SEQ ID NO: 1382222 - RNA, 20 nt, Homo sapiens
agaucaugagaaauuaccaa

SEQ ID NO: 1382223 - RNA, 21 nt, Homo sapiens
agaucgaugauaugaccagaa

SEQ ID NO: 1382224 - RNA, 17 nt, Homo sapiens
agaucgcgccacugcac

SEQ ID NO: 1382225 - RNA, 20 nt, Homo sapiens
agaucuaagccuuuccauaa

SEQ ID NO: 1382226 - RNA, 14 nt, Homo sapiens
agaucuauguacug

SEQ ID NO: 1382227 - RNA, 12 nt, Homo sapiens
agaucugcuguc

SEQ ID NO: 1382228 - RNA, 10 nt, Homo sapiens
agaucuugau

SEQ ID NO: 1382229 - RNA, 17 nt, Homo sapiens
agaucuuucaggaaaga

SEQ ID NO: 1382230 - RNA, 20 nt, Homo sapiens
agaugaagcaaacacauuaa

SEQ ID NO: 1382231 - RNA, 14 nt, Homo sapiens
agaugaaugggagu

SEQ ID NO: 1382232 - RNA, 20 nt, Homo sapiens
agaugacaaugggagccuca

SEQ ID NO: 1382233 - RNA, 16 nt, Homo sapiens
agaugacauggugaaa

SEQ ID NO: 1382234 - RNA, 19 nt, Homo sapiens
agaugcaaggaccaggacu

SEQ ID NO: 1382235 - RNA, 16 nt, Homo sapiens
agaugcaaugugcuac

SEQ ID NO: 1382236 - RNA, 16 nt, Homo sapiens
agauggauagucuguc

SEQ ID NO: 1382237 - RNA, 16 nt, Homo sapiens
agaugggggacugaga

SEQ ID NO: 1382238 - RNA, 21 nt, Homo sapiens
agauggggucucacaguguug

SEQ ID NO: 1382239 - RNA, 21 nt, Homo sapiens
agauguagauaaacucagaaa

SEQ ID NO: 1382240 - RNA, 13 nt, Homo sapiens
agaugucauccca

SEQ ID NO: 1382241 - RNA, 21 nt, Homo sapiens
agaugucugcagcccucagca

SEQ ID NO: 1382242 - RNA, 22 nt, Homo sapiens
agaugugugauucacaguguga

SEQ ID NO: 1382243 - RNA, 19 nt, Homo sapiens
agauguguuaggaauguca

SEQ ID NO: 1382244 - RNA, 23 nt, Homo sapiens
agauuaagagauggguuugacaa

SEQ ID NO: 1382245 - RNA, 22 nt, Homo sapiens
agauuccaggcgaugugcaagu

SEQ ID NO: 1382246 - RNA, 17 nt, Homo sapiens
agauuccgcaccaauaa

SEQ ID NO: 1382247 - RNA, 22 nt, Homo sapiens
agauuccugguuaaauuugaau

SEQ ID NO: 1382248 - RNA, 14 nt, Homo sapiens
agauugucagcucc

SEQ ID NO: 1382249 - RNA, 17 nt, Homo sapiens
agauuuaacaauuccaa

SEQ ID NO: 1382250 - RNA, 17 nt, Homo sapiens
agauuucagauuuguga

SEQ ID NO: 1382251 - RNA, 16 nt, Homo sapiens
agauuugaagacaaaa

SEQ ID NO: 1382252 - RNA, 15 nt, Homo sapiens
agauuuuaugcugcu

SEQ ID NO: 1382253 - RNA, 13 nt, Homo sapiens
agauuuuggcaaa

SEQ ID NO: 1382254 - RNA, 15 nt, Homo sapiens
agcaaaaaaguacuu

SEQ ID NO: 1382255 - RNA, 18 nt, Homo sapiens
agcaaagggagcacuggg

SEQ ID NO: 1382256 - RNA, 17 nt, Homo sapiens
agcaaauaaagaccuga

SEQ ID NO: 1382257 - RNA, 16 nt, Homo sapiens
agcaaauguggcuccu

SEQ ID NO: 1382258 - RNA, 21 nt, Homo sapiens
agcaacacucuauauuuagau

SEQ ID NO: 1382259 - RNA, 24 nt, Homo sapiens
agcaacagauggauagucugucca

SEQ ID NO: 1382260 - RNA, 13 nt, Homo sapiens
agcaacugcagaa

SEQ ID NO: 1382261 - RNA, 14 nt, Homo sapiens
agcaagacacaucc

SEQ ID NO: 1382262 - RNA, 14 nt, Homo sapiens
agcaagcuauucaa

SEQ ID NO: 1382263 - RNA, 16 nt, Homo sapiens
agcaaggaucuuucac

SEQ ID NO: 1382264 - RNA, 15 nt, Homo sapiens
agcaagggcacuuaa

SEQ ID NO: 1382265 - RNA, 23 nt, Homo sapiens
agcaauccuccugagugauccca

SEQ ID NO: 1382266 - RNA, 17 nt, Homo sapiens
agcacaaaagccucuca

SEQ ID NO: 1382267 - RNA, 13 nt, Homo sapiens
agcacacuguagc

SEQ ID NO: 1382268 - RNA, 16 nt, Homo sapiens
agcaccaccaggucuc

SEQ ID NO: 1382269 - RNA, 12 nt, Homo sapiens
ucacuugaucuc

SEQ ID NO: 1382270 - RNA, 20 nt, Homo sapiens
ucacuugugcaguguugaca

SEQ ID NO: 1382271 - RNA, 20 nt, Homo sapiens
ucacuuuaauagaagggcaa

SEQ ID NO: 1382272 - RNA, 19 nt, Homo sapiens
ucacuuuuuacagugcuau

SEQ ID NO: 1382273 - RNA, 14 nt, Homo sapiens
ucagaacacauucu

SEQ ID NO: 1382274 - RNA, 19 nt, Homo sapiens
ucagaaguuucucagcucc

SEQ ID NO: 1382275 - RNA, 16 nt, Homo sapiens
ucagacaggaaaggga

SEQ ID NO: 1382276 - RNA, 19 nt, Homo sapiens
ucagacuccugugcaacuu

SEQ ID NO: 1382277 - RNA, 21 nt, Homo sapiens
ucagacuccugugcaacuuuc

SEQ ID NO: 1382278 - RNA, 17 nt, Homo sapiens
ucagacugcaagugagc

SEQ ID NO: 1382279 - RNA, 21 nt, Homo sapiens
ucagacugcugggacuggcca

SEQ ID NO: 1382280 - RNA, 16 nt, Homo sapiens
ucagagacuaucugau

SEQ ID NO: 1382281 - RNA, 21 nt, Homo sapiens
ucagaggacaccuguacugga

SEQ ID NO: 1382282 - RNA, 15 nt, Homo sapiens
ucagaguugugcaca

SEQ ID NO: 1382283 - RNA, 14 nt, Homo sapiens
ucagauccuacccc

SEQ ID NO: 1382284 - RNA, 23 nt, Homo sapiens
ucagaugaauuguuaauuaucua

SEQ ID NO: 1382285 - RNA, 15 nt, Homo sapiens
ucagaugacuagaaa

SEQ ID NO: 1382286 - RNA, 23 nt, Homo sapiens
ucagaugauucuaugucucauga

SEQ ID NO: 1382287 - RNA, 13 nt, Homo sapiens
ucagaugucucug

SEQ ID NO: 1382288 - RNA, 12 nt, Homo sapiens
ucagauuccacc

SEQ ID NO: 1382289 - RNA, 18 nt, Homo sapiens
ucagcauucucacuccua

SEQ ID NO: 1382290 - RNA, 23 nt, Homo sapiens
ucagccacaugggaaacuuccaa

SEQ ID NO: 1382291 - RNA, 14 nt, Homo sapiens
ucagccacauucua

SEQ ID NO: 1382292 - RNA, 14 nt, Homo sapiens
ucagccucccaaag

SEQ ID NO: 1382293 - RNA, 14 nt, Homo sapiens
ucagcuccuuccac

SEQ ID NO: 1382294 - RNA, 14 nt, Homo sapiens
ucagcuggcacugu

SEQ ID NO: 1382295 - RNA, 19 nt, Homo sapiens
ucagcuuguaaauagcuca

SEQ ID NO: 1382296 - RNA, 13 nt, Homo sapiens
ucaggagucccaa

SEQ ID NO: 1382297 - RNA, 17 nt, Homo sapiens
ucaggcaaagugcugcu

SEQ ID NO: 1382298 - RNA, 16 nt, Homo sapiens
ucaggcagaucucagc

SEQ ID NO: 1382299 - RNA, 18 nt, Homo sapiens
ucaggccaacaagccaac

SEQ ID NO: 1382300 - RNA, 23 nt, Homo sapiens
ucaggccacauggcuaaagaagg

SEQ ID NO: 1382301 - RNA, 17 nt, Homo sapiens
ucagggcacugcugcug

SEQ ID NO: 1382302 - RNA, 14 nt, Homo sapiens
ucagggcugugauc

SEQ ID NO: 1382303 - RNA, 19 nt, Homo sapiens
ucagggggccaggugcaca

SEQ ID NO: 1382304 - RNA, 14 nt, Homo sapiens
ucagguccaauuug

SEQ ID NO: 1382305 - RNA, 14 nt, Homo sapiens
ucagguggaaaaac

SEQ ID NO: 1382306 - RNA, 16 nt, Homo sapiens
ucagguggggcagcuu

SEQ ID NO: 1382307 - RNA, 23 nt, Homo sapiens
ucagguuugggguucguggaaag

SEQ ID NO: 1382308 - RNA, 17 nt, Homo sapiens
ucaguaguaucaaugau

SEQ ID NO: 1382309 - RNA, 18 nt, Homo sapiens
ucaguaguaucaaugauu

SEQ ID NO: 1382310 - RNA, 18 nt, Homo sapiens
ucaguauaauuuaacuuc

SEQ ID NO: 1382311 - RNA, 15 nt, Homo sapiens
ucaguccaccugagc

SEQ ID NO: 1382312 - RNA, 21 nt, Homo sapiens
ucagucugcuuauccuuccac

SEQ ID NO: 1382313 - RNA, 17 nt, Homo sapiens
ucagucuuuuccaugaa

SEQ ID NO: 1382314 - RNA, 14 nt, Homo sapiens
ucagugaaagccag

SEQ ID NO: 1382315 - RNA, 21 nt, Homo sapiens
ucagugcaaagauuugcuuua

SEQ ID NO: 1382316 - RNA, 14 nt, Homo sapiens
ucagugcaggagag

SEQ ID NO: 1382317 - RNA, 14 nt, Homo sapiens
ucaguuggugcugc

SEQ ID NO: 1382318 - RNA, 16 nt, Homo sapiens
ucaguuggugcugcuu

SEQ ID NO: 1382319 - RNA, 20 nt, Homo sapiens
ucaguuucaauucagugcug

SEQ ID NO: 1382320 - RNA, 16 nt, Homo sapiens
ucaguuucacuuucac

SEQ ID NO: 1382321 - RNA, 16 nt, Homo sapiens
ucaguuucccuaucuc

SEQ ID NO: 1382322 - RNA, 22 nt, Homo sapiens
ucaguuuuaucuuuaaucuccu

SEQ ID NO: 1382323 - RNA, 14 nt, Homo sapiens
ucauaacagucuua

SEQ ID NO: 1382324 - RNA, 21 nt, Homo sapiens
ucauaagaaugaauaauaauu

SEQ ID NO: 1382325 - RNA, 14 nt, Homo sapiens
ucauaagcuacuga

SEQ ID NO: 1382326 - RNA, 17 nt, Homo sapiens
ucauaagcuacugauga

SEQ ID NO: 1382327 - RNA, 16 nt, Homo sapiens
ucauaagugacaguuu

SEQ ID NO: 1382328 - RNA, 14 nt, Homo sapiens
ucauacaaugacaa

SEQ ID NO: 1382329 - RNA, 16 nt, Homo sapiens
ucauacucaccucacc

SEQ ID NO: 1382330 - RNA, 19 nt, Homo sapiens
ucauacucaccucacccca

SEQ ID NO: 1382331 - RNA, 18 nt, Homo sapiens
ucauagggaggccuuuag

SEQ ID NO: 1382332 - RNA, 15 nt, Homo sapiens
ucauagggucucuuc

SEQ ID NO: 1382333 - RNA, 14 nt, Homo sapiens
ucauauaccagcaa

SEQ ID NO: 1382334 - RNA, 20 nt, Homo sapiens
uacaaucagccacauucuag

SEQ ID NO: 1382335 - RNA, 12 nt, Homo sapiens
uacaauugugag

SEQ ID NO: 1382336 - RNA, 16 nt, Homo sapiens
uacacaaaccugaaaa

SEQ ID NO: 1382337 - RNA, 14 nt, Homo sapiens
uacacaagacuuuc

SEQ ID NO: 1382338 - RNA, 12 nt, Homo sapiens
uacacacuuuau

SEQ ID NO: 1382339 - RNA, 15 nt, Homo sapiens
uacacagacuauuga

SEQ ID NO: 1382340 - RNA, 20 nt, Homo sapiens
uacacaucuuccacaggucu

SEQ ID NO: 1382341 - RNA, 17 nt, Homo sapiens
uacacccacaguggaaa

SEQ ID NO: 1382342 - RNA, 19 nt, Homo sapiens
uacacgagguaugaggucu

SEQ ID NO: 1382343 - RNA, 15 nt, Homo sapiens
uacacgugacagagu

SEQ ID NO: 1382344 - RNA, 21 nt, Homo sapiens
uacacuaaaaggugaccaaug

SEQ ID NO: 1382345 - RNA, 21 nt, Homo sapiens
uacacucucaaagcaaauaau

SEQ ID NO: 1382346 - RNA, 23 nt, Homo sapiens
uacacucuuauagaaaguucaaa

SEQ ID NO: 1382347 - RNA, 15 nt, Homo sapiens
uacacugucaaacau

SEQ ID NO: 1382348 - RNA, 15 nt, Homo sapiens
uacagauagauauau

SEQ ID NO: 1382349 - RNA, 20 nt, Homo sapiens
uacagcagaaaggagaacua

SEQ ID NO: 1382350 - RNA, 15 nt, Homo sapiens
uacaggacauucuca

SEQ ID NO: 1382351 - RNA, 17 nt, Homo sapiens
uacaggugugagucacc

SEQ ID NO: 1382352 - RNA, 17 nt, Homo sapiens
uacagguuacaugagag

SEQ ID NO: 1382353 - RNA, 20 nt, Homo sapiens
uacaguguauguacuaagca

SEQ ID NO: 1382354 - RNA, 16 nt, Homo sapiens
uacauaguacauacaa

SEQ ID NO: 1382355 - RNA, 21 nt, Homo sapiens
uacauaugcaaaaauauaccu

SEQ ID NO: 1382356 - RNA, 16 nt, Homo sapiens
uacaucccagccugug

SEQ ID NO: 1382357 - RNA, 21 nt, Homo sapiens
uacauccuuguggcacauuuu

SEQ ID NO: 1382358 - RNA, 12 nt, Homo sapiens
uacaucuuucac

SEQ ID NO: 1382359 - RNA, 14 nt, Homo sapiens
uacaucuuucacau

SEQ ID NO: 1382360 - RNA, 19 nt, Homo sapiens
uacaugcagcccaugccca

SEQ ID NO: 1382361 - RNA, 11 nt, Homo sapiens
uacauggguag

SEQ ID NO: 1382362 - RNA, 13 nt, Homo sapiens
uacaugucaauaa

SEQ ID NO: 1382363 - RNA, 15 nt, Homo sapiens
uacauguggcccaac

SEQ ID NO: 1382364 - RNA, 20 nt, Homo sapiens
uacauucugcaagcacaucu

SEQ ID NO: 1382365 - RNA, 22 nt, Homo sapiens
uacauucugcaagcacaucugc

SEQ ID NO: 1382366 - RNA, 16 nt, Homo sapiens
uacauucugcuuucau

SEQ ID NO: 1382367 - RNA, 23 nt, Homo sapiens
uacauuguuugucugucuucaua

SEQ ID NO: 1382368 - RNA, 18 nt, Homo sapiens
uacauuucaccuacuuug

SEQ ID NO: 1382369 - RNA, 16 nt, Homo sapiens
uacauuuccaaauuca

SEQ ID NO: 1382370 - RNA, 18 nt, Homo sapiens
uaccaaaauguccaccaa

SEQ ID NO: 1382371 - RNA, 13 nt, Homo sapiens
uaccaaguuauau

SEQ ID NO: 1382372 - RNA, 12 nt, Homo sapiens
uaccacaguguc

SEQ ID NO: 1382373 - RNA, 21 nt, Homo sapiens
uaccacaugggugaacacuca

SEQ ID NO: 1382374 - RNA, 15 nt, Homo sapiens
uaccaugccucucca

SEQ ID NO: 1382375 - RNA, 19 nt, Homo sapiens
uacccauagcuuccaugag

SEQ ID NO: 1382376 - RNA, 13 nt, Homo sapiens
uaccccaccacga

SEQ ID NO: 1382377 - RNA, 23 nt, Homo sapiens
uaccccaccacgauguggcccug

SEQ ID NO: 1382378 - RNA, 22 nt, Homo sapiens
uaccccugcuaaggaguucuca

SEQ ID NO: 1382379 - RNA, 20 nt, Homo sapiens
uacccguuucacaugcuuuu

SEQ ID NO: 1382380 - RNA, 15 nt, Homo sapiens
ucucauuugucacac

SEQ ID NO: 1382381 - RNA, 16 nt, Homo sapiens
ucuccagaaagcucau

SEQ ID NO: 1382382 - RNA, 12 nt, Homo sapiens
ucuccagaugag

SEQ ID NO: 1382383 - RNA, 19 nt, Homo sapiens
ucuccagaugagaguacac

SEQ ID NO: 1382384 - RNA, 21 nt, Homo sapiens
ucuccagguccucuacuuaau

SEQ ID NO: 1382385 - RNA, 20 nt, Homo sapiens
ucuccagucuuccaccugga

SEQ ID NO: 1382386 - RNA, 19 nt, Homo sapiens
ucucccaauucauccucac

SEQ ID NO: 1382387 - RNA, 21 nt, Homo sapiens
ucucccagccagguucugacu

SEQ ID NO: 1382388 - RNA, 19 nt, Homo sapiens
ucucccaggacccaucacg

SEQ ID NO: 1382389 - RNA, 17 nt, Homo sapiens
ucucccccugggcucug

SEQ ID NO: 1382390 - RNA, 19 nt, Homo sapiens
ucucccuccccugccauuu

SEQ ID NO: 1382391 - RNA, 17 nt, Homo sapiens
ucuccucucucuguaau

SEQ ID NO: 1382392 - RNA, 18 nt, Homo sapiens
ucuccuuuggccauucca

SEQ ID NO: 1382393 - RNA, 22 nt, Homo sapiens
ucucggaguaucugggaacugu

SEQ ID NO: 1382394 - RNA, 23 nt, Homo sapiens
ucucuaaaauagccacuuaccuu

SEQ ID NO: 1382395 - RNA, 23 nt, Homo sapiens
ucucuacaaacucccacuuguca

SEQ ID NO: 1382396 - RNA, 19 nt, Homo sapiens
ucucuacuaccacaaggaa

SEQ ID NO: 1382397 - RNA, 15 nt, Homo sapiens
ucucuauugcugcuc

SEQ ID NO: 1382398 - RNA, 13 nt, Homo sapiens
ucucuccaucaga

SEQ ID NO: 1382399 - RNA, 11 nt, Homo sapiens
ucucucugugg

SEQ ID NO: 1382400 - RNA, 14 nt, Homo sapiens
ucucucuucuccac

SEQ ID NO: 1382401 - RNA, 14 nt, Homo sapiens
ucucucuucuuuuc

SEQ ID NO: 1382402 - RNA, 17 nt, Homo sapiens
ucucugaggacacuaac

SEQ ID NO: 1382403 - RNA, 17 nt, Homo sapiens
ucucuguauuccuagaa

SEQ ID NO: 1382404 - RNA, 14 nt, Homo sapiens
ucucuuucugcaaa

SEQ ID NO: 1382405 - RNA, 22 nt, Homo sapiens
ucucuuugguguacaaaaugga

SEQ ID NO: 1382406 - RNA, 14 nt, Homo sapiens
ucugaaaauuccag

SEQ ID NO: 1382407 - RNA, 15 nt, Homo sapiens
ucugaaacuaaugaa

SEQ ID NO: 1382408 - RNA, 20 nt, Homo sapiens
ucugaaauuuuaauugaacu

SEQ ID NO: 1382409 - RNA, 17 nt, Homo sapiens
ucugaagucacugcaca

SEQ ID NO: 1382410 - RNA, 22 nt, Homo sapiens
ucugaaucgagauguccauagu

SEQ ID NO: 1382411 - RNA, 15 nt, Homo sapiens
ucugaauugacugua

SEQ ID NO: 1382412 - RNA, 15 nt, Homo sapiens
ucugacccacugcuu

SEQ ID NO: 1382413 - RNA, 12 nt, Homo sapiens
ucugacucccaa

SEQ ID NO: 1382414 - RNA, 19 nt, Homo sapiens
ucugacucccaaagagcug

SEQ ID NO: 1382415 - RNA, 18 nt, Homo sapiens
ucugacuggcacagucuu

SEQ ID NO: 1382416 - RNA, 23 nt, Homo sapiens
ucugagcagugcuugaaugaagu

SEQ ID NO: 1382417 - RNA, 15 nt, Homo sapiens
ucugagccaaagaga

SEQ ID NO: 1382418 - RNA, 20 nt, Homo sapiens
ucugaguaagaaacagaauc

SEQ ID NO: 1382419 - RNA, 16 nt, Homo sapiens
ucugaucugaugcaag

SEQ ID NO: 1382420 - RNA, 16 nt, Homo sapiens
ucugaugcaagcaaga

SEQ ID NO: 1382421 - RNA, 18 nt, Homo sapiens
ucugauuuccuaauguca

SEQ ID NO: 1382422 - RNA, 19 nt, Homo sapiens
ucugcaaaggcaccugaau

SEQ ID NO: 1382423 - RNA, 23 nt, Homo sapiens
ucugcaccccccugggcugagag

SEQ ID NO: 1382424 - RNA, 16 nt, Homo sapiens
ucugcaccuuaucuua

SEQ ID NO: 1382425 - RNA, 16 nt, Homo sapiens
ucugcagcuaacuuau

SEQ ID NO: 1382426 - RNA, 19 nt, Homo sapiens
ucugcauguuacauaagau

SEQ ID NO: 1382427 - RNA, 16 nt, Homo sapiens
ucugcauuuucugggu

SEQ ID NO: 1382428 - RNA, 18 nt, Homo sapiens
ucugccagccagcagcca

SEQ ID NO: 1382429 - RNA, 20 nt, Homo sapiens
ucugccccagcucuggcuuc

SEQ ID NO: 1382430 - RNA, 20 nt, Homo sapiens
ucugccggcccuggggcuag

SEQ ID NO: 1382431 - RNA, 20 nt, Homo sapiens
ucugccuguggaguagccau

SEQ ID NO: 1382432 - RNA, 13 nt, Homo sapiens
ucugcuauggaau

SEQ ID NO: 1382433 - RNA, 20 nt, Homo sapiens
ucugcucacauaucugucau

SEQ ID NO: 1382434 - RNA, 10 nt, Homo sapiens
ucugcuccac

SEQ ID NO: 1382435 - RNA, 19 nt, Homo sapiens
ucugcuugcucuuguccua

SEQ ID NO: 1382436 - RNA, 14 nt, Homo sapiens
ucuggaauugcuca

SEQ ID NO: 1382437 - RNA, 17 nt, Homo sapiens
ucuggacauucagaaca

SEQ ID NO: 1382438 - RNA, 22 nt, Homo sapiens
ucuggagaaggugggcacugga

SEQ ID NO: 1382439 - RNA, 13 nt, Homo sapiens
ucuggcaucucuu

SEQ ID NO: 1382440 - RNA, 16 nt, Homo sapiens
ucuggcccuucuugcc

SEQ ID NO: 1382441 - RNA, 18 nt, Homo sapiens
ucuggcugaggauuucaa

SEQ ID NO: 1382442 - RNA, 21 nt, Homo sapiens
ucugggccuucucaccacaga

SEQ ID NO: 1382443 - RNA, 17 nt, Homo sapiens
ucugggugcagcugaga

SEQ ID NO: 1382444 - RNA, 16 nt, Homo sapiens
ucugguggucucugcu

SEQ ID NO: 1382445 - RNA, 15 nt, Homo sapiens
ucuguaguaaacuau

SEQ ID NO: 1382446 - RNA, 18 nt, Homo sapiens
ucugucucugcuauggaa

SEQ ID NO: 1382447 - RNA, 11 nt, Homo sapiens
ucugucuucaa

SEQ ID NO: 1382448 - RNA, 17 nt, Homo sapiens
ucugucuuuauaaucua

SEQ ID NO: 1382449 - RNA, 14 nt, Homo sapiens
ucugugccccaugc

SEQ ID NO: 1382450 - RNA, 16 nt, Homo sapiens
ucugugccccaugccu

SEQ ID NO: 1382451 - RNA, 15 nt, Homo sapiens
ucuguuaaucaugua

SEQ ID NO: 1382452 - RNA, 13 nt, Homo sapiens
ucuguucaaggaa

SEQ ID NO: 1382453 - RNA, 13 nt, Homo sapiens
ucuguucacuuuu

SEQ ID NO: 1382454 - RNA, 19 nt, Homo sapiens
ucuuaaaccacagcacuau

SEQ ID NO: 1382455 - RNA, 23 nt, Homo sapiens
ucuuaacauuucuaacucugaug

SEQ ID NO: 1382456 - RNA, 14 nt, Homo sapiens
ucuuaacuauucaa

SEQ ID NO: 1382457 - RNA, 18 nt, Homo sapiens
ucuuaauauaacugccuu

SEQ ID NO: 1382458 - RNA, 20 nt, Homo sapiens
ucuuaauuaaguaaacuaau

SEQ ID NO: 1382459 - RNA, 13 nt, Homo sapiens
ucuuacaugcauu

SEQ ID NO: 1382460 - RNA, 14 nt, Homo sapiens
ucuuacaugcauuu

SEQ ID NO: 1382461 - RNA, 19 nt, Homo sapiens
ucuuaccuguaugucucca

SEQ ID NO: 1382462 - RNA, 22 nt, Homo sapiens
ucuuacugcaggcaagugggau

SEQ ID NO: 1382463 - RNA, 21 nt, Homo sapiens
ucuuacugcuugguccuugau

SEQ ID NO: 1382464 - RNA, 20 nt, Homo sapiens
ucuuagcugccaaguaaaua

SEQ ID NO: 1382465 - RNA, 11 nt, Homo sapiens
ucuuagcuguc

SEQ ID NO: 1382466 - RNA, 16 nt, Homo sapiens
ucuuagucgagccaag

SEQ ID NO: 1382467 - RNA, 16 nt, Homo sapiens
ucuuaucauauuucaa

SEQ ID NO: 1382468 - RNA, 13 nt, Homo sapiens
ucuuaugccauuu

SEQ ID NO: 1382469 - RNA, 15 nt, Homo sapiens
ucuucaaaugucuaa

SEQ ID NO: 1382470 - RNA, 22 nt, Homo sapiens
ucuucacuucuaaaugcauauc

SEQ ID NO: 1382471 - RNA, 12 nt, Homo sapiens
ucuucagcauuu

SEQ ID NO: 1382472 - RNA, 20 nt, Homo sapiens
ucuucagggcacugcugcug

SEQ ID NO: 1382473 - RNA, 17 nt, Homo sapiens
ucuucaucccacuccaa

SEQ ID NO: 1382474 - RNA, 21 nt, Homo sapiens
ucuuccaacguggcccagaga

SEQ ID NO: 1382475 - RNA, 13 nt, Homo sapiens
ucuuccaucaccu

SEQ ID NO: 1382476 - RNA, 16 nt, Homo sapiens
ucuucccccucuccca

SEQ ID NO: 1382477 - RNA, 14 nt, Homo sapiens
ucuucccuaccuca

SEQ ID NO: 1382478 - RNA, 18 nt, Homo sapiens
ucuucccuaccucaggca

SEQ ID NO: 1382479 - RNA, 19 nt, Homo sapiens
ucuucccuuuuacauacug

SEQ ID NO: 1382480 - RNA, 21 nt, Homo sapiens
ucuuccucccucauuccaccu

SEQ ID NO: 1382481 - RNA, 17 nt, Homo sapiens
ucuucucauagcauuaa

SEQ ID NO: 1382482 - RNA, 13 nt, Homo sapiens
ucuucuccacugg

SEQ ID NO: 1382483 - RNA, 14 nt, Homo sapiens
ucuucuccacugga

SEQ ID NO: 1382484 - RNA, 19 nt, Homo sapiens
ucuucuccauccuaccaca

SEQ ID NO: 1382485 - RNA, 20 nt, Homo sapiens
ucuucuccauccuaccacaa

SEQ ID NO: 1382486 - RNA, 15 nt, Homo sapiens
ucuucucccaauuca

SEQ ID NO: 1382487 - RNA, 19 nt, Homo sapiens
ucuucuuacaugcauuuga

SEQ ID NO: 1382488 - RNA, 14 nt, Homo sapiens
ucuugaaacaagca

SEQ ID NO: 1382489 - RNA, 13 nt, Homo sapiens
ucuugaagugaug

SEQ ID NO: 1382490 - RNA, 22 nt, Homo sapiens
ucuugaccucaggugauccacc

SEQ ID NO: 1382491 - RNA, 15 nt, Homo sapiens
ucuugaggccaggag

SEQ ID NO: 1382492 - RNA, 22 nt, Homo sapiens
ucuugaguucuggaagggacuu

SEQ ID NO: 1382493 - RNA, 23 nt, Homo sapiens
uagaggugcucauucauuuaaca

SEQ ID NO: 1382494 - RNA, 22 nt, Homo sapiens
uagaguccaacguggggcagca

SEQ ID NO: 1382495 - RNA, 23 nt, Homo sapiens
uagauauuagcccagaaauguua

SEQ ID NO: 1382496 - RNA, 21 nt, Homo sapiens
uagauauugugaaguacauau

SEQ ID NO: 1382497 - RNA, 14 nt, Homo sapiens
uagauccagaugag

SEQ ID NO: 1382498 - RNA, 17 nt, Homo sapiens
uagaugcugacuguacu

SEQ ID NO: 1382499 - RNA, 16 nt, Homo sapiens
uagaugguuugagccu

SEQ ID NO: 1382500 - RNA, 12 nt, Homo sapiens
uagaugugcauu

SEQ ID NO: 1382501 - RNA, 20 nt, Homo sapiens
uagaugugucuuaccagauc

SEQ ID NO: 1382502 - RNA, 13 nt, Homo sapiens
uagauucaccugu

SEQ ID NO: 1382503 - RNA, 12 nt, Homo sapiens
uagcaacaugcu

SEQ ID NO: 1382504 - RNA, 17 nt, Homo sapiens
uagcaagacacaucccu

SEQ ID NO: 1382505 - RNA, 14 nt, Homo sapiens
uagcaugcugugau

SEQ ID NO: 1382506 - RNA, 17 nt, Homo sapiens
uagcauuugucaacaaa

SEQ ID NO: 1382507 - RNA, 15 nt, Homo sapiens
uagccaaguguggua

SEQ ID NO: 1382508 - RNA, 22 nt, Homo sapiens
uagccacugcauaccaaccugg

SEQ ID NO: 1382509 - RNA, 11 nt, Homo sapiens
uagcccagaaa

SEQ ID NO: 1382510 - RNA, 17 nt, Homo sapiens
uagcggucaauuugccu

SEQ ID NO: 1382511 - RNA, 16 nt, Homo sapiens
uagcuaauggaaaaug

SEQ ID NO: 1382512 - RNA, 19 nt, Homo sapiens
uagcucuuuucuugggcau

SEQ ID NO: 1382513 - RNA, 16 nt, Homo sapiens
uagcugggacuacagg

SEQ ID NO: 1382514 - RNA, 16 nt, Homo sapiens
uagcuugaaacauaga

SEQ ID NO: 1382515 - RNA, 16 nt, Homo sapiens
uagcuugcaccuuguc

SEQ ID NO: 1382516 - RNA, 13 nt, Homo sapiens
uagcuuuacaaau

SEQ ID NO: 1382517 - RNA, 16 nt, Homo sapiens
uagcuuuagggcaaua

SEQ ID NO: 1382518 - RNA, 19 nt, Homo sapiens
uaggaaagaagagaaccau

SEQ ID NO: 1382519 - RNA, 12 nt, Homo sapiens
uaggaacauacu

SEQ ID NO: 1382520 - RNA, 16 nt, Homo sapiens
uaggaagagaaaccag

SEQ ID NO: 1382521 - RNA, 19 nt, Homo sapiens
uaggaagguuaauguucau

SEQ ID NO: 1382522 - RNA, 13 nt, Homo sapiens
uaggcagcacuag

SEQ ID NO: 1382523 - RNA, 21 nt, Homo sapiens
uaggcauuugcugaauacaga

SEQ ID NO: 1382524 - RNA, 18 nt, Homo sapiens
uaggcuccgucaguauca

SEQ ID NO: 1382525 - RNA, 19 nt, Homo sapiens
uagggcaauauugccaugg

SEQ ID NO: 1382526 - RNA, 18 nt, Homo sapiens
uagggcuuauccaugccu

SEQ ID NO: 1382527 - RNA, 16 nt, Homo sapiens
uaggguggcccuugca

SEQ ID NO: 1382528 - RNA, 16 nt, Homo sapiens
uagguacgucaaagca

SEQ ID NO: 1382529 - RNA, 20 nt, Homo sapiens
uaggugcuaauuaauaaaga

SEQ ID NO: 1382530 - RNA, 20 nt, Homo sapiens
uagguuuacauucaucucau

SEQ ID NO: 1382531 - RNA, 23 nt, Homo sapiens
uaguaaaagccaucuauguauau

SEQ ID NO: 1382532 - RNA, 13 nt, Homo sapiens
uaguaacaagaaa

SEQ ID NO: 1382533 - RNA, 15 nt, Homo sapiens
uaguaacaguuguga

SEQ ID NO: 1382534 - RNA, 12 nt, Homo sapiens
uaguaacauuca

SEQ ID NO: 1382535 - RNA, 13 nt, Homo sapiens
uaguauuuaugaa

SEQ ID NO: 1382536 - RNA, 13 nt, Homo sapiens
uagucaaaccacu

SEQ ID NO: 1382537 - RNA, 17 nt, Homo sapiens
uagucaaaccacuguua

SEQ ID NO: 1382538 - RNA, 18 nt, Homo sapiens
uagucccagcuacucaga

SEQ ID NO: 1382539 - RNA, 20 nt, Homo sapiens
uagucccagcuacuugagag

SEQ ID NO: 1382540 - RNA, 20 nt, Homo sapiens
uagucuaaccaaaugcauca

SEQ ID NO: 1382541 - RNA, 15 nt, Homo sapiens
uagucugcuuuggua

SEQ ID NO: 1382542 - RNA, 21 nt, Homo sapiens
uagugcaugaauagauucucu

SEQ ID NO: 1382543 - RNA, 21 nt, Homo sapiens
uaguggugacugugggcucca

SEQ ID NO: 1382544 - RNA, 14 nt, Homo sapiens
uaguuaaaguaaug

SEQ ID NO: 1382545 - RNA, 22 nt, Homo sapiens
uaguucccugaaaacccagaga

SEQ ID NO: 1382546 - RNA, 20 nt, Homo sapiens
uaguucuguggccaucugcu

SEQ ID NO: 1382547 - RNA, 22 nt, Homo sapiens
uaguuugauacucccagucuug

SEQ ID NO: 1382548 - RNA, 19 nt, Homo sapiens
uaguuugcaguuacacuaa

SEQ ID NO: 1382549 - RNA, 20 nt, Homo sapiens
uaguuuugucaaacuguaga

SEQ ID NO: 1382550 - RNA, 12 nt, Homo sapiens
uauaaacauauc

SEQ ID NO: 1382551 - RNA, 16 nt, Homo sapiens
uauaaagaccuauaaa

SEQ ID NO: 1382552 - RNA, 15 nt, Homo sapiens
uauaaagauggcuga

SEQ ID NO: 1382553 - RNA, 19 nt, Homo sapiens
uauaaauuuguguucucaa

SEQ ID NO: 1382554 - RNA, 18 nt, Homo sapiens
uauaagcauguauauucu

SEQ ID NO: 1382555 - RNA, 16 nt, Homo sapiens
uauaaugcaaaccaua

SEQ ID NO: 1382556 - RNA, 19 nt, Homo sapiens
uauacucacuuucccaaau

SEQ ID NO: 1382557 - RNA, 18 nt, Homo sapiens
uauacuguggcuaugcaa

SEQ ID NO: 1382558 - RNA, 14 nt, Homo sapiens
uauacuguuuacug

SEQ ID NO: 1382559 - RNA, 22 nt, Homo sapiens
uauacuuuuuucuuauuuaacu

SEQ ID NO: 1382560 - RNA, 15 nt, Homo sapiens
uauagugacaaugaa

SEQ ID NO: 1382561 - RNA, 23 nt, Homo sapiens
uauauaaacgguuaacaauauua

SEQ ID NO: 1382562 - RNA, 21 nt, Homo sapiens
uauauaacuaacaaccaaaga

SEQ ID NO: 1382563 - RNA, 14 nt, Homo sapiens
uauaucaguaucug

SEQ ID NO: 1382564 - RNA, 16 nt, Homo sapiens
uauaugagacuuucaa

SEQ ID NO: 1382565 - RNA, 18 nt, Homo sapiens
uauauguguuuuucacau

SEQ ID NO: 1382566 - RNA, 14 nt, Homo sapiens
uauauucucuuugg

SEQ ID NO: 1382567 - RNA, 14 nt, Homo sapiens
uaucaacccagaaa

SEQ ID NO: 1382568 - RNA, 21 nt, Homo sapiens
uaucaagccaguacgugcuaa

SEQ ID NO: 1382569 - RNA, 16 nt, Homo sapiens
uaucaaguguauuuga

SEQ ID NO: 1382570 - RNA, 20 nt, Homo sapiens
uaucaauguuuguccuguau

SEQ ID NO: 1382571 - RNA, 13 nt, Homo sapiens
uaucacacuguau

SEQ ID NO: 1382572 - RNA, 19 nt, Homo sapiens
uauccaagaaucagugaag

SEQ ID NO: 1382573 - RNA, 14 nt, Homo sapiens
uauccaaguuggac

SEQ ID NO: 1382574 - RNA, 22 nt, Homo sapiens
uauccacccagcccauucucuc

SEQ ID NO: 1382575 - RNA, 13 nt, Homo sapiens
uaucccacggaaa

SEQ ID NO: 1382576 - RNA, 19 nt, Homo sapiens
uaucccacggaaaaugcca

SEQ ID NO: 1382577 - RNA, 15 nt, Homo sapiens
uaucccagugaucac

SEQ ID NO: 1382578 - RNA, 13 nt, Homo sapiens
uaucccaucccau

SEQ ID NO: 1382579 - RNA, 15 nt, Homo sapiens
uauccgaacuuuaau

SEQ ID NO: 1382580 - RNA, 22 nt, Homo sapiens
uaucggagacagugaucuccau

SEQ ID NO: 1382581 - RNA, 17 nt, Homo sapiens
uaucucucagugaacug

SEQ ID NO: 1382582 - RNA, 20 nt, Homo sapiens
uaucucucagugaacuguga

SEQ ID NO: 1382583 - RNA, 23 nt, Homo sapiens
uaucugauuuccuaaugucagag

SEQ ID NO: 1382584 - RNA, 22 nt, Homo sapiens
uaucugugaaaugcuggcauuu

SEQ ID NO: 1382585 - RNA, 14 nt, Homo sapiens
uaucuucauacaau

SEQ ID NO: 1382586 - RNA, 20 nt, Homo sapiens
uaucuucauacaaugacaag

SEQ ID NO: 1382587 - RNA, 22 nt, Homo sapiens
uaucuugaaacauagagaucua

SEQ ID NO: 1382588 - RNA, 22 nt, Homo sapiens
uaucuugcuuuuuuucaccaau

SEQ ID NO: 1382589 - RNA, 16 nt, Homo sapiens
uaugacaucacuugua

SEQ ID NO: 1382590 - RNA, 17 nt, Homo sapiens
uaugagaaaguucucau

SEQ ID NO: 1382591 - RNA, 12 nt, Homo sapiens
uaugagggaaaa

SEQ ID NO: 1382592 - RNA, 13 nt, Homo sapiens
uaugaggugggau

SEQ ID NO: 1382593 - RNA, 20 nt, Homo sapiens
uaugaugauuugcuaucaaa

SEQ ID NO: 1382594 - RNA, 22 nt, Homo sapiens
uaugcaauaaauaacagugcaa

SEQ ID NO: 1382595 - RNA, 13 nt, Homo sapiens
uaugcaaucugag

SEQ ID NO: 1382596 - RNA, 15 nt, Homo sapiens
uaugcaucugcuacu

SEQ ID NO: 1382597 - RNA, 16 nt, Homo sapiens
uaugcuaccuacugau

SEQ ID NO: 1382598 - RNA, 18 nt, Homo sapiens
uaugcucagggucaauuu

SEQ ID NO: 1382599 - RNA, 16 nt, Homo sapiens
uaugcucauaacugug

SEQ ID NO: 1382600 - RNA, 19 nt, Homo sapiens
uaugcuguaaccaaauuau

SEQ ID NO: 1382601 - RNA, 22 nt, Homo sapiens
uaugcuuucuauuuugagauca

SEQ ID NO: 1382602 - RNA, 15 nt, Homo sapiens
uaugggggcacugag

SEQ ID NO: 1382603 - RNA, 22 nt, Homo sapiens
uauggugccgaauugucuuugg

SEQ ID NO: 1382604 - RNA, 18 nt, Homo sapiens
uauguaauugaaaaccaa

SEQ ID NO: 1382605 - RNA, 22 nt, Homo sapiens
uauguacaauauuuuaagcauu

SEQ ID NO: 1382606 - RNA, 17 nt, Homo sapiens
gcuuccgccgucucaac

SEQ ID NO: 1382607 - RNA, 15 nt, Homo sapiens
gcuucuccaugagac

SEQ ID NO: 1382608 - RNA, 16 nt, Homo sapiens
gcuucucucucuaaaa

SEQ ID NO: 1382609 - RNA, 11 nt, Homo sapiens
gcuucugccau

SEQ ID NO: 1382610 - RNA, 21 nt, Homo sapiens
gcuucuuaauauaacugccuu

SEQ ID NO: 1382611 - RNA, 19 nt, Homo sapiens
gcuucuuugaaacuuguau

SEQ ID NO: 1382612 - RNA, 13 nt, Homo sapiens
gcuucuuuucacu

SEQ ID NO: 1382613 - RNA, 23 nt, Homo sapiens
gcuucuuuucacuucagagcaca

SEQ ID NO: 1382614 - RNA, 20 nt, Homo sapiens
gcuugacauaauuucacuga

SEQ ID NO: 1382615 - RNA, 22 nt, Homo sapiens
gcuugcaacuuagcucacaccu

SEQ ID NO: 1382616 - RNA, 10 nt, Homo sapiens
gcuugcucuu

SEQ ID NO: 1382617 - RNA, 11 nt, Homo sapiens
gcuugcugagu

SEQ ID NO: 1382618 - RNA, 23 nt, Homo sapiens
gcuuggaaacuggaugaggucau

SEQ ID NO: 1382619 - RNA, 23 nt, Homo sapiens
gcuuggcugugcccucagauucc

SEQ ID NO: 1382620 - RNA, 22 nt, Homo sapiens
gcuuguccccuccucacucccu

SEQ ID NO: 1382621 - RNA, 20 nt, Homo sapiens
gcuuuauuuuuuaaguauuu

SEQ ID NO: 1382622 - RNA, 15 nt, Homo sapiens
gcuuugaaaauucag

SEQ ID NO: 1382623 - RNA, 16 nt, Homo sapiens
gcuuugaauacuaaau

SEQ ID NO: 1382624 - RNA, 14 nt, Homo sapiens
gcuuuguugcccag

SEQ ID NO: 1382625 - RNA, 18 nt, Homo sapiens
gcuuuugaaaaacaaaca

SEQ ID NO: 1382626 - RNA, 14 nt, Homo sapiens
gcuuuuuuacacaa

SEQ ID NO: 1382627 - RNA, 19 nt, Homo sapiens
ggaaaaaccaauagcuuua

SEQ ID NO: 1382628 - RNA, 13 nt, Homo sapiens
ggaaaacaguauu

SEQ ID NO: 1382629 - RNA, 12 nt, Homo sapiens
ggaaacaaagug

SEQ ID NO: 1382630 - RNA, 20 nt, Homo sapiens
ggaaacauauuuaagaaaua

SEQ ID NO: 1382631 - RNA, 20 nt, Homo sapiens
ggaaacuagcuuacaugaga

SEQ ID NO: 1382632 - RNA, 17 nt, Homo sapiens
ggaaacuggaugagguc

SEQ ID NO: 1382633 - RNA, 17 nt, Homo sapiens
ggaaagaaaaagcaaua

SEQ ID NO: 1382634 - RNA, 18 nt, Homo sapiens
ggaaagacagcuucucau

SEQ ID NO: 1382635 - RNA, 17 nt, Homo sapiens
ggaaaguaaauauuuca

SEQ ID NO: 1382636 - RNA, 21 nt, Homo sapiens
ggaaauauuaagaaagacuau

SEQ ID NO: 1382637 - RNA, 19 nt, Homo sapiens
ggaaauggcuugaagccaa

SEQ ID NO: 1382638 - RNA, 16 nt, Homo sapiens
ggaacaagccuaaaaa

SEQ ID NO: 1382639 - RNA, 13 nt, Homo sapiens
ggaacacaaugac

SEQ ID NO: 1382640 - RNA, 22 nt, Homo sapiens
ggaacacccgacuccucaaaag

SEQ ID NO: 1382641 - RNA, 18 nt, Homo sapiens
ggaacagacaacagaagu

SEQ ID NO: 1382642 - RNA, 15 nt, Homo sapiens
ggaacaugaagccag

SEQ ID NO: 1382643 - RNA, 17 nt, Homo sapiens
ggaaccacgucugcuaa

SEQ ID NO: 1382644 - RNA, 22 nt, Homo sapiens
ggaaccacgucugcuaacuugg

SEQ ID NO: 1382645 - RNA, 14 nt, Homo sapiens
ucgaagcuccguga

SEQ ID NO: 1382646 - RNA, 22 nt, Homo sapiens
ucgaauccagagagcagugugg

SEQ ID NO: 1382647 - RNA, 17 nt, Homo sapiens
ucgagguagguggauca

SEQ ID NO: 1382648 - RNA, 13 nt, Homo sapiens
ucgagguggauca

SEQ ID NO: 1382649 - RNA, 19 nt, Homo sapiens
ucgauuauucccuguacaa

SEQ ID NO: 1382650 - RNA, 17 nt, Homo sapiens
ucgcaucucagugcagg

SEQ ID NO: 1382651 - RNA, 19 nt, Homo sapiens
ucgcaucucagugcaggag

SEQ ID NO: 1382652 - RNA, 16 nt, Homo sapiens
ucgccaccccuccuuc

SEQ ID NO: 1382653 - RNA, 18 nt, Homo sapiens
ucgcccaggagacauccg

SEQ ID NO: 1382654 - RNA, 22 nt, Homo sapiens
ucgcuccugugucuugcaaugg

SEQ ID NO: 1382655 - RNA, 15 nt, Homo sapiens
ucgcugucaucucag

SEQ ID NO: 1382656 - RNA, 16 nt, Homo sapiens
ucgcuuuguugcccag

SEQ ID NO: 1382657 - RNA, 14 nt, Homo sapiens
ucggccucccaaag

SEQ ID NO: 1382658 - RNA, 15 nt, Homo sapiens
ucggggaacuccugg

SEQ ID NO: 1382659 - RNA, 15 nt, Homo sapiens
ucgggucccagaugu

SEQ ID NO: 1382660 - RNA, 13 nt, Homo sapiens
ucguagccaucuc

SEQ ID NO: 1382661 - RNA, 15 nt, Homo sapiens
ucgugacaacacuug

SEQ ID NO: 1382662 - RNA, 15 nt, Homo sapiens
ucgugcuaaacgcac

SEQ ID NO: 1382663 - RNA, 20 nt, Homo sapiens
ucguggguguguguagccaa

SEQ ID NO: 1382664 - RNA, 18 nt, Homo sapiens
ucguuuuuuucauuccau

SEQ ID NO: 1382665 - RNA, 17 nt, Homo sapiens
ucuaaaacugccuucca

SEQ ID NO: 1382666 - RNA, 14 nt, Homo sapiens
ucuaaaauagccac

SEQ ID NO: 1382667 - RNA, 17 nt, Homo sapiens
ucuaaaaugaguuaccu

SEQ ID NO: 1382668 - RNA, 12 nt, Homo sapiens
ucuaaacuuuaa

SEQ ID NO: 1382669 - RNA, 19 nt, Homo sapiens
ucuaaaugaagugcaaauu

SEQ ID NO: 1382670 - RNA, 23 nt, Homo sapiens
ucuaacaauggaagauuugccca

SEQ ID NO: 1382671 - RNA, 23 nt, Homo sapiens
ucuaacaccaacauaagguacua

SEQ ID NO: 1382672 - RNA, 19 nt, Homo sapiens
ucuaacuagaaaucugcca

SEQ ID NO: 1382673 - RNA, 12 nt, Homo sapiens
ucuaacucuccc

SEQ ID NO: 1382674 - RNA, 19 nt, Homo sapiens
ucuaagaaguuuuguucug

SEQ ID NO: 1382675 - RNA, 20 nt, Homo sapiens
ucuaagguaguaacuuucca

SEQ ID NO: 1382676 - RNA, 14 nt, Homo sapiens
ucuaaguguuucau

SEQ ID NO: 1382677 - RNA, 20 nt, Homo sapiens
ucuaaugcucacgcucccaa

SEQ ID NO: 1382678 - RNA, 12 nt, Homo sapiens
ucuacacuguau

SEQ ID NO: 1382679 - RNA, 17 nt, Homo sapiens
ucuacauccaauguaug

SEQ ID NO: 1382680 - RNA, 11 nt, Homo sapiens
ucuaccaagcu

SEQ ID NO: 1382681 - RNA, 22 nt, Homo sapiens
ucuacgcucuccuuucuuucua

SEQ ID NO: 1382682 - RNA, 18 nt, Homo sapiens
ucuacguaucugcuacuu

SEQ ID NO: 1382683 - RNA, 16 nt, Homo sapiens
ucuacuaccacaagga

SEQ ID NO: 1382684 - RNA, 17 nt, Homo sapiens
ucuacuccuaccucagc

SEQ ID NO: 1382685 - RNA, 13 nt, Homo sapiens
ucuagaaaagcau

SEQ ID NO: 1382686 - RNA, 22 nt, Homo sapiens
ucuagaacacaggcaaaauccu

SEQ ID NO: 1382687 - RNA, 16 nt, Homo sapiens
ucuagacuugugcuga

SEQ ID NO: 1382688 - RNA, 15 nt, Homo sapiens
ucuagaggcaaggag

SEQ ID NO: 1382689 - RNA, 22 nt, Homo sapiens
ucuagguaggggcccacuucac

SEQ ID NO: 1382690 - RNA, 14 nt, Homo sapiens
ucuaggugcccuug

SEQ ID NO: 1382691 - RNA, 16 nt, Homo sapiens
ucuagguucugagcuc

SEQ ID NO: 1382692 - RNA, 19 nt, Homo sapiens
ucuagucaggggaaaagac

SEQ ID NO: 1382693 - RNA, 17 nt, Homo sapiens
ucuauauggaauugcuu

SEQ ID NO: 1382694 - RNA, 17 nt, Homo sapiens
ucuaugaaauaucaugc

SEQ ID NO: 1382695 - RNA, 21 nt, Homo sapiens
ucuaugccagcucagucccau

SEQ ID NO: 1382696 - RNA, 18 nt, Homo sapiens
ucuauuaaaucuugcaac

SEQ ID NO: 1382697 - RNA, 13 nt, Homo sapiens
ucuauucuaagua

SEQ ID NO: 1382698 - RNA, 21 nt, Homo sapiens
ucuauugagugaacagaauug

SEQ ID NO: 1382699 - RNA, 16 nt, Homo sapiens
ucucaaaugcacaucu

SEQ ID NO: 1382700 - RNA, 19 nt, Homo sapiens
ucucaaaugcacaucucau

SEQ ID NO: 1382701 - RNA, 18 nt, Homo sapiens
ucucaaguuaucagggua

SEQ ID NO: 1382702 - RNA, 14 nt, Homo sapiens
ucucaauaguaaaa

SEQ ID NO: 1382703 - RNA, 21 nt, Homo sapiens
ucucagcuggaucuccauucu

SEQ ID NO: 1382704 - RNA, 22 nt, Homo sapiens
ucucauccaucaaguugcacac

SEQ ID NO: 1382705 - RNA, 20 nt, Homo sapiens
uuggauaucaaaagcaaaua

SEQ ID NO: 1382706 - RNA, 23 nt, Homo sapiens
uuggccagaagggggccaugagg

SEQ ID NO: 1382707 - RNA, 15 nt, Homo sapiens
uuggccagugugaca

SEQ ID NO: 1382708 - RNA, 21 nt, Homo sapiens
uuggcgggggcuuggcugugc

SEQ ID NO: 1382709 - RNA, 14 nt, Homo sapiens
uuggcucaauccuc

SEQ ID NO: 1382710 - RNA, 13 nt, Homo sapiens
uuggcuucagggg

SEQ ID NO: 1382711 - RNA, 14 nt, Homo sapiens
uugggaggccaagg

SEQ ID NO: 1382712 - RNA, 21 nt, Homo sapiens
uugggcaccucgacuugugaa

SEQ ID NO: 1382713 - RNA, 16 nt, Homo sapiens
uugggcugcuccucau

SEQ ID NO: 1382714 - RNA, 20 nt, Homo sapiens
uuggggaugagaaagguuga

SEQ ID NO: 1382715 - RNA, 13 nt, Homo sapiens
uuggggcuuuuac

SEQ ID NO: 1382716 - RNA, 20 nt, Homo sapiens
uugggggauggcuaaaacca

SEQ ID NO: 1382717 - RNA, 21 nt, Homo sapiens
uugguacuacuagaugucuuu

SEQ ID NO: 1382718 - RNA, 11 nt, Homo sapiens
uuggugccuuu

SEQ ID NO: 1382719 - RNA, 18 nt, Homo sapiens
uuguaaacauuaguucua

SEQ ID NO: 1382720 - RNA, 19 nt, Homo sapiens
uuguaaacguuucaguaau

SEQ ID NO: 1382721 - RNA, 17 nt, Homo sapiens
uuguaaauagcucaggu

SEQ ID NO: 1382722 - RNA, 12 nt, Homo sapiens
uuguaacaagaa

SEQ ID NO: 1382723 - RNA, 20 nt, Homo sapiens
uuguaacgaagacacagacu

SEQ ID NO: 1382724 - RNA, 20 nt, Homo sapiens
uuguaagaguggaaccaaca

SEQ ID NO: 1382725 - RNA, 14 nt, Homo sapiens
uuguaauccuguac

SEQ ID NO: 1382726 - RNA, 16 nt, Homo sapiens
uuguaaugucaccacc

SEQ ID NO: 1382727 - RNA, 15 nt, Homo sapiens
uuguaauuccuuacu

SEQ ID NO: 1382728 - RNA, 21 nt, Homo sapiens
uuguagagauggggucucaca

SEQ ID NO: 1382729 - RNA, 14 nt, Homo sapiens
uuguaggguuucua

SEQ ID NO: 1382730 - RNA, 23 nt, Homo sapiens
uuguauauauauuuuguguauaa

SEQ ID NO: 1382731 - RNA, 22 nt, Homo sapiens
uuguauccucugaccuacauac

SEQ ID NO: 1382732 - RNA, 15 nt, Homo sapiens
uuguaugagguuuga

SEQ ID NO: 1382733 - RNA, 13 nt, Homo sapiens
uugucaacaaagu

SEQ ID NO: 1382734 - RNA, 20 nt, Homo sapiens
uugucacaaauaaacauaau

SEQ ID NO: 1382735 - RNA, 16 nt, Homo sapiens
uugucacugacacaca

SEQ ID NO: 1382736 - RNA, 15 nt, Homo sapiens
uugucagcaguuccc

SEQ ID NO: 1382737 - RNA, 14 nt, Homo sapiens
uuguccguuuacuu

SEQ ID NO: 1382738 - RNA, 17 nt, Homo sapiens
uugugagaaacaucuca

SEQ ID NO: 1382739 - RNA, 17 nt, Homo sapiens
uugugagggacugagau

SEQ ID NO: 1382740 - RNA, 14 nt, Homo sapiens
uugugguuaaucug

SEQ ID NO: 1382741 - RNA, 14 nt, Homo sapiens
uuguguaacauauu

SEQ ID NO: 1382742 - RNA, 13 nt, Homo sapiens
uuguguacuguaa

SEQ ID NO: 1382743 - RNA, 15 nt, Homo sapiens
uugugugaguguacc

SEQ ID NO: 1382744 - RNA, 22 nt, Homo sapiens
uugugugcucauguaugugcga

SEQ ID NO: 1382745 - RNA, 16 nt, Homo sapiens
uugugugguggcaccu

SEQ ID NO: 1382746 - RNA, 17 nt, Homo sapiens
uugugugugggcuguga

SEQ ID NO: 1382747 - RNA, 16 nt, Homo sapiens
uugugugugugcaagu

SEQ ID NO: 1382748 - RNA, 16 nt, Homo sapiens
uuguucagucuuucau

SEQ ID NO: 1382749 - RNA, 16 nt, Homo sapiens
uuguuccccacugaca

SEQ ID NO: 1382750 - RNA, 16 nt, Homo sapiens
uuguuggauaaaucag

SEQ ID NO: 1382751 - RNA, 20 nt, Homo sapiens
uuguuguggucugagccaaa

SEQ ID NO: 1382752 - RNA, 19 nt, Homo sapiens
uuguuucaaccaagucaug

SEQ ID NO: 1382753 - RNA, 14 nt, Homo sapiens
uuguuuccaaaaac

SEQ ID NO: 1382754 - RNA, 13 nt, Homo sapiens
uuguuucuuccaa

SEQ ID NO: 1382755 - RNA, 22 nt, Homo sapiens
uuguuugaaaaagcagacagaa

SEQ ID NO: 1382756 - RNA, 22 nt, Homo sapiens
uuuaaacacggggcuugcaacu

SEQ ID NO: 1382757 - RNA, 14 nt, Homo sapiens
uuuaaacaguuuag

SEQ ID NO: 1382758 - RNA, 15 nt, Homo sapiens
uuuaacaacuaugau

SEQ ID NO: 1382759 - RNA, 15 nt, Homo sapiens
uuuaacacacauaaa

SEQ ID NO: 1382760 - RNA, 22 nt, Homo sapiens
uuuaaccagucugaaguuucau

SEQ ID NO: 1382761 - RNA, 21 nt, Homo sapiens
uuuaacuagaauuuauucaau

SEQ ID NO: 1382762 - RNA, 18 nt, Homo sapiens
uuuaacuggcuucagccu

SEQ ID NO: 1382763 - RNA, 19 nt, Homo sapiens
uuuaauacaggguagauaa

SEQ ID NO: 1382764 - RNA, 17 nt, Homo sapiens
uuuaaucguacauuuuc

SEQ ID NO: 1382765 - RNA, 15 nt, Homo sapiens
uuuaaucuuccaugg

SEQ ID NO: 1382766 - RNA, 14 nt, Homo sapiens
uuuaauggggugca

SEQ ID NO: 1382767 - RNA, 14 nt, Homo sapiens
uuuaauuuaaucuu

SEQ ID NO: 1382768 - RNA, 17 nt, Homo sapiens
uuuacaaaguauuugcu

SEQ ID NO: 1382769 - RNA, 21 nt, Homo sapiens
uuuacaacucaaaaaacauug

SEQ ID NO: 1382770 - RNA, 21 nt, Homo sapiens
uuuacauacugcugucuaugu

SEQ ID NO: 1382771 - RNA, 15 nt, Homo sapiens
uuuacauguggccca

SEQ ID NO: 1382772 - RNA, 10 nt, Homo sapiens
uuuacauuca

SEQ ID NO: 1382773 - RNA, 14 nt, Homo sapiens
uuuacauucugcaa

SEQ ID NO: 1382774 - RNA, 22 nt, Homo sapiens
uuuugcauuugaauaaagccug

SEQ ID NO: 1382775 - RNA, 19 nt, Homo sapiens
uuuugcuggucacugccau

SEQ ID NO: 1382776 - RNA, 20 nt, Homo sapiens
uuuuuaaguauuucagaugc

SEQ ID NO: 1382777 - RNA, 18 nt, Homo sapiens
uuuuuaauauaaagccug

SEQ ID NO: 1382778 - RNA, 20 nt, Homo sapiens
uuuuuccaauuuuguugcau

SEQ ID NO: 1382779 - RNA, 18 nt, Homo sapiens
uuuuucccuaucacugaa

SEQ ID NO: 1382780 - RNA, 15 nt, Homo sapiens
uuuuuccuaacagga

SEQ ID NO: 1382781 - RNA, 11 nt, Homo sapiens
uuuuugccaug

SEQ ID NO: 1382782 - RNA, 13 nt, Homo sapiens
uguugauagcaag

SEQ ID NO: 1382783 - RNA, 11 nt, Homo sapiens
uguugauccca

SEQ ID NO: 1382784 - RNA, 12 nt, Homo sapiens
uguugaucccaa

SEQ ID NO: 1382785 - RNA, 23 nt, Homo sapiens
uguugaugaggcagaugccucua

SEQ ID NO: 1382786 - RNA, 13 nt, Homo sapiens
uguugccagagau

SEQ ID NO: 1382787 - RNA, 18 nt, Homo sapiens
uguugcuaagcuguaacc

SEQ ID NO: 1382788 - RNA, 13 nt, Homo sapiens
uguugcugcaucu

SEQ ID NO: 1382789 - RNA, 16 nt, Homo sapiens
uguuggcuagccucug

SEQ ID NO: 1382790 - RNA, 21 nt, Homo sapiens
uguuuaacauaaauuguacug

SEQ ID NO: 1382791 - RNA, 16 nt, Homo sapiens
uguuuacccaguauuc

SEQ ID NO: 1382792 - RNA, 21 nt, Homo sapiens
uguuuacuucucaccauuuga

SEQ ID NO: 1382793 - RNA, 15 nt, Homo sapiens
uguuuauagugcucu

SEQ ID NO: 1382794 - RNA, 14 nt, Homo sapiens
uguuuaugagccag

SEQ ID NO: 1382795 - RNA, 16 nt, Homo sapiens
uguuuauuugcacuau

SEQ ID NO: 1382796 - RNA, 18 nt, Homo sapiens
uguuucaaaaaaucugac

SEQ ID NO: 1382797 - RNA, 14 nt, Homo sapiens
uguuucuauucuaa

SEQ ID NO: 1382798 - RNA, 12 nt, Homo sapiens
uguuucuuccaa

SEQ ID NO: 1382799 - RNA, 13 nt, Homo sapiens
uguuucuuccaaa

SEQ ID NO: 1382800 - RNA, 23 nt, Homo sapiens
uguuugucauagggcaguuggaa

SEQ ID NO: 1382801 - RNA, 13 nt, Homo sapiens
uguuuuaaguuua

SEQ ID NO: 1382802 - RNA, 13 nt, Homo sapiens
uguuuuaucauua

SEQ ID NO: 1382803 - RNA, 20 nt, Homo sapiens
uguuuuaucauuaccauuaa

SEQ ID NO: 1382804 - RNA, 15 nt, Homo sapiens
uguuuugcuaaagga

SEQ ID NO: 1382805 - RNA, 18 nt, Homo sapiens
uguuuuguguaacauauu

SEQ ID NO: 1382806 - RNA, 22 nt, Homo sapiens
uuaaaaaauggacucuugaaau

SEQ ID NO: 1382807 - RNA, 19 nt, Homo sapiens
uuaaaaagauguauguucc

SEQ ID NO: 1382808 - RNA, 20 nt, Homo sapiens
uuaaaacaacacucacauuu

SEQ ID NO: 1382809 - RNA, 22 nt, Homo sapiens
uuaaaacccacaaaaguacaau

SEQ ID NO: 1382810 - RNA, 15 nt, Homo sapiens
uuaaaagccaucaaa

SEQ ID NO: 1382811 - RNA, 23 nt, Homo sapiens
uuaaaaggaaagcagauggugga

SEQ ID NO: 1382812 - RNA, 19 nt, Homo sapiens
uuaaacucugcucaggaua

SEQ ID NO: 1382813 - RNA, 14 nt, Homo sapiens
uuaaacugauucau

SEQ ID NO: 1382814 - RNA, 20 nt, Homo sapiens
uuaaagaaaaaaaaagucag

SEQ ID NO: 1382815 - RNA, 14 nt, Homo sapiens
uuaaagacguaaaa

SEQ ID NO: 1382816 - RNA, 19 nt, Homo sapiens
uuaaagcauuuacuuugaa

SEQ ID NO: 1382817 - RNA, 22 nt, Homo sapiens
uuaaaggcugugguaguacucc

SEQ ID NO: 1382818 - RNA, 16 nt, Homo sapiens
uuaaagguagucaaga

SEQ ID NO: 1382819 - RNA, 19 nt, Homo sapiens
uuaaaguaaugagcaugau

SEQ ID NO: 1382820 - RNA, 21 nt, Homo sapiens
uuaaagucagguccaauuugu

SEQ ID NO: 1382821 - RNA, 23 nt, Homo sapiens
uuaaauaaaucauaaaacuugau

SEQ ID NO: 1382822 - RNA, 14 nt, Homo sapiens
uuaaaugaacauca

SEQ ID NO: 1382823 - RNA, 14 nt, Homo sapiens
uuaaauggcuuuau

SEQ ID NO: 1382824 - RNA, 15 nt, Homo sapiens
uuaaauggcuuuaug

SEQ ID NO: 1382825 - RNA, 13 nt, Homo sapiens
uuaaauguauuau

SEQ ID NO: 1382826 - RNA, 11 nt, Homo sapiens
uuaaauugcag

SEQ ID NO: 1382827 - RNA, 17 nt, Homo sapiens
uuaacaauaacuacugu

SEQ ID NO: 1382828 - RNA, 15 nt, Homo sapiens
uuaacaguuuuccau

SEQ ID NO: 1382829 - RNA, 18 nt, Homo sapiens
uuaacauggacaugaucu

SEQ ID NO: 1382830 - RNA, 16 nt, Homo sapiens
uuaaccagaaauccag

SEQ ID NO: 1382831 - RNA, 19 nt, Homo sapiens
uuaacucaccucucaaggu

SEQ ID NO: 1382832 - RNA, 22 nt, Homo sapiens
uuaagaaugucgauuaaaauca

SEQ ID NO: 1382833 - RNA, 15 nt, Homo sapiens
uuaagaguuacuuaa

SEQ ID NO: 1382834 - RNA, 16 nt, Homo sapiens
uuaagcgugucuguau

SEQ ID NO: 1382835 - RNA, 19 nt, Homo sapiens
uuaagcugggauaaucaca

SEQ ID NO: 1382836 - RNA, 17 nt, Homo sapiens
uuaagcuuaugucagac

SEQ ID NO: 1382837 - RNA, 19 nt, Homo sapiens
uuaaggggagcaacagagg

SEQ ID NO: 1382838 - RNA, 12 nt, Homo sapiens
uuaagugccuuu

SEQ ID NO: 1382839 - RNA, 16 nt, Homo sapiens
uuaaguuuucaugaau

SEQ ID NO: 1382840 - RNA, 15 nt, Homo sapiens
uuaauaacauaacaa

SEQ ID NO: 1382841 - RNA, 14 nt, Homo sapiens
uuaauaguauuuau

SEQ ID NO: 1382842 - RNA, 21 nt, Homo sapiens
uuaauaguuuugauccuaaau

SEQ ID NO: 1382843 - RNA, 14 nt, Homo sapiens
uuaauauaacugcc

SEQ ID NO: 1382844 - RNA, 23 nt, Homo sapiens
uuaauauguuaaccucaguguca

SEQ ID NO: 1382845 - RNA, 20 nt, Homo sapiens
uuccacaccuagcaucucau

SEQ ID NO: 1382846 - RNA, 20 nt, Homo sapiens
uuccacacucaccucuaaaa

SEQ ID NO: 1382847 - RNA, 15 nt, Homo sapiens
uuccacugauggaaa

SEQ ID NO: 1382848 - RNA, 22 nt, Homo sapiens
uuccacugauggaaacaaagug

SEQ ID NO: 1382849 - RNA, 23 nt, Homo sapiens
uuccacuuagaaauugcauuucc

SEQ ID NO: 1382850 - RNA, 22 nt, Homo sapiens
uuccaguuuguuuauuacuuau

SEQ ID NO: 1382851 - RNA, 23 nt, Homo sapiens
uuccaugucgccucugcauucag

SEQ ID NO: 1382852 - RNA, 19 nt, Homo sapiens
uuccauuugugugugugca

SEQ ID NO: 1382853 - RNA, 22 nt, Homo sapiens
uuccauuugugugugugcaagu

SEQ ID NO: 1382854 - RNA, 14 nt, Homo sapiens
uucccaaaacugau

SEQ ID NO: 1382855 - RNA, 23 nt, Homo sapiens
uucccaauuaggaaguguaacag

SEQ ID NO: 1382856 - RNA, 19 nt, Homo sapiens
uucccacagcacuaauuca

SEQ ID NO: 1382857 - RNA, 21 nt, Homo sapiens
uucccaccaggcugcucaggg

SEQ ID NO: 1382858 - RNA, 14 nt, Homo sapiens
uucccauucuugca

SEQ ID NO: 1382859 - RNA, 14 nt, Homo sapiens
uuccccacuugaga

SEQ ID NO: 1382860 - RNA, 19 nt, Homo sapiens
uuccccgugggccauggca

SEQ ID NO: 1382861 - RNA, 21 nt, Homo sapiens
uuccccuugcccagggcucag

SEQ ID NO: 1382862 - RNA, 17 nt, Homo sapiens
uucccuacaguugaaaa

SEQ ID NO: 1382863 - RNA, 12 nt, Homo sapiens
uucccuaucacu

SEQ ID NO: 1382864 - RNA, 20 nt, Homo sapiens
uucccugaaaacccagagag

SEQ ID NO: 1382865 - RNA, 18 nt, Homo sapiens
uucccugaccucccucua

SEQ ID NO: 1382866 - RNA, 21 nt, Homo sapiens
uucccuggaccagaugcugaa

SEQ ID NO: 1382867 - RNA, 18 nt, Homo sapiens
uuccuaaguucuuagaua

SEQ ID NO: 1382868 - RNA, 16 nt, Homo sapiens
uuccuagaaacugaca

SEQ ID NO: 1382869 - RNA, 21 nt, Homo sapiens
uuccuagggaugugugagaau

SEQ ID NO: 1382870 - RNA, 15 nt, Homo sapiens
uuccuauguaacugc

SEQ ID NO: 1382871 - RNA, 17 nt, Homo sapiens
uuccucagauggacaag

SEQ ID NO: 1382872 - RNA, 17 nt, Homo sapiens
uuccucuuccacuuuga

SEQ ID NO: 1382873 - RNA, 18 nt, Homo sapiens
uuccucuuuccaucuacc

SEQ ID NO: 1382874 - RNA, 22 nt, Homo sapiens
uuccugauagagguauggaaag

SEQ ID NO: 1382875 - RNA, 18 nt, Homo sapiens
uuccugcauucacccaga

SEQ ID NO: 1382876 - RNA, 14 nt, Homo sapiens
uuccugccuggucu

SEQ ID NO: 1382877 - RNA, 20 nt, Homo sapiens
uuccuucagacagauuccag

SEQ ID NO: 1382878 - RNA, 14 nt, Homo sapiens
uuccuucuacuuac

SEQ ID NO: 1382879 - RNA, 16 nt, Homo sapiens
uuccuugauucacaau

SEQ ID NO: 1382880 - RNA, 16 nt, Homo sapiens
uuccuugggaugaucu

SEQ ID NO: 1382881 - RNA, 16 nt, Homo sapiens
uucggacaacucaguc

SEQ ID NO: 1382882 - RNA, 20 nt, Homo sapiens
uucuaaaaauaaaaguauug

SEQ ID NO: 1382883 - RNA, 20 nt, Homo sapiens
uucuaacauguuuugugcag

SEQ ID NO: 1382884 - RNA, 18 nt, Homo sapiens
uucuaaggaauaugagcu

SEQ ID NO: 1382885 - RNA, 13 nt, Homo sapiens
uucuaaucaaagc

SEQ ID NO: 1382886 - RNA, 14 nt, Homo sapiens
uucuacagcagaua

SEQ ID NO: 1382887 - RNA, 18 nt, Homo sapiens
uucuaccacccaccaguu

SEQ ID NO: 1382888 - RNA, 20 nt, Homo sapiens
uucuaccacccaccaguuga

SEQ ID NO: 1382889 - RNA, 15 nt, Homo sapiens
uucuaggcaucccag

SEQ ID NO: 1382890 - RNA, 14 nt, Homo sapiens
uucuaugaggcaac

SEQ ID NO: 1382891 - RNA, 15 nt, Homo sapiens
uucucaccacagagc

SEQ ID NO: 1382892 - RNA, 16 nt, Homo sapiens
aagaugggaacacugg

SEQ ID NO: 1382893 - RNA, 17 nt, Homo sapiens
aagauguauccuuccaa

SEQ ID NO: 1382894 - RNA, 18 nt, Homo sapiens
aagauguuucaaaaaauc

SEQ ID NO: 1382895 - RNA, 21 nt, Homo sapiens
aagauuucagauuugugacca

SEQ ID NO: 1382896 - RNA, 23 nt, Homo sapiens
aagauuugcccauuuacacuuuu

SEQ ID NO: 1382897 - RNA, 21 nt, Homo sapiens
aagauuuguacuacaguucuu

SEQ ID NO: 1382898 - RNA, 15 nt, Homo sapiens
aagcaaacacauuaa

SEQ ID NO: 1382899 - RNA, 22 nt, Homo sapiens
aagcaaauaauuuuucacuuca

SEQ ID NO: 1382900 - RNA, 23 nt, Homo sapiens
aagcaacagauggauagucuguc

SEQ ID NO: 1382901 - RNA, 15 nt, Homo sapiens
aagcaaggcuuuaaa

SEQ ID NO: 1382902 - RNA, 23 nt, Homo sapiens
aagcaccuagccucgcucuuggc

SEQ ID NO: 1382903 - RNA, 17 nt, Homo sapiens
aagcaccugccgaccuc

SEQ ID NO: 1382904 - RNA, 21 nt, Homo sapiens
aagcacuccucccugauguac

SEQ ID NO: 1382905 - RNA, 21 nt, Homo sapiens
aagcacucgugugcaacagac

SEQ ID NO: 1382906 - RNA, 21 nt, Homo sapiens
aagcagaaaauuguacaaccu

SEQ ID NO: 1382907 - RNA, 18 nt, Homo sapiens
aagcagccaagcuccuug

SEQ ID NO: 1382908 - RNA, 18 nt, Homo sapiens
aagcagugccuuccauaa

SEQ ID NO: 1382909 - RNA, 16 nt, Homo sapiens
aagcaucaccucaggc

SEQ ID NO: 1382910 - RNA, 16 nt, Homo sapiens
aagcaucacuugggau

SEQ ID NO: 1382911 - RNA, 19 nt, Homo sapiens
aagcaucugagcuaacuua

SEQ ID NO: 1382912 - RNA, 20 nt, Homo sapiens
aagcaucugagcuaacuuau

SEQ ID NO: 1382913 - RNA, 11 nt, Homo sapiens
aagcauuguuu

SEQ ID NO: 1382914 - RNA, 18 nt, Homo sapiens
aagccacauggcugggau

SEQ ID NO: 1382915 - RNA, 17 nt, Homo sapiens
aagccagaagcugagca

SEQ ID NO: 1382916 - RNA, 22 nt, Homo sapiens
aagccaucaaacacaaugccuc

SEQ ID NO: 1382917 - RNA, 15 nt, Homo sapiens
aagccauguaucuca

SEQ ID NO: 1382918 - RNA, 15 nt, Homo sapiens
aagccgugauuuuca

SEQ ID NO: 1382919 - RNA, 13 nt, Homo sapiens
aagccugaggcug

SEQ ID NO: 1382920 - RNA, 18 nt, Homo sapiens
aagcggagguugcaggga

SEQ ID NO: 1382921 - RNA, 12 nt, Homo sapiens
aagcgugaaggc

SEQ ID NO: 1382922 - RNA, 17 nt, Homo sapiens
aagcgugagccacugca

SEQ ID NO: 1382923 - RNA, 18 nt, Homo sapiens
aagcgugagccacugcac

SEQ ID NO: 1382924 - RNA, 20 nt, Homo sapiens
aagcuaaaauuagaugaacu

SEQ ID NO: 1382925 - RNA, 22 nt, Homo sapiens
aagcucaucucagcuccugaaa

SEQ ID NO: 1382926 - RNA, 17 nt, Homo sapiens
aagcuccagaagaacaa

SEQ ID NO: 1382927 - RNA, 13 nt, Homo sapiens
aagcuccucguga

SEQ ID NO: 1382928 - RNA, 15 nt, Homo sapiens
aagcuccucgugaua

SEQ ID NO: 1382929 - RNA, 19 nt, Homo sapiens
aagcuccugccucuuugug

SEQ ID NO: 1382930 - RNA, 14 nt, Homo sapiens
aagcucugaaguca

SEQ ID NO: 1382931 - RNA, 23 nt, Homo sapiens
aagcucugcuccucuccccagca

SEQ ID NO: 1382932 - RNA, 22 nt, Homo sapiens
aagcucuggugacaccagccuu

SEQ ID NO: 1382933 - RNA, 21 nt, Homo sapiens
aagcuguaagauaauguugcu

SEQ ID NO: 1382934 - RNA, 19 nt, Homo sapiens
aagcuguuuccauagggug

SEQ ID NO: 1382935 - RNA, 22 nt, Homo sapiens
aagcuuccauuccaagccugac

SEQ ID NO: 1382936 - RNA, 16 nt, Homo sapiens
aagcuuccauuccaca

SEQ ID NO: 1382937 - RNA, 21 nt, Homo sapiens
aaggaaacuagcuuacaugag

SEQ ID NO: 1382938 - RNA, 12 nt, Homo sapiens
aaggaaagugau

SEQ ID NO: 1382939 - RNA, 19 nt, Homo sapiens
aaggacagcuacacgcuga

SEQ ID NO: 1382940 - RNA, 17 nt, Homo sapiens
aaggagaacuauccaaa

SEQ ID NO: 1382941 - RNA, 18 nt, Homo sapiens
aaggagaacuauccaaaa

SEQ ID NO: 1382942 - RNA, 19 nt, Homo sapiens
aaggagaacuauccaaaac

SEQ ID NO: 1382943 - RNA, 15 nt, Homo sapiens
aaggagagucuugca

SEQ ID NO: 1382944 - RNA, 21 nt, Homo sapiens
aaggagauucaaacucaauga

SEQ ID NO: 1382945 - RNA, 15 nt, Homo sapiens
aaggagccuauggca

SEQ ID NO: 1382946 - RNA, 17 nt, Homo sapiens
aaggaguucagauguuu

SEQ ID NO: 1382947 - RNA, 23 nt, Homo sapiens
aaggauauguggagaaucaucaa

SEQ ID NO: 1382948 - RNA, 12 nt, Homo sapiens
aaggaugaauga

SEQ ID NO: 1382949 - RNA, 14 nt, Homo sapiens
aaggaugggaagga

SEQ ID NO: 1382950 - RNA, 13 nt, Homo sapiens
aaggcacagugaa

SEQ ID NO: 1382951 - RNA, 14 nt, Homo sapiens
aaggcacagugaag

SEQ ID NO: 1382952 - RNA, 14 nt, Homo sapiens
aaggcaguauuuca

SEQ ID NO: 1382953 - RNA, 17 nt, Homo sapiens
aaggccgagaagcaaga

SEQ ID NO: 1382954 - RNA, 12 nt, Homo sapiens
aaggcugaccaa

SEQ ID NO: 1382955 - RNA, 17 nt, Homo sapiens
aaggcugaccaagagag

SEQ ID NO: 1382956 - RNA, 22 nt, Homo sapiens
aaggcuucaauuuauugcacaa

SEQ ID NO: 1382957 - RNA, 22 nt, Homo sapiens
aagggaaaaagccuugacaaua

SEQ ID NO: 1382958 - RNA, 13 nt, Homo sapiens
aagggaaacuauu

SEQ ID NO: 1382959 - RNA, 18 nt, Homo sapiens
aagggaagaaaaggugaa

SEQ ID NO: 1382960 - RNA, 16 nt, Homo sapiens
aagggacauauucauu

SEQ ID NO: 1382961 - RNA, 17 nt, Homo sapiens
aagggauaguccaaaga

SEQ ID NO: 1382962 - RNA, 18 nt, Homo sapiens
aagggauaguccaaagac

SEQ ID NO: 1382963 - RNA, 18 nt, Homo sapiens
aagggauccguacauuca

SEQ ID NO: 1382964 - RNA, 16 nt, Homo sapiens
aagggaucuuccuugg

SEQ ID NO: 1382965 - RNA, 17 nt, Homo sapiens
aaggggacuggauccca

SEQ ID NO: 1382966 - RNA, 18 nt, Homo sapiens
aaggggcccaaauucuuu

SEQ ID NO: 1382967 - RNA, 17 nt, Homo sapiens
aaggggugccugggaac

SEQ ID NO: 1382968 - RNA, 17 nt, Homo sapiens
aagguaguaacuuucca

SEQ ID NO: 1382969 - RNA, 13 nt, Homo sapiens
aagguauguguca

SEQ ID NO: 1382970 - RNA, 17 nt, Homo sapiens
aagguaugugucagcca

SEQ ID NO: 1382971 - RNA, 22 nt, Homo sapiens
aaggucguuuuuuucauuccau

SEQ ID NO: 1382972 - RNA, 16 nt, Homo sapiens
aaggugaagagaccaa

SEQ ID NO: 1382973 - RNA, 19 nt, Homo sapiens
aagguggaacaagcacaga

SEQ ID NO: 1382974 - RNA, 14 nt, Homo sapiens
aagguggucacugu

SEQ ID NO: 1382975 - RNA, 20 nt, Homo sapiens
aaguaaaacuugcugccuga

SEQ ID NO: 1382976 - RNA, 16 nt, Homo sapiens
aaguaacuugucuuaa

SEQ ID NO: 1382977 - RNA, 12 nt, Homo sapiens
aaguaagccaug

SEQ ID NO: 1382978 - RNA, 22 nt, Homo sapiens
aaguaagccauguaucucagga

SEQ ID NO: 1382979 - RNA, 13 nt, Homo sapiens
aaguaaugaauuu

SEQ ID NO: 1382980 - RNA, 15 nt, Homo sapiens
aaguaccacucaggc

SEQ ID NO: 1382981 - RNA, 19 nt, Homo sapiens
aaguacuagcuuacuuuug

SEQ ID NO: 1382982 - RNA, 14 nt, Homo sapiens
aaguagaauccuaa

SEQ ID NO: 1382983 - RNA, 22 nt, Homo sapiens
aaguagacuucauuuuuccuaa

SEQ ID NO: 1382984 - RNA, 17 nt, Homo sapiens
aaguagguuuacauuca

SEQ ID NO: 1382985 - RNA, 13 nt, Homo sapiens
aaguaugagggaa

SEQ ID NO: 1382986 - RNA, 11 nt, Homo sapiens
aaguauuccac

SEQ ID NO: 1382987 - RNA, 18 nt, Homo sapiens
aaguauucugccuuugca

SEQ ID NO: 1382988 - RNA, 13 nt, Homo sapiens
aagucacugcaca

SEQ ID NO: 1382989 - RNA, 16 nt, Homo sapiens
aagucagcucuucucc

SEQ ID NO: 1382990 - RNA, 22 nt, Homo sapiens
aagucagugcccaacuguuaua

SEQ ID NO: 1382991 - RNA, 19 nt, Homo sapiens
aaguccuacaagcuaaaau

SEQ ID NO: 1382992 - RNA, 14 nt, Homo sapiens
aagucuaaaaccuu

SEQ ID NO: 1382993 - RNA, 18 nt, Homo sapiens
aagucucuauuuaaauuc

SEQ ID NO: 1382994 - RNA, 13 nt, Homo sapiens
aagucucuucucu

SEQ ID NO: 1382995 - RNA, 23 nt, Homo sapiens
aagucugauugguuuuaauugaa

SEQ ID NO: 1382996 - RNA, 19 nt, Homo sapiens
aagucugcauuacauuccu

SEQ ID NO: 1382997 - RNA, 16 nt, Homo sapiens
aagucuuagacuugaa

SEQ ID NO: 1382998 - RNA, 15 nt, Homo sapiens
aagucuucaagggcu

SEQ ID NO: 1382999 - RNA, 16 nt, Homo sapiens
aagucuucagggaagg

SEQ ID NO: 1383000 - RNA, 17 nt, Homo sapiens
aagugaaaaacauccag

SEQ ID NO: 1383001 - RNA, 17 nt, Homo sapiens
aagugaaaucugugcaa

SEQ ID NO: 1383002 - RNA, 18 nt, Homo sapiens
aagugaagagauccuucu

SEQ ID NO: 1383003 - RNA, 15 nt, Homo sapiens
aagugacuucacaga

SEQ ID NO: 1383004 - RNA, 15 nt, Homo sapiens
aagugagaacaaauu

SEQ ID NO: 1383005 - RNA, 14 nt, Homo sapiens
aaugaagaugaugc

SEQ ID NO: 1383006 - RNA, 13 nt, Homo sapiens
aaugaagugcaaa

SEQ ID NO: 1383007 - RNA, 13 nt, Homo sapiens
aaugaagugcaau

SEQ ID NO: 1383008 - RNA, 18 nt, Homo sapiens
aaugaauaacagccucau

SEQ ID NO: 1383009 - RNA, 15 nt, Homo sapiens
aaugacaacaaagua

SEQ ID NO: 1383010 - RNA, 15 nt, Homo sapiens
aaugacaaugaugau

SEQ ID NO: 1383011 - RNA, 14 nt, Homo sapiens
aaugaccaauauua

SEQ ID NO: 1383012 - RNA, 16 nt, Homo sapiens
aaugaccaauauuaua

SEQ ID NO: 1383013 - RNA, 20 nt, Homo sapiens
aaugagaucguuguuuacag

SEQ ID NO: 1383014 - RNA, 23 nt, Homo sapiens
aaugagcaaaaccaaauauucca

SEQ ID NO: 1383015 - RNA, 22 nt, Homo sapiens
aaugagugaaucaccuguggua

SEQ ID NO: 1383016 - RNA, 20 nt, Homo sapiens
aaugauccguuccauugcaa

SEQ ID NO: 1383017 - RNA, 17 nt, Homo sapiens
aaugaugcacauuucau

SEQ ID NO: 1383018 - RNA, 15 nt, Homo sapiens
aaugaugggacaaua

SEQ ID NO: 1383019 - RNA, 16 nt, Homo sapiens
aaugaugguaaguuaa

SEQ ID NO: 1383020 - RNA, 13 nt, Homo sapiens
aaugaugugauac

SEQ ID NO: 1383021 - RNA, 14 nt, Homo sapiens
aaugauguuuuccu

SEQ ID NO: 1383022 - RNA, 23 nt, Homo sapiens
aaugcaaaucaauaaauucccaa

SEQ ID NO: 1383023 - RNA, 16 nt, Homo sapiens
aaugcaacaacaugua

SEQ ID NO: 1383024 - RNA, 15 nt, Homo sapiens
aaugcaauagaauaa

SEQ ID NO: 1383025 - RNA, 22 nt, Homo sapiens
aaugcacugacauuguuggcca

SEQ ID NO: 1383026 - RNA, 14 nt, Homo sapiens
aaugcacuuccuua

SEQ ID NO: 1383027 - RNA, 20 nt, Homo sapiens
aaugccaaucuucaguauuu

SEQ ID NO: 1383028 - RNA, 14 nt, Homo sapiens
aaugccugugccaa

SEQ ID NO: 1383029 - RNA, 13 nt, Homo sapiens
aaugcggcccaac

SEQ ID NO: 1383030 - RNA, 17 nt, Homo sapiens
aaugcuauaacuauguu

SEQ ID NO: 1383031 - RNA, 19 nt, Homo sapiens
aauggaagauuugcccauu

SEQ ID NO: 1383032 - RNA, 16 nt, Homo sapiens
aauggacaaaauccau

SEQ ID NO: 1383033 - RNA, 19 nt, Homo sapiens
aauggacaaaauccaugaa

SEQ ID NO: 1383034 - RNA, 20 nt, Homo sapiens
aauggagggaauaauaccua

SEQ ID NO: 1383035 - RNA, 20 nt, Homo sapiens
aauggccuaaacuucagagg

SEQ ID NO: 1383036 - RNA, 15 nt, Homo sapiens
aaugggaaaaccaga

SEQ ID NO: 1383037 - RNA, 15 nt, Homo sapiens
aauggggugcaugaa

SEQ ID NO: 1383038 - RNA, 23 nt, Homo sapiens
aauggguuugcuagaaugugaua

SEQ ID NO: 1383039 - RNA, 20 nt, Homo sapiens
aauggguuuuguguacugua

SEQ ID NO: 1383040 - RNA, 21 nt, Homo sapiens
aaugguaaaauugcauggguu

SEQ ID NO: 1383041 - RNA, 22 nt, Homo sapiens
aauggugcaaauccuacugaau

SEQ ID NO: 1383042 - RNA, 20 nt, Homo sapiens
aauggugguuguuucuucca

SEQ ID NO: 1383043 - RNA, 22 nt, Homo sapiens
aauguaaagacaaaaaacuaua

SEQ ID NO: 1383044 - RNA, 21 nt, Homo sapiens
aauguacaacuuuuuaccuag

SEQ ID NO: 1383045 - RNA, 15 nt, Homo sapiens
aauguagaccuguga

SEQ ID NO: 1383046 - RNA, 19 nt, Homo sapiens
aauguagaccugugagaaa

SEQ ID NO: 1383047 - RNA, 15 nt, Homo sapiens
aauguauuugcuaua

SEQ ID NO: 1383048 - RNA, 14 nt, Homo sapiens
aaugucaccaccuu

SEQ ID NO: 1383049 - RNA, 22 nt, Homo sapiens
aaugucgauuaaaaucacucuc

SEQ ID NO: 1383050 - RNA, 16 nt, Homo sapiens
aaugucuguuaacuua

SEQ ID NO: 1383051 - RNA, 18 nt, Homo sapiens
aaugucuuguaagcaaaa

SEQ ID NO: 1383052 - RNA, 12 nt, Homo sapiens
aaugugaacuua

SEQ ID NO: 1383053 - RNA, 20 nt, Homo sapiens
aauguguuauuugucacaaa

SEQ ID NO: 1383054 - RNA, 15 nt, Homo sapiens
aauguuacauuauua

SEQ ID NO: 1383055 - RNA, 18 nt, Homo sapiens
aauguuacugaucaugca

SEQ ID NO: 1383056 - RNA, 18 nt, Homo sapiens
aauguuagauaguuacua

SEQ ID NO: 1383057 - RNA, 21 nt, Homo sapiens
aauguucauuguaauguuacu

SEQ ID NO: 1383058 - RNA, 14 nt, Homo sapiens
aauguuuacacucu

SEQ ID NO: 1383059 - RNA, 22 nt, Homo sapiens
aauuaaauauauguauguaaaa

SEQ ID NO: 1383060 - RNA, 12 nt, Homo sapiens
aauuaacacugc

SEQ ID NO: 1383061 - RNA, 11 nt, Homo sapiens
aauuaacuggg

SEQ ID NO: 1383062 - RNA, 19 nt, Homo sapiens
aauuaaguaaacuaaugag

SEQ ID NO: 1383063 - RNA, 18 nt, Homo sapiens
aauuaauauucauauuau

SEQ ID NO: 1383064 - RNA, 19 nt, Homo sapiens
aauuaaugacagagccagu

SEQ ID NO: 1383065 - RNA, 23 nt, Homo sapiens
aauuagcaauugacugucacugu

SEQ ID NO: 1383066 - RNA, 14 nt, Homo sapiens
aauuagggcccaau

SEQ ID NO: 1383067 - RNA, 19 nt, Homo sapiens
aauuagguuuuguacaauu

SEQ ID NO: 1383068 - RNA, 13 nt, Homo sapiens
aauuaguauuuau

SEQ ID NO: 1383069 - RNA, 17 nt, Homo sapiens
aauuaucaagcuaauaa

SEQ ID NO: 1383070 - RNA, 18 nt, Homo sapiens
aauuaucggaagcagugc

SEQ ID NO: 1383071 - RNA, 20 nt, Homo sapiens
aauuaucggaagcagugccu

SEQ ID NO: 1383072 - RNA, 14 nt, Homo sapiens
aauuauggcauuuu

SEQ ID NO: 1383073 - RNA, 21 nt, Homo sapiens
aauuauguaauugaaaaccaa

SEQ ID NO: 1383074 - RNA, 18 nt, Homo sapiens
aauucaacauauaccuua

SEQ ID NO: 1383075 - RNA, 12 nt, Homo sapiens
aauucauguuuc

SEQ ID NO: 1383076 - RNA, 18 nt, Homo sapiens
aauuccaaacacauacag

SEQ ID NO: 1383077 - RNA, 18 nt, Homo sapiens
aauuccaucccaucaucu

SEQ ID NO: 1383078 - RNA, 13 nt, Homo sapiens
aauucccagcugu

SEQ ID NO: 1383079 - RNA, 18 nt, Homo sapiens
aauucccauuuugcaaaa

SEQ ID NO: 1383080 - RNA, 13 nt, Homo sapiens
aauuccgcauuua

SEQ ID NO: 1383081 - RNA, 21 nt, Homo sapiens
aauuccuagaaguugagagag

SEQ ID NO: 1383082 - RNA, 15 nt, Homo sapiens
aauuccuguauucua

SEQ ID NO: 1383083 - RNA, 22 nt, Homo sapiens
aauuccuguauucuacagcaga

SEQ ID NO: 1383084 - RNA, 22 nt, Homo sapiens
aauuccuuagcuuagaccucag

SEQ ID NO: 1383085 - RNA, 23 nt, Homo sapiens
aauuccuuagcuuagaccucagc

SEQ ID NO: 1383086 - RNA, 14 nt, Homo sapiens
aauuccuugauuca

SEQ ID NO: 1383087 - RNA, 15 nt, Homo sapiens
aauucgcugcaaccu

SEQ ID NO: 1383088 - RNA, 22 nt, Homo sapiens
aauucgcugcaaccuguugaua

SEQ ID NO: 1383089 - RNA, 13 nt, Homo sapiens
aauucuacuuuga

SEQ ID NO: 1383090 - RNA, 21 nt, Homo sapiens
aauucuauaggaacauaugaa

SEQ ID NO: 1383091 - RNA, 13 nt, Homo sapiens
aauucucaagccg

SEQ ID NO: 1383092 - RNA, 21 nt, Homo sapiens
aauucucaagccgcaucccag

SEQ ID NO: 1383093 - RNA, 18 nt, Homo sapiens
aauucuuacaaacaugug

SEQ ID NO: 1383094 - RNA, 17 nt, Homo sapiens
aauucuuacauguuuuc

SEQ ID NO: 1383095 - RNA, 18 nt, Homo sapiens
aauugaaucacugcucac

SEQ ID NO: 1383096 - RNA, 13 nt, Homo sapiens
aauugacaggauu

SEQ ID NO: 1383097 - RNA, 13 nt, Homo sapiens
aauugacugucac

SEQ ID NO: 1383098 - RNA, 10 nt, Homo sapiens
aauugcucaa

SEQ ID NO: 1383099 - RNA, 11 nt, Homo sapiens
aauugcucaag

SEQ ID NO: 1383100 - RNA, 14 nt, Homo sapiens
aauugcucaugcau

SEQ ID NO: 1383101 - RNA, 19 nt, Homo sapiens
aauuguaaacuguacuagu

SEQ ID NO: 1383102 - RNA, 17 nt, Homo sapiens
aauuguacaaccuguga

SEQ ID NO: 1383103 - RNA, 19 nt, Homo sapiens
aauuguacaaccugugauc

SEQ ID NO: 1383104 - RNA, 15 nt, Homo sapiens
aauuguuuggggaug

SEQ ID NO: 1383105 - RNA, 17 nt, Homo sapiens
aauuguuuuuugcucuu

SEQ ID NO: 1383106 - RNA, 18 nt, Homo sapiens
aauuuaaaacauuacucu

SEQ ID NO: 1383107 - RNA, 22 nt, Homo sapiens
aauuuaaaagacacuguuuaca

SEQ ID NO: 1383108 - RNA, 19 nt, Homo sapiens
aauuuaaucuuccauggau

SEQ ID NO: 1383109 - RNA, 22 nt, Homo sapiens
aauuuauuuauuaagauggauu

SEQ ID NO: 1383110 - RNA, 15 nt, Homo sapiens
aauuuccaguaccuu

SEQ ID NO: 1383111 - RNA, 15 nt, Homo sapiens
aauuuccucugacau

SEQ ID NO: 1383112 - RNA, 17 nt, Homo sapiens
aauuucuaaaaaacaga

SEQ ID NO: 1383113 - RNA, 17 nt, Homo sapiens
aauuucuggaaaacugc

SEQ ID NO: 1383114 - RNA, 14 nt, Homo sapiens
aauuugaaauuuag

SEQ ID NO: 1383115 - RNA, 12 nt, Homo sapiens
aauuugaugaaa

SEQ ID NO: 1383116 - RNA, 18 nt, Homo sapiens
aauuuggccugcacuaau

SEQ ID NO: 1383117 - RNA, 21 nt, Homo sapiens
aauuugguaaauuaguauuua

SEQ ID NO: 1383118 - RNA, 17 nt, Homo sapiens
acagcauucuugucaca

SEQ ID NO: 1383119 - RNA, 18 nt, Homo sapiens
acagccucugaaaaccaa

SEQ ID NO: 1383120 - RNA, 18 nt, Homo sapiens
acagccuggcacagggca

SEQ ID NO: 1383121 - RNA, 21 nt, Homo sapiens
acagcucaagucuucccugau

SEQ ID NO: 1383122 - RNA, 15 nt, Homo sapiens
acagcuccacucuga

SEQ ID NO: 1383123 - RNA, 20 nt, Homo sapiens
acagcuuccccucucuccuc

SEQ ID NO: 1383124 - RNA, 13 nt, Homo sapiens
acaggacucugcc

SEQ ID NO: 1383125 - RNA, 18 nt, Homo sapiens
acaggauggucucugcca

SEQ ID NO: 1383126 - RNA, 20 nt, Homo sapiens
acaggauguuugcucagcuu

SEQ ID NO: 1383127 - RNA, 21 nt, Homo sapiens
acaggcaacugaggcagacag

SEQ ID NO: 1383128 - RNA, 13 nt, Homo sapiens
acaggcaccugcc

SEQ ID NO: 1383129 - RNA, 17 nt, Homo sapiens
acaggguguugucagca

SEQ ID NO: 1383130 - RNA, 14 nt, Homo sapiens
acaggucaacuuca

SEQ ID NO: 1383131 - RNA, 13 nt, Homo sapiens
acaggugugaacc

SEQ ID NO: 1383132 - RNA, 14 nt, Homo sapiens
acaguaacugccau

SEQ ID NO: 1383133 - RNA, 12 nt, Homo sapiens
acaguaucucag

SEQ ID NO: 1383134 - RNA, 20 nt, Homo sapiens
acagucaccgacaacaugcu

SEQ ID NO: 1383135 - RNA, 15 nt, Homo sapiens
acaguccugggagaa

SEQ ID NO: 1383136 - RNA, 19 nt, Homo sapiens
acaguccuucaaacuucca

SEQ ID NO: 1383137 - RNA, 14 nt, Homo sapiens
acagugaggcugca

SEQ ID NO: 1383138 - RNA, 16 nt, Homo sapiens
acaguuaacuuucaga

SEQ ID NO: 1383139 - RNA, 15 nt, Homo sapiens
acaguugggaaaaua

SEQ ID NO: 1383140 - RNA, 22 nt, Homo sapiens
acauaacacuauaaagguugac

SEQ ID NO: 1383141 - RNA, 21 nt, Homo sapiens
acauaagacagacagcaguuu

SEQ ID NO: 1383142 - RNA, 12 nt, Homo sapiens
acauacaauuau

SEQ ID NO: 1383143 - RNA, 20 nt, Homo sapiens
acauacaauuccaaacacau

SEQ ID NO: 1383144 - RNA, 16 nt, Homo sapiens
acauacacacauuaga

SEQ ID NO: 1383145 - RNA, 22 nt, Homo sapiens
acauacaggccauacuuuacaa

SEQ ID NO: 1383146 - RNA, 15 nt, Homo sapiens
acauacguacuuuuc

SEQ ID NO: 1383147 - RNA, 13 nt, Homo sapiens
acauagagaucua

SEQ ID NO: 1383148 - RNA, 18 nt, Homo sapiens
acauagagugaucuuucc

SEQ ID NO: 1383149 - RNA, 23 nt, Homo sapiens
acauauucuuuaaauuucaucuc

SEQ ID NO: 1383150 - RNA, 15 nt, Homo sapiens
acauauuuguuaaau

SEQ ID NO: 1383151 - RNA, 18 nt, Homo sapiens
acaucaagccugugauug

SEQ ID NO: 1383152 - RNA, 16 nt, Homo sapiens
acaucacaacauuuac

SEQ ID NO: 1383153 - RNA, 15 nt, Homo sapiens
acaucacagcuuauu

SEQ ID NO: 1383154 - RNA, 20 nt, Homo sapiens
acaucacuuguacaaaauaa

SEQ ID NO: 1383155 - RNA, 18 nt, Homo sapiens
acaucagaccugucuucc

SEQ ID NO: 1383156 - RNA, 20 nt, Homo sapiens
acaucagcagagaacuggaa

SEQ ID NO: 1383157 - RNA, 21 nt, Homo sapiens
acauccaaggagaaacagaga

SEQ ID NO: 1383158 - RNA, 19 nt, Homo sapiens
acauccacacagccaauac

SEQ ID NO: 1383159 - RNA, 19 nt, Homo sapiens
acauccacaugauaccucu

SEQ ID NO: 1383160 - RNA, 15 nt, Homo sapiens
acauccauguuccga

SEQ ID NO: 1383161 - RNA, 21 nt, Homo sapiens
acauccguugugcuugccugc

SEQ ID NO: 1383162 - RNA, 17 nt, Homo sapiens
acauccuuaagucaaaa

SEQ ID NO: 1383163 - RNA, 22 nt, Homo sapiens
acaucucauccaucaaguugca

SEQ ID NO: 1383164 - RNA, 21 nt, Homo sapiens
acaucuccuccauacucagga

SEQ ID NO: 1383165 - RNA, 15 nt, Homo sapiens
acaucugcauuuuca

SEQ ID NO: 1383166 - RNA, 11 nt, Homo sapiens
acaucuuccac

SEQ ID NO: 1383167 - RNA, 23 nt, Homo sapiens
acaucuuggucagauuugaacuc

SEQ ID NO: 1383168 - RNA, 16 nt, Homo sapiens
acaucuuucacacuuc

SEQ ID NO: 1383169 - RNA, 21 nt, Homo sapiens
acaucuuucacacuuccacca

SEQ ID NO: 1383170 - RNA, 14 nt, Homo sapiens
acaucuuucacauu

SEQ ID NO: 1383171 - RNA, 13 nt, Homo sapiens
acaucuuuuacau

SEQ ID NO: 1383172 - RNA, 19 nt, Homo sapiens
acaucuuuuacauucugca

SEQ ID NO: 1383173 - RNA, 15 nt, Homo sapiens
acaugaaaagcaaau

SEQ ID NO: 1383174 - RNA, 17 nt, Homo sapiens
acaugagaucuagguga

SEQ ID NO: 1383175 - RNA, 21 nt, Homo sapiens
acaugauggagcgcaccugcc

SEQ ID NO: 1383176 - RNA, 18 nt, Homo sapiens
acaugcuaccugauccca

SEQ ID NO: 1383177 - RNA, 13 nt, Homo sapiens
acaugcuucauga

SEQ ID NO: 1383178 - RNA, 18 nt, Homo sapiens
acaugggugaacacucaa

SEQ ID NO: 1383179 - RNA, 20 nt, Homo sapiens
acauggugaaaccucaucuc

SEQ ID NO: 1383180 - RNA, 12 nt, Homo sapiens
acaugugcacau

SEQ ID NO: 1383181 - RNA, 15 nt, Homo sapiens
acaugugcacuugaa

SEQ ID NO: 1383182 - RNA, 20 nt, Homo sapiens
acauguggcccaacacaauu

SEQ ID NO: 1383183 - RNA, 13 nt, Homo sapiens
acaugugguggga

SEQ ID NO: 1383184 - RNA, 13 nt, Homo sapiens
acauuaacuucag

SEQ ID NO: 1383185 - RNA, 15 nt, Homo sapiens
acauuaucaucugaa

SEQ ID NO: 1383186 - RNA, 23 nt, Homo sapiens
acauucaagauuaaacugaguga

SEQ ID NO: 1383187 - RNA, 13 nt, Homo sapiens
acauucacaccau

SEQ ID NO: 1383188 - RNA, 17 nt, Homo sapiens
acauucagagcuuacuu

SEQ ID NO: 1383189 - RNA, 15 nt, Homo sapiens
acauuccguuuacau

SEQ ID NO: 1383190 - RNA, 19 nt, Homo sapiens
acauucuggaaaagcaaaa

SEQ ID NO: 1383191 - RNA, 14 nt, Homo sapiens
acauuuucauaugc

SEQ ID NO: 1383192 - RNA, 11 nt, Homo sapiens
acauuuugcca

SEQ ID NO: 1383193 - RNA, 14 nt, Homo sapiens
accaaaacauuccg

SEQ ID NO: 1383194 - RNA, 16 nt, Homo sapiens
accaaauuccuuggca

SEQ ID NO: 1383195 - RNA, 17 nt, Homo sapiens
accaacaguuccuucag

SEQ ID NO: 1383196 - RNA, 13 nt, Homo sapiens
accaacaugguga

SEQ ID NO: 1383197 - RNA, 13 nt, Homo sapiens
accaacccagaga

SEQ ID NO: 1383198 - RNA, 16 nt, Homo sapiens
accaaccgauugccuu

SEQ ID NO: 1383199 - RNA, 21 nt, Homo sapiens
accaacuggcccucuucuuac

SEQ ID NO: 1383200 - RNA, 22 nt, Homo sapiens
accaagaagcccaagauaucag

SEQ ID NO: 1383201 - RNA, 23 nt, Homo sapiens
accaagaauucuccaaaacaauu

SEQ ID NO: 1383202 - RNA, 16 nt, Homo sapiens
accaagaugccaucug

SEQ ID NO: 1383203 - RNA, 21 nt, Homo sapiens
accaaggcgggagcaucucuu

SEQ ID NO: 1383204 - RNA, 12 nt, Homo sapiens
accacaaggaaa

SEQ ID NO: 1383205 - RNA, 14 nt, Homo sapiens
accacagcacuauu

SEQ ID NO: 1383206 - RNA, 13 nt, Homo sapiens
accacagugucug

SEQ ID NO: 1383207 - RNA, 16 nt, Homo sapiens
accacauagacuuuau

SEQ ID NO: 1383208 - RNA, 17 nt, Homo sapiens
accacauccuccgucca

SEQ ID NO: 1383209 - RNA, 15 nt, Homo sapiens
accaccaccaucacc

SEQ ID NO: 1383210 - RNA, 11 nt, Homo sapiens
accaccugguu

SEQ ID NO: 1383211 - RNA, 14 nt, Homo sapiens
accacuauucuuaa

SEQ ID NO: 1383212 - RNA, 19 nt, Homo sapiens
accacugcuuccauuuaau

SEQ ID NO: 1383213 - RNA, 21 nt, Homo sapiens
accacuuuccccgugggccau

SEQ ID NO: 1383214 - RNA, 13 nt, Homo sapiens
accagaaccacau

SEQ ID NO: 1383215 - RNA, 15 nt, Homo sapiens
accagaagcauuuca

SEQ ID NO: 1383216 - RNA, 19 nt, Homo sapiens
accagacgguucaccagcc

SEQ ID NO: 1383217 - RNA, 19 nt, Homo sapiens
accagagauaauaugagaa

SEQ ID NO: 1383218 - RNA, 13 nt, Homo sapiens
accagauuugcua

SEQ ID NO: 1383219 - RNA, 19 nt, Homo sapiens
accagcagaucccagcuca

SEQ ID NO: 1383220 - RNA, 15 nt, Homo sapiens
accagccugggcaac

SEQ ID NO: 1383221 - RNA, 18 nt, Homo sapiens
accagcgugugacuacuc

SEQ ID NO: 1383222 - RNA, 19 nt, Homo sapiens
accaggccgccccagccuc

SEQ ID NO: 1383223 - RNA, 14 nt, Homo sapiens
accaggcugcucag

SEQ ID NO: 1383224 - RNA, 19 nt, Homo sapiens
accaggcugugggccucaa

SEQ ID NO: 1383225 - RNA, 18 nt, Homo sapiens
accagggugguugggacg

SEQ ID NO: 1383226 - RNA, 14 nt, Homo sapiens
accaggucagggag

SEQ ID NO: 1383227 - RNA, 16 nt, Homo sapiens
accaggucaucuccuu

SEQ ID NO: 1383228 - RNA, 13 nt, Homo sapiens
accauaauguuac

SEQ ID NO: 1383229 - RNA, 12 nt, Homo sapiens
accauacaaaaa

SEQ ID NO: 1383230 - RNA, 16 nt, Homo sapiens
accauaugaacauaua

SEQ ID NO: 1383231 - RNA, 12 nt, Homo sapiens
accaucucaggc

SEQ ID NO: 1383232 - RNA, 20 nt, Homo sapiens
acggguguaaacacugaugg

SEQ ID NO: 1383233 - RNA, 15 nt, Homo sapiens
acgguguccaugccu

SEQ ID NO: 1383234 - RNA, 14 nt, Homo sapiens
acgguucaccagcc

SEQ ID NO: 1383235 - RNA, 16 nt, Homo sapiens
acgucuuaucuaauca

SEQ ID NO: 1383236 - RNA, 13 nt, Homo sapiens
acgugggcauuuu

SEQ ID NO: 1383237 - RNA, 20 nt, Homo sapiens
acgugugugcacguacacac

SEQ ID NO: 1383238 - RNA, 20 nt, Homo sapiens
acguuggccuaacacugggc

SEQ ID NO: 1383239 - RNA, 14 nt, Homo sapiens
acuaaaaauauuau

SEQ ID NO: 1383240 - RNA, 19 nt, Homo sapiens
acuaaaagguaugcaauca

SEQ ID NO: 1383241 - RNA, 16 nt, Homo sapiens
acuaaaaggugaccaa

SEQ ID NO: 1383242 - RNA, 19 nt, Homo sapiens
acuaaauuacaaaugcaau

SEQ ID NO: 1383243 - RNA, 20 nt, Homo sapiens
acuaaauuacaaaugcaauu

SEQ ID NO: 1383244 - RNA, 15 nt, Homo sapiens
acuaagaaauaugca

SEQ ID NO: 1383245 - RNA, 14 nt, Homo sapiens
acuaagaagcagau

SEQ ID NO: 1383246 - RNA, 18 nt, Homo sapiens
acuaagagaaugugcuca

SEQ ID NO: 1383247 - RNA, 16 nt, Homo sapiens
acuaaggaaucuuucu

SEQ ID NO: 1383248 - RNA, 16 nt, Homo sapiens
acuaaugauguuuucc

SEQ ID NO: 1383249 - RNA, 17 nt, Homo sapiens
acuacaaacacaagcaa

SEQ ID NO: 1383250 - RNA, 17 nt, Homo sapiens
acuacaggcaccugcca

SEQ ID NO: 1383251 - RNA, 14 nt, Homo sapiens
acuacauacaagca

SEQ ID NO: 1383252 - RNA, 19 nt, Homo sapiens
acuacgugacuguggcaca

SEQ ID NO: 1383253 - RNA, 18 nt, Homo sapiens
acuagaccuguaacuuuu

SEQ ID NO: 1383254 - RNA, 19 nt, Homo sapiens
acuagucacauucuuguuu

SEQ ID NO: 1383255 - RNA, 15 nt, Homo sapiens
acuauauuaguaugu

SEQ ID NO: 1383256 - RNA, 18 nt, Homo sapiens
acuaucaaacugaagcca

SEQ ID NO: 1383257 - RNA, 15 nt, Homo sapiens
acuauccuggcuuug

SEQ ID NO: 1383258 - RNA, 12 nt, Homo sapiens
acuaugcugcuu

SEQ ID NO: 1383259 - RNA, 18 nt, Homo sapiens
acuauggcucuacuuuca

SEQ ID NO: 1383260 - RNA, 19 nt, Homo sapiens
acuauggcucuacuuucag

SEQ ID NO: 1383261 - RNA, 14 nt, Homo sapiens
acuauucacuaaaa

SEQ ID NO: 1383262 - RNA, 21 nt, Homo sapiens
acuauugaaguugcagauuca

SEQ ID NO: 1383263 - RNA, 13 nt, Homo sapiens
acuauugagauau

SEQ ID NO: 1383264 - RNA, 17 nt, Homo sapiens
acuauuuaucugugcaa

SEQ ID NO: 1383265 - RNA, 17 nt, Homo sapiens
acuauuuaugaaggcaa

SEQ ID NO: 1383266 - RNA, 14 nt, Homo sapiens
acucaaaagagaga

SEQ ID NO: 1383267 - RNA, 19 nt, Homo sapiens
acucaagccaagcagccaa

SEQ ID NO: 1383268 - RNA, 17 nt, Homo sapiens
acucaaggaauuugcau

SEQ ID NO: 1383269 - RNA, 14 nt, Homo sapiens
acucaagugucuca

SEQ ID NO: 1383270 - RNA, 15 nt, Homo sapiens
acucaaguucaagga

SEQ ID NO: 1383271 - RNA, 21 nt, Homo sapiens
acucaaucucugauucuguca

SEQ ID NO: 1383272 - RNA, 23 nt, Homo sapiens
acucacacggacacucaaaagcu

SEQ ID NO: 1383273 - RNA, 12 nt, Homo sapiens
acucacccaagc

SEQ ID NO: 1383274 - RNA, 17 nt, Homo sapiens
acucaccucugccucaa

SEQ ID NO: 1383275 - RNA, 17 nt, Homo sapiens
acucacuuagcaugaau

SEQ ID NO: 1383276 - RNA, 21 nt, Homo sapiens
acucacuuucccaaauugaau

SEQ ID NO: 1383277 - RNA, 17 nt, Homo sapiens
acucagaagacacugau

SEQ ID NO: 1383278 - RNA, 14 nt, Homo sapiens
acucaggacuccag

SEQ ID NO: 1383279 - RNA, 15 nt, Homo sapiens
acucaucauuuccau

SEQ ID NO: 1383280 - RNA, 13 nt, Homo sapiens
acuccagaucugc

SEQ ID NO: 1383281 - RNA, 21 nt, Homo sapiens
acuccagauuuuuuacagcug

SEQ ID NO: 1383282 - RNA, 23 nt, Homo sapiens
acuccagcccugauugcgcaaaa

SEQ ID NO: 1383283 - RNA, 21 nt, Homo sapiens
acuccagccugggcaacacag

SEQ ID NO: 1383284 - RNA, 12 nt, Homo sapiens
acucccaaagag

SEQ ID NO: 1383285 - RNA, 16 nt, Homo sapiens
acuccccaacugaguu

SEQ ID NO: 1383286 - RNA, 13 nt, Homo sapiens
acuccuaaaucaa

SEQ ID NO: 1383287 - RNA, 14 nt, Homo sapiens
acuccuaaaucaag

SEQ ID NO: 1383288 - RNA, 18 nt, Homo sapiens
acuccuaagacuuaugua

SEQ ID NO: 1383289 - RNA, 15 nt, Homo sapiens
acuccucccugaugu

SEQ ID NO: 1383290 - RNA, 16 nt, Homo sapiens
acuccucccugaugua

SEQ ID NO: 1383291 - RNA, 20 nt, Homo sapiens
acuccucuccgcaguuccug

SEQ ID NO: 1383292 - RNA, 19 nt, Homo sapiens
acuccucuguccaggcacu

SEQ ID NO: 1383293 - RNA, 13 nt, Homo sapiens
acuccugcaaaau

SEQ ID NO: 1383294 - RNA, 17 nt, Homo sapiens
acuccuuagagacauca

SEQ ID NO: 1383295 - RNA, 14 nt, Homo sapiens
acucuacacuguga

SEQ ID NO: 1383296 - RNA, 20 nt, Homo sapiens
acucuauuaaaucuugcaac

SEQ ID NO: 1383297 - RNA, 18 nt, Homo sapiens
acucugaaaucucagaau

SEQ ID NO: 1383298 - RNA, 16 nt, Homo sapiens
acucugacuggcacag

SEQ ID NO: 1383299 - RNA, 21 nt, Homo sapiens
acucugauguaaaugaaguaa

SEQ ID NO: 1383300 - RNA, 22 nt, Homo sapiens
acucugcccagaccacacguag

SEQ ID NO: 1383301 - RNA, 19 nt, Homo sapiens
acucugggcugccauguga

SEQ ID NO: 1383302 - RNA, 23 nt, Homo sapiens
acucuggggagccugagccacaa

SEQ ID NO: 1383303 - RNA, 19 nt, Homo sapiens
acucuuaguuacucauuca

SEQ ID NO: 1383304 - RNA, 23 nt, Homo sapiens
acucuuaguuacucauucaggga

SEQ ID NO: 1383305 - RNA, 21 nt, Homo sapiens
acucuuauagaaaguucaaaa

SEQ ID NO: 1383306 - RNA, 14 nt, Homo sapiens
acugaaaggcaugu

SEQ ID NO: 1383307 - RNA, 19 nt, Homo sapiens
acugaacauguacacuggu

SEQ ID NO: 1383308 - RNA, 19 nt, Homo sapiens
acugaaggagaaggugccc

SEQ ID NO: 1383309 - RNA, 17 nt, Homo sapiens
acugaagggguucucac

SEQ ID NO: 1383310 - RNA, 21 nt, Homo sapiens
acugacaaaucaaguuuccaa

SEQ ID NO: 1383311 - RNA, 20 nt, Homo sapiens
acugacauauaucuauuaca

SEQ ID NO: 1383312 - RNA, 16 nt, Homo sapiens
acugacauuguuggcc

SEQ ID NO: 1383313 - RNA, 16 nt, Homo sapiens
acugacuccuguggag

SEQ ID NO: 1383314 - RNA, 19 nt, Homo sapiens
acugagaacagaucuccaa

SEQ ID NO: 1383315 - RNA, 20 nt, Homo sapiens
acugaggcagacagcagcuc

SEQ ID NO: 1383316 - RNA, 14 nt, Homo sapiens
acugauaaccacuc

SEQ ID NO: 1383317 - RNA, 17 nt, Homo sapiens
acugauuuuuagcuuua

SEQ ID NO: 1383318 - RNA, 14 nt, Homo sapiens
acugcaaaucugcc

SEQ ID NO: 1383319 - RNA, 19 nt, Homo sapiens
acugcaaaucugccugaua

SEQ ID NO: 1383320 - RNA, 14 nt, Homo sapiens
acugcaagcacugc

SEQ ID NO: 1383321 - RNA, 21 nt, Homo sapiens
acugcaagcacugcaugggca

SEQ ID NO: 1383322 - RNA, 19 nt, Homo sapiens
acugcacagugcaucucag

SEQ ID NO: 1383323 - RNA, 20 nt, Homo sapiens
acugcacuccaaucugggug

SEQ ID NO: 1383324 - RNA, 17 nt, Homo sapiens
acugcagccuccagaga

SEQ ID NO: 1383325 - RNA, 13 nt, Homo sapiens
acugcagcuuugu

SEQ ID NO: 1383326 - RNA, 14 nt, Homo sapiens
acugcauacaaucu

SEQ ID NO: 1383327 - RNA, 22 nt, Homo sapiens
acugccucuggaauugcucaag

SEQ ID NO: 1383328 - RNA, 22 nt, Homo sapiens
acugccuggguuccaauccugg

SEQ ID NO: 1383329 - RNA, 22 nt, Homo sapiens
acugcucaagagaagcacauga

SEQ ID NO: 1383330 - RNA, 19 nt, Homo sapiens
acugcugcccagccuccaa

SEQ ID NO: 1383331 - RNA, 17 nt, Homo sapiens
acugcugcuccagugca

SEQ ID NO: 1383332 - RNA, 19 nt, Homo sapiens
acugcugcuccagugcagg

SEQ ID NO: 1383333 - RNA, 15 nt, Homo sapiens
acugcugcuucuuaa

SEQ ID NO: 1383334 - RNA, 20 nt, Homo sapiens
acugcuguucauguuacuca

SEQ ID NO: 1383335 - RNA, 20 nt, Homo sapiens
acugcuucuaccaacuggaa

SEQ ID NO: 1383336 - RNA, 15 nt, Homo sapiens
acugcuuuuggucug

SEQ ID NO: 1383337 - RNA, 19 nt, Homo sapiens
acuggaaaaauccugagca

SEQ ID NO: 1383338 - RNA, 17 nt, Homo sapiens
acuggaaagacauagcc

SEQ ID NO: 1383339 - RNA, 13 nt, Homo sapiens
acuggaguccagu

SEQ ID NO: 1383340 - RNA, 15 nt, Homo sapiens
acuggauuaguuaac

SEQ ID NO: 1383341 - RNA, 13 nt, Homo sapiens
acuggcagcaucu

SEQ ID NO: 1383342 - RNA, 22 nt, Homo sapiens
acuggcagggacgaggacaaau

SEQ ID NO: 1383343 - RNA, 17 nt, Homo sapiens
acuggcugucaguauga

SEQ ID NO: 1383344 - RNA, 13 nt, Homo sapiens
acugggcuucuag

SEQ ID NO: 1383345 - RNA, 23 nt, Homo sapiens
cauacacccccaccuccugcaau

SEQ ID NO: 1383346 - RNA, 16 nt, Homo sapiens
cauacagcacaauguu

SEQ ID NO: 1383347 - RNA, 19 nt, Homo sapiens
cauacgucuuucacaguuu

SEQ ID NO: 1383348 - RNA, 16 nt, Homo sapiens
cauacuccuuccauca

SEQ ID NO: 1383349 - RNA, 17 nt, Homo sapiens
cauacucugcuuagaau

SEQ ID NO: 1383350 - RNA, 10 nt, Homo sapiens
cauacugcug

SEQ ID NO: 1383351 - RNA, 21 nt, Homo sapiens
cauagaaauuacacccaaaga

SEQ ID NO: 1383352 - RNA, 22 nt, Homo sapiens
cauagagaucuauguacuguaa

SEQ ID NO: 1383353 - RNA, 15 nt, Homo sapiens
cauagcagugcuuga

SEQ ID NO: 1383354 - RNA, 23 nt, Homo sapiens
cauaguacagguaaggugaggga

SEQ ID NO: 1383355 - RNA, 16 nt, Homo sapiens
cauaguacauacaaaa

SEQ ID NO: 1383356 - RNA, 13 nt, Homo sapiens
cauauaauguugu

SEQ ID NO: 1383357 - RNA, 12 nt, Homo sapiens
cauauaccagca

SEQ ID NO: 1383358 - RNA, 13 nt, Homo sapiens
cauauaccagcaa

SEQ ID NO: 1383359 - RNA, 16 nt, Homo sapiens
cauauauacacacaca

SEQ ID NO: 1383360 - RNA, 14 nt, Homo sapiens
cauauauaugucag

SEQ ID NO: 1383361 - RNA, 18 nt, Homo sapiens
cauauauaugucaggcaa

SEQ ID NO: 1383362 - RNA, 15 nt, Homo sapiens
cauauauuuguauga

SEQ ID NO: 1383363 - RNA, 20 nt, Homo sapiens
cauauccaacaugugcucag

SEQ ID NO: 1383364 - RNA, 13 nt, Homo sapiens
cauaugaacauau

SEQ ID NO: 1383365 - RNA, 18 nt, Homo sapiens
cauaugauugugcacaua

SEQ ID NO: 1383366 - RNA, 20 nt, Homo sapiens
cauaugcaaacauaacaaaa

SEQ ID NO: 1383367 - RNA, 16 nt, Homo sapiens
cauaugcuuuaagaau

SEQ ID NO: 1383368 - RNA, 19 nt, Homo sapiens
cauauguaaggaagucaga

SEQ ID NO: 1383369 - RNA, 18 nt, Homo sapiens
cauauuaauucaugcaaa

SEQ ID NO: 1383370 - RNA, 19 nt, Homo sapiens
cauauucccacagcacuaa

SEQ ID NO: 1383371 - RNA, 15 nt, Homo sapiens
caucaaaguggcaaa

SEQ ID NO: 1383372 - RNA, 22 nt, Homo sapiens
caucaagaugagagaacuggag

SEQ ID NO: 1383373 - RNA, 12 nt, Homo sapiens
caucaagcacag

SEQ ID NO: 1383374 - RNA, 12 nt, Homo sapiens
caucacaacauu

SEQ ID NO: 1383375 - RNA, 21 nt, Homo sapiens
caucacagcugaacuuguuga

SEQ ID NO: 1383376 - RNA, 15 nt, Homo sapiens
caucaccacagggau

SEQ ID NO: 1383377 - RNA, 23 nt, Homo sapiens
caucacccacagccgcagcugua

SEQ ID NO: 1383378 - RNA, 18 nt, Homo sapiens
caucacgccugugcagug

SEQ ID NO: 1383379 - RNA, 23 nt, Homo sapiens
caucacugaaaugcuagcugcaa

SEQ ID NO: 1383380 - RNA, 15 nt, Homo sapiens
caucagacagaugga

SEQ ID NO: 1383381 - RNA, 15 nt, Homo sapiens
caucagcuagcaaaa

SEQ ID NO: 1383382 - RNA, 14 nt, Homo sapiens
caucagcuccagcu

SEQ ID NO: 1383383 - RNA, 12 nt, Homo sapiens
caucaguucccc

SEQ ID NO: 1383384 - RNA, 13 nt, Homo sapiens
caucauaguacag

SEQ ID NO: 1383385 - RNA, 20 nt, Homo sapiens
caucauccuaagcuauucag

SEQ ID NO: 1383386 - RNA, 12 nt, Homo sapiens
caucauguugaa

SEQ ID NO: 1383387 - RNA, 13 nt, Homo sapiens
caucauuccuuga

SEQ ID NO: 1383388 - RNA, 21 nt, Homo sapiens
cauccaaggagaaacagagac

SEQ ID NO: 1383389 - RNA, 19 nt, Homo sapiens
cauccaaugcucaagaaac

SEQ ID NO: 1383390 - RNA, 13 nt, Homo sapiens
cauccaauguaug

SEQ ID NO: 1383391 - RNA, 14 nt, Homo sapiens
cauccacugugcca

SEQ ID NO: 1383392 - RNA, 24 nt, Homo sapiens
cauccauguuccgagaagaacaga

SEQ ID NO: 1383393 - RNA, 15 nt, Homo sapiens
caucccuggaaggac

SEQ ID NO: 1383394 - RNA, 15 nt, Homo sapiens
cauccggcagccugg

SEQ ID NO: 1383395 - RNA, 13 nt, Homo sapiens
cauccuaccacaa

SEQ ID NO: 1383396 - RNA, 21 nt, Homo sapiens
cauccuagagaaaacuugaau

SEQ ID NO: 1383397 - RNA, 23 nt, Homo sapiens
caucgguucauauuaagacauaa

SEQ ID NO: 1383398 - RNA, 20 nt, Homo sapiens
caucuacccugcugaccucc

SEQ ID NO: 1383399 - RNA, 18 nt, Homo sapiens
caucuaguaggugcuuga

SEQ ID NO: 1383400 - RNA, 15 nt, Homo sapiens
caucucagugcugua

SEQ ID NO: 1383401 - RNA, 18 nt, Homo sapiens
caucucagugcuguaaaa

SEQ ID NO: 1383402 - RNA, 13 nt, Homo sapiens
caucucauuccaa

SEQ ID NO: 1383403 - RNA, 22 nt, Homo sapiens
caucuccagggagcaagacaga

SEQ ID NO: 1383404 - RNA, 15 nt, Homo sapiens
caucucugucucaaa

SEQ ID NO: 1383405 - RNA, 22 nt, Homo sapiens
caucugucuggaggggagcucu

SEQ ID NO: 1383406 - RNA, 17 nt, Homo sapiens
caucugugggcacgcug

SEQ ID NO: 1383407 - RNA, 11 nt, Homo sapiens
caucuuccaag

SEQ ID NO: 1383408 - RNA, 21 nt, Homo sapiens
caucuugaccaagcaggaagc

SEQ ID NO: 1383409 - RNA, 16 nt, Homo sapiens
caucuuuccuguucca

SEQ ID NO: 1383410 - RNA, 15 nt, Homo sapiens
caugaaaagcaaaua

SEQ ID NO: 1383411 - RNA, 19 nt, Homo sapiens
caugaaaaugaaccauuca

SEQ ID NO: 1383412 - RNA, 20 nt, Homo sapiens
caugaaguguguuuccuuca

SEQ ID NO: 1383413 - RNA, 13 nt, Homo sapiens
caugaccuggaaa

SEQ ID NO: 1383414 - RNA, 18 nt, Homo sapiens
caugacgacaaagcugcu

SEQ ID NO: 1383415 - RNA, 20 nt, Homo sapiens
caugacucguauaugucuca

SEQ ID NO: 1383416 - RNA, 20 nt, Homo sapiens
caugacugcauuuuacugua

SEQ ID NO: 1383417 - RNA, 18 nt, Homo sapiens
caugagaccacuguuauc

SEQ ID NO: 1383418 - RNA, 17 nt, Homo sapiens
caugagaucuaggugag

SEQ ID NO: 1383419 - RNA, 18 nt, Homo sapiens
caugagucagucugauga

SEQ ID NO: 1383420 - RNA, 22 nt, Homo sapiens
caugagugauucuugacauuca

SEQ ID NO: 1383421 - RNA, 15 nt, Homo sapiens
caugagugccgugug

SEQ ID NO: 1383422 - RNA, 17 nt, Homo sapiens
caugaugaaaccccauc

SEQ ID NO: 1383423 - RNA, 17 nt, Homo sapiens
caugauguauuguugcu

SEQ ID NO: 1383424 - RNA, 18 nt, Homo sapiens
caugauguauuguugcuu

SEQ ID NO: 1383425 - RNA, 19 nt, Homo sapiens
caugauguuaaccagaaua

SEQ ID NO: 1383426 - RNA, 13 nt, Homo sapiens
caugcaaugccuc

SEQ ID NO: 1383427 - RNA, 14 nt, Homo sapiens
caugcauacauaca

SEQ ID NO: 1383428 - RNA, 15 nt, Homo sapiens
caugccaaccccgcc

SEQ ID NO: 1383429 - RNA, 15 nt, Homo sapiens
caugcccccaguuac

SEQ ID NO: 1383430 - RNA, 18 nt, Homo sapiens
caugcccccaguuacugu

SEQ ID NO: 1383431 - RNA, 19 nt, Homo sapiens
caugcccccaguuacugua

SEQ ID NO: 1383432 - RNA, 13 nt, Homo sapiens
caugcccucaauc

SEQ ID NO: 1383433 - RNA, 21 nt, Homo sapiens
caugcuggcucccagggccau

SEQ ID NO: 1383434 - RNA, 19 nt, Homo sapiens
cauggcaauuuuuacacaa

SEQ ID NO: 1383435 - RNA, 16 nt, Homo sapiens
cauggcaccaaagcca

SEQ ID NO: 1383436 - RNA, 21 nt, Homo sapiens
cauggccagguggccacucca

SEQ ID NO: 1383437 - RNA, 19 nt, Homo sapiens
cauggcuugccacagcucu

SEQ ID NO: 1383438 - RNA, 15 nt, Homo sapiens
cauggggguauugua

SEQ ID NO: 1383439 - RNA, 13 nt, Homo sapiens
cauguagccucaa

SEQ ID NO: 1383440 - RNA, 15 nt, Homo sapiens
caugucagacuguac

SEQ ID NO: 1383441 - RNA, 16 nt, Homo sapiens
caugucgccucugcau

SEQ ID NO: 1383442 - RNA, 15 nt, Homo sapiens
caugucucaauagua

SEQ ID NO: 1383443 - RNA, 17 nt, Homo sapiens
caugugagccaccgcug

SEQ ID NO: 1383444 - RNA, 14 nt, Homo sapiens
caugugcacaugca

SEQ ID NO: 1383445 - RNA, 14 nt, Homo sapiens
caugugcacuugaa

SEQ ID NO: 1383446 - RNA, 20 nt, Homo sapiens
cauguggcauguucaucgua

SEQ ID NO: 1383447 - RNA, 20 nt, Homo sapiens
caugugugcgagugugugca

SEQ ID NO: 1383448 - RNA, 21 nt, Homo sapiens
caugugugcgagugugugcau

SEQ ID NO: 1383449 - RNA, 20 nt, Homo sapiens
caugugugcgugugcgugca

SEQ ID NO: 1383450 - RNA, 19 nt, Homo sapiens
caugugugugcaagugugu

SEQ ID NO: 1383451 - RNA, 23 nt, Homo sapiens
caugugugugcaagugugugcau

SEQ ID NO: 1383452 - RNA, 17 nt, Homo sapiens
cauguuacugaccagca

SEQ ID NO: 1383453 - RNA, 21 nt, Homo sapiens
cauguuaggaaaauuucacau

SEQ ID NO: 1383454 - RNA, 14 nt, Homo sapiens
cauguuccucaaaa

SEQ ID NO: 1383455 - RNA, 16 nt, Homo sapiens
cauguuccucaaaagc

SEQ ID NO: 1383456 - RNA, 18 nt, Homo sapiens
cauguuggcuagccucug

SEQ ID NO: 1383457 - RNA, 23 nt, Homo sapiens
cauguuuugccacccccugugag

SEQ ID NO: 1383458 - RNA, 21 nt, Homo sapiens
ccacacuuguuccagcucuuu

SEQ ID NO: 1383459 - RNA, 20 nt, Homo sapiens
ccacagaccuaggauuucau

SEQ ID NO: 1383460 - RNA, 17 nt, Homo sapiens
ccacagcuucugcagca

SEQ ID NO: 1383461 - RNA, 11 nt, Homo sapiens
ccacaguauau

SEQ ID NO: 1383462 - RNA, 20 nt, Homo sapiens
ccacaguggaaagacagcuu

SEQ ID NO: 1383463 - RNA, 23 nt, Homo sapiens
ccaccaauccccgccacagcagg

SEQ ID NO: 1383464 - RNA, 15 nt, Homo sapiens
ccaccaucaccagac

SEQ ID NO: 1383465 - RNA, 16 nt, Homo sapiens
ccacccaaaagucaaa

SEQ ID NO: 1383466 - RNA, 15 nt, Homo sapiens
ccacccaacaagcca

SEQ ID NO: 1383467 - RNA, 20 nt, Homo sapiens
ccaccccagaaauggugaaa

SEQ ID NO: 1383468 - RNA, 23 nt, Homo sapiens
ccacccgaacgucuuaucuaauc

SEQ ID NO: 1383469 - RNA, 13 nt, Homo sapiens
ccacccuaguccc

SEQ ID NO: 1383470 - RNA, 19 nt, Homo sapiens
ccacccucccagcucugag

SEQ ID NO: 1383471 - RNA, 19 nt, Homo sapiens
ccaccuagagcuagaugug

SEQ ID NO: 1383472 - RNA, 15 nt, Homo sapiens
ccaccuccugcaaua

SEQ ID NO: 1383473 - RNA, 16 nt, Homo sapiens
ccaccucuccuuuggc

SEQ ID NO: 1383474 - RNA, 12 nt, Homo sapiens
ccaccugccauu

SEQ ID NO: 1383475 - RNA, 15 nt, Homo sapiens
ccaccugcccaucac

SEQ ID NO: 1383476 - RNA, 17 nt, Homo sapiens
ccaccuucccuguccug

SEQ ID NO: 1383477 - RNA, 12 nt, Homo sapiens
ccacggacucaa

SEQ ID NO: 1383478 - RNA, 20 nt, Homo sapiens
ccacguucucucugccugug

SEQ ID NO: 1383479 - RNA, 13 nt, Homo sapiens
ccacuauggucau

SEQ ID NO: 1383480 - RNA, 13 nt, Homo sapiens
ccacuccuaauau

SEQ ID NO: 1383481 - RNA, 23 nt, Homo sapiens
ccacucugccucugccugcauuc

SEQ ID NO: 1383482 - RNA, 21 nt, Homo sapiens
ccacugagagaucugcuguca

SEQ ID NO: 1383483 - RNA, 20 nt, Homo sapiens
ccacugaucucuacuaccac

SEQ ID NO: 1383484 - RNA, 21 nt, Homo sapiens
ccacugauggaaacaaagugg

SEQ ID NO: 1383485 - RNA, 20 nt, Homo sapiens
ccacuguacauuuuuauaca

SEQ ID NO: 1383486 - RNA, 23 nt, Homo sapiens
ccacuuaccuagauucuacauau

SEQ ID NO: 1383487 - RNA, 17 nt, Homo sapiens
ccacuugccccuguuac

SEQ ID NO: 1383488 - RNA, 12 nt, Homo sapiens
ccagaacccaga

SEQ ID NO: 1383489 - RNA, 14 nt, Homo sapiens
ccagaaccuggaca

SEQ ID NO: 1383490 - RNA, 17 nt, Homo sapiens
ccagaaccuguccuugc

SEQ ID NO: 1383491 - RNA, 21 nt, Homo sapiens
ccagaaccuguccuugcacac

SEQ ID NO: 1383492 - RNA, 19 nt, Homo sapiens
ccagaacuggacucaggau

SEQ ID NO: 1383493 - RNA, 13 nt, Homo sapiens
ccagacaaaugga

SEQ ID NO: 1383494 - RNA, 13 nt, Homo sapiens
ccagagaagccaa

SEQ ID NO: 1383495 - RNA, 14 nt, Homo sapiens
ccagagacugggac

SEQ ID NO: 1383496 - RNA, 20 nt, Homo sapiens
ccagagagccuggugcugcu

SEQ ID NO: 1383497 - RNA, 15 nt, Homo sapiens
ccagagaguggcucc

SEQ ID NO: 1383498 - RNA, 19 nt, Homo sapiens
ccagaggcuauuauuuuca

SEQ ID NO: 1383499 - RNA, 13 nt, Homo sapiens
ccagaugccaggg

SEQ ID NO: 1383500 - RNA, 20 nt, Homo sapiens
ccagauucuaccacacagca

SEQ ID NO: 1383501 - RNA, 12 nt, Homo sapiens
ccagauugcaac

SEQ ID NO: 1383502 - RNA, 17 nt, Homo sapiens
ccagcacccugcaaaau

SEQ ID NO: 1383503 - RNA, 18 nt, Homo sapiens
ccagcacucugaaacuga

SEQ ID NO: 1383504 - RNA, 16 nt, Homo sapiens
ccagcaugacgguguc

SEQ ID NO: 1383505 - RNA, 23 nt, Homo sapiens
ccagcccuguucugggugcagcu

SEQ ID NO: 1383506 - RNA, 14 nt, Homo sapiens
ccagccuccaugcu

SEQ ID NO: 1383507 - RNA, 22 nt, Homo sapiens
ccagccugcuaauuccccagau

SEQ ID NO: 1383508 - RNA, 21 nt, Homo sapiens
ccagcuacucaagaggcugag

SEQ ID NO: 1383509 - RNA, 12 nt, Homo sapiens
ccagcuacucag

SEQ ID NO: 1383510 - RNA, 15 nt, Homo sapiens
ccagcugacucccua

SEQ ID NO: 1383511 - RNA, 18 nt, Homo sapiens
ccagcugcaccugccagc

SEQ ID NO: 1383512 - RNA, 16 nt, Homo sapiens
ccagcugcaucuacuc

SEQ ID NO: 1383513 - RNA, 15 nt, Homo sapiens
ccagcugccuuggac

SEQ ID NO: 1383514 - RNA, 18 nt, Homo sapiens
ccagcugcucugucuucu

SEQ ID NO: 1383515 - RNA, 13 nt, Homo sapiens
ccaggaaugccuc

SEQ ID NO: 1383516 - RNA, 21 nt, Homo sapiens
ccaggagauggaaguugcagu

SEQ ID NO: 1383517 - RNA, 22 nt, Homo sapiens
ccaggagguggaggcugcagug

SEQ ID NO: 1383518 - RNA, 23 nt, Homo sapiens
ccaggaguacaccccaacagcac

SEQ ID NO: 1383519 - RNA, 17 nt, Homo sapiens
ccaggaguuugagacca

SEQ ID NO: 1383520 - RNA, 12 nt, Homo sapiens
ccaggcaauggc

SEQ ID NO: 1383521 - RNA, 20 nt, Homo sapiens
ccaggcaggcugugcgcuga

SEQ ID NO: 1383522 - RNA, 21 nt, Homo sapiens
ccaggcuggacgugguggcuc

SEQ ID NO: 1383523 - RNA, 20 nt, Homo sapiens
ccaggcuggagugcaguggu

SEQ ID NO: 1383524 - RNA, 19 nt, Homo sapiens
ccaggcuggccagcauggu

SEQ ID NO: 1383525 - RNA, 20 nt, Homo sapiens
ccaggcuggcgugcaguggu

SEQ ID NO: 1383526 - RNA, 17 nt, Homo sapiens
ccagggacauguggaaa

SEQ ID NO: 1383527 - RNA, 18 nt, Homo sapiens
ccagggaugacauguccc

SEQ ID NO: 1383528 - RNA, 11 nt, Homo sapiens
ccagggccaug

SEQ ID NO: 1383529 - RNA, 23 nt, Homo sapiens
ccaggggaaugaucucugaugac

SEQ ID NO: 1383530 - RNA, 13 nt, Homo sapiens
ccagggucucacu

SEQ ID NO: 1383531 - RNA, 20 nt, Homo sapiens
ccaggucacggggcaccaaa

SEQ ID NO: 1383532 - RNA, 15 nt, Homo sapiens
ccaggugcugcucag

SEQ ID NO: 1383533 - RNA, 16 nt, Homo sapiens
ccaguaauugguccga

SEQ ID NO: 1383534 - RNA, 16 nt, Homo sapiens
ccaguacgugcuaaca

SEQ ID NO: 1383535 - RNA, 23 nt, Homo sapiens
ccaguaguggugacugugggcuc

SEQ ID NO: 1383536 - RNA, 20 nt, Homo sapiens
ccagucuugucauugccagc

SEQ ID NO: 1383537 - RNA, 16 nt, Homo sapiens
ccagugccaagcacag

SEQ ID NO: 1383538 - RNA, 22 nt, Homo sapiens
ccaguggaacagcgggagaccu

SEQ ID NO: 1383539 - RNA, 14 nt, Homo sapiens
ccauaauguuacau

SEQ ID NO: 1383540 - RNA, 24 nt, Homo sapiens
ccauacucuaacaucuagcuggcu

SEQ ID NO: 1383541 - RNA, 17 nt, Homo sapiens
ccauagaggugagggaa

SEQ ID NO: 1383542 - RNA, 15 nt, Homo sapiens
ccauaugaauaacau

SEQ ID NO: 1383543 - RNA, 16 nt, Homo sapiens
ccaucaaaguggcaaa

SEQ ID NO: 1383544 - RNA, 19 nt, Homo sapiens
ccaucaaaguggcaaaaau

SEQ ID NO: 1383545 - RNA, 19 nt, Homo sapiens
ccaucacccucagcaguuc

SEQ ID NO: 1383546 - RNA, 20 nt, Homo sapiens
ccauccaaagaauuaugcau

SEQ ID NO: 1383547 - RNA, 13 nt, Homo sapiens
ccauccuauuuaa

SEQ ID NO: 1383548 - RNA, 22 nt, Homo sapiens
ccauccuauuuaacuggcuuca

SEQ ID NO: 1383549 - RNA, 17 nt, Homo sapiens
ccaucuccuuucaggga

SEQ ID NO: 1383550 - RNA, 12 nt, Homo sapiens
ccaugaagccac

SEQ ID NO: 1383551 - RNA, 11 nt, Homo sapiens
ccaugagacac

SEQ ID NO: 1383552 - RNA, 21 nt, Homo sapiens
ccaugaggccucaguggacuu

SEQ ID NO: 1383553 - RNA, 19 nt, Homo sapiens
ccaugcaaugccucuggaa

SEQ ID NO: 1383554 - RNA, 10 nt, Homo sapiens
ccaugccacc

SEQ ID NO: 1383555 - RNA, 20 nt, Homo sapiens
ccaugccacccuguuuucag

SEQ ID NO: 1383556 - RNA, 16 nt, Homo sapiens
ccaugcugaccugugu

SEQ ID NO: 1383557 - RNA, 17 nt, Homo sapiens
ccauggacccaauauuu

SEQ ID NO: 1383558 - RNA, 18 nt, Homo sapiens
ccaugggggcaacagcca

SEQ ID NO: 1383559 - RNA, 16 nt, Homo sapiens
ccauggucacagagaa

SEQ ID NO: 1383560 - RNA, 14 nt, Homo sapiens
ccaugugcccaguu

SEQ ID NO: 1383561 - RNA, 20 nt, Homo sapiens
ccaugugccugcaccaggag

SEQ ID NO: 1383562 - RNA, 23 nt, Homo sapiens
ccauguuauuuauaguguugcuu

SEQ ID NO: 1383563 - RNA, 20 nt, Homo sapiens
ccauuaaccagggcaccaag

SEQ ID NO: 1383564 - RNA, 22 nt, Homo sapiens
ccauuagcauuugucaacaaag

SEQ ID NO: 1383565 - RNA, 21 nt, Homo sapiens
ccauuauuuugguuuaucuuc

SEQ ID NO: 1383566 - RNA, 16 nt, Homo sapiens
ccauucacagugcaag

SEQ ID NO: 1383567 - RNA, 12 nt, Homo sapiens
ccauucuuugcu

SEQ ID NO: 1383568 - RNA, 14 nt, Homo sapiens
ccauugucuuuaua

SEQ ID NO: 1383569 - RNA, 13 nt, Homo sapiens
ccauuuacacuuu

SEQ ID NO: 1383570 - RNA, 20 nt, Homo sapiens
ccauuuuuacauccaugaaa

SEQ ID NO: 1383571 - RNA, 18 nt, Homo sapiens
ccugggccccaccaccua

SEQ ID NO: 1383572 - RNA, 17 nt, Homo sapiens
ccuggggcugaucucag

SEQ ID NO: 1383573 - RNA, 18 nt, Homo sapiens
ccugguaccuagcaaagc

SEQ ID NO: 1383574 - RNA, 13 nt, Homo sapiens
ccugguccaugau

SEQ ID NO: 1383575 - RNA, 15 nt, Homo sapiens
ccuguaaaacuuuau

SEQ ID NO: 1383576 - RNA, 19 nt, Homo sapiens
ccuguagucccauugaugu

SEQ ID NO: 1383577 - RNA, 12 nt, Homo sapiens
ccuguauuccca

SEQ ID NO: 1383578 - RNA, 20 nt, Homo sapiens
ccuguauucuacagcagaua

SEQ ID NO: 1383579 - RNA, 21 nt, Homo sapiens
ccugucaaacaaagccagaag

SEQ ID NO: 1383580 - RNA, 20 nt, Homo sapiens
ccugucaaguuaacaaggaa

SEQ ID NO: 1383581 - RNA, 18 nt, Homo sapiens
ccugucauaugcucugau

SEQ ID NO: 1383582 - RNA, 21 nt, Homo sapiens
ccugucuaggucaguacccac

SEQ ID NO: 1383583 - RNA, 22 nt, Homo sapiens
ccuguuaucuguguuugcugag

SEQ ID NO: 1383584 - RNA, 21 nt, Homo sapiens
ccuguucuguuuugccugaag

SEQ ID NO: 1383585 - RNA, 16 nt, Homo sapiens
ccuguugaaaagccau

SEQ ID NO: 1383586 - RNA, 21 nt, Homo sapiens
ccuguugaagcucuggugaca

SEQ ID NO: 1383587 - RNA, 18 nt, Homo sapiens
ccuguuguaacugcccaa

SEQ ID NO: 1383588 - RNA, 19 nt, Homo sapiens
ccuguuuugagcuuaaaaa

SEQ ID NO: 1383589 - RNA, 19 nt, Homo sapiens
ccuuaaaauuuauauguau

SEQ ID NO: 1383590 - RNA, 20 nt, Homo sapiens
ccuuaaauuaaacaauuuau

SEQ ID NO: 1383591 - RNA, 21 nt, Homo sapiens
ccuuaagggacaacauccuua

SEQ ID NO: 1383592 - RNA, 15 nt, Homo sapiens
ccuuaauauguuaac

SEQ ID NO: 1383593 - RNA, 23 nt, Homo sapiens
ccuuaaugauccguuccauugca

SEQ ID NO: 1383594 - RNA, 22 nt, Homo sapiens
ccuuagcuggcauuacagcugg

SEQ ID NO: 1383595 - RNA, 23 nt, Homo sapiens
ccuuaguguuuggguauauucau

SEQ ID NO: 1383596 - RNA, 13 nt, Homo sapiens
ccuucacuucuga

SEQ ID NO: 1383597 - RNA, 12 nt, Homo sapiens
ccuucacuuuac

SEQ ID NO: 1383598 - RNA, 15 nt, Homo sapiens
ccuucauuucaucua

SEQ ID NO: 1383599 - RNA, 20 nt, Homo sapiens
ccuuccagcacccugcaaaa

SEQ ID NO: 1383600 - RNA, 14 nt, Homo sapiens
ccuuccucauuugc

SEQ ID NO: 1383601 - RNA, 20 nt, Homo sapiens
ccuuccuucuugcuucucau

SEQ ID NO: 1383602 - RNA, 18 nt, Homo sapiens
ccuucggguuggcaaaau

SEQ ID NO: 1383603 - RNA, 15 nt, Homo sapiens
ccuucucugcuccac

SEQ ID NO: 1383604 - RNA, 15 nt, Homo sapiens
ccuucuugcuucuca

SEQ ID NO: 1383605 - RNA, 23 nt, Homo sapiens
ccuugacauuguagagcuucugg

SEQ ID NO: 1383606 - RNA, 11 nt, Homo sapiens
ccuugagaaac

SEQ ID NO: 1383607 - RNA, 22 nt, Homo sapiens
ccuugauuuaucacacaaagca

SEQ ID NO: 1383608 - RNA, 13 nt, Homo sapiens
ccuugcaccugca

SEQ ID NO: 1383609 - RNA, 21 nt, Homo sapiens
ccuuggaggcugucuucucag

SEQ ID NO: 1383610 - RNA, 19 nt, Homo sapiens
ccuuggcuaguaaaagcca

SEQ ID NO: 1383611 - RNA, 15 nt, Homo sapiens
ccuugggaugaucuu

SEQ ID NO: 1383612 - RNA, 21 nt, Homo sapiens
ccuugggaugaugccucauga

SEQ ID NO: 1383613 - RNA, 16 nt, Homo sapiens
ccuugggcugcuccuc

SEQ ID NO: 1383614 - RNA, 18 nt, Homo sapiens
ccuuguguccacugugac

SEQ ID NO: 1383615 - RNA, 19 nt, Homo sapiens
ccuuguugacacggccaug

SEQ ID NO: 1383616 - RNA, 13 nt, Homo sapiens
ccuuuaacaucuu

SEQ ID NO: 1383617 - RNA, 14 nt, Homo sapiens
ccuuuacuaaucca

SEQ ID NO: 1383618 - RNA, 16 nt, Homo sapiens
ccuuucaccacaugug

SEQ ID NO: 1383619 - RNA, 22 nt, Homo sapiens
ccuuuccaagcuccucgugaua

SEQ ID NO: 1383620 - RNA, 16 nt, Homo sapiens
ccuuucccaucuucca

SEQ ID NO: 1383621 - RNA, 23 nt, Homo sapiens
ccuuucccuuuagcacguuuaaa

SEQ ID NO: 1383622 - RNA, 19 nt, Homo sapiens
ccuuuccuuccaucccuac

SEQ ID NO: 1383623 - RNA, 20 nt, Homo sapiens
ccuuucuucucuccagugca

SEQ ID NO: 1383624 - RNA, 15 nt, Homo sapiens
ccuuugaaaugaaua

SEQ ID NO: 1383625 - RNA, 16 nt, Homo sapiens
ccuuugagacuauuga

SEQ ID NO: 1383626 - RNA, 14 nt, Homo sapiens
ccuuugcuucauuc

SEQ ID NO: 1383627 - RNA, 16 nt, Homo sapiens
ccuuugcuucauucaa

SEQ ID NO: 1383628 - RNA, 16 nt, Homo sapiens
ccuuuguugcacaaau

SEQ ID NO: 1383629 - RNA, 14 nt, Homo sapiens
ccuuuuaaaacacu

SEQ ID NO: 1383630 - RNA, 21 nt, Homo sapiens
ccuuuuagccuaguucaucca

SEQ ID NO: 1383631 - RNA, 14 nt, Homo sapiens
cgaaaccccaucuc

SEQ ID NO: 1383632 - RNA, 20 nt, Homo sapiens
cgaaaccccaucucuacuaa

SEQ ID NO: 1383633 - RNA, 13 nt, Homo sapiens
cgacaaagccaaa

SEQ ID NO: 1383634 - RNA, 13 nt, Homo sapiens
cgaccagacaccu

SEQ ID NO: 1383635 - RNA, 13 nt, Homo sapiens
cgaccccaccacc

SEQ ID NO: 1383636 - RNA, 19 nt, Homo sapiens
cgagacuccgucucaagga

SEQ ID NO: 1383637 - RNA, 20 nt, Homo sapiens
cgagauugcaccacugcacu

SEQ ID NO: 1383638 - RNA, 17 nt, Homo sapiens
cgaguuguggaaagccu

SEQ ID NO: 1383639 - RNA, 20 nt, Homo sapiens
cgaucuggguucacugcaac

SEQ ID NO: 1383640 - RNA, 17 nt, Homo sapiens
cgaugcagugcuuccaa

SEQ ID NO: 1383641 - RNA, 12 nt, Homo sapiens
cgaugugcaagu

SEQ ID NO: 1383642 - RNA, 23 nt, Homo sapiens
cgaugugcaaguguaugcacgug

SEQ ID NO: 1383643 - RNA, 22 nt, Homo sapiens
cgauuucacaguguguuuguga

SEQ ID NO: 1383644 - RNA, 14 nt, Homo sapiens
cgcaaauucgcaaa

SEQ ID NO: 1383645 - RNA, 17 nt, Homo sapiens
cgcaccaauaaagccuu

SEQ ID NO: 1383646 - RNA, 16 nt, Homo sapiens
cgcaucucagugcagg

SEQ ID NO: 1383647 - RNA, 21 nt, Homo sapiens
cgcccacguggcagaccguga

SEQ ID NO: 1383648 - RNA, 21 nt, Homo sapiens
cgcccagucuggaaugcagug

SEQ ID NO: 1383649 - RNA, 17 nt, Homo sapiens
cgcccgagguggcugcc

SEQ ID NO: 1383650 - RNA, 15 nt, Homo sapiens
cgccuaugaucccag

SEQ ID NO: 1383651 - RNA, 20 nt, Homo sapiens
cgcgcaccuguaaucccagc

SEQ ID NO: 1383652 - RNA, 18 nt, Homo sapiens
cgcugcucuuaugccauu

SEQ ID NO: 1383653 - RNA, 18 nt, Homo sapiens
cgcugugucagcauagaa

SEQ ID NO: 1383654 - RNA, 22 nt, Homo sapiens
cgcuuuugcuggucacugccau

SEQ ID NO: 1383655 - RNA, 13 nt, Homo sapiens
cggaguugugcac

SEQ ID NO: 1383656 - RNA, 21 nt, Homo sapiens
cggaucuggggcucugggaua

SEQ ID NO: 1383657 - RNA, 15 nt, Homo sapiens
cggcagccuggaugu

SEQ ID NO: 1383658 - RNA, 20 nt, Homo sapiens
cggcaguucugggugcuccc

SEQ ID NO: 1383659 - RNA, 15 nt, Homo sapiens
cggccuugggaaauc

SEQ ID NO: 1383660 - RNA, 13 nt, Homo sapiens
cgggaacaguguu

SEQ ID NO: 1383661 - RNA, 21 nt, Homo sapiens
cgggaagcgaugaauuuggag

SEQ ID NO: 1383662 - RNA, 16 nt, Homo sapiens
cgggagaccugugcua

SEQ ID NO: 1383663 - RNA, 15 nt, Homo sapiens
cgggagcagugucuu

SEQ ID NO: 1383664 - RNA, 14 nt, Homo sapiens
cgggagcugcacua

SEQ ID NO: 1383665 - RNA, 21 nt, Homo sapiens
cgggccuggagaacuagagaa

SEQ ID NO: 1383666 - RNA, 15 nt, Homo sapiens
cggguggaucaccug

SEQ ID NO: 1383667 - RNA, 19 nt, Homo sapiens
cggucaauccuguggguga

SEQ ID NO: 1383668 - RNA, 13 nt, Homo sapiens
cggugagcauugu

SEQ ID NO: 1383669 - RNA, 13 nt, Homo sapiens
cguagccaucucu

SEQ ID NO: 1383670 - RNA, 13 nt, Homo sapiens
cgucccuaccucc

SEQ ID NO: 1383671 - RNA, 17 nt, Homo sapiens
cgucccuccacguucac

SEQ ID NO: 1383672 - RNA, 17 nt, Homo sapiens
cgucuaagucaugagcu

SEQ ID NO: 1383673 - RNA, 19 nt, Homo sapiens
cgucuuucacaguuucuuc

SEQ ID NO: 1383674 - RNA, 18 nt, Homo sapiens
cgugaaggccgagaagca

SEQ ID NO: 1383675 - RNA, 17 nt, Homo sapiens
cgugagcagcuuuggaa

SEQ ID NO: 1383676 - RNA, 20 nt, Homo sapiens
cgugauaaugcagacuuccu

SEQ ID NO: 1383677 - RNA, 17 nt, Homo sapiens
cgugcacacaccagagc

SEQ ID NO: 1383678 - RNA, 21 nt, Homo sapiens
cgugcagcagcaacacaaugu

SEQ ID NO: 1383679 - RNA, 19 nt, Homo sapiens
cguggcuaagaguguccua

SEQ ID NO: 1383680 - RNA, 23 nt, Homo sapiens
cgugggacaucuaguaggugcuu

SEQ ID NO: 1383681 - RNA, 21 nt, Homo sapiens
cgugggucuucagggggccag

SEQ ID NO: 1383682 - RNA, 14 nt, Homo sapiens
cgugugcgugcaug

SEQ ID NO: 1383683 - RNA, 14 nt, Homo sapiens
cguguguccaugug

SEQ ID NO: 1383684 - RNA, 23 nt, Homo sapiens
cuauuuuuauuuguuugugcauu

SEQ ID NO: 1383685 - RNA, 21 nt, Homo sapiens
cucaaaagcugggcagguugg

SEQ ID NO: 1383686 - RNA, 20 nt, Homo sapiens
cucaaaccuccaaaagcccu

SEQ ID NO: 1383687 - RNA, 19 nt, Homo sapiens
cucaaacucuuaaaaccca

SEQ ID NO: 1383688 - RNA, 19 nt, Homo sapiens
cucaaagcuuccauuccac

SEQ ID NO: 1383689 - RNA, 15 nt, Homo sapiens
cucaaauaacuaaaa

SEQ ID NO: 1383690 - RNA, 13 nt, Homo sapiens
cucaaaugcacau

SEQ ID NO: 1383691 - RNA, 14 nt, Homo sapiens
cucaaaugcaguau

SEQ ID NO: 1383692 - RNA, 21 nt, Homo sapiens
cucaagccaagcagccaagcu

SEQ ID NO: 1383693 - RNA, 19 nt, Homo sapiens
cucaagcccugcagucaca

SEQ ID NO: 1383694 - RNA, 19 nt, Homo sapiens
cucaagccgcaucccagac

SEQ ID NO: 1383695 - RNA, 19 nt, Homo sapiens
cucaagucuucccugauca

SEQ ID NO: 1383696 - RNA, 15 nt, Homo sapiens
cucacacaugagauc

SEQ ID NO: 1383697 - RNA, 19 nt, Homo sapiens
cucacaccuguaaucccaa

SEQ ID NO: 1383698 - RNA, 16 nt, Homo sapiens
cucacagaacuaugua

SEQ ID NO: 1383699 - RNA, 18 nt, Homo sapiens
cucacagaagaauaugac

SEQ ID NO: 1383700 - RNA, 19 nt, Homo sapiens
cucacagagugcauuguga

SEQ ID NO: 1383701 - RNA, 19 nt, Homo sapiens
cucacauuuauucugcuca

SEQ ID NO: 1383702 - RNA, 17 nt, Homo sapiens
cucaccugcuggccccu

SEQ ID NO: 1383703 - RNA, 13 nt, Homo sapiens
cucacgccuguaa

SEQ ID NO: 1383704 - RNA, 20 nt, Homo sapiens
cucacgccuguaaucccagc

SEQ ID NO: 1383705 - RNA, 17 nt, Homo sapiens
cucacgcucccaacaca

SEQ ID NO: 1383706 - RNA, 15 nt, Homo sapiens
cucacuaugcugcuu

SEQ ID NO: 1383707 - RNA, 16 nt, Homo sapiens
cucacucuguugcuca

SEQ ID NO: 1383708 - RNA, 17 nt, Homo sapiens
cucacugcaagcacugc

SEQ ID NO: 1383709 - RNA, 17 nt, Homo sapiens
cucacuguugaauuuuc

SEQ ID NO: 1383710 - RNA, 18 nt, Homo sapiens
cucacuugugcaguguug

SEQ ID NO: 1383711 - RNA, 19 nt, Homo sapiens
cucacuuuucuccaugagu

SEQ ID NO: 1383712 - RNA, 23 nt, Homo sapiens
cucagagaauuucuaccauuuca

SEQ ID NO: 1383713 - RNA, 14 nt, Homo sapiens
cucagaugcacaug

SEQ ID NO: 1383714 - RNA, 19 nt, Homo sapiens
cucagaugcacaugagcug

SEQ ID NO: 1383715 - RNA, 16 nt, Homo sapiens
cucagcuggaucucca

SEQ ID NO: 1383716 - RNA, 22 nt, Homo sapiens
cucaggacacuaauacaccagg

SEQ ID NO: 1383717 - RNA, 17 nt, Homo sapiens
cucaggcuuccuuggca

SEQ ID NO: 1383718 - RNA, 13 nt, Homo sapiens
cucaggucagggu

SEQ ID NO: 1383719 - RNA, 14 nt, Homo sapiens
cucaggucccugca

SEQ ID NO: 1383720 - RNA, 21 nt, Homo sapiens
cucagucccuaaaaacacaga

SEQ ID NO: 1383721 - RNA, 14 nt, Homo sapiens
cucagucucaggag

SEQ ID NO: 1383722 - RNA, 13 nt, Homo sapiens
cucaguuccugcc

SEQ ID NO: 1383723 - RNA, 14 nt, Homo sapiens
cucaguuggugcug

SEQ ID NO: 1383724 - RNA, 18 nt, Homo sapiens
cucaguuggugcugcuuu

SEQ ID NO: 1383725 - RNA, 21 nt, Homo sapiens
cucaguuugucagacuuuaaa

SEQ ID NO: 1383726 - RNA, 13 nt, Homo sapiens
cucauaguauggu

SEQ ID NO: 1383727 - RNA, 17 nt, Homo sapiens
cucauaugauugugcac

SEQ ID NO: 1383728 - RNA, 20 nt, Homo sapiens
cucauaugauugugcacaua

SEQ ID NO: 1383729 - RNA, 22 nt, Homo sapiens
cucaucauaaaauaaaguauau

SEQ ID NO: 1383730 - RNA, 21 nt, Homo sapiens
cucauccaucaaguugcacac

SEQ ID NO: 1383731 - RNA, 16 nt, Homo sapiens
cucauguagccucaac

SEQ ID NO: 1383732 - RNA, 12 nt, Homo sapiens
cucauucaaaag

SEQ ID NO: 1383733 - RNA, 24 nt, Homo sapiens
cucauucagggauagcacugagca

SEQ ID NO: 1383734 - RNA, 13 nt, Homo sapiens
cucauuccaccuu

SEQ ID NO: 1383735 - RNA, 21 nt, Homo sapiens
cuccaaaacaauuuucugcag

SEQ ID NO: 1383736 - RNA, 18 nt, Homo sapiens
cuccaaauuuuuuuuacu

SEQ ID NO: 1383737 - RNA, 12 nt, Homo sapiens
cuccaacaauaa

SEQ ID NO: 1383738 - RNA, 20 nt, Homo sapiens
cuccaagguagaauuugcaa

SEQ ID NO: 1383739 - RNA, 23 nt, Homo sapiens
cuccacaauagcagacaguguuu

SEQ ID NO: 1383740 - RNA, 18 nt, Homo sapiens
cuccaccaacccaucaga

SEQ ID NO: 1383741 - RNA, 14 nt, Homo sapiens
cuccaccacauccu

SEQ ID NO: 1383742 - RNA, 21 nt, Homo sapiens
cuccagccuggcuacagggcg

SEQ ID NO: 1383743 - RNA, 22 nt, Homo sapiens
cuccagcucaccagccccagug

SEQ ID NO: 1383744 - RNA, 19 nt, Homo sapiens
cuccagcugcucugucuuc

SEQ ID NO: 1383745 - RNA, 16 nt, Homo sapiens
cuccaugagacacauc

SEQ ID NO: 1383746 - RNA, 14 nt, Homo sapiens
cuccauucugacca

SEQ ID NO: 1383747 - RNA, 20 nt, Homo sapiens
cuccauuguucagaugcuuc

SEQ ID NO: 1383748 - RNA, 21 nt, Homo sapiens
cuccauuugcaauugaccucu

SEQ ID NO: 1383749 - RNA, 15 nt, Homo sapiens
cucccaaggcucuga

SEQ ID NO: 1383750 - RNA, 19 nt, Homo sapiens
cucccaaggcucugagcaa

SEQ ID NO: 1383751 - RNA, 12 nt, Homo sapiens
cucccacagaac

SEQ ID NO: 1383752 - RNA, 18 nt, Homo sapiens
cucccaccccacccccuu

SEQ ID NO: 1383753 - RNA, 23 nt, Homo sapiens
cucccaccuuugguccuaagucc

SEQ ID NO: 1383754 - RNA, 18 nt, Homo sapiens
cucccagccagguucuga

SEQ ID NO: 1383755 - RNA, 23 nt, Homo sapiens
cucccagcucuagacaacccugc

SEQ ID NO: 1383756 - RNA, 11 nt, Homo sapiens
cucccagugac

SEQ ID NO: 1383757 - RNA, 13 nt, Homo sapiens
cuccccaccuuca

SEQ ID NO: 1383758 - RNA, 18 nt, Homo sapiens
cuccccugcccuggucca

SEQ ID NO: 1383759 - RNA, 20 nt, Homo sapiens
cucccucaaagcacacguca

SEQ ID NO: 1383760 - RNA, 13 nt, Homo sapiens
cucccucauucca

SEQ ID NO: 1383761 - RNA, 15 nt, Homo sapiens
cucccucauuccacc

SEQ ID NO: 1383762 - RNA, 21 nt, Homo sapiens
cucccucgaacccacacugca

SEQ ID NO: 1383763 - RNA, 22 nt, Homo sapiens
cucccucucucuucugcuccac

SEQ ID NO: 1383764 - RNA, 16 nt, Homo sapiens
cucccucugaccugca

SEQ ID NO: 1383765 - RNA, 12 nt, Homo sapiens
cucccugaugua

SEQ ID NO: 1383766 - RNA, 21 nt, Homo sapiens
cucccuggccuguucuguuuu

SEQ ID NO: 1383767 - RNA, 15 nt, Homo sapiens
cucccuguaacucca

SEQ ID NO: 1383768 - RNA, 14 nt, Homo sapiens
cucccuuccugucc

SEQ ID NO: 1383769 - RNA, 16 nt, Homo sapiens
cuccuagacugacccu

SEQ ID NO: 1383770 - RNA, 20 nt, Homo sapiens
cuccuccagggccacgugcc

SEQ ID NO: 1383771 - RNA, 20 nt, Homo sapiens
cuccuccugcccaccuguca

SEQ ID NO: 1383772 - RNA, 16 nt, Homo sapiens
cuccucuccccagcaa

SEQ ID NO: 1383773 - RNA, 14 nt, Homo sapiens
cuccucuugccacu

SEQ ID NO: 1383774 - RNA, 18 nt, Homo sapiens
cuccugagcgaugacuca

SEQ ID NO: 1383775 - RNA, 12 nt, Homo sapiens
cuccugcaaaau

SEQ ID NO: 1383776 - RNA, 23 nt, Homo sapiens
cuccuggaaaggcucagucucag

SEQ ID NO: 1383777 - RNA, 20 nt, Homo sapiens
cuccuggacucaaaguaucc

SEQ ID NO: 1383778 - RNA, 20 nt, Homo sapiens
cuccuggccucaagugauuc

SEQ ID NO: 1383779 - RNA, 21 nt, Homo sapiens
cuccugggcucaagcagucua

SEQ ID NO: 1383780 - RNA, 23 nt, Homo sapiens
cuccuuccugucuuccugcauuc

SEQ ID NO: 1383781 - RNA, 14 nt, Homo sapiens
cuccuugguauuuc

SEQ ID NO: 1383782 - RNA, 19 nt, Homo sapiens
cuccuuucuuucuaacucc

SEQ ID NO: 1383783 - RNA, 14 nt, Homo sapiens
cuccuuugcaggcu

SEQ ID NO: 1383784 - RNA, 14 nt, Homo sapiens
cucgccgucuguga

SEQ ID NO: 1383785 - RNA, 16 nt, Homo sapiens
cucggccucccaaagu

SEQ ID NO: 1383786 - RNA, 11 nt, Homo sapiens
cucguccuccc

SEQ ID NO: 1383787 - RNA, 12 nt, Homo sapiens
cucgugugcaac

SEQ ID NO: 1383788 - RNA, 21 nt, Homo sapiens
cucguuucugauuaaugcuaa

SEQ ID NO: 1383789 - RNA, 20 nt, Homo sapiens
cucuacccuggcacuauaau

SEQ ID NO: 1383790 - RNA, 15 nt, Homo sapiens
cucuacuaugaagug

SEQ ID NO: 1383791 - RNA, 21 nt, Homo sapiens
cucuacucuagggaaaaacca

SEQ ID NO: 1383792 - RNA, 18 nt, Homo sapiens
cucuagagaaaagucuac

SEQ ID NO: 1383793 - RNA, 21 nt, Homo sapiens
cucuauagacucuaggacaua

SEQ ID NO: 1383794 - RNA, 24 nt, Homo sapiens
cucuaugaccucgcccuccacaaa

SEQ ID NO: 1383795 - RNA, 19 nt, Homo sapiens
cucuaugccagcucagucc

SEQ ID NO: 1383796 - RNA, 19 nt, Homo sapiens
cucuauugcugcucucuca

SEQ ID NO: 1383797 - RNA, 20 nt, Homo sapiens
uaaucaugugggugagccag

SEQ ID NO: 1383798 - RNA, 19 nt, Homo sapiens
uaauccucuuuuucuaguc

SEQ ID NO: 1383799 - RNA, 13 nt, Homo sapiens
uaaucucucagcu

SEQ ID NO: 1383800 - RNA, 22 nt, Homo sapiens
uaaucuguuuauuuacaaggga

SEQ ID NO: 1383801 - RNA, 19 nt, Homo sapiens
uaaucuucuuaugcaauuu

SEQ ID NO: 1383802 - RNA, 14 nt, Homo sapiens
uaaugaacauguga

SEQ ID NO: 1383803 - RNA, 14 nt, Homo sapiens
uaaugaagugcaau

SEQ ID NO: 1383804 - RNA, 13 nt, Homo sapiens
uaaugaaugcaua

SEQ ID NO: 1383805 - RNA, 18 nt, Homo sapiens
uaaugacaaaggcacuga

SEQ ID NO: 1383806 - RNA, 15 nt, Homo sapiens
uaaugauagcuacug

SEQ ID NO: 1383807 - RNA, 13 nt, Homo sapiens
uaaugggacacua

SEQ ID NO: 1383808 - RNA, 14 nt, Homo sapiens
uaauguaagcucua

SEQ ID NO: 1383809 - RNA, 15 nt, Homo sapiens
uaaugucaccaccuu

SEQ ID NO: 1383810 - RNA, 23 nt, Homo sapiens
uaaugucuuuaaaaguauccaga

SEQ ID NO: 1383811 - RNA, 14 nt, Homo sapiens
uaauguuacugauc

SEQ ID NO: 1383812 - RNA, 15 nt, Homo sapiens
uaauguugugguuug

SEQ ID NO: 1383813 - RNA, 15 nt, Homo sapiens
uaauuaaacaugauc

SEQ ID NO: 1383814 - RNA, 14 nt, Homo sapiens
uaauuaauauucau

SEQ ID NO: 1383815 - RNA, 16 nt, Homo sapiens
uaauuauuguuuauau

SEQ ID NO: 1383816 - RNA, 14 nt, Homo sapiens
uaauugauuucaag

SEQ ID NO: 1383817 - RNA, 12 nt, Homo sapiens
uaauuuaaucuu

SEQ ID NO: 1383818 - RNA, 16 nt, Homo sapiens
uaauuuacagcuuuca

SEQ ID NO: 1383819 - RNA, 21 nt, Homo sapiens
uaauuucugaaaugugcagcu

SEQ ID NO: 1383820 - RNA, 13 nt, Homo sapiens
uaauuugaugaaa

SEQ ID NO: 1383821 - RNA, 20 nt, Homo sapiens
uacaaaaauuagcugggcau

SEQ ID NO: 1383822 - RNA, 16 nt, Homo sapiens
uacaaacacaagcaaa

SEQ ID NO: 1383823 - RNA, 12 nt, Homo sapiens
uacaaacaugug

SEQ ID NO: 1383824 - RNA, 22 nt, Homo sapiens
uacaaaugcaauuucauuuaaa

SEQ ID NO: 1383825 - RNA, 15 nt, Homo sapiens
uacaacacacacugu

SEQ ID NO: 1383826 - RNA, 17 nt, Homo sapiens
uacaacuucaagugcau

SEQ ID NO: 1383827 - RNA, 21 nt, Homo sapiens
uacaacuuccacuccaaguga

SEQ ID NO: 1383828 - RNA, 20 nt, Homo sapiens
uacaaguuuucauaagcaca

SEQ ID NO: 1383829 - RNA, 22 nt, Homo sapiens
uacaaguuuucauaagcacacu

SEQ ID NO: 1383830 - RNA, 20 nt, Homo sapiens
uacaauaggugcuuauucuc

SEQ ID NO: 1383831 - RNA, 18 nt, Homo sapiens
uacaauuguaaaacugag

SEQ ID NO: 1383832 - RNA, 13 nt, Homo sapiens
uacaauugugagc

SEQ ID NO: 1383833 - RNA, 14 nt, Homo sapiens
uacacacacaaaga

SEQ ID NO: 1383834 - RNA, 21 nt, Homo sapiens
uacacacacacgcgugcacac

SEQ ID NO: 1383835 - RNA, 14 nt, Homo sapiens
uacacacagcagua

SEQ ID NO: 1383836 - RNA, 12 nt, Homo sapiens
uacacagacuau

SEQ ID NO: 1383837 - RNA, 16 nt, Homo sapiens
uacacagaucacagcu

SEQ ID NO: 1383838 - RNA, 17 nt, Homo sapiens
uacacagaucacagcuu

SEQ ID NO: 1383839 - RNA, 16 nt, Homo sapiens
uacacauagcauguaa

SEQ ID NO: 1383840 - RNA, 11 nt, Homo sapiens
uacacaugaca

SEQ ID NO: 1383841 - RNA, 20 nt, Homo sapiens
uacacuccagccugagcaac

SEQ ID NO: 1383842 - RNA, 20 nt, Homo sapiens
uacagacagaaggugcuaag

SEQ ID NO: 1383843 - RNA, 22 nt, Homo sapiens
uacagagaaggaaugucuuugg

SEQ ID NO: 1383844 - RNA, 20 nt, Homo sapiens
uacagauagauauaugcucu

SEQ ID NO: 1383845 - RNA, 17 nt, Homo sapiens
uacagauaggccuucuu

SEQ ID NO: 1383846 - RNA, 13 nt, Homo sapiens
uacagaugggcaa

SEQ ID NO: 1383847 - RNA, 18 nt, Homo sapiens
uacagauugcugcuucug

SEQ ID NO: 1383848 - RNA, 22 nt, Homo sapiens
uacagcuaaucagcauucucac

SEQ ID NO: 1383849 - RNA, 21 nt, Homo sapiens
uacaggaagcaccccaugcca

SEQ ID NO: 1383850 - RNA, 23 nt, Homo sapiens
uacaggaagcaccccaugccaaa

SEQ ID NO: 1383851 - RNA, 19 nt, Homo sapiens
uacaggaagguagaaauau

SEQ ID NO: 1383852 - RNA, 15 nt, Homo sapiens
uacaggcagcacaga

SEQ ID NO: 1383853 - RNA, 14 nt, Homo sapiens
uacaggugugaguc

SEQ ID NO: 1383854 - RNA, 16 nt, Homo sapiens
uacaggugugagucac

SEQ ID NO: 1383855 - RNA, 15 nt, Homo sapiens
uacagguuacaugag

SEQ ID NO: 1383856 - RNA, 16 nt, Homo sapiens
uacaguaucucagggc

SEQ ID NO: 1383857 - RNA, 13 nt, Homo sapiens
uacagugcuauuu

SEQ ID NO: 1383858 - RNA, 20 nt, Homo sapiens
uacauaaaggugguaugugu

SEQ ID NO: 1383859 - RNA, 18 nt, Homo sapiens
uacauauugucacugaca

SEQ ID NO: 1383860 - RNA, 11 nt, Homo sapiens
uacaucuggcc

SEQ ID NO: 1383861 - RNA, 18 nt, Homo sapiens
uacaugcagcccaugccc

SEQ ID NO: 1383862 - RNA, 13 nt, Homo sapiens
uacaugcauuuga

SEQ ID NO: 1383863 - RNA, 11 nt, Homo sapiens
uacauggaaua

SEQ ID NO: 1383864 - RNA, 14 nt, Homo sapiens
uacauuaacuucag

SEQ ID NO: 1383865 - RNA, 15 nt, Homo sapiens
uacauuaauuaccuu

SEQ ID NO: 1383866 - RNA, 18 nt, Homo sapiens
uacauuuaucuguacaua

SEQ ID NO: 1383867 - RNA, 13 nt, Homo sapiens
uaccaacuggaag

SEQ ID NO: 1383868 - RNA, 13 nt, Homo sapiens
uaccaagcuguga

SEQ ID NO: 1383869 - RNA, 14 nt, Homo sapiens
uaccaaucauuuua

SEQ ID NO: 1383870 - RNA, 15 nt, Homo sapiens
uaccagaucuaauau

SEQ ID NO: 1383871 - RNA, 23 nt, Homo sapiens
uaccauuaaaguucucaaugcaa

SEQ ID NO: 1383872 - RNA, 21 nt, Homo sapiens
uacccaccugagcuuuggacg

SEQ ID NO: 1383873 - RNA, 14 nt, Homo sapiens
uacccagaauguca

SEQ ID NO: 1383874 - RNA, 18 nt, Homo sapiens
uacccuguaacaugcaau

SEQ ID NO: 1383875 - RNA, 17 nt, Homo sapiens
uaccgggcuggccugug

SEQ ID NO: 1383876 - RNA, 17 nt, Homo sapiens
uaccuaguggcccuuca

SEQ ID NO: 1383877 - RNA, 19 nt, Homo sapiens
uaccucacagagugcauug

SEQ ID NO: 1383878 - RNA, 18 nt, Homo sapiens
uaccucacuaugcugcuu

SEQ ID NO: 1383879 - RNA, 13 nt, Homo sapiens
uaccucagccuag

SEQ ID NO: 1383880 - RNA, 17 nt, Homo sapiens
uaccucugauaccucaa

SEQ ID NO: 1383881 - RNA, 18 nt, Homo sapiens
uaccugagucccaaagcu

SEQ ID NO: 1383882 - RNA, 21 nt, Homo sapiens
uaccuuuucucuucauuuucc

SEQ ID NO: 1383883 - RNA, 14 nt, Homo sapiens
uacgcaucagacag

SEQ ID NO: 1383884 - RNA, 13 nt, Homo sapiens
uacgccaggggaa

SEQ ID NO: 1383885 - RNA, 20 nt, Homo sapiens
uacggguguaaacacugaug

SEQ ID NO: 1383886 - RNA, 17 nt, Homo sapiens
uacgugacuguggcaca

SEQ ID NO: 1383887 - RNA, 17 nt, Homo sapiens
uacuaaaaaucaugaga

SEQ ID NO: 1383888 - RNA, 20 nt, Homo sapiens
uacuaacuuuccuucauuca

SEQ ID NO: 1383889 - RNA, 17 nt, Homo sapiens
uacuaaggaaucuuucu

SEQ ID NO: 1383890 - RNA, 12 nt, Homo sapiens
uacuacauacaa

SEQ ID NO: 1383891 - RNA, 14 nt, Homo sapiens
uacuagcaguguuu

SEQ ID NO: 1383892 - RNA, 18 nt, Homo sapiens
uacuaugcucuagagaaa

SEQ ID NO: 1383893 - RNA, 22 nt, Homo sapiens
uacucaccucaccccacugugg

SEQ ID NO: 1383894 - RNA, 17 nt, Homo sapiens
uacuccaggagacccac

SEQ ID NO: 1383895 - RNA, 17 nt, Homo sapiens
uacuccccaacugaguu

SEQ ID NO: 1383896 - RNA, 19 nt, Homo sapiens
uacugauaaccacuccuaa

SEQ ID NO: 1383897 - RNA, 21 nt, Homo sapiens
uacugaugcagaaagaccgug

SEQ ID NO: 1383898 - RNA, 16 nt, Homo sapiens
uacugauggugcauuu

SEQ ID NO: 1383899 - RNA, 22 nt, Homo sapiens
uacugcuucuaccaacuggaag

SEQ ID NO: 1383900 - RNA, 19 nt, Homo sapiens
uacugcuucuuuucacuuc

SEQ ID NO: 1383901 - RNA, 14 nt, Homo sapiens
uacuggugcaguca

SEQ ID NO: 1383902 - RNA, 18 nt, Homo sapiens
uacuguaauagugugauu

SEQ ID NO: 1383903 - RNA, 18 nt, Homo sapiens
uacuguagacucuggaag

SEQ ID NO: 1383904 - RNA, 21 nt, Homo sapiens
uacugugucagggaacauauu

SEQ ID NO: 1383905 - RNA, 13 nt, Homo sapiens
uacuuacguguga

SEQ ID NO: 1383906 - RNA, 20 nt, Homo sapiens
uacuuauauguaaaguauua

SEQ ID NO: 1383907 - RNA, 15 nt, Homo sapiens
uacuuauucauugug

SEQ ID NO: 1383908 - RNA, 17 nt, Homo sapiens
uacuuauucuagauuac

SEQ ID NO: 1383909 - RNA, 21 nt, Homo sapiens
uacuuauuguuuaagguuucc

SEQ ID NO: 1383910 - RNA, 22 nt, Homo sapiens
uacuucaacacuucauguauug

SEQ ID NO: 1383911 - RNA, 19 nt, Homo sapiens
uacuugggagaccuguaau

SEQ ID NO: 1383912 - RNA, 17 nt, Homo sapiens
uacuuguggacacagcu

SEQ ID NO: 1383913 - RNA, 22 nt, Homo sapiens
uagaaaaaaaauaaaacuucaa

SEQ ID NO: 1383914 - RNA, 14 nt, Homo sapiens
uagaaaaaggagcu

SEQ ID NO: 1383915 - RNA, 14 nt, Homo sapiens
uagaaaguucaaaa

SEQ ID NO: 1383916 - RNA, 16 nt, Homo sapiens
uagaaauaauaugcau

SEQ ID NO: 1383917 - RNA, 14 nt, Homo sapiens
uagaaauuccccac

SEQ ID NO: 1383918 - RNA, 17 nt, Homo sapiens
uagaaccuggagccacu

SEQ ID NO: 1383919 - RNA, 18 nt, Homo sapiens
uagaacuauuaaaacagc

SEQ ID NO: 1383920 - RNA, 14 nt, Homo sapiens
uagaagacugucag

SEQ ID NO: 1383921 - RNA, 18 nt, Homo sapiens
uagaagauuuuaugcugc

SEQ ID NO: 1383922 - RNA, 15 nt, Homo sapiens
uagaaggagacagag

SEQ ID NO: 1383923 - RNA, 20 nt, Homo sapiens
uagaaggguaccuugaacac

SEQ ID NO: 1383924 - RNA, 17 nt, Homo sapiens
uagaagucuuagaugua

SEQ ID NO: 1383925 - RNA, 19 nt, Homo sapiens
uagaauaaugugggaagaa

SEQ ID NO: 1383926 - RNA, 15 nt, Homo sapiens
uagaaugaaagacug

SEQ ID NO: 1383927 - RNA, 15 nt, Homo sapiens
uagaaugaugcacau

SEQ ID NO: 1383928 - RNA, 17 nt, Homo sapiens
uagaauuggagaguaaa

SEQ ID NO: 1383929 - RNA, 13 nt, Homo sapiens
uagaauuuauuca

SEQ ID NO: 1383930 - RNA, 14 nt, Homo sapiens
uagacaaaaaccau

SEQ ID NO: 1383931 - RNA, 16 nt, Homo sapiens
uagacaagcuugucca

SEQ ID NO: 1383932 - RNA, 19 nt, Homo sapiens
uagacuuaucugcauauug

SEQ ID NO: 1383933 - RNA, 19 nt, Homo sapiens
uagagaaacacuaaagcau

SEQ ID NO: 1383934 - RNA, 18 nt, Homo sapiens
uagagaauaccaguguua

SEQ ID NO: 1383935 - RNA, 19 nt, Homo sapiens
uagagagggaaggucucag

SEQ ID NO: 1383936 - RNA, 18 nt, Homo sapiens
uagagaucuauguacugu

SEQ ID NO: 1383937 - RNA, 13 nt, Homo sapiens
uagagauggagga

SEQ ID NO: 1383938 - RNA, 14 nt, Homo sapiens
uagagcacacugua

SEQ ID NO: 1383939 - RNA, 21 nt, Homo sapiens
uagagcagccacaaccaaaaa

SEQ ID NO: 1383940 - RNA, 14 nt, Homo sapiens
uagaguauaugcac

SEQ ID NO: 1383941 - RNA, 14 nt, Homo sapiens
uagagucaucucca

SEQ ID NO: 1383942 - RNA, 21 nt, Homo sapiens
uagaguguuuuaaaacauuca

SEQ ID NO: 1383943 - RNA, 16 nt, Homo sapiens
uagaguucagacuuuu

SEQ ID NO: 1383944 - RNA, 16 nt, Homo sapiens
uagaugacauggugaa

SEQ ID NO: 1383945 - RNA, 18 nt, Homo sapiens
uagaugcauguacccuaa

SEQ ID NO: 1383946 - RNA, 17 nt, Homo sapiens
uagauguauauauuucc

SEQ ID NO: 1383947 - RNA, 16 nt, Homo sapiens
uagaugugucuuacca

SEQ ID NO: 1383948 - RNA, 14 nt, Homo sapiens
uagauuaaacaaac

SEQ ID NO: 1383949 - RNA, 15 nt, Homo sapiens
uagauuaaacaaaca

SEQ ID NO: 1383950 - RNA, 17 nt, Homo sapiens
uagauuuccacacgcca

SEQ ID NO: 1383951 - RNA, 23 nt, Homo sapiens
uagauuuuagacccuauugcugc

SEQ ID NO: 1383952 - RNA, 12 nt, Homo sapiens
uagcacauacua

SEQ ID NO: 1383953 - RNA, 15 nt, Homo sapiens
uagcacuacaaacac

SEQ ID NO: 1383954 - RNA, 18 nt, Homo sapiens
uagcaggaagcugugaga

SEQ ID NO: 1383955 - RNA, 20 nt, Homo sapiens
uagcaguucugcaaauagaa

SEQ ID NO: 1383956 - RNA, 20 nt, Homo sapiens
uagcaugaauccuacauaca

SEQ ID NO: 1383957 - RNA, 15 nt, Homo sapiens
uagcaugcacaaagu

SEQ ID NO: 1383958 - RNA, 16 nt, Homo sapiens
uagcauugagugcuuu

SEQ ID NO: 1383959 - RNA, 13 nt, Homo sapiens
uagccaccccaga

SEQ ID NO: 1383960 - RNA, 19 nt, Homo sapiens
uagccaucuugaagugaug

SEQ ID NO: 1383961 - RNA, 21 nt, Homo sapiens
uagccccaacccaaaccugga

SEQ ID NO: 1383962 - RNA, 16 nt, Homo sapiens
uagccgaaaugaucuu

SEQ ID NO: 1383963 - RNA, 17 nt, Homo sapiens
uagccuuagaagucaca

SEQ ID NO: 1383964 - RNA, 18 nt, Homo sapiens
uagccuuagaagucacac

SEQ ID NO: 1383965 - RNA, 20 nt, Homo sapiens
uagcgcugccgcaccccaga

SEQ ID NO: 1383966 - RNA, 17 nt, Homo sapiens
uagcuagaagugggcca

SEQ ID NO: 1383967 - RNA, 23 nt, Homo sapiens
uagcuauauccauguacuguagu

SEQ ID NO: 1383968 - RNA, 13 nt, Homo sapiens
uagcuaugugacc

SEQ ID NO: 1383969 - RNA, 12 nt, Homo sapiens
uagcucuuuucu

SEQ ID NO: 1383970 - RNA, 17 nt, Homo sapiens
uagcugaguaugcugaa

SEQ ID NO: 1383971 - RNA, 15 nt, Homo sapiens
uagcugggacuacag

SEQ ID NO: 1383972 - RNA, 18 nt, Homo sapiens
uagcugggacuacaggug

SEQ ID NO: 1383973 - RNA, 13 nt, Homo sapiens
uagcuugcaccuu

SEQ ID NO: 1383974 - RNA, 23 nt, Homo sapiens
uagcuuuaaaaccugugugccau

SEQ ID NO: 1383975 - RNA, 22 nt, Homo sapiens
uagcuuuccacauuugucacag

SEQ ID NO: 1383976 - RNA, 21 nt, Homo sapiens
uaggaaaauauggguugcauu

SEQ ID NO: 1383977 - RNA, 16 nt, Homo sapiens
uaggaacgguaaauuu

SEQ ID NO: 1383978 - RNA, 16 nt, Homo sapiens
uaggacucugaggcuc

SEQ ID NO: 1383979 - RNA, 15 nt, Homo sapiens
uaggagacuaaugga

SEQ ID NO: 1383980 - RNA, 19 nt, Homo sapiens
uaggagagagaucaugaga

SEQ ID NO: 1383981 - RNA, 20 nt, Homo sapiens
uaggagggcuggcaacuuag

SEQ ID NO: 1383982 - RNA, 20 nt, Homo sapiens
uaggcacccauccuagagaa

SEQ ID NO: 1383983 - RNA, 12 nt, Homo sapiens
uaggcagggaag

SEQ ID NO: 1383984 - RNA, 15 nt, Homo sapiens
uaggcauuugcugaa

SEQ ID NO: 1383985 - RNA, 14 nt, Homo sapiens
uaggcuauucacaa

SEQ ID NO: 1383986 - RNA, 15 nt, Homo sapiens
uagggaguaccugcu

SEQ ID NO: 1383987 - RNA, 21 nt, Homo sapiens
uaggguagaggggaagucaga

SEQ ID NO: 1383988 - RNA, 13 nt, Homo sapiens
uaggucaagaaga

SEQ ID NO: 1383989 - RNA, 14 nt, Homo sapiens
uagguuuacauuca

SEQ ID NO: 1383990 - RNA, 14 nt, Homo sapiens
uaguaaaagccauc

SEQ ID NO: 1383991 - RNA, 16 nt, Homo sapiens
uaguaagagauuccug

SEQ ID NO: 1383992 - RNA, 16 nt, Homo sapiens
uagucaaggaggaaag

SEQ ID NO: 1383993 - RNA, 13 nt, Homo sapiens
uagucaauaucaa

SEQ ID NO: 1383994 - RNA, 15 nt, Homo sapiens
uagugcccucaucca

SEQ ID NO: 1383995 - RNA, 17 nt, Homo sapiens
uagugguggcagugcag

SEQ ID NO: 1383996 - RNA, 18 nt, Homo sapiens
uaguuacucauucaggga

SEQ ID NO: 1383997 - RNA, 15 nt, Homo sapiens
uaguuguaucucuuu

SEQ ID NO: 1383998 - RNA, 22 nt, Homo sapiens
uaguugugcaugccuggcacaa

SEQ ID NO: 1383999 - RNA, 17 nt, Homo sapiens
uaguuuggauuacuuaa

SEQ ID NO: 1384000 - RNA, 13 nt, Homo sapiens
uaguuuucauaca

SEQ ID NO: 1384001 - RNA, 13 nt, Homo sapiens
uauaaacauauca

SEQ ID NO: 1384002 - RNA, 22 nt, Homo sapiens
uauaaauaaaacauuuucacac

SEQ ID NO: 1384003 - RNA, 15 nt, Homo sapiens
uauaaaucagccuaa

SEQ ID NO: 1384004 - RNA, 18 nt, Homo sapiens
uauaaauuuguguucuca

SEQ ID NO: 1384005 - RNA, 20 nt, Homo sapiens
uauaacuaguccuuuacuaa

SEQ ID NO: 1384006 - RNA, 19 nt, Homo sapiens
uauaacuccuuguuucaga

SEQ ID NO: 1384007 - RNA, 19 nt, Homo sapiens
uauaagauucauauuuacu

SEQ ID NO: 1384008 - RNA, 15 nt, Homo sapiens
uauaauauacuaugc

SEQ ID NO: 1384009 - RNA, 12 nt, Homo sapiens
uauaaucuacuc

SEQ ID NO: 1384010 - RNA, 16 nt, Homo sapiens
uauaauguaagcucua

SEQ ID NO: 1384011 - RNA, 19 nt, Homo sapiens
uauaauugccacugagaga

SEQ ID NO: 1384012 - RNA, 21 nt, Homo sapiens
uauacaagauaagcuuccagg

SEQ ID NO: 1384013 - RNA, 23 nt, Homo sapiens
uauacacuuacacuuuaugcaca

SEQ ID NO: 1384014 - RNA, 12 nt, Homo sapiens
uauacaugacuu

SEQ ID NO: 1384015 - RNA, 14 nt, Homo sapiens
uauagacucuagga

SEQ ID NO: 1384016 - RNA, 17 nt, Homo sapiens
uauagaucacauaacag

SEQ ID NO: 1384017 - RNA, 16 nt, Homo sapiens
uauagcaagaucccau

SEQ ID NO: 1384018 - RNA, 22 nt, Homo sapiens
uauaggaucauuuguuggaaug

SEQ ID NO: 1384019 - RNA, 15 nt, Homo sapiens
uauaggucacuccug

SEQ ID NO: 1384020 - RNA, 14 nt, Homo sapiens
uauaguacuggcau

SEQ ID NO: 1384021 - RNA, 20 nt, Homo sapiens
uauaguuaucaaucucuagu

SEQ ID NO: 1384022 - RNA, 21 nt, Homo sapiens
uauaguuuauugacaauaauu

SEQ ID NO: 1384023 - RNA, 15 nt, Homo sapiens
uauauaaacauauca

SEQ ID NO: 1384024 - RNA, 13 nt, Homo sapiens
uauauaacuaaca

SEQ ID NO: 1384025 - RNA, 17 nt, Homo sapiens
uccaguccugcucucua

SEQ ID NO: 1384026 - RNA, 13 nt, Homo sapiens
uccagucuuccac

SEQ ID NO: 1384027 - RNA, 19 nt, Homo sapiens
uccagucuuccaccuggaa

SEQ ID NO: 1384028 - RNA, 11 nt, Homo sapiens
uccagugcagg

SEQ ID NO: 1384029 - RNA, 13 nt, Homo sapiens
uccagugcaggag

SEQ ID NO: 1384030 - RNA, 15 nt, Homo sapiens
uccaguucaugagaa

SEQ ID NO: 1384031 - RNA, 20 nt, Homo sapiens
uccauauggcaauaggugug

SEQ ID NO: 1384032 - RNA, 17 nt, Homo sapiens
uccaucagcuguaagaa

SEQ ID NO: 1384033 - RNA, 14 nt, Homo sapiens
uccaucccuacccc

SEQ ID NO: 1384034 - RNA, 18 nt, Homo sapiens
uccaucgcugucaucuca

SEQ ID NO: 1384035 - RNA, 23 nt, Homo sapiens
uccaugacugcauuuuacuguac

SEQ ID NO: 1384036 - RNA, 14 nt, Homo sapiens
uccaugccugggaa

SEQ ID NO: 1384037 - RNA, 18 nt, Homo sapiens
uccaugcugagaacaaaa

SEQ ID NO: 1384038 - RNA, 16 nt, Homo sapiens
uccaugcugccuccag

SEQ ID NO: 1384039 - RNA, 23 nt, Homo sapiens
uccaugguggaaguuaaagggca

SEQ ID NO: 1384040 - RNA, 16 nt, Homo sapiens
uccaugugcccaguua

SEQ ID NO: 1384041 - RNA, 15 nt, Homo sapiens
uccaugugugugcaa

SEQ ID NO: 1384042 - RNA, 17 nt, Homo sapiens
uccaugugugugcaagu

SEQ ID NO: 1384043 - RNA, 18 nt, Homo sapiens
uccaugugugugcaagug

SEQ ID NO: 1384044 - RNA, 19 nt, Homo sapiens
uccauuuacccuucuuuuc

SEQ ID NO: 1384045 - RNA, 22 nt, Homo sapiens
uccauuugugugugugcaagug

SEQ ID NO: 1384046 - RNA, 16 nt, Homo sapiens
ucccaaagagcugccu

SEQ ID NO: 1384047 - RNA, 21 nt, Homo sapiens
ucccaacuuguauuaaagaca

SEQ ID NO: 1384048 - RNA, 14 nt, Homo sapiens
ucccacagcacuaa

SEQ ID NO: 1384049 - RNA, 12 nt, Homo sapiens
ucccaccacagc

SEQ ID NO: 1384050 - RNA, 17 nt, Homo sapiens
ucccagcuacucaggag

SEQ ID NO: 1384051 - RNA, 15 nt, Homo sapiens
ucccagcuacucggg

SEQ ID NO: 1384052 - RNA, 16 nt, Homo sapiens
ucccagcuacucggga

SEQ ID NO: 1384053 - RNA, 20 nt, Homo sapiens
ucccaggcuggagugcagug

SEQ ID NO: 1384054 - RNA, 13 nt, Homo sapiens
ucccagggccaug

SEQ ID NO: 1384055 - RNA, 22 nt, Homo sapiens
ucccaucacuucccuacaugga

SEQ ID NO: 1384056 - RNA, 11 nt, Homo sapiens
ucccaucccau

SEQ ID NO: 1384057 - RNA, 16 nt, Homo sapiens
ucccaugcugaccugu

SEQ ID NO: 1384058 - RNA, 16 nt, Homo sapiens
uccccaaccacuucau

SEQ ID NO: 1384059 - RNA, 17 nt, Homo sapiens
uccccaacugaguucaa

SEQ ID NO: 1384060 - RNA, 13 nt, Homo sapiens
uccccacugccug

SEQ ID NO: 1384061 - RNA, 17 nt, Homo sapiens
ucccccucucccaguug

SEQ ID NO: 1384062 - RNA, 15 nt, Homo sapiens
uccccgugggccaug

SEQ ID NO: 1384063 - RNA, 16 nt, Homo sapiens
uccccuuuuucuuccu

SEQ ID NO: 1384064 - RNA, 15 nt, Homo sapiens
ucccggccauucucc

SEQ ID NO: 1384065 - RNA, 18 nt, Homo sapiens
ucccggggcuccacugaa

SEQ ID NO: 1384066 - RNA, 12 nt, Homo sapiens
ucccuaccucag

SEQ ID NO: 1384067 - RNA, 17 nt, Homo sapiens
ucccuagggccuucaga

SEQ ID NO: 1384068 - RNA, 16 nt, Homo sapiens
ucccuauaaugcugga

SEQ ID NO: 1384069 - RNA, 21 nt, Homo sapiens
ucccucaaagcacacgucaug

SEQ ID NO: 1384070 - RNA, 21 nt, Homo sapiens
ucccucaaagcuuccauucca

SEQ ID NO: 1384071 - RNA, 18 nt, Homo sapiens
ucccucacuguugaauuu

SEQ ID NO: 1384072 - RNA, 19 nt, Homo sapiens
ucccucgaacccacacugc

SEQ ID NO: 1384073 - RNA, 13 nt, Homo sapiens
ucccugggcauug

SEQ ID NO: 1384074 - RNA, 16 nt, Homo sapiens
ucccuucccauaagcu

SEQ ID NO: 1384075 - RNA, 15 nt, Homo sapiens
ucccuucuacugcuu

SEQ ID NO: 1384076 - RNA, 16 nt, Homo sapiens
ucccuuggccucagaa

SEQ ID NO: 1384077 - RNA, 17 nt, Homo sapiens
ucccuuuaucaguuuga

SEQ ID NO: 1384078 - RNA, 22 nt, Homo sapiens
ucccuuuccagauauucaaguc

SEQ ID NO: 1384079 - RNA, 18 nt, Homo sapiens
ucccuuugaaaugaauau

SEQ ID NO: 1384080 - RNA, 21 nt, Homo sapiens
ucccuuuucuugacuauugga

SEQ ID NO: 1384081 - RNA, 18 nt, Homo sapiens
uccggaauccuguccuca

SEQ ID NO: 1384082 - RNA, 15 nt, Homo sapiens
uccgguggaaggccu

SEQ ID NO: 1384083 - RNA, 20 nt, Homo sapiens
uccguggcacugcauacaau

SEQ ID NO: 1384084 - RNA, 21 nt, Homo sapiens
uccuaaacuguuuauuugcac

SEQ ID NO: 1384085 - RNA, 19 nt, Homo sapiens
uccuaauauuuugauucau

SEQ ID NO: 1384086 - RNA, 14 nt, Homo sapiens
uccuacaagcuaaa

SEQ ID NO: 1384087 - RNA, 17 nt, Homo sapiens
uccuacaguggcuguca

SEQ ID NO: 1384088 - RNA, 20 nt, Homo sapiens
uccuagaaacugacacaugc

SEQ ID NO: 1384089 - RNA, 19 nt, Homo sapiens
uccuaggccacaccaucuc

SEQ ID NO: 1384090 - RNA, 20 nt, Homo sapiens
uccuaggccacaccaucucc

SEQ ID NO: 1384091 - RNA, 16 nt, Homo sapiens
uccuaucccaucccau

SEQ ID NO: 1384092 - RNA, 15 nt, Homo sapiens
uccuauguaacugca

SEQ ID NO: 1384093 - RNA, 23 nt, Homo sapiens
uccucacaucuuucacacuucca

SEQ ID NO: 1384094 - RNA, 20 nt, Homo sapiens
uccucaccucuggacuggcu

SEQ ID NO: 1384095 - RNA, 13 nt, Homo sapiens
uccucacugaaaa

SEQ ID NO: 1384096 - RNA, 21 nt, Homo sapiens
uccucauuagcauuuugcuaa

SEQ ID NO: 1384097 - RNA, 20 nt, Homo sapiens
uccuccagaagccucuggcu

SEQ ID NO: 1384098 - RNA, 14 nt, Homo sapiens
uccucccaaaagua

SEQ ID NO: 1384099 - RNA, 14 nt, Homo sapiens
uccucccaccucag

SEQ ID NO: 1384100 - RNA, 17 nt, Homo sapiens
uccucccccagcuaucu

SEQ ID NO: 1384101 - RNA, 13 nt, Homo sapiens
uccucuauuuccu

SEQ ID NO: 1384102 - RNA, 14 nt, Homo sapiens
uccucuauuuccua

SEQ ID NO: 1384103 - RNA, 18 nt, Homo sapiens
uccucuccacugccuucg

SEQ ID NO: 1384104 - RNA, 11 nt, Homo sapiens
uccucuucuau

SEQ ID NO: 1384105 - RNA, 14 nt, Homo sapiens
uccucuugccacug

SEQ ID NO: 1384106 - RNA, 16 nt, Homo sapiens
uccucuuguugcugag

SEQ ID NO: 1384107 - RNA, 19 nt, Homo sapiens
uccugacagaaggacucag

SEQ ID NO: 1384108 - RNA, 19 nt, Homo sapiens
uccugaccucgugauccac

SEQ ID NO: 1384109 - RNA, 19 nt, Homo sapiens
uccugaggggcaucugccc

SEQ ID NO: 1384110 - RNA, 20 nt, Homo sapiens
uccugauauagaucacauaa

SEQ ID NO: 1384111 - RNA, 10 nt, Homo sapiens
uccugccacc

SEQ ID NO: 1384112 - RNA, 20 nt, Homo sapiens
uccugcccaccugucaaaca

SEQ ID NO: 1384113 - RNA, 17 nt, Homo sapiens
uccugcugcuucugcaa

SEQ ID NO: 1384114 - RNA, 18 nt, Homo sapiens
uccuggacucaaaguauc

SEQ ID NO: 1384115 - RNA, 14 nt, Homo sapiens
uccuggcugagaga

SEQ ID NO: 1384116 - RNA, 21 nt, Homo sapiens
uccugggcagcauacugagac

SEQ ID NO: 1384117 - RNA, 21 nt, Homo sapiens
uccugguuugaagaaauaaca

SEQ ID NO: 1384118 - RNA, 17 nt, Homo sapiens
uccuguacuuuuuccag

SEQ ID NO: 1384119 - RNA, 16 nt, Homo sapiens
uccuguagucccauug

SEQ ID NO: 1384120 - RNA, 22 nt, Homo sapiens
uccuguauucuacagcagauac

SEQ ID NO: 1384121 - RNA, 15 nt, Homo sapiens
uccugucuggcauuu

SEQ ID NO: 1384122 - RNA, 20 nt, Homo sapiens
uccugugucuugcaauggca

SEQ ID NO: 1384123 - RNA, 19 nt, Homo sapiens
uccuguuagcauaauguga

SEQ ID NO: 1384124 - RNA, 18 nt, Homo sapiens
uccuguugagauggggga

SEQ ID NO: 1384125 - RNA, 15 nt, Homo sapiens
uccuucauucaaccc

SEQ ID NO: 1384126 - RNA, 12 nt, Homo sapiens
uccuuccauccc

SEQ ID NO: 1384127 - RNA, 20 nt, Homo sapiens
uccuuccugccaccugcugc

SEQ ID NO: 1384128 - RNA, 22 nt, Homo sapiens
uccuuccugccaccugcugcug

SEQ ID NO: 1384129 - RNA, 18 nt, Homo sapiens
uccuuccugucuuccugc

SEQ ID NO: 1384130 - RNA, 13 nt, Homo sapiens
uccuugauucaca

SEQ ID NO: 1384131 - RNA, 22 nt, Homo sapiens
uccuugauuuaucacacaaagc

SEQ ID NO: 1384132 - RNA, 15 nt, Homo sapiens
uccuuggaaauugga

SEQ ID NO: 1384133 - RNA, 21 nt, Homo sapiens
uccuuggaagagaaugucuga

SEQ ID NO: 1384134 - RNA, 22 nt, Homo sapiens
uccuugggaggccccacugggg

SEQ ID NO: 1384135 - RNA, 18 nt, Homo sapiens
uccuugggaugaucuuga

SEQ ID NO: 1384136 - RNA, 12 nt, Homo sapiens
uccuuggggaca

SEQ ID NO: 1384137 - RNA, 20 nt, Homo sapiens
uccuuguauuuaaauauuaa

SEQ ID NO: 1384138 - RNA, 15 nt, Homo sapiens
ucugaucaaguauuu

SEQ ID NO: 1384139 - RNA, 22 nt, Homo sapiens
ucugaucauccacugugccaug

SEQ ID NO: 1384140 - RNA, 13 nt, Homo sapiens
ucugaugcaagca

SEQ ID NO: 1384141 - RNA, 21 nt, Homo sapiens
ucugaugcaagcaagaaacac

SEQ ID NO: 1384142 - RNA, 24 nt, Homo sapiens
ucugcacgcuuugggguguggaug

SEQ ID NO: 1384143 - RNA, 16 nt, Homo sapiens
ucugcacuggugugag

SEQ ID NO: 1384144 - RNA, 17 nt, Homo sapiens
ucugcauuuagcacaaa

SEQ ID NO: 1384145 - RNA, 19 nt, Homo sapiens
ucugcauuuagcacaaaaa

SEQ ID NO: 1384146 - RNA, 22 nt, Homo sapiens
ucugcauuuucugaaacuaaug

SEQ ID NO: 1384147 - RNA, 16 nt, Homo sapiens
ucugcccagaauucua

SEQ ID NO: 1384148 - RNA, 13 nt, Homo sapiens
ucugcccauuccc

SEQ ID NO: 1384149 - RNA, 16 nt, Homo sapiens
ucugccgugugcccuc

SEQ ID NO: 1384150 - RNA, 15 nt, Homo sapiens
ucugccuauugcagc

SEQ ID NO: 1384151 - RNA, 19 nt, Homo sapiens
ucugccucugacacacagc

SEQ ID NO: 1384152 - RNA, 17 nt, Homo sapiens
ucugccugaagucacac

SEQ ID NO: 1384153 - RNA, 22 nt, Homo sapiens
ucugcuauggaaugccccaugg

SEQ ID NO: 1384154 - RNA, 21 nt, Homo sapiens
ucugcuuuaauggcuuuacaa

SEQ ID NO: 1384155 - RNA, 14 nt, Homo sapiens
ucuggaaaagcaaa

SEQ ID NO: 1384156 - RNA, 19 nt, Homo sapiens
ucuggaauugauauugaau

SEQ ID NO: 1384157 - RNA, 15 nt, Homo sapiens
ucgcgccacugcacu

SEQ ID NO: 1384158 - RNA, 15 nt, Homo sapiens
ucgcuugaacccagg

SEQ ID NO: 1384159 - RNA, 20 nt, Homo sapiens
ucggaagcuccagaagaaca

SEQ ID NO: 1384160 - RNA, 14 nt, Homo sapiens
ucgggaacaguguu

SEQ ID NO: 1384161 - RNA, 18 nt, Homo sapiens
ucgucagcuggcacuguc

SEQ ID NO: 1384162 - RNA, 13 nt, Homo sapiens
ucguggccuuccc

SEQ ID NO: 1384163 - RNA, 21 nt, Homo sapiens
ucguggguguguguagccaag

SEQ ID NO: 1384164 - RNA, 15 nt, Homo sapiens
ucguuugaaucacag

SEQ ID NO: 1384165 - RNA, 19 nt, Homo sapiens
ucguuugaaucacaguaua

SEQ ID NO: 1384166 - RNA, 16 nt, Homo sapiens
ucuaaacuuuaauuca

SEQ ID NO: 1384167 - RNA, 20 nt, Homo sapiens
ucuaaagguggugaggcaau

SEQ ID NO: 1384168 - RNA, 23 nt, Homo sapiens
ucuaaaugcauauccugagccau

SEQ ID NO: 1384169 - RNA, 21 nt, Homo sapiens
ucuaaauguggagaaacugua

SEQ ID NO: 1384170 - RNA, 16 nt, Homo sapiens
ucuaacaaaaacuaca

SEQ ID NO: 1384171 - RNA, 20 nt, Homo sapiens
ucuaacuagaaaucugccaa

SEQ ID NO: 1384172 - RNA, 17 nt, Homo sapiens
ucuaacuccagugaagu

SEQ ID NO: 1384173 - RNA, 17 nt, Homo sapiens
ucuaaguaaugaugucg

SEQ ID NO: 1384174 - RNA, 20 nt, Homo sapiens
ucuaaguggaaaaaguauua

SEQ ID NO: 1384175 - RNA, 19 nt, Homo sapiens
ucuaaugugccuaguucuu

SEQ ID NO: 1384176 - RNA, 18 nt, Homo sapiens
cgugaccugccaggcaca

SEQ ID NO: 1384177 - RNA, 16 nt, Homo sapiens
cgugacuguggcacac

SEQ ID NO: 1384178 - RNA, 13 nt, Homo sapiens
cgugauaaugcag

SEQ ID NO: 1384179 - RNA, 17 nt, Homo sapiens
cgugcacgcacacuguc

SEQ ID NO: 1384180 - RNA, 9 nt, Homo sapiens
cgugcccuc

SEQ ID NO: 1384181 - RNA, 18 nt, Homo sapiens
cgugcuuguuugcucacc

SEQ ID NO: 1384182 - RNA, 22 nt, Homo sapiens
cgugugcgugcaugugcacuug

SEQ ID NO: 1384183 - RNA, 16 nt, Homo sapiens
cugcuaccucacuggg

SEQ ID NO: 1384184 - RNA, 12 nt, Homo sapiens
cugcuacugugu

SEQ ID NO: 1384185 - RNA, 20 nt, Homo sapiens
cugcuauuuuacugucuuaa

SEQ ID NO: 1384186 - RNA, 22 nt, Homo sapiens
cugcucaagagaagcacaugaa

SEQ ID NO: 1384187 - RNA, 14 nt, Homo sapiens
cugcuccaccacau

SEQ ID NO: 1384188 - RNA, 16 nt, Homo sapiens
cugcuccagugcagga

SEQ ID NO: 1384189 - RNA, 18 nt, Homo sapiens
cugcucugaacacgaagc

SEQ ID NO: 1384190 - RNA, 15 nt, Homo sapiens
cugcucuuaggugcu

SEQ ID NO: 1384191 - RNA, 13 nt, Homo sapiens
cugcugaugcuca

SEQ ID NO: 1384192 - RNA, 20 nt, Homo sapiens
cucaaauauuugcuaugaag

SEQ ID NO: 1384193 - RNA, 18 nt, Homo sapiens
cucaaaugcacaucucau

SEQ ID NO: 1384194 - RNA, 20 nt, Homo sapiens
cucaaauucauggugcacug

SEQ ID NO: 1384195 - RNA, 18 nt, Homo sapiens
cucaagaaacaacuucua

SEQ ID NO: 1384196 - RNA, 15 nt, Homo sapiens
cucaaggacuugaaa

SEQ ID NO: 1384197 - RNA, 23 nt, Homo sapiens
cucaaggguuauagacugccaug

SEQ ID NO: 1384198 - RNA, 20 nt, Homo sapiens
cucaaguucauugaugaccc

SEQ ID NO: 1384199 - RNA, 15 nt, Homo sapiens
cucaaugcacugaca

SEQ ID NO: 1384200 - RNA, 19 nt, Homo sapiens
gcuccaguugucuauucau

SEQ ID NO: 1384201 - RNA, 16 nt, Homo sapiens
gcuccauucaaaguga

SEQ ID NO: 1384202 - RNA, 14 nt, Homo sapiens
gcucccagggccau

SEQ ID NO: 1384203 - RNA, 17 nt, Homo sapiens
gcucccagggccaugaa

SEQ ID NO: 1384204 - RNA, 12 nt, Homo sapiens
gcucccaugacc

SEQ ID NO: 1384205 - RNA, 13 nt, Homo sapiens
gcuccccagugaa

SEQ ID NO: 1384206 - RNA, 14 nt, Homo sapiens
gcuccuaagccaug

SEQ ID NO: 1384207 - RNA, 23 nt, Homo sapiens
gcuccugggaaggcuacucaccu

SEQ ID NO: 1384208 - RNA, 15 nt, Homo sapiens
gcuccugucugccag

SEQ ID NO: 1384209 - RNA, 19 nt, Homo sapiens
gcucgcauuugucaaugac

SEQ ID NO: 1384210 - RNA, 21 nt, Homo sapiens
gcucuagccugggcaacaaca

SEQ ID NO: 1384211 - RNA, 16 nt, Homo sapiens
gcucugcugacagaca

SEQ ID NO: 1384212 - RNA, 17 nt, Homo sapiens
gcucugcuggucuucaa

SEQ ID NO: 1384213 - RNA, 15 nt, Homo sapiens
gcucugucucaaaag

SEQ ID NO: 1384214 - RNA, 19 nt, Homo sapiens
gcucugucuucuuugccca

SEQ ID NO: 1384215 - RNA, 20 nt, Homo sapiens
gcucugucuucuuugcccac

SEQ ID NO: 1384216 - RNA, 14 nt, Homo sapiens
gcucuuaugccauu

SEQ ID NO: 1384217 - RNA, 20 nt, Homo sapiens
gcugaaaacugcaacuugua

SEQ ID NO: 1384218 - RNA, 14 nt, Homo sapiens
gcugacucccuagg

SEQ ID NO: 1384219 - RNA, 18 nt, Homo sapiens
gcugacuguacuccuccc

SEQ ID NO: 1384220 - RNA, 12 nt, Homo sapiens
gcugagaacaaa

SEQ ID NO: 1384221 - RNA, 15 nt, Homo sapiens
gcugagagaaccuca

SEQ ID NO: 1384222 - RNA, 14 nt, Homo sapiens
gcugagagacccaa

SEQ ID NO: 1384223 - RNA, 20 nt, Homo sapiens
gcugaggcauccuuccucac

SEQ ID NO: 1384224 - RNA, 21 nt, Homo sapiens
gcugaggggaggaucacugga

SEQ ID NO: 1384225 - RNA, 22 nt, Homo sapiens
gcugaguuucucuuggguauaa

SEQ ID NO: 1384226 - RNA, 21 nt, Homo sapiens
gcugaugaacucuuaaucaaa

SEQ ID NO: 1384227 - RNA, 15 nt, Homo sapiens
gcugauuuuaacaau

SEQ ID NO: 1384228 - RNA, 18 nt, Homo sapiens
gcugcaucuccccucaga

SEQ ID NO: 1384229 - RNA, 19 nt, Homo sapiens
gcugcaucuccccucagau

SEQ ID NO: 1384230 - RNA, 21 nt, Homo sapiens
gcugcaucuccccucagauuc

SEQ ID NO: 1384231 - RNA, 14 nt, Homo sapiens
gcugccaagcccca

SEQ ID NO: 1384232 - RNA, 22 nt, Homo sapiens
gcugccaagccccauccugccg

SEQ ID NO: 1384233 - RNA, 20 nt, Homo sapiens
gcugccauccagggaugcca

SEQ ID NO: 1384234 - RNA, 15 nt, Homo sapiens
gcugccucccugucc

SEQ ID NO: 1384235 - RNA, 13 nt, Homo sapiens
gcugcuagcacuu

SEQ ID NO: 1384236 - RNA, 13 nt, Homo sapiens
gcugcuccagugc

SEQ ID NO: 1384237 - RNA, 14 nt, Homo sapiens
gcugcugaccucca

SEQ ID NO: 1384238 - RNA, 11 nt, Homo sapiens
gcugcugcuaa

SEQ ID NO: 1384239 - RNA, 23 nt, Homo sapiens
gcugcugcuuagcuugcaccuug

SEQ ID NO: 1384240 - RNA, 23 nt, Homo sapiens
gcugcuggaggaaaacugagacu

SEQ ID NO: 1384241 - RNA, 19 nt, Homo sapiens
gcugcuucugcaaaaaacu

SEQ ID NO: 1384242 - RNA, 20 nt, Homo sapiens
gcugcuuucuuguugcugca

SEQ ID NO: 1384243 - RNA, 21 nt, Homo sapiens
gcuggaccaguggugccuugg

SEQ ID NO: 1384244 - RNA, 15 nt, Homo sapiens
gcuggcccagccaaa

SEQ ID NO: 1384245 - RNA, 19 nt, Homo sapiens
gcuggcccgucauguuccu

SEQ ID NO: 1384246 - RNA, 13 nt, Homo sapiens
gcuggcuugcagu

SEQ ID NO: 1384247 - RNA, 14 nt, Homo sapiens
gcugggcagcuguu

SEQ ID NO: 1384248 - RNA, 21 nt, Homo sapiens
gcugggccuucggggugagcc

SEQ ID NO: 1384249 - RNA, 13 nt, Homo sapiens
gcuggguuuacac

SEQ ID NO: 1384250 - RNA, 15 nt, Homo sapiens
gcugguaagggccaa

SEQ ID NO: 1384251 - RNA, 19 nt, Homo sapiens
gcuggucucugcugaaggu

SEQ ID NO: 1384252 - RNA, 13 nt, Homo sapiens
gcuggucuucaau

SEQ ID NO: 1384253 - RNA, 17 nt, Homo sapiens
gcugguugagguuucaa

SEQ ID NO: 1384254 - RNA, 23 nt, Homo sapiens
gcuguaucaaacuagugcaugaa

SEQ ID NO: 1384255 - RNA, 15 nt, Homo sapiens
gcugucuuucacuga

SEQ ID NO: 1384256 - RNA, 18 nt, Homo sapiens
gcugugaaagaaccaaaa

SEQ ID NO: 1384257 - RNA, 20 nt, Homo sapiens
gcuguuuccauagggugaca

SEQ ID NO: 1384258 - RNA, 15 nt, Homo sapiens
gcuuaggacuuucca

SEQ ID NO: 1384259 - RNA, 23 nt, Homo sapiens
gcuuaguucaaguccugccucuu

SEQ ID NO: 1384260 - RNA, 14 nt, Homo sapiens
gcuuauccuuccac

SEQ ID NO: 1384261 - RNA, 17 nt, Homo sapiens
gcuuauguuagaaauaa

SEQ ID NO: 1384262 - RNA, 15 nt, Homo sapiens
gcuucaguggcagcu

SEQ ID NO: 1384263 - RNA, 16 nt, Homo sapiens
gcuucauauaccagca

SEQ ID NO: 1384264 - RNA, 23 nt, Homo sapiens
gcuuccauuugugugugugcaag

SEQ ID NO: 1384265 - RNA, 20 nt, Homo sapiens
gcuucccugucuauugccuu

SEQ ID NO: 1384266 - RNA, 14 nt, Homo sapiens
gcuuccuaacugcu

SEQ ID NO: 1384267 - RNA, 16 nt, Homo sapiens
gcuucuaccaacugga

SEQ ID NO: 1384268 - RNA, 19 nt, Homo sapiens
gcuucucugugacugaugu

SEQ ID NO: 1384269 - RNA, 15 nt, Homo sapiens
gcuucucuugccuaa

SEQ ID NO: 1384270 - RNA, 23 nt, Homo sapiens
gcuugauugcguggaauugugcu

SEQ ID NO: 1384271 - RNA, 21 nt, Homo sapiens
gcuugccccacccaacaagcc

SEQ ID NO: 1384272 - RNA, 20 nt, Homo sapiens
gcuuguaaauagcucaggug

SEQ ID NO: 1384273 - RNA, 22 nt, Homo sapiens
gcuuguaacuccaccaacccau

SEQ ID NO: 1384274 - RNA, 20 nt, Homo sapiens
gcuuguacagaagagacagu

SEQ ID NO: 1384275 - RNA, 18 nt, Homo sapiens
gcuugugggacuagccug

SEQ ID NO: 1384276 - RNA, 14 nt, Homo sapiens
gcuuguguuuuuaa

SEQ ID NO: 1384277 - RNA, 20 nt, Homo sapiens
gcuuuagaauguuuuccuuc

SEQ ID NO: 1384278 - RNA, 16 nt, Homo sapiens
gcuuucagagccuccu

SEQ ID NO: 1384279 - RNA, 20 nt, Homo sapiens
gcuuuccacauuugucacag

SEQ ID NO: 1384280 - RNA, 19 nt, Homo sapiens
gcuuuccguggcacugcau

SEQ ID NO: 1384281 - RNA, 16 nt, Homo sapiens
gcuuucuacccagcga

SEQ ID NO: 1384282 - RNA, 18 nt, Homo sapiens
gcuuucuuaucccaguga

SEQ ID NO: 1384283 - RNA, 19 nt, Homo sapiens
gcuuugccccugagacaaa

SEQ ID NO: 1384284 - RNA, 20 nt, Homo sapiens
gcuuuggacacacacagcuu

SEQ ID NO: 1384285 - RNA, 19 nt, Homo sapiens
gcuuuggacgcacacagcu

SEQ ID NO: 1384286 - RNA, 20 nt, Homo sapiens
gcuuuggacgcacacagcuu

SEQ ID NO: 1384287 - RNA, 13 nt, Homo sapiens
gcuuugguuuaaa

SEQ ID NO: 1384288 - RNA, 17 nt, Homo sapiens
gcuuugucccacagcuu

SEQ ID NO: 1384289 - RNA, 13 nt, Homo sapiens
gcuuuucuuccua

SEQ ID NO: 1384290 - RNA, 20 nt, Homo sapiens
ggaaaacugagacucagaca

SEQ ID NO: 1384291 - RNA, 13 nt, Homo sapiens
ggaaaagcaaaac

SEQ ID NO: 1384292 - RNA, 13 nt, Homo sapiens
ggaaaaucucagc

SEQ ID NO: 1384293 - RNA, 12 nt, Homo sapiens
ggaaaauucucu

SEQ ID NO: 1384294 - RNA, 17 nt, Homo sapiens
ggaaaauuggacauuaa

SEQ ID NO: 1384295 - RNA, 15 nt, Homo sapiens
ggaaagcagcucaaa

SEQ ID NO: 1384296 - RNA, 16 nt, Homo sapiens
ggaaagcaucaccuca

SEQ ID NO: 1384297 - RNA, 22 nt, Homo sapiens
ggaaagcaucaccucaggccag

SEQ ID NO: 1384298 - RNA, 21 nt, Homo sapiens
uuccaggcgaugugcaagugu

SEQ ID NO: 1384299 - RNA, 21 nt, Homo sapiens
uuccagguagcugaaagggga

SEQ ID NO: 1384300 - RNA, 13 nt, Homo sapiens
uuccauaguauau

SEQ ID NO: 1384301 - RNA, 22 nt, Homo sapiens
uuccaucccaggcuuuugaaaa

SEQ ID NO: 1384302 - RNA, 16 nt, Homo sapiens
uuccaugaaaaugcaa

SEQ ID NO: 1384303 - RNA, 22 nt, Homo sapiens
uuccaugagaacagcaggguag

SEQ ID NO: 1384304 - RNA, 13 nt, Homo sapiens
uuccauuuaguaa

SEQ ID NO: 1384305 - RNA, 18 nt, Homo sapiens
uuccauuucgccccucau

SEQ ID NO: 1384306 - RNA, 21 nt, Homo sapiens
uucccaacacuucagacugca

SEQ ID NO: 1384307 - RNA, 23 nt, Homo sapiens
uucccaauagcacuuucauugcc

SEQ ID NO: 1384308 - RNA, 14 nt, Homo sapiens
uucccagcucuccc

SEQ ID NO: 1384309 - RNA, 13 nt, Homo sapiens
uucccagcugucu

SEQ ID NO: 1384310 - RNA, 23 nt, Homo sapiens
uucccaucacuggagcaccaggc

SEQ ID NO: 1384311 - RNA, 14 nt, Homo sapiens
uuccccaccaguga

SEQ ID NO: 1384312 - RNA, 12 nt, Homo sapiens
uuccccacugac

SEQ ID NO: 1384313 - RNA, 17 nt, Homo sapiens
uucccccagcccugugg

SEQ ID NO: 1384314 - RNA, 16 nt, Homo sapiens
uuccccgugggccaug

SEQ ID NO: 1384315 - RNA, 18 nt, Homo sapiens
uucccguauugacaggaa

SEQ ID NO: 1384316 - RNA, 22 nt, Homo sapiens
uucccuacaguugaaaaacagc

SEQ ID NO: 1384317 - RNA, 15 nt, Homo sapiens
uucccuaucacugaa

SEQ ID NO: 1384318 - RNA, 20 nt, Homo sapiens
uucccuauuuugccaguggg

SEQ ID NO: 1384319 - RNA, 14 nt, Homo sapiens
uucccucacaccgc

SEQ ID NO: 1384320 - RNA, 15 nt, Homo sapiens
uucccugcuuaauga

SEQ ID NO: 1384321 - RNA, 20 nt, Homo sapiens
uuccuaaaaguucauaacag

SEQ ID NO: 1384322 - RNA, 19 nt, Homo sapiens
uuccuaaauguauaccugu

SEQ ID NO: 1384323 - RNA, 20 nt, Homo sapiens
uuccuaagacugcugcugaa

SEQ ID NO: 1384324 - RNA, 18 nt, Homo sapiens
uuucuaccuugaggucuu

SEQ ID NO: 1384325 - RNA, 22 nt, Homo sapiens
uuucuacuaaaaauacaaaaau

SEQ ID NO: 1384326 - RNA, 18 nt, Homo sapiens
uuucuauuaaaaguggga

SEQ ID NO: 1384327 - RNA, 17 nt, Homo sapiens
uuucuauucucuccuca

SEQ ID NO: 1384328 - RNA, 21 nt, Homo sapiens
uuucucagcucccaaggcucu

SEQ ID NO: 1384329 - RNA, 13 nt, Homo sapiens
uuucuccaugagu

SEQ ID NO: 1384330 - RNA, 18 nt, Homo sapiens
uuucucuugaagaacuga

SEQ ID NO: 1384331 - RNA, 19 nt, Homo sapiens
uuucucuugaagaacugac

SEQ ID NO: 1384332 - RNA, 13 nt, Homo sapiens
uuucugccuaucu

SEQ ID NO: 1384333 - RNA, 17 nt, Homo sapiens
uuucuggccugccuucg

SEQ ID NO: 1384334 - RNA, 16 nt, Homo sapiens
uuucuucaugcaauga

SEQ ID NO: 1384335 - RNA, 23 nt, Homo sapiens
uuucuuccagaaggcaaaaagac

SEQ ID NO: 1384336 - RNA, 18 nt, Homo sapiens
uuucuuccuuaaacuccu

SEQ ID NO: 1384337 - RNA, 20 nt, Homo sapiens
uuucuuccuuaaacuccugu

SEQ ID NO: 1384338 - RNA, 19 nt, Homo sapiens
uuucuucucuccagugcac

SEQ ID NO: 1384339 - RNA, 19 nt, Homo sapiens
uuucuuucaaagaagccag

SEQ ID NO: 1384340 - RNA, 15 nt, Homo sapiens
uuucuuuuccauuua

SEQ ID NO: 1384341 - RNA, 14 nt, Homo sapiens
uuugaaaucuauga

SEQ ID NO: 1384342 - RNA, 14 nt, Homo sapiens
uuugaauacuaaau

SEQ ID NO: 1384343 - RNA, 14 nt, Homo sapiens
uuugacaaccauga

SEQ ID NO: 1384344 - RNA, 17 nt, Homo sapiens
uuugacagcugugcugu

SEQ ID NO: 1384345 - RNA, 14 nt, Homo sapiens
uuugagacaggaga

SEQ ID NO: 1384346 - RNA, 20 nt, Homo sapiens
uuugauacucccagucuugu

SEQ ID NO: 1384347 - RNA, 14 nt, Homo sapiens
uuugauguuuacag

SEQ ID NO: 1384348 - RNA, 20 nt, Homo sapiens
uuugauuucagguuuguaug

SEQ ID NO: 1384349 - RNA, 13 nt, Homo sapiens
uuugcacuuucag

SEQ ID NO: 1384350 - RNA, 19 nt, Homo sapiens
uuugcagcagugagucucu

SEQ ID NO: 1384351 - RNA, 19 nt, Homo sapiens
uuugcaggcucauagggaa

SEQ ID NO: 1384352 - RNA, 20 nt, Homo sapiens
uuugcccaguguuugugcaa

SEQ ID NO: 1384353 - RNA, 17 nt, Homo sapiens
uuugccuaauacauuaa

SEQ ID NO: 1384354 - RNA, 21 nt, Homo sapiens
uuugcuauggggacauuccaa

SEQ ID NO: 1384355 - RNA, 22 nt, Homo sapiens
uuugcucuuagcugucugcuca

SEQ ID NO: 1384356 - RNA, 20 nt, Homo sapiens
uuugcugccaaacacccaug

SEQ ID NO: 1384357 - RNA, 16 nt, Homo sapiens
uuugcuggucacugcc

SEQ ID NO: 1384358 - RNA, 11 nt, Homo sapiens
uuugcuuuaau

SEQ ID NO: 1384359 - RNA, 22 nt, Homo sapiens
uuuggaaucuucucuuugacaa

SEQ ID NO: 1384360 - RNA, 17 nt, Homo sapiens
uuugggacaaaacagaa

SEQ ID NO: 1384361 - RNA, 15 nt, Homo sapiens
uuuggguaacuucaa

SEQ ID NO: 1384362 - RNA, 14 nt, Homo sapiens
uuugguugccuuaa

SEQ ID NO: 1384363 - RNA, 16 nt, Homo sapiens
uuuguaauauggaaug

SEQ ID NO: 1384364 - RNA, 21 nt, Homo sapiens
uuuguagagccagggucucac

SEQ ID NO: 1384365 - RNA, 18 nt, Homo sapiens
uuugucacaaauaaacau

SEQ ID NO: 1384366 - RNA, 23 nt, Homo sapiens
uuugucagaggcacaaaaggguu

SEQ ID NO: 1384367 - RNA, 23 nt, Homo sapiens
uuugugaaaugaaaacauguaau

SEQ ID NO: 1384368 - RNA, 14 nt, Homo sapiens
uuugugugugugca

SEQ ID NO: 1384369 - RNA, 21 nt, Homo sapiens
uuuguuccccagcccuaagau

SEQ ID NO: 1384370 - RNA, 14 nt, Homo sapiens
uuuuaaaacauuca

SEQ ID NO: 1384371 - RNA, 19 nt, Homo sapiens
uuuuaagaugugucuucaa

SEQ ID NO: 1384372 - RNA, 14 nt, Homo sapiens
uuuuaaggcuucaa

SEQ ID NO: 1384373 - RNA, 12 nt, Homo sapiens
uuuuaaguauuu

SEQ ID NO: 1384374 - RNA, 15 nt, Homo sapiens
uuuuaauuugaugaa

SEQ ID NO: 1384375 - RNA, 23 nt, Homo sapiens
uuuuacaauaaaacuuugcugcc

SEQ ID NO: 1384376 - RNA, 16 nt, Homo sapiens
uuuuacauacugcugu

SEQ ID NO: 1384377 - RNA, 20 nt, Homo sapiens
uuuuacuccccuugagcuga

SEQ ID NO: 1384378 - RNA, 20 nt, Homo sapiens
uuuuauaaaauuaagcaaug

SEQ ID NO: 1384379 - RNA, 15 nt, Homo sapiens
uuuuauagucugaaa

SEQ ID NO: 1384380 - RNA, 18 nt, Homo sapiens
uuuuaucauuaccauuaa

SEQ ID NO: 1384381 - RNA, 19 nt, Homo sapiens
uuuuauccacuuaccuaga

SEQ ID NO: 1384382 - RNA, 23 nt, Homo sapiens
uuuuaugagaaaugccagugugc

SEQ ID NO: 1384383 - RNA, 21 nt, Homo sapiens
uuuuaugccuucacuuuacaa

SEQ ID NO: 1384384 - RNA, 22 nt, Homo sapiens
uuuuauggcgauucccauugaa

SEQ ID NO: 1384385 - RNA, 22 nt, Homo sapiens
uuuucaaugugugugagguguu

SEQ ID NO: 1384386 - RNA, 20 nt, Homo sapiens
uuuucaauuaguaacauuca

SEQ ID NO: 1384387 - RNA, 22 nt, Homo sapiens
uuuucaauuuugcaugcucgau

SEQ ID NO: 1384388 - RNA, 13 nt, Homo sapiens
uuuucaccccacc

SEQ ID NO: 1384389 - RNA, 10 nt, Homo sapiens
uuuucacugc

SEQ ID NO: 1384390 - RNA, 22 nt, Homo sapiens
uuuucacuucaaaacaguauug

SEQ ID NO: 1384391 - RNA, 15 nt, Homo sapiens
uuuucagaccccagc

SEQ ID NO: 1384392 - RNA, 14 nt, Homo sapiens
uuuucagacugcuu

SEQ ID NO: 1384393 - RNA, 16 nt, Homo sapiens
uuuucagacugcuuua

SEQ ID NO: 1384394 - RNA, 14 nt, Homo sapiens
uuuuccugccaggc

SEQ ID NO: 1384395 - RNA, 21 nt, Homo sapiens
uuuucuccugccugugcugug

SEQ ID NO: 1384396 - RNA, 14 nt, Homo sapiens
uuuucugccaggga

SEQ ID NO: 1384397 - RNA, 21 nt, Homo sapiens
uuuugaaaaggcgguacuagu

SEQ ID NO: 1384398 - RNA, 18 nt, Homo sapiens
uuuugacaucaaugauga

SEQ ID NO: 1384399 - RNA, 23 nt, Homo sapiens
uuuugacaucaaugaugaggcuc

SEQ ID NO: 1384400 - RNA, 14 nt, Homo sapiens
uuuugauagcuuua

SEQ ID NO: 1384401 - RNA, 13 nt, Homo sapiens
uuuugccuaauac

SEQ ID NO: 1384402 - RNA, 13 nt, Homo sapiens
uuuuggccaaagu

SEQ ID NO: 1384403 - RNA, 19 nt, Homo sapiens
uuuugucuaugggacucaa

SEQ ID NO: 1384404 - RNA, 13 nt, Homo sapiens
uuuuguuaccuuu

SEQ ID NO: 1384405 - RNA, 18 nt, Homo sapiens
uuuuguuccacaaguuaa

SEQ ID NO: 1384406 - RNA, 18 nt, Homo sapiens
uuuuuaaaaaacugcuga

SEQ ID NO: 1384407 - RNA, 12 nt, Homo sapiens
uuuuuagcuuua

SEQ ID NO: 1384408 - RNA, 11 nt, Homo sapiens
ggaagggucaa

SEQ ID NO: 1384409 - RNA, 15 nt, Homo sapiens
ggaaguguaacagcu

SEQ ID NO: 1384410 - RNA, 17 nt, Homo sapiens
ggaagugugugaucugu

SEQ ID NO: 1384411 - RNA, 12 nt, Homo sapiens
ggaaguuuucag

SEQ ID NO: 1384412 - RNA, 22 nt, Homo sapiens
ggaaucauuguuuggcauugaa

SEQ ID NO: 1384413 - RNA, 17 nt, Homo sapiens
ggaauccagacccggcu

SEQ ID NO: 1384414 - RNA, 21 nt, Homo sapiens
ggaauuaggaagaccaagaca

SEQ ID NO: 1384415 - RNA, 18 nt, Homo sapiens
ggaauuaugucugcugaa

SEQ ID NO: 1384416 - RNA, 13 nt, Homo sapiens
ggaauucaucucu

SEQ ID NO: 1384417 - RNA, 21 nt, Homo sapiens
ggacaacucagucccuaaaaa

SEQ ID NO: 1384418 - RNA, 17 nt, Homo sapiens
ggacaccuguacuggag

SEQ ID NO: 1384419 - RNA, 18 nt, Homo sapiens
ggacacuaauacaccagg

SEQ ID NO: 1384420 - RNA, 17 nt, Homo sapiens
ggacaguccugggagaa

SEQ ID NO: 1384421 - RNA, 16 nt, Homo sapiens
ggacaugaaaaauugc

SEQ ID NO: 1384422 - RNA, 20 nt, Homo sapiens
ggacauuccaauuugcacuu

SEQ ID NO: 1384423 - RNA, 13 nt, Homo sapiens
ggaccacaccucc

SEQ ID NO: 1384424 - RNA, 19 nt, Homo sapiens
ggaccagaagcauuucacc

SEQ ID NO: 1384425 - RNA, 18 nt, Homo sapiens
ggaccauuuuuacaucca

SEQ ID NO: 1384426 - RNA, 14 nt, Homo sapiens
ggaccccugcccuu

SEQ ID NO: 1384427 - RNA, 14 nt, Homo sapiens
ggaccuauguuugc

SEQ ID NO: 1384428 - RNA, 18 nt, Homo sapiens
ggaccuggggaagcaaaa

SEQ ID NO: 1384429 - RNA, 23 nt, Homo sapiens
ggacgagauaaugugaacuagcu

SEQ ID NO: 1384430 - RNA, 16 nt, Homo sapiens
ggacgcacacagcuuu

SEQ ID NO: 1384431 - RNA, 17 nt, Homo sapiens
ggacuacaggcacccac

SEQ ID NO: 1384432 - RNA, 18 nt, Homo sapiens
ggacuaggagcacuguag

SEQ ID NO: 1384433 - RNA, 18 nt, Homo sapiens
ggacuauuacauccacau

SEQ ID NO: 1384434 - RNA, 10 nt, Homo sapiens
ggacuauuau

SEQ ID NO: 1384435 - RNA, 22 nt, Homo sapiens
ggacuauuauaauuuaaugcau

SEQ ID NO: 1384436 - RNA, 19 nt, Homo sapiens
ggacuauuuaugaaggcaa

SEQ ID NO: 1384437 - RNA, 12 nt, Homo sapiens
ggacucaaugca

SEQ ID NO: 1384438 - RNA, 17 nt, Homo sapiens
ggacuccagaucugcac

SEQ ID NO: 1384439 - RNA, 22 nt, Homo sapiens
ggacuggaucccagcagugaug

SEQ ID NO: 1384440 - RNA, 21 nt, Homo sapiens
ggacuuaccgccuggaggcag

SEQ ID NO: 1384441 - RNA, 12 nt, Homo sapiens
ggacuuccuccc

SEQ ID NO: 1384442 - RNA, 17 nt, Homo sapiens
ggagaaaccuacagaau

SEQ ID NO: 1384443 - RNA, 21 nt, Homo sapiens
ggagaaacuguagucucagga

SEQ ID NO: 1384444 - RNA, 22 nt, Homo sapiens
ggagaagaggcagauucaauuu

SEQ ID NO: 1384445 - RNA, 16 nt, Homo sapiens
ggagaagccguggccu

SEQ ID NO: 1384446 - RNA, 13 nt, Homo sapiens
ggagacuccauga

SEQ ID NO: 1384447 - RNA, 15 nt, Homo sapiens
ggagagcccagccau

SEQ ID NO: 1384448 - RNA, 13 nt, Homo sapiens
ggagaggccauga

SEQ ID NO: 1384449 - RNA, 13 nt, Homo sapiens
ggagaggggcaca

SEQ ID NO: 1384450 - RNA, 18 nt, Homo sapiens
ggagaggucgugaggcca

SEQ ID NO: 1384451 - RNA, 13 nt, Homo sapiens
ggagcacuggguu

SEQ ID NO: 1384452 - RNA, 21 nt, Homo sapiens
ggagcaggagccugagccuug

SEQ ID NO: 1384453 - RNA, 17 nt, Homo sapiens
ggagcagggacagauca

SEQ ID NO: 1384454 - RNA, 21 nt, Homo sapiens
ggagccaccugucccaccuca

SEQ ID NO: 1384455 - RNA, 17 nt, Homo sapiens
ggagccccacugcccuu

SEQ ID NO: 1384456 - RNA, 21 nt, Homo sapiens
ggagccuggcuccguccagga

SEQ ID NO: 1384457 - RNA, 19 nt, Homo sapiens
ggagcugccuguucagcuc

SEQ ID NO: 1384458 - RNA, 20 nt, Homo sapiens
ggagcugggcagaaggccaa

SEQ ID NO: 1384459 - RNA, 20 nt, Homo sapiens
ggagcuuuugguaugugaca

SEQ ID NO: 1384460 - RNA, 17 nt, Homo sapiens
ggaggaacacugcacuc

SEQ ID NO: 1384461 - RNA, 17 nt, Homo sapiens
ggaggaaggagccuaug

SEQ ID NO: 1384462 - RNA, 18 nt, Homo sapiens
ggaggaaugcucccccau

SEQ ID NO: 1384463 - RNA, 22 nt, Homo sapiens
ggaggcagagguugcagugagc

SEQ ID NO: 1384464 - RNA, 21 nt, Homo sapiens
ggaggccauucugagccacac

SEQ ID NO: 1384465 - RNA, 20 nt, Homo sapiens
ggaggcggagcuugcaguga

SEQ ID NO: 1384466 - RNA, 18 nt, Homo sapiens
ggaggcugucuucucagg

SEQ ID NO: 1384467 - RNA, 21 nt, Homo sapiens
ggaggcuugccccacccaaca

SEQ ID NO: 1384468 - RNA, 23 nt, Homo sapiens
ggagggguuuuggugauacccaa

SEQ ID NO: 1384469 - RNA, 14 nt, Homo sapiens
ggaggucgacccca

SEQ ID NO: 1384470 - RNA, 20 nt, Homo sapiens
ggaggugaccccagguuucu

SEQ ID NO: 1384471 - RNA, 19 nt, Homo sapiens
ggagguggaggcugcagug

SEQ ID NO: 1384472 - RNA, 20 nt, Homo sapiens
ggagguggagguugcaguga

SEQ ID NO: 1384473 - RNA, 22 nt, Homo sapiens
ggaguacaccccaacagcaccc

SEQ ID NO: 1384474 - RNA, 17 nt, Homo sapiens
ggaguaccauguggcaa

SEQ ID NO: 1384475 - RNA, 20 nt, Homo sapiens
ggagugcccccaacagcacc

SEQ ID NO: 1384476 - RNA, 16 nt, Homo sapiens
ggagugggugucucug

SEQ ID NO: 1384477 - RNA, 18 nt, Homo sapiens
ggaguuaggcuauucaca

SEQ ID NO: 1384478 - RNA, 20 nt, Homo sapiens
ggaguucgaggcugcaguca

SEQ ID NO: 1384479 - RNA, 23 nt, Homo sapiens
ggauaaucacauuaucaucugaa

SEQ ID NO: 1384480 - RNA, 17 nt, Homo sapiens
ggauacuggugcaguca

SEQ ID NO: 1384481 - RNA, 18 nt, Homo sapiens
ggaucccagcagugaugu

SEQ ID NO: 1384482 - RNA, 13 nt, Homo sapiens
ggaucuaccagca

SEQ ID NO: 1384483 - RNA, 17 nt, Homo sapiens
ggaucuaccagcauaaa

SEQ ID NO: 1384484 - RNA, 17 nt, Homo sapiens
ggaucucucuagugaug

SEQ ID NO: 1384485 - RNA, 15 nt, Homo sapiens
ggaugcagagucagc

SEQ ID NO: 1384486 - RNA, 23 nt, Homo sapiens
ggauguuugcucagcuucuccaa

SEQ ID NO: 1384487 - RNA, 20 nt, Homo sapiens
ggauuguuguuuaacuugua

SEQ ID NO: 1384488 - RNA, 17 nt, Homo sapiens
ggauuugccugugccac

SEQ ID NO: 1384489 - RNA, 19 nt, Homo sapiens
ggauuuguccuuggggaca

SEQ ID NO: 1384490 - RNA, 16 nt, Homo sapiens
ggcaaaaaaauuaaau

SEQ ID NO: 1384491 - RNA, 14 nt, Homo sapiens
ggcaaacaggcagu

SEQ ID NO: 1384492 - RNA, 22 nt, Homo sapiens
ggcaaagagagucgcaucucag

SEQ ID NO: 1384493 - RNA, 17 nt, Homo sapiens
ggcaaagccuucauugc

SEQ ID NO: 1384494 - RNA, 22 nt, Homo sapiens
ggcaaccacaggcagcauuuag

SEQ ID NO: 1384495 - RNA, 22 nt, Homo sapiens
ggcaaccuugucucuaugccag

SEQ ID NO: 1384496 - RNA, 23 nt, Homo sapiens
ggcaacuugggaacuagacuccc

SEQ ID NO: 1384497 - RNA, 15 nt, Homo sapiens
ggcaagagaauuacu

SEQ ID NO: 1384498 - RNA, 22 nt, Homo sapiens
ggcaauaggugugaacagggaa

SEQ ID NO: 1384499 - RNA, 18 nt, Homo sapiens
ggcaauauagcaagaucc

SEQ ID NO: 1384500 - RNA, 23 nt, Homo sapiens
ggcaauuuuuacacaaaccugaa

SEQ ID NO: 1384501 - RNA, 23 nt, Homo sapiens
ggcacccacaaauaaaugacaag

SEQ ID NO: 1384502 - RNA, 19 nt, Homo sapiens
ggcacccggccccugcugg

SEQ ID NO: 1384503 - RNA, 11 nt, Homo sapiens
ggcacuggguc

SEQ ID NO: 1384504 - RNA, 15 nt, Homo sapiens
ggcagaaagcaaaug

SEQ ID NO: 1384505 - RNA, 14 nt, Homo sapiens
ucaaguauuggcaa

SEQ ID NO: 1384506 - RNA, 16 nt, Homo sapiens
ucaagucuucccugau

SEQ ID NO: 1384507 - RNA, 23 nt, Homo sapiens
ucaagucuucccugaucaaguca

SEQ ID NO: 1384508 - RNA, 11 nt, Homo sapiens
ucaaguugcac

SEQ ID NO: 1384509 - RNA, 20 nt, Homo sapiens
ucaaguuggcuucuaaucaa

SEQ ID NO: 1384510 - RNA, 19 nt, Homo sapiens
ucaaguuucuucaaucuga

SEQ ID NO: 1384511 - RNA, 24 nt, Homo sapiens
ucaaguuucuucaaucugaagaua

SEQ ID NO: 1384512 - RNA, 16 nt, Homo sapiens
ucaauaaaaugugauu

SEQ ID NO: 1384513 - RNA, 16 nt, Homo sapiens
ucaaucucugauucug

SEQ ID NO: 1384514 - RNA, 15 nt, Homo sapiens
ucaaugucacuuaaa

SEQ ID NO: 1384515 - RNA, 16 nt, Homo sapiens
ucacaaaccaugcaaa

SEQ ID NO: 1384516 - RNA, 21 nt, Homo sapiens
ucacaauggugcucauuucau

SEQ ID NO: 1384517 - RNA, 12 nt, Homo sapiens
ucacacauucca

SEQ ID NO: 1384518 - RNA, 23 nt, Homo sapiens
ucacaccaggcuugccugcaggc

SEQ ID NO: 1384519 - RNA, 14 nt, Homo sapiens
ucacaccugaccaa

SEQ ID NO: 1384520 - RNA, 13 nt, Homo sapiens
ucacaccuguaau

SEQ ID NO: 1384521 - RNA, 11 nt, Homo sapiens
ucacacuguau

SEQ ID NO: 1384522 - RNA, 17 nt, Homo sapiens
ucacacuuccaccagcc

SEQ ID NO: 1384523 - RNA, 19 nt, Homo sapiens
ucacacuuccaccagccug

SEQ ID NO: 1384524 - RNA, 12 nt, Homo sapiens
uugaccucaggu

SEQ ID NO: 1384525 - RNA, 23 nt, Homo sapiens
uugacugucacuguuccuuguca

SEQ ID NO: 1384526 - RNA, 17 nt, Homo sapiens
uugacuuguauaccuug

SEQ ID NO: 1384527 - RNA, 17 nt, Homo sapiens
uugagaucauugcaaac

SEQ ID NO: 1384528 - RNA, 17 nt, Homo sapiens
uugagccuuaaaaccca

SEQ ID NO: 1384529 - RNA, 15 nt, Homo sapiens
uugagcuccccaaaa

SEQ ID NO: 1384530 - RNA, 23 nt, Homo sapiens
uugaggucaaguaagaagacaug

SEQ ID NO: 1384531 - RNA, 12 nt, Homo sapiens
uugauauacuuu

SEQ ID NO: 1384532 - RNA, 17 nt, Homo sapiens
uugaugacccucugacc

SEQ ID NO: 1384533 - RNA, 19 nt, Homo sapiens
uugaugucaaaaacuucaa

SEQ ID NO: 1384534 - RNA, 18 nt, Homo sapiens
uugauguuuguggccuca

SEQ ID NO: 1384535 - RNA, 13 nt, Homo sapiens
uugauuaccuagu

SEQ ID NO: 1384536 - RNA, 15 nt, Homo sapiens
uugauuagacuccua

SEQ ID NO: 1384537 - RNA, 17 nt, Homo sapiens
uugauucaaagcacugu

SEQ ID NO: 1384538 - RNA, 14 nt, Homo sapiens
uugcaacuuagcuc

SEQ ID NO: 1384539 - RNA, 12 nt, Homo sapiens
uugcacacucac

SEQ ID NO: 1384540 - RNA, 23 nt, Homo sapiens
uugcacagcucuccggucucucu

SEQ ID NO: 1384541 - RNA, 14 nt, Homo sapiens
uugcaccacugcac

SEQ ID NO: 1384542 - RNA, 18 nt, Homo sapiens
uugcaggaccucagguga

SEQ ID NO: 1384543 - RNA, 15 nt, Homo sapiens
uugcagugagccaag

SEQ ID NO: 1384544 - RNA, 17 nt, Homo sapiens
uugcauauguaugacuc

SEQ ID NO: 1384545 - RNA, 20 nt, Homo sapiens
uugccaaacagccacacugu

SEQ ID NO: 1384546 - RNA, 19 nt, Homo sapiens
uugccauuaaacuuaccug

SEQ ID NO: 1384547 - RNA, 13 nt, Homo sapiens
uugcccacaaugc

SEQ ID NO: 1384548 - RNA, 16 nt, Homo sapiens
uugcccaccagaucau

SEQ ID NO: 1384549 - RNA, 19 nt, Homo sapiens
uugccccacccaacaagcc

SEQ ID NO: 1384550 - RNA, 19 nt, Homo sapiens
uugccuaauaaacauccuu

SEQ ID NO: 1384551 - RNA, 13 nt, Homo sapiens
aagugugugcaca

SEQ ID NO: 1384552 - RNA, 13 nt, Homo sapiens
aaguguguuuccu

SEQ ID NO: 1384553 - RNA, 15 nt, Homo sapiens
aaguuaaagugaaua

SEQ ID NO: 1384554 - RNA, 20 nt, Homo sapiens
aaguuacuauccuggcuuug

SEQ ID NO: 1384555 - RNA, 20 nt, Homo sapiens
aaguuauaaccaacuuuucu

SEQ ID NO: 1384556 - RNA, 18 nt, Homo sapiens
aaguuauacuguggcuau

SEQ ID NO: 1384557 - RNA, 17 nt, Homo sapiens
aaguucagcaugaagga

SEQ ID NO: 1384558 - RNA, 14 nt, Homo sapiens
aaguugcacacuca

SEQ ID NO: 1384559 - RNA, 13 nt, Homo sapiens
aaguuugagauca

SEQ ID NO: 1384560 - RNA, 22 nt, Homo sapiens
aaguuugugaaugugacuacuu

SEQ ID NO: 1384561 - RNA, 21 nt, Homo sapiens
aaguuuuguggaggagcucag

SEQ ID NO: 1384562 - RNA, 16 nt, Homo sapiens
aauaaaaugagcaaaa

SEQ ID NO: 1384563 - RNA, 15 nt, Homo sapiens
aauaaacccuuccug

SEQ ID NO: 1384564 - RNA, 12 nt, Homo sapiens
aauaaaccuccu

SEQ ID NO: 1384565 - RNA, 20 nt, Homo sapiens
aauaaacuguguuuacucag

SEQ ID NO: 1384566 - RNA, 22 nt, Homo sapiens
aauaaauagcuauauccaugua

SEQ ID NO: 1384567 - RNA, 14 nt, Homo sapiens
aauaaauaucugua

SEQ ID NO: 1384568 - RNA, 12 nt, Homo sapiens
aauaaaugacaa

SEQ ID NO: 1384569 - RNA, 12 nt, Homo sapiens
aauaaaugugaa

SEQ ID NO: 1384570 - RNA, 16 nt, Homo sapiens
aauaaauucaucagau

SEQ ID NO: 1384571 - RNA, 14 nt, Homo sapiens
aauaacacagagag

SEQ ID NO: 1384572 - RNA, 13 nt, Homo sapiens
aauaacugacccu

SEQ ID NO: 1384573 - RNA, 13 nt, Homo sapiens
aauaagcugccuu

SEQ ID NO: 1384574 - RNA, 20 nt, Homo sapiens
aauaaguaucacacuguaua

SEQ ID NO: 1384575 - RNA, 18 nt, Homo sapiens
aauaauaacaaucacaaa

SEQ ID NO: 1384576 - RNA, 16 nt, Homo sapiens
aauaauacaccagaga

SEQ ID NO: 1384577 - RNA, 12 nt, Homo sapiens
aauaauaugcau

SEQ ID NO: 1384578 - RNA, 18 nt, Homo sapiens
aauaauaugcugccaaau

SEQ ID NO: 1384579 - RNA, 13 nt, Homo sapiens
aauaauccagaaa

SEQ ID NO: 1384580 - RNA, 16 nt, Homo sapiens
aauaauguacaucugg

SEQ ID NO: 1384581 - RNA, 17 nt, Homo sapiens
aauaauucuucaccuaa

SEQ ID NO: 1384582 - RNA, 14 nt, Homo sapiens
aauaauugauuuca

SEQ ID NO: 1384583 - RNA, 17 nt, Homo sapiens
aauaauuuuucacuuca

SEQ ID NO: 1384584 - RNA, 21 nt, Homo sapiens
aauacagacuacuucuucccc

SEQ ID NO: 1384585 - RNA, 23 nt, Homo sapiens
aauacagauagauauaugcucug

SEQ ID NO: 1384586 - RNA, 18 nt, Homo sapiens
aauaccaaaauuauuuca

SEQ ID NO: 1384587 - RNA, 15 nt, Homo sapiens
aauaccauguacaua

SEQ ID NO: 1384588 - RNA, 19 nt, Homo sapiens
aauaccuccuccagaucag

SEQ ID NO: 1384589 - RNA, 18 nt, Homo sapiens
aauacgguaaggauacuu

SEQ ID NO: 1384590 - RNA, 14 nt, Homo sapiens
aauacuuaacucaa

SEQ ID NO: 1384591 - RNA, 16 nt, Homo sapiens
aauagaaccacuauga

SEQ ID NO: 1384592 - RNA, 20 nt, Homo sapiens
aauagaagaacauccaagga

SEQ ID NO: 1384593 - RNA, 15 nt, Homo sapiens
aauagagacuguaga

SEQ ID NO: 1384594 - RNA, 14 nt, Homo sapiens
aauagcaugucacu

SEQ ID NO: 1384595 - RNA, 20 nt, Homo sapiens
aauagcuauauccauguacu

SEQ ID NO: 1384596 - RNA, 23 nt, Homo sapiens
aauagggccucacucuguugcuc

SEQ ID NO: 1384597 - RNA, 17 nt, Homo sapiens
aauaggugcuuauucuc

SEQ ID NO: 1384598 - RNA, 19 nt, Homo sapiens
aauaggugcuuauucucaa

SEQ ID NO: 1384599 - RNA, 13 nt, Homo sapiens
aauagguguguga

SEQ ID NO: 1384600 - RNA, 23 nt, Homo sapiens
aauaguaaaagauaacaagaucu

SEQ ID NO: 1384601 - RNA, 18 nt, Homo sapiens
aauaguuuugauccuaaa

SEQ ID NO: 1384602 - RNA, 14 nt, Homo sapiens
aauauaaacacuau

SEQ ID NO: 1384603 - RNA, 22 nt, Homo sapiens
aauauaaauuuguguucucaaa

SEQ ID NO: 1384604 - RNA, 12 nt, Homo sapiens
aauauacauuca

SEQ ID NO: 1384605 - RNA, 14 nt, Homo sapiens
aauauacauucaaa

SEQ ID NO: 1384606 - RNA, 19 nt, Homo sapiens
aauaucuuuauugcaugag

SEQ ID NO: 1384607 - RNA, 19 nt, Homo sapiens
aauauggaaugggcucagu

SEQ ID NO: 1384608 - RNA, 18 nt, Homo sapiens
aauauggguugcauuugg

SEQ ID NO: 1384609 - RNA, 21 nt, Homo sapiens
aauaugguaaugcacaauucc

SEQ ID NO: 1384610 - RNA, 20 nt, Homo sapiens
aauauggugggcacagaagu

SEQ ID NO: 1384611 - RNA, 22 nt, Homo sapiens
aauauuacaauccuugaccuca

SEQ ID NO: 1384612 - RNA, 14 nt, Homo sapiens
aauauucauuguau

SEQ ID NO: 1384613 - RNA, 19 nt, Homo sapiens
uaaaaaccccaaacuguug

SEQ ID NO: 1384614 - RNA, 22 nt, Homo sapiens
uaaaaagggcagggcaucuccu

SEQ ID NO: 1384615 - RNA, 19 nt, Homo sapiens
uaaaaaguuucuaaagugu

SEQ ID NO: 1384616 - RNA, 18 nt, Homo sapiens
uaaaaaucauaguacucu

SEQ ID NO: 1384617 - RNA, 19 nt, Homo sapiens
uaaaaaucauugauuguca

SEQ ID NO: 1384618 - RNA, 12 nt, Homo sapiens
uaaaaaugacaa

SEQ ID NO: 1384619 - RNA, 14 nt, Homo sapiens
uaaaaaugcaacuu

SEQ ID NO: 1384620 - RNA, 15 nt, Homo sapiens
uaaaaaugcaacuuc

SEQ ID NO: 1384621 - RNA, 11 nt, Homo sapiens
uaaaacaaaca

SEQ ID NO: 1384622 - RNA, 20 nt, Homo sapiens
uaaaacaacacucacauuua

SEQ ID NO: 1384623 - RNA, 23 nt, Homo sapiens
uaaaacagguggagaaauuccuu

SEQ ID NO: 1384624 - RNA, 15 nt, Homo sapiens
uaaaaccacuguaca

SEQ ID NO: 1384625 - RNA, 18 nt, Homo sapiens
uaaaaccaucauaguaca

SEQ ID NO: 1384626 - RNA, 16 nt, Homo sapiens
uaaaacccaagugccu

SEQ ID NO: 1384627 - RNA, 18 nt, Homo sapiens
uaaaaccugugugccauu

SEQ ID NO: 1384628 - RNA, 12 nt, Homo sapiens
uaaaaccuuuca

SEQ ID NO: 1384629 - RNA, 15 nt, Homo sapiens
uaaaacuccuguuuc

SEQ ID NO: 1384630 - RNA, 17 nt, Homo sapiens
uaaaacuuaacauucau

SEQ ID NO: 1384631 - RNA, 21 nt, Homo sapiens
uaaaacuucaucuuccccaag

SEQ ID NO: 1384632 - RNA, 22 nt, Homo sapiens
uaaaacuuuaaucccacuugcc

SEQ ID NO: 1384633 - RNA, 15 nt, Homo sapiens
uaaaagacacagaac

SEQ ID NO: 1384634 - RNA, 19 nt, Homo sapiens
uaaaagcagcaucugcuaa

SEQ ID NO: 1384635 - RNA, 11 nt, Homo sapiens
uaaaagccauc

SEQ ID NO: 1384636 - RNA, 17 nt, Homo sapiens
uaaaaggucuaugcuca

SEQ ID NO: 1384637 - RNA, 13 nt, Homo sapiens
uaaaaguuacuua

SEQ ID NO: 1384638 - RNA, 15 nt, Homo sapiens
uaaaaguucauaaca

SEQ ID NO: 1384639 - RNA, 17 nt, Homo sapiens
uaaaauaaaaugcagac

SEQ ID NO: 1384640 - RNA, 17 nt, Homo sapiens
uaaaauaaggauuuuuc

SEQ ID NO: 1384641 - RNA, 14 nt, Homo sapiens
uaaaauaauaacaa

SEQ ID NO: 1384642 - RNA, 16 nt, Homo sapiens
uaaaauagacuaaccu

SEQ ID NO: 1384643 - RNA, 19 nt, Homo sapiens
uaaaaucuuggcacagaaa

SEQ ID NO: 1384644 - RNA, 20 nt, Homo sapiens
uaaaaugaaauuacuacaaa

SEQ ID NO: 1384645 - RNA, 22 nt, Homo sapiens
uaaaaugcuaauuaggcaaaga

SEQ ID NO: 1384646 - RNA, 15 nt, Homo sapiens
uaaaauuaugccaua

SEQ ID NO: 1384647 - RNA, 18 nt, Homo sapiens
uaaaauuaugccauagca

SEQ ID NO: 1384648 - RNA, 23 nt, Homo sapiens
uaaacaaauguaugauuacauca

SEQ ID NO: 1384649 - RNA, 20 nt, Homo sapiens
uaaacacaaagcuguugaaa

SEQ ID NO: 1384650 - RNA, 20 nt, Homo sapiens
uaaacagcuucaugccuuug

SEQ ID NO: 1384651 - RNA, 20 nt, Homo sapiens
uaaacagugagccugaauuu

SEQ ID NO: 1384652 - RNA, 11 nt, Homo sapiens
uaaacagugcc

SEQ ID NO: 1384653 - RNA, 21 nt, Homo sapiens
uaaacauccuucaagaacucu

SEQ ID NO: 1384654 - RNA, 15 nt, Homo sapiens
uaaacauuaguucua

SEQ ID NO: 1384655 - RNA, 15 nt, Homo sapiens
uaaaccacagcacua

SEQ ID NO: 1384656 - RNA, 16 nt, Homo sapiens
uaaaccuccuucggga

SEQ ID NO: 1384657 - RNA, 16 nt, Homo sapiens
uaaacgcugucccuag

SEQ ID NO: 1384658 - RNA, 19 nt, Homo sapiens
uaaacgguuaacaauauua

SEQ ID NO: 1384659 - RNA, 16 nt, Homo sapiens
uaaacuacaaacacaa

SEQ ID NO: 1384660 - RNA, 16 nt, Homo sapiens
uaaacugaaugaacaa

SEQ ID NO: 1384661 - RNA, 19 nt, Homo sapiens
uaaacugaaugaacaaccu

SEQ ID NO: 1384662 - RNA, 21 nt, Homo sapiens
uaaacuuaccugggcauucuu

SEQ ID NO: 1384663 - RNA, 14 nt, Homo sapiens
uaaagaccugagaa

SEQ ID NO: 1384664 - RNA, 12 nt, Homo sapiens
uaaagacuguag

SEQ ID NO: 1384665 - RNA, 19 nt, Homo sapiens
uaaagagagaauguagaua

SEQ ID NO: 1384666 - RNA, 23 nt, Homo sapiens
uaaagcaaagcaaaugaacacac

SEQ ID NO: 1384667 - RNA, 11 nt, Homo sapiens
uaaagcacuua

SEQ ID NO: 1384668 - RNA, 16 nt, Homo sapiens
uaaagcaggugcccag

SEQ ID NO: 1384669 - RNA, 12 nt, Homo sapiens
uaaaggccucuu

SEQ ID NO: 1384670 - RNA, 16 nt, Homo sapiens
uaaaguaaaaagggaa

SEQ ID NO: 1384671 - RNA, 16 nt, Homo sapiens
uaaaguauauauuuau

SEQ ID NO: 1384672 - RNA, 14 nt, Homo sapiens
uaaagugacagaug

SEQ ID NO: 1384673 - RNA, 22 nt, Homo sapiens
uaaaguuucuguugauaaucau

SEQ ID NO: 1384674 - RNA, 23 nt, Homo sapiens
uaaauacacaacacacacacucu

SEQ ID NO: 1384675 - RNA, 13 nt, Homo sapiens
uaaauacuugccu

SEQ ID NO: 1384676 - RNA, 12 nt, Homo sapiens
uaaauagcucag

SEQ ID NO: 1384677 - RNA, 18 nt, Homo sapiens
uaaauaucacaucacuua

SEQ ID NO: 1384678 - RNA, 21 nt, Homo sapiens
uaaauaugccuaaaauacuua

SEQ ID NO: 1384679 - RNA, 17 nt, Homo sapiens
uaaauauuucaggcaua

SEQ ID NO: 1384680 - RNA, 14 nt, Homo sapiens
uaaaucaaugcuau

SEQ ID NO: 1384681 - RNA, 19 nt, Homo sapiens
uaaaucauggcuaagcuua

SEQ ID NO: 1384682 - RNA, 16 nt, Homo sapiens
uaaauccaugcaccua

SEQ ID NO: 1384683 - RNA, 21 nt, Homo sapiens
uaaauccuguugaaaagccau

SEQ ID NO: 1384684 - RNA, 20 nt, Homo sapiens
gugggcagaucacgagguca

SEQ ID NO: 1384685 - RNA, 20 nt, Homo sapiens
gugggccucaaggacuugaa

SEQ ID NO: 1384686 - RNA, 21 nt, Homo sapiens
gugggguaaccaaauguuggc

SEQ ID NO: 1384687 - RNA, 22 nt, Homo sapiens
gugggugccccccuugccagac

SEQ ID NO: 1384688 - RNA, 18 nt, Homo sapiens
gugguuuucuuuugccau

SEQ ID NO: 1384689 - RNA, 18 nt, Homo sapiens
guguaaaauacguuugaa

SEQ ID NO: 1384690 - RNA, 14 nt, Homo sapiens
guguaacaggucuc

SEQ ID NO: 1384691 - RNA, 12 nt, Homo sapiens
guguaacauauu

SEQ ID NO: 1384692 - RNA, 17 nt, Homo sapiens
guguacacgugacagag

SEQ ID NO: 1384693 - RNA, 20 nt, Homo sapiens
guguacagugaaaagucucc

SEQ ID NO: 1384694 - RNA, 15 nt, Homo sapiens
guguagcuuugcucu

SEQ ID NO: 1384695 - RNA, 21 nt, Homo sapiens
guguaugugcgugugugcaag

SEQ ID NO: 1384696 - RNA, 22 nt, Homo sapiens
guguaugugcgugugugcaagu

SEQ ID NO: 1384697 - RNA, 21 nt, Homo sapiens
gugucacuacucacagucucu

SEQ ID NO: 1384698 - RNA, 20 nt, Homo sapiens
gugucauauauggggggcca

SEQ ID NO: 1384699 - RNA, 11 nt, Homo sapiens
guguccaugcc

SEQ ID NO: 1384700 - RNA, 17 nt, Homo sapiens
guguccaugccuuccau

SEQ ID NO: 1384701 - RNA, 13 nt, Homo sapiens
guguccaugugug

SEQ ID NO: 1384702 - RNA, 19 nt, Homo sapiens
guguccaugugugugcaag

SEQ ID NO: 1384703 - RNA, 18 nt, Homo sapiens
guguccuccccucaagga

SEQ ID NO: 1384704 - RNA, 15 nt, Homo sapiens
gugucuggacauuca

SEQ ID NO: 1384705 - RNA, 17 nt, Homo sapiens
gugugagugugugcaag

SEQ ID NO: 1384706 - RNA, 20 nt, Homo sapiens
gugugcaagugugugcacau

SEQ ID NO: 1384707 - RNA, 20 nt, Homo sapiens
gugugcaagugugugcaugu

SEQ ID NO: 1384708 - RNA, 14 nt, Homo sapiens
gugugccauuuuaa

SEQ ID NO: 1384709 - RNA, 22 nt, Homo sapiens
guguggcccagggaagccaaaa

SEQ ID NO: 1384710 - RNA, 19 nt, Homo sapiens
guguggugagaucaugcca

SEQ ID NO: 1384711 - RNA, 23 nt, Homo sapiens
gugugucgcuuaugucuauaacu

SEQ ID NO: 1384712 - RNA, 21 nt, Homo sapiens
guguuaucagucauaacuaaa

SEQ ID NO: 1384713 - RNA, 19 nt, Homo sapiens
guguucuacacucaucuua

SEQ ID NO: 1384714 - RNA, 17 nt, Homo sapiens
guguugacaugugcuuu

SEQ ID NO: 1384715 - RNA, 14 nt, Homo sapiens
guguugaccacaga

SEQ ID NO: 1384716 - RNA, 12 nt, Homo sapiens
guguugauccca

SEQ ID NO: 1384717 - RNA, 14 nt, Homo sapiens
guguugaucccaag

SEQ ID NO: 1384718 - RNA, 16 nt, Homo sapiens
guguuggcacaugccu

SEQ ID NO: 1384719 - RNA, 17 nt, Homo sapiens
guguuuuuuuacauacg

SEQ ID NO: 1384720 - RNA, 19 nt, Homo sapiens
guuaaccucagugucauuu

SEQ ID NO: 1384721 - RNA, 11 nt, Homo sapiens
guuaacuuaau

SEQ ID NO: 1384722 - RNA, 19 nt, Homo sapiens
guuaacuuaauaguauuua

SEQ ID NO: 1384723 - RNA, 18 nt, Homo sapiens
guuaauaaguuucacuga

SEQ ID NO: 1384724 - RNA, 14 nt, Homo sapiens
guuaaugguuugaa

SEQ ID NO: 1384725 - RNA, 12 nt, Homo sapiens
guuacaccagaa

SEQ ID NO: 1384726 - RNA, 21 nt, Homo sapiens
guuacagugaugcugugcuau

SEQ ID NO: 1384727 - RNA, 14 nt, Homo sapiens
guuacauaagauaa

SEQ ID NO: 1384728 - RNA, 18 nt, Homo sapiens
guuacccugcauguuggc

SEQ ID NO: 1384729 - RNA, 10 nt, Homo sapiens
guuaccuaau

SEQ ID NO: 1384730 - RNA, 23 nt, Homo sapiens
guuacuauaugccgcuacaaaaa

SEQ ID NO: 1384731 - RNA, 13 nt, Homo sapiens
guuacuugggagg

SEQ ID NO: 1384732 - RNA, 18 nt, Homo sapiens
guuauaaaucaaugucac

SEQ ID NO: 1384733 - RNA, 15 nt, Homo sapiens
guuauacaaccauca

SEQ ID NO: 1384734 - RNA, 20 nt, Homo sapiens
guuauacaaccaucaaagug

SEQ ID NO: 1384735 - RNA, 13 nt, Homo sapiens
guuaugugaauga

SEQ ID NO: 1384736 - RNA, 16 nt, Homo sapiens
guuauuaacagcugau

SEQ ID NO: 1384737 - RNA, 15 nt, Homo sapiens
guuauuuauaguguu

SEQ ID NO: 1384738 - RNA, 19 nt, Homo sapiens
guuauuuugcuauuugccu

SEQ ID NO: 1384739 - RNA, 16 nt, Homo sapiens
guucaaggaccaacaa

SEQ ID NO: 1384740 - RNA, 13 nt, Homo sapiens
guucaccagguca

SEQ ID NO: 1384741 - RNA, 16 nt, Homo sapiens
guucacccaaccacau

SEQ ID NO: 1384742 - RNA, 17 nt, Homo sapiens
guucaccuauuucaaaa

SEQ ID NO: 1384743 - RNA, 19 nt, Homo sapiens
guucaccuauuucaaaaau

SEQ ID NO: 1384744 - RNA, 16 nt, Homo sapiens
guucaccuugggauga

SEQ ID NO: 1384745 - RNA, 16 nt, Homo sapiens
guucacucccaaccug

SEQ ID NO: 1384746 - RNA, 14 nt, Homo sapiens
guucagaugcuucu

SEQ ID NO: 1384747 - RNA, 14 nt, Homo sapiens
guucagcaugaagg

SEQ ID NO: 1384748 - RNA, 21 nt, Homo sapiens
guucagcuccuuccaccacaa

SEQ ID NO: 1384749 - RNA, 17 nt, Homo sapiens
guucauauuaagacaua

SEQ ID NO: 1384750 - RNA, 16 nt, Homo sapiens
guuccaagacauuguc

SEQ ID NO: 1384751 - RNA, 16 nt, Homo sapiens
guucccccaguaccuc

SEQ ID NO: 1384752 - RNA, 14 nt, Homo sapiens
guuccgacugccau

SEQ ID NO: 1384753 - RNA, 18 nt, Homo sapiens
guuccuucacauccugug

SEQ ID NO: 1384754 - RNA, 20 nt, Homo sapiens
guuccuuuauuuuauguaaa

SEQ ID NO: 1384755 - RNA, 19 nt, Homo sapiens
guucuccuagacugacccu

SEQ ID NO: 1384756 - RNA, 23 nt, Homo sapiens
guucucucugccugugagccagu

SEQ ID NO: 1384757 - RNA, 15 nt, Homo sapiens
guucugggacacagu

SEQ ID NO: 1384758 - RNA, 19 nt, Homo sapiens
gacuucuuuuacucaugau

SEQ ID NO: 1384759 - RNA, 20 nt, Homo sapiens
gacuuggucugauuucagga

SEQ ID NO: 1384760 - RNA, 17 nt, Homo sapiens
gacuuuguauagaaggu

SEQ ID NO: 1384761 - RNA, 20 nt, Homo sapiens
gagaaaccuuauuguaccuc

SEQ ID NO: 1384762 - RNA, 19 nt, Homo sapiens
gagaaagguggacuggaag

SEQ ID NO: 1384763 - RNA, 17 nt, Homo sapiens
gagaaaguucucauuua

SEQ ID NO: 1384764 - RNA, 18 nt, Homo sapiens
gagaaauuccuugauuca

SEQ ID NO: 1384765 - RNA, 14 nt, Homo sapiens
gagaaauugaggau

SEQ ID NO: 1384766 - RNA, 12 nt, Homo sapiens
gagaaccuucca

SEQ ID NO: 1384767 - RNA, 20 nt, Homo sapiens
gagaacuccuaggguggcug

SEQ ID NO: 1384768 - RNA, 14 nt, Homo sapiens
gagaacucugagca

SEQ ID NO: 1384769 - RNA, 17 nt, Homo sapiens
gagaagaaguuugacca

SEQ ID NO: 1384770 - RNA, 19 nt, Homo sapiens
gagaaggaaggagacucac

SEQ ID NO: 1384771 - RNA, 14 nt, Homo sapiens
gagaaguuaagcaa

SEQ ID NO: 1384772 - RNA, 19 nt, Homo sapiens
gagaauggcuuuggucucu

SEQ ID NO: 1384773 - RNA, 17 nt, Homo sapiens
gagaauguugaauacuu

SEQ ID NO: 1384774 - RNA, 13 nt, Homo sapiens
gagacaaauggag

SEQ ID NO: 1384775 - RNA, 19 nt, Homo sapiens
gagacagaguuuucacucu

SEQ ID NO: 1384776 - RNA, 14 nt, Homo sapiens
gagacagauaacuc

SEQ ID NO: 1384777 - RNA, 16 nt, Homo sapiens
gagacaggcccaagag

SEQ ID NO: 1384778 - RNA, 14 nt, Homo sapiens
gagacaguucaaga

SEQ ID NO: 1384779 - RNA, 19 nt, Homo sapiens
gagacauggcuugccacag

SEQ ID NO: 1384780 - RNA, 21 nt, Homo sapiens
gagacccugccuuuaaaaaca

SEQ ID NO: 1384781 - RNA, 14 nt, Homo sapiens
gagacgcaggaaug

SEQ ID NO: 1384782 - RNA, 16 nt, Homo sapiens
gagacuccgucacaac

SEQ ID NO: 1384783 - RNA, 16 nt, Homo sapiens
gagacuccgucucaaa

SEQ ID NO: 1384784 - RNA, 18 nt, Homo sapiens
gagacuccgucucaagga

SEQ ID NO: 1384785 - RNA, 14 nt, Homo sapiens
gagacugcgggaug

SEQ ID NO: 1384786 - RNA, 13 nt, Homo sapiens
gagacugggucuc

SEQ ID NO: 1384787 - RNA, 14 nt, Homo sapiens
gagacugucaguag

SEQ ID NO: 1384788 - RNA, 13 nt, Homo sapiens
gagagaaaaaaga

SEQ ID NO: 1384789 - RNA, 13 nt, Homo sapiens
gagagaacuggag

SEQ ID NO: 1384790 - RNA, 15 nt, Homo sapiens
gagagaagaucacug

SEQ ID NO: 1384791 - RNA, 20 nt, Homo sapiens
gagagaaucccuagucuuca

SEQ ID NO: 1384792 - RNA, 14 nt, Homo sapiens
gagagaaugccaca

SEQ ID NO: 1384793 - RNA, 14 nt, Homo sapiens
gagagaucugcugu

SEQ ID NO: 1384794 - RNA, 20 nt, Homo sapiens
gagagcaaauaaagaccuga

SEQ ID NO: 1384795 - RNA, 17 nt, Homo sapiens
gagaggaagagcugcaa

SEQ ID NO: 1384796 - RNA, 20 nt, Homo sapiens
gagaggcaccacggccucac

SEQ ID NO: 1384797 - RNA, 18 nt, Homo sapiens
gagagggaagagugcauu

SEQ ID NO: 1384798 - RNA, 13 nt, Homo sapiens
gagagggggccac

SEQ ID NO: 1384799 - RNA, 15 nt, Homo sapiens
gagaguagagggcac

SEQ ID NO: 1384800 - RNA, 22 nt, Homo sapiens
gagaguagaugguuugagccug

SEQ ID NO: 1384801 - RNA, 16 nt, Homo sapiens
gagagucgcaucucag

SEQ ID NO: 1384802 - RNA, 21 nt, Homo sapiens
gagaucaugccacuacacucc

SEQ ID NO: 1384803 - RNA, 21 nt, Homo sapiens
gagaucgcgccacugcacucc

SEQ ID NO: 1384804 - RNA, 21 nt, Homo sapiens
gagaucgcgccacugcacucu

SEQ ID NO: 1384805 - RNA, 16 nt, Homo sapiens
gagaucguuguuuaca

SEQ ID NO: 1384806 - RNA, 20 nt, Homo sapiens
gagaucguuguuuacagugu

SEQ ID NO: 1384807 - RNA, 21 nt, Homo sapiens
gagaucguuguuuacagugua

SEQ ID NO: 1384808 - RNA, 15 nt, Homo sapiens
gagaucuaggugagg

SEQ ID NO: 1384809 - RNA, 14 nt, Homo sapiens
gagaucuugaucca

SEQ ID NO: 1384810 - RNA, 18 nt, Homo sapiens
gagaugaaccacauuaua

SEQ ID NO: 1384811 - RNA, 23 nt, Homo sapiens
gagauggccuggggaagcuguga

SEQ ID NO: 1384812 - RNA, 12 nt, Homo sapiens
gagaugucuucu

SEQ ID NO: 1384813 - RNA, 19 nt, Homo sapiens
gagcaaaaucgaugcagug

SEQ ID NO: 1384814 - RNA, 23 nt, Homo sapiens
gagcaaacuaacuugacuuuuaa

SEQ ID NO: 1384815 - RNA, 19 nt, Homo sapiens
gagcaaauaaagaccugag

SEQ ID NO: 1384816 - RNA, 22 nt, Homo sapiens
gagcaagacucugucucaaaaa

SEQ ID NO: 1384817 - RNA, 18 nt, Homo sapiens
gagcaagugagacccugu

SEQ ID NO: 1384818 - RNA, 19 nt, Homo sapiens
gagcagccacaaccaaaaa

SEQ ID NO: 1384819 - RNA, 20 nt, Homo sapiens
gagcagcccuaggcuuccac

SEQ ID NO: 1384820 - RNA, 12 nt, Homo sapiens
gagcagccugug

SEQ ID NO: 1384821 - RNA, 19 nt, Homo sapiens
gagcagcuuuggaaacagg

SEQ ID NO: 1384822 - RNA, 17 nt, Homo sapiens
gagcaguccugccucag

SEQ ID NO: 1384823 - RNA, 19 nt, Homo sapiens
gagcaucucuugaggccag

SEQ ID NO: 1384824 - RNA, 19 nt, Homo sapiens
gagccaccacaccggccaa

SEQ ID NO: 1384825 - RNA, 15 nt, Homo sapiens
gagcccauccagucu

SEQ ID NO: 1384826 - RNA, 14 nt, Homo sapiens
gagccccacacgga

SEQ ID NO: 1384827 - RNA, 22 nt, Homo sapiens
gagcccucuaugguguggcaaa

SEQ ID NO: 1384828 - RNA, 16 nt, Homo sapiens
gagcccuggcaggaug

SEQ ID NO: 1384829 - RNA, 14 nt, Homo sapiens
gagccucgggacau

SEQ ID NO: 1384830 - RNA, 18 nt, Homo sapiens
gagccugagccacaaaaa

SEQ ID NO: 1384831 - RNA, 21 nt, Homo sapiens
gagccuuaaaacccacaaaag

SEQ ID NO: 1384832 - RNA, 14 nt, Homo sapiens
gagcgagacuuggu

SEQ ID NO: 1384833 - RNA, 18 nt, Homo sapiens
gagcuagaugugucuuac

SEQ ID NO: 1384834 - RNA, 19 nt, Homo sapiens
gagcucgcauuugucaaug

SEQ ID NO: 1384835 - RNA, 21 nt, Homo sapiens
gagcucuguuuucaugcuauu

SEQ ID NO: 1384836 - RNA, 13 nt, Homo sapiens
gagcugagugagc

SEQ ID NO: 1384837 - RNA, 14 nt, Homo sapiens
gagcuggaccucac

SEQ ID NO: 1384838 - RNA, 14 nt, Homo sapiens
gagcuggaccugag

SEQ ID NO: 1384839 - RNA, 21 nt, Homo sapiens
gagcugggcagaaggccaaga

SEQ ID NO: 1384840 - RNA, 21 nt, Homo sapiens
gagcugguguggccaagcaca

SEQ ID NO: 1384841 - RNA, 17 nt, Homo sapiens
gagcuguguucuugcca

SEQ ID NO: 1384842 - RNA, 23 nt, Homo sapiens
gaggaaaagagaaggaaagugau

SEQ ID NO: 1384843 - RNA, 14 nt, Homo sapiens
ugaagaccuggacu

SEQ ID NO: 1384844 - RNA, 16 nt, Homo sapiens
ugaagauacaugucuu

SEQ ID NO: 1384845 - RNA, 15 nt, Homo sapiens
ugaagcaaacacauu

SEQ ID NO: 1384846 - RNA, 13 nt, Homo sapiens
ugaagccacugaa

SEQ ID NO: 1384847 - RNA, 21 nt, Homo sapiens
ugaagcucuugaagacacuga

SEQ ID NO: 1384848 - RNA, 16 nt, Homo sapiens
ugaaggagaaggugcc

SEQ ID NO: 1384849 - RNA, 19 nt, Homo sapiens
ugaagguggaacaagcaca

SEQ ID NO: 1384850 - RNA, 18 nt, Homo sapiens
ugaaguaacuugucuuaa

SEQ ID NO: 1384851 - RNA, 13 nt, Homo sapiens
ugaaguagaaucc

SEQ ID NO: 1384852 - RNA, 15 nt, Homo sapiens
ugaagucacacagug

SEQ ID NO: 1384853 - RNA, 23 nt, Homo sapiens
ugaagucaguuucuaucauucug

SEQ ID NO: 1384854 - RNA, 22 nt, Homo sapiens
ugaagucaugcguuuaaucaca

SEQ ID NO: 1384855 - RNA, 23 nt, Homo sapiens
ugaagucaugcguuuaaucacau

SEQ ID NO: 1384856 - RNA, 13 nt, Homo sapiens
ugaauaaccacuu

SEQ ID NO: 1384857 - RNA, 20 nt, Homo sapiens
ugaauaauacaguaucucag

SEQ ID NO: 1384858 - RNA, 22 nt, Homo sapiens
ugaauaauacaguaucucaggg

SEQ ID NO: 1384859 - RNA, 23 nt, Homo sapiens
ugaauacacgagguaugaggucu

SEQ ID NO: 1384860 - RNA, 23 nt, Homo sapiens
ugaauaugauuaguaaagaaaug

SEQ ID NO: 1384861 - RNA, 14 nt, Homo sapiens
ugaauccuacauac

SEQ ID NO: 1384862 - RNA, 17 nt, Homo sapiens
ugaaucuguaucuugcc

SEQ ID NO: 1384863 - RNA, 15 nt, Homo sapiens
ugaaugaacaaccuc

SEQ ID NO: 1384864 - RNA, 15 nt, Homo sapiens
ugaaugcggcccaac

SEQ ID NO: 1384865 - RNA, 13 nt, Homo sapiens
ugaaugugucacu

SEQ ID NO: 1384866 - RNA, 17 nt, Homo sapiens
ugaauuuucaaguaauu

SEQ ID NO: 1384867 - RNA, 19 nt, Homo sapiens
ugacaacuucuaauugcca

SEQ ID NO: 1384868 - RNA, 13 nt, Homo sapiens
ugacaagugagac

SEQ ID NO: 1384869 - RNA, 20 nt, Homo sapiens
ugacaagugagacaaaaagc

SEQ ID NO: 1384870 - RNA, 18 nt, Homo sapiens
ugacaaucaacucuaaua

SEQ ID NO: 1384871 - RNA, 23 nt, Homo sapiens
ugacaaucaacucuaauagugcu

SEQ ID NO: 1384872 - RNA, 14 nt, Homo sapiens
ugacacaugcugaa

SEQ ID NO: 1384873 - RNA, 18 nt, Homo sapiens
ugacagaguucacuauaa

SEQ ID NO: 1384874 - RNA, 12 nt, Homo sapiens
ugacagccuccc

SEQ ID NO: 1384875 - RNA, 16 nt, Homo sapiens
ugacaggcagugccau

SEQ ID NO: 1384876 - RNA, 13 nt, Homo sapiens
ugacaguaugcau

SEQ ID NO: 1384877 - RNA, 18 nt, Homo sapiens
ugacaucagcaauacaga

SEQ ID NO: 1384878 - RNA, 16 nt, Homo sapiens
ugacaucaguggcaug

SEQ ID NO: 1384879 - RNA, 18 nt, Homo sapiens
ugacauccaagcuuccuu

SEQ ID NO: 1384880 - RNA, 19 nt, Homo sapiens
ugacaucucuuugauguca

SEQ ID NO: 1384881 - RNA, 12 nt, Homo sapiens
ugacaugugcuu

SEQ ID NO: 1384882 - RNA, 18 nt, Homo sapiens
ugacauuagcauuguggu

SEQ ID NO: 1384883 - RNA, 13 nt, Homo sapiens
ugacauugauaca

SEQ ID NO: 1384884 - RNA, 20 nt, Homo sapiens
ugaccaaaacaaacaaacag

SEQ ID NO: 1384885 - RNA, 19 nt, Homo sapiens
ugaccaaccuuuucccaac

SEQ ID NO: 1384886 - RNA, 15 nt, Homo sapiens
ugaccaagaacugca

SEQ ID NO: 1384887 - RNA, 20 nt, Homo sapiens
ugaccaagagagaaagaagu

SEQ ID NO: 1384888 - RNA, 24 nt, Homo sapiens
ugaccaaguuauaaaucaauguca

SEQ ID NO: 1384889 - RNA, 13 nt, Homo sapiens
ugaccacuuuauu

SEQ ID NO: 1384890 - RNA, 17 nt, Homo sapiens
ugaccagcagaucccag

SEQ ID NO: 1384891 - RNA, 21 nt, Homo sapiens
ugaccagcagaucccagcuca

SEQ ID NO: 1384892 - RNA, 11 nt, Homo sapiens
ugaccaggaac

SEQ ID NO: 1384893 - RNA, 15 nt, Homo sapiens
ugacccacugaucuc

SEQ ID NO: 1384894 - RNA, 14 nt, Homo sapiens
ugaccggcugcuuu

SEQ ID NO: 1384895 - RNA, 14 nt, Homo sapiens
ugaccucaggugau

SEQ ID NO: 1384896 - RNA, 18 nt, Homo sapiens
ugaccucccccuccuucc

SEQ ID NO: 1384897 - RNA, 22 nt, Homo sapiens
ugaccucuauaauugccacuga

SEQ ID NO: 1384898 - RNA, 15 nt, Homo sapiens
ugacgacgacaacga

SEQ ID NO: 1384899 - RNA, 22 nt, Homo sapiens
ugcaagaauugaagcaggacua

SEQ ID NO: 1384900 - RNA, 19 nt, Homo sapiens
ugcaagcaagaaacacugg

SEQ ID NO: 1384901 - RNA, 23 nt, Homo sapiens
ugcaaggugcccacaugugucca

SEQ ID NO: 1384902 - RNA, 23 nt, Homo sapiens
ugcaagucaggacaucagucuga

SEQ ID NO: 1384903 - RNA, 18 nt, Homo sapiens
ugcaagugucugugugca

SEQ ID NO: 1384904 - RNA, 14 nt, Homo sapiens
ugcaagugugugca

SEQ ID NO: 1384905 - RNA, 19 nt, Homo sapiens
ugcaagugugugcaugugu

SEQ ID NO: 1384906 - RNA, 16 nt, Homo sapiens
ugcaauagagacugua

SEQ ID NO: 1384907 - RNA, 21 nt, Homo sapiens
ugcaauuucauuuaaacuucu

SEQ ID NO: 1384908 - RNA, 15 nt, Homo sapiens
ugcacacauuaggca

SEQ ID NO: 1384909 - RNA, 22 nt, Homo sapiens
ugcacacucacuggcaucuuug

SEQ ID NO: 1384910 - RNA, 17 nt, Homo sapiens
ugcacaugcacgugugu

SEQ ID NO: 1384911 - RNA, 24 nt, Homo sapiens
ugcacaugugugcgugugcgugca

SEQ ID NO: 1384912 - RNA, 13 nt, Homo sapiens
ugcaccaaaucau

SEQ ID NO: 1384913 - RNA, 20 nt, Homo sapiens
ugcaccaaaucaucucucau

SEQ ID NO: 1384914 - RNA, 15 nt, Homo sapiens
ugcacccacccagga

SEQ ID NO: 1384915 - RNA, 23 nt, Homo sapiens
ugcaccugucauaugcucugauu

SEQ ID NO: 1384916 - RNA, 16 nt, Homo sapiens
ugcacuaugagccuau

SEQ ID NO: 1384917 - RNA, 16 nt, Homo sapiens
ugcacuccagccuggg

SEQ ID NO: 1384918 - RNA, 17 nt, Homo sapiens
ugcagaauccaaaguaa

SEQ ID NO: 1384919 - RNA, 20 nt, Homo sapiens
ugcagaauuguuuuuugcuc

SEQ ID NO: 1384920 - RNA, 13 nt, Homo sapiens
ugcagacuggagg

SEQ ID NO: 1384921 - RNA, 17 nt, Homo sapiens
ugcagagugcccagaac

SEQ ID NO: 1384922 - RNA, 15 nt, Homo sapiens
ugcagcaaccagagc

SEQ ID NO: 1384923 - RNA, 20 nt, Homo sapiens
ugcagcaaccagagcacugu

SEQ ID NO: 1384924 - RNA, 22 nt, Homo sapiens
ugcagcagugagucucuucaga

SEQ ID NO: 1384925 - RNA, 18 nt, Homo sapiens
ugcagcuguaaacauauu

SEQ ID NO: 1384926 - RNA, 23 nt, Homo sapiens
ugcaggaagugucuagaggaaua

SEQ ID NO: 1384927 - RNA, 17 nt, Homo sapiens
ugcaggcaagugggaua

SEQ ID NO: 1384928 - RNA, 20 nt, Homo sapiens
ugcagucacagcuacacaga

SEQ ID NO: 1384929 - RNA, 22 nt, Homo sapiens
ugcagucauuaugagaggcaau

SEQ ID NO: 1384930 - RNA, 15 nt, Homo sapiens
ugcagugagcugugu

SEQ ID NO: 1384931 - RNA, 19 nt, Homo sapiens
ugcaguggcccccacagaa

SEQ ID NO: 1384932 - RNA, 20 nt, Homo sapiens
ugcauaaaauguuaaguuga

SEQ ID NO: 1384933 - RNA, 18 nt, Homo sapiens
ugcauaauaagcuaaaga

SEQ ID NO: 1384934 - RNA, 15 nt, Homo sapiens
ugcauacacucucaa

SEQ ID NO: 1384935 - RNA, 18 nt, Homo sapiens
ugcauacagagacagaua

SEQ ID NO: 1384936 - RNA, 14 nt, Homo sapiens
ugcaucauguugaa

SEQ ID NO: 1384937 - RNA, 19 nt, Homo sapiens
ugcaucguuucaucuucca

SEQ ID NO: 1384938 - RNA, 12 nt, Homo sapiens
ugcaucuacuca

SEQ ID NO: 1384939 - RNA, 16 nt, Homo sapiens
ugcaucugcuacugug

SEQ ID NO: 1384940 - RNA, 18 nt, Homo sapiens
ugcaucugcuacuguguc

SEQ ID NO: 1384941 - RNA, 15 nt, Homo sapiens
ugcaucuguacucac

SEQ ID NO: 1384942 - RNA, 19 nt, Homo sapiens
ugcauguaucuucuaagaa

SEQ ID NO: 1384943 - RNA, 22 nt, Homo sapiens
ugcauguccucuuguugcugag

SEQ ID NO: 1384944 - RNA, 15 nt, Homo sapiens
ugcauucacccagac

SEQ ID NO: 1384945 - RNA, 16 nt, Homo sapiens
ugcauucacccagaca

SEQ ID NO: 1384946 - RNA, 19 nt, Homo sapiens
ugcauuuucccagauacuu

SEQ ID NO: 1384947 - RNA, 16 nt, Homo sapiens
ugcauuuuuagaccau

SEQ ID NO: 1384948 - RNA, 15 nt, Homo sapiens
ugccaaacagccaca

SEQ ID NO: 1384949 - RNA, 21 nt, Homo sapiens
ugccaaccggucacccaggag

SEQ ID NO: 1384950 - RNA, 23 nt, Homo sapiens
ugccaauugaauaggaucaaauu

SEQ ID NO: 1384951 - RNA, 20 nt, Homo sapiens
ugccaccauggccagccaac

SEQ ID NO: 1384952 - RNA, 18 nt, Homo sapiens
ugccagaaagcauaaaau

SEQ ID NO: 1384953 - RNA, 19 nt, Homo sapiens
ugccaggcucuaaagccaa

SEQ ID NO: 1384954 - RNA, 18 nt, Homo sapiens
ugccagggacugacaaaa

SEQ ID NO: 1384955 - RNA, 21 nt, Homo sapiens
ugccauagaggacagcaacug

SEQ ID NO: 1384956 - RNA, 14 nt, Homo sapiens
ugccaucauaccca

SEQ ID NO: 1384957 - RNA, 15 nt, Homo sapiens
ugccaugccagcuua

SEQ ID NO: 1384958 - RNA, 16 nt, Homo sapiens
ugccaugugugcugaa

SEQ ID NO: 1384959 - RNA, 22 nt, Homo sapiens
gaaucaauccagcgguucucaa

SEQ ID NO: 1384960 - RNA, 19 nt, Homo sapiens
gaaucacugcucacacugc

SEQ ID NO: 1384961 - RNA, 17 nt, Homo sapiens
gaaucagaucauuucaa

SEQ ID NO: 1384962 - RNA, 21 nt, Homo sapiens
gaaucagccuacaggccucac

SEQ ID NO: 1384963 - RNA, 23 nt, Homo sapiens
gaaucagugaagaugccagugaa

SEQ ID NO: 1384964 - RNA, 16 nt, Homo sapiens
gaauccagacccggcu

SEQ ID NO: 1384965 - RNA, 17 nt, Homo sapiens
gaaucccggcugucaag

SEQ ID NO: 1384966 - RNA, 14 nt, Homo sapiens
gaauccuacauaca

SEQ ID NO: 1384967 - RNA, 21 nt, Homo sapiens
gaaucugcauuuagcacaaaa

SEQ ID NO: 1384968 - RNA, 11 nt, Homo sapiens
gaaucuucucu

SEQ ID NO: 1384969 - RNA, 15 nt, Homo sapiens
gaaucuucuguucca

SEQ ID NO: 1384970 - RNA, 15 nt, Homo sapiens
gaaugaaagacugaa

SEQ ID NO: 1384971 - RNA, 14 nt, Homo sapiens
gaaugaacaaccuc

SEQ ID NO: 1384972 - RNA, 20 nt, Homo sapiens
gaaugagacugaacugugug

SEQ ID NO: 1384973 - RNA, 17 nt, Homo sapiens
gaaugagcaaaaccaaa

SEQ ID NO: 1384974 - RNA, 18 nt, Homo sapiens
gaaugaggucccaggcag

SEQ ID NO: 1384975 - RNA, 22 nt, Homo sapiens
gaaugauuuagguacgucaaag

SEQ ID NO: 1384976 - RNA, 20 nt, Homo sapiens
gaaugcggccgcauucccug

SEQ ID NO: 1384977 - RNA, 23 nt, Homo sapiens
gaaugucuuugguccucuugcca

SEQ ID NO: 1384978 - RNA, 20 nt, Homo sapiens
gaauguguuauuugucacaa

SEQ ID NO: 1384979 - RNA, 17 nt, Homo sapiens
gaauguuuuccuucuac

SEQ ID NO: 1384980 - RNA, 19 nt, Homo sapiens
gaauuaaggaagugacuca

SEQ ID NO: 1384981 - RNA, 23 nt, Homo sapiens
gaauuaaguuagggaauggcaca

SEQ ID NO: 1384982 - RNA, 15 nt, Homo sapiens
gaauuaugucugcug

SEQ ID NO: 1384983 - RNA, 17 nt, Homo sapiens
gaauuaugucugcugaa

SEQ ID NO: 1384984 - RNA, 19 nt, Homo sapiens
gaauucuaagcuggugccc

SEQ ID NO: 1384985 - RNA, 15 nt, Homo sapiens
gaauucuccaaaaca

SEQ ID NO: 1384986 - RNA, 23 nt, Homo sapiens
gaauucuuacauguuuucuuugc

SEQ ID NO: 1384987 - RNA, 17 nt, Homo sapiens
gaauugcuuaccaaagg

SEQ ID NO: 1384988 - RNA, 20 nt, Homo sapiens
gaauuucuaaaaaacagagg

SEQ ID NO: 1384989 - RNA, 17 nt, Homo sapiens
gaauuucuguucuucca

SEQ ID NO: 1384990 - RNA, 13 nt, Homo sapiens
gaauuuuguugcu

SEQ ID NO: 1384991 - RNA, 22 nt, Homo sapiens
gacaaaccagaagcaacagaaa

SEQ ID NO: 1384992 - RNA, 18 nt, Homo sapiens
gacaaagacaaauucugu

SEQ ID NO: 1384993 - RNA, 12 nt, Homo sapiens
gacaaagccaaa

SEQ ID NO: 1384994 - RNA, 17 nt, Homo sapiens
gacaaagguuuuccucu

SEQ ID NO: 1384995 - RNA, 13 nt, Homo sapiens
gacaaagucucca

SEQ ID NO: 1384996 - RNA, 13 nt, Homo sapiens
gacaaauucuguu

SEQ ID NO: 1384997 - RNA, 23 nt, Homo sapiens
gacaaugaaaguuugcacuguau

SEQ ID NO: 1384998 - RNA, 16 nt, Homo sapiens
gacaaugaugaugaua

SEQ ID NO: 1384999 - RNA, 22 nt, Homo sapiens
gacacagggcauccaacugaga

SEQ ID NO: 1385000 - RNA, 24 nt, Homo sapiens
gacacaugcugaacaucacagcuu

SEQ ID NO: 1385001 - RNA, 18 nt, Homo sapiens
gacacuguuugcccagug

SEQ ID NO: 1385002 - RNA, 23 nt, Homo sapiens
gacagaauaaugaauggacucaa

SEQ ID NO: 1385003 - RNA, 12 nt, Homo sapiens
gacagaccuuca

SEQ ID NO: 1385004 - RNA, 16 nt, Homo sapiens
gacagagcgagacucc

SEQ ID NO: 1385005 - RNA, 14 nt, Homo sapiens
gacagagucucacu

SEQ ID NO: 1385006 - RNA, 21 nt, Homo sapiens
gacagauuccaggcgaugugc

SEQ ID NO: 1385007 - RNA, 19 nt, Homo sapiens
gacaggacagcauggugca

SEQ ID NO: 1385008 - RNA, 15 nt, Homo sapiens
gacaggcagugccau

SEQ ID NO: 1385009 - RNA, 14 nt, Homo sapiens
gacagugccuggga

SEQ ID NO: 1385010 - RNA, 18 nt, Homo sapiens
gacauaauuucacugaau

SEQ ID NO: 1385011 - RNA, 15 nt, Homo sapiens
gacauauacuaagau

SEQ ID NO: 1385012 - RNA, 16 nt, Homo sapiens
gacaucgguucauauu

SEQ ID NO: 1385013 - RNA, 21 nt, Homo sapiens
gacaugcgggcugggcagcug

SEQ ID NO: 1385014 - RNA, 18 nt, Homo sapiens
gacauuaagcaucacaaa

SEQ ID NO: 1385015 - RNA, 20 nt, Homo sapiens
gacauucuggaaaagcaaaa

SEQ ID NO: 1385016 - RNA, 16 nt, Homo sapiens
gacauuggacuuccuc

SEQ ID NO: 1385017 - RNA, 16 nt, Homo sapiens
gacauuguuggccaaa

SEQ ID NO: 1385018 - RNA, 11 nt, Homo sapiens
gacauuuugcc

SEQ ID NO: 1385019 - RNA, 17 nt, Homo sapiens
gaccaaaaugacaauga

SEQ ID NO: 1385020 - RNA, 21 nt, Homo sapiens
gaccaaaaugacaaugaugau

SEQ ID NO: 1385021 - RNA, 21 nt, Homo sapiens
gaccacgcuuucuagcuguug

SEQ ID NO: 1385022 - RNA, 12 nt, Homo sapiens
gaccacuccugu

SEQ ID NO: 1385023 - RNA, 17 nt, Homo sapiens
gaccacuguuaucaaaa

SEQ ID NO: 1385024 - RNA, 23 nt, Homo sapiens
gaccacuuuccccgugggccaug

SEQ ID NO: 1385025 - RNA, 21 nt, Homo sapiens
gaccaguaugcuuggacugaa

SEQ ID NO: 1385026 - RNA, 19 nt, Homo sapiens
gaccaguuguugauaacca

SEQ ID NO: 1385027 - RNA, 19 nt, Homo sapiens
gaccauuuuuacauccaug

SEQ ID NO: 1385028 - RNA, 16 nt, Homo sapiens
gacccagggaugacau

SEQ ID NO: 1385029 - RNA, 17 nt, Homo sapiens
gacccuaaaucugagga

SEQ ID NO: 1385030 - RNA, 15 nt, Homo sapiens
gacccuagcucuuuc

SEQ ID NO: 1385031 - RNA, 15 nt, Homo sapiens
gaccgccccucacca

SEQ ID NO: 1385032 - RNA, 17 nt, Homo sapiens
gaccgccccucaccaac

SEQ ID NO: 1385033 - RNA, 21 nt, Homo sapiens
gaccggaggcaaaaggcagug

SEQ ID NO: 1385034 - RNA, 15 nt, Homo sapiens
gaccgugaccaucuu

SEQ ID NO: 1385035 - RNA, 23 nt, Homo sapiens
gaccuaacauucgaucucauuca

SEQ ID NO: 1385036 - RNA, 11 nt, Homo sapiens
gaccucaggug

SEQ ID NO: 1385037 - RNA, 17 nt, Homo sapiens
gaccucaggugcuaggg

SEQ ID NO: 1385038 - RNA, 16 nt, Homo sapiens
gaccucugggcuuuga

SEQ ID NO: 1385039 - RNA, 19 nt, Homo sapiens
gaccugccaggcacacuga

SEQ ID NO: 1385040 - RNA, 17 nt, Homo sapiens
gaccuguaaucauauaa

SEQ ID NO: 1385041 - RNA, 11 nt, Homo sapiens
gaccuguguuu

SEQ ID NO: 1385042 - RNA, 13 nt, Homo sapiens
gaccuucuaggaa

SEQ ID NO: 1385043 - RNA, 17 nt, Homo sapiens
gaccuuuuauccacuua

SEQ ID NO: 1385044 - RNA, 14 nt, Homo sapiens
gaaacuaacacagc

SEQ ID NO: 1385045 - RNA, 17 nt, Homo sapiens
gaaacuaacacagccau

SEQ ID NO: 1385046 - RNA, 19 nt, Homo sapiens
gaaacuaacacagccauca

SEQ ID NO: 1385047 - RNA, 15 nt, Homo sapiens
gaaacugacacaugc

SEQ ID NO: 1385048 - RNA, 18 nt, Homo sapiens
gaaacuguagucucagga

SEQ ID NO: 1385049 - RNA, 19 nt, Homo sapiens
gaaacuguagucucaggac

SEQ ID NO: 1385050 - RNA, 22 nt, Homo sapiens
gaaacuguagucucaggaccua

SEQ ID NO: 1385051 - RNA, 16 nt, Homo sapiens
gaaacuucaagcacca

SEQ ID NO: 1385052 - RNA, 14 nt, Homo sapiens
gaaagaaaucaugu

SEQ ID NO: 1385053 - RNA, 14 nt, Homo sapiens
gaaagaaguaggca

SEQ ID NO: 1385054 - RNA, 14 nt, Homo sapiens
gaaagaagugggga

SEQ ID NO: 1385055 - RNA, 22 nt, Homo sapiens
gaaagcuguggccagcuuguua

SEQ ID NO: 1385056 - RNA, 21 nt, Homo sapiens
gaaaggaccaguaugcuugga

SEQ ID NO: 1385057 - RNA, 21 nt, Homo sapiens
gaaaggagaacuauccaaaac

SEQ ID NO: 1385058 - RNA, 22 nt, Homo sapiens
gaaaggagaacuauccaaaacu

SEQ ID NO: 1385059 - RNA, 16 nt, Homo sapiens
gaaaggcauucucuga

SEQ ID NO: 1385060 - RNA, 13 nt, Homo sapiens
gaaaggcucaguc

SEQ ID NO: 1385061 - RNA, 15 nt, Homo sapiens
gaaaguauaacugag

SEQ ID NO: 1385062 - RNA, 15 nt, Homo sapiens
gaaagugaccauguu

SEQ ID NO: 1385063 - RNA, 22 nt, Homo sapiens
gaaaguucccccaucaguuccc

SEQ ID NO: 1385064 - RNA, 18 nt, Homo sapiens
gaaauaaaguuggugaca

SEQ ID NO: 1385065 - RNA, 19 nt, Homo sapiens
gaaauaaaguuggugacag

SEQ ID NO: 1385066 - RNA, 22 nt, Homo sapiens
gaaauaaauguaccugauguac

SEQ ID NO: 1385067 - RNA, 16 nt, Homo sapiens
gaaauagacaguauau

SEQ ID NO: 1385068 - RNA, 13 nt, Homo sapiens
gaaauauaaugca

SEQ ID NO: 1385069 - RNA, 19 nt, Homo sapiens
gaaauauccagaacauacu

SEQ ID NO: 1385070 - RNA, 16 nt, Homo sapiens
gaaaucaaaaagggaa

SEQ ID NO: 1385071 - RNA, 21 nt, Homo sapiens
gaaaucccccuuucucuaaua

SEQ ID NO: 1385072 - RNA, 13 nt, Homo sapiens
gaaaucugccaau

SEQ ID NO: 1385073 - RNA, 17 nt, Homo sapiens
gaaaucugugcaauaaa

SEQ ID NO: 1385074 - RNA, 12 nt, Homo sapiens
gaaaugcacaau

SEQ ID NO: 1385075 - RNA, 14 nt, Homo sapiens
gaaaugcagaguca

SEQ ID NO: 1385076 - RNA, 13 nt, Homo sapiens
gaaaugccagugu

SEQ ID NO: 1385077 - RNA, 23 nt, Homo sapiens
gaaaugcccaucuaugucccuug

SEQ ID NO: 1385078 - RNA, 22 nt, Homo sapiens
gaaaugucuccacccgugucca

SEQ ID NO: 1385079 - RNA, 19 nt, Homo sapiens
gaaaugucuggucugucca

SEQ ID NO: 1385080 - RNA, 22 nt, Homo sapiens
gaaauguucguuuucuccugcc

SEQ ID NO: 1385081 - RNA, 13 nt, Homo sapiens
gaaauuaaccaua

SEQ ID NO: 1385082 - RNA, 19 nt, Homo sapiens
gaaauugcauuuccugaca

SEQ ID NO: 1385083 - RNA, 20 nt, Homo sapiens
gaaauuuaauucauguuucu

SEQ ID NO: 1385084 - RNA, 22 nt, Homo sapiens
gaacaacuaggcuucagcauau

SEQ ID NO: 1385085 - RNA, 22 nt, Homo sapiens
gaacacaauaaacuauuuugaa

SEQ ID NO: 1385086 - RNA, 17 nt, Homo sapiens
gaacacugcacucuuaa

SEQ ID NO: 1385087 - RNA, 20 nt, Homo sapiens
gaacacugggggaggggaca

SEQ ID NO: 1385088 - RNA, 19 nt, Homo sapiens
gaacagaaggaugaaugag

SEQ ID NO: 1385089 - RNA, 12 nt, Homo sapiens
gaacaguuugua

SEQ ID NO: 1385090 - RNA, 14 nt, Homo sapiens
gaacauaaagccuu

SEQ ID NO: 1385091 - RNA, 19 nt, Homo sapiens
gaacauggggaguguuuca

SEQ ID NO: 1385092 - RNA, 17 nt, Homo sapiens
gaacauuaaauagcaaa

SEQ ID NO: 1385093 - RNA, 15 nt, Homo sapiens
gaaccaggcaacuug

SEQ ID NO: 1385094 - RNA, 18 nt, Homo sapiens
gaaccaggcaacuuggga

SEQ ID NO: 1385095 - RNA, 11 nt, Homo sapiens
gaaccuuccau

SEQ ID NO: 1385096 - RNA, 17 nt, Homo sapiens
gaacgguaaauuucugu

SEQ ID NO: 1385097 - RNA, 15 nt, Homo sapiens
gaacuaacaugcaaa

SEQ ID NO: 1385098 - RNA, 14 nt, Homo sapiens
gaacuauguacuuu

SEQ ID NO: 1385099 - RNA, 14 nt, Homo sapiens
gaacucgcuucucu

SEQ ID NO: 1385100 - RNA, 14 nt, Homo sapiens
gaacucucuccacc

SEQ ID NO: 1385101 - RNA, 13 nt, Homo sapiens
gaacucugagcag

SEQ ID NO: 1385102 - RNA, 16 nt, Homo sapiens
gaacucuggaguucau

SEQ ID NO: 1385103 - RNA, 22 nt, Homo sapiens
gaacucuggggagccugagcca

SEQ ID NO: 1385104 - RNA, 21 nt, Homo sapiens
gaacucuucaaucucuugcac

SEQ ID NO: 1385105 - RNA, 17 nt, Homo sapiens
gaacugcauauguuucg

SEQ ID NO: 1385106 - RNA, 23 nt, Homo sapiens
gaacuggaaaccaggaacucugg

SEQ ID NO: 1385107 - RNA, 19 nt, Homo sapiens
gaacuggaggaguuccuug

SEQ ID NO: 1385108 - RNA, 15 nt, Homo sapiens
gaacuugagcgugaa

SEQ ID NO: 1385109 - RNA, 22 nt, Homo sapiens
gaacuuuguccgguggaaggcc

SEQ ID NO: 1385110 - RNA, 20 nt, Homo sapiens
gaagaaagagcaacaaucca

SEQ ID NO: 1385111 - RNA, 19 nt, Homo sapiens
gaagaagcaucuuccuuag

SEQ ID NO: 1385112 - RNA, 13 nt, Homo sapiens
gaagacaauguga

SEQ ID NO: 1385113 - RNA, 15 nt, Homo sapiens
gaagacacugcaaag

SEQ ID NO: 1385114 - RNA, 20 nt, Homo sapiens
gaagaccaagacacagauca

SEQ ID NO: 1385115 - RNA, 23 nt, Homo sapiens
gaagagaauauuagcuuuacugu

SEQ ID NO: 1385116 - RNA, 14 nt, Homo sapiens
gaagagauccuucu

SEQ ID NO: 1385117 - RNA, 20 nt, Homo sapiens
gaagagggagaagcaugaaa

SEQ ID NO: 1385118 - RNA, 20 nt, Homo sapiens
gaagauguuucaaaaaaucu

SEQ ID NO: 1385119 - RNA, 21 nt, Homo sapiens
gaagcaucacauaaaaaugau

SEQ ID NO: 1385120 - RNA, 20 nt, Homo sapiens
gaagccacugaagcugggau

SEQ ID NO: 1385121 - RNA, 14 nt, Homo sapiens
gaagccaugugauu

SEQ ID NO: 1385122 - RNA, 17 nt, Homo sapiens
gaagcccaagauaucag

SEQ ID NO: 1385123 - RNA, 19 nt, Homo sapiens
gaagcccauuccucugcca

SEQ ID NO: 1385124 - RNA, 21 nt, Homo sapiens
gaagccucacugcaagcacug

SEQ ID NO: 1385125 - RNA, 22 nt, Homo sapiens
gaagcucccugaaguaagcaaa

SEQ ID NO: 1385126 - RNA, 18 nt, Homo sapiens
gaagcucucgauggacaa

SEQ ID NO: 1385127 - RNA, 13 nt, Homo sapiens
gaagcugcuccgu

SEQ ID NO: 1385128 - RNA, 12 nt, Homo sapiens
gaagcugugaaa

SEQ ID NO: 1385129 - RNA, 21 nt, Homo sapiens
gaaggaagucagcaugccucu

SEQ ID NO: 1385130 - RNA, 23 nt, Homo sapiens
gaaggaugucccggguguguaca

SEQ ID NO: 1385131 - RNA, 15 nt, Homo sapiens
cuugucauugccagc

SEQ ID NO: 1385132 - RNA, 15 nt, Homo sapiens
cuuguccauguaaua

SEQ ID NO: 1385133 - RNA, 18 nt, Homo sapiens
cuugugacuagugcugaa

SEQ ID NO: 1385134 - RNA, 17 nt, Homo sapiens
cuugugagggacugaga

SEQ ID NO: 1385135 - RNA, 17 nt, Homo sapiens
cuuguguccacugugac

SEQ ID NO: 1385136 - RNA, 23 nt, Homo sapiens
cuuguguguguguguugauccca

SEQ ID NO: 1385137 - RNA, 14 nt, Homo sapiens
cuuguguuuuuaac

SEQ ID NO: 1385138 - RNA, 16 nt, Homo sapiens
cuuguuccccacugac

SEQ ID NO: 1385139 - RNA, 13 nt, Homo sapiens
cuuguugcucaaa

SEQ ID NO: 1385140 - RNA, 17 nt, Homo sapiens
cuuguugcugcaucucc

SEQ ID NO: 1385141 - RNA, 14 nt, Homo sapiens
cuuguuuccaaaaa

SEQ ID NO: 1385142 - RNA, 21 nt, Homo sapiens
cuuguuuuuccacuacugcua

SEQ ID NO: 1385143 - RNA, 22 nt, Homo sapiens
cuuuaaaaauaugcaccaaauc

SEQ ID NO: 1385144 - RNA, 20 nt, Homo sapiens
cuuuaaaaguauccagagau

SEQ ID NO: 1385145 - RNA, 22 nt, Homo sapiens
cuuuaaacacggggcuugcaac

SEQ ID NO: 1385146 - RNA, 14 nt, Homo sapiens
cuuuaaauuucaaa

SEQ ID NO: 1385147 - RNA, 18 nt, Homo sapiens
cuuuaaauuucaucucag

SEQ ID NO: 1385148 - RNA, 18 nt, Homo sapiens
cuuuaauagaaguuuuau

SEQ ID NO: 1385149 - RNA, 19 nt, Homo sapiens
cuuuaaucuucaguuuuau

SEQ ID NO: 1385150 - RNA, 22 nt, Homo sapiens
cuuuaauuguuaagauaugaug

SEQ ID NO: 1385151 - RNA, 21 nt, Homo sapiens
cuuuacaaaaagacacuugau

SEQ ID NO: 1385152 - RNA, 15 nt, Homo sapiens
cuuuacauaugcuuu

SEQ ID NO: 1385153 - RNA, 22 nt, Homo sapiens
cuuuacggguguaaacacugau

SEQ ID NO: 1385154 - RNA, 13 nt, Homo sapiens
cuuuacuggcuua

SEQ ID NO: 1385155 - RNA, 19 nt, Homo sapiens
cuuuacuguuagucauuug

SEQ ID NO: 1385156 - RNA, 20 nt, Homo sapiens
cuuuacuucauggacuucca

SEQ ID NO: 1385157 - RNA, 15 nt, Homo sapiens
cuuuagcgcccaguu

SEQ ID NO: 1385158 - RNA, 15 nt, Homo sapiens
cuuuauacucaggca

SEQ ID NO: 1385159 - RNA, 19 nt, Homo sapiens
cuuuauuccuucauuucau

SEQ ID NO: 1385160 - RNA, 13 nt, Homo sapiens
cuuuauugcucau

SEQ ID NO: 1385161 - RNA, 15 nt, Homo sapiens
cuuucaagcaaaaaa

SEQ ID NO: 1385162 - RNA, 14 nt, Homo sapiens
cuuucacacuucca

SEQ ID NO: 1385163 - RNA, 17 nt, Homo sapiens
cuuucacaguaccaucu

SEQ ID NO: 1385164 - RNA, 24 nt, Homo sapiens
cuuucaggccacauggcuaaagaa

SEQ ID NO: 1385165 - RNA, 13 nt, Homo sapiens
cuuuccacauuca

SEQ ID NO: 1385166 - RNA, 16 nt, Homo sapiens
cuuucccaucuuccaa

SEQ ID NO: 1385167 - RNA, 17 nt, Homo sapiens
cuuuccccgugggccau

SEQ ID NO: 1385168 - RNA, 19 nt, Homo sapiens
cuuucccuuuaucaguuug

SEQ ID NO: 1385169 - RNA, 14 nt, Homo sapiens
cuuuccuacucuca

SEQ ID NO: 1385170 - RNA, 20 nt, Homo sapiens
cuuuccugaucacuaugcau

SEQ ID NO: 1385171 - RNA, 14 nt, Homo sapiens
cuuuccuucauuca

SEQ ID NO: 1385172 - RNA, 15 nt, Homo sapiens
cuuuccuucauucaa

SEQ ID NO: 1385173 - RNA, 22 nt, Homo sapiens
cuuucucccaggccaggcuccu

SEQ ID NO: 1385174 - RNA, 22 nt, Homo sapiens
cuuucucuuguaaacguuucag

SEQ ID NO: 1385175 - RNA, 19 nt, Homo sapiens
cuuucugcuaucaaagagg

SEQ ID NO: 1385176 - RNA, 13 nt, Homo sapiens
cuuucuggcuuug

SEQ ID NO: 1385177 - RNA, 11 nt, Homo sapiens
cuuucuucccu

SEQ ID NO: 1385178 - RNA, 21 nt, Homo sapiens
cuuucuucucccaauucaucc

SEQ ID NO: 1385179 - RNA, 14 nt, Homo sapiens
cuuucuucucucca

SEQ ID NO: 1385180 - RNA, 15 nt, Homo sapiens
cuuucuucucuccag

SEQ ID NO: 1385181 - RNA, 14 nt, Homo sapiens
cuuucuuuggugcc

SEQ ID NO: 1385182 - RNA, 22 nt, Homo sapiens
cuuugaagugacuucacagaga

SEQ ID NO: 1385183 - RNA, 20 nt, Homo sapiens
cuuugaccucaaccugugau

SEQ ID NO: 1385184 - RNA, 14 nt, Homo sapiens
cuuugaucaguaua

SEQ ID NO: 1385185 - RNA, 15 nt, Homo sapiens
cuuugcaaauggugg

SEQ ID NO: 1385186 - RNA, 20 nt, Homo sapiens
cuuugcuauggggacauucc

SEQ ID NO: 1385187 - RNA, 17 nt, Homo sapiens
cuuugcuuaaacuacaa

SEQ ID NO: 1385188 - RNA, 14 nt, Homo sapiens
cuuuggccauucca

SEQ ID NO: 1385189 - RNA, 18 nt, Homo sapiens
cuuugggauucuuuccau

SEQ ID NO: 1385190 - RNA, 15 nt, Homo sapiens
cuuuguaugcacuuu

SEQ ID NO: 1385191 - RNA, 17 nt, Homo sapiens
cuuuguaugcacuuugu

SEQ ID NO: 1385192 - RNA, 15 nt, Homo sapiens
cuuugucagcaauac

SEQ ID NO: 1385193 - RNA, 23 nt, Homo sapiens
cuuugucccggggcuccacugaa

SEQ ID NO: 1385194 - RNA, 15 nt, Homo sapiens
cuuuguucuucuacc

SEQ ID NO: 1385195 - RNA, 11 nt, Homo sapiens
cuuuguugccc

SEQ ID NO: 1385196 - RNA, 16 nt, Homo sapiens
cuuuguugcucagcaa

SEQ ID NO: 1385197 - RNA, 21 nt, Homo sapiens
cuuuguuuagcccaaaaccaa

SEQ ID NO: 1385198 - RNA, 16 nt, Homo sapiens
cuuuuaaaugcauaaa

SEQ ID NO: 1385199 - RNA, 22 nt, Homo sapiens
cuuuuaaggcuaaaacuuaaca

SEQ ID NO: 1385200 - RNA, 16 nt, Homo sapiens
cuuuuaguuguaucuc

SEQ ID NO: 1385201 - RNA, 19 nt, Homo sapiens
cuuuuauccacuuaccuag

SEQ ID NO: 1385202 - RNA, 12 nt, Homo sapiens
cuuuuauuacau

SEQ ID NO: 1385203 - RNA, 15 nt, Homo sapiens
cuuuucaaacugaua

SEQ ID NO: 1385204 - RNA, 13 nt, Homo sapiens
cuuuucaaugugu

SEQ ID NO: 1385205 - RNA, 15 nt, Homo sapiens
cuuuucauaaccuag

SEQ ID NO: 1385206 - RNA, 18 nt, Homo sapiens
cuuuucauaaccuagccu

SEQ ID NO: 1385207 - RNA, 22 nt, Homo sapiens
cuuuuccaugcacccucauaca

SEQ ID NO: 1385208 - RNA, 21 nt, Homo sapiens
cuuuuccccggucccuugaga

SEQ ID NO: 1385209 - RNA, 16 nt, Homo sapiens
cuuuucccuaagccaa

SEQ ID NO: 1385210 - RNA, 21 nt, Homo sapiens
cuuuucgcaggauucuuccuc

SEQ ID NO: 1385211 - RNA, 14 nt, Homo sapiens
cuuuucuccaugag

SEQ ID NO: 1385212 - RNA, 19 nt, Homo sapiens
cuuuucuuuuuuuguccac

SEQ ID NO: 1385213 - RNA, 23 nt, Homo sapiens
cuuuugacagcugugcuguaaca

SEQ ID NO: 1385214 - RNA, 22 nt, Homo sapiens
cuuuuguuccccagcccuaaga

SEQ ID NO: 1385215 - RNA, 18 nt, Homo sapiens
cuuuuguuuugaguuacu

SEQ ID NO: 1385216 - RNA, 20 nt, Homo sapiens
cuuuuuaauauugauaugcu

SEQ ID NO: 1385217 - RNA, 13 nt, Homo sapiens
cuuuuucuuugaa

SEQ ID NO: 1385218 - RNA, 18 nt, Homo sapiens
cuuuuuuauacucaauca

SEQ ID NO: 1385219 - RNA, 15 nt, Homo sapiens
cuuuuuuuccaauuu

SEQ ID NO: 1385220 - RNA, 19 nt, Homo sapiens
aaugagaacauguugguau

SEQ ID NO: 1385221 - RNA, 22 nt, Homo sapiens
aaugagaagucaacagugaaau

SEQ ID NO: 1385222 - RNA, 21 nt, Homo sapiens
aaugagacugaacugugugaa

SEQ ID NO: 1385223 - RNA, 17 nt, Homo sapiens
aaugagugaaucaccug

SEQ ID NO: 1385224 - RNA, 22 nt, Homo sapiens
aaugaguguguuggcuugugau

SEQ ID NO: 1385225 - RNA, 16 nt, Homo sapiens
aaugaugaagcuuccu

SEQ ID NO: 1385226 - RNA, 19 nt, Homo sapiens
aaugaugauccuaggcauu

SEQ ID NO: 1385227 - RNA, 16 nt, Homo sapiens
aaugaugggacaauaa

SEQ ID NO: 1385228 - RNA, 22 nt, Homo sapiens
aaugauuuagguacgucaaagc

SEQ ID NO: 1385229 - RNA, 13 nt, Homo sapiens
aaugcacaucuca

SEQ ID NO: 1385230 - RNA, 14 nt, Homo sapiens
aaugcacaucucau

SEQ ID NO: 1385231 - RNA, 21 nt, Homo sapiens
aaugcagugccuuucuucucu

SEQ ID NO: 1385232 - RNA, 20 nt, Homo sapiens
aaugcauauccaacaugugc

SEQ ID NO: 1385233 - RNA, 17 nt, Homo sapiens
aaugcaucaauccugug

SEQ ID NO: 1385234 - RNA, 16 nt, Homo sapiens
aaugcauugcuaaaau

SEQ ID NO: 1385235 - RNA, 15 nt, Homo sapiens
aaugccauucucuug

SEQ ID NO: 1385236 - RNA, 14 nt, Homo sapiens
aaugcccagacauu

SEQ ID NO: 1385237 - RNA, 16 nt, Homo sapiens
aaugcucuuuacuuca

SEQ ID NO: 1385238 - RNA, 17 nt, Homo sapiens
aaugcuggcauuugcac

SEQ ID NO: 1385239 - RNA, 22 nt, Homo sapiens
aauggaaaaugauuuuacuuag

SEQ ID NO: 1385240 - RNA, 22 nt, Homo sapiens
aauggcagggauacccagugau

SEQ ID NO: 1385241 - RNA, 20 nt, Homo sapiens
aauggcucaugaccuggaaa

SEQ ID NO: 1385242 - RNA, 21 nt, Homo sapiens
aauggcuuuaugcuaguuuga

SEQ ID NO: 1385243 - RNA, 20 nt, Homo sapiens
aaugggagagcucuuguuau

SEQ ID NO: 1385244 - RNA, 23 nt, Homo sapiens
aauggggccuguuacacaugaca

SEQ ID NO: 1385245 - RNA, 21 nt, Homo sapiens
aauggguuuuguguacuguaa

SEQ ID NO: 1385246 - RNA, 17 nt, Homo sapiens
aauggugaaaugcagag

SEQ ID NO: 1385247 - RNA, 17 nt, Homo sapiens
aauggugcucauuucau

SEQ ID NO: 1385248 - RNA, 19 nt, Homo sapiens
aaugguguaaccugagaug

SEQ ID NO: 1385249 - RNA, 18 nt, Homo sapiens
aauguauucaaauaccaa

SEQ ID NO: 1385250 - RNA, 17 nt, Homo sapiens
aauguauuuguuugcaa

SEQ ID NO: 1385251 - RNA, 20 nt, Homo sapiens
aauguauuuguuugcaauuu

SEQ ID NO: 1385252 - RNA, 21 nt, Homo sapiens
aauguauuuguuugcaauuuu

SEQ ID NO: 1385253 - RNA, 12 nt, Homo sapiens
aaugucacuuaa

SEQ ID NO: 1385254 - RNA, 19 nt, Homo sapiens
aaugucagaaaccaguuau

SEQ ID NO: 1385255 - RNA, 17 nt, Homo sapiens
aaugucaggaacagaag

SEQ ID NO: 1385256 - RNA, 16 nt, Homo sapiens
aaugucuggucugucc

SEQ ID NO: 1385257 - RNA, 14 nt, Homo sapiens
aaugugacuacuua

SEQ ID NO: 1385258 - RNA, 21 nt, Homo sapiens
aauguggcuugaauguaggua

SEQ ID NO: 1385259 - RNA, 12 nt, Homo sapiens
aaugugucacua

SEQ ID NO: 1385260 - RNA, 23 nt, Homo sapiens
aauguuaaguugauggugaugaa

SEQ ID NO: 1385261 - RNA, 16 nt, Homo sapiens
aauguuuguccuguau

SEQ ID NO: 1385262 - RNA, 17 nt, Homo sapiens
aauuaaccuggugcugg

SEQ ID NO: 1385263 - RNA, 18 nt, Homo sapiens
aauuaaguccuacuuuac

SEQ ID NO: 1385264 - RNA, 18 nt, Homo sapiens
aauuaccacaccaucucc

SEQ ID NO: 1385265 - RNA, 17 nt, Homo sapiens
aauuacuaaauuacaaa

SEQ ID NO: 1385266 - RNA, 14 nt, Homo sapiens
aauuagaugaacuc

SEQ ID NO: 1385267 - RNA, 12 nt, Homo sapiens
aauuagcaauug

SEQ ID NO: 1385268 - RNA, 21 nt, Homo sapiens
aauuagcugugugaaauacca

SEQ ID NO: 1385269 - RNA, 21 nt, Homo sapiens
aauuaggagaggcagagauag

SEQ ID NO: 1385270 - RNA, 18 nt, Homo sapiens
aauuagguuuuguacaau

SEQ ID NO: 1385271 - RNA, 15 nt, Homo sapiens
aauuagucaaaccac

SEQ ID NO: 1385272 - RNA, 13 nt, Homo sapiens
aauuaucuuaaaa

SEQ ID NO: 1385273 - RNA, 15 nt, Homo sapiens
aauuaugcuuucuau

SEQ ID NO: 1385274 - RNA, 16 nt, Homo sapiens
aauuaugucugcugaa

SEQ ID NO: 1385275 - RNA, 12 nt, Homo sapiens
aauucaaaaaug

SEQ ID NO: 1385276 - RNA, 14 nt, Homo sapiens
aauucaagccuuag

SEQ ID NO: 1385277 - RNA, 14 nt, Homo sapiens
aauucaucagauaa

SEQ ID NO: 1385278 - RNA, 17 nt, Homo sapiens
aauucaucucucuuuaa

SEQ ID NO: 1385279 - RNA, 23 nt, Homo sapiens
aauucauucucugugguauccaa

SEQ ID NO: 1385280 - RNA, 22 nt, Homo sapiens
aauuccaaguagaauugauuuc

SEQ ID NO: 1385281 - RNA, 13 nt, Homo sapiens
aauuccucuggga

SEQ ID NO: 1385282 - RNA, 18 nt, Homo sapiens
ugcuccagugcaggagac

SEQ ID NO: 1385283 - RNA, 22 nt, Homo sapiens
ugcucgauuauucccuguacaa

SEQ ID NO: 1385284 - RNA, 17 nt, Homo sapiens
ugcucggccgucuucac

SEQ ID NO: 1385285 - RNA, 21 nt, Homo sapiens
ugcucucucacucccccauga

SEQ ID NO: 1385286 - RNA, 15 nt, Homo sapiens
ugcucuuagcugucu

SEQ ID NO: 1385287 - RNA, 15 nt, Homo sapiens
ugcucuuaugccauu

SEQ ID NO: 1385288 - RNA, 14 nt, Homo sapiens
ugcugaacaucaca

SEQ ID NO: 1385289 - RNA, 13 nt, Homo sapiens
ugcugcaucuccc

SEQ ID NO: 1385290 - RNA, 12 nt, Homo sapiens
ugcugccaaaca

SEQ ID NO: 1385291 - RNA, 19 nt, Homo sapiens
ugcugcuugaggcaacuca

SEQ ID NO: 1385292 - RNA, 18 nt, Homo sapiens
ugcuggaggaaaacugag

SEQ ID NO: 1385293 - RNA, 14 nt, Homo sapiens
ugcuggcagaaagc

SEQ ID NO: 1385294 - RNA, 17 nt, Homo sapiens
ugcuggcagaaagcaaa

SEQ ID NO: 1385295 - RNA, 13 nt, Homo sapiens
ugcuggcauuugc

SEQ ID NO: 1385296 - RNA, 14 nt, Homo sapiens
ugcuggcauuugca

SEQ ID NO: 1385297 - RNA, 14 nt, Homo sapiens
ugcuggcugccuua

SEQ ID NO: 1385298 - RNA, 13 nt, Homo sapiens
ugcuggucuucaa

SEQ ID NO: 1385299 - RNA, 23 nt, Homo sapiens
ugcuuaguagagcuuuuugcaug

SEQ ID NO: 1385300 - RNA, 18 nt, Homo sapiens
ugcuuauccuuccacgga

SEQ ID NO: 1385301 - RNA, 19 nt, Homo sapiens
ugcuuauuguuccaagaca

SEQ ID NO: 1385302 - RNA, 13 nt, Homo sapiens
ugcuucagccucc

SEQ ID NO: 1385303 - RNA, 23 nt, Homo sapiens
ugcuucccggcgucccuaccucc

SEQ ID NO: 1385304 - RNA, 18 nt, Homo sapiens
ugcuucuaccaacuggaa

SEQ ID NO: 1385305 - RNA, 13 nt, Homo sapiens
ugcuucuccauga

SEQ ID NO: 1385306 - RNA, 13 nt, Homo sapiens
ugcuucugggaag

SEQ ID NO: 1385307 - RNA, 19 nt, Homo sapiens
ugcuucuuaaaauagccau

SEQ ID NO: 1385308 - RNA, 17 nt, Homo sapiens
ugcuugccgaaacugga

SEQ ID NO: 1385309 - RNA, 19 nt, Homo sapiens
ugcuugccgaaacuggaag

SEQ ID NO: 1385310 - RNA, 16 nt, Homo sapiens
ugcuuucuauuuugag

SEQ ID NO: 1385311 - RNA, 22 nt, Homo sapiens
ugcuuugcaggaagugucuaga

SEQ ID NO: 1385312 - RNA, 13 nt, Homo sapiens
uggaaaagcaaaa

SEQ ID NO: 1385313 - RNA, 22 nt, Homo sapiens
uggaaaagcaaaacuguagggg

SEQ ID NO: 1385314 - RNA, 19 nt, Homo sapiens
uggaaaaggaagacuagag

SEQ ID NO: 1385315 - RNA, 20 nt, Homo sapiens
uggaaaagucuucaagggcu

SEQ ID NO: 1385316 - RNA, 19 nt, Homo sapiens
uggaaagcaucaccucagg

SEQ ID NO: 1385317 - RNA, 20 nt, Homo sapiens
uggaaagccucugcugccau

SEQ ID NO: 1385318 - RNA, 13 nt, Homo sapiens
uggaacaagcaca

SEQ ID NO: 1385319 - RNA, 17 nt, Homo sapiens
uggaacaagcacagaug

SEQ ID NO: 1385320 - RNA, 22 nt, Homo sapiens
uggaagcucugaagucacauca

SEQ ID NO: 1385321 - RNA, 23 nt, Homo sapiens
uggaaguuaaagggcauuuccaa

SEQ ID NO: 1385322 - RNA, 15 nt, Homo sapiens
uggaauaacucugug

SEQ ID NO: 1385323 - RNA, 22 nt, Homo sapiens
uggaauauaaggaaagcaauaa

SEQ ID NO: 1385324 - RNA, 17 nt, Homo sapiens
uggaauguacaugucaa

SEQ ID NO: 1385325 - RNA, 19 nt, Homo sapiens
uggaauuaugucugcugaa

SEQ ID NO: 1385326 - RNA, 13 nt, Homo sapiens
uggaauugcucaa

SEQ ID NO: 1385327 - RNA, 13 nt, Homo sapiens
uggaauugugcug

SEQ ID NO: 1385328 - RNA, 22 nt, Homo sapiens
uggacaaucaugaaauaugcau

SEQ ID NO: 1385329 - RNA, 19 nt, Homo sapiens
uggacaccccugcuauaua

SEQ ID NO: 1385330 - RNA, 17 nt, Homo sapiens
uggacagcaaaaccauu

SEQ ID NO: 1385331 - RNA, 17 nt, Homo sapiens
uggacauaagacagaca

SEQ ID NO: 1385332 - RNA, 13 nt, Homo sapiens
uggaccaaagcug

SEQ ID NO: 1385333 - RNA, 21 nt, Homo sapiens
uggacuauggcucuacuuuca

SEQ ID NO: 1385334 - RNA, 19 nt, Homo sapiens
uggacuuccacugccaucc

SEQ ID NO: 1385335 - RNA, 22 nt, Homo sapiens
uggagaaacuguagucucagga

SEQ ID NO: 1385336 - RNA, 22 nt, Homo sapiens
uggagaaauuccuugauucaca

SEQ ID NO: 1385337 - RNA, 13 nt, Homo sapiens
uggagaagcuccc

SEQ ID NO: 1385338 - RNA, 13 nt, Homo sapiens
uggagacuggaaa

SEQ ID NO: 1385339 - RNA, 22 nt, Homo sapiens
uggagacuggaaaaauccugag

SEQ ID NO: 1385340 - RNA, 13 nt, Homo sapiens
uggagaucaccag

SEQ ID NO: 1385341 - RNA, 22 nt, Homo sapiens
uggagccaccugucccaccuca

SEQ ID NO: 1385342 - RNA, 17 nt, Homo sapiens
uggagccccagugccaa

SEQ ID NO: 1385343 - RNA, 15 nt, Homo sapiens
uggaggcugcaguga

SEQ ID NO: 1385344 - RNA, 17 nt, Homo sapiens
aaaauucuuaaguaugu

SEQ ID NO: 1385345 - RNA, 15 nt, Homo sapiens
aaaauucuuggaaua

SEQ ID NO: 1385346 - RNA, 13 nt, Homo sapiens
aaaauugauauac

SEQ ID NO: 1385347 - RNA, 18 nt, Homo sapiens
aaaauuggcuaguugaau

SEQ ID NO: 1385348 - RNA, 18 nt, Homo sapiens
aaaauuugaaauuuagcu

SEQ ID NO: 1385349 - RNA, 13 nt, Homo sapiens
aaacaaagccaga

SEQ ID NO: 1385350 - RNA, 16 nt, Homo sapiens
aaacaagcaacagaug

SEQ ID NO: 1385351 - RNA, 12 nt, Homo sapiens
aaacaagccaug

SEQ ID NO: 1385352 - RNA, 22 nt, Homo sapiens
aaacacauacaggaagguagaa

SEQ ID NO: 1385353 - RNA, 21 nt, Homo sapiens
aaacacauuaagccuuccaca

SEQ ID NO: 1385354 - RNA, 17 nt, Homo sapiens
aaacaccaaaaagggau

SEQ ID NO: 1385355 - RNA, 15 nt, Homo sapiens
aaacagagaugugau

SEQ ID NO: 1385356 - RNA, 14 nt, Homo sapiens
aaacagcugagggu

SEQ ID NO: 1385357 - RNA, 18 nt, Homo sapiens
aaacagcugccaccauca

SEQ ID NO: 1385358 - RNA, 14 nt, Homo sapiens
aaacauauuggaau

SEQ ID NO: 1385359 - RNA, 18 nt, Homo sapiens
aaacauauuggaauguac

SEQ ID NO: 1385360 - RNA, 22 nt, Homo sapiens
aaacaucaguuacucugaaggg

SEQ ID NO: 1385361 - RNA, 13 nt, Homo sapiens
aaacaucuuucca

SEQ ID NO: 1385362 - RNA, 20 nt, Homo sapiens
aaacaucuuuccaguccuug

SEQ ID NO: 1385363 - RNA, 20 nt, Homo sapiens
aaacaugugguuaaugccau

SEQ ID NO: 1385364 - RNA, 23 nt, Homo sapiens
aaacaugugguuaaugccaugga

SEQ ID NO: 1385365 - RNA, 14 nt, Homo sapiens
aaacauuaguucua

SEQ ID NO: 1385366 - RNA, 12 nt, Homo sapiens
aaaccacuguac

SEQ ID NO: 1385367 - RNA, 18 nt, Homo sapiens
aaaccauaugaacauaua

SEQ ID NO: 1385368 - RNA, 15 nt, Homo sapiens
aaaccccaaacuguu

SEQ ID NO: 1385369 - RNA, 20 nt, Homo sapiens
aaacccgccucccagguuua

SEQ ID NO: 1385370 - RNA, 16 nt, Homo sapiens
aaaccuauacucacuu

SEQ ID NO: 1385371 - RNA, 22 nt, Homo sapiens
aaaccuauacucacuuucccaa

SEQ ID NO: 1385372 - RNA, 13 nt, Homo sapiens
aaaccucaucucu

SEQ ID NO: 1385373 - RNA, 15 nt, Homo sapiens
aaaccucaucucuac

SEQ ID NO: 1385374 - RNA, 14 nt, Homo sapiens
aaaccucuaugcaa

SEQ ID NO: 1385375 - RNA, 12 nt, Homo sapiens
aaaccucugggu

SEQ ID NO: 1385376 - RNA, 13 nt, Homo sapiens
aaaccuuccccag

SEQ ID NO: 1385377 - RNA, 19 nt, Homo sapiens
aaaccuuucaaauuucaca

SEQ ID NO: 1385378 - RNA, 14 nt, Homo sapiens
aaacuauauucuca

SEQ ID NO: 1385379 - RNA, 20 nt, Homo sapiens
aaacucuugaccucagguga

SEQ ID NO: 1385380 - RNA, 23 nt, Homo sapiens
aaacugauacccuuugaaaaagu

SEQ ID NO: 1385381 - RNA, 19 nt, Homo sapiens
aaacugauggauaucccua

SEQ ID NO: 1385382 - RNA, 10 nt, Homo sapiens
aaacuggaag

SEQ ID NO: 1385383 - RNA, 17 nt, Homo sapiens
aaacuguccucuuucag

SEQ ID NO: 1385384 - RNA, 23 nt, Homo sapiens
aaacuguucucuauuagacuuua

SEQ ID NO: 1385385 - RNA, 16 nt, Homo sapiens
aaacuuagcaacuugg

SEQ ID NO: 1385386 - RNA, 17 nt, Homo sapiens
aaacuuaggcaugcaca

SEQ ID NO: 1385387 - RNA, 18 nt, Homo sapiens
aaacuugaauucauagaa

SEQ ID NO: 1385388 - RNA, 21 nt, Homo sapiens
aaacuuuagaguagcaugaga

SEQ ID NO: 1385389 - RNA, 14 nt, Homo sapiens
aaagaaauagccaa

SEQ ID NO: 1385390 - RNA, 16 nt, Homo sapiens
aaagaaaugcccaucu

SEQ ID NO: 1385391 - RNA, 13 nt, Homo sapiens
aaagaaccaaaag

SEQ ID NO: 1385392 - RNA, 22 nt, Homo sapiens
aaagaaggaauucuaggcaucc

SEQ ID NO: 1385393 - RNA, 22 nt, Homo sapiens
aaagaauaauaugcugccaaau

SEQ ID NO: 1385394 - RNA, 15 nt, Homo sapiens
aaagacaggagguaa

SEQ ID NO: 1385395 - RNA, 18 nt, Homo sapiens
aaagaccaaauuccuugg

SEQ ID NO: 1385396 - RNA, 23 nt, Homo sapiens
aaagaccgugugugaaauucucu

SEQ ID NO: 1385397 - RNA, 14 nt, Homo sapiens
aaagaccugagaac

SEQ ID NO: 1385398 - RNA, 18 nt, Homo sapiens
aaagacgauuugucaguu

SEQ ID NO: 1385399 - RNA, 14 nt, Homo sapiens
aaagacuacauauu

SEQ ID NO: 1385400 - RNA, 14 nt, Homo sapiens
aaagacuguagaag

SEQ ID NO: 1385401 - RNA, 19 nt, Homo sapiens
aaagacuuuccucuuaguc

SEQ ID NO: 1385402 - RNA, 18 nt, Homo sapiens
aaagagagucgcaucuca

SEQ ID NO: 1385403 - RNA, 21 nt, Homo sapiens
aaagagcaacaauccaucucu

SEQ ID NO: 1385404 - RNA, 16 nt, Homo sapiens
aaagagguagcacuac

SEQ ID NO: 1385405 - RNA, 14 nt, Homo sapiens
aaagaguccuauuu

SEQ ID NO: 1385406 - RNA, 23 nt, Homo sapiens
aaagauaaucucucagcuuuuaa

SEQ ID NO: 1385407 - RNA, 12 nt, Homo sapiens
auuauguacaaa

SEQ ID NO: 1385408 - RNA, 19 nt, Homo sapiens
auuauuuauugcuguguaa

SEQ ID NO: 1385409 - RNA, 19 nt, Homo sapiens
auuauuuuaauuagguuaa

SEQ ID NO: 1385410 - RNA, 22 nt, Homo sapiens
auucaacugccauguuuugcca

SEQ ID NO: 1385411 - RNA, 13 nt, Homo sapiens
auucaaguguaca

SEQ ID NO: 1385412 - RNA, 18 nt, Homo sapiens
auucacaaaauuuccaca

SEQ ID NO: 1385413 - RNA, 20 nt, Homo sapiens
auucaccucucucacugacu

SEQ ID NO: 1385414 - RNA, 18 nt, Homo sapiens
auucacuagaccagaagu

SEQ ID NO: 1385415 - RNA, 16 nt, Homo sapiens
auucagccaggagaug

SEQ ID NO: 1385416 - RNA, 21 nt, Homo sapiens
auucagucucuucuaagcaaa

SEQ ID NO: 1385417 - RNA, 22 nt, Homo sapiens
auucagucucuucuaagcaaaa

SEQ ID NO: 1385418 - RNA, 23 nt, Homo sapiens
auucagugagggucuucuuacau

SEQ ID NO: 1385419 - RNA, 23 nt, Homo sapiens
auucagugcuguacuugaugaca

SEQ ID NO: 1385420 - RNA, 22 nt, Homo sapiens
auucauauuuacuucuuauaca

SEQ ID NO: 1385421 - RNA, 22 nt, Homo sapiens
auucaugccagggacugacaaa

SEQ ID NO: 1385422 - RNA, 13 nt, Homo sapiens
auucaugcugauu

SEQ ID NO: 1385423 - RNA, 15 nt, Homo sapiens
auucauuuaacagag

SEQ ID NO: 1385424 - RNA, 16 nt, Homo sapiens
auucauuuaacagagc

SEQ ID NO: 1385425 - RNA, 14 nt, Homo sapiens
auuccaacagcuca

SEQ ID NO: 1385426 - RNA, 15 nt, Homo sapiens
auuccaauuugcacu

SEQ ID NO: 1385427 - RNA, 20 nt, Homo sapiens
auuccacaaccugguuugcc

SEQ ID NO: 1385428 - RNA, 16 nt, Homo sapiens
auuccaggcgaugugc

SEQ ID NO: 1385429 - RNA, 14 nt, Homo sapiens
auuccauaugcugu

SEQ ID NO: 1385430 - RNA, 13 nt, Homo sapiens
auuccaucuugcc

SEQ ID NO: 1385431 - RNA, 16 nt, Homo sapiens
auuccccacccugaaa

SEQ ID NO: 1385432 - RNA, 15 nt, Homo sapiens
auuccuagaaguuga

SEQ ID NO: 1385433 - RNA, 19 nt, Homo sapiens
auuccuauauaguuuauug

SEQ ID NO: 1385434 - RNA, 20 nt, Homo sapiens
auuccuauauaguuuauuga

SEQ ID NO: 1385435 - RNA, 14 nt, Homo sapiens
auuccugagccagu

SEQ ID NO: 1385436 - RNA, 16 nt, Homo sapiens
auuccugagccagugu

SEQ ID NO: 1385437 - RNA, 14 nt, Homo sapiens
auuccuuacuguaa

SEQ ID NO: 1385438 - RNA, 14 nt, Homo sapiens
auuccuugauucac

SEQ ID NO: 1385439 - RNA, 19 nt, Homo sapiens
auuccuuggcaugccuucc

SEQ ID NO: 1385440 - RNA, 21 nt, Homo sapiens
auuccuuggcaugccuuccag

SEQ ID NO: 1385441 - RNA, 21 nt, Homo sapiens
auucgcugcaaccuguugaua

SEQ ID NO: 1385442 - RNA, 20 nt, Homo sapiens
auucuaaaugaauguuuaca

SEQ ID NO: 1385443 - RNA, 21 nt, Homo sapiens
auucucacuccaccacccaaa

SEQ ID NO: 1385444 - RNA, 23 nt, Homo sapiens
auucucauaagcuacugaugaga

SEQ ID NO: 1385445 - RNA, 16 nt, Homo sapiens
auucucauuugucaca

SEQ ID NO: 1385446 - RNA, 15 nt, Homo sapiens
auuuuggccaaagug

SEQ ID NO: 1385447 - RNA, 19 nt, Homo sapiens
auuuuuacaguucucccaa

SEQ ID NO: 1385448 - RNA, 17 nt, Homo sapiens
auuuuuauagacaaaua

SEQ ID NO: 1385449 - RNA, 13 nt, Homo sapiens
auuuuugaauaca

SEQ ID NO: 1385450 - RNA, 19 nt, Homo sapiens
auuuuugaauacaggcaua

SEQ ID NO: 1385451 - RNA, 20 nt, Homo sapiens
auuuuuuaguauaaguacau

SEQ ID NO: 1385452 - RNA, 19 nt, Homo sapiens
auuuuuuuucagcagacua

SEQ ID NO: 1385453 - RNA, 20 nt, Homo sapiens
caaaaaaaaccuucagugaa

SEQ ID NO: 1385454 - RNA, 19 nt, Homo sapiens
caaaaaaaccucuaugcaa

SEQ ID NO: 1385455 - RNA, 21 nt, Homo sapiens
caaaaaaaccucuaugcaauc

SEQ ID NO: 1385456 - RNA, 16 nt, Homo sapiens
caaaaaaagaaaaaga

SEQ ID NO: 1385457 - RNA, 11 nt, Homo sapiens
caaaaaaucug

SEQ ID NO: 1385458 - RNA, 13 nt, Homo sapiens
caaaaaccucacc

SEQ ID NO: 1385459 - RNA, 15 nt, Homo sapiens
caaaaaccuucccca

SEQ ID NO: 1385460 - RNA, 16 nt, Homo sapiens
caaaaagaaucugcau

SEQ ID NO: 1385461 - RNA, 13 nt, Homo sapiens
caaaaagacauua

SEQ ID NO: 1385462 - RNA, 23 nt, Homo sapiens
caaaaauacucuaauucuaacca

SEQ ID NO: 1385463 - RNA, 17 nt, Homo sapiens
caaaaauagacaacugu

SEQ ID NO: 1385464 - RNA, 23 nt, Homo sapiens
caaaaaugaaagcaugucucaau

SEQ ID NO: 1385465 - RNA, 16 nt, Homo sapiens
caaaacagagauguga

SEQ ID NO: 1385466 - RNA, 12 nt, Homo sapiens
caaaacauuccg

SEQ ID NO: 1385467 - RNA, 12 nt, Homo sapiens
caaaacauugaa

SEQ ID NO: 1385468 - RNA, 17 nt, Homo sapiens
caaaacccaacaugacu

SEQ ID NO: 1385469 - RNA, 15 nt, Homo sapiens
caaaacccacagaag

SEQ ID NO: 1385470 - RNA, 16 nt, Homo sapiens
caaaacccacagaaga

SEQ ID NO: 1385471 - RNA, 20 nt, Homo sapiens
caaaacugauacccuuugaa

SEQ ID NO: 1385472 - RNA, 13 nt, Homo sapiens
caaaacuuaggca

SEQ ID NO: 1385473 - RNA, 21 nt, Homo sapiens
caaaagagaaggacucuucca

SEQ ID NO: 1385474 - RNA, 19 nt, Homo sapiens
caaaagcacuuugugcugu

SEQ ID NO: 1385475 - RNA, 21 nt, Homo sapiens
caaaagcccaauguaaugcau

SEQ ID NO: 1385476 - RNA, 22 nt, Homo sapiens
caaaaguuucuuacucaaggaa

SEQ ID NO: 1385477 - RNA, 15 nt, Homo sapiens
caaaauauacauuca

SEQ ID NO: 1385478 - RNA, 18 nt, Homo sapiens
caaaauucuuaaguaugu

SEQ ID NO: 1385479 - RNA, 13 nt, Homo sapiens
caaacacaagcaa

SEQ ID NO: 1385480 - RNA, 22 nt, Homo sapiens
caaacaggcaguuggccagaga

SEQ ID NO: 1385481 - RNA, 15 nt, Homo sapiens
caaacaugaagugug

SEQ ID NO: 1385482 - RNA, 19 nt, Homo sapiens
caaacguuuugaacuaaua

SEQ ID NO: 1385483 - RNA, 22 nt, Homo sapiens
caaacucuuaguuacucauuca

SEQ ID NO: 1385484 - RNA, 11 nt, Homo sapiens
caaacugccuu

SEQ ID NO: 1385485 - RNA, 21 nt, Homo sapiens
caaacugccuuggcuucaggg

SEQ ID NO: 1385486 - RNA, 20 nt, Homo sapiens
caaagaauuuuuuuuaacau

SEQ ID NO: 1385487 - RNA, 13 nt, Homo sapiens
caaagacagcauc

SEQ ID NO: 1385488 - RNA, 21 nt, Homo sapiens
caaagacuacauauugucacu

SEQ ID NO: 1385489 - RNA, 17 nt, Homo sapiens
caaagagaaugccauuc

SEQ ID NO: 1385490 - RNA, 12 nt, Homo sapiens
caaagauuugcu

SEQ ID NO: 1385491 - RNA, 17 nt, Homo sapiens
caaagauuugcuuuaau

SEQ ID NO: 1385492 - RNA, 20 nt, Homo sapiens
caaagcacuguuucucucac

SEQ ID NO: 1385493 - RNA, 18 nt, Homo sapiens
caaagccaaacucugcca

SEQ ID NO: 1385494 - RNA, 16 nt, Homo sapiens
caaaggaagcuuucuc

SEQ ID NO: 1385495 - RNA, 18 nt, Homo sapiens
caaaggcacagugaaggc

SEQ ID NO: 1385496 - RNA, 19 nt, Homo sapiens
caaaggcaccugaaugugu

SEQ ID NO: 1385497 - RNA, 21 nt, Homo sapiens
caaaggcuuauuaauuugacu

SEQ ID NO: 1385498 - RNA, 15 nt, Homo sapiens
caaaguagaagucuu

SEQ ID NO: 1385499 - RNA, 20 nt, Homo sapiens
caaagugagacuccgucaca

SEQ ID NO: 1385500 - RNA, 23 nt, Homo sapiens
caaaguggaaggaaagaugcuca

SEQ ID NO: 1385501 - RNA, 14 nt, Homo sapiens
caaauaaaaaccca

SEQ ID NO: 1385502 - RNA, 14 nt, Homo sapiens
caaauaaaugacaa

SEQ ID NO: 1385503 - RNA, 17 nt, Homo sapiens
caaauaauuuguauacc

SEQ ID NO: 1385504 - RNA, 22 nt, Homo sapiens
caaauacauggauaacacauuu

SEQ ID NO: 1385505 - RNA, 18 nt, Homo sapiens
caaauaguagauggcaaa

SEQ ID NO: 1385506 - RNA, 12 nt, Homo sapiens
caaauauuuccc

SEQ ID NO: 1385507 - RNA, 18 nt, Homo sapiens
caaaucagaaacuuguga

SEQ ID NO: 1385508 - RNA, 14 nt, Homo sapiens
caaaucgcccccuu

SEQ ID NO: 1385509 - RNA, 16 nt, Homo sapiens
caaaugcacaucucau

SEQ ID NO: 1385510 - RNA, 20 nt, Homo sapiens
caaaugcacaucucauggca

SEQ ID NO: 1385511 - RNA, 13 nt, Homo sapiens
caaaugucuaagg

SEQ ID NO: 1385512 - RNA, 16 nt, Homo sapiens
caaauguuacauagug

SEQ ID NO: 1385513 - RNA, 16 nt, Homo sapiens
caaauguuaugcauaa

SEQ ID NO: 1385514 - RNA, 16 nt, Homo sapiens
caaauucauggugcac

SEQ ID NO: 1385515 - RNA, 23 nt, Homo sapiens
caaauucucaagccgcaucccag

SEQ ID NO: 1385516 - RNA, 15 nt, Homo sapiens
caaauugauagucaa

SEQ ID NO: 1385517 - RNA, 21 nt, Homo sapiens
caacacaauucuucuuccaac

SEQ ID NO: 1385518 - RNA, 24 nt, Homo sapiens
caacacucacauuuauucugcuca

SEQ ID NO: 1385519 - RNA, 14 nt, Homo sapiens
caacacugcugcuc

SEQ ID NO: 1385520 - RNA, 11 nt, Homo sapiens
caacacuuaag

SEQ ID NO: 1385521 - RNA, 16 nt, Homo sapiens
cgguucaccagccucu

SEQ ID NO: 1385522 - RNA, 12 nt, Homo sapiens
cguacauucaau

SEQ ID NO: 1385523 - RNA, 21 nt, Homo sapiens
cguagcuauccggacagagca

SEQ ID NO: 1385524 - RNA, 14 nt, Homo sapiens
cguaggugauuuga

SEQ ID NO: 1385525 - RNA, 23 nt, Homo sapiens
cgucccuguuagcauaaugugag

SEQ ID NO: 1385526 - RNA, 17 nt, Homo sapiens
cgucuccgaagauuugg

SEQ ID NO: 1385527 - RNA, 12 nt, Homo sapiens
cgugaaacacac

SEQ ID NO: 1385528 - RNA, 18 nt, Homo sapiens
cgugaaucuguaucuugc

SEQ ID NO: 1385529 - RNA, 14 nt, Homo sapiens
cgugacaacaugcg

SEQ ID NO: 1385530 - RNA, 15 nt, Homo sapiens
cgugauccaccugcc

SEQ ID NO: 1385531 - RNA, 12 nt, Homo sapiens
cgugcacucugc

SEQ ID NO: 1385532 - RNA, 13 nt, Homo sapiens
cgugcaugugcac

SEQ ID NO: 1385533 - RNA, 18 nt, Homo sapiens
cgugggcaaacaggcagu

SEQ ID NO: 1385534 - RNA, 17 nt, Homo sapiens
cguguacuacaauuuaa

SEQ ID NO: 1385535 - RNA, 19 nt, Homo sapiens
cgugugcgugcaugugcac

SEQ ID NO: 1385536 - RNA, 15 nt, Homo sapiens
cguguguccaugugu

SEQ ID NO: 1385537 - RNA, 17 nt, Homo sapiens
cgugugugcaagugucu

SEQ ID NO: 1385538 - RNA, 21 nt, Homo sapiens
cguuaaggagaugggccuuuu

SEQ ID NO: 1385539 - RNA, 13 nt, Homo sapiens
cguucacucccaa

SEQ ID NO: 1385540 - RNA, 23 nt, Homo sapiens
cguuccuguuagcauaaugugag

SEQ ID NO: 1385541 - RNA, 12 nt, Homo sapiens
cguuuaaucaca

SEQ ID NO: 1385542 - RNA, 13 nt, Homo sapiens
cguuuaaucacau

SEQ ID NO: 1385543 - RNA, 14 nt, Homo sapiens
cguuugaaucacag

SEQ ID NO: 1385544 - RNA, 23 nt, Homo sapiens
cguuuugugugguggcaccuccu

SEQ ID NO: 1385545 - RNA, 20 nt, Homo sapiens
cuaaaaacacagacauucug

SEQ ID NO: 1385546 - RNA, 13 nt, Homo sapiens
cuaaaaaucauga

SEQ ID NO: 1385547 - RNA, 13 nt, Homo sapiens
cuaaaacaguccu

SEQ ID NO: 1385548 - RNA, 14 nt, Homo sapiens
cuaaaaccaucaua

SEQ ID NO: 1385549 - RNA, 17 nt, Homo sapiens
cuaaaaguuaauagggu

SEQ ID NO: 1385550 - RNA, 16 nt, Homo sapiens
cuaaaaguucauaaca

SEQ ID NO: 1385551 - RNA, 12 nt, Homo sapiens
caagagccacag

SEQ ID NO: 1385552 - RNA, 16 nt, Homo sapiens
caagagccacaguaua

SEQ ID NO: 1385553 - RNA, 15 nt, Homo sapiens
caagaucuguaaugu

SEQ ID NO: 1385554 - RNA, 13 nt, Homo sapiens
caagaucuuucag

SEQ ID NO: 1385555 - RNA, 17 nt, Homo sapiens
caagaucuuucaggaaa

SEQ ID NO: 1385556 - RNA, 22 nt, Homo sapiens
caagaugcuuuucaaacugaua

SEQ ID NO: 1385557 - RNA, 21 nt, Homo sapiens
caagauugcgccauugcacuc

SEQ ID NO: 1385558 - RNA, 20 nt, Homo sapiens
caagcaggaaccccaggaga

SEQ ID NO: 1385559 - RNA, 15 nt, Homo sapiens
caagcaggaagcuca

SEQ ID NO: 1385560 - RNA, 23 nt, Homo sapiens
caagccagccuugcuccuggcug

SEQ ID NO: 1385561 - RNA, 17 nt, Homo sapiens
caagcccugcagucaca

SEQ ID NO: 1385562 - RNA, 19 nt, Homo sapiens
caagcuaauaaaauaucau

SEQ ID NO: 1385563 - RNA, 18 nt, Homo sapiens
caaggaaugccugugcca

SEQ ID NO: 1385564 - RNA, 18 nt, Homo sapiens
caaggagaaaaaaggcag

SEQ ID NO: 1385565 - RNA, 22 nt, Homo sapiens
caaggagaccaaguccuggcua

SEQ ID NO: 1385566 - RNA, 18 nt, Homo sapiens
caaggcaaagacuauucc

SEQ ID NO: 1385567 - RNA, 17 nt, Homo sapiens
caaggccagaugcacau

SEQ ID NO: 1385568 - RNA, 15 nt, Homo sapiens
caaggcugcagugag

SEQ ID NO: 1385569 - RNA, 21 nt, Homo sapiens
caagggaacuugagcgugaau

SEQ ID NO: 1385570 - RNA, 20 nt, Homo sapiens
caagggggacugucuuucag

SEQ ID NO: 1385571 - RNA, 22 nt, Homo sapiens
caaggugggcagggaggcacca

SEQ ID NO: 1385572 - RNA, 19 nt, Homo sapiens
caaggugggccuugcuacc

SEQ ID NO: 1385573 - RNA, 23 nt, Homo sapiens
caaggugggccuugcuaccucaa

SEQ ID NO: 1385574 - RNA, 21 nt, Homo sapiens
caagguucuucccuuuuacau

SEQ ID NO: 1385575 - RNA, 17 nt, Homo sapiens
caaguaaaacuguggua

SEQ ID NO: 1385576 - RNA, 17 nt, Homo sapiens
caaguaagaagacauga

SEQ ID NO: 1385577 - RNA, 15 nt, Homo sapiens
caaguauuggcaaag

SEQ ID NO: 1385578 - RNA, 17 nt, Homo sapiens
caagucacucaucucag

SEQ ID NO: 1385579 - RNA, 13 nt, Homo sapiens
caagucagcucuu

SEQ ID NO: 1385580 - RNA, 18 nt, Homo sapiens
caagugaaaaacauccag

SEQ ID NO: 1385581 - RNA, 14 nt, Homo sapiens
caagugacaucucu

SEQ ID NO: 1385582 - RNA, 17 nt, Homo sapiens
caagugagacaaaaagc

SEQ ID NO: 1385583 - RNA, 13 nt, Homo sapiens
caagugucugugu

SEQ ID NO: 1385584 - RNA, 16 nt, Homo sapiens
caagugucugugugca

SEQ ID NO: 1385585 - RNA, 16 nt, Homo sapiens
caaguguguaugugcg

SEQ ID NO: 1385586 - RNA, 13 nt, Homo sapiens
caagugugugcau

SEQ ID NO: 1385587 - RNA, 18 nt, Homo sapiens
caagugugugcaugugug

SEQ ID NO: 1385588 - RNA, 17 nt, Homo sapiens
caaguuacagugaugcu

SEQ ID NO: 1385589 - RNA, 16 nt, Homo sapiens
caaguuagcucaggag

SEQ ID NO: 1385590 - RNA, 21 nt, Homo sapiens
caaguuauuaauuucuucaca

SEQ ID NO: 1385591 - RNA, 16 nt, Homo sapiens
caaguuguguuugaua

SEQ ID NO: 1385592 - RNA, 15 nt, Homo sapiens
caauaaagccuucaa

SEQ ID NO: 1385593 - RNA, 20 nt, Homo sapiens
caauaaagugcuuuaaaaag

SEQ ID NO: 1385594 - RNA, 15 nt, Homo sapiens
caauaaauuuugcca

SEQ ID NO: 1385595 - RNA, 18 nt, Homo sapiens
caauagaguugggacaau

SEQ ID NO: 1385596 - RNA, 14 nt, Homo sapiens
caauaguaaaagau

SEQ ID NO: 1385597 - RNA, 22 nt, Homo sapiens
caauauacuuguauagcaguuu

SEQ ID NO: 1385598 - RNA, 16 nt, Homo sapiens
caauauuaacauaaga

SEQ ID NO: 1385599 - RNA, 13 nt, Homo sapiens
caauauugccaug

SEQ ID NO: 1385600 - RNA, 13 nt, Homo sapiens
caaucacaagcag

SEQ ID NO: 1385601 - RNA, 17 nt, Homo sapiens
caaucagagagcucacu

SEQ ID NO: 1385602 - RNA, 11 nt, Homo sapiens
caaugaacuuu

SEQ ID NO: 1385603 - RNA, 20 nt, Homo sapiens
caaugaauaacagccucauu

SEQ ID NO: 1385604 - RNA, 18 nt, Homo sapiens
caaugaccacauccugaa

SEQ ID NO: 1385605 - RNA, 17 nt, Homo sapiens
caaugaguaacaggaaa

SEQ ID NO: 1385606 - RNA, 22 nt, Homo sapiens
caaugcuauaacuauguugaua

SEQ ID NO: 1385607 - RNA, 16 nt, Homo sapiens
caaugggagccucaua

SEQ ID NO: 1385608 - RNA, 22 nt, Homo sapiens
caauguagucucauaaccagga

SEQ ID NO: 1385609 - RNA, 14 nt, Homo sapiens
caauguaugaauua

SEQ ID NO: 1385610 - RNA, 17 nt, Homo sapiens
caaugucagaugaaguc

SEQ ID NO: 1385611 - RNA, 18 nt, Homo sapiens
caauuacaacagugagaa

SEQ ID NO: 1385612 - RNA, 21 nt, Homo sapiens
caauuaccacaccaucuccca

SEQ ID NO: 1385613 - RNA, 14 nt, Homo sapiens
caauuccgcauuua

SEQ ID NO: 1385614 - RNA, 19 nt, Homo sapiens
caauucuuacaaacaugug

SEQ ID NO: 1385615 - RNA, 18 nt, Homo sapiens
caauucuuugaauuuccc

SEQ ID NO: 1385616 - RNA, 16 nt, Homo sapiens
caauuuauugcacaaa

SEQ ID NO: 1385617 - RNA, 13 nt, Homo sapiens
caauuucauuuaa

SEQ ID NO: 1385618 - RNA, 21 nt, Homo sapiens
caauuuccggccaacaguuaa

SEQ ID NO: 1385619 - RNA, 14 nt, Homo sapiens
caauuugcacuuuc

SEQ ID NO: 1385620 - RNA, 13 nt, Homo sapiens
caauuugcugcca

SEQ ID NO: 1385621 - RNA, 16 nt, Homo sapiens
caauuugcugccaaac

SEQ ID NO: 1385622 - RNA, 17 nt, Homo sapiens
cacaaaauguacccagu

SEQ ID NO: 1385623 - RNA, 15 nt, Homo sapiens
cacaaagagaguuaa

SEQ ID NO: 1385624 - RNA, 14 nt, Homo sapiens
cacaaaugguagca

SEQ ID NO: 1385625 - RNA, 13 nt, Homo sapiens
cacaaauuaucuu

SEQ ID NO: 1385626 - RNA, 12 nt, Homo sapiens
cacaacccaucu

SEQ ID NO: 1385627 - RNA, 16 nt, Homo sapiens
cacaacccuguuuuau

SEQ ID NO: 1385628 - RNA, 22 nt, Homo sapiens
uccccaagugcggggaguacaa

SEQ ID NO: 1385629 - RNA, 23 nt, Homo sapiens
ucccccaccagcuaaggacauuu

SEQ ID NO: 1385630 - RNA, 17 nt, Homo sapiens
ucccccagcagccuggg

SEQ ID NO: 1385631 - RNA, 14 nt, Homo sapiens
ucccccauagccac

SEQ ID NO: 1385632 - RNA, 17 nt, Homo sapiens
ucccccucucugcccug

SEQ ID NO: 1385633 - RNA, 22 nt, Homo sapiens
ucccccuguagacuagugccgu

SEQ ID NO: 1385634 - RNA, 18 nt, Homo sapiens
uccccggcucaagugauc

SEQ ID NO: 1385635 - RNA, 19 nt, Homo sapiens
uccccucccuggcucccau

SEQ ID NO: 1385636 - RNA, 14 nt, Homo sapiens
uccccuucacuccc

SEQ ID NO: 1385637 - RNA, 21 nt, Homo sapiens
ucccgauucacccuguccaaa

SEQ ID NO: 1385638 - RNA, 19 nt, Homo sapiens
ucccggcgucccuaccucc

SEQ ID NO: 1385639 - RNA, 20 nt, Homo sapiens
ucccggcgucccuaccuccu

SEQ ID NO: 1385640 - RNA, 16 nt, Homo sapiens
ucccggguguguacac

SEQ ID NO: 1385641 - RNA, 20 nt, Homo sapiens
ucccuaaaaacacagacauu

SEQ ID NO: 1385642 - RNA, 20 nt, Homo sapiens
ucccuacauggaguauaugu

SEQ ID NO: 1385643 - RNA, 12 nt, Homo sapiens
ucccuaccuccu

SEQ ID NO: 1385644 - RNA, 17 nt, Homo sapiens
ucccuauggaagcauau

SEQ ID NO: 1385645 - RNA, 23 nt, Homo sapiens
ucccucacaccgcgucuggugac

SEQ ID NO: 1385646 - RNA, 19 nt, Homo sapiens
ucccugaaaacccagagag

SEQ ID NO: 1385647 - RNA, 23 nt, Homo sapiens
ucccugaaaauguuuuucugcca

SEQ ID NO: 1385648 - RNA, 16 nt, Homo sapiens
ucccugaccuucugag

SEQ ID NO: 1385649 - RNA, 16 nt, Homo sapiens
ucccugcaaacauggg

SEQ ID NO: 1385650 - RNA, 17 nt, Homo sapiens
ucccugcuuaaugaaaa

SEQ ID NO: 1385651 - RNA, 15 nt, Homo sapiens
ucccuggaccucaga

SEQ ID NO: 1385652 - RNA, 12 nt, Homo sapiens
ucccuguacaau

SEQ ID NO: 1385653 - RNA, 21 nt, Homo sapiens
ucccuguccuccucggaucac

SEQ ID NO: 1385654 - RNA, 17 nt, Homo sapiens
ucccugucuauugccuu

SEQ ID NO: 1385655 - RNA, 18 nt, Homo sapiens
ucccuucuacugcuucua

SEQ ID NO: 1385656 - RNA, 16 nt, Homo sapiens
ucccuucuccuugaua

SEQ ID NO: 1385657 - RNA, 12 nt, Homo sapiens
ucccuuuuacau

SEQ ID NO: 1385658 - RNA, 17 nt, Homo sapiens
uccgaugaguaaaaagu

SEQ ID NO: 1385659 - RNA, 20 nt, Homo sapiens
uccgcaguuccugucccuuc

SEQ ID NO: 1385660 - RNA, 17 nt, Homo sapiens
uccggaggcugaggcag

SEQ ID NO: 1385661 - RNA, 22 nt, Homo sapiens
uccgggagcggcuguugggcug

SEQ ID NO: 1385662 - RNA, 18 nt, Homo sapiens
uccuaaaaguguaagaaa

SEQ ID NO: 1385663 - RNA, 17 nt, Homo sapiens
uccuaaaguagacuuca

SEQ ID NO: 1385664 - RNA, 19 nt, Homo sapiens
uccuaaaguagacuucauu

SEQ ID NO: 1385665 - RNA, 16 nt, Homo sapiens
uccuaaaugcagugaa

SEQ ID NO: 1385666 - RNA, 22 nt, Homo sapiens
uccuaacaggauuagacaguca

SEQ ID NO: 1385667 - RNA, 22 nt, Homo sapiens
uccuaagccaugggagacacug

SEQ ID NO: 1385668 - RNA, 14 nt, Homo sapiens
uccuaagggcucac

SEQ ID NO: 1385669 - RNA, 13 nt, Homo sapiens
uccuaaucaucca

SEQ ID NO: 1385670 - RNA, 16 nt, Homo sapiens
uccuaccaaccucuga

SEQ ID NO: 1385671 - RNA, 22 nt, Homo sapiens
uccuaccacaaugcagugccuu

SEQ ID NO: 1385672 - RNA, 12 nt, Homo sapiens
uccuaccucagc

SEQ ID NO: 1385673 - RNA, 18 nt, Homo sapiens
uccuacucugugucaggu

SEQ ID NO: 1385674 - RNA, 15 nt, Homo sapiens
uccuacuuuacauau

SEQ ID NO: 1385675 - RNA, 13 nt, Homo sapiens
uccuagcacuuug

SEQ ID NO: 1385676 - RNA, 22 nt, Homo sapiens
uccuagcugugugcagucucuc

SEQ ID NO: 1385677 - RNA, 18 nt, Homo sapiens
uccuaggcauuugcugaa

SEQ ID NO: 1385678 - RNA, 20 nt, Homo sapiens
uccuaucauuuuauuaucac

SEQ ID NO: 1385679 - RNA, 14 nt, Homo sapiens
uccuaucccauccc

SEQ ID NO: 1385680 - RNA, 21 nt, Homo sapiens
uccucacccugauuucuugcu

SEQ ID NO: 1385681 - RNA, 15 nt, Homo sapiens
uccucaguuccugca

SEQ ID NO: 1385682 - RNA, 13 nt, Homo sapiens
uccucauuccuga

SEQ ID NO: 1385683 - RNA, 22 nt, Homo sapiens
uccuccauaaauuauggcauuu

SEQ ID NO: 1385684 - RNA, 12 nt, Homo sapiens
uccuccccaugu

SEQ ID NO: 1385685 - RNA, 17 nt, Homo sapiens
uccuccuugucuuggca

SEQ ID NO: 1385686 - RNA, 19 nt, Homo sapiens
uccucuccccagcaaguga

SEQ ID NO: 1385687 - RNA, 11 nt, Homo sapiens
uccucugacau

SEQ ID NO: 1385688 - RNA, 23 nt, Homo sapiens
uccucuuucaaagguagccauca

SEQ ID NO: 1385689 - RNA, 19 nt, Homo sapiens
uccugaaaaggguguugcu

SEQ ID NO: 1385690 - RNA, 19 nt, Homo sapiens
uccugaaagccacagacaa

SEQ ID NO: 1385691 - RNA, 16 nt, Homo sapiens
uccugaaauccucaau

SEQ ID NO: 1385692 - RNA, 20 nt, Homo sapiens
uccugaucgccaaccuuucc

SEQ ID NO: 1385693 - RNA, 14 nt, Homo sapiens
uccugccuggccag

SEQ ID NO: 1385694 - RNA, 19 nt, Homo sapiens
uccugccugugcugugacu

SEQ ID NO: 1385695 - RNA, 16 nt, Homo sapiens
uccuggccucaaguga

SEQ ID NO: 1385696 - RNA, 15 nt, Homo sapiens
uccuggcuacuccau

SEQ ID NO: 1385697 - RNA, 20 nt, Homo sapiens
uccugggagaaccucaggcu

SEQ ID NO: 1385698 - RNA, 18 nt, Homo sapiens
uccuggggaacauagaac

SEQ ID NO: 1385699 - RNA, 14 nt, Homo sapiens
uccuguauucuaca

SEQ ID NO: 1385700 - RNA, 22 nt, Homo sapiens
uccugugugucgcuuaugucua

SEQ ID NO: 1385701 - RNA, 21 nt, Homo sapiens
uccuguugagaugggggacug

SEQ ID NO: 1385702 - RNA, 18 nt, Homo sapiens
uccuuaaagguagucaag

SEQ ID NO: 1385703 - RNA, 19 nt, Homo sapiens
uccuuacauaugcaaaaau

SEQ ID NO: 1385704 - RNA, 19 nt, Homo sapiens
uccuuaccgugggcacuga

SEQ ID NO: 1385705 - RNA, 15 nt, Homo sapiens
uccuuagcaacagcc

SEQ ID NO: 1385706 - RNA, 18 nt, Homo sapiens
uccuuauuguuaaaaaca

SEQ ID NO: 1385707 - RNA, 15 nt, Homo sapiens
uccuucaagaacucu

SEQ ID NO: 1385708 - RNA, 16 nt, Homo sapiens
uccuuccaauuuggaa

SEQ ID NO: 1385709 - RNA, 20 nt, Homo sapiens
uccuuccuuaucacugacac

SEQ ID NO: 1385710 - RNA, 14 nt, Homo sapiens
uccuuccuucccug

SEQ ID NO: 1385711 - RNA, 15 nt, Homo sapiens
uccuugauaacagcu

SEQ ID NO: 1385712 - RNA, 14 nt, Homo sapiens
uccuugcaccugca

SEQ ID NO: 1385713 - RNA, 17 nt, Homo sapiens
uccuuggggacaucuca

SEQ ID NO: 1385714 - RNA, 15 nt, Homo sapiens
uccuuuacuaaucca

SEQ ID NO: 1385715 - RNA, 15 nt, Homo sapiens
uccuuucacaaccuu

SEQ ID NO: 1385716 - RNA, 22 nt, Homo sapiens
uccuuucagaaaauucccauga

SEQ ID NO: 1385717 - RNA, 19 nt, Homo sapiens
ucgaagcuccgugagugaa

SEQ ID NO: 1385718 - RNA, 18 nt, Homo sapiens
ucgacugugaccuguggg

SEQ ID NO: 1385719 - RNA, 17 nt, Homo sapiens
ucgaugcagugcuucca

SEQ ID NO: 1385720 - RNA, 14 nt, Homo sapiens
ucgccguggcugcg

SEQ ID NO: 1385721 - RNA, 12 nt, Homo sapiens
cuagucuuucac

SEQ ID NO: 1385722 - RNA, 16 nt, Homo sapiens
cuagugauuucugggg

SEQ ID NO: 1385723 - RNA, 14 nt, Homo sapiens
cuaguguugcuugg

SEQ ID NO: 1385724 - RNA, 17 nt, Homo sapiens
cuaguucuucaucccac

SEQ ID NO: 1385725 - RNA, 22 nt, Homo sapiens
cuaguuugugagaaacaucuca

SEQ ID NO: 1385726 - RNA, 20 nt, Homo sapiens
cuauaaaaugagaagucuca

SEQ ID NO: 1385727 - RNA, 20 nt, Homo sapiens
cuauaaagguugacaauaaa

SEQ ID NO: 1385728 - RNA, 21 nt, Homo sapiens
cuauaacuuuugguaucuacu

SEQ ID NO: 1385729 - RNA, 19 nt, Homo sapiens
cuauauaaaaaacauaaua

SEQ ID NO: 1385730 - RNA, 17 nt, Homo sapiens
cuauauacuauaugauu

SEQ ID NO: 1385731 - RNA, 15 nt, Homo sapiens
cuauaugacuucaga

SEQ ID NO: 1385732 - RNA, 22 nt, Homo sapiens
cuauaugccgcuacaaaaaggu

SEQ ID NO: 1385733 - RNA, 18 nt, Homo sapiens
cuauauuaucaugcaaau

SEQ ID NO: 1385734 - RNA, 20 nt, Homo sapiens
cuauauucucaguguagggc

SEQ ID NO: 1385735 - RNA, 23 nt, Homo sapiens
cuaucagcauuuuacuacuuuaa

SEQ ID NO: 1385736 - RNA, 15 nt, Homo sapiens
cuaucucacagcaca

SEQ ID NO: 1385737 - RNA, 17 nt, Homo sapiens
cuaucuuuuaguuuuag

SEQ ID NO: 1385738 - RNA, 20 nt, Homo sapiens
cuaugaaaacagcuaucuca

SEQ ID NO: 1385739 - RNA, 20 nt, Homo sapiens
cuaugaaauaucaugcucca

SEQ ID NO: 1385740 - RNA, 15 nt, Homo sapiens
cuaugauaugcuaau

SEQ ID NO: 1385741 - RNA, 16 nt, Homo sapiens
cuaugauaugcuaaua

SEQ ID NO: 1385742 - RNA, 17 nt, Homo sapiens
cuauggcucuacuuuca

SEQ ID NO: 1385743 - RNA, 15 nt, Homo sapiens
cuaugggggcacuga

SEQ ID NO: 1385744 - RNA, 13 nt, Homo sapiens
cuauguacuuuaa

SEQ ID NO: 1385745 - RNA, 22 nt, Homo sapiens
cuauguauggaauacaguguua

SEQ ID NO: 1385746 - RNA, 14 nt, Homo sapiens
cuaugugcaugcag

SEQ ID NO: 1385747 - RNA, 13 nt, Homo sapiens
cuauguugauaaa

SEQ ID NO: 1385748 - RNA, 20 nt, Homo sapiens
cuauuaaaacagccaaaacu

SEQ ID NO: 1385749 - RNA, 17 nt, Homo sapiens
cuauucuaaguaauucc

SEQ ID NO: 1385750 - RNA, 14 nt, Homo sapiens
cuauucucuccuca

SEQ ID NO: 1385751 - RNA, 16 nt, Homo sapiens
gcucugccuguggagu

SEQ ID NO: 1385752 - RNA, 18 nt, Homo sapiens
gcucuggugacaccagcc

SEQ ID NO: 1385753 - RNA, 18 nt, Homo sapiens
gcucuuaggcaaucacau

SEQ ID NO: 1385754 - RNA, 13 nt, Homo sapiens
gcucuuaggugcu

SEQ ID NO: 1385755 - RNA, 17 nt, Homo sapiens
gcucuuuucaaugaaua

SEQ ID NO: 1385756 - RNA, 20 nt, Homo sapiens
gcugaaaggggaagaccuga

SEQ ID NO: 1385757 - RNA, 17 nt, Homo sapiens
gcugagaacaaaaucac

SEQ ID NO: 1385758 - RNA, 20 nt, Homo sapiens
gcugagaucgcgccacugca

SEQ ID NO: 1385759 - RNA, 14 nt, Homo sapiens
gcugagauuccugg

SEQ ID NO: 1385760 - RNA, 23 nt, Homo sapiens
gcugaggcggguggaucaccuga

SEQ ID NO: 1385761 - RNA, 16 nt, Homo sapiens
gcugcacccacccagg

SEQ ID NO: 1385762 - RNA, 16 nt, Homo sapiens
gcugcaccccaagucc

SEQ ID NO: 1385763 - RNA, 21 nt, Homo sapiens
gcugcaccccaaguccagguc

SEQ ID NO: 1385764 - RNA, 20 nt, Homo sapiens
gcugcagugacgugcaccug

SEQ ID NO: 1385765 - RNA, 12 nt, Homo sapiens
gcugcauaguau

SEQ ID NO: 1385766 - RNA, 18 nt, Homo sapiens
gcugccaaacacccaugc

SEQ ID NO: 1385767 - RNA, 20 nt, Homo sapiens
gcugccuaguuaccaugaac

SEQ ID NO: 1385768 - RNA, 16 nt, Homo sapiens
gcugcuccagugcagg

SEQ ID NO: 1385769 - RNA, 17 nt, Homo sapiens
gcugcucuuaugccauu

SEQ ID NO: 1385770 - RNA, 14 nt, Homo sapiens
gcugcugcugcuaa

SEQ ID NO: 1385771 - RNA, 21 nt, Homo sapiens
gcugcuggaggaaaacugaga

SEQ ID NO: 1385772 - RNA, 23 nt, Homo sapiens
gcugcuuucuuguugcugcaucu

SEQ ID NO: 1385773 - RNA, 21 nt, Homo sapiens
gcuggagucaaaacacuugua

SEQ ID NO: 1385774 - RNA, 15 nt, Homo sapiens
gcuggagugcaguga

SEQ ID NO: 1385775 - RNA, 16 nt, Homo sapiens
gcuggcagaaagcaaa

SEQ ID NO: 1385776 - RNA, 21 nt, Homo sapiens
ggagacagagcugguugggaa

SEQ ID NO: 1385777 - RNA, 15 nt, Homo sapiens
ggagacucguggacu

SEQ ID NO: 1385778 - RNA, 16 nt, Homo sapiens
ggagacugucucaaga

SEQ ID NO: 1385779 - RNA, 16 nt, Homo sapiens
ggagacuuuacaugga

SEQ ID NO: 1385780 - RNA, 14 nt, Homo sapiens
ggagagaaaaaaga

SEQ ID NO: 1385781 - RNA, 14 nt, Homo sapiens
ggagagugcaacag

SEQ ID NO: 1385782 - RNA, 21 nt, Homo sapiens
ggagauuucuuguugcucaaa

SEQ ID NO: 1385783 - RNA, 12 nt, Homo sapiens
ggagcacugggu

SEQ ID NO: 1385784 - RNA, 12 nt, Homo sapiens
ggagcagggaca

SEQ ID NO: 1385785 - RNA, 18 nt, Homo sapiens
ggagcagggacagaucau

SEQ ID NO: 1385786 - RNA, 16 nt, Homo sapiens
ggagcaugagugccgu

SEQ ID NO: 1385787 - RNA, 10 nt, Homo sapiens
ggagccacuc

SEQ ID NO: 1385788 - RNA, 18 nt, Homo sapiens
ggagcccgaggcaccagu

SEQ ID NO: 1385789 - RNA, 19 nt, Homo sapiens
ggagcccugucuccucucu

SEQ ID NO: 1385790 - RNA, 13 nt, Homo sapiens
ggagcgcaccugc

SEQ ID NO: 1385791 - RNA, 23 nt, Homo sapiens
ggagcucuucaggccucccucuc

SEQ ID NO: 1385792 - RNA, 18 nt, Homo sapiens
ggaggaacacugcacucu

SEQ ID NO: 1385793 - RNA, 14 nt, Homo sapiens
ggaggcaccauuca

SEQ ID NO: 1385794 - RNA, 16 nt, Homo sapiens
ggaggccagccaguga

SEQ ID NO: 1385795 - RNA, 21 nt, Homo sapiens
ggaggccagccagugaccuga

SEQ ID NO: 1385796 - RNA, 15 nt, Homo sapiens
ggaggcugaggcaag

SEQ ID NO: 1385797 - RNA, 19 nt, Homo sapiens
ggaggcugucuucucaggc

SEQ ID NO: 1385798 - RNA, 18 nt, Homo sapiens
ggaggcuuccccucacua

SEQ ID NO: 1385799 - RNA, 20 nt, Homo sapiens
ggagggauugacauguuuca

SEQ ID NO: 1385800 - RNA, 14 nt, Homo sapiens
ggaggggugguccu

SEQ ID NO: 1385801 - RNA, 15 nt, Homo sapiens
gggccccaccaccua

SEQ ID NO: 1385802 - RNA, 17 nt, Homo sapiens
gggccucaaggacuuga

SEQ ID NO: 1385803 - RNA, 15 nt, Homo sapiens
gggccuuaaaagcca

SEQ ID NO: 1385804 - RNA, 20 nt, Homo sapiens
gggcggggggcaccuacuac

SEQ ID NO: 1385805 - RNA, 15 nt, Homo sapiens
gggcugaucucaggg

SEQ ID NO: 1385806 - RNA, 16 nt, Homo sapiens
gggcuggcacugacug

SEQ ID NO: 1385807 - RNA, 22 nt, Homo sapiens
ggggaaauaauaaagaugcucu

SEQ ID NO: 1385808 - RNA, 18 nt, Homo sapiens
ggggaagaguggucuuga

SEQ ID NO: 1385809 - RNA, 14 nt, Homo sapiens
ggggaaugaucucu

SEQ ID NO: 1385810 - RNA, 21 nt, Homo sapiens
ggggacauuccaauuugcacu

SEQ ID NO: 1385811 - RNA, 15 nt, Homo sapiens
ggggagguucaguga

SEQ ID NO: 1385812 - RNA, 18 nt, Homo sapiens
ggggagugaggcagguga

SEQ ID NO: 1385813 - RNA, 12 nt, Homo sapiens
ggggcagcacag

SEQ ID NO: 1385814 - RNA, 14 nt, Homo sapiens
ggggccuguuacac

SEQ ID NO: 1385815 - RNA, 23 nt, Homo sapiens
ggggcugggcugggcgcgguggu

SEQ ID NO: 1385816 - RNA, 19 nt, Homo sapiens
gggucucacaguguugccc

SEQ ID NO: 1385817 - RNA, 20 nt, Homo sapiens
gggucucacaguguugccca

SEQ ID NO: 1385818 - RNA, 21 nt, Homo sapiens
gggucucgcuuuguugcccag

SEQ ID NO: 1385819 - RNA, 16 nt, Homo sapiens
gggucuuugaacccuu

SEQ ID NO: 1385820 - RNA, 11 nt, Homo sapiens
gggugcagcug

SEQ ID NO: 1385821 - RNA, 16 nt, Homo sapiens
ggguggaucaccugag

SEQ ID NO: 1385822 - RNA, 21 nt, Homo sapiens
ggguggcccuugcaguucagc

SEQ ID NO: 1385823 - RNA, 14 nt, Homo sapiens
gggugucucugcau

SEQ ID NO: 1385824 - RNA, 21 nt, Homo sapiens
ggguuaguuuacaaucagcca

SEQ ID NO: 1385825 - RNA, 23 nt, Homo sapiens
ggguucauuauuggaauuaaccu

SEQ ID NO: 1385826 - RNA, 20 nt, Homo sapiens
ggguucguggaaagggugcu

SEQ ID NO: 1385827 - RNA, 14 nt, Homo sapiens
ggguucucacagug

SEQ ID NO: 1385828 - RNA, 16 nt, Homo sapiens
ggguuuugaacauaaa

SEQ ID NO: 1385829 - RNA, 18 nt, Homo sapiens
gguaaccucuacuaugaa

SEQ ID NO: 1385830 - RNA, 15 nt, Homo sapiens
gguaacuuugcaaau

SEQ ID NO: 1385831 - RNA, 15 nt, Homo sapiens
gguaagggggugcag

SEQ ID NO: 1385832 - RNA, 20 nt, Homo sapiens
gguagaaaaggcuagguaca

SEQ ID NO: 1385833 - RNA, 11 nt, Homo sapiens
gguagccacug

SEQ ID NO: 1385834 - RNA, 21 nt, Homo sapiens
gguauaaugguugacuggguu

SEQ ID NO: 1385835 - RNA, 18 nt, Homo sapiens
gguauauaaauuuuccca

SEQ ID NO: 1385836 - RNA, 22 nt, Homo sapiens
gguauguguggaugaugcugcc

SEQ ID NO: 1385837 - RNA, 16 nt, Homo sapiens
ggucaaguaagaagac

SEQ ID NO: 1385838 - RNA, 21 nt, Homo sapiens
ggucagaguuccgacugccau

SEQ ID NO: 1385839 - RNA, 16 nt, Homo sapiens
ggucauacuacauaca

SEQ ID NO: 1385840 - RNA, 17 nt, Homo sapiens
ggucccaccuccauuug

SEQ ID NO: 1385841 - RNA, 21 nt, Homo sapiens
gguccucuacuuaaugagaua

SEQ ID NO: 1385842 - RNA, 20 nt, Homo sapiens
gguccugggggccugaccuc

SEQ ID NO: 1385843 - RNA, 20 nt, Homo sapiens
ggucucacaguguugcccag

SEQ ID NO: 1385844 - RNA, 20 nt, Homo sapiens
ggucucaggagaagggauag

SEQ ID NO: 1385845 - RNA, 21 nt, Homo sapiens
ggucucuauacuacauuauua

SEQ ID NO: 1385846 - RNA, 20 nt, Homo sapiens
ggucucugccaugaacugga

SEQ ID NO: 1385847 - RNA, 20 nt, Homo sapiens
ggugaaccuuaguaccuaaa

SEQ ID NO: 1385848 - RNA, 19 nt, Homo sapiens
ggugaagggagagccagcu

SEQ ID NO: 1385849 - RNA, 18 nt, Homo sapiens
ggugaccaguugcacuug

SEQ ID NO: 1385850 - RNA, 19 nt, Homo sapiens
ggugagccgagauugcacc

SEQ ID NO: 1385851 - RNA, 18 nt, Homo sapiens
ggugcaaauccuacugaa

SEQ ID NO: 1385852 - RNA, 17 nt, Homo sapiens
ggugccccucucuccau

SEQ ID NO: 1385853 - RNA, 15 nt, Homo sapiens
gguggaacaagcaca

SEQ ID NO: 1385854 - RNA, 19 nt, Homo sapiens
gguggcccuugcaguucag

SEQ ID NO: 1385855 - RNA, 15 nt, Homo sapiens
gguggcgcgcaccug

SEQ ID NO: 1385856 - RNA, 14 nt, Homo sapiens
ggugggacagggac

SEQ ID NO: 1385857 - RNA, 21 nt, Homo sapiens
ggugggcacuggauuaguuaa

SEQ ID NO: 1385858 - RNA, 19 nt, Homo sapiens
gguggggagacauaaccac

SEQ ID NO: 1385859 - RNA, 20 nt, Homo sapiens
gguggguuuugaacauaaag

SEQ ID NO: 1385860 - RNA, 15 nt, Homo sapiens
ggugugaacagggaa

SEQ ID NO: 1385861 - RNA, 23 nt, Homo sapiens
gguuacacuguuagaacacuauu

SEQ ID NO: 1385862 - RNA, 14 nt, Homo sapiens
gguuauaugucuua

SEQ ID NO: 1385863 - RNA, 19 nt, Homo sapiens
gguucagcuaagcuaggaa

SEQ ID NO: 1385864 - RNA, 19 nt, Homo sapiens
gguuccugagcucacugaa

SEQ ID NO: 1385865 - RNA, 13 nt, Homo sapiens
gguuggcaaaaua

SEQ ID NO: 1385866 - RNA, 15 nt, Homo sapiens
gguuguuucuuccaa

SEQ ID NO: 1385867 - RNA, 18 nt, Homo sapiens
gguuuguugcagccaaag

SEQ ID NO: 1385868 - RNA, 15 nt, Homo sapiens
gguuuuacugcagcu

SEQ ID NO: 1385869 - RNA, 18 nt, Homo sapiens
guaaaaaugagaacaugu

SEQ ID NO: 1385870 - RNA, 21 nt, Homo sapiens
guaaaacuauauucucagugu

SEQ ID NO: 1385871 - RNA, 13 nt, Homo sapiens
guaaaaugaaauu

SEQ ID NO: 1385872 - RNA, 13 nt, Homo sapiens
guaaaauugaaag

SEQ ID NO: 1385873 - RNA, 23 nt, Homo sapiens
guaaaauugaaaggcauucucug

SEQ ID NO: 1385874 - RNA, 12 nt, Homo sapiens
guaaacaaugaa

SEQ ID NO: 1385875 - RNA, 16 nt, Homo sapiens
guaaacauuaguucua

SEQ ID NO: 1385876 - RNA, 18 nt, Homo sapiens
guaaagaguuaguuugag

SEQ ID NO: 1385877 - RNA, 18 nt, Homo sapiens
guaaaggcuauacuuguc

SEQ ID NO: 1385878 - RNA, 17 nt, Homo sapiens
guaaauagcucaggugu

SEQ ID NO: 1385879 - RNA, 19 nt, Homo sapiens
guaaaucacacaacagguu

SEQ ID NO: 1385880 - RNA, 15 nt, Homo sapiens
guaaauguccugcua

SEQ ID NO: 1385881 - RNA, 13 nt, Homo sapiens
guaacaacugugg

SEQ ID NO: 1385882 - RNA, 22 nt, Homo sapiens
guaacaagagugauucuugcug

SEQ ID NO: 1385883 - RNA, 18 nt, Homo sapiens
guaacauaugcaaacaua

SEQ ID NO: 1385884 - RNA, 19 nt, Homo sapiens
guaacuggaaucucaaaag

SEQ ID NO: 1385885 - RNA, 16 nt, Homo sapiens
guaacuggcaguuuuc

SEQ ID NO: 1385886 - RNA, 13 nt, Homo sapiens
guaacuuacuuag

SEQ ID NO: 1385887 - RNA, 19 nt, Homo sapiens
guaacuugguuauacauga

SEQ ID NO: 1385888 - RNA, 18 nt, Homo sapiens
guaagaaagugaagcaaa

SEQ ID NO: 1385889 - RNA, 21 nt, Homo sapiens
agggaggaaucgaggaaccag

SEQ ID NO: 1385890 - RNA, 15 nt, Homo sapiens
agggauaagccagcu

SEQ ID NO: 1385891 - RNA, 14 nt, Homo sapiens
agggcaggcccaaa

SEQ ID NO: 1385892 - RNA, 16 nt, Homo sapiens
agggcagggcucugau

SEQ ID NO: 1385893 - RNA, 16 nt, Homo sapiens
agggccccagcacuaa

SEQ ID NO: 1385894 - RNA, 14 nt, Homo sapiens
agggcccuaccuga

SEQ ID NO: 1385895 - RNA, 20 nt, Homo sapiens
agggcgagacucugucucaa

SEQ ID NO: 1385896 - RNA, 16 nt, Homo sapiens
agggcugucuucguau

SEQ ID NO: 1385897 - RNA, 17 nt, Homo sapiens
agggcuugagguuggug

SEQ ID NO: 1385898 - RNA, 21 nt, Homo sapiens
agggcuugucauuaccagacg

SEQ ID NO: 1385899 - RNA, 23 nt, Homo sapiens
aggggagcaaaaucgaugcagug

SEQ ID NO: 1385900 - RNA, 17 nt, Homo sapiens
aggggaggaucacugga

SEQ ID NO: 1385901 - RNA, 14 nt, Homo sapiens
aggggcaacgaaga

SEQ ID NO: 1385902 - RNA, 15 nt, Homo sapiens
aggggccaagcagug

SEQ ID NO: 1385903 - RNA, 19 nt, Homo sapiens
aggggcugcugaccuccac

SEQ ID NO: 1385904 - RNA, 21 nt, Homo sapiens
agggggcgaagggaucagccc

SEQ ID NO: 1385905 - RNA, 16 nt, Homo sapiens
aggguaccuugaacac

SEQ ID NO: 1385906 - RNA, 15 nt, Homo sapiens
aggguagaggggaag

SEQ ID NO: 1385907 - RNA, 20 nt, Homo sapiens
aggguagauaaccuguacuu

SEQ ID NO: 1385908 - RNA, 20 nt, Homo sapiens
aggguaucaggugcugccau

SEQ ID NO: 1385909 - RNA, 13 nt, Homo sapiens
agggucucuucag

SEQ ID NO: 1385910 - RNA, 18 nt, Homo sapiens
agggucuucccuaccuca

SEQ ID NO: 1385911 - RNA, 19 nt, Homo sapiens
agggucuucuuacaugcau

SEQ ID NO: 1385912 - RNA, 17 nt, Homo sapiens
agggucuuugcaagaau

SEQ ID NO: 1385913 - RNA, 16 nt, Homo sapiens
aggguggcccuugcag

SEQ ID NO: 1385914 - RNA, 13 nt, Homo sapiens
aggguggugaccu

SEQ ID NO: 1385915 - RNA, 17 nt, Homo sapiens
aggguuccuguagaccu

SEQ ID NO: 1385916 - RNA, 16 nt, Homo sapiens
agguacagcagaaagg

SEQ ID NO: 1385917 - RNA, 18 nt, Homo sapiens
agguaccccagcucugcu

SEQ ID NO: 1385918 - RNA, 19 nt, Homo sapiens
agguagaaauaucugaaaa

SEQ ID NO: 1385919 - RNA, 22 nt, Homo sapiens
agguaucauuuucugcauuuaa

SEQ ID NO: 1385920 - RNA, 21 nt, Homo sapiens
agguaugugucagccaugacc

SEQ ID NO: 1385921 - RNA, 22 nt, Homo sapiens
agguaugugucagccaugacca

SEQ ID NO: 1385922 - RNA, 19 nt, Homo sapiens
agguauucugcugaugcua

SEQ ID NO: 1385923 - RNA, 14 nt, Homo sapiens
aggucaaguaagaa

SEQ ID NO: 1385924 - RNA, 15 nt, Homo sapiens
aggucagggugagga

SEQ ID NO: 1385925 - RNA, 14 nt, Homo sapiens
aggucagguguuca

SEQ ID NO: 1385926 - RNA, 21 nt, Homo sapiens
aggucgaccccaaagccccuu

SEQ ID NO: 1385927 - RNA, 13 nt, Homo sapiens
aggucuccaaaau

SEQ ID NO: 1385928 - RNA, 22 nt, Homo sapiens
aggucugcucggccgucuucac

SEQ ID NO: 1385929 - RNA, 20 nt, Homo sapiens
aggucugguuuauuucccag

SEQ ID NO: 1385930 - RNA, 13 nt, Homo sapiens
aggugacagugag

SEQ ID NO: 1385931 - RNA, 22 nt, Homo sapiens
aggugauuugaaggucuugauu

SEQ ID NO: 1385932 - RNA, 21 nt, Homo sapiens
aggugcuauguucuuagugga

SEQ ID NO: 1385933 - RNA, 23 nt, Homo sapiens
aggugcuguugucauugcuuuac

SEQ ID NO: 1385934 - RNA, 21 nt, Homo sapiens
aggugcuugacauaauuucac

SEQ ID NO: 1385935 - RNA, 18 nt, Homo sapiens
agguggaacaagcacaga

SEQ ID NO: 1385936 - RNA, 20 nt, Homo sapiens
aggugggaggauugcuugag

SEQ ID NO: 1385937 - RNA, 23 nt, Homo sapiens
aggugggauaucccuaugcugcc

SEQ ID NO: 1385938 - RNA, 19 nt, Homo sapiens
aggugggaucacuaaggga

SEQ ID NO: 1385939 - RNA, 21 nt, Homo sapiens
agguuacccuguaacaugcaa

SEQ ID NO: 1385940 - RNA, 19 nt, Homo sapiens
agguucuuagugucacuua

SEQ ID NO: 1385941 - RNA, 12 nt, Homo sapiens
agguucuugaua

SEQ ID NO: 1385942 - RNA, 20 nt, Homo sapiens
agguugaggggcuccuggaa

SEQ ID NO: 1385943 - RNA, 15 nt, Homo sapiens
agguugggagccaaa

SEQ ID NO: 1385944 - RNA, 23 nt, Homo sapiens
agguugucugaagucacugcaca

SEQ ID NO: 1385945 - RNA, 14 nt, Homo sapiens
agguuuacauucau

SEQ ID NO: 1385946 - RNA, 21 nt, Homo sapiens
aguaacaagagugauucuugc

SEQ ID NO: 1385947 - RNA, 14 nt, Homo sapiens
aguaacaguuguga

SEQ ID NO: 1385948 - RNA, 15 nt, Homo sapiens
aguaacuugucuuaa

SEQ ID NO: 1385949 - RNA, 20 nt, Homo sapiens
aguaagaaaacaucacugaa

SEQ ID NO: 1385950 - RNA, 15 nt, Homo sapiens
aguaagaagacauga

SEQ ID NO: 1385951 - RNA, 19 nt, Homo sapiens
aguaauaaaacaucuuucc

SEQ ID NO: 1385952 - RNA, 23 nt, Homo sapiens
aguaauaaaacaucuuuccaguc

SEQ ID NO: 1385953 - RNA, 15 nt, Homo sapiens
aguaaugagcaugau

SEQ ID NO: 1385954 - RNA, 16 nt, Homo sapiens
aguacaccccaacagc

SEQ ID NO: 1385955 - RNA, 17 nt, Homo sapiens
aguacaccccaacagca

SEQ ID NO: 1385956 - RNA, 18 nt, Homo sapiens
aguacaccccaacagcac

SEQ ID NO: 1385957 - RNA, 23 nt, Homo sapiens
aguacaccccaacagcacccucu

SEQ ID NO: 1385958 - RNA, 20 nt, Homo sapiens
aguacccaccugagcuuugg

SEQ ID NO: 1385959 - RNA, 14 nt, Homo sapiens
aguacuggcauggu

SEQ ID NO: 1385960 - RNA, 12 nt, Homo sapiens
aguacuuaaaac

SEQ ID NO: 1385961 - RNA, 16 nt, Homo sapiens
aguagaaauuuuacaa

SEQ ID NO: 1385962 - RNA, 22 nt, Homo sapiens
aguagaagauuuuaugcugcug

SEQ ID NO: 1385963 - RNA, 20 nt, Homo sapiens
aguagaauugauuucccuuc

SEQ ID NO: 1385964 - RNA, 21 nt, Homo sapiens
aguagacuucauuuuuccuaa

SEQ ID NO: 1385965 - RNA, 21 nt, Homo sapiens
aguagagcagccacaaccaaa

SEQ ID NO: 1385966 - RNA, 22 nt, Homo sapiens
aguagguuuacauucaucucau

SEQ ID NO: 1385967 - RNA, 13 nt, Homo sapiens
aguagucauuuca

SEQ ID NO: 1385968 - RNA, 14 nt, Homo sapiens
aguauaauuuaacu

SEQ ID NO: 1385969 - RNA, 16 nt, Homo sapiens
aguauauaacuaacaa

SEQ ID NO: 1385970 - RNA, 17 nt, Homo sapiens
aguaucacacuguauau

SEQ ID NO: 1385971 - RNA, 21 nt, Homo sapiens
aguauccacuguuuauucaac

SEQ ID NO: 1385972 - RNA, 14 nt, Homo sapiens
aguaugagggaaaa

SEQ ID NO: 1385973 - RNA, 12 nt, Homo sapiens
aguaugcauuaa

SEQ ID NO: 1385974 - RNA, 21 nt, Homo sapiens
aguauuccuuuccugaucacu

SEQ ID NO: 1385975 - RNA, 19 nt, Homo sapiens
aguauuggcaaagaugugg

SEQ ID NO: 1385976 - RNA, 22 nt, Homo sapiens
aguauuugcugaauggggaccu

SEQ ID NO: 1385977 - RNA, 15 nt, Homo sapiens
agucaaaacagagau

SEQ ID NO: 1385978 - RNA, 16 nt, Homo sapiens
agucaaaagagagaag

SEQ ID NO: 1385979 - RNA, 12 nt, Homo sapiens
agucaaaccacu

SEQ ID NO: 1385980 - RNA, 23 nt, Homo sapiens
agucaauccccucauucaggaaa

SEQ ID NO: 1385981 - RNA, 13 nt, Homo sapiens
agucacagagaua

SEQ ID NO: 1385982 - RNA, 21 nt, Homo sapiens
agucacccggcccccaugcaa

SEQ ID NO: 1385983 - RNA, 13 nt, Homo sapiens
agucaccugccca

SEQ ID NO: 1385984 - RNA, 14 nt, Homo sapiens
agucacugcacagu

SEQ ID NO: 1385985 - RNA, 14 nt, Homo sapiens
agucagaugcccag

SEQ ID NO: 1385986 - RNA, 19 nt, Homo sapiens
agucaucagcuauucaguu

SEQ ID NO: 1385987 - RNA, 14 nt, Homo sapiens
aguccauauuucaa

SEQ ID NO: 1385988 - RNA, 16 nt, Homo sapiens
agucccagcuacuuga

SEQ ID NO: 1385989 - RNA, 20 nt, Homo sapiens
agucccauccucuugucagg

SEQ ID NO: 1385990 - RNA, 13 nt, Homo sapiens
agucccugacucu

SEQ ID NO: 1385991 - RNA, 22 nt, Homo sapiens
aguccuuuacuaauccaaccca

SEQ ID NO: 1385992 - RNA, 23 nt, Homo sapiens
agucgaggacagggaggugaccc

SEQ ID NO: 1385993 - RNA, 19 nt, Homo sapiens
agucgcaucucagugcagg

SEQ ID NO: 1385994 - RNA, 16 nt, Homo sapiens
agucucuagguucuga

SEQ ID NO: 1385995 - RNA, 13 nt, Homo sapiens
agucucugugaau

SEQ ID NO: 1385996 - RNA, 15 nt, Homo sapiens
agucucugugaauug

SEQ ID NO: 1385997 - RNA, 17 nt, Homo sapiens
agucucuucugcuggca

SEQ ID NO: 1385998 - RNA, 20 nt, Homo sapiens
agucugaauagucuucagag

SEQ ID NO: 1385999 - RNA, 18 nt, Homo sapiens
agucugugacccacuuac

SEQ ID NO: 1386000 - RNA, 19 nt, Homo sapiens
agucuucucauagcauuaa

SEQ ID NO: 1386001 - RNA, 21 nt, Homo sapiens
agucuucucauagcauuaacu

SEQ ID NO: 1386002 - RNA, 19 nt, Homo sapiens
agcuuggaaaggaccagua

SEQ ID NO: 1386003 - RNA, 23 nt, Homo sapiens
agcuuggauggagacuccaugag

SEQ ID NO: 1386004 - RNA, 24 nt, Homo sapiens
agcuuggccagaagggggccauga

SEQ ID NO: 1386005 - RNA, 12 nt, Homo sapiens
agcuuugcucuu

SEQ ID NO: 1386006 - RNA, 19 nt, Homo sapiens
agcuuuggacacacacagc

SEQ ID NO: 1386007 - RNA, 15 nt, Homo sapiens
aggaaaaaaaugacu

SEQ ID NO: 1386008 - RNA, 18 nt, Homo sapiens
aggaaaaugggaauuuau

SEQ ID NO: 1386009 - RNA, 22 nt, Homo sapiens
aggaaacuugcauacagagaca

SEQ ID NO: 1386010 - RNA, 15 nt, Homo sapiens
aggaaaugaaccaca

SEQ ID NO: 1386011 - RNA, 19 nt, Homo sapiens
aggaacacucugaauucca

SEQ ID NO: 1386012 - RNA, 14 nt, Homo sapiens
aggaacacugcacu

SEQ ID NO: 1386013 - RNA, 14 nt, Homo sapiens
aggaaccucagggc

SEQ ID NO: 1386014 - RNA, 23 nt, Homo sapiens
aggaacuauguucacaagaacaa

SEQ ID NO: 1386015 - RNA, 14 nt, Homo sapiens
aggaagcucagacu

SEQ ID NO: 1386016 - RNA, 21 nt, Homo sapiens
aggaaggaaagaaagaaggaa

SEQ ID NO: 1386017 - RNA, 13 nt, Homo sapiens
aggaaucaggcaa

SEQ ID NO: 1386018 - RNA, 23 nt, Homo sapiens
aggaauggaggcucuaauugaau

SEQ ID NO: 1386019 - RNA, 17 nt, Homo sapiens
aggaauuaaguuaggga

SEQ ID NO: 1386020 - RNA, 16 nt, Homo sapiens
aggaauucuaggcauc

SEQ ID NO: 1386021 - RNA, 22 nt, Homo sapiens
aggacaaaauaaggaacaugaa

SEQ ID NO: 1386022 - RNA, 18 nt, Homo sapiens
aggacaaccauuccagac

SEQ ID NO: 1386023 - RNA, 18 nt, Homo sapiens
aggacaccuuuuaacuca

SEQ ID NO: 1386024 - RNA, 18 nt, Homo sapiens
aggacagggaggugaccc

SEQ ID NO: 1386025 - RNA, 21 nt, Homo sapiens
aggacaugaaaaauugcuaug

SEQ ID NO: 1386026 - RNA, 19 nt, Homo sapiens
aggaccagaagcauuucac

SEQ ID NO: 1386027 - RNA, 15 nt, Homo sapiens
aggacccacuuccug

SEQ ID NO: 1386028 - RNA, 16 nt, Homo sapiens
aggacugcaccauugc

SEQ ID NO: 1386029 - RNA, 15 nt, Homo sapiens
aggacuggcuuuguc

SEQ ID NO: 1386030 - RNA, 16 nt, Homo sapiens
aggacuuccauuugcu

SEQ ID NO: 1386031 - RNA, 21 nt, Homo sapiens
aggacuuccauuugcuuuguc

SEQ ID NO: 1386032 - RNA, 15 nt, Homo sapiens
aggacuugaaagcau

SEQ ID NO: 1386033 - RNA, 13 nt, Homo sapiens
aggagaaacacau

SEQ ID NO: 1386034 - RNA, 21 nt, Homo sapiens
aggagaaccacuacaugcagc

SEQ ID NO: 1386035 - RNA, 17 nt, Homo sapiens
aggagaaucacuugcac

SEQ ID NO: 1386036 - RNA, 12 nt, Homo sapiens
aggagaccaagg

SEQ ID NO: 1386037 - RNA, 18 nt, Homo sapiens
aggagacccacagguaug

SEQ ID NO: 1386038 - RNA, 22 nt, Homo sapiens
aggagacucaccucugccucaa

SEQ ID NO: 1386039 - RNA, 21 nt, Homo sapiens
aggagacuuuacauggaugcc

SEQ ID NO: 1386040 - RNA, 18 nt, Homo sapiens
aggagaggggcacagggu

SEQ ID NO: 1386041 - RNA, 20 nt, Homo sapiens
aggagagucuugcagugauu

SEQ ID NO: 1386042 - RNA, 21 nt, Homo sapiens
aggagccuauggcaucuuccc

SEQ ID NO: 1386043 - RNA, 19 nt, Homo sapiens
auacuacauacaagcauaa

SEQ ID NO: 1386044 - RNA, 18 nt, Homo sapiens
auacucaccucaccccac

SEQ ID NO: 1386045 - RNA, 13 nt, Homo sapiens
auacugcauaaaa

SEQ ID NO: 1386046 - RNA, 14 nt, Homo sapiens
auacuggcaaagca

SEQ ID NO: 1386047 - RNA, 16 nt, Homo sapiens
auacuguauuuuuacc

SEQ ID NO: 1386048 - RNA, 23 nt, Homo sapiens
auacuugccugugacauuuugcc

SEQ ID NO: 1386049 - RNA, 13 nt, Homo sapiens
auacuuuacaaag

SEQ ID NO: 1386050 - RNA, 15 nt, Homo sapiens
auagaaccacuauga

SEQ ID NO: 1386051 - RNA, 19 nt, Homo sapiens
auagaagaugaaucauuga

SEQ ID NO: 1386052 - RNA, 22 nt, Homo sapiens
auagaaggaaacuagcuuacau

SEQ ID NO: 1386053 - RNA, 23 nt, Homo sapiens
auagaaggaggagagggaaaaug

SEQ ID NO: 1386054 - RNA, 23 nt, Homo sapiens
auagaccucucaauuucuggaaa

SEQ ID NO: 1386055 - RNA, 18 nt, Homo sapiens
auagaggggggcugccug

SEQ ID NO: 1386056 - RNA, 16 nt, Homo sapiens
auagaucacauaacag

SEQ ID NO: 1386057 - RNA, 17 nt, Homo sapiens
auagcauuggggacaug

SEQ ID NO: 1386058 - RNA, 20 nt, Homo sapiens
auagcuacuuuggaggacaa

SEQ ID NO: 1386059 - RNA, 18 nt, Homo sapiens
auagcuauauccauguac

SEQ ID NO: 1386060 - RNA, 16 nt, Homo sapiens
auaggaaugcuaacag

SEQ ID NO: 1386061 - RNA, 21 nt, Homo sapiens
auaggagagagaucaugagaa

SEQ ID NO: 1386062 - RNA, 13 nt, Homo sapiens
auaggcaaagggg

SEQ ID NO: 1386063 - RNA, 23 nt, Homo sapiens
auaguacagguaaggugagggaa

SEQ ID NO: 1386064 - RNA, 14 nt, Homo sapiens
auaguauugugcau

SEQ ID NO: 1386065 - RNA, 15 nt, Homo sapiens
auaguauugugcaua

SEQ ID NO: 1386066 - RNA, 22 nt, Homo sapiens
auaguuuaggagaaaccagcuu

SEQ ID NO: 1386067 - RNA, 19 nt, Homo sapiens
auaguuuuucauuguacca

SEQ ID NO: 1386068 - RNA, 20 nt, Homo sapiens
auauaacuaacaaccaaaga

SEQ ID NO: 1386069 - RNA, 12 nt, Homo sapiens
auauaacugccu

SEQ ID NO: 1386070 - RNA, 14 nt, Homo sapiens
auauaauaugcaca

SEQ ID NO: 1386071 - RNA, 21 nt, Homo sapiens
auauaauuuccauagugugag

SEQ ID NO: 1386072 - RNA, 12 nt, Homo sapiens
auauacaaauag

SEQ ID NO: 1386073 - RNA, 19 nt, Homo sapiens
auauacauacaugcauaca

SEQ ID NO: 1386074 - RNA, 23 nt, Homo sapiens
auauacauacaugcauacacucu

SEQ ID NO: 1386075 - RNA, 18 nt, Homo sapiens
auauacuauuuucauucu

SEQ ID NO: 1386076 - RNA, 20 nt, Homo sapiens
auauacuauuuucauucucu

SEQ ID NO: 1386077 - RNA, 13 nt, Homo sapiens
auauaggggcaau

SEQ ID NO: 1386078 - RNA, 13 nt, Homo sapiens
auauaguuuacua

SEQ ID NO: 1386079 - RNA, 17 nt, Homo sapiens
auauauuucagauauca

SEQ ID NO: 1386080 - RNA, 22 nt, Homo sapiens
auaucaauguuuguccuguaua

SEQ ID NO: 1386081 - RNA, 20 nt, Homo sapiens
auaucaguuugcuagcagaa

SEQ ID NO: 1386082 - RNA, 23 nt, Homo sapiens
auaucaugccccuguacuccagc

SEQ ID NO: 1386083 - RNA, 16 nt, Homo sapiens
auaucccuaugcugcc

SEQ ID NO: 1386084 - RNA, 16 nt, Homo sapiens
auaucugaaaauguau

SEQ ID NO: 1386085 - RNA, 20 nt, Homo sapiens
auaucugaagagcuauuaua

SEQ ID NO: 1386086 - RNA, 20 nt, Homo sapiens
auaucuguuuuacugcuuuu

SEQ ID NO: 1386087 - RNA, 15 nt, Homo sapiens
auaucuuuauugcau

SEQ ID NO: 1386088 - RNA, 16 nt, Homo sapiens
auaugaacggugagca

SEQ ID NO: 1386089 - RNA, 16 nt, Homo sapiens
auaugauuaguaaaga

SEQ ID NO: 1386090 - RNA, 14 nt, Homo sapiens
auaugauugugcac

SEQ ID NO: 1386091 - RNA, 11 nt, Homo sapiens
auaugcaauau

SEQ ID NO: 1386092 - RNA, 14 nt, Homo sapiens
auaugcacuugaaa

SEQ ID NO: 1386093 - RNA, 17 nt, Homo sapiens
auaugcucugauuuauc

SEQ ID NO: 1386094 - RNA, 20 nt, Homo sapiens
auaugcuuauacacuuacac

SEQ ID NO: 1386095 - RNA, 15 nt, Homo sapiens
auaugggcacuuuaa

SEQ ID NO: 1386096 - RNA, 14 nt, Homo sapiens
auaugugcuugccu

SEQ ID NO: 1386097 - RNA, 16 nt, Homo sapiens
auauguguucauuaaa

SEQ ID NO: 1386098 - RNA, 22 nt, Homo sapiens
auauguugauuucuuguaacau

SEQ ID NO: 1386099 - RNA, 21 nt, Homo sapiens
auauuaagaaagacuaucuaa

SEQ ID NO: 1386100 - RNA, 13 nt, Homo sapiens
auauucauuucaa

SEQ ID NO: 1386101 - RNA, 18 nt, Homo sapiens
auauucccacagcacuaa

SEQ ID NO: 1386102 - RNA, 15 nt, Homo sapiens
auauucucuuuggug

SEQ ID NO: 1386103 - RNA, 16 nt, Homo sapiens
auauuuaaguauucaa

SEQ ID NO: 1386104 - RNA, 17 nt, Homo sapiens
auauuuaccagaccaca

SEQ ID NO: 1386105 - RNA, 16 nt, Homo sapiens
auauuuauaacucauc

SEQ ID NO: 1386106 - RNA, 19 nt, Homo sapiens
auauuuauggggggagaac

SEQ ID NO: 1386107 - RNA, 13 nt, Homo sapiens
auauuucaggcau

SEQ ID NO: 1386108 - RNA, 22 nt, Homo sapiens
auauuuguaugauccuaaugaa

SEQ ID NO: 1386109 - RNA, 19 nt, Homo sapiens
aucaaacacaaugccucau

SEQ ID NO: 1386110 - RNA, 12 nt, Homo sapiens
aucaaauuucac

SEQ ID NO: 1386111 - RNA, 18 nt, Homo sapiens
aucaacaucuuggucaga

SEQ ID NO: 1386112 - RNA, 15 nt, Homo sapiens
aucaacccuaaaaag

SEQ ID NO: 1386113 - RNA, 13 nt, Homo sapiens
aucaagccuguga

SEQ ID NO: 1386114 - RNA, 19 nt, Homo sapiens
aucaauagaaggauguaca

SEQ ID NO: 1386115 - RNA, 15 nt, Homo sapiens
auccuaacacauuau

SEQ ID NO: 1386116 - RNA, 21 nt, Homo sapiens
auccuacaacuuccacuccaa

SEQ ID NO: 1386117 - RNA, 14 nt, Homo sapiens
auccuagcacuuug

SEQ ID NO: 1386118 - RNA, 14 nt, Homo sapiens
auccuaggcauuug

SEQ ID NO: 1386119 - RNA, 19 nt, Homo sapiens
auccuaucucuccaaccag

SEQ ID NO: 1386120 - RNA, 21 nt, Homo sapiens
auccuaugguuucuccaucca

SEQ ID NO: 1386121 - RNA, 22 nt, Homo sapiens
auccuaugguuucuccauccaa

SEQ ID NO: 1386122 - RNA, 11 nt, Homo sapiens
auccuauuuau

SEQ ID NO: 1386123 - RNA, 15 nt, Homo sapiens
auccucccaccucag

SEQ ID NO: 1386124 - RNA, 17 nt, Homo sapiens
auccucugguucuucau

SEQ ID NO: 1386125 - RNA, 23 nt, Homo sapiens
auccugaaaaggguguugcuaag

SEQ ID NO: 1386126 - RNA, 18 nt, Homo sapiens
auccuguugaaaagccau

SEQ ID NO: 1386127 - RNA, 18 nt, Homo sapiens
auccuuaaguaucagaaa

SEQ ID NO: 1386128 - RNA, 24 nt, Homo sapiens
auccuuggaaauuggaagagcaca

SEQ ID NO: 1386129 - RNA, 21 nt, Homo sapiens
auccuuguugacacggccaug

SEQ ID NO: 1386130 - RNA, 15 nt, Homo sapiens
aucgcgccacugcac

SEQ ID NO: 1386131 - RNA, 16 nt, Homo sapiens
aucggaagcagugccu

SEQ ID NO: 1386132 - RNA, 23 nt, Homo sapiens
aucggaucuggggcucugggaua

SEQ ID NO: 1386133 - RNA, 17 nt, Homo sapiens
aucggggccagaggcag

SEQ ID NO: 1386134 - RNA, 22 nt, Homo sapiens
aucgucuaaacuuuagaauuaa

SEQ ID NO: 1386135 - RNA, 12 nt, Homo sapiens
aucgugcuaaau

SEQ ID NO: 1386136 - RNA, 17 nt, Homo sapiens
aucguuguuuacagugu

SEQ ID NO: 1386137 - RNA, 20 nt, Homo sapiens
aucuaaaguaaaaagggaau

SEQ ID NO: 1386138 - RNA, 18 nt, Homo sapiens
aucuacaaaaaacaacaa

SEQ ID NO: 1386139 - RNA, 11 nt, Homo sapiens
aucuaccagca

SEQ ID NO: 1386140 - RNA, 14 nt, Homo sapiens
aucuagaagacugu

SEQ ID NO: 1386141 - RNA, 20 nt, Homo sapiens
aucuaucagaguauccacug

SEQ ID NO: 1386142 - RNA, 16 nt, Homo sapiens
aucuaugauaugcuaa

SEQ ID NO: 1386143 - RNA, 21 nt, Homo sapiens
aucucacuggaugcaaagaaa

SEQ ID NO: 1386144 - RNA, 18 nt, Homo sapiens
aucucaggccaccugccc

SEQ ID NO: 1386145 - RNA, 20 nt, Homo sapiens
aucucaugagugccaagcaa

SEQ ID NO: 1386146 - RNA, 16 nt, Homo sapiens
aucucauggcagcuaa

SEQ ID NO: 1386147 - RNA, 21 nt, Homo sapiens
aucuccccucagauuccaccu

SEQ ID NO: 1386148 - RNA, 13 nt, Homo sapiens
aucuccugaccuc

SEQ ID NO: 1386149 - RNA, 19 nt, Homo sapiens
aucuccugugcauggguga

SEQ ID NO: 1386150 - RNA, 20 nt, Homo sapiens
aucucgccaccccuccuucc

SEQ ID NO: 1386151 - RNA, 16 nt, Homo sapiens
aucucuacuaccacaa

SEQ ID NO: 1386152 - RNA, 13 nt, Homo sapiens
aucucucuacucc

SEQ ID NO: 1386153 - RNA, 14 nt, Homo sapiens
aucucucuuuacau

SEQ ID NO: 1386154 - RNA, 23 nt, Homo sapiens
aucucuuguauaugaugaucugg

SEQ ID NO: 1386155 - RNA, 16 nt, Homo sapiens
aucucuuugaugucau

SEQ ID NO: 1386156 - RNA, 13 nt, Homo sapiens
aucugaggcacau

SEQ ID NO: 1386157 - RNA, 20 nt, Homo sapiens
aucugaguugacuugacaga

SEQ ID NO: 1386158 - RNA, 21 nt, Homo sapiens
aucugccuccccuucacuccc

SEQ ID NO: 1386159 - RNA, 21 nt, Homo sapiens
aucugcucuuaggugcuucuu

SEQ ID NO: 1386160 - RNA, 20 nt, Homo sapiens
aucuggaguugaacagcaaa

SEQ ID NO: 1386161 - RNA, 16 nt, Homo sapiens
aucugggauauuucca

SEQ ID NO: 1386162 - RNA, 21 nt, Homo sapiens
aucuggggauacuggcaaagc

SEQ ID NO: 1386163 - RNA, 17 nt, Homo sapiens
aucuggguucacugcaa

SEQ ID NO: 1386164 - RNA, 16 nt, Homo sapiens
aucuguauauacaaua

SEQ ID NO: 1386165 - RNA, 17 nt, Homo sapiens
aucugugcaaauccuug

SEQ ID NO: 1386166 - RNA, 13 nt, Homo sapiens
aucugugcaauaa

SEQ ID NO: 1386167 - RNA, 17 nt, Homo sapiens
aucugugccccaugccu

SEQ ID NO: 1386168 - RNA, 13 nt, Homo sapiens
aucuuaacucuuu

SEQ ID NO: 1386169 - RNA, 23 nt, Homo sapiens
aucuucacuucuaaaugcauauc

SEQ ID NO: 1386170 - RNA, 16 nt, Homo sapiens
aucuucaggacacuca

SEQ ID NO: 1386171 - RNA, 18 nt, Homo sapiens
aucuuccccaacgaaaag

SEQ ID NO: 1386172 - RNA, 19 nt, Homo sapiens
aucuugaccaagcaggaag

SEQ ID NO: 1386173 - RNA, 17 nt, Homo sapiens
aucuugcuuuuuuucac

SEQ ID NO: 1386174 - RNA, 19 nt, Homo sapiens
aucuuggacugacauuuag

SEQ ID NO: 1386175 - RNA, 23 nt, Homo sapiens
aucuuguuuuuccacuacugcua

SEQ ID NO: 1386176 - RNA, 24 nt, Homo sapiens
aucuuguuuuuccacuacugcuac

SEQ ID NO: 1386177 - RNA, 23 nt, Homo sapiens
aucuuuaggagacuaauggaaau

SEQ ID NO: 1386178 - RNA, 18 nt, Homo sapiens
aucuuuauugcaugagaa

SEQ ID NO: 1386179 - RNA, 19 nt, Homo sapiens
aucuuugcuauggggacau

SEQ ID NO: 1386180 - RNA, 21 nt, Homo sapiens
aucuuugcuauggggacauuc

SEQ ID NO: 1386181 - RNA, 23 nt, Homo sapiens
aucuuuuaguuuuaguugcagaa

SEQ ID NO: 1386182 - RNA, 16 nt, Homo sapiens
aucuuuuuuagcauaa

SEQ ID NO: 1386183 - RNA, 17 nt, Homo sapiens
augaaaaugaaccauuc

SEQ ID NO: 1386184 - RNA, 13 nt, Homo sapiens
augaaaaugucag

SEQ ID NO: 1386185 - RNA, 16 nt, Homo sapiens
augaaauguaaauacu

SEQ ID NO: 1386186 - RNA, 17 nt, Homo sapiens
cacuugggauugucuua

SEQ ID NO: 1386187 - RNA, 20 nt, Homo sapiens
cacuugugugugggcuguga

SEQ ID NO: 1386188 - RNA, 15 nt, Homo sapiens
cacuuuaaagcccuu

SEQ ID NO: 1386189 - RNA, 20 nt, Homo sapiens
cacuuugggaggcugaggcg

SEQ ID NO: 1386190 - RNA, 14 nt, Homo sapiens
cagaaaaacaauaa

SEQ ID NO: 1386191 - RNA, 14 nt, Homo sapiens
cagaaaaacugugg

SEQ ID NO: 1386192 - RNA, 17 nt, Homo sapiens
cagaaaaacugugggua

SEQ ID NO: 1386193 - RNA, 18 nt, Homo sapiens
cagaaacaaaaacacuaa

SEQ ID NO: 1386194 - RNA, 19 nt, Homo sapiens
cagaaacaguucaccuuga

SEQ ID NO: 1386195 - RNA, 19 nt, Homo sapiens
cagaaagagagcacugacc

SEQ ID NO: 1386196 - RNA, 18 nt, Homo sapiens
cagaaagcuagaaagugu

SEQ ID NO: 1386197 - RNA, 18 nt, Homo sapiens
cagaaaguggccaugcca

SEQ ID NO: 1386198 - RNA, 19 nt, Homo sapiens
cagaaaguggccaugccac

SEQ ID NO: 1386199 - RNA, 19 nt, Homo sapiens
cagaaaucuagaagacugu

SEQ ID NO: 1386200 - RNA, 12 nt, Homo sapiens
cagaacaggaau

SEQ ID NO: 1386201 - RNA, 11 nt, Homo sapiens
cagaacaguua

SEQ ID NO: 1386202 - RNA, 16 nt, Homo sapiens
cagaacccagauuucc

SEQ ID NO: 1386203 - RNA, 15 nt, Homo sapiens
cagaacccuggugag

SEQ ID NO: 1386204 - RNA, 18 nt, Homo sapiens
cagaacuggacucaggau

SEQ ID NO: 1386205 - RNA, 16 nt, Homo sapiens
cagaagacacugcaaa

SEQ ID NO: 1386206 - RNA, 14 nt, Homo sapiens
cagaagguauuccu

SEQ ID NO: 1386207 - RNA, 14 nt, Homo sapiens
cagaauacuagcca

SEQ ID NO: 1386208 - RNA, 14 nt, Homo sapiens
cagaauauacuaaa

SEQ ID NO: 1386209 - RNA, 14 nt, Homo sapiens
cagaaucccggcug

SEQ ID NO: 1386210 - RNA, 15 nt, Homo sapiens
cagaaucucaaauaa

SEQ ID NO: 1386211 - RNA, 17 nt, Homo sapiens
cagaaucucaaauaacu

SEQ ID NO: 1386212 - RNA, 21 nt, Homo sapiens
cagaaucucucuucuuuucaa

SEQ ID NO: 1386213 - RNA, 13 nt, Homo sapiens
cagaauguguuau

SEQ ID NO: 1386214 - RNA, 19 nt, Homo sapiens
cagaauugcuuguuugcuu

SEQ ID NO: 1386215 - RNA, 13 nt, Homo sapiens
cagacagauucca

SEQ ID NO: 1386216 - RNA, 16 nt, Homo sapiens
cagacgguucaccagc

SEQ ID NO: 1386217 - RNA, 19 nt, Homo sapiens
cagacuauugacaucagca

SEQ ID NO: 1386218 - RNA, 12 nt, Homo sapiens
cagacuccaugg

SEQ ID NO: 1386219 - RNA, 15 nt, Homo sapiens
cagacuccugugcaa

SEQ ID NO: 1386220 - RNA, 20 nt, Homo sapiens
cagacucuacagaggccaug

SEQ ID NO: 1386221 - RNA, 18 nt, Homo sapiens
cagacugcaagugagcaa

SEQ ID NO: 1386222 - RNA, 21 nt, Homo sapiens
cagacuggaggggacgcuggu

SEQ ID NO: 1386223 - RNA, 20 nt, Homo sapiens
cagacuggauaguccgucuc

SEQ ID NO: 1386224 - RNA, 17 nt, Homo sapiens
cagacuucacacugcaa

SEQ ID NO: 1386225 - RNA, 18 nt, Homo sapiens
cagagaaccugcuuuacu

SEQ ID NO: 1386226 - RNA, 22 nt, Homo sapiens
cagagaaggaaugucuuugguc

SEQ ID NO: 1386227 - RNA, 21 nt, Homo sapiens
cagagaagggcuuggacucaa

SEQ ID NO: 1386228 - RNA, 16 nt, Homo sapiens
cagagacaggaaaauc

SEQ ID NO: 1386229 - RNA, 16 nt, Homo sapiens
cagagagcagugugga

SEQ ID NO: 1386230 - RNA, 16 nt, Homo sapiens
cagagcacuguauacc

SEQ ID NO: 1386231 - RNA, 16 nt, Homo sapiens
cagagcagaacuuuca

SEQ ID NO: 1386232 - RNA, 19 nt, Homo sapiens
cagagcccugggcaucaga

SEQ ID NO: 1386233 - RNA, 20 nt, Homo sapiens
cagagcgagagucugucuca

SEQ ID NO: 1386234 - RNA, 16 nt, Homo sapiens
cagagcugagcccuca

SEQ ID NO: 1386235 - RNA, 16 nt, Homo sapiens
cagaggagccaugucc

SEQ ID NO: 1386236 - RNA, 14 nt, Homo sapiens
cagaggcacagccg

SEQ ID NO: 1386237 - RNA, 22 nt, Homo sapiens
cagaggcagcgaguuguggaaa

SEQ ID NO: 1386238 - RNA, 22 nt, Homo sapiens
cagaggccuauaacuuuuggua

SEQ ID NO: 1386239 - RNA, 16 nt, Homo sapiens
cagagggaaacacagc

SEQ ID NO: 1386240 - RNA, 21 nt, Homo sapiens
cagagguucauuucaaauaca

SEQ ID NO: 1386241 - RNA, 16 nt, Homo sapiens
cagagguugcagugag

SEQ ID NO: 1386242 - RNA, 18 nt, Homo sapiens
cagaguacuggcugaugg

SEQ ID NO: 1386243 - RNA, 18 nt, Homo sapiens
cagagucucacuguugcc

SEQ ID NO: 1386244 - RNA, 14 nt, Homo sapiens
cagauaacucuccu

SEQ ID NO: 1386245 - RNA, 12 nt, Homo sapiens
cagauacuuggg

SEQ ID NO: 1386246 - RNA, 22 nt, Homo sapiens
cagaucacccggggcuuacuua

SEQ ID NO: 1386247 - RNA, 20 nt, Homo sapiens
cagaucagauucuucucuua

SEQ ID NO: 1386248 - RNA, 20 nt, Homo sapiens
cagaugaacucuuucuggcc

SEQ ID NO: 1386249 - RNA, 19 nt, Homo sapiens
cagaugcugaaagagaaaa

SEQ ID NO: 1386250 - RNA, 21 nt, Homo sapiens
cagauggcaggaugggcacug

SEQ ID NO: 1386251 - RNA, 13 nt, Homo sapiens
cagaugugugauu

SEQ ID NO: 1386252 - RNA, 21 nt, Homo sapiens
cagauguuuuucuucauuaac

SEQ ID NO: 1386253 - RNA, 19 nt, Homo sapiens
cagauuccaccuagagcua

SEQ ID NO: 1386254 - RNA, 22 nt, Homo sapiens
cagauuccaggcgaugugcaag

SEQ ID NO: 1386255 - RNA, 19 nt, Homo sapiens
cagauugcaacaggcuggg

SEQ ID NO: 1386256 - RNA, 18 nt, Homo sapiens
cagcaaaacuccaucuca

SEQ ID NO: 1386257 - RNA, 22 nt, Homo sapiens
cagcaacacaauguuauucguu

SEQ ID NO: 1386258 - RNA, 17 nt, Homo sapiens
cagcaacccuccuauca

SEQ ID NO: 1386259 - RNA, 21 nt, Homo sapiens
cagcaaccuguaagacugaua

SEQ ID NO: 1386260 - RNA, 23 nt, Homo sapiens
cagcaaggccagaugcacauccc

SEQ ID NO: 1386261 - RNA, 18 nt, Homo sapiens
cagcaagugagagcuggg

SEQ ID NO: 1386262 - RNA, 23 nt, Homo sapiens
cagcaauacuaagggaagaaaca

SEQ ID NO: 1386263 - RNA, 12 nt, Homo sapiens
cagcaaugauua

SEQ ID NO: 1386264 - RNA, 14 nt, Homo sapiens
cagcaauuccaugc

SEQ ID NO: 1386265 - RNA, 19 nt, Homo sapiens
cagcacccagcaacuccaa

SEQ ID NO: 1386266 - RNA, 17 nt, Homo sapiens
cagcacccccuucucug

SEQ ID NO: 1386267 - RNA, 15 nt, Homo sapiens
cagcacccucuccag

SEQ ID NO: 1386268 - RNA, 20 nt, Homo sapiens
cagcaccugcgggagcugca

SEQ ID NO: 1386269 - RNA, 21 nt, Homo sapiens
cagcacuaaagcaguggacac

SEQ ID NO: 1386270 - RNA, 14 nt, Homo sapiens
cagcacuaauucaa

SEQ ID NO: 1386271 - RNA, 19 nt, Homo sapiens
cagcacucugaaacugaga

SEQ ID NO: 1386272 - RNA, 18 nt, Homo sapiens
cagcacuuagguuuuccu

SEQ ID NO: 1386273 - RNA, 18 nt, Homo sapiens
cagcacuuguguugucug

SEQ ID NO: 1386274 - RNA, 17 nt, Homo sapiens
cagcagaacuucugaaa

SEQ ID NO: 1386275 - RNA, 16 nt, Homo sapiens
cagcagaucccagcuc

SEQ ID NO: 1386276 - RNA, 20 nt, Homo sapiens
cagcagccagcucucagcca

SEQ ID NO: 1386277 - RNA, 21 nt, Homo sapiens
cagcagcucaggcacacuucu

SEQ ID NO: 1386278 - RNA, 22 nt, Homo sapiens
cagcagcuucucuccacugaaa

SEQ ID NO: 1386279 - RNA, 19 nt, Homo sapiens
cagcaucuaagaaguuuug

SEQ ID NO: 1386280 - RNA, 14 nt, Homo sapiens
cagcaucuaaguaa

SEQ ID NO: 1386281 - RNA, 19 nt, Homo sapiens
cagcaugcauucauaacag

SEQ ID NO: 1386282 - RNA, 16 nt, Homo sapiens
cagcauggagucacag

SEQ ID NO: 1386283 - RNA, 11 nt, Homo sapiens
cagcauugcuu

SEQ ID NO: 1386284 - RNA, 20 nt, Homo sapiens
cagcauuuuacuacuuuaaa

SEQ ID NO: 1386285 - RNA, 18 nt, Homo sapiens
cagccaaacccugucuga

SEQ ID NO: 1386286 - RNA, 12 nt, Homo sapiens
cagccagugacc

SEQ ID NO: 1386287 - RNA, 15 nt, Homo sapiens
cagccaucaagggaa

SEQ ID NO: 1386288 - RNA, 18 nt, Homo sapiens
cagccauuaccauggaga

SEQ ID NO: 1386289 - RNA, 16 nt, Homo sapiens
cagcccacguucucuc

SEQ ID NO: 1386290 - RNA, 13 nt, Homo sapiens
cagcccacuggau

SEQ ID NO: 1386291 - RNA, 14 nt, Homo sapiens
cagcccaggccucc

SEQ ID NO: 1386292 - RNA, 11 nt, Homo sapiens
cagcccauucu

SEQ ID NO: 1386293 - RNA, 19 nt, Homo sapiens
cagcccugauugcgcaaaa

SEQ ID NO: 1386294 - RNA, 12 nt, Homo sapiens
cagcccugugga

SEQ ID NO: 1386295 - RNA, 22 nt, Homo sapiens
cagcccuguucugggugcagcu

SEQ ID NO: 1386296 - RNA, 15 nt, Homo sapiens
cagccucaggaugag

SEQ ID NO: 1386297 - RNA, 20 nt, Homo sapiens
cagccuccagagaguaucug

SEQ ID NO: 1386298 - RNA, 18 nt, Homo sapiens
cagccucccaguagcugg

SEQ ID NO: 1386299 - RNA, 19 nt, Homo sapiens
cagccucccgaauagcugg

SEQ ID NO: 1386300 - RNA, 20 nt, Homo sapiens
cagccucccucugaccugca

SEQ ID NO: 1386301 - RNA, 20 nt, Homo sapiens
cagccuccuguguagcuggg

SEQ ID NO: 1386302 - RNA, 22 nt, Homo sapiens
cagccucugaaaaccaauguuc

SEQ ID NO: 1386303 - RNA, 15 nt, Homo sapiens
cagccugcuccagcu

SEQ ID NO: 1386304 - RNA, 18 nt, Homo sapiens
cagccuggauguuuuuuc

SEQ ID NO: 1386305 - RNA, 19 nt, Homo sapiens
cagccugggcaacagagca

SEQ ID NO: 1386306 - RNA, 20 nt, Homo sapiens
cagccugugguuacagugca

SEQ ID NO: 1386307 - RNA, 22 nt, Homo sapiens
cagccugugguuacagugcaga

SEQ ID NO: 1386308 - RNA, 23 nt, Homo sapiens
cagcggccacacuguacucugca

SEQ ID NO: 1386309 - RNA, 13 nt, Homo sapiens
cagcuaaaaccua

SEQ ID NO: 1386310 - RNA, 19 nt, Homo sapiens
cagcuaaggacauuuccca

SEQ ID NO: 1386311 - RNA, 15 nt, Homo sapiens
cagcuaucucucagu

SEQ ID NO: 1386312 - RNA, 19 nt, Homo sapiens
cagcuauuuucaacauaac

SEQ ID NO: 1386313 - RNA, 15 nt, Homo sapiens
cagcucaaaggcaca

SEQ ID NO: 1386314 - RNA, 15 nt, Homo sapiens
cagcucacgucacac

SEQ ID NO: 1386315 - RNA, 17 nt, Homo sapiens
cagcuccuuccaccaca

SEQ ID NO: 1386316 - RNA, 14 nt, Homo sapiens
cagcucguucucug

SEQ ID NO: 1386317 - RNA, 16 nt, Homo sapiens
cagcucugaggacugc

SEQ ID NO: 1386318 - RNA, 18 nt, Homo sapiens
cagcucugaggacugcac

SEQ ID NO: 1386319 - RNA, 14 nt, Homo sapiens
cagcugacacaucu

SEQ ID NO: 1386320 - RNA, 13 nt, Homo sapiens
cagcugcaccugc

SEQ ID NO: 1386321 - RNA, 15 nt, Homo sapiens
cagcugcaccugcca

SEQ ID NO: 1386322 - RNA, 19 nt, Homo sapiens
cagcugcgguccacccagg

SEQ ID NO: 1386323 - RNA, 21 nt, Homo sapiens
cagcuggaagggucaacaucu

SEQ ID NO: 1386324 - RNA, 18 nt, Homo sapiens
cagcuggcacugucucug

SEQ ID NO: 1386325 - RNA, 23 nt, Homo sapiens
cagcuggguuggaaaacaguauu

SEQ ID NO: 1386326 - RNA, 22 nt, Homo sapiens
cagcugugguuuucuuuugcca

SEQ ID NO: 1386327 - RNA, 16 nt, Homo sapiens
cagcuguuagagucca

SEQ ID NO: 1386328 - RNA, 20 nt, Homo sapiens
cagcuuaggggcugcugacc

SEQ ID NO: 1386329 - RNA, 13 nt, Homo sapiens
cagcuuaucucag

SEQ ID NO: 1386330 - RNA, 22 nt, Homo sapiens
cagcuuaucucaggggugugcg

SEQ ID NO: 1386331 - RNA, 14 nt, Homo sapiens
cagcuuggggccau

SEQ ID NO: 1386332 - RNA, 22 nt, Homo sapiens
cagcuuguaaauagcucaggug

SEQ ID NO: 1386333 - RNA, 23 nt, Homo sapiens
cagcuuuguuuguugucagcuga

SEQ ID NO: 1386334 - RNA, 20 nt, Homo sapiens
caggaaagaauagaagugau

SEQ ID NO: 1386335 - RNA, 15 nt, Homo sapiens
caggaaccucagggc

SEQ ID NO: 1386336 - RNA, 21 nt, Homo sapiens
caggaagggcaggaaggagag

SEQ ID NO: 1386337 - RNA, 15 nt, Homo sapiens
caggaagguagaaau

SEQ ID NO: 1386338 - RNA, 20 nt, Homo sapiens
caggaaucuccucacugaaa

SEQ ID NO: 1386339 - RNA, 14 nt, Homo sapiens
caggacauucucau

SEQ ID NO: 1386340 - RNA, 12 nt, Homo sapiens
caggacuagcug

SEQ ID NO: 1386341 - RNA, 14 nt, Homo sapiens
caggagaagggaua

SEQ ID NO: 1386342 - RNA, 18 nt, Homo sapiens
caggagaccuggcacugg

SEQ ID NO: 1386343 - RNA, 19 nt, Homo sapiens
caggagaccuggcacugga

SEQ ID NO: 1386344 - RNA, 17 nt, Homo sapiens
caggagcauggggauaa

SEQ ID NO: 1386345 - RNA, 11 nt, Homo sapiens
caggagcucuu

SEQ ID NO: 1386346 - RNA, 21 nt, Homo sapiens
caggagguaaagaaauagcca

SEQ ID NO: 1386347 - RNA, 21 nt, Homo sapiens
caggagguugagguaggagaa

SEQ ID NO: 1386348 - RNA, 20 nt, Homo sapiens
caggaguguggccacguggg

SEQ ID NO: 1386349 - RNA, 20 nt, Homo sapiens
caggaguucaagaccagccu

SEQ ID NO: 1386350 - RNA, 22 nt, Homo sapiens
caggaguuugaggcugcagcga

SEQ ID NO: 1386351 - RNA, 18 nt, Homo sapiens
caggaugaguuacuugaa

SEQ ID NO: 1386352 - RNA, 18 nt, Homo sapiens
caggaugauuguacagaa

SEQ ID NO: 1386353 - RNA, 20 nt, Homo sapiens
caggauggcacuguuggcac

SEQ ID NO: 1386354 - RNA, 19 nt, Homo sapiens
caggauggucucugccaug

SEQ ID NO: 1386355 - RNA, 19 nt, Homo sapiens
caggauguuugcucagcuu

SEQ ID NO: 1386356 - RNA, 22 nt, Homo sapiens
caggauucuccuuuuuaccccu

SEQ ID NO: 1386357 - RNA, 20 nt, Homo sapiens
caggcaacgcacaaaacaga

SEQ ID NO: 1386358 - RNA, 17 nt, Homo sapiens
caggcacccaccaucau

SEQ ID NO: 1386359 - RNA, 16 nt, Homo sapiens
caggcagaucugugcc

SEQ ID NO: 1386360 - RNA, 20 nt, Homo sapiens
caggcagcuuuuucucuccc

SEQ ID NO: 1386361 - RNA, 12 nt, Homo sapiens
caggcaggccac

SEQ ID NO: 1386362 - RNA, 16 nt, Homo sapiens
caggcagguccagggu

SEQ ID NO: 1386363 - RNA, 15 nt, Homo sapiens
caggcauguucucug

SEQ ID NO: 1386364 - RNA, 17 nt, Homo sapiens
caggccaggugcagugg

SEQ ID NO: 1386365 - RNA, 17 nt, Homo sapiens
caggcccacagcccagc

SEQ ID NO: 1386366 - RNA, 17 nt, Homo sapiens
caggccccgcuugucca

SEQ ID NO: 1386367 - RNA, 14 nt, Homo sapiens
caggccccugccac

SEQ ID NO: 1386368 - RNA, 18 nt, Homo sapiens
caggcccggcuccaggcu

SEQ ID NO: 1386369 - RNA, 21 nt, Homo sapiens
caggcccuuccucuccacugc

SEQ ID NO: 1386370 - RNA, 14 nt, Homo sapiens
caggccucccucaa

SEQ ID NO: 1386371 - RNA, 15 nt, Homo sapiens
caggcgugaccugcc

SEQ ID NO: 1386372 - RNA, 23 nt, Homo sapiens
caggcgugaccugccaggcacac

SEQ ID NO: 1386373 - RNA, 15 nt, Homo sapiens
caggcgugguggcac

SEQ ID NO: 1386374 - RNA, 16 nt, Homo sapiens
caggcuccaggccuca

SEQ ID NO: 1386375 - RNA, 18 nt, Homo sapiens
caggcugcauagaaggag

SEQ ID NO: 1386376 - RNA, 16 nt, Homo sapiens
caggcuggagugcagu

SEQ ID NO: 1386377 - RNA, 20 nt, Homo sapiens
caggcugggcuucaguggca

SEQ ID NO: 1386378 - RNA, 14 nt, Homo sapiens
caggcugugggccu

SEQ ID NO: 1386379 - RNA, 19 nt, Homo sapiens
caggcuguuuuugggugca

SEQ ID NO: 1386380 - RNA, 17 nt, Homo sapiens
cagggacccacuucaca

SEQ ID NO: 1386381 - RNA, 19 nt, Homo sapiens
cagggagguggcuggguuu

SEQ ID NO: 1386382 - RNA, 20 nt, Homo sapiens
cagggauggggccacagcca

SEQ ID NO: 1386383 - RNA, 21 nt, Homo sapiens
cagggcccugcagaggggaaa

SEQ ID NO: 1386384 - RNA, 13 nt, Homo sapiens
cagggcgugggac

SEQ ID NO: 1386385 - RNA, 21 nt, Homo sapiens
cagggcucagccuggugggcc

SEQ ID NO: 1386386 - RNA, 20 nt, Homo sapiens
cagggcucugugaccaggaa

SEQ ID NO: 1386387 - RNA, 20 nt, Homo sapiens
cagggcuggucuuuuaggac

SEQ ID NO: 1386388 - RNA, 17 nt, Homo sapiens
caggggaccacaccucc

SEQ ID NO: 1386389 - RNA, 19 nt, Homo sapiens
caggguauaaaaugacauc

SEQ ID NO: 1386390 - RNA, 19 nt, Homo sapiens
cagggucucacucugucgc

SEQ ID NO: 1386391 - RNA, 19 nt, Homo sapiens
cagguaagggggugcagca

SEQ ID NO: 1386392 - RNA, 17 nt, Homo sapiens
caggucaucuccuuuca

SEQ ID NO: 1386393 - RNA, 22 nt, Homo sapiens
cagguccucuacuuaaugagau

SEQ ID NO: 1386394 - RNA, 11 nt, Homo sapiens
caggugcacag

SEQ ID NO: 1386395 - RNA, 20 nt, Homo sapiens
caggugccccucucuccauc

SEQ ID NO: 1386396 - RNA, 16 nt, Homo sapiens
caggugugaaccacca

SEQ ID NO: 1386397 - RNA, 19 nt, Homo sapiens
caggugugaaccaccacac

SEQ ID NO: 1386398 - RNA, 22 nt, Homo sapiens
cagguguucuacacucaucuua

SEQ ID NO: 1386399 - RNA, 19 nt, Homo sapiens
cagguuacaugagagcaau

SEQ ID NO: 1386400 - RNA, 19 nt, Homo sapiens
cagguuuugaaaauguaca

SEQ ID NO: 1386401 - RNA, 21 nt, Homo sapiens
caguaaacuuuggcuuauaaa

SEQ ID NO: 1386402 - RNA, 22 nt, Homo sapiens
caguaaaguguaacauaugcaa

SEQ ID NO: 1386403 - RNA, 21 nt, Homo sapiens
caguaauaaaacaucuuucca

SEQ ID NO: 1386404 - RNA, 19 nt, Homo sapiens
caguagaaauaauaugcau

SEQ ID NO: 1386405 - RNA, 16 nt, Homo sapiens
caguagagucaucucc

SEQ ID NO: 1386406 - RNA, 20 nt, Homo sapiens
caguauauaacuaacaacca

SEQ ID NO: 1386407 - RNA, 20 nt, Homo sapiens
caguauauuuauagucacaa

SEQ ID NO: 1386408 - RNA, 15 nt, Homo sapiens
caguaucuugggcau

SEQ ID NO: 1386409 - RNA, 22 nt, Homo sapiens
caguauuuuccaaacuaccuuc

SEQ ID NO: 1386410 - RNA, 14 nt, Homo sapiens
cagucaauuuucac

SEQ ID NO: 1386411 - RNA, 21 nt, Homo sapiens
cauggaacucauuccugccug

SEQ ID NO: 1386412 - RNA, 17 nt, Homo sapiens
cauggagccagugccug

SEQ ID NO: 1386413 - RNA, 17 nt, Homo sapiens
cauggagucacagccac

SEQ ID NO: 1386414 - RNA, 21 nt, Homo sapiens
cauggagucuucagguagaaa

SEQ ID NO: 1386415 - RNA, 23 nt, Homo sapiens
cauggcugggauuuaaagccuuu

SEQ ID NO: 1386416 - RNA, 18 nt, Homo sapiens
caugggucucuguagaaa

SEQ ID NO: 1386417 - RNA, 20 nt, Homo sapiens
caugguaaaaccccaucucu

SEQ ID NO: 1386418 - RNA, 15 nt, Homo sapiens
caugguccccaagac

SEQ ID NO: 1386419 - RNA, 13 nt, Homo sapiens
cauggugcacuga

SEQ ID NO: 1386420 - RNA, 15 nt, Homo sapiens
cauggugcacugagc

SEQ ID NO: 1386421 - RNA, 13 nt, Homo sapiens
cauggugcaugcc

SEQ ID NO: 1386422 - RNA, 19 nt, Homo sapiens
cauguaauuaaguacuaug

SEQ ID NO: 1386423 - RNA, 19 nt, Homo sapiens
cauguagccucaaccuccc

SEQ ID NO: 1386424 - RNA, 17 nt, Homo sapiens
caugugcacaugcacgu

SEQ ID NO: 1386425 - RNA, 22 nt, Homo sapiens
caugugccagguuuuuggucug

SEQ ID NO: 1386426 - RNA, 15 nt, Homo sapiens
caugugcucagggaa

SEQ ID NO: 1386427 - RNA, 15 nt, Homo sapiens
caugugcugugacca

SEQ ID NO: 1386428 - RNA, 19 nt, Homo sapiens
cauguggaagcacuuuaag

SEQ ID NO: 1386429 - RNA, 13 nt, Homo sapiens
cauguguauuucc

SEQ ID NO: 1386430 - RNA, 19 nt, Homo sapiens
caugugugagugugugcaa

SEQ ID NO: 1386431 - RNA, 12 nt, Homo sapiens
caugugugugca

SEQ ID NO: 1386432 - RNA, 22 nt, Homo sapiens
caugugugugcaagugugugca

SEQ ID NO: 1386433 - RNA, 18 nt, Homo sapiens
cauguuauuuauaguguu

SEQ ID NO: 1386434 - RNA, 22 nt, Homo sapiens
cauguuggccaggcuggucuca

SEQ ID NO: 1386435 - RNA, 17 nt, Homo sapiens
cauuaacaaaagcaauu

SEQ ID NO: 1386436 - RNA, 17 nt, Homo sapiens
cauuaaccagggcacca

SEQ ID NO: 1386437 - RNA, 19 nt, Homo sapiens
cauuaagcaucacaaauga

SEQ ID NO: 1386438 - RNA, 22 nt, Homo sapiens
cauuaccgucauuggccuguga

SEQ ID NO: 1386439 - RNA, 13 nt, Homo sapiens
cauuacucugaaa

SEQ ID NO: 1386440 - RNA, 19 nt, Homo sapiens
cauuacucugaaauuguaa

SEQ ID NO: 1386441 - RNA, 12 nt, Homo sapiens
cauuagaccaag

SEQ ID NO: 1386442 - RNA, 13 nt, Homo sapiens
cauuagagucagc

SEQ ID NO: 1386443 - RNA, 17 nt, Homo sapiens
cauuauaaacgugauga

SEQ ID NO: 1386444 - RNA, 18 nt, Homo sapiens
cauuauaacugaaggaga

SEQ ID NO: 1386445 - RNA, 17 nt, Homo sapiens
cauucacccagacagcu

SEQ ID NO: 1386446 - RNA, 17 nt, Homo sapiens
cauucacuugcauuucu

SEQ ID NO: 1386447 - RNA, 17 nt, Homo sapiens
cauucagggauagcacu

SEQ ID NO: 1386448 - RNA, 19 nt, Homo sapiens
cauucagggauagcacuga

SEQ ID NO: 1386449 - RNA, 13 nt, Homo sapiens
cauucaguauuaa

SEQ ID NO: 1386450 - RNA, 16 nt, Homo sapiens
cauucaucucauucca

SEQ ID NO: 1386451 - RNA, 15 nt, Homo sapiens
cauuccaauuugcac

SEQ ID NO: 1386452 - RNA, 11 nt, Homo sapiens
cauucccugag

SEQ ID NO: 1386453 - RNA, 19 nt, Homo sapiens
cauucgcaauaaguaccaa

SEQ ID NO: 1386454 - RNA, 13 nt, Homo sapiens
cauucgucaucac

SEQ ID NO: 1386455 - RNA, 17 nt, Homo sapiens
cauucuaguacuuggga

SEQ ID NO: 1386456 - RNA, 14 nt, Homo sapiens
cauucugacaucuu

SEQ ID NO: 1386457 - RNA, 17 nt, Homo sapiens
cauucuggaaaagcaaa

SEQ ID NO: 1386458 - RNA, 20 nt, Homo sapiens
cauugaaagagaaccaguuu

SEQ ID NO: 1386459 - RNA, 22 nt, Homo sapiens
cauuguguucucuauugcugcu

SEQ ID NO: 1386460 - RNA, 12 nt, Homo sapiens
cauuguuuauug

SEQ ID NO: 1386461 - RNA, 13 nt, Homo sapiens
cauuuacauugcc

SEQ ID NO: 1386462 - RNA, 12 nt, Homo sapiens
cauuuacuuaac

SEQ ID NO: 1386463 - RNA, 22 nt, Homo sapiens
cauuuagaggacauucuggaaa

SEQ ID NO: 1386464 - RNA, 13 nt, Homo sapiens
cauuuagcacaaa

SEQ ID NO: 1386465 - RNA, 16 nt, Homo sapiens
cauuuagcacauacua

SEQ ID NO: 1386466 - RNA, 12 nt, Homo sapiens
cauuuauagaau

SEQ ID NO: 1386467 - RNA, 22 nt, Homo sapiens
cauuuaugucucagaccacuau

SEQ ID NO: 1386468 - RNA, 15 nt, Homo sapiens
cauuucaaaguuugg

SEQ ID NO: 1386469 - RNA, 17 nt, Homo sapiens
cauuucaggggucguca

SEQ ID NO: 1386470 - RNA, 16 nt, Homo sapiens
cauuuccaaauucaca

SEQ ID NO: 1386471 - RNA, 17 nt, Homo sapiens
cauuuccaaauucacaa

SEQ ID NO: 1386472 - RNA, 22 nt, Homo sapiens
cauuucucaaaugcacaucuca

SEQ ID NO: 1386473 - RNA, 16 nt, Homo sapiens
cauuucugagaucaaa

SEQ ID NO: 1386474 - RNA, 16 nt, Homo sapiens
cauuuguaccucgagu

SEQ ID NO: 1386475 - RNA, 14 nt, Homo sapiens
cauuugucaacaaa

SEQ ID NO: 1386476 - RNA, 13 nt, Homo sapiens
cauuuguuuucac

SEQ ID NO: 1386477 - RNA, 14 nt, Homo sapiens
cauuuuaacaugga

SEQ ID NO: 1386478 - RNA, 14 nt, Homo sapiens
cauuuuauuaucac

SEQ ID NO: 1386479 - RNA, 16 nt, Homo sapiens
cauuuuauucuuuaag

SEQ ID NO: 1386480 - RNA, 14 nt, Homo sapiens
cauuuucaccccac

SEQ ID NO: 1386481 - RNA, 19 nt, Homo sapiens
cauuuucugaaacuaauga

SEQ ID NO: 1386482 - RNA, 15 nt, Homo sapiens
cauuuucugcauuua

SEQ ID NO: 1386483 - RNA, 18 nt, Homo sapiens
cauuuugccacuggaaca

SEQ ID NO: 1386484 - RNA, 14 nt, Homo sapiens
cauuuugguuuaaa

SEQ ID NO: 1386485 - RNA, 17 nt, Homo sapiens
cauuuuuaaguauuuca

SEQ ID NO: 1386486 - RNA, 17 nt, Homo sapiens
cauuuuuauguuauuac

SEQ ID NO: 1386487 - RNA, 14 nt, Homo sapiens
cauuuuucugggag

SEQ ID NO: 1386488 - RNA, 22 nt, Homo sapiens
ccaaacccaugaggcaauguca

SEQ ID NO: 1386489 - RNA, 15 nt, Homo sapiens
ccaaacucugccagc

SEQ ID NO: 1386490 - RNA, 18 nt, Homo sapiens
ccaaaggauaaguguccc

SEQ ID NO: 1386491 - RNA, 13 nt, Homo sapiens
ccaaagugcugcg

SEQ ID NO: 1386492 - RNA, 19 nt, Homo sapiens
ccaaucccaccaacccuca

SEQ ID NO: 1386493 - RNA, 14 nt, Homo sapiens
ccaaugauggucac

SEQ ID NO: 1386494 - RNA, 22 nt, Homo sapiens
ccaauggcaacaucuugcaaaa

SEQ ID NO: 1386495 - RNA, 21 nt, Homo sapiens
ccaauguccagccucuuuaac

SEQ ID NO: 1386496 - RNA, 22 nt, Homo sapiens
ccaauuuaaagaaaacuguuaa

SEQ ID NO: 1386497 - RNA, 21 nt, Homo sapiens
ccacaaaugggaaaaccagac

SEQ ID NO: 1386498 - RNA, 17 nt, Homo sapiens
ccacaaccaaaaaauuc

SEQ ID NO: 1386499 - RNA, 18 nt, Homo sapiens
ccacaaccgaccagaugc

SEQ ID NO: 1386500 - RNA, 21 nt, Homo sapiens
ccacaacuauauuaucaugca

SEQ ID NO: 1386501 - RNA, 21 nt, Homo sapiens
ccacaauagcagacaguguuu

SEQ ID NO: 1386502 - RNA, 15 nt, Homo sapiens
ccacacagcagcagu

SEQ ID NO: 1386503 - RNA, 16 nt, Homo sapiens
ccacacucaccucuaa

SEQ ID NO: 1386504 - RNA, 15 nt, Homo sapiens
ccacacuguacucug

SEQ ID NO: 1386505 - RNA, 15 nt, Homo sapiens
ccacagaaauacaug

SEQ ID NO: 1386506 - RNA, 15 nt, Homo sapiens
ccacagacaagguag

SEQ ID NO: 1386507 - RNA, 12 nt, Homo sapiens
ccacagcacuau

SEQ ID NO: 1386508 - RNA, 18 nt, Homo sapiens
ccacagccgcagcuguaa

SEQ ID NO: 1386509 - RNA, 17 nt, Homo sapiens
ccacaggcagcauuuag

SEQ ID NO: 1386510 - RNA, 12 nt, Homo sapiens
ccacagucugac

SEQ ID NO: 1386511 - RNA, 21 nt, Homo sapiens
ccacaguggaaagacagcuuc

SEQ ID NO: 1386512 - RNA, 22 nt, Homo sapiens
ccacauagacuuuaugcaauaa

SEQ ID NO: 1386513 - RNA, 21 nt, Homo sapiens
ccacaucuugcucugcugaca

SEQ ID NO: 1386514 - RNA, 20 nt, Homo sapiens
ccaccaacagcccucagguc

SEQ ID NO: 1386515 - RNA, 13 nt, Homo sapiens
ccaccacugcucc

SEQ ID NO: 1386516 - RNA, 16 nt, Homo sapiens
ccaccagccugcacua

SEQ ID NO: 1386517 - RNA, 13 nt, Homo sapiens
ccaccccacacuu

SEQ ID NO: 1386518 - RNA, 18 nt, Homo sapiens
ccaccccacucacagaga

SEQ ID NO: 1386519 - RNA, 12 nt, Homo sapiens
ccacccuugugu

SEQ ID NO: 1386520 - RNA, 22 nt, Homo sapiens
ccaccuagagcuagaugugucu

SEQ ID NO: 1386521 - RNA, 17 nt, Homo sapiens
ccaccuccccagccuuu

SEQ ID NO: 1386522 - RNA, 17 nt, Homo sapiens
ccaccugagcuuuggac

SEQ ID NO: 1386523 - RNA, 12 nt, Homo sapiens
ccaccuucuuca

SEQ ID NO: 1386524 - RNA, 17 nt, Homo sapiens
ccaccuuggcucaaguc

SEQ ID NO: 1386525 - RNA, 15 nt, Homo sapiens
ccacgcccccagaaa

SEQ ID NO: 1386526 - RNA, 21 nt, Homo sapiens
ccacggcaggccccugcagga

SEQ ID NO: 1386527 - RNA, 15 nt, Homo sapiens
ccacggccaggccag

SEQ ID NO: 1386528 - RNA, 16 nt, Homo sapiens
ccacgucaacagaauu

SEQ ID NO: 1386529 - RNA, 19 nt, Homo sapiens
ccacgugggcaaacaggca

SEQ ID NO: 1386530 - RNA, 20 nt, Homo sapiens
ccacgugggcaaacaggcag

SEQ ID NO: 1386531 - RNA, 16 nt, Homo sapiens
ccacuaggacucugag

SEQ ID NO: 1386532 - RNA, 19 nt, Homo sapiens
ccacuauugcuugcacaaa

SEQ ID NO: 1386533 - RNA, 15 nt, Homo sapiens
ccacucugacuggca

SEQ ID NO: 1386534 - RNA, 20 nt, Homo sapiens
ccacucuguccugggaaaug

SEQ ID NO: 1386535 - RNA, 14 nt, Homo sapiens
ccacugccaaagaa

SEQ ID NO: 1386536 - RNA, 21 nt, Homo sapiens
ccacugccaaagaacuuggaa

SEQ ID NO: 1386537 - RNA, 19 nt, Homo sapiens
ccacuuaaaaaauguccau

SEQ ID NO: 1386538 - RNA, 12 nt, Homo sapiens
ccacuucugcca

SEQ ID NO: 1386539 - RNA, 21 nt, Homo sapiens
ccacuuuccccgugggccaug

SEQ ID NO: 1386540 - RNA, 17 nt, Homo sapiens
ccagaacaguuuguaca

SEQ ID NO: 1386541 - RNA, 21 nt, Homo sapiens
ccagaaccuggacauuggcca

SEQ ID NO: 1386542 - RNA, 16 nt, Homo sapiens
ccagaagaagcuuaag

SEQ ID NO: 1386543 - RNA, 22 nt, Homo sapiens
ccagaaggcagggaaaggcucu

SEQ ID NO: 1386544 - RNA, 13 nt, Homo sapiens
ccagaccuuuuau

SEQ ID NO: 1386545 - RNA, 19 nt, Homo sapiens
ccagagaggguggugaccu

SEQ ID NO: 1386546 - RNA, 20 nt, Homo sapiens
ccagagaggguggugaccuc

SEQ ID NO: 1386547 - RNA, 17 nt, Homo sapiens
ccagagcugggugagug

SEQ ID NO: 1386548 - RNA, 10 nt, Homo sapiens
ccagaggcac

SEQ ID NO: 1386549 - RNA, 23 nt, Homo sapiens
ccagaucagauucuucucuuaau

SEQ ID NO: 1386550 - RNA, 13 nt, Homo sapiens
ccagcaacuccaa

SEQ ID NO: 1386551 - RNA, 11 nt, Homo sapiens
ccagcacucug

SEQ ID NO: 1386552 - RNA, 19 nt, Homo sapiens
ccagcagaucccagcucac

SEQ ID NO: 1386553 - RNA, 22 nt, Homo sapiens
ccagccaccccgggcucucugc

SEQ ID NO: 1386554 - RNA, 16 nt, Homo sapiens
ccagcccacguucucu

SEQ ID NO: 1386555 - RNA, 16 nt, Homo sapiens
ccagccuccaugcugc

SEQ ID NO: 1386556 - RNA, 16 nt, Homo sapiens
ccagccucuuuaacau

SEQ ID NO: 1386557 - RNA, 20 nt, Homo sapiens
ccagccugggcagcauagca

SEQ ID NO: 1386558 - RNA, 20 nt, Homo sapiens
ccagccugggugacagagca

SEQ ID NO: 1386559 - RNA, 15 nt, Homo sapiens
ccagcuacucaggag

SEQ ID NO: 1386560 - RNA, 20 nt, Homo sapiens
ccagcuauugauauaaauaa

SEQ ID NO: 1386561 - RNA, 13 nt, Homo sapiens
ccagcugcagcug

SEQ ID NO: 1386562 - RNA, 20 nt, Homo sapiens
ccagcugccuuggacugugu

SEQ ID NO: 1386563 - RNA, 14 nt, Homo sapiens
ccagcuuaucucag

SEQ ID NO: 1386564 - RNA, 17 nt, Homo sapiens
ccaggaagccgugcccu

SEQ ID NO: 1386565 - RNA, 18 nt, Homo sapiens
ccaggcaggucuugaacu

SEQ ID NO: 1386566 - RNA, 23 nt, Homo sapiens
ccaggcaucugcuuuacucugga

SEQ ID NO: 1386567 - RNA, 22 nt, Homo sapiens
ccaggcccggggcuggcggcua

SEQ ID NO: 1386568 - RNA, 15 nt, Homo sapiens
ccaggccugccuguu

SEQ ID NO: 1386569 - RNA, 15 nt, Homo sapiens
ccaggcgaugugcaa

SEQ ID NO: 1386570 - RNA, 16 nt, Homo sapiens
ccaggcgaugugcaag

SEQ ID NO: 1386571 - RNA, 17 nt, Homo sapiens
ccaggcgugguggcaca

SEQ ID NO: 1386572 - RNA, 15 nt, Homo sapiens
ccagggagcaagaca

SEQ ID NO: 1386573 - RNA, 17 nt, Homo sapiens
ccaugaaaaugcaacaa

SEQ ID NO: 1386574 - RNA, 23 nt, Homo sapiens
ccaugaaaaugcaacaacaugua

SEQ ID NO: 1386575 - RNA, 22 nt, Homo sapiens
ccaugacaacuucuaauugcca

SEQ ID NO: 1386576 - RNA, 13 nt, Homo sapiens
ccaugcaaugccu

SEQ ID NO: 1386577 - RNA, 21 nt, Homo sapiens
ccauggacagaagaaggcagc

SEQ ID NO: 1386578 - RNA, 21 nt, Homo sapiens
ccaugugugagugugugcaag

SEQ ID NO: 1386579 - RNA, 20 nt, Homo sapiens
ccaugugugugcaagugugu

SEQ ID NO: 1386580 - RNA, 22 nt, Homo sapiens
ccauguuauuuauaguguugcu

SEQ ID NO: 1386581 - RNA, 17 nt, Homo sapiens
ccauguuggccaggcug

SEQ ID NO: 1386582 - RNA, 17 nt, Homo sapiens
ccauuccagacugcuuc

SEQ ID NO: 1386583 - RNA, 13 nt, Homo sapiens
ccauucugaccau

SEQ ID NO: 1386584 - RNA, 16 nt, Homo sapiens
ccauugagacuauuua

SEQ ID NO: 1386585 - RNA, 20 nt, Homo sapiens
ccauuugugugugugcaagu

SEQ ID NO: 1386586 - RNA, 22 nt, Homo sapiens
cccaaaacugauacccuuugaa

SEQ ID NO: 1386587 - RNA, 14 nt, Homo sapiens
cccaaaucugccua

SEQ ID NO: 1386588 - RNA, 10 nt, Homo sapiens
cccaacagca

SEQ ID NO: 1386589 - RNA, 18 nt, Homo sapiens
cccaacgaaaagcacauc

SEQ ID NO: 1386590 - RNA, 19 nt, Homo sapiens
cccaauggcaacaucuugc

SEQ ID NO: 1386591 - RNA, 19 nt, Homo sapiens
cccacauguguccauccca

SEQ ID NO: 1386592 - RNA, 15 nt, Homo sapiens
cccaccaucaugucu

SEQ ID NO: 1386593 - RNA, 14 nt, Homo sapiens
cccaccuaccuuca

SEQ ID NO: 1386594 - RNA, 22 nt, Homo sapiens
cccacucccuggcucucagaag

SEQ ID NO: 1386595 - RNA, 18 nt, Homo sapiens
cccacuuaccuugcaucu

SEQ ID NO: 1386596 - RNA, 21 nt, Homo sapiens
cccacuuaccuugcaucucac

SEQ ID NO: 1386597 - RNA, 15 nt, Homo sapiens
cccacuucugccaua

SEQ ID NO: 1386598 - RNA, 19 nt, Homo sapiens
cccagaacuggacucagga

SEQ ID NO: 1386599 - RNA, 15 nt, Homo sapiens
cccagauacuuccca

SEQ ID NO: 1386600 - RNA, 12 nt, Homo sapiens
cccagauugcaa

SEQ ID NO: 1386601 - RNA, 12 nt, Homo sapiens
cccagcacccag

SEQ ID NO: 1386602 - RNA, 23 nt, Homo sapiens
cccaggaggucgaccccaaagcc

SEQ ID NO: 1386603 - RNA, 16 nt, Homo sapiens
cccaggaguguggcca

SEQ ID NO: 1386604 - RNA, 19 nt, Homo sapiens
cccagggccuuaaaagcca

SEQ ID NO: 1386605 - RNA, 13 nt, Homo sapiens
cccagggcuaccc

SEQ ID NO: 1386606 - RNA, 18 nt, Homo sapiens
cccagguggcugacccag

SEQ ID NO: 1386607 - RNA, 23 nt, Homo sapiens
cccaguauucuagguagugcccu

SEQ ID NO: 1386608 - RNA, 15 nt, Homo sapiens
cccagugaucaccug

SEQ ID NO: 1386609 - RNA, 23 nt, Homo sapiens
cccaguuaaauuuucauuucaga

SEQ ID NO: 1386610 - RNA, 16 nt, Homo sapiens
cccaguuagcucucaa

SEQ ID NO: 1386611 - RNA, 17 nt, Homo sapiens
cccauaucugugaaaug

SEQ ID NO: 1386612 - RNA, 16 nt, Homo sapiens
cccaucagcuccagcu

SEQ ID NO: 1386613 - RNA, 14 nt, Homo sapiens
cccaucccauccca

SEQ ID NO: 1386614 - RNA, 16 nt, Homo sapiens
cccaucccaucccauc

SEQ ID NO: 1386615 - RNA, 14 nt, Homo sapiens
cccaucccgugcaa

SEQ ID NO: 1386616 - RNA, 14 nt, Homo sapiens
cccaugaagccaca

SEQ ID NO: 1386617 - RNA, 21 nt, Homo sapiens
cccauggcuuuagcuaccuca

SEQ ID NO: 1386618 - RNA, 16 nt, Homo sapiens
ccccaaaaaacaauua

SEQ ID NO: 1386619 - RNA, 15 nt, Homo sapiens
ccccaccaccugguu

SEQ ID NO: 1386620 - RNA, 16 nt, Homo sapiens
ccccagcccacaggug

SEQ ID NO: 1386621 - RNA, 22 nt, Homo sapiens
ccccagcucuggcuuccagaaa

SEQ ID NO: 1386622 - RNA, 13 nt, Homo sapiens
ccccagcuuugca

SEQ ID NO: 1386623 - RNA, 15 nt, Homo sapiens
ccccaugccugucca

SEQ ID NO: 1386624 - RNA, 18 nt, Homo sapiens
cccccacgugacagugcc

SEQ ID NO: 1386625 - RNA, 21 nt, Homo sapiens
cccccgugaggaugucacuca

SEQ ID NO: 1386626 - RNA, 15 nt, Homo sapiens
cccccugccagugcc

SEQ ID NO: 1386627 - RNA, 19 nt, Homo sapiens
cccccuguagacuagugcc

SEQ ID NO: 1386628 - RNA, 21 nt, Homo sapiens
ccccucagauuccaccuagag

SEQ ID NO: 1386629 - RNA, 20 nt, Homo sapiens
ccccucauuguuuauuaaca

SEQ ID NO: 1386630 - RNA, 22 nt, Homo sapiens
ccccucugcuggccgggcacag

SEQ ID NO: 1386631 - RNA, 17 nt, Homo sapiens
ccccugcccugggaugu

SEQ ID NO: 1386632 - RNA, 18 nt, Homo sapiens
ccccuggaucuaccagca

SEQ ID NO: 1386633 - RNA, 19 nt, Homo sapiens
ccccuggaucuaccagcau

SEQ ID NO: 1386634 - RNA, 19 nt, Homo sapiens
ccccuucauuuggcauucc

SEQ ID NO: 1386635 - RNA, 18 nt, Homo sapiens
ccccuugccagacaugug

SEQ ID NO: 1386636 - RNA, 21 nt, Homo sapiens
ccccuuucgcccacagucuga

SEQ ID NO: 1386637 - RNA, 13 nt, Homo sapiens
cccgacagccugg

SEQ ID NO: 1386638 - RNA, 19 nt, Homo sapiens
cccgagcugggggccauga

SEQ ID NO: 1386639 - RNA, 18 nt, Homo sapiens
cccggcucaagugauccu

SEQ ID NO: 1386640 - RNA, 14 nt, Homo sapiens
cccuaagauugaaa

SEQ ID NO: 1386641 - RNA, 13 nt, Homo sapiens
cccuaccuugaaa

SEQ ID NO: 1386642 - RNA, 23 nt, Homo sapiens
cccuacuuccagguucugguuag

SEQ ID NO: 1386643 - RNA, 20 nt, Homo sapiens
cccucaaaaugacagccaug

SEQ ID NO: 1386644 - RNA, 23 nt, Homo sapiens
cccucaacaccucugcacaagcu

SEQ ID NO: 1386645 - RNA, 19 nt, Homo sapiens
cccucaacugugucugaug

SEQ ID NO: 1386646 - RNA, 13 nt, Homo sapiens
cccucagauucca

SEQ ID NO: 1386647 - RNA, 15 nt, Homo sapiens
cccucagauuccacc

SEQ ID NO: 1386648 - RNA, 15 nt, Homo sapiens
cccucaguuucccua

SEQ ID NO: 1386649 - RNA, 15 nt, Homo sapiens
cccuccccugccauu

SEQ ID NO: 1386650 - RNA, 15 nt, Homo sapiens
cccuccguggcauca

SEQ ID NO: 1386651 - RNA, 18 nt, Homo sapiens
cccuccguggcaucaccu

SEQ ID NO: 1386652 - RNA, 14 nt, Homo sapiens
cccucucacugugu

SEQ ID NO: 1386653 - RNA, 22 nt, Homo sapiens
cccugaaguaagcaaagacuuu

SEQ ID NO: 1386654 - RNA, 21 nt, Homo sapiens
gaaagacauagccaacugcug

SEQ ID NO: 1386655 - RNA, 18 nt, Homo sapiens
gaaagaguccuauuugca

SEQ ID NO: 1386656 - RNA, 23 nt, Homo sapiens
gaaagcaucauuauuugcagaga

SEQ ID NO: 1386657 - RNA, 19 nt, Homo sapiens
gaaagcugauuacugucaa

SEQ ID NO: 1386658 - RNA, 14 nt, Homo sapiens
gaaaggagacuaga

SEQ ID NO: 1386659 - RNA, 23 nt, Homo sapiens
gaaagggagcagagaaggccagg

SEQ ID NO: 1386660 - RNA, 22 nt, Homo sapiens
gaaaguaaauauuucaggcaua

SEQ ID NO: 1386661 - RNA, 15 nt, Homo sapiens
gaaaguuugcacugu

SEQ ID NO: 1386662 - RNA, 23 nt, Homo sapiens
gaaauacacagugcugaccagac

SEQ ID NO: 1386663 - RNA, 22 nt, Homo sapiens
gaaauagugauuuccacaguga

SEQ ID NO: 1386664 - RNA, 14 nt, Homo sapiens
gaaauauagccaaa

SEQ ID NO: 1386665 - RNA, 22 nt, Homo sapiens
gaaauauauauguguguguaug

SEQ ID NO: 1386666 - RNA, 20 nt, Homo sapiens
gaaauaugugguuuccacga

SEQ ID NO: 1386667 - RNA, 17 nt, Homo sapiens
gaaaucaaaaagggaau

SEQ ID NO: 1386668 - RNA, 12 nt, Homo sapiens
gaaaucaagggc

SEQ ID NO: 1386669 - RNA, 19 nt, Homo sapiens
gaaaucuaugaaauaucau

SEQ ID NO: 1386670 - RNA, 16 nt, Homo sapiens
gaaaucucuagcucag

SEQ ID NO: 1386671 - RNA, 22 nt, Homo sapiens
gaaaugcaaauucucaagccgc

SEQ ID NO: 1386672 - RNA, 21 nt, Homo sapiens
gaaaugcccaucuaugucccu

SEQ ID NO: 1386673 - RNA, 11 nt, Homo sapiens
gaaauuacuuc

SEQ ID NO: 1386674 - RNA, 21 nt, Homo sapiens
gaaauuuuaaugaagugcaau

SEQ ID NO: 1386675 - RNA, 22 nt, Homo sapiens
gaacacguuuuuucacuauuaa

SEQ ID NO: 1386676 - RNA, 18 nt, Homo sapiens
gaacacucugaauuccaa

SEQ ID NO: 1386677 - RNA, 12 nt, Homo sapiens
gaacacuggggg

SEQ ID NO: 1386678 - RNA, 12 nt, Homo sapiens
gaacacuugaag

SEQ ID NO: 1386679 - RNA, 19 nt, Homo sapiens
gaaugcaaaguagcaauuu

SEQ ID NO: 1386680 - RNA, 14 nt, Homo sapiens
gaaugcggcaagaa

SEQ ID NO: 1386681 - RNA, 12 nt, Homo sapiens
gaaugcggccca

SEQ ID NO: 1386682 - RNA, 21 nt, Homo sapiens
gaaugcucuuuacuucaugga

SEQ ID NO: 1386683 - RNA, 14 nt, Homo sapiens
gaauguacucuguu

SEQ ID NO: 1386684 - RNA, 20 nt, Homo sapiens
gaauguauugaacuuggaaa

SEQ ID NO: 1386685 - RNA, 21 nt, Homo sapiens
gaaugugcucaugcauugcuu

SEQ ID NO: 1386686 - RNA, 21 nt, Homo sapiens
gaaugugucugcguuccuguu

SEQ ID NO: 1386687 - RNA, 17 nt, Homo sapiens
gaauguuuacacucuuu

SEQ ID NO: 1386688 - RNA, 14 nt, Homo sapiens
gaauguuugccucu

SEQ ID NO: 1386689 - RNA, 19 nt, Homo sapiens
gaauuaaccuggugcugga

SEQ ID NO: 1386690 - RNA, 13 nt, Homo sapiens
gaauuaagcacag

SEQ ID NO: 1386691 - RNA, 22 nt, Homo sapiens
gaauuacuaaauuacaaaugca

SEQ ID NO: 1386692 - RNA, 15 nt, Homo sapiens
gaauuauaaaggcca

SEQ ID NO: 1386693 - RNA, 15 nt, Homo sapiens
gaauuuaaaaucaua

SEQ ID NO: 1386694 - RNA, 15 nt, Homo sapiens
gaauuuaaggcccaa

SEQ ID NO: 1386695 - RNA, 13 nt, Homo sapiens
gaauuucccacau

SEQ ID NO: 1386696 - RNA, 19 nt, Homo sapiens
gaauuuucucuaacuucaa

SEQ ID NO: 1386697 - RNA, 21 nt, Homo sapiens
gaauuuuuauauccacuaaaa

SEQ ID NO: 1386698 - RNA, 21 nt, Homo sapiens
gacaaaaagcacuaguauaaa

SEQ ID NO: 1386699 - RNA, 21 nt, Homo sapiens
gacaaagguuuuccucuucua

SEQ ID NO: 1386700 - RNA, 16 nt, Homo sapiens
gacaaagugagacucc

SEQ ID NO: 1386701 - RNA, 17 nt, Homo sapiens
gacaaagugagacuccg

SEQ ID NO: 1386702 - RNA, 18 nt, Homo sapiens
gacaaaucaaguuuccaa

SEQ ID NO: 1386703 - RNA, 12 nt, Homo sapiens
gacaacauuucu

SEQ ID NO: 1386704 - RNA, 22 nt, Homo sapiens
gagacuggaaaaauccugagca

SEQ ID NO: 1386705 - RNA, 17 nt, Homo sapiens
gagacuguagauugcuu

SEQ ID NO: 1386706 - RNA, 22 nt, Homo sapiens
gagacuugaggagggagggcuu

SEQ ID NO: 1386707 - RNA, 17 nt, Homo sapiens
gagagccuggugcugcu

SEQ ID NO: 1386708 - RNA, 16 nt, Homo sapiens
gagagcgccugccccu

SEQ ID NO: 1386709 - RNA, 21 nt, Homo sapiens
gagaggagggaugcugccuga

SEQ ID NO: 1386710 - RNA, 18 nt, Homo sapiens
gagaggccuuuuggaaug

SEQ ID NO: 1386711 - RNA, 12 nt, Homo sapiens
gagagggggcca

SEQ ID NO: 1386712 - RNA, 22 nt, Homo sapiens
gagagucgcaucucagugcagg

SEQ ID NO: 1386713 - RNA, 19 nt, Homo sapiens
gagagugucuucacggcag

SEQ ID NO: 1386714 - RNA, 14 nt, Homo sapiens
gagaguuucuguua

SEQ ID NO: 1386715 - RNA, 18 nt, Homo sapiens
gagauaauucuagcuuug

SEQ ID NO: 1386716 - RNA, 14 nt, Homo sapiens
gagauagaaccugg

SEQ ID NO: 1386717 - RNA, 20 nt, Homo sapiens
gagaucauugcaaacucaac

SEQ ID NO: 1386718 - RNA, 21 nt, Homo sapiens
gagaucccacccgaacgucuu

SEQ ID NO: 1386719 - RNA, 20 nt, Homo sapiens
gagaucgcgccacugcacuc

SEQ ID NO: 1386720 - RNA, 21 nt, Homo sapiens
gagaugcaggauuucuucaca

SEQ ID NO: 1386721 - RNA, 23 nt, Homo sapiens
gagaugggcuuguuuucuugcca

SEQ ID NO: 1386722 - RNA, 13 nt, Homo sapiens
gagauggggagaa

SEQ ID NO: 1386723 - RNA, 15 nt, Homo sapiens
gagauuccugagcca

SEQ ID NO: 1386724 - RNA, 21 nt, Homo sapiens
gagauugcaccauugcgcucu

SEQ ID NO: 1386725 - RNA, 17 nt, Homo sapiens
gagauugugccacuuca

SEQ ID NO: 1386726 - RNA, 20 nt, Homo sapiens
gagauugugccacuucacuc

SEQ ID NO: 1386727 - RNA, 15 nt, Homo sapiens
gagcaacagaggaca

SEQ ID NO: 1386728 - RNA, 15 nt, Homo sapiens
gcagaaaaacucugg

SEQ ID NO: 1386729 - RNA, 13 nt, Homo sapiens
gcagaacuuucac

SEQ ID NO: 1386730 - RNA, 21 nt, Homo sapiens
gcagaagaauugaacccagga

SEQ ID NO: 1386731 - RNA, 17 nt, Homo sapiens
gcagaagagaaaagcug

SEQ ID NO: 1386732 - RNA, 17 nt, Homo sapiens
gcagacaggccauguga

SEQ ID NO: 1386733 - RNA, 13 nt, Homo sapiens
gcagacuaugaau

SEQ ID NO: 1386734 - RNA, 13 nt, Homo sapiens
gcagacugucccu

SEQ ID NO: 1386735 - RNA, 21 nt, Homo sapiens
gcagaguacaaaguaagccau

SEQ ID NO: 1386736 - RNA, 19 nt, Homo sapiens
gcagauccuuugucuacag

SEQ ID NO: 1386737 - RNA, 19 nt, Homo sapiens
gcagcaaccagagcacugu

SEQ ID NO: 1386738 - RNA, 22 nt, Homo sapiens
gcagcagggagggcuucugcca

SEQ ID NO: 1386739 - RNA, 18 nt, Homo sapiens
gcagcauagcaagacaca

SEQ ID NO: 1386740 - RNA, 23 nt, Homo sapiens
gcagccugccuggaguacuuuga

SEQ ID NO: 1386741 - RNA, 18 nt, Homo sapiens
gcagccuggggucugaca

SEQ ID NO: 1386742 - RNA, 19 nt, Homo sapiens
gcagccuggggucugacaa

SEQ ID NO: 1386743 - RNA, 22 nt, Homo sapiens
gcagcgauuaauaacaggcaaa

SEQ ID NO: 1386744 - RNA, 19 nt, Homo sapiens
gcagcuaucucucagugaa

SEQ ID NO: 1386745 - RNA, 19 nt, Homo sapiens
gcagcugagaaaaugagug

SEQ ID NO: 1386746 - RNA, 15 nt, Homo sapiens
gcaggaagcucagac

SEQ ID NO: 1386747 - RNA, 19 nt, Homo sapiens
gcaggaagcucagacuggu

SEQ ID NO: 1386748 - RNA, 18 nt, Homo sapiens
gcaggacuaaaugucuag

SEQ ID NO: 1386749 - RNA, 17 nt, Homo sapiens
gcaggagaauggcguga

SEQ ID NO: 1386750 - RNA, 17 nt, Homo sapiens
gcaggaggauugcuuga

SEQ ID NO: 1386751 - RNA, 23 nt, Homo sapiens
gcaggcaugagucagucugauga

SEQ ID NO: 1386752 - RNA, 16 nt, Homo sapiens
gucugcuagccaggau

SEQ ID NO: 1386753 - RNA, 14 nt, Homo sapiens
gucugcuucugcac

SEQ ID NO: 1386754 - RNA, 16 nt, Homo sapiens
gucugcuuugguacua

SEQ ID NO: 1386755 - RNA, 18 nt, Homo sapiens
gucugcuuugguacuaau

SEQ ID NO: 1386756 - RNA, 19 nt, Homo sapiens
gucuggcugaggauuucaa

SEQ ID NO: 1386757 - RNA, 13 nt, Homo sapiens
gucuguuaacuua

SEQ ID NO: 1386758 - RNA, 17 nt, Homo sapiens
gucuucagggaagguca

SEQ ID NO: 1386759 - RNA, 14 nt, Homo sapiens
gucuucccuaccuc

SEQ ID NO: 1386760 - RNA, 12 nt, Homo sapiens
gucuucucaggc

SEQ ID NO: 1386761 - RNA, 16 nt, Homo sapiens
gucuucuuuugauaua

SEQ ID NO: 1386762 - RNA, 13 nt, Homo sapiens
gucuuucugacau

SEQ ID NO: 1386763 - RNA, 23 nt, Homo sapiens
gucuuugaagugacuucacagag

SEQ ID NO: 1386764 - RNA, 20 nt, Homo sapiens
gucuuuguuaagacugcuga

SEQ ID NO: 1386765 - RNA, 14 nt, Homo sapiens
gucuuuguucuucu

SEQ ID NO: 1386766 - RNA, 19 nt, Homo sapiens
gugaaagaaaauucuugga

SEQ ID NO: 1386767 - RNA, 20 nt, Homo sapiens
gugaaagcaucacuugggau

SEQ ID NO: 1386768 - RNA, 20 nt, Homo sapiens
gugaaaugcuggcauuugca

SEQ ID NO: 1386769 - RNA, 16 nt, Homo sapiens
gugaaauuacuucugg

SEQ ID NO: 1386770 - RNA, 17 nt, Homo sapiens
gugaagaaaaauguauu

SEQ ID NO: 1386771 - RNA, 20 nt, Homo sapiens
gugaagagggagaagcauga

SEQ ID NO: 1386772 - RNA, 23 nt, Homo sapiens
gugaauuuuucucuaacucagaa

SEQ ID NO: 1386773 - RNA, 19 nt, Homo sapiens
gugacaaggccccagagac

SEQ ID NO: 1386774 - RNA, 16 nt, Homo sapiens
gugacaucaguggcau

SEQ ID NO: 1386775 - RNA, 16 nt, Homo sapiens
gugaccccugaccuca

SEQ ID NO: 1386776 - RNA, 20 nt, Homo sapiens
gugacucgagucacacucaa

SEQ ID NO: 1386777 - RNA, 14 nt, Homo sapiens
guucaguaccacau

SEQ ID NO: 1386778 - RNA, 19 nt, Homo sapiens
guucauauuggacugauaa

SEQ ID NO: 1386779 - RNA, 21 nt, Homo sapiens
guucaucagacuccugugcaa

SEQ ID NO: 1386780 - RNA, 14 nt, Homo sapiens
guuccccacugaca

SEQ ID NO: 1386781 - RNA, 18 nt, Homo sapiens
guucccggguagccacug

SEQ ID NO: 1386782 - RNA, 16 nt, Homo sapiens
guucccuauuuugcca

SEQ ID NO: 1386783 - RNA, 13 nt, Homo sapiens
guucgaagcuccg

SEQ ID NO: 1386784 - RNA, 16 nt, Homo sapiens
guucgagaccaaccug

SEQ ID NO: 1386785 - RNA, 20 nt, Homo sapiens
guucgagaccagccuggcca

SEQ ID NO: 1386786 - RNA, 16 nt, Homo sapiens
guucucacagugggag

SEQ ID NO: 1386787 - RNA, 21 nt, Homo sapiens
guucucacagugggagccagg

SEQ ID NO: 1386788 - RNA, 22 nt, Homo sapiens
guucucuauugcugcucucuca

SEQ ID NO: 1386789 - RNA, 15 nt, Homo sapiens
guucugaaagugacu

SEQ ID NO: 1386790 - RNA, 23 nt, Homo sapiens
guucugacauuaacaguuuucca

SEQ ID NO: 1386791 - RNA, 14 nt, Homo sapiens
guucugaguguuuu

SEQ ID NO: 1386792 - RNA, 13 nt, Homo sapiens
guucuuaguguca

SEQ ID NO: 1386793 - RNA, 23 nt, Homo sapiens
guucuucccuuuuacauacugcu

SEQ ID NO: 1386794 - RNA, 13 nt, Homo sapiens
guucuucuaccac

SEQ ID NO: 1386795 - RNA, 12 nt, Homo sapiens
guugaaaagcca

SEQ ID NO: 1386796 - RNA, 16 nt, Homo sapiens
guugaauaaugcuguu

SEQ ID NO: 1386797 - RNA, 22 nt, Homo sapiens
guugagcuucauauaccagcaa

SEQ ID NO: 1386798 - RNA, 14 nt, Homo sapiens
guugcccagugugu

SEQ ID NO: 1386799 - RNA, 15 nt, Homo sapiens
guugcuuucuuaucc

SEQ ID NO: 1386800 - RNA, 13 nt, Homo sapiens
guuggaacauccu

SEQ ID NO: 1386801 - RNA, 18 nt, Homo sapiens
guuggccugcacuggugu

SEQ ID NO: 1386802 - RNA, 22 nt, Homo sapiens
guuggcgggggcuuggcugugc

SEQ ID NO: 1386803 - RNA, 23 nt, Homo sapiens
guuggugcugcuuucuuguugcu

SEQ ID NO: 1386804 - RNA, 21 nt, Homo sapiens
guugucugaagucacugcaca

SEQ ID NO: 1386805 - RNA, 10 nt, Homo sapiens
guuguggaaa

SEQ ID NO: 1386806 - RNA, 24 nt, Homo sapiens
guuguuuucagacucagacuccau

SEQ ID NO: 1386807 - RNA, 17 nt, Homo sapiens
guuguuuucccaaagag

SEQ ID NO: 1386808 - RNA, 22 nt, Homo sapiens
guuuaaaagccaucaaacacaa

SEQ ID NO: 1386809 - RNA, 20 nt, Homo sapiens
guuuaaacauaggaaagaag

SEQ ID NO: 1386810 - RNA, 18 nt, Homo sapiens
guuuagcccaaaaccaag

SEQ ID NO: 1386811 - RNA, 14 nt, Homo sapiens
guuuagugaucuga

SEQ ID NO: 1386812 - RNA, 19 nt, Homo sapiens
guuuauacccguuucacau

SEQ ID NO: 1386813 - RNA, 19 nt, Homo sapiens
guuuauuguauacugccuu

SEQ ID NO: 1386814 - RNA, 21 nt, Homo sapiens
guuuauuuccuagacuguuau

SEQ ID NO: 1386815 - RNA, 19 nt, Homo sapiens
guuucaaaauaaaaaccaa

SEQ ID NO: 1386816 - RNA, 21 nt, Homo sapiens
guuucaacaaaauaaugcacu

SEQ ID NO: 1386817 - RNA, 20 nt, Homo sapiens
guuucaccaucagucaauga

SEQ ID NO: 1386818 - RNA, 23 nt, Homo sapiens
guuucagaguuuguauugugauu

SEQ ID NO: 1386819 - RNA, 20 nt, Homo sapiens
guuucauggguuauguguau

SEQ ID NO: 1386820 - RNA, 17 nt, Homo sapiens
guuuccaaugaugggau

SEQ ID NO: 1386821 - RNA, 17 nt, Homo sapiens
guuucccguauugacag

SEQ ID NO: 1386822 - RNA, 15 nt, Homo sapiens
guuucccuaucucga

SEQ ID NO: 1386823 - RNA, 16 nt, Homo sapiens
guuuccucauuccuga

SEQ ID NO: 1386824 - RNA, 20 nt, Homo sapiens
guuucuauucuaaguaauuc

SEQ ID NO: 1386825 - RNA, 21 nt, Homo sapiens
guuucucuugaagaacugacu

SEQ ID NO: 1386826 - RNA, 23 nt, Homo sapiens
guuucucuuggguauaaaggcua

SEQ ID NO: 1386827 - RNA, 20 nt, Homo sapiens
guuucugaucugaugcaagc

SEQ ID NO: 1386828 - RNA, 16 nt, Homo sapiens
guuucuggaauugaua

SEQ ID NO: 1386829 - RNA, 17 nt, Homo sapiens
guuucuguuucuauucu

SEQ ID NO: 1386830 - RNA, 20 nt, Homo sapiens
guuugaaaaagcagacagaa

SEQ ID NO: 1386831 - RNA, 17 nt, Homo sapiens
guuugaaucacaguaua

SEQ ID NO: 1386832 - RNA, 18 nt, Homo sapiens
guuugcucagcuucucca

SEQ ID NO: 1386833 - RNA, 14 nt, Homo sapiens
guuuggcgggccaa

SEQ ID NO: 1386834 - RNA, 15 nt, Homo sapiens
guuugguuucuagca

SEQ ID NO: 1386835 - RNA, 17 nt, Homo sapiens
guuugugagaaacaucu

SEQ ID NO: 1386836 - RNA, 14 nt, Homo sapiens
guuuguggccucag

SEQ ID NO: 1386837 - RNA, 22 nt, Homo sapiens
guuuguugaugugaaacauuau

SEQ ID NO: 1386838 - RNA, 17 nt, Homo sapiens
guuuuaacaguucacuu

SEQ ID NO: 1386839 - RNA, 21 nt, Homo sapiens
guuuuacuguccaaagacaug

SEQ ID NO: 1386840 - RNA, 18 nt, Homo sapiens
guuuuagcacccccaugg

SEQ ID NO: 1386841 - RNA, 21 nt, Homo sapiens
guuuuagcggucaauuugccu

SEQ ID NO: 1386842 - RNA, 22 nt, Homo sapiens
guuuuaugagaaaugccagugu

SEQ ID NO: 1386843 - RNA, 17 nt, Homo sapiens
guuuuccuaaaugcagu

SEQ ID NO: 1386844 - RNA, 16 nt, Homo sapiens
guuuugacaucaauga

SEQ ID NO: 1386845 - RNA, 16 nt, Homo sapiens
guuuugucaaacugua

SEQ ID NO: 1386846 - RNA, 18 nt, Homo sapiens
guuuuuccacuacugcua

SEQ ID NO: 1386847 - RNA, 19 nt, Homo sapiens
guuuuuccacuacugcuac

SEQ ID NO: 1386848 - RNA, 23 nt, Homo sapiens
guuuuuuuuuuccacuuagaaau

SEQ ID NO: 1386849 - RNA, 13 nt, Homo sapiens
uaaaaacaaacag

SEQ ID NO: 1386850 - RNA, 23 nt, Homo sapiens
uaaaaagucugcauuacauuccu

SEQ ID NO: 1386851 - RNA, 15 nt, Homo sapiens
uaaaaauacaaaaau

SEQ ID NO: 1386852 - RNA, 19 nt, Homo sapiens
uaaaaaucaugagauccuu

SEQ ID NO: 1386853 - RNA, 19 nt, Homo sapiens
uaaaaauggccauuugcuu

SEQ ID NO: 1386854 - RNA, 22 nt, Homo sapiens
uaaaacagguggagaaauuccu

SEQ ID NO: 1386855 - RNA, 16 nt, Homo sapiens
uaaaacaucuuuccag

SEQ ID NO: 1386856 - RNA, 17 nt, Homo sapiens
uaaaacaugcuggugaa

SEQ ID NO: 1386857 - RNA, 20 nt, Homo sapiens
uaaaacaugcuggugaacca

SEQ ID NO: 1386858 - RNA, 18 nt, Homo sapiens
uaaaacauuaugaguuuc

SEQ ID NO: 1386859 - RNA, 20 nt, Homo sapiens
uaaaacccacaaaaguacaa

SEQ ID NO: 1386860 - RNA, 15 nt, Homo sapiens
uaaaaccccaucucu

SEQ ID NO: 1386861 - RNA, 16 nt, Homo sapiens
uaaaacuauauucuca

SEQ ID NO: 1386862 - RNA, 17 nt, Homo sapiens
uaaaacuauauucucag

SEQ ID NO: 1386863 - RNA, 17 nt, Homo sapiens
uaaaacuucaucuuccc

SEQ ID NO: 1386864 - RNA, 13 nt, Homo sapiens
uaaaagaaaugca

SEQ ID NO: 1386865 - RNA, 19 nt, Homo sapiens
uaaaagaaccgagcaauuu

SEQ ID NO: 1386866 - RNA, 18 nt, Homo sapiens
uaaugaauuuuuaugaua

SEQ ID NO: 1386867 - RNA, 13 nt, Homo sapiens
uaaugcaccugaa

SEQ ID NO: 1386868 - RNA, 16 nt, Homo sapiens
uaaugcccagacauuu

SEQ ID NO: 1386869 - RNA, 16 nt, Homo sapiens
uaaugcucgucugugu

SEQ ID NO: 1386870 - RNA, 17 nt, Homo sapiens
uaaugcuguugccucau

SEQ ID NO: 1386871 - RNA, 16 nt, Homo sapiens
uaaugguugacugggu

SEQ ID NO: 1386872 - RNA, 21 nt, Homo sapiens
uaauguauuuguuugcaauuu

SEQ ID NO: 1386873 - RNA, 20 nt, Homo sapiens
uaauguggcagcugucucaa

SEQ ID NO: 1386874 - RNA, 13 nt, Homo sapiens
uaauguuacauua

SEQ ID NO: 1386875 - RNA, 22 nt, Homo sapiens
uaauguuacugaucaugcauug

SEQ ID NO: 1386876 - RNA, 20 nt, Homo sapiens
uaauguuguaauucaugcca

SEQ ID NO: 1386877 - RNA, 18 nt, Homo sapiens
uaauguuuaauauugaga

SEQ ID NO: 1386878 - RNA, 19 nt, Homo sapiens
uaauguuuuauacuguuua

SEQ ID NO: 1386879 - RNA, 13 nt, Homo sapiens
uaauuagcugugc

SEQ ID NO: 1386880 - RNA, 20 nt, Homo sapiens
uaauuaggcaaagacaggag

SEQ ID NO: 1386881 - RNA, 17 nt, Homo sapiens
uaauuagggguugcuaa

SEQ ID NO: 1386882 - RNA, 17 nt, Homo sapiens
uaauucuaaucuaacaa

SEQ ID NO: 1386883 - RNA, 16 nt, Homo sapiens
uaauucuagcuuugag

SEQ ID NO: 1386884 - RNA, 14 nt, Homo sapiens
uaauucugcaucug

SEQ ID NO: 1386885 - RNA, 15 nt, Homo sapiens
uaauugaacuaacaa

SEQ ID NO: 1386886 - RNA, 15 nt, Homo sapiens
uaauugagaagcgua

SEQ ID NO: 1386887 - RNA, 13 nt, Homo sapiens
uaauugauuucaa

SEQ ID NO: 1386888 - RNA, 12 nt, Homo sapiens
uaauugccaugu

SEQ ID NO: 1386889 - RNA, 15 nt, Homo sapiens
uaauuuaaucuucca

SEQ ID NO: 1386890 - RNA, 17 nt, Homo sapiens
uaauuuccucugacaug

SEQ ID NO: 1386891 - RNA, 20 nt, Homo sapiens
uaauuucuucucaaagggua

SEQ ID NO: 1386892 - RNA, 21 nt, Homo sapiens
uaauuugauaguauugugcau

SEQ ID NO: 1386893 - RNA, 18 nt, Homo sapiens
uacaaaagauguauccuu

SEQ ID NO: 1386894 - RNA, 16 nt, Homo sapiens
uacaaaguaagccaug

SEQ ID NO: 1386895 - RNA, 19 nt, Homo sapiens
uacaaaguaagccauguau

SEQ ID NO: 1386896 - RNA, 20 nt, Homo sapiens
uacaaccugugaucaagcaa

SEQ ID NO: 1386897 - RNA, 16 nt, Homo sapiens
uacaacuuccacucca

SEQ ID NO: 1386898 - RNA, 23 nt, Homo sapiens
uacaacuuuuuaccuaguacaag

SEQ ID NO: 1386899 - RNA, 22 nt, Homo sapiens
uacaagaaaaaaugaauuuugu

SEQ ID NO: 1386900 - RNA, 14 nt, Homo sapiens
uacaagaaagcaau

SEQ ID NO: 1386901 - RNA, 11 nt, Homo sapiens
uacaagggaag

SEQ ID NO: 1386902 - RNA, 21 nt, Homo sapiens
uacaauaaaacuuugcugcca

SEQ ID NO: 1386903 - RNA, 11 nt, Homo sapiens
uacaauuguga

SEQ ID NO: 1386904 - RNA, 13 nt, Homo sapiens
uacacacacaaag

SEQ ID NO: 1386905 - RNA, 18 nt, Homo sapiens
uacacacuuuuuaagaaa

SEQ ID NO: 1386906 - RNA, 15 nt, Homo sapiens
uacacagaucacagc

SEQ ID NO: 1386907 - RNA, 18 nt, Homo sapiens
uacaccauuaucuuggaa

SEQ ID NO: 1386908 - RNA, 15 nt, Homo sapiens
uacacccccaccucc

SEQ ID NO: 1386909 - RNA, 13 nt, Homo sapiens
uacacgugacaga

SEQ ID NO: 1386910 - RNA, 15 nt, Homo sapiens
uacacuguauuacau

SEQ ID NO: 1386911 - RNA, 15 nt, Homo sapiens
uacagacguaugcuu

SEQ ID NO: 1386912 - RNA, 14 nt, Homo sapiens
uacagcaaauuuau

SEQ ID NO: 1386913 - RNA, 14 nt, Homo sapiens
uacagccaaagaua

SEQ ID NO: 1386914 - RNA, 17 nt, Homo sapiens
uacaggaagcaccccau

SEQ ID NO: 1386915 - RNA, 15 nt, Homo sapiens
uacaggagugagcac

SEQ ID NO: 1386916 - RNA, 20 nt, Homo sapiens
uacaggcauagaguucagac

SEQ ID NO: 1386917 - RNA, 19 nt, Homo sapiens
uacaggccauacuuuacaa

SEQ ID NO: 1386918 - RNA, 18 nt, Homo sapiens
uacagggcauucaaaugg

SEQ ID NO: 1386919 - RNA, 22 nt, Homo sapiens
uacagugaugcugugcuaugaa

SEQ ID NO: 1386920 - RNA, 16 nt, Homo sapiens
uacaguguauguacua

SEQ ID NO: 1386921 - RNA, 12 nt, Homo sapiens
uacaguguuauu

SEQ ID NO: 1386922 - RNA, 20 nt, Homo sapiens
uacaguugggaaaauauguc

SEQ ID NO: 1386923 - RNA, 20 nt, Homo sapiens
uacauacaggccauacuuua

SEQ ID NO: 1386924 - RNA, 23 nt, Homo sapiens
uacauacaggccauacuuuacaa

SEQ ID NO: 1386925 - RNA, 16 nt, Homo sapiens
uacauauuugcauaug

SEQ ID NO: 1386926 - RNA, 20 nt, Homo sapiens
uacauggaauaacauguaau

SEQ ID NO: 1386927 - RNA, 23 nt, Homo sapiens
uacaugucuuucuccagggacau

SEQ ID NO: 1386928 - RNA, 18 nt, Homo sapiens
uacauugcuggucuugua

SEQ ID NO: 1386929 - RNA, 18 nt, Homo sapiens
uacauuuccaaauucaca

SEQ ID NO: 1386930 - RNA, 19 nt, Homo sapiens
uacauuuccaaauucacaa

SEQ ID NO: 1386931 - RNA, 13 nt, Homo sapiens
uaccaaucauuuu

SEQ ID NO: 1386932 - RNA, 16 nt, Homo sapiens
uaccacaaacacauua

SEQ ID NO: 1386933 - RNA, 21 nt, Homo sapiens
uaccacaaggaaaauaguuua

SEQ ID NO: 1386934 - RNA, 19 nt, Homo sapiens
uaccacugauuuggagaua

SEQ ID NO: 1386935 - RNA, 22 nt, Homo sapiens
uaccaggccgccccagccucug

SEQ ID NO: 1386936 - RNA, 14 nt, Homo sapiens
uaccaugccucucc

SEQ ID NO: 1386937 - RNA, 15 nt, Homo sapiens
uaccauuuauuugcu

SEQ ID NO: 1386938 - RNA, 12 nt, Homo sapiens
uacccaccugag

SEQ ID NO: 1386939 - RNA, 15 nt, Homo sapiens
uacccaccugagcuu

SEQ ID NO: 1386940 - RNA, 18 nt, Homo sapiens
uacccaccugagcuuugg

SEQ ID NO: 1386941 - RNA, 19 nt, Homo sapiens
uacccaccugagcuuugga

SEQ ID NO: 1386942 - RNA, 18 nt, Homo sapiens
uaccgaaaaucauauaau

SEQ ID NO: 1386943 - RNA, 17 nt, Homo sapiens
uaccgcugcauaguauu

SEQ ID NO: 1386944 - RNA, 20 nt, Homo sapiens
uaccuacauuuuaaugcacc

SEQ ID NO: 1386945 - RNA, 18 nt, Homo sapiens
uaccuaguacaaggcaac

SEQ ID NO: 1386946 - RNA, 18 nt, Homo sapiens
uaccuaguagucauuuca

SEQ ID NO: 1386947 - RNA, 19 nt, Homo sapiens
uaccuaguagucauuucau

SEQ ID NO: 1386948 - RNA, 23 nt, Homo sapiens
uaccucacagagugcauugugag

SEQ ID NO: 1386949 - RNA, 19 nt, Homo sapiens
uaccucugaucaaguauuu

SEQ ID NO: 1386950 - RNA, 17 nt, Homo sapiens
uaccuugaacacugggg

SEQ ID NO: 1386951 - RNA, 17 nt, Homo sapiens
uaccuugagccaguaau

SEQ ID NO: 1386952 - RNA, 19 nt, Homo sapiens
uacguuugaaauaguugau

SEQ ID NO: 1386953 - RNA, 16 nt, Homo sapiens
uacuaaaaauacagaa

SEQ ID NO: 1386954 - RNA, 20 nt, Homo sapiens
uacuaaauuacaaaugcaau

SEQ ID NO: 1386955 - RNA, 16 nt, Homo sapiens
uacuaaggaaucuuuc

SEQ ID NO: 1386956 - RNA, 14 nt, Homo sapiens
uacuacauacaagc

SEQ ID NO: 1386957 - RNA, 23 nt, Homo sapiens
uacuacauacaagcauaagcaaa

SEQ ID NO: 1386958 - RNA, 15 nt, Homo sapiens
uacuaccacaaggaa

SEQ ID NO: 1386959 - RNA, 18 nt, Homo sapiens
uacuaguucagacacuuu

SEQ ID NO: 1386960 - RNA, 16 nt, Homo sapiens
uacuauuuucauucuc

SEQ ID NO: 1386961 - RNA, 20 nt, Homo sapiens
uacucaccucaccccacugu

SEQ ID NO: 1386962 - RNA, 20 nt, Homo sapiens
uacucaggaggcugaggcag

SEQ ID NO: 1386963 - RNA, 13 nt, Homo sapiens
uacucaugaucuu

SEQ ID NO: 1386964 - RNA, 20 nt, Homo sapiens
uacucauuaaaaauaauaga

SEQ ID NO: 1386965 - RNA, 15 nt, Homo sapiens
uacucauucagggau

SEQ ID NO: 1386966 - RNA, 22 nt, Homo sapiens
uacucauucagggauagcacug

SEQ ID NO: 1386967 - RNA, 15 nt, Homo sapiens
uacucucaugcugca

SEQ ID NO: 1386968 - RNA, 14 nt, Homo sapiens
uacucuccaaccug

SEQ ID NO: 1386969 - RNA, 16 nt, Homo sapiens
uacucugcacuggugu

SEQ ID NO: 1386970 - RNA, 13 nt, Homo sapiens
uacugaccagcaa

SEQ ID NO: 1386971 - RNA, 22 nt, Homo sapiens
uacugcucaucauuccuugaga

SEQ ID NO: 1386972 - RNA, 22 nt, Homo sapiens
uacuguaaagaauuuagcugua

SEQ ID NO: 1386973 - RNA, 12 nt, Homo sapiens
uacuguacuuaa

SEQ ID NO: 1386974 - RNA, 13 nt, Homo sapiens
uacuguacuuaau

SEQ ID NO: 1386975 - RNA, 14 nt, Homo sapiens
uacuguccaaagac

SEQ ID NO: 1386976 - RNA, 14 nt, Homo sapiens
uacuguuacugugu

SEQ ID NO: 1386977 - RNA, 19 nt, Homo sapiens
uacuguuacugugucagga

SEQ ID NO: 1386978 - RNA, 15 nt, Homo sapiens
uacuuaaaacuguaa

SEQ ID NO: 1386979 - RNA, 16 nt, Homo sapiens
uaucccaaacuaagcu

SEQ ID NO: 1386980 - RNA, 18 nt, Homo sapiens
uaucccauugaaacaaaa

SEQ ID NO: 1386981 - RNA, 18 nt, Homo sapiens
uaucccuuuucuugacua

SEQ ID NO: 1386982 - RNA, 20 nt, Homo sapiens
uauccgaacuuuaauuucag

SEQ ID NO: 1386983 - RNA, 20 nt, Homo sapiens
uauccugagccaucggugaa

SEQ ID NO: 1386984 - RNA, 13 nt, Homo sapiens
uaucgaucucuua

SEQ ID NO: 1386985 - RNA, 17 nt, Homo sapiens
uaucgggaacaguguuu

SEQ ID NO: 1386986 - RNA, 21 nt, Homo sapiens
uaucgggagcagugucuucca

SEQ ID NO: 1386987 - RNA, 13 nt, Homo sapiens
uaucuauuuuccu

SEQ ID NO: 1386988 - RNA, 18 nt, Homo sapiens
uaucugagucaacuccuu

SEQ ID NO: 1386989 - RNA, 14 nt, Homo sapiens
uaucugauuuccua

SEQ ID NO: 1386990 - RNA, 14 nt, Homo sapiens
uaucugcuacuuug

SEQ ID NO: 1386991 - RNA, 21 nt, Homo sapiens
uaucugcucuuaggugcuucu

SEQ ID NO: 1386992 - RNA, 17 nt, Homo sapiens
uaucuuaaaacuccugu

SEQ ID NO: 1386993 - RNA, 15 nt, Homo sapiens
uaugacaucagcaau

SEQ ID NO: 1386994 - RNA, 21 nt, Homo sapiens
uaugacaugaucgcuuucuac

SEQ ID NO: 1386995 - RNA, 18 nt, Homo sapiens
uaugagggaaaaugagua

SEQ ID NO: 1386996 - RNA, 17 nt, Homo sapiens
uaugaguuucuuuuugc

SEQ ID NO: 1386997 - RNA, 21 nt, Homo sapiens
uaugaguuuuugauagcuuua

SEQ ID NO: 1386998 - RNA, 18 nt, Homo sapiens
uaugauauugcauaugca

SEQ ID NO: 1386999 - RNA, 17 nt, Homo sapiens
uaugaucacggcucacu

SEQ ID NO: 1387000 - RNA, 15 nt, Homo sapiens
uaugcaccaaaucau

SEQ ID NO: 1387001 - RNA, 16 nt, Homo sapiens
uaugcacgugugcaca

SEQ ID NO: 1387002 - RNA, 19 nt, Homo sapiens
uaugcaggggcaaacaccu

SEQ ID NO: 1387003 - RNA, 12 nt, Homo sapiens
uaugcauaucag

SEQ ID NO: 1387004 - RNA, 18 nt, Homo sapiens
uaugcaucugcuacugug

SEQ ID NO: 1387005 - RNA, 22 nt, Homo sapiens
uaugcaucugcuacugugucag

SEQ ID NO: 1387006 - RNA, 16 nt, Homo sapiens
uauggaacucucucca

SEQ ID NO: 1387007 - RNA, 16 nt, Homo sapiens
uauggcacccaugcac

SEQ ID NO: 1387008 - RNA, 16 nt, Homo sapiens
uauggcuuaaugacac

SEQ ID NO: 1387009 - RNA, 21 nt, Homo sapiens
uaugggccaagcccagcuuaa

SEQ ID NO: 1387010 - RNA, 13 nt, Homo sapiens
uauggggggccaa

SEQ ID NO: 1387011 - RNA, 20 nt, Homo sapiens
uaugguaaaaguuacuuauu

SEQ ID NO: 1387012 - RNA, 22 nt, Homo sapiens
uaugguuaauaaguuucacuga

SEQ ID NO: 1387013 - RNA, 15 nt, Homo sapiens
uaugguuuuguggau

SEQ ID NO: 1387014 - RNA, 19 nt, Homo sapiens
uauguaaaauuuugccuaa

SEQ ID NO: 1387015 - RNA, 13 nt, Homo sapiens
uauguacuaagca

SEQ ID NO: 1387016 - RNA, 22 nt, Homo sapiens
uaugucaggcaaagugcugcug

SEQ ID NO: 1387017 - RNA, 16 nt, Homo sapiens
uaugucaguuugcagu

SEQ ID NO: 1387018 - RNA, 18 nt, Homo sapiens
uaugucuaaaauccugcu

SEQ ID NO: 1387019 - RNA, 16 nt, Homo sapiens
uaugugcgugugugca

SEQ ID NO: 1387020 - RNA, 19 nt, Homo sapiens
uaugugcgugugugcaagu

SEQ ID NO: 1387021 - RNA, 19 nt, Homo sapiens
uaugugucagccaugacca

SEQ ID NO: 1387022 - RNA, 18 nt, Homo sapiens
uaugugugaggagcugcu

SEQ ID NO: 1387023 - RNA, 20 nt, Homo sapiens
uauguguggaugaugcugcc

SEQ ID NO: 1387024 - RNA, 17 nt, Homo sapiens
uauguguguuuugcuaa

SEQ ID NO: 1387025 - RNA, 22 nt, Homo sapiens
uauguucaacuggagacacuau

SEQ ID NO: 1387026 - RNA, 15 nt, Homo sapiens
uauguuuacacuguc

SEQ ID NO: 1387027 - RNA, 16 nt, Homo sapiens
uauguuuacacuguca

SEQ ID NO: 1387028 - RNA, 18 nt, Homo sapiens
uauuaacauaagaaaaga

SEQ ID NO: 1387029 - RNA, 17 nt, Homo sapiens
uauuaauuucuucacac

SEQ ID NO: 1387030 - RNA, 20 nt, Homo sapiens
uauuacaguuuaucuauggc

SEQ ID NO: 1387031 - RNA, 22 nt, Homo sapiens
uauuacaguuuaucuauggcac

SEQ ID NO: 1387032 - RNA, 13 nt, Homo sapiens
uauuaccacugaa

SEQ ID NO: 1387033 - RNA, 14 nt, Homo sapiens
uauuacuuauuugg

SEQ ID NO: 1387034 - RNA, 14 nt, Homo sapiens
uauuagcccagaaa

SEQ ID NO: 1387035 - RNA, 12 nt, Homo sapiens
uauuaugcauaa

SEQ ID NO: 1387036 - RNA, 15 nt, Homo sapiens
uauuauuucaaugug

SEQ ID NO: 1387037 - RNA, 12 nt, Homo sapiens
uauucaacaacu

SEQ ID NO: 1387038 - RNA, 14 nt, Homo sapiens
uauuccaccuuaaa

SEQ ID NO: 1387039 - RNA, 15 nt, Homo sapiens
uauuccauaauucca

SEQ ID NO: 1387040 - RNA, 13 nt, Homo sapiens
uauuccugcauuu

SEQ ID NO: 1387041 - RNA, 17 nt, Homo sapiens
uauucucacuccaccac

SEQ ID NO: 1387042 - RNA, 16 nt, Homo sapiens
uauucuuaacuauuca

SEQ ID NO: 1387043 - RNA, 21 nt, Homo sapiens
uauucuuuaaauuucaucuca

SEQ ID NO: 1387044 - RNA, 18 nt, Homo sapiens
uauugaaugaugugauac

SEQ ID NO: 1387045 - RNA, 19 nt, Homo sapiens
uauugaugauguugaacaa

SEQ ID NO: 1387046 - RNA, 14 nt, Homo sapiens
uauuuaaucuuaau

SEQ ID NO: 1387047 - RNA, 19 nt, Homo sapiens
uauuuaaucuuaaucuguu

SEQ ID NO: 1387048 - RNA, 15 nt, Homo sapiens
uauuuacaagggaag

SEQ ID NO: 1387049 - RNA, 15 nt, Homo sapiens
uauuuacauaugaaa

SEQ ID NO: 1387050 - RNA, 16 nt, Homo sapiens
uauuuaccagaccaca

SEQ ID NO: 1387051 - RNA, 13 nt, Homo sapiens
uauuuaugaaggc

SEQ ID NO: 1387052 - RNA, 21 nt, Homo sapiens
uauuuaugagaaaguucucau

SEQ ID NO: 1387053 - RNA, 16 nt, Homo sapiens
uauuuccauauggcaa

SEQ ID NO: 1387054 - RNA, 22 nt, Homo sapiens
uauuucuaucccaaacuaagcu

SEQ ID NO: 1387055 - RNA, 16 nt, Homo sapiens
uauuugaaucuacaaa

SEQ ID NO: 1387056 - RNA, 19 nt, Homo sapiens
uauuuuauucccuuucaca

SEQ ID NO: 1387057 - RNA, 18 nt, Homo sapiens
uauuuugcauaguaccaa

SEQ ID NO: 1387058 - RNA, 16 nt, Homo sapiens
uauuuuuagacagagu

SEQ ID NO: 1387059 - RNA, 22 nt, Homo sapiens
uauuuuuguuucuuccaaagca

SEQ ID NO: 1387060 - RNA, 22 nt, Homo sapiens
uauuuuuucgugcacucugcua

SEQ ID NO: 1387061 - RNA, 20 nt, Homo sapiens
ucaaaaaaucugaccaaaac

SEQ ID NO: 1387062 - RNA, 20 nt, Homo sapiens
ucaaaaauacucacauggcu

SEQ ID NO: 1387063 - RNA, 20 nt, Homo sapiens
ucaaaauaaaaaccaagaag

SEQ ID NO: 1387064 - RNA, 19 nt, Homo sapiens
ucaaaaucuguagagcagg

SEQ ID NO: 1387065 - RNA, 13 nt, Homo sapiens
ucaaacaaagcca

SEQ ID NO: 1387066 - RNA, 11 nt, Homo sapiens
ucaaacagcuc

SEQ ID NO: 1387067 - RNA, 14 nt, Homo sapiens
ucaaacauuucaaa

SEQ ID NO: 1387068 - RNA, 14 nt, Homo sapiens
ucaaacugccuugg

SEQ ID NO: 1387069 - RNA, 12 nt, Homo sapiens
ucaaagcacugu

SEQ ID NO: 1387070 - RNA, 21 nt, Homo sapiens
ucaaagcacuguuucucucac

SEQ ID NO: 1387071 - RNA, 12 nt, Homo sapiens
ucaaagcaguag

SEQ ID NO: 1387072 - RNA, 21 nt, Homo sapiens
ucaaagcuuuuuccagaggcu

SEQ ID NO: 1387073 - RNA, 13 nt, Homo sapiens
ucaaagugagcuc

SEQ ID NO: 1387074 - RNA, 12 nt, Homo sapiens
ucaaaguggcaa

SEQ ID NO: 1387075 - RNA, 13 nt, Homo sapiens
ucaaauacaucuu

SEQ ID NO: 1387076 - RNA, 20 nt, Homo sapiens
ucaaauagaaccacuaugaa

SEQ ID NO: 1387077 - RNA, 14 nt, Homo sapiens
ucaaauagcauaag

SEQ ID NO: 1387078 - RNA, 12 nt, Homo sapiens
ucaaaugcacau

SEQ ID NO: 1387079 - RNA, 16 nt, Homo sapiens
ucaaaugcacaucuca

SEQ ID NO: 1387080 - RNA, 16 nt, Homo sapiens
ucaacaaagucaccca

SEQ ID NO: 1387081 - RNA, 16 nt, Homo sapiens
ucaacaccucugcaca

SEQ ID NO: 1387082 - RNA, 22 nt, Homo sapiens
ucaacaucuuggucagauuuga

SEQ ID NO: 1387083 - RNA, 23 nt, Homo sapiens
ucaaccauccccuccguggcauc

SEQ ID NO: 1387084 - RNA, 15 nt, Homo sapiens
ucaaccugugaugag

SEQ ID NO: 1387085 - RNA, 17 nt, Homo sapiens
ucaacuccuuucucauc

SEQ ID NO: 1387086 - RNA, 17 nt, Homo sapiens
ucaacugaaaagacuca

SEQ ID NO: 1387087 - RNA, 22 nt, Homo sapiens
ucaacugaaaagacucaguguu

SEQ ID NO: 1387088 - RNA, 19 nt, Homo sapiens
ucaacuguuuuugucuaca

SEQ ID NO: 1387089 - RNA, 12 nt, Homo sapiens
ucaacuuugaca

SEQ ID NO: 1387090 - RNA, 16 nt, Homo sapiens
ucaagaacucugggcu

SEQ ID NO: 1387091 - RNA, 16 nt, Homo sapiens
ucaagaagaagaugga

SEQ ID NO: 1387092 - RNA, 21 nt, Homo sapiens
ucaagauuuucauacuuuuac

SEQ ID NO: 1387093 - RNA, 21 nt, Homo sapiens
ucaagcaauccuccugaguga

SEQ ID NO: 1387094 - RNA, 19 nt, Homo sapiens
ucaagccaguacgugcuaa

SEQ ID NO: 1387095 - RNA, 23 nt, Homo sapiens
ucaagccgcaucccagacuugcu

SEQ ID NO: 1387096 - RNA, 14 nt, Homo sapiens
ucaaggaauuugca

SEQ ID NO: 1387097 - RNA, 22 nt, Homo sapiens
ucaaggccagcaagguggagug

SEQ ID NO: 1387098 - RNA, 21 nt, Homo sapiens
ucaagggaacuugagcgugaa

SEQ ID NO: 1387099 - RNA, 17 nt, Homo sapiens
ucaagggcugcuucaaa

SEQ ID NO: 1387100 - RNA, 16 nt, Homo sapiens
ucaaguaauugugaaa

SEQ ID NO: 1387101 - RNA, 18 nt, Homo sapiens
ucaaguauuggcaaagau

SEQ ID NO: 1387102 - RNA, 21 nt, Homo sapiens
ucaaguauuuuugacauuuac

SEQ ID NO: 1387103 - RNA, 15 nt, Homo sapiens
ucaagugauccuccu

SEQ ID NO: 1387104 - RNA, 12 nt, Homo sapiens
ucaaguggcaug

SEQ ID NO: 1387105 - RNA, 17 nt, Homo sapiens
ucaaguuaacaaggaau

SEQ ID NO: 1387106 - RNA, 13 nt, Homo sapiens
ucaaguucauuga

SEQ ID NO: 1387107 - RNA, 16 nt, Homo sapiens
ucaaguuggcuucuaa

SEQ ID NO: 1387108 - RNA, 18 nt, Homo sapiens
ucaauaaaaccacuguac

SEQ ID NO: 1387109 - RNA, 13 nt, Homo sapiens
ucaauaggcaaag

SEQ ID NO: 1387110 - RNA, 21 nt, Homo sapiens
ucaauaucugaaucaccuuga

SEQ ID NO: 1387111 - RNA, 14 nt, Homo sapiens
ucaauaucuuuauu

SEQ ID NO: 1387112 - RNA, 16 nt, Homo sapiens
ucaauccgaaguauga

SEQ ID NO: 1387113 - RNA, 13 nt, Homo sapiens
ucaaucucuaguu

SEQ ID NO: 1387114 - RNA, 22 nt, Homo sapiens
ucaaugcuauaacuauguugau

SEQ ID NO: 1387115 - RNA, 16 nt, Homo sapiens
ucaauggaaagcugcu

SEQ ID NO: 1387116 - RNA, 17 nt, Homo sapiens
ucaauguucauuguaau

SEQ ID NO: 1387117 - RNA, 21 nt, Homo sapiens
ucaauguuucuuuuaucacga

SEQ ID NO: 1387118 - RNA, 15 nt, Homo sapiens
ucaauguuuguccug

SEQ ID NO: 1387119 - RNA, 15 nt, Homo sapiens
ucaauuuauugcaca

SEQ ID NO: 1387120 - RNA, 21 nt, Homo sapiens
ucacaaaggaauggaggcucu

SEQ ID NO: 1387121 - RNA, 17 nt, Homo sapiens
ucacaaauaaacauaau

SEQ ID NO: 1387122 - RNA, 17 nt, Homo sapiens
ucacaacauuuacuuaa

SEQ ID NO: 1387123 - RNA, 19 nt, Homo sapiens
ucacaaccacucauucaaa

SEQ ID NO: 1387124 - RNA, 19 nt, Homo sapiens
ucacaacccaucuaccccu

SEQ ID NO: 1387125 - RNA, 21 nt, Homo sapiens
ucacaagugaaaaacauccag

SEQ ID NO: 1387126 - RNA, 13 nt, Homo sapiens
ucacaaugaaaug

SEQ ID NO: 1387127 - RNA, 21 nt, Homo sapiens
ucacacuguauauaaacauau

SEQ ID NO: 1387128 - RNA, 21 nt, Homo sapiens
ucacacuuccaccagccugca

SEQ ID NO: 1387129 - RNA, 15 nt, Homo sapiens
ucacagagugcauug

SEQ ID NO: 1387130 - RNA, 12 nt, Homo sapiens
ucacagugcaag

SEQ ID NO: 1387131 - RNA, 18 nt, Homo sapiens
ucacagugggagccaggg

SEQ ID NO: 1387132 - RNA, 17 nt, Homo sapiens
ucacauagagugaucuu

SEQ ID NO: 1387133 - RNA, 16 nt, Homo sapiens
ucacaucugcaucuua

SEQ ID NO: 1387134 - RNA, 13 nt, Homo sapiens
ucacaucuuggca

SEQ ID NO: 1387135 - RNA, 18 nt, Homo sapiens
ucacauucgaguguuuca

SEQ ID NO: 1387136 - RNA, 23 nt, Homo sapiens
ucacauuggcuauuuaaagacaa

SEQ ID NO: 1387137 - RNA, 22 nt, Homo sapiens
ucaccaauaaguauucuguguu

SEQ ID NO: 1387138 - RNA, 16 nt, Homo sapiens
ucaccacaugugcaca

SEQ ID NO: 1387139 - RNA, 12 nt, Homo sapiens
ucaccagugugu

SEQ ID NO: 1387140 - RNA, 15 nt, Homo sapiens
ucaccauguacauag

SEQ ID NO: 1387141 - RNA, 17 nt, Homo sapiens
ucaccauguacauagcu

SEQ ID NO: 1387142 - RNA, 17 nt, Homo sapiens
ucacccugucaaguuaa

SEQ ID NO: 1387143 - RNA, 14 nt, Homo sapiens
ucacccuguccaaa

SEQ ID NO: 1387144 - RNA, 18 nt, Homo sapiens
ucacccuguccaaacugc

SEQ ID NO: 1387145 - RNA, 18 nt, Homo sapiens
ucaccucaccccacugug

SEQ ID NO: 1387146 - RNA, 17 nt, Homo sapiens
ucaccucuuaugcacac

SEQ ID NO: 1387147 - RNA, 14 nt, Homo sapiens
ucaccuuccagugu

SEQ ID NO: 1387148 - RNA, 16 nt, Homo sapiens
ucacggcucacugcag

SEQ ID NO: 1387149 - RNA, 15 nt, Homo sapiens
ucacgucacacuugg

SEQ ID NO: 1387150 - RNA, 15 nt, Homo sapiens
ucacuaugcauuuua

SEQ ID NO: 1387151 - RNA, 14 nt, Homo sapiens
ucacucccagucca

SEQ ID NO: 1387152 - RNA, 21 nt, Homo sapiens
ucacucuauuaaaucuugcaa

SEQ ID NO: 1387153 - RNA, 18 nt, Homo sapiens
ucacucuguugcucaggc

SEQ ID NO: 1387154 - RNA, 22 nt, Homo sapiens
ucacugcaggggucuggugguc

SEQ ID NO: 1387155 - RNA, 17 nt, Homo sapiens
ucacuggaccacugggc

SEQ ID NO: 1387156 - RNA, 18 nt, Homo sapiens
ucacuucaaaacaguauu

SEQ ID NO: 1387157 - RNA, 12 nt, Homo sapiens
ucacuucacccu

SEQ ID NO: 1387158 - RNA, 20 nt, Homo sapiens
ucacuucuuccauccaaaga

SEQ ID NO: 1387159 - RNA, 15 nt, Homo sapiens
ucacuugaucuccgu

SEQ ID NO: 1387160 - RNA, 15 nt, Homo sapiens
ucacuuuuauugaua

SEQ ID NO: 1387161 - RNA, 14 nt, Homo sapiens
ucagaaaacagaaa

SEQ ID NO: 1387162 - RNA, 18 nt, Homo sapiens
ucagaaaguaauuucuuc

SEQ ID NO: 1387163 - RNA, 23 nt, Homo sapiens
ucagaaauuuaauucauguuucu

SEQ ID NO: 1387164 - RNA, 22 nt, Homo sapiens
ucagaagacacugaugggcaac

SEQ ID NO: 1387165 - RNA, 13 nt, Homo sapiens
ucagaagccugag

SEQ ID NO: 1387166 - RNA, 14 nt, Homo sapiens
ucagagcacagcag

SEQ ID NO: 1387167 - RNA, 15 nt, Homo sapiens
ucagagccaccccua

SEQ ID NO: 1387168 - RNA, 19 nt, Homo sapiens
ucagaguuccgacugccau

SEQ ID NO: 1387169 - RNA, 16 nt, Homo sapiens
ucagaguugugcacau

SEQ ID NO: 1387170 - RNA, 13 nt, Homo sapiens
ucagauaugauau

SEQ ID NO: 1387171 - RNA, 14 nt, Homo sapiens
ucagaugauucuau

SEQ ID NO: 1387172 - RNA, 12 nt, Homo sapiens
ucagauggacaa

SEQ ID NO: 1387173 - RNA, 15 nt, Homo sapiens
ucagauuccaccuag

SEQ ID NO: 1387174 - RNA, 18 nt, Homo sapiens
ucagauuccgcaccaaua

SEQ ID NO: 1387175 - RNA, 20 nt, Homo sapiens
ucagauuccuuucccuuuag

SEQ ID NO: 1387176 - RNA, 16 nt, Homo sapiens
ucagauucuucucuua

SEQ ID NO: 1387177 - RNA, 19 nt, Homo sapiens
ucagcaaaaaaguacuuaa

SEQ ID NO: 1387178 - RNA, 17 nt, Homo sapiens
ucagcaagaauuugauc

SEQ ID NO: 1387179 - RNA, 18 nt, Homo sapiens
ucagcaaggggcucugcc

SEQ ID NO: 1387180 - RNA, 21 nt, Homo sapiens
ucagcaguucagcuccuucca

SEQ ID NO: 1387181 - RNA, 12 nt, Homo sapiens
ucagccaugagg

SEQ ID NO: 1387182 - RNA, 22 nt, Homo sapiens
ucagccuuuaagauaccuugau

SEQ ID NO: 1387183 - RNA, 15 nt, Homo sapiens
ucagcugaaccuggg

SEQ ID NO: 1387184 - RNA, 15 nt, Homo sapiens
ucagcuggcacuguc

SEQ ID NO: 1387185 - RNA, 14 nt, Homo sapiens
ugaaagaccuucuc

SEQ ID NO: 1387186 - RNA, 17 nt, Homo sapiens
ugaaagccacagacaau

SEQ ID NO: 1387187 - RNA, 19 nt, Homo sapiens
ugaaagucaugaacacauc

SEQ ID NO: 1387188 - RNA, 19 nt, Homo sapiens
ugaaauaaaugccccaaag

SEQ ID NO: 1387189 - RNA, 21 nt, Homo sapiens
ugaaauauacacacagcagua

SEQ ID NO: 1387190 - RNA, 16 nt, Homo sapiens
ugaaauaucaugcucc

SEQ ID NO: 1387191 - RNA, 14 nt, Homo sapiens
ugaaaugaugguaa

SEQ ID NO: 1387192 - RNA, 19 nt, Homo sapiens
ugaaaugcuggcauuugca

SEQ ID NO: 1387193 - RNA, 16 nt, Homo sapiens
ugaaauuagggcccaa

SEQ ID NO: 1387194 - RNA, 19 nt, Homo sapiens
ugaaauuuaauauagcuau

SEQ ID NO: 1387195 - RNA, 16 nt, Homo sapiens
ugaaauuuuaauugaa

SEQ ID NO: 1387196 - RNA, 15 nt, Homo sapiens
ugaaauuuuaccaag

SEQ ID NO: 1387197 - RNA, 18 nt, Homo sapiens
ugaacacauugugucaca

SEQ ID NO: 1387198 - RNA, 21 nt, Homo sapiens
ugaacacguuuuuucacuauu

SEQ ID NO: 1387199 - RNA, 14 nt, Homo sapiens
ugaacauaaagccu

SEQ ID NO: 1387200 - RNA, 18 nt, Homo sapiens
ugaacaugugaaguuaua

SEQ ID NO: 1387201 - RNA, 13 nt, Homo sapiens
ugaaccacaucuu

SEQ ID NO: 1387202 - RNA, 20 nt, Homo sapiens
ugaaccauucacagugcaag

SEQ ID NO: 1387203 - RNA, 16 nt, Homo sapiens
ugaaccuuccaucucg

SEQ ID NO: 1387204 - RNA, 22 nt, Homo sapiens
ugaacuggguacuuguggacac

SEQ ID NO: 1387205 - RNA, 14 nt, Homo sapiens
ugaacuguauuuau

SEQ ID NO: 1387206 - RNA, 16 nt, Homo sapiens
ugaacuucagcuagag

SEQ ID NO: 1387207 - RNA, 14 nt, Homo sapiens
ugaacuucagggag

SEQ ID NO: 1387208 - RNA, 21 nt, Homo sapiens
ugaacuuggaaagaaaugccc

SEQ ID NO: 1387209 - RNA, 23 nt, Homo sapiens
ugaagaagagacucuuugcauau

SEQ ID NO: 1387210 - RNA, 16 nt, Homo sapiens
ugaagaagauauguga

SEQ ID NO: 1387211 - RNA, 17 nt, Homo sapiens
ugaagaagauaugugaa

SEQ ID NO: 1387212 - RNA, 17 nt, Homo sapiens
ugaagaagcaucuuccu

SEQ ID NO: 1387213 - RNA, 20 nt, Homo sapiens
ugaagacugggugaggauaa

SEQ ID NO: 1387214 - RNA, 18 nt, Homo sapiens
ugaagagggagaagcaug

SEQ ID NO: 1387215 - RNA, 21 nt, Homo sapiens
ugaagaugcugaaacaggaga

SEQ ID NO: 1387216 - RNA, 23 nt, Homo sapiens
ugaagauguuucaaaaaaucuga

SEQ ID NO: 1387217 - RNA, 16 nt, Homo sapiens
ugaagcaaaucagaaa

SEQ ID NO: 1387218 - RNA, 15 nt, Homo sapiens
ugaagcauccaggca

SEQ ID NO: 1387219 - RNA, 21 nt, Homo sapiens
ugaaggaaaugaaccacauag

SEQ ID NO: 1387220 - RNA, 13 nt, Homo sapiens
ugaaggaugccau

SEQ ID NO: 1387221 - RNA, 14 nt, Homo sapiens
ugaaggcuguccuu

SEQ ID NO: 1387222 - RNA, 14 nt, Homo sapiens
ugaagugauguugu

SEQ ID NO: 1387223 - RNA, 12 nt, Homo sapiens
ugaagugcaaau

SEQ ID NO: 1387224 - RNA, 21 nt, Homo sapiens
ugaauaaagccugcuuuuuaa

SEQ ID NO: 1387225 - RNA, 19 nt, Homo sapiens
ugaauaagacaacaaagag

SEQ ID NO: 1387226 - RNA, 14 nt, Homo sapiens
ugaauacaggcaua

SEQ ID NO: 1387227 - RNA, 14 nt, Homo sapiens
ugaauaugccacuu

SEQ ID NO: 1387228 - RNA, 17 nt, Homo sapiens
ugaaucagacccuaccc

SEQ ID NO: 1387229 - RNA, 22 nt, Homo sapiens
ugaaucaugguuuuucuuagua

SEQ ID NO: 1387230 - RNA, 11 nt, Homo sapiens
ugaaucuacaa

SEQ ID NO: 1387231 - RNA, 17 nt, Homo sapiens
ugaaucuuggugucuac

SEQ ID NO: 1387232 - RNA, 22 nt, Homo sapiens
ugaaugaaagucuugugacuag

SEQ ID NO: 1387233 - RNA, 15 nt, Homo sapiens
ugaaugauacccuga

SEQ ID NO: 1387234 - RNA, 14 nt, Homo sapiens
ugaaugaugugaua

SEQ ID NO: 1387235 - RNA, 14 nt, Homo sapiens
ugaaugcaaaguag

SEQ ID NO: 1387236 - RNA, 18 nt, Homo sapiens
ugaaugcacacuagccuc

SEQ ID NO: 1387237 - RNA, 12 nt, Homo sapiens
ugaaugcuuccu

SEQ ID NO: 1387238 - RNA, 14 nt, Homo sapiens
ugaauggacucaaa

SEQ ID NO: 1387239 - RNA, 17 nt, Homo sapiens
ugaaugugacuacuuag

SEQ ID NO: 1387240 - RNA, 17 nt, Homo sapiens
ugaauuggaccauccua

SEQ ID NO: 1387241 - RNA, 15 nt, Homo sapiens
ugaauuugaaucuca

SEQ ID NO: 1387242 - RNA, 19 nt, Homo sapiens
ugaauuuucaagcaucucc

SEQ ID NO: 1387243 - RNA, 21 nt, Homo sapiens
ugaauuuucaaguaauuguga

SEQ ID NO: 1387244 - RNA, 20 nt, Homo sapiens
ugacaaccgaguggcuguca

SEQ ID NO: 1387245 - RNA, 12 nt, Homo sapiens
ugacaaccucuu

SEQ ID NO: 1387246 - RNA, 15 nt, Homo sapiens
ugacaauaauuucag

SEQ ID NO: 1387247 - RNA, 13 nt, Homo sapiens
ugacaauagaaca

SEQ ID NO: 1387248 - RNA, 14 nt, Homo sapiens
ugacaaucaacucu

SEQ ID NO: 1387249 - RNA, 17 nt, Homo sapiens
ugacaaugggagccuca

SEQ ID NO: 1387250 - RNA, 20 nt, Homo sapiens
ugacaccagccuuucuccca

SEQ ID NO: 1387251 - RNA, 21 nt, Homo sapiens
ugacacccauugggcccuucc

SEQ ID NO: 1387252 - RNA, 14 nt, Homo sapiens
ugacacggccauga

SEQ ID NO: 1387253 - RNA, 18 nt, Homo sapiens
ugacacgucugccuaccc

SEQ ID NO: 1387254 - RNA, 14 nt, Homo sapiens
ugacagaacacugu

SEQ ID NO: 1387255 - RNA, 15 nt, Homo sapiens
ugacagaacacuguc

SEQ ID NO: 1387256 - RNA, 12 nt, Homo sapiens
ugacagagccag

SEQ ID NO: 1387257 - RNA, 12 nt, Homo sapiens
ugacagaucucu

SEQ ID NO: 1387258 - RNA, 13 nt, Homo sapiens
ugacauaauuuca

SEQ ID NO: 1387259 - RNA, 18 nt, Homo sapiens
ugacauauaucuauuaca

SEQ ID NO: 1387260 - RNA, 19 nt, Homo sapiens
ugacaucaaacuugugagg

SEQ ID NO: 1387261 - RNA, 14 nt, Homo sapiens
ugacaucacuugua

SEQ ID NO: 1387262 - RNA, 18 nt, Homo sapiens
ugacauccccacccuugg

SEQ ID NO: 1387263 - RNA, 16 nt, Homo sapiens
ugaccaagaacugcau

SEQ ID NO: 1387264 - RNA, 15 nt, Homo sapiens
ugaccaagcaggaag

SEQ ID NO: 1387265 - RNA, 16 nt, Homo sapiens
ugacccagucagaguu

SEQ ID NO: 1387266 - RNA, 22 nt, Homo sapiens
ugacccagucagaguugugcac

SEQ ID NO: 1387267 - RNA, 16 nt, Homo sapiens
ugaccccugaccucac

SEQ ID NO: 1387268 - RNA, 22 nt, Homo sapiens
ugaccccuguccccacacugac

SEQ ID NO: 1387269 - RNA, 19 nt, Homo sapiens
ugaccuaaccuaagcaaaa

SEQ ID NO: 1387270 - RNA, 16 nt, Homo sapiens
ugaccucacugugacc

SEQ ID NO: 1387271 - RNA, 13 nt, Homo sapiens
ugaccuccacagc

SEQ ID NO: 1387272 - RNA, 23 nt, Homo sapiens
ugaccucuauaauugccacugag

SEQ ID NO: 1387273 - RNA, 19 nt, Homo sapiens
ugaccugaggaagcgugaa

SEQ ID NO: 1387274 - RNA, 21 nt, Homo sapiens
ugaccugccaggcacacugag

SEQ ID NO: 1387275 - RNA, 17 nt, Homo sapiens
ugaccugugaccagcac

SEQ ID NO: 1387276 - RNA, 12 nt, Homo sapiens
ugacggugucca

SEQ ID NO: 1387277 - RNA, 22 nt, Homo sapiens
ugacgucacuggaccacugggc

SEQ ID NO: 1387278 - RNA, 22 nt, Homo sapiens
ugacuaaacaacuaccuccuca

SEQ ID NO: 1387279 - RNA, 16 nt, Homo sapiens
ugacucacuuauccca

SEQ ID NO: 1387280 - RNA, 17 nt, Homo sapiens
ugacuggcacagucuuu

SEQ ID NO: 1387281 - RNA, 15 nt, Homo sapiens
ugacuguaucugugu

SEQ ID NO: 1387282 - RNA, 22 nt, Homo sapiens
ugacuguauuuuccaacuuguu

SEQ ID NO: 1387283 - RNA, 17 nt, Homo sapiens
ugagaaaaugagugacu

SEQ ID NO: 1387284 - RNA, 15 nt, Homo sapiens
ugagaaacaucucaa

SEQ ID NO: 1387285 - RNA, 18 nt, Homo sapiens
ugagaaaugccagugugc

SEQ ID NO: 1387286 - RNA, 19 nt, Homo sapiens
ugagaaugagggccaagaa

SEQ ID NO: 1387287 - RNA, 23 nt, Homo sapiens
ugagacaggagaccuggcacugg

SEQ ID NO: 1387288 - RNA, 13 nt, Homo sapiens
ugagaccuggcag

SEQ ID NO: 1387289 - RNA, 16 nt, Homo sapiens
ugagacuccgucacaa

SEQ ID NO: 1387290 - RNA, 17 nt, Homo sapiens
ugagacucugucucaaa

SEQ ID NO: 1387291 - RNA, 15 nt, Homo sapiens
ugagagacaggacua

SEQ ID NO: 1387292 - RNA, 14 nt, Homo sapiens
ugagaggcaaugau

SEQ ID NO: 1387293 - RNA, 16 nt, Homo sapiens
ugagaguacaccccaa

SEQ ID NO: 1387294 - RNA, 15 nt, Homo sapiens
ugagaucauugcaaa

SEQ ID NO: 1387295 - RNA, 17 nt, Homo sapiens
ugagaucguuguuuaca

SEQ ID NO: 1387296 - RNA, 21 nt, Homo sapiens
ugagcaaaaccaaauauucca

SEQ ID NO: 1387297 - RNA, 15 nt, Homo sapiens
ugagcaccaggggau

SEQ ID NO: 1387298 - RNA, 19 nt, Homo sapiens
ugagcagacugcaaaucug

SEQ ID NO: 1387299 - RNA, 21 nt, Homo sapiens
ugagcagugcuugaaugaagu

SEQ ID NO: 1387300 - RNA, 15 nt, Homo sapiens
ugagcaugcuuucug

SEQ ID NO: 1387301 - RNA, 11 nt, Homo sapiens
ugagcauuuag

SEQ ID NO: 1387302 - RNA, 19 nt, Homo sapiens
ugagccaaagagaaugcca

SEQ ID NO: 1387303 - RNA, 20 nt, Homo sapiens
ugagccaaagagaaugccau

SEQ ID NO: 1387304 - RNA, 18 nt, Homo sapiens
ugagccagucuaguuccu

SEQ ID NO: 1387305 - RNA, 18 nt, Homo sapiens
ugagcccggaugcuucuc

SEQ ID NO: 1387306 - RNA, 24 nt, Homo sapiens
ugagcgaugacucaagugucucag

SEQ ID NO: 1387307 - RNA, 14 nt, Homo sapiens
ugagcuaacuuaua

SEQ ID NO: 1387308 - RNA, 19 nt, Homo sapiens
ugagcuccccaaaaaccuc

SEQ ID NO: 1387309 - RNA, 22 nt, Homo sapiens
ugagcugcaacuucuuacuucc

SEQ ID NO: 1387310 - RNA, 21 nt, Homo sapiens
ugagcuuggaaaggaccagua

SEQ ID NO: 1387311 - RNA, 21 nt, Homo sapiens
ugaggaaaggccagcuggcag

SEQ ID NO: 1387312 - RNA, 21 nt, Homo sapiens
ugaggaauuucuguucuucca

SEQ ID NO: 1387313 - RNA, 15 nt, Homo sapiens
ugaggaccacuccug

SEQ ID NO: 1387314 - RNA, 22 nt, Homo sapiens
ugaggaggcuugccccacccaa

SEQ ID NO: 1387315 - RNA, 15 nt, Homo sapiens
ugaggaugucacuca

SEQ ID NO: 1387316 - RNA, 22 nt, Homo sapiens
ugaggcagacagcagcucaggc

SEQ ID NO: 1387317 - RNA, 14 nt, Homo sapiens
ugaggcugcaccca

SEQ ID NO: 1387318 - RNA, 14 nt, Homo sapiens
ugaggcugcagcga

SEQ ID NO: 1387319 - RNA, 22 nt, Homo sapiens
ugaggggguaauaaaccuccuu

SEQ ID NO: 1387320 - RNA, 13 nt, Homo sapiens
ugagggucagaga

SEQ ID NO: 1387321 - RNA, 18 nt, Homo sapiens
ugagggucuuugcaagaa

SEQ ID NO: 1387322 - RNA, 22 nt, Homo sapiens
ugagguacagcagaaaggagaa

SEQ ID NO: 1387323 - RNA, 19 nt, Homo sapiens
ugaguagagagcaagggaa

SEQ ID NO: 1387324 - RNA, 10 nt, Homo sapiens
ugaguagccc

SEQ ID NO: 1387325 - RNA, 19 nt, Homo sapiens
ugaguagccccaacccaaa

SEQ ID NO: 1387326 - RNA, 14 nt, Homo sapiens
ugagucaugaucuc

SEQ ID NO: 1387327 - RNA, 18 nt, Homo sapiens
ugagucugcagaugagga

SEQ ID NO: 1387328 - RNA, 20 nt, Homo sapiens
ugagugaaucugcauuuucu

SEQ ID NO: 1387329 - RNA, 17 nt, Homo sapiens
ugaguggaugauguuuc

SEQ ID NO: 1387330 - RNA, 15 nt, Homo sapiens
ugaguguaaguguga

SEQ ID NO: 1387331 - RNA, 14 nt, Homo sapiens
ugagugugugcaag

SEQ ID NO: 1387332 - RNA, 22 nt, Homo sapiens
ugaguucuggaagggacuuuag

SEQ ID NO: 1387333 - RNA, 12 nt, Homo sapiens
ugauacuuuuaa

SEQ ID NO: 1387334 - RNA, 20 nt, Homo sapiens
ugauauagaucacauaacag

SEQ ID NO: 1387335 - RNA, 20 nt, Homo sapiens
ugauaugaaaaauaugauau

SEQ ID NO: 1387336 - RNA, 18 nt, Homo sapiens
ugauauguaaacauaauu

SEQ ID NO: 1387337 - RNA, 23 nt, Homo sapiens
ugauaugucagggcgugggacau

SEQ ID NO: 1387338 - RNA, 19 nt, Homo sapiens
ugauauguucaacuggaga

SEQ ID NO: 1387339 - RNA, 11 nt, Homo sapiens
ugaucaaguca

SEQ ID NO: 1387340 - RNA, 16 nt, Homo sapiens
ugaucaccugccaaau

SEQ ID NO: 1387341 - RNA, 18 nt, Homo sapiens
ugaucacggcucacugca

SEQ ID NO: 1387342 - RNA, 21 nt, Homo sapiens
ugaucaggcuauguauggaau

SEQ ID NO: 1387343 - RNA, 21 nt, Homo sapiens
ugauccaugaguuugcccugg

SEQ ID NO: 1387344 - RNA, 12 nt, Homo sapiens
ugaucugaugca

SEQ ID NO: 1387345 - RNA, 17 nt, Homo sapiens
ugaugaggcagaugccu

SEQ ID NO: 1387346 - RNA, 22 nt, Homo sapiens
ugaugucccuauggaagcauau

SEQ ID NO: 1387347 - RNA, 15 nt, Homo sapiens
ugaugugaaacauua

SEQ ID NO: 1387348 - RNA, 20 nt, Homo sapiens
ugaugugauacaaauugaua

SEQ ID NO: 1387349 - RNA, 20 nt, Homo sapiens
ugauguuuguggccucagaa

SEQ ID NO: 1387350 - RNA, 16 nt, Homo sapiens
ugauucccuccugcua

SEQ ID NO: 1387351 - RNA, 22 nt, Homo sapiens
ugauucccuccugcuacucugu

SEQ ID NO: 1387352 - RNA, 24 nt, Homo sapiens
ugauuccuuuccuaaaaguguaag

SEQ ID NO: 1387353 - RNA, 20 nt, Homo sapiens
ugauucgcccaaagccagac

SEQ ID NO: 1387354 - RNA, 16 nt, Homo sapiens
ugauucugucaauguc

SEQ ID NO: 1387355 - RNA, 20 nt, Homo sapiens
ugauugcuuaucaguaguau

SEQ ID NO: 1387356 - RNA, 13 nt, Homo sapiens
ugauugugauuau

SEQ ID NO: 1387357 - RNA, 19 nt, Homo sapiens
ugauuguguuuauugauga

SEQ ID NO: 1387358 - RNA, 16 nt, Homo sapiens
ugauuuaucacacaaa

SEQ ID NO: 1387359 - RNA, 13 nt, Homo sapiens
ugauuucaggaua

SEQ ID NO: 1387360 - RNA, 18 nt, Homo sapiens
ugauuugucccuaugcau

SEQ ID NO: 1387361 - RNA, 14 nt, Homo sapiens
ugauuuuacauuua

SEQ ID NO: 1387362 - RNA, 15 nt, Homo sapiens
ugauuuuuuuccaca

SEQ ID NO: 1387363 - RNA, 17 nt, Homo sapiens
ugcaaaacauugaagag

SEQ ID NO: 1387364 - RNA, 19 nt, Homo sapiens
ugcaaauccacuagcaccg

SEQ ID NO: 1387365 - RNA, 16 nt, Homo sapiens
ugcaacuuagcucaca

SEQ ID NO: 1387366 - RNA, 13 nt, Homo sapiens
ugcaacuuguaaa

SEQ ID NO: 1387367 - RNA, 22 nt, Homo sapiens
ugcaagaaggauaccaaauacc

SEQ ID NO: 1387368 - RNA, 23 nt, Homo sapiens
ugcaagcuucuuuuaguuguauc

SEQ ID NO: 1387369 - RNA, 14 nt, Homo sapiens
ugcaagugagcaaa

SEQ ID NO: 1387370 - RNA, 19 nt, Homo sapiens
ugcaagugucugugugcaa

SEQ ID NO: 1387371 - RNA, 19 nt, Homo sapiens
ugcaagugugugcacaugu

SEQ ID NO: 1387372 - RNA, 17 nt, Homo sapiens
ugcaagugugugcaugu

SEQ ID NO: 1387373 - RNA, 15 nt, Homo sapiens
ugcaauaaaauaaca

SEQ ID NO: 1387374 - RNA, 18 nt, Homo sapiens
ugcaauaaaauaguagca

SEQ ID NO: 1387375 - RNA, 21 nt, Homo sapiens
ugcaauagaauaaaaaugaca

SEQ ID NO: 1387376 - RNA, 18 nt, Homo sapiens
ugcaauaggugugcguca

SEQ ID NO: 1387377 - RNA, 17 nt, Homo sapiens
ugcaaugccucuggaau

SEQ ID NO: 1387378 - RNA, 13 nt, Homo sapiens
ugcaaugucacaa

SEQ ID NO: 1387379 - RNA, 13 nt, Homo sapiens
ugcaaugugcuac

SEQ ID NO: 1387380 - RNA, 15 nt, Homo sapiens
ugcacaaagcccuuc

SEQ ID NO: 1387381 - RNA, 16 nt, Homo sapiens
ugcacaaagcccuucc

SEQ ID NO: 1387382 - RNA, 17 nt, Homo sapiens
ugcacaaagcccuucca

SEQ ID NO: 1387383 - RNA, 17 nt, Homo sapiens
ugcacacauuaggcauu

SEQ ID NO: 1387384 - RNA, 12 nt, Homo sapiens
ugcacauuucau

SEQ ID NO: 1387385 - RNA, 14 nt, Homo sapiens
ugcacccacucugc

SEQ ID NO: 1387386 - RNA, 18 nt, Homo sapiens
ugcaccuguacucaggag

SEQ ID NO: 1387387 - RNA, 20 nt, Homo sapiens
ugcacguggcuucugaugaa

SEQ ID NO: 1387388 - RNA, 13 nt, Homo sapiens
ugcacucuagccg

SEQ ID NO: 1387389 - RNA, 23 nt, Homo sapiens
ugcacuugcacgcccauguguga

SEQ ID NO: 1387390 - RNA, 20 nt, Homo sapiens
ugcacuuucaggaacacucu

SEQ ID NO: 1387391 - RNA, 16 nt, Homo sapiens
ugcagaaaauugccua

SEQ ID NO: 1387392 - RNA, 13 nt, Homo sapiens
ugcagagacagag

SEQ ID NO: 1387393 - RNA, 13 nt, Homo sapiens
ugcagaguacugg

SEQ ID NO: 1387394 - RNA, 18 nt, Homo sapiens
ugcagagugcccagaacu

SEQ ID NO: 1387395 - RNA, 14 nt, Homo sapiens
ugcagcagagccug

SEQ ID NO: 1387396 - RNA, 21 nt, Homo sapiens
ugcagcagcaacacaauguua

SEQ ID NO: 1387397 - RNA, 19 nt, Homo sapiens
ugcagcccagaauagcuuu

SEQ ID NO: 1387398 - RNA, 15 nt, Homo sapiens
ugcagcccaugccca

SEQ ID NO: 1387399 - RNA, 17 nt, Homo sapiens
ugcaggagagacaguga

SEQ ID NO: 1387400 - RNA, 14 nt, Homo sapiens
ugcagggacugcca

SEQ ID NO: 1387401 - RNA, 18 nt, Homo sapiens
ugcagggccuccauuccu

SEQ ID NO: 1387402 - RNA, 23 nt, Homo sapiens
ugcaggggcaaacaccugcugau

SEQ ID NO: 1387403 - RNA, 18 nt, Homo sapiens
ugcagucaucuugaccaa

SEQ ID NO: 1387404 - RNA, 13 nt, Homo sapiens
ugcagugcuucca

SEQ ID NO: 1387405 - RNA, 20 nt, Homo sapiens
ugcauaagugcaugacauau

SEQ ID NO: 1387406 - RNA, 21 nt, Homo sapiens
ugcauaguucccauguuaaau

SEQ ID NO: 1387407 - RNA, 13 nt, Homo sapiens
ugcauauauacau

SEQ ID NO: 1387408 - RNA, 15 nt, Homo sapiens
ugcauauguaugacu

SEQ ID NO: 1387409 - RNA, 17 nt, Homo sapiens
ugcauccccaacuuagc

SEQ ID NO: 1387410 - RNA, 13 nt, Homo sapiens
ugcaucuacucag

SEQ ID NO: 1387411 - RNA, 22 nt, Homo sapiens
ugcaucuccccucagauuccac

SEQ ID NO: 1387412 - RNA, 16 nt, Homo sapiens
guaagacuaaaucugu

SEQ ID NO: 1387413 - RNA, 15 nt, Homo sapiens
guaaggugagggaau

SEQ ID NO: 1387414 - RNA, 20 nt, Homo sapiens
guaaguaccacucaggccaa

SEQ ID NO: 1387415 - RNA, 23 nt, Homo sapiens
guaaguugaauggccugccuuga

SEQ ID NO: 1387416 - RNA, 20 nt, Homo sapiens
guaauaaaccuccuucggga

SEQ ID NO: 1387417 - RNA, 18 nt, Homo sapiens
guaaucccagaacuuugg

SEQ ID NO: 1387418 - RNA, 23 nt, Homo sapiens
guaauucuaaaugaauguuuaca

SEQ ID NO: 1387419 - RNA, 22 nt, Homo sapiens
guaauuuuguaucuugaugucu

SEQ ID NO: 1387420 - RNA, 20 nt, Homo sapiens
guacaaacacaggauuugua

SEQ ID NO: 1387421 - RNA, 16 nt, Homo sapiens
guacacagacuauuga

SEQ ID NO: 1387422 - RNA, 19 nt, Homo sapiens
guacaccccaacagcaccc

SEQ ID NO: 1387423 - RNA, 15 nt, Homo sapiens
guacaggcaacaaug

SEQ ID NO: 1387424 - RNA, 22 nt, Homo sapiens
guacauaauucuugcuaugaaa

SEQ ID NO: 1387425 - RNA, 12 nt, Homo sapiens
guacaucuggcc

SEQ ID NO: 1387426 - RNA, 21 nt, Homo sapiens
guacauggaauaacauguaau

SEQ ID NO: 1387427 - RNA, 22 nt, Homo sapiens
guacauggaauaacauguaauu

SEQ ID NO: 1387428 - RNA, 21 nt, Homo sapiens
guaccauagcgcugcucuuau

SEQ ID NO: 1387429 - RNA, 19 nt, Homo sapiens
guacccaccugagcuuugg

SEQ ID NO: 1387430 - RNA, 21 nt, Homo sapiens
guaccccagcucugcuugccg

SEQ ID NO: 1387431 - RNA, 23 nt, Homo sapiens
guacccuaaggucauuaccacag

SEQ ID NO: 1387432 - RNA, 14 nt, Homo sapiens
guacuaaaaauaca

SEQ ID NO: 1387433 - RNA, 17 nt, Homo sapiens
guacuaguucagacacu

SEQ ID NO: 1387434 - RNA, 16 nt, Homo sapiens
guacuccuuaagaaca

SEQ ID NO: 1387435 - RNA, 21 nt, Homo sapiens
guacuucaaguuaaagugaau

SEQ ID NO: 1387436 - RNA, 23 nt, Homo sapiens
aacugguuccuagggauguguga

SEQ ID NO: 1387437 - RNA, 13 nt, Homo sapiens
aacuguagucuca

SEQ ID NO: 1387438 - RNA, 12 nt, Homo sapiens
aacuguauuuau

SEQ ID NO: 1387439 - RNA, 15 nt, Homo sapiens
aacuguggucaaucc

SEQ ID NO: 1387440 - RNA, 21 nt, Homo sapiens
aacugugugcagacucaauaa

SEQ ID NO: 1387441 - RNA, 17 nt, Homo sapiens
aacuguguggacuguga

SEQ ID NO: 1387442 - RNA, 12 nt, Homo sapiens
aacuuagcucac

SEQ ID NO: 1387443 - RNA, 19 nt, Homo sapiens
aacuuaucuuacaaagugu

SEQ ID NO: 1387444 - RNA, 13 nt, Homo sapiens
aacuucaagcaaa

SEQ ID NO: 1387445 - RNA, 15 nt, Homo sapiens
aacuucaucuucccc

SEQ ID NO: 1387446 - RNA, 12 nt, Homo sapiens
aacuuccacucc

SEQ ID NO: 1387447 - RNA, 11 nt, Homo sapiens
aacuuccucag

SEQ ID NO: 1387448 - RNA, 17 nt, Homo sapiens
aacuucuacuucugccc

SEQ ID NO: 1387449 - RNA, 20 nt, Homo sapiens
aacuucuacuucugcccuug

SEQ ID NO: 1387450 - RNA, 24 nt, Homo sapiens
aacuucuacuucugcccuugccaa

SEQ ID NO: 1387451 - RNA, 23 nt, Homo sapiens
aacuugaauuaauccacacauca

SEQ ID NO: 1387452 - RNA, 14 nt, Homo sapiens
aacuugacccccuu

SEQ ID NO: 1387453 - RNA, 22 nt, Homo sapiens
aacuugagcgugaaucuguauc

SEQ ID NO: 1387454 - RNA, 20 nt, Homo sapiens
aacuugcacgacgccugcca

SEQ ID NO: 1387455 - RNA, 12 nt, Homo sapiens
aacuugggccac

SEQ ID NO: 1387456 - RNA, 21 nt, Homo sapiens
aacuugggggaccucauuccu

SEQ ID NO: 1387457 - RNA, 12 nt, Homo sapiens
aacuuuccuuca

SEQ ID NO: 1387458 - RNA, 20 nt, Homo sapiens
aacuuuccuucauucaaccc

SEQ ID NO: 1387459 - RNA, 18 nt, Homo sapiens
aacuuugcuuaaacuaca

SEQ ID NO: 1387460 - RNA, 23 nt, Homo sapiens
aacuuuguuuagcccaaaaccaa

SEQ ID NO: 1387461 - RNA, 13 nt, Homo sapiens
aacuuuucuauua

SEQ ID NO: 1387462 - RNA, 17 nt, Homo sapiens
aacuuuugguaucuacu

SEQ ID NO: 1387463 - RNA, 21 nt, Homo sapiens
aagaaaaaaauaauuuuauga

SEQ ID NO: 1387464 - RNA, 16 nt, Homo sapiens
aagaaaacaucacuga

SEQ ID NO: 1387465 - RNA, 22 nt, Homo sapiens
aagaaaaguagguuuacauuca

SEQ ID NO: 1387466 - RNA, 14 nt, Homo sapiens
aagaaaaugauugc

SEQ ID NO: 1387467 - RNA, 15 nt, Homo sapiens
aagaaaaugauugcu

SEQ ID NO: 1387468 - RNA, 21 nt, Homo sapiens
aagaaaauguuacuucucuca

SEQ ID NO: 1387469 - RNA, 14 nt, Homo sapiens
aagaaagacuaucu

SEQ ID NO: 1387470 - RNA, 13 nt, Homo sapiens
aagaaaugcacaa

SEQ ID NO: 1387471 - RNA, 18 nt, Homo sapiens
aagaacucugggcugcua

SEQ ID NO: 1387472 - RNA, 20 nt, Homo sapiens
aagaacugacuagugagaug

SEQ ID NO: 1387473 - RNA, 12 nt, Homo sapiens
aagaagacauga

SEQ ID NO: 1387474 - RNA, 23 nt, Homo sapiens
aagaagcccaagauaucagccca

SEQ ID NO: 1387475 - RNA, 16 nt, Homo sapiens
aagaagugaccaagga

SEQ ID NO: 1387476 - RNA, 17 nt, Homo sapiens
aagaagugggacuuccc

SEQ ID NO: 1387477 - RNA, 14 nt, Homo sapiens
aagaaguugcucug

SEQ ID NO: 1387478 - RNA, 15 nt, Homo sapiens
aagaaguuugaccau

SEQ ID NO: 1387479 - RNA, 13 nt, Homo sapiens
aagaauacagaaa

SEQ ID NO: 1387480 - RNA, 17 nt, Homo sapiens
aagaaugaauaauaauu

SEQ ID NO: 1387481 - RNA, 12 nt, Homo sapiens
aagaaugcucuu

SEQ ID NO: 1387482 - RNA, 15 nt, Homo sapiens
aagacaaaugcugcg

SEQ ID NO: 1387483 - RNA, 16 nt, Homo sapiens
aagacaacauuucuca

SEQ ID NO: 1387484 - RNA, 17 nt, Homo sapiens
aagacaccguucauuca

SEQ ID NO: 1387485 - RNA, 16 nt, Homo sapiens
aagacagagcugggau

SEQ ID NO: 1387486 - RNA, 22 nt, Homo sapiens
aagacagugccuauacugccuc

SEQ ID NO: 1387487 - RNA, 13 nt, Homo sapiens
aagacuacugaag

SEQ ID NO: 1387488 - RNA, 17 nt, Homo sapiens
aagacuauauuguacac

SEQ ID NO: 1387489 - RNA, 17 nt, Homo sapiens
aagacuauugugccuua

SEQ ID NO: 1387490 - RNA, 15 nt, Homo sapiens
aagacuuaacugguu

SEQ ID NO: 1387491 - RNA, 19 nt, Homo sapiens
aagagaaaaaauauuuucc

SEQ ID NO: 1387492 - RNA, 14 nt, Homo sapiens
aagagaaugccauu

SEQ ID NO: 1387493 - RNA, 21 nt, Homo sapiens
aagagagaucuugauccacag

SEQ ID NO: 1387494 - RNA, 21 nt, Homo sapiens
aagagaggaaugccuguguga

SEQ ID NO: 1387495 - RNA, 20 nt, Homo sapiens
aagagaucacaauacucaaa

SEQ ID NO: 1387496 - RNA, 13 nt, Homo sapiens
aagagcaacaauc

SEQ ID NO: 1387497 - RNA, 11 nt, Homo sapiens
aagagccacag

SEQ ID NO: 1387498 - RNA, 19 nt, Homo sapiens
aagaggaugaagugauaug

SEQ ID NO: 1387499 - RNA, 12 nt, Homo sapiens
aagaggcuggau

SEQ ID NO: 1387500 - RNA, 12 nt, Homo sapiens
aagaggggaaaa

SEQ ID NO: 1387501 - RNA, 16 nt, Homo sapiens
aagagggucugaggaa

SEQ ID NO: 1387502 - RNA, 15 nt, Homo sapiens
aagagugagagggca

SEQ ID NO: 1387503 - RNA, 19 nt, Homo sapiens
aagagugccguaacaacug

SEQ ID NO: 1387504 - RNA, 14 nt, Homo sapiens
aagaguggaaccaa

SEQ ID NO: 1387505 - RNA, 11 nt, Homo sapiens
aagaguggucu

SEQ ID NO: 1387506 - RNA, 17 nt, Homo sapiens
aagagugguuaugccuc

SEQ ID NO: 1387507 - RNA, 21 nt, Homo sapiens
aagaguucuuaaggauuguga

SEQ ID NO: 1387508 - RNA, 14 nt, Homo sapiens
aagaguuuucuucc

SEQ ID NO: 1387509 - RNA, 14 nt, Homo sapiens
aagauaaaugugcu

SEQ ID NO: 1387510 - RNA, 19 nt, Homo sapiens
aagauaaaugugcugaaug

SEQ ID NO: 1387511 - RNA, 15 nt, Homo sapiens
aagauaagcuuccag

SEQ ID NO: 1387512 - RNA, 13 nt, Homo sapiens
aagauaauguugc

SEQ ID NO: 1387513 - RNA, 13 nt, Homo sapiens
aagauaucuugaa

SEQ ID NO: 1387514 - RNA, 22 nt, Homo sapiens
aagaucaggccaaccccaaaga

SEQ ID NO: 1387515 - RNA, 23 nt, Homo sapiens
aagaucaggccaaccccaaagaa

SEQ ID NO: 1387516 - RNA, 18 nt, Homo sapiens
aagauggcuuuuucuccu

SEQ ID NO: 1387517 - RNA, 22 nt, Homo sapiens
aagaugguauauuugguacugu

SEQ ID NO: 1387518 - RNA, 14 nt, Homo sapiens
aagaugucauccca

SEQ ID NO: 1387519 - RNA, 15 nt, Homo sapiens
aagaugugucuucaa

SEQ ID NO: 1387520 - RNA, 17 nt, Homo sapiens
aagauguucacuguggc

SEQ ID NO: 1387521 - RNA, 23 nt, Homo sapiens
aagauuccugguuaaauuugaau

SEQ ID NO: 1387522 - RNA, 21 nt, Homo sapiens
aagauugcgccauugcacucc

SEQ ID NO: 1387523 - RNA, 13 nt, Homo sapiens
aagauuugcccau

SEQ ID NO: 1387524 - RNA, 19 nt, Homo sapiens
aagauuuugaaugcuuccu

SEQ ID NO: 1387525 - RNA, 17 nt, Homo sapiens
aagcaaaaacgaaagcu

SEQ ID NO: 1387526 - RNA, 15 nt, Homo sapiens
aagcaaaacuuaacu

SEQ ID NO: 1387527 - RNA, 17 nt, Homo sapiens
aagcaacagauggauag

SEQ ID NO: 1387528 - RNA, 20 nt, Homo sapiens
aagcaacaucuagcaaaugu

SEQ ID NO: 1387529 - RNA, 18 nt, Homo sapiens
aagcaaggcuuuaaauga

SEQ ID NO: 1387530 - RNA, 14 nt, Homo sapiens
aagcaauaauaauu

SEQ ID NO: 1387531 - RNA, 14 nt, Homo sapiens
aagcagaagccaua

SEQ ID NO: 1387532 - RNA, 21 nt, Homo sapiens
aagcagaugcaaagaggcaag

SEQ ID NO: 1387533 - RNA, 15 nt, Homo sapiens
aagcagcucaaaggc

SEQ ID NO: 1387534 - RNA, 15 nt, Homo sapiens
aagcaggccuuuuga

SEQ ID NO: 1387535 - RNA, 21 nt, Homo sapiens
aagcagucaauuuucacauca

SEQ ID NO: 1387536 - RNA, 13 nt, Homo sapiens
aagcauaacuuau

SEQ ID NO: 1387537 - RNA, 13 nt, Homo sapiens
aagcauaagcaaa

SEQ ID NO: 1387538 - RNA, 16 nt, Homo sapiens
aagcauauuguuauua

SEQ ID NO: 1387539 - RNA, 15 nt, Homo sapiens
aagcaucaccucagg

SEQ ID NO: 1387540 - RNA, 21 nt, Homo sapiens
aagcaucucauuuugaguaga

SEQ ID NO: 1387541 - RNA, 14 nt, Homo sapiens
aagcaucuuccuua

SEQ ID NO: 1387542 - RNA, 15 nt, Homo sapiens
aagcaugaaaaagca

SEQ ID NO: 1387543 - RNA, 23 nt, Homo sapiens
aagcaugucucaauaguaaaaga

SEQ ID NO: 1387544 - RNA, 17 nt, Homo sapiens
aagccaaacucugccag

SEQ ID NO: 1387545 - RNA, 20 nt, Homo sapiens
aagccacagcuggugguauc

SEQ ID NO: 1387546 - RNA, 20 nt, Homo sapiens
aagccagacagcaacgggga

SEQ ID NO: 1387547 - RNA, 16 nt, Homo sapiens
aagccagcugcagcug

SEQ ID NO: 1387548 - RNA, 20 nt, Homo sapiens
aagccagcugcagcugggcu

SEQ ID NO: 1387549 - RNA, 15 nt, Homo sapiens
aagccccauccugcc

SEQ ID NO: 1387550 - RNA, 14 nt, Homo sapiens
aagcccuaagugac

SEQ ID NO: 1387551 - RNA, 20 nt, Homo sapiens
aagcccuccgccauucucaa

SEQ ID NO: 1387552 - RNA, 23 nt, Homo sapiens
aagccgccaggaccgccaaagaa

SEQ ID NO: 1387553 - RNA, 14 nt, Homo sapiens
aagccugugaaagg

SEQ ID NO: 1387554 - RNA, 21 nt, Homo sapiens
aagccuuuagagccagcccau

SEQ ID NO: 1387555 - RNA, 18 nt, Homo sapiens
aagcucaucucagcuccu

SEQ ID NO: 1387556 - RNA, 20 nt, Homo sapiens
aagcuccagaagaacaaaga

SEQ ID NO: 1387557 - RNA, 16 nt, Homo sapiens
aagcucugaagucaca

SEQ ID NO: 1387558 - RNA, 20 nt, Homo sapiens
aagcucuggugacaccagcc

SEQ ID NO: 1387559 - RNA, 21 nt, Homo sapiens
aagcucuggugacaccagccu

SEQ ID NO: 1387560 - RNA, 16 nt, Homo sapiens
aauacucaaaagagag

SEQ ID NO: 1387561 - RNA, 11 nt, Homo sapiens
aauacugaugg

SEQ ID NO: 1387562 - RNA, 21 nt, Homo sapiens
aauagaauauaauuaucggaa

SEQ ID NO: 1387563 - RNA, 23 nt, Homo sapiens
aauagcugggacuacagguguga

SEQ ID NO: 1387564 - RNA, 15 nt, Homo sapiens
aauagugauuuccac

SEQ ID NO: 1387565 - RNA, 19 nt, Homo sapiens
aauagugauuuccacagug

SEQ ID NO: 1387566 - RNA, 16 nt, Homo sapiens
aauauaaaaguaaaua

SEQ ID NO: 1387567 - RNA, 19 nt, Homo sapiens
aauauaauaugcacacagu

SEQ ID NO: 1387568 - RNA, 19 nt, Homo sapiens
aauauauaguggacaguaa

SEQ ID NO: 1387569 - RNA, 21 nt, Homo sapiens
acacugguuugagcuuaguga

SEQ ID NO: 1387570 - RNA, 13 nt, Homo sapiens
acacuguacucug

SEQ ID NO: 1387571 - RNA, 18 nt, Homo sapiens
acacuguauauaaacaua

SEQ ID NO: 1387572 - RNA, 23 nt, Homo sapiens
acacuugggauugucuuacuguu

SEQ ID NO: 1387573 - RNA, 17 nt, Homo sapiens
acagaaaaaaucgucuc

SEQ ID NO: 1387574 - RNA, 17 nt, Homo sapiens
acagaaagacugagcuc

SEQ ID NO: 1387575 - RNA, 14 nt, Homo sapiens
acagaacacugucu

SEQ ID NO: 1387576 - RNA, 23 nt, Homo sapiens
acagaagagugacauguuuacaa

SEQ ID NO: 1387577 - RNA, 16 nt, Homo sapiens
acagaaggaugaauga

SEQ ID NO: 1387578 - RNA, 20 nt, Homo sapiens
acagaagugcuuucuucucc

SEQ ID NO: 1387579 - RNA, 24 nt, Homo sapiens
acagaauugcuuguuugcuucaac

SEQ ID NO: 1387580 - RNA, 21 nt, Homo sapiens
acagacaauauggucccaaau

SEQ ID NO: 1387581 - RNA, 21 nt, Homo sapiens
acagacgucccuccacguuca

SEQ ID NO: 1387582 - RNA, 16 nt, Homo sapiens
acagacuggaagcaca

SEQ ID NO: 1387583 - RNA, 17 nt, Homo sapiens
acagacuucuccagacc

SEQ ID NO: 1387584 - RNA, 17 nt, Homo sapiens
acagagacaggcccaag

SEQ ID NO: 1387585 - RNA, 20 nt, Homo sapiens
acagagagacagacuugaga

SEQ ID NO: 1387586 - RNA, 20 nt, Homo sapiens
acagagauaauucuagcuuu

SEQ ID NO: 1387587 - RNA, 20 nt, Homo sapiens
acagagcaagacucugucuc

SEQ ID NO: 1387588 - RNA, 15 nt, Homo sapiens
acagagcagaacuuu

SEQ ID NO: 1387589 - RNA, 17 nt, Homo sapiens
acagagcagaacuuuca

SEQ ID NO: 1387590 - RNA, 15 nt, Homo sapiens
acagagcguccuucc

SEQ ID NO: 1387591 - RNA, 23 nt, Homo sapiens
acagagcugguugggaagacaug

SEQ ID NO: 1387592 - RNA, 22 nt, Homo sapiens
acagaucacagcuucagccagg

SEQ ID NO: 1387593 - RNA, 19 nt, Homo sapiens
acagauggauagucugucc

SEQ ID NO: 1387594 - RNA, 20 nt, Homo sapiens
acagauggcaggaugggcac

SEQ ID NO: 1387595 - RNA, 19 nt, Homo sapiens
acagauugcugcuucugcu

SEQ ID NO: 1387596 - RNA, 18 nt, Homo sapiens
acagcacccucuccagau

SEQ ID NO: 1387597 - RNA, 19 nt, Homo sapiens
acagcacccucuccagaug

SEQ ID NO: 1387598 - RNA, 18 nt, Homo sapiens
acagcagauacuuuguca

SEQ ID NO: 1387599 - RNA, 18 nt, Homo sapiens
acagcagcucaggcacac

SEQ ID NO: 1387600 - RNA, 23 nt, Homo sapiens
acagcaggcgccucgggucccag

SEQ ID NO: 1387601 - RNA, 14 nt, Homo sapiens
acagcauguguauu

SEQ ID NO: 1387602 - RNA, 12 nt, Homo sapiens
acagcauugcuu

SEQ ID NO: 1387603 - RNA, 17 nt, Homo sapiens
acagccaauacaauuag

SEQ ID NO: 1387604 - RNA, 19 nt, Homo sapiens
acagcuacacagaucacag

SEQ ID NO: 1387605 - RNA, 16 nt, Homo sapiens
acagcuaccaugacaa

SEQ ID NO: 1387606 - RNA, 16 nt, Homo sapiens
acagcuccuucugucc

SEQ ID NO: 1387607 - RNA, 22 nt, Homo sapiens
acagcuguaguaccccaagaag

SEQ ID NO: 1387608 - RNA, 15 nt, Homo sapiens
acagcugucccuguc

SEQ ID NO: 1387609 - RNA, 13 nt, Homo sapiens
acagcuucagcca

SEQ ID NO: 1387610 - RNA, 20 nt, Homo sapiens
acaggaagcaccccaugcca

SEQ ID NO: 1387611 - RNA, 15 nt, Homo sapiens
acaggagaccuggca

SEQ ID NO: 1387612 - RNA, 23 nt, Homo sapiens
acaggagcugggauccuaagggc

SEQ ID NO: 1387613 - RNA, 22 nt, Homo sapiens
acaggauggucucugccaugaa

SEQ ID NO: 1387614 - RNA, 18 nt, Homo sapiens
acaggauuuguaauuccu

SEQ ID NO: 1387615 - RNA, 13 nt, Homo sapiens
acaggcacccacc

SEQ ID NO: 1387616 - RNA, 14 nt, Homo sapiens
acaggcagcauuua

SEQ ID NO: 1387617 - RNA, 15 nt, Homo sapiens
acaggcagcauuuag

SEQ ID NO: 1387618 - RNA, 22 nt, Homo sapiens
acagggaacucagaauacagac

SEQ ID NO: 1387619 - RNA, 22 nt, Homo sapiens
acagggcauccaacugagaaaa

SEQ ID NO: 1387620 - RNA, 15 nt, Homo sapiens
acagggcauggccag

SEQ ID NO: 1387621 - RNA, 20 nt, Homo sapiens
acagggcgagacucugucuc

SEQ ID NO: 1387622 - RNA, 22 nt, Homo sapiens
acagguauucugcugaugcuac

SEQ ID NO: 1387623 - RNA, 19 nt, Homo sapiens
acaggucugggagaggcag

SEQ ID NO: 1387624 - RNA, 15 nt, Homo sapiens
acaggugugagucac

SEQ ID NO: 1387625 - RNA, 17 nt, Homo sapiens
acaguauacgcuccauc

SEQ ID NO: 1387626 - RNA, 14 nt, Homo sapiens
acaguauguucaaa

SEQ ID NO: 1387627 - RNA, 15 nt, Homo sapiens
acaguauuacuucug

SEQ ID NO: 1387628 - RNA, 20 nt, Homo sapiens
acaguauucuguaccauagc

SEQ ID NO: 1387629 - RNA, 14 nt, Homo sapiens
acaguauuuuccca

SEQ ID NO: 1387630 - RNA, 19 nt, Homo sapiens
acagugccuaauaauacug

SEQ ID NO: 1387631 - RNA, 19 nt, Homo sapiens
acaguguugaaaauguuca

SEQ ID NO: 1387632 - RNA, 14 nt, Homo sapiens
acaguguugcccag

SEQ ID NO: 1387633 - RNA, 18 nt, Homo sapiens
acaguuagguagcuuuag

SEQ ID NO: 1387634 - RNA, 13 nt, Homo sapiens
acaguuccuucag

SEQ ID NO: 1387635 - RNA, 16 nt, Homo sapiens
acaguuccuucagcuu

SEQ ID NO: 1387636 - RNA, 22 nt, Homo sapiens
acaguugaaaaacagcugaggg

SEQ ID NO: 1387637 - RNA, 14 nt, Homo sapiens
acaguuucuuccau

SEQ ID NO: 1387638 - RNA, 14 nt, Homo sapiens
acauaaagccuugg

SEQ ID NO: 1387639 - RNA, 21 nt, Homo sapiens
acauacaagcauaagcaaaac

SEQ ID NO: 1387640 - RNA, 19 nt, Homo sapiens
acauacaggccauacuuua

SEQ ID NO: 1387641 - RNA, 15 nt, Homo sapiens
acauacgucuuucac

SEQ ID NO: 1387642 - RNA, 14 nt, Homo sapiens
acauacuucagcuc

SEQ ID NO: 1387643 - RNA, 18 nt, Homo sapiens
acauacuuuuucaagauu

SEQ ID NO: 1387644 - RNA, 15 nt, Homo sapiens
acauaggcagcacua

SEQ ID NO: 1387645 - RNA, 13 nt, Homo sapiens
acauagugaaagu

SEQ ID NO: 1387646 - RNA, 22 nt, Homo sapiens
acauauuaggaaaauauggguu

SEQ ID NO: 1387647 - RNA, 16 nt, Homo sapiens
acauauuaugucuuca

SEQ ID NO: 1387648 - RNA, 23 nt, Homo sapiens
acauauuggaauguacaugucaa

SEQ ID NO: 1387649 - RNA, 22 nt, Homo sapiens
acaucaaagacagcaucuaaga

SEQ ID NO: 1387650 - RNA, 13 nt, Homo sapiens
acaucaagcacag

SEQ ID NO: 1387651 - RNA, 13 nt, Homo sapiens
acaucaaugauga

SEQ ID NO: 1387652 - RNA, 13 nt, Homo sapiens
acaucaauguuca

SEQ ID NO: 1387653 - RNA, 14 nt, Homo sapiens
acaucaauguucau

SEQ ID NO: 1387654 - RNA, 14 nt, Homo sapiens
acaucagcuagcaa

SEQ ID NO: 1387655 - RNA, 22 nt, Homo sapiens
acaucauccagaagacacacau

SEQ ID NO: 1387656 - RNA, 21 nt, Homo sapiens
acauccaaccccccaccugcc

SEQ ID NO: 1387657 - RNA, 16 nt, Homo sapiens
acaucccauugcccug

SEQ ID NO: 1387658 - RNA, 17 nt, Homo sapiens
acaucucuuugauguca

SEQ ID NO: 1387659 - RNA, 22 nt, Homo sapiens
acaucuggccuugaaaccaccu

SEQ ID NO: 1387660 - RNA, 18 nt, Homo sapiens
acaucuugcucugcugac

SEQ ID NO: 1387661 - RNA, 18 nt, Homo sapiens
acaucuuggucagauuug

SEQ ID NO: 1387662 - RNA, 11 nt, Homo sapiens
acaucuuucac

SEQ ID NO: 1387663 - RNA, 18 nt, Homo sapiens
acaucuuucacacuucca

SEQ ID NO: 1387664 - RNA, 17 nt, Homo sapiens
acaucuuuuacauucug

SEQ ID NO: 1387665 - RNA, 14 nt, Homo sapiens
acaugaagaagcua

SEQ ID NO: 1387666 - RNA, 13 nt, Homo sapiens
acaugaaugcaca

SEQ ID NO: 1387667 - RNA, 12 nt, Homo sapiens
acaugacuguuu

SEQ ID NO: 1387668 - RNA, 18 nt, Homo sapiens
acaugaucuucuuuauaa

SEQ ID NO: 1387669 - RNA, 23 nt, Homo sapiens
acaugcaaagauccccaaaacag

SEQ ID NO: 1387670 - RNA, 16 nt, Homo sapiens
acaugcaauuuugcau

SEQ ID NO: 1387671 - RNA, 19 nt, Homo sapiens
acaugcauacacucucaaa

SEQ ID NO: 1387672 - RNA, 20 nt, Homo sapiens
acaugcuaccugaucccacu

SEQ ID NO: 1387673 - RNA, 18 nt, Homo sapiens
acauggaauaacauguaa

SEQ ID NO: 1387674 - RNA, 23 nt, Homo sapiens
acauggugaaaccucaucucuac

SEQ ID NO: 1387675 - RNA, 18 nt, Homo sapiens
accuaagucucugugaau

SEQ ID NO: 1387676 - RNA, 12 nt, Homo sapiens
accuacuuugua

SEQ ID NO: 1387677 - RNA, 19 nt, Homo sapiens
accuagagcuagauguguc

SEQ ID NO: 1387678 - RNA, 13 nt, Homo sapiens
accuaggauuuca

SEQ ID NO: 1387679 - RNA, 14 nt, Homo sapiens
accuagggauguuc

SEQ ID NO: 1387680 - RNA, 18 nt, Homo sapiens
accuaguagucauuucau

SEQ ID NO: 1387681 - RNA, 13 nt, Homo sapiens
accuauaaaucau

SEQ ID NO: 1387682 - RNA, 15 nt, Homo sapiens
accuauaauaccagc

SEQ ID NO: 1387683 - RNA, 15 nt, Homo sapiens
accuauguuugcuca

SEQ ID NO: 1387684 - RNA, 19 nt, Homo sapiens
accuauucacugcuuaugc

SEQ ID NO: 1387685 - RNA, 15 nt, Homo sapiens
accucacgcaccucc

SEQ ID NO: 1387686 - RNA, 17 nt, Homo sapiens
accucacgcaccuccca

SEQ ID NO: 1387687 - RNA, 11 nt, Homo sapiens
accucagggcu

SEQ ID NO: 1387688 - RNA, 22 nt, Homo sapiens
accucauaucaguuugcuagca

SEQ ID NO: 1387689 - RNA, 15 nt, Homo sapiens
accucaucucuacua

SEQ ID NO: 1387690 - RNA, 17 nt, Homo sapiens
accuccaaaagcccuga

SEQ ID NO: 1387691 - RNA, 21 nt, Homo sapiens
accucggugggcccagugggg

SEQ ID NO: 1387692 - RNA, 13 nt, Homo sapiens
accucguccuccc

SEQ ID NO: 1387693 - RNA, 20 nt, Homo sapiens
accucgugauccaccugccu

SEQ ID NO: 1387694 - RNA, 15 nt, Homo sapiens
accucgugcuuuaag

SEQ ID NO: 1387695 - RNA, 20 nt, Homo sapiens
accucuagacugguucauuc

SEQ ID NO: 1387696 - RNA, 15 nt, Homo sapiens
accucugcacaagcu

SEQ ID NO: 1387697 - RNA, 17 nt, Homo sapiens
accucugggucaucucu

SEQ ID NO: 1387698 - RNA, 15 nt, Homo sapiens
accucuuaugcacac

SEQ ID NO: 1387699 - RNA, 15 nt, Homo sapiens
accucuugaaaauag

SEQ ID NO: 1387700 - RNA, 21 nt, Homo sapiens
accucuugaaaauagaacaac

SEQ ID NO: 1387701 - RNA, 14 nt, Homo sapiens
accugaacugaugg

SEQ ID NO: 1387702 - RNA, 16 nt, Homo sapiens
accugaacugaugggu

SEQ ID NO: 1387703 - RNA, 13 nt, Homo sapiens
accugaagacacc

SEQ ID NO: 1387704 - RNA, 12 nt, Homo sapiens
accugagcugcc

SEQ ID NO: 1387705 - RNA, 11 nt, Homo sapiens
accugagcuuu

SEQ ID NO: 1387706 - RNA, 15 nt, Homo sapiens
accugccacuaggcu

SEQ ID NO: 1387707 - RNA, 18 nt, Homo sapiens
accugggcaauauagcaa

SEQ ID NO: 1387708 - RNA, 16 nt, Homo sapiens
accuguaaucauauaa

SEQ ID NO: 1387709 - RNA, 19 nt, Homo sapiens
accuguccuugcacacucc

SEQ ID NO: 1387710 - RNA, 14 nt, Homo sapiens
accugugaccagca

SEQ ID NO: 1387711 - RNA, 23 nt, Homo sapiens
accuguuaucuguguuugcugag

SEQ ID NO: 1387712 - RNA, 21 nt, Homo sapiens
accuguugauagcaagugaau

SEQ ID NO: 1387713 - RNA, 19 nt, Homo sapiens
accuuaucuuaaagcacuu

SEQ ID NO: 1387714 - RNA, 19 nt, Homo sapiens
accuucaauaaaguaucua

SEQ ID NO: 1387715 - RNA, 15 nt, Homo sapiens
accuugaacacuggg

SEQ ID NO: 1387716 - RNA, 14 nt, Homo sapiens
accuugcaucucac

SEQ ID NO: 1387717 - RNA, 13 nt, Homo sapiens
accuuuucccaac

SEQ ID NO: 1387718 - RNA, 19 nt, Homo sapiens
accuuuuuggacacacaaa

SEQ ID NO: 1387719 - RNA, 11 nt, Homo sapiens
acgaaacugcu

SEQ ID NO: 1387720 - RNA, 13 nt, Homo sapiens
acgacaacgauga

SEQ ID NO: 1387721 - RNA, 21 nt, Homo sapiens
acgaggcugggccaagccagg

SEQ ID NO: 1387722 - RNA, 22 nt, Homo sapiens
acgauacuccaaccauauggau

SEQ ID NO: 1387723 - RNA, 15 nt, Homo sapiens
acgaucuuccuggcu

SEQ ID NO: 1387724 - RNA, 13 nt, Homo sapiens
acgauuugucagu

SEQ ID NO: 1387725 - RNA, 14 nt, Homo sapiens
acgcacacugucug

SEQ ID NO: 1387726 - RNA, 15 nt, Homo sapiens
acgccagaacugcuu

SEQ ID NO: 1387727 - RNA, 18 nt, Homo sapiens
acgccagaacugcuuuau

SEQ ID NO: 1387728 - RNA, 17 nt, Homo sapiens
acgccuccccuuuguga

SEQ ID NO: 1387729 - RNA, 17 nt, Homo sapiens
acgccuguaaucccagc

SEQ ID NO: 1387730 - RNA, 18 nt, Homo sapiens
acgccuguaaucccagca

SEQ ID NO: 1387731 - RNA, 17 nt, Homo sapiens
acgccuuguucuuggcc

SEQ ID NO: 1387732 - RNA, 16 nt, Homo sapiens
acggggcuugcaacuu

SEQ ID NO: 1387733 - RNA, 22 nt, Homo sapiens
acggggcuugcaacuuagcuca

SEQ ID NO: 1387734 - RNA, 21 nt, Homo sapiens
acguaaaaagaaaaaaaccau

SEQ ID NO: 1387735 - RNA, 16 nt, Homo sapiens
acgucaaacaugaagu

SEQ ID NO: 1387736 - RNA, 12 nt, Homo sapiens
acgucacacuug

SEQ ID NO: 1387737 - RNA, 16 nt, Homo sapiens
acguccaccccagugc

SEQ ID NO: 1387738 - RNA, 14 nt, Homo sapiens
acgucugacaggca

SEQ ID NO: 1387739 - RNA, 15 nt, Homo sapiens
acgugacuguggcac

SEQ ID NO: 1387740 - RNA, 20 nt, Homo sapiens
acgugacuguggcacacgcc

SEQ ID NO: 1387741 - RNA, 22 nt, Homo sapiens
acguggcccagagaagccaaaa

SEQ ID NO: 1387742 - RNA, 17 nt, Homo sapiens
acgugggcggcagagag

SEQ ID NO: 1387743 - RNA, 15 nt, Homo sapiens
acguggggcagcaca

SEQ ID NO: 1387744 - RNA, 18 nt, Homo sapiens
acguggggcagcacagag

SEQ ID NO: 1387745 - RNA, 22 nt, Homo sapiens
acguugccuaauaaacauccuu

SEQ ID NO: 1387746 - RNA, 15 nt, Homo sapiens
acuaacagauaagca

SEQ ID NO: 1387747 - RNA, 20 nt, Homo sapiens
acuaagcaguaagcuaucuu

SEQ ID NO: 1387748 - RNA, 20 nt, Homo sapiens
acuaagggauggggcagucu

SEQ ID NO: 1387749 - RNA, 16 nt, Homo sapiens
acuaauacagacuaug

SEQ ID NO: 1387750 - RNA, 17 nt, Homo sapiens
acuaauggaaauauuau

SEQ ID NO: 1387751 - RNA, 18 nt, Homo sapiens
acuacaauuuaaagcaaa

SEQ ID NO: 1387752 - RNA, 22 nt, Homo sapiens
acuacacauucaauaagcauca

SEQ ID NO: 1387753 - RNA, 13 nt, Homo sapiens
acuacacuccagc

SEQ ID NO: 1387754 - RNA, 19 nt, Homo sapiens
acuacagggaccagggaug

SEQ ID NO: 1387755 - RNA, 15 nt, Homo sapiens
acuacauacaagcau

SEQ ID NO: 1387756 - RNA, 20 nt, Homo sapiens
acuacauacaagcauaagca

SEQ ID NO: 1387757 - RNA, 17 nt, Homo sapiens
acuacaugcaaggcacu

SEQ ID NO: 1387758 - RNA, 19 nt, Homo sapiens
acuacucccucaaagcaca

SEQ ID NO: 1387759 - RNA, 14 nt, Homo sapiens
acuacugugaucag

SEQ ID NO: 1387760 - RNA, 15 nt, Homo sapiens
acuagaacucuccau

SEQ ID NO: 1387761 - RNA, 19 nt, Homo sapiens
acuauaucuguuuuacugc

SEQ ID NO: 1387762 - RNA, 16 nt, Homo sapiens
acuauauucucagugu

SEQ ID NO: 1387763 - RNA, 13 nt, Homo sapiens
acuaucaguuccc

SEQ ID NO: 1387764 - RNA, 15 nt, Homo sapiens
acuauccuaccccac

SEQ ID NO: 1387765 - RNA, 11 nt, Homo sapiens
acuaugcacaa

SEQ ID NO: 1387766 - RNA, 15 nt, Homo sapiens
acuauguugcccagg

SEQ ID NO: 1387767 - RNA, 18 nt, Homo sapiens
acuauguugcccaggcag

SEQ ID NO: 1387768 - RNA, 15 nt, Homo sapiens
acuauguuucuauuc

SEQ ID NO: 1387769 - RNA, 16 nt, Homo sapiens
acuauuaaaacagcca

SEQ ID NO: 1387770 - RNA, 20 nt, Homo sapiens
acuauugaaaucaagcuuau

SEQ ID NO: 1387771 - RNA, 18 nt, Homo sapiens
acuauugaaguugcagau

SEQ ID NO: 1387772 - RNA, 13 nt, Homo sapiens
acuauuuucauuc

SEQ ID NO: 1387773 - RNA, 12 nt, Homo sapiens
acucaacauguu

SEQ ID NO: 1387774 - RNA, 23 nt, Homo sapiens
acucaacauguuacugaccagca

SEQ ID NO: 1387775 - RNA, 20 nt, Homo sapiens
acucaaguccuuaccucuuc

SEQ ID NO: 1387776 - RNA, 14 nt, Homo sapiens
acucaaucauuucu

SEQ ID NO: 1387777 - RNA, 13 nt, Homo sapiens
acucaaucucuga

SEQ ID NO: 1387778 - RNA, 15 nt, Homo sapiens
acucacagucucuuu

SEQ ID NO: 1387779 - RNA, 12 nt, Homo sapiens
acucaccaucug

SEQ ID NO: 1387780 - RNA, 18 nt, Homo sapiens
acucacuggcaucuuugc

SEQ ID NO: 1387781 - RNA, 20 nt, Homo sapiens
acucagccaaccuuacuuac

SEQ ID NO: 1387782 - RNA, 22 nt, Homo sapiens
acucaggaugcccagggccacu

SEQ ID NO: 1387783 - RNA, 18 nt, Homo sapiens
acucaggccaacaagcca

SEQ ID NO: 1387784 - RNA, 11 nt, Homo sapiens
acauugaacaa

SEQ ID NO: 1387785 - RNA, 20 nt, Homo sapiens
acauugaccaagaacugcau

SEQ ID NO: 1387786 - RNA, 12 nt, Homo sapiens
acauugugccuu

SEQ ID NO: 1387787 - RNA, 21 nt, Homo sapiens
acauuguuuuguguaacauau

SEQ ID NO: 1387788 - RNA, 14 nt, Homo sapiens
acauuuacugugga

SEQ ID NO: 1387789 - RNA, 15 nt, Homo sapiens
acauuuacuguggau

SEQ ID NO: 1387790 - RNA, 21 nt, Homo sapiens
acauuuauagauaauugauau

SEQ ID NO: 1387791 - RNA, 22 nt, Homo sapiens
accaaagccaccagacugacaa

SEQ ID NO: 1387792 - RNA, 17 nt, Homo sapiens
accaaaucagcugcuac

SEQ ID NO: 1387793 - RNA, 13 nt, Homo sapiens
accaaauuuguau

SEQ ID NO: 1387794 - RNA, 19 nt, Homo sapiens
accaacaguuccuucagcu

SEQ ID NO: 1387795 - RNA, 14 nt, Homo sapiens
accaacauggagaa

SEQ ID NO: 1387796 - RNA, 17 nt, Homo sapiens
accaaccuuuucccaac

SEQ ID NO: 1387797 - RNA, 18 nt, Homo sapiens
accaacuauagaauguau

SEQ ID NO: 1387798 - RNA, 14 nt, Homo sapiens
accaagaacugcau

SEQ ID NO: 1387799 - RNA, 13 nt, Homo sapiens
accaagcaggaag

SEQ ID NO: 1387800 - RNA, 17 nt, Homo sapiens
accaauaaagccuucaa

SEQ ID NO: 1387801 - RNA, 16 nt, Homo sapiens
accaauaccuccucca

SEQ ID NO: 1387802 - RNA, 13 nt, Homo sapiens
accaauagcuuua

SEQ ID NO: 1387803 - RNA, 12 nt, Homo sapiens
accaauguagaa

SEQ ID NO: 1387804 - RNA, 23 nt, Homo sapiens
accacaggcagcauuuagcacau

SEQ ID NO: 1387805 - RNA, 14 nt, Homo sapiens
accacauagacuuu

SEQ ID NO: 1387806 - RNA, 17 nt, Homo sapiens
accacaucccacucaca

SEQ ID NO: 1387807 - RNA, 22 nt, Homo sapiens
accacaucccacucacaacagc

SEQ ID NO: 1387808 - RNA, 18 nt, Homo sapiens
accacaucuugcucugcu

SEQ ID NO: 1387809 - RNA, 18 nt, Homo sapiens
accacaugugcacaugca

SEQ ID NO: 1387810 - RNA, 21 nt, Homo sapiens
accacggccucacccaggcau

SEQ ID NO: 1387811 - RNA, 23 nt, Homo sapiens
accacuacaugcagcccaugccc

SEQ ID NO: 1387812 - RNA, 21 nt, Homo sapiens
accacuauucuuaacuauuca

SEQ ID NO: 1387813 - RNA, 14 nt, Homo sapiens
accacuggagauca

SEQ ID NO: 1387814 - RNA, 23 nt, Homo sapiens
accacuguaagugagaacaaauu

SEQ ID NO: 1387815 - RNA, 22 nt, Homo sapiens
accacuuuccccgugggccaug

SEQ ID NO: 1387816 - RNA, 15 nt, Homo sapiens
accagaaccuggaca

SEQ ID NO: 1387817 - RNA, 22 nt, Homo sapiens
accagagaagggcuuggacuca

SEQ ID NO: 1387818 - RNA, 23 nt, Homo sapiens
accagagaagggcuuggacucaa

SEQ ID NO: 1387819 - RNA, 18 nt, Homo sapiens
accagagcacuguauacc

SEQ ID NO: 1387820 - RNA, 15 nt, Homo sapiens
accagagcucuggag

SEQ ID NO: 1387821 - RNA, 16 nt, Homo sapiens
accagaggucaggugu

SEQ ID NO: 1387822 - RNA, 17 nt, Homo sapiens
accagauugucagcucc

SEQ ID NO: 1387823 - RNA, 12 nt, Homo sapiens
accagauuugcu

SEQ ID NO: 1387824 - RNA, 22 nt, Homo sapiens
accagccaagagggcugcaaaa

SEQ ID NO: 1387825 - RNA, 17 nt, Homo sapiens
accagccugcacuacuc

SEQ ID NO: 1387826 - RNA, 22 nt, Homo sapiens
accaggaaccuccuccacacca

SEQ ID NO: 1387827 - RNA, 17 nt, Homo sapiens
accaggcccacagccca

SEQ ID NO: 1387828 - RNA, 22 nt, Homo sapiens
accagguagaacacaaggucau

SEQ ID NO: 1387829 - RNA, 15 nt, Homo sapiens
accaggucaucuccu

SEQ ID NO: 1387830 - RNA, 17 nt, Homo sapiens
accaggucucccgggaa

SEQ ID NO: 1387831 - RNA, 18 nt, Homo sapiens
accagucugaaguuucau

SEQ ID NO: 1387832 - RNA, 13 nt, Homo sapiens
accaguguagccu

SEQ ID NO: 1387833 - RNA, 18 nt, Homo sapiens
accaucccaccucuggau

SEQ ID NO: 1387834 - RNA, 16 nt, Homo sapiens
accaugaaauauccag

SEQ ID NO: 1387835 - RNA, 21 nt, Homo sapiens
accaugaacacguuuuuucac

SEQ ID NO: 1387836 - RNA, 23 nt, Homo sapiens
accaugauuaaccacuucagcug

SEQ ID NO: 1387837 - RNA, 17 nt, Homo sapiens
accaugcccagcucaga

SEQ ID NO: 1387838 - RNA, 24 nt, Homo sapiens
accaugccucuccaacaucuucaa

SEQ ID NO: 1387839 - RNA, 15 nt, Homo sapiens
accauguacauagcu

SEQ ID NO: 1387840 - RNA, 17 nt, Homo sapiens
accauguuagccaggau

SEQ ID NO: 1387841 - RNA, 18 nt, Homo sapiens
accauuagcauuugucaa

SEQ ID NO: 1387842 - RNA, 14 nt, Homo sapiens
acccaaaguaucag

SEQ ID NO: 1387843 - RNA, 12 nt, Homo sapiens
acccacccagga

SEQ ID NO: 1387844 - RNA, 14 nt, Homo sapiens
acccaccccagugc

SEQ ID NO: 1387845 - RNA, 12 nt, Homo sapiens
acccaccucagc

SEQ ID NO: 1387846 - RNA, 14 nt, Homo sapiens
acccaccucagccu

SEQ ID NO: 1387847 - RNA, 21 nt, Homo sapiens
acccacugcuuuuggucugug

SEQ ID NO: 1387848 - RNA, 20 nt, Homo sapiens
acccagagaaccugcuuuac

SEQ ID NO: 1387849 - RNA, 23 nt, Homo sapiens
acccaguguuuuaggagcaugag

SEQ ID NO: 1387850 - RNA, 14 nt, Homo sapiens
acccauauuacaga

SEQ ID NO: 1387851 - RNA, 20 nt, Homo sapiens
acccauucguggugaucaau

SEQ ID NO: 1387852 - RNA, 13 nt, Homo sapiens
accccaacagcac

SEQ ID NO: 1387853 - RNA, 18 nt, Homo sapiens
accccaacagcacccucu

SEQ ID NO: 1387854 - RNA, 22 nt, Homo sapiens
accccaacagcacccucuccag

SEQ ID NO: 1387855 - RNA, 15 nt, Homo sapiens
accccaagcaggaac

SEQ ID NO: 1387856 - RNA, 13 nt, Homo sapiens
accccaccuugcc

SEQ ID NO: 1387857 - RNA, 15 nt, Homo sapiens
accccaguaagccac

SEQ ID NO: 1387858 - RNA, 21 nt, Homo sapiens
acccccagcaacccuccuauc

SEQ ID NO: 1387859 - RNA, 15 nt, Homo sapiens
accccccagaaccug

SEQ ID NO: 1387860 - RNA, 14 nt, Homo sapiens
acccccuucagugc

SEQ ID NO: 1387861 - RNA, 13 nt, Homo sapiens
accccuacaugaa

SEQ ID NO: 1387862 - RNA, 18 nt, Homo sapiens
accccuccuuccuugacc

SEQ ID NO: 1387863 - RNA, 18 nt, Homo sapiens
accccugaccucacugug

SEQ ID NO: 1387864 - RNA, 23 nt, Homo sapiens
accccugcccugggauguccaca

SEQ ID NO: 1387865 - RNA, 15 nt, Homo sapiens
accccugcuaaggag

SEQ ID NO: 1387866 - RNA, 17 nt, Homo sapiens
accccugcuauauacua

SEQ ID NO: 1387867 - RNA, 15 nt, Homo sapiens
accccuuagccuccc

SEQ ID NO: 1387868 - RNA, 22 nt, Homo sapiens
acccuaaaaagcagagcuuugc

SEQ ID NO: 1387869 - RNA, 13 nt, Homo sapiens
acccuagucccuu

SEQ ID NO: 1387870 - RNA, 14 nt, Homo sapiens
acccucaauucaua

SEQ ID NO: 1387871 - RNA, 19 nt, Homo sapiens
acccucagaugcacaugag

SEQ ID NO: 1387872 - RNA, 16 nt, Homo sapiens
acccucccacugccaa

SEQ ID NO: 1387873 - RNA, 14 nt, Homo sapiens
acccucccagcucu

SEQ ID NO: 1387874 - RNA, 22 nt, Homo sapiens
acccuccuuucaccacaugugc

SEQ ID NO: 1387875 - RNA, 14 nt, Homo sapiens
acccucgaugaagc

SEQ ID NO: 1387876 - RNA, 22 nt, Homo sapiens
acccugauuuuacacacauuaa

SEQ ID NO: 1387877 - RNA, 23 nt, Homo sapiens
acccugauuuuacacacauuaaa

SEQ ID NO: 1387878 - RNA, 17 nt, Homo sapiens
acccugcaaaggacugu

SEQ ID NO: 1387879 - RNA, 16 nt, Homo sapiens
acccugcauguuggcc

SEQ ID NO: 1387880 - RNA, 21 nt, Homo sapiens
acccuggagcccauccagucu

SEQ ID NO: 1387881 - RNA, 23 nt, Homo sapiens
acccuggagcccauccagucucc

SEQ ID NO: 1387882 - RNA, 20 nt, Homo sapiens
acccuggaucaguccuuuga

SEQ ID NO: 1387883 - RNA, 19 nt, Homo sapiens
acccuguagguucuugaua

SEQ ID NO: 1387884 - RNA, 22 nt, Homo sapiens
acccugucaaguuaacaaggaa

SEQ ID NO: 1387885 - RNA, 14 nt, Homo sapiens
acccuguuuuacaa

SEQ ID NO: 1387886 - RNA, 17 nt, Homo sapiens
acccuucuuuucugacu

SEQ ID NO: 1387887 - RNA, 17 nt, Homo sapiens
acccuugaaaagacauc

SEQ ID NO: 1387888 - RNA, 19 nt, Homo sapiens
acccuuguguccacuguga

SEQ ID NO: 1387889 - RNA, 16 nt, Homo sapiens
accgagucucuucucc

SEQ ID NO: 1387890 - RNA, 21 nt, Homo sapiens
accgagucucuucuccacugg

SEQ ID NO: 1387891 - RNA, 14 nt, Homo sapiens
agcucuacugaggu

SEQ ID NO: 1387892 - RNA, 13 nt, Homo sapiens
agcucugaaguca

SEQ ID NO: 1387893 - RNA, 16 nt, Homo sapiens
aggcauccuuccucac

SEQ ID NO: 1387894 - RNA, 17 nt, Homo sapiens
aguuuauugacaauaau

SEQ ID NO: 1387895 - RNA, 14 nt, Homo sapiens
aguuucacugacuu

SEQ ID NO: 1387896 - RNA, 20 nt, Homo sapiens
aguuucauuuaugauacaaa

SEQ ID NO: 1387897 - RNA, 14 nt, Homo sapiens
aguuucuucaaucu

SEQ ID NO: 1387898 - RNA, 14 nt, Homo sapiens
aguuucuuccauuc

SEQ ID NO: 1387899 - RNA, 17 nt, Homo sapiens
aguuugcaaugucacaa

SEQ ID NO: 1387900 - RNA, 19 nt, Homo sapiens
aguuugcuuuguaugcacu

SEQ ID NO: 1387901 - RNA, 17 nt, Homo sapiens
aguuuguuuauuacuua

SEQ ID NO: 1387902 - RNA, 18 nt, Homo sapiens
aguuuguuuauuacuuau

SEQ ID NO: 1387903 - RNA, 14 nt, Homo sapiens
aguuuuaaacuggu

SEQ ID NO: 1387904 - RNA, 13 nt, Homo sapiens
aguuuuaguugca

SEQ ID NO: 1387905 - RNA, 23 nt, Homo sapiens
aguuuuccuucucaucugugauu

SEQ ID NO: 1387906 - RNA, 22 nt, Homo sapiens
aguuuuucaauuaguaacauuc

SEQ ID NO: 1387907 - RNA, 16 nt, Homo sapiens
auaaaaacccaauuca

SEQ ID NO: 1387908 - RNA, 19 nt, Homo sapiens
auaaaaacucauccauggc

SEQ ID NO: 1387909 - RNA, 20 nt, Homo sapiens
auaaaaaucauucuacugaa

SEQ ID NO: 1387910 - RNA, 22 nt, Homo sapiens
auaaaaugacaucccauuaauu

SEQ ID NO: 1387911 - RNA, 13 nt, Homo sapiens
auaaaaugugauu

SEQ ID NO: 1387912 - RNA, 20 nt, Homo sapiens
auaaaauuaugccauagcaa

SEQ ID NO: 1387913 - RNA, 19 nt, Homo sapiens
auaaacaagaucgucagga

SEQ ID NO: 1387914 - RNA, 17 nt, Homo sapiens
auaaacgguuaacaaua

SEQ ID NO: 1387915 - RNA, 18 nt, Homo sapiens
auaaagacaaaugcugcg

SEQ ID NO: 1387916 - RNA, 15 nt, Homo sapiens
auaaagaccugagaa

SEQ ID NO: 1387917 - RNA, 13 nt, Homo sapiens
auaaagauguuau

SEQ ID NO: 1387918 - RNA, 13 nt, Homo sapiens
auaaaggacagug

SEQ ID NO: 1387919 - RNA, 20 nt, Homo sapiens
auaaaggcauuucaaagucu

SEQ ID NO: 1387920 - RNA, 22 nt, Homo sapiens
auaaaggcccagacuccauggu

SEQ ID NO: 1387921 - RNA, 20 nt, Homo sapiens
auaaaggggagggacucauc

SEQ ID NO: 1387922 - RNA, 19 nt, Homo sapiens
auaaaguauuccaccuuaa

SEQ ID NO: 1387923 - RNA, 13 nt, Homo sapiens
auaaagugacaga

SEQ ID NO: 1387924 - RNA, 13 nt, Homo sapiens
auaaagugcuuua

SEQ ID NO: 1387925 - RNA, 15 nt, Homo sapiens
auaaagugcuuuaaa

SEQ ID NO: 1387926 - RNA, 17 nt, Homo sapiens
auaaaguuggugacaga

SEQ ID NO: 1387927 - RNA, 15 nt, Homo sapiens
auaaauaaaguuucu

SEQ ID NO: 1387928 - RNA, 14 nt, Homo sapiens
auaaauaugcucag

SEQ ID NO: 1387929 - RNA, 17 nt, Homo sapiens
auaaauguacauuaauu

SEQ ID NO: 1387930 - RNA, 21 nt, Homo sapiens
auaaaugucuuaaucaugaga

SEQ ID NO: 1387931 - RNA, 18 nt, Homo sapiens
auaaauugcuccuugaca

SEQ ID NO: 1387932 - RNA, 17 nt, Homo sapiens
auaaauuuuauaaucau

SEQ ID NO: 1387933 - RNA, 13 nt, Homo sapiens
auaacaaucacaa

SEQ ID NO: 1387934 - RNA, 22 nt, Homo sapiens
auaacacagagagacagacuug

SEQ ID NO: 1387935 - RNA, 13 nt, Homo sapiens
auaacagccucau

SEQ ID NO: 1387936 - RNA, 20 nt, Homo sapiens
auaaccccagcucccuagga

SEQ ID NO: 1387937 - RNA, 18 nt, Homo sapiens
auaacuaguguugcuugg

SEQ ID NO: 1387938 - RNA, 21 nt, Homo sapiens
auaacuuaaaaaaaugacaga

SEQ ID NO: 1387939 - RNA, 20 nt, Homo sapiens
auaacuuuguuuagcccaaa

SEQ ID NO: 1387940 - RNA, 11 nt, Homo sapiens
auaagcaagag

SEQ ID NO: 1387941 - RNA, 16 nt, Homo sapiens
auaagcagaagccaua

SEQ ID NO: 1387942 - RNA, 18 nt, Homo sapiens
auaagcuaaagaggcuga

SEQ ID NO: 1387943 - RNA, 15 nt, Homo sapiens
auaaggaaagcaaua

SEQ ID NO: 1387944 - RNA, 16 nt, Homo sapiens
auaaggaaagcaauaa

SEQ ID NO: 1387945 - RNA, 19 nt, Homo sapiens
auaaggaucagaacagcag

SEQ ID NO: 1387946 - RNA, 17 nt, Homo sapiens
auaaguaucacacugua

SEQ ID NO: 1387947 - RNA, 19 nt, Homo sapiens
auaagucaauuccuagaag

SEQ ID NO: 1387948 - RNA, 18 nt, Homo sapiens
auaauaaaaggaguucag

SEQ ID NO: 1387949 - RNA, 19 nt, Homo sapiens
auaauaaacaacauugucu

SEQ ID NO: 1387950 - RNA, 17 nt, Homo sapiens
auaauaaagaugcucuu

SEQ ID NO: 1387951 - RNA, 18 nt, Homo sapiens
auaauaaaggcauuucaa

SEQ ID NO: 1387952 - RNA, 14 nt, Homo sapiens
auaauauacuaugc

SEQ ID NO: 1387953 - RNA, 22 nt, Homo sapiens
auaaucaaaacccaacaugacu

SEQ ID NO: 1387954 - RNA, 19 nt, Homo sapiens
auaaucacauuaucaucug

SEQ ID NO: 1387955 - RNA, 12 nt, Homo sapiens
auaaucuacucc

SEQ ID NO: 1387956 - RNA, 14 nt, Homo sapiens
auaaugcaauagaa

SEQ ID NO: 1387957 - RNA, 18 nt, Homo sapiens
auaaugcuguugccucau

SEQ ID NO: 1387958 - RNA, 18 nt, Homo sapiens
auaauggggccuguuaca

SEQ ID NO: 1387959 - RNA, 14 nt, Homo sapiens
auaaugucuuguua

SEQ ID NO: 1387960 - RNA, 19 nt, Homo sapiens
auaauguuaacauggacau

SEQ ID NO: 1387961 - RNA, 21 nt, Homo sapiens
auaauguuacauuauuaucaa

SEQ ID NO: 1387962 - RNA, 17 nt, Homo sapiens
auaauuacauauuugca

SEQ ID NO: 1387963 - RNA, 19 nt, Homo sapiens
auaauuccauaugcuguuu

SEQ ID NO: 1387964 - RNA, 22 nt, Homo sapiens
auaauucuuuucuuuuccauuu

SEQ ID NO: 1387965 - RNA, 17 nt, Homo sapiens
auaauugccacugagag

SEQ ID NO: 1387966 - RNA, 15 nt, Homo sapiens
auaauuuaacuucag

SEQ ID NO: 1387967 - RNA, 15 nt, Homo sapiens
auacaaaaauuccuu

SEQ ID NO: 1387968 - RNA, 19 nt, Homo sapiens
auacaauuccaaacacaua

SEQ ID NO: 1387969 - RNA, 22 nt, Homo sapiens
auacacacacacgcgugcacac

SEQ ID NO: 1387970 - RNA, 16 nt, Homo sapiens
auacagauagauauau

SEQ ID NO: 1387971 - RNA, 15 nt, Homo sapiens
auacagaugacaaug

SEQ ID NO: 1387972 - RNA, 16 nt, Homo sapiens
auacagaugacaaugg

SEQ ID NO: 1387973 - RNA, 23 nt, Homo sapiens
auacagccaaagauaaucucuca

SEQ ID NO: 1387974 - RNA, 23 nt, Homo sapiens
auacagguauucugcugaugcua

SEQ ID NO: 1387975 - RNA, 14 nt, Homo sapiens
auacaguaucucag

SEQ ID NO: 1387976 - RNA, 21 nt, Homo sapiens
auacaguauucuguaccauag

SEQ ID NO: 1387977 - RNA, 14 nt, Homo sapiens
auacaugcauacac

SEQ ID NO: 1387978 - RNA, 14 nt, Homo sapiens
auacauggguagcu

SEQ ID NO: 1387979 - RNA, 19 nt, Homo sapiens
auacauggguagcuucuga

SEQ ID NO: 1387980 - RNA, 21 nt, Homo sapiens
auacaugucuuucuccaggga

SEQ ID NO: 1387981 - RNA, 18 nt, Homo sapiens
auacauuaaagcagucac

SEQ ID NO: 1387982 - RNA, 15 nt, Homo sapiens
auacauuugauaaag

SEQ ID NO: 1387983 - RNA, 13 nt, Homo sapiens
auaccaacuuuag

SEQ ID NO: 1387984 - RNA, 19 nt, Homo sapiens
auaccaagaugccaucugu

SEQ ID NO: 1387985 - RNA, 13 nt, Homo sapiens
auaccaagcuugu

SEQ ID NO: 1387986 - RNA, 12 nt, Homo sapiens
auaccagcaaua

SEQ ID NO: 1387987 - RNA, 22 nt, Homo sapiens
auaccauguacauaauucuugc

SEQ ID NO: 1387988 - RNA, 21 nt, Homo sapiens
auacccuccuuccaccaaguu

SEQ ID NO: 1387989 - RNA, 18 nt, Homo sapiens
auacuaaaaaucaugaga

SEQ ID NO: 1387990 - RNA, 17 nt, Homo sapiens
auacuaaauuauagugu

SEQ ID NO: 1387991 - RNA, 18 nt, Homo sapiens
auacuaagggaagaaaca

SEQ ID NO: 1387992 - RNA, 17 nt, Homo sapiens
auacuauuuucauucuc

SEQ ID NO: 1387993 - RNA, 17 nt, Homo sapiens
auacucaaaagagagag

SEQ ID NO: 1387994 - RNA, 17 nt, Homo sapiens
auacucacuuucccaaa

SEQ ID NO: 1387995 - RNA, 14 nt, Homo sapiens
auacugaguaugug

SEQ ID NO: 1387996 - RNA, 13 nt, Homo sapiens
auacuuuacaugg

SEQ ID NO: 1387997 - RNA, 23 nt, Homo sapiens
auagaagaaaaaagaaugucaga

SEQ ID NO: 1387998 - RNA, 16 nt, Homo sapiens
auagaagugauugaau

SEQ ID NO: 1387999 - RNA, 22 nt, Homo sapiens
auagagggucuaagauucaucc

SEQ ID NO: 1388000 - RNA, 20 nt, Homo sapiens
auagauauaugcucugcaug

SEQ ID NO: 1388001 - RNA, 13 nt, Homo sapiens
auagcaagacaca

SEQ ID NO: 1388002 - RNA, 15 nt, Homo sapiens
auagcaagaucccau

SEQ ID NO: 1388003 - RNA, 23 nt, Homo sapiens
auagcaguugaaacaagaagcca

SEQ ID NO: 1388004 - RNA, 12 nt, Homo sapiens
auagccaaaaau

SEQ ID NO: 1388005 - RNA, 14 nt, Homo sapiens
auagccaacugcug

SEQ ID NO: 1388006 - RNA, 16 nt, Homo sapiens
cauacagagacagaua

SEQ ID NO: 1388007 - RNA, 19 nt, Homo sapiens
cauacagagacagauauac

SEQ ID NO: 1388008 - RNA, 20 nt, Homo sapiens
cauacaugcauacacucuca

SEQ ID NO: 1388009 - RNA, 18 nt, Homo sapiens
cauacuacauacaagcau

SEQ ID NO: 1388010 - RNA, 18 nt, Homo sapiens
cauuagaccaagcuuguc

SEQ ID NO: 1388011 - RNA, 20 nt, Homo sapiens
cauuagccuaugugcaugca

SEQ ID NO: 1388012 - RNA, 18 nt, Homo sapiens
cauuaucgggagcagugu

SEQ ID NO: 1388013 - RNA, 19 nt, Homo sapiens
cauuaucuugcagcuguaa

SEQ ID NO: 1388014 - RNA, 22 nt, Homo sapiens
cauuaucuugcagcuguaaaca

SEQ ID NO: 1388015 - RNA, 16 nt, Homo sapiens
cauuaugagaggcaau

SEQ ID NO: 1388016 - RNA, 19 nt, Homo sapiens
cauuauuaaauguuucuca

SEQ ID NO: 1388017 - RNA, 18 nt, Homo sapiens
cauucaauguuuaugcaa

SEQ ID NO: 1388018 - RNA, 19 nt, Homo sapiens
cauucacccagacagcucc

SEQ ID NO: 1388019 - RNA, 19 nt, Homo sapiens
cauucaggcaacgcacaaa

SEQ ID NO: 1388020 - RNA, 18 nt, Homo sapiens
cauuccagacugcuucca

SEQ ID NO: 1388021 - RNA, 21 nt, Homo sapiens
cauucuacguaucugcuacuu

SEQ ID NO: 1388022 - RNA, 14 nt, Homo sapiens
cauucucaagcccu

SEQ ID NO: 1388023 - RNA, 18 nt, Homo sapiens
cauucugcaagcacaucu

SEQ ID NO: 1388024 - RNA, 10 nt, Homo sapiens
cauugaacaa

SEQ ID NO: 1388025 - RNA, 18 nt, Homo sapiens
cauugaaguaaugaauuu

SEQ ID NO: 1388026 - RNA, 13 nt, Homo sapiens
cauugaugacccu

SEQ ID NO: 1388027 - RNA, 18 nt, Homo sapiens
cauugcacuccagccugg

SEQ ID NO: 1388028 - RNA, 13 nt, Homo sapiens
cauugcagucugc

SEQ ID NO: 1388029 - RNA, 17 nt, Homo sapiens
cauugcuuuccacugag

SEQ ID NO: 1388030 - RNA, 15 nt, Homo sapiens
cauuggacuuccucc

SEQ ID NO: 1388031 - RNA, 14 nt, Homo sapiens
cauugggauauucu

SEQ ID NO: 1388032 - RNA, 20 nt, Homo sapiens
cauuguaaacaaacugugua

SEQ ID NO: 1388033 - RNA, 19 nt, Homo sapiens
cauuguugagguggucuga

SEQ ID NO: 1388034 - RNA, 18 nt, Homo sapiens
cauuguuuauuguauacu

SEQ ID NO: 1388035 - RNA, 18 nt, Homo sapiens
cauuuaaaaaaaaucccu

SEQ ID NO: 1388036 - RNA, 21 nt, Homo sapiens
cauuuacuuguacgagacaga

SEQ ID NO: 1388037 - RNA, 14 nt, Homo sapiens
cauuuagcacaaaa

SEQ ID NO: 1388038 - RNA, 12 nt, Homo sapiens
cauuuagcacau

SEQ ID NO: 1388039 - RNA, 15 nt, Homo sapiens
cauuuauuauuucaa

SEQ ID NO: 1388040 - RNA, 21 nt, Homo sapiens
cauuucuauuuauuuacugag

SEQ ID NO: 1388041 - RNA, 19 nt, Homo sapiens
cauuucucaaaugcacauc

SEQ ID NO: 1388042 - RNA, 15 nt, Homo sapiens
cauuucucucuccag

SEQ ID NO: 1388043 - RNA, 20 nt, Homo sapiens
cauuucugagaucaaaacgg

SEQ ID NO: 1388044 - RNA, 16 nt, Homo sapiens
cauuugaaaucuauga

SEQ ID NO: 1388045 - RNA, 16 nt, Homo sapiens
cauuugcaccuaccuc

SEQ ID NO: 1388046 - RNA, 18 nt, Homo sapiens
cauuuggccuugugcggu

SEQ ID NO: 1388047 - RNA, 17 nt, Homo sapiens
cauuugugugugugcaa

SEQ ID NO: 1388048 - RNA, 17 nt, Homo sapiens
cauuuuaaugcaccuga

SEQ ID NO: 1388049 - RNA, 17 nt, Homo sapiens
cauuuuaugucauuaaa

SEQ ID NO: 1388050 - RNA, 16 nt, Homo sapiens
cauuuucugcauuuaa

SEQ ID NO: 1388051 - RNA, 19 nt, Homo sapiens
cauuuugcaaaauuuccag

SEQ ID NO: 1388052 - RNA, 15 nt, Homo sapiens
cauuuuggucucuau

SEQ ID NO: 1388053 - RNA, 21 nt, Homo sapiens
cauuuuuaguagagacagggu

SEQ ID NO: 1388054 - RNA, 18 nt, Homo sapiens
cauuuuuaucccauugag

SEQ ID NO: 1388055 - RNA, 22 nt, Homo sapiens
cauuuuuauuacccuucuuucc

SEQ ID NO: 1388056 - RNA, 20 nt, Homo sapiens
ccaaaaagggauccguacau

SEQ ID NO: 1388057 - RNA, 18 nt, Homo sapiens
ccaaaauaaaaccagcuc

SEQ ID NO: 1388058 - RNA, 19 nt, Homo sapiens
ccaaagagaaugccauucu

SEQ ID NO: 1388059 - RNA, 19 nt, Homo sapiens
ccaaagagcugccuaagag

SEQ ID NO: 1388060 - RNA, 23 nt, Homo sapiens
ccaaagagcugccuaagaggcaa

SEQ ID NO: 1388061 - RNA, 18 nt, Homo sapiens
ccaaagcagcacuuauaa

SEQ ID NO: 1388062 - RNA, 14 nt, Homo sapiens
ccaaaguaaauguc

SEQ ID NO: 1388063 - RNA, 14 nt, Homo sapiens
ccaaauacugaugg

SEQ ID NO: 1388064 - RNA, 16 nt, Homo sapiens
ccaaauuauuguccaa

SEQ ID NO: 1388065 - RNA, 15 nt, Homo sapiens
ccaacaagggcagug

SEQ ID NO: 1388066 - RNA, 10 nt, Homo sapiens
ccaacagcac

SEQ ID NO: 1388067 - RNA, 22 nt, Homo sapiens
ccaacaggagcugggauccuaa

SEQ ID NO: 1388068 - RNA, 18 nt, Homo sapiens
ccaacagucaaaacagag

SEQ ID NO: 1388069 - RNA, 20 nt, Homo sapiens
ccaacaucaacaucuugguc

SEQ ID NO: 1388070 - RNA, 14 nt, Homo sapiens
ccaacccaucagaa

SEQ ID NO: 1388071 - RNA, 17 nt, Homo sapiens
ccaaccggucacccagg

SEQ ID NO: 1388072 - RNA, 14 nt, Homo sapiens
ccaaccuccugacc

SEQ ID NO: 1388073 - RNA, 16 nt, Homo sapiens
ccaaccugaagacacc

SEQ ID NO: 1388074 - RNA, 23 nt, Homo sapiens
ccaacgaaaagcacauccaggca

SEQ ID NO: 1388075 - RNA, 17 nt, Homo sapiens
ccaacguggcccagaga

SEQ ID NO: 1388076 - RNA, 23 nt, Homo sapiens
ccaacugcuguucauguuacuca

SEQ ID NO: 1388077 - RNA, 13 nt, Homo sapiens
ccaacuuuugcau

SEQ ID NO: 1388078 - RNA, 18 nt, Homo sapiens
ccaagaacagcaggccca

SEQ ID NO: 1388079 - RNA, 13 nt, Homo sapiens
ccaagaacugcau

SEQ ID NO: 1388080 - RNA, 10 nt, Homo sapiens
ccaagcacag

SEQ ID NO: 1388081 - RNA, 21 nt, Homo sapiens
ccaagcacagugccugcaugu

SEQ ID NO: 1388082 - RNA, 13 nt, Homo sapiens
ccaagccugacca

SEQ ID NO: 1388083 - RNA, 22 nt, Homo sapiens
ccaagcuccuugggaggcccca

SEQ ID NO: 1388084 - RNA, 12 nt, Homo sapiens
ccaagcugugac

SEQ ID NO: 1388085 - RNA, 16 nt, Homo sapiens
ccaaggagaugaagca

SEQ ID NO: 1388086 - RNA, 23 nt, Homo sapiens
ccaaggagggcagaucacuucag

SEQ ID NO: 1388087 - RNA, 12 nt, Homo sapiens
ccaaggugggag

SEQ ID NO: 1388088 - RNA, 16 nt, Homo sapiens
ccaagucaaagacauu

SEQ ID NO: 1388089 - RNA, 13 nt, Homo sapiens
ccaauaaagccuu

SEQ ID NO: 1388090 - RNA, 14 nt, Homo sapiens
ccaauagaaugagu

SEQ ID NO: 1388091 - RNA, 16 nt, Homo sapiens
ccaauaggaaugcuaa

SEQ ID NO: 1388092 - RNA, 14 nt, Homo sapiens
ccaauuuacauacu

SEQ ID NO: 1388093 - RNA, 15 nt, Homo sapiens
ccaauuuuguugcau

SEQ ID NO: 1388094 - RNA, 14 nt, Homo sapiens
ccacaaccaaaaaa

SEQ ID NO: 1388095 - RNA, 18 nt, Homo sapiens
ccacaaguccuuguucca

SEQ ID NO: 1388096 - RNA, 22 nt, Homo sapiens
ccacacccuggaggauuucauc

SEQ ID NO: 1388097 - RNA, 11 nt, Homo sapiens
ccacaccucag

SEQ ID NO: 1388098 - RNA, 17 nt, Homo sapiens
ccacacuguacucugca

SEQ ID NO: 1388099 - RNA, 21 nt, Homo sapiens
ccacacuuccuguccagagag

SEQ ID NO: 1388100 - RNA, 22 nt, Homo sapiens
ccacagaagugcuuucuucucc

SEQ ID NO: 1388101 - RNA, 15 nt, Homo sapiens
ccacagaugccucca

SEQ ID NO: 1388102 - RNA, 13 nt, Homo sapiens
ccacagcacuaau

SEQ ID NO: 1388103 - RNA, 14 nt, Homo sapiens
ccacagcccuguca

SEQ ID NO: 1388104 - RNA, 16 nt, Homo sapiens
ccacaggcagcauuua

SEQ ID NO: 1388105 - RNA, 14 nt, Homo sapiens
ccacaugugcacau

SEQ ID NO: 1388106 - RNA, 13 nt, Homo sapiens
ccacaugugucca

SEQ ID NO: 1388107 - RNA, 16 nt, Homo sapiens
ccaccacuucuuuuau

SEQ ID NO: 1388108 - RNA, 14 nt, Homo sapiens
ccaccaggcccaca

SEQ ID NO: 1388109 - RNA, 17 nt, Homo sapiens
ccaccccuaaagagaua

SEQ ID NO: 1388110 - RNA, 20 nt, Homo sapiens
ccacccuccuuucaccacau

SEQ ID NO: 1388111 - RNA, 13 nt, Homo sapiens
ccaccugcugcug

SEQ ID NO: 1388112 - RNA, 13 nt, Homo sapiens
ccaccugucucag

SEQ ID NO: 1388113 - RNA, 18 nt, Homo sapiens
ccacgcuggagugcagug

SEQ ID NO: 1388114 - RNA, 22 nt, Homo sapiens
ccacguccagcuggaaggguca

SEQ ID NO: 1388115 - RNA, 21 nt, Homo sapiens
ccacgugggcaaacaggcagu

SEQ ID NO: 1388116 - RNA, 18 nt, Homo sapiens
ccacuagacaaguccagc

SEQ ID NO: 1388117 - RNA, 15 nt, Homo sapiens
ccacucaggccaaca

SEQ ID NO: 1388118 - RNA, 14 nt, Homo sapiens
ccacuccuguacac

SEQ ID NO: 1388119 - RNA, 20 nt, Homo sapiens
cccagccaaacccugucuga

SEQ ID NO: 1388120 - RNA, 21 nt, Homo sapiens
cccagcccuguucugggugca

SEQ ID NO: 1388121 - RNA, 16 nt, Homo sapiens
cccagccucucuuccu

SEQ ID NO: 1388122 - RNA, 15 nt, Homo sapiens
cccagcuacucggga

SEQ ID NO: 1388123 - RNA, 15 nt, Homo sapiens
cccagcucagucuuc

SEQ ID NO: 1388124 - RNA, 17 nt, Homo sapiens
cccagcugucuguguca

SEQ ID NO: 1388125 - RNA, 21 nt, Homo sapiens
cccagcuuaauggcucaugac

SEQ ID NO: 1388126 - RNA, 15 nt, Homo sapiens
cccaggacccaucac

SEQ ID NO: 1388127 - RNA, 12 nt, Homo sapiens
cccaggaguaca

SEQ ID NO: 1388128 - RNA, 17 nt, Homo sapiens
cccaggcaaacuugcac

SEQ ID NO: 1388129 - RNA, 19 nt, Homo sapiens
cccaggcuuuugaaaaaca

SEQ ID NO: 1388130 - RNA, 17 nt, Homo sapiens
cccagggaagccaaaag

SEQ ID NO: 1388131 - RNA, 22 nt, Homo sapiens
cccaggugguuauggagagggu

SEQ ID NO: 1388132 - RNA, 15 nt, Homo sapiens
cccagugccaagcac

SEQ ID NO: 1388133 - RNA, 14 nt, Homo sapiens
cccaguggccucaa

SEQ ID NO: 1388134 - RNA, 21 nt, Homo sapiens
cccaguguguuucugaucuga

SEQ ID NO: 1388135 - RNA, 15 nt, Homo sapiens
cccaguguuugugca

SEQ ID NO: 1388136 - RNA, 14 nt, Homo sapiens
cccauagcuuccau

SEQ ID NO: 1388137 - RNA, 15 nt, Homo sapiens
cccauaucugugaaa

SEQ ID NO: 1388138 - RNA, 15 nt, Homo sapiens
cccaucccaucccau

SEQ ID NO: 1388139 - RNA, 23 nt, Homo sapiens
cccaugucuacacagauguucac

SEQ ID NO: 1388140 - RNA, 22 nt, Homo sapiens
cccaugugugagugugugcaag

SEQ ID NO: 1388141 - RNA, 17 nt, Homo sapiens
cccauuccuauuucuua

SEQ ID NO: 1388142 - RNA, 16 nt, Homo sapiens
ccccaacuuagcuguc

SEQ ID NO: 1388143 - RNA, 22 nt, Homo sapiens
ccccacacugaccuguguuccc

SEQ ID NO: 1388144 - RNA, 22 nt, Homo sapiens
ccccaccugccauuugcacccu

SEQ ID NO: 1388145 - RNA, 11 nt, Homo sapiens
ccccacugaca

SEQ ID NO: 1388146 - RNA, 22 nt, Homo sapiens
ccccacuggggaaauaacagcu

SEQ ID NO: 1388147 - RNA, 23 nt, Homo sapiens
ccccagaaccuguccuugcacac

SEQ ID NO: 1388148 - RNA, 14 nt, Homo sapiens
ccccagagcuguuu

SEQ ID NO: 1388149 - RNA, 15 nt, Homo sapiens
ccccagcccugugga

SEQ ID NO: 1388150 - RNA, 17 nt, Homo sapiens
ccccaggggucccagcc

SEQ ID NO: 1388151 - RNA, 15 nt, Homo sapiens
ccccagugcccacag

SEQ ID NO: 1388152 - RNA, 20 nt, Homo sapiens
ccccaucugccacguguauu

SEQ ID NO: 1388153 - RNA, 18 nt, Homo sapiens
ccccaugccuguccagcc

SEQ ID NO: 1388154 - RNA, 22 nt, Homo sapiens
cccccaaaaaacaauuauguaa

SEQ ID NO: 1388155 - RNA, 21 nt, Homo sapiens
cccccauuaaccagggcacca

SEQ ID NO: 1388156 - RNA, 20 nt, Homo sapiens
cccccugacauuaucuugga

SEQ ID NO: 1388157 - RNA, 14 nt, Homo sapiens
cccccugggcugag

SEQ ID NO: 1388158 - RNA, 18 nt, Homo sapiens
ccccgcauuccaggcucc

SEQ ID NO: 1388159 - RNA, 13 nt, Homo sapiens
ccccggaacaagc

SEQ ID NO: 1388160 - RNA, 19 nt, Homo sapiens
ccccgugggccauggcaau

SEQ ID NO: 1388161 - RNA, 13 nt, Homo sapiens
ccccuacaugaaa

SEQ ID NO: 1388162 - RNA, 18 nt, Homo sapiens
ccccucaacaccucugca

SEQ ID NO: 1388163 - RNA, 18 nt, Homo sapiens
ccccugaccucacuguga

SEQ ID NO: 1388164 - RNA, 22 nt, Homo sapiens
ccccuggcugguaagggccaag

SEQ ID NO: 1388165 - RNA, 14 nt, Homo sapiens
ccccuggcuuuuca

SEQ ID NO: 1388166 - RNA, 20 nt, Homo sapiens
ccccuguagacuagugccgu

SEQ ID NO: 1388167 - RNA, 22 nt, Homo sapiens
ccccuguagagugggagcugag

SEQ ID NO: 1388168 - RNA, 23 nt, Homo sapiens
ccccuuagccaguuguauauuau

SEQ ID NO: 1388169 - RNA, 12 nt, Homo sapiens
ccccuuugcccu

SEQ ID NO: 1388170 - RNA, 16 nt, Homo sapiens
cccgacuccucaaaag

SEQ ID NO: 1388171 - RNA, 11 nt, Homo sapiens
cccgagcagaa

SEQ ID NO: 1388172 - RNA, 23 nt, Homo sapiens
cccgaucaucuuuccuguuccag

SEQ ID NO: 1388173 - RNA, 13 nt, Homo sapiens
cccgcaaugugcc

SEQ ID NO: 1388174 - RNA, 19 nt, Homo sapiens
cccggcugucaaggggugu

SEQ ID NO: 1388175 - RNA, 15 nt, Homo sapiens
cccgggacucacugg

SEQ ID NO: 1388176 - RNA, 14 nt, Homo sapiens
cccgucauguuccu

SEQ ID NO: 1388177 - RNA, 16 nt, Homo sapiens
cccgucauguuccuca

SEQ ID NO: 1388178 - RNA, 18 nt, Homo sapiens
cccgugggagucaucuca

SEQ ID NO: 1388179 - RNA, 11 nt, Homo sapiens
cccuacaugga

SEQ ID NO: 1388180 - RNA, 14 nt, Homo sapiens
cccuagggccuuca

SEQ ID NO: 1388181 - RNA, 17 nt, Homo sapiens
cccuagucuuuuaaaca

SEQ ID NO: 1388182 - RNA, 16 nt, Homo sapiens
cccuauccacccagcc

SEQ ID NO: 1388183 - RNA, 20 nt, Homo sapiens
cccucaaagcuuccauucca

SEQ ID NO: 1388184 - RNA, 18 nt, Homo sapiens
cccucaacaccucugcac

SEQ ID NO: 1388185 - RNA, 20 nt, Homo sapiens
cccucagauuccaccuagag

SEQ ID NO: 1388186 - RNA, 22 nt, Homo sapiens
cccucccacugccaaagaacuu

SEQ ID NO: 1388187 - RNA, 19 nt, Homo sapiens
cccucuagaaauuuuucag

SEQ ID NO: 1388188 - RNA, 18 nt, Homo sapiens
cccugacauuaucuugga

SEQ ID NO: 1388189 - RNA, 23 nt, Homo sapiens
cccugacccagagccuaggggau

SEQ ID NO: 1388190 - RNA, 20 nt, Homo sapiens
cccugaccucacugugaccu

SEQ ID NO: 1388191 - RNA, 18 nt, Homo sapiens
cccugagacaaauggagg

SEQ ID NO: 1388192 - RNA, 14 nt, Homo sapiens
cccugaucaaguca

SEQ ID NO: 1388193 - RNA, 16 nt, Homo sapiens
cccugauugcgcaaaa

SEQ ID NO: 1388194 - RNA, 17 nt, Homo sapiens
cccugcaggaaaacuga

SEQ ID NO: 1388195 - RNA, 17 nt, Homo sapiens
cccugcaguuugagaca

SEQ ID NO: 1388196 - RNA, 15 nt, Homo sapiens
cccugccccugccuu

SEQ ID NO: 1388197 - RNA, 15 nt, Homo sapiens
cccuggcaaccagga

SEQ ID NO: 1388198 - RNA, 16 nt, Homo sapiens
cccugggauguccaca

SEQ ID NO: 1388199 - RNA, 14 nt, Homo sapiens
cccugggcaucaga

SEQ ID NO: 1388200 - RNA, 23 nt, Homo sapiens
cccugggcaucagaccuuaacca

SEQ ID NO: 1388201 - RNA, 11 nt, Homo sapiens
cccuguacaau

SEQ ID NO: 1388202 - RNA, 21 nt, Homo sapiens
cccuguaccacaaacacauua

SEQ ID NO: 1388203 - RNA, 19 nt, Homo sapiens
cccuguuucucuugaagaa

SEQ ID NO: 1388204 - RNA, 15 nt, Homo sapiens
cccuuccucccaaaa

SEQ ID NO: 1388205 - RNA, 15 nt, Homo sapiens
cccuucgcguauuuc

SEQ ID NO: 1388206 - RNA, 15 nt, Homo sapiens
cccuucucuaccuca

SEQ ID NO: 1388207 - RNA, 16 nt, Homo sapiens
cccuucucugcccauu

SEQ ID NO: 1388208 - RNA, 14 nt, Homo sapiens
cccuucuuuccauu

SEQ ID NO: 1388209 - RNA, 13 nt, Homo sapiens
cccuugcagcuag

SEQ ID NO: 1388210 - RNA, 11 nt, Homo sapiens
cccuuucacaa

SEQ ID NO: 1388211 - RNA, 18 nt, Homo sapiens
cccuuuccagauauucaa

SEQ ID NO: 1388212 - RNA, 21 nt, Homo sapiens
cccuuuggagaacgccagucu

SEQ ID NO: 1388213 - RNA, 13 nt, Homo sapiens
cccuuuuacauac

SEQ ID NO: 1388214 - RNA, 16 nt, Homo sapiens
ccgaaguaugagggaa

SEQ ID NO: 1388215 - RNA, 17 nt, Homo sapiens
ccgaauagcugggacua

SEQ ID NO: 1388216 - RNA, 17 nt, Homo sapiens
ccgacuccucaaaagca

SEQ ID NO: 1388217 - RNA, 13 nt, Homo sapiens
ccgagacauggcu

SEQ ID NO: 1388218 - RNA, 22 nt, Homo sapiens
ccgaguggauagaugcccugcu

SEQ ID NO: 1388219 - RNA, 23 nt, Homo sapiens
ccgcaacaguuuuuuaugcuaau

SEQ ID NO: 1388220 - RNA, 18 nt, Homo sapiens
ccgccuccaaaugccaac

SEQ ID NO: 1388221 - RNA, 19 nt, Homo sapiens
ccgcucaggcugaccacuu

SEQ ID NO: 1388222 - RNA, 19 nt, Homo sapiens
ccggaggcaaaaggcagug

SEQ ID NO: 1388223 - RNA, 23 nt, Homo sapiens
ccggcgaaauaaaaucagaguug

SEQ ID NO: 1388224 - RNA, 19 nt, Homo sapiens
ccgggcaauccagacagca

SEQ ID NO: 1388225 - RNA, 19 nt, Homo sapiens
ccgggcacagcugugguga

SEQ ID NO: 1388226 - RNA, 18 nt, Homo sapiens
ccgugugugaaauucucu

SEQ ID NO: 1388227 - RNA, 17 nt, Homo sapiens
ccguuuacuuguuucag

SEQ ID NO: 1388228 - RNA, 18 nt, Homo sapiens
ccuaaaaggaaaucucac

SEQ ID NO: 1388229 - RNA, 19 nt, Homo sapiens
ccuaaauaauguuaucugu

SEQ ID NO: 1388230 - RNA, 22 nt, Homo sapiens
ccuaaaucugccuuuucaucua

SEQ ID NO: 1388231 - RNA, 14 nt, Homo sapiens
ccuaaauguauacc

SEQ ID NO: 1388232 - RNA, 23 nt, Homo sapiens
ccuaaccucuuuucugcaucauc

SEQ ID NO: 1388233 - RNA, 16 nt, Homo sapiens
ccuaagacugcugcug

SEQ ID NO: 1388234 - RNA, 23 nt, Homo sapiens
ccuaaggucauuaccacaggcca

SEQ ID NO: 1388235 - RNA, 20 nt, Homo sapiens
ccuaaguuaccuuucuaggu

SEQ ID NO: 1388236 - RNA, 22 nt, Homo sapiens
ccuaauaaacauccuucaagaa

SEQ ID NO: 1388237 - RNA, 22 nt, Homo sapiens
ccuaauguggcagcugucucaa

SEQ ID NO: 1388238 - RNA, 22 nt, Homo sapiens
ccuacauuuuaaugcaccugaa

SEQ ID NO: 1388239 - RNA, 21 nt, Homo sapiens
ccuaccucacagagugcauug

SEQ ID NO: 1388240 - RNA, 14 nt, Homo sapiens
ccuacucuguguca

SEQ ID NO: 1388241 - RNA, 13 nt, Homo sapiens
ccuagaaacugac

SEQ ID NO: 1388242 - RNA, 22 nt, Homo sapiens
ccuagcugggaaggugaccaca

SEQ ID NO: 1388243 - RNA, 14 nt, Homo sapiens
ccuagcugugugca

SEQ ID NO: 1388244 - RNA, 17 nt, Homo sapiens
ccuaggcauuugcugaa

SEQ ID NO: 1388245 - RNA, 18 nt, Homo sapiens
ccuagggccugguccaug

SEQ ID NO: 1388246 - RNA, 11 nt, Homo sapiens
ccuaguacaag

SEQ ID NO: 1388247 - RNA, 23 nt, Homo sapiens
ccuauggaagcauauuguuauua

SEQ ID NO: 1388248 - RNA, 18 nt, Homo sapiens
ccuauuucuuauagucaa

SEQ ID NO: 1388249 - RNA, 11 nt, Homo sapiens
ccuauuugcac

SEQ ID NO: 1388250 - RNA, 13 nt, Homo sapiens
ccucaaagcacac

SEQ ID NO: 1388251 - RNA, 22 nt, Homo sapiens
ccucaaaguuggggcaggcugg

SEQ ID NO: 1388252 - RNA, 20 nt, Homo sapiens
ccucacagagugcauuguga

SEQ ID NO: 1388253 - RNA, 12 nt, Homo sapiens
ccucacugggug

SEQ ID NO: 1388254 - RNA, 12 nt, Homo sapiens
ccucagauucca

SEQ ID NO: 1388255 - RNA, 13 nt, Homo sapiens
ccucagauuccac

SEQ ID NO: 1388256 - RNA, 22 nt, Homo sapiens
ccucagauuccaccuagagcua

SEQ ID NO: 1388257 - RNA, 17 nt, Homo sapiens
ccucaggcaggugggau

SEQ ID NO: 1388258 - RNA, 15 nt, Homo sapiens
ccucagggacagaga

SEQ ID NO: 1388259 - RNA, 15 nt, Homo sapiens
ccucagguuugccug

SEQ ID NO: 1388260 - RNA, 19 nt, Homo sapiens
ccucaguuucccuaucucg

SEQ ID NO: 1388261 - RNA, 14 nt, Homo sapiens
ccucauacacagaa

SEQ ID NO: 1388262 - RNA, 19 nt, Homo sapiens
ccucaucuccuaaaaggca

SEQ ID NO: 1388263 - RNA, 20 nt, Homo sapiens
ccuccaagcuccaucuccac

SEQ ID NO: 1388264 - RNA, 20 nt, Homo sapiens
ccuccagcccucucacugug

SEQ ID NO: 1388265 - RNA, 22 nt, Homo sapiens
ccuccaggaugaguuacuugaa

SEQ ID NO: 1388266 - RNA, 18 nt, Homo sapiens
ccucccacugccaaagaa

SEQ ID NO: 1388267 - RNA, 22 nt, Homo sapiens
ccucccaggaacugggccaacu

SEQ ID NO: 1388268 - RNA, 23 nt, Homo sapiens
ccucccagugaccccugaccuca

SEQ ID NO: 1388269 - RNA, 22 nt, Homo sapiens
ccucccucucucuucugcucca

SEQ ID NO: 1388270 - RNA, 15 nt, Homo sapiens
ccuccgccauucuca

SEQ ID NO: 1388271 - RNA, 20 nt, Homo sapiens
ccuccuaguucuucauccca

SEQ ID NO: 1388272 - RNA, 13 nt, Homo sapiens
ccuccucaccucu

SEQ ID NO: 1388273 - RNA, 19 nt, Homo sapiens
ccuccucggaucaccgaga

SEQ ID NO: 1388274 - RNA, 21 nt, Homo sapiens
ccuccucuccuacuuugggac

SEQ ID NO: 1388275 - RNA, 18 nt, Homo sapiens
ccuccuuccuugaccagc

SEQ ID NO: 1388276 - RNA, 16 nt, Homo sapiens
ccuccuugucuuggca

SEQ ID NO: 1388277 - RNA, 12 nt, Homo sapiens
ccuccuuuccca

SEQ ID NO: 1388278 - RNA, 20 nt, Homo sapiens
ccuccuuucccaacacuuca

SEQ ID NO: 1388279 - RNA, 18 nt, Homo sapiens
ccucggccucccaaagug

SEQ ID NO: 1388280 - RNA, 16 nt, Homo sapiens
ccucguagccaucucu

SEQ ID NO: 1388281 - RNA, 14 nt, Homo sapiens
ccucguaugcaugg

SEQ ID NO: 1388282 - RNA, 14 nt, Homo sapiens
ccucuagaggcaag

SEQ ID NO: 1388283 - RNA, 19 nt, Homo sapiens
ccucucucccuggaccuca

SEQ ID NO: 1388284 - RNA, 12 nt, Homo sapiens
ccucucucugua

SEQ ID NO: 1388285 - RNA, 13 nt, Homo sapiens
ccucuggacaaag

SEQ ID NO: 1388286 - RNA, 15 nt, Homo sapiens
ccucugguucuucau

SEQ ID NO: 1388287 - RNA, 22 nt, Homo sapiens
ccucuguucaguaacagggccu

SEQ ID NO: 1388288 - RNA, 23 nt, Homo sapiens
ccucuuaaaaaauaaaaacugac

SEQ ID NO: 1388289 - RNA, 19 nt, Homo sapiens
ccucuuaaagcugccugua

SEQ ID NO: 1388290 - RNA, 16 nt, Homo sapiens
ccucuuuuucuagucu

SEQ ID NO: 1388291 - RNA, 18 nt, Homo sapiens
ccugaaaaggguguugcu

SEQ ID NO: 1388292 - RNA, 19 nt, Homo sapiens
ccugaaaaggguguugcua

SEQ ID NO: 1388293 - RNA, 20 nt, Homo sapiens
ccugaaacuuacacacaaaa

SEQ ID NO: 1388294 - RNA, 21 nt, Homo sapiens
ccugaagaacaguaacugcca

SEQ ID NO: 1388295 - RNA, 14 nt, Homo sapiens
ccugaagucacaca

SEQ ID NO: 1388296 - RNA, 23 nt, Homo sapiens
ccugaaugugucugcgucccugu

SEQ ID NO: 1388297 - RNA, 17 nt, Homo sapiens
ccugacccuacuucuuu

SEQ ID NO: 1388298 - RNA, 14 nt, Homo sapiens
ccugaccugucuca

SEQ ID NO: 1388299 - RNA, 16 nt, Homo sapiens
ccugacucaggcauca

SEQ ID NO: 1388300 - RNA, 12 nt, Homo sapiens
ccugaguuucaa

SEQ ID NO: 1388301 - RNA, 20 nt, Homo sapiens
ccugauaggacccauauucc

SEQ ID NO: 1388302 - RNA, 14 nt, Homo sapiens
ccugcaggcagcuu

SEQ ID NO: 1388303 - RNA, 23 nt, Homo sapiens
ccugccaaaugaauaagacaaca

SEQ ID NO: 1388304 - RNA, 16 nt, Homo sapiens
ccugcccugcugccgc

SEQ ID NO: 1388305 - RNA, 20 nt, Homo sapiens
ccugcccugggauguccaca

SEQ ID NO: 1388306 - RNA, 14 nt, Homo sapiens
ccugccuaggaauu

SEQ ID NO: 1388307 - RNA, 14 nt, Homo sapiens
ccugccuggacugu

SEQ ID NO: 1388308 - RNA, 17 nt, Homo sapiens
ccugcuagaaaugggaa

SEQ ID NO: 1388309 - RNA, 14 nt, Homo sapiens
ccugcucccacaga

SEQ ID NO: 1388310 - RNA, 22 nt, Homo sapiens
ccugcugaccucccagugaccc

SEQ ID NO: 1388311 - RNA, 23 nt, Homo sapiens
ccugcugagggaccagccaagag

SEQ ID NO: 1388312 - RNA, 17 nt, Homo sapiens
ccugcugcuucugcaaa

SEQ ID NO: 1388313 - RNA, 20 nt, Homo sapiens
ccuggaaagaaaaagcaaua

SEQ ID NO: 1388314 - RNA, 11 nt, Homo sapiens
ccuggagcucc

SEQ ID NO: 1388315 - RNA, 21 nt, Homo sapiens
ccuggaguacuuugaagaugu

SEQ ID NO: 1388316 - RNA, 16 nt, Homo sapiens
ccuggaguccuugacc

SEQ ID NO: 1388317 - RNA, 16 nt, Homo sapiens
ccuggaucuaccagca

SEQ ID NO: 1388318 - RNA, 18 nt, Homo sapiens
ccuggaugaaguuaucug

SEQ ID NO: 1388319 - RNA, 19 nt, Homo sapiens
ccuggcagaacugagcucc

SEQ ID NO: 1388320 - RNA, 20 nt, Homo sapiens
ccuggccaacaugaugaaac

SEQ ID NO: 1388321 - RNA, 17 nt, Homo sapiens
ccuggccaggagcucuu

SEQ ID NO: 1388322 - RNA, 20 nt, Homo sapiens
ccuggcccacugcaucguuu

SEQ ID NO: 1388323 - RNA, 16 nt, Homo sapiens
ccuggcucagccucaa

SEQ ID NO: 1388324 - RNA, 15 nt, Homo sapiens
ccugggauguccaca

SEQ ID NO: 1388325 - RNA, 12 nt, Homo sapiens
ccugggggccug

SEQ ID NO: 1388326 - RNA, 18 nt, Homo sapiens
ccuggguaacuagggaag

SEQ ID NO: 1388327 - RNA, 22 nt, Homo sapiens
ccugggugacagagcaagugag

SEQ ID NO: 1388328 - RNA, 17 nt, Homo sapiens
ccuggucaacaugguga

SEQ ID NO: 1388329 - RNA, 19 nt, Homo sapiens
ccuggucaacauggugaaa

SEQ ID NO: 1388330 - RNA, 15 nt, Homo sapiens
ccuggugcugcugcu

SEQ ID NO: 1388331 - RNA, 13 nt, Homo sapiens
ccugguuccacau

SEQ ID NO: 1388332 - RNA, 19 nt, Homo sapiens
ccugguuccggcucugcac

SEQ ID NO: 1388333 - RNA, 20 nt, Homo sapiens
cuugcccagagaugccucca

SEQ ID NO: 1388334 - RNA, 16 nt, Homo sapiens
cuugcuugcaauaggu

SEQ ID NO: 1388335 - RNA, 21 nt, Homo sapiens
cuuggaaauuggaagagcaca

SEQ ID NO: 1388336 - RNA, 18 nt, Homo sapiens
cuuggaccucgugcuuua

SEQ ID NO: 1388337 - RNA, 19 nt, Homo sapiens
cuuggagggcccacuugua

SEQ ID NO: 1388338 - RNA, 19 nt, Homo sapiens
cuuggcaugccuuccagca

SEQ ID NO: 1388339 - RNA, 12 nt, Homo sapiens
cuuggccagaag

SEQ ID NO: 1388340 - RNA, 22 nt, Homo sapiens
cuuggccagaagggggccauga

SEQ ID NO: 1388341 - RNA, 10 nt, Homo sapiens
cuuggcugug

SEQ ID NO: 1388342 - RNA, 11 nt, Homo sapiens
cuuggggccau

SEQ ID NO: 1388343 - RNA, 13 nt, Homo sapiens
cuugguguugccc

SEQ ID NO: 1388344 - RNA, 15 nt, Homo sapiens
cuugguucaucagug

SEQ ID NO: 1388345 - RNA, 14 nt, Homo sapiens
cuuguaaagacugu

SEQ ID NO: 1388346 - RNA, 16 nt, Homo sapiens
cuuguaaagacuguag

SEQ ID NO: 1388347 - RNA, 13 nt, Homo sapiens
cuuguaaauuaca

SEQ ID NO: 1388348 - RNA, 20 nt, Homo sapiens
cuuguccacauagguuuaga

SEQ ID NO: 1388349 - RNA, 16 nt, Homo sapiens
cuugucucacuugugc

SEQ ID NO: 1388350 - RNA, 16 nt, Homo sapiens
cuugucugucuaguua

SEQ ID NO: 1388351 - RNA, 11 nt, Homo sapiens
cuugugacuag

SEQ ID NO: 1388352 - RNA, 16 nt, Homo sapiens
cuuguuagaaaugcaa

SEQ ID NO: 1388353 - RNA, 13 nt, Homo sapiens
cuuguugcugagu

SEQ ID NO: 1388354 - RNA, 20 nt, Homo sapiens
cuuguuguuuucccaaagag

SEQ ID NO: 1388355 - RNA, 13 nt, Homo sapiens
cuuguuugcuuca

SEQ ID NO: 1388356 - RNA, 14 nt, Homo sapiens
cuuguuuucuugcc

SEQ ID NO: 1388357 - RNA, 21 nt, Homo sapiens
cuuuaaaauauuguugaacac

SEQ ID NO: 1388358 - RNA, 15 nt, Homo sapiens
cuuuaaauccuucca

SEQ ID NO: 1388359 - RNA, 15 nt, Homo sapiens
cuuuacaaauauguc

SEQ ID NO: 1388360 - RNA, 20 nt, Homo sapiens
cuuuagaaaugucaguugcu

SEQ ID NO: 1388361 - RNA, 13 nt, Homo sapiens
cuuuagaaugaga

SEQ ID NO: 1388362 - RNA, 20 nt, Homo sapiens
cuuuagagccagcccauggc

SEQ ID NO: 1388363 - RNA, 19 nt, Homo sapiens
cuuuaggagacuaauggaa

SEQ ID NO: 1388364 - RNA, 19 nt, Homo sapiens
cuuuauaaucuacuccuug

SEQ ID NO: 1388365 - RNA, 21 nt, Homo sapiens
cuuuaugcuaguuugaccuca

SEQ ID NO: 1388366 - RNA, 22 nt, Homo sapiens
cuuuaugcuaguuugaccucau

SEQ ID NO: 1388367 - RNA, 22 nt, Homo sapiens
cuuuauuacaguuuaucuaugg

SEQ ID NO: 1388368 - RNA, 12 nt, Homo sapiens
cuuuauuuuaga

SEQ ID NO: 1388369 - RNA, 19 nt, Homo sapiens
cuuuauuuugcuuccacau

SEQ ID NO: 1388370 - RNA, 20 nt, Homo sapiens
cuuucacacuuccaccagcc

SEQ ID NO: 1388371 - RNA, 21 nt, Homo sapiens
cuuucacacuuccaccagccu

SEQ ID NO: 1388372 - RNA, 15 nt, Homo sapiens
cuuucaggaacacuc

SEQ ID NO: 1388373 - RNA, 18 nt, Homo sapiens
cuuucauugccagugucu

SEQ ID NO: 1388374 - RNA, 14 nt, Homo sapiens
cuuuccacauucag

SEQ ID NO: 1388375 - RNA, 17 nt, Homo sapiens
cuuucccccacuuuucu

SEQ ID NO: 1388376 - RNA, 15 nt, Homo sapiens
cuuucccuuuaucag

SEQ ID NO: 1388377 - RNA, 17 nt, Homo sapiens
cuuuccuguagucccau

SEQ ID NO: 1388378 - RNA, 13 nt, Homo sapiens
cuuuccuguucca

SEQ ID NO: 1388379 - RNA, 15 nt, Homo sapiens
cuuucuacacuguau

SEQ ID NO: 1388380 - RNA, 20 nt, Homo sapiens
cuuucuacuuuuucuagcua

SEQ ID NO: 1388381 - RNA, 21 nt, Homo sapiens
cuuucucaggaccuaguugcu

SEQ ID NO: 1388382 - RNA, 19 nt, Homo sapiens
cuuucucaucuugucccca

SEQ ID NO: 1388383 - RNA, 18 nt, Homo sapiens
cuuucugaaauuagggcc

SEQ ID NO: 1388384 - RNA, 18 nt, Homo sapiens
cuuucugcuaucaaagag

SEQ ID NO: 1388385 - RNA, 15 nt, Homo sapiens
cuuucuguugccaca

SEQ ID NO: 1388386 - RNA, 18 nt, Homo sapiens
cuuucuuaucccagugau

SEQ ID NO: 1388387 - RNA, 20 nt, Homo sapiens
cuuucuucccuacaguugaa

SEQ ID NO: 1388388 - RNA, 16 nt, Homo sapiens
cuuucuugaauugcau

SEQ ID NO: 1388389 - RNA, 13 nt, Homo sapiens
cuuucuugacucu

SEQ ID NO: 1388390 - RNA, 15 nt, Homo sapiens
cuuucuuguugcugc

SEQ ID NO: 1388391 - RNA, 17 nt, Homo sapiens
cuuucuuguugcugcau

SEQ ID NO: 1388392 - RNA, 18 nt, Homo sapiens
cuuucuuucuaacuccag

SEQ ID NO: 1388393 - RNA, 17 nt, Homo sapiens
cuuucuuuggugccuuu

SEQ ID NO: 1388394 - RNA, 13 nt, Homo sapiens
cuuugaauguggc

SEQ ID NO: 1388395 - RNA, 17 nt, Homo sapiens
cuuugaauuucccaguc

SEQ ID NO: 1388396 - RNA, 22 nt, Homo sapiens
cuuugagauagaagaacugcaa

SEQ ID NO: 1388397 - RNA, 15 nt, Homo sapiens
cuuugauuaugacug

SEQ ID NO: 1388398 - RNA, 14 nt, Homo sapiens
cuuugccccugaga

SEQ ID NO: 1388399 - RNA, 17 nt, Homo sapiens
cuuugcuauggggacau

SEQ ID NO: 1388400 - RNA, 18 nt, Homo sapiens
cuuugcucuuucuugacu

SEQ ID NO: 1388401 - RNA, 15 nt, Homo sapiens
cuuugcucuuuggua

SEQ ID NO: 1388402 - RNA, 19 nt, Homo sapiens
cuuugcuucauucaaguca

SEQ ID NO: 1388403 - RNA, 18 nt, Homo sapiens
cuuugcuucucucucuaa

SEQ ID NO: 1388404 - RNA, 20 nt, Homo sapiens
cuuuggaaacaggaccacaa

SEQ ID NO: 1388405 - RNA, 16 nt, Homo sapiens
cuuuggaaauacacag

SEQ ID NO: 1388406 - RNA, 15 nt, Homo sapiens
cuuuggaaaucacac

SEQ ID NO: 1388407 - RNA, 20 nt, Homo sapiens
cuuuggacacacacagcuuc

SEQ ID NO: 1388408 - RNA, 20 nt, Homo sapiens
cuuuggacgcacacagcuuu

SEQ ID NO: 1388409 - RNA, 21 nt, Homo sapiens
cuuuguaaagaaaguggcuug

SEQ ID NO: 1388410 - RNA, 20 nt, Homo sapiens
cuuuguauccucugaccuac

SEQ ID NO: 1388411 - RNA, 24 nt, Homo sapiens
cuuuguauccucugaccuacauac

SEQ ID NO: 1388412 - RNA, 22 nt, Homo sapiens
cuuuuaauguauuuguuugcaa

SEQ ID NO: 1388413 - RNA, 13 nt, Homo sapiens
cuuuuauaacuag

SEQ ID NO: 1388414 - RNA, 19 nt, Homo sapiens
cuuuuaucuuggacugaca

SEQ ID NO: 1388415 - RNA, 20 nt, Homo sapiens
cuuuuaugagacccauuccu

SEQ ID NO: 1388416 - RNA, 14 nt, Homo sapiens
cuuuuaugccuuca

SEQ ID NO: 1388417 - RNA, 14 nt, Homo sapiens
cuuuucaaugugug

SEQ ID NO: 1388418 - RNA, 14 nt, Homo sapiens
cuuuucccaaccau

SEQ ID NO: 1388419 - RNA, 17 nt, Homo sapiens
cuuuucuccuaucuuca

SEQ ID NO: 1388420 - RNA, 19 nt, Homo sapiens
cuuuugcauaagugcauga

SEQ ID NO: 1388421 - RNA, 21 nt, Homo sapiens
cuuuugcauaagugcaugaca

SEQ ID NO: 1388422 - RNA, 16 nt, Homo sapiens
cuuuugguaugugaca

SEQ ID NO: 1388423 - RNA, 22 nt, Homo sapiens
cuuuugugcuccccuuugccua

SEQ ID NO: 1388424 - RNA, 13 nt, Homo sapiens
cuuuuguguacag

SEQ ID NO: 1388425 - RNA, 19 nt, Homo sapiens
cuuuuguucagggcuguga

SEQ ID NO: 1388426 - RNA, 13 nt, Homo sapiens
cuuuuucauucuu

SEQ ID NO: 1388427 - RNA, 17 nt, Homo sapiens
cuuuuuggacacacaaa

SEQ ID NO: 1388428 - RNA, 21 nt, Homo sapiens
cuuuuuucaaugguaugcaaa

SEQ ID NO: 1388429 - RNA, 16 nt, Homo sapiens
gaaaaagccugugaaa

SEQ ID NO: 1388430 - RNA, 18 nt, Homo sapiens
gaaaaauccugagcaaac

SEQ ID NO: 1388431 - RNA, 18 nt, Homo sapiens
gaaaacacuaguaccuuc

SEQ ID NO: 1388432 - RNA, 17 nt, Homo sapiens
gaaaacaguauuuucca

SEQ ID NO: 1388433 - RNA, 17 nt, Homo sapiens
gaaaaccauuaccugac

SEQ ID NO: 1388434 - RNA, 16 nt, Homo sapiens
gaaaacugagacucag

SEQ ID NO: 1388435 - RNA, 20 nt, Homo sapiens
gaaaagauuauauauuauuu

SEQ ID NO: 1388436 - RNA, 15 nt, Homo sapiens
gaaacacuaaagcau

SEQ ID NO: 1388437 - RNA, 17 nt, Homo sapiens
gaaacauuaugccuuaa

SEQ ID NO: 1388438 - RNA, 18 nt, Homo sapiens
gaaacccgacagagggaa

SEQ ID NO: 1388439 - RNA, 17 nt, Homo sapiens
gaaaccuuauuguaccu

SEQ ID NO: 1388440 - RNA, 17 nt, Homo sapiens
gaaacuucggggcugca

SEQ ID NO: 1388441 - RNA, 17 nt, Homo sapiens
gaaacuugcauacagag

SEQ ID NO: 1388442 - RNA, 17 nt, Homo sapiens
gaaagacugagcucaag

SEQ ID NO: 1388443 - RNA, 20 nt, Homo sapiens
gaaagacuuucucugccccu

SEQ ID NO: 1388444 - RNA, 19 nt, Homo sapiens
gaaagaguccuauuugcac

SEQ ID NO: 1388445 - RNA, 12 nt, Homo sapiens
gaaagauuugua

SEQ ID NO: 1388446 - RNA, 18 nt, Homo sapiens
gaaagcaucacuugggau

SEQ ID NO: 1388447 - RNA, 22 nt, Homo sapiens
gaaagcaucugagcuaacuuau

SEQ ID NO: 1388448 - RNA, 19 nt, Homo sapiens
gaaagccucugcugccaug

SEQ ID NO: 1388449 - RNA, 18 nt, Homo sapiens
gaaagcuucaaacugcau

SEQ ID NO: 1388450 - RNA, 16 nt, Homo sapiens
gaaagggauaguccaa

SEQ ID NO: 1388451 - RNA, 19 nt, Homo sapiens
gaaaguuuccccaccagug

SEQ ID NO: 1388452 - RNA, 14 nt, Homo sapiens
gaaauaaacuuugg

SEQ ID NO: 1388453 - RNA, 17 nt, Homo sapiens
gaaauacguccuuccac

SEQ ID NO: 1388454 - RNA, 20 nt, Homo sapiens
gaaauacugaggggucucca

SEQ ID NO: 1388455 - RNA, 15 nt, Homo sapiens
gaaauagacaguaua

SEQ ID NO: 1388456 - RNA, 15 nt, Homo sapiens
gaaauauaaugcaaa

SEQ ID NO: 1388457 - RNA, 16 nt, Homo sapiens
gaaauauuauuggugu

SEQ ID NO: 1388458 - RNA, 14 nt, Homo sapiens
gaaauauuuggaaa

SEQ ID NO: 1388459 - RNA, 16 nt, Homo sapiens
gaaaucagaguuuuca

SEQ ID NO: 1388460 - RNA, 18 nt, Homo sapiens
gaaaucuagaagacuguc

SEQ ID NO: 1388461 - RNA, 19 nt, Homo sapiens
gaaaucuagaagacuguca

SEQ ID NO: 1388462 - RNA, 13 nt, Homo sapiens
gaaaucuaugaaa

SEQ ID NO: 1388463 - RNA, 15 nt, Homo sapiens
gaaaucucuagcuca

SEQ ID NO: 1388464 - RNA, 12 nt, Homo sapiens
gaaaucugccaa

SEQ ID NO: 1388465 - RNA, 16 nt, Homo sapiens
gaaaucugugcaauaa

SEQ ID NO: 1388466 - RNA, 16 nt, Homo sapiens
gaaaugcaaauucuca

SEQ ID NO: 1388467 - RNA, 17 nt, Homo sapiens
gaaaugcaaauucucaa

SEQ ID NO: 1388468 - RNA, 23 nt, Homo sapiens
gaaaugccuaagaagaugacuuc

SEQ ID NO: 1388469 - RNA, 15 nt, Homo sapiens
gaaauggggaacuac

SEQ ID NO: 1388470 - RNA, 13 nt, Homo sapiens
gaaauuaccaaaa

SEQ ID NO: 1388471 - RNA, 18 nt, Homo sapiens
gaacaaccucggcuccug

SEQ ID NO: 1388472 - RNA, 21 nt, Homo sapiens
gaacacccgacuccucaaaag

SEQ ID NO: 1388473 - RNA, 12 nt, Homo sapiens
gaacacugcacu

SEQ ID NO: 1388474 - RNA, 21 nt, Homo sapiens
gaacacuggcaacaacaaagc

SEQ ID NO: 1388475 - RNA, 16 nt, Homo sapiens
gaacagacaacagaag

SEQ ID NO: 1388476 - RNA, 21 nt, Homo sapiens
gaacagacaacagaagucaug

SEQ ID NO: 1388477 - RNA, 22 nt, Homo sapiens
gaacagcgggagaccugugcua

SEQ ID NO: 1388478 - RNA, 16 nt, Homo sapiens
gaacaguaacugccau

SEQ ID NO: 1388479 - RNA, 18 nt, Homo sapiens
gaaccaaaagagaucaca

SEQ ID NO: 1388480 - RNA, 15 nt, Homo sapiens
gaaccaauauuugua

SEQ ID NO: 1388481 - RNA, 21 nt, Homo sapiens
gaaccagagccauggacucua

SEQ ID NO: 1388482 - RNA, 17 nt, Homo sapiens
gaaccaugguaugaagg

SEQ ID NO: 1388483 - RNA, 19 nt, Homo sapiens
gaaccauucacagugcaag

SEQ ID NO: 1388484 - RNA, 12 nt, Homo sapiens
gaaccucagggc

SEQ ID NO: 1388485 - RNA, 16 nt, Homo sapiens
gaaccuuccaucucgc

SEQ ID NO: 1388486 - RNA, 15 nt, Homo sapiens
gaacgaguuguuggc

SEQ ID NO: 1388487 - RNA, 13 nt, Homo sapiens
gaacggggagaaa

SEQ ID NO: 1388488 - RNA, 13 nt, Homo sapiens
gaacuaacaugca

SEQ ID NO: 1388489 - RNA, 15 nt, Homo sapiens
gaacuagagaaggac

SEQ ID NO: 1388490 - RNA, 17 nt, Homo sapiens
gaacuauauuaguaugu

SEQ ID NO: 1388491 - RNA, 22 nt, Homo sapiens
gaacucauuccugccugucucc

SEQ ID NO: 1388492 - RNA, 12 nt, Homo sapiens
gaacucugagca

SEQ ID NO: 1388493 - RNA, 21 nt, Homo sapiens
gaacugcuuuaucccacggaa

SEQ ID NO: 1388494 - RNA, 15 nt, Homo sapiens
gaacuggacucagga

SEQ ID NO: 1388495 - RNA, 16 nt, Homo sapiens
gaacuggguacuugug

SEQ ID NO: 1388496 - RNA, 14 nt, Homo sapiens
gaagaaaaaauaca

SEQ ID NO: 1388497 - RNA, 15 nt, Homo sapiens
gaagaaauaacaaau

SEQ ID NO: 1388498 - RNA, 19 nt, Homo sapiens
gaagaacaguaacugccau

SEQ ID NO: 1388499 - RNA, 17 nt, Homo sapiens
gaagaacauccaaggag

SEQ ID NO: 1388500 - RNA, 17 nt, Homo sapiens
gaagaagaaaacacuag

SEQ ID NO: 1388501 - RNA, 17 nt, Homo sapiens
gaagaagugaccaagga

SEQ ID NO: 1388502 - RNA, 23 nt, Homo sapiens
gaagacaauggcuuacuccagga

SEQ ID NO: 1388503 - RNA, 12 nt, Homo sapiens
gaagacacugaa

SEQ ID NO: 1388504 - RNA, 16 nt, Homo sapiens
gaagagaaugugacag

SEQ ID NO: 1388505 - RNA, 14 nt, Homo sapiens
gaagagcuuggaaa

SEQ ID NO: 1388506 - RNA, 19 nt, Homo sapiens
gaagaguggguuucacaag

SEQ ID NO: 1388507 - RNA, 22 nt, Homo sapiens
gaagaguggguuucacaaguga

SEQ ID NO: 1388508 - RNA, 19 nt, Homo sapiens
gaagaguuaagaagaaaau

SEQ ID NO: 1388509 - RNA, 14 nt, Homo sapiens
gaagauacaugucu

SEQ ID NO: 1388510 - RNA, 23 nt, Homo sapiens
gaagaucaggccaaccccaaaga

SEQ ID NO: 1388511 - RNA, 24 nt, Homo sapiens
gaagauuuuaugcugcuguuuaca

SEQ ID NO: 1388512 - RNA, 15 nt, Homo sapiens
gaagcagugccuucc

SEQ ID NO: 1388513 - RNA, 22 nt, Homo sapiens
gaagccaagucagcuuugccuu

SEQ ID NO: 1388514 - RNA, 12 nt, Homo sapiens
gaagcucucgau

SEQ ID NO: 1388515 - RNA, 22 nt, Homo sapiens
gaagcuguguccuugcaccugc

SEQ ID NO: 1388516 - RNA, 15 nt, Homo sapiens
gaagcuuccauucca

SEQ ID NO: 1388517 - RNA, 13 nt, Homo sapiens
gaaggaagugaag

SEQ ID NO: 1388518 - RNA, 13 nt, Homo sapiens
gaaggaugaauga

SEQ ID NO: 1388519 - RNA, 13 nt, Homo sapiens
gaaggcaaaaaga

SEQ ID NO: 1388520 - RNA, 23 nt, Homo sapiens
gaagggcuuggacucaagcaaga

SEQ ID NO: 1388521 - RNA, 22 nt, Homo sapiens
gaagguauuccuuuuguguaca

SEQ ID NO: 1388522 - RNA, 21 nt, Homo sapiens
gaaggucccaccuccauuugc

SEQ ID NO: 1388523 - RNA, 22 nt, Homo sapiens
gaaggucucaggagaagggaua

SEQ ID NO: 1388524 - RNA, 13 nt, Homo sapiens
gaagguugcucua

SEQ ID NO: 1388525 - RNA, 15 nt, Homo sapiens
gaagguugugaugaa

SEQ ID NO: 1388526 - RNA, 19 nt, Homo sapiens
gaagguuuguauauuguca

SEQ ID NO: 1388527 - RNA, 23 nt, Homo sapiens
gaaguaacaaaagaagugacauc

SEQ ID NO: 1388528 - RNA, 18 nt, Homo sapiens
gaaguagaauuuguccaa

SEQ ID NO: 1388529 - RNA, 13 nt, Homo sapiens
gaagucacaucac

SEQ ID NO: 1388530 - RNA, 15 nt, Homo sapiens
gaaguuaagaaccug

SEQ ID NO: 1388531 - RNA, 20 nt, Homo sapiens
gaaguugcagugagcugaua

SEQ ID NO: 1388532 - RNA, 15 nt, Homo sapiens
gaaguuuacaaucaa

SEQ ID NO: 1388533 - RNA, 21 nt, Homo sapiens
gaaguuuagauuuuaaucaaa

SEQ ID NO: 1388534 - RNA, 20 nt, Homo sapiens
gaaguuuguuuaaaugacag

SEQ ID NO: 1388535 - RNA, 14 nt, Homo sapiens
gaauaaaacauaca

SEQ ID NO: 1388536 - RNA, 11 nt, Homo sapiens
gaauaaagccu

SEQ ID NO: 1388537 - RNA, 12 nt, Homo sapiens
gaauaaccacuu

SEQ ID NO: 1388538 - RNA, 15 nt, Homo sapiens
gacuuuagaaauaaa

SEQ ID NO: 1388539 - RNA, 23 nt, Homo sapiens
gacuuuagaaauaaauguaccug

SEQ ID NO: 1388540 - RNA, 16 nt, Homo sapiens
gacuuuaugcaauaaa

SEQ ID NO: 1388541 - RNA, 13 nt, Homo sapiens
gagaaaccagcuu

SEQ ID NO: 1388542 - RNA, 22 nt, Homo sapiens
gagaaaccuuauuguaccucuc

SEQ ID NO: 1388543 - RNA, 19 nt, Homo sapiens
gagaaaugaauaauuuccc

SEQ ID NO: 1388544 - RNA, 15 nt, Homo sapiens
gagaaaugacuuuga

SEQ ID NO: 1388545 - RNA, 20 nt, Homo sapiens
gagaaauugaacuucaggga

SEQ ID NO: 1388546 - RNA, 13 nt, Homo sapiens
gagaaccucaggc

SEQ ID NO: 1388547 - RNA, 16 nt, Homo sapiens
gagaacuauccaaaac

SEQ ID NO: 1388548 - RNA, 15 nt, Homo sapiens
gagaaggaaagugau

SEQ ID NO: 1388549 - RNA, 21 nt, Homo sapiens
gagaagugccccugcugccuc

SEQ ID NO: 1388550 - RNA, 18 nt, Homo sapiens
gagaaucagaucauuuca

SEQ ID NO: 1388551 - RNA, 21 nt, Homo sapiens
gagaaucgcuugaacccagga

SEQ ID NO: 1388552 - RNA, 12 nt, Homo sapiens
gagaaugccauu

SEQ ID NO: 1388553 - RNA, 16 nt, Homo sapiens
gagaauguuguauuca

SEQ ID NO: 1388554 - RNA, 13 nt, Homo sapiens
gagacacagggca

SEQ ID NO: 1388555 - RNA, 23 nt, Homo sapiens
gagacacuauuuaucugugcaaa

SEQ ID NO: 1388556 - RNA, 15 nt, Homo sapiens
gagacaggcccaaga

SEQ ID NO: 1388557 - RNA, 12 nt, Homo sapiens
gagacaggguuu

SEQ ID NO: 1388558 - RNA, 14 nt, Homo sapiens
gagacagugaggcu

SEQ ID NO: 1388559 - RNA, 12 nt, Homo sapiens
gagacauggcuu

SEQ ID NO: 1388560 - RNA, 20 nt, Homo sapiens
gagacccucguggccuuccc

SEQ ID NO: 1388561 - RNA, 20 nt, Homo sapiens
gagacucaccucugccucaa

SEQ ID NO: 1388562 - RNA, 23 nt, Homo sapiens
gagacucagggccccagcacuaa

SEQ ID NO: 1388563 - RNA, 13 nt, Homo sapiens
gagacuccgucuc

SEQ ID NO: 1388564 - RNA, 17 nt, Homo sapiens
gagacuggauacugccc

SEQ ID NO: 1388565 - RNA, 17 nt, Homo sapiens
gagacuuuacauggaug

SEQ ID NO: 1388566 - RNA, 21 nt, Homo sapiens
gagagaacaacuacugugauc

SEQ ID NO: 1388567 - RNA, 12 nt, Homo sapiens
gagagaacugaa

SEQ ID NO: 1388568 - RNA, 12 nt, Homo sapiens
gagagauguuuu

SEQ ID NO: 1388569 - RNA, 17 nt, Homo sapiens
gagagauucaugcugau

SEQ ID NO: 1388570 - RNA, 16 nt, Homo sapiens
gagagcaacacaggau

SEQ ID NO: 1388571 - RNA, 13 nt, Homo sapiens
gagagcagugugg

SEQ ID NO: 1388572 - RNA, 23 nt, Homo sapiens
gagaguaucugaggcacauguca

SEQ ID NO: 1388573 - RNA, 17 nt, Homo sapiens
gagagucugugacccac

SEQ ID NO: 1388574 - RNA, 16 nt, Homo sapiens
gagaguggaacagaag

SEQ ID NO: 1388575 - RNA, 16 nt, Homo sapiens
gagaguggcuccuccc

SEQ ID NO: 1388576 - RNA, 23 nt, Homo sapiens
gagauagaagaacugcaaaggua

SEQ ID NO: 1388577 - RNA, 21 nt, Homo sapiens
gagauaggccugugggccaga

SEQ ID NO: 1388578 - RNA, 17 nt, Homo sapiens
gagauccuuuaaauccu

SEQ ID NO: 1388579 - RNA, 17 nt, Homo sapiens
gagaucgcgccacugca

SEQ ID NO: 1388580 - RNA, 19 nt, Homo sapiens
gagaucuauauauguauaa

SEQ ID NO: 1388581 - RNA, 19 nt, Homo sapiens
gagaugggaugcuugccua

SEQ ID NO: 1388582 - RNA, 17 nt, Homo sapiens
gagauggguuugacaag

SEQ ID NO: 1388583 - RNA, 18 nt, Homo sapiens
gagauuucuuguugcuca

SEQ ID NO: 1388584 - RNA, 21 nt, Homo sapiens
gagcaaauaaagaccugagaa

SEQ ID NO: 1388585 - RNA, 14 nt, Homo sapiens
gagcaacacaggau

SEQ ID NO: 1388586 - RNA, 15 nt, Homo sapiens
gagcagaacuuucac

SEQ ID NO: 1388587 - RNA, 20 nt, Homo sapiens
gagcagugcuugaaugaagu

SEQ ID NO: 1388588 - RNA, 21 nt, Homo sapiens
gagcagugcuugaaugaaguu

SEQ ID NO: 1388589 - RNA, 14 nt, Homo sapiens
gagcagugucuucc

SEQ ID NO: 1388590 - RNA, 21 nt, Homo sapiens
gagcaugcucaguuggugcug

SEQ ID NO: 1388591 - RNA, 17 nt, Homo sapiens
gagcauguuacugacag

SEQ ID NO: 1388592 - RNA, 23 nt, Homo sapiens
gagccaauugauuucaacagaau

SEQ ID NO: 1388593 - RNA, 17 nt, Homo sapiens
gagccaccccuaaagag

SEQ ID NO: 1388594 - RNA, 18 nt, Homo sapiens
gagccagggcugucuucg

SEQ ID NO: 1388595 - RNA, 22 nt, Homo sapiens
gagcccccagagcuggaccuga

SEQ ID NO: 1388596 - RNA, 21 nt, Homo sapiens
gagccccugggacugcugcuu

SEQ ID NO: 1388597 - RNA, 22 nt, Homo sapiens
gagcccugucuccucucucugu

SEQ ID NO: 1388598 - RNA, 14 nt, Homo sapiens
gagcccuuaugaca

SEQ ID NO: 1388599 - RNA, 21 nt, Homo sapiens
gagccgagauugcaccacugc

SEQ ID NO: 1388600 - RNA, 16 nt, Homo sapiens
gagccuccacugccuc

SEQ ID NO: 1388601 - RNA, 12 nt, Homo sapiens
gagccugcaguu

SEQ ID NO: 1388602 - RNA, 16 nt, Homo sapiens
gagccugcugcauggg

SEQ ID NO: 1388603 - RNA, 12 nt, Homo sapiens
gagccuggacaa

SEQ ID NO: 1388604 - RNA, 16 nt, Homo sapiens
gagccuggcaagaaug

SEQ ID NO: 1388605 - RNA, 17 nt, Homo sapiens
gagcguuugcccaaauc

SEQ ID NO: 1388606 - RNA, 14 nt, Homo sapiens
gagcuagucuuuca

SEQ ID NO: 1388607 - RNA, 23 nt, Homo sapiens
gagcuauucucacucggaccugg

SEQ ID NO: 1388608 - RNA, 17 nt, Homo sapiens
gagcuggaccucaccaa

SEQ ID NO: 1388609 - RNA, 16 nt, Homo sapiens
gagcugggauguuucu

SEQ ID NO: 1388610 - RNA, 13 nt, Homo sapiens
gagcugggcagaa

SEQ ID NO: 1388611 - RNA, 14 nt, Homo sapiens
gagcugggggccau

SEQ ID NO: 1388612 - RNA, 16 nt, Homo sapiens
gagcugggggccauga

SEQ ID NO: 1388613 - RNA, 20 nt, Homo sapiens
gagcuguuuucccugaccuc

SEQ ID NO: 1388614 - RNA, 24 nt, Homo sapiens
gagcuucugggaagacaacuagga

SEQ ID NO: 1388615 - RNA, 13 nt, Homo sapiens
gagcuugcaguga

SEQ ID NO: 1388616 - RNA, 14 nt, Homo sapiens
gagcuuucugcuau

SEQ ID NO: 1388617 - RNA, 20 nt, Homo sapiens
gagcuuuugguaugugacau

SEQ ID NO: 1388618 - RNA, 17 nt, Homo sapiens
gaggaacacugcacucu

SEQ ID NO: 1388619 - RNA, 19 nt, Homo sapiens
gaggacuguugacauccaa

SEQ ID NO: 1388620 - RNA, 14 nt, Homo sapiens
gaggaguuccuuga

SEQ ID NO: 1388621 - RNA, 14 nt, Homo sapiens
gaggauaugggugg

SEQ ID NO: 1388622 - RNA, 20 nt, Homo sapiens
gaggauaugggugggagcga

SEQ ID NO: 1388623 - RNA, 16 nt, Homo sapiens
gaggauuucaucucuu

SEQ ID NO: 1388624 - RNA, 20 nt, Homo sapiens
gaggcaagagaauugcuuga

SEQ ID NO: 1388625 - RNA, 20 nt, Homo sapiens
gaggcagagguugcagugag

SEQ ID NO: 1388626 - RNA, 22 nt, Homo sapiens
gaggcagccccauucugccugc

SEQ ID NO: 1388627 - RNA, 20 nt, Homo sapiens
gaggcaggagaauugcuuga

SEQ ID NO: 1388628 - RNA, 12 nt, Homo sapiens
gaggcagggaag

SEQ ID NO: 1388629 - RNA, 18 nt, Homo sapiens
gaggccaaggagggugga

SEQ ID NO: 1388630 - RNA, 12 nt, Homo sapiens
gaggccuguccu

SEQ ID NO: 1388631 - RNA, 16 nt, Homo sapiens
gaggcugaggcaagag

SEQ ID NO: 1388632 - RNA, 13 nt, Homo sapiens
gaggcugcaguga

SEQ ID NO: 1388633 - RNA, 13 nt, Homo sapiens
gaggcugucuucu

SEQ ID NO: 1388634 - RNA, 20 nt, Homo sapiens
gagggaaaguaaauauuuca

SEQ ID NO: 1388635 - RNA, 13 nt, Homo sapiens
gagggagguguuu

SEQ ID NO: 1388636 - RNA, 21 nt, Homo sapiens
gaggggacuauuuaugaaggc

SEQ ID NO: 1388637 - RNA, 20 nt, Homo sapiens
gaggguuguucuccuagacu

SEQ ID NO: 1388638 - RNA, 15 nt, Homo sapiens
gcaacugaggcagac

SEQ ID NO: 1388639 - RNA, 22 nt, Homo sapiens
gcaacugaggcagacagcagcu

SEQ ID NO: 1388640 - RNA, 18 nt, Homo sapiens
gcaagaagucaaaguaaa

SEQ ID NO: 1388641 - RNA, 17 nt, Homo sapiens
gcaagagaauuacuuga

SEQ ID NO: 1388642 - RNA, 19 nt, Homo sapiens
gcaaggagaccaccaacag

SEQ ID NO: 1388643 - RNA, 20 nt, Homo sapiens
gcaaguauguuuuagcaugu

SEQ ID NO: 1388644 - RNA, 16 nt, Homo sapiens
gcaagucccugacucu

SEQ ID NO: 1388645 - RNA, 13 nt, Homo sapiens
gcaagugugugca

SEQ ID NO: 1388646 - RNA, 21 nt, Homo sapiens
gcaaguuggaaaauauguaac

SEQ ID NO: 1388647 - RNA, 23 nt, Homo sapiens
gcaauaaaauaacagacugucug

SEQ ID NO: 1388648 - RNA, 20 nt, Homo sapiens
gcaauaaccucaaagugacu

SEQ ID NO: 1388649 - RNA, 15 nt, Homo sapiens
gcaaucacauaguga

SEQ ID NO: 1388650 - RNA, 14 nt, Homo sapiens
gcaaugauuacucu

SEQ ID NO: 1388651 - RNA, 22 nt, Homo sapiens
gcaaugccaaucuucaguauuu

SEQ ID NO: 1388652 - RNA, 15 nt, Homo sapiens
gcaaugucagaugaa

SEQ ID NO: 1388653 - RNA, 18 nt, Homo sapiens
gcaaugucagaugaaguc

SEQ ID NO: 1388654 - RNA, 19 nt, Homo sapiens
gcaauugggauggcgcuag

SEQ ID NO: 1388655 - RNA, 22 nt, Homo sapiens
gcacaaaauauaaagcaucuaa

SEQ ID NO: 1388656 - RNA, 22 nt, Homo sapiens
gcacaaaccaauuaaacccagu

SEQ ID NO: 1388657 - RNA, 18 nt, Homo sapiens
gcacacagcugcagagac

SEQ ID NO: 1388658 - RNA, 20 nt, Homo sapiens
gcacacuagccucuccagga

SEQ ID NO: 1388659 - RNA, 22 nt, Homo sapiens
gcacacucacuggcaucuuugc

SEQ ID NO: 1388660 - RNA, 15 nt, Homo sapiens
gcacacucagcaccc

SEQ ID NO: 1388661 - RNA, 19 nt, Homo sapiens
gcacacuccccugcacugg

SEQ ID NO: 1388662 - RNA, 23 nt, Homo sapiens
gcacagagagggggccaccuccc

SEQ ID NO: 1388663 - RNA, 13 nt, Homo sapiens
gcacagauggauu

SEQ ID NO: 1388664 - RNA, 15 nt, Homo sapiens
gcaccaauaaagccu

SEQ ID NO: 1388665 - RNA, 16 nt, Homo sapiens
gcaccaauaaagccuu

SEQ ID NO: 1388666 - RNA, 13 nt, Homo sapiens
gcaccaucucuga

SEQ ID NO: 1388667 - RNA, 19 nt, Homo sapiens
gcaccauugcugcuccuua

SEQ ID NO: 1388668 - RNA, 13 nt, Homo sapiens
gcacccucuccag

SEQ ID NO: 1388669 - RNA, 14 nt, Homo sapiens
gcacccuugcgcuu

SEQ ID NO: 1388670 - RNA, 12 nt, Homo sapiens
gcaccuaccuca

SEQ ID NO: 1388671 - RNA, 23 nt, Homo sapiens
gcacguaguagggucaggccacg

SEQ ID NO: 1388672 - RNA, 15 nt, Homo sapiens
gcacugacugggcau

SEQ ID NO: 1388673 - RNA, 22 nt, Homo sapiens
gcacuggguugacuuucaggua

SEQ ID NO: 1388674 - RNA, 15 nt, Homo sapiens
gcacuuuaaaugaag

SEQ ID NO: 1388675 - RNA, 21 nt, Homo sapiens
gcagacugcaaaucugccuga

SEQ ID NO: 1388676 - RNA, 21 nt, Homo sapiens
gcagacuggugagcagacugg

SEQ ID NO: 1388677 - RNA, 21 nt, Homo sapiens
gcagagcuugaacacagucuc

SEQ ID NO: 1388678 - RNA, 22 nt, Homo sapiens
gcagagcuugaacacagucuca

SEQ ID NO: 1388679 - RNA, 20 nt, Homo sapiens
gcagagcuuguuuuguuuca

SEQ ID NO: 1388680 - RNA, 16 nt, Homo sapiens
gcagaguacaaaguaa

SEQ ID NO: 1388681 - RNA, 20 nt, Homo sapiens
gcagaguacuggcugaugga

SEQ ID NO: 1388682 - RNA, 19 nt, Homo sapiens
gcagauacaggaaaagcug

SEQ ID NO: 1388683 - RNA, 21 nt, Homo sapiens
gcagauugaaaaggacaccuu

SEQ ID NO: 1388684 - RNA, 16 nt, Homo sapiens
gcagccacaaccaaaa

SEQ ID NO: 1388685 - RNA, 13 nt, Homo sapiens
gcagcccaugccc

SEQ ID NO: 1388686 - RNA, 20 nt, Homo sapiens
gcagcccucagcagcugcag

SEQ ID NO: 1388687 - RNA, 18 nt, Homo sapiens
gcagcgccucaucuucaa

SEQ ID NO: 1388688 - RNA, 22 nt, Homo sapiens
gcagcuaccagguguucuacac

SEQ ID NO: 1388689 - RNA, 18 nt, Homo sapiens
gcagcuaucucucaguga

SEQ ID NO: 1388690 - RNA, 15 nt, Homo sapiens
gcagcugccagagaa

SEQ ID NO: 1388691 - RNA, 21 nt, Homo sapiens
gcaggagaaucacuugcacuc

SEQ ID NO: 1388692 - RNA, 17 nt, Homo sapiens
gcaggagaauugcuuga

SEQ ID NO: 1388693 - RNA, 15 nt, Homo sapiens
gcagggaaacagcua

SEQ ID NO: 1388694 - RNA, 13 nt, Homo sapiens
gcagggcucugau

SEQ ID NO: 1388695 - RNA, 20 nt, Homo sapiens
gcagggggugugucugcuca

SEQ ID NO: 1388696 - RNA, 18 nt, Homo sapiens
gcagucacuuuuccugug

SEQ ID NO: 1388697 - RNA, 18 nt, Homo sapiens
gcagugacgugcaccugu

SEQ ID NO: 1388698 - RNA, 15 nt, Homo sapiens
gcagugaugcuggau

SEQ ID NO: 1388699 - RNA, 21 nt, Homo sapiens
gcagugaugcuggaugcuccu

SEQ ID NO: 1388700 - RNA, 18 nt, Homo sapiens
gcagugcagcaaccagag

SEQ ID NO: 1388701 - RNA, 22 nt, Homo sapiens
gcagugccuuucuucucuccag

SEQ ID NO: 1388702 - RNA, 21 nt, Homo sapiens
gcaguguuucccguauugaca

SEQ ID NO: 1388703 - RNA, 22 nt, Homo sapiens
gcaguugaaacaagaagccaca

SEQ ID NO: 1388704 - RNA, 12 nt, Homo sapiens
gcaguuguuauu

SEQ ID NO: 1388705 - RNA, 18 nt, Homo sapiens
gcauaauaagcuaaagag

SEQ ID NO: 1388706 - RNA, 18 nt, Homo sapiens
gcauagaguucagacuuu

SEQ ID NO: 1388707 - RNA, 16 nt, Homo sapiens
gcauagcaagacacau

SEQ ID NO: 1388708 - RNA, 18 nt, Homo sapiens
gcauaugaggaugcagag

SEQ ID NO: 1388709 - RNA, 12 nt, Homo sapiens
gcaucauuucag

SEQ ID NO: 1388710 - RNA, 14 nt, Homo sapiens
gcaucccaggggac

SEQ ID NO: 1388711 - RNA, 23 nt, Homo sapiens
gcaucucacagguagacaguaua

SEQ ID NO: 1388712 - RNA, 9 nt, Homo sapiens
gcaucuccc

SEQ ID NO: 1388713 - RNA, 14 nt, Homo sapiens
gcaucuccccucag

SEQ ID NO: 1388714 - RNA, 20 nt, Homo sapiens
gcaugaccugugaccagcac

SEQ ID NO: 1388715 - RNA, 21 nt, Homo sapiens
gcaugcauuuugcagcaguga

SEQ ID NO: 1388716 - RNA, 17 nt, Homo sapiens
gcauucaaguguacagu

SEQ ID NO: 1388717 - RNA, 12 nt, Homo sapiens
gcauucacccag

SEQ ID NO: 1388718 - RNA, 15 nt, Homo sapiens
gcauucauaacagaa

SEQ ID NO: 1388719 - RNA, 16 nt, Homo sapiens
gcauugagcaaagggg

SEQ ID NO: 1388720 - RNA, 15 nt, Homo sapiens
gcauuuuucugggag

SEQ ID NO: 1388721 - RNA, 13 nt, Homo sapiens
gccaaaagccuuu

SEQ ID NO: 1388722 - RNA, 15 nt, Homo sapiens
gccaaagauaaucuc

SEQ ID NO: 1388723 - RNA, 18 nt, Homo sapiens
gccaaccggucacccagg

SEQ ID NO: 1388724 - RNA, 18 nt, Homo sapiens
gccaagaggcuguuccca

SEQ ID NO: 1388725 - RNA, 19 nt, Homo sapiens
gccaagagggcugcaaaag

SEQ ID NO: 1388726 - RNA, 15 nt, Homo sapiens
gccaagcagugccca

SEQ ID NO: 1388727 - RNA, 15 nt, Homo sapiens
gccaagggccucuug

SEQ ID NO: 1388728 - RNA, 18 nt, Homo sapiens
gccaaguaagaaagugaa

SEQ ID NO: 1388729 - RNA, 15 nt, Homo sapiens
gccaaucacaagcag

SEQ ID NO: 1388730 - RNA, 14 nt, Homo sapiens
gccacaacccuguu

SEQ ID NO: 1388731 - RNA, 21 nt, Homo sapiens
gccacagaccuaggauuucau

SEQ ID NO: 1388732 - RNA, 21 nt, Homo sapiens
gccacagcuggugguaucuga

SEQ ID NO: 1388733 - RNA, 23 nt, Homo sapiens
gccacaugggaaacuuccaagac

SEQ ID NO: 1388734 - RNA, 16 nt, Homo sapiens
gccacgcgguacaaag

SEQ ID NO: 1388735 - RNA, 13 nt, Homo sapiens
gccacgugcucuc

SEQ ID NO: 1388736 - RNA, 20 nt, Homo sapiens
uggcagaccgugaccaucuu

SEQ ID NO: 1388737 - RNA, 15 nt, Homo sapiens
uggcagauuuuacaa

SEQ ID NO: 1388738 - RNA, 20 nt, Homo sapiens
uggcagcagaguguggccuu

SEQ ID NO: 1388739 - RNA, 17 nt, Homo sapiens
uggcagccgugccuuca

SEQ ID NO: 1388740 - RNA, 20 nt, Homo sapiens
uggcagcgccucaucuucaa

SEQ ID NO: 1388741 - RNA, 20 nt, Homo sapiens
uggcagugcagcaaccagag

SEQ ID NO: 1388742 - RNA, 19 nt, Homo sapiens
uggccagaagggggccaug

SEQ ID NO: 1388743 - RNA, 15 nt, Homo sapiens
uggccagcacucuga

SEQ ID NO: 1388744 - RNA, 15 nt, Homo sapiens
uggcccaacacaauu

SEQ ID NO: 1388745 - RNA, 16 nt, Homo sapiens
uggcccacgcacuucg

SEQ ID NO: 1388746 - RNA, 17 nt, Homo sapiens
uggcccagagaagccaa

SEQ ID NO: 1388747 - RNA, 16 nt, Homo sapiens
uggccgggcacagcug

SEQ ID NO: 1388748 - RNA, 15 nt, Homo sapiens
uggccucaagugauu

SEQ ID NO: 1388749 - RNA, 15 nt, Homo sapiens
uggccuccugugcau

SEQ ID NO: 1388750 - RNA, 19 nt, Homo sapiens
uggccugcugggcucucca

SEQ ID NO: 1388751 - RNA, 16 nt, Homo sapiens
uggccuggggcuucug

SEQ ID NO: 1388752 - RNA, 17 nt, Homo sapiens
uggccuugaaaccaccu

SEQ ID NO: 1388753 - RNA, 14 nt, Homo sapiens
uggcuaacuggcga

SEQ ID NO: 1388754 - RNA, 16 nt, Homo sapiens
uggcuaaggacaggca

SEQ ID NO: 1388755 - RNA, 18 nt, Homo sapiens
uggcuaguaaaagccauc

SEQ ID NO: 1388756 - RNA, 15 nt, Homo sapiens
uggcuccaacacugc

SEQ ID NO: 1388757 - RNA, 17 nt, Homo sapiens
uggcuccaggacagacc

SEQ ID NO: 1388758 - RNA, 19 nt, Homo sapiens
uggcucugagauacuaaua

SEQ ID NO: 1388759 - RNA, 12 nt, Homo sapiens
uggcugcaguga

SEQ ID NO: 1388760 - RNA, 15 nt, Homo sapiens
uggcugcuagcacuu

SEQ ID NO: 1388761 - RNA, 12 nt, Homo sapiens
uggcuggcugcc

SEQ ID NO: 1388762 - RNA, 13 nt, Homo sapiens
uggcuucagggga

SEQ ID NO: 1388763 - RNA, 13 nt, Homo sapiens
uggcuucugauga

SEQ ID NO: 1388764 - RNA, 14 nt, Homo sapiens
uggcuucugaugaa

SEQ ID NO: 1388765 - RNA, 19 nt, Homo sapiens
ugggaacaugcgugugacc

SEQ ID NO: 1388766 - RNA, 15 nt, Homo sapiens
ugggaacugugccuu

SEQ ID NO: 1388767 - RNA, 15 nt, Homo sapiens
ugggaaggugaccac

SEQ ID NO: 1388768 - RNA, 16 nt, Homo sapiens
ugggacaaaggacauu

SEQ ID NO: 1388769 - RNA, 12 nt, Homo sapiens
ugggacugagau

SEQ ID NO: 1388770 - RNA, 13 nt, Homo sapiens
ugggacugagaug

SEQ ID NO: 1388771 - RNA, 15 nt, Homo sapiens
ugggagcaccgccug

SEQ ID NO: 1388772 - RNA, 21 nt, Homo sapiens
ugggagguggagguugcagug

SEQ ID NO: 1388773 - RNA, 21 nt, Homo sapiens
ugggagugcccccaacagcac

SEQ ID NO: 1388774 - RNA, 20 nt, Homo sapiens
ugggaguucagcugcuucuc

SEQ ID NO: 1388775 - RNA, 14 nt, Homo sapiens
ugggaugaugccuc

SEQ ID NO: 1388776 - RNA, 15 nt, Homo sapiens
ugggauggauuucca

SEQ ID NO: 1388777 - RNA, 21 nt, Homo sapiens
ugggauguccacagaugccuc

SEQ ID NO: 1388778 - RNA, 19 nt, Homo sapiens
ugggauuacaggugugaac

SEQ ID NO: 1388779 - RNA, 17 nt, Homo sapiens
ugggcaacauagugaga

SEQ ID NO: 1388780 - RNA, 21 nt, Homo sapiens
ugggcaccuggggagugggac

SEQ ID NO: 1388781 - RNA, 15 nt, Homo sapiens
ugggcagaaggccaa

SEQ ID NO: 1388782 - RNA, 15 nt, Homo sapiens
ugggcagacacuguu

SEQ ID NO: 1388783 - RNA, 22 nt, Homo sapiens
ugggcagacacuguuugcccag

SEQ ID NO: 1388784 - RNA, 12 nt, Homo sapiens
ugggccaaagaa

SEQ ID NO: 1388785 - RNA, 19 nt, Homo sapiens
ugggccaagucaaagacau

SEQ ID NO: 1388786 - RNA, 14 nt, Homo sapiens
ugggccacugugaa

SEQ ID NO: 1388787 - RNA, 20 nt, Homo sapiens
ugggcccagaggcacagccg

SEQ ID NO: 1388788 - RNA, 13 nt, Homo sapiens
ugggccuccucua

SEQ ID NO: 1388789 - RNA, 16 nt, Homo sapiens
ugggccuucgggguga

SEQ ID NO: 1388790 - RNA, 20 nt, Homo sapiens
uggggaaacggcccaccaag

SEQ ID NO: 1388791 - RNA, 14 nt, Homo sapiens
uggggaagacugug

SEQ ID NO: 1388792 - RNA, 15 nt, Homo sapiens
uggggaagcugugaa

SEQ ID NO: 1388793 - RNA, 23 nt, Homo sapiens
uggggacagagcagaacuuucac

SEQ ID NO: 1388794 - RNA, 18 nt, Homo sapiens
uggggagaaaagacauga

SEQ ID NO: 1388795 - RNA, 17 nt, Homo sapiens
uggggagacaccucaga

SEQ ID NO: 1388796 - RNA, 19 nt, Homo sapiens
uggggagggagagccauca

SEQ ID NO: 1388797 - RNA, 18 nt, Homo sapiens
uggggagggagguguuua

SEQ ID NO: 1388798 - RNA, 16 nt, Homo sapiens
uggggauaugauuuaa

SEQ ID NO: 1388799 - RNA, 17 nt, Homo sapiens
uggggaugguccacugu

SEQ ID NO: 1388800 - RNA, 20 nt, Homo sapiens
uggggcagcuugaggguugg

SEQ ID NO: 1388801 - RNA, 20 nt, Homo sapiens
uggggcaggcagugaugcug

SEQ ID NO: 1388802 - RNA, 19 nt, Homo sapiens
uggggcagucucugcccaa

SEQ ID NO: 1388803 - RNA, 23 nt, Homo sapiens
uggggcaugguauuugagacauu

SEQ ID NO: 1388804 - RNA, 14 nt, Homo sapiens
uggggccacagcca

SEQ ID NO: 1388805 - RNA, 18 nt, Homo sapiens
uggggcuuuuacaccagu

SEQ ID NO: 1388806 - RNA, 18 nt, Homo sapiens
ugggggacgugggcauuu

SEQ ID NO: 1388807 - RNA, 15 nt, Homo sapiens
ugggggaucuguugu

SEQ ID NO: 1388808 - RNA, 17 nt, Homo sapiens
ugggggccaugagcucc

SEQ ID NO: 1388809 - RNA, 16 nt, Homo sapiens
ugggggcuugcaagua

SEQ ID NO: 1388810 - RNA, 14 nt, Homo sapiens
uggggguauuguau

SEQ ID NO: 1388811 - RNA, 18 nt, Homo sapiens
uggguacuuguggacaca

SEQ ID NO: 1388812 - RNA, 14 nt, Homo sapiens
ugggugaagacaga

SEQ ID NO: 1388813 - RNA, 20 nt, Homo sapiens
ugggugacagagcaagugag

SEQ ID NO: 1388814 - RNA, 22 nt, Homo sapiens
uggguuccaauccuggcucugu

SEQ ID NO: 1388815 - RNA, 20 nt, Homo sapiens
uggguuuugggucuuugaac

SEQ ID NO: 1388816 - RNA, 18 nt, Homo sapiens
ugguaaccucuacuauga

SEQ ID NO: 1388817 - RNA, 22 nt, Homo sapiens
ugguagaacguaaccacggaaa

SEQ ID NO: 1388818 - RNA, 19 nt, Homo sapiens
ugguagcgggcgccuguag

SEQ ID NO: 1388819 - RNA, 20 nt, Homo sapiens
uggucaauccgaaguaugag

SEQ ID NO: 1388820 - RNA, 14 nt, Homo sapiens
uggucagauuugaa

SEQ ID NO: 1388821 - RNA, 20 nt, Homo sapiens
ugguccugacucaacauguu

SEQ ID NO: 1388822 - RNA, 19 nt, Homo sapiens
uggugaaaccccaucucua

SEQ ID NO: 1388823 - RNA, 17 nt, Homo sapiens
uggugacaccagccuuu

SEQ ID NO: 1388824 - RNA, 21 nt, Homo sapiens
uggugagaacuacucagggaa

SEQ ID NO: 1388825 - RNA, 13 nt, Homo sapiens
uggugaggcaaua

SEQ ID NO: 1388826 - RNA, 14 nt, Homo sapiens
uggugaggcaauaa

SEQ ID NO: 1388827 - RNA, 13 nt, Homo sapiens
uggugcacugagc

SEQ ID NO: 1388828 - RNA, 15 nt, Homo sapiens
ugguggagaaccaca

SEQ ID NO: 1388829 - RNA, 16 nt, Homo sapiens
ugguggguucagggga

SEQ ID NO: 1388830 - RNA, 17 nt, Homo sapiens
ugguguggccagcacuc

SEQ ID NO: 1388831 - RNA, 17 nt, Homo sapiens
ugguguugacaugugcu

SEQ ID NO: 1388832 - RNA, 17 nt, Homo sapiens
ugguuaagacuacugaa

SEQ ID NO: 1388833 - RNA, 23 nt, Homo sapiens
ugguuccggaauccuguccucag

SEQ ID NO: 1388834 - RNA, 17 nt, Homo sapiens
ugguuccggcucugcac

SEQ ID NO: 1388835 - RNA, 15 nt, Homo sapiens
ugguuggguccucac

SEQ ID NO: 1388836 - RNA, 18 nt, Homo sapiens
uguaaaacuauauucuca

SEQ ID NO: 1388837 - RNA, 19 nt, Homo sapiens
uguaaacauaauucuugua

SEQ ID NO: 1388838 - RNA, 22 nt, Homo sapiens
uguaaacuguacuagucugugu

SEQ ID NO: 1388839 - RNA, 21 nt, Homo sapiens
uguaaagcaggugcccaggaa

SEQ ID NO: 1388840 - RNA, 17 nt, Homo sapiens
uguaaauacacauagca

SEQ ID NO: 1388841 - RNA, 18 nt, Homo sapiens
uguaaauacacauagcau

SEQ ID NO: 1388842 - RNA, 22 nt, Homo sapiens
uguaacaagaaaggagagucuu

SEQ ID NO: 1388843 - RNA, 17 nt, Homo sapiens
uguaagcaccccuucau

SEQ ID NO: 1388844 - RNA, 24 nt, Homo sapiens
uguaagcucuuugaaacaacuuuc

SEQ ID NO: 1388845 - RNA, 18 nt, Homo sapiens
uguaagguggucacuguu

SEQ ID NO: 1388846 - RNA, 21 nt, Homo sapiens
uguaauaaguaucacacugua

SEQ ID NO: 1388847 - RNA, 20 nt, Homo sapiens
uguaaucccaacauuuuggg

SEQ ID NO: 1388848 - RNA, 19 nt, Homo sapiens
uguaaucccagcacuuugg

SEQ ID NO: 1388849 - RNA, 19 nt, Homo sapiens
uguaaucccagcuacuugg

SEQ ID NO: 1388850 - RNA, 12 nt, Homo sapiens
uguaaugcauag

SEQ ID NO: 1388851 - RNA, 22 nt, Homo sapiens
uguaaugguaucuuaaagugug

SEQ ID NO: 1388852 - RNA, 16 nt, Homo sapiens
uguaauugaaaaccaa

SEQ ID NO: 1388853 - RNA, 13 nt, Homo sapiens
uguacaccaaggu

SEQ ID NO: 1388854 - RNA, 21 nt, Homo sapiens
uguacaguauguucaaaguca

SEQ ID NO: 1388855 - RNA, 15 nt, Homo sapiens
uguaccugaugcuau

SEQ ID NO: 1388856 - RNA, 21 nt, Homo sapiens
uguacuggagagcaacacagg

SEQ ID NO: 1388857 - RNA, 16 nt, Homo sapiens
uguacuguuacugugu

SEQ ID NO: 1388858 - RNA, 19 nt, Homo sapiens
uguacuuuaaaaagaugua

SEQ ID NO: 1388859 - RNA, 19 nt, Homo sapiens
uguagaaaagaacuggaaa

SEQ ID NO: 1388860 - RNA, 15 nt, Homo sapiens
uguagacuauuugcu

SEQ ID NO: 1388861 - RNA, 17 nt, Homo sapiens
uguagauaaacucagaa

SEQ ID NO: 1388862 - RNA, 18 nt, Homo sapiens
uguagaugacauggugaa

SEQ ID NO: 1388863 - RNA, 22 nt, Homo sapiens
uguagccucgccgucugugaau

SEQ ID NO: 1388864 - RNA, 19 nt, Homo sapiens
uguaggcagucauggcacc

SEQ ID NO: 1388865 - RNA, 16 nt, Homo sapiens
uguaguaaacuauuua

SEQ ID NO: 1388866 - RNA, 13 nt, Homo sapiens
uguaguacuccuu

SEQ ID NO: 1388867 - RNA, 20 nt, Homo sapiens
uguagucccagcuacuugag

SEQ ID NO: 1388868 - RNA, 16 nt, Homo sapiens
uguauauaaacauauc

SEQ ID NO: 1388869 - RNA, 15 nt, Homo sapiens
uguaucaaguggcau

SEQ ID NO: 1388870 - RNA, 17 nt, Homo sapiens
uguaucauuugaacaac

SEQ ID NO: 1388871 - RNA, 17 nt, Homo sapiens
uguaucggagacaguga

SEQ ID NO: 1388872 - RNA, 20 nt, Homo sapiens
uguaugauuacaucaaggcu

SEQ ID NO: 1388873 - RNA, 19 nt, Homo sapiens
uguaugccaagugaaaaaa

SEQ ID NO: 1388874 - RNA, 22 nt, Homo sapiens
uguaugugcgugugugcaagug

SEQ ID NO: 1388875 - RNA, 16 nt, Homo sapiens
uguauuguucccagug

SEQ ID NO: 1388876 - RNA, 17 nt, Homo sapiens
uguauuuccagugcaau

SEQ ID NO: 1388877 - RNA, 17 nt, Homo sapiens
uguauuuuauuacaucu

SEQ ID NO: 1388878 - RNA, 16 nt, Homo sapiens
ugucaaugacaguuuc

SEQ ID NO: 1388879 - RNA, 19 nt, Homo sapiens
ugucacauagagugaucuu

SEQ ID NO: 1388880 - RNA, 15 nt, Homo sapiens
ugucacccaaugcau

SEQ ID NO: 1388881 - RNA, 15 nt, Homo sapiens
ugucacuaaagcagg

SEQ ID NO: 1388882 - RNA, 15 nt, Homo sapiens
ugucagcaaguccua

SEQ ID NO: 1388883 - RNA, 15 nt, Homo sapiens
ugucagccaugacca

SEQ ID NO: 1388884 - RNA, 12 nt, Homo sapiens
ugucauaugcag

SEQ ID NO: 1388885 - RNA, 21 nt, Homo sapiens
ugucaucucagcuggaucucc

SEQ ID NO: 1388886 - RNA, 21 nt, Homo sapiens
ugucaucuuccuggaagcaga

SEQ ID NO: 1388887 - RNA, 22 nt, Homo sapiens
ugucaucuuccuggaagcagag

SEQ ID NO: 1388888 - RNA, 14 nt, Homo sapiens
ugucauugcuuuac

SEQ ID NO: 1388889 - RNA, 14 nt, Homo sapiens
uguccaacuccagu

SEQ ID NO: 1388890 - RNA, 18 nt, Homo sapiens
uguccauaucuaaccagu

SEQ ID NO: 1388891 - RNA, 14 nt, Homo sapiens
uguccaucccagcg

SEQ ID NO: 1388892 - RNA, 15 nt, Homo sapiens
uguccaugccuucca

SEQ ID NO: 1388893 - RNA, 21 nt, Homo sapiens
uguccccuuuuauugcugcuu

SEQ ID NO: 1388894 - RNA, 18 nt, Homo sapiens
uguccuccccucaaggac

SEQ ID NO: 1388895 - RNA, 17 nt, Homo sapiens
uguccucccuuguggcu

SEQ ID NO: 1388896 - RNA, 13 nt, Homo sapiens
ugucguagccaag

SEQ ID NO: 1388897 - RNA, 16 nt, Homo sapiens
ugucuauguauguuau

SEQ ID NO: 1388898 - RNA, 22 nt, Homo sapiens
ugucucaaaccuccaaaagccc

SEQ ID NO: 1388899 - RNA, 16 nt, Homo sapiens
ugucucaaauucaugg

SEQ ID NO: 1388900 - RNA, 16 nt, Homo sapiens
ugucucagaccacuau

SEQ ID NO: 1388901 - RNA, 12 nt, Homo sapiens
ugucucauauga

SEQ ID NO: 1388902 - RNA, 14 nt, Homo sapiens
ugucuccuaccucu

SEQ ID NO: 1388903 - RNA, 18 nt, Homo sapiens
ugucucuuuaaugucaca

SEQ ID NO: 1388904 - RNA, 14 nt, Homo sapiens
ugucugacaaccuc

SEQ ID NO: 1388905 - RNA, 21 nt, Homo sapiens
ugucuguaaugacaaauaagu

SEQ ID NO: 1388906 - RNA, 22 nt, Homo sapiens
ugucuguaucggagacagugau

SEQ ID NO: 1388907 - RNA, 13 nt, Homo sapiens
ugucugugugcaa

SEQ ID NO: 1388908 - RNA, 15 nt, Homo sapiens
ugucuguuaacuuaa

SEQ ID NO: 1388909 - RNA, 20 nt, Homo sapiens
ugucuuccugcauucaccca

SEQ ID NO: 1388910 - RNA, 15 nt, Homo sapiens
ugucuucuuugccca

SEQ ID NO: 1388911 - RNA, 19 nt, Homo sapiens
ugucuuuauaaucuacucc

SEQ ID NO: 1388912 - RNA, 16 nt, Homo sapiens
ugucuuuggugcuuuu

SEQ ID NO: 1388913 - RNA, 19 nt, Homo sapiens
ugucuuuguucuucuacca

SEQ ID NO: 1388914 - RNA, 12 nt, Homo sapiens
ugugaaagucag

SEQ ID NO: 1388915 - RNA, 15 nt, Homo sapiens
ugugaaccaccacac

SEQ ID NO: 1388916 - RNA, 14 nt, Homo sapiens
ugugaaguacauau

SEQ ID NO: 1388917 - RNA, 21 nt, Homo sapiens
ugugaccauuagcauuuguca

SEQ ID NO: 1388918 - RNA, 12 nt, Homo sapiens
ugugagcaagaa

SEQ ID NO: 1388919 - RNA, 18 nt, Homo sapiens
ugugagugugugcaagua

SEQ ID NO: 1388920 - RNA, 19 nt, Homo sapiens
ugugagugugugcaaguau

SEQ ID NO: 1388921 - RNA, 13 nt, Homo sapiens
ugugauaaaaccc

SEQ ID NO: 1388922 - RNA, 18 nt, Homo sapiens
ugugaucggccuggggaa

SEQ ID NO: 1388923 - RNA, 20 nt, Homo sapiens
ugugcagguuuugaaaaugu

SEQ ID NO: 1388924 - RNA, 20 nt, Homo sapiens
ugugcccagagaugggacug

SEQ ID NO: 1388925 - RNA, 13 nt, Homo sapiens
ugugcccucagau

SEQ ID NO: 1388926 - RNA, 17 nt, Homo sapiens
ugugccugaagucccag

SEQ ID NO: 1388927 - RNA, 16 nt, Homo sapiens
ugugccuggagcuccu

SEQ ID NO: 1388928 - RNA, 19 nt, Homo sapiens
ugugccuuaggaaaagcau

SEQ ID NO: 1388929 - RNA, 15 nt, Homo sapiens
ugugcgccuacagga

SEQ ID NO: 1388930 - RNA, 12 nt, Homo sapiens
ugugcucaggga

SEQ ID NO: 1388931 - RNA, 13 nt, Homo sapiens
ugugcucagggaa

SEQ ID NO: 1388932 - RNA, 11 nt, Homo sapiens
ugugcugugac

SEQ ID NO: 1388933 - RNA, 12 nt, Homo sapiens
ugugcugugacu

SEQ ID NO: 1388934 - RNA, 23 nt, Homo sapiens
uguggaauauaaagauggcugac

SEQ ID NO: 1388935 - RNA, 19 nt, Homo sapiens
uguggccaugguccccaag

SEQ ID NO: 1388936 - RNA, 14 nt, Homo sapiens
uguggcccaagaca

SEQ ID NO: 1388937 - RNA, 23 nt, Homo sapiens
uguggcccagggaagccaaaaga

SEQ ID NO: 1388938 - RNA, 15 nt, Homo sapiens
uguggccccaacaca

SEQ ID NO: 1388939 - RNA, 16 nt, Homo sapiens
uguggccuuggucuaa

SEQ ID NO: 1388940 - RNA, 16 nt, Homo sapiens
uguggcucacgugugu

SEQ ID NO: 1388941 - RNA, 14 nt, Homo sapiens
uguggcuuccucag

SEQ ID NO: 1388942 - RNA, 20 nt, Homo sapiens
ugugggaaugcggcaagaag

SEQ ID NO: 1388943 - RNA, 18 nt, Homo sapiens
uguggggaagaguggucu

SEQ ID NO: 1388944 - RNA, 20 nt, Homo sapiens
uguggucaauccgaaguaug

SEQ ID NO: 1388945 - RNA, 16 nt, Homo sapiens
uguggugagaucaugc

SEQ ID NO: 1388946 - RNA, 21 nt, Homo sapiens
uguguaacugcccaaagcagc

SEQ ID NO: 1388947 - RNA, 16 nt, Homo sapiens
uguguaccugugacua

SEQ ID NO: 1388948 - RNA, 13 nt, Homo sapiens
uguguaugugcgu

SEQ ID NO: 1388949 - RNA, 18 nt, Homo sapiens
uguguauuuccagugcaa

SEQ ID NO: 1388950 - RNA, 19 nt, Homo sapiens
uguguauuuccagugcaau

SEQ ID NO: 1388951 - RNA, 24 nt, Homo sapiens
uguguauuuccagugcaauuguag

SEQ ID NO: 1388952 - RNA, 16 nt, Homo sapiens
ugugucagccaugacc

SEQ ID NO: 1388953 - RNA, 19 nt, Homo sapiens
ugugucagggaacauauuu

SEQ ID NO: 1388954 - RNA, 15 nt, Homo sapiens
uguguccaacuccag

SEQ ID NO: 1388955 - RNA, 13 nt, Homo sapiens
uguguccaugugu

SEQ ID NO: 1388956 - RNA, 15 nt, Homo sapiens
ugugucgcuuauguc

SEQ ID NO: 1388957 - RNA, 18 nt, Homo sapiens
ugugugaacuaacaugca

SEQ ID NO: 1388958 - RNA, 17 nt, Homo sapiens
ugugugagaauaaacua

SEQ ID NO: 1388959 - RNA, 13 nt, Homo sapiens
ugugugcaagugu

SEQ ID NO: 1388960 - RNA, 17 nt, Homo sapiens
ugugugcaagugugugc

SEQ ID NO: 1388961 - RNA, 12 nt, Homo sapiens
aaaaaaaauccc

SEQ ID NO: 1388962 - RNA, 12 nt, Homo sapiens
aaaaaacagagg

SEQ ID NO: 1388963 - RNA, 18 nt, Homo sapiens
aaaaaaccuucagugaaa

SEQ ID NO: 1388964 - RNA, 12 nt, Homo sapiens
aaaaaagccaaa

SEQ ID NO: 1388965 - RNA, 20 nt, Homo sapiens
aaaaaaguaaguaccacuca

SEQ ID NO: 1388966 - RNA, 12 nt, Homo sapiens
aaaaaaucugac

SEQ ID NO: 1388967 - RNA, 12 nt, Homo sapiens
aaaaacuuccau

SEQ ID NO: 1388968 - RNA, 14 nt, Homo sapiens
aaaaagacacuuga

SEQ ID NO: 1388969 - RNA, 18 nt, Homo sapiens
aaaaagauagcauugggg

SEQ ID NO: 1388970 - RNA, 12 nt, Homo sapiens
aaaaaggcaccu

SEQ ID NO: 1388971 - RNA, 21 nt, Homo sapiens
aaaaagggauccguacauuca

SEQ ID NO: 1388972 - RNA, 22 nt, Homo sapiens
aaaaagggauccguacauucaa

SEQ ID NO: 1388973 - RNA, 16 nt, Homo sapiens
aaaaaguucagcauga

SEQ ID NO: 1388974 - RNA, 23 nt, Homo sapiens
aaaaaguucagcaugaaggaugc

SEQ ID NO: 1388975 - RNA, 16 nt, Homo sapiens
aaaaauaguggccaga

SEQ ID NO: 1388976 - RNA, 19 nt, Homo sapiens
aaaaauccauaaaauccuu

SEQ ID NO: 1388977 - RNA, 14 nt, Homo sapiens
aaaaaugacuaaaa

SEQ ID NO: 1388978 - RNA, 18 nt, Homo sapiens
aaaaauuuaagcauuguu

SEQ ID NO: 1388979 - RNA, 14 nt, Homo sapiens
aaaacacagacauu

SEQ ID NO: 1388980 - RNA, 13 nt, Homo sapiens
aaaacacuuccau

SEQ ID NO: 1388981 - RNA, 13 nt, Homo sapiens
aaaacagaaagca

SEQ ID NO: 1388982 - RNA, 18 nt, Homo sapiens
aaaacagccucacagaag

SEQ ID NO: 1388983 - RNA, 11 nt, Homo sapiens
aaaacauucac

SEQ ID NO: 1388984 - RNA, 13 nt, Homo sapiens
aaaacauuuuacu

SEQ ID NO: 1388985 - RNA, 16 nt, Homo sapiens
aaaaccaauagcuuua

SEQ ID NO: 1388986 - RNA, 24 nt, Homo sapiens
aaaaccaauguucucucuucucca

SEQ ID NO: 1388987 - RNA, 14 nt, Homo sapiens
aaaacccacagaag

SEQ ID NO: 1388988 - RNA, 14 nt, Homo sapiens
aaaaccuuccccag

SEQ ID NO: 1388989 - RNA, 20 nt, Homo sapiens
aaaacuacauuuuaacaugg

SEQ ID NO: 1388990 - RNA, 21 nt, Homo sapiens
aaaacuccacagucaauauua

SEQ ID NO: 1388991 - RNA, 22 nt, Homo sapiens
aaaacucugggaaauaagagag

SEQ ID NO: 1388992 - RNA, 11 nt, Homo sapiens
aaaacugacuc

SEQ ID NO: 1388993 - RNA, 17 nt, Homo sapiens
aaaacugauuuuuagcu

SEQ ID NO: 1388994 - RNA, 14 nt, Homo sapiens
aaaacugucccuuu

SEQ ID NO: 1388995 - RNA, 14 nt, Homo sapiens
aaaacuuaacauuc

SEQ ID NO: 1388996 - RNA, 18 nt, Homo sapiens
aaaacuuuaaucccacuu

SEQ ID NO: 1388997 - RNA, 18 nt, Homo sapiens
aaaacuuuucuaauacuc

SEQ ID NO: 1388998 - RNA, 22 nt, Homo sapiens
aaaagaaauucccuggaccaga

SEQ ID NO: 1388999 - RNA, 18 nt, Homo sapiens
aaaagaaccgagcaauuu

SEQ ID NO: 1389000 - RNA, 15 nt, Homo sapiens
aaaagacacagaaca

SEQ ID NO: 1389001 - RNA, 17 nt, Homo sapiens
aaaagagagaucuugau

SEQ ID NO: 1389002 - RNA, 15 nt, Homo sapiens
aaaagaugugcagau

SEQ ID NO: 1389003 - RNA, 21 nt, Homo sapiens
aaaagauguugugucuugugu

SEQ ID NO: 1389004 - RNA, 14 nt, Homo sapiens
aaaagcagcuacca

SEQ ID NO: 1389005 - RNA, 11 nt, Homo sapiens
aaaagccaaaa

SEQ ID NO: 1389006 - RNA, 12 nt, Homo sapiens
aaaagccaaaaa

SEQ ID NO: 1389007 - RNA, 23 nt, Homo sapiens
aaaaggcaccuauaaaacagguc

SEQ ID NO: 1389008 - RNA, 18 nt, Homo sapiens
aaaagggcagggcaucuc

SEQ ID NO: 1389009 - RNA, 15 nt, Homo sapiens
aaaaguaagcccuug

SEQ ID NO: 1389010 - RNA, 19 nt, Homo sapiens
aaaaguagguuuacauuca

SEQ ID NO: 1389011 - RNA, 18 nt, Homo sapiens
aaaagucuacgcucuccu

SEQ ID NO: 1389012 - RNA, 15 nt, Homo sapiens
aaaauaaaguuacau

SEQ ID NO: 1389013 - RNA, 20 nt, Homo sapiens
aaaauagaaauauagccaaa

SEQ ID NO: 1389014 - RNA, 11 nt, Homo sapiens
aaaauagccac

SEQ ID NO: 1389015 - RNA, 13 nt, Homo sapiens
aaaauaguaaugu

SEQ ID NO: 1389016 - RNA, 21 nt, Homo sapiens
aaaauauauuucagauaucag

SEQ ID NO: 1389017 - RNA, 11 nt, Homo sapiens
aaaauaugcau

SEQ ID NO: 1389018 - RNA, 17 nt, Homo sapiens
aaaauauguucuuuaaa

SEQ ID NO: 1389019 - RNA, 16 nt, Homo sapiens
aaaaucaaacagagac

SEQ ID NO: 1389020 - RNA, 19 nt, Homo sapiens
aaaaucaaguauuggcaaa

SEQ ID NO: 1389021 - RNA, 13 nt, Homo sapiens
aaaaucacucuca

SEQ ID NO: 1389022 - RNA, 19 nt, Homo sapiens
aaaauccaugaacaauuua

SEQ ID NO: 1389023 - RNA, 22 nt, Homo sapiens
aaaaucucagcaaugauuacuc

SEQ ID NO: 1389024 - RNA, 17 nt, Homo sapiens
aaaaugacaaugaugau

SEQ ID NO: 1389025 - RNA, 14 nt, Homo sapiens
aaaaugagguacuc

SEQ ID NO: 1389026 - RNA, 19 nt, Homo sapiens
aaaauguccaugauggaau

SEQ ID NO: 1389027 - RNA, 22 nt, Homo sapiens
aaaauguccucccuuguggcuu

SEQ ID NO: 1389028 - RNA, 15 nt, Homo sapiens
aaaauuggcauuaaa

SEQ ID NO: 1389029 - RNA, 17 nt, Homo sapiens
aaaauugugaucagacc

SEQ ID NO: 1389030 - RNA, 15 nt, Homo sapiens
aaaauuuaaauggag

SEQ ID NO: 1389031 - RNA, 11 nt, Homo sapiens
aaaauuuugcc

SEQ ID NO: 1389032 - RNA, 22 nt, Homo sapiens
aaacaaaaaaaccucuaugcaa

SEQ ID NO: 1389033 - RNA, 11 nt, Homo sapiens
aaacaaaaaua

SEQ ID NO: 1389034 - RNA, 12 nt, Homo sapiens
aaacaaaaccac

SEQ ID NO: 1389035 - RNA, 14 nt, Homo sapiens
aaacaaauaugcaa

SEQ ID NO: 1389036 - RNA, 15 nt, Homo sapiens
aaacaacuaccuccu

SEQ ID NO: 1389037 - RNA, 16 nt, Homo sapiens
aaacaacuuucucuug

SEQ ID NO: 1389038 - RNA, 21 nt, Homo sapiens
aaacaccugcugauguggcaa

SEQ ID NO: 1389039 - RNA, 22 nt, Homo sapiens
aaacagagacaggcccaagaga

SEQ ID NO: 1389040 - RNA, 22 nt, Homo sapiens
aaacaggcaguuggccagagag

SEQ ID NO: 1389041 - RNA, 13 nt, Homo sapiens
agaauauacuaaa

SEQ ID NO: 1389042 - RNA, 17 nt, Homo sapiens
agaaucacuugcacucc

SEQ ID NO: 1389043 - RNA, 21 nt, Homo sapiens
agaaucccggcugucaagggg

SEQ ID NO: 1389044 - RNA, 23 nt, Homo sapiens
agaaugagugaaucaccuguggu

SEQ ID NO: 1389045 - RNA, 16 nt, Homo sapiens
agaaugucugaucuaa

SEQ ID NO: 1389046 - RNA, 23 nt, Homo sapiens
agaauguucuuauguugcccagu

SEQ ID NO: 1389047 - RNA, 15 nt, Homo sapiens
agaauuuaaaccuau

SEQ ID NO: 1389048 - RNA, 14 nt, Homo sapiens
agaauuuagcugua

SEQ ID NO: 1389049 - RNA, 23 nt, Homo sapiens
agaauuugguaaauuaguauuua

SEQ ID NO: 1389050 - RNA, 15 nt, Homo sapiens
agaauuuguccaaua

SEQ ID NO: 1389051 - RNA, 21 nt, Homo sapiens
agacaaauagucggauuagaa

SEQ ID NO: 1389052 - RNA, 21 nt, Homo sapiens
agacaagcuuguccauguaau

SEQ ID NO: 1389053 - RNA, 16 nt, Homo sapiens
agacaagugacuguau

SEQ ID NO: 1389054 - RNA, 24 nt, Homo sapiens
agacaagugacuguaucuguguag

SEQ ID NO: 1389055 - RNA, 18 nt, Homo sapiens
agacaauauggucccaaa

SEQ ID NO: 1389056 - RNA, 18 nt, Homo sapiens
agacagaagucacucaau

SEQ ID NO: 1389057 - RNA, 16 nt, Homo sapiens
agacagacuugagaac

SEQ ID NO: 1389058 - RNA, 20 nt, Homo sapiens
agacaggccaugugagccac

SEQ ID NO: 1389059 - RNA, 21 nt, Homo sapiens
agacaggguuucgcaauguug

SEQ ID NO: 1389060 - RNA, 19 nt, Homo sapiens
agacaggguuuugccaugu

SEQ ID NO: 1389061 - RNA, 15 nt, Homo sapiens
agacaguucaagaaa

SEQ ID NO: 1389062 - RNA, 14 nt, Homo sapiens
agacaugaaccaag

SEQ ID NO: 1389063 - RNA, 13 nt, Homo sapiens
agacaugaauaug

SEQ ID NO: 1389064 - RNA, 15 nt, Homo sapiens
agacaugugcacuug

SEQ ID NO: 1389065 - RNA, 19 nt, Homo sapiens
agaccaagacacagaucac

SEQ ID NO: 1389066 - RNA, 14 nt, Homo sapiens
agaccauaauguua

SEQ ID NO: 1389067 - RNA, 12 nt, Homo sapiens
agacccggcugc

SEQ ID NO: 1389068 - RNA, 17 nt, Homo sapiens
agaccgccccucaccaa

SEQ ID NO: 1389069 - RNA, 22 nt, Homo sapiens
agaccucucaauuucuggaaaa

SEQ ID NO: 1389070 - RNA, 15 nt, Homo sapiens
agacuaugucaccca

SEQ ID NO: 1389071 - RNA, 19 nt, Homo sapiens
agacuauucccuucuaacc

SEQ ID NO: 1389072 - RNA, 20 nt, Homo sapiens
agacucagggccccagcacu

SEQ ID NO: 1389073 - RNA, 14 nt, Homo sapiens
agacuccgucucaa

SEQ ID NO: 1389074 - RNA, 20 nt, Homo sapiens
agacucuggaaguauacuuu

SEQ ID NO: 1389075 - RNA, 16 nt, Homo sapiens
agacuggauacugccc

SEQ ID NO: 1389076 - RNA, 22 nt, Homo sapiens
agacuggcagggacgaggacaa

SEQ ID NO: 1389077 - RNA, 13 nt, Homo sapiens
agacuguacuaac

SEQ ID NO: 1389078 - RNA, 17 nt, Homo sapiens
agacugucagcuuccaa

SEQ ID NO: 1389079 - RNA, 13 nt, Homo sapiens
agacugucaguag

SEQ ID NO: 1389080 - RNA, 17 nt, Homo sapiens
agacuuauguauuagcu

SEQ ID NO: 1389081 - RNA, 13 nt, Homo sapiens
agacuucccugaa

SEQ ID NO: 1389082 - RNA, 18 nt, Homo sapiens
agacuugaaauacuacuu

SEQ ID NO: 1389083 - RNA, 20 nt, Homo sapiens
agacuuuacauggaugccaa

SEQ ID NO: 1389084 - RNA, 16 nt, Homo sapiens
agacuuuaugcaauaa

SEQ ID NO: 1389085 - RNA, 11 nt, Homo sapiens
agacuuucaag

SEQ ID NO: 1389086 - RNA, 18 nt, Homo sapiens
agacuuucuuaucacuua

SEQ ID NO: 1389087 - RNA, 20 nt, Homo sapiens
agacuuuuugguggauguaa

SEQ ID NO: 1389088 - RNA, 18 nt, Homo sapiens
agagaaagaaguaggcau

SEQ ID NO: 1389089 - RNA, 21 nt, Homo sapiens
agagaaagagagagaauucuu

SEQ ID NO: 1389090 - RNA, 16 nt, Homo sapiens
agagaaaguacuucuc

SEQ ID NO: 1389091 - RNA, 14 nt, Homo sapiens
agagaacaacuacu

SEQ ID NO: 1389092 - RNA, 20 nt, Homo sapiens
agagaaggacucuuccagag

SEQ ID NO: 1389093 - RNA, 14 nt, Homo sapiens
agagaaucauacuu

SEQ ID NO: 1389094 - RNA, 15 nt, Homo sapiens
agagaaugugcucau

SEQ ID NO: 1389095 - RNA, 22 nt, Homo sapiens
agagaauuguaucauuugaaca

SEQ ID NO: 1389096 - RNA, 14 nt, Homo sapiens
agagacaagacuuc

SEQ ID NO: 1389097 - RNA, 21 nt, Homo sapiens
agagacaggguuuugccaugu

SEQ ID NO: 1389098 - RNA, 13 nt, Homo sapiens
agagagccuggug

SEQ ID NO: 1389099 - RNA, 15 nt, Homo sapiens
agagagcuguuccca

SEQ ID NO: 1389100 - RNA, 14 nt, Homo sapiens
agagagggggccac

SEQ ID NO: 1389101 - RNA, 22 nt, Homo sapiens
agagagucgcaucucagugcag

SEQ ID NO: 1389102 - RNA, 15 nt, Homo sapiens
agagaugaaccacau

SEQ ID NO: 1389103 - RNA, 20 nt, Homo sapiens
agagauggggucucacagug

SEQ ID NO: 1389104 - RNA, 16 nt, Homo sapiens
agagauuccugagcca

SEQ ID NO: 1389105 - RNA, 17 nt, Homo sapiens
agagauuuggagcacuc

SEQ ID NO: 1389106 - RNA, 21 nt, Homo sapiens
agagcaacaauccaucucuca

SEQ ID NO: 1389107 - RNA, 15 nt, Homo sapiens
agagcacacuguagc

SEQ ID NO: 1389108 - RNA, 12 nt, Homo sapiens
agagcagugugg

SEQ ID NO: 1389109 - RNA, 18 nt, Homo sapiens
agagccccacuugacacu

SEQ ID NO: 1389110 - RNA, 18 nt, Homo sapiens
agagccucuggcaucucu

SEQ ID NO: 1389111 - RNA, 12 nt, Homo sapiens
agagccuggaag

SEQ ID NO: 1389112 - RNA, 20 nt, Homo sapiens
agagcgagacuccgucucaa

SEQ ID NO: 1389113 - RNA, 14 nt, Homo sapiens
agagcuagaugugu

SEQ ID NO: 1389114 - RNA, 16 nt, Homo sapiens
agagcuagucuuucac

SEQ ID NO: 1389115 - RNA, 19 nt, Homo sapiens
agagcuggggagggagagc

SEQ ID NO: 1389116 - RNA, 16 nt, Homo sapiens
agagcugggugucaag

SEQ ID NO: 1389117 - RNA, 13 nt, Homo sapiens
agagcugguuggg

SEQ ID NO: 1389118 - RNA, 17 nt, Homo sapiens
agaggaagagugcaaaa

SEQ ID NO: 1389119 - RNA, 14 nt, Homo sapiens
agagggcccaggca

SEQ ID NO: 1389120 - RNA, 23 nt, Homo sapiens
agagguugcagugagcugagauc

SEQ ID NO: 1389121 - RNA, 14 nt, Homo sapiens
agagucgcaucuca

SEQ ID NO: 1389122 - RNA, 21 nt, Homo sapiens
agagucgcaucucagugcagg

SEQ ID NO: 1389123 - RNA, 20 nt, Homo sapiens
agagugagacucugucucaa

SEQ ID NO: 1389124 - RNA, 18 nt, Homo sapiens
agagugauucuugcugcu

SEQ ID NO: 1389125 - RNA, 22 nt, Homo sapiens
agaguggaaccaacacuaacau

SEQ ID NO: 1389126 - RNA, 19 nt, Homo sapiens
agaguggucuuucuggaga

SEQ ID NO: 1389127 - RNA, 23 nt, Homo sapiens
agagugucuucacggcaggacaa

SEQ ID NO: 1389128 - RNA, 22 nt, Homo sapiens
agaguguuuggggguuccguga

SEQ ID NO: 1389129 - RNA, 13 nt, Homo sapiens
agauaaaugugcu

SEQ ID NO: 1389130 - RNA, 14 nt, Homo sapiens
agauaaaugugcug

SEQ ID NO: 1389131 - RNA, 19 nt, Homo sapiens
agauaaccucaagucacau

SEQ ID NO: 1389132 - RNA, 13 nt, Homo sapiens
agauaagcuucca

SEQ ID NO: 1389133 - RNA, 20 nt, Homo sapiens
agauaaucuuagcugccaag

SEQ ID NO: 1389134 - RNA, 21 nt, Homo sapiens
agauacaugguugugaccuga

SEQ ID NO: 1389135 - RNA, 20 nt, Homo sapiens
agauagaaccuggagccacu

SEQ ID NO: 1389136 - RNA, 17 nt, Homo sapiens
agauagaagaacugcaa

SEQ ID NO: 1389137 - RNA, 15 nt, Homo sapiens
agauaucagcccaaa

SEQ ID NO: 1389138 - RNA, 11 nt, Homo sapiens
agauaugauau

SEQ ID NO: 1389139 - RNA, 22 nt, Homo sapiens
agaucacuucaggucaggaguu

SEQ ID NO: 1389140 - RNA, 17 nt, Homo sapiens
agaucaggccaacccca

SEQ ID NO: 1389141 - RNA, 19 nt, Homo sapiens
agaucaugagaaauuacca

SEQ ID NO: 1389142 - RNA, 18 nt, Homo sapiens
agaucgcgccacugcacu

SEQ ID NO: 1389143 - RNA, 19 nt, Homo sapiens
agaucgcgccacugcacuc

SEQ ID NO: 1389144 - RNA, 15 nt, Homo sapiens
agaucguuguuuaca

SEQ ID NO: 1389145 - RNA, 21 nt, Homo sapiens
agaucuaauauugacugccuc

SEQ ID NO: 1389146 - RNA, 18 nt, Homo sapiens
agaucuauguacuguaau

SEQ ID NO: 1389147 - RNA, 14 nt, Homo sapiens
agaucuccaaagcu

SEQ ID NO: 1389148 - RNA, 20 nt, Homo sapiens
agaucuuucaggaaagacgg

SEQ ID NO: 1389149 - RNA, 13 nt, Homo sapiens
agaugaaccacau

SEQ ID NO: 1389150 - RNA, 19 nt, Homo sapiens
agaugaaucauugauugaa

SEQ ID NO: 1389151 - RNA, 18 nt, Homo sapiens
agaugacauggugaaaau

SEQ ID NO: 1389152 - RNA, 21 nt, Homo sapiens
agaugacuucccaacugcaag

SEQ ID NO: 1389153 - RNA, 20 nt, Homo sapiens
agaugcagaaaauugccuaa

SEQ ID NO: 1389154 - RNA, 14 nt, Homo sapiens
aguguguaugugcg

SEQ ID NO: 1389155 - RNA, 16 nt, Homo sapiens
aguguguccaagugug

SEQ ID NO: 1389156 - RNA, 20 nt, Homo sapiens
agugugugcaaguaugugag

SEQ ID NO: 1389157 - RNA, 15 nt, Homo sapiens
agugugugcacaugu

SEQ ID NO: 1389158 - RNA, 22 nt, Homo sapiens
aguguugcccaggcuggucuca

SEQ ID NO: 1389159 - RNA, 19 nt, Homo sapiens
aguguuuggguauauucau

SEQ ID NO: 1389160 - RNA, 19 nt, Homo sapiens
aguuaacagacaacacguu

SEQ ID NO: 1389161 - RNA, 14 nt, Homo sapiens
aguuaagaaccuga

SEQ ID NO: 1389162 - RNA, 12 nt, Homo sapiens
aguuaagggaug

SEQ ID NO: 1389163 - RNA, 20 nt, Homo sapiens
aguuaaggggagcaacagag

SEQ ID NO: 1389164 - RNA, 12 nt, Homo sapiens
aguuaaggguua

SEQ ID NO: 1389165 - RNA, 13 nt, Homo sapiens
aguuacacuaaaa

SEQ ID NO: 1389166 - RNA, 14 nt, Homo sapiens
aguuacauugcugg

SEQ ID NO: 1389167 - RNA, 15 nt, Homo sapiens
aguuagguagcuuua

SEQ ID NO: 1389168 - RNA, 13 nt, Homo sapiens
aguuagugccaua

SEQ ID NO: 1389169 - RNA, 12 nt, Homo sapiens
aguuauaaccaa

SEQ ID NO: 1389170 - RNA, 22 nt, Homo sapiens
aguucacuuuuuacagugcuau

SEQ ID NO: 1389171 - RNA, 18 nt, Homo sapiens
aguucauagggucucuuc

SEQ ID NO: 1389172 - RNA, 16 nt, Homo sapiens
aguucauauguaccau

SEQ ID NO: 1389173 - RNA, 17 nt, Homo sapiens
aguucauauguaccaug

SEQ ID NO: 1389174 - RNA, 17 nt, Homo sapiens
aguucccuuggccucag

SEQ ID NO: 1389175 - RNA, 22 nt, Homo sapiens
aguuccgacugccaucuuggac

SEQ ID NO: 1389176 - RNA, 21 nt, Homo sapiens
aguuccucauuagcauuuugc

SEQ ID NO: 1389177 - RNA, 23 nt, Homo sapiens
aguuccucauuuuugaauacagg

SEQ ID NO: 1389178 - RNA, 12 nt, Homo sapiens
aguuccugauga

SEQ ID NO: 1389179 - RNA, 16 nt, Homo sapiens
aguuccuuucaauggu

SEQ ID NO: 1389180 - RNA, 18 nt, Homo sapiens
aguucuauuucuauccca

SEQ ID NO: 1389181 - RNA, 19 nt, Homo sapiens
aguucuggcugaacacugg

SEQ ID NO: 1389182 - RNA, 23 nt, Homo sapiens
aguugaaagaguccuauuugcac

SEQ ID NO: 1389183 - RNA, 17 nt, Homo sapiens
aguugaaauucuauucu

SEQ ID NO: 1389184 - RNA, 18 nt, Homo sapiens
aguugaagcuaagauuua

SEQ ID NO: 1389185 - RNA, 12 nt, Homo sapiens
aguugcacuugg

SEQ ID NO: 1389186 - RNA, 16 nt, Homo sapiens
aguugcugaugaacuc

SEQ ID NO: 1389187 - RNA, 17 nt, Homo sapiens
aguugcugaugaacucu

SEQ ID NO: 1389188 - RNA, 20 nt, Homo sapiens
aguuggagaagccguggccu

SEQ ID NO: 1389189 - RNA, 15 nt, Homo sapiens
aguuggugcugcuuu

SEQ ID NO: 1389190 - RNA, 19 nt, Homo sapiens
aguuuaagaggcaaguaaa

SEQ ID NO: 1389191 - RNA, 14 nt, Homo sapiens
aguuuagauuuuaa

SEQ ID NO: 1389192 - RNA, 19 nt, Homo sapiens
aguuuagauuuuaaucaaa

SEQ ID NO: 1389193 - RNA, 19 nt, Homo sapiens
aguuuagugcccucaucca

SEQ ID NO: 1389194 - RNA, 14 nt, Homo sapiens
aguuuagugugaua

SEQ ID NO: 1389195 - RNA, 20 nt, Homo sapiens
aguuuauaaaugugaacuua

SEQ ID NO: 1389196 - RNA, 15 nt, Homo sapiens
aguuuauugacaaua

SEQ ID NO: 1389197 - RNA, 14 nt, Homo sapiens
aguuucccuaucuc

SEQ ID NO: 1389198 - RNA, 18 nt, Homo sapiens
aguuucuuccauucccau

SEQ ID NO: 1389199 - RNA, 13 nt, Homo sapiens
aguuugagacagg

SEQ ID NO: 1389200 - RNA, 20 nt, Homo sapiens
aguuugagacaggagaccug

SEQ ID NO: 1389201 - RNA, 17 nt, Homo sapiens
aguuugagaccugaaua

SEQ ID NO: 1389202 - RNA, 19 nt, Homo sapiens
aguuugcccugguuucacu

SEQ ID NO: 1389203 - RNA, 17 nt, Homo sapiens
aguuugcuuuguaugca

SEQ ID NO: 1389204 - RNA, 21 nt, Homo sapiens
aguuugugagaaacaucucaa

SEQ ID NO: 1389205 - RNA, 14 nt, Homo sapiens
aguuuuaacuguaa

SEQ ID NO: 1389206 - RNA, 12 nt, Homo sapiens
aguuuuaugaga

SEQ ID NO: 1389207 - RNA, 18 nt, Homo sapiens
aguuuuauuuuuguagag

SEQ ID NO: 1389208 - RNA, 13 nt, Homo sapiens
aguuuuccaugaa

SEQ ID NO: 1389209 - RNA, 17 nt, Homo sapiens
aguuuugacaucaauga

SEQ ID NO: 1389210 - RNA, 14 nt, Homo sapiens
auaaaaaugacaac

SEQ ID NO: 1389211 - RNA, 14 nt, Homo sapiens
auaaaaguugcaaa

SEQ ID NO: 1389212 - RNA, 17 nt, Homo sapiens
auaaaaucaaacagaga

SEQ ID NO: 1389213 - RNA, 22 nt, Homo sapiens
auaaaaugguguuuucauguaa

SEQ ID NO: 1389214 - RNA, 16 nt, Homo sapiens
auaaaauuaugccaua

SEQ ID NO: 1389215 - RNA, 20 nt, Homo sapiens
auaaacaaauaacaaugugc

SEQ ID NO: 1389216 - RNA, 16 nt, Homo sapiens
auaaacucagaaauuu

SEQ ID NO: 1389217 - RNA, 20 nt, Homo sapiens
auaaauacuugccugugaca

SEQ ID NO: 1389218 - RNA, 13 nt, Homo sapiens
auaaaucauaaaa

SEQ ID NO: 1389219 - RNA, 21 nt, Homo sapiens
auaaaucauuaagacaacuga

SEQ ID NO: 1389220 - RNA, 14 nt, Homo sapiens
auaaauguauucaa

SEQ ID NO: 1389221 - RNA, 21 nt, Homo sapiens
auaaauuacuuuuucauucuu

SEQ ID NO: 1389222 - RNA, 14 nt, Homo sapiens
auaaauuugguucu

SEQ ID NO: 1389223 - RNA, 20 nt, Homo sapiens
auaacaagaucuuucaggaa

SEQ ID NO: 1389224 - RNA, 13 nt, Homo sapiens
auaacagcauucu

SEQ ID NO: 1389225 - RNA, 11 nt, Homo sapiens
auaacauaaca

SEQ ID NO: 1389226 - RNA, 12 nt, Homo sapiens
auaaccacuuaa

SEQ ID NO: 1389227 - RNA, 22 nt, Homo sapiens
auaaccucaaagugacuauuca

SEQ ID NO: 1389228 - RNA, 21 nt, Homo sapiens
auaacuuuugguaucuacuuc

SEQ ID NO: 1389229 - RNA, 13 nt, Homo sapiens
auaagagauuugg

SEQ ID NO: 1389230 - RNA, 20 nt, Homo sapiens
auaagaguuggcuggucaac

SEQ ID NO: 1389231 - RNA, 23 nt, Homo sapiens
auaagcaaagggagcacuggguu

SEQ ID NO: 1389232 - RNA, 20 nt, Homo sapiens
auaagcuauagacccgagga

SEQ ID NO: 1389233 - RNA, 21 nt, Homo sapiens
auaaggaacaugaaaagcaaa

SEQ ID NO: 1389234 - RNA, 15 nt, Homo sapiens
auaaguagagacuga

SEQ ID NO: 1389235 - RNA, 20 nt, Homo sapiens
auaaguaucacacuguauau

SEQ ID NO: 1389236 - RNA, 16 nt, Homo sapiens
auaaguuaacuuccaa

SEQ ID NO: 1389237 - RNA, 17 nt, Homo sapiens
auaauaaaggcauuuca

SEQ ID NO: 1389238 - RNA, 16 nt, Homo sapiens
auaauaugagaaucag

SEQ ID NO: 1389239 - RNA, 16 nt, Homo sapiens
auaauaugcugccaaa

SEQ ID NO: 1389240 - RNA, 23 nt, Homo sapiens
auaauauuaaggaagacaaugug

SEQ ID NO: 1389241 - RNA, 15 nt, Homo sapiens
auaaucacauuauca

SEQ ID NO: 1389242 - RNA, 13 nt, Homo sapiens
auaaucauuuauc

SEQ ID NO: 1389243 - RNA, 12 nt, Homo sapiens
auaaugaugaug

SEQ ID NO: 1389244 - RNA, 17 nt, Homo sapiens
auaaugcuguugccuca

SEQ ID NO: 1389245 - RNA, 19 nt, Homo sapiens
auaaugguugacuggguuu

SEQ ID NO: 1389246 - RNA, 17 nt, Homo sapiens
auaauuccauaugcugu

SEQ ID NO: 1389247 - RNA, 15 nt, Homo sapiens
auaauucccuaucuu

SEQ ID NO: 1389248 - RNA, 18 nt, Homo sapiens
auaauucuaaucuaacaa

SEQ ID NO: 1389249 - RNA, 15 nt, Homo sapiens
auaauucuucaccua

SEQ ID NO: 1389250 - RNA, 14 nt, Homo sapiens
auacaagauacuuu

SEQ ID NO: 1389251 - RNA, 13 nt, Homo sapiens
auacaauuccaaa

SEQ ID NO: 1389252 - RNA, 13 nt, Homo sapiens
auacacuaugaag

SEQ ID NO: 1389253 - RNA, 13 nt, Homo sapiens
auacacuuacacu

SEQ ID NO: 1389254 - RNA, 18 nt, Homo sapiens
auacagaugacaauggga

SEQ ID NO: 1389255 - RNA, 22 nt, Homo sapiens
auacagccaaagauaaucucuc

SEQ ID NO: 1389256 - RNA, 16 nt, Homo sapiens
auacagcucagcuuuu

SEQ ID NO: 1389257 - RNA, 22 nt, Homo sapiens
auacaggacauucucaucacca

SEQ ID NO: 1389258 - RNA, 19 nt, Homo sapiens
auacaggagucugucucug

SEQ ID NO: 1389259 - RNA, 21 nt, Homo sapiens
auacaggagucugucucugcu

SEQ ID NO: 1389260 - RNA, 15 nt, Homo sapiens
auacaguaucucagg

SEQ ID NO: 1389261 - RNA, 19 nt, Homo sapiens
auacaugcauacacucuca

SEQ ID NO: 1389262 - RNA, 18 nt, Homo sapiens
auacaugucuuucuccag

SEQ ID NO: 1389263 - RNA, 22 nt, Homo sapiens
auaccaaccugaagacaccguu

SEQ ID NO: 1389264 - RNA, 21 nt, Homo sapiens
auacccaaguuauugggaugu

SEQ ID NO: 1389265 - RNA, 20 nt, Homo sapiens
auaccccuuacuuagcaugc

SEQ ID NO: 1389266 - RNA, 15 nt, Homo sapiens
auacccuguccuuuc

SEQ ID NO: 1389267 - RNA, 23 nt, Homo sapiens
auaccgggaacaugaagccaggu

SEQ ID NO: 1389268 - RNA, 13 nt, Homo sapiens
auucucacucgga

SEQ ID NO: 1389269 - RNA, 19 nt, Homo sapiens
auucucaguguagggcaga

SEQ ID NO: 1389270 - RNA, 23 nt, Homo sapiens
auucucaugccucagccucccag

SEQ ID NO: 1389271 - RNA, 19 nt, Homo sapiens
auucucuuguuauugcauc

SEQ ID NO: 1389272 - RNA, 15 nt, Homo sapiens
auucugaccauuuca

SEQ ID NO: 1389273 - RNA, 18 nt, Homo sapiens
auucugagccacacugaa

SEQ ID NO: 1389274 - RNA, 17 nt, Homo sapiens
auucugccgugugcccu

SEQ ID NO: 1389275 - RNA, 22 nt, Homo sapiens
auucugccuccauucugaccau

SEQ ID NO: 1389276 - RNA, 20 nt, Homo sapiens
auucugcuaccucacugggg

SEQ ID NO: 1389277 - RNA, 18 nt, Homo sapiens
auucugcugaugcuacug

SEQ ID NO: 1389278 - RNA, 16 nt, Homo sapiens
auucugucaaugucuu

SEQ ID NO: 1389279 - RNA, 18 nt, Homo sapiens
auucuguuggccagugug

SEQ ID NO: 1389280 - RNA, 20 nt, Homo sapiens
auucuuacaaacaugugguu

SEQ ID NO: 1389281 - RNA, 21 nt, Homo sapiens
auucuucuuugguggagauaa

SEQ ID NO: 1389282 - RNA, 13 nt, Homo sapiens
auucuugcugcua

SEQ ID NO: 1389283 - RNA, 15 nt, Homo sapiens
auucuugucacaaua

SEQ ID NO: 1389284 - RNA, 22 nt, Homo sapiens
auucuuugaccucaaccuguga

SEQ ID NO: 1389285 - RNA, 14 nt, Homo sapiens
auucuuuguuacag

SEQ ID NO: 1389286 - RNA, 20 nt, Homo sapiens
auugaaaaaaauuggcauua

SEQ ID NO: 1389287 - RNA, 12 nt, Homo sapiens
auugaaaaccaa

SEQ ID NO: 1389288 - RNA, 16 nt, Homo sapiens
auugaaggaugcuguc

SEQ ID NO: 1389289 - RNA, 16 nt, Homo sapiens
auugaaguuuugacau

SEQ ID NO: 1389290 - RNA, 23 nt, Homo sapiens
auugaaguuuugacaucaaugau

SEQ ID NO: 1389291 - RNA, 14 nt, Homo sapiens
auugaauaggauca

SEQ ID NO: 1389292 - RNA, 17 nt, Homo sapiens
auugacuuguauaccuu

SEQ ID NO: 1389293 - RNA, 16 nt, Homo sapiens
auugagugaaacauug

SEQ ID NO: 1389294 - RNA, 15 nt, Homo sapiens
auugauauaauuucc

SEQ ID NO: 1389295 - RNA, 17 nt, Homo sapiens
auugauaugcuuauaca

SEQ ID NO: 1389296 - RNA, 14 nt, Homo sapiens
auugaugacccucu

SEQ ID NO: 1389297 - RNA, 15 nt, Homo sapiens
auugcagaguacugg

SEQ ID NO: 1389298 - RNA, 16 nt, Homo sapiens
auugcuaagaagggaa

SEQ ID NO: 1389299 - RNA, 15 nt, Homo sapiens
auugcuggucuugua

SEQ ID NO: 1389300 - RNA, 16 nt, Homo sapiens
auugcuggucuuguaa

SEQ ID NO: 1389301 - RNA, 19 nt, Homo sapiens
auugcuugcacaaaccaau

SEQ ID NO: 1389302 - RNA, 18 nt, Homo sapiens
auuggaaauuuguuauaa

SEQ ID NO: 1389303 - RNA, 14 nt, Homo sapiens
auuggaagagcaca

SEQ ID NO: 1389304 - RNA, 16 nt, Homo sapiens
auugggauuuucuaca

SEQ ID NO: 1389305 - RNA, 14 nt, Homo sapiens
auugggccaaagaa

SEQ ID NO: 1389306 - RNA, 18 nt, Homo sapiens
auuggggaagacuguggc

SEQ ID NO: 1389307 - RNA, 19 nt, Homo sapiens
auuggguacccaguuaaau

SEQ ID NO: 1389308 - RNA, 22 nt, Homo sapiens
auugguccagcuugcucuucag

SEQ ID NO: 1389309 - RNA, 20 nt, Homo sapiens
auuguaaacauuaguucuau

SEQ ID NO: 1389310 - RNA, 22 nt, Homo sapiens
auuguaacucaaaggguggaau

SEQ ID NO: 1389311 - RNA, 14 nt, Homo sapiens
auuguacuaauacc

SEQ ID NO: 1389312 - RNA, 14 nt, Homo sapiens
auuguauuuaguua

SEQ ID NO: 1389313 - RNA, 15 nt, Homo sapiens
auuguccguuuacuu

SEQ ID NO: 1389314 - RNA, 11 nt, Homo sapiens
auugugcacau

SEQ ID NO: 1389315 - RNA, 19 nt, Homo sapiens
auugugccacuucacucca

SEQ ID NO: 1389316 - RNA, 22 nt, Homo sapiens
auuguguuaggacagcauauaa

SEQ ID NO: 1389317 - RNA, 15 nt, Homo sapiens
auuguuaaaauaacu

SEQ ID NO: 1389318 - RNA, 16 nt, Homo sapiens
auuguuaaaauaacua

SEQ ID NO: 1389319 - RNA, 14 nt, Homo sapiens
auuguucccaguga

SEQ ID NO: 1389320 - RNA, 16 nt, Homo sapiens
auuguugaacacuuga

SEQ ID NO: 1389321 - RNA, 17 nt, Homo sapiens
auuguuuucaguguaca

SEQ ID NO: 1389322 - RNA, 22 nt, Homo sapiens
auuguuuucaguguacauggaa

SEQ ID NO: 1389323 - RNA, 20 nt, Homo sapiens
auuguuuuguguaacauauu

SEQ ID NO: 1389324 - RNA, 18 nt, Homo sapiens
auuguuuuugcucaaggc

SEQ ID NO: 1389325 - RNA, 21 nt, Homo sapiens
auuuaaaaaaauacaguauuc

SEQ ID NO: 1389326 - RNA, 19 nt, Homo sapiens
auuuaaauguaaagacaaa

SEQ ID NO: 1389327 - RNA, 13 nt, Homo sapiens
auuuacaagggaa

SEQ ID NO: 1389328 - RNA, 14 nt, Homo sapiens
auuuacaagggaag

SEQ ID NO: 1389329 - RNA, 21 nt, Homo sapiens
auuuacugaaguuauuuauua

SEQ ID NO: 1389330 - RNA, 19 nt, Homo sapiens
auuuacugacauauaucua

SEQ ID NO: 1389331 - RNA, 13 nt, Homo sapiens
auuuauaacucau

SEQ ID NO: 1389332 - RNA, 12 nt, Homo sapiens
auuuauauaugu

SEQ ID NO: 1389333 - RNA, 13 nt, Homo sapiens
auuuaucccucaa

SEQ ID NO: 1389334 - RNA, 19 nt, Homo sapiens
auuuaugacagugaacauu

SEQ ID NO: 1389335 - RNA, 13 nt, Homo sapiens
auuuaugucucag

SEQ ID NO: 1389336 - RNA, 16 nt, Homo sapiens
auuuauuuaagcauca

SEQ ID NO: 1389337 - RNA, 14 nt, Homo sapiens
auuucacagugugu

SEQ ID NO: 1389338 - RNA, 13 nt, Homo sapiens
auuucacauuaau

SEQ ID NO: 1389339 - RNA, 16 nt, Homo sapiens
auuucaccuacuuugu

SEQ ID NO: 1389340 - RNA, 12 nt, Homo sapiens
auuucagauauc

SEQ ID NO: 1389341 - RNA, 14 nt, Homo sapiens
auuucagcauuauu

SEQ ID NO: 1389342 - RNA, 16 nt, Homo sapiens
auuuccaaauucacaa

SEQ ID NO: 1389343 - RNA, 17 nt, Homo sapiens
auuuccaaauucacaag

SEQ ID NO: 1389344 - RNA, 21 nt, Homo sapiens
auuuccacaaaaucuguccaa

SEQ ID NO: 1389345 - RNA, 20 nt, Homo sapiens
auuuccuaaugucagaguag

SEQ ID NO: 1389346 - RNA, 18 nt, Homo sapiens
auuucuaacucugaugua

SEQ ID NO: 1389347 - RNA, 21 nt, Homo sapiens
auuucucaaaugcacaucuca

SEQ ID NO: 1389348 - RNA, 15 nt, Homo sapiens
auuucucuacagaug

SEQ ID NO: 1389349 - RNA, 17 nt, Homo sapiens
auuucugaaaugugcag

SEQ ID NO: 1389350 - RNA, 14 nt, Homo sapiens
auuucuguucuucc

SEQ ID NO: 1389351 - RNA, 13 nt, Homo sapiens
auuugaagacaaa

SEQ ID NO: 1389352 - RNA, 21 nt, Homo sapiens
auuugccaaaauaaugucuug

SEQ ID NO: 1389353 - RNA, 12 nt, Homo sapiens
auuugccuguuu

SEQ ID NO: 1389354 - RNA, 13 nt, Homo sapiens
auuugcuaucaaa

SEQ ID NO: 1389355 - RNA, 19 nt, Homo sapiens
auuugcugagcauguacug

SEQ ID NO: 1389356 - RNA, 20 nt, Homo sapiens
auuuggugaauuugaaucuc

SEQ ID NO: 1389357 - RNA, 20 nt, Homo sapiens
auuuguaauugaacuuaucc

SEQ ID NO: 1389358 - RNA, 17 nt, Homo sapiens
auuugucaacaaaguca

SEQ ID NO: 1389359 - RNA, 21 nt, Homo sapiens
auuugucaacaaagucaccca

SEQ ID NO: 1389360 - RNA, 20 nt, Homo sapiens
auuugucccuaugcauauca

SEQ ID NO: 1389361 - RNA, 20 nt, Homo sapiens
auuuguuaaugguuugaaua

SEQ ID NO: 1389362 - RNA, 14 nt, Homo sapiens
auuuguuugugcau

SEQ ID NO: 1389363 - RNA, 14 nt, Homo sapiens
auuuuaauuugaua

SEQ ID NO: 1389364 - RNA, 15 nt, Homo sapiens
auuuuaggcacccau

SEQ ID NO: 1389365 - RNA, 15 nt, Homo sapiens
auuuuauacauuaac

SEQ ID NO: 1389366 - RNA, 13 nt, Homo sapiens
auuuuaugcugcu

SEQ ID NO: 1389367 - RNA, 21 nt, Homo sapiens
auuuuaugcugcuguuuacaa

SEQ ID NO: 1389368 - RNA, 18 nt, Homo sapiens
auuuuauuacaucuuuca

SEQ ID NO: 1389369 - RNA, 18 nt, Homo sapiens
auuuucaaauucuacuga

SEQ ID NO: 1389370 - RNA, 16 nt, Homo sapiens
auuuucacaucaaaga

SEQ ID NO: 1389371 - RNA, 17 nt, Homo sapiens
auuuucagacugcuuua

SEQ ID NO: 1389372 - RNA, 16 nt, Homo sapiens
auuuucauguauaugu

SEQ ID NO: 1389373 - RNA, 14 nt, Homo sapiens
auuuucccaauaaa

SEQ ID NO: 1389374 - RNA, 21 nt, Homo sapiens
auuuuccgcccucaaaaugac

SEQ ID NO: 1389375 - RNA, 18 nt, Homo sapiens
auuuuccugcauaaucau

SEQ ID NO: 1389376 - RNA, 21 nt, Homo sapiens
auuuucuauuauuaacacuga

SEQ ID NO: 1389377 - RNA, 15 nt, Homo sapiens
auuuugauccaagcu

SEQ ID NO: 1389378 - RNA, 16 nt, Homo sapiens
auuuuggcaaagccag

SEQ ID NO: 1389379 - RNA, 14 nt, Homo sapiens
auuuuggcauugua

SEQ ID NO: 1389380 - RNA, 18 nt, Homo sapiens
auuuugggguaagacuuu

SEQ ID NO: 1389381 - RNA, 16 nt, Homo sapiens
auuuuguggucauuaa

SEQ ID NO: 1389382 - RNA, 19 nt, Homo sapiens
caggaacacccgacuccuc

SEQ ID NO: 1389383 - RNA, 18 nt, Homo sapiens
caggaagugucuagagga

SEQ ID NO: 1389384 - RNA, 12 nt, Homo sapiens
caggaaucuccu

SEQ ID NO: 1389385 - RNA, 22 nt, Homo sapiens
caggacucugccuccucuucaa

SEQ ID NO: 1389386 - RNA, 17 nt, Homo sapiens
caggagaaccacuacau

SEQ ID NO: 1389387 - RNA, 19 nt, Homo sapiens
caggagagacagugaggcu

SEQ ID NO: 1389388 - RNA, 15 nt, Homo sapiens
caggaggauggcaaa

SEQ ID NO: 1389389 - RNA, 22 nt, Homo sapiens
caggagguggaggcugcaguga

SEQ ID NO: 1389390 - RNA, 23 nt, Homo sapiens
caggagguggaggcugcagugag

SEQ ID NO: 1389391 - RNA, 22 nt, Homo sapiens
caggagucugucucugcuaugg

SEQ ID NO: 1389392 - RNA, 21 nt, Homo sapiens
caggaguucagggucauagca

SEQ ID NO: 1389393 - RNA, 15 nt, Homo sapiens
caggauacucuguca

SEQ ID NO: 1389394 - RNA, 19 nt, Homo sapiens
caggaugaggcagaaggaa

SEQ ID NO: 1389395 - RNA, 13 nt, Homo sapiens
caggaugaguuac

SEQ ID NO: 1389396 - RNA, 14 nt, Homo sapiens
caggauggcacugu

SEQ ID NO: 1389397 - RNA, 14 nt, Homo sapiens
caggaugggcacug

SEQ ID NO: 1389398 - RNA, 17 nt, Homo sapiens
caggauuagacagucaa

SEQ ID NO: 1389399 - RNA, 15 nt, Homo sapiens
caggcaaaauugaua

SEQ ID NO: 1389400 - RNA, 17 nt, Homo sapiens
caggcaaagugcugcug

SEQ ID NO: 1389401 - RNA, 13 nt, Homo sapiens
caggcaagcaccu

SEQ ID NO: 1389402 - RNA, 15 nt, Homo sapiens
caggcacugcugccc

SEQ ID NO: 1389403 - RNA, 20 nt, Homo sapiens
caggcagaucugugccccau

SEQ ID NO: 1389404 - RNA, 22 nt, Homo sapiens
caggcagcauuuagcacauacu

SEQ ID NO: 1389405 - RNA, 19 nt, Homo sapiens
caggcaugagucagucuga

SEQ ID NO: 1389406 - RNA, 15 nt, Homo sapiens
caggccacauggcua

SEQ ID NO: 1389407 - RNA, 13 nt, Homo sapiens
caggccaccugcc

SEQ ID NO: 1389408 - RNA, 17 nt, Homo sapiens
caggccaugugagccac

SEQ ID NO: 1389409 - RNA, 18 nt, Homo sapiens
caggcccuuccucuccac

SEQ ID NO: 1389410 - RNA, 17 nt, Homo sapiens
caggccucacacacaau

SEQ ID NO: 1389411 - RNA, 20 nt, Homo sapiens
caggcgauccaccugucuca

SEQ ID NO: 1389412 - RNA, 16 nt, Homo sapiens
caggcgugguggcaca

SEQ ID NO: 1389413 - RNA, 14 nt, Homo sapiens
cagggaaugaaggu

SEQ ID NO: 1389414 - RNA, 15 nt, Homo sapiens
cagggacccacuuca

SEQ ID NO: 1389415 - RNA, 13 nt, Homo sapiens
cagggaugccauc

SEQ ID NO: 1389416 - RNA, 14 nt, Homo sapiens
cagggauggggcca

SEQ ID NO: 1389417 - RNA, 17 nt, Homo sapiens
cagggcagggcucugau

SEQ ID NO: 1389418 - RNA, 18 nt, Homo sapiens
cagggccuuaaaagccau

SEQ ID NO: 1389419 - RNA, 14 nt, Homo sapiens
cagggcuggucuuu

SEQ ID NO: 1389420 - RNA, 14 nt, Homo sapiens
cagggcugucuucg

SEQ ID NO: 1389421 - RNA, 14 nt, Homo sapiens
cagggcugugaucg

SEQ ID NO: 1389422 - RNA, 21 nt, Homo sapiens
caggggcaaacaccugcugau

SEQ ID NO: 1389423 - RNA, 22 nt, Homo sapiens
caggggcucuuaggcaaucaca

SEQ ID NO: 1389424 - RNA, 12 nt, Homo sapiens
cagggucucacu

SEQ ID NO: 1389425 - RNA, 18 nt, Homo sapiens
caggguuggggugguuuu

SEQ ID NO: 1389426 - RNA, 13 nt, Homo sapiens
caggguuuuuaga

SEQ ID NO: 1389427 - RNA, 13 nt, Homo sapiens
cagguaaugugaa

SEQ ID NO: 1389428 - RNA, 14 nt, Homo sapiens
cagguaaugugaau

SEQ ID NO: 1389429 - RNA, 13 nt, Homo sapiens
caggugcacagac

SEQ ID NO: 1389430 - RNA, 10 nt, Homo sapiens
caggugggag

SEQ ID NO: 1389431 - RNA, 17 nt, Homo sapiens
caggugugguugcucac

SEQ ID NO: 1389432 - RNA, 16 nt, Homo sapiens
cagguguuuauacagc

SEQ ID NO: 1389433 - RNA, 17 nt, Homo sapiens
cagguucugacucuugg

SEQ ID NO: 1389434 - RNA, 21 nt, Homo sapiens
cagguucugacucuuggcaca

SEQ ID NO: 1389435 - RNA, 15 nt, Homo sapiens
cagguuuuuggucug

SEQ ID NO: 1389436 - RNA, 18 nt, Homo sapiens
caguaacuugguuauaca

SEQ ID NO: 1389437 - RNA, 17 nt, Homo sapiens
caguaagcuaucuucaa

SEQ ID NO: 1389438 - RNA, 19 nt, Homo sapiens
caguaauaaaacaucuuuc

SEQ ID NO: 1389439 - RNA, 18 nt, Homo sapiens
caguagaaauaauaugca

SEQ ID NO: 1389440 - RNA, 17 nt, Homo sapiens
caguaguggugacugug

SEQ ID NO: 1389441 - RNA, 17 nt, Homo sapiens
caguauauuuauaguca

SEQ ID NO: 1389442 - RNA, 14 nt, Homo sapiens
caguaugacauuuc

SEQ ID NO: 1389443 - RNA, 12 nt, Homo sapiens
cagucaccugcc

SEQ ID NO: 1389444 - RNA, 16 nt, Homo sapiens
cagucacuugaucucc

SEQ ID NO: 1389445 - RNA, 20 nt, Homo sapiens
cagucagaguugugcacaug

SEQ ID NO: 1389446 - RNA, 14 nt, Homo sapiens
caguccaaggggac

SEQ ID NO: 1389447 - RNA, 21 nt, Homo sapiens
caguccaccugagcugccauc

SEQ ID NO: 1389448 - RNA, 15 nt, Homo sapiens
cagucccaucagaga

SEQ ID NO: 1389449 - RNA, 18 nt, Homo sapiens
cagucggaagcuccagaa

SEQ ID NO: 1389450 - RNA, 19 nt, Homo sapiens
cagucucuucuaagcaaaa

SEQ ID NO: 1389451 - RNA, 16 nt, Homo sapiens
cagucuuccaccugga

SEQ ID NO: 1389452 - RNA, 15 nt, Homo sapiens
cagugaaauaugaua

SEQ ID NO: 1389453 - RNA, 19 nt, Homo sapiens
cagugaccccugaccucac

SEQ ID NO: 1389454 - RNA, 23 nt, Homo sapiens
cagugaccccugaccucacugug

SEQ ID NO: 1389455 - RNA, 18 nt, Homo sapiens
cagugacuccacucugag

SEQ ID NO: 1389456 - RNA, 19 nt, Homo sapiens
cagugagcugagauugugc

SEQ ID NO: 1389457 - RNA, 13 nt, Homo sapiens
cagugaucuccau

SEQ ID NO: 1389458 - RNA, 17 nt, Homo sapiens
cagugccaugggggcaa

SEQ ID NO: 1389459 - RNA, 21 nt, Homo sapiens
cagugcccaccaacaucccau

SEQ ID NO: 1389460 - RNA, 16 nt, Homo sapiens
cagugccuuccauaau

SEQ ID NO: 1389461 - RNA, 17 nt, Homo sapiens
cagugcuguacuugaug

SEQ ID NO: 1389462 - RNA, 21 nt, Homo sapiens
cagugcuguggccugggcaag

SEQ ID NO: 1389463 - RNA, 18 nt, Homo sapiens
cagugcuucuuacuauua

SEQ ID NO: 1389464 - RNA, 16 nt, Homo sapiens
cagugcuugaaugaag

SEQ ID NO: 1389465 - RNA, 14 nt, Homo sapiens
caguggaacuaaga

SEQ ID NO: 1389466 - RNA, 13 nt, Homo sapiens
caguguacaugga

SEQ ID NO: 1389467 - RNA, 20 nt, Homo sapiens
caguguccuccccucaagga

SEQ ID NO: 1389468 - RNA, 21 nt, Homo sapiens
caguguggggaagcccauucc

SEQ ID NO: 1389469 - RNA, 22 nt, Homo sapiens
caguguggggaagcccauuccu

SEQ ID NO: 1389470 - RNA, 19 nt, Homo sapiens
caguguguuucugaucuga

SEQ ID NO: 1389471 - RNA, 17 nt, Homo sapiens
caguguuauuaaugaca

SEQ ID NO: 1389472 - RNA, 22 nt, Homo sapiens
caguguuuuaggagcaugagug

SEQ ID NO: 1389473 - RNA, 13 nt, Homo sapiens
caguuagccucug

SEQ ID NO: 1389474 - RNA, 16 nt, Homo sapiens
caguuagguagcuuua

SEQ ID NO: 1389475 - RNA, 20 nt, Homo sapiens
caguucaccuauuucaaaaa

SEQ ID NO: 1389476 - RNA, 15 nt, Homo sapiens
caguuccaaaagaga

SEQ ID NO: 1389477 - RNA, 16 nt, Homo sapiens
caguuccuuucaaugg

SEQ ID NO: 1389478 - RNA, 23 nt, Homo sapiens
caguugagcuucauauaccagca

SEQ ID NO: 1389479 - RNA, 15 nt, Homo sapiens
caguugucuauucau

SEQ ID NO: 1389480 - RNA, 22 nt, Homo sapiens
caguuguugauaaccacuaaga

SEQ ID NO: 1389481 - RNA, 21 nt, Homo sapiens
caguuuaccgaaaaucauaua

SEQ ID NO: 1389482 - RNA, 13 nt, Homo sapiens
caguuucuuccau

SEQ ID NO: 1389483 - RNA, 15 nt, Homo sapiens
caguuugacuguggc

SEQ ID NO: 1389484 - RNA, 15 nt, Homo sapiens
caguuugauaacuag

SEQ ID NO: 1389485 - RNA, 14 nt, Homo sapiens
caguuuuccaugaa

SEQ ID NO: 1389486 - RNA, 13 nt, Homo sapiens
caguuuucuugca

SEQ ID NO: 1389487 - RNA, 15 nt, Homo sapiens
cauaaagucagugcc

SEQ ID NO: 1389488 - RNA, 21 nt, Homo sapiens
cauaaagucuuugaagugacu

SEQ ID NO: 1389489 - RNA, 15 nt, Homo sapiens
cauaacagaacaaga

SEQ ID NO: 1389490 - RNA, 18 nt, Homo sapiens
cauaaccacugcuuccau

SEQ ID NO: 1389491 - RNA, 20 nt, Homo sapiens
cauaagagagccuugguuca

SEQ ID NO: 1389492 - RNA, 18 nt, Homo sapiens
cauaagcaaaacuuaacu

SEQ ID NO: 1389493 - RNA, 18 nt, Homo sapiens
cauaauuucuucacucaa

SEQ ID NO: 1389494 - RNA, 23 nt, Homo sapiens
cauacaagcauaagcaaaacuua

SEQ ID NO: 1389495 - RNA, 22 nt, Homo sapiens
cauacacacacacgcgugcaca

SEQ ID NO: 1389496 - RNA, 15 nt, Homo sapiens
gaacaguaacugcca

SEQ ID NO: 1389497 - RNA, 20 nt, Homo sapiens
gaacaguuaagcagccgcca

SEQ ID NO: 1389498 - RNA, 18 nt, Homo sapiens
gaacaucccugccagcuc

SEQ ID NO: 1389499 - RNA, 18 nt, Homo sapiens
gaacaucucgaauacaau

SEQ ID NO: 1389500 - RNA, 20 nt, Homo sapiens
gaacauguuuuucuucuccc

SEQ ID NO: 1389501 - RNA, 16 nt, Homo sapiens
gaaccaggcaacuugg

SEQ ID NO: 1389502 - RNA, 10 nt, Homo sapiens
gaaccaugaa

SEQ ID NO: 1389503 - RNA, 18 nt, Homo sapiens
gaaccaugaaaaugggga

SEQ ID NO: 1389504 - RNA, 20 nt, Homo sapiens
gaacccaggaggcagagguu

SEQ ID NO: 1389505 - RNA, 21 nt, Homo sapiens
gaaccugcccugcucccacag

SEQ ID NO: 1389506 - RNA, 16 nt, Homo sapiens
gaaccuguccuugcac

SEQ ID NO: 1389507 - RNA, 20 nt, Homo sapiens
gaaccuguccuugcacacuc

SEQ ID NO: 1389508 - RNA, 22 nt, Homo sapiens
gaaccuguccuugcacacuccc

SEQ ID NO: 1389509 - RNA, 14 nt, Homo sapiens
gaaccuuccaucuc

SEQ ID NO: 1389510 - RNA, 13 nt, Homo sapiens
gaacuagacuccc

SEQ ID NO: 1389511 - RNA, 22 nt, Homo sapiens
gaacuagugguggcucugagaa

SEQ ID NO: 1389512 - RNA, 16 nt, Homo sapiens
gaacucauaucuguaa

SEQ ID NO: 1389513 - RNA, 11 nt, Homo sapiens
gaacucuccau

SEQ ID NO: 1389514 - RNA, 18 nt, Homo sapiens
gaacugaaaacaagccau

SEQ ID NO: 1389515 - RNA, 19 nt, Homo sapiens
gaacugaaaacaagccaug

SEQ ID NO: 1389516 - RNA, 22 nt, Homo sapiens
gaacugaauaaacaggaaaaug

SEQ ID NO: 1389517 - RNA, 18 nt, Homo sapiens
gaacugaugacacugaga

SEQ ID NO: 1389518 - RNA, 22 nt, Homo sapiens
gaacuugagcgugaaucuguau

SEQ ID NO: 1389519 - RNA, 22 nt, Homo sapiens
gaagaacagauaaucccuguau

SEQ ID NO: 1389520 - RNA, 13 nt, Homo sapiens
gaagaacaguaac

SEQ ID NO: 1389521 - RNA, 13 nt, Homo sapiens
gaagaacauagaa

SEQ ID NO: 1389522 - RNA, 11 nt, Homo sapiens
gaagaacugac

SEQ ID NO: 1389523 - RNA, 17 nt, Homo sapiens
gaagaacugacuaguga

SEQ ID NO: 1389524 - RNA, 12 nt, Homo sapiens
gaagaagcuaaa

SEQ ID NO: 1389525 - RNA, 15 nt, Homo sapiens
gaagacagagggaaa

SEQ ID NO: 1389526 - RNA, 21 nt, Homo sapiens
gaagaccaagacacagaucac

SEQ ID NO: 1389527 - RNA, 17 nt, Homo sapiens
gaagacuauauuguaca

SEQ ID NO: 1389528 - RNA, 12 nt, Homo sapiens
gaagacuguggc

SEQ ID NO: 1389529 - RNA, 14 nt, Homo sapiens
gaagagaccaagac

SEQ ID NO: 1389530 - RNA, 17 nt, Homo sapiens
gaagagauccuucugua

SEQ ID NO: 1389531 - RNA, 23 nt, Homo sapiens
gaagagccuugcggaagguucua

SEQ ID NO: 1389532 - RNA, 14 nt, Homo sapiens
gaagaucaggccaa

SEQ ID NO: 1389533 - RNA, 15 nt, Homo sapiens
gaagaugaugcuauu

SEQ ID NO: 1389534 - RNA, 21 nt, Homo sapiens
gaagauggauugguguaaaag

SEQ ID NO: 1389535 - RNA, 22 nt, Homo sapiens
gaagauuauuuacugacauaua

SEQ ID NO: 1389536 - RNA, 23 nt, Homo sapiens
gaagcaaaucagaaacuugugaa

SEQ ID NO: 1389537 - RNA, 16 nt, Homo sapiens
gaagcaccccaugcca

SEQ ID NO: 1389538 - RNA, 22 nt, Homo sapiens
gaagcagucaauuuucacauca

SEQ ID NO: 1389539 - RNA, 19 nt, Homo sapiens
gaagcagugccuuccauaa

SEQ ID NO: 1389540 - RNA, 15 nt, Homo sapiens
gaagcauuuacuuug

SEQ ID NO: 1389541 - RNA, 17 nt, Homo sapiens
gaagcauuuacuuugug

SEQ ID NO: 1389542 - RNA, 14 nt, Homo sapiens
gaagccacccuccc

SEQ ID NO: 1389543 - RNA, 18 nt, Homo sapiens
gaagccacccucccagcu

SEQ ID NO: 1389544 - RNA, 16 nt, Homo sapiens
gaagcccucucuggcu

SEQ ID NO: 1389545 - RNA, 14 nt, Homo sapiens
gaagccgugcccug

SEQ ID NO: 1389546 - RNA, 19 nt, Homo sapiens
gaagcuccagaagaacaaa

SEQ ID NO: 1389547 - RNA, 21 nt, Homo sapiens
gaagcucuggugacaccagcc

SEQ ID NO: 1389548 - RNA, 21 nt, Homo sapiens
gaagcuguguccuugcaccug

SEQ ID NO: 1389549 - RNA, 20 nt, Homo sapiens
gaaggacucuuccagaguca

SEQ ID NO: 1389550 - RNA, 23 nt, Homo sapiens
gaaggaggcuggcuuguccccuc

SEQ ID NO: 1389551 - RNA, 12 nt, Homo sapiens
gaaggagggaga

SEQ ID NO: 1389552 - RNA, 14 nt, Homo sapiens
gaaggcagagccau

SEQ ID NO: 1389553 - RNA, 23 nt, Homo sapiens
gaaggguaccuugaacacugggg

SEQ ID NO: 1389554 - RNA, 19 nt, Homo sapiens
gaaggugaaagugcaguuc

SEQ ID NO: 1389555 - RNA, 21 nt, Homo sapiens
gaaguaagcaaagacuuuccu

SEQ ID NO: 1389556 - RNA, 21 nt, Homo sapiens
gaaguagcucuggugaccuug

SEQ ID NO: 1389557 - RNA, 21 nt, Homo sapiens
gaaguauuuuccuccaggcaa

SEQ ID NO: 1389558 - RNA, 22 nt, Homo sapiens
gaaguauuuuccuccaggcaaa

SEQ ID NO: 1389559 - RNA, 16 nt, Homo sapiens
gaagucacugcacagu

SEQ ID NO: 1389560 - RNA, 15 nt, Homo sapiens
gaagucaugcguuua

SEQ ID NO: 1389561 - RNA, 15 nt, Homo sapiens
gaagugaccaaggag

SEQ ID NO: 1389562 - RNA, 17 nt, Homo sapiens
gaagugcuuucuucucc

SEQ ID NO: 1389563 - RNA, 13 nt, Homo sapiens
gaagugugugauc

SEQ ID NO: 1389564 - RNA, 17 nt, Homo sapiens
gaauaaauugcuccuug

SEQ ID NO: 1389565 - RNA, 16 nt, Homo sapiens
gaauaaugaauggacu

SEQ ID NO: 1389566 - RNA, 12 nt, Homo sapiens
gaauaaugcugu

SEQ ID NO: 1389567 - RNA, 18 nt, Homo sapiens
gaauaaugcuguuuuaua

SEQ ID NO: 1389568 - RNA, 22 nt, Homo sapiens
gaauacuuaacucaauaauucu

SEQ ID NO: 1389569 - RNA, 14 nt, Homo sapiens
gaauaguacagaca

SEQ ID NO: 1389570 - RNA, 18 nt, Homo sapiens
gaauauaacuuuuuccaa

SEQ ID NO: 1389571 - RNA, 13 nt, Homo sapiens
gaauaugcacaaa

SEQ ID NO: 1389572 - RNA, 23 nt, Homo sapiens
gaauauggugggcacagaaguag

SEQ ID NO: 1389573 - RNA, 13 nt, Homo sapiens
gaaucaauccagc

SEQ ID NO: 1389574 - RNA, 13 nt, Homo sapiens
gaaucacauucuu

SEQ ID NO: 1389575 - RNA, 16 nt, Homo sapiens
gaaucaccuugauuca

SEQ ID NO: 1389576 - RNA, 20 nt, Homo sapiens
gaaucagugaagaugccagu

SEQ ID NO: 1389577 - RNA, 19 nt, Homo sapiens
gaaucauauaguauguaac

SEQ ID NO: 1389578 - RNA, 20 nt, Homo sapiens
gaaucauugcuuaugacaug

SEQ ID NO: 1389579 - RNA, 23 nt, Homo sapiens
gaauccagagagcaguguggaaa

SEQ ID NO: 1389580 - RNA, 12 nt, Homo sapiens
gaauccaugcuu

SEQ ID NO: 1389581 - RNA, 16 nt, Homo sapiens
gaaucuuuccuuccuc

SEQ ID NO: 1389582 - RNA, 21 nt, Homo sapiens
gaaucuuugucagcaguuccc

SEQ ID NO: 1389583 - RNA, 15 nt, Homo sapiens
gaaugaacaaccucg

SEQ ID NO: 1389584 - RNA, 19 nt, Homo sapiens
gaaugagcaaaaccaaaua

SEQ ID NO: 1389585 - RNA, 23 nt, Homo sapiens
gaaugagugaaucaccuguggua

SEQ ID NO: 1389586 - RNA, 18 nt, Homo sapiens
gaaugaugcacauuucau

SEQ ID NO: 1389587 - RNA, 20 nt, Homo sapiens
gaaugauuuagguacgucaa

SEQ ID NO: 1389588 - RNA, 24 nt, Homo sapiens
gaaugcacacuagccucuccagga

SEQ ID NO: 1389589 - RNA, 21 nt, Homo sapiens
gaaugcauuauuuauugcugu

SEQ ID NO: 1389590 - RNA, 19 nt, Homo sapiens
gaauggggugcaugaaggu

SEQ ID NO: 1389591 - RNA, 20 nt, Homo sapiens
gaaugguagucuaaccaaau

SEQ ID NO: 1389592 - RNA, 15 nt, Homo sapiens
gaaugugauauuuga

SEQ ID NO: 1389593 - RNA, 17 nt, Homo sapiens
gaaugugauauuugaag

SEQ ID NO: 1389594 - RNA, 16 nt, Homo sapiens
gaauuaggaagaccaa

SEQ ID NO: 1389595 - RNA, 17 nt, Homo sapiens
gaauuaggaagaccaag

SEQ ID NO: 1389596 - RNA, 20 nt, Homo sapiens
gaauuauaauuaguuccuca

SEQ ID NO: 1389597 - RNA, 22 nt, Homo sapiens
gaauucugcuaccucacugggg

SEQ ID NO: 1389598 - RNA, 13 nt, Homo sapiens
gaauugcagagua

SEQ ID NO: 1389599 - RNA, 19 nt, Homo sapiens
gaauugcucgaacuuggag

SEQ ID NO: 1389600 - RNA, 23 nt, Homo sapiens
gaauugucuuuggugcuuuucac

SEQ ID NO: 1389601 - RNA, 17 nt, Homo sapiens
gaauuuauucaauuccu

SEQ ID NO: 1389602 - RNA, 18 nt, Homo sapiens
gaauuugaguuggaucau

SEQ ID NO: 1389603 - RNA, 15 nt, Homo sapiens
gaauuuuaagugcuu

SEQ ID NO: 1389604 - RNA, 20 nt, Homo sapiens
gaauuuucucuaacuucaag

SEQ ID NO: 1389605 - RNA, 18 nt, Homo sapiens
gaauuuuguuuguugaug

SEQ ID NO: 1389606 - RNA, 17 nt, Homo sapiens
gacaaagaaacccaagu

SEQ ID NO: 1389607 - RNA, 13 nt, Homo sapiens
gacaaaugcugcg

SEQ ID NO: 1389608 - RNA, 21 nt, Homo sapiens
gacaacauuucucaaaugcac

SEQ ID NO: 1389609 - RNA, 16 nt, Homo sapiens
gcccaagagaugaaga

SEQ ID NO: 1389610 - RNA, 19 nt, Homo sapiens
gcccacagucugacuuccc

SEQ ID NO: 1389611 - RNA, 21 nt, Homo sapiens
gcccacauguguccaucccag

SEQ ID NO: 1389612 - RNA, 21 nt, Homo sapiens
gcccacgccuguaaucccagc

SEQ ID NO: 1389613 - RNA, 23 nt, Homo sapiens
gcccacguggaggcccaccugcc

SEQ ID NO: 1389614 - RNA, 13 nt, Homo sapiens
gcccacuucaggg

SEQ ID NO: 1389615 - RNA, 16 nt, Homo sapiens
gcccacuucugccaua

SEQ ID NO: 1389616 - RNA, 21 nt, Homo sapiens
gcccagccuccaagcuccauc

SEQ ID NO: 1389617 - RNA, 21 nt, Homo sapiens
gcccaggaguuugaauccauc

SEQ ID NO: 1389618 - RNA, 17 nt, Homo sapiens
gcccaggccugccuguu

SEQ ID NO: 1389619 - RNA, 16 nt, Homo sapiens
gcccagggaagccaaa

SEQ ID NO: 1389620 - RNA, 19 nt, Homo sapiens
gcccagggccacucugccu

SEQ ID NO: 1389621 - RNA, 23 nt, Homo sapiens
gcccaggguucccccagcccugu

SEQ ID NO: 1389622 - RNA, 14 nt, Homo sapiens
gcccauaucuguga

SEQ ID NO: 1389623 - RNA, 15 nt, Homo sapiens
gcccaugugugagug

SEQ ID NO: 1389624 - RNA, 20 nt, Homo sapiens
gcccaugugugagugugugc

SEQ ID NO: 1389625 - RNA, 15 nt, Homo sapiens
gccccaggaagccgu

SEQ ID NO: 1389626 - RNA, 22 nt, Homo sapiens
gccccagugccaagcacagugc

SEQ ID NO: 1389627 - RNA, 19 nt, Homo sapiens
gccccaugaagccacagcc

SEQ ID NO: 1389628 - RNA, 20 nt, Homo sapiens
gccccccuugccagacaugu

SEQ ID NO: 1389629 - RNA, 15 nt, Homo sapiens
gccccuccuaguucu

SEQ ID NO: 1389630 - RNA, 15 nt, Homo sapiens
gccccugcccggcug

SEQ ID NO: 1389631 - RNA, 15 nt, Homo sapiens
gccccugccuggacu

SEQ ID NO: 1389632 - RNA, 16 nt, Homo sapiens
gcccggggcagcugcc

SEQ ID NO: 1389633 - RNA, 20 nt, Homo sapiens
gcccgucauguuccucaaaa

SEQ ID NO: 1389634 - RNA, 21 nt, Homo sapiens
gcccgucauguuccucaaaag

SEQ ID NO: 1389635 - RNA, 21 nt, Homo sapiens
gcccuaccugauuggugcaac

SEQ ID NO: 1389636 - RNA, 17 nt, Homo sapiens
gcccuagagcacacugu

SEQ ID NO: 1389637 - RNA, 20 nt, Homo sapiens
gcccucaaaaugacagccau

SEQ ID NO: 1389638 - RNA, 22 nt, Homo sapiens
gcccucagaaucgcuccaccuu

SEQ ID NO: 1389639 - RNA, 12 nt, Homo sapiens
gcccugggaugu

SEQ ID NO: 1389640 - RNA, 15 nt, Homo sapiens
gcccuggugcugcca

SEQ ID NO: 1389641 - RNA, 21 nt, Homo sapiens
gcccuugaagauaucuugaaa

SEQ ID NO: 1389642 - RNA, 23 nt, Homo sapiens
gcccuuuauuuauaauacauuuc

SEQ ID NO: 1389643 - RNA, 21 nt, Homo sapiens
gccgagaucgcgccacugcac

SEQ ID NO: 1389644 - RNA, 19 nt, Homo sapiens
gccgugccuucagcucuac

SEQ ID NO: 1389645 - RNA, 12 nt, Homo sapiens
gccguggcugcg

SEQ ID NO: 1389646 - RNA, 17 nt, Homo sapiens
gccuaaaaaugcaacuu

SEQ ID NO: 1389647 - RNA, 16 nt, Homo sapiens
gccuacuaacauauaa

SEQ ID NO: 1389648 - RNA, 16 nt, Homo sapiens
gccuaggggucaggga

SEQ ID NO: 1389649 - RNA, 15 nt, Homo sapiens
gccuagucagccaca

SEQ ID NO: 1389650 - RNA, 16 nt, Homo sapiens
gccuaucagcauuuua

SEQ ID NO: 1389651 - RNA, 14 nt, Homo sapiens
gccuaugugcaugc

SEQ ID NO: 1389652 - RNA, 21 nt, Homo sapiens
gccucauugaugucaaaaacu

SEQ ID NO: 1389653 - RNA, 18 nt, Homo sapiens
gccuccaccgcugccuaa

SEQ ID NO: 1389654 - RNA, 20 nt, Homo sapiens
gccuccauucugaccauuuc

SEQ ID NO: 1389655 - RNA, 21 nt, Homo sapiens
gccuccucuguccagggcccu

SEQ ID NO: 1389656 - RNA, 20 nt, Homo sapiens
gccucggccucccaaagugu

SEQ ID NO: 1389657 - RNA, 20 nt, Homo sapiens
gccucgggacaucaaaaaca

SEQ ID NO: 1389658 - RNA, 16 nt, Homo sapiens
gccucucuuccuaucc

SEQ ID NO: 1389659 - RNA, 21 nt, Homo sapiens
gccucugccccgucucaugag

SEQ ID NO: 1389660 - RNA, 16 nt, Homo sapiens
gccucugggaggccag

SEQ ID NO: 1389661 - RNA, 19 nt, Homo sapiens
gccugaaccuuccaucucg

SEQ ID NO: 1389662 - RNA, 13 nt, Homo sapiens
gccugaacugagg

SEQ ID NO: 1389663 - RNA, 17 nt, Homo sapiens
gccugaagaacaguaac

SEQ ID NO: 1389664 - RNA, 15 nt, Homo sapiens
gccugaagucacaca

SEQ ID NO: 1389665 - RNA, 18 nt, Homo sapiens
gccugaugcucccucccc

SEQ ID NO: 1389666 - RNA, 20 nt, Homo sapiens
gccuggccaacauggugaaa

SEQ ID NO: 1389667 - RNA, 14 nt, Homo sapiens
gccugguggcagcu

SEQ ID NO: 1389668 - RNA, 23 nt, Homo sapiens
gccugucgcaugagaacauuaac

SEQ ID NO: 1389669 - RNA, 14 nt, Homo sapiens
gccugugcugugac

SEQ ID NO: 1389670 - RNA, 14 nt, Homo sapiens
gccuuaaaagccau

SEQ ID NO: 1389671 - RNA, 15 nt, Homo sapiens
gccuuccacaauuca

SEQ ID NO: 1389672 - RNA, 23 nt, Homo sapiens
gccuuucucccaggccaggcucc

SEQ ID NO: 1389673 - RNA, 15 nt, Homo sapiens
gccuuuguugcucag

SEQ ID NO: 1389674 - RNA, 15 nt, Homo sapiens
gcgagacuccgucuc

SEQ ID NO: 1389675 - RNA, 13 nt, Homo sapiens
gcgaggcucuaac

SEQ ID NO: 1389676 - RNA, 17 nt, Homo sapiens
gcgagucuuacuuugag

SEQ ID NO: 1389677 - RNA, 22 nt, Homo sapiens
gcgauccaccugucucagccuc

SEQ ID NO: 1389678 - RNA, 16 nt, Homo sapiens
gcgauuacaggcauga

SEQ ID NO: 1389679 - RNA, 20 nt, Homo sapiens
gcgcaauugcucaugcauag

SEQ ID NO: 1389680 - RNA, 15 nt, Homo sapiens
gcgccacugcacucc

SEQ ID NO: 1389681 - RNA, 15 nt, Homo sapiens
gcgccucggguccca

SEQ ID NO: 1389682 - RNA, 20 nt, Homo sapiens
gcggcucaaaaggaaaccaa

SEQ ID NO: 1389683 - RNA, 15 nt, Homo sapiens
gcggucaauuugccu

SEQ ID NO: 1389684 - RNA, 12 nt, Homo sapiens
gcgguggcucac

SEQ ID NO: 1389685 - RNA, 16 nt, Homo sapiens
gcgugagccacugcac

SEQ ID NO: 1389686 - RNA, 14 nt, Homo sapiens
gcgugcaugugcac

SEQ ID NO: 1389687 - RNA, 13 nt, Homo sapiens
gcgugguggcaca

SEQ ID NO: 1389688 - RNA, 19 nt, Homo sapiens
gcgugguggcgggcaccua

SEQ ID NO: 1389689 - RNA, 18 nt, Homo sapiens
gcgugucccucucggaag

SEQ ID NO: 1389690 - RNA, 21 nt, Homo sapiens
gcgugugcgugcaugugcacu

SEQ ID NO: 1389691 - RNA, 23 nt, Homo sapiens
gcguguggcucacgugugugacu

SEQ ID NO: 1389692 - RNA, 15 nt, Homo sapiens
gcgugugugcaagug

SEQ ID NO: 1389693 - RNA, 20 nt, Homo sapiens
gcuaacccccuucuacugag

SEQ ID NO: 1389694 - RNA, 14 nt, Homo sapiens
gcuaaucuucaggg

SEQ ID NO: 1389695 - RNA, 19 nt, Homo sapiens
gcuacacagaucacagcuu

SEQ ID NO: 1389696 - RNA, 17 nt, Homo sapiens
gcuaccuacauacaauu

SEQ ID NO: 1389697 - RNA, 16 nt, Homo sapiens
gcuaccucacuggggu

SEQ ID NO: 1389698 - RNA, 14 nt, Homo sapiens
gcuaccucuucuau

SEQ ID NO: 1389699 - RNA, 18 nt, Homo sapiens
gcuacucagaagccugag

SEQ ID NO: 1389700 - RNA, 20 nt, Homo sapiens
gcuacucuguuccuucacau

SEQ ID NO: 1389701 - RNA, 22 nt, Homo sapiens
gcuacugacuauggcuaccaaa

SEQ ID NO: 1389702 - RNA, 12 nt, Homo sapiens
gcuacuguguca

SEQ ID NO: 1389703 - RNA, 22 nt, Homo sapiens
gcuagacaagcuuguccaugua

SEQ ID NO: 1389704 - RNA, 18 nt, Homo sapiens
gcuagaugugucuuacca

SEQ ID NO: 1389705 - RNA, 15 nt, Homo sapiens
gcuagcaaauuugag

SEQ ID NO: 1389706 - RNA, 12 nt, Homo sapiens
gcuagucuuuca

SEQ ID NO: 1389707 - RNA, 22 nt, Homo sapiens
gcuauagacccgaggaaacuca

SEQ ID NO: 1389708 - RNA, 14 nt, Homo sapiens
gcuauagcuacagg

SEQ ID NO: 1389709 - RNA, 11 nt, Homo sapiens
gcuaucucugu

SEQ ID NO: 1389710 - RNA, 22 nt, Homo sapiens
gcuaugaaaacagcuaucucac

SEQ ID NO: 1389711 - RNA, 23 nt, Homo sapiens
gcuauggucagguuauacuccuc

SEQ ID NO: 1389712 - RNA, 21 nt, Homo sapiens
gcucaagcagucuacccaccu

SEQ ID NO: 1389713 - RNA, 16 nt, Homo sapiens
gcucaagugauccucc

SEQ ID NO: 1389714 - RNA, 19 nt, Homo sapiens
gcucaauauuccugaauga

SEQ ID NO: 1389715 - RNA, 17 nt, Homo sapiens
gcucacacaugagaucu

SEQ ID NO: 1389716 - RNA, 18 nt, Homo sapiens
gcucaccagccccagugc

SEQ ID NO: 1389717 - RNA, 19 nt, Homo sapiens
gcucagcggggacagcucc

SEQ ID NO: 1389718 - RNA, 15 nt, Homo sapiens
gcucaggggcgugug

SEQ ID NO: 1389719 - RNA, 15 nt, Homo sapiens
gcucaguuggugcug

SEQ ID NO: 1389720 - RNA, 18 nt, Homo sapiens
gcucaguuggugcugcuu

SEQ ID NO: 1389721 - RNA, 20 nt, Homo sapiens
gcucaguuggugcugcuuuc

SEQ ID NO: 1389722 - RNA, 11 nt, Homo sapiens
gucagugcagc

SEQ ID NO: 1389723 - RNA, 19 nt, Homo sapiens
gucauauauggggggccaa

SEQ ID NO: 1389724 - RNA, 19 nt, Homo sapiens
gucaucacuccucugucau

SEQ ID NO: 1389725 - RNA, 24 nt, Homo sapiens
gucauggcaccaaagccaccagac

SEQ ID NO: 1389726 - RNA, 18 nt, Homo sapiens
gucauuaaacaugacauu

SEQ ID NO: 1389727 - RNA, 22 nt, Homo sapiens
gucauuuuuauaaaacuuugaa

SEQ ID NO: 1389728 - RNA, 23 nt, Homo sapiens
guccaaggcuauauuucugggau

SEQ ID NO: 1389729 - RNA, 19 nt, Homo sapiens
guccaagugugugugcgug

SEQ ID NO: 1389730 - RNA, 23 nt, Homo sapiens
guccagccgccauugccaccagg

SEQ ID NO: 1389731 - RNA, 15 nt, Homo sapiens
guccagcucguucuc

SEQ ID NO: 1389732 - RNA, 16 nt, Homo sapiens
guccagcucguucucu

SEQ ID NO: 1389733 - RNA, 18 nt, Homo sapiens
guccagucucuucugcug

SEQ ID NO: 1389734 - RNA, 23 nt, Homo sapiens
guccaucuucuuuauacaaugac

SEQ ID NO: 1389735 - RNA, 15 nt, Homo sapiens
guccaugccuuccau

SEQ ID NO: 1389736 - RNA, 17 nt, Homo sapiens
guccaugugugugcaag

SEQ ID NO: 1389737 - RNA, 14 nt, Homo sapiens
guccauuuugcccu

SEQ ID NO: 1389738 - RNA, 17 nt, Homo sapiens
gucccagcuacucagaa

SEQ ID NO: 1389739 - RNA, 16 nt, Homo sapiens
gucccauugauguacu

SEQ ID NO: 1389740 - RNA, 17 nt, Homo sapiens
guccccagcccacugga

SEQ ID NO: 1389741 - RNA, 16 nt, Homo sapiens
guccccugacccagag

SEQ ID NO: 1389742 - RNA, 18 nt, Homo sapiens
gucccugucaccaagcuc

SEQ ID NO: 1389743 - RNA, 16 nt, Homo sapiens
gucccuuccaggccau

SEQ ID NO: 1389744 - RNA, 19 nt, Homo sapiens
guccuaagccuguuagcau

SEQ ID NO: 1389745 - RNA, 17 nt, Homo sapiens
guccucacucccagucc

SEQ ID NO: 1389746 - RNA, 16 nt, Homo sapiens
guccugaaagccacag

SEQ ID NO: 1389747 - RNA, 22 nt, Homo sapiens
guccugaaagccacagacaaua

SEQ ID NO: 1389748 - RNA, 21 nt, Homo sapiens
guccuucucucaccuccuaaa

SEQ ID NO: 1389749 - RNA, 17 nt, Homo sapiens
gucggggggacagcucc

SEQ ID NO: 1389750 - RNA, 19 nt, Homo sapiens
gucgucagcuggcacuguc

SEQ ID NO: 1389751 - RNA, 12 nt, Homo sapiens
gucuaaaaccuu

SEQ ID NO: 1389752 - RNA, 13 nt, Homo sapiens
gucuaccaucucc

SEQ ID NO: 1389753 - RNA, 17 nt, Homo sapiens
gucuacguuaccaggca

SEQ ID NO: 1389754 - RNA, 20 nt, Homo sapiens
gucucaaccccucacaggag

SEQ ID NO: 1389755 - RNA, 19 nt, Homo sapiens
gucucaagagggcacuggu

SEQ ID NO: 1389756 - RNA, 18 nt, Homo sapiens
gucucacugaacuagaag

SEQ ID NO: 1389757 - RNA, 22 nt, Homo sapiens
gucuccucuuaaaaaauaaaaa

SEQ ID NO: 1389758 - RNA, 17 nt, Homo sapiens
gucucgcuuuguugccc

SEQ ID NO: 1389759 - RNA, 20 nt, Homo sapiens
gucucugcuauggaaugccc

SEQ ID NO: 1389760 - RNA, 12 nt, Homo sapiens
gucugacaggca

SEQ ID NO: 1389761 - RNA, 13 nt, Homo sapiens
gucugagccaaag

SEQ ID NO: 1389762 - RNA, 16 nt, Homo sapiens
gucuggaaugcagugg

SEQ ID NO: 1389763 - RNA, 19 nt, Homo sapiens
gucuggaggggcauggcca

SEQ ID NO: 1389764 - RNA, 13 nt, Homo sapiens
gucugguuuauuu

SEQ ID NO: 1389765 - RNA, 20 nt, Homo sapiens
gucugugugcaagugugugc

SEQ ID NO: 1389766 - RNA, 21 nt, Homo sapiens
gucuuaacauuucuaacucug

SEQ ID NO: 1389767 - RNA, 21 nt, Homo sapiens
gucuuacuguugcauaacuau

SEQ ID NO: 1389768 - RNA, 23 nt, Homo sapiens
gucuuagacuugaaauacuacuu

SEQ ID NO: 1389769 - RNA, 12 nt, Homo sapiens
gucuugaacucc

SEQ ID NO: 1389770 - RNA, 13 nt, Homo sapiens
gucuugauuuguu

SEQ ID NO: 1389771 - RNA, 17 nt, Homo sapiens
gucuugcaauggcagcc

SEQ ID NO: 1389772 - RNA, 15 nt, Homo sapiens
gucuugguacuugcu

SEQ ID NO: 1389773 - RNA, 14 nt, Homo sapiens
gucuuugaacccuu

SEQ ID NO: 1389774 - RNA, 13 nt, Homo sapiens
gucuuuggugcuu

SEQ ID NO: 1389775 - RNA, 21 nt, Homo sapiens
gugaaaaaguuaaacauugaa

SEQ ID NO: 1389776 - RNA, 17 nt, Homo sapiens
gugaaaccucaucucua

SEQ ID NO: 1389777 - RNA, 15 nt, Homo sapiens
gugaaaucugugcaa

SEQ ID NO: 1389778 - RNA, 23 nt, Homo sapiens
gugaaccaccacacccagcccac

SEQ ID NO: 1389779 - RNA, 13 nt, Homo sapiens
gugaaugaucucu

SEQ ID NO: 1389780 - RNA, 23 nt, Homo sapiens
gugacaaccgaguggcugucauc

SEQ ID NO: 1389781 - RNA, 20 nt, Homo sapiens
gugacaucucuuugauguca

SEQ ID NO: 1389782 - RNA, 13 nt, Homo sapiens
gugacauuuugcc

SEQ ID NO: 1389783 - RNA, 23 nt, Homo sapiens
gugaccccugaccucacugugac

SEQ ID NO: 1389784 - RNA, 14 nt, Homo sapiens
gugaccuugagcaa

SEQ ID NO: 1389785 - RNA, 15 nt, Homo sapiens
gugagaggacucuga

SEQ ID NO: 1389786 - RNA, 14 nt, Homo sapiens
gugagaucaugcca

SEQ ID NO: 1389787 - RNA, 16 nt, Homo sapiens
gugagcaaagggcuca

SEQ ID NO: 1389788 - RNA, 14 nt, Homo sapiens
gugaguuaauuuaa

SEQ ID NO: 1389789 - RNA, 18 nt, Homo sapiens
gugauccacccaccucag

SEQ ID NO: 1389790 - RNA, 21 nt, Homo sapiens
gugaugaugaaaugaggucag

SEQ ID NO: 1389791 - RNA, 16 nt, Homo sapiens
gugauggauaaggaug

SEQ ID NO: 1389792 - RNA, 23 nt, Homo sapiens
gugauucccuccugcuacucugu

SEQ ID NO: 1389793 - RNA, 15 nt, Homo sapiens
gugcacgcacacugu

SEQ ID NO: 1389794 - RNA, 13 nt, Homo sapiens
gugcagauaucac

SEQ ID NO: 1389795 - RNA, 21 nt, Homo sapiens
gugccacugcccgagcuggug

SEQ ID NO: 1389796 - RNA, 23 nt, Homo sapiens
gugccacugcccgagcuggugca

SEQ ID NO: 1389797 - RNA, 19 nt, Homo sapiens
gugccccaugccuguccag

SEQ ID NO: 1389798 - RNA, 18 nt, Homo sapiens
gugccguaacaacugugg

SEQ ID NO: 1389799 - RNA, 20 nt, Homo sapiens
gugccucagccguucuugac

SEQ ID NO: 1389800 - RNA, 14 nt, Homo sapiens
gugccuuccauaau

SEQ ID NO: 1389801 - RNA, 12 nt, Homo sapiens
gugccuucugcc

SEQ ID NO: 1389802 - RNA, 18 nt, Homo sapiens
gugcgugcaugugcacuu

SEQ ID NO: 1389803 - RNA, 14 nt, Homo sapiens
gugcgugugugcaa

SEQ ID NO: 1389804 - RNA, 19 nt, Homo sapiens
gugcguguuuccugugcaa

SEQ ID NO: 1389805 - RNA, 18 nt, Homo sapiens
gugcuaaacgcacacagu

SEQ ID NO: 1389806 - RNA, 12 nt, Homo sapiens
gugcuacaugac

SEQ ID NO: 1389807 - RNA, 13 nt, Homo sapiens
gugcucauuucau

SEQ ID NO: 1389808 - RNA, 21 nt, Homo sapiens
gugcugggauuacagguguga

SEQ ID NO: 1389809 - RNA, 22 nt, Homo sapiens
gugcuucuuaaaauagccauaa

SEQ ID NO: 1389810 - RNA, 18 nt, Homo sapiens
guggaaccaacacuaaca

SEQ ID NO: 1389811 - RNA, 19 nt, Homo sapiens
guggaauagccucccugua

SEQ ID NO: 1389812 - RNA, 12 nt, Homo sapiens
guggacugugau

SEQ ID NO: 1389813 - RNA, 17 nt, Homo sapiens
guggagaaacuguaguc

SEQ ID NO: 1389814 - RNA, 20 nt, Homo sapiens
guggagaaauuccuugauuc

SEQ ID NO: 1389815 - RNA, 16 nt, Homo sapiens
guggagguugcaguga

SEQ ID NO: 1389816 - RNA, 21 nt, Homo sapiens
guggcagauaaucagccucuu

SEQ ID NO: 1389817 - RNA, 21 nt, Homo sapiens
guggcagcugcuuuugucuau

SEQ ID NO: 1389818 - RNA, 23 nt, Homo sapiens
guggcagcugucucaaaccucca

SEQ ID NO: 1389819 - RNA, 14 nt, Homo sapiens
guggcaugugcugu

SEQ ID NO: 1389820 - RNA, 19 nt, Homo sapiens
guggccaugguccccaaga

SEQ ID NO: 1389821 - RNA, 18 nt, Homo sapiens
guggcccagagaagccaa

SEQ ID NO: 1389822 - RNA, 14 nt, Homo sapiens
guggcgacucuaua

SEQ ID NO: 1389823 - RNA, 15 nt, Homo sapiens
guggcuucugaugaa

SEQ ID NO: 1389824 - RNA, 13 nt, Homo sapiens
gugggacugagau

SEQ ID NO: 1389825 - RNA, 21 nt, Homo sapiens
gugggagcagcgguuugggga

SEQ ID NO: 1389826 - RNA, 17 nt, Homo sapiens
gugggcauggagccagu

SEQ ID NO: 1389827 - RNA, 11 nt, Homo sapiens
gugggccaugg

SEQ ID NO: 1389828 - RNA, 12 nt, Homo sapiens
gugggcugugag

SEQ ID NO: 1389829 - RNA, 16 nt, Homo sapiens
guggggcagcacagag

SEQ ID NO: 1389830 - RNA, 18 nt, Homo sapiens
gugguggagaaccacagc

SEQ ID NO: 1389831 - RNA, 20 nt, Homo sapiens
gugguggcacacaccuguag

SEQ ID NO: 1389832 - RNA, 18 nt, Homo sapiens
gugguuuccaaggagcug

SEQ ID NO: 1389833 - RNA, 16 nt, Homo sapiens
guguacacgugacaga

SEQ ID NO: 1389834 - RNA, 19 nt, Homo sapiens
guguaugcacgugugcaca

SEQ ID NO: 1389835 - RNA, 19 nt, Homo sapiens
ugagcugcccccaaaucaa

SEQ ID NO: 1389836 - RNA, 22 nt, Homo sapiens
ugagcuuaaaaaaaaaguauac

SEQ ID NO: 1389837 - RNA, 14 nt, Homo sapiens
ugagcuuagugaaa

SEQ ID NO: 1389838 - RNA, 22 nt, Homo sapiens
ugagcuuuauguaauaauguga

SEQ ID NO: 1389839 - RNA, 19 nt, Homo sapiens
ugagcuuuggacacacaca

SEQ ID NO: 1389840 - RNA, 22 nt, Homo sapiens
ugagcuuuggacacacacagcu

SEQ ID NO: 1389841 - RNA, 22 nt, Homo sapiens
ugagcuuuggacgcacacagcu

SEQ ID NO: 1389842 - RNA, 18 nt, Homo sapiens
ugaggaugcagagucagc

SEQ ID NO: 1389843 - RNA, 12 nt, Homo sapiens
ugaggauuucaa

SEQ ID NO: 1389844 - RNA, 17 nt, Homo sapiens
ugaggcaaccacaggca

SEQ ID NO: 1389845 - RNA, 22 nt, Homo sapiens
ugaggcaggagaauggcgugaa

SEQ ID NO: 1389846 - RNA, 18 nt, Homo sapiens
ugaggcaggugacaguga

SEQ ID NO: 1389847 - RNA, 19 nt, Homo sapiens
ugaggcaggugacagugag

SEQ ID NO: 1389848 - RNA, 19 nt, Homo sapiens
ugaggcuggacuccagauc

SEQ ID NO: 1389849 - RNA, 21 nt, Homo sapiens
ugaggcuggacuccagaucug

SEQ ID NO: 1389850 - RNA, 15 nt, Homo sapiens
ugagggaaaaugagu

SEQ ID NO: 1389851 - RNA, 22 nt, Homo sapiens
ugaggggcuccuggaaaggcuc

SEQ ID NO: 1389852 - RNA, 17 nt, Homo sapiens
ugaggggcuggcacuga

SEQ ID NO: 1389853 - RNA, 14 nt, Homo sapiens
ugagguacagcaga

SEQ ID NO: 1389854 - RNA, 16 nt, Homo sapiens
ugaggucucuugaggg

SEQ ID NO: 1389855 - RNA, 15 nt, Homo sapiens
ugaguaagauuuacc

SEQ ID NO: 1389856 - RNA, 16 nt, Homo sapiens
ugaguauaacucuaac

SEQ ID NO: 1389857 - RNA, 20 nt, Homo sapiens
ugagucaugaucucccugcc

SEQ ID NO: 1389858 - RNA, 16 nt, Homo sapiens
ugagucccagagccaa

SEQ ID NO: 1389859 - RNA, 14 nt, Homo sapiens
ugagucgaggacag

SEQ ID NO: 1389860 - RNA, 15 nt, Homo sapiens
ugagugggugaauaa

SEQ ID NO: 1389861 - RNA, 15 nt, Homo sapiens
ugaguuaaauuauac

SEQ ID NO: 1389862 - RNA, 12 nt, Homo sapiens
ugaguuacuuga

SEQ ID NO: 1389863 - RNA, 19 nt, Homo sapiens
ugaguugcccaucuuguuu

SEQ ID NO: 1389864 - RNA, 21 nt, Homo sapiens
ugaguugguguugacaugugc

SEQ ID NO: 1389865 - RNA, 15 nt, Homo sapiens
ugaguuuagugaucu

SEQ ID NO: 1389866 - RNA, 20 nt, Homo sapiens
ugauaacagcuaccaugaca

SEQ ID NO: 1389867 - RNA, 14 nt, Homo sapiens
ugauacacuaugaa

SEQ ID NO: 1389868 - RNA, 15 nt, Homo sapiens
ugauacauaugugaa

SEQ ID NO: 1389869 - RNA, 22 nt, Homo sapiens
ugauacccaaguuauugggaug

SEQ ID NO: 1389870 - RNA, 23 nt, Homo sapiens
ugauagagguucuuuauugcuca

SEQ ID NO: 1389871 - RNA, 13 nt, Homo sapiens
ugauagcuuuauu

SEQ ID NO: 1389872 - RNA, 14 nt, Homo sapiens
ugauaugucagggc

SEQ ID NO: 1389873 - RNA, 15 nt, Homo sapiens
ugauauugcauaugc

SEQ ID NO: 1389874 - RNA, 17 nt, Homo sapiens
ugaucaauaaaauguga

SEQ ID NO: 1389875 - RNA, 17 nt, Homo sapiens
ugauccacccaccucag

SEQ ID NO: 1389876 - RNA, 16 nt, Homo sapiens
ugauccguuccauugc

SEQ ID NO: 1389877 - RNA, 20 nt, Homo sapiens
ugaucuugcucuaucucaca

SEQ ID NO: 1389878 - RNA, 14 nt, Homo sapiens
ugaucuuugcagac

SEQ ID NO: 1389879 - RNA, 17 nt, Homo sapiens
ugaugaaagcugauuac

SEQ ID NO: 1389880 - RNA, 13 nt, Homo sapiens
ugaugacacugag

SEQ ID NO: 1389881 - RNA, 13 nt, Homo sapiens
ugaugaucuuugc

SEQ ID NO: 1389882 - RNA, 17 nt, Homo sapiens
ugaugauuugcuaucaa

SEQ ID NO: 1389883 - RNA, 16 nt, Homo sapiens
ugaugggagggauuga

SEQ ID NO: 1389884 - RNA, 17 nt, Homo sapiens
ugaugucguuugaauca

SEQ ID NO: 1389885 - RNA, 15 nt, Homo sapiens
ugauuauuaaagucc

SEQ ID NO: 1389886 - RNA, 13 nt, Homo sapiens
ugauucuaugucu

SEQ ID NO: 1389887 - RNA, 17 nt, Homo sapiens
ugauugucagcuacuaa

SEQ ID NO: 1389888 - RNA, 16 nt, Homo sapiens
ugauugugccuacgaa

SEQ ID NO: 1389889 - RNA, 16 nt, Homo sapiens
ugcaaaaaacucagag

SEQ ID NO: 1389890 - RNA, 20 nt, Homo sapiens
ugcaaacauaacaaaaucac

SEQ ID NO: 1389891 - RNA, 19 nt, Homo sapiens
ugcaaaggcgucugaaugu

SEQ ID NO: 1389892 - RNA, 20 nt, Homo sapiens
ugcaaaguucccuacuuccu

SEQ ID NO: 1389893 - RNA, 13 nt, Homo sapiens
ugcaaauucucaa

SEQ ID NO: 1389894 - RNA, 16 nt, Homo sapiens
ugcaacaguagcauag

SEQ ID NO: 1389895 - RNA, 16 nt, Homo sapiens
ugcaacccuuaccccu

SEQ ID NO: 1389896 - RNA, 21 nt, Homo sapiens
ugcaacuucuuacuucccuaa

SEQ ID NO: 1389897 - RNA, 14 nt, Homo sapiens
ugcaagaaggauac

SEQ ID NO: 1389898 - RNA, 15 nt, Homo sapiens
ugcaagcacaucugc

SEQ ID NO: 1389899 - RNA, 19 nt, Homo sapiens
ugcaagcacaucugcauuu

SEQ ID NO: 1389900 - RNA, 18 nt, Homo sapiens
ugcaaggggaaaaucuca

SEQ ID NO: 1389901 - RNA, 20 nt, Homo sapiens
ugcaagugucugugugcaag

SEQ ID NO: 1389902 - RNA, 23 nt, Homo sapiens
ugcaagugugugcacaugugugc

SEQ ID NO: 1389903 - RNA, 14 nt, Homo sapiens
ugcaauaaauaaca

SEQ ID NO: 1389904 - RNA, 12 nt, Homo sapiens
ugcaaugucaca

SEQ ID NO: 1389905 - RNA, 14 nt, Homo sapiens
ugcaauugaccucu

SEQ ID NO: 1389906 - RNA, 15 nt, Homo sapiens
ugcacaaaccaauua

SEQ ID NO: 1389907 - RNA, 13 nt, Homo sapiens
ugcacacaccaga

SEQ ID NO: 1389908 - RNA, 16 nt, Homo sapiens
ugcacacucacuggca

SEQ ID NO: 1389909 - RNA, 21 nt, Homo sapiens
ugcacacuccccugcacugga

SEQ ID NO: 1389910 - RNA, 19 nt, Homo sapiens
ugcacauacuugagacugu

SEQ ID NO: 1389911 - RNA, 15 nt, Homo sapiens
ugcacaucacaacau

SEQ ID NO: 1389912 - RNA, 17 nt, Homo sapiens
ugcaccaaaucaucucu

SEQ ID NO: 1389913 - RNA, 14 nt, Homo sapiens
ugcaccacugcacu

SEQ ID NO: 1389914 - RNA, 17 nt, Homo sapiens
ugcaccaggagacagac

SEQ ID NO: 1389915 - RNA, 22 nt, Homo sapiens
ugcaccuuaucuuaaagcacuu

SEQ ID NO: 1389916 - RNA, 14 nt, Homo sapiens
ugcacgcacacugu

SEQ ID NO: 1389917 - RNA, 19 nt, Homo sapiens
ugcacgggagaauauacaa

SEQ ID NO: 1389918 - RNA, 12 nt, Homo sapiens
ugcacgugugca

SEQ ID NO: 1389919 - RNA, 14 nt, Homo sapiens
ugcacgugugugca

SEQ ID NO: 1389920 - RNA, 19 nt, Homo sapiens
ugcacuacagcccuggccu

SEQ ID NO: 1389921 - RNA, 20 nt, Homo sapiens
ugcacuccagccugggcaac

SEQ ID NO: 1389922 - RNA, 21 nt, Homo sapiens
ugcacuugcacgcccaugugu

SEQ ID NO: 1389923 - RNA, 15 nt, Homo sapiens
ugcacuuggccucug

SEQ ID NO: 1389924 - RNA, 22 nt, Homo sapiens
ugcacuuucaggaacacucuga

SEQ ID NO: 1389925 - RNA, 17 nt, Homo sapiens
ugcagaaacaguucacc

SEQ ID NO: 1389926 - RNA, 23 nt, Homo sapiens
ugcagacaggccaugugagccac

SEQ ID NO: 1389927 - RNA, 16 nt, Homo sapiens
ugcagaccgccccuca

SEQ ID NO: 1389928 - RNA, 20 nt, Homo sapiens
ugcagacucuacagaggcca

SEQ ID NO: 1389929 - RNA, 16 nt, Homo sapiens
ugcagaguaggcagcu

SEQ ID NO: 1389930 - RNA, 12 nt, Homo sapiens
ugcagagucaau

SEQ ID NO: 1389931 - RNA, 14 nt, Homo sapiens
ugcagauaucacag

SEQ ID NO: 1389932 - RNA, 15 nt, Homo sapiens
ugcagaugaggacua

SEQ ID NO: 1389933 - RNA, 13 nt, Homo sapiens
ugcagcagagccu

SEQ ID NO: 1389934 - RNA, 17 nt, Homo sapiens
ugcagccuuugccuccc

SEQ ID NO: 1389935 - RNA, 17 nt, Homo sapiens
ugcagcuguaaacauau

SEQ ID NO: 1389936 - RNA, 23 nt, Homo sapiens
ugcaggaaagaauagaagugauu

SEQ ID NO: 1389937 - RNA, 17 nt, Homo sapiens
ugcaggauuucuucaca

SEQ ID NO: 1389938 - RNA, 22 nt, Homo sapiens
ugcaguagagucaucuccauca

SEQ ID NO: 1389939 - RNA, 17 nt, Homo sapiens
ugcagugagcugagauc

SEQ ID NO: 1389940 - RNA, 18 nt, Homo sapiens
ugcagugguaugaucacg

SEQ ID NO: 1389941 - RNA, 23 nt, Homo sapiens
ugcagugguaugaucacggcuca

SEQ ID NO: 1389942 - RNA, 18 nt, Homo sapiens
ugcaguucagcaccaccc

SEQ ID NO: 1389943 - RNA, 16 nt, Homo sapiens
ugcauaagugcaugac

SEQ ID NO: 1389944 - RNA, 22 nt, Homo sapiens
ugcauaaucauaugguugacag

SEQ ID NO: 1389945 - RNA, 19 nt, Homo sapiens
ugcauagagccacguaugu

SEQ ID NO: 1389946 - RNA, 14 nt, Homo sapiens
ugcauaguauucca

SEQ ID NO: 1389947 - RNA, 20 nt, Homo sapiens
ugcauauccaacaugugcuc

SEQ ID NO: 1389948 - RNA, 19 nt, Homo sapiens
uuacaaucagccacauucu

SEQ ID NO: 1389949 - RNA, 20 nt, Homo sapiens
uuacaaucagccacauucua

SEQ ID NO: 1389950 - RNA, 23 nt, Homo sapiens
uuacaauccuugaccucagugaa

SEQ ID NO: 1389951 - RNA, 19 nt, Homo sapiens
uuacaauuguaaaacugag

SEQ ID NO: 1389952 - RNA, 17 nt, Homo sapiens
uuacacaaauuugccug

SEQ ID NO: 1389953 - RNA, 19 nt, Homo sapiens
uuacacaguugcugucaua

SEQ ID NO: 1389954 - RNA, 23 nt, Homo sapiens
uuacagagaggagaaacacaucu

SEQ ID NO: 1389955 - RNA, 14 nt, Homo sapiens
uuacaugcauuuga

SEQ ID NO: 1389956 - RNA, 12 nt, Homo sapiens
uuacauugccuu

SEQ ID NO: 1389957 - RNA, 17 nt, Homo sapiens
uuacauuugaaaucuau

SEQ ID NO: 1389958 - RNA, 19 nt, Homo sapiens
uuacauuugaaaucuauga

SEQ ID NO: 1389959 - RNA, 22 nt, Homo sapiens
uuaccagacgguucaccagccu

SEQ ID NO: 1389960 - RNA, 12 nt, Homo sapiens
uuaccucugaua

SEQ ID NO: 1389961 - RNA, 16 nt, Homo sapiens
uuaccuugugcuaauc

SEQ ID NO: 1389962 - RNA, 19 nt, Homo sapiens
uuacuagcagucacuugau

SEQ ID NO: 1389963 - RNA, 12 nt, Homo sapiens
uuacucuuguaa

SEQ ID NO: 1389964 - RNA, 14 nt, Homo sapiens
uuacugaccagcaa

SEQ ID NO: 1389965 - RNA, 21 nt, Homo sapiens
uuacugcuucuuuucacuuca

SEQ ID NO: 1389966 - RNA, 14 nt, Homo sapiens
uuacuguggauaaa

SEQ ID NO: 1389967 - RNA, 18 nt, Homo sapiens
uuacuuagcaugcacaaa

SEQ ID NO: 1389968 - RNA, 16 nt, Homo sapiens
uuacuugcauugaaua

SEQ ID NO: 1389969 - RNA, 19 nt, Homo sapiens
uuagaaaaaccaccaccau

SEQ ID NO: 1389970 - RNA, 13 nt, Homo sapiens
uuagaaaugcaaa

SEQ ID NO: 1389971 - RNA, 20 nt, Homo sapiens
uuagaaaugucaguugcugc

SEQ ID NO: 1389972 - RNA, 12 nt, Homo sapiens
uuagaacuauua

SEQ ID NO: 1389973 - RNA, 23 nt, Homo sapiens
uuagacagucaaggaguggcuua

SEQ ID NO: 1389974 - RNA, 12 nt, Homo sapiens
uuagacuugaaa

SEQ ID NO: 1389975 - RNA, 14 nt, Homo sapiens
uuagagacaucaaa

SEQ ID NO: 1389976 - RNA, 21 nt, Homo sapiens
uuagcauaaaauuuucuacuc

SEQ ID NO: 1389977 - RNA, 22 nt, Homo sapiens
uuagcauaaaauuuucuacucu

SEQ ID NO: 1389978 - RNA, 14 nt, Homo sapiens
uuagcauaauguga

SEQ ID NO: 1389979 - RNA, 15 nt, Homo sapiens
uuagccagugaugcu

SEQ ID NO: 1389980 - RNA, 14 nt, Homo sapiens
uuagcuuuacaaau

SEQ ID NO: 1389981 - RNA, 21 nt, Homo sapiens
uuaggaccaauaccuccucca

SEQ ID NO: 1389982 - RNA, 13 nt, Homo sapiens
uuagguagcuuua

SEQ ID NO: 1389983 - RNA, 21 nt, Homo sapiens
uuaggugcuucuucacuucag

SEQ ID NO: 1389984 - RNA, 16 nt, Homo sapiens
uuaguaauuucuugcu

SEQ ID NO: 1389985 - RNA, 18 nt, Homo sapiens
uuaguauuugcauauucu

SEQ ID NO: 1389986 - RNA, 15 nt, Homo sapiens
uuagucgagccaagu

SEQ ID NO: 1389987 - RNA, 17 nt, Homo sapiens
uuaguuuccguuuccag

SEQ ID NO: 1389988 - RNA, 24 nt, Homo sapiens
uuauaaaagaugcauuaucuauga

SEQ ID NO: 1389989 - RNA, 17 nt, Homo sapiens
uuauaaaaucaaacaga

SEQ ID NO: 1389990 - RNA, 21 nt, Homo sapiens
uuauaaacuuuagaguagcau

SEQ ID NO: 1389991 - RNA, 16 nt, Homo sapiens
uuauaaauuauuauga

SEQ ID NO: 1389992 - RNA, 23 nt, Homo sapiens
uuauaagagugccguaacaacug

SEQ ID NO: 1389993 - RNA, 19 nt, Homo sapiens
uuauaauaaaauugguguu

SEQ ID NO: 1389994 - RNA, 12 nt, Homo sapiens
uuauaaucuacu

SEQ ID NO: 1389995 - RNA, 19 nt, Homo sapiens
uuauacaauauacuuguau

SEQ ID NO: 1389996 - RNA, 13 nt, Homo sapiens
uuauacagugaua

SEQ ID NO: 1389997 - RNA, 13 nt, Homo sapiens
uuauacauuugau

SEQ ID NO: 1389998 - RNA, 11 nt, Homo sapiens
uuauacuccuc

SEQ ID NO: 1389999 - RNA, 19 nt, Homo sapiens
uuauacuguggcuaugcaa

SEQ ID NO: 1390000 - RNA, 22 nt, Homo sapiens
uuauauaauaaaguauuccacc

SEQ ID NO: 1390001 - RNA, 23 nt, Homo sapiens
uuauaugaacauagacuagagaa

SEQ ID NO: 1390002 - RNA, 19 nt, Homo sapiens
uuaucacacuucugugaga

SEQ ID NO: 1390003 - RNA, 22 nt, Homo sapiens
uuaucauuaaaaggaaagcaga

SEQ ID NO: 1390004 - RNA, 15 nt, Homo sapiens
uuaucuuacaaagug

SEQ ID NO: 1390005 - RNA, 15 nt, Homo sapiens
uuaucuuggacugac

SEQ ID NO: 1390006 - RNA, 15 nt, Homo sapiens
uuaucuugucucugg

SEQ ID NO: 1390007 - RNA, 12 nt, Homo sapiens
uuaugacaugau

SEQ ID NO: 1390008 - RNA, 23 nt, Homo sapiens
uuaugagaggcaaugauuguuaa

SEQ ID NO: 1390009 - RNA, 15 nt, Homo sapiens
uuaugcaucugcuac

SEQ ID NO: 1390010 - RNA, 23 nt, Homo sapiens
uuauggaguucuucuucuccuag

SEQ ID NO: 1390011 - RNA, 23 nt, Homo sapiens
uuauggugccgaauugucuuugg

SEQ ID NO: 1390012 - RNA, 18 nt, Homo sapiens
uuauguaauugaaaacca

SEQ ID NO: 1390013 - RNA, 23 nt, Homo sapiens
uuauguauuugaaaacucacaga

SEQ ID NO: 1390014 - RNA, 19 nt, Homo sapiens
uuaugugugaggagcugcu

SEQ ID NO: 1390015 - RNA, 16 nt, Homo sapiens
uuauuacaucuuucac

SEQ ID NO: 1390016 - RNA, 21 nt, Homo sapiens
uuauuaccucugauaccucaa

SEQ ID NO: 1390017 - RNA, 19 nt, Homo sapiens
uuauucaagguaaaauucu

SEQ ID NO: 1390018 - RNA, 23 nt, Homo sapiens
uuauucuguaguuucacucucau

SEQ ID NO: 1390019 - RNA, 23 nt, Homo sapiens
uuauugccuggagugugaacugu

SEQ ID NO: 1390020 - RNA, 21 nt, Homo sapiens
uuauuuccacuuauaaaggaa

SEQ ID NO: 1390021 - RNA, 21 nt, Homo sapiens
uuauuuuuucgugcacucugc

SEQ ID NO: 1390022 - RNA, 21 nt, Homo sapiens
uucaaaagcacuuugugcugu

SEQ ID NO: 1390023 - RNA, 19 nt, Homo sapiens
uucaaacugcaugauucau

SEQ ID NO: 1390024 - RNA, 17 nt, Homo sapiens
uucaaagagacauauac

SEQ ID NO: 1390025 - RNA, 13 nt, Homo sapiens
uucaaagucucac

SEQ ID NO: 1390026 - RNA, 11 nt, Homo sapiens
uucaaccacug

SEQ ID NO: 1390027 - RNA, 22 nt, Homo sapiens
uucaacugccauguuuugccac

SEQ ID NO: 1390028 - RNA, 11 nt, Homo sapiens
uucaacuggag

SEQ ID NO: 1390029 - RNA, 16 nt, Homo sapiens
uucaagauuaaacuga

SEQ ID NO: 1390030 - RNA, 22 nt, Homo sapiens
uucaaggucauuuacuuguacg

SEQ ID NO: 1390031 - RNA, 16 nt, Homo sapiens
uucaaguaauugugaa

SEQ ID NO: 1390032 - RNA, 12 nt, Homo sapiens
uucaaguguaca

SEQ ID NO: 1390033 - RNA, 22 nt, Homo sapiens
uucaaucugaagauacaugucu

SEQ ID NO: 1390034 - RNA, 13 nt, Homo sapiens
uucacaccuaccc

SEQ ID NO: 1390035 - RNA, 13 nt, Homo sapiens
uucaccaauaagu

SEQ ID NO: 1390036 - RNA, 17 nt, Homo sapiens
uucaccacaugugcaca

SEQ ID NO: 1390037 - RNA, 20 nt, Homo sapiens
uucacccugauuuuacacac

SEQ ID NO: 1390038 - RNA, 15 nt, Homo sapiens
uucacccuguccaaa

SEQ ID NO: 1390039 - RNA, 22 nt, Homo sapiens
uucacgccuguaaucccagcac

SEQ ID NO: 1390040 - RNA, 17 nt, Homo sapiens
uucacgugcagcagcaa

SEQ ID NO: 1390041 - RNA, 18 nt, Homo sapiens
uucacuauaaaugguguu

SEQ ID NO: 1390042 - RNA, 17 nt, Homo sapiens
uucagaagguugcucua

SEQ ID NO: 1390043 - RNA, 14 nt, Homo sapiens
uucagacacuuugg

SEQ ID NO: 1390044 - RNA, 12 nt, Homo sapiens
uucagacuguuu

SEQ ID NO: 1390045 - RNA, 15 nt, Homo sapiens
uucagagagcuggua

SEQ ID NO: 1390046 - RNA, 16 nt, Homo sapiens
uucagcagacuaugaa

SEQ ID NO: 1390047 - RNA, 14 nt, Homo sapiens
uucagccaccucuc

SEQ ID NO: 1390048 - RNA, 15 nt, Homo sapiens
uucagcccucagaau

SEQ ID NO: 1390049 - RNA, 20 nt, Homo sapiens
uucagccuagccgaccucag

SEQ ID NO: 1390050 - RNA, 19 nt, Homo sapiens
uucagcuccuuccaccaca

SEQ ID NO: 1390051 - RNA, 14 nt, Homo sapiens
uucagcucugcaag

SEQ ID NO: 1390052 - RNA, 16 nt, Homo sapiens
uucaggaacacucuga

SEQ ID NO: 1390053 - RNA, 14 nt, Homo sapiens
uucaggaggcugga

SEQ ID NO: 1390054 - RNA, 17 nt, Homo sapiens
uucagggauagcacuga

SEQ ID NO: 1390055 - RNA, 18 nt, Homo sapiens
uucagggcagggcucuga

SEQ ID NO: 1390056 - RNA, 13 nt, Homo sapiens
uucagggggccag

SEQ ID NO: 1390057 - RNA, 23 nt, Homo sapiens
uucagggggccaggugcacagac

SEQ ID NO: 1390058 - RNA, 17 nt, Homo sapiens
uucaguaauguugacug

SEQ ID NO: 1390059 - RNA, 20 nt, Homo sapiens
uucauauauuuguaugaucc

SEQ ID NO: 1390060 - RNA, 20 nt, Homo sapiens
uucauauguaccauguacau

SEQ ID NO: 1390061 - RNA, 17 nt, Homo sapiens
caugcugauuguuauug

SEQ ID NO: 1390062 - RNA, 20 nt, Homo sapiens
caugcugcuuuaauugugaa

SEQ ID NO: 1390063 - RNA, 22 nt, Homo sapiens
caugcuggcucccagggccaug

SEQ ID NO: 1390064 - RNA, 13 nt, Homo sapiens
caugcuggggcaa

SEQ ID NO: 1390065 - RNA, 14 nt, Homo sapiens
caugcuggggcaag

SEQ ID NO: 1390066 - RNA, 12 nt, Homo sapiens
caugcuggugaa

SEQ ID NO: 1390067 - RNA, 15 nt, Homo sapiens
caugcugugugcugg

SEQ ID NO: 1390068 - RNA, 22 nt, Homo sapiens
cauggcuuaguuuucauacaca

SEQ ID NO: 1390069 - RNA, 16 nt, Homo sapiens
caugggaaacuuccaa

SEQ ID NO: 1390070 - RNA, 23 nt, Homo sapiens
cauggguuauguguaugugccau

SEQ ID NO: 1390071 - RNA, 16 nt, Homo sapiens
caugguacuaguguuu

SEQ ID NO: 1390072 - RNA, 15 nt, Homo sapiens
cauguagcaaucaga

SEQ ID NO: 1390073 - RNA, 17 nt, Homo sapiens
caugucagcaaguccua

SEQ ID NO: 1390074 - RNA, 21 nt, Homo sapiens
cauguccugcugcuucugcaa

SEQ ID NO: 1390075 - RNA, 12 nt, Homo sapiens
caugugaaggga

SEQ ID NO: 1390076 - RNA, 19 nt, Homo sapiens
cauguggugggacagggac

SEQ ID NO: 1390077 - RNA, 20 nt, Homo sapiens
caugugugagugugugcaag

SEQ ID NO: 1390078 - RNA, 21 nt, Homo sapiens
caugugugagugugugcaagu

SEQ ID NO: 1390079 - RNA, 23 nt, Homo sapiens
caugugugcgagugugugcaugu

SEQ ID NO: 1390080 - RNA, 23 nt, Homo sapiens
caugugugcgugugcgugcaugu

SEQ ID NO: 1390081 - RNA, 15 nt, Homo sapiens
caugugugugcaagu

SEQ ID NO: 1390082 - RNA, 16 nt, Homo sapiens
cauguuacucaugacu

SEQ ID NO: 1390083 - RNA, 18 nt, Homo sapiens
cauguuacugaccagcaa

SEQ ID NO: 1390084 - RNA, 18 nt, Homo sapiens
auccugucuuuaaggaaa

SEQ ID NO: 1390085 - RNA, 15 nt, Homo sapiens
auccuuuacuguuag

SEQ ID NO: 1390086 - RNA, 14 nt, Homo sapiens
aucgccaugcccau

SEQ ID NO: 1390087 - RNA, 23 nt, Homo sapiens
aucgcugcgauacuggcauuucc

SEQ ID NO: 1390088 - RNA, 17 nt, Homo sapiens
aucggagacagugaucu

SEQ ID NO: 1390089 - RNA, 13 nt, Homo sapiens
aucuaaaccauau

SEQ ID NO: 1390090 - RNA, 18 nt, Homo sapiens
aucuaaaguaaaaaggga

SEQ ID NO: 1390091 - RNA, 15 nt, Homo sapiens
aucuaacugugcuca

SEQ ID NO: 1390092 - RNA, 19 nt, Homo sapiens
aucuaagggaaaaagccuu

SEQ ID NO: 1390093 - RNA, 23 nt, Homo sapiens
aucuacccuccgauuguuccuga

SEQ ID NO: 1390094 - RNA, 13 nt, Homo sapiens
aucuacccugcug

SEQ ID NO: 1390095 - RNA, 18 nt, Homo sapiens
aucuacccugcugaccuc

SEQ ID NO: 1390096 - RNA, 17 nt, Homo sapiens
aucuacuucuacaucca

SEQ ID NO: 1390097 - RNA, 15 nt, Homo sapiens
aucuagaagacuguc

SEQ ID NO: 1390098 - RNA, 22 nt, Homo sapiens
aucuaugaaauaucaugcucca

SEQ ID NO: 1390099 - RNA, 16 nt, Homo sapiens
aucuauuucugagaag

SEQ ID NO: 1390100 - RNA, 17 nt, Homo sapiens
aucucaaccauccccuc

SEQ ID NO: 1390101 - RNA, 21 nt, Homo sapiens
aucucagagguagggcugcca

SEQ ID NO: 1390102 - RNA, 12 nt, Homo sapiens
aucucagugcag

SEQ ID NO: 1390103 - RNA, 16 nt, Homo sapiens
aucuccccuucacaug

SEQ ID NO: 1390104 - RNA, 22 nt, Homo sapiens
aucucccugccgccucaaugug

SEQ ID NO: 1390105 - RNA, 20 nt, Homo sapiens
aucucggcucacugcaagcu

SEQ ID NO: 1390106 - RNA, 19 nt, Homo sapiens
aucucucacacauuccagg

SEQ ID NO: 1390107 - RNA, 22 nt, Homo sapiens
aucucucccuccccugccauuu

SEQ ID NO: 1390108 - RNA, 22 nt, Homo sapiens
aucucugauucugucaaugucu

SEQ ID NO: 1390109 - RNA, 15 nt, Homo sapiens
aucucuuugauguca

SEQ ID NO: 1390110 - RNA, 14 nt, Homo sapiens
aucugaaaauguau

SEQ ID NO: 1390111 - RNA, 22 nt, Homo sapiens
aucugagaccccaaacucucca

SEQ ID NO: 1390112 - RNA, 23 nt, Homo sapiens
aucugagaccccaaacucuccaa

SEQ ID NO: 1390113 - RNA, 19 nt, Homo sapiens
aucugcauuuagcacaaaa

SEQ ID NO: 1390114 - RNA, 16 nt, Homo sapiens
cccugucucuuaaaaa

SEQ ID NO: 1390115 - RNA, 14 nt, Homo sapiens
cccuguuaccuaau

SEQ ID NO: 1390116 - RNA, 22 nt, Homo sapiens
cccuucaaccauuccccauggg

SEQ ID NO: 1390117 - RNA, 14 nt, Homo sapiens
cccuucacacaacu

SEQ ID NO: 1390118 - RNA, 19 nt, Homo sapiens
cccuucuaaccugaacuga

SEQ ID NO: 1390119 - RNA, 19 nt, Homo sapiens
cccuucucugcccauuccc

SEQ ID NO: 1390120 - RNA, 16 nt, Homo sapiens
cccuuggagccaaugg

SEQ ID NO: 1390121 - RNA, 21 nt, Homo sapiens
cccuuggaggcugucuucuca

SEQ ID NO: 1390122 - RNA, 21 nt, Homo sapiens
cccuugugcgugggugaagcc

SEQ ID NO: 1390123 - RNA, 20 nt, Homo sapiens
cccuuucugugugaagauca

SEQ ID NO: 1390124 - RNA, 19 nt, Homo sapiens
cccuuugaugauuaauuca

SEQ ID NO: 1390125 - RNA, 18 nt, Homo sapiens
cccuuuuacauacugcug

SEQ ID NO: 1390126 - RNA, 15 nt, Homo sapiens
ccgaaaaucauauaa

SEQ ID NO: 1390127 - RNA, 19 nt, Homo sapiens
ccgaaaaucauauaaucuu

SEQ ID NO: 1390128 - RNA, 18 nt, Homo sapiens
ccgacaaccgaugcucca

SEQ ID NO: 1390129 - RNA, 22 nt, Homo sapiens
ccgacggugggcauuugugagg

SEQ ID NO: 1390130 - RNA, 12 nt, Homo sapiens
ccgagaagaaca

SEQ ID NO: 1390131 - RNA, 16 nt, Homo sapiens
ccaauauuuaccagac

SEQ ID NO: 1390132 - RNA, 21 nt, Homo sapiens
ccaauauuuaccagaccacaa

SEQ ID NO: 1390133 - RNA, 13 nt, Homo sapiens
ccaaucacaagca

SEQ ID NO: 1390134 - RNA, 23 nt, Homo sapiens
ccaaucucuucuaaaaaaaaaca

SEQ ID NO: 1390135 - RNA, 22 nt, Homo sapiens
ccaauuaaguccuacuuuacau

SEQ ID NO: 1390136 - RNA, 14 nt, Homo sapiens
ccacaaaaguacaa

SEQ ID NO: 1390137 - RNA, 15 nt, Homo sapiens
ccacaaaaguacaau

SEQ ID NO: 1390138 - RNA, 13 nt, Homo sapiens
ccacaccaucucc

SEQ ID NO: 1390139 - RNA, 16 nt, Homo sapiens
ccacacggaggcaucu

SEQ ID NO: 1390140 - RNA, 23 nt, Homo sapiens
ccacagaacacagcaauuccuca

SEQ ID NO: 1390141 - RNA, 19 nt, Homo sapiens
ccacagccgcagcuguaag

SEQ ID NO: 1390142 - RNA, 20 nt, Homo sapiens
ccacagugacuccacucuga

SEQ ID NO: 1390143 - RNA, 17 nt, Homo sapiens
ccacaucuugcucugcu

SEQ ID NO: 1390144 - RNA, 18 nt, Homo sapiens
ccaccaccaucaccagac

SEQ ID NO: 1390145 - RNA, 18 nt, Homo sapiens
ccaccagccugcacuacu

SEQ ID NO: 1390146 - RNA, 16 nt, Homo sapiens
ccaccaggcugcucag

SEQ ID NO: 1390147 - RNA, 11 nt, Homo sapiens
ccaccagugaa

SEQ ID NO: 1390148 - RNA, 19 nt, Homo sapiens
ccaccaguugaauuucauc

SEQ ID NO: 1390149 - RNA, 17 nt, Homo sapiens
ccacccccuucagugcc

SEQ ID NO: 1390150 - RNA, 18 nt, Homo sapiens
ccacccucccacugccaa

SEQ ID NO: 1390151 - RNA, 22 nt, Homo sapiens
ccacccuuggaggcugucuucu

SEQ ID NO: 1390152 - RNA, 15 nt, Homo sapiens
ccaccuagagcuaga

SEQ ID NO: 1390153 - RNA, 12 nt, Homo sapiens
aauauuccugaa

SEQ ID NO: 1390154 - RNA, 14 nt, Homo sapiens
aauauuuaccagac

SEQ ID NO: 1390155 - RNA, 17 nt, Homo sapiens
aauauuuauuaccucug

SEQ ID NO: 1390156 - RNA, 20 nt, Homo sapiens
aauauuuauuaccucugaua

SEQ ID NO: 1390157 - RNA, 22 nt, Homo sapiens
aauauuuuggcauuguacuaau

SEQ ID NO: 1390158 - RNA, 22 nt, Homo sapiens
aaucaaguuggcuucuaaucaa

SEQ ID NO: 1390159 - RNA, 15 nt, Homo sapiens
aaucaaugcuauaac

SEQ ID NO: 1390160 - RNA, 23 nt, Homo sapiens
aaucacacgucuggcuucacaga

SEQ ID NO: 1390161 - RNA, 22 nt, Homo sapiens
aaucacuugcacuccggaggua

SEQ ID NO: 1390162 - RNA, 15 nt, Homo sapiens
aaucagagagcucac

SEQ ID NO: 1390163 - RNA, 17 nt, Homo sapiens
aaucagcauucucacuc

SEQ ID NO: 1390164 - RNA, 15 nt, Homo sapiens
aaucagccacauucu

SEQ ID NO: 1390165 - RNA, 16 nt, Homo sapiens
aaucagccacauucua

SEQ ID NO: 1390166 - RNA, 19 nt, Homo sapiens
aaucauaaauauaaucuaa

SEQ ID NO: 1390167 - RNA, 23 nt, Homo sapiens
aaucauaaauauaaucuaauaca

SEQ ID NO: 1390168 - RNA, 23 nt, Homo sapiens
aaucauaugguugacaguaugca

SEQ ID NO: 1390169 - RNA, 15 nt, Homo sapiens
aaucaucucucauca

SEQ ID NO: 1390170 - RNA, 16 nt, Homo sapiens
aaucaugaaacucccu

SEQ ID NO: 1390171 - RNA, 17 nt, Homo sapiens
aaucauucuacugaaca

SEQ ID NO: 1390172 - RNA, 17 nt, Homo sapiens
aaucauuuuaauuauua

SEQ ID NO: 1390173 - RNA, 19 nt, Homo sapiens
aauccacauugccagugac

SEQ ID NO: 1390174 - RNA, 20 nt, Homo sapiens
aaucccuagucuucaagcag

SEQ ID NO: 1390175 - RNA, 15 nt, Homo sapiens
aauccuccugaguga

SEQ ID NO: 1390176 - RNA, 22 nt, Homo sapiens
aauccugagcaaacaaaaccac

SEQ ID NO: 1390177 - RNA, 12 nt, Homo sapiens
aauccuguacaa

SEQ ID NO: 1390178 - RNA, 20 nt, Homo sapiens
aauccuguccucagcuucuu

SEQ ID NO: 1390179 - RNA, 17 nt, Homo sapiens
aauccuuaaagaacugu

SEQ ID NO: 1390180 - RNA, 15 nt, Homo sapiens
aauccuuccaugaaa

SEQ ID NO: 1390181 - RNA, 18 nt, Homo sapiens
aauccuuuacuguuaguc

SEQ ID NO: 1390182 - RNA, 20 nt, Homo sapiens
aaucuauugggauuuucuac

SEQ ID NO: 1390183 - RNA, 18 nt, Homo sapiens
aaucucuaaaaauccaua

SEQ ID NO: 1390184 - RNA, 21 nt, Homo sapiens
aaucugaccaaaacaaacaaa

SEQ ID NO: 1390185 - RNA, 23 nt, Homo sapiens
aaucugaggccuccucucucagu

SEQ ID NO: 1390186 - RNA, 22 nt, Homo sapiens
aaucugaguagagcagccacaa

SEQ ID NO: 1390187 - RNA, 18 nt, Homo sapiens
aaucugcauuuagcacaa

SEQ ID NO: 1390188 - RNA, 15 nt, Homo sapiens
aaucuguucaaggaa

SEQ ID NO: 1390189 - RNA, 23 nt, Homo sapiens
aaucuguuuauuuacaagggaag

SEQ ID NO: 1390190 - RNA, 19 nt, Homo sapiens
aaucuucucuuugacaauu

SEQ ID NO: 1390191 - RNA, 22 nt, Homo sapiens
aaucuuuccuuccucucauccu

SEQ ID NO: 1390192 - RNA, 16 nt, Homo sapiens
aaugaaauuuuaccaa

SEQ ID NO: 1390193 - RNA, 15 nt, Homo sapiens
aaugaagaugaugcu

SEQ ID NO: 1390194 - RNA, 16 nt, Homo sapiens
aaugaagaugaugcua

SEQ ID NO: 1390195 - RNA, 20 nt, Homo sapiens
aaugaagaugaugcuauuaa

SEQ ID NO: 1390196 - RNA, 15 nt, Homo sapiens
aaugaagaugucuaa

SEQ ID NO: 1390197 - RNA, 22 nt, Homo sapiens
aaugaagcuaauaauucuucac

SEQ ID NO: 1390198 - RNA, 22 nt, Homo sapiens
aaugaauuuuguuuggacuucu

SEQ ID NO: 1390199 - RNA, 22 nt, Homo sapiens
aaugacacuagcuaauaucaau

SEQ ID NO: 1390200 - RNA, 14 nt, Homo sapiens
aaugacauguguca

SEQ ID NO: 1390201 - RNA, 14 nt, Homo sapiens
aaugaccucaagau

SEQ ID NO: 1390202 - RNA, 13 nt, Homo sapiens
aaugacuaaagac

SEQ ID NO: 1390203 - RNA, 12 nt, Homo sapiens
acaaacaugugg

SEQ ID NO: 1390204 - RNA, 23 nt, Homo sapiens
acaaauagucggauuagaaauaa

SEQ ID NO: 1390205 - RNA, 22 nt, Homo sapiens
acaaauauggaugagguggaga

SEQ ID NO: 1390206 - RNA, 14 nt, Homo sapiens
acaaaucagacaua

SEQ ID NO: 1390207 - RNA, 13 nt, Homo sapiens
acaaaugacauca

SEQ ID NO: 1390208 - RNA, 15 nt, Homo sapiens
acaaaugacaucaaa

SEQ ID NO: 1390209 - RNA, 15 nt, Homo sapiens
acaaaugguagcaua

SEQ ID NO: 1390210 - RNA, 18 nt, Homo sapiens
acaaaugguagcauacuu

SEQ ID NO: 1390211 - RNA, 17 nt, Homo sapiens
acaaauuaaaagcuaua

SEQ ID NO: 1390212 - RNA, 22 nt, Homo sapiens
acaaauugauagucaauaucaa

SEQ ID NO: 1390213 - RNA, 14 nt, Homo sapiens
acaacagaagucau

SEQ ID NO: 1390214 - RNA, 17 nt, Homo sapiens
acaacaucaagccugug

SEQ ID NO: 1390215 - RNA, 22 nt, Homo sapiens
acaacauuucucaaaugcacau

SEQ ID NO: 1390216 - RNA, 21 nt, Homo sapiens
acaaccugugaucaagcaaua

SEQ ID NO: 1390217 - RNA, 15 nt, Homo sapiens
acaacuaccuccuca

SEQ ID NO: 1390218 - RNA, 12 nt, Homo sapiens
acaacucagucc

SEQ ID NO: 1390219 - RNA, 17 nt, Homo sapiens
acaacucagucccuaaa

SEQ ID NO: 1390220 - RNA, 17 nt, Homo sapiens
acaacuguggucaaucc

SEQ ID NO: 1390221 - RNA, 13 nt, Homo sapiens
acaacuucuuugu

SEQ ID NO: 1390222 - RNA, 18 nt, Homo sapiens
acaacuuucucuuguaaa

SEQ ID NO: 1390223 - RNA, 12 nt, Homo sapiens
acaagaagccac

SEQ ID NO: 1390224 - RNA, 22 nt, Homo sapiens
acaagaauuucuugguaagaag

SEQ ID NO: 1390225 - RNA, 22 nt, Homo sapiens
acaagagugauucuugcugcua

SEQ ID NO: 1390226 - RNA, 23 nt, Homo sapiens
acaagauagccaccgagauccuu

SEQ ID NO: 1390227 - RNA, 11 nt, Homo sapiens
acaagauuccc

SEQ ID NO: 1390228 - RNA, 20 nt, Homo sapiens
acaagccaacgacaaagcca

SEQ ID NO: 1390229 - RNA, 14 nt, Homo sapiens
acaagccauagugg

SEQ ID NO: 1390230 - RNA, 15 nt, Homo sapiens
acaaggcugaccaag

SEQ ID NO: 1390231 - RNA, 16 nt, Homo sapiens
acaaguaaaacugugg

SEQ ID NO: 1390232 - RNA, 22 nt, Homo sapiens
acaaguauucugccuuugcaga

SEQ ID NO: 1390233 - RNA, 13 nt, Homo sapiens
acaagugacugua

SEQ ID NO: 1390234 - RNA, 14 nt, Homo sapiens
acaauaaauguauu

SEQ ID NO: 1390235 - RNA, 21 nt, Homo sapiens
acaauaggugcuuauucucaa

SEQ ID NO: 1390236 - RNA, 16 nt, Homo sapiens
acaauauacuuguaua

SEQ ID NO: 1390237 - RNA, 17 nt, Homo sapiens
acaauaugggcacuuua

SEQ ID NO: 1390238 - RNA, 15 nt, Homo sapiens
acaauauucaaucaa

SEQ ID NO: 1390239 - RNA, 19 nt, Homo sapiens
acaaucaugaaauaugcau

SEQ ID NO: 1390240 - RNA, 15 nt, Homo sapiens
acaauccaucucuca

SEQ ID NO: 1390241 - RNA, 22 nt, Homo sapiens
acaaugaagaugaugcuauuaa

SEQ ID NO: 1390242 - RNA, 19 nt, Homo sapiens
acaauggaagauuugccca

SEQ ID NO: 1390243 - RNA, 17 nt, Homo sapiens
acaauggcuuacuccag

SEQ ID NO: 1390244 - RNA, 22 nt, Homo sapiens
acaauguuauucguuuugucua

SEQ ID NO: 1390245 - RNA, 22 nt, Homo sapiens
acaauuagucaaaccacuguua

SEQ ID NO: 1390246 - RNA, 18 nt, Homo sapiens
acaauuauaucaguccuc

SEQ ID NO: 1390247 - RNA, 15 nt, Homo sapiens
acacaaauuuguaaa

SEQ ID NO: 1390248 - RNA, 17 nt, Homo sapiens
acacaauucuucuucca

SEQ ID NO: 1390249 - RNA, 19 nt, Homo sapiens
acacacacguuauaaucau

SEQ ID NO: 1390250 - RNA, 22 nt, Homo sapiens
acacacacucuacccuauacaa

SEQ ID NO: 1390251 - RNA, 15 nt, Homo sapiens
acacagcagcaguua

SEQ ID NO: 1390252 - RNA, 21 nt, Homo sapiens
acacagcugcagagacagaga

SEQ ID NO: 1390253 - RNA, 12 nt, Homo sapiens
acacagcuuuua

SEQ ID NO: 1390254 - RNA, 17 nt, Homo sapiens
acacaguauuacuucug

SEQ ID NO: 1390255 - RNA, 17 nt, Homo sapiens
acacaugacacucuucu

SEQ ID NO: 1390256 - RNA, 20 nt, Homo sapiens
acacaugcugaacaucacag

SEQ ID NO: 1390257 - RNA, 14 nt, Homo sapiens
acacauuaagccuu

SEQ ID NO: 1390258 - RNA, 17 nt, Homo sapiens
acacauuaagccuucca

SEQ ID NO: 1390259 - RNA, 17 nt, Homo sapiens
acaccaucucccaugaa

SEQ ID NO: 1390260 - RNA, 21 nt, Homo sapiens
acaccaucuuuccaucccagg

SEQ ID NO: 1390261 - RNA, 23 nt, Homo sapiens
acacccuauauuuugcauaguac

SEQ ID NO: 1390262 - RNA, 15 nt, Homo sapiens
acaccuacucuauca

SEQ ID NO: 1390263 - RNA, 23 nt, Homo sapiens
acaccucaguucccuuggccuca

SEQ ID NO: 1390264 - RNA, 15 nt, Homo sapiens
acaccugaccaauca

SEQ ID NO: 1390265 - RNA, 15 nt, Homo sapiens
acaccuguaauccca

SEQ ID NO: 1390266 - RNA, 17 nt, Homo sapiens
acaccuguaaucccagc

SEQ ID NO: 1390267 - RNA, 14 nt, Homo sapiens
aaggauugugauau

SEQ ID NO: 1390268 - RNA, 12 nt, Homo sapiens
aaggcaaaaaga

SEQ ID NO: 1390269 - RNA, 23 nt, Homo sapiens
aaggcaccuauaaaacaggucaa

SEQ ID NO: 1390270 - RNA, 15 nt, Homo sapiens
aaggcagaguacaaa

SEQ ID NO: 1390271 - RNA, 16 nt, Homo sapiens
aaggcauuuucaucuu

SEQ ID NO: 1390272 - RNA, 18 nt, Homo sapiens
aaggcccauaucugugaa

SEQ ID NO: 1390273 - RNA, 22 nt, Homo sapiens
aagggaacuugagcgugaaucu

SEQ ID NO: 1390274 - RNA, 17 nt, Homo sapiens
aagggacauauucauuu

SEQ ID NO: 1390275 - RNA, 13 nt, Homo sapiens
aagggguucucac

SEQ ID NO: 1390276 - RNA, 18 nt, Homo sapiens
aaggguucaccaggucag

SEQ ID NO: 1390277 - RNA, 22 nt, Homo sapiens
aaggguucaccaggucagggag

SEQ ID NO: 1390278 - RNA, 20 nt, Homo sapiens
aaggguucagagacucaggg

SEQ ID NO: 1390279 - RNA, 22 nt, Homo sapiens
aagguaauaauacagccaaaga

SEQ ID NO: 1390280 - RNA, 18 nt, Homo sapiens
aagguaugugucagccau

SEQ ID NO: 1390281 - RNA, 15 nt, Homo sapiens
aaggugaaaaaagcu

SEQ ID NO: 1390282 - RNA, 16 nt, Homo sapiens
aaggugaaagugcagu

SEQ ID NO: 1390283 - RNA, 22 nt, Homo sapiens
aaggugggccuugcuaccucaa

SEQ ID NO: 1390284 - RNA, 15 nt, Homo sapiens
aagguggucacuguu

SEQ ID NO: 1390285 - RNA, 17 nt, Homo sapiens
aagguucuuacugcuug

SEQ ID NO: 1390286 - RNA, 13 nt, Homo sapiens
aaguaaaaaggga

SEQ ID NO: 1390287 - RNA, 14 nt, Homo sapiens
aaguaaacugcccu

SEQ ID NO: 1390288 - RNA, 20 nt, Homo sapiens
aaguaaacugcccugucuag

SEQ ID NO: 1390289 - RNA, 12 nt, Homo sapiens
aaguaagcccuu

SEQ ID NO: 1390290 - RNA, 13 nt, Homo sapiens
aaguaagcccuug

SEQ ID NO: 1390291 - RNA, 18 nt, Homo sapiens
aaguacuucuccacccug

SEQ ID NO: 1390292 - RNA, 23 nt, Homo sapiens
aaguagacuucauuuuuccuaac

SEQ ID NO: 1390293 - RNA, 12 nt, Homo sapiens
aaguagcaauuu

SEQ ID NO: 1390294 - RNA, 18 nt, Homo sapiens
aaguagcucuggugaccu

SEQ ID NO: 1390295 - RNA, 22 nt, Homo sapiens
aaguagggguugugggugacca

SEQ ID NO: 1390296 - RNA, 17 nt, Homo sapiens
aaguaucacacuguaua

SEQ ID NO: 1390297 - RNA, 12 nt, Homo sapiens
aaguauuagcca

SEQ ID NO: 1390298 - RNA, 15 nt, Homo sapiens
aaguauuccuuuccu

SEQ ID NO: 1390299 - RNA, 19 nt, Homo sapiens
aaguauucugccuuugcag

SEQ ID NO: 1390300 - RNA, 13 nt, Homo sapiens
aaguauugaauua

SEQ ID NO: 1390301 - RNA, 12 nt, Homo sapiens
aagucacacagu

SEQ ID NO: 1390302 - RNA, 18 nt, Homo sapiens
aagucaccggagcuuuca

SEQ ID NO: 1390303 - RNA, 23 nt, Homo sapiens
aagucacugcacagugcaucuca

SEQ ID NO: 1390304 - RNA, 20 nt, Homo sapiens
aagucaggacaucagucuga

SEQ ID NO: 1390305 - RNA, 16 nt, Homo sapiens
aagucagguccaauuu

SEQ ID NO: 1390306 - RNA, 17 nt, Homo sapiens
aagucaugugcauuucc

SEQ ID NO: 1390307 - RNA, 20 nt, Homo sapiens
aagucucacuuuuauugaua

SEQ ID NO: 1390308 - RNA, 18 nt, Homo sapiens
aagucucugugaauugaa

SEQ ID NO: 1390309 - RNA, 20 nt, Homo sapiens
aagugagacccugucucaaa

SEQ ID NO: 1390310 - RNA, 15 nt, Homo sapiens
aagugagagagacaa

SEQ ID NO: 1390311 - RNA, 22 nt, Homo sapiens
aagugagagagacaagaagcaa

SEQ ID NO: 1390312 - RNA, 17 nt, Homo sapiens
aagugauaugcauuucc

SEQ ID NO: 1390313 - RNA, 13 nt, Homo sapiens
aagugauccuccu

SEQ ID NO: 1390314 - RNA, 23 nt, Homo sapiens
aagugcugggauuacagguguga

SEQ ID NO: 1390315 - RNA, 19 nt, Homo sapiens
aagugguacuaacuuuccu

SEQ ID NO: 1390316 - RNA, 15 nt, Homo sapiens
aaguguaaauccuuu

SEQ ID NO: 1390317 - RNA, 21 nt, Homo sapiens
aaguguccccuauggggaugg

SEQ ID NO: 1390318 - RNA, 12 nt, Homo sapiens
aagugugugauc

SEQ ID NO: 1390319 - RNA, 21 nt, Homo sapiens
ugacggcgcccccagugugca

SEQ ID NO: 1390320 - RNA, 23 nt, Homo sapiens
ugacgugcaccuguacucaggag

SEQ ID NO: 1390321 - RNA, 11 nt, Homo sapiens
ugacuaaagag

SEQ ID NO: 1390322 - RNA, 18 nt, Homo sapiens
ugacuaaagcagggacaa

SEQ ID NO: 1390323 - RNA, 14 nt, Homo sapiens
ugacuagugcugaa

SEQ ID NO: 1390324 - RNA, 17 nt, Homo sapiens
ugacuauggcuaccaaa

SEQ ID NO: 1390325 - RNA, 16 nt, Homo sapiens
ugacuccuuucucuaa

SEQ ID NO: 1390326 - RNA, 22 nt, Homo sapiens
ugacuccuuucucuaaaacugc

SEQ ID NO: 1390327 - RNA, 14 nt, Homo sapiens
ugacucuccagaaa

SEQ ID NO: 1390328 - RNA, 19 nt, Homo sapiens
ugacugagcagacugguga

SEQ ID NO: 1390329 - RNA, 22 nt, Homo sapiens
ugacuguggccaugguccccaa

SEQ ID NO: 1390330 - RNA, 15 nt, Homo sapiens
ugacuuccacaccua

SEQ ID NO: 1390331 - RNA, 19 nt, Homo sapiens
ugacuugacagaacacugu

SEQ ID NO: 1390332 - RNA, 17 nt, Homo sapiens
ugagaaagaaacuaaua

SEQ ID NO: 1390333 - RNA, 15 nt, Homo sapiens
ugagaacaaaaucac

SEQ ID NO: 1390334 - RNA, 17 nt, Homo sapiens
ugagaacuacucaggga

SEQ ID NO: 1390335 - RNA, 17 nt, Homo sapiens
ugagaauucagcugccc

SEQ ID NO: 1390336 - RNA, 15 nt, Homo sapiens
ugagaccaaccuggg

SEQ ID NO: 1390337 - RNA, 18 nt, Homo sapiens
ugagaccuggcagccaca

SEQ ID NO: 1390338 - RNA, 23 nt, Homo sapiens
ugagacucagacaggaaagggaa

SEQ ID NO: 1390339 - RNA, 16 nt, Homo sapiens
ugagacugaacugugu

SEQ ID NO: 1390340 - RNA, 12 nt, Homo sapiens
ugagacuuucaa

SEQ ID NO: 1390341 - RNA, 13 nt, Homo sapiens
ugagagaaccuca

SEQ ID NO: 1390342 - RNA, 14 nt, Homo sapiens
ugagagacccaagg

SEQ ID NO: 1390343 - RNA, 14 nt, Homo sapiens
ugagagagacaaga

SEQ ID NO: 1390344 - RNA, 15 nt, Homo sapiens
ugagagcacagcagg

SEQ ID NO: 1390345 - RNA, 19 nt, Homo sapiens
ugagaggagagagacucca

SEQ ID NO: 1390346 - RNA, 23 nt, Homo sapiens
ugagaggagagagacuccagcug

SEQ ID NO: 1390347 - RNA, 18 nt, Homo sapiens
ugagaggggaacagacug

SEQ ID NO: 1390348 - RNA, 12 nt, Homo sapiens
ugagaguauuua

SEQ ID NO: 1390349 - RNA, 21 nt, Homo sapiens
ugagauagaagaacugcaaag

SEQ ID NO: 1390350 - RNA, 18 nt, Homo sapiens
ugagcaaacaaaaccacc

SEQ ID NO: 1390351 - RNA, 16 nt, Homo sapiens
ugagcagcggacuuca

SEQ ID NO: 1390352 - RNA, 13 nt, Homo sapiens
ugagccacugcac

SEQ ID NO: 1390353 - RNA, 22 nt, Homo sapiens
ugagccccugggacugcugcuu

SEQ ID NO: 1390354 - RNA, 23 nt, Homo sapiens
ugagcccucuaugguguggcaaa

SEQ ID NO: 1390355 - RNA, 23 nt, Homo sapiens
ugagcgugaaucuguaucuugcc

SEQ ID NO: 1390356 - RNA, 19 nt, Homo sapiens
ugagcucacugaaaagacu

SEQ ID NO: 1390357 - RNA, 15 nt, Homo sapiens
ugagcuccccaaaaa

SEQ ID NO: 1390358 - RNA, 19 nt, Homo sapiens
ugagcugccuguaacuuga

SEQ ID NO: 1390359 - RNA, 20 nt, Homo sapiens
ugagcuucauauaccagcaa

SEQ ID NO: 1390360 - RNA, 16 nt, Homo sapiens
ugaggaagugaacauu

SEQ ID NO: 1390361 - RNA, 15 nt, Homo sapiens
ugaggacauguggaa

SEQ ID NO: 1390362 - RNA, 23 nt, Homo sapiens
ugaggacuuaaaauauuccugca

SEQ ID NO: 1390363 - RNA, 15 nt, Homo sapiens
ugaggagugaacauu

SEQ ID NO: 1390364 - RNA, 20 nt, Homo sapiens
ugaggauuuugauccaagcu

SEQ ID NO: 1390365 - RNA, 14 nt, Homo sapiens
ugaggcaauaaaaa

SEQ ID NO: 1390366 - RNA, 21 nt, Homo sapiens
ugaggcacgagcaaagugaag

SEQ ID NO: 1390367 - RNA, 13 nt, Homo sapiens
ugaggcaggagaa

SEQ ID NO: 1390368 - RNA, 21 nt, Homo sapiens
ugaggcggguggaucacuuga

SEQ ID NO: 1390369 - RNA, 16 nt, Homo sapiens
ugaggggcuccuggaa

SEQ ID NO: 1390370 - RNA, 22 nt, Homo sapiens
ugagguugggguguacuaguua

SEQ ID NO: 1390371 - RNA, 13 nt, Homo sapiens
ugaguaaucugau

SEQ ID NO: 1390372 - RNA, 19 nt, Homo sapiens
ugagucccagagccaauca

SEQ ID NO: 1390373 - RNA, 17 nt, Homo sapiens
ugagugaucccauuucu

SEQ ID NO: 1390374 - RNA, 16 nt, Homo sapiens
ugaguguaacaagaaa

SEQ ID NO: 1390375 - RNA, 19 nt, Homo sapiens
ugaguguguccaagugugu

SEQ ID NO: 1390376 - RNA, 20 nt, Homo sapiens
ugaguuuuugauagcuuuau

SEQ ID NO: 1390377 - RNA, 14 nt, Homo sapiens
ugauaaccacuaag

SEQ ID NO: 1390378 - RNA, 20 nt, Homo sapiens
uggaggcugucuucucaggc

SEQ ID NO: 1390379 - RNA, 21 nt, Homo sapiens
uggagggauaagccagcugca

SEQ ID NO: 1390380 - RNA, 20 nt, Homo sapiens
uggagguugcagugagccaa

SEQ ID NO: 1390381 - RNA, 17 nt, Homo sapiens
uggaguggaugccucag

SEQ ID NO: 1390382 - RNA, 13 nt, Homo sapiens
uggaguuaucuaa

SEQ ID NO: 1390383 - RNA, 22 nt, Homo sapiens
uggauaggcacauagagaggga

SEQ ID NO: 1390384 - RNA, 14 nt, Homo sapiens
uggauagucugucc

SEQ ID NO: 1390385 - RNA, 20 nt, Homo sapiens
uggaucaguccuuugaucag

SEQ ID NO: 1390386 - RNA, 18 nt, Homo sapiens
uggaucuccauucucuca

SEQ ID NO: 1390387 - RNA, 13 nt, Homo sapiens
uggauucagaaua

SEQ ID NO: 1390388 - RNA, 20 nt, Homo sapiens
uggauugugggaauuaagga

SEQ ID NO: 1390389 - RNA, 14 nt, Homo sapiens
uggcaaagccuuca

SEQ ID NO: 1390390 - RNA, 17 nt, Homo sapiens
uggcaacaucuugcaaa

SEQ ID NO: 1390391 - RNA, 23 nt, Homo sapiens
uggcaauaggugugaacagggaa

SEQ ID NO: 1390392 - RNA, 16 nt, Homo sapiens
uggcacugacugggca

SEQ ID NO: 1390393 - RNA, 16 nt, Homo sapiens
uggcacuggaugcaga

SEQ ID NO: 1390394 - RNA, 17 nt, Homo sapiens
uggcacuggaugcagaa

SEQ ID NO: 1390395 - RNA, 14 nt, Homo sapiens
uggcagauuuuaca

SEQ ID NO: 1390396 - RNA, 21 nt, Homo sapiens
uggcagcaucuucacuucuaa

SEQ ID NO: 1390397 - RNA, 16 nt, Homo sapiens
uggcagccgugccuuc

SEQ ID NO: 1390398 - RNA, 11 nt, Homo sapiens
uggcagggaua

SEQ ID NO: 1390399 - RNA, 21 nt, Homo sapiens
uggcagugggagcugccuguu

SEQ ID NO: 1390400 - RNA, 19 nt, Homo sapiens
uggcauacgccuguagucc

SEQ ID NO: 1390401 - RNA, 15 nt, Homo sapiens
uggcaucacagggca

SEQ ID NO: 1390402 - RNA, 18 nt, Homo sapiens
uggcaucucuuucugcaa

SEQ ID NO: 1390403 - RNA, 23 nt, Homo sapiens
uggcaucuuugcuauggggacau

SEQ ID NO: 1390404 - RNA, 15 nt, Homo sapiens
uggcaugccuuccag

SEQ ID NO: 1390405 - RNA, 21 nt, Homo sapiens
uggcauugucuguaaugacaa

SEQ ID NO: 1390406 - RNA, 14 nt, Homo sapiens
uggccaaagaccaa

SEQ ID NO: 1390407 - RNA, 22 nt, Homo sapiens
uggccacgugggcaaacaggca

SEQ ID NO: 1390408 - RNA, 23 nt, Homo sapiens
uggccagagagccuggugcugcu

SEQ ID NO: 1390409 - RNA, 18 nt, Homo sapiens
uggccagugugaucccaa

SEQ ID NO: 1390410 - RNA, 23 nt, Homo sapiens
uggccaguuggaaccacggagau

SEQ ID NO: 1390411 - RNA, 18 nt, Homo sapiens
uggccauuccaacagcuc

SEQ ID NO: 1390412 - RNA, 19 nt, Homo sapiens
uggcccaacacaauucuuc

SEQ ID NO: 1390413 - RNA, 14 nt, Homo sapiens
uggccccaugucuc

SEQ ID NO: 1390414 - RNA, 17 nt, Homo sapiens
uggcccccacagaaaga

SEQ ID NO: 1390415 - RNA, 24 nt, Homo sapiens
uggccccuucacuucugaccacac

SEQ ID NO: 1390416 - RNA, 23 nt, Homo sapiens
uggcccucaguuucccuaucucg

SEQ ID NO: 1390417 - RNA, 14 nt, Homo sapiens
uggcccuggggccu

SEQ ID NO: 1390418 - RNA, 14 nt, Homo sapiens
uggcccuucuugcc

SEQ ID NO: 1390419 - RNA, 23 nt, Homo sapiens
uggccuuccccagccucuucuag

SEQ ID NO: 1390420 - RNA, 19 nt, Homo sapiens
uggcuaaaaccaucauagu

SEQ ID NO: 1390421 - RNA, 18 nt, Homo sapiens
uggcuaaaggucccaagg

SEQ ID NO: 1390422 - RNA, 16 nt, Homo sapiens
uggcuaagaguguccu

SEQ ID NO: 1390423 - RNA, 13 nt, Homo sapiens
uggcuaugcaaca

SEQ ID NO: 1390424 - RNA, 16 nt, Homo sapiens
uggcucacaccuguaa

SEQ ID NO: 1390425 - RNA, 16 nt, Homo sapiens
uggcucacgccuguaa

SEQ ID NO: 1390426 - RNA, 20 nt, Homo sapiens
uggcuccaacacugcugcuc

SEQ ID NO: 1390427 - RNA, 15 nt, Homo sapiens
uggcucucagaaggu

SEQ ID NO: 1390428 - RNA, 14 nt, Homo sapiens
uggcucugaccgaa

SEQ ID NO: 1390429 - RNA, 20 nt, Homo sapiens
agaagcugagcaccagggga

SEQ ID NO: 1390430 - RNA, 18 nt, Homo sapiens
agaaggagggagacauga

SEQ ID NO: 1390431 - RNA, 17 nt, Homo sapiens
agaaggauguacauuuc

SEQ ID NO: 1390432 - RNA, 22 nt, Homo sapiens
agaaggcagcaggcggccuuug

SEQ ID NO: 1390433 - RNA, 17 nt, Homo sapiens
agaagggggccaugagg

SEQ ID NO: 1390434 - RNA, 22 nt, Homo sapiens
agaaggguuuuccacccuggaa

SEQ ID NO: 1390435 - RNA, 19 nt, Homo sapiens
agaaguaaauauagcucag

SEQ ID NO: 1390436 - RNA, 16 nt, Homo sapiens
agaagugucuaaaaac

SEQ ID NO: 1390437 - RNA, 22 nt, Homo sapiens
agaaguugacaggcagugccau

SEQ ID NO: 1390438 - RNA, 23 nt, Homo sapiens
agaauauuauuggaaaauucucu

SEQ ID NO: 1390439 - RNA, 18 nt, Homo sapiens
agaaucccuagucuucaa

SEQ ID NO: 1390440 - RNA, 18 nt, Homo sapiens
agaaucccuguucauugu

SEQ ID NO: 1390441 - RNA, 14 nt, Homo sapiens
agaaucucaaauaa

SEQ ID NO: 1390442 - RNA, 17 nt, Homo sapiens
agaaucugcagcuaacu

SEQ ID NO: 1390443 - RNA, 11 nt, Homo sapiens
agaaugcucuu

SEQ ID NO: 1390444 - RNA, 15 nt, Homo sapiens
agaauggaaggugga

SEQ ID NO: 1390445 - RNA, 23 nt, Homo sapiens
agaauucugcuaccucacugggg

SEQ ID NO: 1390446 - RNA, 16 nt, Homo sapiens
agaauucuuacauguu

SEQ ID NO: 1390447 - RNA, 14 nt, Homo sapiens
agaauugauuuccc

SEQ ID NO: 1390448 - RNA, 13 nt, Homo sapiens
agaauuguaucau

SEQ ID NO: 1390449 - RNA, 14 nt, Homo sapiens
agaauuguaucauu

SEQ ID NO: 1390450 - RNA, 20 nt, Homo sapiens
agaauuuaaaccuauacuca

SEQ ID NO: 1390451 - RNA, 16 nt, Homo sapiens
agacaacagaagucau

SEQ ID NO: 1390452 - RNA, 22 nt, Homo sapiens
agacaacccugcaaaggacugu

SEQ ID NO: 1390453 - RNA, 21 nt, Homo sapiens
agacaagugacuguaucugug

SEQ ID NO: 1390454 - RNA, 18 nt, Homo sapiens
agacaccuugacagggca

SEQ ID NO: 1390455 - RNA, 18 nt, Homo sapiens
agacacugaaauauacac

SEQ ID NO: 1390456 - RNA, 15 nt, Homo sapiens
agacagcuucucauc

SEQ ID NO: 1390457 - RNA, 16 nt, Homo sapiens
agacaggcccaagaga

SEQ ID NO: 1390458 - RNA, 18 nt, Homo sapiens
agacaggguuuugccaug

SEQ ID NO: 1390459 - RNA, 14 nt, Homo sapiens
agacaguauauaac

SEQ ID NO: 1390460 - RNA, 19 nt, Homo sapiens
agacaguguuuucugggau

SEQ ID NO: 1390461 - RNA, 14 nt, Homo sapiens
agacaguucaagaa

SEQ ID NO: 1390462 - RNA, 21 nt, Homo sapiens
agacauaaccacugcuuccau

SEQ ID NO: 1390463 - RNA, 11 nt, Homo sapiens
agacauacucc

SEQ ID NO: 1390464 - RNA, 14 nt, Homo sapiens
agacaugaaugcac

SEQ ID NO: 1390465 - RNA, 16 nt, Homo sapiens
agacaugugcacuuga

SEQ ID NO: 1390466 - RNA, 14 nt, Homo sapiens
agaccacuauucuu

SEQ ID NO: 1390467 - RNA, 23 nt, Homo sapiens
agaccacuauucuuaacuauuca

SEQ ID NO: 1390468 - RNA, 20 nt, Homo sapiens
agaccauuuaucugggauua

SEQ ID NO: 1390469 - RNA, 17 nt, Homo sapiens
agacccaccacaccgca

SEQ ID NO: 1390470 - RNA, 18 nt, Homo sapiens
agaccccuggcugguaag

SEQ ID NO: 1390471 - RNA, 14 nt, Homo sapiens
agaccuccagcugu

SEQ ID NO: 1390472 - RNA, 23 nt, Homo sapiens
agacgggcaaaauaaagugacag

SEQ ID NO: 1390473 - RNA, 18 nt, Homo sapiens
agacguuuaaaagccauc

SEQ ID NO: 1390474 - RNA, 15 nt, Homo sapiens
agacuauugagauau

SEQ ID NO: 1390475 - RNA, 17 nt, Homo sapiens
agacuauugugccuuag

SEQ ID NO: 1390476 - RNA, 13 nt, Homo sapiens
agacuccaugaga

SEQ ID NO: 1390477 - RNA, 15 nt, Homo sapiens
agacuccugugcaac

SEQ ID NO: 1390478 - RNA, 14 nt, Homo sapiens
agacucugucucaa

SEQ ID NO: 1390479 - RNA, 17 nt, Homo sapiens
agacugaacagccaaau

SEQ ID NO: 1390480 - RNA, 19 nt, Homo sapiens
agacugcugggacuggcca

SEQ ID NO: 1390481 - RNA, 15 nt, Homo sapiens
agacuggaagcacag

SEQ ID NO: 1390482 - RNA, 17 nt, Homo sapiens
agacuggaagcacagcu

SEQ ID NO: 1390483 - RNA, 19 nt, Homo sapiens
agacugucucaagagggca

SEQ ID NO: 1390484 - RNA, 19 nt, Homo sapiens
agacuuggggaaauugcuu

SEQ ID NO: 1390485 - RNA, 14 nt, Homo sapiens
agacuuuacaugga

SEQ ID NO: 1390486 - RNA, 16 nt, Homo sapiens
agagaaaaauugccuu

SEQ ID NO: 1390487 - RNA, 15 nt, Homo sapiens
agagaaaagucuacc

SEQ ID NO: 1390488 - RNA, 23 nt, Homo sapiens
agagaacuggaaagacauagcca

SEQ ID NO: 1390489 - RNA, 15 nt, Homo sapiens
agagaauaccagugu

SEQ ID NO: 1390490 - RNA, 20 nt, Homo sapiens
agagaauucucuuauccaac

SEQ ID NO: 1390491 - RNA, 13 nt, Homo sapiens
agagacaccugca

SEQ ID NO: 1390492 - RNA, 19 nt, Homo sapiens
agagacagauaacucuccu

SEQ ID NO: 1390493 - RNA, 12 nt, Homo sapiens
agagacccaagg

SEQ ID NO: 1390494 - RNA, 18 nt, Homo sapiens
agagacgcagacaugugc

SEQ ID NO: 1390495 - RNA, 18 nt, Homo sapiens
agagacuaucugauuucc

SEQ ID NO: 1390496 - RNA, 21 nt, Homo sapiens
agagacuuggggaaauugcuu

SEQ ID NO: 1390497 - RNA, 18 nt, Homo sapiens
agagagacagacuugaga

SEQ ID NO: 1390498 - RNA, 15 nt, Homo sapiens
agagaggacuguuga

SEQ ID NO: 1390499 - RNA, 20 nt, Homo sapiens
cucgauuauucccuguacaa

SEQ ID NO: 1390500 - RNA, 22 nt, Homo sapiens
cucgauuauucccuguacaaua

SEQ ID NO: 1390501 - RNA, 20 nt, Homo sapiens
cucuaacucagaaacaucag

SEQ ID NO: 1390502 - RNA, 12 nt, Homo sapiens
cucuaacuucaa

SEQ ID NO: 1390503 - RNA, 12 nt, Homo sapiens
cucuacaaaaag

SEQ ID NO: 1390504 - RNA, 14 nt, Homo sapiens
cucuacaaaaagca

SEQ ID NO: 1390505 - RNA, 16 nt, Homo sapiens
cucuacagacuucucc

SEQ ID NO: 1390506 - RNA, 15 nt, Homo sapiens
cucuacccuauacaa

SEQ ID NO: 1390507 - RNA, 20 nt, Homo sapiens
cucuacuaaaaauacaaaau

SEQ ID NO: 1390508 - RNA, 17 nt, Homo sapiens
cucuacuccuaccucag

SEQ ID NO: 1390509 - RNA, 21 nt, Homo sapiens
cucuacugaaaguacaaaaau

SEQ ID NO: 1390510 - RNA, 12 nt, Homo sapiens
cucuauggugug

SEQ ID NO: 1390511 - RNA, 17 nt, Homo sapiens
cucuaugguguggcaaa

SEQ ID NO: 1390512 - RNA, 16 nt, Homo sapiens
cucuauuaaaauuacu

SEQ ID NO: 1390513 - RNA, 23 nt, Homo sapiens
cucucaggaucaagaaaguguug

SEQ ID NO: 1390514 - RNA, 18 nt, Homo sapiens
cucuccaaauacugaugg

SEQ ID NO: 1390515 - RNA, 17 nt, Homo sapiens
cucuccccuucucugua

SEQ ID NO: 1390516 - RNA, 17 nt, Homo sapiens
cucuccuccauguugcc

SEQ ID NO: 1390517 - RNA, 19 nt, Homo sapiens
cucuccuuuggccauucca

SEQ ID NO: 1390518 - RNA, 13 nt, Homo sapiens
cucucuccagucu

SEQ ID NO: 1390519 - RNA, 19 nt, Homo sapiens
cucugaaaucucagaauuc

SEQ ID NO: 1390520 - RNA, 14 nt, Homo sapiens
cucugaauuccaag

SEQ ID NO: 1390521 - RNA, 16 nt, Homo sapiens
cucugacccuagcucu

SEQ ID NO: 1390522 - RNA, 22 nt, Homo sapiens
cucugagauacuaauaggugug

SEQ ID NO: 1390523 - RNA, 20 nt, Homo sapiens
cucugagcaaauguggcucc

SEQ ID NO: 1390524 - RNA, 12 nt, Homo sapiens
cucugauaccuc

SEQ ID NO: 1390525 - RNA, 15 nt, Homo sapiens
cucugaucaaguauu

SEQ ID NO: 1390526 - RNA, 18 nt, Homo sapiens
cucugccugaaccuucca

SEQ ID NO: 1390527 - RNA, 13 nt, Homo sapiens
cucugcuauggaa

SEQ ID NO: 1390528 - RNA, 20 nt, Homo sapiens
cucugcuugccgaaacugga

SEQ ID NO: 1390529 - RNA, 23 nt, Homo sapiens
cucuggccaggauggaggggugg

SEQ ID NO: 1390530 - RNA, 15 nt, Homo sapiens
cucuggcgacaguuu

SEQ ID NO: 1390531 - RNA, 17 nt, Homo sapiens
cucuggcgacaguuuuc

SEQ ID NO: 1390532 - RNA, 22 nt, Homo sapiens
cucuggcuuugccuuggcuuug

SEQ ID NO: 1390533 - RNA, 17 nt, Homo sapiens
cucugggccaagucaaa

SEQ ID NO: 1390534 - RNA, 18 nt, Homo sapiens
cucugguuagguuaggac

SEQ ID NO: 1390535 - RNA, 13 nt, Homo sapiens
cucuguauguacu

SEQ ID NO: 1390536 - RNA, 13 nt, Homo sapiens
cucugucuucuuu

SEQ ID NO: 1390537 - RNA, 18 nt, Homo sapiens
cucugugaauugaaaugu

SEQ ID NO: 1390538 - RNA, 16 nt, Homo sapiens
cucuguuuucaugcua

SEQ ID NO: 1390539 - RNA, 20 nt, Homo sapiens
cucuuaaaccacagcacuau

SEQ ID NO: 1390540 - RNA, 17 nt, Homo sapiens
cucuuaaucaaauagca

SEQ ID NO: 1390541 - RNA, 19 nt, Homo sapiens
cucuuauagaaaguucaaa

SEQ ID NO: 1390542 - RNA, 18 nt, Homo sapiens
cucuucaacugaccagcc

SEQ ID NO: 1390543 - RNA, 19 nt, Homo sapiens
cucuucaacugaccagccu

SEQ ID NO: 1390544 - RNA, 21 nt, Homo sapiens
cucuucaacugaccagccucc

SEQ ID NO: 1390545 - RNA, 22 nt, Homo sapiens
cucuucagguucuuagugucac

SEQ ID NO: 1390546 - RNA, 20 nt, Homo sapiens
cucuuccacuuugauaccau

SEQ ID NO: 1390547 - RNA, 22 nt, Homo sapiens
cucuuccacuuugauaccauug

SEQ ID NO: 1390548 - RNA, 14 nt, Homo sapiens
cucuucuuacuuga

SEQ ID NO: 1390549 - RNA, 16 nt, Homo sapiens
cucuucuuacuugaug

SEQ ID NO: 1390550 - RNA, 19 nt, Homo sapiens
cucuugaaaauagaacaac

SEQ ID NO: 1390551 - RNA, 19 nt, Homo sapiens
cucuugaaaucuguuaaaa

SEQ ID NO: 1390552 - RNA, 14 nt, Homo sapiens
cucuugaaccacag

SEQ ID NO: 1390553 - RNA, 17 nt, Homo sapiens
cucuugaagacacugaa

SEQ ID NO: 1390554 - RNA, 16 nt, Homo sapiens
cucuugaagaugcuga

SEQ ID NO: 1390555 - RNA, 21 nt, Homo sapiens
cucuugagccugggaggucaa

SEQ ID NO: 1390556 - RNA, 20 nt, Homo sapiens
cucuugagggagcuuagcca

SEQ ID NO: 1390557 - RNA, 18 nt, Homo sapiens
cucuugccuaaguauucc

SEQ ID NO: 1390558 - RNA, 15 nt, Homo sapiens
cucuuuaaugucaca

SEQ ID NO: 1390559 - RNA, 18 nt, Homo sapiens
cucuuugacaauuccuag

SEQ ID NO: 1390560 - RNA, 14 nt, Homo sapiens
cucuuuucaaugug

SEQ ID NO: 1390561 - RNA, 18 nt, Homo sapiens
cucuuuugaauccaugcu

SEQ ID NO: 1390562 - RNA, 19 nt, Homo sapiens
cugaaaaccaauguucucu

SEQ ID NO: 1390563 - RNA, 19 nt, Homo sapiens
cugaaaagacucaguguuc

SEQ ID NO: 1390564 - RNA, 12 nt, Homo sapiens
cugaaacuaaug

SEQ ID NO: 1390565 - RNA, 17 nt, Homo sapiens
cugaaagccacagacaa

SEQ ID NO: 1390566 - RNA, 21 nt, Homo sapiens
cugaaauagugguucuuggaa

SEQ ID NO: 1390567 - RNA, 19 nt, Homo sapiens
cugaaaugcuagcugcaag

SEQ ID NO: 1390568 - RNA, 22 nt, Homo sapiens
cugaaauuauuuuuaaggauaa

SEQ ID NO: 1390569 - RNA, 19 nt, Homo sapiens
cugaacaguguuggcuuuc

SEQ ID NO: 1390570 - RNA, 22 nt, Homo sapiens
cugaagaggaacugggccuguu

SEQ ID NO: 1390571 - RNA, 13 nt, Homo sapiens
cugaaggcuuuca

SEQ ID NO: 1390572 - RNA, 17 nt, Homo sapiens
cugaaguaagcaaagac

SEQ ID NO: 1390573 - RNA, 16 nt, Homo sapiens
cugaagucacaucaca

SEQ ID NO: 1390574 - RNA, 20 nt, Homo sapiens
cugaagucaguuucuaucau

SEQ ID NO: 1390575 - RNA, 15 nt, Homo sapiens
cugaauaaacaggaa

SEQ ID NO: 1390576 - RNA, 23 nt, Homo sapiens
cugaauaccucuuugaaagaagg

SEQ ID NO: 1390577 - RNA, 23 nt, Homo sapiens
cugaaucuuccuuuguugcacaa

SEQ ID NO: 1390578 - RNA, 16 nt, Homo sapiens
cugaaugaacaaccuc

SEQ ID NO: 1390579 - RNA, 12 nt, Homo sapiens
cugaauguucug

SEQ ID NO: 1390580 - RNA, 18 nt, Homo sapiens
cugacacacagcucuguc

SEQ ID NO: 1390581 - RNA, 16 nt, Homo sapiens
cugaccaaaacaaaca

SEQ ID NO: 1390582 - RNA, 14 nt, Homo sapiens
agaucccagcucac

SEQ ID NO: 1390583 - RNA, 16 nt, Homo sapiens
agauccccguguuacu

SEQ ID NO: 1390584 - RNA, 20 nt, Homo sapiens
agaucgcgccacugcacucc

SEQ ID NO: 1390585 - RNA, 22 nt, Homo sapiens
agaucuggucccuugcagcuag

SEQ ID NO: 1390586 - RNA, 21 nt, Homo sapiens
agaucuguuaagugguuucau

SEQ ID NO: 1390587 - RNA, 16 nt, Homo sapiens
agaugacaaugggagc

SEQ ID NO: 1390588 - RNA, 15 nt, Homo sapiens
agaugagaguacacc

SEQ ID NO: 1390589 - RNA, 16 nt, Homo sapiens
agaugagaguacaccc

SEQ ID NO: 1390590 - RNA, 16 nt, Homo sapiens
agaugcagccccaucu

SEQ ID NO: 1390591 - RNA, 17 nt, Homo sapiens
agaugcauccuuucaua

SEQ ID NO: 1390592 - RNA, 20 nt, Homo sapiens
agaugcauuaucuaugauau

SEQ ID NO: 1390593 - RNA, 16 nt, Homo sapiens
agaugccagagcaaag

SEQ ID NO: 1390594 - RNA, 18 nt, Homo sapiens
agaugccccagagcuguu

SEQ ID NO: 1390595 - RNA, 18 nt, Homo sapiens
agaugccucccugacccu

SEQ ID NO: 1390596 - RNA, 21 nt, Homo sapiens
agauggaaaagggagauucag

SEQ ID NO: 1390597 - RNA, 21 nt, Homo sapiens
agauggcaggaugggcacugc

SEQ ID NO: 1390598 - RNA, 15 nt, Homo sapiens
agaugggacugggag

SEQ ID NO: 1390599 - RNA, 18 nt, Homo sapiens
agaugggaugcuugccua

SEQ ID NO: 1390600 - RNA, 14 nt, Homo sapiens
agauguagcaacau

SEQ ID NO: 1390601 - RNA, 16 nt, Homo sapiens
agauguauauauuucc

SEQ ID NO: 1390602 - RNA, 19 nt, Homo sapiens
agaugucaucccauugucu

SEQ ID NO: 1390603 - RNA, 16 nt, Homo sapiens
agauguuauacaacca

SEQ ID NO: 1390604 - RNA, 19 nt, Homo sapiens
agauguuauacaaccauca

SEQ ID NO: 1390605 - RNA, 17 nt, Homo sapiens
agauguucacuguggca

SEQ ID NO: 1390606 - RNA, 12 nt, Homo sapiens
agauguuugcaa

SEQ ID NO: 1390607 - RNA, 16 nt, Homo sapiens
agauuaaacaaacaaa

SEQ ID NO: 1390608 - RNA, 18 nt, Homo sapiens
agauuauauauuauuucu

SEQ ID NO: 1390609 - RNA, 17 nt, Homo sapiens
agauuccaccuagagcu

SEQ ID NO: 1390610 - RNA, 19 nt, Homo sapiens
agauuccaccuagagcuag

SEQ ID NO: 1390611 - RNA, 21 nt, Homo sapiens
agauuccaggcgaugugcaag

SEQ ID NO: 1390612 - RNA, 19 nt, Homo sapiens
agauugcaccauugcgcuc

SEQ ID NO: 1390613 - RNA, 17 nt, Homo sapiens
agauugcgccauugcac

SEQ ID NO: 1390614 - RNA, 19 nt, Homo sapiens
agauugcgccauugcacuc

SEQ ID NO: 1390615 - RNA, 23 nt, Homo sapiens
agauugugccacuucacuccagc

SEQ ID NO: 1390616 - RNA, 23 nt, Homo sapiens
agauuugcccauuuacacuuuug

SEQ ID NO: 1390617 - RNA, 22 nt, Homo sapiens
agauuuugaaugcuuccugaca

SEQ ID NO: 1390618 - RNA, 13 nt, Homo sapiens
agcaaaaccaaau

SEQ ID NO: 1390619 - RNA, 17 nt, Homo sapiens
agcaaaacuccaucuca

SEQ ID NO: 1390620 - RNA, 18 nt, Homo sapiens
agcaaacaaaaccaccug

SEQ ID NO: 1390621 - RNA, 13 nt, Homo sapiens
agcaaagggcuca

SEQ ID NO: 1390622 - RNA, 17 nt, Homo sapiens
agcaaaguuuuaccugu

SEQ ID NO: 1390623 - RNA, 15 nt, Homo sapiens
agcaaauguggcucc

SEQ ID NO: 1390624 - RNA, 11 nt, Homo sapiens
agcaaccagag

SEQ ID NO: 1390625 - RNA, 18 nt, Homo sapiens
agcaagaucccaucucuu

SEQ ID NO: 1390626 - RNA, 14 nt, Homo sapiens
agcaagguggagug

SEQ ID NO: 1390627 - RNA, 20 nt, Homo sapiens
agcaauacccaugucuacac

SEQ ID NO: 1390628 - RNA, 20 nt, Homo sapiens
agcaauugacugucacuguu

SEQ ID NO: 1390629 - RNA, 11 nt, Homo sapiens
agcacacugua

SEQ ID NO: 1390630 - RNA, 14 nt, Homo sapiens
agcacccucuccag

SEQ ID NO: 1390631 - RNA, 19 nt, Homo sapiens
agcacccucuccagaugag

SEQ ID NO: 1390632 - RNA, 21 nt, Homo sapiens
agcaccugcgggagcugcacu

SEQ ID NO: 1390633 - RNA, 15 nt, Homo sapiens
agcacuaaagcagug

SEQ ID NO: 1390634 - RNA, 20 nt, Homo sapiens
agcacugagcaaagcauuga

SEQ ID NO: 1390635 - RNA, 14 nt, Homo sapiens
agcacuuacagaua

SEQ ID NO: 1390636 - RNA, 13 nt, Homo sapiens
agcagauaauggu

SEQ ID NO: 1390637 - RNA, 18 nt, Homo sapiens
agcagccacaaccaaaaa

SEQ ID NO: 1390638 - RNA, 23 nt, Homo sapiens
agcagcuaucucucagugaacug

SEQ ID NO: 1390639 - RNA, 21 nt, Homo sapiens
agcaggacucugcccagacca

SEQ ID NO: 1390640 - RNA, 23 nt, Homo sapiens
agcaggcggccuuuguugcucag

SEQ ID NO: 1390641 - RNA, 15 nt, Homo sapiens
agcagggacagauca

SEQ ID NO: 1390642 - RNA, 19 nt, Homo sapiens
agcaguaagcuaucuucaa

SEQ ID NO: 1390643 - RNA, 20 nt, Homo sapiens
agcagucuacccaccucagc

SEQ ID NO: 1390644 - RNA, 21 nt, Homo sapiens
agcagugaaauaugauaauaa

SEQ ID NO: 1390645 - RNA, 16 nt, Homo sapiens
agcagugccuuccaua

SEQ ID NO: 1390646 - RNA, 15 nt, Homo sapiens
agcagugucuuccau

SEQ ID NO: 1390647 - RNA, 16 nt, Homo sapiens
agcagugucuuccaua

SEQ ID NO: 1390648 - RNA, 22 nt, Homo sapiens
agcaguuacaaaaaccuucccc

SEQ ID NO: 1390649 - RNA, 20 nt, Homo sapiens
agcaguucagcuccuuccac

SEQ ID NO: 1390650 - RNA, 22 nt, Homo sapiens
agcaguuugcuuuguaugcacu

SEQ ID NO: 1390651 - RNA, 19 nt, Homo sapiens
gcccugggccccaccaccu

SEQ ID NO: 1390652 - RNA, 21 nt, Homo sapiens
gcccuggggcugaucucaggg

SEQ ID NO: 1390653 - RNA, 18 nt, Homo sapiens
gcccuuccucuccacugc

SEQ ID NO: 1390654 - RNA, 23 nt, Homo sapiens
gccgaauugucuuuggugcuuuu

SEQ ID NO: 1390655 - RNA, 21 nt, Homo sapiens
gccgagauugcaccacugcac

SEQ ID NO: 1390656 - RNA, 19 nt, Homo sapiens
gccgcauucccugagucac

SEQ ID NO: 1390657 - RNA, 14 nt, Homo sapiens
gccggagugacaga

SEQ ID NO: 1390658 - RNA, 20 nt, Homo sapiens
gccgggcacagcugugguga

SEQ ID NO: 1390659 - RNA, 13 nt, Homo sapiens
gccuaacacuggg

SEQ ID NO: 1390660 - RNA, 19 nt, Homo sapiens
gccuacaggagugagcacu

SEQ ID NO: 1390661 - RNA, 23 nt, Homo sapiens
gccuagauccacacacagaggaa

SEQ ID NO: 1390662 - RNA, 16 nt, Homo sapiens
gccuagccgaccucag

SEQ ID NO: 1390663 - RNA, 20 nt, Homo sapiens
gccuaggggucagggaccaa

SEQ ID NO: 1390664 - RNA, 21 nt, Homo sapiens
gccuccaccccccagaaccug

SEQ ID NO: 1390665 - RNA, 16 nt, Homo sapiens
gccuccagcccucuca

SEQ ID NO: 1390666 - RNA, 22 nt, Homo sapiens
gccuccucccugggcagaaagu

SEQ ID NO: 1390667 - RNA, 21 nt, Homo sapiens
gccucggccucccaaaguguu

SEQ ID NO: 1390668 - RNA, 12 nt, Homo sapiens
gccucuggaaua

SEQ ID NO: 1390669 - RNA, 22 nt, Homo sapiens
gccucuuccgugacgucacugg

SEQ ID NO: 1390670 - RNA, 19 nt, Homo sapiens
gccucuuccucccucauuc

SEQ ID NO: 1390671 - RNA, 14 nt, Homo sapiens
gccugaaccuucca

SEQ ID NO: 1390672 - RNA, 15 nt, Homo sapiens
gccugaaccuuccau

SEQ ID NO: 1390673 - RNA, 19 nt, Homo sapiens
gccugagucacccaugaag

SEQ ID NO: 1390674 - RNA, 16 nt, Homo sapiens
gccugcacuaauuuga

SEQ ID NO: 1390675 - RNA, 20 nt, Homo sapiens
gccugcggaguugugcacgu

SEQ ID NO: 1390676 - RNA, 17 nt, Homo sapiens
gccuggagccccacugc

SEQ ID NO: 1390677 - RNA, 21 nt, Homo sapiens
gccuggcagaacugagcuccu

SEQ ID NO: 1390678 - RNA, 14 nt, Homo sapiens
gccuggugcagugg

SEQ ID NO: 1390679 - RNA, 20 nt, Homo sapiens
gccuguaaucccagcacuuu

SEQ ID NO: 1390680 - RNA, 22 nt, Homo sapiens
gccuguagaugacauggugaaa

SEQ ID NO: 1390681 - RNA, 13 nt, Homo sapiens
gccuguaguccca

SEQ ID NO: 1390682 - RNA, 14 nt, Homo sapiens
gccugucuccuuug

SEQ ID NO: 1390683 - RNA, 17 nt, Homo sapiens
gccugucuccuuugcag

SEQ ID NO: 1390684 - RNA, 14 nt, Homo sapiens
gccugucuuuccca

SEQ ID NO: 1390685 - RNA, 18 nt, Homo sapiens
gccugugcugugacucga

SEQ ID NO: 1390686 - RNA, 19 nt, Homo sapiens
gccugugguuacagugcag

SEQ ID NO: 1390687 - RNA, 14 nt, Homo sapiens
gccuguuccaugaa

SEQ ID NO: 1390688 - RNA, 20 nt, Homo sapiens
gccuguugaagaugcuugua

SEQ ID NO: 1390689 - RNA, 15 nt, Homo sapiens
gccuuaaaagccauc

SEQ ID NO: 1390690 - RNA, 21 nt, Homo sapiens
gccuuaaaagccaucauguaa

SEQ ID NO: 1390691 - RNA, 21 nt, Homo sapiens
gccuuaggaaaagcauuugcu

SEQ ID NO: 1390692 - RNA, 20 nt, Homo sapiens
gccuuccauaauuaugacag

SEQ ID NO: 1390693 - RNA, 18 nt, Homo sapiens
gccuucccaggaguacac

SEQ ID NO: 1390694 - RNA, 19 nt, Homo sapiens
gccuucccaggaguacacc

SEQ ID NO: 1390695 - RNA, 12 nt, Homo sapiens
gccuucucacca

SEQ ID NO: 1390696 - RNA, 23 nt, Homo sapiens
gccuucuccagacaaaccagaag

SEQ ID NO: 1390697 - RNA, 18 nt, Homo sapiens
gccuucuccaugcugaga

SEQ ID NO: 1390698 - RNA, 15 nt, Homo sapiens
gccuucuugugaucu

SEQ ID NO: 1390699 - RNA, 16 nt, Homo sapiens
gccuugaaaccaccuu

SEQ ID NO: 1390700 - RNA, 21 nt, Homo sapiens
gccuuuaguuuuaacaguuca

SEQ ID NO: 1390701 - RNA, 22 nt, Homo sapiens
gcgcaagccuguaaucccagcu

SEQ ID NO: 1390702 - RNA, 14 nt, Homo sapiens
gcgcaucaggccug

SEQ ID NO: 1390703 - RNA, 20 nt, Homo sapiens
gcgcugcucuuaugccauuu

SEQ ID NO: 1390704 - RNA, 17 nt, Homo sapiens
gcgggccaaggacugcc

SEQ ID NO: 1390705 - RNA, 19 nt, Homo sapiens
gcgugaaucuguaucuugc

SEQ ID NO: 1390706 - RNA, 17 nt, Homo sapiens
gcgugacucacccaagc

SEQ ID NO: 1390707 - RNA, 12 nt, Homo sapiens
gcgugcacacac

SEQ ID NO: 1390708 - RNA, 19 nt, Homo sapiens
gcuaccucacuaugcugcu

SEQ ID NO: 1390709 - RNA, 21 nt, Homo sapiens
gcuacucuguuccuucacauc

SEQ ID NO: 1390710 - RNA, 19 nt, Homo sapiens
gcuagaugugucuuaccag

SEQ ID NO: 1390711 - RNA, 15 nt, Homo sapiens
gcuagggaaggcggg

SEQ ID NO: 1390712 - RNA, 16 nt, Homo sapiens
gcuaguaaaagccauc

SEQ ID NO: 1390713 - RNA, 16 nt, Homo sapiens
gcuaguuugaccucau

SEQ ID NO: 1390714 - RNA, 17 nt, Homo sapiens
gcuauaacuauguugau

SEQ ID NO: 1390715 - RNA, 17 nt, Homo sapiens
gcuauauccauguacug

SEQ ID NO: 1390716 - RNA, 23 nt, Homo sapiens
gcuaucucucagugaacugugag

SEQ ID NO: 1390717 - RNA, 20 nt, Homo sapiens
gcuauggggagaaaagacau

SEQ ID NO: 1390718 - RNA, 17 nt, Homo sapiens
gcucaaaggcacaguga

SEQ ID NO: 1390719 - RNA, 15 nt, Homo sapiens
gcucaauauuccuga

SEQ ID NO: 1390720 - RNA, 14 nt, Homo sapiens
gcucacaccuguaa

SEQ ID NO: 1390721 - RNA, 18 nt, Homo sapiens
gcucacauaucugucauu

SEQ ID NO: 1390722 - RNA, 17 nt, Homo sapiens
gcucacgucacacuugg

SEQ ID NO: 1390723 - RNA, 19 nt, Homo sapiens
gcucagggaauaauccaga

SEQ ID NO: 1390724 - RNA, 12 nt, Homo sapiens
gcucagggcuga

SEQ ID NO: 1390725 - RNA, 16 nt, Homo sapiens
gcucagggcugacacg

SEQ ID NO: 1390726 - RNA, 11 nt, Homo sapiens
gcucauuucau

SEQ ID NO: 1390727 - RNA, 13 nt, Homo sapiens
gcuccacugaaca

SEQ ID NO: 1390728 - RNA, 22 nt, Homo sapiens
gcuccaguggaagaagaaaaca

SEQ ID NO: 1390729 - RNA, 17 nt, Homo sapiens
gcucccuaggagaccaa

SEQ ID NO: 1390730 - RNA, 11 nt, Homo sapiens
gcuccuggacu

SEQ ID NO: 1390731 - RNA, 15 nt, Homo sapiens
gcuccuggggcaaug

SEQ ID NO: 1390732 - RNA, 19 nt, Homo sapiens
gcuccuuagcugccaagcc

SEQ ID NO: 1390733 - RNA, 15 nt, Homo sapiens
gcuccuucuguccua

SEQ ID NO: 1390734 - RNA, 20 nt, Homo sapiens
gcucuagagaaaagucuacc

SEQ ID NO: 1390735 - RNA, 19 nt, Homo sapiens
gcucucagaagguauuccu

SEQ ID NO: 1390736 - RNA, 14 nt, Homo sapiens
gcucugaacacgaa

SEQ ID NO: 1390737 - RNA, 22 nt, Homo sapiens
gcucugcccugcccuagcucca

SEQ ID NO: 1390738 - RNA, 18 nt, Homo sapiens
gcuggcgucugucuucaa

SEQ ID NO: 1390739 - RNA, 20 nt, Homo sapiens
gcuggcgugcaguggugcga

SEQ ID NO: 1390740 - RNA, 16 nt, Homo sapiens
gcugggacuacaggug

SEQ ID NO: 1390741 - RNA, 15 nt, Homo sapiens
gcugggacuggccag

SEQ ID NO: 1390742 - RNA, 16 nt, Homo sapiens
gcugggauuacaggug

SEQ ID NO: 1390743 - RNA, 15 nt, Homo sapiens
gcuggguccagggga

SEQ ID NO: 1390744 - RNA, 20 nt, Homo sapiens
gcugguuuuccuaaaugcag

SEQ ID NO: 1390745 - RNA, 13 nt, Homo sapiens
gcugucaucucag

SEQ ID NO: 1390746 - RNA, 17 nt, Homo sapiens
gcugugaaagaaccaaa

SEQ ID NO: 1390747 - RNA, 20 nt, Homo sapiens
gcugugaucggccuggggaa

SEQ ID NO: 1390748 - RNA, 22 nt, Homo sapiens
gcuguggccaucaaccucugua

SEQ ID NO: 1390749 - RNA, 13 nt, Homo sapiens
gcugugugcaguc

SEQ ID NO: 1390750 - RNA, 16 nt, Homo sapiens
gcuguuauucuuccac

SEQ ID NO: 1390751 - RNA, 20 nt, Homo sapiens
gcuguuguguuguuguuauu

SEQ ID NO: 1390752 - RNA, 23 nt, Homo sapiens
gcuuaguagagcuuuuugcaugu

SEQ ID NO: 1390753 - RNA, 14 nt, Homo sapiens
gcuuauaaaaucaa

SEQ ID NO: 1390754 - RNA, 21 nt, Homo sapiens
gcuuauacacuuacacuuuau

SEQ ID NO: 1390755 - RNA, 19 nt, Homo sapiens
gcuucacagaugugugauu

SEQ ID NO: 1390756 - RNA, 13 nt, Homo sapiens
gcuucagccugag

SEQ ID NO: 1390757 - RNA, 20 nt, Homo sapiens
gcuucauauaccagcaauau

SEQ ID NO: 1390758 - RNA, 16 nt, Homo sapiens
gcuucauuuccugugu

SEQ ID NO: 1390759 - RNA, 18 nt, Homo sapiens
gcuucuaccaacuggaag

SEQ ID NO: 1390760 - RNA, 22 nt, Homo sapiens
gcuucucacugccaugccagcu

SEQ ID NO: 1390761 - RNA, 16 nt, Homo sapiens
gcuucucuccacugaa

SEQ ID NO: 1390762 - RNA, 15 nt, Homo sapiens
gcuugagcccaggag

SEQ ID NO: 1390763 - RNA, 17 nt, Homo sapiens
gcuugccgaaacuggaa

SEQ ID NO: 1390764 - RNA, 13 nt, Homo sapiens
gcuuggaaaggac

SEQ ID NO: 1390765 - RNA, 17 nt, Homo sapiens
gcuuggaaaggaccagu

SEQ ID NO: 1390766 - RNA, 22 nt, Homo sapiens
gcuuggaaaggaccaguaugcu

SEQ ID NO: 1390767 - RNA, 16 nt, Homo sapiens
gcuugggcuuccauuu

SEQ ID NO: 1390768 - RNA, 15 nt, Homo sapiens
gcuuuacuuugccca

SEQ ID NO: 1390769 - RNA, 13 nt, Homo sapiens
gcuuuagggcaau

SEQ ID NO: 1390770 - RNA, 16 nt, Homo sapiens
gcuuuaucccacggaa

SEQ ID NO: 1390771 - RNA, 21 nt, Homo sapiens
gcuuuauuuuuuaaguauuua

SEQ ID NO: 1390772 - RNA, 16 nt, Homo sapiens
gcuuucugaacucgcu

SEQ ID NO: 1390773 - RNA, 15 nt, Homo sapiens
gcuuucuuguugcug

SEQ ID NO: 1390774 - RNA, 19 nt, Homo sapiens
gcuuuggacacacacagcu

SEQ ID NO: 1390775 - RNA, 14 nt, Homo sapiens
gcuuugguacuaau

SEQ ID NO: 1390776 - RNA, 24 nt, Homo sapiens
gcuuuucaugcguguguguugucu

SEQ ID NO: 1390777 - RNA, 17 nt, Homo sapiens
gcuuuucuaacuaagag

SEQ ID NO: 1390778 - RNA, 19 nt, Homo sapiens
ggaaaagcaaaacuguagg

SEQ ID NO: 1390779 - RNA, 20 nt, Homo sapiens
ggaaaagcugcugacagugu

SEQ ID NO: 1390780 - RNA, 20 nt, Homo sapiens
ggaaaauaaaucaaugcuau

SEQ ID NO: 1390781 - RNA, 12 nt, Homo sapiens
ggaaaaugagua

SEQ ID NO: 1390782 - RNA, 20 nt, Homo sapiens
ggaaacagcuaaugggacac

SEQ ID NO: 1390783 - RNA, 14 nt, Homo sapiens
ggaaaccaguguag

SEQ ID NO: 1390784 - RNA, 19 nt, Homo sapiens
ggaaacuggaugaggucau

SEQ ID NO: 1390785 - RNA, 18 nt, Homo sapiens
ggaaacuguugccagaga

SEQ ID NO: 1390786 - RNA, 16 nt, Homo sapiens
ggaaagaugaucagcu

SEQ ID NO: 1390787 - RNA, 14 nt, Homo sapiens
ggaaaggauucaug

SEQ ID NO: 1390788 - RNA, 22 nt, Homo sapiens
ggaaaguaaauauuucaggcau

SEQ ID NO: 1390789 - RNA, 21 nt, Homo sapiens
ggaaauaaaaaagucucuauu

SEQ ID NO: 1390790 - RNA, 22 nt, Homo sapiens
ggaaauaaaauuuaggaccaau

SEQ ID NO: 1390791 - RNA, 16 nt, Homo sapiens
ggaaauauuaugcaaa

SEQ ID NO: 1390792 - RNA, 14 nt, Homo sapiens
ggaaaugaaccaca

SEQ ID NO: 1390793 - RNA, 14 nt, Homo sapiens
ggaacacugcacuc

SEQ ID NO: 1390794 - RNA, 22 nt, Homo sapiens
ggaacccccagaauaaauaugc

SEQ ID NO: 1390795 - RNA, 12 nt, Homo sapiens
ggaacucuggag

SEQ ID NO: 1390796 - RNA, 13 nt, Homo sapiens
ggaacugcaauaa

SEQ ID NO: 1390797 - RNA, 23 nt, Homo sapiens
ggaacugggccaacucaccugag

SEQ ID NO: 1390798 - RNA, 14 nt, Homo sapiens
ggaagaccaagaca

SEQ ID NO: 1390799 - RNA, 19 nt, Homo sapiens
ggaagagcugcaacggaau

SEQ ID NO: 1390800 - RNA, 19 nt, Homo sapiens
ggaagcucugaagucacau

SEQ ID NO: 1390801 - RNA, 19 nt, Homo sapiens
ggaagggccuacagcccau

SEQ ID NO: 1390802 - RNA, 19 nt, Homo sapiens
ggaagggggguugcagugg

SEQ ID NO: 1390803 - RNA, 22 nt, Homo sapiens
ggaaggucucaggagaagggau

SEQ ID NO: 1390804 - RNA, 17 nt, Homo sapiens
ggaagucagcaugccuc

SEQ ID NO: 1390805 - RNA, 16 nt, Homo sapiens
ggaagucgagggaugg

SEQ ID NO: 1390806 - RNA, 23 nt, Homo sapiens
ggaagugaagagggagaagggau

SEQ ID NO: 1390807 - RNA, 21 nt, Homo sapiens
ggaaguuuuguggaggagcuc

SEQ ID NO: 1390808 - RNA, 15 nt, Homo sapiens
ggaauaaggccuuaa

SEQ ID NO: 1390809 - RNA, 16 nt, Homo sapiens
ggaauaugagcuuuau

SEQ ID NO: 1390810 - RNA, 23 nt, Homo sapiens
ggaaucuagaagaaaugaaauuu

SEQ ID NO: 1390811 - RNA, 20 nt, Homo sapiens
ggacaaagucuccagcccac

SEQ ID NO: 1390812 - RNA, 18 nt, Homo sapiens
ggacaccuuuuaacucac

SEQ ID NO: 1390813 - RNA, 15 nt, Homo sapiens
ggacaggcauguucu

SEQ ID NO: 1390814 - RNA, 13 nt, Homo sapiens
ggaccaauaccuc

SEQ ID NO: 1390815 - RNA, 19 nt, Homo sapiens
ggacgagacccuacaggag

SEQ ID NO: 1390816 - RNA, 21 nt, Homo sapiens
ggacuauggcucuacuuucag

SEQ ID NO: 1390817 - RNA, 23 nt, Homo sapiens
ggacucagguugucugaagucac

SEQ ID NO: 1390818 - RNA, 13 nt, Homo sapiens
ggacuccagaucu

SEQ ID NO: 1390819 - RNA, 15 nt, Homo sapiens
ggacucuucucaucc

SEQ ID NO: 1390820 - RNA, 22 nt, Homo sapiens
ggacugcaccauugcugcuccu

SEQ ID NO: 1390821 - RNA, 19 nt, Homo sapiens
ggacuuccuccccauguga

SEQ ID NO: 1390822 - RNA, 18 nt, Homo sapiens
ggagaaacccuugaaaag

SEQ ID NO: 1390823 - RNA, 17 nt, Homo sapiens
ggagaaaugacuuugaa

SEQ ID NO: 1390824 - RNA, 13 nt, Homo sapiens
ggagaacuagaga

SEQ ID NO: 1390825 - RNA, 18 nt, Homo sapiens
ggagaaucacuugcacuc

SEQ ID NO: 1390826 - RNA, 18 nt, Homo sapiens
uucuccccauuuccccca

SEQ ID NO: 1390827 - RNA, 20 nt, Homo sapiens
uucuccugccugugcuguga

SEQ ID NO: 1390828 - RNA, 18 nt, Homo sapiens
uucucgugacaccaccaa

SEQ ID NO: 1390829 - RNA, 23 nt, Homo sapiens
uucucucugugguggagaaccac

SEQ ID NO: 1390830 - RNA, 15 nt, Homo sapiens
uucucucuucuccac

SEQ ID NO: 1390831 - RNA, 19 nt, Homo sapiens
uucucuggcgacaguuuuc

SEQ ID NO: 1390832 - RNA, 22 nt, Homo sapiens
uucucugggccuucucaccaca

SEQ ID NO: 1390833 - RNA, 20 nt, Homo sapiens
uucucuuuuccuuugguccu

SEQ ID NO: 1390834 - RNA, 14 nt, Homo sapiens
uucugaaaugugca

SEQ ID NO: 1390835 - RNA, 22 nt, Homo sapiens
uucugaacacaauaaacuauuu

SEQ ID NO: 1390836 - RNA, 15 nt, Homo sapiens
uucugagaaggugag

SEQ ID NO: 1390837 - RNA, 11 nt, Homo sapiens
uucugagauca

SEQ ID NO: 1390838 - RNA, 16 nt, Homo sapiens
uucugaggauugcaga

SEQ ID NO: 1390839 - RNA, 10 nt, Homo sapiens
uucugaugaa

SEQ ID NO: 1390840 - RNA, 20 nt, Homo sapiens
uucugcagcaugaccuguga

SEQ ID NO: 1390841 - RNA, 12 nt, Homo sapiens
uucugcauuuaa

SEQ ID NO: 1390842 - RNA, 23 nt, Homo sapiens
uucugccuaucuucuuucacaua

SEQ ID NO: 1390843 - RNA, 19 nt, Homo sapiens
uucugcuaccucacugggg

SEQ ID NO: 1390844 - RNA, 17 nt, Homo sapiens
uucugcugaugcuacug

SEQ ID NO: 1390845 - RNA, 16 nt, Homo sapiens
uucugggaacuuccuc

SEQ ID NO: 1390846 - RNA, 16 nt, Homo sapiens
uucugggacacaguuc

SEQ ID NO: 1390847 - RNA, 23 nt, Homo sapiens
uucugggagacacccaaagggug

SEQ ID NO: 1390848 - RNA, 17 nt, Homo sapiens
uucugggugcagcugag

SEQ ID NO: 1390849 - RNA, 15 nt, Homo sapiens
uucugguuacugugg

SEQ ID NO: 1390850 - RNA, 16 nt, Homo sapiens
uucuguaccauagcgc

SEQ ID NO: 1390851 - RNA, 17 nt, Homo sapiens
uucugucaucuaccuuu

SEQ ID NO: 1390852 - RNA, 22 nt, Homo sapiens
uucugugggagaauucuuacau

SEQ ID NO: 1390853 - RNA, 13 nt, Homo sapiens
uucuuaacuauuc

SEQ ID NO: 1390854 - RNA, 13 nt, Homo sapiens
uucuuaagacaug

SEQ ID NO: 1390855 - RNA, 16 nt, Homo sapiens
uucuuacaaacaugug

SEQ ID NO: 1390856 - RNA, 14 nt, Homo sapiens
uucuuacaugcauu

SEQ ID NO: 1390857 - RNA, 19 nt, Homo sapiens
uucuuacuucccuaaugaa

SEQ ID NO: 1390858 - RNA, 14 nt, Homo sapiens
uucuuaggccacau

SEQ ID NO: 1390859 - RNA, 14 nt, Homo sapiens
uucuuagugucacu

SEQ ID NO: 1390860 - RNA, 17 nt, Homo sapiens
uucuuauguugcccagu

SEQ ID NO: 1390861 - RNA, 16 nt, Homo sapiens
uucuucccuacaguug

SEQ ID NO: 1390862 - RNA, 22 nt, Homo sapiens
uucuucuucagaagacacugca

SEQ ID NO: 1390863 - RNA, 13 nt, Homo sapiens
uucuugcagauca

SEQ ID NO: 1390864 - RNA, 22 nt, Homo sapiens
uucuuggagggcccacuuguau

SEQ ID NO: 1390865 - RNA, 19 nt, Homo sapiens
uucuuguggcaagagcagc

SEQ ID NO: 1390866 - RNA, 15 nt, Homo sapiens
uucuuguugcugcau

SEQ ID NO: 1390867 - RNA, 19 nt, Homo sapiens
uucuuguugcugcaucucc

SEQ ID NO: 1390868 - RNA, 18 nt, Homo sapiens
uucuuugacuuaaugucu

SEQ ID NO: 1390869 - RNA, 21 nt, Homo sapiens
uugaaaaggcgguacuaguuc

SEQ ID NO: 1390870 - RNA, 18 nt, Homo sapiens
uugaaacauagagaucua

SEQ ID NO: 1390871 - RNA, 21 nt, Homo sapiens
uugaaaugaugguaaguuaau

SEQ ID NO: 1390872 - RNA, 17 nt, Homo sapiens
uugaaauuguaagugaa

SEQ ID NO: 1390873 - RNA, 23 nt, Homo sapiens
uugaacaacuaggcuucagcaua

SEQ ID NO: 1390874 - RNA, 12 nt, Homo sapiens
uugaacuuggaa

SEQ ID NO: 1390875 - RNA, 13 nt, Homo sapiens
uugaagccaucua

SEQ ID NO: 1390876 - RNA, 20 nt, Homo sapiens
uugaaguauauucaaccaaa

SEQ ID NO: 1390877 - RNA, 18 nt, Homo sapiens
uugaagugacuucacaga

SEQ ID NO: 1390878 - RNA, 13 nt, Homo sapiens
uugaaguuuacaa

SEQ ID NO: 1390879 - RNA, 20 nt, Homo sapiens
uugaaucuacaaaaaacaac

SEQ ID NO: 1390880 - RNA, 15 nt, Homo sapiens
uugaauggguuugcu

SEQ ID NO: 1390881 - RNA, 19 nt, Homo sapiens
uugacaaagaaacccaagu

SEQ ID NO: 1390882 - RNA, 14 nt, Homo sapiens
uugacacggccaug

SEQ ID NO: 1390883 - RNA, 18 nt, Homo sapiens
uugaccaagaacugcaug

SEQ ID NO: 1390884 - RNA, 11 nt, Homo sapiens
uugaccacaga

SEQ ID NO: 1390885 - RNA, 12 nt, Homo sapiens
uugaccacagag

SEQ ID NO: 1390886 - RNA, 15 nt, Homo sapiens
uugacucuccagaaa

SEQ ID NO: 1390887 - RNA, 22 nt, Homo sapiens
uugacuggguuucucuguauag

SEQ ID NO: 1390888 - RNA, 13 nt, Homo sapiens
uugagacagaguu

SEQ ID NO: 1390889 - RNA, 18 nt, Homo sapiens
uugagaguugcuggugua

SEQ ID NO: 1390890 - RNA, 20 nt, Homo sapiens
uugagcucaggaguuugaga

SEQ ID NO: 1390891 - RNA, 23 nt, Homo sapiens
uugagcuccccaaaaaccucacc

SEQ ID NO: 1390892 - RNA, 21 nt, Homo sapiens
uugaggacaaccauuccagac

SEQ ID NO: 1390893 - RNA, 19 nt, Homo sapiens
uugaggcggauggcuguga

SEQ ID NO: 1390894 - RNA, 21 nt, Homo sapiens
uugagguuuccuucagacaga

SEQ ID NO: 1390895 - RNA, 20 nt, Homo sapiens
uugaguccagaaguuugaga

SEQ ID NO: 1390896 - RNA, 14 nt, Homo sapiens
uugauaaugggaug

SEQ ID NO: 1390897 - RNA, 19 nt, Homo sapiens
uugauaggauguggauuaa

SEQ ID NO: 1390898 - RNA, 19 nt, Homo sapiens
uugauauaaauaaaacauu

SEQ ID NO: 1390899 - RNA, 22 nt, Homo sapiens
uugauauacuauuuucauucuc

SEQ ID NO: 1390900 - RNA, 14 nt, Homo sapiens
uugauggugaugaa

SEQ ID NO: 1390901 - RNA, 20 nt, Homo sapiens
uugauugcguggaauugugc

SEQ ID NO: 1390902 - RNA, 19 nt, Homo sapiens
uugauugucagcuacuaau

SEQ ID NO: 1390903 - RNA, 15 nt, Homo sapiens
uugauuucauuaaua

SEQ ID NO: 1390904 - RNA, 17 nt, Homo sapiens
uugcaaacaucacugag

SEQ ID NO: 1390905 - RNA, 23 nt, Homo sapiens
uugcaaauccacuagcaccgacc

SEQ ID NO: 1390906 - RNA, 14 nt, Homo sapiens
uugcaacacacaga

SEQ ID NO: 1390907 - RNA, 15 nt, Homo sapiens
uugcaauguggcuug

SEQ ID NO: 1390908 - RNA, 22 nt, Homo sapiens
uugcacaaauugggccaaagaa

SEQ ID NO: 1390909 - RNA, 14 nt, Homo sapiens
uugcagacaggcaa

SEQ ID NO: 1390910 - RNA, 20 nt, Homo sapiens
uugcagcagugagucucuuc

SEQ ID NO: 1390911 - RNA, 20 nt, Homo sapiens
uugcaggaccucaggugaga

SEQ ID NO: 1390912 - RNA, 20 nt, Homo sapiens
uugcagugagccgagaucac

SEQ ID NO: 1390913 - RNA, 17 nt, Homo sapiens
uugcauauguaaggaag

SEQ ID NO: 1390914 - RNA, 16 nt, Homo sapiens
uugcauaugucuauau

SEQ ID NO: 1390915 - RNA, 18 nt, Homo sapiens
uugccagaugcaauacaa

SEQ ID NO: 1390916 - RNA, 16 nt, Homo sapiens
uugccaugugugcuga

SEQ ID NO: 1390917 - RNA, 17 nt, Homo sapiens
uugccaugugugcugaa

SEQ ID NO: 1390918 - RNA, 14 nt, Homo sapiens
uugccauguuggcc

SEQ ID NO: 1390919 - RNA, 20 nt, Homo sapiens
uugcccaggcuggucucaaa

SEQ ID NO: 1390920 - RNA, 15 nt, Homo sapiens
uugcccauuuacacu

SEQ ID NO: 1390921 - RNA, 14 nt, Homo sapiens
uugccuaaacccua

SEQ ID NO: 1390922 - RNA, 21 nt, Homo sapiens
uugccugaaguuggagugagu

SEQ ID NO: 1390923 - RNA, 22 nt, Homo sapiens
uugccuuuuccuguaucuauuu

SEQ ID NO: 1390924 - RNA, 22 nt, Homo sapiens
uugcuaagaagcgagcacugac

SEQ ID NO: 1390925 - RNA, 21 nt, Homo sapiens
uugcuauggggacauuccaau

SEQ ID NO: 1390926 - RNA, 23 nt, Homo sapiens
uugcuauggggagaaaagacaug

SEQ ID NO: 1390927 - RNA, 17 nt, Homo sapiens
uugcucagcuucuccaa

SEQ ID NO: 1390928 - RNA, 21 nt, Homo sapiens
uugcugucauaagaaugaaua

SEQ ID NO: 1390929 - RNA, 20 nt, Homo sapiens
uugcuguguccaacuccagu

SEQ ID NO: 1390930 - RNA, 20 nt, Homo sapiens
uuuccuucggguuggcaaaa

SEQ ID NO: 1390931 - RNA, 19 nt, Homo sapiens
uuuccuucuacuuacacau

SEQ ID NO: 1390932 - RNA, 18 nt, Homo sapiens
uuuccuuuguaaguuccu

SEQ ID NO: 1390933 - RNA, 15 nt, Homo sapiens
uuucucccccuaguu

SEQ ID NO: 1390934 - RNA, 19 nt, Homo sapiens
uuucuccuaucuucauauc

SEQ ID NO: 1390935 - RNA, 17 nt, Homo sapiens
uuucucuagggagaaaa

SEQ ID NO: 1390936 - RNA, 21 nt, Homo sapiens
uuucugauauagaauugcaau

SEQ ID NO: 1390937 - RNA, 22 nt, Homo sapiens
uuucugcuaaaaaguccuugau

SEQ ID NO: 1390938 - RNA, 22 nt, Homo sapiens
aaagaugcaaggaccaggacuc

SEQ ID NO: 1390939 - RNA, 19 nt, Homo sapiens
aaagauguuugucagauau

SEQ ID NO: 1390940 - RNA, 23 nt, Homo sapiens
aaagauuggacaccccugcuaua

SEQ ID NO: 1390941 - RNA, 14 nt, Homo sapiens
aaagauuuguacua

SEQ ID NO: 1390942 - RNA, 19 nt, Homo sapiens
aaagcaaacuuaagaaaca

SEQ ID NO: 1390943 - RNA, 13 nt, Homo sapiens
aaagcaaauguga

SEQ ID NO: 1390944 - RNA, 14 nt, Homo sapiens
aaagcaauaaccuc

SEQ ID NO: 1390945 - RNA, 18 nt, Homo sapiens
aaagcacuguuucucuca

SEQ ID NO: 1390946 - RNA, 12 nt, Homo sapiens
aaagcagcaucu

SEQ ID NO: 1390947 - RNA, 19 nt, Homo sapiens
aaagcagcucaaaggcaca

SEQ ID NO: 1390948 - RNA, 13 nt, Homo sapiens
aaagcaucaccuc

SEQ ID NO: 1390949 - RNA, 14 nt, Homo sapiens
aaagcauccaugug

SEQ ID NO: 1390950 - RNA, 21 nt, Homo sapiens
aaagcaucugagcuaacuuau

SEQ ID NO: 1390951 - RNA, 15 nt, Homo sapiens
aaagcauuugcugug

SEQ ID NO: 1390952 - RNA, 12 nt, Homo sapiens
aaagccaaaaac

SEQ ID NO: 1390953 - RNA, 18 nt, Homo sapiens
aaagcccaaccuccugac

SEQ ID NO: 1390954 - RNA, 21 nt, Homo sapiens
aaagcccuuaaaaauaugugu

SEQ ID NO: 1390955 - RNA, 21 nt, Homo sapiens
aaagcuagaaaguguaugugu

SEQ ID NO: 1390956 - RNA, 22 nt, Homo sapiens
aaagcugauuacugucaauaaa

SEQ ID NO: 1390957 - RNA, 20 nt, Homo sapiens
aaagcuuaccaaggggaaug

SEQ ID NO: 1390958 - RNA, 11 nt, Homo sapiens
aaagcuucccc

SEQ ID NO: 1390959 - RNA, 22 nt, Homo sapiens
aaaggaacuauguucacaagaa

SEQ ID NO: 1390960 - RNA, 14 nt, Homo sapiens
aaaggaagacuaga

SEQ ID NO: 1390961 - RNA, 16 nt, Homo sapiens
aaaggagaacuaucca

SEQ ID NO: 1390962 - RNA, 13 nt, Homo sapiens
aaaggaggggaua

SEQ ID NO: 1390963 - RNA, 19 nt, Homo sapiens
aaaggcgguacuaguucag

SEQ ID NO: 1390964 - RNA, 16 nt, Homo sapiens
aaagggauuuucagcc

SEQ ID NO: 1390965 - RNA, 22 nt, Homo sapiens
aaagggccaauaaauaugaugu

SEQ ID NO: 1390966 - RNA, 23 nt, Homo sapiens
aaagguaaaacaugcuggugaac

SEQ ID NO: 1390967 - RNA, 22 nt, Homo sapiens
aaaggucuaugcucauaacugu

SEQ ID NO: 1390968 - RNA, 16 nt, Homo sapiens
aaagguugagauguaa

SEQ ID NO: 1390969 - RNA, 14 nt, Homo sapiens
aaaguacuucucca

SEQ ID NO: 1390970 - RNA, 15 nt, Homo sapiens
aaaguauuccaccuu

SEQ ID NO: 1390971 - RNA, 23 nt, Homo sapiens
aaagucagugcccaacuguuaua

SEQ ID NO: 1390972 - RNA, 21 nt, Homo sapiens
aaagucuaccccugcuaagga

SEQ ID NO: 1390973 - RNA, 20 nt, Homo sapiens
aaagucugcauuacauuccu

SEQ ID NO: 1390974 - RNA, 22 nt, Homo sapiens
aaagucuuugaagugacuucac

SEQ ID NO: 1390975 - RNA, 14 nt, Homo sapiens
aaagugacuauuca

SEQ ID NO: 1390976 - RNA, 20 nt, Homo sapiens
aaagugcugcuggaaguaga

SEQ ID NO: 1390977 - RNA, 16 nt, Homo sapiens
aaagugguuucagcaa

SEQ ID NO: 1390978 - RNA, 17 nt, Homo sapiens
aaaguguaacauaugca

SEQ ID NO: 1390979 - RNA, 14 nt, Homo sapiens
aaagugugagcaaa

SEQ ID NO: 1390980 - RNA, 19 nt, Homo sapiens
aaaguguguuucuauguga

SEQ ID NO: 1390981 - RNA, 15 nt, Homo sapiens
aaaguuaaacauuga

SEQ ID NO: 1390982 - RNA, 23 nt, Homo sapiens
aaaguuaugguacuauguuagcc

SEQ ID NO: 1390983 - RNA, 20 nt, Homo sapiens
aaaguucauaacagugccau

SEQ ID NO: 1390984 - RNA, 16 nt, Homo sapiens
aaaguucucaaugcaa

SEQ ID NO: 1390985 - RNA, 17 nt, Homo sapiens
aaaguuucucuuuucaa

SEQ ID NO: 1390986 - RNA, 18 nt, Homo sapiens
aaauaaaaggucuaugcu

SEQ ID NO: 1390987 - RNA, 17 nt, Homo sapiens
aaauaaaaugcagacag

SEQ ID NO: 1390988 - RNA, 12 nt, Homo sapiens
accucccaguga

SEQ ID NO: 1390989 - RNA, 18 nt, Homo sapiens
accuccccuccuugccuc

SEQ ID NO: 1390990 - RNA, 21 nt, Homo sapiens
accuccuacgucaaacaugaa

SEQ ID NO: 1390991 - RNA, 16 nt, Homo sapiens
accuccuccucuggac

SEQ ID NO: 1390992 - RNA, 16 nt, Homo sapiens
accuccuggaaggcag

SEQ ID NO: 1390993 - RNA, 20 nt, Homo sapiens
accucggcuccuggacucau

SEQ ID NO: 1390994 - RNA, 14 nt, Homo sapiens
accucgugcuuuaa

SEQ ID NO: 1390995 - RNA, 17 nt, Homo sapiens
accucuauaauugccac

SEQ ID NO: 1390996 - RNA, 16 nt, Homo sapiens
accucuauauuugcuc

SEQ ID NO: 1390997 - RNA, 14 nt, Homo sapiens
accucucaauuucu

SEQ ID NO: 1390998 - RNA, 13 nt, Homo sapiens
accucucugggcc

SEQ ID NO: 1390999 - RNA, 20 nt, Homo sapiens
accucugccugaagucacac

SEQ ID NO: 1391000 - RNA, 22 nt, Homo sapiens
accucugccugaagucacacag

SEQ ID NO: 1391001 - RNA, 20 nt, Homo sapiens
accucuggauaauuuugcau

SEQ ID NO: 1391002 - RNA, 13 nt, Homo sapiens
accugaauguguc

SEQ ID NO: 1391003 - RNA, 21 nt, Homo sapiens
accugauguaccugaugcuau

SEQ ID NO: 1391004 - RNA, 23 nt, Homo sapiens
accugcauaaaaaggucuuuaaa

SEQ ID NO: 1391005 - RNA, 19 nt, Homo sapiens
accugccaggcacacugag

SEQ ID NO: 1391006 - RNA, 20 nt, Homo sapiens
accugcugagggaccagcca

SEQ ID NO: 1391007 - RNA, 19 nt, Homo sapiens
accuggcagccacaacugc

SEQ ID NO: 1391008 - RNA, 20 nt, Homo sapiens
accugguuccggcucugcac

SEQ ID NO: 1391009 - RNA, 15 nt, Homo sapiens
accuguaaucccagc

SEQ ID NO: 1391010 - RNA, 13 nt, Homo sapiens
accuguauuccca

SEQ ID NO: 1391011 - RNA, 22 nt, Homo sapiens
accugucuuccaaggagaccaa

SEQ ID NO: 1391012 - RNA, 11 nt, Homo sapiens
accugugauga

SEQ ID NO: 1391013 - RNA, 19 nt, Homo sapiens
accuuaaauuaaacaauuu

SEQ ID NO: 1391014 - RNA, 22 nt, Homo sapiens
accuuacauuugaaaucuauga

SEQ ID NO: 1391015 - RNA, 21 nt, Homo sapiens
accuuauaguguuaauaucuu

SEQ ID NO: 1391016 - RNA, 14 nt, Homo sapiens
accuucagugaaag

SEQ ID NO: 1391017 - RNA, 21 nt, Homo sapiens
accuucuaggaagcuccaguu

SEQ ID NO: 1391018 - RNA, 20 nt, Homo sapiens
accuucuguggcucacagaa

SEQ ID NO: 1391019 - RNA, 16 nt, Homo sapiens
accuugaacacugggg

SEQ ID NO: 1391020 - RNA, 17 nt, Homo sapiens
accuugacggcauugcu

SEQ ID NO: 1391021 - RNA, 21 nt, Homo sapiens
accuugacuugauuagugccu

SEQ ID NO: 1391022 - RNA, 15 nt, Homo sapiens
accuugcuccugugu

SEQ ID NO: 1391023 - RNA, 17 nt, Homo sapiens
accuuucaaauuucaca

SEQ ID NO: 1391024 - RNA, 20 nt, Homo sapiens
accuuuucccaaccauacaa

SEQ ID NO: 1391025 - RNA, 19 nt, Homo sapiens
accuuuuccugcggcauca

SEQ ID NO: 1391026 - RNA, 18 nt, Homo sapiens
acgaagcuuaguauaaac

SEQ ID NO: 1391027 - RNA, 22 nt, Homo sapiens
acgacaaagccaaacucugcca

SEQ ID NO: 1391028 - RNA, 21 nt, Homo sapiens
acgagggauguggagcacaaa

SEQ ID NO: 1391029 - RNA, 20 nt, Homo sapiens
acgcacacacacacacagga

SEQ ID NO: 1391030 - RNA, 18 nt, Homo sapiens
acgcaucagacagaugga

SEQ ID NO: 1391031 - RNA, 11 nt, Homo sapiens
acgccacugca

SEQ ID NO: 1391032 - RNA, 21 nt, Homo sapiens
acgccacugcacuauagccua

SEQ ID NO: 1391033 - RNA, 14 nt, Homo sapiens
acggaaaaugccaa

SEQ ID NO: 1391034 - RNA, 12 nt, Homo sapiens
acggacacucaa

SEQ ID NO: 1391035 - RNA, 17 nt, Homo sapiens
acggagaucuccuugcc

SEQ ID NO: 1391036 - RNA, 23 nt, Homo sapiens
acggaguuuaguuuuauauugcu

SEQ ID NO: 1391037 - RNA, 12 nt, Homo sapiens
acggccagcugc

SEQ ID NO: 1391038 - RNA, 14 nt, Homo sapiens
acgggcucagcaaa

SEQ ID NO: 1391039 - RNA, 19 nt, Homo sapiens
acggugcguuuggccaaaa

SEQ ID NO: 1391040 - RNA, 22 nt, Homo sapiens
acgguggccuaggguacaggca

SEQ ID NO: 1391041 - RNA, 20 nt, Homo sapiens
acguaaaucuguucaaggaa

SEQ ID NO: 1391042 - RNA, 18 nt, Homo sapiens
acguccagcucguucucu

SEQ ID NO: 1391043 - RNA, 17 nt, Homo sapiens
acgugacuguggcacac

SEQ ID NO: 1391044 - RNA, 16 nt, Homo sapiens
acguggagagggauga

SEQ ID NO: 1391045 - RNA, 19 nt, Homo sapiens
acgugggcaaacaggcagu

SEQ ID NO: 1391046 - RNA, 15 nt, Homo sapiens
acguuaagugaugaa

SEQ ID NO: 1391047 - RNA, 17 nt, Homo sapiens
acguucauuugugugcu

SEQ ID NO: 1391048 - RNA, 16 nt, Homo sapiens
acguuuauagccgaaa

SEQ ID NO: 1391049 - RNA, 16 nt, Homo sapiens
acuaaaaauacaaaaa

SEQ ID NO: 1391050 - RNA, 18 nt, Homo sapiens
acuaaacaacuaccuccu

SEQ ID NO: 1391051 - RNA, 18 nt, Homo sapiens
acuaaagcauucaauuua

SEQ ID NO: 1391052 - RNA, 12 nt, Homo sapiens
acuaacacagcc

SEQ ID NO: 1391053 - RNA, 15 nt, Homo sapiens
acuaacguacauuca

SEQ ID NO: 1391054 - RNA, 15 nt, Homo sapiens
acuaagagucucuau

SEQ ID NO: 1391055 - RNA, 13 nt, Homo sapiens
acuaagauguuca

SEQ ID NO: 1391056 - RNA, 14 nt, Homo sapiens
acuaauggaaauau

SEQ ID NO: 1391057 - RNA, 16 nt, Homo sapiens
acuacaaacacaagca

SEQ ID NO: 1391058 - RNA, 17 nt, Homo sapiens
acuacaaacacaauauu

SEQ ID NO: 1391059 - RNA, 23 nt, Homo sapiens
acuacacauucaauaagcaucaa

SEQ ID NO: 1391060 - RNA, 15 nt, Homo sapiens
acuacagacauuaaa

SEQ ID NO: 1391061 - RNA, 14 nt, Homo sapiens
acuagaacucucca

SEQ ID NO: 1391062 - RNA, 15 nt, Homo sapiens
acuagacaaguccag

SEQ ID NO: 1391063 - RNA, 18 nt, Homo sapiens
acuagaggcuugcauaau

SEQ ID NO: 1391064 - RNA, 18 nt, Homo sapiens
acuagagggauacacuga

SEQ ID NO: 1391065 - RNA, 15 nt, Homo sapiens
acuaggacucugagg

SEQ ID NO: 1391066 - RNA, 14 nt, Homo sapiens
acuaggagcacugu

SEQ ID NO: 1391067 - RNA, 20 nt, Homo sapiens
acuagggcuuauccaugccu

SEQ ID NO: 1391068 - RNA, 15 nt, Homo sapiens
acuaguaccuucaga

SEQ ID NO: 1391069 - RNA, 20 nt, Homo sapiens
acuaguucagacacuuugga

SEQ ID NO: 1391070 - RNA, 21 nt, Homo sapiens
acuaguucagacacuuuggaa

SEQ ID NO: 1391071 - RNA, 17 nt, Homo sapiens
acuaguuuuuauuccuu

SEQ ID NO: 1391072 - RNA, 18 nt, Homo sapiens
acuauaauguaagcucua

SEQ ID NO: 1391073 - RNA, 22 nt, Homo sapiens
acuauagccuaggugacagagu

SEQ ID NO: 1391074 - RNA, 14 nt, Homo sapiens
acuauccuacccca

SEQ ID NO: 1391075 - RNA, 19 nt, Homo sapiens
acuaugaagcuaccucaaa

SEQ ID NO: 1391076 - RNA, 16 nt, Homo sapiens
acuauuacaccaaaua

SEQ ID NO: 1391077 - RNA, 18 nt, Homo sapiens
acuauucuuaacuauuca

SEQ ID NO: 1391078 - RNA, 16 nt, Homo sapiens
acuauugagugaaaca

SEQ ID NO: 1391079 - RNA, 16 nt, Homo sapiens
acuauugcuugcacaa

SEQ ID NO: 1391080 - RNA, 16 nt, Homo sapiens
acuauuuuaacuggga

SEQ ID NO: 1391081 - RNA, 13 nt, Homo sapiens
acucaaacugccu

SEQ ID NO: 1391082 - RNA, 19 nt, Homo sapiens
acucaagaggcugaggcag

SEQ ID NO: 1391083 - RNA, 22 nt, Homo sapiens
acucaaguuucuucaaucugaa

SEQ ID NO: 1391084 - RNA, 21 nt, Homo sapiens
acucacacggacacucaaaag

SEQ ID NO: 1391085 - RNA, 20 nt, Homo sapiens
acucacuccacaacccaaga

SEQ ID NO: 1391086 - RNA, 20 nt, Homo sapiens
acucacuuaucccaagagaa

SEQ ID NO: 1391087 - RNA, 16 nt, Homo sapiens
acucaguuuucuugca

SEQ ID NO: 1391088 - RNA, 22 nt, Homo sapiens
acucauucuucuguacgucuga

SEQ ID NO: 1391089 - RNA, 22 nt, Homo sapiens
acucauuucauuccuaacacag

SEQ ID NO: 1391090 - RNA, 13 nt, Homo sapiens
acuccagccugag

SEQ ID NO: 1391091 - RNA, 15 nt, Homo sapiens
acuccagccugggca

SEQ ID NO: 1391092 - RNA, 18 nt, Homo sapiens
acuccaggcugucuuuca

SEQ ID NO: 1391093 - RNA, 12 nt, Homo sapiens
acuccaucucaa

SEQ ID NO: 1391094 - RNA, 18 nt, Homo sapiens
acucccaaagagcugccu

SEQ ID NO: 1391095 - RNA, 12 nt, Homo sapiens
acuccccugcac

SEQ ID NO: 1391096 - RNA, 12 nt, Homo sapiens
acuccugcaaaa

SEQ ID NO: 1391097 - RNA, 19 nt, Homo sapiens
acuccuguaggaagguuaa

SEQ ID NO: 1391098 - RNA, 13 nt, Homo sapiens
acuccuuccauca

SEQ ID NO: 1391099 - RNA, 20 nt, Homo sapiens
acuccuuucucaucuugucc

SEQ ID NO: 1391100 - RNA, 21 nt, Homo sapiens
acucgcuucccccauagccac

SEQ ID NO: 1391101 - RNA, 18 nt, Homo sapiens
gauuccaggcgaugugca

SEQ ID NO: 1391102 - RNA, 23 nt, Homo sapiens
gauuccaggcgaugugcaagugu

SEQ ID NO: 1391103 - RNA, 16 nt, Homo sapiens
gauucucaugccucag

SEQ ID NO: 1391104 - RNA, 23 nt, Homo sapiens
gauucuucucuuaauuucauaga

SEQ ID NO: 1391105 - RNA, 19 nt, Homo sapiens
gauugauagaguguuauca

SEQ ID NO: 1391106 - RNA, 19 nt, Homo sapiens
gauuuagcaggaagcugug

SEQ ID NO: 1391107 - RNA, 22 nt, Homo sapiens
gauuucaggauacucugucaga

SEQ ID NO: 1391108 - RNA, 20 nt, Homo sapiens
gauuuccaaaagacuugaag

SEQ ID NO: 1391109 - RNA, 13 nt, Homo sapiens
gauuugccugugc

SEQ ID NO: 1391110 - RNA, 19 nt, Homo sapiens
gauuuguccuuggggacau

SEQ ID NO: 1391111 - RNA, 14 nt, Homo sapiens
gauuuuaugcugcu

SEQ ID NO: 1391112 - RNA, 21 nt, Homo sapiens
gcaaaaacgaaagcugggcaa

SEQ ID NO: 1391113 - RNA, 12 nt, Homo sapiens
gcaaaaccaaau

SEQ ID NO: 1391114 - RNA, 22 nt, Homo sapiens
gcaaaaccaaauauuccagaga

SEQ ID NO: 1391115 - RNA, 15 nt, Homo sapiens
gcaaaacuuaggcau

SEQ ID NO: 1391116 - RNA, 22 nt, Homo sapiens
gcaaaacuucacggggucauac

SEQ ID NO: 1391117 - RNA, 15 nt, Homo sapiens
gcaaacagauggcag

SEQ ID NO: 1391118 - RNA, 16 nt, Homo sapiens
gcaaagauuugcuuua

SEQ ID NO: 1391119 - RNA, 20 nt, Homo sapiens
gcaaaggggggaagggacau

SEQ ID NO: 1391120 - RNA, 22 nt, Homo sapiens
gcaaagugaagacacuggcuca

SEQ ID NO: 1391121 - RNA, 19 nt, Homo sapiens
gcaaaguucccuacuuccu

SEQ ID NO: 1391122 - RNA, 16 nt, Homo sapiens
gcaaauccacuagcac

SEQ ID NO: 1391123 - RNA, 20 nt, Homo sapiens
gcaacaaugagcagaccaac

SEQ ID NO: 1391124 - RNA, 23 nt, Homo sapiens
gcaaccuuuuugauuucuuccag

SEQ ID NO: 1391125 - RNA, 22 nt, Homo sapiens
gcaacuuaagcugggauaauca

SEQ ID NO: 1391126 - RNA, 23 nt, Homo sapiens
gcaacuuaagcugggauaaucac

SEQ ID NO: 1391127 - RNA, 14 nt, Homo sapiens
gcaagaaacacugg

SEQ ID NO: 1391128 - RNA, 21 nt, Homo sapiens
gcaagaccaaaaugacaauga

SEQ ID NO: 1391129 - RNA, 15 nt, Homo sapiens
gcaagagccacagua

SEQ ID NO: 1391130 - RNA, 18 nt, Homo sapiens
gcaagaucccaucucuuu

SEQ ID NO: 1391131 - RNA, 21 nt, Homo sapiens
gcaaggacggccuucaacuga

SEQ ID NO: 1391132 - RNA, 14 nt, Homo sapiens
gcaagucaggacau

SEQ ID NO: 1391133 - RNA, 23 nt, Homo sapiens
gcaaguguaugcacgugugcaca

SEQ ID NO: 1391134 - RNA, 17 nt, Homo sapiens
gcaagugucugugugca

SEQ ID NO: 1391135 - RNA, 19 nt, Homo sapiens
gcaagugucugugugcaag

SEQ ID NO: 1391136 - RNA, 21 nt, Homo sapiens
gcaagugugugcacaugugug

SEQ ID NO: 1391137 - RNA, 18 nt, Homo sapiens
gcaagugugugcaugugu

SEQ ID NO: 1391138 - RNA, 19 nt, Homo sapiens
gcaauaaccucaaagugac

SEQ ID NO: 1391139 - RNA, 20 nt, Homo sapiens
gcaauacugagugugccuca

SEQ ID NO: 1391140 - RNA, 15 nt, Homo sapiens
gcaauaguguguucu

SEQ ID NO: 1391141 - RNA, 23 nt, Homo sapiens
gcaaucaaguccuacaagcuaaa

SEQ ID NO: 1391142 - RNA, 12 nt, Homo sapiens
gcaaugugcuac

SEQ ID NO: 1391143 - RNA, 22 nt, Homo sapiens
gcaauuccgcauuuaauucaug

SEQ ID NO: 1391144 - RNA, 21 nt, Homo sapiens
gcaauugaauuaaauuaggaa

SEQ ID NO: 1391145 - RNA, 14 nt, Homo sapiens
gcaauugacuguca

SEQ ID NO: 1391146 - RNA, 12 nt, Homo sapiens
gcaauugcucau

SEQ ID NO: 1391147 - RNA, 16 nt, Homo sapiens
gcacaaaagccucuca

SEQ ID NO: 1391148 - RNA, 15 nt, Homo sapiens
gcacaauaugggcac

SEQ ID NO: 1391149 - RNA, 18 nt, Homo sapiens
gcacacuccccugcacug

SEQ ID NO: 1391150 - RNA, 20 nt, Homo sapiens
gcacacuuaugggccaagcc

SEQ ID NO: 1391151 - RNA, 18 nt, Homo sapiens
gcacagagagggggccac

SEQ ID NO: 1391152 - RNA, 17 nt, Homo sapiens
gcacaucacaacauuua

SEQ ID NO: 1391153 - RNA, 15 nt, Homo sapiens
gcacauccaggcaau

SEQ ID NO: 1391154 - RNA, 16 nt, Homo sapiens
gcacauccaggcaaug

SEQ ID NO: 1391155 - RNA, 22 nt, Homo sapiens
gcacauuagccuaugugcaugc

SEQ ID NO: 1391156 - RNA, 19 nt, Homo sapiens
gcaccaaaucaucucucau

SEQ ID NO: 1391157 - RNA, 18 nt, Homo sapiens
gcaccaauaaagccuuca

SEQ ID NO: 1391158 - RNA, 13 nt, Homo sapiens
gcaccuaccucac

SEQ ID NO: 1391159 - RNA, 22 nt, Homo sapiens
gcaccuggcuaguuucuaacau

SEQ ID NO: 1391160 - RNA, 16 nt, Homo sapiens
gcaccuguacucagga

SEQ ID NO: 1391161 - RNA, 21 nt, Homo sapiens
gcacuauaauguaagcucuac

SEQ ID NO: 1391162 - RNA, 22 nt, Homo sapiens
gcacucugaguuuaccauuugu

SEQ ID NO: 1391163 - RNA, 20 nt, Homo sapiens
gcacuugcacgcccaugugu

SEQ ID NO: 1391164 - RNA, 17 nt, Homo sapiens
gcagaauugagagugau

SEQ ID NO: 1391165 - RNA, 17 nt, Homo sapiens
gcagaccgccccucacc

SEQ ID NO: 1391166 - RNA, 21 nt, Homo sapiens
gcagacucuacagaggccaug

SEQ ID NO: 1391167 - RNA, 14 nt, Homo sapiens
gcagaggagccaug

SEQ ID NO: 1391168 - RNA, 16 nt, Homo sapiens
gcagaguacuggcuga

SEQ ID NO: 1391169 - RNA, 20 nt, Homo sapiens
gcagaugguggagcugaaua

SEQ ID NO: 1391170 - RNA, 12 nt, Homo sapiens
gcagcacuagcg

SEQ ID NO: 1391171 - RNA, 14 nt, Homo sapiens
gcagcccaugccca

SEQ ID NO: 1391172 - RNA, 23 nt, Homo sapiens
gcagcccaugcccaccugcccau

SEQ ID NO: 1391173 - RNA, 14 nt, Homo sapiens
gcagcuaaaaccua

SEQ ID NO: 1391174 - RNA, 14 nt, Homo sapiens
gcagcugaacagug

SEQ ID NO: 1391175 - RNA, 18 nt, Homo sapiens
gcagcuucucuccacuga

SEQ ID NO: 1391176 - RNA, 21 nt, Homo sapiens
gcaggaagcaacgaagggaaa

SEQ ID NO: 1391177 - RNA, 15 nt, Homo sapiens
gcaggaagugucuag

SEQ ID NO: 1391178 - RNA, 19 nt, Homo sapiens
gcaggaugauuguacagaa

SEQ ID NO: 1391179 - RNA, 22 nt, Homo sapiens
gcaggauuugggcucuuggaau

SEQ ID NO: 1391180 - RNA, 23 nt, Homo sapiens
gcaggcaagugggauaaaggccc

SEQ ID NO: 1391181 - RNA, 18 nt, Homo sapiens
gcagggacaauuugcugc

SEQ ID NO: 1391182 - RNA, 20 nt, Homo sapiens
gcagggccuugcccagagau

SEQ ID NO: 1391183 - RNA, 15 nt, Homo sapiens
gcaggugacagugag

SEQ ID NO: 1391184 - RNA, 21 nt, Homo sapiens
gcagguuaacagcugucuaug

SEQ ID NO: 1391185 - RNA, 23 nt, Homo sapiens
gcagguuggugggggccucggug

SEQ ID NO: 1391186 - RNA, 13 nt, Homo sapiens
gcagucacuugau

SEQ ID NO: 1391187 - RNA, 23 nt, Homo sapiens
gcagucacuuuuccugugcuguu

SEQ ID NO: 1391188 - RNA, 19 nt, Homo sapiens
gcaguccugccucagccuc

SEQ ID NO: 1391189 - RNA, 15 nt, Homo sapiens
gcagugagcugagau

SEQ ID NO: 1391190 - RNA, 17 nt, Homo sapiens
gcagugagcuguguucu

SEQ ID NO: 1391191 - RNA, 19 nt, Homo sapiens
gcagugcuugaaugaaguu

SEQ ID NO: 1391192 - RNA, 13 nt, Homo sapiens
gcaguggaacuaa

SEQ ID NO: 1391193 - RNA, 23 nt, Homo sapiens
gcaguucagcuccuuccaccaca

SEQ ID NO: 1391194 - RNA, 17 nt, Homo sapiens
gcaguuccugucccuuc

SEQ ID NO: 1391195 - RNA, 19 nt, Homo sapiens
gcaguucugggugcucccu

SEQ ID NO: 1391196 - RNA, 18 nt, Homo sapiens
gcauaaguuaacuuccaa

SEQ ID NO: 1391197 - RNA, 21 nt, Homo sapiens
gcauaaguuucugggaccuca

SEQ ID NO: 1391198 - RNA, 16 nt, Homo sapiens
gcauaguauuccauug

SEQ ID NO: 1391199 - RNA, 13 nt, Homo sapiens
gcauaugucuaua

SEQ ID NO: 1391200 - RNA, 12 nt, Homo sapiens
gcaucagaccuu

SEQ ID NO: 1391201 - RNA, 14 nt, Homo sapiens
gcaucagaugaauu

SEQ ID NO: 1391202 - RNA, 13 nt, Homo sapiens
gcaucuccugugc

SEQ ID NO: 1391203 - RNA, 20 nt, Homo sapiens
gcaucugggcaggaugacuu

SEQ ID NO: 1391204 - RNA, 21 nt, Homo sapiens
gcaucugggcaggaugacuuu

SEQ ID NO: 1391205 - RNA, 22 nt, Homo sapiens
gcaucuuccccaacgaaaagca

SEQ ID NO: 1391206 - RNA, 20 nt, Homo sapiens
gcaugagagaauuguaucau

SEQ ID NO: 1391207 - RNA, 11 nt, Homo sapiens
gcaugcacaaa

SEQ ID NO: 1391208 - RNA, 12 nt, Homo sapiens
gcaugcggccca

SEQ ID NO: 1391209 - RNA, 18 nt, Homo sapiens
gcaugggggccucagggc

SEQ ID NO: 1391210 - RNA, 16 nt, Homo sapiens
gcauguguauuuccag

SEQ ID NO: 1391211 - RNA, 22 nt, Homo sapiens
gcauguuuugcccaccagauca

SEQ ID NO: 1391212 - RNA, 22 nt, Homo sapiens
gcauuaucuaugauaugcuaau

SEQ ID NO: 1391213 - RNA, 20 nt, Homo sapiens
cuggaaaggcucagucucag

SEQ ID NO: 1391214 - RNA, 23 nt, Homo sapiens
cuggaaaggcucagucucaggag

SEQ ID NO: 1391215 - RNA, 23 nt, Homo sapiens
cuggaagcauguaggagaaucca

SEQ ID NO: 1391216 - RNA, 12 nt, Homo sapiens
cuggaaguagaa

SEQ ID NO: 1391217 - RNA, 14 nt, Homo sapiens
cuggaauacaugaa

SEQ ID NO: 1391218 - RNA, 15 nt, Homo sapiens
cuggaaucacauucu

SEQ ID NO: 1391219 - RNA, 15 nt, Homo sapiens
cuggaaucucaaaag

SEQ ID NO: 1391220 - RNA, 14 nt, Homo sapiens
cuggaccaaagcug

SEQ ID NO: 1391221 - RNA, 18 nt, Homo sapiens
cuggacugugggacccuc

SEQ ID NO: 1391222 - RNA, 20 nt, Homo sapiens
cuggagaacuagagaaggac

SEQ ID NO: 1391223 - RNA, 17 nt, Homo sapiens
cuggagccccacugccc

SEQ ID NO: 1391224 - RNA, 21 nt, Homo sapiens
cuggagcccgaggcaccagug

SEQ ID NO: 1391225 - RNA, 16 nt, Homo sapiens
cuggaguccuugaccg

SEQ ID NO: 1391226 - RNA, 13 nt, Homo sapiens
cuggagugcagug

SEQ ID NO: 1391227 - RNA, 13 nt, Homo sapiens
cuggauccaucag

SEQ ID NO: 1391228 - RNA, 15 nt, Homo sapiens
cuggaucuaccagca

SEQ ID NO: 1391229 - RNA, 22 nt, Homo sapiens
cuggauuuccuaggcugacuaa

SEQ ID NO: 1391230 - RNA, 16 nt, Homo sapiens
cuggcaagaugcuuua

SEQ ID NO: 1391231 - RNA, 12 nt, Homo sapiens
cuggcacugacu

SEQ ID NO: 1391232 - RNA, 19 nt, Homo sapiens
cuggcagggacgaggacaa

SEQ ID NO: 1391233 - RNA, 19 nt, Homo sapiens
cuggcauuugcaccuaccu

SEQ ID NO: 1391234 - RNA, 16 nt, Homo sapiens
cuggcucagccucaaa

SEQ ID NO: 1391235 - RNA, 19 nt, Homo sapiens
cuuagcagcuaucucucag

SEQ ID NO: 1391236 - RNA, 14 nt, Homo sapiens
cuuagcaugcacaa

SEQ ID NO: 1391237 - RNA, 21 nt, Homo sapiens
cuuagcucacaccugaccaau

SEQ ID NO: 1391238 - RNA, 16 nt, Homo sapiens
cuuagcugucugcuca

SEQ ID NO: 1391239 - RNA, 20 nt, Homo sapiens
cuuaggacuuuccacuccug

SEQ ID NO: 1391240 - RNA, 16 nt, Homo sapiens
cuuaggcaaucacaua

SEQ ID NO: 1391241 - RNA, 17 nt, Homo sapiens
cuuagguuggcaaaaag

SEQ ID NO: 1391242 - RNA, 14 nt, Homo sapiens
cuuauaaaaucaaa

SEQ ID NO: 1391243 - RNA, 17 nt, Homo sapiens
cuuaucaguaguaucaa

SEQ ID NO: 1391244 - RNA, 18 nt, Homo sapiens
cuuaucccagugaucacc

SEQ ID NO: 1391245 - RNA, 23 nt, Homo sapiens
cuuauguuacagguuacaugaga

SEQ ID NO: 1391246 - RNA, 14 nt, Homo sapiens
cuuauuaauuugac

SEQ ID NO: 1391247 - RNA, 20 nt, Homo sapiens
cuuauuaauuugacuagaaa

SEQ ID NO: 1391248 - RNA, 19 nt, Homo sapiens
cuuauuucucaucacauca

SEQ ID NO: 1391249 - RNA, 23 nt, Homo sapiens
cuuauuugggguugcaucagaaa

SEQ ID NO: 1391250 - RNA, 21 nt, Homo sapiens
cuucaaaacggggcagccaaa

SEQ ID NO: 1391251 - RNA, 15 nt, Homo sapiens
cuucaaauauuuccc

SEQ ID NO: 1391252 - RNA, 16 nt, Homo sapiens
cuucaagaacucuggg

SEQ ID NO: 1391253 - RNA, 18 nt, Homo sapiens
cuucaagagccucuggca

SEQ ID NO: 1391254 - RNA, 22 nt, Homo sapiens
cuucaaggcccauaucugugaa

SEQ ID NO: 1391255 - RNA, 19 nt, Homo sapiens
cuucaaguuaaagugaaua

SEQ ID NO: 1391256 - RNA, 16 nt, Homo sapiens
cuucaaucugaagaua

SEQ ID NO: 1391257 - RNA, 17 nt, Homo sapiens
cuucacaccauaacuag

SEQ ID NO: 1391258 - RNA, 20 nt, Homo sapiens
cuucacaccuacccuccuuu

SEQ ID NO: 1391259 - RNA, 13 nt, Homo sapiens
cuucacaguguuu

SEQ ID NO: 1391260 - RNA, 17 nt, Homo sapiens
cuucaccuaagucucug

SEQ ID NO: 1391261 - RNA, 21 nt, Homo sapiens
cuucacgccuccccuuuguga

SEQ ID NO: 1391262 - RNA, 15 nt, Homo sapiens
cuucacucaaucucu

SEQ ID NO: 1391263 - RNA, 17 nt, Homo sapiens
cuucagaagacacugca

SEQ ID NO: 1391264 - RNA, 22 nt, Homo sapiens
cuucagccuagccgaccucagc

SEQ ID NO: 1391265 - RNA, 14 nt, Homo sapiens
cuucaggacacuca

SEQ ID NO: 1391266 - RNA, 22 nt, Homo sapiens
cuucaguauuuuuaaauuguaa

SEQ ID NO: 1391267 - RNA, 15 nt, Homo sapiens
cuucauauaccagca

SEQ ID NO: 1391268 - RNA, 22 nt, Homo sapiens
cuucauguaacuucccugaaaa

SEQ ID NO: 1391269 - RNA, 13 nt, Homo sapiens
cuucauugccuua

SEQ ID NO: 1391270 - RNA, 21 nt, Homo sapiens
cuuccaacugcugccccaaag

SEQ ID NO: 1391271 - RNA, 11 nt, Homo sapiens
cuuccaaggau

SEQ ID NO: 1391272 - RNA, 23 nt, Homo sapiens
cuuccacaccuagcaucucauga

SEQ ID NO: 1391273 - RNA, 13 nt, Homo sapiens
cuuccaccuggaa

SEQ ID NO: 1391274 - RNA, 21 nt, Homo sapiens
cuuccacgcugucuccagacc

SEQ ID NO: 1391275 - RNA, 20 nt, Homo sapiens
cuucccggcgucccuaccuc

SEQ ID NO: 1391276 - RNA, 18 nt, Homo sapiens
cuuccuaucccaucccau

SEQ ID NO: 1391277 - RNA, 14 nt, Homo sapiens
cuuccucacaccag

SEQ ID NO: 1391278 - RNA, 20 nt, Homo sapiens
cuuccuugggaugaucuuga

SEQ ID NO: 1391279 - RNA, 23 nt, Homo sapiens
cuucgauacaccgggccuggaga

SEQ ID NO: 1391280 - RNA, 20 nt, Homo sapiens
cuucuaaaugaagugcaaau

SEQ ID NO: 1391281 - RNA, 20 nt, Homo sapiens
cuucuaaccugaacugaugg

SEQ ID NO: 1391282 - RNA, 16 nt, Homo sapiens
cuucuaccaacuggaa

SEQ ID NO: 1391283 - RNA, 18 nt, Homo sapiens
cuucuauuccauggcuaa

SEQ ID NO: 1391284 - RNA, 14 nt, Homo sapiens
cuucucauagcauu

SEQ ID NO: 1391285 - RNA, 14 nt, Homo sapiens
cuucuccaugagac

SEQ ID NO: 1391286 - RNA, 18 nt, Homo sapiens
cuucucgugacaccacca

SEQ ID NO: 1391287 - RNA, 18 nt, Homo sapiens
cuucucuacagacuucuc

SEQ ID NO: 1391288 - RNA, 13 nt, Homo sapiens
cuucugaccacac

SEQ ID NO: 1391289 - RNA, 17 nt, Homo sapiens
cuucuguccuacucugu

SEQ ID NO: 1391290 - RNA, 21 nt, Homo sapiens
cuucuuaauauaacugccuua

SEQ ID NO: 1391291 - RNA, 14 nt, Homo sapiens
cuucuuacuauuaa

SEQ ID NO: 1391292 - RNA, 13 nt, Homo sapiens
cuucuuacuugau

SEQ ID NO: 1391293 - RNA, 12 nt, Homo sapiens
cuucuuugccca

SEQ ID NO: 1391294 - RNA, 14 nt, Homo sapiens
cuucuuuuacucau

SEQ ID NO: 1391295 - RNA, 15 nt, Homo sapiens
cuugaaaauagaaca

SEQ ID NO: 1391296 - RNA, 22 nt, Homo sapiens
cuugaaacaagcaacagaugga

SEQ ID NO: 1391297 - RNA, 13 nt, Homo sapiens
cuugaaacauaga

SEQ ID NO: 1391298 - RNA, 22 nt, Homo sapiens
cuugaaacauagagaucuaugu

SEQ ID NO: 1391299 - RNA, 15 nt, Homo sapiens
cuugaaaucaagggc

SEQ ID NO: 1391300 - RNA, 13 nt, Homo sapiens
cuugaaaugaugg

SEQ ID NO: 1391301 - RNA, 20 nt, Homo sapiens
cuugaacacaguauuuuccc

SEQ ID NO: 1391302 - RNA, 22 nt, Homo sapiens
cuugaagaaccucucacuucac

SEQ ID NO: 1391303 - RNA, 13 nt, Homo sapiens
cuugaagaacuga

SEQ ID NO: 1391304 - RNA, 20 nt, Homo sapiens
cuugaagauaucuugaaaug

SEQ ID NO: 1391305 - RNA, 12 nt, Homo sapiens
cuugaagccauc

SEQ ID NO: 1391306 - RNA, 23 nt, Homo sapiens
cuugaauggcaugcuaguagcag

SEQ ID NO: 1391307 - RNA, 17 nt, Homo sapiens
cuugacagaacacuguc

SEQ ID NO: 1391308 - RNA, 14 nt, Homo sapiens
cuugacagggcaca

SEQ ID NO: 1391309 - RNA, 24 nt, Homo sapiens
cuugaccagcagaucccagcucac

SEQ ID NO: 1391310 - RNA, 20 nt, Homo sapiens
cuugaccucaggugauccac

SEQ ID NO: 1391311 - RNA, 14 nt, Homo sapiens
cuugacggcauugc

SEQ ID NO: 1391312 - RNA, 20 nt, Homo sapiens
cuugacuauuggaggaccaa

SEQ ID NO: 1391313 - RNA, 21 nt, Homo sapiens
cuugagaaaccuuauuguacc

SEQ ID NO: 1391314 - RNA, 15 nt, Homo sapiens
cuugagcaaauuacc

SEQ ID NO: 1391315 - RNA, 20 nt, Homo sapiens
cuugagccaguaauuggucc

SEQ ID NO: 1391316 - RNA, 15 nt, Homo sapiens
cuugagcgugaaucu

SEQ ID NO: 1391317 - RNA, 18 nt, Homo sapiens
cuugagcuuggcagcuga

SEQ ID NO: 1391318 - RNA, 16 nt, Homo sapiens
cuugaggcaacucauc

SEQ ID NO: 1391319 - RNA, 18 nt, Homo sapiens
cuugaucuguauauacaa

SEQ ID NO: 1391320 - RNA, 20 nt, Homo sapiens
cuugauuagugccuucugcc

SEQ ID NO: 1391321 - RNA, 19 nt, Homo sapiens
cuugcaacacacagacaca

SEQ ID NO: 1391322 - RNA, 14 nt, Homo sapiens
cuugcagcuguaaa

SEQ ID NO: 1391323 - RNA, 20 nt, Homo sapiens
cuacucuagggaaaaaccag

SEQ ID NO: 1391324 - RNA, 16 nt, Homo sapiens
cuacucucaugcugca

SEQ ID NO: 1391325 - RNA, 23 nt, Homo sapiens
cuacucuguuccuucacauccug

SEQ ID NO: 1391326 - RNA, 16 nt, Homo sapiens
cuacugauuguuucau

SEQ ID NO: 1391327 - RNA, 16 nt, Homo sapiens
cuacuucuacauccaa

SEQ ID NO: 1391328 - RNA, 18 nt, Homo sapiens
cuacuucugcccuugcca

SEQ ID NO: 1391329 - RNA, 14 nt, Homo sapiens
cuacuugggagcac

SEQ ID NO: 1391330 - RNA, 19 nt, Homo sapiens
cuacuugggaggcugaggc

SEQ ID NO: 1391331 - RNA, 20 nt, Homo sapiens
cuacuugggaggcugaggca

SEQ ID NO: 1391332 - RNA, 20 nt, Homo sapiens
cuacuuuuucuagcuacaau

SEQ ID NO: 1391333 - RNA, 17 nt, Homo sapiens
cuagaaacugacacaug

SEQ ID NO: 1391334 - RNA, 15 nt, Homo sapiens
cuagaaaucugccaa

SEQ ID NO: 1391335 - RNA, 16 nt, Homo sapiens
cuagaaaucugccaau

SEQ ID NO: 1391336 - RNA, 18 nt, Homo sapiens
cuagaauuucauuuauuu

SEQ ID NO: 1391337 - RNA, 11 nt, Homo sapiens
cgcguauuuca

SEQ ID NO: 1391338 - RNA, 16 nt, Homo sapiens
cgcugacggaggagcu

SEQ ID NO: 1391339 - RNA, 16 nt, Homo sapiens
cgcuggaccuugaacu

SEQ ID NO: 1391340 - RNA, 18 nt, Homo sapiens
cgcuggcugggggccuca

SEQ ID NO: 1391341 - RNA, 23 nt, Homo sapiens
cggagacggagucccaccuuggc

SEQ ID NO: 1391342 - RNA, 16 nt, Homo sapiens
cggagaucuccuugcc

SEQ ID NO: 1391343 - RNA, 19 nt, Homo sapiens
cggagcccugucuccucuc

SEQ ID NO: 1391344 - RNA, 13 nt, Homo sapiens
cggcaagaaggaa

SEQ ID NO: 1391345 - RNA, 13 nt, Homo sapiens
cggccaaccuccc

SEQ ID NO: 1391346 - RNA, 21 nt, Homo sapiens
cggccccugcugguucagggu

SEQ ID NO: 1391347 - RNA, 21 nt, Homo sapiens
cggcugagucaugaucucccu

SEQ ID NO: 1391348 - RNA, 21 nt, Homo sapiens
cgggagaagaaguuugaccau

SEQ ID NO: 1391349 - RNA, 22 nt, Homo sapiens
cgggaggauguucugggacaca

SEQ ID NO: 1391350 - RNA, 19 nt, Homo sapiens
cgggcacucagaagacacu

SEQ ID NO: 1391351 - RNA, 23 nt, Homo sapiens
cacauuaucgggagcagugucuu

SEQ ID NO: 1391352 - RNA, 23 nt, Homo sapiens
caccaaaucagcugcuacuacuc

SEQ ID NO: 1391353 - RNA, 16 nt, Homo sapiens
caccaauaaagccuuc

SEQ ID NO: 1391354 - RNA, 13 nt, Homo sapiens
caccaccccagcu

SEQ ID NO: 1391355 - RNA, 21 nt, Homo sapiens
caccagaggucagguguucaa

SEQ ID NO: 1391356 - RNA, 14 nt, Homo sapiens
caccaggcccacag

SEQ ID NO: 1391357 - RNA, 15 nt, Homo sapiens
caccaggucagggag

SEQ ID NO: 1391358 - RNA, 23 nt, Homo sapiens
caccaggucucccgggaagccac

SEQ ID NO: 1391359 - RNA, 19 nt, Homo sapiens
caccaguguguggcuuuca

SEQ ID NO: 1391360 - RNA, 18 nt, Homo sapiens
caccauucgucaucacuc

SEQ ID NO: 1391361 - RNA, 14 nt, Homo sapiens
caccauugcugcuc

SEQ ID NO: 1391362 - RNA, 14 nt, Homo sapiens
cacccaaugcauau

SEQ ID NO: 1391363 - RNA, 13 nt, Homo sapiens
cacccaugcaccu

SEQ ID NO: 1391364 - RNA, 23 nt, Homo sapiens
cacccccuucucugcccauuccc

SEQ ID NO: 1391365 - RNA, 20 nt, Homo sapiens
cacccccuucucugcuccac

SEQ ID NO: 1391366 - RNA, 13 nt, Homo sapiens
caccccugcaguu

SEQ ID NO: 1391367 - RNA, 15 nt, Homo sapiens
cacccugaaagcccu

SEQ ID NO: 1391368 - RNA, 23 nt, Homo sapiens
cacccuggaaucaagaugucaga

SEQ ID NO: 1391369 - RNA, 21 nt, Homo sapiens
cacccuggaggauuucaucuc

SEQ ID NO: 1391370 - RNA, 21 nt, Homo sapiens
cacccuuccccuccuucuccc

SEQ ID NO: 1391371 - RNA, 21 nt, Homo sapiens
caccgaccccaccaccugguu

SEQ ID NO: 1391372 - RNA, 20 nt, Homo sapiens
caccgagaauguuguauuca

SEQ ID NO: 1391373 - RNA, 18 nt, Homo sapiens
caccgcugccagcacaga

SEQ ID NO: 1391374 - RNA, 19 nt, Homo sapiens
caccuaagucucugugaau

SEQ ID NO: 1391375 - RNA, 21 nt, Homo sapiens
caccuaauguuuaugagccag

SEQ ID NO: 1391376 - RNA, 22 nt, Homo sapiens
caccuaauguuuaugagccaga

SEQ ID NO: 1391377 - RNA, 23 nt, Homo sapiens
caccuagcaucucaugagugcca

SEQ ID NO: 1391378 - RNA, 18 nt, Homo sapiens
caccuauaaaacagguca

SEQ ID NO: 1391379 - RNA, 13 nt, Homo sapiens
caccuccauuugc

SEQ ID NO: 1391380 - RNA, 16 nt, Homo sapiens
caccuccugcaauaaa

SEQ ID NO: 1391381 - RNA, 16 nt, Homo sapiens
caccugggcugaggca

SEQ ID NO: 1391382 - RNA, 14 nt, Homo sapiens
caccuguaauccca

SEQ ID NO: 1391383 - RNA, 14 nt, Homo sapiens
caccugugaguuua

SEQ ID NO: 1391384 - RNA, 14 nt, Homo sapiens
caccuucuucagcc

SEQ ID NO: 1391385 - RNA, 14 nt, Homo sapiens
caccuugacagggc

SEQ ID NO: 1391386 - RNA, 13 nt, Homo sapiens
caccuugucacau

SEQ ID NO: 1391387 - RNA, 12 nt, Homo sapiens
cacgagaucaag

SEQ ID NO: 1391388 - RNA, 13 nt, Homo sapiens
cacgccuguaauc

SEQ ID NO: 1391389 - RNA, 22 nt, Homo sapiens
cacgccuguaaucccagcacuu

SEQ ID NO: 1391390 - RNA, 15 nt, Homo sapiens
cacgccugugcagug

SEQ ID NO: 1391391 - RNA, 14 nt, Homo sapiens
cacgcgguacaaag

SEQ ID NO: 1391392 - RNA, 13 nt, Homo sapiens
cacgcgugcacac

SEQ ID NO: 1391393 - RNA, 18 nt, Homo sapiens
cacguacacacacauaca

SEQ ID NO: 1391394 - RNA, 12 nt, Homo sapiens
cacgucugcuaa

SEQ ID NO: 1391395 - RNA, 18 nt, Homo sapiens
cacgucuggcuucacaga

SEQ ID NO: 1391396 - RNA, 19 nt, Homo sapiens
cacguggaggaaugcuccc

SEQ ID NO: 1391397 - RNA, 17 nt, Homo sapiens
cacguggcagaccguga

SEQ ID NO: 1391398 - RNA, 20 nt, Homo sapiens
cacgugggcaaacaggcagu

SEQ ID NO: 1391399 - RNA, 18 nt, Homo sapiens
cacgugugcacacacacc

SEQ ID NO: 1391400 - RNA, 22 nt, Homo sapiens
cacguuacuagcagucacuuga

SEQ ID NO: 1391401 - RNA, 16 nt, Homo sapiens
cacuaaaagaucgcag

SEQ ID NO: 1391402 - RNA, 19 nt, Homo sapiens
cacuacacuccagccugag

SEQ ID NO: 1391403 - RNA, 21 nt, Homo sapiens
cacuacucccucaaagcacac

SEQ ID NO: 1391404 - RNA, 19 nt, Homo sapiens
cacuauagccuaggugaca

SEQ ID NO: 1391405 - RNA, 12 nt, Homo sapiens
cacuaugcugcu

SEQ ID NO: 1391406 - RNA, 19 nt, Homo sapiens
cacuauucuuaacuauuca

SEQ ID NO: 1391407 - RNA, 14 nt, Homo sapiens
cacuauuuacauac

SEQ ID NO: 1391408 - RNA, 21 nt, Homo sapiens
cacucaggccaacaagccaac

SEQ ID NO: 1391409 - RNA, 22 nt, Homo sapiens
cacuccuuccugccaccugcug

SEQ ID NO: 1391410 - RNA, 14 nt, Homo sapiens
cacucugaaacuga

SEQ ID NO: 1391411 - RNA, 20 nt, Homo sapiens
cacugaauuuuguguguacc

SEQ ID NO: 1391412 - RNA, 21 nt, Homo sapiens
cacugacuauuacaguugcau

SEQ ID NO: 1391413 - RNA, 16 nt, Homo sapiens
cacugacuccugugga

SEQ ID NO: 1391414 - RNA, 22 nt, Homo sapiens
cacugagaagucaaacauuuca

SEQ ID NO: 1391415 - RNA, 18 nt, Homo sapiens
cacugaugggcaaccccc

SEQ ID NO: 1391416 - RNA, 23 nt, Homo sapiens
cacugaugguauaucaguaucug

SEQ ID NO: 1391417 - RNA, 19 nt, Homo sapiens
cacugcacuauagccuagg

SEQ ID NO: 1391418 - RNA, 13 nt, Homo sapiens
cacugcauacaau

SEQ ID NO: 1391419 - RNA, 13 nt, Homo sapiens
cacugcauaccaa

SEQ ID NO: 1391420 - RNA, 19 nt, Homo sapiens
cacugcauaccaaccuggg

SEQ ID NO: 1391421 - RNA, 21 nt, Homo sapiens
cacugccaaagaacuuggaaa

SEQ ID NO: 1391422 - RNA, 17 nt, Homo sapiens
cacugcccgagcuggug

SEQ ID NO: 1391423 - RNA, 18 nt, Homo sapiens
cacugccgagaacagcau

SEQ ID NO: 1391424 - RNA, 22 nt, Homo sapiens
cacugccucucccuggcccuca

SEQ ID NO: 1391425 - RNA, 20 nt, Homo sapiens
cacugcugcuccagugcagg

SEQ ID NO: 1391426 - RNA, 14 nt, Homo sapiens
cacugggcuucuag

SEQ ID NO: 1391427 - RNA, 13 nt, Homo sapiens
cacuggguugacu

SEQ ID NO: 1391428 - RNA, 20 nt, Homo sapiens
cacuguacauuuuuauacag

SEQ ID NO: 1391429 - RNA, 15 nt, Homo sapiens
cacuguacucugcac

SEQ ID NO: 1391430 - RNA, 15 nt, Homo sapiens
cacuguauguuuacu

SEQ ID NO: 1391431 - RNA, 17 nt, Homo sapiens
cacuguugcccaggcug

SEQ ID NO: 1391432 - RNA, 17 nt, Homo sapiens
cacuuaagacuguguau

SEQ ID NO: 1391433 - RNA, 18 nt, Homo sapiens
cacuuacacuuuaugcac

SEQ ID NO: 1391434 - RNA, 14 nt, Homo sapiens
cacuuccauaguga

SEQ ID NO: 1391435 - RNA, 17 nt, Homo sapiens
cacuuccuguccagaga

SEQ ID NO: 1391436 - RNA, 16 nt, Homo sapiens
caagaggagacuuuaa

SEQ ID NO: 1391437 - RNA, 19 nt, Homo sapiens
caagauaucagcccaaaag

SEQ ID NO: 1391438 - RNA, 16 nt, Homo sapiens
caagaucuuucaggaa

SEQ ID NO: 1391439 - RNA, 19 nt, Homo sapiens
caagcacagugccugcaug

SEQ ID NO: 1391440 - RNA, 18 nt, Homo sapiens
caagccugugauuguguu

SEQ ID NO: 1391441 - RNA, 22 nt, Homo sapiens
caagcuaaaauuagaugaacuc

SEQ ID NO: 1391442 - RNA, 18 nt, Homo sapiens
caagcuaauaaaauauca

SEQ ID NO: 1391443 - RNA, 19 nt, Homo sapiens
caagcuccuggucuugaga

SEQ ID NO: 1391444 - RNA, 11 nt, Homo sapiens
caagcucugcu

SEQ ID NO: 1391445 - RNA, 16 nt, Homo sapiens
caagcuggacuauggc

SEQ ID NO: 1391446 - RNA, 21 nt, Homo sapiens
caagcuggucccacucagucc

SEQ ID NO: 1391447 - RNA, 20 nt, Homo sapiens
caaggaaagccccagcacua

SEQ ID NO: 1391448 - RNA, 21 nt, Homo sapiens
caaggcaaagacuauucccuu

SEQ ID NO: 1391449 - RNA, 14 nt, Homo sapiens
caaggcugcaguga

SEQ ID NO: 1391450 - RNA, 19 nt, Homo sapiens
caaggcuuuauauuuuuaa

SEQ ID NO: 1391451 - RNA, 15 nt, Homo sapiens
caaggucauuugcua

SEQ ID NO: 1391452 - RNA, 21 nt, Homo sapiens
caagguggaguggaugccuca

SEQ ID NO: 1391453 - RNA, 21 nt, Homo sapiens
caaguaagaaagugaagcaaa

SEQ ID NO: 1391454 - RNA, 14 nt, Homo sapiens
caagucacaaagga

SEQ ID NO: 1391455 - RNA, 17 nt, Homo sapiens
caagucaccggagcuuu

SEQ ID NO: 1391456 - RNA, 12 nt, Homo sapiens
caagucaccucc

SEQ ID NO: 1391457 - RNA, 21 nt, Homo sapiens
caagucaggacaucagucuga

SEQ ID NO: 1391458 - RNA, 21 nt, Homo sapiens
caagucaggcccuuauuuuca

SEQ ID NO: 1391459 - RNA, 17 nt, Homo sapiens
caaguccuuaccucuuc

SEQ ID NO: 1391460 - RNA, 19 nt, Homo sapiens
caagucuugaaacaagcaa

SEQ ID NO: 1391461 - RNA, 14 nt, Homo sapiens
caagugaaggagcu

SEQ ID NO: 1391462 - RNA, 15 nt, Homo sapiens
caagugaaggagcug

SEQ ID NO: 1391463 - RNA, 12 nt, Homo sapiens
caagugagcaaa

SEQ ID NO: 1391464 - RNA, 22 nt, Homo sapiens
caagugauccuccugccucagc

SEQ ID NO: 1391465 - RNA, 15 nt, Homo sapiens
caagugccuuagcaa

SEQ ID NO: 1391466 - RNA, 12 nt, Homo sapiens
caaguggcaugu

SEQ ID NO: 1391467 - RNA, 19 nt, Homo sapiens
caaguggcaugugcuguga

SEQ ID NO: 1391468 - RNA, 18 nt, Homo sapiens
caaguguagguaucauuu

SEQ ID NO: 1391469 - RNA, 22 nt, Homo sapiens
caaguguaugcacgugugcaca

SEQ ID NO: 1391470 - RNA, 15 nt, Homo sapiens
caagugucucagucc

SEQ ID NO: 1391471 - RNA, 21 nt, Homo sapiens
caagugucucaguccaccuga

SEQ ID NO: 1391472 - RNA, 24 nt, Homo sapiens
caaguguguaugugcgugugugca

SEQ ID NO: 1391473 - RNA, 16 nt, Homo sapiens
caagugugugcaugug

SEQ ID NO: 1391474 - RNA, 22 nt, Homo sapiens
caagugugugcaugugugcgag

SEQ ID NO: 1391475 - RNA, 13 nt, Homo sapiens
caaguuacaguga

SEQ ID NO: 1391476 - RNA, 17 nt, Homo sapiens
caaguugcacacucacu

SEQ ID NO: 1391477 - RNA, 20 nt, Homo sapiens
caaguuggcuucuaaucaaa

SEQ ID NO: 1391478 - RNA, 16 nt, Homo sapiens
caauaaaaccacugua

SEQ ID NO: 1391479 - RNA, 13 nt, Homo sapiens
caauaaagccuuc

SEQ ID NO: 1391480 - RNA, 19 nt, Homo sapiens
caauaaagccuucaaacuc

SEQ ID NO: 1391481 - RNA, 13 nt, Homo sapiens
caauaacagguca

SEQ ID NO: 1391482 - RNA, 18 nt, Homo sapiens
caauaacuacuguguucc

SEQ ID NO: 1391483 - RNA, 14 nt, Homo sapiens
caauagagacugua

SEQ ID NO: 1391484 - RNA, 15 nt, Homo sapiens
caaucacauagugaa

SEQ ID NO: 1391485 - RNA, 23 nt, Homo sapiens
caaucaguagccagcaucugccu

SEQ ID NO: 1391486 - RNA, 18 nt, Homo sapiens
caauccagcgguucucaa

SEQ ID NO: 1391487 - RNA, 15 nt, Homo sapiens
caauccaucucucaa

SEQ ID NO: 1391488 - RNA, 15 nt, Homo sapiens
caauccuugaccuca

SEQ ID NO: 1391489 - RNA, 22 nt, Homo sapiens
caaucuggggauacuggcaaag

SEQ ID NO: 1391490 - RNA, 17 nt, Homo sapiens
caaugaccacauccuga

SEQ ID NO: 1391491 - RNA, 17 nt, Homo sapiens
caaugauuuacucaaua

SEQ ID NO: 1391492 - RNA, 22 nt, Homo sapiens
caaugcagugccuuucuucucu

SEQ ID NO: 1391493 - RNA, 14 nt, Homo sapiens
caaugcauugcuaa

SEQ ID NO: 1391494 - RNA, 23 nt, Homo sapiens
caaugccccuggaucuaccagca

SEQ ID NO: 1391495 - RNA, 23 nt, Homo sapiens
caaugcuauaacuauguugauaa

SEQ ID NO: 1391496 - RNA, 17 nt, Homo sapiens
caauggaagauuugccc

SEQ ID NO: 1391497 - RNA, 14 nt, Homo sapiens
caauguagucucau

SEQ ID NO: 1391498 - RNA, 20 nt, Homo sapiens
caaugucacaaccucucuga

SEQ ID NO: 1391499 - RNA, 13 nt, Homo sapiens
caaugucacuuaa

SEQ ID NO: 1391500 - RNA, 16 nt, Homo sapiens
caauuaguaacauuca

SEQ ID NO: 1391501 - RNA, 17 nt, Homo sapiens
caauucacuagaccaga

SEQ ID NO: 1391502 - RNA, 14 nt, Homo sapiens
caauucauccucac

SEQ ID NO: 1391503 - RNA, 20 nt, Homo sapiens
caauuccaaaggaaucucca

SEQ ID NO: 1391504 - RNA, 13 nt, Homo sapiens
caauucuucuucc

SEQ ID NO: 1391505 - RNA, 14 nt, Homo sapiens
caauugcucaugca

SEQ ID NO: 1391506 - RNA, 12 nt, Homo sapiens
caauuugcacuu

SEQ ID NO: 1391507 - RNA, 20 nt, Homo sapiens
caauuuguucagucuuucau

SEQ ID NO: 1391508 - RNA, 23 nt, Homo sapiens
caauuuucuuuuuuauacucaau

SEQ ID NO: 1391509 - RNA, 15 nt, Homo sapiens
caauuuuguugcauc

SEQ ID NO: 1391510 - RNA, 12 nt, Homo sapiens
cacaaaacagaa

SEQ ID NO: 1391511 - RNA, 18 nt, Homo sapiens
cacaaagcccuuccaugu

SEQ ID NO: 1391512 - RNA, 17 nt, Homo sapiens
cacaacaaaaauuugaa

SEQ ID NO: 1391513 - RNA, 17 nt, Homo sapiens
cacaacauuuacuuaac

SEQ ID NO: 1391514 - RNA, 14 nt, Homo sapiens
cacaacccaagaau

SEQ ID NO: 1391515 - RNA, 15 nt, Homo sapiens
cacaaggcugaccaa

SEQ ID NO: 1391516 - RNA, 14 nt, Homo sapiens
cacaauaaauguau

SEQ ID NO: 1391517 - RNA, 20 nt, Homo sapiens
cacaauagcaguugaaacaa

SEQ ID NO: 1391518 - RNA, 16 nt, Homo sapiens
cacaauguuauuaccu

SEQ ID NO: 1391519 - RNA, 15 nt, Homo sapiens
cacacacaccacaca

SEQ ID NO: 1391520 - RNA, 15 nt, Homo sapiens
cacacaccacacaua

SEQ ID NO: 1391521 - RNA, 22 nt, Homo sapiens
cacaccuuauauuuacguauga

SEQ ID NO: 1391522 - RNA, 18 nt, Homo sapiens
aggcacccauccuagaga

SEQ ID NO: 1391523 - RNA, 23 nt, Homo sapiens
aggcagaauccuacaacuuccac

SEQ ID NO: 1391524 - RNA, 14 nt, Homo sapiens
aggcagagaaucau

SEQ ID NO: 1391525 - RNA, 21 nt, Homo sapiens
aggcagagauagaaccuggag

SEQ ID NO: 1391526 - RNA, 23 nt, Homo sapiens
aggcagaucugugccccaugccu

SEQ ID NO: 1391527 - RNA, 15 nt, Homo sapiens
aggcagcaaacagau

SEQ ID NO: 1391528 - RNA, 20 nt, Homo sapiens
aggcagcuuuuucucuccca

SEQ ID NO: 1391529 - RNA, 16 nt, Homo sapiens
aggcaggugacaguga

SEQ ID NO: 1391530 - RNA, 19 nt, Homo sapiens
aggcauaagaaaacuaaga

SEQ ID NO: 1391531 - RNA, 15 nt, Homo sapiens
aggcauacugacacu

SEQ ID NO: 1391532 - RNA, 21 nt, Homo sapiens
aggcaucauuccaccauggcu

SEQ ID NO: 1391533 - RNA, 20 nt, Homo sapiens
aggcaugugccaucauaccc

SEQ ID NO: 1391534 - RNA, 15 nt, Homo sapiens
aggcauucucugaag

SEQ ID NO: 1391535 - RNA, 19 nt, Homo sapiens
aggccaggauggcacuguu

SEQ ID NO: 1391536 - RNA, 22 nt, Homo sapiens
aggccagugugccgaccucucu

SEQ ID NO: 1391537 - RNA, 19 nt, Homo sapiens
aggcccagggaggugaccc

SEQ ID NO: 1391538 - RNA, 19 nt, Homo sapiens
aggcccuuauuuucaagaa

SEQ ID NO: 1391539 - RNA, 18 nt, Homo sapiens
aggccgagaagcaagaaa

SEQ ID NO: 1391540 - RNA, 22 nt, Homo sapiens
aggccuauaaccccagcucccu

SEQ ID NO: 1391541 - RNA, 23 nt, Homo sapiens
aggccuggccagaugcaccagcc

SEQ ID NO: 1391542 - RNA, 16 nt, Homo sapiens
aggccugugauuauuc

SEQ ID NO: 1391543 - RNA, 15 nt, Homo sapiens
aggccuguugcuuuu

SEQ ID NO: 1391544 - RNA, 18 nt, Homo sapiens
aggcggagcuugcaguga

SEQ ID NO: 1391545 - RNA, 18 nt, Homo sapiens
aggcggguggaucaccug

SEQ ID NO: 1391546 - RNA, 15 nt, Homo sapiens
aggcuaaggcaggaa

SEQ ID NO: 1391547 - RNA, 17 nt, Homo sapiens
aggcucaggccauggcu

SEQ ID NO: 1391548 - RNA, 22 nt, Homo sapiens
aggcucugcccugcccuagcuc

SEQ ID NO: 1391549 - RNA, 14 nt, Homo sapiens
aggcugacuaagaa

SEQ ID NO: 1391550 - RNA, 18 nt, Homo sapiens
aggcugaggcaggaggau

SEQ ID NO: 1391551 - RNA, 12 nt, Homo sapiens
aggcugcaguga

SEQ ID NO: 1391552 - RNA, 16 nt, Homo sapiens
aggcugcucagggcug

SEQ ID NO: 1391553 - RNA, 18 nt, Homo sapiens
aggcugcuggacacgucg

SEQ ID NO: 1391554 - RNA, 21 nt, Homo sapiens
aggcuggagugcaguggugcu

SEQ ID NO: 1391555 - RNA, 14 nt, Homo sapiens
aggcuggcagauuu

SEQ ID NO: 1391556 - RNA, 21 nt, Homo sapiens
auucccacagcacuaauucaa

SEQ ID NO: 1391557 - RNA, 17 nt, Homo sapiens
auucccauuuugcaaaa

SEQ ID NO: 1391558 - RNA, 14 nt, Homo sapiens
auucccuguacaau

SEQ ID NO: 1391559 - RNA, 14 nt, Homo sapiens
auuccgcaccaaua

SEQ ID NO: 1391560 - RNA, 17 nt, Homo sapiens
auucgcugugucagcau

SEQ ID NO: 1391561 - RNA, 17 nt, Homo sapiens
auucgugacaacaugcg

SEQ ID NO: 1391562 - RNA, 17 nt, Homo sapiens
auucuacguaucugcua

SEQ ID NO: 1391563 - RNA, 16 nt, Homo sapiens
auucuaguuuugucaa

SEQ ID NO: 1391564 - RNA, 19 nt, Homo sapiens
auucucaagccgcauccca

SEQ ID NO: 1391565 - RNA, 15 nt, Homo sapiens
auucuccugccucag

SEQ ID NO: 1391566 - RNA, 21 nt, Homo sapiens
auucucucaggcuugcugcca

SEQ ID NO: 1391567 - RNA, 22 nt, Homo sapiens
auucucugugguauccaagaau

SEQ ID NO: 1391568 - RNA, 23 nt, Homo sapiens
auucucuguuugucuguugugga

SEQ ID NO: 1391569 - RNA, 11 nt, Homo sapiens
auucugaccau

SEQ ID NO: 1391570 - RNA, 22 nt, Homo sapiens
auucuggaaaagcaaaacugua

SEQ ID NO: 1391571 - RNA, 14 nt, Homo sapiens
auucugguuuauuu

SEQ ID NO: 1391572 - RNA, 15 nt, Homo sapiens
auucuguaguuucac

SEQ ID NO: 1391573 - RNA, 22 nt, Homo sapiens
auucuuaaaauauauuucagau

SEQ ID NO: 1391574 - RNA, 13 nt, Homo sapiens
auucuucugcuuc

SEQ ID NO: 1391575 - RNA, 13 nt, Homo sapiens
auucuucuuccaa

SEQ ID NO: 1391576 - RNA, 15 nt, Homo sapiens
auucuugacauucac

SEQ ID NO: 1391577 - RNA, 15 nt, Homo sapiens
auucuugaguucugg

SEQ ID NO: 1391578 - RNA, 21 nt, Homo sapiens
auucuugcuaugaaaaguuuc

SEQ ID NO: 1391579 - RNA, 21 nt, Homo sapiens
auucuuggguguuuauccuau

SEQ ID NO: 1391580 - RNA, 20 nt, Homo sapiens
auucuuuaaauuucaucuca

SEQ ID NO: 1391581 - RNA, 21 nt, Homo sapiens
auugaaaggcauucucugaag

SEQ ID NO: 1391582 - RNA, 22 nt, Homo sapiens
auugaaugaugugauacaaauu

SEQ ID NO: 1391583 - RNA, 22 nt, Homo sapiens
auugaccaagaacugcauggac

SEQ ID NO: 1391584 - RNA, 19 nt, Homo sapiens
auugagaaagaaacuaaua

SEQ ID NO: 1391585 - RNA, 14 nt, Homo sapiens
auugagacuauuua

SEQ ID NO: 1391586 - RNA, 18 nt, Homo sapiens
auugauagucaauaucaa

SEQ ID NO: 1391587 - RNA, 20 nt, Homo sapiens
auugauauugaaugauguga

SEQ ID NO: 1391588 - RNA, 21 nt, Homo sapiens
auugcacgggagaauauacaa

SEQ ID NO: 1391589 - RNA, 16 nt, Homo sapiens
auugcaugcugcuuua

SEQ ID NO: 1391590 - RNA, 14 nt, Homo sapiens
auugcuaugaauga

SEQ ID NO: 1391591 - RNA, 22 nt, Homo sapiens
auugcuaugaaugauacccuga

SEQ ID NO: 1391592 - RNA, 20 nt, Homo sapiens
auugcuguguccaacuccag

SEQ ID NO: 1391593 - RNA, 12 nt, Homo sapiens
auugcuugcaca

SEQ ID NO: 1391594 - RNA, 13 nt, Homo sapiens
auugcuuuacugg

SEQ ID NO: 1391595 - RNA, 16 nt, Homo sapiens
auuggaaaguacuccc

SEQ ID NO: 1391596 - RNA, 19 nt, Homo sapiens
auuggaccagucagcacag

SEQ ID NO: 1391597 - RNA, 19 nt, Homo sapiens
auuggaccauccuauuuaa

SEQ ID NO: 1391598 - RNA, 14 nt, Homo sapiens
auuggagcagggac

SEQ ID NO: 1391599 - RNA, 17 nt, Homo sapiens
auuggaggaccaaaaaa

SEQ ID NO: 1391600 - RNA, 21 nt, Homo sapiens
auugguccgaucuuugacucu

SEQ ID NO: 1391601 - RNA, 19 nt, Homo sapiens
auugucagcuacuaaugau

SEQ ID NO: 1391602 - RNA, 18 nt, Homo sapiens
auugucuguaaugacaaa

SEQ ID NO: 1391603 - RNA, 19 nt, Homo sapiens
auugugcacauacuugaga

SEQ ID NO: 1391604 - RNA, 23 nt, Homo sapiens
auugugccgagaaaagcauuuua

SEQ ID NO: 1391605 - RNA, 20 nt, Homo sapiens
auugugugaguguaccauaa

SEQ ID NO: 1391606 - RNA, 20 nt, Homo sapiens
auuguguuaggacagcauau

SEQ ID NO: 1391607 - RNA, 15 nt, Homo sapiens
auuguuaauuaucua

SEQ ID NO: 1391608 - RNA, 15 nt, Homo sapiens
auuguuccaagacau

SEQ ID NO: 1391609 - RNA, 23 nt, Homo sapiens
auuguuugaacccgggaggcaga

SEQ ID NO: 1391610 - RNA, 14 nt, Homo sapiens
auuguuuucagugu

SEQ ID NO: 1391611 - RNA, 22 nt, Homo sapiens
auuguuuuuuaucuuuucuaca

SEQ ID NO: 1391612 - RNA, 18 nt, Homo sapiens
auuuacagccucacuuga

SEQ ID NO: 1391613 - RNA, 20 nt, Homo sapiens
auuuacagccucacuugaau

SEQ ID NO: 1391614 - RNA, 20 nt, Homo sapiens
auuuacauacucugcuuaga

SEQ ID NO: 1391615 - RNA, 13 nt, Homo sapiens
auuuagcacaaaa

SEQ ID NO: 1391616 - RNA, 13 nt, Homo sapiens
auuuagcacauac

SEQ ID NO: 1391617 - RNA, 22 nt, Homo sapiens
auuuauaguguugcuuuccuug

SEQ ID NO: 1391618 - RNA, 17 nt, Homo sapiens
auuuaucacacaaagca

SEQ ID NO: 1391619 - RNA, 12 nt, Homo sapiens
auuuaugaaggc

SEQ ID NO: 1391620 - RNA, 20 nt, Homo sapiens
auuuauggucaacacuuaag

SEQ ID NO: 1391621 - RNA, 22 nt, Homo sapiens
auuuaugugaguguguguuugu

SEQ ID NO: 1391622 - RNA, 13 nt, Homo sapiens
auuuauguuuauu

SEQ ID NO: 1391623 - RNA, 14 nt, Homo sapiens
auuuauuauuucaa

SEQ ID NO: 1391624 - RNA, 18 nt, Homo sapiens
auuuauugcuguguaaca

SEQ ID NO: 1391625 - RNA, 15 nt, Homo sapiens
auuuauuuaagcuua

SEQ ID NO: 1391626 - RNA, 20 nt, Homo sapiens
auuuauuuacaacucaaaaa

SEQ ID NO: 1391627 - RNA, 19 nt, Homo sapiens
auuucaaaauauacauuca

SEQ ID NO: 1391628 - RNA, 22 nt, Homo sapiens
auuucagauaaacaacaaauaa

SEQ ID NO: 1391629 - RNA, 12 nt, Homo sapiens
auuucaggcaua

SEQ ID NO: 1391630 - RNA, 17 nt, Homo sapiens
auuucagugcugcugaa

SEQ ID NO: 1391631 - RNA, 20 nt, Homo sapiens
auuucaugauuucauuucaa

SEQ ID NO: 1391632 - RNA, 13 nt, Homo sapiens
auuuccacaaaau

SEQ ID NO: 1391633 - RNA, 16 nt, Homo sapiens
auuuccuaaugucaga

SEQ ID NO: 1391634 - RNA, 22 nt, Homo sapiens
auuuccuaaugucagaguagaa

SEQ ID NO: 1391635 - RNA, 23 nt, Homo sapiens
auuuccuaucauuuuauuaucac

SEQ ID NO: 1391636 - RNA, 13 nt, Homo sapiens
auuuccugacaga

SEQ ID NO: 1391637 - RNA, 21 nt, Homo sapiens
auuuccugacagaaggacuca

SEQ ID NO: 1391638 - RNA, 23 nt, Homo sapiens
auuuccugugucuuuuuucacua

SEQ ID NO: 1391639 - RNA, 21 nt, Homo sapiens
auuucuaucccaaacuaagcu

SEQ ID NO: 1391640 - RNA, 13 nt, Homo sapiens
agacgugaugaag

SEQ ID NO: 1391641 - RNA, 15 nt, Homo sapiens
agacuagauugccuu

SEQ ID NO: 1391642 - RNA, 17 nt, Homo sapiens
agacucauacagaaggu

SEQ ID NO: 1391643 - RNA, 16 nt, Homo sapiens
agacucccaagcugga

SEQ ID NO: 1391644 - RNA, 17 nt, Homo sapiens
agacuccgucucaagga

SEQ ID NO: 1391645 - RNA, 13 nt, Homo sapiens
agacugagcucaa

SEQ ID NO: 1391646 - RNA, 16 nt, Homo sapiens
agacugagcucaaggu

SEQ ID NO: 1391647 - RNA, 18 nt, Homo sapiens
agacuggauucgugacaa

SEQ ID NO: 1391648 - RNA, 21 nt, Homo sapiens
agacugggucucgcuuuguug

SEQ ID NO: 1391649 - RNA, 21 nt, Homo sapiens
agacugguugaguucagguag

SEQ ID NO: 1391650 - RNA, 23 nt, Homo sapiens
agacuugcuuuucuaacuaagag

SEQ ID NO: 1391651 - RNA, 13 nt, Homo sapiens
agagaaaguguga

SEQ ID NO: 1391652 - RNA, 12 nt, Homo sapiens
agagaaccauga

SEQ ID NO: 1391653 - RNA, 13 nt, Homo sapiens
agagaacuggagg

SEQ ID NO: 1391654 - RNA, 14 nt, Homo sapiens
agagaaugccauuc

SEQ ID NO: 1391655 - RNA, 12 nt, Homo sapiens
agagacaucaaa

SEQ ID NO: 1391656 - RNA, 16 nt, Homo sapiens
agagacgcagacaugu

SEQ ID NO: 1391657 - RNA, 19 nt, Homo sapiens
agagacugaaaacuugccg

SEQ ID NO: 1391658 - RNA, 12 nt, Homo sapiens
agagacuguaga

SEQ ID NO: 1391659 - RNA, 14 nt, Homo sapiens
agagagaagugccc

SEQ ID NO: 1391660 - RNA, 19 nt, Homo sapiens
agagagccuggugcugcug

SEQ ID NO: 1391661 - RNA, 23 nt, Homo sapiens
agagaggagguaguuaagggaug

SEQ ID NO: 1391662 - RNA, 20 nt, Homo sapiens
agagaguaucugaggcacau

SEQ ID NO: 1391663 - RNA, 23 nt, Homo sapiens
agagagucgcaucucagugcagg

SEQ ID NO: 1391664 - RNA, 15 nt, Homo sapiens
agagaucuauguacu

SEQ ID NO: 1391665 - RNA, 20 nt, Homo sapiens
agagcaagacucugucucaa

SEQ ID NO: 1391666 - RNA, 13 nt, Homo sapiens
agagcacacugua

SEQ ID NO: 1391667 - RNA, 19 nt, Homo sapiens
agagcacacuguagcauua

SEQ ID NO: 1391668 - RNA, 22 nt, Homo sapiens
agagcaguuugguuucuagcau

SEQ ID NO: 1391669 - RNA, 13 nt, Homo sapiens
agagccagggucu

SEQ ID NO: 1391670 - RNA, 19 nt, Homo sapiens
agagccucuggcaucucuu

SEQ ID NO: 1391671 - RNA, 13 nt, Homo sapiens
agagcuauacagu

SEQ ID NO: 1391672 - RNA, 15 nt, Homo sapiens
agagcucacuaaaau

SEQ ID NO: 1391673 - RNA, 20 nt, Homo sapiens
agagcuggaccugagcuauu

SEQ ID NO: 1391674 - RNA, 19 nt, Homo sapiens
agaggaagagcugcaacgg

SEQ ID NO: 1391675 - RNA, 21 nt, Homo sapiens
agaggagagagacuccagcug

SEQ ID NO: 1391676 - RNA, 17 nt, Homo sapiens
agaggaucggaggcuug

SEQ ID NO: 1391677 - RNA, 20 nt, Homo sapiens
agaggcagaacccuggugag

SEQ ID NO: 1391678 - RNA, 13 nt, Homo sapiens
agaggggaaaaug

SEQ ID NO: 1391679 - RNA, 14 nt, Homo sapiens
accuucaacuucca

SEQ ID NO: 1391680 - RNA, 22 nt, Homo sapiens
accuucaauaaaguaucuacau

SEQ ID NO: 1391681 - RNA, 17 nt, Homo sapiens
accuucagauccuaccc

SEQ ID NO: 1391682 - RNA, 16 nt, Homo sapiens
accuucccaugcccug

SEQ ID NO: 1391683 - RNA, 23 nt, Homo sapiens
accuuuucucuucauuuucccau

SEQ ID NO: 1391684 - RNA, 15 nt, Homo sapiens
accuuuuuggacaca

SEQ ID NO: 1391685 - RNA, 17 nt, Homo sapiens
accuuuuuggacacaca

SEQ ID NO: 1391686 - RNA, 12 nt, Homo sapiens
acgaacuuucca

SEQ ID NO: 1391687 - RNA, 18 nt, Homo sapiens
acgaguggaccauuauca

SEQ ID NO: 1391688 - RNA, 15 nt, Homo sapiens
acgauacuccaacca

SEQ ID NO: 1391689 - RNA, 17 nt, Homo sapiens
acgauacuccaaccaua

SEQ ID NO: 1391690 - RNA, 19 nt, Homo sapiens
acgcaaaaaauaacuacag

SEQ ID NO: 1391691 - RNA, 12 nt, Homo sapiens
acgcacacagcu

SEQ ID NO: 1391692 - RNA, 15 nt, Homo sapiens
acgccacugcacucc

SEQ ID NO: 1391693 - RNA, 20 nt, Homo sapiens
acgccuccccuuugugacuu

SEQ ID NO: 1391694 - RNA, 15 nt, Homo sapiens
acgccuguaauccca

SEQ ID NO: 1391695 - RNA, 21 nt, Homo sapiens
acgccuguaaucccagcacuu

SEQ ID NO: 1391696 - RNA, 16 nt, Homo sapiens
acgccuguaauccuag

SEQ ID NO: 1391697 - RNA, 13 nt, Homo sapiens
acgccuguagucc

SEQ ID NO: 1391698 - RNA, 18 nt, Homo sapiens
acgcugacggaggagcua

SEQ ID NO: 1391699 - RNA, 15 nt, Homo sapiens
acgcugucuccagac

SEQ ID NO: 1391700 - RNA, 17 nt, Homo sapiens
acggacacucaaaagcu

SEQ ID NO: 1391701 - RNA, 12 nt, Homo sapiens
acggcacugugg

SEQ ID NO: 1391702 - RNA, 21 nt, Homo sapiens
acgggaccauuuuuacaucca

SEQ ID NO: 1391703 - RNA, 17 nt, Homo sapiens
acgggagaauauacaaa

SEQ ID NO: 1391704 - RNA, 20 nt, Homo sapiens
acgggcccgugacaucccca

SEQ ID NO: 1391705 - RNA, 14 nt, Homo sapiens
acggugggcauuug

SEQ ID NO: 1391706 - RNA, 20 nt, Homo sapiens
acgguguccaugccuuccau

SEQ ID NO: 1391707 - RNA, 15 nt, Homo sapiens
acguaucugcuacuu

SEQ ID NO: 1391708 - RNA, 14 nt, Homo sapiens
acgucaagucuccu

SEQ ID NO: 1391709 - RNA, 17 nt, Homo sapiens
acgugcacgcacacugu

SEQ ID NO: 1391710 - RNA, 18 nt, Homo sapiens
acguggcuucugaugaau

SEQ ID NO: 1391711 - RNA, 15 nt, Homo sapiens
acguguguuucuaga

SEQ ID NO: 1391712 - RNA, 22 nt, Homo sapiens
acguugaggacuuuucgaccaa

SEQ ID NO: 1391713 - RNA, 19 nt, Homo sapiens
acguuuguuucuucgugcc

SEQ ID NO: 1391714 - RNA, 14 nt, Homo sapiens
acuaaaaaucauga

SEQ ID NO: 1391715 - RNA, 21 nt, Homo sapiens
acuaaacaacuaccuccucag

SEQ ID NO: 1391716 - RNA, 17 nt, Homo sapiens
acuaacagauaagcaag

SEQ ID NO: 1391717 - RNA, 19 nt, Homo sapiens
acuaaccucuaacaacaaa

SEQ ID NO: 1391718 - RNA, 18 nt, Homo sapiens
acuaaccuggguucccuu

SEQ ID NO: 1391719 - RNA, 17 nt, Homo sapiens
acuaaggugugcucuga

SEQ ID NO: 1391720 - RNA, 22 nt, Homo sapiens
acuaaggugugcucugaucauc

SEQ ID NO: 1391721 - RNA, 20 nt, Homo sapiens
acuaauucugcaucugggca

SEQ ID NO: 1391722 - RNA, 17 nt, Homo sapiens
acuacaauguagucuca

SEQ ID NO: 1391723 - RNA, 16 nt, Homo sapiens
acuacaggcaccugcc

SEQ ID NO: 1391724 - RNA, 20 nt, Homo sapiens
acuacaugcaaggcacugua

SEQ ID NO: 1391725 - RNA, 16 nt, Homo sapiens
acuagaagggccaguc

SEQ ID NO: 1391726 - RNA, 16 nt, Homo sapiens
acuaucugauuuccua

SEQ ID NO: 1391727 - RNA, 13 nt, Homo sapiens
acuaugagccuau

SEQ ID NO: 1391728 - RNA, 15 nt, Homo sapiens
acuauuaagcaguaa

SEQ ID NO: 1391729 - RNA, 16 nt, Homo sapiens
acuauugaaaucaagc

SEQ ID NO: 1391730 - RNA, 20 nt, Homo sapiens
acuauugacaucagcaucac

SEQ ID NO: 1391731 - RNA, 20 nt, Homo sapiens
acuauugagugaaacauuga

SEQ ID NO: 1391732 - RNA, 21 nt, Homo sapiens
acuauuuucauucucuuguua

SEQ ID NO: 1391733 - RNA, 14 nt, Homo sapiens
acucaaacugccuu

SEQ ID NO: 1391734 - RNA, 16 nt, Homo sapiens
acucagaagacacuga

SEQ ID NO: 1391735 - RNA, 18 nt, Homo sapiens
acucagauggaaccgcag

SEQ ID NO: 1391736 - RNA, 22 nt, Homo sapiens
acucagauggaaccgcaggaag

SEQ ID NO: 1391737 - RNA, 15 nt, Homo sapiens
acucaggaugcccag

SEQ ID NO: 1391738 - RNA, 21 nt, Homo sapiens
acucagucccuaaaaacacag

SEQ ID NO: 1391739 - RNA, 18 nt, Homo sapiens
acucaucuuagugccuga

SEQ ID NO: 1391740 - RNA, 20 nt, Homo sapiens
acucaucuuagugccugaga

SEQ ID NO: 1391741 - RNA, 12 nt, Homo sapiens
acucaugaucuu

SEQ ID NO: 1391742 - RNA, 12 nt, Homo sapiens
acucauuccugc

SEQ ID NO: 1391743 - RNA, 15 nt, Homo sapiens
acucauuucuagcag

SEQ ID NO: 1391744 - RNA, 17 nt, Homo sapiens
acuccacagucaauauu

SEQ ID NO: 1391745 - RNA, 15 nt, Homo sapiens
acuccagaucugcac

SEQ ID NO: 1391746 - RNA, 20 nt, Homo sapiens
acuccagauuuuuuacagcu

SEQ ID NO: 1391747 - RNA, 13 nt, Homo sapiens
acuccagcccauu

SEQ ID NO: 1391748 - RNA, 15 nt, Homo sapiens
acuccccugcacugg

SEQ ID NO: 1391749 - RNA, 20 nt, Homo sapiens
aaaacugccuuuuaucugcc

SEQ ID NO: 1391750 - RNA, 22 nt, Homo sapiens
aaaacuguggguagagacuuug

SEQ ID NO: 1391751 - RNA, 19 nt, Homo sapiens
aaaacuucaguaaguacgu

SEQ ID NO: 1391752 - RNA, 17 nt, Homo sapiens
aaaacuugcugccugaa

SEQ ID NO: 1391753 - RNA, 23 nt, Homo sapiens
aaaacuuuucuaauacucuaccc

SEQ ID NO: 1391754 - RNA, 21 nt, Homo sapiens
aaaagaaagcaaacuuaagaa

SEQ ID NO: 1391755 - RNA, 21 nt, Homo sapiens
aaaagaagacaacauuucuca

SEQ ID NO: 1391756 - RNA, 16 nt, Homo sapiens
aaaagaauacagaaag

SEQ ID NO: 1391757 - RNA, 13 nt, Homo sapiens
aaaagaccuauga

SEQ ID NO: 1391758 - RNA, 16 nt, Homo sapiens
aaaagauaacaagauc

SEQ ID NO: 1391759 - RNA, 23 nt, Homo sapiens
aaaagaugcuucucacugccaug

SEQ ID NO: 1391760 - RNA, 23 nt, Homo sapiens
aaaagcaaauaguagauggcaaa

SEQ ID NO: 1391761 - RNA, 13 nt, Homo sapiens
aaaagcaccugcc

SEQ ID NO: 1391762 - RNA, 18 nt, Homo sapiens
aaaagcaguaacugacaa

SEQ ID NO: 1391763 - RNA, 21 nt, Homo sapiens
aaaaggaaaccaaguggucag

SEQ ID NO: 1391764 - RNA, 14 nt, Homo sapiens
aaaaggcagaguac

SEQ ID NO: 1391765 - RNA, 23 nt, Homo sapiens
aaaagggaauuaugaguuuuuca

SEQ ID NO: 1391766 - RNA, 22 nt, Homo sapiens
aaaaguaaguaccacucaggcc

SEQ ID NO: 1391767 - RNA, 21 nt, Homo sapiens
aaaagugaucaauaaaaugug

SEQ ID NO: 1391768 - RNA, 18 nt, Homo sapiens
aaaauaaaguuacauugc

SEQ ID NO: 1391769 - RNA, 16 nt, Homo sapiens
aaaauaaggaacauga

SEQ ID NO: 1391770 - RNA, 15 nt, Homo sapiens
aaaauaguggccaga

SEQ ID NO: 1391771 - RNA, 23 nt, Homo sapiens
aaaauauaccuucagagacuguc

SEQ ID NO: 1391772 - RNA, 14 nt, Homo sapiens
aaaauauauuucag

SEQ ID NO: 1391773 - RNA, 17 nt, Homo sapiens
aaaauauguccauaucu

SEQ ID NO: 1391774 - RNA, 19 nt, Homo sapiens
aaaaucacucucagugcuu

SEQ ID NO: 1391775 - RNA, 16 nt, Homo sapiens
aaaaucauaguacucu

SEQ ID NO: 1391776 - RNA, 17 nt, Homo sapiens
aaaaucauucuacugaa

SEQ ID NO: 1391777 - RNA, 11 nt, Homo sapiens
aaaauccugcu

SEQ ID NO: 1391778 - RNA, 12 nt, Homo sapiens
aaaauccuucua

SEQ ID NO: 1391779 - RNA, 19 nt, Homo sapiens
aaaaugaaagcaugucuca

SEQ ID NO: 1391780 - RNA, 13 nt, Homo sapiens
aaaaugaagauua

SEQ ID NO: 1391781 - RNA, 23 nt, Homo sapiens
aaaaugaagguggaacaagcaca

SEQ ID NO: 1391782 - RNA, 14 nt, Homo sapiens
aaaaugagcaaaag

SEQ ID NO: 1391783 - RNA, 22 nt, Homo sapiens
aaaaugagguucaacuguugau

SEQ ID NO: 1391784 - RNA, 15 nt, Homo sapiens
aaaaugaguuaccua

SEQ ID NO: 1391785 - RNA, 23 nt, Homo sapiens
aaaauggacaaaauccaugaaca

SEQ ID NO: 1391786 - RNA, 18 nt, Homo sapiens
aaaaugguaauuguugcu

SEQ ID NO: 1391787 - RNA, 18 nt, Homo sapiens
aaaauguccaccaauaga

SEQ ID NO: 1391788 - RNA, 13 nt, Homo sapiens
aaaauguccauga

SEQ ID NO: 1391789 - RNA, 21 nt, Homo sapiens
aaaauuagccgggcauggugg

SEQ ID NO: 1391790 - RNA, 17 nt, Homo sapiens
aaaauucagagaguuag

SEQ ID NO: 1391791 - RNA, 21 nt, Homo sapiens
aaaauucuauuacaguauguc

SEQ ID NO: 1391792 - RNA, 20 nt, Homo sapiens
aaaauucucuuaaaccacag

SEQ ID NO: 1391793 - RNA, 15 nt, Homo sapiens
aaaauuuaaaucaua

SEQ ID NO: 1391794 - RNA, 16 nt, Homo sapiens
aaaauuucagcauuau

SEQ ID NO: 1391795 - RNA, 21 nt, Homo sapiens
aaaauuuugcuccccagugaa

SEQ ID NO: 1391796 - RNA, 17 nt, Homo sapiens
aaacaaaacaccaggga

SEQ ID NO: 1391797 - RNA, 17 nt, Homo sapiens
aaacaaugaagacaauu

SEQ ID NO: 1391798 - RNA, 19 nt, Homo sapiens
aaacacagacauucugcca

SEQ ID NO: 1391799 - RNA, 22 nt, Homo sapiens
aaacaccaaacucauaacaguc

SEQ ID NO: 1391800 - RNA, 14 nt, Homo sapiens
aaacacccaugccc

SEQ ID NO: 1391801 - RNA, 16 nt, Homo sapiens
aaacaggaccacaaaa

SEQ ID NO: 1391802 - RNA, 23 nt, Homo sapiens
aaacauaacaaaaucacuuccau

SEQ ID NO: 1391803 - RNA, 20 nt, Homo sapiens
acagccgcuccugucugcca

SEQ ID NO: 1391804 - RNA, 22 nt, Homo sapiens
acagccggggccugccuagcac

SEQ ID NO: 1391805 - RNA, 21 nt, Homo sapiens
acagccucccacccccaucuc

SEQ ID NO: 1391806 - RNA, 14 nt, Homo sapiens
acagccuggcacag

SEQ ID NO: 1391807 - RNA, 18 nt, Homo sapiens
acagcgagacuccgucuc

SEQ ID NO: 1391808 - RNA, 15 nt, Homo sapiens
acagcuacacagauc

SEQ ID NO: 1391809 - RNA, 14 nt, Homo sapiens
acagcucuucucca

SEQ ID NO: 1391810 - RNA, 18 nt, Homo sapiens
acagcucuucuccaggcu

SEQ ID NO: 1391811 - RNA, 14 nt, Homo sapiens
acagcugcagagac

SEQ ID NO: 1391812 - RNA, 14 nt, Homo sapiens
acaggaaaaugcca

SEQ ID NO: 1391813 - RNA, 22 nt, Homo sapiens
acaggaacugugagagucuuug

SEQ ID NO: 1391814 - RNA, 19 nt, Homo sapiens
acaggaauacuuaacucaa

SEQ ID NO: 1391815 - RNA, 21 nt, Homo sapiens
acaggaauacuuaacucaaua

SEQ ID NO: 1391816 - RNA, 14 nt, Homo sapiens
acaggagcugggau

SEQ ID NO: 1391817 - RNA, 23 nt, Homo sapiens
acaggagucugucucugcuaugg

SEQ ID NO: 1391818 - RNA, 19 nt, Homo sapiens
acaggauuauuggaaauuu

SEQ ID NO: 1391819 - RNA, 14 nt, Homo sapiens
acaggcaagcaccu

SEQ ID NO: 1391820 - RNA, 23 nt, Homo sapiens
acaggcaaugcuggcuguuggcu

SEQ ID NO: 1391821 - RNA, 15 nt, Homo sapiens
acaggccauacuuua

SEQ ID NO: 1391822 - RNA, 14 nt, Homo sapiens
acaggcccaagaga

SEQ ID NO: 1391823 - RNA, 22 nt, Homo sapiens
acaggcccuuccucuccacugc

SEQ ID NO: 1391824 - RNA, 15 nt, Homo sapiens
acagggaggugaccc

SEQ ID NO: 1391825 - RNA, 19 nt, Homo sapiens
acagggcaugcauuuugca

SEQ ID NO: 1391826 - RNA, 13 nt, Homo sapiens
acagggcauucaa

SEQ ID NO: 1391827 - RNA, 16 nt, Homo sapiens
acaggguguugucagc

SEQ ID NO: 1391828 - RNA, 22 nt, Homo sapiens
acaggguuuugccauguuggcc

SEQ ID NO: 1391829 - RNA, 15 nt, Homo sapiens
acagguuacaugaga

SEQ ID NO: 1391830 - RNA, 20 nt, Homo sapiens
acaguauugacuuguauacc

SEQ ID NO: 1391831 - RNA, 22 nt, Homo sapiens
acaguccugggagaaccucagg

SEQ ID NO: 1391832 - RNA, 18 nt, Homo sapiens
acagugaaggcuguccuu

SEQ ID NO: 1391833 - RNA, 20 nt, Homo sapiens
acagugacuccacucugagu

SEQ ID NO: 1391834 - RNA, 15 nt, Homo sapiens
acagugagaaaccau

SEQ ID NO: 1391835 - RNA, 21 nt, Homo sapiens
acagugagucgaggacaggga

SEQ ID NO: 1391836 - RNA, 21 nt, Homo sapiens
acagugaugcugugcuaugaa

SEQ ID NO: 1391837 - RNA, 13 nt, Homo sapiens
acagugccugcau

SEQ ID NO: 1391838 - RNA, 22 nt, Homo sapiens
acaguguauguacuaagcagua

SEQ ID NO: 1391839 - RNA, 23 nt, Homo sapiens
acaguuuuccuaaauguauaccu

SEQ ID NO: 1391840 - RNA, 15 nt, Homo sapiens
acauaaaauagauuu

SEQ ID NO: 1391841 - RNA, 23 nt, Homo sapiens
acauaaauuacuuuuucauucuu

SEQ ID NO: 1391842 - RNA, 15 nt, Homo sapiens
acauaagacagacag

SEQ ID NO: 1391843 - RNA, 21 nt, Homo sapiens
acauacaugcauacacucuca

SEQ ID NO: 1391844 - RNA, 16 nt, Homo sapiens
acauacuccuuccauc

SEQ ID NO: 1391845 - RNA, 19 nt, Homo sapiens
acauacuccuuccaucaaa

SEQ ID NO: 1391846 - RNA, 21 nt, Homo sapiens
acauacucugcuuagaauuug

SEQ ID NO: 1391847 - RNA, 11 nt, Homo sapiens
acauacugcug

SEQ ID NO: 1391848 - RNA, 23 nt, Homo sapiens
acauagugaaaccccaucucuac

SEQ ID NO: 1391849 - RNA, 16 nt, Homo sapiens
acauauauaugucagg

SEQ ID NO: 1391850 - RNA, 18 nt, Homo sapiens
acauauucuuuaaauuuc

SEQ ID NO: 1391851 - RNA, 12 nt, Homo sapiens
acaucaaugaug

SEQ ID NO: 1391852 - RNA, 17 nt, Homo sapiens
acaucaaugaugaggcu

SEQ ID NO: 1391853 - RNA, 12 nt, Homo sapiens
acaucaauguuc

SEQ ID NO: 1391854 - RNA, 17 nt, Homo sapiens
acaucacugaaaugcua

SEQ ID NO: 1391855 - RNA, 14 nt, Homo sapiens
acaucagcagagaa

SEQ ID NO: 1391856 - RNA, 16 nt, Homo sapiens
acauccaagcuuccuu

SEQ ID NO: 1391857 - RNA, 18 nt, Homo sapiens
acauccaggcaauggccu

SEQ ID NO: 1391858 - RNA, 19 nt, Homo sapiens
acauccaggcaauggccua

SEQ ID NO: 1391859 - RNA, 12 nt, Homo sapiens
acauccaugaaa

SEQ ID NO: 1391860 - RNA, 22 nt, Homo sapiens
acaucuagcuggcuucccuguc

SEQ ID NO: 1391861 - RNA, 22 nt, Homo sapiens
acaucucaauaaagugcuuuaa

SEQ ID NO: 1391862 - RNA, 23 nt, Homo sapiens
acaucucaauaaagugcuuuaaa

SEQ ID NO: 1391863 - RNA, 19 nt, Homo sapiens
acaucuugcucugcugaca

SEQ ID NO: 1391864 - RNA, 13 nt, Homo sapiens
acaucuuucacau

SEQ ID NO: 1391865 - RNA, 10 nt, Homo sapiens
acaugaauau

SEQ ID NO: 1391866 - RNA, 11 nt, Homo sapiens
acaugacuguu

SEQ ID NO: 1391867 - RNA, 22 nt, Homo sapiens
acaugauggagcgcaccugccc

SEQ ID NO: 1391868 - RNA, 15 nt, Homo sapiens
acaugcacgugugug

SEQ ID NO: 1391869 - RNA, 20 nt, Homo sapiens
gagucaucucaaccaucccc

SEQ ID NO: 1391870 - RNA, 17 nt, Homo sapiens
gagucucuucuccacug

SEQ ID NO: 1391871 - RNA, 18 nt, Homo sapiens
gagucucuucuccacugg

SEQ ID NO: 1391872 - RNA, 13 nt, Homo sapiens
gagugagcugguu

SEQ ID NO: 1391873 - RNA, 18 nt, Homo sapiens
gagugcccccaacagcac

SEQ ID NO: 1391874 - RNA, 22 nt, Homo sapiens
gagugccguaacaacugugguc

SEQ ID NO: 1391875 - RNA, 23 nt, Homo sapiens
gagugccuuuucgagacuggcag

SEQ ID NO: 1391876 - RNA, 16 nt, Homo sapiens
gagugcucaccgccuc

SEQ ID NO: 1391877 - RNA, 13 nt, Homo sapiens
gaguggaugccuc

SEQ ID NO: 1391878 - RNA, 14 nt, Homo sapiens
gagugugugcaagu

SEQ ID NO: 1391879 - RNA, 18 nt, Homo sapiens
gaguuaggcuauucacaa

SEQ ID NO: 1391880 - RNA, 13 nt, Homo sapiens
gaguuagugccau

SEQ ID NO: 1391881 - RNA, 16 nt, Homo sapiens
gaguuccgacugccau

SEQ ID NO: 1391882 - RNA, 17 nt, Homo sapiens
gaguuccuaacaggaug

SEQ ID NO: 1391883 - RNA, 19 nt, Homo sapiens
gaguucgaggcugcaguca

SEQ ID NO: 1391884 - RNA, 21 nt, Homo sapiens
gaguugauucagcucugcaag

SEQ ID NO: 1391885 - RNA, 20 nt, Homo sapiens
gaguuguuucugacccacug

SEQ ID NO: 1391886 - RNA, 16 nt, Homo sapiens
gauaaaaagauggccu

SEQ ID NO: 1391887 - RNA, 19 nt, Homo sapiens
gauaaugcuguugccucau

SEQ ID NO: 1391888 - RNA, 18 nt, Homo sapiens
gauacaggaaaagcugcu

SEQ ID NO: 1391889 - RNA, 14 nt, Homo sapiens
gauacaugucuuuc

SEQ ID NO: 1391890 - RNA, 16 nt, Homo sapiens
gauaccaaauaccaug

SEQ ID NO: 1391891 - RNA, 19 nt, Homo sapiens
gauaccaagaugccaucug

SEQ ID NO: 1391892 - RNA, 20 nt, Homo sapiens
gauacccaaguuauugggau

SEQ ID NO: 1391893 - RNA, 23 nt, Homo sapiens
gauacuaauaggugugugaggcu

SEQ ID NO: 1391894 - RNA, 13 nt, Homo sapiens
gauagaaccugga

SEQ ID NO: 1391895 - RNA, 15 nt, Homo sapiens
gauagauaacucuuu

SEQ ID NO: 1391896 - RNA, 14 nt, Homo sapiens
gauagcaugucuuu

SEQ ID NO: 1391897 - RNA, 14 nt, Homo sapiens
gauaggccuguggg

SEQ ID NO: 1391898 - RNA, 13 nt, Homo sapiens
gauaguuuugcca

SEQ ID NO: 1391899 - RNA, 13 nt, Homo sapiens
gauauaugcucug

SEQ ID NO: 1391900 - RNA, 15 nt, Homo sapiens
gauaucaugccccug

SEQ ID NO: 1391901 - RNA, 15 nt, Homo sapiens
gaucaagucacucau

SEQ ID NO: 1391902 - RNA, 18 nt, Homo sapiens
gaucaauaaaaugugauu

SEQ ID NO: 1391903 - RNA, 23 nt, Homo sapiens
gaucacagggccccagaaggcag

SEQ ID NO: 1391904 - RNA, 15 nt, Homo sapiens
gaucacuaugcauuu

SEQ ID NO: 1391905 - RNA, 20 nt, Homo sapiens
gaucagccugggcaauguga

SEQ ID NO: 1391906 - RNA, 18 nt, Homo sapiens
gaucauccacugugccau

SEQ ID NO: 1391907 - RNA, 16 nt, Homo sapiens
gaucaucuuuccuguu

SEQ ID NO: 1391908 - RNA, 20 nt, Homo sapiens
gaucaucuuuccuguuccag

SEQ ID NO: 1391909 - RNA, 20 nt, Homo sapiens
gaucaugccacuacacucca

SEQ ID NO: 1391910 - RNA, 13 nt, Homo sapiens
gaucauugcaaac

SEQ ID NO: 1391911 - RNA, 16 nt, Homo sapiens
gauccacccaccucag

SEQ ID NO: 1391912 - RNA, 20 nt, Homo sapiens
gauccauccaucuccaggga

SEQ ID NO: 1391913 - RNA, 17 nt, Homo sapiens
gaucccacuccuaggac

SEQ ID NO: 1391914 - RNA, 13 nt, Homo sapiens
gaucccagcucac

SEQ ID NO: 1391915 - RNA, 13 nt, Homo sapiens
gauccccagugaa

SEQ ID NO: 1391916 - RNA, 16 nt, Homo sapiens
gauccucccaccucag

SEQ ID NO: 1391917 - RNA, 15 nt, Homo sapiens
gauccuccugccuca

SEQ ID NO: 1391918 - RNA, 20 nt, Homo sapiens
gaucuaagccuuuccauaag

SEQ ID NO: 1391919 - RNA, 15 nt, Homo sapiens
gaucucgaacuucug

SEQ ID NO: 1391920 - RNA, 22 nt, Homo sapiens
gaucucugcuuuggaaaucaca

SEQ ID NO: 1391921 - RNA, 23 nt, Homo sapiens
gaucugaacagaaauaccaaaau

SEQ ID NO: 1391922 - RNA, 17 nt, Homo sapiens
gaucugaugcaagcaag

SEQ ID NO: 1391923 - RNA, 15 nt, Homo sapiens
gaucuuugacucuuu

SEQ ID NO: 1391924 - RNA, 23 nt, Homo sapiens
gaugaccccuccccuaaugccug

SEQ ID NO: 1391925 - RNA, 15 nt, Homo sapiens
gaugacccucugacc

SEQ ID NO: 1391926 - RNA, 12 nt, Homo sapiens
gaugagcauuua

SEQ ID NO: 1391927 - RNA, 21 nt, Homo sapiens
gaugaggucauagcagugcuu

SEQ ID NO: 1391928 - RNA, 16 nt, Homo sapiens
gaugauaaaacacaaa

SEQ ID NO: 1391929 - RNA, 18 nt, Homo sapiens
gaugcacaugagcuggcg

SEQ ID NO: 1391930 - RNA, 20 nt, Homo sapiens
gaugcacauuucauguauuc

SEQ ID NO: 1391931 - RNA, 16 nt, Homo sapiens
gaugcaggauuucuuc

SEQ ID NO: 1391932 - RNA, 14 nt, Homo sapiens
gaugcccacuuccc

SEQ ID NO: 1391933 - RNA, 19 nt, Homo sapiens
gaugcgguggcuaaagguc

SEQ ID NO: 1391934 - RNA, 20 nt, Homo sapiens
gaugcugcaguuccaaaaga

SEQ ID NO: 1391935 - RNA, 22 nt, Homo sapiens
gaugcugucuucguacugggaa

SEQ ID NO: 1391936 - RNA, 17 nt, Homo sapiens
gauggaauaacucugug

SEQ ID NO: 1391937 - RNA, 17 nt, Homo sapiens
gauggaggggugguccu

SEQ ID NO: 1391938 - RNA, 18 nt, Homo sapiens
gauggauagucuguccaa

SEQ ID NO: 1391939 - RNA, 18 nt, Homo sapiens
gauggcaccacugcacuc

SEQ ID NO: 1391940 - RNA, 21 nt, Homo sapiens
gauggcaggaugggcacugcc

SEQ ID NO: 1391941 - RNA, 14 nt, Homo sapiens
gaugggagguugug

SEQ ID NO: 1391942 - RNA, 23 nt, Homo sapiens
gauguacuuuaccugaaacaacc

SEQ ID NO: 1391943 - RNA, 13 nt, Homo sapiens
gaugucaucuucc

SEQ ID NO: 1391944 - RNA, 14 nt, Homo sapiens
gaugugucuuacca

SEQ ID NO: 1391945 - RNA, 15 nt, Homo sapiens
gauguucugggacac

SEQ ID NO: 1391946 - RNA, 19 nt, Homo sapiens
gauuaaagguggugccaau

SEQ ID NO: 1391947 - RNA, 22 nt, Homo sapiens
gauuagugccuucugcccuccc

SEQ ID NO: 1391948 - RNA, 19 nt, Homo sapiens
gauuauucccuguacaaua

SEQ ID NO: 1391949 - RNA, 21 nt, Homo sapiens
gauuauuggaaauuuguuaua

SEQ ID NO: 1391950 - RNA, 20 nt, Homo sapiens
gauucacaaugaaaugcucu

SEQ ID NO: 1391951 - RNA, 15 nt, Homo sapiens
gcccaacgcaaauuc

SEQ ID NO: 1391952 - RNA, 15 nt, Homo sapiens
gcccaagauaucagc

SEQ ID NO: 1391953 - RNA, 23 nt, Homo sapiens
gcccacccuuguguccacuguga

SEQ ID NO: 1391954 - RNA, 22 nt, Homo sapiens
gcccacuucaccguacuaacca

SEQ ID NO: 1391955 - RNA, 14 nt, Homo sapiens
gcccacuucccucc

SEQ ID NO: 1391956 - RNA, 19 nt, Homo sapiens
gcccagaauucccagcugu

SEQ ID NO: 1391957 - RNA, 14 nt, Homo sapiens
gcccagcugcaccu

SEQ ID NO: 1391958 - RNA, 15 nt, Homo sapiens
gcccagcugcaccug

SEQ ID NO: 1391959 - RNA, 16 nt, Homo sapiens
gcccagcugcaccugc

SEQ ID NO: 1391960 - RNA, 20 nt, Homo sapiens
gcccaggcuggcgugcagug

SEQ ID NO: 1391961 - RNA, 20 nt, Homo sapiens
gcccagggaagccaaaagau

SEQ ID NO: 1391962 - RNA, 18 nt, Homo sapiens
gcccagggagaggccaug

SEQ ID NO: 1391963 - RNA, 13 nt, Homo sapiens
gcccagugcacac

SEQ ID NO: 1391964 - RNA, 18 nt, Homo sapiens
gcccaucaauuauagaaa

SEQ ID NO: 1391965 - RNA, 22 nt, Homo sapiens
gcccaucacaggguugggccca

SEQ ID NO: 1391966 - RNA, 19 nt, Homo sapiens
gcccaugcccaccugccca

SEQ ID NO: 1391967 - RNA, 22 nt, Homo sapiens
gcccauggcuuuagcuaccuca

SEQ ID NO: 1391968 - RNA, 23 nt, Homo sapiens
gcccauggcuuuagcuaccucac

SEQ ID NO: 1391969 - RNA, 23 nt, Homo sapiens
gcccaugugugagugugugcaag

SEQ ID NO: 1391970 - RNA, 16 nt, Homo sapiens
gcccauuuacacuuuu

SEQ ID NO: 1391971 - RNA, 16 nt, Homo sapiens
gccccaaaaccacagc

SEQ ID NO: 1391972 - RNA, 18 nt, Homo sapiens
gccccacugcccuucuca

SEQ ID NO: 1391973 - RNA, 13 nt, Homo sapiens
gcccccaacagca

SEQ ID NO: 1391974 - RNA, 20 nt, Homo sapiens
gcccccgagcugggggccau

SEQ ID NO: 1391975 - RNA, 16 nt, Homo sapiens
gccccgugcagacugg

SEQ ID NO: 1391976 - RNA, 15 nt, Homo sapiens
gccccuauuagcucu

SEQ ID NO: 1391977 - RNA, 13 nt, Homo sapiens
gccccucauuuau

SEQ ID NO: 1391978 - RNA, 22 nt, Homo sapiens
gccccucccagaacacacucca

SEQ ID NO: 1391979 - RNA, 16 nt, Homo sapiens
gccccugcacaaagcc

SEQ ID NO: 1391980 - RNA, 20 nt, Homo sapiens
gccccuguaacccuacucuc

SEQ ID NO: 1391981 - RNA, 16 nt, Homo sapiens
gcccucauccauuuau

SEQ ID NO: 1391982 - RNA, 15 nt, Homo sapiens
gcccuccacugcccu

SEQ ID NO: 1391983 - RNA, 14 nt, Homo sapiens
gcccuccgccauuc

SEQ ID NO: 1391984 - RNA, 20 nt, Homo sapiens
gcccugcucugaacacgaag

SEQ ID NO: 1391985 - RNA, 14 nt, Homo sapiens
gcccuggauccauc

SEQ ID NO: 1391986 - RNA, 14 nt, Homo sapiens
gcccugucagugca

SEQ ID NO: 1391987 - RNA, 20 nt, Homo sapiens
gcccuuuauuuauaauacau

SEQ ID NO: 1391988 - RNA, 14 nt, Homo sapiens
gccggucacugcag

SEQ ID NO: 1391989 - RNA, 14 nt, Homo sapiens
gccuacaggccuca

SEQ ID NO: 1391990 - RNA, 12 nt, Homo sapiens
gccuaggguaca

SEQ ID NO: 1391991 - RNA, 19 nt, Homo sapiens
gccucaagaugaaggcaaa

SEQ ID NO: 1391992 - RNA, 20 nt, Homo sapiens
gccucacccaggcaucugcu

SEQ ID NO: 1391993 - RNA, 17 nt, Homo sapiens
gccucacucaccaucug

SEQ ID NO: 1391994 - RNA, 16 nt, Homo sapiens
gccucacuucuuccau

SEQ ID NO: 1391995 - RNA, 16 nt, Homo sapiens
gccucagccuccugag

SEQ ID NO: 1391996 - RNA, 13 nt, Homo sapiens
gccucaucuucaa

SEQ ID NO: 1391997 - RNA, 15 nt, Homo sapiens
gccucauugauguca

SEQ ID NO: 1391998 - RNA, 16 nt, Homo sapiens
gccuccucgauugcuc

SEQ ID NO: 1391999 - RNA, 16 nt, Homo sapiens
gccucugccugcauuc

SEQ ID NO: 1392000 - RNA, 23 nt, Homo sapiens
gccucuuugugugcgucacugug

SEQ ID NO: 1392001 - RNA, 21 nt, Homo sapiens
gccugaagucccagcauugau

SEQ ID NO: 1392002 - RNA, 22 nt, Homo sapiens
gccugagacagcugucuuguga

SEQ ID NO: 1392003 - RNA, 23 nt, Homo sapiens
gccugccccaaacaaauaugcaa

SEQ ID NO: 1392004 - RNA, 13 nt, Homo sapiens
gccugccuugaag

SEQ ID NO: 1392005 - RNA, 18 nt, Homo sapiens
gccugcuggaucucccag

SEQ ID NO: 1392006 - RNA, 14 nt, Homo sapiens
gccuggacccugug

SEQ ID NO: 1392007 - RNA, 20 nt, Homo sapiens
gccuggccaggagcucuuca

SEQ ID NO: 1392008 - RNA, 16 nt, Homo sapiens
gccuggucguuuucaa

SEQ ID NO: 1392009 - RNA, 13 nt, Homo sapiens
gccuguaauccca

SEQ ID NO: 1392010 - RNA, 21 nt, Homo sapiens
gccuguaaucccagcacuuug

SEQ ID NO: 1392011 - RNA, 19 nt, Homo sapiens
gccuguaaucccagcuacu

SEQ ID NO: 1392012 - RNA, 19 nt, Homo sapiens
gccuguagucccagcuacu

SEQ ID NO: 1392013 - RNA, 17 nt, Homo sapiens
gccugucgcaugagaac

SEQ ID NO: 1392014 - RNA, 12 nt, Homo sapiens
gccugucuuucc

SEQ ID NO: 1392015 - RNA, 15 nt, Homo sapiens
gccuguuaacuggua

SEQ ID NO: 1392016 - RNA, 17 nt, Homo sapiens
gccuguuacacaugaca

SEQ ID NO: 1392017 - RNA, 14 nt, Homo sapiens
gccuguugcccuuu

SEQ ID NO: 1392018 - RNA, 19 nt, Homo sapiens
gccuuaaguaauguuaauu

SEQ ID NO: 1392019 - RNA, 13 nt, Homo sapiens
gccuucaaacucc

SEQ ID NO: 1392020 - RNA, 15 nt, Homo sapiens
gccuucacuuuacaa

SEQ ID NO: 1392021 - RNA, 22 nt, Homo sapiens
gccuuccacgcugucuccagac

SEQ ID NO: 1392022 - RNA, 17 nt, Homo sapiens
gccuucucaccacagag

SEQ ID NO: 1392023 - RNA, 15 nt, Homo sapiens
gccuuggcuucaggg

SEQ ID NO: 1392024 - RNA, 14 nt, Homo sapiens
gccuugggcugcuc

SEQ ID NO: 1392025 - RNA, 22 nt, Homo sapiens
gccuugugcgguuguguucuca

SEQ ID NO: 1392026 - RNA, 16 nt, Homo sapiens
gccuuuagucgcugag

SEQ ID NO: 1392027 - RNA, 14 nt, Homo sapiens
gccuuuuguguuuu

SEQ ID NO: 1392028 - RNA, 15 nt, Homo sapiens
gcgaaaccccaucuc

SEQ ID NO: 1392029 - RNA, 20 nt, Homo sapiens
ucauauaccagcaauauauc

SEQ ID NO: 1392030 - RNA, 14 nt, Homo sapiens
ucauauuggacuga

SEQ ID NO: 1392031 - RNA, 16 nt, Homo sapiens
ucaucccauugucuuc

SEQ ID NO: 1392032 - RNA, 14 nt, Homo sapiens
ucauccuuagcaac

SEQ ID NO: 1392033 - RNA, 16 nt, Homo sapiens
ucaucuacccugcuga

SEQ ID NO: 1392034 - RNA, 16 nt, Homo sapiens
ucaucuauaacaugca

SEQ ID NO: 1392035 - RNA, 14 nt, Homo sapiens
ucaucucauuccaa

SEQ ID NO: 1392036 - RNA, 20 nt, Homo sapiens
ucaucucucacacauuccag

SEQ ID NO: 1392037 - RNA, 21 nt, Homo sapiens
ucaugaauugcgccucagauu

SEQ ID NO: 1392038 - RNA, 16 nt, Homo sapiens
ucaugauuucauuuca

SEQ ID NO: 1392039 - RNA, 16 nt, Homo sapiens
ucaugcaaaugcugua

SEQ ID NO: 1392040 - RNA, 23 nt, Homo sapiens
ucaugccaccauggccagccaac

SEQ ID NO: 1392041 - RNA, 17 nt, Homo sapiens
ucauggcaccaaagcca

SEQ ID NO: 1392042 - RNA, 15 nt, Homo sapiens
ucauggugcacugag

SEQ ID NO: 1392043 - RNA, 13 nt, Homo sapiens
ucauucaacccac

SEQ ID NO: 1392044 - RNA, 19 nt, Homo sapiens
ucauuccaugugcccaguu

SEQ ID NO: 1392045 - RNA, 22 nt, Homo sapiens
ucauuccugaaagaaacaguua

SEQ ID NO: 1392046 - RNA, 15 nt, Homo sapiens
ucauugaaguauuuu

SEQ ID NO: 1392047 - RNA, 21 nt, Homo sapiens
ucauugaaguauuuuccucca

SEQ ID NO: 1392048 - RNA, 21 nt, Homo sapiens
ucauuguuuauuguauacugc

SEQ ID NO: 1392049 - RNA, 15 nt, Homo sapiens
ucauuuacuuguacg

SEQ ID NO: 1392050 - RNA, 15 nt, Homo sapiens
ucauuuaucccucaa

SEQ ID NO: 1392051 - RNA, 21 nt, Homo sapiens
ucauuuccuauguaacugcau

SEQ ID NO: 1392052 - RNA, 14 nt, Homo sapiens
ucauuugaugcuaa

SEQ ID NO: 1392053 - RNA, 16 nt, Homo sapiens
ucauuugugugcucau

SEQ ID NO: 1392054 - RNA, 23 nt, Homo sapiens
ucauuuuaacuuuaucacauuau

SEQ ID NO: 1392055 - RNA, 18 nt, Homo sapiens
uccaaacauuaaugcaau

SEQ ID NO: 1392056 - RNA, 19 nt, Homo sapiens
uccaaacuaccuuccaguu

SEQ ID NO: 1392057 - RNA, 20 nt, Homo sapiens
uccaaagcacauugaaagag

SEQ ID NO: 1392058 - RNA, 22 nt, Homo sapiens
uccaaauacugauggugcauuu

SEQ ID NO: 1392059 - RNA, 19 nt, Homo sapiens
uccaacagcucaagucuuc

SEQ ID NO: 1392060 - RNA, 14 nt, Homo sapiens
uccaacaugugcuc

SEQ ID NO: 1392061 - RNA, 15 nt, Homo sapiens
uccaacaugugcuca

SEQ ID NO: 1392062 - RNA, 19 nt, Homo sapiens
uccaaccagauugucagcu

SEQ ID NO: 1392063 - RNA, 21 nt, Homo sapiens
uccaaccccccaccugccauu

SEQ ID NO: 1392064 - RNA, 22 nt, Homo sapiens
uccaaugucuuuuuaagcuuau

SEQ ID NO: 1392065 - RNA, 14 nt, Homo sapiens
uccaauuugcacuu

SEQ ID NO: 1392066 - RNA, 13 nt, Homo sapiens
uccacacagccaa

SEQ ID NO: 1392067 - RNA, 18 nt, Homo sapiens
uccacagaaauacaugaa

SEQ ID NO: 1392068 - RNA, 13 nt, Homo sapiens
uccacagugacuc

SEQ ID NO: 1392069 - RNA, 13 nt, Homo sapiens
uccacagugccua

SEQ ID NO: 1392070 - RNA, 15 nt, Homo sapiens
uccacauuugucaca

SEQ ID NO: 1392071 - RNA, 14 nt, Homo sapiens
uccaccccccagaa

SEQ ID NO: 1392072 - RNA, 19 nt, Homo sapiens
uccacccuuggacuuucuu

SEQ ID NO: 1392073 - RNA, 21 nt, Homo sapiens
uccacccuuggccugucucau

SEQ ID NO: 1392074 - RNA, 20 nt, Homo sapiens
uccaccuagagcuagaugug

SEQ ID NO: 1392075 - RNA, 19 nt, Homo sapiens
uccacugauggaaacaaag

SEQ ID NO: 1392076 - RNA, 19 nt, Homo sapiens
uccacuucuuguuccccac

SEQ ID NO: 1392077 - RNA, 18 nt, Homo sapiens
uccagagacugggacuaa

SEQ ID NO: 1392078 - RNA, 14 nt, Homo sapiens
uccagaucagauuc

SEQ ID NO: 1392079 - RNA, 16 nt, Homo sapiens
uccagaucagauucuu

SEQ ID NO: 1392080 - RNA, 14 nt, Homo sapiens
uggcugccuuagaa

SEQ ID NO: 1392081 - RNA, 19 nt, Homo sapiens
uggcugggggccucagugc

SEQ ID NO: 1392082 - RNA, 22 nt, Homo sapiens
uggcuguggcaggccagcugug

SEQ ID NO: 1392083 - RNA, 14 nt, Homo sapiens
uggcuuacuccagg

SEQ ID NO: 1392084 - RNA, 15 nt, Homo sapiens
uggcuucuuacugaa

SEQ ID NO: 1392085 - RNA, 18 nt, Homo sapiens
uggcuuuagcuaccucac

SEQ ID NO: 1392086 - RNA, 13 nt, Homo sapiens
ugggaacucccaa

SEQ ID NO: 1392087 - RNA, 15 nt, Homo sapiens
ugggaacucccaaga

SEQ ID NO: 1392088 - RNA, 15 nt, Homo sapiens
ugggaacugcaauaa

SEQ ID NO: 1392089 - RNA, 21 nt, Homo sapiens
ugggaagauaggcucugcaca

SEQ ID NO: 1392090 - RNA, 17 nt, Homo sapiens
ugggaagcaggagccca

SEQ ID NO: 1392091 - RNA, 16 nt, Homo sapiens
ugggaagggguuucua

SEQ ID NO: 1392092 - RNA, 21 nt, Homo sapiens
ugggacaaaacagaaguccau

SEQ ID NO: 1392093 - RNA, 23 nt, Homo sapiens
ugggaccucaguuuuaucauuuu

SEQ ID NO: 1392094 - RNA, 14 nt, Homo sapiens
ugggagacacugau

SEQ ID NO: 1392095 - RNA, 17 nt, Homo sapiens
ugggagacacugaugua

SEQ ID NO: 1392096 - RNA, 18 nt, Homo sapiens
ugggagccagggcugucu

SEQ ID NO: 1392097 - RNA, 16 nt, Homo sapiens
ugggaggccaaggugg

SEQ ID NO: 1392098 - RNA, 17 nt, Homo sapiens
ugggaggcuguggagcc

SEQ ID NO: 1392099 - RNA, 14 nt, Homo sapiens
ugggaggcuucccc

SEQ ID NO: 1392100 - RNA, 19 nt, Homo sapiens
ugggaguuuagugugauaa

SEQ ID NO: 1392101 - RNA, 23 nt, Homo sapiens
ugggauauuuccauauggcaaua

SEQ ID NO: 1392102 - RNA, 15 nt, Homo sapiens
ugggauuuucuacaa

SEQ ID NO: 1392103 - RNA, 16 nt, Homo sapiens
ugggcaaacaggcagu

SEQ ID NO: 1392104 - RNA, 18 nt, Homo sapiens
ugggcaacacagcgagac

SEQ ID NO: 1392105 - RNA, 16 nt, Homo sapiens
ugggcaauauagcaag

SEQ ID NO: 1392106 - RNA, 18 nt, Homo sapiens
ugggcaauauagcaagau

SEQ ID NO: 1392107 - RNA, 14 nt, Homo sapiens
ugggcaaugugaua

SEQ ID NO: 1392108 - RNA, 19 nt, Homo sapiens
ugggcauuuuucuuacuuu

SEQ ID NO: 1392109 - RNA, 18 nt, Homo sapiens
ugggccaagucaaagaca

SEQ ID NO: 1392110 - RNA, 16 nt, Homo sapiens
ugggccccaccaccua

SEQ ID NO: 1392111 - RNA, 20 nt, Homo sapiens
ugggcuccuggggcaauggg

SEQ ID NO: 1392112 - RNA, 19 nt, Homo sapiens
ugggcugggcucgccacau

SEQ ID NO: 1392113 - RNA, 16 nt, Homo sapiens
uggggaagcugugaaa

SEQ ID NO: 1392114 - RNA, 16 nt, Homo sapiens
uggggaagcuucuuaa

SEQ ID NO: 1392115 - RNA, 22 nt, Homo sapiens
uggggacagagcagaacuuuca

SEQ ID NO: 1392116 - RNA, 19 nt, Homo sapiens
uggggagaaaagacaugaa

SEQ ID NO: 1392117 - RNA, 15 nt, Homo sapiens
uggggaggggugcuc

SEQ ID NO: 1392118 - RNA, 19 nt, Homo sapiens
uggggaguaggacauacca

SEQ ID NO: 1392119 - RNA, 14 nt, Homo sapiens
uggggagucaggga

SEQ ID NO: 1392120 - RNA, 19 nt, Homo sapiens
uggggaugguccacuguca

SEQ ID NO: 1392121 - RNA, 16 nt, Homo sapiens
uggggcaggcagugau

SEQ ID NO: 1392122 - RNA, 21 nt, Homo sapiens
uggggcuggaugucuccaucu

SEQ ID NO: 1392123 - RNA, 19 nt, Homo sapiens
ugggggacgugggcauuuu

SEQ ID NO: 1392124 - RNA, 18 nt, Homo sapiens
uggggugcaccuguccaa

SEQ ID NO: 1392125 - RNA, 16 nt, Homo sapiens
ugggguugcaucagaa

SEQ ID NO: 1392126 - RNA, 13 nt, Homo sapiens
uggguaccuguau

SEQ ID NO: 1392127 - RNA, 15 nt, Homo sapiens
ugggugaacacucaa

SEQ ID NO: 1392128 - RNA, 20 nt, Homo sapiens
uggguggggcugcuccucca

SEQ ID NO: 1392129 - RNA, 20 nt, Homo sapiens
uggguuauguguaugugcca

SEQ ID NO: 1392130 - RNA, 19 nt, Homo sapiens
uggguuggaaaacaguauu

SEQ ID NO: 1392131 - RNA, 18 nt, Homo sapiens
ugguaaaaccccaucucu

SEQ ID NO: 1392132 - RNA, 14 nt, Homo sapiens
ugguaaaauacuuc

SEQ ID NO: 1392133 - RNA, 16 nt, Homo sapiens
ugguaaauuaguauuu

SEQ ID NO: 1392134 - RNA, 17 nt, Homo sapiens
ugguaaauuaguauuua

SEQ ID NO: 1392135 - RNA, 12 nt, Homo sapiens
ugguaaccucuu

SEQ ID NO: 1392136 - RNA, 16 nt, Homo sapiens
ugguaacuuugcaaau

SEQ ID NO: 1392137 - RNA, 18 nt, Homo sapiens
ugguaagcuuccaggaaa

SEQ ID NO: 1392138 - RNA, 17 nt, Homo sapiens
ugguaucuacuucuaca

SEQ ID NO: 1392139 - RNA, 12 nt, Homo sapiens
ugguaugaaggu

SEQ ID NO: 1392140 - RNA, 21 nt, Homo sapiens
ugguauguguguguaugcuac

SEQ ID NO: 1392141 - RNA, 19 nt, Homo sapiens
uggucaauccgaaguauga

SEQ ID NO: 1392142 - RNA, 13 nt, Homo sapiens
uggucaccaaauc

SEQ ID NO: 1392143 - RNA, 14 nt, Homo sapiens
ugguccgaucuuug

SEQ ID NO: 1392144 - RNA, 13 nt, Homo sapiens
uggucucugccau

SEQ ID NO: 1392145 - RNA, 19 nt, Homo sapiens
uggugaaaccucaucucua

SEQ ID NO: 1392146 - RNA, 14 nt, Homo sapiens
uggugaaaugcaga

SEQ ID NO: 1392147 - RNA, 17 nt, Homo sapiens
uggugaaaugcagaguc

SEQ ID NO: 1392148 - RNA, 18 nt, Homo sapiens
uggugacccagucagagu

SEQ ID NO: 1392149 - RNA, 17 nt, Homo sapiens
uggugcacugagcugca

SEQ ID NO: 1392150 - RNA, 20 nt, Homo sapiens
uggugcccaguuagccucug

SEQ ID NO: 1392151 - RNA, 15 nt, Homo sapiens
uggugcucauuucau

SEQ ID NO: 1392152 - RNA, 19 nt, Homo sapiens
uggugcugcuuucuuguug

SEQ ID NO: 1392153 - RNA, 19 nt, Homo sapiens
ugguggcucacgccuguaa

SEQ ID NO: 1392154 - RNA, 19 nt, Homo sapiens
ugguggucucugcuugcau

SEQ ID NO: 1392155 - RNA, 20 nt, Homo sapiens
ugguguggccagcacucuga

SEQ ID NO: 1392156 - RNA, 20 nt, Homo sapiens
ugguuaucuaauauguaaca

SEQ ID NO: 1392157 - RNA, 17 nt, Homo sapiens
ugguugaguucagguag

SEQ ID NO: 1392158 - RNA, 16 nt, Homo sapiens
ugguuguuucuuccaa

SEQ ID NO: 1392159 - RNA, 17 nt, Homo sapiens
ugguuuauuucccagua

SEQ ID NO: 1392160 - RNA, 22 nt, Homo sapiens
ugguuuuuaaaaaacugcugac

SEQ ID NO: 1392161 - RNA, 18 nt, Homo sapiens
uguaaaauggacaguacu

SEQ ID NO: 1392162 - RNA, 21 nt, Homo sapiens
uguaaaugaaguaacuugucu

SEQ ID NO: 1392163 - RNA, 19 nt, Homo sapiens
uguaacaugcaauuuugca

SEQ ID NO: 1392164 - RNA, 11 nt, Homo sapiens
uguaacugccc

SEQ ID NO: 1392165 - RNA, 17 nt, Homo sapiens
uguaagaaacacacuga

SEQ ID NO: 1392166 - RNA, 17 nt, Homo sapiens
uguaagauaauguugcu

SEQ ID NO: 1392167 - RNA, 17 nt, Homo sapiens
uguaagcauaacuuauu

SEQ ID NO: 1392168 - RNA, 22 nt, Homo sapiens
uguaagcucuacugaggugcua

SEQ ID NO: 1392169 - RNA, 17 nt, Homo sapiens
uguaagguggucacugu

SEQ ID NO: 1392170 - RNA, 18 nt, Homo sapiens
uguaagugagagagacaa

SEQ ID NO: 1392171 - RNA, 14 nt, Homo sapiens
uguaauccuguaca

SEQ ID NO: 1392172 - RNA, 19 nt, Homo sapiens
uguacagugaaaagucucc

SEQ ID NO: 1392173 - RNA, 19 nt, Homo sapiens
uguacaguguguaaagugu

SEQ ID NO: 1392174 - RNA, 15 nt, Homo sapiens
uguacauacuuuuuc

SEQ ID NO: 1392175 - RNA, 19 nt, Homo sapiens
uguacauaggcagcacuag

SEQ ID NO: 1392176 - RNA, 21 nt, Homo sapiens
uguacauaggcagcacuagcg

SEQ ID NO: 1392177 - RNA, 17 nt, Homo sapiens
uguacauggaauaacau

SEQ ID NO: 1392178 - RNA, 10 nt, Homo sapiens
uguacauuuc

SEQ ID NO: 1392179 - RNA, 15 nt, Homo sapiens
uguacuaagcaguaa

SEQ ID NO: 1392180 - RNA, 15 nt, Homo sapiens
uguacuguuacugug

SEQ ID NO: 1392181 - RNA, 17 nt, Homo sapiens
uguagauauugugaagu

SEQ ID NO: 1392182 - RNA, 15 nt, Homo sapiens
uguagcaacaugaga

SEQ ID NO: 1392183 - RNA, 16 nt, Homo sapiens
uguagcaacaugagaa

SEQ ID NO: 1392184 - RNA, 17 nt, Homo sapiens
uguagccucaaccuccc

SEQ ID NO: 1392185 - RNA, 17 nt, Homo sapiens
uguagcuccucaacuca

SEQ ID NO: 1392186 - RNA, 16 nt, Homo sapiens
uguaggguaaggugcc

SEQ ID NO: 1392187 - RNA, 18 nt, Homo sapiens
uguaguccuagccacuca

SEQ ID NO: 1392188 - RNA, 13 nt, Homo sapiens
uguagucucagga

SEQ ID NO: 1392189 - RNA, 21 nt, Homo sapiens
uguaguuuuucuucaacauca

SEQ ID NO: 1392190 - RNA, 17 nt, Homo sapiens
uguauaaguccuugcaa

SEQ ID NO: 1392191 - RNA, 12 nt, Homo sapiens
uguauacugugg

SEQ ID NO: 1392192 - RNA, 18 nt, Homo sapiens
uguaucauuaugaaguca

SEQ ID NO: 1392193 - RNA, 19 nt, Homo sapiens
uguaucccaacuccuauaa

SEQ ID NO: 1392194 - RNA, 22 nt, Homo sapiens
uccuauuuauaagagugccgua

SEQ ID NO: 1392195 - RNA, 11 nt, Homo sapiens
uccucacuccc

SEQ ID NO: 1392196 - RNA, 22 nt, Homo sapiens
uccucauuuuugaauacaggca

SEQ ID NO: 1392197 - RNA, 15 nt, Homo sapiens
uccucccaccucagc

SEQ ID NO: 1392198 - RNA, 15 nt, Homo sapiens
uccucccucauucca

SEQ ID NO: 1392199 - RNA, 22 nt, Homo sapiens
uccucccuuguggcuuccucag

SEQ ID NO: 1392200 - RNA, 19 nt, Homo sapiens
uccuccuuguucuacucau

SEQ ID NO: 1392201 - RNA, 13 nt, Homo sapiens
uccucguagccau

SEQ ID NO: 1392202 - RNA, 16 nt, Homo sapiens
uccucuccacugccuu

SEQ ID NO: 1392203 - RNA, 14 nt, Homo sapiens
uccucuccuacuuu

SEQ ID NO: 1392204 - RNA, 21 nt, Homo sapiens
uccucugacagaagaacccca

SEQ ID NO: 1392205 - RNA, 15 nt, Homo sapiens
uccucugccaccucc

SEQ ID NO: 1392206 - RNA, 19 nt, Homo sapiens
uccucuguccaggcacugc

SEQ ID NO: 1392207 - RNA, 15 nt, Homo sapiens
uccucuugaaccaca

SEQ ID NO: 1392208 - RNA, 16 nt, Homo sapiens
uccugagcaaacaaaa

SEQ ID NO: 1392209 - RNA, 21 nt, Homo sapiens
uccugagcaaacaaaaccacc

SEQ ID NO: 1392210 - RNA, 20 nt, Homo sapiens
uccugaguaguugggauuac

SEQ ID NO: 1392211 - RNA, 22 nt, Homo sapiens
uccugcaauaaaauaguagcau

SEQ ID NO: 1392212 - RNA, 19 nt, Homo sapiens
uccugcauucacccagaca

SEQ ID NO: 1392213 - RNA, 20 nt, Homo sapiens
uccugccucagccuccugag

SEQ ID NO: 1392214 - RNA, 18 nt, Homo sapiens
uccuggaguacaaacaca

SEQ ID NO: 1392215 - RNA, 16 nt, Homo sapiens
uccugggagugagcug

SEQ ID NO: 1392216 - RNA, 16 nt, Homo sapiens
uccuggggaacauaga

SEQ ID NO: 1392217 - RNA, 23 nt, Homo sapiens
uccuggggaacauagaacucaug

SEQ ID NO: 1392218 - RNA, 19 nt, Homo sapiens
uccuguacaauugcaucac

SEQ ID NO: 1392219 - RNA, 21 nt, Homo sapiens
uccuguacuuuuuccagacac

SEQ ID NO: 1392220 - RNA, 19 nt, Homo sapiens
uccuguauucuacagcaga

SEQ ID NO: 1392221 - RNA, 20 nt, Homo sapiens
uccuguccaaccuaaccccu

SEQ ID NO: 1392222 - RNA, 17 nt, Homo sapiens
uccugucggagcccugu

SEQ ID NO: 1392223 - RNA, 13 nt, Homo sapiens
uccugucugccag

SEQ ID NO: 1392224 - RNA, 11 nt, Homo sapiens
uccugugcaac

SEQ ID NO: 1392225 - RNA, 16 nt, Homo sapiens
uccuguucagcauucu

SEQ ID NO: 1392226 - RNA, 21 nt, Homo sapiens
uccuguuguuauggaaacugu

SEQ ID NO: 1392227 - RNA, 14 nt, Homo sapiens
uccuuaagggacaa

SEQ ID NO: 1392228 - RNA, 16 nt, Homo sapiens
uccuuaccgugggcac

SEQ ID NO: 1392229 - RNA, 18 nt, Homo sapiens
uccuuagcuuagaccuca

SEQ ID NO: 1392230 - RNA, 19 nt, Homo sapiens
uccuuagcuuagaccucag

SEQ ID NO: 1392231 - RNA, 23 nt, Homo sapiens
uccuuaggucugcccugcuugca

SEQ ID NO: 1392232 - RNA, 15 nt, Homo sapiens
uccuuaucacugaca

SEQ ID NO: 1392233 - RNA, 13 nt, Homo sapiens
uccuucagugcau

SEQ ID NO: 1392234 - RNA, 17 nt, Homo sapiens
uccuucauucaacccac

SEQ ID NO: 1392235 - RNA, 22 nt, Homo sapiens
uccuucccucuccccaagacuu

SEQ ID NO: 1392236 - RNA, 14 nt, Homo sapiens
uccuuccuuaucac

SEQ ID NO: 1392237 - RNA, 18 nt, Homo sapiens
uccuuccuugaccagcag

SEQ ID NO: 1392238 - RNA, 15 nt, Homo sapiens
uccuucuaaucugcu

SEQ ID NO: 1392239 - RNA, 16 nt, Homo sapiens
uccuucucaucuguga

SEQ ID NO: 1392240 - RNA, 15 nt, Homo sapiens
uccuucugcuggaua

SEQ ID NO: 1392241 - RNA, 23 nt, Homo sapiens
uccuugaccagcagaucccagcu

SEQ ID NO: 1392242 - RNA, 12 nt, Homo sapiens
uccuugcacacu

SEQ ID NO: 1392243 - RNA, 17 nt, Homo sapiens
uccuuguaaagacugua

SEQ ID NO: 1392244 - RNA, 17 nt, Homo sapiens
uccuuuagcgcccaguu

SEQ ID NO: 1392245 - RNA, 16 nt, Homo sapiens
uccuuuggccauucca

SEQ ID NO: 1392246 - RNA, 17 nt, Homo sapiens
uccuuugguccuucaaa

SEQ ID NO: 1392247 - RNA, 16 nt, Homo sapiens
uauuucuguaccaaag

SEQ ID NO: 1392248 - RNA, 20 nt, Homo sapiens
uauuugcauauguaugacuc

SEQ ID NO: 1392249 - RNA, 19 nt, Homo sapiens
uauuugcauguuaccuccu

SEQ ID NO: 1392250 - RNA, 13 nt, Homo sapiens
uauuugcuaugaa

SEQ ID NO: 1392251 - RNA, 15 nt, Homo sapiens
uauuuggauaucaaa

SEQ ID NO: 1392252 - RNA, 22 nt, Homo sapiens
uauuugggguugcaucagaaau

SEQ ID NO: 1392253 - RNA, 15 nt, Homo sapiens
uauuuguuugugcau

SEQ ID NO: 1392254 - RNA, 18 nt, Homo sapiens
uauuuuaaucuaauucua

SEQ ID NO: 1392255 - RNA, 23 nt, Homo sapiens
uauuuuauguaaacccucaaggg

SEQ ID NO: 1392256 - RNA, 21 nt, Homo sapiens
uauuuuuagacagagucucac

SEQ ID NO: 1392257 - RNA, 12 nt, Homo sapiens
ucaaaaagggaa

SEQ ID NO: 1392258 - RNA, 16 nt, Homo sapiens
ucaaaaauacucacau

SEQ ID NO: 1392259 - RNA, 19 nt, Homo sapiens
ucaaaacagagaugugaua

SEQ ID NO: 1392260 - RNA, 15 nt, Homo sapiens
ucaaaaggaaaccaa

SEQ ID NO: 1392261 - RNA, 18 nt, Homo sapiens
ucaaaauaaaaaccaaga

SEQ ID NO: 1392262 - RNA, 17 nt, Homo sapiens
ucaaaauaaaaaugagg

SEQ ID NO: 1392263 - RNA, 16 nt, Homo sapiens
ucaaaauauacauuca

SEQ ID NO: 1392264 - RNA, 17 nt, Homo sapiens
ucaaaauauacauucaa

SEQ ID NO: 1392265 - RNA, 12 nt, Homo sapiens
ucaaaaugacag

SEQ ID NO: 1392266 - RNA, 14 nt, Homo sapiens
ucaaaauugcaauc

SEQ ID NO: 1392267 - RNA, 23 nt, Homo sapiens
ucaaacaugaaguguguuuccuu

SEQ ID NO: 1392268 - RNA, 18 nt, Homo sapiens
ucaaaccccgaccaccug

SEQ ID NO: 1392269 - RNA, 18 nt, Homo sapiens
ucaaaccuccaaaagccc

SEQ ID NO: 1392270 - RNA, 14 nt, Homo sapiens
ucaaacucaaacac

SEQ ID NO: 1392271 - RNA, 17 nt, Homo sapiens
ucaaacugcaugauuca

SEQ ID NO: 1392272 - RNA, 20 nt, Homo sapiens
ucaaagcacuguuucucuca

SEQ ID NO: 1392273 - RNA, 13 nt, Homo sapiens
ucaaagcaguagu

SEQ ID NO: 1392274 - RNA, 15 nt, Homo sapiens
ucaaaggcacaguga

SEQ ID NO: 1392275 - RNA, 17 nt, Homo sapiens
ucaaagugacuauucag

SEQ ID NO: 1392276 - RNA, 22 nt, Homo sapiens
ucaaagugagcuccuaagccau

SEQ ID NO: 1392277 - RNA, 21 nt, Homo sapiens
ucaaaguuuggauuguaucaa

SEQ ID NO: 1392278 - RNA, 13 nt, Homo sapiens
ucaaauagcauaa

SEQ ID NO: 1392279 - RNA, 17 nt, Homo sapiens
ucaaaugcacaucucau

SEQ ID NO: 1392280 - RNA, 12 nt, Homo sapiens
ucaaaugggcug

SEQ ID NO: 1392281 - RNA, 18 nt, Homo sapiens
ucaaauuauuaccaguga

SEQ ID NO: 1392282 - RNA, 22 nt, Homo sapiens
ucaacaaaauaaugcacuuccu

SEQ ID NO: 1392283 - RNA, 17 nt, Homo sapiens
ucaaccccucacaggag

SEQ ID NO: 1392284 - RNA, 23 nt, Homo sapiens
ucaacuggagacacuauuuaucu

SEQ ID NO: 1392285 - RNA, 15 nt, Homo sapiens
ucaagaccauaguga

SEQ ID NO: 1392286 - RNA, 19 nt, Homo sapiens
ucaagaccauagugaccaa

SEQ ID NO: 1392287 - RNA, 18 nt, Homo sapiens
ucaagaugagagaacugg

SEQ ID NO: 1392288 - RNA, 17 nt, Homo sapiens
ucaagauuaaacugagu

SEQ ID NO: 1392289 - RNA, 22 nt, Homo sapiens
ucaagcccugcagucacagcua

SEQ ID NO: 1392290 - RNA, 21 nt, Homo sapiens
ucaaggcccauaucugugaaa

SEQ ID NO: 1392291 - RNA, 15 nt, Homo sapiens
ucaaggcugcaguga

SEQ ID NO: 1392292 - RNA, 23 nt, Homo sapiens
ucaaggugggccuugcuaccuca

SEQ ID NO: 1392293 - RNA, 22 nt, Homo sapiens
ucaagguguuuugaaaugcaga

SEQ ID NO: 1392294 - RNA, 16 nt, Homo sapiens
ucaaguccugccucuu

SEQ ID NO: 1392295 - RNA, 20 nt, Homo sapiens
ucaaguggcaugugcuguga

SEQ ID NO: 1392296 - RNA, 14 nt, Homo sapiens
ucaaguguauuuga

SEQ ID NO: 1392297 - RNA, 16 nt, Homo sapiens
ucaaguuaacaaggaa

SEQ ID NO: 1392298 - RNA, 16 nt, Homo sapiens
ucaaguugcacacuca

SEQ ID NO: 1392299 - RNA, 22 nt, Homo sapiens
ucaaguuggcuucuaaucaaag

SEQ ID NO: 1392300 - RNA, 22 nt, Homo sapiens
ucaauaaacagcuucaugccuu

SEQ ID NO: 1392301 - RNA, 17 nt, Homo sapiens
ucaauaagccucagcuu

SEQ ID NO: 1392302 - RNA, 20 nt, Homo sapiens
ucaauacuauggaguaccau

SEQ ID NO: 1392303 - RNA, 14 nt, Homo sapiens
ucaauauuccugaa

SEQ ID NO: 1392304 - RNA, 19 nt, Homo sapiens
ucaaucaaaacucaguauc

SEQ ID NO: 1392305 - RNA, 15 nt, Homo sapiens
ucaaucacguguaua

SEQ ID NO: 1392306 - RNA, 18 nt, Homo sapiens
ucaaucccagcuacucaa

SEQ ID NO: 1392307 - RNA, 20 nt, Homo sapiens
ucaaugauuuacucaauauc

SEQ ID NO: 1392308 - RNA, 12 nt, Homo sapiens
ucaaugcuauaa

SEQ ID NO: 1392309 - RNA, 20 nt, Homo sapiens
ucaauguuuguccuguauaa

SEQ ID NO: 1392310 - RNA, 16 nt, Homo sapiens
ucaauuacaacaguga

SEQ ID NO: 1392311 - RNA, 16 nt, Homo sapiens
ucaauucagugcugua

SEQ ID NO: 1392312 - RNA, 22 nt, Homo sapiens
ucaauuucuggaaaacugccuu

SEQ ID NO: 1392313 - RNA, 16 nt, Homo sapiens
uuucugaucugaugca

SEQ ID NO: 1392314 - RNA, 19 nt, Homo sapiens
uuucugcuaaaaaguccuu

SEQ ID NO: 1392315 - RNA, 17 nt, Homo sapiens
uuucuggaaaacugccu

SEQ ID NO: 1392316 - RNA, 22 nt, Homo sapiens
uuucugucacaucagcuccacu

SEQ ID NO: 1392317 - RNA, 22 nt, Homo sapiens
uuucuuauagucaauguuucuu

SEQ ID NO: 1392318 - RNA, 18 nt, Homo sapiens
uuucuuccaagacuccag

SEQ ID NO: 1392319 - RNA, 17 nt, Homo sapiens
uuucuugcagaucaaau

SEQ ID NO: 1392320 - RNA, 16 nt, Homo sapiens
uuucuuguugcugcau

SEQ ID NO: 1392321 - RNA, 16 nt, Homo sapiens
uuucuuuuaucacgau

SEQ ID NO: 1392322 - RNA, 15 nt, Homo sapiens
uuugaaaucuaugaa

SEQ ID NO: 1392323 - RNA, 23 nt, Homo sapiens
uuugaaauugagcuggaccucac

SEQ ID NO: 1392324 - RNA, 14 nt, Homo sapiens
uuugaaccaaaaca

SEQ ID NO: 1392325 - RNA, 19 nt, Homo sapiens
uuugaagcugcagugagcu

SEQ ID NO: 1392326 - RNA, 16 nt, Homo sapiens
uuugaaucacaguaua

SEQ ID NO: 1392327 - RNA, 16 nt, Homo sapiens
uuugagguuuccuuca

SEQ ID NO: 1392328 - RNA, 15 nt, Homo sapiens
uuugaguugaauuua

SEQ ID NO: 1392329 - RNA, 19 nt, Homo sapiens
uuugauacaagaaagcaau

SEQ ID NO: 1392330 - RNA, 21 nt, Homo sapiens
uuugauauacuauuuucauuc

SEQ ID NO: 1392331 - RNA, 20 nt, Homo sapiens
uuugaugauuaauucaccuu

SEQ ID NO: 1392332 - RNA, 22 nt, Homo sapiens
uuugcacuuucaggaacacucu

SEQ ID NO: 1392333 - RNA, 21 nt, Homo sapiens
uuugcuaaaugugaaugauga

SEQ ID NO: 1392334 - RNA, 15 nt, Homo sapiens
uuugcuaccugaaca

SEQ ID NO: 1392335 - RNA, 17 nt, Homo sapiens
uuugcuaccugaacacu

SEQ ID NO: 1392336 - RNA, 15 nt, Homo sapiens
uuugcuagcagaaau

SEQ ID NO: 1392337 - RNA, 20 nt, Homo sapiens
uuugcuauggggacauucca

SEQ ID NO: 1392338 - RNA, 13 nt, Homo sapiens
uuugcucagaaca

SEQ ID NO: 1392339 - RNA, 20 nt, Homo sapiens
uuugggaacugcaauaaccu

SEQ ID NO: 1392340 - RNA, 17 nt, Homo sapiens
uuuggggacucauuuca

SEQ ID NO: 1392341 - RNA, 19 nt, Homo sapiens
uuugggguguggaugucga

SEQ ID NO: 1392342 - RNA, 21 nt, Homo sapiens
uuugggguguggaugucgaga

SEQ ID NO: 1392343 - RNA, 16 nt, Homo sapiens
uuugguuaaacccaug

SEQ ID NO: 1392344 - RNA, 16 nt, Homo sapiens
uuuguaucauuaugaa

SEQ ID NO: 1392345 - RNA, 20 nt, Homo sapiens
uuuguaucauuaugaaguca

SEQ ID NO: 1392346 - RNA, 20 nt, Homo sapiens
uuuguauccucugaccuaca

SEQ ID NO: 1392347 - RNA, 22 nt, Homo sapiens
uuugucacaaauaaacauaaua

SEQ ID NO: 1392348 - RNA, 15 nt, Homo sapiens
uuugugcagcacagu

SEQ ID NO: 1392349 - RNA, 13 nt, Homo sapiens
uuuguggccucag

SEQ ID NO: 1392350 - RNA, 20 nt, Homo sapiens
uuuguguguaccugugacua

SEQ ID NO: 1392351 - RNA, 16 nt, Homo sapiens
uuugugugugugcaag

SEQ ID NO: 1392352 - RNA, 17 nt, Homo sapiens
uuuguuaagacugcuga

SEQ ID NO: 1392353 - RNA, 15 nt, Homo sapiens
uuuguugcagccaaa

SEQ ID NO: 1392354 - RNA, 12 nt, Homo sapiens
uuuguugcccag

SEQ ID NO: 1392355 - RNA, 17 nt, Homo sapiens
uuuuaaauuuucuucag

SEQ ID NO: 1392356 - RNA, 13 nt, Homo sapiens
uuuuaacauucca

SEQ ID NO: 1392357 - RNA, 20 nt, Homo sapiens
uuuuaaggcuaaaacuuaac

SEQ ID NO: 1392358 - RNA, 15 nt, Homo sapiens
uuuuaagugccuuua

SEQ ID NO: 1392359 - RNA, 19 nt, Homo sapiens
uuuuaaugaagugcaauac

SEQ ID NO: 1392360 - RNA, 12 nt, Homo sapiens
uuuuacaccagu

SEQ ID NO: 1392361 - RNA, 17 nt, Homo sapiens
uuuuacagugcuauuua

SEQ ID NO: 1392362 - RNA, 17 nt, Homo sapiens
uuuuacauguggcccaa

SEQ ID NO: 1392363 - RNA, 16 nt, Homo sapiens
uuuuacuacuguggaa

SEQ ID NO: 1392364 - RNA, 19 nt, Homo sapiens
uuuuagacccuauugcugc

SEQ ID NO: 1392365 - RNA, 18 nt, Homo sapiens
uuuuaguagacaguagga

SEQ ID NO: 1392366 - RNA, 21 nt, Homo sapiens
uuuuauaccgcugcauaguau

SEQ ID NO: 1392367 - RNA, 12 nt, Homo sapiens
uuuuauauccac

SEQ ID NO: 1392368 - RNA, 14 nt, Homo sapiens
uuuucaacauaacu

SEQ ID NO: 1392369 - RNA, 16 nt, Homo sapiens
uuuucaauucaaaaau

SEQ ID NO: 1392370 - RNA, 21 nt, Homo sapiens
uuuucacugcuggcugccuua

SEQ ID NO: 1392371 - RNA, 17 nt, Homo sapiens
uuuucauaugcuucaaa

SEQ ID NO: 1392372 - RNA, 12 nt, Homo sapiens
uuuucauuccau

SEQ ID NO: 1392373 - RNA, 17 nt, Homo sapiens
uuuucauugauaugaaa

SEQ ID NO: 1392374 - RNA, 13 nt, Homo sapiens
uuuuccacuuaga

SEQ ID NO: 1392375 - RNA, 18 nt, Homo sapiens
uuuuccaugacugcauuu

SEQ ID NO: 1392376 - RNA, 23 nt, Homo sapiens
uuuuccauuuuuauuucaaaaua

SEQ ID NO: 1392377 - RNA, 16 nt, Homo sapiens
uuuuccuucuacuuac

SEQ ID NO: 1392378 - RNA, 21 nt, Homo sapiens
uuuuccuucuacuuacacauc

SEQ ID NO: 1392379 - RNA, 15 nt, Homo sapiens
uuuucuagucuucau

SEQ ID NO: 1392380 - RNA, 18 nt, Homo sapiens
uuuucuuauuuaacuuaa

SEQ ID NO: 1392381 - RNA, 14 nt, Homo sapiens
uuuucuuccuugua

SEQ ID NO: 1392382 - RNA, 15 nt, Homo sapiens
uuuucuugccaauga

SEQ ID NO: 1392383 - RNA, 12 nt, Homo sapiens
uuuugacaucaa

SEQ ID NO: 1392384 - RNA, 16 nt, Homo sapiens
uucucaccauuugagu

SEQ ID NO: 1392385 - RNA, 20 nt, Homo sapiens
uucucaguguagggcagaga

SEQ ID NO: 1392386 - RNA, 14 nt, Homo sapiens
uucuccaaaugaga

SEQ ID NO: 1392387 - RNA, 20 nt, Homo sapiens
uucuccauacgcacugguau

SEQ ID NO: 1392388 - RNA, 16 nt, Homo sapiens
uucucccucagucugg

SEQ ID NO: 1392389 - RNA, 19 nt, Homo sapiens
uucucuacagaugucccau

SEQ ID NO: 1392390 - RNA, 16 nt, Homo sapiens
uucucuaccucauggg

SEQ ID NO: 1392391 - RNA, 22 nt, Homo sapiens
uucucuagggaaggccaccugc

SEQ ID NO: 1392392 - RNA, 15 nt, Homo sapiens
uucucuauugcugcu

SEQ ID NO: 1392393 - RNA, 20 nt, Homo sapiens
uucucucaccuccuaaagua

SEQ ID NO: 1392394 - RNA, 20 nt, Homo sapiens
uucugaaaagaugguaucau

SEQ ID NO: 1392395 - RNA, 11 nt, Homo sapiens
uucugacccac

SEQ ID NO: 1392396 - RNA, 16 nt, Homo sapiens
uucugaucugaugcaa

SEQ ID NO: 1392397 - RNA, 15 nt, Homo sapiens
uucugauuaaugcua

SEQ ID NO: 1392398 - RNA, 23 nt, Homo sapiens
uucugccaggcccccaagccugc

SEQ ID NO: 1392399 - RNA, 21 nt, Homo sapiens
uucugccuccauucugaccau

SEQ ID NO: 1392400 - RNA, 13 nt, Homo sapiens
uucugcucacaua

SEQ ID NO: 1392401 - RNA, 16 nt, Homo sapiens
uucuggaaaagcaaaa

SEQ ID NO: 1392402 - RNA, 14 nt, Homo sapiens
uucuguaguacucc

SEQ ID NO: 1392403 - RNA, 20 nt, Homo sapiens
uucuguccgagcuuugaaaa

SEQ ID NO: 1392404 - RNA, 18 nt, Homo sapiens
uucugucuuuauaaucua

SEQ ID NO: 1392405 - RNA, 13 nt, Homo sapiens
uucuguuccacau

SEQ ID NO: 1392406 - RNA, 16 nt, Homo sapiens
uucuguugaaguuuac

SEQ ID NO: 1392407 - RNA, 22 nt, Homo sapiens
uucuguuucuauucucuccuca

SEQ ID NO: 1392408 - RNA, 21 nt, Homo sapiens
uucuuaaacaaauguaugauu

SEQ ID NO: 1392409 - RNA, 17 nt, Homo sapiens
uucuuaaagaguucuua

SEQ ID NO: 1392410 - RNA, 19 nt, Homo sapiens
uucuuaauauaacugccuu

SEQ ID NO: 1392411 - RNA, 13 nt, Homo sapiens
uucuuacaaacau

SEQ ID NO: 1392412 - RNA, 16 nt, Homo sapiens
uucuuacucacacaca

SEQ ID NO: 1392413 - RNA, 13 nt, Homo sapiens
uucuucaaucuga

SEQ ID NO: 1392414 - RNA, 14 nt, Homo sapiens
uucuucaucccacu

SEQ ID NO: 1392415 - RNA, 22 nt, Homo sapiens
uucuuccacagugccuaauaau

SEQ ID NO: 1392416 - RNA, 22 nt, Homo sapiens
uucuucucaaaggguacuucca

SEQ ID NO: 1392417 - RNA, 16 nt, Homo sapiens
uucuucuuagcaccac

SEQ ID NO: 1392418 - RNA, 12 nt, Homo sapiens
uucuugcugcua

SEQ ID NO: 1392419 - RNA, 19 nt, Homo sapiens
uucuuuaaauuucaucuca

SEQ ID NO: 1392420 - RNA, 18 nt, Homo sapiens
uucuuucaaagaagccag

SEQ ID NO: 1392421 - RNA, 19 nt, Homo sapiens
uucuuucagaaagcuuuga

SEQ ID NO: 1392422 - RNA, 13 nt, Homo sapiens
uucuuugaaguuu

SEQ ID NO: 1392423 - RNA, 12 nt, Homo sapiens
uucuuugcccac

SEQ ID NO: 1392424 - RNA, 12 nt, Homo sapiens
uugaaaaccugg

SEQ ID NO: 1392425 - RNA, 13 nt, Homo sapiens
uugaaacuuguau

SEQ ID NO: 1392426 - RNA, 13 nt, Homo sapiens
uugaaaucuauga

SEQ ID NO: 1392427 - RNA, 17 nt, Homo sapiens
uugaaauuaaccauaga

SEQ ID NO: 1392428 - RNA, 21 nt, Homo sapiens
uugaacuuaaauaaaugucau

SEQ ID NO: 1392429 - RNA, 14 nt, Homo sapiens
uugaagaagauaug

SEQ ID NO: 1392430 - RNA, 18 nt, Homo sapiens
uugaagauaucuugaaau

SEQ ID NO: 1392431 - RNA, 17 nt, Homo sapiens
uugaagaugucauccca

SEQ ID NO: 1392432 - RNA, 23 nt, Homo sapiens
uugaagaugucaucccauugucu

SEQ ID NO: 1392433 - RNA, 22 nt, Homo sapiens
uugaagcucuggugacaccagc

SEQ ID NO: 1392434 - RNA, 23 nt, Homo sapiens
uugaaggccuuauucuacauuuc

SEQ ID NO: 1392435 - RNA, 16 nt, Homo sapiens
uugaauauaaacacua

SEQ ID NO: 1392436 - RNA, 20 nt, Homo sapiens
uugaaugaugugauacaaau

SEQ ID NO: 1392437 - RNA, 22 nt, Homo sapiens
uugaauggcaugcuaguagcag

SEQ ID NO: 1392438 - RNA, 15 nt, Homo sapiens
uugacacggccauga

SEQ ID NO: 1392439 - RNA, 14 nt, Homo sapiens
uugacauaacacua

SEQ ID NO: 1392440 - RNA, 16 nt, Homo sapiens
uugacauaauuucacu

SEQ ID NO: 1392441 - RNA, 18 nt, Homo sapiens
uugacauaauuucacuga

SEQ ID NO: 1392442 - RNA, 14 nt, Homo sapiens
uugacaucaaugau

SEQ ID NO: 1392443 - RNA, 17 nt, Homo sapiens
uugaccaagaacugcau

SEQ ID NO: 1392444 - RNA, 21 nt, Homo sapiens
uugacucuuguuuucaguuuc

SEQ ID NO: 1392445 - RNA, 17 nt, Homo sapiens
uugacuucgacugugac

SEQ ID NO: 1392446 - RNA, 17 nt, Homo sapiens
uugacuugacagaacac

SEQ ID NO: 1392447 - RNA, 18 nt, Homo sapiens
uugagacuauugagauau

SEQ ID NO: 1392448 - RNA, 11 nt, Homo sapiens
uugagccaugc

SEQ ID NO: 1392449 - RNA, 19 nt, Homo sapiens
uugagcuuaagaauuuuga

SEQ ID NO: 1392450 - RNA, 21 nt, Homo sapiens
uugagcuucauauaccagcaa

SEQ ID NO: 1392451 - RNA, 15 nt, Homo sapiens
uugagggguggaccc

SEQ ID NO: 1392452 - RNA, 13 nt, Homo sapiens
uuaauccuagcug

SEQ ID NO: 1392453 - RNA, 17 nt, Homo sapiens
uuaauuguuaagauaug

SEQ ID NO: 1392454 - RNA, 18 nt, Homo sapiens
uuaauuugauaguauugu

SEQ ID NO: 1392455 - RNA, 15 nt, Homo sapiens
uuaauuuucaguaua

SEQ ID NO: 1392456 - RNA, 17 nt, Homo sapiens
uuaauuuucaguauaau

SEQ ID NO: 1392457 - RNA, 14 nt, Homo sapiens
uuaauuuugauuca

SEQ ID NO: 1392458 - RNA, 15 nt, Homo sapiens
uuacaaacugcaaua

SEQ ID NO: 1392459 - RNA, 14 nt, Homo sapiens
uuacaaaugcaauu

SEQ ID NO: 1392460 - RNA, 12 nt, Homo sapiens
uuacacaugaca

SEQ ID NO: 1392461 - RNA, 11 nt, Homo sapiens
uuacagcugcc

SEQ ID NO: 1392462 - RNA, 16 nt, Homo sapiens
uuacauuuuggucucu

SEQ ID NO: 1392463 - RNA, 13 nt, Homo sapiens
uuaccaaaggaua

SEQ ID NO: 1392464 - RNA, 22 nt, Homo sapiens
uuaccauuuguaauaaaguaua

SEQ ID NO: 1392465 - RNA, 19 nt, Homo sapiens
uuacccaggcuggagugca

SEQ ID NO: 1392466 - RNA, 16 nt, Homo sapiens
uuacccaguauuccau

SEQ ID NO: 1392467 - RNA, 16 nt, Homo sapiens
uuacccuucuuuccau

SEQ ID NO: 1392468 - RNA, 21 nt, Homo sapiens
uuaccuagauuuacagccuca

SEQ ID NO: 1392469 - RNA, 14 nt, Homo sapiens
uuaccuccuaucag

SEQ ID NO: 1392470 - RNA, 16 nt, Homo sapiens
uuaccuugcaucucac

SEQ ID NO: 1392471 - RNA, 12 nt, Homo sapiens
uuacugaaguua

SEQ ID NO: 1392472 - RNA, 20 nt, Homo sapiens
uuacugagcuucucugugaa

SEQ ID NO: 1392473 - RNA, 13 nt, Homo sapiens
uuacugugucagg

SEQ ID NO: 1392474 - RNA, 22 nt, Homo sapiens
uuacugugucaggaaacauauu

SEQ ID NO: 1392475 - RNA, 20 nt, Homo sapiens
uuacuuccuaucaagccagu

SEQ ID NO: 1392476 - RNA, 20 nt, Homo sapiens
uuagauugaguaagauuuac

SEQ ID NO: 1392477 - RNA, 17 nt, Homo sapiens
uuagcaauugacuguca

SEQ ID NO: 1392478 - RNA, 16 nt, Homo sapiens
uuagcaguucugcaaa

SEQ ID NO: 1392479 - RNA, 13 nt, Homo sapiens
uuagccaaaggau

SEQ ID NO: 1392480 - RNA, 15 nt, Homo sapiens
uuagcccaaaaccaa

SEQ ID NO: 1392481 - RNA, 23 nt, Homo sapiens
uuagcuaccucacuaugcugcuu

SEQ ID NO: 1392482 - RNA, 19 nt, Homo sapiens
uuaggcacccauccuagag

SEQ ID NO: 1392483 - RNA, 15 nt, Homo sapiens
uuaggcuauucacaa

SEQ ID NO: 1392484 - RNA, 17 nt, Homo sapiens
uuagguuuuguacaauu

SEQ ID NO: 1392485 - RNA, 12 nt, Homo sapiens
uuaguaauuucu

SEQ ID NO: 1392486 - RNA, 11 nt, Homo sapiens
uuaguauuuau

SEQ ID NO: 1392487 - RNA, 14 nt, Homo sapiens
uuagucaaaccacu

SEQ ID NO: 1392488 - RNA, 19 nt, Homo sapiens
uuagugguuacccaguuag

SEQ ID NO: 1392489 - RNA, 17 nt, Homo sapiens
uuaguuguguacucugg

SEQ ID NO: 1392490 - RNA, 21 nt, Homo sapiens
uuauaacccagugaguucagc

SEQ ID NO: 1392491 - RNA, 12 nt, Homo sapiens
uuauaacuuuaa

SEQ ID NO: 1392492 - RNA, 19 nt, Homo sapiens
uuauaauuuuaagauuccu

SEQ ID NO: 1392493 - RNA, 20 nt, Homo sapiens
uuauaccgcuaucauuccaa

SEQ ID NO: 1392494 - RNA, 19 nt, Homo sapiens
uuauauauuuauaacucau

SEQ ID NO: 1392495 - RNA, 12 nt, Homo sapiens
uuauauugcuag

SEQ ID NO: 1392496 - RNA, 13 nt, Homo sapiens
uuaucaguaguau

SEQ ID NO: 1392497 - RNA, 12 nt, Homo sapiens
uuaucaucugaa

SEQ ID NO: 1392498 - RNA, 19 nt, Homo sapiens
uuaucaugcaaaugcugua

SEQ ID NO: 1392499 - RNA, 21 nt, Homo sapiens
uuaucaugcaaaugcuguauu

SEQ ID NO: 1392500 - RNA, 15 nt, Homo sapiens
uuauccuuccacgga

SEQ ID NO: 1392501 - RNA, 22 nt, Homo sapiens
uuaucuaaucaugaaacucccu

SEQ ID NO: 1392502 - RNA, 13 nt, Homo sapiens
uuaucucaggggu

SEQ ID NO: 1392503 - RNA, 18 nt, Homo sapiens
aaaaccuuucaaauuuca

SEQ ID NO: 1392504 - RNA, 17 nt, Homo sapiens
aaaacguuuuauugugu

SEQ ID NO: 1392505 - RNA, 13 nt, Homo sapiens
aaaacuaauuucc

SEQ ID NO: 1392506 - RNA, 20 nt, Homo sapiens
aaaacuaauuuccucugaca

SEQ ID NO: 1392507 - RNA, 13 nt, Homo sapiens
aaaacucauuucc

SEQ ID NO: 1392508 - RNA, 14 nt, Homo sapiens
aaaacuucaauauc

SEQ ID NO: 1392509 - RNA, 14 nt, Homo sapiens
aaaacuugcugccu

SEQ ID NO: 1392510 - RNA, 22 nt, Homo sapiens
aaaagaugcauuaucuaugaua

SEQ ID NO: 1392511 - RNA, 13 nt, Homo sapiens
aaaagcugggcag

SEQ ID NO: 1392512 - RNA, 14 nt, Homo sapiens
aaaagggagauuca

SEQ ID NO: 1392513 - RNA, 20 nt, Homo sapiens
aaaagggagauucagacugu

SEQ ID NO: 1392514 - RNA, 20 nt, Homo sapiens
aaaagggcagggcaucuccu

SEQ ID NO: 1392515 - RNA, 19 nt, Homo sapiens
aaaaggguguugcuaagcu

SEQ ID NO: 1392516 - RNA, 20 nt, Homo sapiens
aaaaggucauagcugagauu

SEQ ID NO: 1392517 - RNA, 15 nt, Homo sapiens
aaaagguuauauacc

SEQ ID NO: 1392518 - RNA, 13 nt, Homo sapiens
aaaagugggccag

SEQ ID NO: 1392519 - RNA, 22 nt, Homo sapiens
aaaaguucauaacagugccauu

SEQ ID NO: 1392520 - RNA, 22 nt, Homo sapiens
aaaauaaaaaagaucuccaagc

SEQ ID NO: 1392521 - RNA, 18 nt, Homo sapiens
aaaauacaguauucugua

SEQ ID NO: 1392522 - RNA, 13 nt, Homo sapiens
aaaauagcaacac

SEQ ID NO: 1392523 - RNA, 21 nt, Homo sapiens
aaaauaggagagagaucauga

SEQ ID NO: 1392524 - RNA, 15 nt, Homo sapiens
aaaauauacauucaa

SEQ ID NO: 1392525 - RNA, 21 nt, Homo sapiens
aaaauccuucuaaucugcuau

SEQ ID NO: 1392526 - RNA, 12 nt, Homo sapiens
aaaaucugucca

SEQ ID NO: 1392527 - RNA, 15 nt, Homo sapiens
aaaaugcaacaacau

SEQ ID NO: 1392528 - RNA, 18 nt, Homo sapiens
aaaaugcaacaacaugua

SEQ ID NO: 1392529 - RNA, 16 nt, Homo sapiens
aaaauggccauuugcu

SEQ ID NO: 1392530 - RNA, 16 nt, Homo sapiens
aaaaugguaaaauugc

SEQ ID NO: 1392531 - RNA, 20 nt, Homo sapiens
aaaaugguguuuucauguaa

SEQ ID NO: 1392532 - RNA, 15 nt, Homo sapiens
aaaauguauuuuucc

SEQ ID NO: 1392533 - RNA, 19 nt, Homo sapiens
aaaauguccaccaauagaa

SEQ ID NO: 1392534 - RNA, 16 nt, Homo sapiens
aaaauuaaauugcaga

SEQ ID NO: 1392535 - RNA, 14 nt, Homo sapiens
aaaauuaugccaua

SEQ ID NO: 1392536 - RNA, 15 nt, Homo sapiens
aaaauucucuuaaac

SEQ ID NO: 1392537 - RNA, 20 nt, Homo sapiens
aaaauugaauuuaacaaugc

SEQ ID NO: 1392538 - RNA, 20 nt, Homo sapiens
aaaauuggcauuaaaacuua

SEQ ID NO: 1392539 - RNA, 21 nt, Homo sapiens
aaaauuuaggaccaauaccuc

SEQ ID NO: 1392540 - RNA, 13 nt, Homo sapiens
aaacaaauaugca

SEQ ID NO: 1392541 - RNA, 16 nt, Homo sapiens
aaacacagacauucug

SEQ ID NO: 1392542 - RNA, 22 nt, Homo sapiens
aaacacuauauggcagugucuu

SEQ ID NO: 1392543 - RNA, 12 nt, Homo sapiens
aaacacugaugg

SEQ ID NO: 1392544 - RNA, 13 nt, Homo sapiens
aaacacugauggu

SEQ ID NO: 1392545 - RNA, 20 nt, Homo sapiens
aaacagaaagcauccuaaau

SEQ ID NO: 1392546 - RNA, 19 nt, Homo sapiens
aaacagguggagaaauucc

SEQ ID NO: 1392547 - RNA, 23 nt, Homo sapiens
aaacaugggguuggcugggccca

SEQ ID NO: 1392548 - RNA, 15 nt, Homo sapiens
aaacauuaaugcaau

SEQ ID NO: 1392549 - RNA, 23 nt, Homo sapiens
aaacauugauuauaagcauguau

SEQ ID NO: 1392550 - RNA, 15 nt, Homo sapiens
aaaccacagcccugu

SEQ ID NO: 1392551 - RNA, 15 nt, Homo sapiens
aaaccacuagaacuc

SEQ ID NO: 1392552 - RNA, 21 nt, Homo sapiens
aaaccacuagaacucuccauc

SEQ ID NO: 1392553 - RNA, 13 nt, Homo sapiens
aaaccccaucucu

SEQ ID NO: 1392554 - RNA, 22 nt, Homo sapiens
aaaccucacaugcauacauaca

SEQ ID NO: 1392555 - RNA, 15 nt, Homo sapiens
aaaccuggaugucac

SEQ ID NO: 1392556 - RNA, 14 nt, Homo sapiens
aaaccugugugcca

SEQ ID NO: 1392557 - RNA, 21 nt, Homo sapiens
aaacgcuuauguuacagguua

SEQ ID NO: 1392558 - RNA, 14 nt, Homo sapiens
aaacuaagcuaugu

SEQ ID NO: 1392559 - RNA, 13 nt, Homo sapiens
aaacuauauucuc

SEQ ID NO: 1392560 - RNA, 20 nt, Homo sapiens
aaacucacagaacuauguac

SEQ ID NO: 1392561 - RNA, 17 nt, Homo sapiens
aaacucccuaguuccuu

SEQ ID NO: 1392562 - RNA, 18 nt, Homo sapiens
aaacuccugggcucaggc

SEQ ID NO: 1392563 - RNA, 20 nt, Homo sapiens
aaacugauuuuuagcuuuac

SEQ ID NO: 1392564 - RNA, 18 nt, Homo sapiens
aaacugguuuguugcagc

SEQ ID NO: 1392565 - RNA, 18 nt, Homo sapiens
aaacuucaucuuccccaa

SEQ ID NO: 1392566 - RNA, 22 nt, Homo sapiens
aaacuuccagugcaacacugaa

SEQ ID NO: 1392567 - RNA, 23 nt, Homo sapiens
aaacuucugcuuuaauggcuuua

SEQ ID NO: 1392568 - RNA, 19 nt, Homo sapiens
aaacuuguaaaugcuguca

SEQ ID NO: 1392569 - RNA, 19 nt, Homo sapiens
aaacuugugagguguuugc

SEQ ID NO: 1392570 - RNA, 17 nt, Homo sapiens
aaacuuuagaguagcau

SEQ ID NO: 1392571 - RNA, 23 nt, Homo sapiens
aaacuuuucuuaaaaaguuauaa

SEQ ID NO: 1392572 - RNA, 18 nt, Homo sapiens
aaagaaaaagaccuauga

SEQ ID NO: 1392573 - RNA, 15 nt, Homo sapiens
aaagaaagaaggaag

SEQ ID NO: 1392574 - RNA, 18 nt, Homo sapiens
aaagaaagccucagagaa

SEQ ID NO: 1392575 - RNA, 17 nt, Homo sapiens
aaagaaggaagugaaga

SEQ ID NO: 1392576 - RNA, 13 nt, Homo sapiens
aaagaagguuuca

SEQ ID NO: 1392577 - RNA, 15 nt, Homo sapiens
aaagaauucugugag

SEQ ID NO: 1392578 - RNA, 19 nt, Homo sapiens
aaagacuacauauugucac

SEQ ID NO: 1392579 - RNA, 14 nt, Homo sapiens
aaagacugcauuua

SEQ ID NO: 1392580 - RNA, 17 nt, Homo sapiens
aaagacuguacaaagua

SEQ ID NO: 1392581 - RNA, 19 nt, Homo sapiens
aaagacuguacaaaguaga

SEQ ID NO: 1392582 - RNA, 11 nt, Homo sapiens
aaagacuguag

SEQ ID NO: 1392583 - RNA, 19 nt, Homo sapiens
aaagagacauauacuaaga

SEQ ID NO: 1392584 - RNA, 18 nt, Homo sapiens
aaagaguuugagaccuga

SEQ ID NO: 1392585 - RNA, 20 nt, Homo sapiens
aaagauaacaagaucuuuca

SEQ ID NO: 1392586 - RNA, 19 nt, Homo sapiens
aaagauccaacaaggccau

SEQ ID NO: 1392587 - RNA, 23 nt, Homo sapiens
aaagauccccaaaacaggccagg

SEQ ID NO: 1392588 - RNA, 21 nt, Homo sapiens
aaagaucuuucaggacucuac

SEQ ID NO: 1392589 - RNA, 22 nt, Homo sapiens
aaagaugcauuaucuaugauau

SEQ ID NO: 1392590 - RNA, 21 nt, Homo sapiens
aaagauggcugugccucugcc

SEQ ID NO: 1392591 - RNA, 21 nt, Homo sapiens
aaagauguuauacaaccauca

SEQ ID NO: 1392592 - RNA, 17 nt, Homo sapiens
aaagauuuaaaauaauu

SEQ ID NO: 1392593 - RNA, 20 nt, Homo sapiens
aaagauuucuugaguuuugu

SEQ ID NO: 1392594 - RNA, 12 nt, Homo sapiens
aaagcaccugcc

SEQ ID NO: 1392595 - RNA, 15 nt, Homo sapiens
aaagcacuuacagau

SEQ ID NO: 1392596 - RNA, 15 nt, Homo sapiens
aaagcaggugcccag

SEQ ID NO: 1392597 - RNA, 22 nt, Homo sapiens
aaagcauccauguguggacuca

SEQ ID NO: 1392598 - RNA, 18 nt, Homo sapiens
aaagccaaacucugccag

SEQ ID NO: 1392599 - RNA, 15 nt, Homo sapiens
aaagccaucauguaa

SEQ ID NO: 1392600 - RNA, 13 nt, Homo sapiens
aaagcccuuccau

SEQ ID NO: 1392601 - RNA, 15 nt, Homo sapiens
aaagcccuuccaugu

SEQ ID NO: 1392602 - RNA, 17 nt, Homo sapiens
aaagccuucaaacuccc

SEQ ID NO: 1392603 - RNA, 17 nt, Homo sapiens
aaagcuaaaguaucugu

SEQ ID NO: 1392604 - RNA, 13 nt, Homo sapiens
aaagcucaucuca

SEQ ID NO: 1392605 - RNA, 13 nt, Homo sapiens
aaagcugccugua

SEQ ID NO: 1392606 - RNA, 16 nt, Homo sapiens
aaagcugcuaaaucuc

SEQ ID NO: 1392607 - RNA, 17 nt, Homo sapiens
aaagcugcuaaaucucc

SEQ ID NO: 1392608 - RNA, 15 nt, Homo sapiens
aaagcuuccauucca

SEQ ID NO: 1392609 - RNA, 19 nt, Homo sapiens
aaaggaaaauaguaauguu

SEQ ID NO: 1392610 - RNA, 15 nt, Homo sapiens
aaaggaaaccaagug

SEQ ID NO: 1392611 - RNA, 16 nt, Homo sapiens
aaaggaaagauuugcc

SEQ ID NO: 1392612 - RNA, 22 nt, Homo sapiens
aaaggaaagauuugccaauuga

SEQ ID NO: 1392613 - RNA, 13 nt, Homo sapiens
aaaggaaucucca

SEQ ID NO: 1392614 - RNA, 15 nt, Homo sapiens
aaaggaccaguaugc

SEQ ID NO: 1392615 - RNA, 13 nt, Homo sapiens
aaaggcacaguga

SEQ ID NO: 1392616 - RNA, 20 nt, Homo sapiens
caaguguaugcacgugugca

SEQ ID NO: 1392617 - RNA, 21 nt, Homo sapiens
caaguguaugcacgugugcac

SEQ ID NO: 1392618 - RNA, 18 nt, Homo sapiens
caagugucugugugcaag

SEQ ID NO: 1392619 - RNA, 15 nt, Homo sapiens
caccuagcaucucau

SEQ ID NO: 1392620 - RNA, 14 nt, Homo sapiens
caccuauaauacca

SEQ ID NO: 1392621 - RNA, 16 nt, Homo sapiens
caccucugcacaagcu

SEQ ID NO: 1392622 - RNA, 23 nt, Homo sapiens
cguguggcucacgugugugacuc

SEQ ID NO: 1392623 - RNA, 13 nt, Homo sapiens
cgugugugcaagu

SEQ ID NO: 1392624 - RNA, 16 nt, Homo sapiens
cguuuggccaaaaaga

SEQ ID NO: 1392625 - RNA, 17 nt, Homo sapiens
cguuuuuuucauuccau

SEQ ID NO: 1392626 - RNA, 12 nt, Homo sapiens
cuaaaacuuaac

SEQ ID NO: 1392627 - RNA, 14 nt, Homo sapiens
cuaaaacuuaacau

SEQ ID NO: 1392628 - RNA, 18 nt, Homo sapiens
cuaaaacuuaacauucau

SEQ ID NO: 1392629 - RNA, 16 nt, Homo sapiens
cuaaaagguaugcaau

SEQ ID NO: 1392630 - RNA, 21 nt, Homo sapiens
cuaaaaggugaccaaugaugg

SEQ ID NO: 1392631 - RNA, 19 nt, Homo sapiens
cuaaaaugaguuaccuaca

SEQ ID NO: 1392632 - RNA, 15 nt, Homo sapiens
cuaaaauuagaugaa

SEQ ID NO: 1392633 - RNA, 19 nt, Homo sapiens
cuaaaauuagaugaacuca

SEQ ID NO: 1392634 - RNA, 15 nt, Homo sapiens
cuaaagaagguuuca

SEQ ID NO: 1392635 - RNA, 20 nt, Homo sapiens
cuaaagccaaggguauccaa

SEQ ID NO: 1392636 - RNA, 21 nt, Homo sapiens
cuaaagguggugaggcaauaa

SEQ ID NO: 1392637 - RNA, 22 nt, Homo sapiens
cuaaaucuguaagcucuuugaa

SEQ ID NO: 1392638 - RNA, 15 nt, Homo sapiens
cuaaaugaagugcaa

SEQ ID NO: 1392639 - RNA, 18 nt, Homo sapiens
cuaaaugaauguuuacac

SEQ ID NO: 1392640 - RNA, 15 nt, Homo sapiens
cuaacacagccauca

SEQ ID NO: 1392641 - RNA, 20 nt, Homo sapiens
cuaacacagccaucaaggga

SEQ ID NO: 1392642 - RNA, 21 nt, Homo sapiens
cuaacaggauuagacagucaa

SEQ ID NO: 1392643 - RNA, 16 nt, Homo sapiens
cuaaccagccugguca

SEQ ID NO: 1392644 - RNA, 17 nt, Homo sapiens
cuaacuucaaggcccau

SEQ ID NO: 1392645 - RNA, 15 nt, Homo sapiens
cuaagaugggugggg

SEQ ID NO: 1392646 - RNA, 15 nt, Homo sapiens
cuaagcaaaaccacu

SEQ ID NO: 1392647 - RNA, 16 nt, Homo sapiens
cuaagcuauucaguaa

SEQ ID NO: 1392648 - RNA, 19 nt, Homo sapiens
cuaaggaauaugagcuuua

SEQ ID NO: 1392649 - RNA, 14 nt, Homo sapiens
cuaaggugugcucu

SEQ ID NO: 1392650 - RNA, 15 nt, Homo sapiens
cuaagucucugugaa

SEQ ID NO: 1392651 - RNA, 23 nt, Homo sapiens
cuaagugauccucccaccucagc

SEQ ID NO: 1392652 - RNA, 18 nt, Homo sapiens
cuaaguggaauagccucc

SEQ ID NO: 1392653 - RNA, 12 nt, Homo sapiens
cuaauacauuaa

SEQ ID NO: 1392654 - RNA, 17 nt, Homo sapiens
cuaauauguaacaagcc

SEQ ID NO: 1392655 - RNA, 21 nt, Homo sapiens
cuaauccucuuuuucuagucu

SEQ ID NO: 1392656 - RNA, 17 nt, Homo sapiens
cuaaucuaacaauggaa

SEQ ID NO: 1392657 - RNA, 13 nt, Homo sapiens
cuaaucuucaggg

SEQ ID NO: 1392658 - RNA, 15 nt, Homo sapiens
cuaaugucagaguag

SEQ ID NO: 1392659 - RNA, 20 nt, Homo sapiens
cuaauguggcagcugucuca

SEQ ID NO: 1392660 - RNA, 21 nt, Homo sapiens
cuaauuuauccugaaauuuca

SEQ ID NO: 1392661 - RNA, 21 nt, Homo sapiens
cuaauuuccucugacauguaa

SEQ ID NO: 1392662 - RNA, 15 nt, Homo sapiens
cuacaaacacaagca

SEQ ID NO: 1392663 - RNA, 20 nt, Homo sapiens
cuacaaacacaauauucaau

SEQ ID NO: 1392664 - RNA, 14 nt, Homo sapiens
cuacacagaucaca

SEQ ID NO: 1392665 - RNA, 22 nt, Homo sapiens
cuacacauucaauaagcaucaa

SEQ ID NO: 1392666 - RNA, 13 nt, Homo sapiens
cuacagacauuaa

SEQ ID NO: 1392667 - RNA, 21 nt, Homo sapiens
cuacagagagaaaaauugccu

SEQ ID NO: 1392668 - RNA, 20 nt, Homo sapiens
cuacaggaagcaccccaugc

SEQ ID NO: 1392669 - RNA, 14 nt, Homo sapiens
cuacauacaagcau

SEQ ID NO: 1392670 - RNA, 21 nt, Homo sapiens
cuaccaaagcaccuuagcugg

SEQ ID NO: 1392671 - RNA, 13 nt, Homo sapiens
cuaccacaaggaa

SEQ ID NO: 1392672 - RNA, 16 nt, Homo sapiens
cuacccuggcacuaua

SEQ ID NO: 1392673 - RNA, 15 nt, Homo sapiens
cuaccuaaacauguu

SEQ ID NO: 1392674 - RNA, 22 nt, Homo sapiens
cuaccucauggggguauuguau

SEQ ID NO: 1392675 - RNA, 23 nt, Homo sapiens
cuaccugagucccaaagcucccu

SEQ ID NO: 1392676 - RNA, 15 nt, Homo sapiens
cuaccuucaaagcug

SEQ ID NO: 1392677 - RNA, 22 nt, Homo sapiens
cuacgucaaacaugaagugugu

SEQ ID NO: 1392678 - RNA, 19 nt, Homo sapiens
cuacucaagaggcugaggc

SEQ ID NO: 1392679 - RNA, 12 nt, Homo sapiens
cuacucagggaa

SEQ ID NO: 1392680 - RNA, 19 nt, Homo sapiens
cuacucccucaaagcacac

SEQ ID NO: 1392681 - RNA, 20 nt, Homo sapiens
cuacuccuuguaaagacugu

SEQ ID NO: 1392682 - RNA, 12 nt, Homo sapiens
cuacugcugguu

SEQ ID NO: 1392683 - RNA, 21 nt, Homo sapiens
cuacugcuucuaccaacugga

SEQ ID NO: 1392684 - RNA, 17 nt, Homo sapiens
cuacuucuuuugcucuu

SEQ ID NO: 1392685 - RNA, 17 nt, Homo sapiens
cuagacaaaaaccauug

SEQ ID NO: 1392686 - RNA, 18 nt, Homo sapiens
cuagagccgugaugccuc

SEQ ID NO: 1392687 - RNA, 21 nt, Homo sapiens
cuagagcuagaugugucuuac

SEQ ID NO: 1392688 - RNA, 23 nt, Homo sapiens
cuagagcuagaugugucuuacca

SEQ ID NO: 1392689 - RNA, 22 nt, Homo sapiens
cuagaggcuugcauaauaagcu

SEQ ID NO: 1392690 - RNA, 17 nt, Homo sapiens
cuagaugagaauucagc

SEQ ID NO: 1392691 - RNA, 14 nt, Homo sapiens
cuagcugcaaguga

SEQ ID NO: 1392692 - RNA, 16 nt, Homo sapiens
cuagcugugugcaguc

SEQ ID NO: 1392693 - RNA, 15 nt, Homo sapiens
cuaggagaccaaggc

SEQ ID NO: 1392694 - RNA, 21 nt, Homo sapiens
cuaggccacuccuccaaagga

SEQ ID NO: 1392695 - RNA, 17 nt, Homo sapiens
cuagguaggggcccacu

SEQ ID NO: 1392696 - RNA, 15 nt, Homo sapiens
cuaguaaaagccauc

SEQ ID NO: 1392697 - RNA, 19 nt, Homo sapiens
cuagucagccacaugggaa

SEQ ID NO: 1392698 - RNA, 12 nt, Homo sapiens
cuaguuacacau

SEQ ID NO: 1392699 - RNA, 14 nt, Homo sapiens
cuaguuugaccuca

SEQ ID NO: 1392700 - RNA, 20 nt, Homo sapiens
cuauaauugccacugagaga

SEQ ID NO: 1392701 - RNA, 18 nt, Homo sapiens
cuauagccuaggugacag

SEQ ID NO: 1392702 - RNA, 23 nt, Homo sapiens
cuauagccuaggugacagaguga

SEQ ID NO: 1392703 - RNA, 13 nt, Homo sapiens
cuauauccaugua

SEQ ID NO: 1392704 - RNA, 19 nt, Homo sapiens
cuauauccauguacuguag

SEQ ID NO: 1392705 - RNA, 17 nt, Homo sapiens
cuauauuuaaguauuca

SEQ ID NO: 1392706 - RNA, 20 nt, Homo sapiens
cuaucaccucuuaugcacac

SEQ ID NO: 1392707 - RNA, 21 nt, Homo sapiens
cuaugaaaacagcuaucucac

SEQ ID NO: 1392708 - RNA, 18 nt, Homo sapiens
cuaugaaaauuauaucuc

SEQ ID NO: 1392709 - RNA, 17 nt, Homo sapiens
cuaugagcacauaggac

SEQ ID NO: 1392710 - RNA, 16 nt, Homo sapiens
cuaugaggcaaccaca

SEQ ID NO: 1392711 - RNA, 22 nt, Homo sapiens
cuaugcaacagcucucaccuac

SEQ ID NO: 1392712 - RNA, 16 nt, Homo sapiens
cuauggcacccaugca

SEQ ID NO: 1392713 - RNA, 23 nt, Homo sapiens
cuauggucagguuauacuccucc

SEQ ID NO: 1392714 - RNA, 15 nt, Homo sapiens
cuauguacuguaaua

SEQ ID NO: 1392715 - RNA, 19 nt, Homo sapiens
cuauuaaaucuugcaacug

SEQ ID NO: 1392716 - RNA, 16 nt, Homo sapiens
cuauuauuaacacuga

SEQ ID NO: 1392717 - RNA, 14 nt, Homo sapiens
cuauugacaucagc

SEQ ID NO: 1392718 - RNA, 17 nt, Homo sapiens
cuauugcuggcaaagac

SEQ ID NO: 1392719 - RNA, 14 nt, Homo sapiens
cuauuuaucuguag

SEQ ID NO: 1392720 - RNA, 19 nt, Homo sapiens
cuauuugcacuguagccuc

SEQ ID NO: 1392721 - RNA, 13 nt, Homo sapiens
cuauuuguauugu

SEQ ID NO: 1392722 - RNA, 21 nt, Homo sapiens
cucaaaagaaaaaaaaaagca

SEQ ID NO: 1392723 - RNA, 18 nt, Homo sapiens
cucaaacgguacacagac

SEQ ID NO: 1392724 - RNA, 20 nt, Homo sapiens
cucaaacucuugaccucagg

SEQ ID NO: 1392725 - RNA, 14 nt, Homo sapiens
cucaaacugugauu

SEQ ID NO: 1392726 - RNA, 16 nt, Homo sapiens
cucaaaguuaaccuac

SEQ ID NO: 1392727 - RNA, 22 nt, Homo sapiens
cucaauucauauuuaugaaucu

SEQ ID NO: 1392728 - RNA, 19 nt, Homo sapiens
cucacaccuguaaucccag

SEQ ID NO: 1392729 - RNA, 20 nt, Homo sapiens
cucacaccuguaaucccagc

SEQ ID NO: 1392730 - RNA, 14 nt, Homo sapiens
cucacagagugcau

SEQ ID NO: 1392731 - RNA, 14 nt, Homo sapiens
cucacagcuguaau

SEQ ID NO: 1392732 - RNA, 15 nt, Homo sapiens
cucacuccaccaccc

SEQ ID NO: 1392733 - RNA, 21 nt, Homo sapiens
cucacucccuucccauaagcu

SEQ ID NO: 1392734 - RNA, 10 nt, Homo sapiens
cucacugugu

SEQ ID NO: 1392735 - RNA, 22 nt, Homo sapiens
cucagaagacacugaugggcaa

SEQ ID NO: 1392736 - RNA, 16 nt, Homo sapiens
cucagaauacagacaa

SEQ ID NO: 1392737 - RNA, 20 nt, Homo sapiens
cucagaauugaucauuuucc

SEQ ID NO: 1392738 - RNA, 18 nt, Homo sapiens
cucagagguagggcugcc

SEQ ID NO: 1392739 - RNA, 13 nt, Homo sapiens
cucagaugcacau

SEQ ID NO: 1392740 - RNA, 14 nt, Homo sapiens
cucagcaaugauua

SEQ ID NO: 1392741 - RNA, 17 nt, Homo sapiens
cucagcuggaucuccau

SEQ ID NO: 1392742 - RNA, 16 nt, Homo sapiens
cucagcuuuuaaaugg

SEQ ID NO: 1392743 - RNA, 22 nt, Homo sapiens
cucaguaagaagagcuuggaaa

SEQ ID NO: 1392744 - RNA, 16 nt, Homo sapiens
cucaguagucagacug

SEQ ID NO: 1392745 - RNA, 17 nt, Homo sapiens
cucagucccaucagaga

SEQ ID NO: 1392746 - RNA, 21 nt, Homo sapiens
cucagucugggugggacuuau

SEQ ID NO: 1392747 - RNA, 15 nt, Homo sapiens
cucagugaacuguga

SEQ ID NO: 1392748 - RNA, 11 nt, Homo sapiens
cucagugcagg

SEQ ID NO: 1392749 - RNA, 11 nt, Homo sapiens
cucagugccac

SEQ ID NO: 1392750 - RNA, 13 nt, Homo sapiens
cucagugcuguaa

SEQ ID NO: 1392751 - RNA, 15 nt, Homo sapiens
cucagugucauuuau

SEQ ID NO: 1392752 - RNA, 16 nt, Homo sapiens
cucaguuccugcagca

SEQ ID NO: 1392753 - RNA, 16 nt, Homo sapiens
cucaguuggugcugcu

SEQ ID NO: 1392754 - RNA, 17 nt, Homo sapiens
cucaguuucacuuucac

SEQ ID NO: 1392755 - RNA, 14 nt, Homo sapiens
cucauacucaccuc

SEQ ID NO: 1392756 - RNA, 19 nt, Homo sapiens
cucauaugauugugcacau

SEQ ID NO: 1392757 - RNA, 17 nt, Homo sapiens
cucaucaucaacccuaa

SEQ ID NO: 1392758 - RNA, 13 nt, Homo sapiens
cucaucugggcaa

SEQ ID NO: 1392759 - RNA, 13 nt, Homo sapiens
cucaucugugauu

SEQ ID NO: 1392760 - RNA, 11 nt, Homo sapiens
cucaugaucuu

SEQ ID NO: 1392761 - RNA, 20 nt, Homo sapiens
cucaugauguauuguugcuu

SEQ ID NO: 1392762 - RNA, 20 nt, Homo sapiens
cucauggcagcuaagccaca

SEQ ID NO: 1392763 - RNA, 12 nt, Homo sapiens
cucauguagccu

SEQ ID NO: 1392764 - RNA, 18 nt, Homo sapiens
cucauuaccuugugcuaa

SEQ ID NO: 1392765 - RNA, 18 nt, Homo sapiens
cucauuccccaaccacuu

SEQ ID NO: 1392766 - RNA, 13 nt, Homo sapiens
cucauuugucaca

SEQ ID NO: 1392767 - RNA, 13 nt, Homo sapiens
cuccaaaugagau

SEQ ID NO: 1392768 - RNA, 13 nt, Homo sapiens
cuccaagcuccau

SEQ ID NO: 1392769 - RNA, 20 nt, Homo sapiens
cuccacaaaugggaaaacca

SEQ ID NO: 1392770 - RNA, 17 nt, Homo sapiens
cuccacagucaauauua

SEQ ID NO: 1392771 - RNA, 12 nt, Homo sapiens
cuccacccuaua

SEQ ID NO: 1392772 - RNA, 20 nt, Homo sapiens
cuccacugaaagaaguggga

SEQ ID NO: 1392773 - RNA, 19 nt, Homo sapiens
cuccagaaagcucaucuca

SEQ ID NO: 1392774 - RNA, 23 nt, Homo sapiens
cuccagaauggucuuucuaaugu

SEQ ID NO: 1392775 - RNA, 19 nt, Homo sapiens
cuccagagggaauugcaga

SEQ ID NO: 1392776 - RNA, 16 nt, Homo sapiens
cuccagagucaaaagg

SEQ ID NO: 1392777 - RNA, 15 nt, Homo sapiens
cuccagaugagagua

SEQ ID NO: 1392778 - RNA, 22 nt, Homo sapiens
cuccagaugagaguacacccca

SEQ ID NO: 1392779 - RNA, 16 nt, Homo sapiens
cuccaggaucuauuga

SEQ ID NO: 1392780 - RNA, 22 nt, Homo sapiens
cuccaggcugucuuucacugaa

SEQ ID NO: 1392781 - RNA, 12 nt, Homo sapiens
cuccagugcagg

SEQ ID NO: 1392782 - RNA, 12 nt, Homo sapiens
cuccauacucua

SEQ ID NO: 1392783 - RNA, 16 nt, Homo sapiens
cuccauccuaccacaa

SEQ ID NO: 1392784 - RNA, 17 nt, Homo sapiens
cuccaucuccacuccag

SEQ ID NO: 1392785 - RNA, 19 nt, Homo sapiens
cuccaugcugccuccagaa

SEQ ID NO: 1392786 - RNA, 14 nt, Homo sapiens
cuccauguuugaug

SEQ ID NO: 1392787 - RNA, 19 nt, Homo sapiens
cuccauucugaccauuuca

SEQ ID NO: 1392788 - RNA, 17 nt, Homo sapiens
cucccagaacacacucc

SEQ ID NO: 1392789 - RNA, 19 nt, Homo sapiens
cucccagaacacacuccau

SEQ ID NO: 1392790 - RNA, 20 nt, Homo sapiens
cucccagaacacacuccauc

SEQ ID NO: 1392791 - RNA, 21 nt, Homo sapiens
cucccagggccuuaaaagcca

SEQ ID NO: 1392792 - RNA, 16 nt, Homo sapiens
cucccagggcuacuca

SEQ ID NO: 1392793 - RNA, 17 nt, Homo sapiens
cucccauccuaaucauc

SEQ ID NO: 1392794 - RNA, 18 nt, Homo sapiens
cuccccagcaagugagag

SEQ ID NO: 1392795 - RNA, 16 nt, Homo sapiens
cuccccucagauucca

SEQ ID NO: 1392796 - RNA, 17 nt, Homo sapiens
cuccccuucacucccac

SEQ ID NO: 1392797 - RNA, 13 nt, Homo sapiens
cucccuaccaccu

SEQ ID NO: 1392798 - RNA, 16 nt, Homo sapiens
cucccuagggccuuca

SEQ ID NO: 1392799 - RNA, 20 nt, Homo sapiens
cucccucgaacccacacugc

SEQ ID NO: 1392800 - RNA, 23 nt, Homo sapiens
cucccuucuacugcuucuaccaa

SEQ ID NO: 1392801 - RNA, 19 nt, Homo sapiens
cucccuuguggcuuccuca

SEQ ID NO: 1392802 - RNA, 19 nt, Homo sapiens
cuccgcuuucuacccagcg

SEQ ID NO: 1392803 - RNA, 18 nt, Homo sapiens
cuccguuuggcagugcaa

SEQ ID NO: 1392804 - RNA, 13 nt, Homo sapiens
cuccucagacugc

SEQ ID NO: 1392805 - RNA, 19 nt, Homo sapiens
cuccucccaggaacugggc

SEQ ID NO: 1392806 - RNA, 17 nt, Homo sapiens
cuccucguaugcaugga

SEQ ID NO: 1392807 - RNA, 23 nt, Homo sapiens
cuccugauauagaucacauaaca

SEQ ID NO: 1392808 - RNA, 18 nt, Homo sapiens
cuccugcccaccugucaa

SEQ ID NO: 1392809 - RNA, 15 nt, Homo sapiens
cuccugcccaggaga

SEQ ID NO: 1392810 - RNA, 14 nt, Homo sapiens
cuccugccuacuca

SEQ ID NO: 1392811 - RNA, 23 nt, Homo sapiens
cuccuggacucaaaguauccucc

SEQ ID NO: 1392812 - RNA, 23 nt, Homo sapiens
cuccuggcuggggccuguugaag

SEQ ID NO: 1392813 - RNA, 18 nt, Homo sapiens
cuccugggcuaagugauc

SEQ ID NO: 1392814 - RNA, 13 nt, Homo sapiens
cuccugggcucag

SEQ ID NO: 1392815 - RNA, 16 nt, Homo sapiens
cuccuggucuugagau

SEQ ID NO: 1392816 - RNA, 14 nt, Homo sapiens
cuccuggugcugcc

SEQ ID NO: 1392817 - RNA, 14 nt, Homo sapiens
cuccuguacacuga

SEQ ID NO: 1392818 - RNA, 18 nt, Homo sapiens
cuccuguuagcuguuauu

SEQ ID NO: 1392819 - RNA, 12 nt, Homo sapiens
cuccuguuucac

SEQ ID NO: 1392820 - RNA, 19 nt, Homo sapiens
cuccuuaagaacacaaagc

SEQ ID NO: 1392821 - RNA, 19 nt, Homo sapiens
cuccuuccaacaggagcug

SEQ ID NO: 1392822 - RNA, 24 nt, Homo sapiens
cuccuuucaccacaugugcacaug

SEQ ID NO: 1392823 - RNA, 15 nt, Homo sapiens
cuccuuucucaucuu

SEQ ID NO: 1392824 - RNA, 17 nt, Homo sapiens
cuccuuuggccauucca

SEQ ID NO: 1392825 - RNA, 16 nt, Homo sapiens
cucgaugaagcccaau

SEQ ID NO: 1392826 - RNA, 17 nt, Homo sapiens
cucgcuuuguugcccag

SEQ ID NO: 1392827 - RNA, 22 nt, Homo sapiens
cucgggucccagaugucugcag

SEQ ID NO: 1392828 - RNA, 20 nt, Homo sapiens
cucguauaugucucaggucc

SEQ ID NO: 1392829 - RNA, 23 nt, Homo sapiens
cucgugguggaaacuuuucuuaa

SEQ ID NO: 1392830 - RNA, 14 nt, Homo sapiens
cucuaaaaauccau

SEQ ID NO: 1392831 - RNA, 12 nt, Homo sapiens
cucuaacaacaa

SEQ ID NO: 1392832 - RNA, 17 nt, Homo sapiens
gcccaaauggcagggau

SEQ ID NO: 1392833 - RNA, 15 nt, Homo sapiens
gcccaauguaaugca

SEQ ID NO: 1392834 - RNA, 15 nt, Homo sapiens
gcccaauuaccagaa

SEQ ID NO: 1392835 - RNA, 22 nt, Homo sapiens
gcccacauguguccaucccagc

SEQ ID NO: 1392836 - RNA, 16 nt, Homo sapiens
gcccaccuaccuucaa

SEQ ID NO: 1392837 - RNA, 20 nt, Homo sapiens
gcccacgcuggagugcagug

SEQ ID NO: 1392838 - RNA, 21 nt, Homo sapiens
gcccagaacuggacucaggau

SEQ ID NO: 1392839 - RNA, 20 nt, Homo sapiens
gcccagagaagccaaaagau

SEQ ID NO: 1392840 - RNA, 20 nt, Homo sapiens
gcccagccauuaccauggag

SEQ ID NO: 1392841 - RNA, 13 nt, Homo sapiens
gcccagcccagcu

SEQ ID NO: 1392842 - RNA, 17 nt, Homo sapiens
gcccaggauggcuuuga

SEQ ID NO: 1392843 - RNA, 19 nt, Homo sapiens
gcccaggccuccagcucag

SEQ ID NO: 1392844 - RNA, 15 nt, Homo sapiens
gcccauuuacacuuu

SEQ ID NO: 1392845 - RNA, 18 nt, Homo sapiens
gccccagaaggcagggaa

SEQ ID NO: 1392846 - RNA, 11 nt, Homo sapiens
gccccagagac

SEQ ID NO: 1392847 - RNA, 23 nt, Homo sapiens
gccccagagcuguuuauggccuc

SEQ ID NO: 1392848 - RNA, 23 nt, Homo sapiens
gccccagcacuaaagcaguggac

SEQ ID NO: 1392849 - RNA, 18 nt, Homo sapiens
gccccaucagcuccagcu

SEQ ID NO: 1392850 - RNA, 15 nt, Homo sapiens
gccccaugccugucc

SEQ ID NO: 1392851 - RNA, 12 nt, Homo sapiens
gcccccagcugu

SEQ ID NO: 1392852 - RNA, 17 nt, Homo sapiens
gcccccaggcugcugga

SEQ ID NO: 1392853 - RNA, 20 nt, Homo sapiens
gccccucccugccagcaccc

SEQ ID NO: 1392854 - RNA, 17 nt, Homo sapiens
gccccucugacucccaa

SEQ ID NO: 1392855 - RNA, 18 nt, Homo sapiens
gccccuggcucugaccga

SEQ ID NO: 1392856 - RNA, 18 nt, Homo sapiens
gcccgacagccuggcaca

SEQ ID NO: 1392857 - RNA, 14 nt, Homo sapiens
gcccucagauuccg

SEQ ID NO: 1392858 - RNA, 19 nt, Homo sapiens
gcccucagauuccgcacca

SEQ ID NO: 1392859 - RNA, 23 nt, Homo sapiens
gcccucgugguggaaacuuuucu

SEQ ID NO: 1392860 - RNA, 23 nt, Homo sapiens
gcccucuaugguguggcaaagcc

SEQ ID NO: 1392861 - RNA, 20 nt, Homo sapiens
gcccuggggccuguacaaaa

SEQ ID NO: 1392862 - RNA, 23 nt, Homo sapiens
gcccugugcccccugaaacagcu

SEQ ID NO: 1392863 - RNA, 18 nt, Homo sapiens
gcccuguucugggugcag

SEQ ID NO: 1392864 - RNA, 21 nt, Homo sapiens
gccgagaucacgccacugcac

SEQ ID NO: 1392865 - RNA, 21 nt, Homo sapiens
gccguacucuuuggggcagcu

SEQ ID NO: 1392866 - RNA, 20 nt, Homo sapiens
gccgugauuuucauugcugg

SEQ ID NO: 1392867 - RNA, 23 nt, Homo sapiens
gccuaauacauuaaagcagucac

SEQ ID NO: 1392868 - RNA, 22 nt, Homo sapiens
gccuagcugggaaggugaccac

SEQ ID NO: 1392869 - RNA, 14 nt, Homo sapiens
gccuaggugacaga

SEQ ID NO: 1392870 - RNA, 13 nt, Homo sapiens
gccuauggcaucu

SEQ ID NO: 1392871 - RNA, 13 nt, Homo sapiens
gccucagugccac

SEQ ID NO: 1392872 - RNA, 16 nt, Homo sapiens
gccuccaagcuccauc

SEQ ID NO: 1392873 - RNA, 23 nt, Homo sapiens
gccuccaccccccagaaccuguc

SEQ ID NO: 1392874 - RNA, 14 nt, Homo sapiens
gccuccaugcugcc

SEQ ID NO: 1392875 - RNA, 12 nt, Homo sapiens
gccucccaaagu

SEQ ID NO: 1392876 - RNA, 19 nt, Homo sapiens
gccucccacccccaucucu

SEQ ID NO: 1392877 - RNA, 16 nt, Homo sapiens
gccuccccaacccugc

SEQ ID NO: 1392878 - RNA, 17 nt, Homo sapiens
gccucccccaauggcaa

SEQ ID NO: 1392879 - RNA, 19 nt, Homo sapiens
gccuccucuaacaggggcu

SEQ ID NO: 1392880 - RNA, 15 nt, Homo sapiens
gccucucccaucacu

SEQ ID NO: 1392881 - RNA, 17 nt, Homo sapiens
gccucugccugcauucu

SEQ ID NO: 1392882 - RNA, 18 nt, Homo sapiens
gccucuggaauugcucaa

SEQ ID NO: 1392883 - RNA, 13 nt, Homo sapiens
gccugaccaacau

SEQ ID NO: 1392884 - RNA, 12 nt, Homo sapiens
gccugaccuccc

SEQ ID NO: 1392885 - RNA, 17 nt, Homo sapiens
gccugagggcgagggga

SEQ ID NO: 1392886 - RNA, 18 nt, Homo sapiens
gccugauaggacccauau

SEQ ID NO: 1392887 - RNA, 13 nt, Homo sapiens
gccugcauucugc

SEQ ID NO: 1392888 - RNA, 14 nt, Homo sapiens
gccugccucuucuc

SEQ ID NO: 1392889 - RNA, 24 nt, Homo sapiens
gccugcgcagcuuggauggagacu

SEQ ID NO: 1392890 - RNA, 19 nt, Homo sapiens
gccuggagccccacugccc

SEQ ID NO: 1392891 - RNA, 20 nt, Homo sapiens
gccuggcagccgugccuuca

SEQ ID NO: 1392892 - RNA, 15 nt, Homo sapiens
gccuggcuucuggag

SEQ ID NO: 1392893 - RNA, 16 nt, Homo sapiens
gccugggcaacaacag

SEQ ID NO: 1392894 - RNA, 21 nt, Homo sapiens
gccugggcucccuugugcgug

SEQ ID NO: 1392895 - RNA, 18 nt, Homo sapiens
gccugggcuguggacaga

SEQ ID NO: 1392896 - RNA, 17 nt, Homo sapiens
gccuggggucugacaau

SEQ ID NO: 1392897 - RNA, 23 nt, Homo sapiens
gccuggggucugacaauaccucg

SEQ ID NO: 1392898 - RNA, 14 nt, Homo sapiens
gccuguaaucccag

SEQ ID NO: 1392899 - RNA, 19 nt, Homo sapiens
gccuguaaucccagcacuu

SEQ ID NO: 1392900 - RNA, 15 nt, Homo sapiens
gccugugccuaucac

SEQ ID NO: 1392901 - RNA, 15 nt, Homo sapiens
gccugugcugugacu

SEQ ID NO: 1392902 - RNA, 11 nt, Homo sapiens
gccuguggcau

SEQ ID NO: 1392903 - RNA, 20 nt, Homo sapiens
gccugugguuacagugcaga

SEQ ID NO: 1392904 - RNA, 13 nt, Homo sapiens
gccuuaaaagcca

SEQ ID NO: 1392905 - RNA, 22 nt, Homo sapiens
gccuuaccuccugcccaggaga

SEQ ID NO: 1392906 - RNA, 21 nt, Homo sapiens
gccuucacuccggugugccug

SEQ ID NO: 1392907 - RNA, 15 nt, Homo sapiens
gccuucugcccuccc

SEQ ID NO: 1392908 - RNA, 13 nt, Homo sapiens
gccuuucucccag

SEQ ID NO: 1392909 - RNA, 14 nt, Homo sapiens
gccuuuguugcuca

SEQ ID NO: 1392910 - RNA, 18 nt, Homo sapiens
gcgaaggggcccuggucc

SEQ ID NO: 1392911 - RNA, 20 nt, Homo sapiens
gcgagcccugguggcagugg

SEQ ID NO: 1392912 - RNA, 14 nt, Homo sapiens
gcgagucacugccu

SEQ ID NO: 1392913 - RNA, 20 nt, Homo sapiens
gcgaucuggguucacugcaa

SEQ ID NO: 1392914 - RNA, 19 nt, Homo sapiens
gcgccagaacccagauuuc

SEQ ID NO: 1392915 - RNA, 13 nt, Homo sapiens
gcggccugcugga

SEQ ID NO: 1392916 - RNA, 15 nt, Homo sapiens
gcggcuggugcaggg

SEQ ID NO: 1392917 - RNA, 18 nt, Homo sapiens
gcggcuggugcagggccu

SEQ ID NO: 1392918 - RNA, 12 nt, Homo sapiens
gcgucacuguga

SEQ ID NO: 1392919 - RNA, 22 nt, Homo sapiens
gcgugaaggccgagaagcaaga

SEQ ID NO: 1392920 - RNA, 16 nt, Homo sapiens
gcguguguccaugugu

SEQ ID NO: 1392921 - RNA, 20 nt, Homo sapiens
gcguguguccaugugugugc

SEQ ID NO: 1392922 - RNA, 23 nt, Homo sapiens
gcguguguccaugugugugcaag

SEQ ID NO: 1392923 - RNA, 13 nt, Homo sapiens
gcgugugugcaag

SEQ ID NO: 1392924 - RNA, 23 nt, Homo sapiens
gcuaaauguaagaaucauuguaa

SEQ ID NO: 1392925 - RNA, 14 nt, Homo sapiens
gcuaauauugcaau

SEQ ID NO: 1392926 - RNA, 21 nt, Homo sapiens
gcuaauugcuggcuggcugcc

SEQ ID NO: 1392927 - RNA, 15 nt, Homo sapiens
gcuaccuacugauaa

SEQ ID NO: 1392928 - RNA, 23 nt, Homo sapiens
gcuacugugucagggaacauauu

SEQ ID NO: 1392929 - RNA, 18 nt, Homo sapiens
gcuagacaagcuugucca

SEQ ID NO: 1392930 - RNA, 14 nt, Homo sapiens
ggcauucucugaag

SEQ ID NO: 1392931 - RNA, 20 nt, Homo sapiens
ggcauuugcaccuaccucac

SEQ ID NO: 1392932 - RNA, 22 nt, Homo sapiens
ggccaagcccagcuuaauggcu

SEQ ID NO: 1392933 - RNA, 20 nt, Homo sapiens
ggccaaggagggcagaucac

SEQ ID NO: 1392934 - RNA, 15 nt, Homo sapiens
ggccaauaaauauga

SEQ ID NO: 1392935 - RNA, 19 nt, Homo sapiens
ggccaauaaauaugauguu

SEQ ID NO: 1392936 - RNA, 17 nt, Homo sapiens
ggccagcugcaucuacu

SEQ ID NO: 1392937 - RNA, 18 nt, Homo sapiens
ggccagcugggaucugac

SEQ ID NO: 1392938 - RNA, 15 nt, Homo sapiens
ggccaggauggcacu

SEQ ID NO: 1392939 - RNA, 17 nt, Homo sapiens
ggccaugccacccuguu

SEQ ID NO: 1392940 - RNA, 17 nt, Homo sapiens
ggcccacagcccagcga

SEQ ID NO: 1392941 - RNA, 17 nt, Homo sapiens
ggcccaccuaccuucaa

SEQ ID NO: 1392942 - RNA, 19 nt, Homo sapiens
ggcccgacagccuggcaca

SEQ ID NO: 1392943 - RNA, 15 nt, Homo sapiens
ggccggccgggugcu

SEQ ID NO: 1392944 - RNA, 19 nt, Homo sapiens
ggccgggcgcgguggcuca

SEQ ID NO: 1392945 - RNA, 17 nt, Homo sapiens
ggccuaacacugggcug

SEQ ID NO: 1392946 - RNA, 16 nt, Homo sapiens
ggccuagggcccagga

SEQ ID NO: 1392947 - RNA, 10 nt, Homo sapiens
ggccucagaa

SEQ ID NO: 1392948 - RNA, 20 nt, Homo sapiens
ggccucccaaagugcuggga

SEQ ID NO: 1392949 - RNA, 20 nt, Homo sapiens
ggccuccucucucaguuuuu

SEQ ID NO: 1392950 - RNA, 22 nt, Homo sapiens
ggccucuuccuugcugugucau

SEQ ID NO: 1392951 - RNA, 21 nt, Homo sapiens
ggccuguugaagaugcuugua

SEQ ID NO: 1392952 - RNA, 23 nt, Homo sapiens
ggccuucuugugaucuugcucua

SEQ ID NO: 1392953 - RNA, 17 nt, Homo sapiens
ggcgaaaccccaucucu

SEQ ID NO: 1392954 - RNA, 20 nt, Homo sapiens
ggcgacagagcgagacuccg

SEQ ID NO: 1392955 - RNA, 16 nt, Homo sapiens
ggcgccugggaucuga

SEQ ID NO: 1392956 - RNA, 12 nt, Homo sapiens
ggcgugaucuug

SEQ ID NO: 1392957 - RNA, 15 nt, Homo sapiens
ggcuaaaaccaucau

SEQ ID NO: 1392958 - RNA, 16 nt, Homo sapiens
ggcuaagaguguccua

SEQ ID NO: 1392959 - RNA, 12 nt, Homo sapiens
ggcuaagugauc

SEQ ID NO: 1392960 - RNA, 13 nt, Homo sapiens
ggcuaccuacaua

SEQ ID NO: 1392961 - RNA, 17 nt, Homo sapiens
ggcuaguaaaagccauc

SEQ ID NO: 1392962 - RNA, 19 nt, Homo sapiens
ggcucagcggggacagcuc

SEQ ID NO: 1392963 - RNA, 18 nt, Homo sapiens
ggcucaggccauggcucc

SEQ ID NO: 1392964 - RNA, 16 nt, Homo sapiens
ggcucagucucaggag

SEQ ID NO: 1392965 - RNA, 21 nt, Homo sapiens
ggcucauauuccugcagccug

SEQ ID NO: 1392966 - RNA, 13 nt, Homo sapiens
ggcucaugaccug

SEQ ID NO: 1392967 - RNA, 14 nt, Homo sapiens
ggcucccaugacca

SEQ ID NO: 1392968 - RNA, 21 nt, Homo sapiens
ggcucgucggggggacagcuc

SEQ ID NO: 1392969 - RNA, 17 nt, Homo sapiens
ggcucuuaggcaaucac

SEQ ID NO: 1392970 - RNA, 19 nt, Homo sapiens
ggcugagagaggaagagcu

SEQ ID NO: 1392971 - RNA, 15 nt, Homo sapiens
ggcugaucucaggga

SEQ ID NO: 1392972 - RNA, 18 nt, Homo sapiens
ggcugcacccacccagga

SEQ ID NO: 1392973 - RNA, 19 nt, Homo sapiens
ggcugcccacacaccccaa

SEQ ID NO: 1392974 - RNA, 15 nt, Homo sapiens
ggcugcugaccucca

SEQ ID NO: 1392975 - RNA, 20 nt, Homo sapiens
ggcuggagugcaguggugcu

SEQ ID NO: 1392976 - RNA, 13 nt, Homo sapiens
ggcuggcacugac

SEQ ID NO: 1392977 - RNA, 14 nt, Homo sapiens
ggcuugcagugcgc

SEQ ID NO: 1392978 - RNA, 13 nt, Homo sapiens
ggcuugcugccaa

SEQ ID NO: 1392979 - RNA, 22 nt, Homo sapiens
gggaaaccaguguagccuugcc

SEQ ID NO: 1392980 - RNA, 22 nt, Homo sapiens
gggaaagggauuuucagcccuc

SEQ ID NO: 1392981 - RNA, 21 nt, Homo sapiens
gggaagacaacuaggauacuu

SEQ ID NO: 1392982 - RNA, 14 nt, Homo sapiens
gggaagacuguggc

SEQ ID NO: 1392983 - RNA, 22 nt, Homo sapiens
gggaagcgaugaauuuggagac

SEQ ID NO: 1392984 - RNA, 14 nt, Homo sapiens
gggacagcccacug

SEQ ID NO: 1392985 - RNA, 14 nt, Homo sapiens
gggaccacaaggaa

SEQ ID NO: 1392986 - RNA, 16 nt, Homo sapiens
gggacugagagacagg

SEQ ID NO: 1392987 - RNA, 11 nt, Homo sapiens
gggacugcugc

SEQ ID NO: 1392988 - RNA, 23 nt, Homo sapiens
gggacuuauguauuuaugaccuu

SEQ ID NO: 1392989 - RNA, 13 nt, Homo sapiens
gggagacacugau

SEQ ID NO: 1392990 - RNA, 18 nt, Homo sapiens
gggagauggaucaaucaa

SEQ ID NO: 1392991 - RNA, 20 nt, Homo sapiens
gggaggcagagguugcagug

SEQ ID NO: 1392992 - RNA, 20 nt, Homo sapiens
gggaggucaaggcugcagug

SEQ ID NO: 1392993 - RNA, 18 nt, Homo sapiens
gggagugcucaccgccuc

SEQ ID NO: 1392994 - RNA, 14 nt, Homo sapiens
gggauaagccagcu

SEQ ID NO: 1392995 - RNA, 23 nt, Homo sapiens
gggauaaguaaguuugauuucau

SEQ ID NO: 1392996 - RNA, 16 nt, Homo sapiens
gggauacccagugaug

SEQ ID NO: 1392997 - RNA, 13 nt, Homo sapiens
gggauagaaagga

SEQ ID NO: 1392998 - RNA, 19 nt, Homo sapiens
gggauggcuaaaaccauca

SEQ ID NO: 1392999 - RNA, 17 nt, Homo sapiens
gggauguuucugucaca

SEQ ID NO: 1393000 - RNA, 17 nt, Homo sapiens
gggauuggggaagacug

SEQ ID NO: 1393001 - RNA, 20 nt, Homo sapiens
gggauuuucagcccucagaa

SEQ ID NO: 1393002 - RNA, 17 nt, Homo sapiens
gggcaacagagcaagau

SEQ ID NO: 1393003 - RNA, 16 nt, Homo sapiens
gggcaagucccugacu

SEQ ID NO: 1393004 - RNA, 11 nt, Homo sapiens
gggcacagcug

SEQ ID NO: 1393005 - RNA, 23 nt, Homo sapiens
gggcagacacuguuugcccagug

SEQ ID NO: 1393006 - RNA, 13 nt, Homo sapiens
gggcagcacagag

SEQ ID NO: 1393007 - RNA, 15 nt, Homo sapiens
gggcagcauagcaag

SEQ ID NO: 1393008 - RNA, 13 nt, Homo sapiens
gggcagccacgug

SEQ ID NO: 1393009 - RNA, 19 nt, Homo sapiens
gggcagucuggcgcccaug

SEQ ID NO: 1393010 - RNA, 16 nt, Homo sapiens
gggcauggagccagug

SEQ ID NO: 1393011 - RNA, 22 nt, Homo sapiens
gggcugagcccuggcaggauga

SEQ ID NO: 1393012 - RNA, 15 nt, Homo sapiens
gggcuuacacgugga

SEQ ID NO: 1393013 - RNA, 16 nt, Homo sapiens
gggcuuuuacaccagu

SEQ ID NO: 1393014 - RNA, 22 nt, Homo sapiens
ggggaaaaucucagcaaugauu

SEQ ID NO: 1393015 - RNA, 12 nt, Homo sapiens
ggggacaucuca

SEQ ID NO: 1393016 - RNA, 15 nt, Homo sapiens
ggggacugucuuuca

SEQ ID NO: 1393017 - RNA, 14 nt, Homo sapiens
ggggaggccaagug

SEQ ID NO: 1393018 - RNA, 13 nt, Homo sapiens
ggggcagcacaga

SEQ ID NO: 1393019 - RNA, 17 nt, Homo sapiens
ggggcuuuuacaccagu

SEQ ID NO: 1393020 - RNA, 20 nt, Homo sapiens
ggggugguuuuugagccaug

SEQ ID NO: 1393021 - RNA, 19 nt, Homo sapiens
ggguaaccaaauguuggcc

SEQ ID NO: 1393022 - RNA, 19 nt, Homo sapiens
gggucucgcuuuguugccc

SEQ ID NO: 1393023 - RNA, 20 nt, Homo sapiens
gggucucgcuuuguugccca

SEQ ID NO: 1393024 - RNA, 19 nt, Homo sapiens
gggugacagagcaagugag

SEQ ID NO: 1393025 - RNA, 11 nt, Homo sapiens
gggugagccag

SEQ ID NO: 1393026 - RNA, 11 nt, Homo sapiens
gggugugcuau

SEQ ID NO: 1393027 - RNA, 13 nt, Homo sapiens
ggguguguguagc

SEQ ID NO: 1393028 - RNA, 17 nt, Homo sapiens
uuuaucuugucucuggg

SEQ ID NO: 1393029 - RNA, 12 nt, Homo sapiens
uuuaugcugcug

SEQ ID NO: 1393030 - RNA, 22 nt, Homo sapiens
uuuaugucucagaccacuauuc

SEQ ID NO: 1393031 - RNA, 21 nt, Homo sapiens
uuuauguuuggugaacuauau

SEQ ID NO: 1393032 - RNA, 14 nt, Homo sapiens
uuuauuaucaccau

SEQ ID NO: 1393033 - RNA, 13 nt, Homo sapiens
uuuauucuuguga

SEQ ID NO: 1393034 - RNA, 22 nt, Homo sapiens
uuucaaaaaaucugaccaaaac

SEQ ID NO: 1393035 - RNA, 19 nt, Homo sapiens
uuucaaaauauacauucaa

SEQ ID NO: 1393036 - RNA, 13 nt, Homo sapiens
uuucaaacugaua

SEQ ID NO: 1393037 - RNA, 17 nt, Homo sapiens
uuucaaucaaaacucag

SEQ ID NO: 1393038 - RNA, 20 nt, Homo sapiens
uuucacacaauacaauaagu

SEQ ID NO: 1393039 - RNA, 18 nt, Homo sapiens
uuucagauaaacaacaaa

SEQ ID NO: 1393040 - RNA, 18 nt, Homo sapiens
uuucagcuguuucaccau

SEQ ID NO: 1393041 - RNA, 18 nt, Homo sapiens
uuucaggaguuacuggau

SEQ ID NO: 1393042 - RNA, 18 nt, Homo sapiens
uuucaguauaauuuaacu

SEQ ID NO: 1393043 - RNA, 22 nt, Homo sapiens
uuucaguauaauuuaacuucag

SEQ ID NO: 1393044 - RNA, 15 nt, Homo sapiens
uuucauaugcuucaa

SEQ ID NO: 1393045 - RNA, 15 nt, Homo sapiens
uuucaucuaauguga

SEQ ID NO: 1393046 - RNA, 15 nt, Homo sapiens
uuucaugcgugugug

SEQ ID NO: 1393047 - RNA, 18 nt, Homo sapiens
uuucauuguguucucuau

SEQ ID NO: 1393048 - RNA, 22 nt, Homo sapiens
uuuccacaagauucccagagac

SEQ ID NO: 1393049 - RNA, 12 nt, Homo sapiens
uuucccaaagag

SEQ ID NO: 1393050 - RNA, 15 nt, Homo sapiens
uuuccuaaaagugua

SEQ ID NO: 1393051 - RNA, 20 nt, Homo sapiens
uuuccuguagucccauugau

SEQ ID NO: 1393052 - RNA, 21 nt, Homo sapiens
uuuccuguguacacgugacag

SEQ ID NO: 1393053 - RNA, 15 nt, Homo sapiens
uuuccuucagugcau

SEQ ID NO: 1393054 - RNA, 18 nt, Homo sapiens
uuuccuuugguccuucaa

SEQ ID NO: 1393055 - RNA, 19 nt, Homo sapiens
uuucguuaacauugaccaa

SEQ ID NO: 1393056 - RNA, 15 nt, Homo sapiens
aaaaaaugcauuuaa

SEQ ID NO: 1393057 - RNA, 19 nt, Homo sapiens
aaaaaaugcucacacucca

SEQ ID NO: 1393058 - RNA, 19 nt, Homo sapiens
aaaaacacagacauucugc

SEQ ID NO: 1393059 - RNA, 18 nt, Homo sapiens
aaaaaccaauagcuuuaa

SEQ ID NO: 1393060 - RNA, 22 nt, Homo sapiens
aaaaaccucuaugcaaucugag

SEQ ID NO: 1393061 - RNA, 21 nt, Homo sapiens
aaaaagcccuuaaaaauaugu

SEQ ID NO: 1393062 - RNA, 20 nt, Homo sapiens
aaaaagcuuuuaugagcuca

SEQ ID NO: 1393063 - RNA, 17 nt, Homo sapiens
aaaaauacucacauggc

SEQ ID NO: 1393064 - RNA, 21 nt, Homo sapiens
aaaaaucaugagauccuuuaa

SEQ ID NO: 1393065 - RNA, 21 nt, Homo sapiens
aaaaauccauaaaauccuuaa

SEQ ID NO: 1393066 - RNA, 21 nt, Homo sapiens
aaaaauggacaaaauccauga

SEQ ID NO: 1393067 - RNA, 14 nt, Homo sapiens
aaaaauguaucaaa

SEQ ID NO: 1393068 - RNA, 23 nt, Homo sapiens
aaaaauuugaaccaaaacauucc

SEQ ID NO: 1393069 - RNA, 16 nt, Homo sapiens
aaaacaaaaacaccua

SEQ ID NO: 1393070 - RNA, 22 nt, Homo sapiens
aaaacagaaauuaaucuuacaa

SEQ ID NO: 1393071 - RNA, 18 nt, Homo sapiens
aaaacagagaugugauaa

SEQ ID NO: 1393072 - RNA, 17 nt, Homo sapiens
aaaacaucgucuaaacu

SEQ ID NO: 1393073 - RNA, 20 nt, Homo sapiens
aaaacaucuuuccaguccuu

SEQ ID NO: 1393074 - RNA, 23 nt, Homo sapiens
aaaacauuuuacuuuaaaaggag

SEQ ID NO: 1393075 - RNA, 18 nt, Homo sapiens
aaaaccccaucucuacua

SEQ ID NO: 1393076 - RNA, 15 nt, Homo sapiens
aaaaccucuaugcaa

SEQ ID NO: 1393077 - RNA, 16 nt, Homo sapiens
aaaaccucuaugcaau

SEQ ID NO: 1393078 - RNA, 21 nt, Homo sapiens
ucaggaacacucugaauucca

SEQ ID NO: 1393079 - RNA, 20 nt, Homo sapiens
ucaggaaggaugagcauuua

SEQ ID NO: 1393080 - RNA, 18 nt, Homo sapiens
ucaggaguuccuaaccag

SEQ ID NO: 1393081 - RNA, 19 nt, Homo sapiens
ucaggaucaagaaaguguu

SEQ ID NO: 1393082 - RNA, 15 nt, Homo sapiens
ucaggcaacgcacaa

SEQ ID NO: 1393083 - RNA, 23 nt, Homo sapiens
ucaggcgauccaccugucucagc

SEQ ID NO: 1393084 - RNA, 14 nt, Homo sapiens
ucagggaacauauu

SEQ ID NO: 1393085 - RNA, 23 nt, Homo sapiens
ucagggauagcacugagcaaagc

SEQ ID NO: 1393086 - RNA, 18 nt, Homo sapiens
ucagggcagggcucugau

SEQ ID NO: 1393087 - RNA, 20 nt, Homo sapiens
ucagguuguaguaaagaaau

SEQ ID NO: 1393088 - RNA, 18 nt, Homo sapiens
ucaguaaacaaugaauag

SEQ ID NO: 1393089 - RNA, 21 nt, Homo sapiens
ucaguaagaccggaagcuccu

SEQ ID NO: 1393090 - RNA, 22 nt, Homo sapiens
ucaguaauaaaacaucuuucca

SEQ ID NO: 1393091 - RNA, 15 nt, Homo sapiens
ucaguaauaacucua

SEQ ID NO: 1393092 - RNA, 17 nt, Homo sapiens
ucaguacccaccugagc

SEQ ID NO: 1393093 - RNA, 23 nt, Homo sapiens
ucagucuuuuccuguuuuuguua

SEQ ID NO: 1393094 - RNA, 20 nt, Homo sapiens
ucagugaaagccagauucaa

SEQ ID NO: 1393095 - RNA, 23 nt, Homo sapiens
ucagugacagaguucacuauaaa

SEQ ID NO: 1393096 - RNA, 14 nt, Homo sapiens
ucagugcugcugaa

SEQ ID NO: 1393097 - RNA, 13 nt, Homo sapiens
aacauuaugccuu

SEQ ID NO: 1393098 - RNA, 16 nt, Homo sapiens
aacauuccaaugcauu

SEQ ID NO: 1393099 - RNA, 18 nt, Homo sapiens
aacauugaacucauaucu

SEQ ID NO: 1393100 - RNA, 14 nt, Homo sapiens
aacauugaccaaga

SEQ ID NO: 1393101 - RNA, 23 nt, Homo sapiens
aacauuguuuuguguaacauauu

SEQ ID NO: 1393102 - RNA, 14 nt, Homo sapiens
aaccaacacuaaca

SEQ ID NO: 1393103 - RNA, 18 nt, Homo sapiens
aaccacaggcagcauuua

SEQ ID NO: 1393104 - RNA, 23 nt, Homo sapiens
aaccacauagacuuuaugcaaua

SEQ ID NO: 1393105 - RNA, 12 nt, Homo sapiens
aaccacauuaua

SEQ ID NO: 1393106 - RNA, 19 nt, Homo sapiens
aaccacuaagagucucuau

SEQ ID NO: 1393107 - RNA, 16 nt, Homo sapiens
aaccagaaauccaguu

SEQ ID NO: 1393108 - RNA, 16 nt, Homo sapiens
aaccagaccauugucu

SEQ ID NO: 1393109 - RNA, 22 nt, Homo sapiens
aaccaggaacucuggaguucau

SEQ ID NO: 1393110 - RNA, 16 nt, Homo sapiens
aaccaguauacaagau

SEQ ID NO: 1393111 - RNA, 13 nt, Homo sapiens
aaccaucccugau

SEQ ID NO: 1393112 - RNA, 17 nt, Homo sapiens
aacccaacaugacuguu

SEQ ID NO: 1393113 - RNA, 20 nt, Homo sapiens
aacccaggagauggaaguug

SEQ ID NO: 1393114 - RNA, 19 nt, Homo sapiens
aacccaggaguucaggguc

SEQ ID NO: 1393115 - RNA, 14 nt, Homo sapiens
aaccccaucucuac

SEQ ID NO: 1393116 - RNA, 19 nt, Homo sapiens
aaccccaucucuacugaaa

SEQ ID NO: 1393117 - RNA, 17 nt, Homo sapiens
aaccccgggcaagacuu

SEQ ID NO: 1393118 - RNA, 19 nt, Homo sapiens
aacccuauugguaaagaau

SEQ ID NO: 1393119 - RNA, 22 nt, Homo sapiens
aaccgaugcuccagccaacccc

SEQ ID NO: 1393120 - RNA, 22 nt, Homo sapiens
aaccgauugccuuuauuuugcu

SEQ ID NO: 1393121 - RNA, 17 nt, Homo sapiens
aaccgcaggaagcugcu

SEQ ID NO: 1393122 - RNA, 16 nt, Homo sapiens
aaccguccucuuuuuc

SEQ ID NO: 1393123 - RNA, 16 nt, Homo sapiens
aaccucaaagugacua

SEQ ID NO: 1393124 - RNA, 12 nt, Homo sapiens
aaccucaucucu

SEQ ID NO: 1393125 - RNA, 22 nt, Homo sapiens
aaccucugggucaucucucaca

SEQ ID NO: 1393126 - RNA, 19 nt, Homo sapiens
aaccucuuuucugcaucau

SEQ ID NO: 1393127 - RNA, 13 nt, Homo sapiens
aaccugcucuccu

SEQ ID NO: 1393128 - RNA, 13 nt, Homo sapiens
aaccugcuuuacu

SEQ ID NO: 1393129 - RNA, 15 nt, Homo sapiens
aaccuguccuugcac

SEQ ID NO: 1393130 - RNA, 19 nt, Homo sapiens
aaccuguccuugcacacuc

SEQ ID NO: 1393131 - RNA, 14 nt, Homo sapiens
aaccuuccaucucg

SEQ ID NO: 1393132 - RNA, 11 nt, Homo sapiens
aaccuuucaaa

SEQ ID NO: 1393133 - RNA, 13 nt, Homo sapiens
aaccuuuucccaa

SEQ ID NO: 1393134 - RNA, 17 nt, Homo sapiens
aaccuuuucccaaccau

SEQ ID NO: 1393135 - RNA, 15 nt, Homo sapiens
aacgacaaagccaaa

SEQ ID NO: 1393136 - RNA, 23 nt, Homo sapiens
aacgacaaagccaaacucugcca

SEQ ID NO: 1393137 - RNA, 15 nt, Homo sapiens
aacgaguuguuggcu

SEQ ID NO: 1393138 - RNA, 17 nt, Homo sapiens
aacgcacacaguaucua

SEQ ID NO: 1393139 - RNA, 15 nt, Homo sapiens
aacgguacacagacu

SEQ ID NO: 1393140 - RNA, 13 nt, Homo sapiens
aacuaacacagcc

SEQ ID NO: 1393141 - RNA, 23 nt, Homo sapiens
aacuaacucuccuccauguugcc

SEQ ID NO: 1393142 - RNA, 19 nt, Homo sapiens
aacuaagaaauaugcacaa

SEQ ID NO: 1393143 - RNA, 21 nt, Homo sapiens
aacuaauucuuggguguuuau

SEQ ID NO: 1393144 - RNA, 14 nt, Homo sapiens
aacuacaaacacaa

SEQ ID NO: 1393145 - RNA, 14 nt, Homo sapiens
aacuacaauguagu

SEQ ID NO: 1393146 - RNA, 13 nt, Homo sapiens
aacuacugugauc

SEQ ID NO: 1393147 - RNA, 21 nt, Homo sapiens
aacuacuguguuccuggcaau

SEQ ID NO: 1393148 - RNA, 13 nt, Homo sapiens
aacuauauucuca

SEQ ID NO: 1393149 - RNA, 14 nt, Homo sapiens
aacuauguacaaua

SEQ ID NO: 1393150 - RNA, 19 nt, Homo sapiens
aacuauguucacaagaaca

SEQ ID NO: 1393151 - RNA, 21 nt, Homo sapiens
aacuauuggagggugggagag

SEQ ID NO: 1393152 - RNA, 10 nt, Homo sapiens
aacuauuuau

SEQ ID NO: 1393153 - RNA, 16 nt, Homo sapiens
aacucaaacucuuaaa

SEQ ID NO: 1393154 - RNA, 20 nt, Homo sapiens
aacucaaacucuuaaaaccc

SEQ ID NO: 1393155 - RNA, 19 nt, Homo sapiens
aacucaauauuuuccauga

SEQ ID NO: 1393156 - RNA, 21 nt, Homo sapiens
aacucagccaaccuuacuuac

SEQ ID NO: 1393157 - RNA, 13 nt, Homo sapiens
aagacaauggcuu

SEQ ID NO: 1393158 - RNA, 14 nt, Homo sapiens
aagacacagacugc

SEQ ID NO: 1393159 - RNA, 12 nt, Homo sapiens
aagacacuugau

SEQ ID NO: 1393160 - RNA, 15 nt, Homo sapiens
aagacagcuucucau

SEQ ID NO: 1393161 - RNA, 20 nt, Homo sapiens
aagacauaaauuacuuuuuc

SEQ ID NO: 1393162 - RNA, 15 nt, Homo sapiens
aagacaucaagcaca

SEQ ID NO: 1393163 - RNA, 12 nt, Homo sapiens
aagaccaagaca

SEQ ID NO: 1393164 - RNA, 22 nt, Homo sapiens
aagaccugcugagggaccagcc

SEQ ID NO: 1393165 - RNA, 21 nt, Homo sapiens
aagacgauuugucaguuauuu

SEQ ID NO: 1393166 - RNA, 18 nt, Homo sapiens
aagacuagaggcuugcau

SEQ ID NO: 1393167 - RNA, 23 nt, Homo sapiens
aagacuauaaaaaaaugcauuua

SEQ ID NO: 1393168 - RNA, 19 nt, Homo sapiens
aagacugucagcuuccaaa

SEQ ID NO: 1393169 - RNA, 14 nt, Homo sapiens
aagacuuaacuggu

SEQ ID NO: 1393170 - RNA, 16 nt, Homo sapiens
aagacuugguguccuu

SEQ ID NO: 1393171 - RNA, 13 nt, Homo sapiens
aagagaaaaugua

SEQ ID NO: 1393172 - RNA, 14 nt, Homo sapiens
aagagaaugucuga

SEQ ID NO: 1393173 - RNA, 20 nt, Homo sapiens
aagagagagcugagugagcu

SEQ ID NO: 1393174 - RNA, 17 nt, Homo sapiens
aagagagucgcaucuca

SEQ ID NO: 1393175 - RNA, 23 nt, Homo sapiens
aagagaucacaauacucaaaaga

SEQ ID NO: 1393176 - RNA, 13 nt, Homo sapiens
aagagauuccuga

SEQ ID NO: 1393177 - RNA, 18 nt, Homo sapiens
aagagcagcuaaaaccua

SEQ ID NO: 1393178 - RNA, 13 nt, Homo sapiens
aagagccacagua

SEQ ID NO: 1393179 - RNA, 17 nt, Homo sapiens
aagagccaggugcugcu

SEQ ID NO: 1393180 - RNA, 13 nt, Homo sapiens
aagagcuuuacaa

SEQ ID NO: 1393181 - RNA, 13 nt, Homo sapiens
aagaggaugaagu

SEQ ID NO: 1393182 - RNA, 17 nt, Homo sapiens
aagagggagaagggaug

SEQ ID NO: 1393183 - RNA, 21 nt, Homo sapiens
aagagguuuuaaaaaaauccc

SEQ ID NO: 1393184 - RNA, 14 nt, Homo sapiens
aagagucucuauua

SEQ ID NO: 1393185 - RNA, 22 nt, Homo sapiens
aagaguggguuucacaagugaa

SEQ ID NO: 1393186 - RNA, 19 nt, Homo sapiens
aagaguuugagaccugaau

SEQ ID NO: 1393187 - RNA, 20 nt, Homo sapiens
aagauaaucuuagcugccaa

SEQ ID NO: 1393188 - RNA, 18 nt, Homo sapiens
aagauaguugaaaagccu

SEQ ID NO: 1393189 - RNA, 18 nt, Homo sapiens
aagaucaggccaacccca

SEQ ID NO: 1393190 - RNA, 24 nt, Homo sapiens
aagaucuuucaggacucuaccuca

SEQ ID NO: 1393191 - RNA, 14 nt, Homo sapiens
aagaugaugcuauu

SEQ ID NO: 1393192 - RNA, 20 nt, Homo sapiens
aagaugcuucucacugccau

SEQ ID NO: 1393193 - RNA, 16 nt, Homo sapiens
aagaugugucuucaau

SEQ ID NO: 1393194 - RNA, 20 nt, Homo sapiens
aagauuauuuacugacauau

SEQ ID NO: 1393195 - RNA, 17 nt, Homo sapiens
aagauuauuuuuuauga

SEQ ID NO: 1393196 - RNA, 20 nt, Homo sapiens
aagauucauauuuacuucuu

SEQ ID NO: 1393197 - RNA, 21 nt, Homo sapiens
aagauucauauuuacuucuua

SEQ ID NO: 1393198 - RNA, 15 nt, Homo sapiens
aagauucauccauuu

SEQ ID NO: 1393199 - RNA, 13 nt, Homo sapiens
aagauugauacuu

SEQ ID NO: 1393200 - RNA, 18 nt, Homo sapiens
aagcaaaaccacugagcu

SEQ ID NO: 1393201 - RNA, 14 nt, Homo sapiens
aagcaaaacuucac

SEQ ID NO: 1393202 - RNA, 21 nt, Homo sapiens
aagcacacggagacgugauga

SEQ ID NO: 1393203 - RNA, 13 nt, Homo sapiens
aagcacagugccu

SEQ ID NO: 1393204 - RNA, 13 nt, Homo sapiens
aagcacaucugca

SEQ ID NO: 1393205 - RNA, 18 nt, Homo sapiens
aagcagaugcaaagaggc

SEQ ID NO: 1393206 - RNA, 16 nt, Homo sapiens
aagcaggaagcucaga

SEQ ID NO: 1393207 - RNA, 19 nt, Homo sapiens
aagcaguaagcuaucuuca

SEQ ID NO: 1393208 - RNA, 20 nt, Homo sapiens
aagcaguaagcuaucuucaa

SEQ ID NO: 1393209 - RNA, 20 nt, Homo sapiens
aagcaucauuauuugcagag

SEQ ID NO: 1393210 - RNA, 17 nt, Homo sapiens
aagcaucuaaacuuuaa

SEQ ID NO: 1393211 - RNA, 18 nt, Homo sapiens
aagcauugagcaaagggg

SEQ ID NO: 1393212 - RNA, 14 nt, Homo sapiens
aagcauuuacuuug

SEQ ID NO: 1393213 - RNA, 16 nt, Homo sapiens
aagccaaacucugcca

SEQ ID NO: 1393214 - RNA, 21 nt, Homo sapiens
aagccaagucagcuuugccuu

SEQ ID NO: 1393215 - RNA, 12 nt, Homo sapiens
aagccacccucc

SEQ ID NO: 1393216 - RNA, 11 nt, Homo sapiens
aagccacugaa

SEQ ID NO: 1393217 - RNA, 21 nt, Homo sapiens
aagccagcugcagcugggcug

SEQ ID NO: 1393218 - RNA, 21 nt, Homo sapiens
aagccagucuuaacauuucua

SEQ ID NO: 1393219 - RNA, 23 nt, Homo sapiens
aagccauaguggagagaacugaa

SEQ ID NO: 1393220 - RNA, 15 nt, Homo sapiens
aagcccaauauuaua

SEQ ID NO: 1393221 - RNA, 14 nt, Homo sapiens
aagcccagcuccag

SEQ ID NO: 1393222 - RNA, 17 nt, Homo sapiens
aagccgcaucccagacu

SEQ ID NO: 1393223 - RNA, 22 nt, Homo sapiens
aagccugcagucaucuugacca

SEQ ID NO: 1393224 - RNA, 12 nt, Homo sapiens
aagccugugaaa

SEQ ID NO: 1393225 - RNA, 20 nt, Homo sapiens
aagcgauucucaugccucag

SEQ ID NO: 1393226 - RNA, 22 nt, Homo sapiens
aagcuaaaauuagaugaacuca

SEQ ID NO: 1393227 - RNA, 22 nt, Homo sapiens
aagcuggugccccacugaauuu

SEQ ID NO: 1393228 - RNA, 22 nt, Homo sapiens
aagcugugaaagaaccaaaaga

SEQ ID NO: 1393229 - RNA, 22 nt, Homo sapiens
aagcuguguccuugcaccugca

SEQ ID NO: 1393230 - RNA, 14 nt, Homo sapiens
aagcuuccauucca

SEQ ID NO: 1393231 - RNA, 15 nt, Homo sapiens
aagcuuccauuccac

SEQ ID NO: 1393232 - RNA, 15 nt, Homo sapiens
aaggaaaucucaccc

SEQ ID NO: 1393233 - RNA, 19 nt, Homo sapiens
aaggaacaugaaaagcaaa

SEQ ID NO: 1393234 - RNA, 14 nt, Homo sapiens
aaggaagaggaaga

SEQ ID NO: 1393235 - RNA, 17 nt, Homo sapiens
aaggaagaucaggccaa

SEQ ID NO: 1393236 - RNA, 20 nt, Homo sapiens
aaggacaccuuuuaacucac

SEQ ID NO: 1393237 - RNA, 22 nt, Homo sapiens
aaggagauucaaacucaaugau

SEQ ID NO: 1393238 - RNA, 24 nt, Homo sapiens
aaggagccaauugauuucaacaga

SEQ ID NO: 1393239 - RNA, 20 nt, Homo sapiens
aaggagggcagaucacuuca

SEQ ID NO: 1393240 - RNA, 23 nt, Homo sapiens
aaggauauuuaagaaaauacaau

SEQ ID NO: 1393241 - RNA, 13 nt, Homo sapiens
aaggauggaccac

SEQ ID NO: 1393242 - RNA, 15 nt, Homo sapiens
aaggcaccuauaaaa

SEQ ID NO: 1393243 - RNA, 17 nt, Homo sapiens
aaggcaccugaaugugu

SEQ ID NO: 1393244 - RNA, 15 nt, Homo sapiens
aaggcagccaggcug

SEQ ID NO: 1393245 - RNA, 22 nt, Homo sapiens
aaggcauaugcuggcccauaaa

SEQ ID NO: 1393246 - RNA, 23 nt, Homo sapiens
aaggccugucccuggccaucucu

SEQ ID NO: 1393247 - RNA, 22 nt, Homo sapiens
aaggcgguacuaguucagacac

SEQ ID NO: 1393248 - RNA, 17 nt, Homo sapiens
aaggcuagaucaugaag

SEQ ID NO: 1393249 - RNA, 19 nt, Homo sapiens
aaggcuauauuucugggau

SEQ ID NO: 1393250 - RNA, 13 nt, Homo sapiens
aaggcucagucuc

SEQ ID NO: 1393251 - RNA, 22 nt, Homo sapiens
aaggcucugagcaaauguggcu

SEQ ID NO: 1393252 - RNA, 21 nt, Homo sapiens
aaggcuuacacccacagugga

SEQ ID NO: 1393253 - RNA, 14 nt, Homo sapiens
aaggcuuucagggc

SEQ ID NO: 1393254 - RNA, 15 nt, Homo sapiens
aagggaggaggugaa

SEQ ID NO: 1393255 - RNA, 15 nt, Homo sapiens
aagggauaguccaaa

SEQ ID NO: 1393256 - RNA, 16 nt, Homo sapiens
aagggauaguccaaag

SEQ ID NO: 1393257 - RNA, 19 nt, Homo sapiens
aagggauggaaaaggaaga

SEQ ID NO: 1393258 - RNA, 23 nt, Homo sapiens
aagggcaguggaggugcugcauu

SEQ ID NO: 1393259 - RNA, 12 nt, Homo sapiens
aagggcauuucc

SEQ ID NO: 1393260 - RNA, 18 nt, Homo sapiens
aagggcucacgcauucag

SEQ ID NO: 1393261 - RNA, 23 nt, Homo sapiens
aaggguaccuugaacacuggggg

SEQ ID NO: 1393262 - RNA, 18 nt, Homo sapiens
aaggguaucccaaaaaua

SEQ ID NO: 1393263 - RNA, 23 nt, Homo sapiens
aaggguguugcuaagcuguaacc

SEQ ID NO: 1393264 - RNA, 16 nt, Homo sapiens
aaggucuaugcucaua

SEQ ID NO: 1393265 - RNA, 17 nt, Homo sapiens
aaggugagcaaagggcu

SEQ ID NO: 1393266 - RNA, 13 nt, Homo sapiens
aagguugugauga

SEQ ID NO: 1393267 - RNA, 15 nt, Homo sapiens
aaguaaaacuuaaga

SEQ ID NO: 1393268 - RNA, 13 nt, Homo sapiens
aaguaaacuaaug

SEQ ID NO: 1393269 - RNA, 20 nt, Homo sapiens
aaguaaauauagcucaggua

SEQ ID NO: 1393270 - RNA, 14 nt, Homo sapiens
aaugguuugaauau

SEQ ID NO: 1393271 - RNA, 14 nt, Homo sapiens
aauguaaagacaaa

SEQ ID NO: 1393272 - RNA, 22 nt, Homo sapiens
aauguacaaaauaaaguuacau

SEQ ID NO: 1393273 - RNA, 16 nt, Homo sapiens
aauguacaugucaaua

SEQ ID NO: 1393274 - RNA, 13 nt, Homo sapiens
aauguauugaacu

SEQ ID NO: 1393275 - RNA, 19 nt, Homo sapiens
aaugucacaaccucucuga

SEQ ID NO: 1393276 - RNA, 14 nt, Homo sapiens
aaugucuuaaucau

SEQ ID NO: 1393277 - RNA, 19 nt, Homo sapiens
aaugucuuaaucaugagau

SEQ ID NO: 1393278 - RNA, 21 nt, Homo sapiens
aaugucuuaaucaugagauaa

SEQ ID NO: 1393279 - RNA, 13 nt, Homo sapiens
aaugucuuugguc

SEQ ID NO: 1393280 - RNA, 19 nt, Homo sapiens
aaugucuuuuuaagcuuau

SEQ ID NO: 1393281 - RNA, 19 nt, Homo sapiens
aaugugaacuagcuggaau

SEQ ID NO: 1393282 - RNA, 16 nt, Homo sapiens
aaugugaaucaugguu

SEQ ID NO: 1393283 - RNA, 21 nt, Homo sapiens
aaugugauauuugaagcauca

SEQ ID NO: 1393284 - RNA, 15 nt, Homo sapiens
aaugugcucaugcau

SEQ ID NO: 1393285 - RNA, 19 nt, Homo sapiens
aauguggcauuugugauca

SEQ ID NO: 1393286 - RNA, 18 nt, Homo sapiens
aaugugggaagaaacaaa

SEQ ID NO: 1393287 - RNA, 21 nt, Homo sapiens
aauguguucggugauuucaga

SEQ ID NO: 1393288 - RNA, 18 nt, Homo sapiens
aauguuacauuauuauca

SEQ ID NO: 1393289 - RNA, 19 nt, Homo sapiens
aauguuacugaucaugcau

SEQ ID NO: 1393290 - RNA, 20 nt, Homo sapiens
aauguuacugaucaugcauu

SEQ ID NO: 1393291 - RNA, 14 nt, Homo sapiens
aauguuauuaccua

SEQ ID NO: 1393292 - RNA, 21 nt, Homo sapiens
aauguuauuuuuuaauuauua

SEQ ID NO: 1393293 - RNA, 15 nt, Homo sapiens
aauguugaauacuua

SEQ ID NO: 1393294 - RNA, 15 nt, Homo sapiens
aauguuguaauucau

SEQ ID NO: 1393295 - RNA, 17 nt, Homo sapiens
aauguuuguccuguaua

SEQ ID NO: 1393296 - RNA, 14 nt, Homo sapiens
aauuaaacaauuua

SEQ ID NO: 1393297 - RNA, 16 nt, Homo sapiens
aauuaauuuacuagaa

SEQ ID NO: 1393298 - RNA, 15 nt, Homo sapiens
aauuacaucugucau

SEQ ID NO: 1393299 - RNA, 15 nt, Homo sapiens
aauuaccagaaccac

SEQ ID NO: 1393300 - RNA, 18 nt, Homo sapiens
aauuacuugagcccagga

SEQ ID NO: 1393301 - RNA, 19 nt, Homo sapiens
aauuaggagaggcagagau

SEQ ID NO: 1393302 - RNA, 18 nt, Homo sapiens
aauuaucgggaacagugu

SEQ ID NO: 1393303 - RNA, 22 nt, Homo sapiens
aauuaugcaucugcuacugugu

SEQ ID NO: 1393304 - RNA, 12 nt, Homo sapiens
aauuaugccaua

SEQ ID NO: 1393305 - RNA, 21 nt, Homo sapiens
aauuauuauuuaaacaucagc

SEQ ID NO: 1393306 - RNA, 17 nt, Homo sapiens
aauuauuuuaguagugu

SEQ ID NO: 1393307 - RNA, 12 nt, Homo sapiens
aauucaaccacu

SEQ ID NO: 1393308 - RNA, 21 nt, Homo sapiens
aauucauacauaguacauaca

SEQ ID NO: 1393309 - RNA, 15 nt, Homo sapiens
aauucccagcugucu

SEQ ID NO: 1393310 - RNA, 12 nt, Homo sapiens
aauucuauuaca

SEQ ID NO: 1393311 - RNA, 17 nt, Homo sapiens
aauucuauucugaucuu

SEQ ID NO: 1393312 - RNA, 22 nt, Homo sapiens
aauucucagucaguaauugcca

SEQ ID NO: 1393313 - RNA, 18 nt, Homo sapiens
aauucucauuugucacac

SEQ ID NO: 1393314 - RNA, 19 nt, Homo sapiens
aauucugaauuaagcacag

SEQ ID NO: 1393315 - RNA, 21 nt, Homo sapiens
aauucuuuucuuuuccauuua

SEQ ID NO: 1393316 - RNA, 13 nt, Homo sapiens
aauugauagucaa

SEQ ID NO: 1393317 - RNA, 16 nt, Homo sapiens
aauugcugcaucuuag

SEQ ID NO: 1393318 - RNA, 17 nt, Homo sapiens
aauugugaucagaccau

SEQ ID NO: 1393319 - RNA, 19 nt, Homo sapiens
aauugugaucagaccauaa

SEQ ID NO: 1393320 - RNA, 11 nt, Homo sapiens
aauuguugcua

SEQ ID NO: 1393321 - RNA, 23 nt, Homo sapiens
aauuguuuuuaaguuuucaugaa

SEQ ID NO: 1393322 - RNA, 15 nt, Homo sapiens
aauuuaauauagcua

SEQ ID NO: 1393323 - RNA, 23 nt, Homo sapiens
aauuucacauuaauauuugcuga

SEQ ID NO: 1393324 - RNA, 18 nt, Homo sapiens
aauuucacgucgucuucu

SEQ ID NO: 1393325 - RNA, 15 nt, Homo sapiens
aauuucaguaaacaa

SEQ ID NO: 1393326 - RNA, 20 nt, Homo sapiens
aauuucaguaaacaaugaau

SEQ ID NO: 1393327 - RNA, 20 nt, Homo sapiens
aauuuccggccaacaguuaa

SEQ ID NO: 1393328 - RNA, 19 nt, Homo sapiens
aauuucuggaaaacugccu

SEQ ID NO: 1393329 - RNA, 23 nt, Homo sapiens
aauuucugugucuaaauuucuuc

SEQ ID NO: 1393330 - RNA, 14 nt, Homo sapiens
aauuugaaccaaaa

SEQ ID NO: 1393331 - RNA, 15 nt, Homo sapiens
aauuugaugaaauca

SEQ ID NO: 1393332 - RNA, 21 nt, Homo sapiens
aauuugauguuuacaggugga

SEQ ID NO: 1393333 - RNA, 15 nt, Homo sapiens
aauuugcacuuucag

SEQ ID NO: 1393334 - RNA, 18 nt, Homo sapiens
aauuuggagacucugugg

SEQ ID NO: 1393335 - RNA, 24 nt, Homo sapiens
aauuuucuucaugcaaugacaucu

SEQ ID NO: 1393336 - RNA, 12 nt, Homo sapiens
aauuuugauuca

SEQ ID NO: 1393337 - RNA, 12 nt, Homo sapiens
aauuuuguugca

SEQ ID NO: 1393338 - RNA, 21 nt, Homo sapiens
aauuuuucucuaacucagaaa

SEQ ID NO: 1393339 - RNA, 19 nt, Homo sapiens
aauuuuuuaaaaagcaaaa

SEQ ID NO: 1393340 - RNA, 21 nt, Homo sapiens
aauuuuuuaaaguuacuuugu

SEQ ID NO: 1393341 - RNA, 23 nt, Homo sapiens
aauuuuuuaguauaaguacauua

SEQ ID NO: 1393342 - RNA, 22 nt, Homo sapiens
acaaaaaugaaagcaugucuca

SEQ ID NO: 1393343 - RNA, 14 nt, Homo sapiens
acaaaagauguauc

SEQ ID NO: 1393344 - RNA, 15 nt, Homo sapiens
acaaaagauguaucc

SEQ ID NO: 1393345 - RNA, 21 nt, Homo sapiens
acaaaagcccaauguaaugca

SEQ ID NO: 1393346 - RNA, 14 nt, Homo sapiens
acaaacaaacagaa

SEQ ID NO: 1393347 - RNA, 13 nt, Homo sapiens
acaaacacaagca

SEQ ID NO: 1393348 - RNA, 20 nt, Homo sapiens
acaaacccguuuuaugauuu

SEQ ID NO: 1393349 - RNA, 15 nt, Homo sapiens
acaaagcccuuccau

SEQ ID NO: 1393350 - RNA, 18 nt, Homo sapiens
acaaagcccuuccauguc

SEQ ID NO: 1393351 - RNA, 13 nt, Homo sapiens
acaaagcugcuaa

SEQ ID NO: 1393352 - RNA, 15 nt, Homo sapiens
acaaaguaagccaug

SEQ ID NO: 1393353 - RNA, 19 nt, Homo sapiens
acaaaguaagccauguauc

SEQ ID NO: 1393354 - RNA, 21 nt, Homo sapiens
acaaauaaguggaaaccgugu

SEQ ID NO: 1393355 - RNA, 22 nt, Homo sapiens
acaaauaaucaaaacccaacau

SEQ ID NO: 1393356 - RNA, 15 nt, Homo sapiens
acaaauaugucaguu

SEQ ID NO: 1393357 - RNA, 20 nt, Homo sapiens
acaaaucaaguuuccaagca

SEQ ID NO: 1393358 - RNA, 18 nt, Homo sapiens
acaaaugggaaaaccaga

SEQ ID NO: 1393359 - RNA, 13 nt, Homo sapiens
acaaauguaugau

SEQ ID NO: 1393360 - RNA, 16 nt, Homo sapiens
acaaauuauguuacau

SEQ ID NO: 1393361 - RNA, 17 nt, Homo sapiens
acaaauuauguuacauc

SEQ ID NO: 1393362 - RNA, 14 nt, Homo sapiens
acaacaaaaagcuu

SEQ ID NO: 1393363 - RNA, 14 nt, Homo sapiens
acaacagugagaaa

SEQ ID NO: 1393364 - RNA, 19 nt, Homo sapiens
acaacauccuuaagucaaa

SEQ ID NO: 1393365 - RNA, 14 nt, Homo sapiens
acaacauuuacuua

SEQ ID NO: 1393366 - RNA, 19 nt, Homo sapiens
acaacauuuacuuaacaga

SEQ ID NO: 1393367 - RNA, 14 nt, Homo sapiens
acaacauuucucaa

SEQ ID NO: 1393368 - RNA, 16 nt, Homo sapiens
acaaccugugaucaag

SEQ ID NO: 1393369 - RNA, 20 nt, Homo sapiens
acaaccugugaucaagcaau

SEQ ID NO: 1393370 - RNA, 16 nt, Homo sapiens
acaacuaugauuugga

SEQ ID NO: 1393371 - RNA, 18 nt, Homo sapiens
acaacuguggucaauccg

SEQ ID NO: 1393372 - RNA, 17 nt, Homo sapiens
acaacuucuaauugcca

SEQ ID NO: 1393373 - RNA, 23 nt, Homo sapiens
acaagaaaaguugaagaagauau

SEQ ID NO: 1393374 - RNA, 16 nt, Homo sapiens
acaagaacacugaaaa

SEQ ID NO: 1393375 - RNA, 22 nt, Homo sapiens
acaagaagccacagaccuagga

SEQ ID NO: 1393376 - RNA, 20 nt, Homo sapiens
acaagauuaccccaccuugc

SEQ ID NO: 1393377 - RNA, 17 nt, Homo sapiens
acaagcuaggugcuaau

SEQ ID NO: 1393378 - RNA, 16 nt, Homo sapiens
acaagcugcacccuca

SEQ ID NO: 1393379 - RNA, 17 nt, Homo sapiens
acaagcuuguccaugua

SEQ ID NO: 1393380 - RNA, 23 nt, Homo sapiens
acaaggcauucaaguguacagug

SEQ ID NO: 1393381 - RNA, 16 nt, Homo sapiens
acaaggcugaccaaga

SEQ ID NO: 1393382 - RNA, 17 nt, Homo sapiens
acaaguaaaacuguggu

SEQ ID NO: 1393383 - RNA, 18 nt, Homo sapiens
acaaguaaaacuguggua

SEQ ID NO: 1393384 - RNA, 14 nt, Homo sapiens
acaaguaugaugau

SEQ ID NO: 1393385 - RNA, 18 nt, Homo sapiens
acaaguauguugagaguu

SEQ ID NO: 1393386 - RNA, 17 nt, Homo sapiens
acaagugagacaaaaag

SEQ ID NO: 1393387 - RNA, 21 nt, Homo sapiens
acaaguugcgacggagagaaa

SEQ ID NO: 1393388 - RNA, 15 nt, Homo sapiens
acaaguuucagacag

SEQ ID NO: 1393389 - RNA, 18 nt, Homo sapiens
acaaguuuuaauccagaa

SEQ ID NO: 1393390 - RNA, 14 nt, Homo sapiens
acaauaaacuauuu

SEQ ID NO: 1393391 - RNA, 21 nt, Homo sapiens
acaauaaauguauucaaauac

SEQ ID NO: 1393392 - RNA, 15 nt, Homo sapiens
acaauauacuuguau

SEQ ID NO: 1393393 - RNA, 20 nt, Homo sapiens
acaauaucuucauacaauga

SEQ ID NO: 1393394 - RNA, 23 nt, Homo sapiens
acaaucaacucuaauagugcuua

SEQ ID NO: 1393395 - RNA, 18 nt, Homo sapiens
acaaucaugaaauaugca

SEQ ID NO: 1393396 - RNA, 23 nt, Homo sapiens
acaauccaucucucaaguagugu

SEQ ID NO: 1393397 - RNA, 18 nt, Homo sapiens
acaaugacuaaagacaua

SEQ ID NO: 1393398 - RNA, 14 nt, Homo sapiens
acaaugcagugccu

SEQ ID NO: 1393399 - RNA, 18 nt, Homo sapiens
acaaugcagugccuuucu

SEQ ID NO: 1393400 - RNA, 17 nt, Homo sapiens
acaauuaacugagcaua

SEQ ID NO: 1393401 - RNA, 17 nt, Homo sapiens
acaauuagucaaaccac

SEQ ID NO: 1393402 - RNA, 21 nt, Homo sapiens
acaauuauuuuuacaguucuc

SEQ ID NO: 1393403 - RNA, 16 nt, Homo sapiens
acaauuccuagauaaa

SEQ ID NO: 1393404 - RNA, 17 nt, Homo sapiens
acaauuuucugcaggau

SEQ ID NO: 1393405 - RNA, 19 nt, Homo sapiens
acacaaaauguacccagua

SEQ ID NO: 1393406 - RNA, 18 nt, Homo sapiens
acacaaggugcaaaucaa

SEQ ID NO: 1393407 - RNA, 18 nt, Homo sapiens
acacaaguagaugccuga

SEQ ID NO: 1393408 - RNA, 22 nt, Homo sapiens
acacagauguucacccaaccac

SEQ ID NO: 1393409 - RNA, 20 nt, Homo sapiens
acacagcgagacuccgucuc

SEQ ID NO: 1393410 - RNA, 20 nt, Homo sapiens
acacagcucuucuccaggcu

SEQ ID NO: 1393411 - RNA, 22 nt, Homo sapiens
acacagcugcagagacagagag

SEQ ID NO: 1393412 - RNA, 18 nt, Homo sapiens
acacaggcaaaauccuug

SEQ ID NO: 1393413 - RNA, 17 nt, Homo sapiens
acacauuaaaauguuag

SEQ ID NO: 1393414 - RNA, 16 nt, Homo sapiens
acacauuaagccuucc

SEQ ID NO: 1393415 - RNA, 19 nt, Homo sapiens
acaccagggacacauuucu

SEQ ID NO: 1393416 - RNA, 17 nt, Homo sapiens
acaccagggaugguacu

SEQ ID NO: 1393417 - RNA, 11 nt, Homo sapiens
acaccaucucc

SEQ ID NO: 1393418 - RNA, 17 nt, Homo sapiens
acaccaugauuaaccac

SEQ ID NO: 1393419 - RNA, 16 nt, Homo sapiens
acacccgacuccucaa

SEQ ID NO: 1393420 - RNA, 13 nt, Homo sapiens
acaccucccugaa

SEQ ID NO: 1393421 - RNA, 20 nt, Homo sapiens
acacgagguaugaggucuag

SEQ ID NO: 1393422 - RNA, 14 nt, Homo sapiens
acacgcgugcacac

SEQ ID NO: 1393423 - RNA, 23 nt, Homo sapiens
acacuaacgauuuguuaaugaua

SEQ ID NO: 1393424 - RNA, 13 nt, Homo sapiens
acacucacuggca

SEQ ID NO: 1393425 - RNA, 16 nt, Homo sapiens
acacucugaauuccaa

SEQ ID NO: 1393426 - RNA, 15 nt, Homo sapiens
acacugaaauauaca

SEQ ID NO: 1393427 - RNA, 20 nt, Homo sapiens
acacugcuaggugggccagc

SEQ ID NO: 1393428 - RNA, 20 nt, Homo sapiens
acacugcugcuccagugcag

SEQ ID NO: 1393429 - RNA, 22 nt, Homo sapiens
acacugcugcuccagugcagga

SEQ ID NO: 1393430 - RNA, 21 nt, Homo sapiens
acacugggcuucuagaaccag

SEQ ID NO: 1393431 - RNA, 15 nt, Homo sapiens
acacugucuugaaga

SEQ ID NO: 1393432 - RNA, 14 nt, Homo sapiens
acacuuaacagaug

SEQ ID NO: 1393433 - RNA, 16 nt, Homo sapiens
acacuuccaccagccu

SEQ ID NO: 1393434 - RNA, 20 nt, Homo sapiens
acacuuggaacacaaugacu

SEQ ID NO: 1393435 - RNA, 15 nt, Homo sapiens
acagaaaacgguuaa

SEQ ID NO: 1393436 - RNA, 16 nt, Homo sapiens
acagaaauacaugaaa

SEQ ID NO: 1393437 - RNA, 20 nt, Homo sapiens
acagaauacuagccagagcu

SEQ ID NO: 1393438 - RNA, 16 nt, Homo sapiens
acagacagagaaggca

SEQ ID NO: 1393439 - RNA, 20 nt, Homo sapiens
acagaccuaggauuucauga

SEQ ID NO: 1393440 - RNA, 24 nt, Homo sapiens
acagacuaugucacccaaugcaua

SEQ ID NO: 1393441 - RNA, 12 nt, Homo sapiens
accauguggcaa

SEQ ID NO: 1393442 - RNA, 19 nt, Homo sapiens
accauuuugggguacccac

SEQ ID NO: 1393443 - RNA, 20 nt, Homo sapiens
accauuuuuacauccaugaa

SEQ ID NO: 1393444 - RNA, 13 nt, Homo sapiens
acccaacaugacu

SEQ ID NO: 1393445 - RNA, 18 nt, Homo sapiens
acccaauaguuguugauu

SEQ ID NO: 1393446 - RNA, 19 nt, Homo sapiens
acccaauauuuaccagacc

SEQ ID NO: 1393447 - RNA, 22 nt, Homo sapiens
acccaauuaaguccuacuuuac

SEQ ID NO: 1393448 - RNA, 17 nt, Homo sapiens
acccacaaaaguacaau

SEQ ID NO: 1393449 - RNA, 20 nt, Homo sapiens
acccacaguggaaagacagc

SEQ ID NO: 1393450 - RNA, 14 nt, Homo sapiens
acccacccagcacc

SEQ ID NO: 1393451 - RNA, 23 nt, Homo sapiens
acccacucugcuuugacugagca

SEQ ID NO: 1393452 - RNA, 15 nt, Homo sapiens
acccagaaaucauuu

SEQ ID NO: 1393453 - RNA, 16 nt, Homo sapiens
acccagacagcucccu

SEQ ID NO: 1393454 - RNA, 19 nt, Homo sapiens
acccagcaagggcacuuaa

SEQ ID NO: 1393455 - RNA, 17 nt, Homo sapiens
acccaggaguguggcca

SEQ ID NO: 1393456 - RNA, 20 nt, Homo sapiens
acccaggcuggagugcagug

SEQ ID NO: 1393457 - RNA, 17 nt, Homo sapiens
acccaguuagcucucaa

SEQ ID NO: 1393458 - RNA, 18 nt, Homo sapiens
acccaugagauucauuca

SEQ ID NO: 1393459 - RNA, 17 nt, Homo sapiens
acccaugcccagcugua

SEQ ID NO: 1393460 - RNA, 18 nt, Homo sapiens
accccaaacuguugauua

SEQ ID NO: 1393461 - RNA, 15 nt, Homo sapiens
accccaacagcaccc

SEQ ID NO: 1393462 - RNA, 13 nt, Homo sapiens
accccaccacuuc

SEQ ID NO: 1393463 - RNA, 15 nt, Homo sapiens
accccaucucuacua

SEQ ID NO: 1393464 - RNA, 16 nt, Homo sapiens
accccaucucuacuga

SEQ ID NO: 1393465 - RNA, 14 nt, Homo sapiens
accccaugccaaag

SEQ ID NO: 1393466 - RNA, 19 nt, Homo sapiens
acccccaaaaaacaauuau

SEQ ID NO: 1393467 - RNA, 22 nt, Homo sapiens
accccccagaaccuguccuugc

SEQ ID NO: 1393468 - RNA, 20 nt, Homo sapiens
accccccccacacacaccau

SEQ ID NO: 1393469 - RNA, 20 nt, Homo sapiens
acccccggaacaagccuaaa

SEQ ID NO: 1393470 - RNA, 19 nt, Homo sapiens
acccccguguccaccguga

SEQ ID NO: 1393471 - RNA, 19 nt, Homo sapiens
acccccugugagcagggau

SEQ ID NO: 1393472 - RNA, 22 nt, Homo sapiens
accccgaccaccugcccaaccu

SEQ ID NO: 1393473 - RNA, 14 nt, Homo sapiens
accccgggcucucu

SEQ ID NO: 1393474 - RNA, 12 nt, Homo sapiens
accccucuggcc

SEQ ID NO: 1393475 - RNA, 16 nt, Homo sapiens
accccuggaugaaguu

SEQ ID NO: 1393476 - RNA, 22 nt, Homo sapiens
accccuuacuuagcaugcacaa

SEQ ID NO: 1393477 - RNA, 14 nt, Homo sapiens
accccuuagccucc

SEQ ID NO: 1393478 - RNA, 18 nt, Homo sapiens
accccuuagccucccuga

SEQ ID NO: 1393479 - RNA, 20 nt, Homo sapiens
acccuaaaaagcagagcuuu

SEQ ID NO: 1393480 - RNA, 20 nt, Homo sapiens
acccuaaggucauuaccaca

SEQ ID NO: 1393481 - RNA, 18 nt, Homo sapiens
acccuauacaacuggaca

SEQ ID NO: 1393482 - RNA, 14 nt, Homo sapiens
acccucauacacag

SEQ ID NO: 1393483 - RNA, 17 nt, Homo sapiens
acccuccuaucaccucc

SEQ ID NO: 1393484 - RNA, 19 nt, Homo sapiens
acccucuuagaaaaaccac

SEQ ID NO: 1393485 - RNA, 17 nt, Homo sapiens
acccugcaaaaugagac

SEQ ID NO: 1393486 - RNA, 22 nt, Homo sapiens
acccugcugaccucccagugac

SEQ ID NO: 1393487 - RNA, 16 nt, Homo sapiens
acccugcuucaaauau

SEQ ID NO: 1393488 - RNA, 20 nt, Homo sapiens
acccuuguguccacugugac

SEQ ID NO: 1393489 - RNA, 19 nt, Homo sapiens
accgcaggauuugggcucu

SEQ ID NO: 1393490 - RNA, 16 nt, Homo sapiens
accgccccucaccaac

SEQ ID NO: 1393491 - RNA, 23 nt, Homo sapiens
accuaaaaggaaaucucacccca

SEQ ID NO: 1393492 - RNA, 17 nt, Homo sapiens
accuaagggaguagugu

SEQ ID NO: 1393493 - RNA, 23 nt, Homo sapiens
accuaagucucugugaauugaaa

SEQ ID NO: 1393494 - RNA, 18 nt, Homo sapiens
accuacauuuuaaugcac

SEQ ID NO: 1393495 - RNA, 21 nt, Homo sapiens
accuagccuuagaagucacac

SEQ ID NO: 1393496 - RNA, 17 nt, Homo sapiens
accuaguagucauuuca

SEQ ID NO: 1393497 - RNA, 17 nt, Homo sapiens
accucaaccuaugguau

SEQ ID NO: 1393498 - RNA, 11 nt, Homo sapiens
accucaccaag

SEQ ID NO: 1393499 - RNA, 13 nt, Homo sapiens
accucacugugac

SEQ ID NO: 1393500 - RNA, 22 nt, Homo sapiens
accucagggcuguguguacuaa

SEQ ID NO: 1393501 - RNA, 20 nt, Homo sapiens
accucaggugagaagcagag

SEQ ID NO: 1393502 - RNA, 12 nt, Homo sapiens
accucaguuuua

SEQ ID NO: 1393503 - RNA, 16 nt, Homo sapiens
accucaucucuacuaa

SEQ ID NO: 1393504 - RNA, 22 nt, Homo sapiens
accucauggggguauuguauaa

SEQ ID NO: 1393505 - RNA, 19 nt, Homo sapiens
agccucgaacuccugggcu

SEQ ID NO: 1393506 - RNA, 16 nt, Homo sapiens
agccucugaaaaccaa

SEQ ID NO: 1393507 - RNA, 17 nt, Homo sapiens
agccucugaauaugaac

SEQ ID NO: 1393508 - RNA, 13 nt, Homo sapiens
agccugcagucau

SEQ ID NO: 1393509 - RNA, 23 nt, Homo sapiens
agccugcaguuauuaacacuaac

SEQ ID NO: 1393510 - RNA, 18 nt, Homo sapiens
agccuggagacucgugga

SEQ ID NO: 1393511 - RNA, 21 nt, Homo sapiens
agccuggcacagggcaguggg

SEQ ID NO: 1393512 - RNA, 21 nt, Homo sapiens
agccuggccaacauggugaaa

SEQ ID NO: 1393513 - RNA, 20 nt, Homo sapiens
agccugguugcccagggauu

SEQ ID NO: 1393514 - RNA, 23 nt, Homo sapiens
agccuguggcaucuuugccuugg

SEQ ID NO: 1393515 - RNA, 21 nt, Homo sapiens
agccuuggauguauaugucau

SEQ ID NO: 1393516 - RNA, 17 nt, Homo sapiens
agccuugggaacaugcg

SEQ ID NO: 1393517 - RNA, 16 nt, Homo sapiens
agcggaaagcagcuca

SEQ ID NO: 1393518 - RNA, 21 nt, Homo sapiens
agcggacuggugaggagcaca

SEQ ID NO: 1393519 - RNA, 15 nt, Homo sapiens
agcguagcuaaguga

SEQ ID NO: 1393520 - RNA, 13 nt, Homo sapiens
agcgugagccacu

SEQ ID NO: 1393521 - RNA, 13 nt, Homo sapiens
agcuaacacuggc

SEQ ID NO: 1393522 - RNA, 23 nt, Homo sapiens
agcuaaggucacauugugccuuu

SEQ ID NO: 1393523 - RNA, 13 nt, Homo sapiens
agcuaccaggugu

SEQ ID NO: 1393524 - RNA, 23 nt, Homo sapiens
agcuaccagguguucuacacuca

SEQ ID NO: 1393525 - RNA, 20 nt, Homo sapiens
agcuaccucacuaugcugcu

SEQ ID NO: 1393526 - RNA, 19 nt, Homo sapiens
agcuacucagaagccugag

SEQ ID NO: 1393527 - RNA, 20 nt, Homo sapiens
agcuacucaggagguugagg

SEQ ID NO: 1393528 - RNA, 12 nt, Homo sapiens
agcuacugauga

SEQ ID NO: 1393529 - RNA, 13 nt, Homo sapiens
agcuacugaugag

SEQ ID NO: 1393530 - RNA, 22 nt, Homo sapiens
agcuacuguuuauuauuuuauu

SEQ ID NO: 1393531 - RNA, 14 nt, Homo sapiens
agcuagucuuucac

SEQ ID NO: 1393532 - RNA, 16 nt, Homo sapiens
agcuaugaucgcgcca

SEQ ID NO: 1393533 - RNA, 16 nt, Homo sapiens
agcuauuuaucuguag

SEQ ID NO: 1393534 - RNA, 22 nt, Homo sapiens
agcuauuuucaacauaacugaa

SEQ ID NO: 1393535 - RNA, 20 nt, Homo sapiens
agcucagaggguuguucucc

SEQ ID NO: 1393536 - RNA, 17 nt, Homo sapiens
agcucagucccaucaga

SEQ ID NO: 1393537 - RNA, 12 nt, Homo sapiens
agcucaguuuau

SEQ ID NO: 1393538 - RNA, 19 nt, Homo sapiens
agcucauguagcaaucaga

SEQ ID NO: 1393539 - RNA, 14 nt, Homo sapiens
agcuccagaagaac

SEQ ID NO: 1393540 - RNA, 18 nt, Homo sapiens
agcucccuaggagaccaa

SEQ ID NO: 1393541 - RNA, 20 nt, Homo sapiens
agcuccuccuugucuuggca

SEQ ID NO: 1393542 - RNA, 12 nt, Homo sapiens
agcuccuuccac

SEQ ID NO: 1393543 - RNA, 20 nt, Homo sapiens
agcucucgauggacaaugaa

SEQ ID NO: 1393544 - RNA, 15 nt, Homo sapiens
agcucuggcuuccag

SEQ ID NO: 1393545 - RNA, 19 nt, Homo sapiens
agcucuggugacaccagcc

SEQ ID NO: 1393546 - RNA, 19 nt, Homo sapiens
agcucuguuuuacaauaaa

SEQ ID NO: 1393547 - RNA, 19 nt, Homo sapiens
agcucuugaagacacugaa

SEQ ID NO: 1393548 - RNA, 13 nt, Homo sapiens
agcugaaccuggg

SEQ ID NO: 1393549 - RNA, 15 nt, Homo sapiens
agcugaguaugcuga

SEQ ID NO: 1393550 - RNA, 14 nt, Homo sapiens
agcugcaacggaau

SEQ ID NO: 1393551 - RNA, 14 nt, Homo sapiens
agcugcacuacagc

SEQ ID NO: 1393552 - RNA, 13 nt, Homo sapiens
agcugcaucuacu

SEQ ID NO: 1393553 - RNA, 15 nt, Homo sapiens
agcugcaucuacuca

SEQ ID NO: 1393554 - RNA, 17 nt, Homo sapiens
agcugcuguggccauca

SEQ ID NO: 1393555 - RNA, 17 nt, Homo sapiens
agcuggaccaguggugc

SEQ ID NO: 1393556 - RNA, 18 nt, Homo sapiens
agcuggcacugucucugc

SEQ ID NO: 1393557 - RNA, 18 nt, Homo sapiens
agcugggacuacaggcac

SEQ ID NO: 1393558 - RNA, 17 nt, Homo sapiens
agcugggauaaucacau

SEQ ID NO: 1393559 - RNA, 14 nt, Homo sapiens
agcugggaucugac

SEQ ID NO: 1393560 - RNA, 17 nt, Homo sapiens
agcuggguguguuggca

SEQ ID NO: 1393561 - RNA, 15 nt, Homo sapiens
agcuguaaacauauu

SEQ ID NO: 1393562 - RNA, 14 nt, Homo sapiens
agcuguaaccgaua

SEQ ID NO: 1393563 - RNA, 13 nt, Homo sapiens
agcugucugcuca

SEQ ID NO: 1393564 - RNA, 19 nt, Homo sapiens
agcugugcgcaauugcuca

SEQ ID NO: 1393565 - RNA, 12 nt, Homo sapiens
agcuguggugag

SEQ ID NO: 1393566 - RNA, 17 nt, Homo sapiens
agcuguuuauggccuca

SEQ ID NO: 1393567 - RNA, 21 nt, Homo sapiens
agcuguuucaccaucagucaa

SEQ ID NO: 1393568 - RNA, 14 nt, Homo sapiens
agcuguuuccauag

SEQ ID NO: 1393569 - RNA, 16 nt, Homo sapiens
agcuguuuucccugac

SEQ ID NO: 1393570 - RNA, 12 nt, Homo sapiens
agcuuaucucag

SEQ ID NO: 1393571 - RNA, 14 nt, Homo sapiens
agcuuaugucagac

SEQ ID NO: 1393572 - RNA, 12 nt, Homo sapiens
agcuuccaugag

SEQ ID NO: 1393573 - RNA, 13 nt, Homo sapiens
agcuucugaccuc

SEQ ID NO: 1393574 - RNA, 23 nt, Homo sapiens
agcuugaaacauagagggagaga

SEQ ID NO: 1393575 - RNA, 14 nt, Homo sapiens
agcuugcaacaaaa

SEQ ID NO: 1393576 - RNA, 14 nt, Homo sapiens
agcuuggaaacugg

SEQ ID NO: 1393577 - RNA, 14 nt, Homo sapiens
aguggccuggccag

SEQ ID NO: 1393578 - RNA, 23 nt, Homo sapiens
aguggcucacgccuaugauccca

SEQ ID NO: 1393579 - RNA, 20 nt, Homo sapiens
agugggagcugaguggggga

SEQ ID NO: 1393580 - RNA, 18 nt, Homo sapiens
aguggggagacaccucag

SEQ ID NO: 1393581 - RNA, 15 nt, Homo sapiens
agugggggaucacag

SEQ ID NO: 1393582 - RNA, 14 nt, Homo sapiens
aguggggucagggc

SEQ ID NO: 1393583 - RNA, 19 nt, Homo sapiens
agugggugaauaauacagu

SEQ ID NO: 1393584 - RNA, 13 nt, Homo sapiens
agugggugucucu

SEQ ID NO: 1393585 - RNA, 15 nt, Homo sapiens
aguggucgcuuacuu

SEQ ID NO: 1393586 - RNA, 22 nt, Homo sapiens
aguggugggcaccuauaauacc

SEQ ID NO: 1393587 - RNA, 13 nt, Homo sapiens
agugguuacccag

SEQ ID NO: 1393588 - RNA, 14 nt, Homo sapiens
agugguuugugcua

SEQ ID NO: 1393589 - RNA, 12 nt, Homo sapiens
agugucacuuac

SEQ ID NO: 1393590 - RNA, 13 nt, Homo sapiens
agugucucagucc

SEQ ID NO: 1393591 - RNA, 16 nt, Homo sapiens
agugucugugugcaag

SEQ ID NO: 1393592 - RNA, 12 nt, Homo sapiens
agugugauccca

SEQ ID NO: 1393593 - RNA, 16 nt, Homo sapiens
aguguguuuccuucag

SEQ ID NO: 1393594 - RNA, 23 nt, Homo sapiens
aguguugcccaggcuggucucaa

SEQ ID NO: 1393595 - RNA, 15 nt, Homo sapiens
aguguuggcuuucau

SEQ ID NO: 1393596 - RNA, 23 nt, Homo sapiens
aguguuuggguauauucauuuca

SEQ ID NO: 1393597 - RNA, 20 nt, Homo sapiens
aguuaaagugaauaaccacu

SEQ ID NO: 1393598 - RNA, 21 nt, Homo sapiens
aguuaaauagaguauaugcac

SEQ ID NO: 1393599 - RNA, 16 nt, Homo sapiens
aguuaagcaacaucua

SEQ ID NO: 1393600 - RNA, 21 nt, Homo sapiens
aguuaaggggagcaacagagg

SEQ ID NO: 1393601 - RNA, 13 nt, Homo sapiens
aguuaaucuugcu

SEQ ID NO: 1393602 - RNA, 13 nt, Homo sapiens
aguuacaaaaacc

SEQ ID NO: 1393603 - RNA, 17 nt, Homo sapiens
aguuaccuuucuagguc

SEQ ID NO: 1393604 - RNA, 12 nt, Homo sapiens
aguuacuugaaa

SEQ ID NO: 1393605 - RNA, 20 nt, Homo sapiens
aguuaggcuauucacaacca

SEQ ID NO: 1393606 - RNA, 23 nt, Homo sapiens
aguuaugaaaaauaagucacuua

SEQ ID NO: 1393607 - RNA, 20 nt, Homo sapiens
aguucacuugcaguggaaga

SEQ ID NO: 1393608 - RNA, 19 nt, Homo sapiens
aguucagcuccuuccacca

SEQ ID NO: 1393609 - RNA, 18 nt, Homo sapiens
aguucauaacagugccau

SEQ ID NO: 1393610 - RNA, 19 nt, Homo sapiens
aguucauacccuguuacca

SEQ ID NO: 1393611 - RNA, 16 nt, Homo sapiens
aguuccaaaagagaag

SEQ ID NO: 1393612 - RNA, 22 nt, Homo sapiens
aguucggaaaccguccugugua

SEQ ID NO: 1393613 - RNA, 23 nt, Homo sapiens
aguucucaucccucugucagggu

SEQ ID NO: 1393614 - RNA, 20 nt, Homo sapiens
aguucuucaucccacuccaa

SEQ ID NO: 1393615 - RNA, 13 nt, Homo sapiens
aguugaaacaaga

SEQ ID NO: 1393616 - RNA, 15 nt, Homo sapiens
aguugacuugacaga

SEQ ID NO: 1393617 - RNA, 22 nt, Homo sapiens
aguugacuugacagaacacugu

SEQ ID NO: 1393618 - RNA, 14 nt, Homo sapiens
aguugaggccagga

SEQ ID NO: 1393619 - RNA, 17 nt, Homo sapiens
aguugauggugaugaaa

SEQ ID NO: 1393620 - RNA, 18 nt, Homo sapiens
aguugauuuuacaauuga

SEQ ID NO: 1393621 - RNA, 12 nt, Homo sapiens
aguugcaaaggu

SEQ ID NO: 1393622 - RNA, 17 nt, Homo sapiens
aguugcaauugaauuaa

SEQ ID NO: 1393623 - RNA, 11 nt, Homo sapiens
aguugcacaaa

SEQ ID NO: 1393624 - RNA, 13 nt, Homo sapiens
aguugcacacuca

SEQ ID NO: 1393625 - RNA, 23 nt, Homo sapiens
aguugcgacggagagaaaaaaga

SEQ ID NO: 1393626 - RNA, 17 nt, Homo sapiens
aguuuaaacugaaugaa

SEQ ID NO: 1393627 - RNA, 18 nt, Homo sapiens
aguuucauuuaugauaca

SEQ ID NO: 1393628 - RNA, 19 nt, Homo sapiens
aguuucugaaaccgcucag

SEQ ID NO: 1393629 - RNA, 19 nt, Homo sapiens
aguuugagaccaaccuggg

SEQ ID NO: 1393630 - RNA, 13 nt, Homo sapiens
aguuugagaccag

SEQ ID NO: 1393631 - RNA, 18 nt, Homo sapiens
aguuugcaguuaugcaga

SEQ ID NO: 1393632 - RNA, 16 nt, Homo sapiens
aguuugguuucuagca

SEQ ID NO: 1393633 - RNA, 21 nt, Homo sapiens
aguuugugaaugugacuacuu

SEQ ID NO: 1393634 - RNA, 18 nt, Homo sapiens
aguuugugagaaacaucu

SEQ ID NO: 1393635 - RNA, 23 nt, Homo sapiens
aguuuuauuuuuucgugcacucu

SEQ ID NO: 1393636 - RNA, 14 nt, Homo sapiens
auaaaaaacauaau

SEQ ID NO: 1393637 - RNA, 15 nt, Homo sapiens
auaaaaaagucucua

SEQ ID NO: 1393638 - RNA, 18 nt, Homo sapiens
auaaaaaauaauaauaca

SEQ ID NO: 1393639 - RNA, 16 nt, Homo sapiens
auaaaacaggucaaua

SEQ ID NO: 1393640 - RNA, 15 nt, Homo sapiens
auaaaaccacuguac

SEQ ID NO: 1393641 - RNA, 21 nt, Homo sapiens
auaaaagaaccgagcaauuuu

SEQ ID NO: 1393642 - RNA, 20 nt, Homo sapiens
auaaaaguacuagcuuacuu

SEQ ID NO: 1393643 - RNA, 21 nt, Homo sapiens
auaaaauauauugguauguaa

SEQ ID NO: 1393644 - RNA, 18 nt, Homo sapiens
auaaaaucaaacagagac

SEQ ID NO: 1393645 - RNA, 15 nt, Homo sapiens
auaaaaucagaguug

SEQ ID NO: 1393646 - RNA, 14 nt, Homo sapiens
auaaacagcuucau

SEQ ID NO: 1393647 - RNA, 22 nt, Homo sapiens
auaaacaggaaaaugccagagc

SEQ ID NO: 1393648 - RNA, 22 nt, Homo sapiens
auaaacauccuucaagaacucu

SEQ ID NO: 1393649 - RNA, 15 nt, Homo sapiens
aggagcugggggcag

SEQ ID NO: 1393650 - RNA, 23 nt, Homo sapiens
aggaggaaggagccuauggcauc

SEQ ID NO: 1393651 - RNA, 22 nt, Homo sapiens
aggagggaugcugccugaguca

SEQ ID NO: 1393652 - RNA, 16 nt, Homo sapiens
aggagggcccuaccug

SEQ ID NO: 1393653 - RNA, 15 nt, Homo sapiens
aggaguaguggcccu

SEQ ID NO: 1393654 - RNA, 16 nt, Homo sapiens
aggauagauaacucuu

SEQ ID NO: 1393655 - RNA, 16 nt, Homo sapiens
aggauauuuucuucca

SEQ ID NO: 1393656 - RNA, 18 nt, Homo sapiens
aggaucaagucacucauc

SEQ ID NO: 1393657 - RNA, 22 nt, Homo sapiens
aggaucaagucacucaucucag

SEQ ID NO: 1393658 - RNA, 14 nt, Homo sapiens
aggaucagaaagua

SEQ ID NO: 1393659 - RNA, 16 nt, Homo sapiens
aggaugacuacagaca

SEQ ID NO: 1393660 - RNA, 15 nt, Homo sapiens
aggaugagcauuuag

SEQ ID NO: 1393661 - RNA, 17 nt, Homo sapiens
aggaugaguuacuugaa

SEQ ID NO: 1393662 - RNA, 20 nt, Homo sapiens
aggaugauuguacagaauca

SEQ ID NO: 1393663 - RNA, 16 nt, Homo sapiens
aggauggucucugcca

SEQ ID NO: 1393664 - RNA, 14 nt, Homo sapiens
aggauugcuacugu

SEQ ID NO: 1393665 - RNA, 15 nt, Homo sapiens
aggcaaccacaggca

SEQ ID NO: 1393666 - RNA, 23 nt, Homo sapiens
aggcaacugaggcagacagcagc

SEQ ID NO: 1393667 - RNA, 21 nt, Homo sapiens
aggcaaggggugccugggaac

SEQ ID NO: 1393668 - RNA, 13 nt, Homo sapiens
aggcacagaugaa

SEQ ID NO: 1393669 - RNA, 20 nt, Homo sapiens
aggcagagaaucauacuuag

SEQ ID NO: 1393670 - RNA, 23 nt, Homo sapiens
aggcagagguugcagugagcuga

SEQ ID NO: 1393671 - RNA, 12 nt, Homo sapiens
aggcagaucugu

SEQ ID NO: 1393672 - RNA, 12 nt, Homo sapiens
aggcagcacaga

SEQ ID NO: 1393673 - RNA, 17 nt, Homo sapiens
aggcagcugacacaucu

SEQ ID NO: 1393674 - RNA, 21 nt, Homo sapiens
aggcagcuuuuucucucccac

SEQ ID NO: 1393675 - RNA, 23 nt, Homo sapiens
aggcagcuuuuucucucccacua

SEQ ID NO: 1393676 - RNA, 20 nt, Homo sapiens
aggcaggaggauugcuugag

SEQ ID NO: 1393677 - RNA, 17 nt, Homo sapiens
aggcaggugacagugag

SEQ ID NO: 1393678 - RNA, 23 nt, Homo sapiens
aggcagugaugcuggaugcuccu

SEQ ID NO: 1393679 - RNA, 18 nt, Homo sapiens
aggcaugagucagucuga

SEQ ID NO: 1393680 - RNA, 22 nt, Homo sapiens
aggcaugugccaucauacccag

SEQ ID NO: 1393681 - RNA, 18 nt, Homo sapiens
aggcauugagacuucaag

SEQ ID NO: 1393682 - RNA, 18 nt, Homo sapiens
aggcauuuucaucuuucc

SEQ ID NO: 1393683 - RNA, 19 nt, Homo sapiens
aggccaagggccaagagaa

SEQ ID NO: 1393684 - RNA, 20 nt, Homo sapiens
aggccagagggagugacaga

SEQ ID NO: 1393685 - RNA, 21 nt, Homo sapiens
aggccauugggauauucugaa

SEQ ID NO: 1393686 - RNA, 14 nt, Homo sapiens
aggcccaacauuaa

SEQ ID NO: 1393687 - RNA, 13 nt, Homo sapiens
aggcccaagagau

SEQ ID NO: 1393688 - RNA, 17 nt, Homo sapiens
aggcccaccuaccuuca

SEQ ID NO: 1393689 - RNA, 22 nt, Homo sapiens
aggcccuuccucuccacugccu

SEQ ID NO: 1393690 - RNA, 23 nt, Homo sapiens
aggcccuuccucuccacugccuu

SEQ ID NO: 1393691 - RNA, 16 nt, Homo sapiens
aggccgagaagcaaga

SEQ ID NO: 1393692 - RNA, 20 nt, Homo sapiens
aggccgggcgcgguggcuca

SEQ ID NO: 1393693 - RNA, 14 nt, Homo sapiens
aggccgggugcuca

SEQ ID NO: 1393694 - RNA, 21 nt, Homo sapiens
aggccggugugggcugugucg

SEQ ID NO: 1393695 - RNA, 14 nt, Homo sapiens
aggccguggcugcc

SEQ ID NO: 1393696 - RNA, 23 nt, Homo sapiens
aggccuauaacuuuugguaucua

SEQ ID NO: 1393697 - RNA, 14 nt, Homo sapiens
aggccucaguggac

SEQ ID NO: 1393698 - RNA, 12 nt, Homo sapiens
aggccugccugu

SEQ ID NO: 1393699 - RNA, 20 nt, Homo sapiens
aggccuggccagaugcacca

SEQ ID NO: 1393700 - RNA, 14 nt, Homo sapiens
aggcguucuucgag

SEQ ID NO: 1393701 - RNA, 19 nt, Homo sapiens
aggcuaagguggguggauc

SEQ ID NO: 1393702 - RNA, 17 nt, Homo sapiens
aggcucaauauuccuga

SEQ ID NO: 1393703 - RNA, 21 nt, Homo sapiens
aggcuccuuccugucuuccug

SEQ ID NO: 1393704 - RNA, 16 nt, Homo sapiens
aggcugaccaagagag

SEQ ID NO: 1393705 - RNA, 15 nt, Homo sapiens
aggcugacuaagaau

SEQ ID NO: 1393706 - RNA, 21 nt, Homo sapiens
aggcugaggcaagagaauuac

SEQ ID NO: 1393707 - RNA, 13 nt, Homo sapiens
aggcugcagugag

SEQ ID NO: 1393708 - RNA, 23 nt, Homo sapiens
aggcuggagugcaguggugcuau

SEQ ID NO: 1393709 - RNA, 13 nt, Homo sapiens
aggcuggucucaa

SEQ ID NO: 1393710 - RNA, 17 nt, Homo sapiens
aggcugucuucucaggc

SEQ ID NO: 1393711 - RNA, 18 nt, Homo sapiens
aggcuucaauuuauugca

SEQ ID NO: 1393712 - RNA, 14 nt, Homo sapiens
agggaaaaugagua

SEQ ID NO: 1393713 - RNA, 15 nt, Homo sapiens
agggaaacacagcag

SEQ ID NO: 1393714 - RNA, 19 nt, Homo sapiens
agggaaaggauggggacca

SEQ ID NO: 1393715 - RNA, 20 nt, Homo sapiens
agggaagagugcauuuuccc

SEQ ID NO: 1393716 - RNA, 13 nt, Homo sapiens
agggaagccaaaa

SEQ ID NO: 1393717 - RNA, 18 nt, Homo sapiens
agggaccaaggaccccuc

SEQ ID NO: 1393718 - RNA, 14 nt, Homo sapiens
agggacccacuuca

SEQ ID NO: 1393719 - RNA, 14 nt, Homo sapiens
agggagauucagac

SEQ ID NO: 1393720 - RNA, 19 nt, Homo sapiens
aucaauccagcgguucuca

SEQ ID NO: 1393721 - RNA, 14 nt, Homo sapiens
aucaccacagggau

SEQ ID NO: 1393722 - RNA, 11 nt, Homo sapiens
aucaccagaca

SEQ ID NO: 1393723 - RNA, 20 nt, Homo sapiens
aucaccaguguguggcuuuc

SEQ ID NO: 1393724 - RNA, 15 nt, Homo sapiens
aucaccucaggccag

SEQ ID NO: 1393725 - RNA, 20 nt, Homo sapiens
aucaccugccaaaugaauaa

SEQ ID NO: 1393726 - RNA, 15 nt, Homo sapiens
aucacgccacugcac

SEQ ID NO: 1393727 - RNA, 21 nt, Homo sapiens
aucacgccacugcacuccagc

SEQ ID NO: 1393728 - RNA, 17 nt, Homo sapiens
aucacgccugugcagug

SEQ ID NO: 1393729 - RNA, 22 nt, Homo sapiens
aucacuaacauuauauugcaau

SEQ ID NO: 1393730 - RNA, 19 nt, Homo sapiens
aucacuaagggauggggca

SEQ ID NO: 1393731 - RNA, 21 nt, Homo sapiens
aucacugaagaaacuucugcu

SEQ ID NO: 1393732 - RNA, 17 nt, Homo sapiens
aucagaaucauugaagu

SEQ ID NO: 1393733 - RNA, 16 nt, Homo sapiens
aucagagagcucacua

SEQ ID NO: 1393734 - RNA, 15 nt, Homo sapiens
aucagcauuuuacua

SEQ ID NO: 1393735 - RNA, 14 nt, Homo sapiens
aucagcugcuacua

SEQ ID NO: 1393736 - RNA, 22 nt, Homo sapiens
aucaguaauguauucuaucucu

SEQ ID NO: 1393737 - RNA, 20 nt, Homo sapiens
aucaguucccccaguaccuc

SEQ ID NO: 1393738 - RNA, 13 nt, Homo sapiens
aucaucuguagau

SEQ ID NO: 1393739 - RNA, 14 nt, Homo sapiens
aucaugcauuguug

SEQ ID NO: 1393740 - RNA, 19 nt, Homo sapiens
aucauuguuuauuguauac

SEQ ID NO: 1393741 - RNA, 20 nt, Homo sapiens
aucauuguuuauuguauacu

SEQ ID NO: 1393742 - RNA, 20 nt, Homo sapiens
auccaaagaauuaugcaucu

SEQ ID NO: 1393743 - RNA, 19 nt, Homo sapiens
auccaaccccccaccugcc

SEQ ID NO: 1393744 - RNA, 18 nt, Homo sapiens
auccaauccucacugggu

SEQ ID NO: 1393745 - RNA, 14 nt, Homo sapiens
auccacccaccuca

SEQ ID NO: 1393746 - RNA, 13 nt, Homo sapiens
auccacugugcca

SEQ ID NO: 1393747 - RNA, 15 nt, Homo sapiens
auccacuucuuucag

SEQ ID NO: 1393748 - RNA, 19 nt, Homo sapiens
auccaggcgugguggcaca

SEQ ID NO: 1393749 - RNA, 20 nt, Homo sapiens
auccaugcuuggguguaaca

SEQ ID NO: 1393750 - RNA, 21 nt, Homo sapiens
auccauguuaguuuuuacuuu

SEQ ID NO: 1393751 - RNA, 13 nt, Homo sapiens
auccauucaguca

SEQ ID NO: 1393752 - RNA, 20 nt, Homo sapiens
aucccacggaaaaugccaau

SEQ ID NO: 1393753 - RNA, 17 nt, Homo sapiens
aucccagcuacucaaga

SEQ ID NO: 1393754 - RNA, 15 nt, Homo sapiens
aucccaguggccuca

SEQ ID NO: 1393755 - RNA, 12 nt, Homo sapiens
auccccagugaa

SEQ ID NO: 1393756 - RNA, 22 nt, Homo sapiens
aucccgccucuucuucuucaga

SEQ ID NO: 1393757 - RNA, 23 nt, Homo sapiens
aucccuguucauuguaagcacuu

SEQ ID NO: 1393758 - RNA, 15 nt, Homo sapiens
auccgaggcaggguc

SEQ ID NO: 1393759 - RNA, 22 nt, Homo sapiens
auccgaggcagggucaggagag

SEQ ID NO: 1393760 - RNA, 17 nt, Homo sapiens
auccguaguucccugaa

SEQ ID NO: 1393761 - RNA, 19 nt, Homo sapiens
cagucaccgacaacaugcu

SEQ ID NO: 1393762 - RNA, 21 nt, Homo sapiens
cagucauaacuaaauaaagcu

SEQ ID NO: 1393763 - RNA, 21 nt, Homo sapiens
cagucauggcaccaaagccac

SEQ ID NO: 1393764 - RNA, 18 nt, Homo sapiens
cagucccuaaaaacacag

SEQ ID NO: 1393765 - RNA, 19 nt, Homo sapiens
cagucccuaaaaacacaga

SEQ ID NO: 1393766 - RNA, 23 nt, Homo sapiens
caguccugggagaaccucaggcu

SEQ ID NO: 1393767 - RNA, 16 nt, Homo sapiens
cagucggaagcuccag

SEQ ID NO: 1393768 - RNA, 14 nt, Homo sapiens
cagucuaguuccug

SEQ ID NO: 1393769 - RNA, 19 nt, Homo sapiens
cagucugcuucugcaccuu

SEQ ID NO: 1393770 - RNA, 17 nt, Homo sapiens
cagucuuccaccuggaa

SEQ ID NO: 1393771 - RNA, 20 nt, Homo sapiens
cagugaaggcuguccuuacc

SEQ ID NO: 1393772 - RNA, 15 nt, Homo sapiens
cagugaccccugacc

SEQ ID NO: 1393773 - RNA, 18 nt, Homo sapiens
cagugaccccugaccuca

SEQ ID NO: 1393774 - RNA, 17 nt, Homo sapiens
cagugacgugcaccugu

SEQ ID NO: 1393775 - RNA, 22 nt, Homo sapiens
cagugagccgcaucuucuccau

SEQ ID NO: 1393776 - RNA, 19 nt, Homo sapiens
cagugagcuuggaaaggac

SEQ ID NO: 1393777 - RNA, 15 nt, Homo sapiens
cagugaucuccauau

SEQ ID NO: 1393778 - RNA, 20 nt, Homo sapiens
cagugaugcuggaugcuccu

SEQ ID NO: 1393779 - RNA, 21 nt, Homo sapiens
cagugaugcuggaugcuccuu

SEQ ID NO: 1393780 - RNA, 23 nt, Homo sapiens
cagugaugcugugcuaugaauuu

SEQ ID NO: 1393781 - RNA, 15 nt, Homo sapiens
cagugcaaagauuug

SEQ ID NO: 1393782 - RNA, 15 nt, Homo sapiens
cagugccaagcacag

SEQ ID NO: 1393783 - RNA, 22 nt, Homo sapiens
cagugcccacaggaucagucug

SEQ ID NO: 1393784 - RNA, 21 nt, Homo sapiens
cagugccuuucuucucuccag

SEQ ID NO: 1393785 - RNA, 14 nt, Homo sapiens
caguggacaccagg

SEQ ID NO: 1393786 - RNA, 17 nt, Homo sapiens
caguggauugcauuucu

SEQ ID NO: 1393787 - RNA, 14 nt, Homo sapiens
caguggcuaccuac

SEQ ID NO: 1393788 - RNA, 15 nt, Homo sapiens
cagugguaugaucac

SEQ ID NO: 1393789 - RNA, 16 nt, Homo sapiens
caguguauguacuaag

SEQ ID NO: 1393790 - RNA, 15 nt, Homo sapiens
caguguguggcuuuc

SEQ ID NO: 1393791 - RNA, 12 nt, Homo sapiens
caguguguuucu

SEQ ID NO: 1393792 - RNA, 11 nt, Homo sapiens
caguguugccc

SEQ ID NO: 1393793 - RNA, 14 nt, Homo sapiens
caguuagcucucaa

SEQ ID NO: 1393794 - RNA, 20 nt, Homo sapiens
caguuaugugaaugaucucu

SEQ ID NO: 1393795 - RNA, 16 nt, Homo sapiens
caguucaccuugaaga

SEQ ID NO: 1393796 - RNA, 18 nt, Homo sapiens
caguucccccaguaccuc

SEQ ID NO: 1393797 - RNA, 14 nt, Homo sapiens
caguuggugcugcu

SEQ ID NO: 1393798 - RNA, 24 nt, Homo sapiens
caguugucccgauuguaacucaaa

SEQ ID NO: 1393799 - RNA, 19 nt, Homo sapiens
caguuucuaucauucugcu

SEQ ID NO: 1393800 - RNA, 21 nt, Homo sapiens
caguuugauuguuguuuauaa

SEQ ID NO: 1393801 - RNA, 23 nt, Homo sapiens
caguuuucaggaugauacacuau

SEQ ID NO: 1393802 - RNA, 16 nt, Homo sapiens
caguuuucuugcagau

SEQ ID NO: 1393803 - RNA, 18 nt, Homo sapiens
cauaaaaaggucuuuaaa

SEQ ID NO: 1393804 - RNA, 14 nt, Homo sapiens
cauaaaauguuaag

SEQ ID NO: 1393805 - RNA, 18 nt, Homo sapiens
cauaaagccuuggaugua

SEQ ID NO: 1393806 - RNA, 16 nt, Homo sapiens
cauaacagaaugcacc

SEQ ID NO: 1393807 - RNA, 17 nt, Homo sapiens
cauaacugaaggcauau

SEQ ID NO: 1393808 - RNA, 16 nt, Homo sapiens
cauaagaaaacuaaga

SEQ ID NO: 1393809 - RNA, 16 nt, Homo sapiens
cauaauaaaaggaguu

SEQ ID NO: 1393810 - RNA, 16 nt, Homo sapiens
cauaauaaauaucugu

SEQ ID NO: 1393811 - RNA, 18 nt, Homo sapiens
cauaauaaauaucuguac

SEQ ID NO: 1393812 - RNA, 22 nt, Homo sapiens
cauaauguauuuaaccagucuu

SEQ ID NO: 1393813 - RNA, 16 nt, Homo sapiens
cauaauguuacauuau

SEQ ID NO: 1393814 - RNA, 23 nt, Homo sapiens
cauaauuucuucacucaaucucu

SEQ ID NO: 1393815 - RNA, 19 nt, Homo sapiens
cauaauuuguacauaugua

SEQ ID NO: 1393816 - RNA, 21 nt, Homo sapiens
cauaauuuucuucaugcaaug

SEQ ID NO: 1393817 - RNA, 23 nt, Homo sapiens
cauacaauuauuuuuacaguucu

SEQ ID NO: 1393818 - RNA, 15 nt, Homo sapiens
cauacacagaaacca

SEQ ID NO: 1393819 - RNA, 14 nt, Homo sapiens
cauacacagccugg

SEQ ID NO: 1393820 - RNA, 17 nt, Homo sapiens
cauacauaguacauaca

SEQ ID NO: 1393821 - RNA, 14 nt, Homo sapiens
cauacuacauacaa

SEQ ID NO: 1393822 - RNA, 17 nt, Homo sapiens
cauagacuuuaugcaau

SEQ ID NO: 1393823 - RNA, 19 nt, Homo sapiens
cauagacuuuaugcaauaa

SEQ ID NO: 1393824 - RNA, 21 nt, Homo sapiens
cauagaggacagcaacuggug

SEQ ID NO: 1393825 - RNA, 22 nt, Homo sapiens
cauagaggugagggaagccuga

SEQ ID NO: 1393826 - RNA, 17 nt, Homo sapiens
cauagagugaucuuucc

SEQ ID NO: 1393827 - RNA, 17 nt, Homo sapiens
cauagaguucagacuuu

SEQ ID NO: 1393828 - RNA, 22 nt, Homo sapiens
cauagauucaccuguaaaacuu

SEQ ID NO: 1393829 - RNA, 19 nt, Homo sapiens
cauagcaagacacaucccu

SEQ ID NO: 1393830 - RNA, 23 nt, Homo sapiens
cauagcgcugcucuuaugccauu

SEQ ID NO: 1393831 - RNA, 15 nt, Homo sapiens
cauauaaauguaaua

SEQ ID NO: 1393832 - RNA, 19 nt, Homo sapiens
cauauaauguuguuauuua

SEQ ID NO: 1393833 - RNA, 15 nt, Homo sapiens
cauauagaggcaaga

SEQ ID NO: 1393834 - RNA, 20 nt, Homo sapiens
cauauauacacacacaaaga

SEQ ID NO: 1393835 - RNA, 13 nt, Homo sapiens
cauauaucuauua

SEQ ID NO: 1393836 - RNA, 16 nt, Homo sapiens
cauauauuagcauuua

SEQ ID NO: 1393837 - RNA, 18 nt, Homo sapiens
cauaucaguugagcuuca

SEQ ID NO: 1393838 - RNA, 17 nt, Homo sapiens
cauauguaccauguaca

SEQ ID NO: 1393839 - RNA, 15 nt, Homo sapiens
cauauuaagacauaa

SEQ ID NO: 1393840 - RNA, 23 nt, Homo sapiens
cauauucuuauguaugugaaagu

SEQ ID NO: 1393841 - RNA, 23 nt, Homo sapiens
cauauucuuuaaauuucaucuca

SEQ ID NO: 1393842 - RNA, 15 nt, Homo sapiens
cauauuggacugaua

SEQ ID NO: 1393843 - RNA, 16 nt, Homo sapiens
cauauugucacugaca

SEQ ID NO: 1393844 - RNA, 14 nt, Homo sapiens
cauauuguuauuau

SEQ ID NO: 1393845 - RNA, 14 nt, Homo sapiens
cauauuuguuaaau

SEQ ID NO: 1393846 - RNA, 20 nt, Homo sapiens
caucaaccucuguauuugaa

SEQ ID NO: 1393847 - RNA, 19 nt, Homo sapiens
caucaaugcugaguuaaua

SEQ ID NO: 1393848 - RNA, 23 nt, Homo sapiens
caucacuccucugucauaugcag

SEQ ID NO: 1393849 - RNA, 18 nt, Homo sapiens
caucacuuaacugauguu

SEQ ID NO: 1393850 - RNA, 19 nt, Homo sapiens
caucagaccugucuuccaa

SEQ ID NO: 1393851 - RNA, 18 nt, Homo sapiens
caucagaggacaccugua

SEQ ID NO: 1393852 - RNA, 14 nt, Homo sapiens
caucagccugugua

SEQ ID NO: 1393853 - RNA, 14 nt, Homo sapiens
caucagcuauucag

SEQ ID NO: 1393854 - RNA, 16 nt, Homo sapiens
caucaugggcuggaca

SEQ ID NO: 1393855 - RNA, 14 nt, Homo sapiens
caucaugucuggcu

SEQ ID NO: 1393856 - RNA, 13 nt, Homo sapiens
caucauuuccauu

SEQ ID NO: 1393857 - RNA, 14 nt, Homo sapiens
cauccaagcuuccu

SEQ ID NO: 1393858 - RNA, 16 nt, Homo sapiens
cauccacugugccaug

SEQ ID NO: 1393859 - RNA, 19 nt, Homo sapiens
caucccacucacaacagcu

SEQ ID NO: 1393860 - RNA, 21 nt, Homo sapiens
caucccacucacaacagcugc

SEQ ID NO: 1393861 - RNA, 15 nt, Homo sapiens
caucccaucaucuug

SEQ ID NO: 1393862 - RNA, 14 nt, Homo sapiens
caucccaucccauc

SEQ ID NO: 1393863 - RNA, 17 nt, Homo sapiens
caucccaucccauccca

SEQ ID NO: 1393864 - RNA, 19 nt, Homo sapiens
caucccucgggugugcuau

SEQ ID NO: 1393865 - RNA, 18 nt, Homo sapiens
caucccugaugucugucu

SEQ ID NO: 1393866 - RNA, 18 nt, Homo sapiens
cauccugcaggcagcuuu

SEQ ID NO: 1393867 - RNA, 20 nt, Homo sapiens
cauccugggcagcauacuga

SEQ ID NO: 1393868 - RNA, 21 nt, Homo sapiens
caucuaaaguaaaaagggaau

SEQ ID NO: 1393869 - RNA, 17 nt, Homo sapiens
caucuacccugcugacc

SEQ ID NO: 1393870 - RNA, 18 nt, Homo sapiens
caucuccccucagauucc

SEQ ID NO: 1393871 - RNA, 21 nt, Homo sapiens
caucuccccucagauuccacc

SEQ ID NO: 1393872 - RNA, 20 nt, Homo sapiens
caucucuacugaaaguacaa

SEQ ID NO: 1393873 - RNA, 21 nt, Homo sapiens
augaaaugucuggucugucca

SEQ ID NO: 1393874 - RNA, 13 nt, Homo sapiens
augaacaaccucg

SEQ ID NO: 1393875 - RNA, 11 nt, Homo sapiens
augaacauaua

SEQ ID NO: 1393876 - RNA, 15 nt, Homo sapiens
augaacucuuaauca

SEQ ID NO: 1393877 - RNA, 21 nt, Homo sapiens
augaagaugucuaauaguuau

SEQ ID NO: 1393878 - RNA, 20 nt, Homo sapiens
augaagcaagccccacuuau

SEQ ID NO: 1393879 - RNA, 22 nt, Homo sapiens
augaagccacagcccaggccuc

SEQ ID NO: 1393880 - RNA, 20 nt, Homo sapiens
augaagcuaccucaaacuuc

SEQ ID NO: 1393881 - RNA, 18 nt, Homo sapiens
augaagguggaacaagca

SEQ ID NO: 1393882 - RNA, 20 nt, Homo sapiens
augaauauuuuguaacuauu

SEQ ID NO: 1393883 - RNA, 18 nt, Homo sapiens
augaaucauugauugaau

SEQ ID NO: 1393884 - RNA, 19 nt, Homo sapiens
augaaugaggucccaggca

SEQ ID NO: 1393885 - RNA, 12 nt, Homo sapiens
augaaugcacac

SEQ ID NO: 1393886 - RNA, 17 nt, Homo sapiens
augaaugggagugaggg

SEQ ID NO: 1393887 - RNA, 20 nt, Homo sapiens
augacaacuucuaauugcca

SEQ ID NO: 1393888 - RNA, 16 nt, Homo sapiens
augacauggugaaaau

SEQ ID NO: 1393889 - RNA, 22 nt, Homo sapiens
augaccccuccccuaaugccug

SEQ ID NO: 1393890 - RNA, 18 nt, Homo sapiens
augaccuaaccuaagcaa

SEQ ID NO: 1393891 - RNA, 22 nt, Homo sapiens
augaccuuggacaaucaugaaa

SEQ ID NO: 1393892 - RNA, 12 nt, Homo sapiens
augacuaaagag

SEQ ID NO: 1393893 - RNA, 20 nt, Homo sapiens
augacuauguuucuauucua

SEQ ID NO: 1393894 - RNA, 13 nt, Homo sapiens
augacucacauga

SEQ ID NO: 1393895 - RNA, 24 nt, Homo sapiens
augacuucccaacugcaagucaca

SEQ ID NO: 1393896 - RNA, 15 nt, Homo sapiens
augagaaauuaccaa

SEQ ID NO: 1393897 - RNA, 15 nt, Homo sapiens
augagacuguacuaa

SEQ ID NO: 1393898 - RNA, 14 nt, Homo sapiens
augagagaacugga

SEQ ID NO: 1393899 - RNA, 18 nt, Homo sapiens
augagaucuaggugagga

SEQ ID NO: 1393900 - RNA, 20 nt, Homo sapiens
augagccuggcaagaaugug

SEQ ID NO: 1393901 - RNA, 14 nt, Homo sapiens
augagcuccagacc

SEQ ID NO: 1393902 - RNA, 22 nt, Homo sapiens
augaggacuugugucucugugc

SEQ ID NO: 1393903 - RNA, 16 nt, Homo sapiens
augagggaaaaugagu

SEQ ID NO: 1393904 - RNA, 15 nt, Homo sapiens
augagguacucuccu

SEQ ID NO: 1393905 - RNA, 16 nt, Homo sapiens
augagguggagagugg

SEQ ID NO: 1393906 - RNA, 18 nt, Homo sapiens
augagugauucuugacau

SEQ ID NO: 1393907 - RNA, 22 nt, Homo sapiens
augaguuacuugaaauuugccu

SEQ ID NO: 1393908 - RNA, 21 nt, Homo sapiens
augaguuuuugauagcuuuau

SEQ ID NO: 1393909 - RNA, 22 nt, Homo sapiens
augaguuuuugauagcuuuauu

SEQ ID NO: 1393910 - RNA, 17 nt, Homo sapiens
augauaauaaaggcauu

SEQ ID NO: 1393911 - RNA, 14 nt, Homo sapiens
augaucacggcuca

SEQ ID NO: 1393912 - RNA, 16 nt, Homo sapiens
augauccuaaugaaug

SEQ ID NO: 1393913 - RNA, 14 nt, Homo sapiens
caucucucuuuaau

SEQ ID NO: 1393914 - RNA, 11 nt, Homo sapiens
caucucugucu

SEQ ID NO: 1393915 - RNA, 14 nt, Homo sapiens
caucucuuguauau

SEQ ID NO: 1393916 - RNA, 14 nt, Homo sapiens
caucuucagcauuu

SEQ ID NO: 1393917 - RNA, 22 nt, Homo sapiens
caucuugcucugcugacagaca

SEQ ID NO: 1393918 - RNA, 14 nt, Homo sapiens
caucuuguccccaa

SEQ ID NO: 1393919 - RNA, 22 nt, Homo sapiens
caucuuguccccaacaccccac

SEQ ID NO: 1393920 - RNA, 12 nt, Homo sapiens
caucuuucacau

SEQ ID NO: 1393921 - RNA, 23 nt, Homo sapiens
caucuuuccuucggguuggcaaa

SEQ ID NO: 1393922 - RNA, 21 nt, Homo sapiens
caucuuucuucuauuuuauuc

SEQ ID NO: 1393923 - RNA, 14 nt, Homo sapiens
caucuuugauacuu

SEQ ID NO: 1393924 - RNA, 22 nt, Homo sapiens
caugaaaugucuggucugucca

SEQ ID NO: 1393925 - RNA, 21 nt, Homo sapiens
caugaacacaucagcuagcaa

SEQ ID NO: 1393926 - RNA, 18 nt, Homo sapiens
caugaagcccaagugaaa

SEQ ID NO: 1393927 - RNA, 12 nt, Homo sapiens
caugaauaugau

SEQ ID NO: 1393928 - RNA, 22 nt, Homo sapiens
caugacaacccugugguuucca

SEQ ID NO: 1393929 - RNA, 18 nt, Homo sapiens
caugacgguguccaugcc

SEQ ID NO: 1393930 - RNA, 18 nt, Homo sapiens
caugagaaauuaccaaaa

SEQ ID NO: 1393931 - RNA, 19 nt, Homo sapiens
caugagaccacuguuauca

SEQ ID NO: 1393932 - RNA, 21 nt, Homo sapiens
caugagccucagcauccuggc

SEQ ID NO: 1393933 - RNA, 20 nt, Homo sapiens
caugagcuggcgggauugaa

SEQ ID NO: 1393934 - RNA, 17 nt, Homo sapiens
caugagguacagcagaa

SEQ ID NO: 1393935 - RNA, 15 nt, Homo sapiens
caugagucagucuga

SEQ ID NO: 1393936 - RNA, 22 nt, Homo sapiens
caugaucgcuuucuacacugua

SEQ ID NO: 1393937 - RNA, 14 nt, Homo sapiens
caugaugagaguuu

SEQ ID NO: 1393938 - RNA, 16 nt, Homo sapiens
caugauuucauuucaa

SEQ ID NO: 1393939 - RNA, 22 nt, Homo sapiens
caugauuucauuucaacuguuu

SEQ ID NO: 1393940 - RNA, 22 nt, Homo sapiens
caugauuuuuuuuuuucagucc

SEQ ID NO: 1393941 - RNA, 12 nt, Homo sapiens
caugcacaaagu

SEQ ID NO: 1393942 - RNA, 19 nt, Homo sapiens
caugccacccuguuuucag

SEQ ID NO: 1393943 - RNA, 15 nt, Homo sapiens
caugccugggaaaug

SEQ ID NO: 1393944 - RNA, 21 nt, Homo sapiens
caugcugugugcuggagacac

SEQ ID NO: 1393945 - RNA, 14 nt, Homo sapiens
caugcuucaugaaa

SEQ ID NO: 1393946 - RNA, 13 nt, Homo sapiens
ccaaaguguuaau

SEQ ID NO: 1393947 - RNA, 17 nt, Homo sapiens
ccaaauauuccagagac

SEQ ID NO: 1393948 - RNA, 15 nt, Homo sapiens
ccaaaucaucucuca

SEQ ID NO: 1393949 - RNA, 12 nt, Homo sapiens
ccaaaugacuga

SEQ ID NO: 1393950 - RNA, 14 nt, Homo sapiens
ccaaauuacgugua

SEQ ID NO: 1393951 - RNA, 16 nt, Homo sapiens
ccaaauuaucaagcua

SEQ ID NO: 1393952 - RNA, 22 nt, Homo sapiens
ccaaauuggauacugcugccaa

SEQ ID NO: 1393953 - RNA, 16 nt, Homo sapiens
ccaaauuuguauuuaa

SEQ ID NO: 1393954 - RNA, 21 nt, Homo sapiens
ccaacacugcugcuccagugc

SEQ ID NO: 1393955 - RNA, 12 nt, Homo sapiens
ccaacagcaccc

SEQ ID NO: 1393956 - RNA, 14 nt, Homo sapiens
ccaacaugugcuca

SEQ ID NO: 1393957 - RNA, 18 nt, Homo sapiens
ccaacaugugcucaggga

SEQ ID NO: 1393958 - RNA, 23 nt, Homo sapiens
ccaaccauguucccuucuucuua

SEQ ID NO: 1393959 - RNA, 16 nt, Homo sapiens
ccaacccaaaccugga

SEQ ID NO: 1393960 - RNA, 21 nt, Homo sapiens
ccaacguggggcagcacagag

SEQ ID NO: 1393961 - RNA, 23 nt, Homo sapiens
ccaacguggggcagcacagagag

SEQ ID NO: 1393962 - RNA, 19 nt, Homo sapiens
ccaacuaacguacauucaa

SEQ ID NO: 1393963 - RNA, 22 nt, Homo sapiens
ccaacugcaagucacaaaggaa

SEQ ID NO: 1393964 - RNA, 19 nt, Homo sapiens
ccaagaacugcauggaccu

SEQ ID NO: 1393965 - RNA, 20 nt, Homo sapiens
ccaagagugguuaugccucc

SEQ ID NO: 1393966 - RNA, 18 nt, Homo sapiens
ccaagcaggaaccccagg

SEQ ID NO: 1393967 - RNA, 12 nt, Homo sapiens
ccaagcucugcu

SEQ ID NO: 1393968 - RNA, 17 nt, Homo sapiens
ccaagcuggagugcagu

SEQ ID NO: 1393969 - RNA, 18 nt, Homo sapiens
ccaagcuggagugcagug

SEQ ID NO: 1393970 - RNA, 18 nt, Homo sapiens
ccaaggguacuaaggaau

SEQ ID NO: 1393971 - RNA, 15 nt, Homo sapiens
ccaagucaugugcau

SEQ ID NO: 1393972 - RNA, 14 nt, Homo sapiens
ccaaguuuauauac

SEQ ID NO: 1393973 - RNA, 21 nt, Homo sapiens
ccaauaccuccuccagaucag

SEQ ID NO: 1393974 - RNA, 16 nt, Homo sapiens
ccaauagcacuuucau

SEQ ID NO: 1393975 - RNA, 20 nt, Homo sapiens
ccaauagcacuuucauugcc

SEQ ID NO: 1393976 - RNA, 17 nt, Homo sapiens
ccaauauuuaccagacc

SEQ ID NO: 1393977 - RNA, 20 nt, Homo sapiens
ccaauauuucucagacaucg

SEQ ID NO: 1393978 - RNA, 15 nt, Homo sapiens
ccagggaugacaugu

SEQ ID NO: 1393979 - RNA, 18 nt, Homo sapiens
ccagggccacucugccuc

SEQ ID NO: 1393980 - RNA, 10 nt, Homo sapiens
ccaggggaug

SEQ ID NO: 1393981 - RNA, 12 nt, Homo sapiens
ccaggugcugcu

SEQ ID NO: 1393982 - RNA, 22 nt, Homo sapiens
ccagguguucuacacucaucuu

SEQ ID NO: 1393983 - RNA, 18 nt, Homo sapiens
ccaguaagccacugccac

SEQ ID NO: 1393984 - RNA, 22 nt, Homo sapiens
ccaguauuuuuauuucuuuaau

SEQ ID NO: 1393985 - RNA, 12 nt, Homo sapiens
ccaguccaugag

SEQ ID NO: 1393986 - RNA, 14 nt, Homo sapiens
ccagucuaguuccu

SEQ ID NO: 1393987 - RNA, 12 nt, Homo sapiens
ccagucuuccac

SEQ ID NO: 1393988 - RNA, 13 nt, Homo sapiens
ccagugacacuuc

SEQ ID NO: 1393989 - RNA, 20 nt, Homo sapiens
ccagugaccccugaccucac

SEQ ID NO: 1393990 - RNA, 20 nt, Homo sapiens
ccagugcaacacugaagcuc

SEQ ID NO: 1393991 - RNA, 19 nt, Homo sapiens
ccagugcaccugucauaug

SEQ ID NO: 1393992 - RNA, 21 nt, Homo sapiens
ccaguggaagaagaaaacacu

SEQ ID NO: 1393993 - RNA, 19 nt, Homo sapiens
ccaguggccuggcuccgcu

SEQ ID NO: 1393994 - RNA, 22 nt, Homo sapiens
ccaguugucuauucauugacug

SEQ ID NO: 1393995 - RNA, 13 nt, Homo sapiens
ccauaauguuaca

SEQ ID NO: 1393996 - RNA, 18 nt, Homo sapiens
ccauagccaccccagaaa

SEQ ID NO: 1393997 - RNA, 16 nt, Homo sapiens
ccauagugaccaacau

SEQ ID NO: 1393998 - RNA, 15 nt, Homo sapiens
ccauaugaacauaua

SEQ ID NO: 1393999 - RNA, 11 nt, Homo sapiens
ccaucaaacac

SEQ ID NO: 1394000 - RNA, 12 nt, Homo sapiens
ccaucaccagac

SEQ ID NO: 1394001 - RNA, 12 nt, Homo sapiens
ccaucacuggag

SEQ ID NO: 1394002 - RNA, 20 nt, Homo sapiens
ccaucagcaaauauuauucu

SEQ ID NO: 1394003 - RNA, 22 nt, Homo sapiens
ccaucauaauucuaaucuaaca

SEQ ID NO: 1394004 - RNA, 23 nt, Homo sapiens
ccaucaugggcuggacauuggac

SEQ ID NO: 1394005 - RNA, 12 nt, Homo sapiens
ccauccagguuc

SEQ ID NO: 1394006 - RNA, 19 nt, Homo sapiens
ccaucccgcucuuuuccua

SEQ ID NO: 1394007 - RNA, 15 nt, Homo sapiens
ccaucuaugucccuu

SEQ ID NO: 1394008 - RNA, 19 nt, Homo sapiens
ccaucucuacaaaaagcau

SEQ ID NO: 1394009 - RNA, 16 nt, Homo sapiens
ccaucucugauuuuca

SEQ ID NO: 1394010 - RNA, 15 nt, Homo sapiens
cugggacugcugcuu

SEQ ID NO: 1394011 - RNA, 17 nt, Homo sapiens
cugggagaaccucaggc

SEQ ID NO: 1394012 - RNA, 22 nt, Homo sapiens
cugggaggccaggauggcacug

SEQ ID NO: 1394013 - RNA, 16 nt, Homo sapiens
cugggauauuuccaua

SEQ ID NO: 1394014 - RNA, 22 nt, Homo sapiens
cugggauauuuccauauggcaa

SEQ ID NO: 1394015 - RNA, 22 nt, Homo sapiens
cugggauguccacagaugccuc

SEQ ID NO: 1394016 - RNA, 15 nt, Homo sapiens
cugggauguuuugag

SEQ ID NO: 1394017 - RNA, 14 nt, Homo sapiens
cugggcagaaggcc

SEQ ID NO: 1394018 - RNA, 18 nt, Homo sapiens
cugggcagaaggccaaga

SEQ ID NO: 1394019 - RNA, 13 nt, Homo sapiens
cugggcauugcuu

SEQ ID NO: 1394020 - RNA, 13 nt, Homo sapiens
cugggccaaguca

SEQ ID NO: 1394021 - RNA, 22 nt, Homo sapiens
cugggccccaccaccuaggcca

SEQ ID NO: 1394022 - RNA, 14 nt, Homo sapiens
cugggcucaagcaa

SEQ ID NO: 1394023 - RNA, 15 nt, Homo sapiens
cugggcuugucugua

SEQ ID NO: 1394024 - RNA, 15 nt, Homo sapiens
cuggggcaaugggag

SEQ ID NO: 1394025 - RNA, 15 nt, Homo sapiens
cuggggccuguugaa

SEQ ID NO: 1394026 - RNA, 16 nt, Homo sapiens
cugggggccucagugc

SEQ ID NO: 1394027 - RNA, 12 nt, Homo sapiens
cugggugcuccc

SEQ ID NO: 1394028 - RNA, 14 nt, Homo sapiens
cugguaagggccaa

SEQ ID NO: 1394029 - RNA, 14 nt, Homo sapiens
cuggugacaccagc

SEQ ID NO: 1394030 - RNA, 18 nt, Homo sapiens
cuggugacaccagccuuu

SEQ ID NO: 1394031 - RNA, 18 nt, Homo sapiens
cuggugguggcaccaucu

SEQ ID NO: 1394032 - RNA, 19 nt, Homo sapiens
cugguugucauuuuugcag

SEQ ID NO: 1394033 - RNA, 21 nt, Homo sapiens
cugguuguugccaaacagcca

SEQ ID NO: 1394034 - RNA, 18 nt, Homo sapiens
cuguaaaaacugugggau

SEQ ID NO: 1394035 - RNA, 13 nt, Homo sapiens
cuguaaacauauu

SEQ ID NO: 1394036 - RNA, 23 nt, Homo sapiens
cuguaaagguuuuuggaauuaug

SEQ ID NO: 1394037 - RNA, 17 nt, Homo sapiens
cuguaaucccagcacuu

SEQ ID NO: 1394038 - RNA, 21 nt, Homo sapiens
cuguaaucccagcacuuuggg

SEQ ID NO: 1394039 - RNA, 18 nt, Homo sapiens
cuguaaucccagcuacuu

SEQ ID NO: 1394040 - RNA, 19 nt, Homo sapiens
cuguacaaaagggacauga

SEQ ID NO: 1394041 - RNA, 15 nt, Homo sapiens
cuguacacacuuuau

SEQ ID NO: 1394042 - RNA, 13 nt, Homo sapiens
cuguaccauuuau

SEQ ID NO: 1394043 - RNA, 17 nt, Homo sapiens
cuguagacuagugccgu

SEQ ID NO: 1394044 - RNA, 16 nt, Homo sapiens
cuguaggggcaaaaau

SEQ ID NO: 1394045 - RNA, 12 nt, Homo sapiens
cuguagucccag

SEQ ID NO: 1394046 - RNA, 19 nt, Homo sapiens
cuguagucccagcuacuca

SEQ ID NO: 1394047 - RNA, 22 nt, Homo sapiens
cuguagucccagcuacucagga

SEQ ID NO: 1394048 - RNA, 15 nt, Homo sapiens
cuguauaccccguga

SEQ ID NO: 1394049 - RNA, 16 nt, Homo sapiens
cuguauaguacuggca

SEQ ID NO: 1394050 - RNA, 12 nt, Homo sapiens
cuguaugccaag

SEQ ID NO: 1394051 - RNA, 18 nt, Homo sapiens
cuguaugccaagugaaaa

SEQ ID NO: 1394052 - RNA, 14 nt, Homo sapiens
cuguauuagucaca

SEQ ID NO: 1394053 - RNA, 15 nt, Homo sapiens
cuguauuuauuuuag

SEQ ID NO: 1394054 - RNA, 21 nt, Homo sapiens
cugucaaacaaagccagaagc

SEQ ID NO: 1394055 - RNA, 19 nt, Homo sapiens
cugucaauacuauggagua

SEQ ID NO: 1394056 - RNA, 23 nt, Homo sapiens
cugucacaucagcuccacuuuca

SEQ ID NO: 1394057 - RNA, 15 nt, Homo sapiens
cugucauaugcagaa

SEQ ID NO: 1394058 - RNA, 17 nt, Homo sapiens
cuguccccacacugacc

SEQ ID NO: 1394059 - RNA, 14 nt, Homo sapiens
cuguccucuuucag

SEQ ID NO: 1394060 - RNA, 16 nt, Homo sapiens
cuguccugaaagccac

SEQ ID NO: 1394061 - RNA, 18 nt, Homo sapiens
cuguccugggaaaugaag

SEQ ID NO: 1394062 - RNA, 13 nt, Homo sapiens
cugucucauauga

SEQ ID NO: 1394063 - RNA, 19 nt, Homo sapiens
cugucuggaggggagcucu

SEQ ID NO: 1394064 - RNA, 16 nt, Homo sapiens
cugucuggcugaggau

SEQ ID NO: 1394065 - RNA, 19 nt, Homo sapiens
cugucuucauccuuagcaa

SEQ ID NO: 1394066 - RNA, 20 nt, Homo sapiens
cugucuuuauaaucuacucc

SEQ ID NO: 1394067 - RNA, 19 nt, Homo sapiens
cugugaaagaaccaaaaga

SEQ ID NO: 1394068 - RNA, 20 nt, Homo sapiens
cugugaaagaaccaaaagag

SEQ ID NO: 1394069 - RNA, 14 nt, Homo sapiens
cugugacccacuua

SEQ ID NO: 1394070 - RNA, 18 nt, Homo sapiens
cugugcccucagauuccg

SEQ ID NO: 1394071 - RNA, 17 nt, Homo sapiens
cugugccuaucaccucu

SEQ ID NO: 1394072 - RNA, 17 nt, Homo sapiens
cugugccucugccuguc

SEQ ID NO: 1394073 - RNA, 22 nt, Homo sapiens
cugugccuggagcuccugggaa

SEQ ID NO: 1394074 - RNA, 14 nt, Homo sapiens
cugugcguuacuaa

SEQ ID NO: 1394075 - RNA, 15 nt, Homo sapiens
cugugcuaguuuuac

SEQ ID NO: 1394076 - RNA, 15 nt, Homo sapiens
cugugcuaugaauuu

SEQ ID NO: 1394077 - RNA, 18 nt, Homo sapiens
cuguggccuguuaacugg

SEQ ID NO: 1394078 - RNA, 16 nt, Homo sapiens
cuguggcggugccugg

SEQ ID NO: 1394079 - RNA, 22 nt, Homo sapiens
cugugggcauggucaaaggcuc

SEQ ID NO: 1394080 - RNA, 19 nt, Homo sapiens
cugugguacugauggacuu

SEQ ID NO: 1394081 - RNA, 22 nt, Homo sapiens
cuguguaaaacuauauucucag

SEQ ID NO: 1394082 - RNA, 23 nt, Homo sapiens
cugugugccauuuuaagaguuac

SEQ ID NO: 1394083 - RNA, 17 nt, Homo sapiens
cuguguguacuaauaca

SEQ ID NO: 1394084 - RNA, 15 nt, Homo sapiens
cuguguuugcugagg

SEQ ID NO: 1394085 - RNA, 15 nt, Homo sapiens
cuguuacacaugaca

SEQ ID NO: 1394086 - RNA, 12 nt, Homo sapiens
cuguuacugugu

SEQ ID NO: 1394087 - RNA, 16 nt, Homo sapiens
cuguuagucauuugcu

SEQ ID NO: 1394088 - RNA, 17 nt, Homo sapiens
cuguucauguuacucau

SEQ ID NO: 1394089 - RNA, 20 nt, Homo sapiens
cuguucauuguaagcacuuu

SEQ ID NO: 1394090 - RNA, 15 nt, Homo sapiens
cuguuccacauccac

SEQ ID NO: 1394091 - RNA, 22 nt, Homo sapiens
cuguucccaccaggcugcucag

SEQ ID NO: 1394092 - RNA, 18 nt, Homo sapiens
cuguucugggugcagcug

SEQ ID NO: 1394093 - RNA, 21 nt, Homo sapiens
cuguugaagcucuggugacac

SEQ ID NO: 1394094 - RNA, 13 nt, Homo sapiens
cuguugacaucca

SEQ ID NO: 1394095 - RNA, 16 nt, Homo sapiens
cuguuggccaguguga

SEQ ID NO: 1394096 - RNA, 21 nt, Homo sapiens
cuguuggccagugugacaagg

SEQ ID NO: 1394097 - RNA, 12 nt, Homo sapiens
cuguuggucugu

SEQ ID NO: 1394098 - RNA, 14 nt, Homo sapiens
cuguuggucugucc

SEQ ID NO: 1394099 - RNA, 17 nt, Homo sapiens
cuguuuauuugcacuau

SEQ ID NO: 1394100 - RNA, 17 nt, Homo sapiens
cuguuucugcuugcucu

SEQ ID NO: 1394101 - RNA, 17 nt, Homo sapiens
cuguuucuuccacagug

SEQ ID NO: 1394102 - RNA, 15 nt, Homo sapiens
cuguuuuucagggag

SEQ ID NO: 1394103 - RNA, 15 nt, Homo sapiens
cuguuuuuuccugag

SEQ ID NO: 1394104 - RNA, 15 nt, Homo sapiens
cuuaaaaaaugucca

SEQ ID NO: 1394105 - RNA, 16 nt, Homo sapiens
cuuaaaaaauguccau

SEQ ID NO: 1394106 - RNA, 16 nt, Homo sapiens
cuuaaaaaguuauaac

SEQ ID NO: 1394107 - RNA, 14 nt, Homo sapiens
cuuaaaauagccau

SEQ ID NO: 1394108 - RNA, 13 nt, Homo sapiens
cuuaaaauuguau

SEQ ID NO: 1394109 - RNA, 16 nt, Homo sapiens
cuuaaaccacagcacu

SEQ ID NO: 1394110 - RNA, 23 nt, Homo sapiens
cuuaaaccgccaaggcuggggga

SEQ ID NO: 1394111 - RNA, 17 nt, Homo sapiens
cuuaaacuacaaacaca

SEQ ID NO: 1394112 - RNA, 12 nt, Homo sapiens
cuuaacauucau

SEQ ID NO: 1394113 - RNA, 15 nt, Homo sapiens
cuuaacauucauaga

SEQ ID NO: 1394114 - RNA, 13 nt, Homo sapiens
cuuaagcugggau

SEQ ID NO: 1394115 - RNA, 21 nt, Homo sapiens
cuuaauuucauagauuguguu

SEQ ID NO: 1394116 - RNA, 14 nt, Homo sapiens
cuuacaaacaugug

SEQ ID NO: 1394117 - RNA, 20 nt, Homo sapiens
cuuacacuuuaugcacaaaa

SEQ ID NO: 1394118 - RNA, 23 nt, Homo sapiens
cuuacagauaggccuucuuguga

SEQ ID NO: 1394119 - RNA, 20 nt, Homo sapiens
cuuacauuugaaaucuauga

SEQ ID NO: 1394120 - RNA, 18 nt, Homo sapiens
cuuacccuucugugccca

SEQ ID NO: 1394121 - RNA, 19 nt, Homo sapiens
cuuaccuagauucuacaua

SEQ ID NO: 1394122 - RNA, 18 nt, Homo sapiens
cuuacuagaccuguaacu

SEQ ID NO: 1394123 - RNA, 16 nt, Homo sapiens
cuuacuuagcaugcac

SEQ ID NO: 1394124 - RNA, 19 nt, Homo sapiens
ccugcggaguugugcacgu

SEQ ID NO: 1394125 - RNA, 13 nt, Homo sapiens
ccugcuaaggagu

SEQ ID NO: 1394126 - RNA, 18 nt, Homo sapiens
ccugcugagggaccagcc

SEQ ID NO: 1394127 - RNA, 17 nt, Homo sapiens
ccugcugauguggcaac

SEQ ID NO: 1394128 - RNA, 22 nt, Homo sapiens
ccugcuggaucucccagggcua

SEQ ID NO: 1394129 - RNA, 18 nt, Homo sapiens
ccugcuuaaaacuuuuca

SEQ ID NO: 1394130 - RNA, 15 nt, Homo sapiens
ccugcuuaaugaaaa

SEQ ID NO: 1394131 - RNA, 11 nt, Homo sapiens
ccugcuugcaa

SEQ ID NO: 1394132 - RNA, 16 nt, Homo sapiens
ccuggagacucgugga

SEQ ID NO: 1394133 - RNA, 18 nt, Homo sapiens
ccuggagcccgaggcacc

SEQ ID NO: 1394134 - RNA, 17 nt, Homo sapiens
ccuggaucuaccagcau

SEQ ID NO: 1394135 - RNA, 22 nt, Homo sapiens
ccuggcagccacaacugcaguc

SEQ ID NO: 1394136 - RNA, 14 nt, Homo sapiens
ccuggccaggagcu

SEQ ID NO: 1394137 - RNA, 15 nt, Homo sapiens
ccuggcccucaguuu

SEQ ID NO: 1394138 - RNA, 14 nt, Homo sapiens
ccuggccucaagug

SEQ ID NO: 1394139 - RNA, 17 nt, Homo sapiens
ccuggcgaaaccccauc

SEQ ID NO: 1394140 - RNA, 22 nt, Homo sapiens
ccuggcugagagaggaagagcu

SEQ ID NO: 1394141 - RNA, 20 nt, Homo sapiens
ccuggcuggggccuguugaa

SEQ ID NO: 1394142 - RNA, 19 nt, Homo sapiens
ccugggaauguauuauucu

SEQ ID NO: 1394143 - RNA, 14 nt, Homo sapiens
ccugggcaauguga

SEQ ID NO: 1394144 - RNA, 15 nt, Homo sapiens
ccugggcaaugugau

SEQ ID NO: 1394145 - RNA, 17 nt, Homo sapiens
ccugggcaauuccgcau

SEQ ID NO: 1394146 - RNA, 18 nt, Homo sapiens
ccuggggaagcugugaaa

SEQ ID NO: 1394147 - RNA, 20 nt, Homo sapiens
ccuggggcugaucucaggga

SEQ ID NO: 1394148 - RNA, 14 nt, Homo sapiens
ccuggggcuucuga

SEQ ID NO: 1394149 - RNA, 17 nt, Homo sapiens
ccuggguggggcugcuc

SEQ ID NO: 1394150 - RNA, 14 nt, Homo sapiens
ccugguccaugaug

SEQ ID NO: 1394151 - RNA, 13 nt, Homo sapiens
ccuggugcugcug

SEQ ID NO: 1394152 - RNA, 15 nt, Homo sapiens
ccugguggucaggga

SEQ ID NO: 1394153 - RNA, 18 nt, Homo sapiens
ccuguaaucccagcacuu

SEQ ID NO: 1394154 - RNA, 21 nt, Homo sapiens
ccuguacaaaagggacaugaa

SEQ ID NO: 1394155 - RNA, 13 nt, Homo sapiens
cuucacuuuacaa

SEQ ID NO: 1394156 - RNA, 15 nt, Homo sapiens
cuucagaaauguuaa

SEQ ID NO: 1394157 - RNA, 23 nt, Homo sapiens
cuucagacguguaugcaaaugag

SEQ ID NO: 1394158 - RNA, 15 nt, Homo sapiens
cuucagcauuuucca

SEQ ID NO: 1394159 - RNA, 23 nt, Homo sapiens
cuucagggggccaggugcacaga

SEQ ID NO: 1394160 - RNA, 21 nt, Homo sapiens
cuucauccucugagugugacc

SEQ ID NO: 1394161 - RNA, 22 nt, Homo sapiens
cuucauccucugagugugacca

SEQ ID NO: 1394162 - RNA, 14 nt, Homo sapiens
cuucauugccuuaa

SEQ ID NO: 1394163 - RNA, 11 nt, Homo sapiens
cuucauuucau

SEQ ID NO: 1394164 - RNA, 19 nt, Homo sapiens
cuucauuucaucuaccauu

SEQ ID NO: 1394165 - RNA, 16 nt, Homo sapiens
cuucauuuuuccuaac

SEQ ID NO: 1394166 - RNA, 22 nt, Homo sapiens
cuuccaggggagguucagugaa

SEQ ID NO: 1394167 - RNA, 19 nt, Homo sapiens
cuuccagugcaacacugaa

SEQ ID NO: 1394168 - RNA, 16 nt, Homo sapiens
cuuccauaauguauaa

SEQ ID NO: 1394169 - RNA, 14 nt, Homo sapiens
cuuccaucaccucc

SEQ ID NO: 1394170 - RNA, 11 nt, Homo sapiens
cuuccauuugc

SEQ ID NO: 1394171 - RNA, 16 nt, Homo sapiens
cuuccauuugugugug

SEQ ID NO: 1394172 - RNA, 16 nt, Homo sapiens
cuuccccaacgaaaag

SEQ ID NO: 1394173 - RNA, 19 nt, Homo sapiens
cuucccugguaccuagcaa

SEQ ID NO: 1394174 - RNA, 13 nt, Homo sapiens
cuuccucacacca

SEQ ID NO: 1394175 - RNA, 15 nt, Homo sapiens
cuuccucuccacugc

SEQ ID NO: 1394176 - RNA, 15 nt, Homo sapiens
cuuccuguccagaga

SEQ ID NO: 1394177 - RNA, 19 nt, Homo sapiens
cuuccuuaaacuccuguga

SEQ ID NO: 1394178 - RNA, 15 nt, Homo sapiens
cuucgaggcccagcg

SEQ ID NO: 1394179 - RNA, 16 nt, Homo sapiens
cuucgggcccugccug

SEQ ID NO: 1394180 - RNA, 12 nt, Homo sapiens
cuucgugccugu

SEQ ID NO: 1394181 - RNA, 14 nt, Homo sapiens
cuucuaaucaaagc

SEQ ID NO: 1394182 - RNA, 16 nt, Homo sapiens
cuucuaaucugcuaug

SEQ ID NO: 1394183 - RNA, 22 nt, Homo sapiens
cuucuaaucugcuaugcuugaa

SEQ ID NO: 1394184 - RNA, 17 nt, Homo sapiens
cuucuaccaacuggaag

SEQ ID NO: 1394185 - RNA, 15 nt, Homo sapiens
cuucuccaaaugaga

SEQ ID NO: 1394186 - RNA, 15 nt, Homo sapiens
cuucucccacacugc

SEQ ID NO: 1394187 - RNA, 16 nt, Homo sapiens
cuucucguuaaggaga

SEQ ID NO: 1394188 - RNA, 19 nt, Homo sapiens
cuucucucaccuccuaaag

SEQ ID NO: 1394189 - RNA, 19 nt, Homo sapiens
cuucucugagcuccagugg

SEQ ID NO: 1394190 - RNA, 21 nt, Homo sapiens
cuucugaggcgcugcuuuguc

SEQ ID NO: 1394191 - RNA, 23 nt, Homo sapiens
cuucugaggcgcugcuuugucaa

SEQ ID NO: 1394192 - RNA, 17 nt, Homo sapiens
cuucugaugaaucuugc

SEQ ID NO: 1394193 - RNA, 10 nt, Homo sapiens
cuucugccau

SEQ ID NO: 1394194 - RNA, 18 nt, Homo sapiens
cuucugccccagcuuugc

SEQ ID NO: 1394195 - RNA, 16 nt, Homo sapiens
cuucugcccuugccaa

SEQ ID NO: 1394196 - RNA, 22 nt, Homo sapiens
cuucugcuggcagaaagcaaau

SEQ ID NO: 1394197 - RNA, 23 nt, Homo sapiens
cuucugggaagacaacuaggaua

SEQ ID NO: 1394198 - RNA, 13 nt, Homo sapiens
cuucuguaaaggu

SEQ ID NO: 1394199 - RNA, 15 nt, Homo sapiens
cuucuguccuacucu

SEQ ID NO: 1394200 - RNA, 13 nt, Homo sapiens
cuucuguuccaca

SEQ ID NO: 1394201 - RNA, 22 nt, Homo sapiens
cuucuuaauauaacugccuuaa

SEQ ID NO: 1394202 - RNA, 17 nt, Homo sapiens
cuucuuagcaccacaaa

SEQ ID NO: 1394203 - RNA, 14 nt, Homo sapiens
cuucuucagaagac

SEQ ID NO: 1394204 - RNA, 14 nt, Homo sapiens
cuucuucuuagcac

SEQ ID NO: 1394205 - RNA, 16 nt, Homo sapiens
cuucuugugaucuugc

SEQ ID NO: 1394206 - RNA, 23 nt, Homo sapiens
cuucuuuccauuucucucuccag

SEQ ID NO: 1394207 - RNA, 19 nt, Homo sapiens
cuucuuuuauaacuagucc

SEQ ID NO: 1394208 - RNA, 20 nt, Homo sapiens
cuucuuuuuuuuugagaugg

SEQ ID NO: 1394209 - RNA, 13 nt, Homo sapiens
cuugaaaguuuuc

SEQ ID NO: 1394210 - RNA, 22 nt, Homo sapiens
cuugaaaugaugguaaguuaau

SEQ ID NO: 1394211 - RNA, 13 nt, Homo sapiens
cuugaacacuggg

SEQ ID NO: 1394212 - RNA, 14 nt, Homo sapiens
cuugaacacugggg

SEQ ID NO: 1394213 - RNA, 15 nt, Homo sapiens
cuugaagacacugaa

SEQ ID NO: 1394214 - RNA, 18 nt, Homo sapiens
cuugacaauagaacauug

SEQ ID NO: 1394215 - RNA, 20 nt, Homo sapiens
cuugacaguaaaucacacaa

SEQ ID NO: 1394216 - RNA, 18 nt, Homo sapiens
cuugacccccuugagggu

SEQ ID NO: 1394217 - RNA, 19 nt, Homo sapiens
cuugaccucaggugaucca

SEQ ID NO: 1394218 - RNA, 16 nt, Homo sapiens
cuugaccucagugaaa

SEQ ID NO: 1394219 - RNA, 21 nt, Homo sapiens
cuugagaauuacccuuuugcc

SEQ ID NO: 1394220 - RNA, 22 nt, Homo sapiens
cuugagaggguggaauauccaa

SEQ ID NO: 1394221 - RNA, 22 nt, Homo sapiens
cuugagcgugaaucuguaucuu

SEQ ID NO: 1394222 - RNA, 21 nt, Homo sapiens
cuugaggcggauggcugugac

SEQ ID NO: 1394223 - RNA, 14 nt, Homo sapiens
cuugagguugguga

SEQ ID NO: 1394224 - RNA, 16 nt, Homo sapiens
cuugauaaagggccaa

SEQ ID NO: 1394225 - RNA, 12 nt, Homo sapiens
cuugauucacaa

SEQ ID NO: 1394226 - RNA, 20 nt, Homo sapiens
cuugauuuagcacuauuuac

SEQ ID NO: 1394227 - RNA, 21 nt, Homo sapiens
cuugauuuaucacacaaagca

SEQ ID NO: 1394228 - RNA, 16 nt, Homo sapiens
cuugcaaauccacuag

SEQ ID NO: 1394229 - RNA, 20 nt, Homo sapiens
cuugcacgcccaugugugag

SEQ ID NO: 1394230 - RNA, 20 nt, Homo sapiens
cuugcacuccggagguagag

SEQ ID NO: 1394231 - RNA, 17 nt, Homo sapiens
cuugcagcuaguuuucu

SEQ ID NO: 1394232 - RNA, 10 nt, Homo sapiens
cuugcauaau

SEQ ID NO: 1394233 - RNA, 13 nt, Homo sapiens
cuugcauacagag

SEQ ID NO: 1394234 - RNA, 15 nt, Homo sapiens
cuugcauacagagac

SEQ ID NO: 1394235 - RNA, 18 nt, Homo sapiens
cuugcauacagagacaga

SEQ ID NO: 1394236 - RNA, 23 nt, Homo sapiens
cuugcauccccaacuuagcuguc

SEQ ID NO: 1394237 - RNA, 20 nt, Homo sapiens
cuugccugugacauuuugcc

SEQ ID NO: 1394238 - RNA, 18 nt, Homo sapiens
cuugcuagcuaugugacc

SEQ ID NO: 1394239 - RNA, 12 nt, Homo sapiens
cuugcugccaaa

SEQ ID NO: 1394240 - RNA, 17 nt, Homo sapiens
cuugcugugugaccuca

SEQ ID NO: 1394241 - RNA, 14 nt, Homo sapiens
cuuggaaaggacca

SEQ ID NO: 1394242 - RNA, 14 nt, Homo sapiens
gagcaacagaguga

SEQ ID NO: 1394243 - RNA, 18 nt, Homo sapiens
gagcacacuuaugggcca

SEQ ID NO: 1394244 - RNA, 20 nt, Homo sapiens
gagcaccuacuacaugcaag

SEQ ID NO: 1394245 - RNA, 11 nt, Homo sapiens
gagcagggauu

SEQ ID NO: 1394246 - RNA, 20 nt, Homo sapiens
gagcaugcucaguuggugcu

SEQ ID NO: 1394247 - RNA, 23 nt, Homo sapiens
gagcaugcucaguuggugcugcu

SEQ ID NO: 1394248 - RNA, 21 nt, Homo sapiens
gagcauuguggcugucagcag

SEQ ID NO: 1394249 - RNA, 20 nt, Homo sapiens
gagccaaagagaaugccauu

SEQ ID NO: 1394250 - RNA, 20 nt, Homo sapiens
gagccaccacguccagcugg

SEQ ID NO: 1394251 - RNA, 18 nt, Homo sapiens
gagccacugcaccgggcc

SEQ ID NO: 1394252 - RNA, 17 nt, Homo sapiens
gagccagucuaguuccu

SEQ ID NO: 1394253 - RNA, 20 nt, Homo sapiens
gagccagucuaguuccugau

SEQ ID NO: 1394254 - RNA, 16 nt, Homo sapiens
gagccgagauugcacc

SEQ ID NO: 1394255 - RNA, 15 nt, Homo sapiens
gagccgugaugccuc

SEQ ID NO: 1394256 - RNA, 17 nt, Homo sapiens
gagccuccacugccucu

SEQ ID NO: 1394257 - RNA, 20 nt, Homo sapiens
gagccuggaagacacccuaa

SEQ ID NO: 1394258 - RNA, 19 nt, Homo sapiens
gagcuagaugugucuuacc

SEQ ID NO: 1394259 - RNA, 15 nt, Homo sapiens
gagcuccccaaaaac

SEQ ID NO: 1394260 - RNA, 15 nt, Homo sapiens
gagcuccuaagccau

SEQ ID NO: 1394261 - RNA, 21 nt, Homo sapiens
gagcucgguggacccagggau

SEQ ID NO: 1394262 - RNA, 18 nt, Homo sapiens
gagcuucauauaccagca

SEQ ID NO: 1394263 - RNA, 20 nt, Homo sapiens
gagcuuuggacgcacacagc

SEQ ID NO: 1394264 - RNA, 20 nt, Homo sapiens
gaggaaaaauaaagacaaau

SEQ ID NO: 1394265 - RNA, 13 nt, Homo sapiens
gaggaaacuugca

SEQ ID NO: 1394266 - RNA, 13 nt, Homo sapiens
gaggaaagaaaga

SEQ ID NO: 1394267 - RNA, 14 nt, Homo sapiens
gaggaacacugcac

SEQ ID NO: 1394268 - RNA, 23 nt, Homo sapiens
gaggaagggcaaaaccacuagaa

SEQ ID NO: 1394269 - RNA, 18 nt, Homo sapiens
gaggacacuaaccacgcu

SEQ ID NO: 1394270 - RNA, 21 nt, Homo sapiens
gaggacugcaccauugcugcu

SEQ ID NO: 1394271 - RNA, 18 nt, Homo sapiens
gaggagggcgugacucac

SEQ ID NO: 1394272 - RNA, 19 nt, Homo sapiens
gaggauugcuugagcucag

SEQ ID NO: 1394273 - RNA, 18 nt, Homo sapiens
gaggccagccagugaccu

SEQ ID NO: 1394274 - RNA, 21 nt, Homo sapiens
gaggcccccuggugugucuga

SEQ ID NO: 1394275 - RNA, 16 nt, Homo sapiens
gaggccuguccugacc

SEQ ID NO: 1394276 - RNA, 19 nt, Homo sapiens
gaggcgggcagaucaccag

SEQ ID NO: 1394277 - RNA, 19 nt, Homo sapiens
gaggcggguggaucacuug

SEQ ID NO: 1394278 - RNA, 18 nt, Homo sapiens
gaggcuccggauguuucu

SEQ ID NO: 1394279 - RNA, 20 nt, Homo sapiens
gaggcugcacccacccagga

SEQ ID NO: 1394280 - RNA, 18 nt, Homo sapiens
gaggcugucuucucaggc

SEQ ID NO: 1394281 - RNA, 12 nt, Homo sapiens
gaggcuuggaaa

SEQ ID NO: 1394282 - RNA, 14 nt, Homo sapiens
gagggaaaaugagu

SEQ ID NO: 1394283 - RNA, 16 nt, Homo sapiens
gagggaggagaaugag

SEQ ID NO: 1394284 - RNA, 23 nt, Homo sapiens
gagggauaagccagcugcagcug

SEQ ID NO: 1394285 - RNA, 15 nt, Homo sapiens
gagggauguggagca

SEQ ID NO: 1394286 - RNA, 16 nt, Homo sapiens
gaggugacacccauug

SEQ ID NO: 1394287 - RNA, 20 nt, Homo sapiens
gagguggagguugcagugag

SEQ ID NO: 1394288 - RNA, 13 nt, Homo sapiens
gagguggcugccu

SEQ ID NO: 1394289 - RNA, 18 nt, Homo sapiens
gaguacaccccaacagca

SEQ ID NO: 1394290 - RNA, 19 nt, Homo sapiens
gaguacaccccaacagcac

SEQ ID NO: 1394291 - RNA, 15 nt, Homo sapiens
gaguauaacucuaac

SEQ ID NO: 1394292 - RNA, 22 nt, Homo sapiens
gagucaauccccucauucagga

SEQ ID NO: 1394293 - RNA, 13 nt, Homo sapiens
gagucaccaggaa

SEQ ID NO: 1394294 - RNA, 20 nt, Homo sapiens
gagucaggccuuaauuuuca

SEQ ID NO: 1394295 - RNA, 23 nt, Homo sapiens
gagucaucuaccugagucccaaa

SEQ ID NO: 1394296 - RNA, 13 nt, Homo sapiens
gagucccuuccag

SEQ ID NO: 1394297 - RNA, 17 nt, Homo sapiens
gagucgaggacagggag

SEQ ID NO: 1394298 - RNA, 19 nt, Homo sapiens
gagugagacucugucucaa

SEQ ID NO: 1394299 - RNA, 14 nt, Homo sapiens
gagugauccuccaa

SEQ ID NO: 1394300 - RNA, 13 nt, Homo sapiens
gagugaucuuucc

SEQ ID NO: 1394301 - RNA, 18 nt, Homo sapiens
gagugggguggggagcau

SEQ ID NO: 1394302 - RNA, 21 nt, Homo sapiens
gaguuaauauauagaagggua

SEQ ID NO: 1394303 - RNA, 20 nt, Homo sapiens
gaguuacuggauuuguuguu

SEQ ID NO: 1394304 - RNA, 16 nt, Homo sapiens
gaguuaguuugaguua

SEQ ID NO: 1394305 - RNA, 21 nt, Homo sapiens
gaguuauuuuuauuuauuuaa

SEQ ID NO: 1394306 - RNA, 20 nt, Homo sapiens
gaguucauacccuguuacca

SEQ ID NO: 1394307 - RNA, 14 nt, Homo sapiens
gaguuguguuguuc

SEQ ID NO: 1394308 - RNA, 17 nt, Homo sapiens
gaguuugcaaugucaca

SEQ ID NO: 1394309 - RNA, 20 nt, Homo sapiens
gauaaaaagaggaauauucu

SEQ ID NO: 1394310 - RNA, 13 nt, Homo sapiens
gauaaacucagaa

SEQ ID NO: 1394311 - RNA, 16 nt, Homo sapiens
gauaaauuccacugga

SEQ ID NO: 1394312 - RNA, 21 nt, Homo sapiens
gauaagcuugucuaugguaca

SEQ ID NO: 1394313 - RNA, 20 nt, Homo sapiens
gauaaguaaguuugauuuca

SEQ ID NO: 1394314 - RNA, 19 nt, Homo sapiens
gauaauaaaggcauuucaa

SEQ ID NO: 1394315 - RNA, 18 nt, Homo sapiens
gauaaucuuagcugccaa

SEQ ID NO: 1394316 - RNA, 23 nt, Homo sapiens
gauacacugaaguuaacagagac

SEQ ID NO: 1394317 - RNA, 20 nt, Homo sapiens
gauacagguauucugcugau

SEQ ID NO: 1394318 - RNA, 13 nt, Homo sapiens
gauacaugucuuu

SEQ ID NO: 1394319 - RNA, 15 nt, Homo sapiens
gauacuccaaccaua

SEQ ID NO: 1394320 - RNA, 15 nt, Homo sapiens
gauagauauaugcuc

SEQ ID NO: 1394321 - RNA, 17 nt, Homo sapiens
gauaguggggucagggc

SEQ ID NO: 1394322 - RNA, 16 nt, Homo sapiens
gauaucaaaagcaaau

SEQ ID NO: 1394323 - RNA, 21 nt, Homo sapiens
gauaucaugccccuguacucc

SEQ ID NO: 1394324 - RNA, 17 nt, Homo sapiens
gauaucccuaugcugcc

SEQ ID NO: 1394325 - RNA, 13 nt, Homo sapiens
gauaugcuguauu

SEQ ID NO: 1394326 - RNA, 22 nt, Homo sapiens
gaucacugaagaaacuucugcu

SEQ ID NO: 1394327 - RNA, 19 nt, Homo sapiens
gaucacuucaggucaggag

SEQ ID NO: 1394328 - RNA, 14 nt, Homo sapiens
gaucccuacugcug

SEQ ID NO: 1394329 - RNA, 17 nt, Homo sapiens
gaucgcgccacugcacu

SEQ ID NO: 1394330 - RNA, 13 nt, Homo sapiens
gaucuaccagcau

SEQ ID NO: 1394331 - RNA, 17 nt, Homo sapiens
gaucuccauauguuaca

SEQ ID NO: 1394332 - RNA, 19 nt, Homo sapiens
gaucucccugccgccucaa

SEQ ID NO: 1394333 - RNA, 22 nt, Homo sapiens
gaucucggcucauguagccuca

SEQ ID NO: 1394334 - RNA, 16 nt, Homo sapiens
gaucugcugucagucu

SEQ ID NO: 1394335 - RNA, 16 nt, Homo sapiens
gaugaaagcugauuac

SEQ ID NO: 1394336 - RNA, 20 nt, Homo sapiens
gaugacaaugggagccucau

SEQ ID NO: 1394337 - RNA, 21 nt, Homo sapiens
gaugagaguacaccccaacag

SEQ ID NO: 1394338 - RNA, 13 nt, Homo sapiens
gaugauaaaacac

SEQ ID NO: 1394339 - RNA, 13 nt, Homo sapiens
gaugcaagcaaga

SEQ ID NO: 1394340 - RNA, 14 nt, Homo sapiens
gaugcacauuucau

SEQ ID NO: 1394341 - RNA, 16 nt, Homo sapiens
gaugccagggacccac

SEQ ID NO: 1394342 - RNA, 15 nt, Homo sapiens
gaugcuaccaugccu

SEQ ID NO: 1394343 - RNA, 14 nt, Homo sapiens
gaugcuacugcugc

SEQ ID NO: 1394344 - RNA, 14 nt, Homo sapiens
gaugcugugcuaug

SEQ ID NO: 1394345 - RNA, 16 nt, Homo sapiens
gauggaaacaaagugg

SEQ ID NO: 1394346 - RNA, 18 nt, Homo sapiens
gauggaaguugcagugag

SEQ ID NO: 1394347 - RNA, 22 nt, Homo sapiens
gauggacaagauuaccccaccu

SEQ ID NO: 1394348 - RNA, 15 nt, Homo sapiens
gauggacuacugaag

SEQ ID NO: 1394349 - RNA, 16 nt, Homo sapiens
gauggagcgcaccugc

SEQ ID NO: 1394350 - RNA, 23 nt, Homo sapiens
gauggaggggugguccugacuca

SEQ ID NO: 1394351 - RNA, 17 nt, Homo sapiens
gauggagucagguuugg

SEQ ID NO: 1394352 - RNA, 13 nt, Homo sapiens
gauggauuuccag

SEQ ID NO: 1394353 - RNA, 16 nt, Homo sapiens
gauggcaccacugcac

SEQ ID NO: 1394354 - RNA, 13 nt, Homo sapiens
gaugguccacugu

SEQ ID NO: 1394355 - RNA, 16 nt, Homo sapiens
gcagggacugccaguc

SEQ ID NO: 1394356 - RNA, 22 nt, Homo sapiens
gcaggguuuuaucucugucuac

SEQ ID NO: 1394357 - RNA, 15 nt, Homo sapiens
gcagguauggaaggg

SEQ ID NO: 1394358 - RNA, 22 nt, Homo sapiens
gcaggugaccuucugggaaaug

SEQ ID NO: 1394359 - RNA, 17 nt, Homo sapiens
gcaguacuuuaccuccu

SEQ ID NO: 1394360 - RNA, 19 nt, Homo sapiens
gcaguagaaauaauaugca

SEQ ID NO: 1394361 - RNA, 20 nt, Homo sapiens
gcaguagaaauaauaugcau

SEQ ID NO: 1394362 - RNA, 17 nt, Homo sapiens
gcagucaauuuucacau

SEQ ID NO: 1394363 - RNA, 13 nt, Homo sapiens
gcagucacagcua

SEQ ID NO: 1394364 - RNA, 23 nt, Homo sapiens
gcagugacgugcaccuguacuca

SEQ ID NO: 1394365 - RNA, 21 nt, Homo sapiens
gcagugagcugauaucaugcc

SEQ ID NO: 1394366 - RNA, 11 nt, Homo sapiens
gcagugcagca

SEQ ID NO: 1394367 - RNA, 12 nt, Homo sapiens
gcaguguggaaa

SEQ ID NO: 1394368 - RNA, 21 nt, Homo sapiens
gcaguuugcuuuguaugcacu

SEQ ID NO: 1394369 - RNA, 13 nt, Homo sapiens
gcauaaaugcauu

SEQ ID NO: 1394370 - RNA, 12 nt, Homo sapiens
gcauaacuuauu

SEQ ID NO: 1394371 - RNA, 19 nt, Homo sapiens
gcauaagaaaacuaagaaa

SEQ ID NO: 1394372 - RNA, 19 nt, Homo sapiens
gcauagaguucagacuuuu

SEQ ID NO: 1394373 - RNA, 13 nt, Homo sapiens
gcauauaaaugua

SEQ ID NO: 1394374 - RNA, 15 nt, Homo sapiens
gcaucaaauauuugu

SEQ ID NO: 1394375 - RNA, 18 nt, Homo sapiens
gcauccuggcacccggcc

SEQ ID NO: 1394376 - RNA, 19 nt, Homo sapiens
gcaucuccccucagauucc

SEQ ID NO: 1394377 - RNA, 16 nt, Homo sapiens
gcaucugcuacugugu

SEQ ID NO: 1394378 - RNA, 17 nt, Homo sapiens
gcaugaagguuucugaa

SEQ ID NO: 1394379 - RNA, 19 nt, Homo sapiens
gcaugagucagucugauga

SEQ ID NO: 1394380 - RNA, 21 nt, Homo sapiens
gcaugcucaguuggugcugcu

SEQ ID NO: 1394381 - RNA, 22 nt, Homo sapiens
gcaugcuggcucccagggccau

SEQ ID NO: 1394382 - RNA, 18 nt, Homo sapiens
gcauggagucuucaggua

SEQ ID NO: 1394383 - RNA, 20 nt, Homo sapiens
gcaugugugcgagugugugc

SEQ ID NO: 1394384 - RNA, 21 nt, Homo sapiens
gcauuaaaaaaaaaaucaaug

SEQ ID NO: 1394385 - RNA, 13 nt, Homo sapiens
gcauucaagugua

SEQ ID NO: 1394386 - RNA, 22 nt, Homo sapiens
gcauugaauauauuauaaucuu

SEQ ID NO: 1394387 - RNA, 14 nt, Homo sapiens
gcauugcuuuccac

SEQ ID NO: 1394388 - RNA, 18 nt, Homo sapiens
gcauugucuguaaugaca

SEQ ID NO: 1394389 - RNA, 18 nt, Homo sapiens
gcauuuaaauuagauaac

SEQ ID NO: 1394390 - RNA, 19 nt, Homo sapiens
gcauuuacuuuguguucac

SEQ ID NO: 1394391 - RNA, 16 nt, Homo sapiens
gcauuugucaacaaag

SEQ ID NO: 1394392 - RNA, 21 nt, Homo sapiens
gcauuugucaaugacaguuuc

SEQ ID NO: 1394393 - RNA, 24 nt, Homo sapiens
gcauuuuguagucuuaacuucucc

SEQ ID NO: 1394394 - RNA, 15 nt, Homo sapiens
gcauuuuuaaauaca

SEQ ID NO: 1394395 - RNA, 14 nt, Homo sapiens
gcauuuuucuggga

SEQ ID NO: 1394396 - RNA, 17 nt, Homo sapiens
gccaaacccaugaggca

SEQ ID NO: 1394397 - RNA, 15 nt, Homo sapiens
gccaaacucugccag

SEQ ID NO: 1394398 - RNA, 16 nt, Homo sapiens
gccaaagauaaucucu

SEQ ID NO: 1394399 - RNA, 13 nt, Homo sapiens
gccaaauguaauu

SEQ ID NO: 1394400 - RNA, 17 nt, Homo sapiens
gccaaccggucacccag

SEQ ID NO: 1394401 - RNA, 19 nt, Homo sapiens
gccaaccggucacccagga

SEQ ID NO: 1394402 - RNA, 19 nt, Homo sapiens
gccaagcagccaagcuccu

SEQ ID NO: 1394403 - RNA, 12 nt, Homo sapiens
gccaagcaguuu

SEQ ID NO: 1394404 - RNA, 13 nt, Homo sapiens
gccaagugaaaaa

SEQ ID NO: 1394405 - RNA, 14 nt, Homo sapiens
gccaauuagcaauu

SEQ ID NO: 1394406 - RNA, 19 nt, Homo sapiens
gccacacuguacucugcac

SEQ ID NO: 1394407 - RNA, 18 nt, Homo sapiens
gccaccagacugacaaau

SEQ ID NO: 1394408 - RNA, 18 nt, Homo sapiens
gccacccucccacugcca

SEQ ID NO: 1394409 - RNA, 19 nt, Homo sapiens
gccaccuccccaggccgug

SEQ ID NO: 1394410 - RNA, 13 nt, Homo sapiens
gccacggcagccu

SEQ ID NO: 1394411 - RNA, 21 nt, Homo sapiens
gccacguauguuuuuguguau

SEQ ID NO: 1394412 - RNA, 20 nt, Homo sapiens
gccacuccagaccccuggcu

SEQ ID NO: 1394413 - RNA, 13 nt, Homo sapiens
gccacugcacucc

SEQ ID NO: 1394414 - RNA, 18 nt, Homo sapiens
gccacuggacugacgacu

SEQ ID NO: 1394415 - RNA, 17 nt, Homo sapiens
gccagaagggggccaug

SEQ ID NO: 1394416 - RNA, 24 nt, Homo sapiens
gccagcaccugcgggagcugcacu

SEQ ID NO: 1394417 - RNA, 17 nt, Homo sapiens
gccagccagugaccuga

SEQ ID NO: 1394418 - RNA, 17 nt, Homo sapiens
gccagcuuaucucaggg

SEQ ID NO: 1394419 - RNA, 13 nt, Homo sapiens
gccaggcucaggc

SEQ ID NO: 1394420 - RNA, 20 nt, Homo sapiens
gccaggcugccaaggccaga

SEQ ID NO: 1394421 - RNA, 18 nt, Homo sapiens
gccagggcccugcagagg

SEQ ID NO: 1394422 - RNA, 12 nt, Homo sapiens
gccagguggcca

SEQ ID NO: 1394423 - RNA, 20 nt, Homo sapiens
gccagguucugacucuuggc

SEQ ID NO: 1394424 - RNA, 22 nt, Homo sapiens
gccagugaccaaccuuuuccca

SEQ ID NO: 1394425 - RNA, 15 nt, Homo sapiens
gccagugugggaaug

SEQ ID NO: 1394426 - RNA, 22 nt, Homo sapiens
gccauauucuguuggccagugu

SEQ ID NO: 1394427 - RNA, 14 nt, Homo sapiens
gccaucaagggaau

SEQ ID NO: 1394428 - RNA, 17 nt, Homo sapiens
gccauccucccaagggg

SEQ ID NO: 1394429 - RNA, 15 nt, Homo sapiens
gccaucgccaaguaa

SEQ ID NO: 1394430 - RNA, 21 nt, Homo sapiens
gccaugacuugagaaacaaau

SEQ ID NO: 1394431 - RNA, 22 nt, Homo sapiens
gccauucucccucuuguuuuca

SEQ ID NO: 1394432 - RNA, 14 nt, Homo sapiens
gccauugcacucca

SEQ ID NO: 1394433 - RNA, 13 nt, Homo sapiens
gccauugucuuua

SEQ ID NO: 1394434 - RNA, 22 nt, Homo sapiens
gcccaacccacaccaaauaaga

SEQ ID NO: 1394435 - RNA, 23 nt, Homo sapiens
gcccacugaggaaugaugaagcu

SEQ ID NO: 1394436 - RNA, 20 nt, Homo sapiens
gcccagaacuggacucagga

SEQ ID NO: 1394437 - RNA, 19 nt, Homo sapiens
gcccagagcugggugagug

SEQ ID NO: 1394438 - RNA, 21 nt, Homo sapiens
gcccagauucuaccacacagc

SEQ ID NO: 1394439 - RNA, 22 nt, Homo sapiens
gcccagauucuaccacacagca

SEQ ID NO: 1394440 - RNA, 20 nt, Homo sapiens
gcccagcagggccucaaagu

SEQ ID NO: 1394441 - RNA, 14 nt, Homo sapiens
gcccagcuccaggg

SEQ ID NO: 1394442 - RNA, 22 nt, Homo sapiens
gcccaggaucaagucacucauc

SEQ ID NO: 1394443 - RNA, 15 nt, Homo sapiens
gacaacgaugaugcu

SEQ ID NO: 1394444 - RNA, 17 nt, Homo sapiens
gacaaggccccagagac

SEQ ID NO: 1394445 - RNA, 19 nt, Homo sapiens
gacaaucaugaaauaugca

SEQ ID NO: 1394446 - RNA, 20 nt, Homo sapiens
gacaaucaugaaauaugcau

SEQ ID NO: 1394447 - RNA, 18 nt, Homo sapiens
gacacacaaauuaucuua

SEQ ID NO: 1394448 - RNA, 20 nt, Homo sapiens
gacacaugcugaacaucaca

SEQ ID NO: 1394449 - RNA, 17 nt, Homo sapiens
gacaccuugacagggca

SEQ ID NO: 1394450 - RNA, 20 nt, Homo sapiens
gacacuauuuaucugugcaa

SEQ ID NO: 1394451 - RNA, 23 nt, Homo sapiens
gacagaaaaagauagcauugggg

SEQ ID NO: 1394452 - RNA, 13 nt, Homo sapiens
gacagaacacugu

SEQ ID NO: 1394453 - RNA, 14 nt, Homo sapiens
gacagaagcguaua

SEQ ID NO: 1394454 - RNA, 19 nt, Homo sapiens
gacagagcagaacuuucac

SEQ ID NO: 1394455 - RNA, 14 nt, Homo sapiens
gacagagcugggau

SEQ ID NO: 1394456 - RNA, 18 nt, Homo sapiens
gacagauggaaaagggag

SEQ ID NO: 1394457 - RNA, 15 nt, Homo sapiens
gacaggaauacuuaa

SEQ ID NO: 1394458 - RNA, 14 nt, Homo sapiens
gacagugaacauuc

SEQ ID NO: 1394459 - RNA, 15 nt, Homo sapiens
gacagugaggcugca

SEQ ID NO: 1394460 - RNA, 21 nt, Homo sapiens
gacauagccaacugcuguuca

SEQ ID NO: 1394461 - RNA, 19 nt, Homo sapiens
gacauccccacccuuggag

SEQ ID NO: 1394462 - RNA, 17 nt, Homo sapiens
gacaugaaauaaaugcc

SEQ ID NO: 1394463 - RNA, 23 nt, Homo sapiens
gacauggcuugccacagcucuug

SEQ ID NO: 1394464 - RNA, 16 nt, Homo sapiens
gacauugauacaguga

SEQ ID NO: 1394465 - RNA, 18 nt, Homo sapiens
gacauugcggacagccac

SEQ ID NO: 1394466 - RNA, 14 nt, Homo sapiens
gaccaaaacaaaca

SEQ ID NO: 1394467 - RNA, 22 nt, Homo sapiens
gaccaauucaacccuuugcccc

SEQ ID NO: 1394468 - RNA, 16 nt, Homo sapiens
gaccagccugggcaac

SEQ ID NO: 1394469 - RNA, 17 nt, Homo sapiens
gaccccgcccagcauug

SEQ ID NO: 1394470 - RNA, 20 nt, Homo sapiens
gaccccucaccuugcaacac

SEQ ID NO: 1394471 - RNA, 20 nt, Homo sapiens
gacccggaggggccuggcag

SEQ ID NO: 1394472 - RNA, 14 nt, Homo sapiens
gacccuaaaucuga

SEQ ID NO: 1394473 - RNA, 23 nt, Homo sapiens
gacccuccuggggcucucagugu

SEQ ID NO: 1394474 - RNA, 23 nt, Homo sapiens
gaccgccccucaccaacccagag

SEQ ID NO: 1394475 - RNA, 17 nt, Homo sapiens
gaccuaaccuaagcaaa

SEQ ID NO: 1394476 - RNA, 15 nt, Homo sapiens
gaccuaggauuucau

SEQ ID NO: 1394477 - RNA, 22 nt, Homo sapiens
gaccucacugugaccuugacuu

SEQ ID NO: 1394478 - RNA, 14 nt, Homo sapiens
gaccucagccugug

SEQ ID NO: 1394479 - RNA, 20 nt, Homo sapiens
gaccucaggugauccaccca

SEQ ID NO: 1394480 - RNA, 22 nt, Homo sapiens
gaccucaggugauccacccacc

SEQ ID NO: 1394481 - RNA, 18 nt, Homo sapiens
gaccuccuuacauaugca

SEQ ID NO: 1394482 - RNA, 17 nt, Homo sapiens
gaccuggggaaacggcc

SEQ ID NO: 1394483 - RNA, 17 nt, Homo sapiens
gaccuucuccccauucu

SEQ ID NO: 1394484 - RNA, 13 nt, Homo sapiens
gaccuugaacucc

SEQ ID NO: 1394485 - RNA, 16 nt, Homo sapiens
gacuaagaaucccuaa

SEQ ID NO: 1394486 - RNA, 19 nt, Homo sapiens
gacuaaguguaccagagaa

SEQ ID NO: 1394487 - RNA, 16 nt, Homo sapiens
gacuagaggcagggag

SEQ ID NO: 1394488 - RNA, 18 nt, Homo sapiens
gacuagaggcuugcauaa

SEQ ID NO: 1394489 - RNA, 17 nt, Homo sapiens
gacuauggcuaccaaaa

SEQ ID NO: 1394490 - RNA, 23 nt, Homo sapiens
gacuauucccuucuaaccugaac

SEQ ID NO: 1394491 - RNA, 16 nt, Homo sapiens
gacuauuuaugaaggc

SEQ ID NO: 1394492 - RNA, 12 nt, Homo sapiens
gacucaagcaag

SEQ ID NO: 1394493 - RNA, 18 nt, Homo sapiens
gacucaaguccuuaccuc

SEQ ID NO: 1394494 - RNA, 12 nt, Homo sapiens
gacucaaugcac

SEQ ID NO: 1394495 - RNA, 16 nt, Homo sapiens
gacucaucauuuccau

SEQ ID NO: 1394496 - RNA, 21 nt, Homo sapiens
gacucauugcuucacaaccca

SEQ ID NO: 1394497 - RNA, 13 nt, Homo sapiens
gacuccugugcaa

SEQ ID NO: 1394498 - RNA, 16 nt, Homo sapiens
gacucuaggugcccuu

SEQ ID NO: 1394499 - RNA, 20 nt, Homo sapiens
gacucuuguuuucaguuuca

SEQ ID NO: 1394500 - RNA, 17 nt, Homo sapiens
gacucuuuggacacuca

SEQ ID NO: 1394501 - RNA, 16 nt, Homo sapiens
gacugacccugaucag

SEQ ID NO: 1394502 - RNA, 15 nt, Homo sapiens
gacugagcagacugg

SEQ ID NO: 1394503 - RNA, 13 nt, Homo sapiens
gacugaguccucg

SEQ ID NO: 1394504 - RNA, 14 nt, Homo sapiens
gacugauggugaaa

SEQ ID NO: 1394505 - RNA, 23 nt, Homo sapiens
gacugcacguggcuucugaugaa

SEQ ID NO: 1394506 - RNA, 21 nt, Homo sapiens
gacugccaugcuagacaagcu

SEQ ID NO: 1394507 - RNA, 11 nt, Homo sapiens
gacuggcuuug

SEQ ID NO: 1394508 - RNA, 14 nt, Homo sapiens
gacuguacuccucc

SEQ ID NO: 1394509 - RNA, 13 nt, Homo sapiens
gacuguagaagaa

SEQ ID NO: 1394510 - RNA, 16 nt, Homo sapiens
gacuguggccuguuaa

SEQ ID NO: 1394511 - RNA, 13 nt, Homo sapiens
gacuucacacugc

SEQ ID NO: 1394512 - RNA, 20 nt, Homo sapiens
gacuucauuuuuccuaacag

SEQ ID NO: 1394513 - RNA, 20 nt, Homo sapiens
gacuugacagaacacugucu

SEQ ID NO: 1394514 - RNA, 18 nt, Homo sapiens
gacuugauuagugccuuc

SEQ ID NO: 1394515 - RNA, 20 nt, Homo sapiens
gacuuuuuuuaaauaguaaa

SEQ ID NO: 1394516 - RNA, 19 nt, Homo sapiens
gagaaaaaagaaguguccg

SEQ ID NO: 1394517 - RNA, 23 nt, Homo sapiens
gagaaaaaauauuuuccugccag

SEQ ID NO: 1394518 - RNA, 21 nt, Homo sapiens
gagaaacaaauaauuuguaua

SEQ ID NO: 1394519 - RNA, 23 nt, Homo sapiens
gagaaaccagggagccccuuuga

SEQ ID NO: 1394520 - RNA, 15 nt, Homo sapiens
gagaaacuguagucu

SEQ ID NO: 1394521 - RNA, 16 nt, Homo sapiens
gagaaauuaccaaaau

SEQ ID NO: 1394522 - RNA, 18 nt, Homo sapiens
gagaacucugagcagugc

SEQ ID NO: 1394523 - RNA, 18 nt, Homo sapiens
gagaacuggaaagacaua

SEQ ID NO: 1394524 - RNA, 14 nt, Homo sapiens
gagaagcagugagc

SEQ ID NO: 1394525 - RNA, 21 nt, Homo sapiens
gagaauaaacuagacucugaa

SEQ ID NO: 1394526 - RNA, 18 nt, Homo sapiens
gagaauugcuugaaccug

SEQ ID NO: 1394527 - RNA, 23 nt, Homo sapiens
gagacagauauacugggagaaau

SEQ ID NO: 1394528 - RNA, 19 nt, Homo sapiens
gagacaugagcauggcuga

SEQ ID NO: 1394529 - RNA, 22 nt, Homo sapiens
gagaccaagacucugaaaucuc

SEQ ID NO: 1394530 - RNA, 20 nt, Homo sapiens
gagacuccgucacaacaaca
